United States Patent 7,691,997 (FUNCTIONAL AND HYPERFUNCTIONAL SIRNA) - sequence listing, part 6

SEQ ID NO: 205619 - RNA, 19 nt, Homo sapiens
caacccaaauugcuuagua

SEQ ID NO: 205620 - RNA, 19 nt, Homo sapiens
ugagugagcuaaauacaaa

SEQ ID NO: 205621 - RNA, 19 nt, Homo sapiens
aagcugaacuugaaacuaa

SEQ ID NO: 205622 - RNA, 19 nt, Homo sapiens
ggaauuaagucgggugaaa

SEQ ID NO: 205623 - RNA, 19 nt, Homo sapiens
gaagacgacuuuaaucagu

SEQ ID NO: 205624 - RNA, 19 nt, Homo sapiens
uaagaaagcaguaugauga

SEQ ID NO: 205625 - RNA, 19 nt, Homo sapiens
caagguauauuaagucaga

SEQ ID NO: 205626 - RNA, 19 nt, Homo sapiens
gcaggaagaucuugaacug

SEQ ID NO: 205627 - RNA, 19 nt, Homo sapiens
gcagagacuuacagaacua

SEQ ID NO: 205628 - RNA, 19 nt, Homo sapiens
gugaauagccaauacauaa

SEQ ID NO: 205629 - RNA, 19 nt, Homo sapiens
guaccucauuguuuacuua

SEQ ID NO: 205630 - RNA, 19 nt, Homo sapiens
ggaauuagaggaccauauu

SEQ ID NO: 205631 - RNA, 19 nt, Homo sapiens
gaagaaagaguuaucugaa

SEQ ID NO: 205632 - RNA, 19 nt, Homo sapiens
gaauguugauguacugaaa

SEQ ID NO: 205633 - RNA, 19 nt, Homo sapiens
gaaauggcccgaugaaugu

SEQ ID NO: 205634 - RNA, 19 nt, Homo sapiens
ggagaaagaucaguauauc

SEQ ID NO: 205635 - RNA, 19 nt, Homo sapiens
ggagaaauggugauaguuu

SEQ ID NO: 205636 - RNA, 19 nt, Homo sapiens
gaauaagucucugaaggaa

SEQ ID NO: 205637 - RNA, 19 nt, Homo sapiens
gaccaguucuuuaagcuaa

SEQ ID NO: 205638 - RNA, 19 nt, Homo sapiens
ggaacuaaccugucagauu

SEQ ID NO: 205639 - RNA, 19 nt, Homo sapiens
gcaacaggcugcuucugaa

SEQ ID NO: 205640 - RNA, 19 nt, Homo sapiens
caugaaggcugauauugaa

SEQ ID NO: 205641 - RNA, 19 nt, Homo sapiens
gacgagaacucaaugaugu

SEQ ID NO: 205642 - RNA, 19 nt, Homo sapiens
caaguugacaguaucauua

SEQ ID NO: 205643 - RNA, 19 nt, Homo sapiens
agacuaaacuuaucacuca

SEQ ID NO: 205644 - RNA, 19 nt, Homo sapiens
gaagaccguuugaagaaau

SEQ ID NO: 205645 - RNA, 19 nt, Homo sapiens
gaacaagagcuggaaauga

SEQ ID NO: 205646 - RNA, 19 nt, Homo sapiens
gcagaaagaccuucgaaug

SEQ ID NO: 205647 - RNA, 19 nt, Homo sapiens
gaaagcacagucaagauuu

SEQ ID NO: 205648 - RNA, 19 nt, Homo sapiens
gaagaaagcacagucaaga

SEQ ID NO: 205649 - RNA, 19 nt, Homo sapiens
uaagcaggauacaacauua

SEQ ID NO: 205650 - RNA, 19 nt, Homo sapiens
ggacugagaaggcauuaaa

SEQ ID NO: 205651 - RNA, 19 nt, Homo sapiens
gcaaacagaacuagaauca

SEQ ID NO: 205652 - RNA, 19 nt, Homo sapiens
guacugaaguucccugaug

SEQ ID NO: 205653 - RNA, 19 nt, Homo sapiens
gaaagaaguacauagaguu

SEQ ID NO: 205654 - RNA, 19 nt, Homo sapiens
uagcagaguugaagagaaa

SEQ ID NO: 205655 - RNA, 19 nt, Homo sapiens
uaacucagcuggaaucagu

SEQ ID NO: 205656 - RNA, 19 nt, Homo sapiens
gcaucaggcucauguagaa

SEQ ID NO: 205657 - RNA, 19 nt, Homo sapiens
gaucaggaagccaaacuua

SEQ ID NO: 205658 - RNA, 19 nt, Homo sapiens
caaaggagaugcaagaaac

SEQ ID NO: 205659 - RNA, 19 nt, Homo sapiens
ggagaacccuggcaaugau

SEQ ID NO: 205660 - RNA, 19 nt, Homo sapiens
gaaauaaacccacagaacu

SEQ ID NO: 205661 - RNA, 19 nt, Homo sapiens
agaaagugcugcaaaauua

SEQ ID NO: 205662 - RNA, 19 nt, Homo sapiens
gcagauccagcuugaguua

SEQ ID NO: 205663 - RNA, 19 nt, Homo sapiens
gagcaggacaucuucauuu

SEQ ID NO: 205664 - RNA, 19 nt, Homo sapiens
uaacuuaaccugcuuuaug

SEQ ID NO: 205665 - RNA, 19 nt, Homo sapiens
gcagaagacauaugaagaa

SEQ ID NO: 205666 - RNA, 19 nt, Homo sapiens
aaacagaguuaaagucuca

SEQ ID NO: 205667 - RNA, 19 nt, Homo sapiens
gaauuagaagcacaacuua

SEQ ID NO: 205668 - RNA, 19 nt, Homo sapiens
uugcacaguuucugaauua

SEQ ID NO: 205669 - RNA, 19 nt, Homo sapiens
gaugaagaauuccagaguu

SEQ ID NO: 205670 - RNA, 19 nt, Homo sapiens
aagaagagaugaacaagga

SEQ ID NO: 205671 - RNA, 19 nt, Homo sapiens
cagcagaaguuguuggauu

SEQ ID NO: 205672 - RNA, 19 nt, Homo sapiens
gaagcaaacagaacuagaa

SEQ ID NO: 205673 - RNA, 19 nt, Homo sapiens
ggaaaugaaagaagaagaa

SEQ ID NO: 205674 - RNA, 19 nt, Homo sapiens
gaaacaauucagucacaua

SEQ ID NO: 205675 - RNA, 19 nt, Homo sapiens
uaagggaccugcagacuca

SEQ ID NO: 205676 - RNA, 19 nt, Homo sapiens
gaucuggaguuuaaauuag

SEQ ID NO: 205677 - RNA, 19 nt, Homo sapiens
gcuccgaucuucaucuuga

SEQ ID NO: 205678 - RNA, 19 nt, Homo sapiens
guuguuaucucaaauggaa

SEQ ID NO: 205679 - RNA, 19 nt, Homo sapiens
aaagcacagucaagauuua

SEQ ID NO: 205680 - RNA, 19 nt, Homo sapiens
ugaauuacaggaacaguua

SEQ ID NO: 205681 - RNA, 19 nt, Homo sapiens
cuaccgaauuugaguauuu

SEQ ID NO: 205682 - RNA, 19 nt, Homo sapiens
uggagaaccuaccgaauuu

SEQ ID NO: 205683 - RNA, 19 nt, Homo sapiens
gaacagauucacaauuuag

SEQ ID NO: 205684 - RNA, 19 nt, Homo sapiens
gcaagaauuggaaauacua

SEQ ID NO: 205685 - RNA, 19 nt, Homo sapiens
ucacauugaugaaagaaga

SEQ ID NO: 205686 - RNA, 19 nt, Homo sapiens
gaaaucagcuuuaguauga

SEQ ID NO: 205687 - RNA, 19 nt, Homo sapiens
ggaaugagcuggagaaauu

SEQ ID NO: 205688 - RNA, 19 nt, Homo sapiens
gaaagaagcucaagaggaa

SEQ ID NO: 205689 - RNA, 19 nt, Homo sapiens
gggaauagcuccaauuaaa

SEQ ID NO: 205690 - RNA, 19 nt, Homo sapiens
ggaauucucucaccucuaa

SEQ ID NO: 205691 - RNA, 19 nt, Homo sapiens
gaaaggagcuucugcaaag

SEQ ID NO: 205692 - RNA, 19 nt, Homo sapiens
gaagguaggugaaauugaa

SEQ ID NO: 205693 - RNA, 19 nt, Homo sapiens
ggaagaagauaaugaaguu

SEQ ID NO: 205694 - RNA, 19 nt, Homo sapiens
cuaaagagauugagaguuu

SEQ ID NO: 205695 - RNA, 19 nt, Homo sapiens
ggacaggucuuuauuggaa

SEQ ID NO: 205696 - RNA, 19 nt, Homo sapiens
gaaagaacccggaaauaaa

SEQ ID NO: 205697 - RNA, 19 nt, Homo sapiens
gaaaguagaguuagaauug

SEQ ID NO: 205698 - RNA, 19 nt, Homo sapiens
gaacuagagucucgguaua

SEQ ID NO: 205699 - RNA, 19 nt, Homo sapiens
gaaagacucucuaagugaa

SEQ ID NO: 205700 - RNA, 19 nt, Homo sapiens
gcacagaguucuacagaga

SEQ ID NO: 205701 - RNA, 19 nt, Homo sapiens
gcagaaagaugaagcucua

SEQ ID NO: 205702 - RNA, 19 nt, Homo sapiens
gcaagaggcugauauucaa

SEQ ID NO: 205703 - RNA, 19 nt, Homo sapiens
cagcaauacuuacagauua

SEQ ID NO: 205704 - RNA, 19 nt, Homo sapiens
gaagauaauugcaguguuc

SEQ ID NO: 205705 - RNA, 19 nt, Homo sapiens
gcaagaagaagguacuuua

SEQ ID NO: 205706 - RNA, 19 nt, Homo sapiens
agaaagaauugcuggauua

SEQ ID NO: 205707 - RNA, 19 nt, Homo sapiens
gaaagagacaaacucauua

SEQ ID NO: 205708 - RNA, 19 nt, Homo sapiens
aaucagaccuugcaagaua

SEQ ID NO: 205709 - RNA, 19 nt, Homo sapiens
gcacaaagcagaaauggaa

SEQ ID NO: 205710 - RNA, 19 nt, Homo sapiens
aaacagagaugcaacagaa

SEQ ID NO: 205711 - RNA, 19 nt, Homo sapiens
gaacuucagucaaauaaag

SEQ ID NO: 205712 - RNA, 19 nt, Homo sapiens
cuacagagauggaagaauu

SEQ ID NO: 205713 - RNA, 19 nt, Homo sapiens
gagaugcucuucuuucuga

SEQ ID NO: 205714 - RNA, 19 nt, Homo sapiens
gcaggaagcugagcaagaa

SEQ ID NO: 205715 - RNA, 19 nt, Homo sapiens
gacaauaucugagaaagaa

SEQ ID NO: 205716 - RNA, 19 nt, Homo sapiens
gaaggaaauugaaucuuug

SEQ ID NO: 205717 - RNA, 19 nt, Homo sapiens
ggaaauagaggcugagaaa

SEQ ID NO: 205718 - RNA, 19 nt, Homo sapiens
gaacagauccauagucuca

SEQ ID NO: 205719 - RNA, 19 nt, Homo sapiens
ggaagaauuuguaaugaug

SEQ ID NO: 205720 - RNA, 19 nt, Homo sapiens
ccaagaaucugacauggaa

SEQ ID NO: 205721 - RNA, 19 nt, Homo sapiens
uaaggaagcugcuggaaga

SEQ ID NO: 205722 - RNA, 19 nt, Homo sapiens
gagaagaccugaaccaagu

SEQ ID NO: 205723 - RNA, 19 nt, Homo sapiens
gaaagcagccaacuacaaa

SEQ ID NO: 205724 - RNA, 19 nt, Homo sapiens
ggagaaggaucaacaagug

SEQ ID NO: 205725 - RNA, 19 nt, Homo sapiens
gaaaccagauucucucuca

SEQ ID NO: 205726 - RNA, 19 nt, Homo sapiens
gaacaugacaagcagauuu

SEQ ID NO: 205727 - RNA, 19 nt, Homo sapiens
agaauuagcuagcuucaaa

SEQ ID NO: 205728 - RNA, 19 nt, Homo sapiens
gagacaaacucauuacaga

SEQ ID NO: 205729 - RNA, 19 nt, Homo sapiens
gcaauuauccagaaguuaa

SEQ ID NO: 205730 - RNA, 19 nt, Homo sapiens
gaaggaacuugaaauaaca

SEQ ID NO: 205731 - RNA, 19 nt, Homo sapiens
gaacagggacucuuaaaca

SEQ ID NO: 205732 - RNA, 19 nt, Homo sapiens
gaaauuagacucaaagaag

SEQ ID NO: 205733 - RNA, 19 nt, Homo sapiens
ggagaaauuucgaaaguca

SEQ ID NO: 205734 - RNA, 19 nt, Homo sapiens
aaacuaagguggaaucaga

SEQ ID NO: 205735 - RNA, 19 nt, Homo sapiens
uaaagcaacuggaaaugaa

SEQ ID NO: 205736 - RNA, 19 nt, Homo sapiens
ggagagaacuguuaaagcu

SEQ ID NO: 205737 - RNA, 19 nt, Homo sapiens
gcacagaggcaaacaagaa

SEQ ID NO: 205738 - RNA, 19 nt, Homo sapiens
gaaggaacuuagcauggua

SEQ ID NO: 205739 - RNA, 19 nt, Homo sapiens
ugagaaagcuaaggaaauu

SEQ ID NO: 205740 - RNA, 19 nt, Homo sapiens
uagaacaucugaggaaaua

SEQ ID NO: 205741 - RNA, 19 nt, Homo sapiens
cgacaucucucuauaaucu

SEQ ID NO: 205742 - RNA, 19 nt, Homo sapiens
gaagagaggcuuaugaauc

SEQ ID NO: 205743 - RNA, 19 nt, Homo sapiens
uaagagaauugcaaccuaa

SEQ ID NO: 205744 - RNA, 19 nt, Homo sapiens
gaagagagugguagaacua

SEQ ID NO: 205745 - RNA, 19 nt, Homo sapiens
ggagauggaacagaaauua

SEQ ID NO: 205746 - RNA, 19 nt, Homo sapiens
gagaggaaguuuagugaug

SEQ ID NO: 205747 - RNA, 19 nt, Homo sapiens
gacaggaagugaaugaauu

SEQ ID NO: 205748 - RNA, 19 nt, Homo sapiens
cagcacaaauucagucuuu

SEQ ID NO: 205749 - RNA, 19 nt, Homo sapiens
guacacagguuaagugcuu

SEQ ID NO: 205750 - RNA, 19 nt, Homo sapiens
ccaaguagcuauugcugaa

SEQ ID NO: 205751 - RNA, 19 nt, Homo sapiens
caaagcuucuccaagauaa

SEQ ID NO: 205752 - RNA, 19 nt, Homo sapiens
gagaucaccuguggaauga

SEQ ID NO: 205753 - RNA, 19 nt, Homo sapiens
agagaaagaugauuuggaa

SEQ ID NO: 205754 - RNA, 19 nt, Homo sapiens
uaaggcauaucucaaguaa

SEQ ID NO: 205755 - RNA, 19 nt, Homo sapiens
gcaaagaagacuugauuau

SEQ ID NO: 205756 - RNA, 19 nt, Homo sapiens
gcugaaagcugagaaugaa

SEQ ID NO: 205757 - RNA, 19 nt, Homo sapiens
gcagccaucuacuuucuaa

SEQ ID NO: 205758 - RNA, 19 nt, Homo sapiens
ggaacuugaugaacugaaa

SEQ ID NO: 205759 - RNA, 19 nt, Homo sapiens
gaaggucugugauacucua

SEQ ID NO: 205760 - RNA, 19 nt, Homo sapiens
uaaagcagcuacagaagga

SEQ ID NO: 205761 - RNA, 19 nt, Homo sapiens
gcacaagaccuacauguuc

SEQ ID NO: 205762 - RNA, 19 nt, Homo sapiens
gaagauacagggcaagauu

SEQ ID NO: 205763 - RNA, 19 nt, Homo sapiens
gaaggaaucugaggaagca

SEQ ID NO: 205764 - RNA, 19 nt, Homo sapiens
ggaagaggcaauccaagua

SEQ ID NO: 205765 - RNA, 19 nt, Homo sapiens
gaaauggacaggucuuuau

SEQ ID NO: 205766 - RNA, 19 nt, Homo sapiens
gcaaagagucaguagauug

SEQ ID NO: 205767 - RNA, 19 nt, Homo sapiens
gaagauaaacugaagaaag

SEQ ID NO: 205768 - RNA, 19 nt, Homo sapiens
caaaggaacuucaggaacu

SEQ ID NO: 205769 - RNA, 19 nt, Homo sapiens
acaaauugcuggccuagaa

SEQ ID NO: 205770 - RNA, 19 nt, Homo sapiens
cagaagagguauuucaguu

SEQ ID NO: 205771 - RNA, 19 nt, Homo sapiens
gagggaauagcuccaauua

SEQ ID NO: 205772 - RNA, 19 nt, Homo sapiens
gaaccaagugauaacaaua

SEQ ID NO: 205773 - RNA, 19 nt, Homo sapiens
aaacgaaugucacugaaga

SEQ ID NO: 205774 - RNA, 19 nt, Homo sapiens
gcuaaagaguguauggaaa

SEQ ID NO: 205775 - RNA, 19 nt, Homo sapiens
gaagagguauuucaguuac

SEQ ID NO: 205776 - RNA, 19 nt, Homo sapiens
gaaaguuaguucuacaaca

SEQ ID NO: 205777 - RNA, 19 nt, Homo sapiens
aaaggaagcuugaggaaca

SEQ ID NO: 205778 - RNA, 19 nt, Homo sapiens
gaagagauggaaauagaaa

SEQ ID NO: 205779 - RNA, 19 nt, Homo sapiens
ggaagcugcuggaagaaga

SEQ ID NO: 205780 - RNA, 19 nt, Homo sapiens
ggaagugaaugaauuaagg

SEQ ID NO: 205781 - RNA, 19 nt, Homo sapiens
cagguuaagugcuuuguuu

SEQ ID NO: 205782 - RNA, 19 nt, Homo sapiens
gaacugauccaauauagag

SEQ ID NO: 205783 - RNA, 19 nt, Homo sapiens
aagagaaacuggaugcuuu

SEQ ID NO: 205784 - RNA, 19 nt, Homo sapiens
ucaaaguccugcuagauga

SEQ ID NO: 205785 - RNA, 19 nt, Homo sapiens
caucagguaucaagagaaa

SEQ ID NO: 205786 - RNA, 19 nt, Homo sapiens
gaacaucccuugagacgaa

SEQ ID NO: 205787 - RNA, 19 nt, Homo sapiens
gagaagaucgugcggauua

SEQ ID NO: 205788 - RNA, 19 nt, Homo sapiens
gcacaaaccuacauguaca

SEQ ID NO: 205789 - RNA, 19 nt, Homo sapiens
aauuggagcugauuucuua

SEQ ID NO: 205790 - RNA, 19 nt, Homo sapiens
gacaauggcugaccggauu

SEQ ID NO: 205791 - RNA, 19 nt, Homo sapiens
gagcauaucgcacggauga

SEQ ID NO: 205792 - RNA, 19 nt, Homo sapiens
gcacggacacguacauauu

SEQ ID NO: 205793 - RNA, 19 nt, Homo sapiens
guaguucucugucaugugu

SEQ ID NO: 205794 - RNA, 19 nt, Homo sapiens
ugaaugaucuggagaaugc

SEQ ID NO: 205795 - RNA, 19 nt, Homo sapiens
ugaagaaaguggagcagaa

SEQ ID NO: 205796 - RNA, 19 nt, Homo sapiens
ccuaagcuuugguucuuua

SEQ ID NO: 205797 - RNA, 19 nt, Homo sapiens
ccaagcagguugaguaucu

SEQ ID NO: 205798 - RNA, 19 nt, Homo sapiens
gcaaguccuuucccagaug

SEQ ID NO: 205799 - RNA, 19 nt, Homo sapiens
ugaaggagccaaaguguga

SEQ ID NO: 205800 - RNA, 19 nt, Homo sapiens
ggucaaagcaaauuaagau

SEQ ID NO: 205801 - RNA, 19 nt, Homo sapiens
guagugcauucugauauuu

SEQ ID NO: 205802 - RNA, 19 nt, Homo sapiens
gugguaagaaggauauuua

SEQ ID NO: 205803 - RNA, 19 nt, Homo sapiens
gaacuucgggcucuacaau

SEQ ID NO: 205804 - RNA, 19 nt, Homo sapiens
gcccagcacucaaggagaa

SEQ ID NO: 205805 - RNA, 19 nt, Homo sapiens
caaaguaguucucugucau

SEQ ID NO: 205806 - RNA, 19 nt, Homo sapiens
gaaaguggagcagaagauu

SEQ ID NO: 205807 - RNA, 19 nt, Homo sapiens
guacuuugaucaugagaca

SEQ ID NO: 205808 - RNA, 19 nt, Homo sapiens
gaagagaacaucccuugag

SEQ ID NO: 205809 - RNA, 19 nt, Homo sapiens
gaauggacagguaauguga

SEQ ID NO: 205810 - RNA, 19 nt, Homo sapiens
uaggaggugugcaaucuuu

SEQ ID NO: 205811 - RNA, 19 nt, Homo sapiens
ggaggucaaagcaaauuaa

SEQ ID NO: 205812 - RNA, 19 nt, Homo sapiens
ccaaaguaguucucuguca

SEQ ID NO: 205813 - RNA, 19 nt, Homo sapiens
guacauaccauggauuaga

SEQ ID NO: 205814 - RNA, 19 nt, Homo sapiens
caagaacacaccugucuau

SEQ ID NO: 205815 - RNA, 19 nt, Homo sapiens
gccauucuauuguguucua

SEQ ID NO: 205816 - RNA, 19 nt, Homo sapiens
gaacucagggcacgacuag

SEQ ID NO: 205817 - RNA, 19 nt, Homo sapiens
uuaaagacauucgguccua

SEQ ID NO: 205818 - RNA, 19 nt, Homo sapiens
gagcugugcuucucgucuu

SEQ ID NO: 205819 - RNA, 19 nt, Homo sapiens
aagaguacuuugaucauga

SEQ ID NO: 205820 - RNA, 19 nt, Homo sapiens
gaacaaacaacaagaacac

SEQ ID NO: 205821 - RNA, 19 nt, Homo sapiens
gggaacaggugcacuucga

SEQ ID NO: 205822 - RNA, 19 nt, Homo sapiens
caagcucacugccgacuuc

SEQ ID NO: 205823 - RNA, 19 nt, Homo sapiens
caaauucuagucccaaaga

SEQ ID NO: 205824 - RNA, 19 nt, Homo sapiens
cagguaaugugaagacaau

SEQ ID NO: 205825 - RNA, 19 nt, Homo sapiens
gagagagucgggaaucuga

SEQ ID NO: 205826 - RNA, 19 nt, Homo sapiens
cguagugcauucugauauu

SEQ ID NO: 205827 - RNA, 19 nt, Homo sapiens
aaacaccacccguccagua

SEQ ID NO: 205828 - RNA, 19 nt, Homo sapiens
gguaggaggugugcaaucu

SEQ ID NO: 205829 - RNA, 19 nt, Homo sapiens
gaacaggugcacuucgaau

SEQ ID NO: 205830 - RNA, 19 nt, Homo sapiens
uagccuaaaucacgaguau

SEQ ID NO: 205831 - RNA, 19 nt, Homo sapiens
aagagaacaucccuugaga

SEQ ID NO: 205832 - RNA, 19 nt, Homo sapiens
ggaauggacagguaaugug

SEQ ID NO: 205833 - RNA, 19 nt, Homo sapiens
gcuccugaguucuccauug

SEQ ID NO: 205834 - RNA, 19 nt, Homo sapiens
ugacaugcacggacacgua

SEQ ID NO: 205835 - RNA, 19 nt, Homo sapiens
cuggaaaccuggagagaga

SEQ ID NO: 205836 - RNA, 19 nt, Homo sapiens
acacguacauauuuaacug

SEQ ID NO: 205837 - RNA, 19 nt, Homo sapiens
gaaaagaaccugagagcau

SEQ ID NO: 205838 - RNA, 19 nt, Homo sapiens
gcccaguccuucuccaaga

SEQ ID NO: 205839 - RNA, 19 nt, Homo sapiens
acggacacguacauauuua

SEQ ID NO: 205840 - RNA, 19 nt, Homo sapiens
ccugaguucuccauuguug

SEQ ID NO: 205841 - RNA, 19 nt, Homo sapiens
gagccauucuauuguguuc

SEQ ID NO: 205842 - RNA, 19 nt, Homo sapiens
guccuaagcuuugguucuu

SEQ ID NO: 205843 - RNA, 19 nt, Homo sapiens
gcauuaaauucaucaucuc

SEQ ID NO: 205844 - RNA, 19 nt, Homo sapiens
gaaucugacugugguugga

SEQ ID NO: 205845 - RNA, 19 nt, Homo sapiens
ggaacaaacaacaagaaca

SEQ ID NO: 205846 - RNA, 19 nt, Homo sapiens
gcagaagauugcuaaugac

SEQ ID NO: 205847 - RNA, 19 nt, Homo sapiens
ccaugaagcagucaccaaa

SEQ ID NO: 205848 - RNA, 19 nt, Homo sapiens
gaucaaauuggcauguuca

SEQ ID NO: 205849 - RNA, 19 nt, Homo sapiens
cuacugggaugcagagaag

SEQ ID NO: 205850 - RNA, 19 nt, Homo sapiens
gcaccuccgucagucuuug

SEQ ID NO: 205851 - RNA, 19 nt, Homo sapiens
gaugacagcccagcacuca

SEQ ID NO: 205852 - RNA, 19 nt, Homo sapiens
gagccaaagugugaaugug

SEQ ID NO: 205853 - RNA, 19 nt, Homo sapiens
gaauuggagcugauuucuu

SEQ ID NO: 205854 - RNA, 19 nt, Homo sapiens
caaagaucaaguugucuga

SEQ ID NO: 205855 - RNA, 19 nt, Homo sapiens
uaucuugucccucucacua

SEQ ID NO: 205856 - RNA, 19 nt, Homo sapiens
gaccggauucugaccauga

SEQ ID NO: 205857 - RNA, 19 nt, Homo sapiens
gaagaaaguggagcagaag

SEQ ID NO: 205858 - RNA, 19 nt, Homo sapiens
gaucaaguugucugaagga

SEQ ID NO: 205859 - RNA, 19 nt, Homo sapiens
ucccaaagaucaaguuguc

SEQ ID NO: 205860 - RNA, 19 nt, Homo sapiens
gaguaucuggucaaugaaa

SEQ ID NO: 205861 - RNA, 19 nt, Homo sapiens
ccagggagcacgaauugug

SEQ ID NO: 205862 - RNA, 19 nt, Homo sapiens
gcccagggagcacgaauug

SEQ ID NO: 205863 - RNA, 19 nt, Homo sapiens
ccaagaacuucgggcucua

SEQ ID NO: 205864 - RNA, 19 nt, Homo sapiens
uaaagacauucgguccuau

SEQ ID NO: 205865 - RNA, 19 nt, Homo sapiens
uacaaauucuagucccaaa

SEQ ID NO: 205866 - RNA, 19 nt, Homo sapiens
gaauuuggagacugggauu

SEQ ID NO: 205867 - RNA, 19 nt, Homo sapiens
uaucagggcuucgcaucug

SEQ ID NO: 205868 - RNA, 19 nt, Homo sapiens
ucaccaaccugggagaauc

SEQ ID NO: 205869 - RNA, 19 nt, Homo sapiens
uagggugacugugguaaga

SEQ ID NO: 205870 - RNA, 19 nt, Homo sapiens
caacgugaguggcuuaacc

SEQ ID NO: 205871 - RNA, 19 nt, Homo sapiens
cacggacacguacauauuu

SEQ ID NO: 205872 - RNA, 19 nt, Homo sapiens
ggacagguaaugugaagac

SEQ ID NO: 205873 - RNA, 19 nt, Homo sapiens
uuugaggaauggacaggua

SEQ ID NO: 205874 - RNA, 19 nt, Homo sapiens
agagaugccugggccauuc

SEQ ID NO: 205875 - RNA, 19 nt, Homo sapiens
ucuauuguguucuacuuca

SEQ ID NO: 205876 - RNA, 19 nt, Homo sapiens
aaauuggcauguucagcuu

SEQ ID NO: 205877 - RNA, 19 nt, Homo sapiens
ccugggccauucgcuauuu

SEQ ID NO: 205878 - RNA, 19 nt, Homo sapiens
gagcaguggaagcagauug

SEQ ID NO: 205879 - RNA, 19 nt, Homo sapiens
ggaacaggugcacuucgaa

SEQ ID NO: 205880 - RNA, 19 nt, Homo sapiens
acuucgggcucuacaauga

SEQ ID NO: 205881 - RNA, 19 nt, Homo sapiens
gaagcaccgguuucuguuc

SEQ ID NO: 205882 - RNA, 19 nt, Homo sapiens
agaacacaccugucuaugu

SEQ ID NO: 205883 - RNA, 19 nt, Homo sapiens
gagagaugccugggccauu

SEQ ID NO: 205884 - RNA, 19 nt, Homo sapiens
caacuccggagcaguggaa

SEQ ID NO: 205885 - RNA, 19 nt, Homo sapiens
gcguagugcauucugauau

SEQ ID NO: 205886 - RNA, 19 nt, Homo sapiens
gcaguuuccugucuuauuu

SEQ ID NO: 205887 - RNA, 19 nt, Homo sapiens
guaggaaacuguacuuuau

SEQ ID NO: 205888 - RNA, 19 nt, Homo sapiens
gcaugcagcuacaagguua

SEQ ID NO: 205889 - RNA, 19 nt, Homo sapiens
caaggcaucugcagaacua

SEQ ID NO: 205890 - RNA, 19 nt, Homo sapiens
gcuggcgucuggaauauua

SEQ ID NO: 205891 - RNA, 19 nt, Homo sapiens
gaaacaagcacaccuuaga

SEQ ID NO: 205892 - RNA, 19 nt, Homo sapiens
ccaagaacaugggcuuaua

SEQ ID NO: 205893 - RNA, 19 nt, Homo sapiens
gugaguggaucauuucuuu

SEQ ID NO: 205894 - RNA, 19 nt, Homo sapiens
gaaccaccaucugcucuaa

SEQ ID NO: 205895 - RNA, 19 nt, Homo sapiens
ggaacaaccuuaucaacag

SEQ ID NO: 205896 - RNA, 19 nt, Homo sapiens
gggagucacugaagccuuu

SEQ ID NO: 205897 - RNA, 19 nt, Homo sapiens
ggcauccucuugaaugaua

SEQ ID NO: 205898 - RNA, 19 nt, Homo sapiens
ggaaggaaauagcaacagu

SEQ ID NO: 205899 - RNA, 19 nt, Homo sapiens
gagaaacaagcacaccuua

SEQ ID NO: 205900 - RNA, 19 nt, Homo sapiens
gaacaugggcuuauauggu

SEQ ID NO: 205901 - RNA, 19 nt, Homo sapiens
gcuacaagguuaucgguau

SEQ ID NO: 205902 - RNA, 19 nt, Homo sapiens
ggaaacagagacaaccuuu

SEQ ID NO: 205903 - RNA, 19 nt, Homo sapiens
caucugcucuaaccaugua

SEQ ID NO: 205904 - RNA, 19 nt, Homo sapiens
gaaaugggaccuccagauc

SEQ ID NO: 205905 - RNA, 19 nt, Homo sapiens
gguggugaguggaucauuu

SEQ ID NO: 205906 - RNA, 19 nt, Homo sapiens
acacaucaccgaccaaauu

SEQ ID NO: 205907 - RNA, 19 nt, Homo sapiens
gaacagcgaagucuugaag

SEQ ID NO: 205908 - RNA, 19 nt, Homo sapiens
gguuggaccuccucccuuu

SEQ ID NO: 205909 - RNA, 19 nt, Homo sapiens
gcaguuucaucccauucua

SEQ ID NO: 205910 - RNA, 19 nt, Homo sapiens
guaggagccuucacuaugg

SEQ ID NO: 205911 - RNA, 19 nt, Homo sapiens
uagcaacaguggugaagaa

SEQ ID NO: 205912 - RNA, 19 nt, Homo sapiens
aaauuggcauguucuguuu

SEQ ID NO: 205913 - RNA, 19 nt, Homo sapiens
caaauuggcauguucuguu

SEQ ID NO: 205914 - RNA, 19 nt, Homo sapiens
ugaaugauagugcaaguuu

SEQ ID NO: 205915 - RNA, 19 nt, Homo sapiens
gaguuuacaugugcaagaa

SEQ ID NO: 205916 - RNA, 19 nt, Homo sapiens
gagcagaguguucuucuuc

SEQ ID NO: 205917 - RNA, 19 nt, Homo sapiens
gaacuagcccugggugaga

SEQ ID NO: 205918 - RNA, 19 nt, Homo sapiens
caaagaauaguggagagua

SEQ ID NO: 205919 - RNA, 19 nt, Homo sapiens
gagagaaggccagcuaguu

SEQ ID NO: 205920 - RNA, 19 nt, Homo sapiens
gaacuggagccuuaaggau

SEQ ID NO: 205921 - RNA, 19 nt, Homo sapiens
gugcaaguuucuccaguug

SEQ ID NO: 205922 - RNA, 19 nt, Homo sapiens
gaaugauagugcaaguuuc

SEQ ID NO: 205923 - RNA, 19 nt, Homo sapiens
cauccuaucgagauuauuu

SEQ ID NO: 205924 - RNA, 19 nt, Homo sapiens
auugagagcuucacacaga

SEQ ID NO: 205925 - RNA, 19 nt, Homo sapiens
cuacaagguuaucgguauu

SEQ ID NO: 205926 - RNA, 19 nt, Homo sapiens
caggaaagaggauauucua

SEQ ID NO: 205927 - RNA, 19 nt, Homo sapiens
cugcagaaaugauguuuua

SEQ ID NO: 205928 - RNA, 19 nt, Homo sapiens
ucagguuccucgugagaaa

SEQ ID NO: 205929 - RNA, 19 nt, Homo sapiens
ggaaaugggaccuccagau

SEQ ID NO: 205930 - RNA, 19 nt, Homo sapiens
gaaucucuuugcguucuuu

SEQ ID NO: 205931 - RNA, 19 nt, Homo sapiens
gcagggugguaccaggaaa

SEQ ID NO: 205932 - RNA, 19 nt, Homo sapiens
gaccaucaacuccauccua

SEQ ID NO: 205933 - RNA, 19 nt, Homo sapiens
aacaauggcugcaagaagu

SEQ ID NO: 205934 - RNA, 19 nt, Homo sapiens
agaaagucaucgcaccaaa

SEQ ID NO: 205935 - RNA, 19 nt, Homo sapiens
ucuccaaccucaagaagga

SEQ ID NO: 205936 - RNA, 19 nt, Homo sapiens
caagaacaugggcuuauau

SEQ ID NO: 205937 - RNA, 19 nt, Homo sapiens
gguuuucucuguuacaaua

SEQ ID NO: 205938 - RNA, 19 nt, Homo sapiens
aaagaauaguggagaguag

SEQ ID NO: 205939 - RNA, 19 nt, Homo sapiens
ccagcuaguucugucauga

SEQ ID NO: 205940 - RNA, 19 nt, Homo sapiens
aaacagagacaaccuuucu

SEQ ID NO: 205941 - RNA, 19 nt, Homo sapiens
caacacaucaccgaccaaa

SEQ ID NO: 205942 - RNA, 19 nt, Homo sapiens
ucacuauggucugcaaaga

SEQ ID NO: 205943 - RNA, 19 nt, Homo sapiens
ccaaucauaugccaagaac

SEQ ID NO: 205944 - RNA, 19 nt, Homo sapiens
aagguuaucgguauuauga

SEQ ID NO: 205945 - RNA, 19 nt, Homo sapiens
ucacacagacaaugagaga

SEQ ID NO: 205946 - RNA, 19 nt, Homo sapiens
aggaauaccugcccauugg

SEQ ID NO: 205947 - RNA, 19 nt, Homo sapiens
ggaacuggagccuuaagga

SEQ ID NO: 205948 - RNA, 19 nt, Homo sapiens
gaguggaucauuucuuuca

SEQ ID NO: 205949 - RNA, 19 nt, Homo sapiens
ccggauugcugcugccauu

SEQ ID NO: 205950 - RNA, 19 nt, Homo sapiens
cugcaaagaugcggaugaa

SEQ ID NO: 205951 - RNA, 19 nt, Homo sapiens
cuaaccauguagacuuauu

SEQ ID NO: 205952 - RNA, 19 nt, Homo sapiens
guaacacucagcauuugaa

SEQ ID NO: 205953 - RNA, 19 nt, Homo sapiens
acuauggucugcaaagaug

SEQ ID NO: 205954 - RNA, 19 nt, Homo sapiens
gagaacagcgaagucuuga

SEQ ID NO: 205955 - RNA, 19 nt, Homo sapiens
cuaccgggaugauaaugga

SEQ ID NO: 205956 - RNA, 19 nt, Homo sapiens
ccauugcaauauuucagaa

SEQ ID NO: 205957 - RNA, 19 nt, Homo sapiens
caaggcagaggcccagauu

SEQ ID NO: 205958 - RNA, 19 nt, Homo sapiens
caacaguggugaagaaaag

SEQ ID NO: 205959 - RNA, 19 nt, Homo sapiens
gaacaguggaaggaaauag

SEQ ID NO: 205960 - RNA, 19 nt, Homo sapiens
cagccgagaugucuuucug

SEQ ID NO: 205961 - RNA, 19 nt, Homo sapiens
gugccuaccgggaugauaa

SEQ ID NO: 205962 - RNA, 19 nt, Homo sapiens
ccauucuacugcuugauug

SEQ ID NO: 205963 - RNA, 19 nt, Homo sapiens
ugagaacagcgaagucuug

SEQ ID NO: 205964 - RNA, 19 nt, Homo sapiens
cuaguucugucaugaguag

SEQ ID NO: 205965 - RNA, 19 nt, Homo sapiens
cuuagaggcuuugagagaa

SEQ ID NO: 205966 - RNA, 19 nt, Homo sapiens
gcaauauuucagaagcuuu

SEQ ID NO: 205967 - RNA, 19 nt, Homo sapiens
ucucaaagaguuuacaugu

SEQ ID NO: 205968 - RNA, 19 nt, Homo sapiens
ggaaaccacacacccaucu

SEQ ID NO: 205969 - RNA, 19 nt, Homo sapiens
aaugcaguuuccugucuua

SEQ ID NO: 205970 - RNA, 19 nt, Homo sapiens
uggagcggcugaucaagga

SEQ ID NO: 205971 - RNA, 19 nt, Homo sapiens
gagggacaccaauagcaaa

SEQ ID NO: 205972 - RNA, 19 nt, Homo sapiens
uggaaagccuuacguucug

SEQ ID NO: 205973 - RNA, 19 nt, Homo sapiens
ggaacaguggaaggaaaua

SEQ ID NO: 205974 - RNA, 19 nt, Homo sapiens
ccggaacaguggaaggaaa

SEQ ID NO: 205975 - RNA, 19 nt, Homo sapiens
gcacugcagaaaugauguu

SEQ ID NO: 205976 - RNA, 19 nt, Homo sapiens
uguaggagccuucacuaug

SEQ ID NO: 205977 - RNA, 19 nt, Homo sapiens
ggaaucucuuugcguucuu

SEQ ID NO: 205978 - RNA, 19 nt, Homo sapiens
guucagccgagaugucuuu

SEQ ID NO: 205979 - RNA, 19 nt, Homo sapiens
ggaccuccucccuuuguug

SEQ ID NO: 205980 - RNA, 19 nt, Homo sapiens
ugucuguccucccaucuug

SEQ ID NO: 205981 - RNA, 19 nt, Homo sapiens
uuuaagagggacaccaaua

SEQ ID NO: 205982 - RNA, 19 nt, Homo sapiens
ucacugaagccuuuaagag

SEQ ID NO: 205983 - RNA, 19 nt, Homo sapiens
caaggaauaccugcccauu

SEQ ID NO: 205984 - RNA, 19 nt, Homo sapiens
aaaagaacauguagugaca

SEQ ID NO: 205985 - RNA, 19 nt, Homo sapiens
gaaaccacacacccaucuu

SEQ ID NO: 205986 - RNA, 19 nt, Homo sapiens
gggagaagguggagacuga

SEQ ID NO: 205987 - RNA, 19 nt, Homo sapiens
ggagggugcuguccaguau

SEQ ID NO: 205988 - RNA, 19 nt, Homo sapiens
gaugaagggugacuacuac

SEQ ID NO: 205989 - RNA, 19 nt, Homo sapiens
ggagagagccagucugauc

SEQ ID NO: 205990 - RNA, 19 nt, Homo sapiens
gacaagaagcgcaucauug

SEQ ID NO: 205991 - RNA, 19 nt, Homo sapiens
acaagaagcgcaucauuga

SEQ ID NO: 205992 - RNA, 19 nt, Homo sapiens
cauguuuccucucaauaaa

SEQ ID NO: 205993 - RNA, 19 nt, Homo sapiens
gcgcuguucuugcuccaaa

SEQ ID NO: 205994 - RNA, 19 nt, Homo sapiens
gaccauguuuccucucaau

SEQ ID NO: 205995 - RNA, 19 nt, Homo sapiens
caauaaaguuccccuguga

SEQ ID NO: 205996 - RNA, 19 nt, Homo sapiens
ccauguuuccucucaauaa

SEQ ID NO: 205997 - RNA, 19 nt, Homo sapiens
ggacagccaccucaucaag

SEQ ID NO: 205998 - RNA, 19 nt, Homo sapiens
cgacaagaagcgcaucauu

SEQ ID NO: 205999 - RNA, 19 nt, Homo sapiens
cgagacaaccugacacugu

SEQ ID NO: 206000 - RNA, 19 nt, Homo sapiens
aaagacagcacccucauca

SEQ ID NO: 206001 - RNA, 19 nt, Homo sapiens
gaagaugaagggugacuac

SEQ ID NO: 206002 - RNA, 19 nt, Homo sapiens
ccauggacaucagcaagaa

SEQ ID NO: 206003 - RNA, 19 nt, Homo sapiens
agacagcacccucaucaug

SEQ ID NO: 206004 - RNA, 19 nt, Homo sapiens
acagccaccucaucaagga

SEQ ID NO: 206005 - RNA, 19 nt, Homo sapiens
gcgaaaccugcucucagua

SEQ ID NO: 206006 - RNA, 19 nt, Homo sapiens
gaccgagacugagggaaag

SEQ ID NO: 206007 - RNA, 19 nt, Homo sapiens
gugaccauguuuccucuca

SEQ ID NO: 206008 - RNA, 19 nt, Homo sapiens
agaccgagacugagggaaa

SEQ ID NO: 206009 - RNA, 19 nt, Homo sapiens
ccucugaucguaggaauug

SEQ ID NO: 206010 - RNA, 19 nt, Homo sapiens
agaugaagggugacuacua

SEQ ID NO: 206011 - RNA, 19 nt, Homo sapiens
agacacagaguccggcauu

SEQ ID NO: 206012 - RNA, 19 nt, Homo sapiens
cgaacgcuaugaggacaug

SEQ ID NO: 206013 - RNA, 19 nt, Homo sapiens
cgaaaccugcucucaguag

SEQ ID NO: 206014 - RNA, 19 nt, Homo sapiens
gagaugggugugugugugu

SEQ ID NO: 206015 - RNA, 19 nt, Homo sapiens
gacacagaguccggcauug

SEQ ID NO: 206016 - RNA, 19 nt, Homo sapiens
gagcaggccgaacgcuaug

SEQ ID NO: 206017 - RNA, 19 nt, Homo sapiens
agggugcuguccaguauug

SEQ ID NO: 206018 - RNA, 19 nt, Homo sapiens
ggaucccacucuucuugca

SEQ ID NO: 206019 - RNA, 19 nt, Homo sapiens
ccuaggcgcuguucuugcu

SEQ ID NO: 206020 - RNA, 19 nt, Homo sapiens
gccgagaggacuaguaugg

SEQ ID NO: 206021 - RNA, 19 nt, Homo sapiens
caaagacagcacccucauc

SEQ ID NO: 206022 - RNA, 19 nt, Homo sapiens
uguccaguauugagcagaa

SEQ ID NO: 206023 - RNA, 19 nt, Homo sapiens
gccauggacaucagcaaga

SEQ ID NO: 206024 - RNA, 19 nt, Homo sapiens
agcgaaaccugcucucagu

SEQ ID NO: 206025 - RNA, 19 nt, Homo sapiens
gcaugucugcuggguguga

SEQ ID NO: 206026 - RNA, 19 nt, Homo sapiens
agacugagggaaagcaugu

SEQ ID NO: 206027 - RNA, 19 nt, Homo sapiens
cguaggaauugaggagugu

SEQ ID NO: 206028 - RNA, 19 nt, Homo sapiens
ccugcugccucugaucgua

SEQ ID NO: 206029 - RNA, 19 nt, Homo sapiens
gaagcgcaucauugacuca

SEQ ID NO: 206030 - RNA, 19 nt, Homo sapiens
ucucaguagccuauaagaa

SEQ ID NO: 206031 - RNA, 19 nt, Homo sapiens
gugaguaccgggagaaggu

SEQ ID NO: 206032 - RNA, 19 nt, Homo sapiens
caagagaacucgcuguaua

SEQ ID NO: 206033 - RNA, 19 nt, Homo sapiens
acacagaccuauaugauua

SEQ ID NO: 206034 - RNA, 19 nt, Homo sapiens
gagguucgcuucccacuuu

SEQ ID NO: 206035 - RNA, 19 nt, Homo sapiens
gaagugaacugugacaaga

SEQ ID NO: 206036 - RNA, 19 nt, Homo sapiens
caacacaggcacacaauuu

SEQ ID NO: 206037 - RNA, 19 nt, Homo sapiens
ucaaggccaugaccucuaa

SEQ ID NO: 206038 - RNA, 19 nt, Homo sapiens
ugaaugggcuggagaaucu

SEQ ID NO: 206039 - RNA, 19 nt, Homo sapiens
ucacucagcugaaccuaga

SEQ ID NO: 206040 - RNA, 19 nt, Homo sapiens
caaggacuguggucaaguu

SEQ ID NO: 206041 - RNA, 19 nt, Homo sapiens
acugugagauccucuauuu

SEQ ID NO: 206042 - RNA, 19 nt, Homo sapiens
gcacagugagcauuaggua

SEQ ID NO: 206043 - RNA, 19 nt, Homo sapiens
uuacaaauaugggugguuu

SEQ ID NO: 206044 - RNA, 19 nt, Homo sapiens
uuacaaauaugggugguuu

SEQ ID NO: 206045 - RNA, 19 nt, Homo sapiens
ccugugggcucuccuauug

SEQ ID NO: 206046 - RNA, 19 nt, Homo sapiens
gaacucgcuguauacaaua

SEQ ID NO: 206047 - RNA, 19 nt, Homo sapiens
agaacucgcuguauacaau

SEQ ID NO: 206048 - RNA, 19 nt, Homo sapiens
gaaaggcaaugagcugaag

SEQ ID NO: 206049 - RNA, 19 nt, Homo sapiens
caagagcucuaccugaaag

SEQ ID NO: 206050 - RNA, 19 nt, Homo sapiens
caacacaagaauccacuaa

SEQ ID NO: 206051 - RNA, 19 nt, Homo sapiens
cuaaggagcagaccacauu

SEQ ID NO: 206052 - RNA, 19 nt, Homo sapiens
uccaagagcucuaccugaa

SEQ ID NO: 206053 - RNA, 19 nt, Homo sapiens
agacaaagcucccgaugcu

SEQ ID NO: 206054 - RNA, 19 nt, Homo sapiens
ggucccaccuccugccuuu

SEQ ID NO: 206055 - RNA, 19 nt, Homo sapiens
ugacaauucagacaaguuu

SEQ ID NO: 206056 - RNA, 19 nt, Homo sapiens
aagaaaaucuggaaaguga

SEQ ID NO: 206057 - RNA, 19 nt, Homo sapiens
cuccagaccugccgaaaga

SEQ ID NO: 206058 - RNA, 19 nt, Homo sapiens
caaguuucccgucuacaaa

SEQ ID NO: 206059 - RNA, 19 nt, Homo sapiens
gaugugagcacucguugug

SEQ ID NO: 206060 - RNA, 19 nt, Homo sapiens
gaugugagcacucguugug

SEQ ID NO: 206061 - RNA, 19 nt, Homo sapiens
gacacagaccuauaugauu

SEQ ID NO: 206062 - RNA, 19 nt, Homo sapiens
acacaagaauccacuaagg

SEQ ID NO: 206063 - RNA, 19 nt, Homo sapiens
gaaaaugucuacguaugga

SEQ ID NO: 206064 - RNA, 19 nt, Homo sapiens
gucuggauguuacaaauau

SEQ ID NO: 206065 - RNA, 19 nt, Homo sapiens
gucuggauguuacaaauau

SEQ ID NO: 206066 - RNA, 19 nt, Homo sapiens
agaccuauaugauuacuac

SEQ ID NO: 206067 - RNA, 19 nt, Homo sapiens
ugacacagaccuauaugau

SEQ ID NO: 206068 - RNA, 19 nt, Homo sapiens
gaaccauuuuggcagaaua

SEQ ID NO: 206069 - RNA, 19 nt, Homo sapiens
ccucuaacguggccagugu

SEQ ID NO: 206070 - RNA, 19 nt, Homo sapiens
gcaggacaaugcugaaaau

SEQ ID NO: 206071 - RNA, 19 nt, Homo sapiens
ucugugaggucuccaaagu

SEQ ID NO: 206072 - RNA, 19 nt, Homo sapiens
cagaccacauucccaccua

SEQ ID NO: 206073 - RNA, 19 nt, Homo sapiens
cuacaaauacccaggaaag

SEQ ID NO: 206074 - RNA, 19 nt, Homo sapiens
uaaggaacacagggugaua

SEQ ID NO: 206075 - RNA, 19 nt, Homo sapiens
gugagaaccuccuguacac

SEQ ID NO: 206076 - RNA, 19 nt, Homo sapiens
ugagugagaaccuccugua

SEQ ID NO: 206077 - RNA, 19 nt, Homo sapiens
gcucuccuauuggaaucua

SEQ ID NO: 206078 - RNA, 19 nt, Homo sapiens
gaacuugaucagccaccaa

SEQ ID NO: 206079 - RNA, 19 nt, Homo sapiens
ccguaucacucuuagaauc

SEQ ID NO: 206080 - RNA, 19 nt, Homo sapiens
ccaagagcucuaccugaaa

SEQ ID NO: 206081 - RNA, 19 nt, Homo sapiens
guucccacaugcauuuaug

SEQ ID NO: 206082 - RNA, 19 nt, Homo sapiens
ucacaacacaggcacacaa

SEQ ID NO: 206083 - RNA, 19 nt, Homo sapiens
aaccaucccugaacuugau

SEQ ID NO: 206084 - RNA, 19 nt, Homo sapiens
caagccugaucacuccaaa

SEQ ID NO: 206085 - RNA, 19 nt, Homo sapiens
ccaaauuucacacuucaca

SEQ ID NO: 206086 - RNA, 19 nt, Homo sapiens
cgacacccuucuccuccaa

SEQ ID NO: 206087 - RNA, 19 nt, Homo sapiens
gagcuggguugggcaugug

SEQ ID NO: 206088 - RNA, 19 nt, Homo sapiens
gagaacucgcuguauacaa

SEQ ID NO: 206089 - RNA, 19 nt, Homo sapiens
cuaacaacaacuugacuga

SEQ ID NO: 206090 - RNA, 19 nt, Homo sapiens
ccagccaccuagaagugaa

SEQ ID NO: 206091 - RNA, 19 nt, Homo sapiens
cacaagaauccacuaagga

SEQ ID NO: 206092 - RNA, 19 nt, Homo sapiens
caacugugagauccucuau

SEQ ID NO: 206093 - RNA, 19 nt, Homo sapiens
gcaacugugagauccucua

SEQ ID NO: 206094 - RNA, 19 nt, Homo sapiens
ggucuauucuacucauggu

SEQ ID NO: 206095 - RNA, 19 nt, Homo sapiens
ugucuggauguuacaaaua

SEQ ID NO: 206096 - RNA, 19 nt, Homo sapiens
ugucuggauguuacaaaua

SEQ ID NO: 206097 - RNA, 19 nt, Homo sapiens
gccaaaugcccuccuccuu

SEQ ID NO: 206098 - RNA, 19 nt, Homo sapiens
gauaaggugcgugccacaa

SEQ ID NO: 206099 - RNA, 19 nt, Homo sapiens
gaacugugacaagaggaau

SEQ ID NO: 206100 - RNA, 19 nt, Homo sapiens
uuucacacuucacauggaa

SEQ ID NO: 206101 - RNA, 19 nt, Homo sapiens
gugaugaaggugacacaga

SEQ ID NO: 206102 - RNA, 19 nt, Homo sapiens
aguuucccgucuacaaaua

SEQ ID NO: 206103 - RNA, 19 nt, Homo sapiens
accuagaagugaacuguga

SEQ ID NO: 206104 - RNA, 19 nt, Homo sapiens
acaaguuucccgucuacaa

SEQ ID NO: 206105 - RNA, 19 nt, Homo sapiens
ccaagagaacucgcuguau

SEQ ID NO: 206106 - RNA, 19 nt, Homo sapiens
ugaaaggcaaugagcugaa

SEQ ID NO: 206107 - RNA, 19 nt, Homo sapiens
gugucuggauguuacaaau

SEQ ID NO: 206108 - RNA, 19 nt, Homo sapiens
gugucuggauguuacaaau

SEQ ID NO: 206109 - RNA, 19 nt, Homo sapiens
ugugggcucuccuauugga

SEQ ID NO: 206110 - RNA, 19 nt, Homo sapiens
aaaccaucccugaacuuga

SEQ ID NO: 206111 - RNA, 19 nt, Homo sapiens
aaauuucacacuucacaug

SEQ ID NO: 206112 - RNA, 19 nt, Homo sapiens
ggcagaauacagcaugguu

SEQ ID NO: 206113 - RNA, 19 nt, Homo sapiens
cugagcacagugagcauua

SEQ ID NO: 206114 - RNA, 19 nt, Homo sapiens
aaacccguaucacucuuag

SEQ ID NO: 206115 - RNA, 19 nt, Homo sapiens
uaugauuacuacccagaag

SEQ ID NO: 206116 - RNA, 19 nt, Homo sapiens
uccaagagaacucgcugua

SEQ ID NO: 206117 - RNA, 19 nt, Homo sapiens
gaagaaaaucuggaaagug

SEQ ID NO: 206118 - RNA, 19 nt, Homo sapiens
cagaagggguaaugacaug

SEQ ID NO: 206119 - RNA, 19 nt, Homo sapiens
acacaggcacacaauuuca

SEQ ID NO: 206120 - RNA, 19 nt, Homo sapiens
acucuuagaauccaccaaa

SEQ ID NO: 206121 - RNA, 19 nt, Homo sapiens
ggccagccaccuagaagug

SEQ ID NO: 206122 - RNA, 19 nt, Homo sapiens
uggccagugugcaguguga

SEQ ID NO: 206123 - RNA, 19 nt, Homo sapiens
acaaauaugggugguuuua

SEQ ID NO: 206124 - RNA, 19 nt, Homo sapiens
acaaauaugggugguuuua

SEQ ID NO: 206125 - RNA, 19 nt, Homo sapiens
guaaggaacacagggugau

SEQ ID NO: 206126 - RNA, 19 nt, Homo sapiens
gggcucuccuauuggaauc

SEQ ID NO: 206127 - RNA, 19 nt, Homo sapiens
ccuggacucuggccaaggu

SEQ ID NO: 206128 - RNA, 19 nt, Homo sapiens
gcuccagaaaugacccuuu

SEQ ID NO: 206129 - RNA, 19 nt, Homo sapiens
acacugagggcgauaaggu

SEQ ID NO: 206130 - RNA, 19 nt, Homo sapiens
ggacacugagggcgauaag

SEQ ID NO: 206131 - RNA, 19 nt, Homo sapiens
gugacacagaccuauauga

SEQ ID NO: 206132 - RNA, 19 nt, Homo sapiens
gaauaaacccuucugaucu

SEQ ID NO: 206133 - RNA, 19 nt, Homo sapiens
aaacucuggugcugaauaa

SEQ ID NO: 206134 - RNA, 19 nt, Homo sapiens
ugaauaaacccuucugauc

SEQ ID NO: 206135 - RNA, 19 nt, Homo sapiens
caaacucuggugcugaaua

SEQ ID NO: 206136 - RNA, 19 nt, Homo sapiens
aauaaacccuucugaucug

SEQ ID NO: 206137 - RNA, 19 nt, Homo sapiens
uccaaacucuggugcugaa

SEQ ID NO: 206138 - RNA, 19 nt, Homo sapiens
gcugaauaaacccuucuga

SEQ ID NO: 206139 - RNA, 19 nt, Homo sapiens
cgccuucccugucgacaca

SEQ ID NO: 206140 - RNA, 19 nt, Homo sapiens
gaaacuccgucucuacuaa

SEQ ID NO: 206141 - RNA, 19 nt, Homo sapiens
gaaagccgguucucaguuc

SEQ ID NO: 206142 - RNA, 19 nt, Homo sapiens
agaaacagcugcucaaauc

SEQ ID NO: 206143 - RNA, 19 nt, Homo sapiens
gacaggaccucaauaguuc

SEQ ID NO: 206144 - RNA, 19 nt, Homo sapiens
aaacagaggugcuggugaa

SEQ ID NO: 206145 - RNA, 19 nt, Homo sapiens
guucugauguccacaguuu

SEQ ID NO: 206146 - RNA, 19 nt, Homo sapiens
ucacacaggcuugguauua

SEQ ID NO: 206147 - RNA, 19 nt, Homo sapiens
guucagauguucauguuug

SEQ ID NO: 206148 - RNA, 19 nt, Homo sapiens
gaguugagauugugccauu

SEQ ID NO: 206149 - RNA, 19 nt, Homo sapiens
ggacgggaauggagaguuc

SEQ ID NO: 206150 - RNA, 19 nt, Homo sapiens
aggcugaccuugugaagua

SEQ ID NO: 206151 - RNA, 19 nt, Homo sapiens
gaccagaacuacacgaauc

SEQ ID NO: 206152 - RNA, 19 nt, Homo sapiens
gaagucaaguccgcaguga

SEQ ID NO: 206153 - RNA, 19 nt, Homo sapiens
ccagggagaucaaggugaa

SEQ ID NO: 206154 - RNA, 19 nt, Homo sapiens
caucuggccuugaaguuug

SEQ ID NO: 206155 - RNA, 19 nt, Homo sapiens
gaacagugccagccuucuu

SEQ ID NO: 206156 - RNA, 19 nt, Homo sapiens
guaugugggugccaucuug

SEQ ID NO: 206157 - RNA, 19 nt, Homo sapiens
gugauucucuuaaugaaca

SEQ ID NO: 206158 - RNA, 19 nt, Homo sapiens
gcagugaguugagauugug

SEQ ID NO: 206159 - RNA, 19 nt, Homo sapiens
agacaggaccucaauaguu

SEQ ID NO: 206160 - RNA, 19 nt, Homo sapiens
gcagacaggaccucaauag

SEQ ID NO: 206161 - RNA, 19 nt, Homo sapiens
gcagcgagguuauggaaac

SEQ ID NO: 206162 - RNA, 19 nt, Homo sapiens
gagaggaacuggguaucug

SEQ ID NO: 206163 - RNA, 19 nt, Homo sapiens
ggccaaggcaggagaauug

SEQ ID NO: 206164 - RNA, 19 nt, Homo sapiens
gcuagugccugcaggaaca

SEQ ID NO: 206165 - RNA, 19 nt, Homo sapiens
gaaggaggaguaaggaugu

SEQ ID NO: 206166 - RNA, 19 nt, Homo sapiens
uggcuuggcuguucugaga

SEQ ID NO: 206167 - RNA, 19 nt, Homo sapiens
ggaaagccgguucucaguu

SEQ ID NO: 206168 - RNA, 19 nt, Homo sapiens
cacacaggcuugguauuaa

SEQ ID NO: 206169 - RNA, 19 nt, Homo sapiens
agaacuacacgaauccuua

SEQ ID NO: 206170 - RNA, 19 nt, Homo sapiens
cuacacgaauccuuacgaa

SEQ ID NO: 206171 - RNA, 19 nt, Homo sapiens
ggaagucugcguacagcaa

SEQ ID NO: 206172 - RNA, 19 nt, Homo sapiens
gcaucuggccuugaaguuu

SEQ ID NO: 206173 - RNA, 19 nt, Homo sapiens
gaagucugcguacagcaaa

SEQ ID NO: 206174 - RNA, 19 nt, Homo sapiens
gaauuacacccuccuggau

SEQ ID NO: 206175 - RNA, 19 nt, Homo sapiens
caguucagauguucauguu

SEQ ID NO: 206176 - RNA, 19 nt, Homo sapiens
cugcaugccucaccuuaug

SEQ ID NO: 206177 - RNA, 19 nt, Homo sapiens
gagaguucauugucaggau

SEQ ID NO: 206178 - RNA, 19 nt, Homo sapiens
gaaacagcugcucaaauca

SEQ ID NO: 206179 - RNA, 19 nt, Homo sapiens
gaaggcacucccuggugua

SEQ ID NO: 206180 - RNA, 19 nt, Homo sapiens
ggacauuaugaccuaguuu

SEQ ID NO: 206181 - RNA, 19 nt, Homo sapiens
gagacaccauccucaacau

SEQ ID NO: 206182 - RNA, 19 nt, Homo sapiens
ggucagcaguucaaaauca

SEQ ID NO: 206183 - RNA, 19 nt, Homo sapiens
gaacuacacgaauccuuac

SEQ ID NO: 206184 - RNA, 19 nt, Homo sapiens
gaaagucagccuccaagcu

SEQ ID NO: 206185 - RNA, 19 nt, Homo sapiens
ccacuggacaugaaaguca

SEQ ID NO: 206186 - RNA, 19 nt, Homo sapiens
ucaaggccaggcuagguua

SEQ ID NO: 206187 - RNA, 19 nt, Homo sapiens
ucaaguccgcagugaagua

SEQ ID NO: 206188 - RNA, 19 nt, Homo sapiens
ucuccuuggucaaugauuu

SEQ ID NO: 206189 - RNA, 19 nt, Homo sapiens
ucaaacccaugccaucuac

SEQ ID NO: 206190 - RNA, 19 nt, Homo sapiens
ugaagguggacaaauguuu

SEQ ID NO: 206191 - RNA, 19 nt, Homo sapiens
ggaccucaauaguucugau

SEQ ID NO: 206192 - RNA, 19 nt, Homo sapiens
ggcacucccugguguaauc

SEQ ID NO: 206193 - RNA, 19 nt, Homo sapiens
gcucccauguggcugaaug

SEQ ID NO: 206194 - RNA, 19 nt, Homo sapiens
guucuucccucuggcaaug

SEQ ID NO: 206195 - RNA, 19 nt, Homo sapiens
gaggagaggaacuggguau

SEQ ID NO: 206196 - RNA, 19 nt, Homo sapiens
cugagcaucuggccuugaa

SEQ ID NO: 206197 - RNA, 19 nt, Homo sapiens
caggauggcccucuuccaa

SEQ ID NO: 206198 - RNA, 19 nt, Homo sapiens
cagaaacagcugcucaaau

SEQ ID NO: 206199 - RNA, 19 nt, Homo sapiens
ugaaacuccgucucuacua

SEQ ID NO: 206200 - RNA, 19 nt, Homo sapiens
ucggagaggugcacagucu

SEQ ID NO: 206201 - RNA, 19 nt, Homo sapiens
ucucugugauucucuuaau

SEQ ID NO: 206202 - RNA, 19 nt, Homo sapiens
cgaaggggaugcaguugaa

SEQ ID NO: 206203 - RNA, 19 nt, Homo sapiens
gacaccauccucaacauca

SEQ ID NO: 206204 - RNA, 19 nt, Homo sapiens
aggugaagguggacaaaug

SEQ ID NO: 206205 - RNA, 19 nt, Homo sapiens
guucucaguucagauguuc

SEQ ID NO: 206206 - RNA, 19 nt, Homo sapiens
gaaguauuucaucaucaga

SEQ ID NO: 206207 - RNA, 19 nt, Homo sapiens
ggaguggcaacugcuguuu

SEQ ID NO: 206208 - RNA, 19 nt, Homo sapiens
gugcagcgagguuauggaa

SEQ ID NO: 206209 - RNA, 19 nt, Homo sapiens
gcagcaucuugcagacaga

SEQ ID NO: 206210 - RNA, 19 nt, Homo sapiens
gccuuggucuccugcauuc

SEQ ID NO: 206211 - RNA, 19 nt, Homo sapiens
gguggagguugcagugagu

SEQ ID NO: 206212 - RNA, 19 nt, Homo sapiens
gagcaucuggccuugaagu

SEQ ID NO: 206213 - RNA, 19 nt, Homo sapiens
cauugaagccaguucguau

SEQ ID NO: 206214 - RNA, 19 nt, Homo sapiens
ggagaggaacuggguaucu

SEQ ID NO: 206215 - RNA, 19 nt, Homo sapiens
ggugaagguggacaaaugu

SEQ ID NO: 206216 - RNA, 19 nt, Homo sapiens
agacagacgcucccaugug

SEQ ID NO: 206217 - RNA, 19 nt, Homo sapiens
caggagaauugcucgaacu

SEQ ID NO: 206218 - RNA, 19 nt, Homo sapiens
aaacuccgucucuacuaaa

SEQ ID NO: 206219 - RNA, 19 nt, Homo sapiens
ccuugaaguuuguguucuu

SEQ ID NO: 206220 - RNA, 19 nt, Homo sapiens
ucugugauucucuuaauga

SEQ ID NO: 206221 - RNA, 19 nt, Homo sapiens
ucagaaacagcugcucaaa

SEQ ID NO: 206222 - RNA, 19 nt, Homo sapiens
acaccauccucaacaucaa

SEQ ID NO: 206223 - RNA, 19 nt, Homo sapiens
ggagugccuugcccucaac

SEQ ID NO: 206224 - RNA, 19 nt, Homo sapiens
ggagguugcagugaguuga

SEQ ID NO: 206225 - RNA, 19 nt, Homo sapiens
ggcuugguauuaacagaau

SEQ ID NO: 206226 - RNA, 19 nt, Homo sapiens
acacaggcuugguauuaac

SEQ ID NO: 206227 - RNA, 19 nt, Homo sapiens
gguucucaguucagauguu

SEQ ID NO: 206228 - RNA, 19 nt, Homo sapiens
ucagagacaccauccucaa

SEQ ID NO: 206229 - RNA, 19 nt, Homo sapiens
ccauugaagccaguucgua

SEQ ID NO: 206230 - RNA, 19 nt, Homo sapiens
ccuacccacuggacaugaa

SEQ ID NO: 206231 - RNA, 19 nt, Homo sapiens
gcaacugcuguuucuggaa

SEQ ID NO: 206232 - RNA, 19 nt, Homo sapiens
ggagaauugcucgaacuca

SEQ ID NO: 206233 - RNA, 19 nt, Homo sapiens
ccuccuggcuuggcuguuc

SEQ ID NO: 206234 - RNA, 19 nt, Homo sapiens
ggaugucggagaccugugu

SEQ ID NO: 206235 - RNA, 19 nt, Homo sapiens
aaacccaugccaucuacaa

SEQ ID NO: 206236 - RNA, 19 nt, Homo sapiens
ccaggcggguaccaugugu

SEQ ID NO: 206237 - RNA, 19 nt, Homo sapiens
gauuucaucaucagagaca

SEQ ID NO: 206238 - RNA, 19 nt, Homo sapiens
caggaacauucuggagaga

SEQ ID NO: 206239 - RNA, 19 nt, Homo sapiens
gcagugcagcgagguuaug

SEQ ID NO: 206240 - RNA, 19 nt, Homo sapiens
gaacaagggcucugagaua

SEQ ID NO: 206241 - RNA, 19 nt, Homo sapiens
ggagaaauaccuaauguaa

SEQ ID NO: 206242 - RNA, 19 nt, Homo sapiens
ggaaucagguuauauaugg

SEQ ID NO: 206243 - RNA, 19 nt, Homo sapiens
gagaacagcuggccaagau

SEQ ID NO: 206244 - RNA, 19 nt, Homo sapiens
gcuaaaaccuccacuauaa

SEQ ID NO: 206245 - RNA, 19 nt, Homo sapiens
gaucacaggucaggaguuu

SEQ ID NO: 206246 - RNA, 19 nt, Homo sapiens
gaacagugaggcauccuua

SEQ ID NO: 206247 - RNA, 19 nt, Homo sapiens
gcucuaagucuuucaguua

SEQ ID NO: 206248 - RNA, 19 nt, Homo sapiens
ggguaggucucuaauguuu

SEQ ID NO: 206249 - RNA, 19 nt, Homo sapiens
gcucuuggcuuugacagua

SEQ ID NO: 206250 - RNA, 19 nt, Homo sapiens
gaagagcuuugaguuggua

SEQ ID NO: 206251 - RNA, 19 nt, Homo sapiens
guaggaaucagguuauaua

SEQ ID NO: 206252 - RNA, 19 nt, Homo sapiens
aaagaaaccuuggcacuga

SEQ ID NO: 206253 - RNA, 19 nt, Homo sapiens
caaccaaccuggcacaugu

SEQ ID NO: 206254 - RNA, 19 nt, Homo sapiens
gaaacuggauugauuugca

SEQ ID NO: 206255 - RNA, 19 nt, Homo sapiens
cauaguaccugcuucauag

SEQ ID NO: 206256 - RNA, 19 nt, Homo sapiens
caggugcgcugcuggauaa

SEQ ID NO: 206257 - RNA, 19 nt, Homo sapiens
gcaaaggguaggucucuaa

SEQ ID NO: 206258 - RNA, 19 nt, Homo sapiens
gaacuaucuugguugcaaa

SEQ ID NO: 206259 - RNA, 19 nt, Homo sapiens
gaaaucaaugcguggauaa

SEQ ID NO: 206260 - RNA, 19 nt, Homo sapiens
gggcaaaggucaagaucau

SEQ ID NO: 206261 - RNA, 19 nt, Homo sapiens
gaacucugccaccucauuu

SEQ ID NO: 206262 - RNA, 19 nt, Homo sapiens
cuacuugucuagucccaua

SEQ ID NO: 206263 - RNA, 19 nt, Homo sapiens
ugaaaucaaugcguggaua

SEQ ID NO: 206264 - RNA, 19 nt, Homo sapiens
ucacacgccuggacuguug

SEQ ID NO: 206265 - RNA, 19 nt, Homo sapiens
ggucaucucuccaccuugu

SEQ ID NO: 206266 - RNA, 19 nt, Homo sapiens
agagagagcccuuggguaa

SEQ ID NO: 206267 - RNA, 19 nt, Homo sapiens
agucugaguuugcuaagua

SEQ ID NO: 206268 - RNA, 19 nt, Homo sapiens
gaacacaugccauccaagu

SEQ ID NO: 206269 - RNA, 19 nt, Homo sapiens
guaggucucuaauguuuca

SEQ ID NO: 206270 - RNA, 19 nt, Homo sapiens
ccacugcucuuggcuuuga

SEQ ID NO: 206271 - RNA, 19 nt, Homo sapiens
gcacugauuuuguuagauu

SEQ ID NO: 206272 - RNA, 19 nt, Homo sapiens
gagacgggcuuugccauau

SEQ ID NO: 206273 - RNA, 19 nt, Homo sapiens
gguaaauguuugugaaauc

SEQ ID NO: 206274 - RNA, 19 nt, Homo sapiens
gcagaaccauuucagacau

SEQ ID NO: 206275 - RNA, 19 nt, Homo sapiens
gauaguguuaggagaaaua

SEQ ID NO: 206276 - RNA, 19 nt, Homo sapiens
gcaucaugauuucuaaaga

SEQ ID NO: 206277 - RNA, 19 nt, Homo sapiens
guagagcucuugccauuuu

SEQ ID NO: 206278 - RNA, 19 nt, Homo sapiens
aaguagagcucuugccauu

SEQ ID NO: 206279 - RNA, 19 nt, Homo sapiens
gcacagaguaagccgguaa

SEQ ID NO: 206280 - RNA, 19 nt, Homo sapiens
gcccgucucuggaaacuga

SEQ ID NO: 206281 - RNA, 19 nt, Homo sapiens
gaaagugucgaaucacaug

SEQ ID NO: 206282 - RNA, 19 nt, Homo sapiens
cuagguauccuuccucuuu

SEQ ID NO: 206283 - RNA, 19 nt, Homo sapiens
gcagugggccgucucaguu

SEQ ID NO: 206284 - RNA, 19 nt, Homo sapiens
gaccuacucugguaaaguc

SEQ ID NO: 206285 - RNA, 19 nt, Homo sapiens
uggagaaccugaaguuguu

SEQ ID NO: 206286 - RNA, 19 nt, Homo sapiens
uauauggucucucgguuug

SEQ ID NO: 206287 - RNA, 19 nt, Homo sapiens
gacaguaggaaucagguua

SEQ ID NO: 206288 - RNA, 19 nt, Homo sapiens
ugguucaucuucccauuua

SEQ ID NO: 206289 - RNA, 19 nt, Homo sapiens
cuaguguucuugccaguaa

SEQ ID NO: 206290 - RNA, 19 nt, Homo sapiens
ugacaacuguggguucaaa

SEQ ID NO: 206291 - RNA, 19 nt, Homo sapiens
guuaacaugugacugguau

SEQ ID NO: 206292 - RNA, 19 nt, Homo sapiens
cauguacccuagaacuuaa

SEQ ID NO: 206293 - RNA, 19 nt, Homo sapiens
caaccuggcacauguauuc

SEQ ID NO: 206294 - RNA, 19 nt, Homo sapiens
guaagccgguaaauguuug

SEQ ID NO: 206295 - RNA, 19 nt, Homo sapiens
agaguaagccgguaaaugu

SEQ ID NO: 206296 - RNA, 19 nt, Homo sapiens
gcaaaggucaagaucauag

SEQ ID NO: 206297 - RNA, 19 nt, Homo sapiens
ucccaaaccucaguucuuu

SEQ ID NO: 206298 - RNA, 19 nt, Homo sapiens
gauaauuugcuucuuccua

SEQ ID NO: 206299 - RNA, 19 nt, Homo sapiens
gaaaucacauccguuccau

SEQ ID NO: 206300 - RNA, 19 nt, Homo sapiens
ugacggagcugcaguucca

SEQ ID NO: 206301 - RNA, 19 nt, Homo sapiens
gcagagcucuaagucuuuc

SEQ ID NO: 206302 - RNA, 19 nt, Homo sapiens
aaggguaggucucuaaugu

SEQ ID NO: 206303 - RNA, 19 nt, Homo sapiens
ccuggcacauguauucaua

SEQ ID NO: 206304 - RNA, 19 nt, Homo sapiens
ggagagggauaguguuagg

SEQ ID NO: 206305 - RNA, 19 nt, Homo sapiens
augauaagcuugauucuag

SEQ ID NO: 206306 - RNA, 19 nt, Homo sapiens
gggaaaggauaggcuguug

SEQ ID NO: 206307 - RNA, 19 nt, Homo sapiens
gggaaaaucuucuaauuac

SEQ ID NO: 206308 - RNA, 19 nt, Homo sapiens
gggauaguguuaggagaaa

SEQ ID NO: 206309 - RNA, 19 nt, Homo sapiens
uacaauaccuaguguucuu

SEQ ID NO: 206310 - RNA, 19 nt, Homo sapiens
ggcaauaaagcauauaaug

SEQ ID NO: 206311 - RNA, 19 nt, Homo sapiens
ccaaagugcugggauuaca

SEQ ID NO: 206312 - RNA, 19 nt, Homo sapiens
caucguguuugcuaugauu

SEQ ID NO: 206313 - RNA, 19 nt, Homo sapiens
acucauaggugggaauuga

SEQ ID NO: 206314 - RNA, 19 nt, Homo sapiens
gcucugugcucuucauucu

SEQ ID NO: 206315 - RNA, 19 nt, Homo sapiens
cuuagaaccugaccagaug

SEQ ID NO: 206316 - RNA, 19 nt, Homo sapiens
gugcacauguacccuagaa

SEQ ID NO: 206317 - RNA, 19 nt, Homo sapiens
ucacaggucaggaguuuga

SEQ ID NO: 206318 - RNA, 19 nt, Homo sapiens
cugcagacaauacauguua

SEQ ID NO: 206319 - RNA, 19 nt, Homo sapiens
gaaugucugugcuuaugag

SEQ ID NO: 206320 - RNA, 19 nt, Homo sapiens
ccucugcgcucuuucuuca

SEQ ID NO: 206321 - RNA, 19 nt, Homo sapiens
ugaggcauccuuagaacua

SEQ ID NO: 206322 - RNA, 19 nt, Homo sapiens
gcaggagaaucacuugaac

SEQ ID NO: 206323 - RNA, 19 nt, Homo sapiens
ccaacucuuucgaaaauua

SEQ ID NO: 206324 - RNA, 19 nt, Homo sapiens
ccuuagaacuaucuugguu

SEQ ID NO: 206325 - RNA, 19 nt, Homo sapiens
acuauaauguugagcagaa

SEQ ID NO: 206326 - RNA, 19 nt, Homo sapiens
gcaaggauaccacccucuu

SEQ ID NO: 206327 - RNA, 19 nt, Homo sapiens
guaaaugacgaguuaaugg

SEQ ID NO: 206328 - RNA, 19 nt, Homo sapiens
uaacauaguaccugcuuca

SEQ ID NO: 206329 - RNA, 19 nt, Homo sapiens
guaaaaccuuuguugcuuu

SEQ ID NO: 206330 - RNA, 19 nt, Homo sapiens
ggaacucugccaccucauu

SEQ ID NO: 206331 - RNA, 19 nt, Homo sapiens
uggccuggcugaucucaaa

SEQ ID NO: 206332 - RNA, 19 nt, Homo sapiens
gaaccagaaucagcucgau

SEQ ID NO: 206333 - RNA, 19 nt, Homo sapiens
guaccugcuucauagaguu

SEQ ID NO: 206334 - RNA, 19 nt, Homo sapiens
gacgggcuuugccauauug

SEQ ID NO: 206335 - RNA, 19 nt, Homo sapiens
caguaggaaucagguuaua

SEQ ID NO: 206336 - RNA, 19 nt, Homo sapiens
ucacgaaucuggagaaccu

SEQ ID NO: 206337 - RNA, 19 nt, Homo sapiens
gccagucucuucacgaauc

SEQ ID NO: 206338 - RNA, 19 nt, Homo sapiens
ccaccaaccucacgcacau

SEQ ID NO: 206339 - RNA, 19 nt, Homo sapiens
acauguacccuagaacuua

SEQ ID NO: 206340 - RNA, 19 nt, Homo sapiens
ccacagaggcccuggauug

SEQ ID NO: 206341 - RNA, 19 nt, Homo sapiens
gcucagcuguuuuauauaa

SEQ ID NO: 206342 - RNA, 19 nt, Homo sapiens
caccagaagcccagaauaa

SEQ ID NO: 206343 - RNA, 19 nt, Homo sapiens
cagcagaggccaccaagga

SEQ ID NO: 206344 - RNA, 19 nt, Homo sapiens
cuucuacgguguccagaga

SEQ ID NO: 206345 - RNA, 19 nt, Homo sapiens
ccaccagaagcccagaaua

SEQ ID NO: 206346 - RNA, 19 nt, Homo sapiens
cagaagcccagaauaaacu

SEQ ID NO: 206347 - RNA, 19 nt, Homo sapiens
ccagaagcccagaauaaac

SEQ ID NO: 206348 - RNA, 19 nt, Homo sapiens
cugcagacccucgauguga

SEQ ID NO: 206349 - RNA, 19 nt, Homo sapiens
cacagaggcccuggauuga

SEQ ID NO: 206350 - RNA, 19 nt, Homo sapiens
ugacugcagccucaccuau

SEQ ID NO: 206351 - RNA, 19 nt, Homo sapiens
gcuguaucccauagaguug

SEQ ID NO: 206352 - RNA, 19 nt, Homo sapiens
accagaagcccagaauaaa

SEQ ID NO: 206353 - RNA, 19 nt, Homo sapiens
ccacagcagaggccaccaa

SEQ ID NO: 206354 - RNA, 19 nt, Homo sapiens
aggagcaccugaccaaagg

SEQ ID NO: 206355 - RNA, 19 nt, Homo sapiens
gaaccugacuuuagauguu

SEQ ID NO: 206356 - RNA, 19 nt, Homo sapiens
caacacagacgauauuuaa

SEQ ID NO: 206357 - RNA, 19 nt, Homo sapiens
ccucugagaugaugcauga

SEQ ID NO: 206358 - RNA, 19 nt, Homo sapiens
ccaaacaugcauccauuua

SEQ ID NO: 206359 - RNA, 19 nt, Homo sapiens
ucaugaagcuggucuacug

SEQ ID NO: 206360 - RNA, 19 nt, Homo sapiens
cagcuucgaugaccacuuc

SEQ ID NO: 206361 - RNA, 19 nt, Homo sapiens
ccagcgagauggaggagaa

SEQ ID NO: 206362 - RNA, 19 nt, Homo sapiens
cacagacgauauuuaauuc

SEQ ID NO: 206363 - RNA, 19 nt, Homo sapiens
gcucaucaccgacaaguuc

SEQ ID NO: 206364 - RNA, 19 nt, Homo sapiens
aaacaugcauccauuuacu

SEQ ID NO: 206365 - RNA, 19 nt, Homo sapiens
ucuggaaccugacuuuaga

SEQ ID NO: 206366 - RNA, 19 nt, Homo sapiens
acucagagcugcgccugua

SEQ ID NO: 206367 - RNA, 19 nt, Homo sapiens
gcaaguccaccccauaaua

SEQ ID NO: 206368 - RNA, 19 nt, Homo sapiens
gcuuagugcugcuuugcuu

SEQ ID NO: 206369 - RNA, 19 nt, Homo sapiens
auaaaaggcuggaaaccua

SEQ ID NO: 206370 - RNA, 19 nt, Homo sapiens
ucaacgcccuccaggacaa

SEQ ID NO: 206371 - RNA, 19 nt, Homo sapiens
uugaguccuuguaugaaua

SEQ ID NO: 206372 - RNA, 19 nt, Homo sapiens
acaacacagacgauauuua

SEQ ID NO: 206373 - RNA, 19 nt, Homo sapiens
auacaacacagacgauauu

SEQ ID NO: 206374 - RNA, 19 nt, Homo sapiens
caucggguguggagagugu

SEQ ID NO: 206375 - RNA, 19 nt, Homo sapiens
ucaugcagcugaagaucau

SEQ ID NO: 206376 - RNA, 19 nt, Homo sapiens
aggagacgcuggccgaguu

SEQ ID NO: 206377 - RNA, 19 nt, Homo sapiens
uuccaaacaugcauccauu

SEQ ID NO: 206378 - RNA, 19 nt, Homo sapiens
gcccaaaagccauguauuu

SEQ ID NO: 206379 - RNA, 19 nt, Homo sapiens
cucgagagcugucaugaag

SEQ ID NO: 206380 - RNA, 19 nt, Homo sapiens
aaccugacuuuagauguuu

SEQ ID NO: 206381 - RNA, 19 nt, Homo sapiens
gccggaaggucagcaggaa

SEQ ID NO: 206382 - RNA, 19 nt, Homo sapiens
caaguccaccccauaauaa

SEQ ID NO: 206383 - RNA, 19 nt, Homo sapiens
ccacugcugaggagucuga

SEQ ID NO: 206384 - RNA, 19 nt, Homo sapiens
aaauacaacacagacgaua

SEQ ID NO: 206385 - RNA, 19 nt, Homo sapiens
gacagaggccaaggacuga

SEQ ID NO: 206386 - RNA, 19 nt, Homo sapiens
gcugcugccugaugacuac

SEQ ID NO: 206387 - RNA, 19 nt, Homo sapiens
ggaaccugacuuuagaugu

SEQ ID NO: 206388 - RNA, 19 nt, Homo sapiens
caaacaugcauccauuuac

SEQ ID NO: 206389 - RNA, 19 nt, Homo sapiens
acggggaccuggauaguua

SEQ ID NO: 206390 - RNA, 19 nt, Homo sapiens
uccgggaccuguacucaga

SEQ ID NO: 206391 - RNA, 19 nt, Homo sapiens
ggcccugcccugacuauug

SEQ ID NO: 206392 - RNA, 19 nt, Homo sapiens
gcccugcccugacuauugc

SEQ ID NO: 206393 - RNA, 19 nt, Homo sapiens
guuaagggcuuuuccaaac

SEQ ID NO: 206394 - RNA, 19 nt, Homo sapiens
cuuccuggcccuuacagua

SEQ ID NO: 206395 - RNA, 19 nt, Homo sapiens
cguggcugcucgcuccuuu

SEQ ID NO: 206396 - RNA, 19 nt, Homo sapiens
cgugggcucugccaaugug

SEQ ID NO: 206397 - RNA, 19 nt, Homo sapiens
ugaguccuuguaugaauaa

SEQ ID NO: 206398 - RNA, 19 nt, Homo sapiens
uuugaguccuuguaugaau

SEQ ID NO: 206399 - RNA, 19 nt, Homo sapiens
caaaagccauguauuucag

SEQ ID NO: 206400 - RNA, 19 nt, Homo sapiens
cagacgauauuuaauucac

SEQ ID NO: 206401 - RNA, 19 nt, Homo sapiens
cggaaggucagcaggaaga

SEQ ID NO: 206402 - RNA, 19 nt, Homo sapiens
ggacucuggcacagugaug

SEQ ID NO: 206403 - RNA, 19 nt, Homo sapiens
cgaggcugguggcugcuau

SEQ ID NO: 206404 - RNA, 19 nt, Homo sapiens
cuggauaguuaagggcuuu

SEQ ID NO: 206405 - RNA, 19 nt, Homo sapiens
acaugcauccauuuacuga

SEQ ID NO: 206406 - RNA, 19 nt, Homo sapiens
gcacugcacacgggaaugc

SEQ ID NO: 206407 - RNA, 19 nt, Homo sapiens
ccaaaagccauguauuuca

SEQ ID NO: 206408 - RNA, 19 nt, Homo sapiens
gggagccagugugcccaaa

SEQ ID NO: 206409 - RNA, 19 nt, Homo sapiens
cagagcugcgccuguacua

SEQ ID NO: 206410 - RNA, 19 nt, Homo sapiens
augcauccauuuacugaca

SEQ ID NO: 206411 - RNA, 19 nt, Homo sapiens
cgccugccuuucugccuuu

SEQ ID NO: 206412 - RNA, 19 nt, Homo sapiens
ucaccaagccggacaugac

SEQ ID NO: 206413 - RNA, 19 nt, Homo sapiens
caggcacgcuggagaagcu

SEQ ID NO: 206414 - RNA, 19 nt, Homo sapiens
gagaaagaguugcugaaug

SEQ ID NO: 206415 - RNA, 19 nt, Homo sapiens
caagaaagucugcauugua

SEQ ID NO: 206416 - RNA, 19 nt, Homo sapiens
gcaagaaagucugcauugu

SEQ ID NO: 206417 - RNA, 19 nt, Homo sapiens
ggaagacauuggaggcaaa

SEQ ID NO: 206418 - RNA, 19 nt, Homo sapiens
acaccaaacuuccguauca

SEQ ID NO: 206419 - RNA, 19 nt, Homo sapiens
agaaagaguugcugaaugg

SEQ ID NO: 206420 - RNA, 19 nt, Homo sapiens
agagaucuguggagccuua

SEQ ID NO: 206421 - RNA, 19 nt, Homo sapiens
caccauggcuagcaagaaa

SEQ ID NO: 206422 - RNA, 19 nt, Homo sapiens
acuggcauaucucuuauua

SEQ ID NO: 206423 - RNA, 19 nt, Homo sapiens
gcaugagaaugucaaauac

SEQ ID NO: 206424 - RNA, 19 nt, Homo sapiens
aagaaagucugcauuguag

SEQ ID NO: 206425 - RNA, 19 nt, Homo sapiens
gcaagagguggacacagua

SEQ ID NO: 206426 - RNA, 19 nt, Homo sapiens
cgagguggcugaugagaag

SEQ ID NO: 206427 - RNA, 19 nt, Homo sapiens
gcagaaucauccagaacau

SEQ ID NO: 206428 - RNA, 19 nt, Homo sapiens
gcucaucucggaagugauu

SEQ ID NO: 206429 - RNA, 19 nt, Homo sapiens
gcucagccaucgccaagau

SEQ ID NO: 206430 - RNA, 19 nt, Homo sapiens
gcagagucuucucaucguu

SEQ ID NO: 206431 - RNA, 19 nt, Homo sapiens
guacaggaaaguccauuga

SEQ ID NO: 206432 - RNA, 19 nt, Homo sapiens
ccaaugggcugaagcucau

SEQ ID NO: 206433 - RNA, 19 nt, Homo sapiens
gaucguggguggcaaugca

SEQ ID NO: 206434 - RNA, 19 nt, Homo sapiens
ggagaaagaguugcugaau

SEQ ID NO: 206435 - RNA, 19 nt, Homo sapiens
uugagcagcuggagaaaga

SEQ ID NO: 206436 - RNA, 19 nt, Homo sapiens
guucauggcuguguacaag

SEQ ID NO: 206437 - RNA, 19 nt, Homo sapiens
acaagggccugguagacaa

SEQ ID NO: 206438 - RNA, 19 nt, Homo sapiens
ccacuggcauaucucuuau

SEQ ID NO: 206439 - RNA, 19 nt, Homo sapiens
gcugacauccugaucuuug

SEQ ID NO: 206440 - RNA, 19 nt, Homo sapiens
gguccaggcugcagaggau

SEQ ID NO: 206441 - RNA, 19 nt, Homo sapiens
ggagcagagucuucucauc

SEQ ID NO: 206442 - RNA, 19 nt, Homo sapiens
agggacaacuccugaaaga

SEQ ID NO: 206443 - RNA, 19 nt, Homo sapiens
gccagugggugaauucauc

SEQ ID NO: 206444 - RNA, 19 nt, Homo sapiens
ccaccacauucgccagaaa

SEQ ID NO: 206445 - RNA, 19 nt, Homo sapiens
uuggagagcugugguguug

SEQ ID NO: 206446 - RNA, 19 nt, Homo sapiens
ggagagcugugguguugcu

SEQ ID NO: 206447 - RNA, 19 nt, Homo sapiens
ccauugagcagcuggagaa

SEQ ID NO: 206448 - RNA, 19 nt, Homo sapiens
aagcucaucucggaaguga

SEQ ID NO: 206449 - RNA, 19 nt, Homo sapiens
agcaugagaaugucaaaua

SEQ ID NO: 206450 - RNA, 19 nt, Homo sapiens
acacgcagcaugagaaugu

SEQ ID NO: 206451 - RNA, 19 nt, Homo sapiens
agaaucauccagaacauau

SEQ ID NO: 206452 - RNA, 19 nt, Homo sapiens
uguggagccuuaaagaaug

SEQ ID NO: 206453 - RNA, 19 nt, Homo sapiens
ccugaucacuaccugcuau

SEQ ID NO: 206454 - RNA, 19 nt, Homo sapiens
cagaaucauccagaacaua

SEQ ID NO: 206455 - RNA, 19 nt, Homo sapiens
ugcaagagguggacacagu

SEQ ID NO: 206456 - RNA, 19 nt, Homo sapiens
gguauuugaggaagacauu

SEQ ID NO: 206457 - RNA, 19 nt, Homo sapiens
gcucaagggccaucugaag

SEQ ID NO: 206458 - RNA, 19 nt, Homo sapiens
gaucacuaccugcuaugga

SEQ ID NO: 206459 - RNA, 19 nt, Homo sapiens
guaucacaguggugcaaga

SEQ ID NO: 206460 - RNA, 19 nt, Homo sapiens
gagcugaugcagacaccaa

SEQ ID NO: 206461 - RNA, 19 nt, Homo sapiens
ucaacacgcagcaugagaa

SEQ ID NO: 206462 - RNA, 19 nt, Homo sapiens
uugcugaccugaucacuac

SEQ ID NO: 206463 - RNA, 19 nt, Homo sapiens
caacacgcagcaugagaau

SEQ ID NO: 206464 - RNA, 19 nt, Homo sapiens
agacaaccauuggcugcaa

SEQ ID NO: 206465 - RNA, 19 nt, Homo sapiens
ggugauguauguggagaag

SEQ ID NO: 206466 - RNA, 19 nt, Homo sapiens
uggagauccugaacuguca

SEQ ID NO: 206467 - RNA, 19 nt, Homo sapiens
gcacaagggccugguagac

SEQ ID NO: 206468 - RNA, 19 nt, Homo sapiens
gcagcuggagaaagaguug

SEQ ID NO: 206469 - RNA, 19 nt, Homo sapiens
guggagccuuaaagaaugu

SEQ ID NO: 206470 - RNA, 19 nt, Homo sapiens
gcaccauggcuagcaagaa

SEQ ID NO: 206471 - RNA, 19 nt, Homo sapiens
cagagucuucucaucguuu

SEQ ID NO: 206472 - RNA, 19 nt, Homo sapiens
gaaucauccagaacauaug

SEQ ID NO: 206473 - RNA, 19 nt, Homo sapiens
ugugguggcugucccagau

SEQ ID NO: 206474 - RNA, 19 nt, Homo sapiens
gaucuguggagccuuaaag

SEQ ID NO: 206475 - RNA, 19 nt, Homo sapiens
gaugcagacaccaaacuuc

SEQ ID NO: 206476 - RNA, 19 nt, Homo sapiens
gcgagguggcugaugagaa

SEQ ID NO: 206477 - RNA, 19 nt, Homo sapiens
gggccugguagacaaguuu

SEQ ID NO: 206478 - RNA, 19 nt, Homo sapiens
uagcaagaaagucugcauu

SEQ ID NO: 206479 - RNA, 19 nt, Homo sapiens
gugaccauguggguauuug

SEQ ID NO: 206480 - RNA, 19 nt, Homo sapiens
caagaucguggguggcaau

SEQ ID NO: 206481 - RNA, 19 nt, Homo sapiens
gcagcaugagaaugucaaa

SEQ ID NO: 206482 - RNA, 19 nt, Homo sapiens
cagcuacgcaccuggagau

SEQ ID NO: 206483 - RNA, 19 nt, Homo sapiens
ccugcagaaucauccagaa

SEQ ID NO: 206484 - RNA, 19 nt, Homo sapiens
ucauggcuguguacaaggu

SEQ ID NO: 206485 - RNA, 19 nt, Homo sapiens
caccaaggcggcagugauc

SEQ ID NO: 206486 - RNA, 19 nt, Homo sapiens
caagagguggacacaguag

SEQ ID NO: 206487 - RNA, 19 nt, Homo sapiens
cagcucaagggccaucuga

SEQ ID NO: 206488 - RNA, 19 nt, Homo sapiens
agagucuucucaucguuuc

SEQ ID NO: 206489 - RNA, 19 nt, Homo sapiens
uguacaaggugugcuacga

SEQ ID NO: 206490 - RNA, 19 nt, Homo sapiens
gcggcaccauggcuagcaa

SEQ ID NO: 206491 - RNA, 19 nt, Homo sapiens
guugcugaccugaucacua

SEQ ID NO: 206492 - RNA, 19 nt, Homo sapiens
ggcugggacucauggagau

SEQ ID NO: 206493 - RNA, 19 nt, Homo sapiens
gugauggccugggcuuugg

SEQ ID NO: 206494 - RNA, 19 nt, Homo sapiens
gagguggacacaguagaga

SEQ ID NO: 206495 - RNA, 19 nt, Homo sapiens
ugaaugaagugcguaauua

SEQ ID NO: 206496 - RNA, 19 nt, Homo sapiens
guaauuaccugaguuguga

SEQ ID NO: 206497 - RNA, 19 nt, Homo sapiens
gauaugauuucacgucgua

SEQ ID NO: 206498 - RNA, 19 nt, Homo sapiens
gaaccuggccuauguuaaa

SEQ ID NO: 206499 - RNA, 19 nt, Homo sapiens
gaacugaauugggaugauu

SEQ ID NO: 206500 - RNA, 19 nt, Homo sapiens
gagcaauugucuacuauga

SEQ ID NO: 206501 - RNA, 19 nt, Homo sapiens
cauaaaugcugcugucaaa

SEQ ID NO: 206502 - RNA, 19 nt, Homo sapiens
gagaguggccuuauuacua

SEQ ID NO: 206503 - RNA, 19 nt, Homo sapiens
gaaaugggcuauaaaucuc

SEQ ID NO: 206504 - RNA, 19 nt, Homo sapiens
ugaaaccacucugaaauaa

SEQ ID NO: 206505 - RNA, 19 nt, Homo sapiens
gaucagaacaguuaacaga

SEQ ID NO: 206506 - RNA, 19 nt, Homo sapiens
gaggugaaauaugggauua

SEQ ID NO: 206507 - RNA, 19 nt, Homo sapiens
cuauaaugcuuccaguuua

SEQ ID NO: 206508 - RNA, 19 nt, Homo sapiens
gaagagaaccucgacagaa

SEQ ID NO: 206509 - RNA, 19 nt, Homo sapiens
gaauugggaugauuauaag

SEQ ID NO: 206510 - RNA, 19 nt, Homo sapiens
aaaccacucugaaauaaug

SEQ ID NO: 206511 - RNA, 19 nt, Homo sapiens
gcaguuauguccucagcaa

SEQ ID NO: 206512 - RNA, 19 nt, Homo sapiens
cuauaaaucucgaucagaa

SEQ ID NO: 206513 - RNA, 19 nt, Homo sapiens
ggaauccguccucuuguua

SEQ ID NO: 206514 - RNA, 19 nt, Homo sapiens
gcaggaauuugacgugaga

SEQ ID NO: 206515 - RNA, 19 nt, Homo sapiens
gaaaauacacuccaugaaa

SEQ ID NO: 206516 - RNA, 19 nt, Homo sapiens
gaguaucaauguccaaaug

SEQ ID NO: 206517 - RNA, 19 nt, Homo sapiens
gcaggaagcaauugccuaa

SEQ ID NO: 206518 - RNA, 19 nt, Homo sapiens
aaacagcccuuguagaaag

SEQ ID NO: 206519 - RNA, 19 nt, Homo sapiens
aauaugggauuaaggagua

SEQ ID NO: 206520 - RNA, 19 nt, Homo sapiens
gcacugcuguggauaugau

SEQ ID NO: 206521 - RNA, 19 nt, Homo sapiens
aagcagaggugaaauaugg

SEQ ID NO: 206522 - RNA, 19 nt, Homo sapiens
ggcagaagauaccauaaau

SEQ ID NO: 206523 - RNA, 19 nt, Homo sapiens
ccaaauguguuaucaaugc

SEQ ID NO: 206524 - RNA, 19 nt, Homo sapiens
gcaaaacacaucugaauuu

SEQ ID NO: 206525 - RNA, 19 nt, Homo sapiens
aaaugaaccuggccuaugu

SEQ ID NO: 206526 - RNA, 19 nt, Homo sapiens
cuucagacauugacaggua

SEQ ID NO: 206527 - RNA, 19 nt, Homo sapiens
gaggugcucuugcaacugu

SEQ ID NO: 206528 - RNA, 19 nt, Homo sapiens
ucaugaaguuggauauuga

SEQ ID NO: 206529 - RNA, 19 nt, Homo sapiens
ucacagggcaggaauuuga

SEQ ID NO: 206530 - RNA, 19 nt, Homo sapiens
ucaguuugcucauuacaga

SEQ ID NO: 206531 - RNA, 19 nt, Homo sapiens
cgacagaagaguuccaauu

SEQ ID NO: 206532 - RNA, 19 nt, Homo sapiens
gaaagggacgauucuuguu

SEQ ID NO: 206533 - RNA, 19 nt, Homo sapiens
agaguggccuuauuacuau

SEQ ID NO: 206534 - RNA, 19 nt, Homo sapiens
uaggagcaauugucuacua

SEQ ID NO: 206535 - RNA, 19 nt, Homo sapiens
uuaagguguugguguauuu

SEQ ID NO: 206536 - RNA, 19 nt, Homo sapiens
gcaggauuauggacuugaa

SEQ ID NO: 206537 - RNA, 19 nt, Homo sapiens
ggaugaaccuugccauugc

SEQ ID NO: 206538 - RNA, 19 nt, Homo sapiens
ucagcuccauugccuauaa

SEQ ID NO: 206539 - RNA, 19 nt, Homo sapiens
cagaagcacuaaauugauc

SEQ ID NO: 206540 - RNA, 19 nt, Homo sapiens
uuucucaguuugcucauua

SEQ ID NO: 206541 - RNA, 19 nt, Homo sapiens
gacagaagaguuccaauuc

SEQ ID NO: 206542 - RNA, 19 nt, Homo sapiens
ccaauuacauggagguagu

SEQ ID NO: 206543 - RNA, 19 nt, Homo sapiens
caagcuguaugauuugguu

SEQ ID NO: 206544 - RNA, 19 nt, Homo sapiens
agaaggccaucaugaaguu

SEQ ID NO: 206545 - RNA, 19 nt, Homo sapiens
cagcagaagcacuaaauug

SEQ ID NO: 206546 - RNA, 19 nt, Homo sapiens
ugaaaugggcuauaaaucu

SEQ ID NO: 206547 - RNA, 19 nt, Homo sapiens
ugaaauaugggauuaagga

SEQ ID NO: 206548 - RNA, 19 nt, Homo sapiens
ggcaaaagguggccuauug

SEQ ID NO: 206549 - RNA, 19 nt, Homo sapiens
ggaccaaguagaacaguug

SEQ ID NO: 206550 - RNA, 19 nt, Homo sapiens
gaaccucgacagaagaguu

SEQ ID NO: 206551 - RNA, 19 nt, Homo sapiens
gcugaugagugcuauucaa

SEQ ID NO: 206552 - RNA, 19 nt, Homo sapiens
gugccaaccugcuagaaau

SEQ ID NO: 206553 - RNA, 19 nt, Homo sapiens
gcagaaggccaucaugaag

SEQ ID NO: 206554 - RNA, 19 nt, Homo sapiens
ucagaacaguuaacagauc

SEQ ID NO: 206555 - RNA, 19 nt, Homo sapiens
ccuauaaugcuuccaguuu

SEQ ID NO: 206556 - RNA, 19 nt, Homo sapiens
gacauugacagguauaaga

SEQ ID NO: 206557 - RNA, 19 nt, Homo sapiens
cuacugauacuccaacuga

SEQ ID NO: 206558 - RNA, 19 nt, Homo sapiens
ggguaggaaucaagcugua

SEQ ID NO: 206559 - RNA, 19 nt, Homo sapiens
gcagaagcacuaaauugau

SEQ ID NO: 206560 - RNA, 19 nt, Homo sapiens
cagcguguauuagagagua

SEQ ID NO: 206561 - RNA, 19 nt, Homo sapiens
gcaggaacaacuugaaaca

SEQ ID NO: 206562 - RNA, 19 nt, Homo sapiens
gcagaagauaccauaaaug

SEQ ID NO: 206563 - RNA, 19 nt, Homo sapiens
gauccaugguggugugaga

SEQ ID NO: 206564 - RNA, 19 nt, Homo sapiens
gaaaccacucugaaauaau

SEQ ID NO: 206565 - RNA, 19 nt, Homo sapiens
cugaaaccacucugaaaua

SEQ ID NO: 206566 - RNA, 19 nt, Homo sapiens
cagaagaguuccaauucca

SEQ ID NO: 206567 - RNA, 19 nt, Homo sapiens
ccuacugccuucagacauu

SEQ ID NO: 206568 - RNA, 19 nt, Homo sapiens
gaagcaggaacaacuugaa

SEQ ID NO: 206569 - RNA, 19 nt, Homo sapiens
gguggcaguuaccuuacua

SEQ ID NO: 206570 - RNA, 19 nt, Homo sapiens
caaaugaaccuggccuaug

SEQ ID NO: 206571 - RNA, 19 nt, Homo sapiens
aagagaaccucgacagaag

SEQ ID NO: 206572 - RNA, 19 nt, Homo sapiens
ggugaaauaugggauuaag

SEQ ID NO: 206573 - RNA, 19 nt, Homo sapiens
cagaagaagauaucaacuu

SEQ ID NO: 206574 - RNA, 19 nt, Homo sapiens
uaaauccacagccaacaaa

SEQ ID NO: 206575 - RNA, 19 nt, Homo sapiens
ccaaauggaugaaaauaca

SEQ ID NO: 206576 - RNA, 19 nt, Homo sapiens
gaguugugauguugaagug

SEQ ID NO: 206577 - RNA, 19 nt, Homo sapiens
gauaaagacgcagcagcua

SEQ ID NO: 206578 - RNA, 19 nt, Homo sapiens
caaaauggaugauaaagac

SEQ ID NO: 206579 - RNA, 19 nt, Homo sapiens
gcagugaaagggacgauuc

SEQ ID NO: 206580 - RNA, 19 nt, Homo sapiens
uuuaggacuuucucaguuu

SEQ ID NO: 206581 - RNA, 19 nt, Homo sapiens
guaaauccacagccaacaa

SEQ ID NO: 206582 - RNA, 19 nt, Homo sapiens
cgccuggccuuucuaaaug

SEQ ID NO: 206583 - RNA, 19 nt, Homo sapiens
guacucgccuggccuuucu

SEQ ID NO: 206584 - RNA, 19 nt, Homo sapiens
gugagagccaaauguguua

SEQ ID NO: 206585 - RNA, 19 nt, Homo sapiens
uaucucaggcuaagaaaug

SEQ ID NO: 206586 - RNA, 19 nt, Homo sapiens
cagaagauaccauaaaugc

SEQ ID NO: 206587 - RNA, 19 nt, Homo sapiens
agugagaguggccuuauua

SEQ ID NO: 206588 - RNA, 19 nt, Homo sapiens
ccauuuaucagcuccauug

SEQ ID NO: 206589 - RNA, 19 nt, Homo sapiens
gcagcagaagcacuaaauu

SEQ ID NO: 206590 - RNA, 19 nt, Homo sapiens
ugacagguauaagaagaga

SEQ ID NO: 206591 - RNA, 19 nt, Homo sapiens
gaguggccuuauuacuaua

SEQ ID NO: 206592 - RNA, 19 nt, Homo sapiens
ugaaagggacgauucuugu

SEQ ID NO: 206593 - RNA, 19 nt, Homo sapiens
ggaggaggagcaacaggaa

SEQ ID NO: 206594 - RNA, 19 nt, Homo sapiens
aacgacaaaucaccaugua

SEQ ID NO: 206595 - RNA, 19 nt, Homo sapiens
ggaaauacaucaccaaauc

SEQ ID NO: 206596 - RNA, 19 nt, Homo sapiens
agaauuggcugaaguguuu

SEQ ID NO: 206597 - RNA, 19 nt, Homo sapiens
ccaaugggcucaucaacuu

SEQ ID NO: 206598 - RNA, 19 nt, Homo sapiens
ggaagggucugcaucacaa

SEQ ID NO: 206599 - RNA, 19 nt, Homo sapiens
ucaccaagcucacaccauu

SEQ ID NO: 206600 - RNA, 19 nt, Homo sapiens
caaccaaagugaaggaguu

SEQ ID NO: 206601 - RNA, 19 nt, Homo sapiens
gaugauacccugugacuuc

SEQ ID NO: 206602 - RNA, 19 nt, Homo sapiens
ucacgacgcuucuaccaau

SEQ ID NO: 206603 - RNA, 19 nt, Homo sapiens
ggaaaucgcccaaccaacu

SEQ ID NO: 206604 - RNA, 19 nt, Homo sapiens
cauaaggucuuugaaggaa

SEQ ID NO: 206605 - RNA, 19 nt, Homo sapiens
ugaaggaguuuggaauuga

SEQ ID NO: 206606 - RNA, 19 nt, Homo sapiens
ccaaccaacucuauugugu

SEQ ID NO: 206607 - RNA, 19 nt, Homo sapiens
cugaagcccuuaagccaua

SEQ ID NO: 206608 - RNA, 19 nt, Homo sapiens
ccaauaaacucgugcucau

SEQ ID NO: 206609 - RNA, 19 nt, Homo sapiens
aaauagagccugagcuuga

SEQ ID NO: 206610 - RNA, 19 nt, Homo sapiens
ucaacaagguucuggacaa

SEQ ID NO: 206611 - RNA, 19 nt, Homo sapiens
gagaggcugcugccacaua

SEQ ID NO: 206612 - RNA, 19 nt, Homo sapiens
gagccuuggucgccaugua

SEQ ID NO: 206613 - RNA, 19 nt, Homo sapiens
gugaaggaguuuggaauug

SEQ ID NO: 206614 - RNA, 19 nt, Homo sapiens
aaacacacccauccuggua

SEQ ID NO: 206615 - RNA, 19 nt, Homo sapiens
ccaagaugauacccuguga

SEQ ID NO: 206616 - RNA, 19 nt, Homo sapiens
uccagaagcugcagcaaug

SEQ ID NO: 206617 - RNA, 19 nt, Homo sapiens
ucacggacgucaucaacau

SEQ ID NO: 206618 - RNA, 19 nt, Homo sapiens
caacaagguucuggacaag

SEQ ID NO: 206619 - RNA, 19 nt, Homo sapiens
gauguucaauggugagaag

SEQ ID NO: 206620 - RNA, 19 nt, Homo sapiens
gaaaauagagccugagcuu

SEQ ID NO: 206621 - RNA, 19 nt, Homo sapiens
uaaggucuuugaaggaaau

SEQ ID NO: 206622 - RNA, 19 nt, Homo sapiens
agaggcugcugccacauaa

SEQ ID NO: 206623 - RNA, 19 nt, Homo sapiens
gaaauacaucaccaaaucu

SEQ ID NO: 206624 - RNA, 19 nt, Homo sapiens
gcacuuuguugcccugucu

SEQ ID NO: 206625 - RNA, 19 nt, Homo sapiens
ccaauggccagcaugcuuu

SEQ ID NO: 206626 - RNA, 19 nt, Homo sapiens
uaacacaaccaaagugaag

SEQ ID NO: 206627 - RNA, 19 nt, Homo sapiens
gggagcggauguucaaugg

SEQ ID NO: 206628 - RNA, 19 nt, Homo sapiens
caacaaggaccgcuucaac

SEQ ID NO: 206629 - RNA, 19 nt, Homo sapiens
ccaaggcaccaagaugaua

SEQ ID NO: 206630 - RNA, 19 nt, Homo sapiens
caccaaggcaccaagauga

SEQ ID NO: 206631 - RNA, 19 nt, Homo sapiens
gaaggaguuuggaauugac

SEQ ID NO: 206632 - RNA, 19 nt, Homo sapiens
gaacucacauugccaaaac

SEQ ID NO: 206633 - RNA, 19 nt, Homo sapiens
acaagguucuggacaagau

SEQ ID NO: 206634 - RNA, 19 nt, Homo sapiens
ccacauaaggucuuugaag

SEQ ID NO: 206635 - RNA, 19 nt, Homo sapiens
gugagaagaucaacuacac

SEQ ID NO: 206636 - RNA, 19 nt, Homo sapiens
cuggguaucugguacauca

SEQ ID NO: 206637 - RNA, 19 nt, Homo sapiens
gugcucaagugaccucuca

SEQ ID NO: 206638 - RNA, 19 nt, Homo sapiens
aaccaacucuauuguguuc

SEQ ID NO: 206639 - RNA, 19 nt, Homo sapiens
gcucacaccauucaugcuu

SEQ ID NO: 206640 - RNA, 19 nt, Homo sapiens
ggcaucaucugggacauca

SEQ ID NO: 206641 - RNA, 19 nt, Homo sapiens
caggagaccaucacgaaug

SEQ ID NO: 206642 - RNA, 19 nt, Homo sapiens
gcucaucaacuucaucaag

SEQ ID NO: 206643 - RNA, 19 nt, Homo sapiens
caaccaacucuauuguguu

SEQ ID NO: 206644 - RNA, 19 nt, Homo sapiens
gaaggaaaucgcccaacca

SEQ ID NO: 206645 - RNA, 19 nt, Homo sapiens
ggaguccaaugggaaauac

SEQ ID NO: 206646 - RNA, 19 nt, Homo sapiens
ugccagaggucaacaaggu

SEQ ID NO: 206647 - RNA, 19 nt, Homo sapiens
gaaaucgcccaaccaacuc

SEQ ID NO: 206648 - RNA, 19 nt, Homo sapiens
gggaaauacaucaccaaau

SEQ ID NO: 206649 - RNA, 19 nt, Homo sapiens
ccucuucgaugccaacaag

SEQ ID NO: 206650 - RNA, 19 nt, Homo sapiens
acacacccauccugguaga

SEQ ID NO: 206651 - RNA, 19 nt, Homo sapiens
gaggccagaguccaauaaa

SEQ ID NO: 206652 - RNA, 19 nt, Homo sapiens
gauggcagugcucaaguga

SEQ ID NO: 206653 - RNA, 19 nt, Homo sapiens
uguaugagcacaagaucuu

SEQ ID NO: 206654 - RNA, 19 nt, Homo sapiens
acgccaugcugcccuauga

SEQ ID NO: 206655 - RNA, 19 nt, Homo sapiens
ccaccaaggcaccaagaug

SEQ ID NO: 206656 - RNA, 19 nt, Homo sapiens
gcacguggguuuugacaac

SEQ ID NO: 206657 - RNA, 19 nt, Homo sapiens
uuguugcccugucuacuaa

SEQ ID NO: 206658 - RNA, 19 nt, Homo sapiens
gaccaucacggacgucauc

SEQ ID NO: 206659 - RNA, 19 nt, Homo sapiens
ugacccauguucacguugu

SEQ ID NO: 206660 - RNA, 19 nt, Homo sapiens
ggccagaguccaauaaacu

SEQ ID NO: 206661 - RNA, 19 nt, Homo sapiens
guucaauggugagaagauc

SEQ ID NO: 206662 - RNA, 19 nt, Homo sapiens
caagcucacaccauucaug

SEQ ID NO: 206663 - RNA, 19 nt, Homo sapiens
ccagacagaggcccugaug

SEQ ID NO: 206664 - RNA, 19 nt, Homo sapiens
ucugguacaucaacugcuu

SEQ ID NO: 206665 - RNA, 19 nt, Homo sapiens
gacccauguucacguuguu

SEQ ID NO: 206666 - RNA, 19 nt, Homo sapiens
ugauggcagugcucaagug

SEQ ID NO: 206667 - RNA, 19 nt, Homo sapiens
agacagaggcccugaugag

SEQ ID NO: 206668 - RNA, 19 nt, Homo sapiens
cuacuaacacaaccaaagu

SEQ ID NO: 206669 - RNA, 19 nt, Homo sapiens
cgaggccagaguccaauaa

SEQ ID NO: 206670 - RNA, 19 nt, Homo sapiens
gcgaggccagaguccaaua

SEQ ID NO: 206671 - RNA, 19 nt, Homo sapiens
gcacaagaucuucguucag

SEQ ID NO: 206672 - RNA, 19 nt, Homo sapiens
ggaccacgagcccuuagca

SEQ ID NO: 206673 - RNA, 19 nt, Homo sapiens
ucugcagccuccucuguga

SEQ ID NO: 206674 - RNA, 19 nt, Homo sapiens
ucugggacaucaacagcuu

SEQ ID NO: 206675 - RNA, 19 nt, Homo sapiens
ccgcuuugcugcguacuuc

SEQ ID NO: 206676 - RNA, 19 nt, Homo sapiens
ggccaucggacucuccauu

SEQ ID NO: 206677 - RNA, 19 nt, Homo sapiens
gggcucaucaacuucauca

SEQ ID NO: 206678 - RNA, 19 nt, Homo sapiens
cgacgccccuggagaagaa

SEQ ID NO: 206679 - RNA, 19 nt, Homo sapiens
uagaauuggcugaaguguu

SEQ ID NO: 206680 - RNA, 19 nt, Homo sapiens
agaagcugcagcaauggua

SEQ ID NO: 206681 - RNA, 19 nt, Homo sapiens
gcugccacauaaggucuuu

SEQ ID NO: 206682 - RNA, 19 nt, Homo sapiens
ucaacugcuuuggguguga

SEQ ID NO: 206683 - RNA, 19 nt, Homo sapiens
gccaucggacucuccauug

SEQ ID NO: 206684 - RNA, 19 nt, Homo sapiens
gagccggcacugcauguuc

SEQ ID NO: 206685 - RNA, 19 nt, Homo sapiens
guagacggcaaggauguga

SEQ ID NO: 206686 - RNA, 19 nt, Homo sapiens
ggugagaagaucaacuaca

SEQ ID NO: 206687 - RNA, 19 nt, Homo sapiens
aaagugaaggaguuuggaa

SEQ ID NO: 206688 - RNA, 19 nt, Homo sapiens
cccaggagaccaucacgaa

SEQ ID NO: 206689 - RNA, 19 nt, Homo sapiens
aauagagccugagcuugau

SEQ ID NO: 206690 - RNA, 19 nt, Homo sapiens
cuaugcucccucuguguua

SEQ ID NO: 206691 - RNA, 19 nt, Homo sapiens
cugcggaaccggucaaaca

SEQ ID NO: 206692 - RNA, 19 nt, Homo sapiens
aaggaaaucgcccaaccaa

SEQ ID NO: 206693 - RNA, 19 nt, Homo sapiens
auaaggucuuugaaggaaa

SEQ ID NO: 206694 - RNA, 19 nt, Homo sapiens
acauaaggucuuugaagga

SEQ ID NO: 206695 - RNA, 19 nt, Homo sapiens
gagaacacguggacacaua

SEQ ID NO: 206696 - RNA, 19 nt, Homo sapiens
gaagccagcucaagguuug

SEQ ID NO: 206697 - RNA, 19 nt, Homo sapiens
cagagaaacugguagcuuu

SEQ ID NO: 206698 - RNA, 19 nt, Homo sapiens
ugagugaccuggaugauga

SEQ ID NO: 206699 - RNA, 19 nt, Homo sapiens
ggacaucuacuguaacuug

SEQ ID NO: 206700 - RNA, 19 nt, Homo sapiens
ugacacaccuuuauguaug

SEQ ID NO: 206701 - RNA, 19 nt, Homo sapiens
gccaggacaucuacuguaa

SEQ ID NO: 206702 - RNA, 19 nt, Homo sapiens
acugguagcuuucuuguuu

SEQ ID NO: 206703 - RNA, 19 nt, Homo sapiens
guacacaauuccuccuaaa

SEQ ID NO: 206704 - RNA, 19 nt, Homo sapiens
ccagaaauaugugaaauag

SEQ ID NO: 206705 - RNA, 19 nt, Homo sapiens
ucaaagaucuacugggaau

SEQ ID NO: 206706 - RNA, 19 nt, Homo sapiens
ccacuaauauuuaccaucu

SEQ ID NO: 206707 - RNA, 19 nt, Homo sapiens
gaugucagcuggcauaguc

SEQ ID NO: 206708 - RNA, 19 nt, Homo sapiens
ccucugugguuaucuguua

SEQ ID NO: 206709 - RNA, 19 nt, Homo sapiens
caucuuacuucuugucauu

SEQ ID NO: 206710 - RNA, 19 nt, Homo sapiens
gcagaugucagcuggcaua

SEQ ID NO: 206711 - RNA, 19 nt, Homo sapiens
ggacacagagaaacuggua

SEQ ID NO: 206712 - RNA, 19 nt, Homo sapiens
aaagaauuguucagccaua

SEQ ID NO: 206713 - RNA, 19 nt, Homo sapiens
uggcucagauugaagauuu

SEQ ID NO: 206714 - RNA, 19 nt, Homo sapiens
guaagugggagcuaaauga

SEQ ID NO: 206715 - RNA, 19 nt, Homo sapiens
aaaggucccucugugguua

SEQ ID NO: 206716 - RNA, 19 nt, Homo sapiens
ugacaugacuggcaaaugc

SEQ ID NO: 206717 - RNA, 19 nt, Homo sapiens
gcuagcuguuuccaaguua

SEQ ID NO: 206718 - RNA, 19 nt, Homo sapiens
gaaaagucaucaccgaaaa

SEQ ID NO: 206719 - RNA, 19 nt, Homo sapiens
ggagaaggacacagagaaa

SEQ ID NO: 206720 - RNA, 19 nt, Homo sapiens
agaaauguauggugagaug

SEQ ID NO: 206721 - RNA, 19 nt, Homo sapiens
gaaaggucccucugugguu

SEQ ID NO: 206722 - RNA, 19 nt, Homo sapiens
agucagaccugcuguacaa

SEQ ID NO: 206723 - RNA, 19 nt, Homo sapiens
guucagccauaaagaaaga

SEQ ID NO: 206724 - RNA, 19 nt, Homo sapiens
ugagccaguuugaauuuaa

SEQ ID NO: 206725 - RNA, 19 nt, Homo sapiens
uacuuagggugaugaaaua

SEQ ID NO: 206726 - RNA, 19 nt, Homo sapiens
gaaacuguauggucgaaaa

SEQ ID NO: 206727 - RNA, 19 nt, Homo sapiens
cuuagcaucuuacuucuug

SEQ ID NO: 206728 - RNA, 19 nt, Homo sapiens
gaacaauuccaagaguauu

SEQ ID NO: 206729 - RNA, 19 nt, Homo sapiens
gaggguguauggcuacuuc

SEQ ID NO: 206730 - RNA, 19 nt, Homo sapiens
caucuaaaccuuucuucuu

SEQ ID NO: 206731 - RNA, 19 nt, Homo sapiens
gcauuuugguccacuaaua

SEQ ID NO: 206732 - RNA, 19 nt, Homo sapiens
gagaaacuguauggucgaa

SEQ ID NO: 206733 - RNA, 19 nt, Homo sapiens
gugaugaaauaaucugugu

SEQ ID NO: 206734 - RNA, 19 nt, Homo sapiens
aaaccaaacacuccauauu

SEQ ID NO: 206735 - RNA, 19 nt, Homo sapiens
ccaccucucucaugcugaa

SEQ ID NO: 206736 - RNA, 19 nt, Homo sapiens
gagaucaugucugcuuuca

SEQ ID NO: 206737 - RNA, 19 nt, Homo sapiens
gaaaaggcccaauauguau

SEQ ID NO: 206738 - RNA, 19 nt, Homo sapiens
gaccucagcugaccucaac

SEQ ID NO: 206739 - RNA, 19 nt, Homo sapiens
guucacauauccaguucuu

SEQ ID NO: 206740 - RNA, 19 nt, Homo sapiens
guagcuuucuuguuuggaa

SEQ ID NO: 206741 - RNA, 19 nt, Homo sapiens
gcaccagaaauaugugaaa

SEQ ID NO: 206742 - RNA, 19 nt, Homo sapiens
aaagaucuacugggaauuu

SEQ ID NO: 206743 - RNA, 19 nt, Homo sapiens
gagccaguuugaauuuaau

SEQ ID NO: 206744 - RNA, 19 nt, Homo sapiens
caugggagcuauugauuuu

SEQ ID NO: 206745 - RNA, 19 nt, Homo sapiens
gaacaagaucaugcccuuu

SEQ ID NO: 206746 - RNA, 19 nt, Homo sapiens
ucacauauccaguucuuag

SEQ ID NO: 206747 - RNA, 19 nt, Homo sapiens
ccaugccaaucaaaguaua

SEQ ID NO: 206748 - RNA, 19 nt, Homo sapiens
uuucuucuuucccaacuua

SEQ ID NO: 206749 - RNA, 19 nt, Homo sapiens
uggaauuacuucucacaug

SEQ ID NO: 206750 - RNA, 19 nt, Homo sapiens
caugacacaccuuuaugua

SEQ ID NO: 206751 - RNA, 19 nt, Homo sapiens
ggagggagagaucaggaaa

SEQ ID NO: 206752 - RNA, 19 nt, Homo sapiens
uccauauucucacuuguaa

SEQ ID NO: 206753 - RNA, 19 nt, Homo sapiens
cggauuccauguccuuuau

SEQ ID NO: 206754 - RNA, 19 nt, Homo sapiens
ggugagaugcuagcuguuu

SEQ ID NO: 206755 - RNA, 19 nt, Homo sapiens
uugaaugucuuuccaaugg

SEQ ID NO: 206756 - RNA, 19 nt, Homo sapiens
gggagaaggacacagagaa

SEQ ID NO: 206757 - RNA, 19 nt, Homo sapiens
cuuauugccuguagucaga

SEQ ID NO: 206758 - RNA, 19 nt, Homo sapiens
gagggaagcagaagggaau

SEQ ID NO: 206759 - RNA, 19 nt, Homo sapiens
gcccaugccaaucaaagua

SEQ ID NO: 206760 - RNA, 19 nt, Homo sapiens
gacacaccuuuauguaugu

SEQ ID NO: 206761 - RNA, 19 nt, Homo sapiens
agugggagcuaaaugagaa

SEQ ID NO: 206762 - RNA, 19 nt, Homo sapiens
caaacacuccauauucuca

SEQ ID NO: 206763 - RNA, 19 nt, Homo sapiens
ucucuuggcugcagaugug

SEQ ID NO: 206764 - RNA, 19 nt, Homo sapiens
gaacacguggacacauaga

SEQ ID NO: 206765 - RNA, 19 nt, Homo sapiens
auauaugacugcaccagaa

SEQ ID NO: 206766 - RNA, 19 nt, Homo sapiens
aagaucuacugggaauuua

SEQ ID NO: 206767 - RNA, 19 nt, Homo sapiens
guugagccaguuugaauuu

SEQ ID NO: 206768 - RNA, 19 nt, Homo sapiens
guauugauuucuccugaag

SEQ ID NO: 206769 - RNA, 19 nt, Homo sapiens
caggcugggccauuuguua

SEQ ID NO: 206770 - RNA, 19 nt, Homo sapiens
guguaugucuacuuugguu

SEQ ID NO: 206771 - RNA, 19 nt, Homo sapiens
aggcuuggcugggcaauga

SEQ ID NO: 206772 - RNA, 19 nt, Homo sapiens
gaucuacugggaauuuaug

SEQ ID NO: 206773 - RNA, 19 nt, Homo sapiens
gguaugugccagucaaaga

SEQ ID NO: 206774 - RNA, 19 nt, Homo sapiens
aagaauuguucagccauaa

SEQ ID NO: 206775 - RNA, 19 nt, Homo sapiens
gaccugcuguacaaccuau

SEQ ID NO: 206776 - RNA, 19 nt, Homo sapiens
ucacuggacuccguuucuu

SEQ ID NO: 206777 - RNA, 19 nt, Homo sapiens
uaugacugcaccagaaaua

SEQ ID NO: 206778 - RNA, 19 nt, Homo sapiens
agaaaaggcccaauaugua

SEQ ID NO: 206779 - RNA, 19 nt, Homo sapiens
uaaggacaauguucauagg

SEQ ID NO: 206780 - RNA, 19 nt, Homo sapiens
caagcuucauguuggagaa

SEQ ID NO: 206781 - RNA, 19 nt, Homo sapiens
gcuuucuuguuuggaauua

SEQ ID NO: 206782 - RNA, 19 nt, Homo sapiens
ccauaaagaaagaacaaga

SEQ ID NO: 206783 - RNA, 19 nt, Homo sapiens
gaggauagcagauguaacc

SEQ ID NO: 206784 - RNA, 19 nt, Homo sapiens
caggacaucuacuguaacu

SEQ ID NO: 206785 - RNA, 19 nt, Homo sapiens
ugccguguaugucuacuuu

SEQ ID NO: 206786 - RNA, 19 nt, Homo sapiens
uuggaggacuggaugauau

SEQ ID NO: 206787 - RNA, 19 nt, Homo sapiens
gaaaaccaaacacuccaua

SEQ ID NO: 206788 - RNA, 19 nt, Homo sapiens
aaggaggaaugucuucuuc

SEQ ID NO: 206789 - RNA, 19 nt, Homo sapiens
caaacaaggaggaaugucu

SEQ ID NO: 206790 - RNA, 19 nt, Homo sapiens
agaagccggugggcaauga

SEQ ID NO: 206791 - RNA, 19 nt, Homo sapiens
gccaaucaaaguauaauag

SEQ ID NO: 206792 - RNA, 19 nt, Homo sapiens
gcauguaccccugaacuua

SEQ ID NO: 206793 - RNA, 19 nt, Homo sapiens
uuagggugaugaaauaauc

SEQ ID NO: 206794 - RNA, 19 nt, Homo sapiens
uguacacaauuccuccuaa

SEQ ID NO: 206795 - RNA, 19 nt, Homo sapiens
guaaugauguugacacuuu

SEQ ID NO: 206796 - RNA, 19 nt, Homo sapiens
gaaggugguuuauuacaaa

SEQ ID NO: 206797 - RNA, 19 nt, Homo sapiens
gaagaucaguggccauauu

SEQ ID NO: 206798 - RNA, 19 nt, Homo sapiens
gaacaugaccuuccacuug

SEQ ID NO: 206799 - RNA, 19 nt, Homo sapiens
gaagaaagguagccaugga

SEQ ID NO: 206800 - RNA, 19 nt, Homo sapiens
gaaaaggcuuccauuaaua

SEQ ID NO: 206801 - RNA, 19 nt, Homo sapiens
uaacaaagagcaaucagua

SEQ ID NO: 206802 - RNA, 19 nt, Homo sapiens
gcuguaaagugucuucuaa

SEQ ID NO: 206803 - RNA, 19 nt, Homo sapiens
caagaaugcuguaaagugu

SEQ ID NO: 206804 - RNA, 19 nt, Homo sapiens
caaagagcaaucaguauua

SEQ ID NO: 206805 - RNA, 19 nt, Homo sapiens
gauuaugcauuccguagua

SEQ ID NO: 206806 - RNA, 19 nt, Homo sapiens
gaaagugcuucucaucaau

SEQ ID NO: 206807 - RNA, 19 nt, Homo sapiens
gcacugauuugaccauugu

SEQ ID NO: 206808 - RNA, 19 nt, Homo sapiens
guagcaggcauuacaauua

SEQ ID NO: 206809 - RNA, 19 nt, Homo sapiens
ggauaucuguggcaugauu

SEQ ID NO: 206810 - RNA, 19 nt, Homo sapiens
cuugaugacucuugaaaua

SEQ ID NO: 206811 - RNA, 19 nt, Homo sapiens
uagcaggcauuacaauuaa

SEQ ID NO: 206812 - RNA, 19 nt, Homo sapiens
gcuaaugcauggcuaguug

SEQ ID NO: 206813 - RNA, 19 nt, Homo sapiens
cauaacaccuuuugcauua

SEQ ID NO: 206814 - RNA, 19 nt, Homo sapiens
cgaaagugcuucucaucaa

SEQ ID NO: 206815 - RNA, 19 nt, Homo sapiens
gcagaaguaugaagacauc

SEQ ID NO: 206816 - RNA, 19 nt, Homo sapiens
gaagagggacagacacaaa

SEQ ID NO: 206817 - RNA, 19 nt, Homo sapiens
agaaguggcuggauuggaa

SEQ ID NO: 206818 - RNA, 19 nt, Homo sapiens
ugaaugcauugguguuuaa

SEQ ID NO: 206819 - RNA, 19 nt, Homo sapiens
gcucaaugcauacacauaa

SEQ ID NO: 206820 - RNA, 19 nt, Homo sapiens
guuugaaaguguagugaua

SEQ ID NO: 206821 - RNA, 19 nt, Homo sapiens
gcaccucuguaaacuauuc

SEQ ID NO: 206822 - RNA, 19 nt, Homo sapiens
guagaaacaguaaugcuaa

SEQ ID NO: 206823 - RNA, 19 nt, Homo sapiens
ggaccauuguacauuauga

SEQ ID NO: 206824 - RNA, 19 nt, Homo sapiens
ccacuucccauguguuaua

SEQ ID NO: 206825 - RNA, 19 nt, Homo sapiens
uauaauagcuuugcuugca

SEQ ID NO: 206826 - RNA, 19 nt, Homo sapiens
gauguagccugacaagaca

SEQ ID NO: 206827 - RNA, 19 nt, Homo sapiens
agaaugaucucuuugugau

SEQ ID NO: 206828 - RNA, 19 nt, Homo sapiens
gaaggaagagcaagagcuu

SEQ ID NO: 206829 - RNA, 19 nt, Homo sapiens
ugaaggugguuuauuacaa

SEQ ID NO: 206830 - RNA, 19 nt, Homo sapiens
aagggaccauuguacauua

SEQ ID NO: 206831 - RNA, 19 nt, Homo sapiens
gcaagagcuucaugacauc

SEQ ID NO: 206832 - RNA, 19 nt, Homo sapiens
ggccauggauucuacugaa

SEQ ID NO: 206833 - RNA, 19 nt, Homo sapiens
agucaugcaucaucaguaa

SEQ ID NO: 206834 - RNA, 19 nt, Homo sapiens
ugguuuaccuguaguguuu

SEQ ID NO: 206835 - RNA, 19 nt, Homo sapiens
guaguauugugcacugauu

SEQ ID NO: 206836 - RNA, 19 nt, Homo sapiens
guagacuauugaagaauga

SEQ ID NO: 206837 - RNA, 19 nt, Homo sapiens
gagcauguagaaacaguaa

SEQ ID NO: 206838 - RNA, 19 nt, Homo sapiens
ugauuucgguaacuaguuu

SEQ ID NO: 206839 - RNA, 19 nt, Homo sapiens
guauuaaugggcuucuuua

SEQ ID NO: 206840 - RNA, 19 nt, Homo sapiens
acaaagagcaaucaguauu

SEQ ID NO: 206841 - RNA, 19 nt, Homo sapiens
ugaaaaggcuuccauuaau

SEQ ID NO: 206842 - RNA, 19 nt, Homo sapiens
cuacugagcugaacaugac

SEQ ID NO: 206843 - RNA, 19 nt, Homo sapiens
ggagacacacuggauguuu

SEQ ID NO: 206844 - RNA, 19 nt, Homo sapiens
gaacagagugcuugcaaaa

SEQ ID NO: 206845 - RNA, 19 nt, Homo sapiens
ugaugacucuugaaauaug

SEQ ID NO: 206846 - RNA, 19 nt, Homo sapiens
cagcugcguucuuugugua

SEQ ID NO: 206847 - RNA, 19 nt, Homo sapiens
uaccaugauugacaucuuu

SEQ ID NO: 206848 - RNA, 19 nt, Homo sapiens
gaaagguagccauggaaga

SEQ ID NO: 206849 - RNA, 19 nt, Homo sapiens
acaccaggcuuaccuuuua

SEQ ID NO: 206850 - RNA, 19 nt, Homo sapiens
aaucuaaggugcaauuucu

SEQ ID NO: 206851 - RNA, 19 nt, Homo sapiens
caaagauacuaacauuguc

SEQ ID NO: 206852 - RNA, 19 nt, Homo sapiens
ugaaucaccugaguacaau

SEQ ID NO: 206853 - RNA, 19 nt, Homo sapiens
ucaacauucugcaaaccua

SEQ ID NO: 206854 - RNA, 19 nt, Homo sapiens
gugagcgcuugguucauua

SEQ ID NO: 206855 - RNA, 19 nt, Homo sapiens
gcagcugcguucuuugugu

SEQ ID NO: 206856 - RNA, 19 nt, Homo sapiens
gggcuucuuuaaauucuau

SEQ ID NO: 206857 - RNA, 19 nt, Homo sapiens
guaccuguaucaaaggaau

SEQ ID NO: 206858 - RNA, 19 nt, Homo sapiens
gcauguagaaacaguaaug

SEQ ID NO: 206859 - RNA, 19 nt, Homo sapiens
uuuaagaaguggcuggauu

SEQ ID NO: 206860 - RNA, 19 nt, Homo sapiens
gauugugacaccaggcuua

SEQ ID NO: 206861 - RNA, 19 nt, Homo sapiens
ccaaccauccaaccuuuaa

SEQ ID NO: 206862 - RNA, 19 nt, Homo sapiens
gcauuccguaguauuauuu

SEQ ID NO: 206863 - RNA, 19 nt, Homo sapiens
aaacgaaagugcuucucau

SEQ ID NO: 206864 - RNA, 19 nt, Homo sapiens
ccacucuacucgcuccaaa

SEQ ID NO: 206865 - RNA, 19 nt, Homo sapiens
ugugagcgcuugguucauu

SEQ ID NO: 206866 - RNA, 19 nt, Homo sapiens
ucaguuccgugucuuaaca

SEQ ID NO: 206867 - RNA, 19 nt, Homo sapiens
gauaucuguggcaugauua

SEQ ID NO: 206868 - RNA, 19 nt, Homo sapiens
aagaucaguggccauauua

SEQ ID NO: 206869 - RNA, 19 nt, Homo sapiens
gcauugguguuuaacuaag

SEQ ID NO: 206870 - RNA, 19 nt, Homo sapiens
auaaaugcaucuuccuguu

SEQ ID NO: 206871 - RNA, 19 nt, Homo sapiens
gagcaagagcuucaugaca

SEQ ID NO: 206872 - RNA, 19 nt, Homo sapiens
aaaaguaccuguaucaaag

SEQ ID NO: 206873 - RNA, 19 nt, Homo sapiens
aaacaguaaugcuaaugca

SEQ ID NO: 206874 - RNA, 19 nt, Homo sapiens
ucauugcuaugguucacua

SEQ ID NO: 206875 - RNA, 19 nt, Homo sapiens
gagacacacuggauguuuu

SEQ ID NO: 206876 - RNA, 19 nt, Homo sapiens
uuccgugucuuaacaguuu

SEQ ID NO: 206877 - RNA, 19 nt, Homo sapiens
uaugcauuccguaguauua

SEQ ID NO: 206878 - RNA, 19 nt, Homo sapiens
agggauaucuguggcauga

SEQ ID NO: 206879 - RNA, 19 nt, Homo sapiens
acaagaaugcuguaaagug

SEQ ID NO: 206880 - RNA, 19 nt, Homo sapiens
uguagacuauugaagaaug

SEQ ID NO: 206881 - RNA, 19 nt, Homo sapiens
aaagguauuucccucagau

SEQ ID NO: 206882 - RNA, 19 nt, Homo sapiens
uugaaugcauugguguuua

SEQ ID NO: 206883 - RNA, 19 nt, Homo sapiens
ccuguucuuucuaccauuu

SEQ ID NO: 206884 - RNA, 19 nt, Homo sapiens
ggaagagaauauggaagag

SEQ ID NO: 206885 - RNA, 19 nt, Homo sapiens
caguuuacauguacuucaa

SEQ ID NO: 206886 - RNA, 19 nt, Homo sapiens
agcaagagcuucaugacau

SEQ ID NO: 206887 - RNA, 19 nt, Homo sapiens
augaagacaucaagucgaa

SEQ ID NO: 206888 - RNA, 19 nt, Homo sapiens
gcuuggaccuucgucaguu

SEQ ID NO: 206889 - RNA, 19 nt, Homo sapiens
uugcaccucuguaaacuau

SEQ ID NO: 206890 - RNA, 19 nt, Homo sapiens
ccucagauuacucauguuu

SEQ ID NO: 206891 - RNA, 19 nt, Homo sapiens
gugcuucuuaucuuuguua

SEQ ID NO: 206892 - RNA, 19 nt, Homo sapiens
caaagggaccauuguacau

SEQ ID NO: 206893 - RNA, 19 nt, Homo sapiens
augcauugguguuuaacua

SEQ ID NO: 206894 - RNA, 19 nt, Homo sapiens
ggaugcagaaguaugaaga

SEQ ID NO: 206895 - RNA, 19 nt, Homo sapiens
gaagauugcugcacuaaau

SEQ ID NO: 206896 - RNA, 19 nt, Homo sapiens
gagcagaucuguguggaua

SEQ ID NO: 206897 - RNA, 19 nt, Homo sapiens
gaaagaaccuagagagcaa

SEQ ID NO: 206898 - RNA, 19 nt, Homo sapiens
ccaaaugacccucaaauaa

SEQ ID NO: 206899 - RNA, 19 nt, Homo sapiens
gaacaaagccaagagagaa

SEQ ID NO: 206900 - RNA, 19 nt, Homo sapiens
gagaacaucugcaacacaa

SEQ ID NO: 206901 - RNA, 19 nt, Homo sapiens
aaacucaccuugcauggua

SEQ ID NO: 206902 - RNA, 19 nt, Homo sapiens
uuagagagcaguaucuuua

SEQ ID NO: 206903 - RNA, 19 nt, Homo sapiens
caugauggcuacuacauau

SEQ ID NO: 206904 - RNA, 19 nt, Homo sapiens
caccuugcaugguagauua

SEQ ID NO: 206905 - RNA, 19 nt, Homo sapiens
caaaugacccucaaauaag

SEQ ID NO: 206906 - RNA, 19 nt, Homo sapiens
gaaaacaagugcugaagau

SEQ ID NO: 206907 - RNA, 19 nt, Homo sapiens
gauaaccaguuucaaugau

SEQ ID NO: 206908 - RNA, 19 nt, Homo sapiens
gaagagaaccguuuuaauc

SEQ ID NO: 206909 - RNA, 19 nt, Homo sapiens
uaaccaguuucaaugauga

SEQ ID NO: 206910 - RNA, 19 nt, Homo sapiens
aaacaagugcugaagauga

SEQ ID NO: 206911 - RNA, 19 nt, Homo sapiens
aaugagaucugguggcuau

SEQ ID NO: 206912 - RNA, 19 nt, Homo sapiens
aagaugaaauggaagagaa

SEQ ID NO: 206913 - RNA, 19 nt, Homo sapiens
caaacgaguucuacauguc

SEQ ID NO: 206914 - RNA, 19 nt, Homo sapiens
gagcaguaucuuuaaauga

SEQ ID NO: 206915 - RNA, 19 nt, Homo sapiens
uaaagcagagucuagguuu

SEQ ID NO: 206916 - RNA, 19 nt, Homo sapiens
caaauaagccagaugaaaa

SEQ ID NO: 206917 - RNA, 19 nt, Homo sapiens
caacauauggucaacuugu

SEQ ID NO: 206918 - RNA, 19 nt, Homo sapiens
caccacaagugcagugaaa

SEQ ID NO: 206919 - RNA, 19 nt, Homo sapiens
ucaaauaagccagaugaaa

SEQ ID NO: 206920 - RNA, 19 nt, Homo sapiens
gcagaucuguguggauauc

SEQ ID NO: 206921 - RNA, 19 nt, Homo sapiens
agagagcaguaucuuuaaa

SEQ ID NO: 206922 - RNA, 19 nt, Homo sapiens
ccuaucaccuguucauugu

SEQ ID NO: 206923 - RNA, 19 nt, Homo sapiens
gagaucugguggcuauuuc

SEQ ID NO: 206924 - RNA, 19 nt, Homo sapiens
gcucugcccuggagaacau

SEQ ID NO: 206925 - RNA, 19 nt, Homo sapiens
aacaagugcugaagaugaa

SEQ ID NO: 206926 - RNA, 19 nt, Homo sapiens
gagucuagguuucugcaau

SEQ ID NO: 206927 - RNA, 19 nt, Homo sapiens
ucauugcccugcugaucua

SEQ ID NO: 206928 - RNA, 19 nt, Homo sapiens
uacaacauauggucaacuu

SEQ ID NO: 206929 - RNA, 19 nt, Homo sapiens
gaggaauggugcccgaauc

SEQ ID NO: 206930 - RNA, 19 nt, Homo sapiens
gaagaugaaauggaagaga

SEQ ID NO: 206931 - RNA, 19 nt, Homo sapiens
gagagcaguaucuuuaaau

SEQ ID NO: 206932 - RNA, 19 nt, Homo sapiens
ucacugacacuccagacua

SEQ ID NO: 206933 - RNA, 19 nt, Homo sapiens
uugcugcacuaaauucuaa

SEQ ID NO: 206934 - RNA, 19 nt, Homo sapiens
acaaacgaguucuacaugu

SEQ ID NO: 206935 - RNA, 19 nt, Homo sapiens
gaacaucugcaacacaaac

SEQ ID NO: 206936 - RNA, 19 nt, Homo sapiens
ggaaacugcagccgaggaa

SEQ ID NO: 206937 - RNA, 19 nt, Homo sapiens
cacugacacuccagacuaa

SEQ ID NO: 206938 - RNA, 19 nt, Homo sapiens
ggaagauugcugcacuaaa

SEQ ID NO: 206939 - RNA, 19 nt, Homo sapiens
uuaguaaacucaccuugca

SEQ ID NO: 206940 - RNA, 19 nt, Homo sapiens
cuaaauugcauaaggaguu

SEQ ID NO: 206941 - RNA, 19 nt, Homo sapiens
ccacaagugcagugaaaga

SEQ ID NO: 206942 - RNA, 19 nt, Homo sapiens
gaaccuagagagcaagaag

SEQ ID NO: 206943 - RNA, 19 nt, Homo sapiens
caggauggccagucauuga

SEQ ID NO: 206944 - RNA, 19 nt, Homo sapiens
ugauggcuacuacauauaa

SEQ ID NO: 206945 - RNA, 19 nt, Homo sapiens
agagcaguaucuuuaaaug

SEQ ID NO: 206946 - RNA, 19 nt, Homo sapiens
guguggauauccgacaaua

SEQ ID NO: 206947 - RNA, 19 nt, Homo sapiens
caagugcagugaaagaacu

SEQ ID NO: 206948 - RNA, 19 nt, Homo sapiens
uaugucaucuauggaauug

SEQ ID NO: 206949 - RNA, 19 nt, Homo sapiens
ucagacggguguaaauaag

SEQ ID NO: 206950 - RNA, 19 nt, Homo sapiens
ccucaaauaagccagauga

SEQ ID NO: 206951 - RNA, 19 nt, Homo sapiens
gcaacacaaacgaguucua

SEQ ID NO: 206952 - RNA, 19 nt, Homo sapiens
aaucagacggguguaaaua

SEQ ID NO: 206953 - RNA, 19 nt, Homo sapiens
uguaugggaucauucuguu

SEQ ID NO: 206954 - RNA, 19 nt, Homo sapiens
gacuuacuguacaugaauu

SEQ ID NO: 206955 - RNA, 19 nt, Homo sapiens
agucuagguuucugcaauu

SEQ ID NO: 206956 - RNA, 19 nt, Homo sapiens
ucuguagcaugaaauauca

SEQ ID NO: 206957 - RNA, 19 nt, Homo sapiens
ggaaaauacugaacaaagc

SEQ ID NO: 206958 - RNA, 19 nt, Homo sapiens
ggaggggaguccaaaagaa

SEQ ID NO: 206959 - RNA, 19 nt, Homo sapiens
uagcaugaaauaucacuga

SEQ ID NO: 206960 - RNA, 19 nt, Homo sapiens
ugauaaccaguuucaauga

SEQ ID NO: 206961 - RNA, 19 nt, Homo sapiens
gggaagauugcugcacuaa

SEQ ID NO: 206962 - RNA, 19 nt, Homo sapiens
ggagaacaucugcaacaca

SEQ ID NO: 206963 - RNA, 19 nt, Homo sapiens
uagagagcaguaucuuuaa

SEQ ID NO: 206964 - RNA, 19 nt, Homo sapiens
gaugacuuacuguacauga

SEQ ID NO: 206965 - RNA, 19 nt, Homo sapiens
gcaccguggcgauucuuga

SEQ ID NO: 206966 - RNA, 19 nt, Homo sapiens
ugaacaaagccaagagaga

SEQ ID NO: 206967 - RNA, 19 nt, Homo sapiens
guaugaagccagccaugga

SEQ ID NO: 206968 - RNA, 19 nt, Homo sapiens
uaagccagaugaaaauuug

SEQ ID NO: 206969 - RNA, 19 nt, Homo sapiens
aaaugacccucaaauaagc

SEQ ID NO: 206970 - RNA, 19 nt, Homo sapiens
ccugauaaccaguuucaau

SEQ ID NO: 206971 - RNA, 19 nt, Homo sapiens
uuaagagucgggaagauug

SEQ ID NO: 206972 - RNA, 19 nt, Homo sapiens
caacacaaacgaguucuac

SEQ ID NO: 206973 - RNA, 19 nt, Homo sapiens
ucaagucaccgcagaccaa

SEQ ID NO: 206974 - RNA, 19 nt, Homo sapiens
ucucagcggugcccguguu

SEQ ID NO: 206975 - RNA, 19 nt, Homo sapiens
auaaccaguuucaaugaug

SEQ ID NO: 206976 - RNA, 19 nt, Homo sapiens
cagcggugcccguguuuau

SEQ ID NO: 206977 - RNA, 19 nt, Homo sapiens
ugcaguaugucaucuaugg

SEQ ID NO: 206978 - RNA, 19 nt, Homo sapiens
ugagcgaggugauacaacu

SEQ ID NO: 206979 - RNA, 19 nt, Homo sapiens
accaaaugacccucaaaua

SEQ ID NO: 206980 - RNA, 19 nt, Homo sapiens
ugagaucugguggcuauuu

SEQ ID NO: 206981 - RNA, 19 nt, Homo sapiens
cgggaagauugcugcacua

SEQ ID NO: 206982 - RNA, 19 nt, Homo sapiens
ugcugaagaugaaauggaa

SEQ ID NO: 206983 - RNA, 19 nt, Homo sapiens
gcaugguagauuaauaaga

SEQ ID NO: 206984 - RNA, 19 nt, Homo sapiens
aaagcagagucuagguuuc

SEQ ID NO: 206985 - RNA, 19 nt, Homo sapiens
cacaaacgaguucuacaug

SEQ ID NO: 206986 - RNA, 19 nt, Homo sapiens
ggcuggguguguuugguuu

SEQ ID NO: 206987 - RNA, 19 nt, Homo sapiens
gcuuguggccgaugcauca

SEQ ID NO: 206988 - RNA, 19 nt, Homo sapiens
guaugucaucuauggaauu

SEQ ID NO: 206989 - RNA, 19 nt, Homo sapiens
aaauggaagagaaccguuu

SEQ ID NO: 206990 - RNA, 19 nt, Homo sapiens
ugacuuacuguacaugaau

SEQ ID NO: 206991 - RNA, 19 nt, Homo sapiens
cuugcaugguagauuaaua

SEQ ID NO: 206992 - RNA, 19 nt, Homo sapiens
cuaaagcagagucuagguu

SEQ ID NO: 206993 - RNA, 19 nt, Homo sapiens
cauguccuaucaccuguuc

SEQ ID NO: 206994 - RNA, 19 nt, Homo sapiens
acacaaacgaguucuacau

SEQ ID NO: 206995 - RNA, 19 nt, Homo sapiens
ccuaugaccuagacuauua

SEQ ID NO: 206996 - RNA, 19 nt, Homo sapiens
gaggaaacauuauuugaag

SEQ ID NO: 206997 - RNA, 19 nt, Homo sapiens
ugacuugggugaaauuuau

SEQ ID NO: 206998 - RNA, 19 nt, Homo sapiens
ggaggaaacauuauuugaa

SEQ ID NO: 206999 - RNA, 19 nt, Homo sapiens
uaucaccuguuuagcauuu

SEQ ID NO: 207000 - RNA, 19 nt, Homo sapiens
ggaccacuauauccacuug

SEQ ID NO: 207001 - RNA, 19 nt, Homo sapiens
cucaagaacucucugauug

SEQ ID NO: 207002 - RNA, 19 nt, Homo sapiens
gguuuggcauuccucaaua

SEQ ID NO: 207003 - RNA, 19 nt, Homo sapiens
cuugauccauccugucuua

SEQ ID NO: 207004 - RNA, 19 nt, Homo sapiens
gaaucugugucuccuggaa

SEQ ID NO: 207005 - RNA, 19 nt, Homo sapiens
gaacucagaaaccaagaau

SEQ ID NO: 207006 - RNA, 19 nt, Homo sapiens
gauccugaccucacuuuga

SEQ ID NO: 207007 - RNA, 19 nt, Homo sapiens
caagaacucucugauuguc

SEQ ID NO: 207008 - RNA, 19 nt, Homo sapiens
ugggugaaauuuaucauug

SEQ ID NO: 207009 - RNA, 19 nt, Homo sapiens
gggucucccugguguuaua

SEQ ID NO: 207010 - RNA, 19 nt, Homo sapiens
uggcauuccucaauaguug

SEQ ID NO: 207011 - RNA, 19 nt, Homo sapiens
cuacuugugucucaucuuc

SEQ ID NO: 207012 - RNA, 19 nt, Homo sapiens
gauccauccugucuuaucu

SEQ ID NO: 207013 - RNA, 19 nt, Homo sapiens
ccuggaaacagcucaauaa

SEQ ID NO: 207014 - RNA, 19 nt, Homo sapiens
cauccuuuauguccuaauu

SEQ ID NO: 207015 - RNA, 19 nt, Homo sapiens
gaagcgaacaguccugauc

SEQ ID NO: 207016 - RNA, 19 nt, Homo sapiens
gcuuuuggcuucucuaauu

SEQ ID NO: 207017 - RNA, 19 nt, Homo sapiens
cauccugucuuaucucauc

SEQ ID NO: 207018 - RNA, 19 nt, Homo sapiens
ggaguucaauaaucauacu

SEQ ID NO: 207019 - RNA, 19 nt, Homo sapiens
aggcauuucuggacaauuc

SEQ ID NO: 207020 - RNA, 19 nt, Homo sapiens
agauuuggaggaaacauua

SEQ ID NO: 207021 - RNA, 19 nt, Homo sapiens
uuugggagcucaccauuca

SEQ ID NO: 207022 - RNA, 19 nt, Homo sapiens
gugaacagcucaggaacuc

SEQ ID NO: 207023 - RNA, 19 nt, Homo sapiens
gcucaccauucaccacaau

SEQ ID NO: 207024 - RNA, 19 nt, Homo sapiens
guuguggccuuugugguuu

SEQ ID NO: 207025 - RNA, 19 nt, Homo sapiens
caaagccaauuccuucacu

SEQ ID NO: 207026 - RNA, 19 nt, Homo sapiens
ccuauguggccaugaauuu

SEQ ID NO: 207027 - RNA, 19 nt, Homo sapiens
ggcaccauguucugacuug

SEQ ID NO: 207028 - RNA, 19 nt, Homo sapiens
ccucaagaacucucugauu

SEQ ID NO: 207029 - RNA, 19 nt, Homo sapiens
gaaaguccagcugggaguu

SEQ ID NO: 207030 - RNA, 19 nt, Homo sapiens
gaauuuccacuggcccuuu

SEQ ID NO: 207031 - RNA, 19 nt, Homo sapiens
guuccucaaucuagccauu

SEQ ID NO: 207032 - RNA, 19 nt, Homo sapiens
cauacucuuugcuauaaca

SEQ ID NO: 207033 - RNA, 19 nt, Homo sapiens
ggaacucagaaaccaagaa

SEQ ID NO: 207034 - RNA, 19 nt, Homo sapiens
ugaccuagacuauuacucu

SEQ ID NO: 207035 - RNA, 19 nt, Homo sapiens
gguuguggccuuugugguu

SEQ ID NO: 207036 - RNA, 19 nt, Homo sapiens
uuggcuaucucuucccuuu

SEQ ID NO: 207037 - RNA, 19 nt, Homo sapiens
gaucaggcaccauguucug

SEQ ID NO: 207038 - RNA, 19 nt, Homo sapiens
ucaagaacucucugauugu

SEQ ID NO: 207039 - RNA, 19 nt, Homo sapiens
gaucagccuggaccacuau

SEQ ID NO: 207040 - RNA, 19 nt, Homo sapiens
ugaucagccuggaccacua

SEQ ID NO: 207041 - RNA, 19 nt, Homo sapiens
gugguuugcuggacuccuu

SEQ ID NO: 207042 - RNA, 19 nt, Homo sapiens
gggugaaauuuaucauugg

SEQ ID NO: 207043 - RNA, 19 nt, Homo sapiens
uaucauuggcuaucucuuc

SEQ ID NO: 207044 - RNA, 19 nt, Homo sapiens
ucuccuauguggccaugaa

SEQ ID NO: 207045 - RNA, 19 nt, Homo sapiens
agaagacagucaccacucu

SEQ ID NO: 207046 - RNA, 19 nt, Homo sapiens
agucugauuuggaggagaa

SEQ ID NO: 207047 - RNA, 19 nt, Homo sapiens
gcaugauccugaccucacu

SEQ ID NO: 207048 - RNA, 19 nt, Homo sapiens
cuguggaguucaauaauca

SEQ ID NO: 207049 - RNA, 19 nt, Homo sapiens
ucucuucccuuugcuaaca

SEQ ID NO: 207050 - RNA, 19 nt, Homo sapiens
guggaguucaauaaucaua

SEQ ID NO: 207051 - RNA, 19 nt, Homo sapiens
caucgaacccucaagaacu

SEQ ID NO: 207052 - RNA, 19 nt, Homo sapiens
ccauucaccacaauagcua

SEQ ID NO: 207053 - RNA, 19 nt, Homo sapiens
guaggcauuucuggacaau

SEQ ID NO: 207054 - RNA, 19 nt, Homo sapiens
guucugacuugggugaaau

SEQ ID NO: 207055 - RNA, 19 nt, Homo sapiens
uggaggaaacauuauuuga

SEQ ID NO: 207056 - RNA, 19 nt, Homo sapiens
cuuaucaccuguuuagcau

SEQ ID NO: 207057 - RNA, 19 nt, Homo sapiens
ugaacauguuugccagugu

SEQ ID NO: 207058 - RNA, 19 nt, Homo sapiens
aaaccaagaaucugugucu

SEQ ID NO: 207059 - RNA, 19 nt, Homo sapiens
caauucugguugugguugu

SEQ ID NO: 207060 - RNA, 19 nt, Homo sapiens
gaucuccaguaggcauuuc

SEQ ID NO: 207061 - RNA, 19 nt, Homo sapiens
agaacucucugauugucau

SEQ ID NO: 207062 - RNA, 19 nt, Homo sapiens
ucccugguguuauauuguu

SEQ ID NO: 207063 - RNA, 19 nt, Homo sapiens
gcaucuggcugugcaaagc

SEQ ID NO: 207064 - RNA, 19 nt, Homo sapiens
gguugugguuguggccuuu

SEQ ID NO: 207065 - RNA, 19 nt, Homo sapiens
gcaucgaacccucaagaac

SEQ ID NO: 207066 - RNA, 19 nt, Homo sapiens
acucagaaaccaagaaucu

SEQ ID NO: 207067 - RNA, 19 nt, Homo sapiens
cagcucaggaacucagaaa

SEQ ID NO: 207068 - RNA, 19 nt, Homo sapiens
gcuugaaccccauccuuua

SEQ ID NO: 207069 - RNA, 19 nt, Homo sapiens
ggcuaucucuucccuuugc

SEQ ID NO: 207070 - RNA, 19 nt, Homo sapiens
caauaaucauacucuuugc

SEQ ID NO: 207071 - RNA, 19 nt, Homo sapiens
ucucccugguguuauauug

SEQ ID NO: 207072 - RNA, 19 nt, Homo sapiens
ucaaguggaagaagacagu

SEQ ID NO: 207073 - RNA, 19 nt, Homo sapiens
uaucucuucccuuugcuaa

SEQ ID NO: 207074 - RNA, 19 nt, Homo sapiens
acucucugauugucauuau

SEQ ID NO: 207075 - RNA, 19 nt, Homo sapiens
gaacucucugauugucauu

SEQ ID NO: 207076 - RNA, 19 nt, Homo sapiens
gccauugcggauuucauuu

SEQ ID NO: 207077 - RNA, 19 nt, Homo sapiens
acuguggaguucaauaauc

SEQ ID NO: 207078 - RNA, 19 nt, Homo sapiens
cggcaucgaacccucaaga

SEQ ID NO: 207079 - RNA, 19 nt, Homo sapiens
guuuggcauuccucaauag

SEQ ID NO: 207080 - RNA, 19 nt, Homo sapiens
gcaaagccaauuccuucac

SEQ ID NO: 207081 - RNA, 19 nt, Homo sapiens
gaaagaggcagggaccuaa

SEQ ID NO: 207082 - RNA, 19 nt, Homo sapiens
caacuagggcugcgaaucu

SEQ ID NO: 207083 - RNA, 19 nt, Homo sapiens
gcuggauacugccgaucua

SEQ ID NO: 207084 - RNA, 19 nt, Homo sapiens
gggaugaagaggacgcaua

SEQ ID NO: 207085 - RNA, 19 nt, Homo sapiens
cuaaagggacuaccucugu

SEQ ID NO: 207086 - RNA, 19 nt, Homo sapiens
caccaucucuggccucuac

SEQ ID NO: 207087 - RNA, 19 nt, Homo sapiens
ugccggagcuuugcuacaa

SEQ ID NO: 207088 - RNA, 19 nt, Homo sapiens
ggaugaagaggacgcauac

SEQ ID NO: 207089 - RNA, 19 nt, Homo sapiens
ggauacugccgaucuacug

SEQ ID NO: 207090 - RNA, 19 nt, Homo sapiens
agaaagaggcagggaccua

SEQ ID NO: 207091 - RNA, 19 nt, Homo sapiens
ggcugagggucgugggaaa

SEQ ID NO: 207092 - RNA, 19 nt, Homo sapiens
ccagcaaacgcaaggaugu

SEQ ID NO: 207093 - RNA, 19 nt, Homo sapiens
aaagaggcagggaccuaaa

SEQ ID NO: 207094 - RNA, 19 nt, Homo sapiens
ugccuugccacauuaaauu

SEQ ID NO: 207095 - RNA, 19 nt, Homo sapiens
aacuagggcugcgaaucua

SEQ ID NO: 207096 - RNA, 19 nt, Homo sapiens
gggcuggagucugggaagu

SEQ ID NO: 207097 - RNA, 19 nt, Homo sapiens
gcacuuugcugcugucuuc

SEQ ID NO: 207098 - RNA, 19 nt, Homo sapiens
acaaugcccucaccuacua

SEQ ID NO: 207099 - RNA, 19 nt, Homo sapiens
gaucaacccuaucaucuac

SEQ ID NO: 207100 - RNA, 19 nt, Homo sapiens
caaccaggaugugcagaaa

SEQ ID NO: 207101 - RNA, 19 nt, Homo sapiens
ucaggcaacgugaauguaa

SEQ ID NO: 207102 - RNA, 19 nt, Homo sapiens
gcaaccaggaugugcagaa

SEQ ID NO: 207103 - RNA, 19 nt, Homo sapiens
ggccauugccuucuucaug

SEQ ID NO: 207104 - RNA, 19 nt, Homo sapiens
uggauggccugaccacaug

SEQ ID NO: 207105 - RNA, 19 nt, Homo sapiens
uuuauccacucuccaagaa

SEQ ID NO: 207106 - RNA, 19 nt, Homo sapiens
gcucaggcaacgugaaugu

SEQ ID NO: 207107 - RNA, 19 nt, Homo sapiens
acaccuaucuuaccuugcu

SEQ ID NO: 207108 - RNA, 19 nt, Homo sapiens
caccuacuauucagagaca

SEQ ID NO: 207109 - RNA, 19 nt, Homo sapiens
gcugucugcugcugcuguu

SEQ ID NO: 207110 - RNA, 19 nt, Homo sapiens
ccaccucucuacaccuauc

SEQ ID NO: 207111 - RNA, 19 nt, Homo sapiens
gacacggaccuaugugaug

SEQ ID NO: 207112 - RNA, 19 nt, Homo sapiens
gggauguggugcucugcau

SEQ ID NO: 207113 - RNA, 19 nt, Homo sapiens
cuccaccucucuacaccua

SEQ ID NO: 207114 - RNA, 19 nt, Homo sapiens
gcagcucuacgcccaaauc

SEQ ID NO: 207115 - RNA, 19 nt, Homo sapiens
caacagugacacggaccua

SEQ ID NO: 207116 - RNA, 19 nt, Homo sapiens
ccucucuacaccuaucuua

SEQ ID NO: 207117 - RNA, 19 nt, Homo sapiens
ggccugguccugcacuuug

SEQ ID NO: 207118 - RNA, 19 nt, Homo sapiens
gcugguugcccuucacugu

SEQ ID NO: 207119 - RNA, 19 nt, Homo sapiens
cccagcagauugcccuuca

SEQ ID NO: 207120 - RNA, 19 nt, Homo sapiens
caccacugcccucgccuaa

SEQ ID NO: 207121 - RNA, 19 nt, Homo sapiens
cguggugcuuggagccuuu

SEQ ID NO: 207122 - RNA, 19 nt, Homo sapiens
cuaccuuucucuguacaau

SEQ ID NO: 207123 - RNA, 19 nt, Homo sapiens
accgcuaccuuucucugua

SEQ ID NO: 207124 - RNA, 19 nt, Homo sapiens
accaggaugugcagaaagu

SEQ ID NO: 207125 - RNA, 19 nt, Homo sapiens
caggcaacgugaauguaag

SEQ ID NO: 207126 - RNA, 19 nt, Homo sapiens
ugccugugcuggccuggaa

SEQ ID NO: 207127 - RNA, 19 nt, Homo sapiens
ugacacggaccuaugugau

SEQ ID NO: 207128 - RNA, 19 nt, Homo sapiens
gaagaaaggguauuuauuc

SEQ ID NO: 207129 - RNA, 19 nt, Homo sapiens
agacuucccuccugucaua

SEQ ID NO: 207130 - RNA, 19 nt, Homo sapiens
gaaaguggaaggagaaaug

SEQ ID NO: 207131 - RNA, 19 nt, Homo sapiens
cauaagaccgcaauucuaa

SEQ ID NO: 207132 - RNA, 19 nt, Homo sapiens
gagaaaugcagccgauaua

SEQ ID NO: 207133 - RNA, 19 nt, Homo sapiens
gaggagaugaguaaauaua

SEQ ID NO: 207134 - RNA, 19 nt, Homo sapiens
ggaagaaggugugggacaa

SEQ ID NO: 207135 - RNA, 19 nt, Homo sapiens
ucacagggcucaccauaca

SEQ ID NO: 207136 - RNA, 19 nt, Homo sapiens
gcaacgagcugggcgucua

SEQ ID NO: 207137 - RNA, 19 nt, Homo sapiens
gaacauaagaccgcaauuc

SEQ ID NO: 207138 - RNA, 19 nt, Homo sapiens
gaaaugcagccgauauaga

SEQ ID NO: 207139 - RNA, 19 nt, Homo sapiens
aaacagcgaucuccaaguc

SEQ ID NO: 207140 - RNA, 19 nt, Homo sapiens
ccaaagugcucagauuaga

SEQ ID NO: 207141 - RNA, 19 nt, Homo sapiens
aggaggagaugaguaaaua

SEQ ID NO: 207142 - RNA, 19 nt, Homo sapiens
auacauaaccuccuugaaa

SEQ ID NO: 207143 - RNA, 19 nt, Homo sapiens
ugaaggaggagaugaguaa

SEQ ID NO: 207144 - RNA, 19 nt, Homo sapiens
aaagggcuguguuaauauu

SEQ ID NO: 207145 - RNA, 19 nt, Homo sapiens
cacacugacuccauacaua

SEQ ID NO: 207146 - RNA, 19 nt, Homo sapiens
uaaauggagucucacuaug

SEQ ID NO: 207147 - RNA, 19 nt, Homo sapiens
ggagaaaugcagccgauau

SEQ ID NO: 207148 - RNA, 19 nt, Homo sapiens
cuacacauacuuccuaauu

SEQ ID NO: 207149 - RNA, 19 nt, Homo sapiens
caagaagaaaggguauuua

SEQ ID NO: 207150 - RNA, 19 nt, Homo sapiens
ugucagaacucaagugaag

SEQ ID NO: 207151 - RNA, 19 nt, Homo sapiens
acccaugccuggcuaauuu

SEQ ID NO: 207152 - RNA, 19 nt, Homo sapiens
caaccacaccuucugcuuu

SEQ ID NO: 207153 - RNA, 19 nt, Homo sapiens
gaagagggagaaugucaga

SEQ ID NO: 207154 - RNA, 19 nt, Homo sapiens
agaccgcaauucuaaguuu

SEQ ID NO: 207155 - RNA, 19 nt, Homo sapiens
ccagaucccaucacaguuu

SEQ ID NO: 207156 - RNA, 19 nt, Homo sapiens
guaugcaaauuguauggaa

SEQ ID NO: 207157 - RNA, 19 nt, Homo sapiens
agacaaauagagaagguua

SEQ ID NO: 207158 - RNA, 19 nt, Homo sapiens
ccucaucucuucccuguag

SEQ ID NO: 207159 - RNA, 19 nt, Homo sapiens
cgauauagagucauuaugu

SEQ ID NO: 207160 - RNA, 19 nt, Homo sapiens
gcuuucgucuccuccauaa

SEQ ID NO: 207161 - RNA, 19 nt, Homo sapiens
ucucaacacuuccucaugu

SEQ ID NO: 207162 - RNA, 19 nt, Homo sapiens
ccucauguauuucuugugu

SEQ ID NO: 207163 - RNA, 19 nt, Homo sapiens
gggagaaugucagaacuca

SEQ ID NO: 207164 - RNA, 19 nt, Homo sapiens
ggaugaagagggagaaugu

SEQ ID NO: 207165 - RNA, 19 nt, Homo sapiens
caacacuuccucauguauu

SEQ ID NO: 207166 - RNA, 19 nt, Homo sapiens
gauaaacagcgaucuccaa

SEQ ID NO: 207167 - RNA, 19 nt, Homo sapiens
uuacuuaucucuguugcuu

SEQ ID NO: 207168 - RNA, 19 nt, Homo sapiens
caucacaguuuggcgauug

SEQ ID NO: 207169 - RNA, 19 nt, Homo sapiens
gaugugagccgccaugucu

SEQ ID NO: 207170 - RNA, 19 nt, Homo sapiens
ccagcgaucuucccacauc

SEQ ID NO: 207171 - RNA, 19 nt, Homo sapiens
gagaaugucagaacucaag

SEQ ID NO: 207172 - RNA, 19 nt, Homo sapiens
cagccgauauagagucauu

SEQ ID NO: 207173 - RNA, 19 nt, Homo sapiens
uguccuaucucaacacuuc

SEQ ID NO: 207174 - RNA, 19 nt, Homo sapiens
acacugacuccauacauaa

SEQ ID NO: 207175 - RNA, 19 nt, Homo sapiens
ggucugguguaugcaaauu

SEQ ID NO: 207176 - RNA, 19 nt, Homo sapiens
gcacaaccugcuccgcuuu

SEQ ID NO: 207177 - RNA, 19 nt, Homo sapiens
ucaccagccucaacugugu

SEQ ID NO: 207178 - RNA, 19 nt, Homo sapiens
caccauacacaaguaaaua

SEQ ID NO: 207179 - RNA, 19 nt, Homo sapiens
ggacaagaagaaaggguau

SEQ ID NO: 207180 - RNA, 19 nt, Homo sapiens
cacaucagccucccgagua

SEQ ID NO: 207181 - RNA, 19 nt, Homo sapiens
aaccacaccuucugcuuug

SEQ ID NO: 207182 - RNA, 19 nt, Homo sapiens
gaccuuacuuaucucuguu

SEQ ID NO: 207183 - RNA, 19 nt, Homo sapiens
aauggagucucacuauguu

SEQ ID NO: 207184 - RNA, 19 nt, Homo sapiens
gaauacaagaacuuaggaa

SEQ ID NO: 207185 - RNA, 19 nt, Homo sapiens
ugaccuuacuuaucucugu

SEQ ID NO: 207186 - RNA, 19 nt, Homo sapiens
acacauacuuccuaauugc

SEQ ID NO: 207187 - RNA, 19 nt, Homo sapiens
aacacuuccucauguauuu

SEQ ID NO: 207188 - RNA, 19 nt, Homo sapiens
aaagacaaauagagaaggu

SEQ ID NO: 207189 - RNA, 19 nt, Homo sapiens
uacaagaacuuaggaagag

SEQ ID NO: 207190 - RNA, 19 nt, Homo sapiens
uacccaaccucaucucuuc

SEQ ID NO: 207191 - RNA, 19 nt, Homo sapiens
gcaaaccaucuccuucuca

SEQ ID NO: 207192 - RNA, 19 nt, Homo sapiens
uacacauacuuccuaauug

SEQ ID NO: 207193 - RNA, 19 nt, Homo sapiens
uagcugcgcuguguccuau

SEQ ID NO: 207194 - RNA, 19 nt, Homo sapiens
ucccaaagugcucagauua

SEQ ID NO: 207195 - RNA, 19 nt, Homo sapiens
gagugagguugguguguca

SEQ ID NO: 207196 - RNA, 19 nt, Homo sapiens
acaagaagaaaggguauuu

SEQ ID NO: 207197 - RNA, 19 nt, Homo sapiens
gaccgcaauucuaaguuuc

SEQ ID NO: 207198 - RNA, 19 nt, Homo sapiens
gcucccagaucccaucaca

SEQ ID NO: 207199 - RNA, 19 nt, Homo sapiens
gugcucagauuagagaugu

SEQ ID NO: 207200 - RNA, 19 nt, Homo sapiens
gcacagaauccccaguuuu

SEQ ID NO: 207201 - RNA, 19 nt, Homo sapiens
gggaccaggugcagcugaa

SEQ ID NO: 207202 - RNA, 19 nt, Homo sapiens
cagaucccaucacaguuug

SEQ ID NO: 207203 - RNA, 19 nt, Homo sapiens
cgccaucccucuacaucuu

SEQ ID NO: 207204 - RNA, 19 nt, Homo sapiens
uacauaaccuccuugaaaa

SEQ ID NO: 207205 - RNA, 19 nt, Homo sapiens
ggagaaggccaagaucaag

SEQ ID NO: 207206 - RNA, 19 nt, Homo sapiens
ucaccauccuccagacuuc

SEQ ID NO: 207207 - RNA, 19 nt, Homo sapiens
uugacacacugacuccaua

SEQ ID NO: 207208 - RNA, 19 nt, Homo sapiens
ggcuacacauacuuccuaa

SEQ ID NO: 207209 - RNA, 19 nt, Homo sapiens
gagggagaaugucagaacu

SEQ ID NO: 207210 - RNA, 19 nt, Homo sapiens
acauaagaccgcaauucua

SEQ ID NO: 207211 - RNA, 19 nt, Homo sapiens
auaaauggagucucacuau

SEQ ID NO: 207212 - RNA, 19 nt, Homo sapiens
acagcgaucuccaagucaa

SEQ ID NO: 207213 - RNA, 19 nt, Homo sapiens
aaagugcucagauuagaga

SEQ ID NO: 207214 - RNA, 19 nt, Homo sapiens
aaauggagucucacuaugu

SEQ ID NO: 207215 - RNA, 19 nt, Homo sapiens
uagcugggaccacaaaugu

SEQ ID NO: 207216 - RNA, 19 nt, Homo sapiens
ggaggagaugaguaaauau

SEQ ID NO: 207217 - RNA, 19 nt, Homo sapiens
gaaggaggagaugaguaaa

SEQ ID NO: 207218 - RNA, 19 nt, Homo sapiens
ccaaggcccugcacaaccu

SEQ ID NO: 207219 - RNA, 19 nt, Homo sapiens
cuacaccaauaucuacauc

SEQ ID NO: 207220 - RNA, 19 nt, Homo sapiens
gcucaccauacacaaguaa

SEQ ID NO: 207221 - RNA, 19 nt, Homo sapiens
gaaggugugggacaagaag

SEQ ID NO: 207222 - RNA, 19 nt, Homo sapiens
uaagaccgcaauucuaagu

SEQ ID NO: 207223 - RNA, 19 nt, Homo sapiens
gagucauuauguuugcaaa

SEQ ID NO: 207224 - RNA, 19 nt, Homo sapiens
gcucagauuagagauguga

SEQ ID NO: 207225 - RNA, 19 nt, Homo sapiens
auacaagaacuuaggaaga

SEQ ID NO: 207226 - RNA, 19 nt, Homo sapiens
ccgcaauucuaaguuucua

SEQ ID NO: 207227 - RNA, 19 nt, Homo sapiens
gaggaacagcacagccaaa

SEQ ID NO: 207228 - RNA, 19 nt, Homo sapiens
gcacacaccugaaacaugu

SEQ ID NO: 207229 - RNA, 19 nt, Homo sapiens
ccaaacagcagcuagaaua

SEQ ID NO: 207230 - RNA, 19 nt, Homo sapiens
gcaaacuccucaauaugau

SEQ ID NO: 207231 - RNA, 19 nt, Homo sapiens
ucugcaaacuccucaauau

SEQ ID NO: 207232 - RNA, 19 nt, Homo sapiens
gguguucgccugcuuguug

SEQ ID NO: 207233 - RNA, 19 nt, Homo sapiens
ugcaaacuccucaauauga

SEQ ID NO: 207234 - RNA, 19 nt, Homo sapiens
ucaauaugaucuucuccau

SEQ ID NO: 207235 - RNA, 19 nt, Homo sapiens
gaauacgcccugcucaucu

SEQ ID NO: 207236 - RNA, 19 nt, Homo sapiens
auuccgaacucacguggua

SEQ ID NO: 207237 - RNA, 19 nt, Homo sapiens
uguggguccuggugaagua

SEQ ID NO: 207238 - RNA, 19 nt, Homo sapiens
gcuuuaacccggugcucua

SEQ ID NO: 207239 - RNA, 19 nt, Homo sapiens
cuacaacuucacccuguuu

SEQ ID NO: 207240 - RNA, 19 nt, Homo sapiens
ccagagagcaccaccuuuu

SEQ ID NO: 207241 - RNA, 19 nt, Homo sapiens
uuaacccggugcucuaugu

SEQ ID NO: 207242 - RNA, 19 nt, Homo sapiens
uccacaaggugcuuucuuc

SEQ ID NO: 207243 - RNA, 19 nt, Homo sapiens
caacuucacccuguuucug

SEQ ID NO: 207244 - RNA, 19 nt, Homo sapiens
uggagucccucaccaacau

SEQ ID NO: 207245 - RNA, 19 nt, Homo sapiens
caaacagcagcuagaauac

SEQ ID NO: 207246 - RNA, 19 nt, Homo sapiens
guaccucaccuccgucuac

SEQ ID NO: 207247 - RNA, 19 nt, Homo sapiens
ggccaaacagcagcuagaa

SEQ ID NO: 207248 - RNA, 19 nt, Homo sapiens
cuacagcagcaucuucuuc

SEQ ID NO: 207249 - RNA, 19 nt, Homo sapiens
gagacuuccucugcaaacu

SEQ ID NO: 207250 - RNA, 19 nt, Homo sapiens
gggagacuuccucugcaaa

SEQ ID NO: 207251 - RNA, 19 nt, Homo sapiens
ggguccuggugaaguauga

SEQ ID NO: 207252 - RNA, 19 nt, Homo sapiens
ugggagacuuccucugcaa

SEQ ID NO: 207253 - RNA, 19 nt, Homo sapiens
gcugggugcugggagacuu

SEQ ID NO: 207254 - RNA, 19 nt, Homo sapiens
ccuacaacuucacccuguu

SEQ ID NO: 207255 - RNA, 19 nt, Homo sapiens
ggagacuuccucugcaaac

SEQ ID NO: 207256 - RNA, 19 nt, Homo sapiens
agaauacgcccugcucauc

SEQ ID NO: 207257 - RNA, 19 nt, Homo sapiens
gcacggucaagcucaucuu

SEQ ID NO: 207258 - RNA, 19 nt, Homo sapiens
caacaucuucauccucaac

SEQ ID NO: 207259 - RNA, 19 nt, Homo sapiens
auaacgcgcucaccuauua

SEQ ID NO: 207260 - RNA, 19 nt, Homo sapiens
ggccucaucuugcacuuug

SEQ ID NO: 207261 - RNA, 19 nt, Homo sapiens
gaucaaucccaucaucuau

SEQ ID NO: 207262 - RNA, 19 nt, Homo sapiens
guauaacgcgcucaccuau

SEQ ID NO: 207263 - RNA, 19 nt, Homo sapiens
gcuguggccucaucuugca

SEQ ID NO: 207264 - RNA, 19 nt, Homo sapiens
ucaaucccaucaucuaugc

SEQ ID NO: 207265 - RNA, 19 nt, Homo sapiens
cagaaaggguguggguaca

SEQ ID NO: 207266 - RNA, 19 nt, Homo sapiens
caucuugcacuuuguguuc

SEQ ID NO: 207267 - RNA, 19 nt, Homo sapiens
gggcuguggccucaucuug

SEQ ID NO: 207268 - RNA, 19 nt, Homo sapiens
uguauaacgcgcucaccua

SEQ ID NO: 207269 - RNA, 19 nt, Homo sapiens
cuacaacuccaugaucaau

SEQ ID NO: 207270 - RNA, 19 nt, Homo sapiens
acagugaucgcuggagaaa

SEQ ID NO: 207271 - RNA, 19 nt, Homo sapiens
gcuaccugucccuguauaa

SEQ ID NO: 207272 - RNA, 19 nt, Homo sapiens
gcacuuuguguuccaguac

SEQ ID NO: 207273 - RNA, 19 nt, Homo sapiens
gacagugaucgcuggagaa

SEQ ID NO: 207274 - RNA, 19 nt, Homo sapiens
uauaacgcgcucaccuauu

SEQ ID NO: 207275 - RNA, 19 nt, Homo sapiens
gaaccuccgccagcugaua

SEQ ID NO: 207276 - RNA, 19 nt, Homo sapiens
caccaucuguguccucuau

SEQ ID NO: 207277 - RNA, 19 nt, Homo sapiens
ccaagaagcgggugaccuu

SEQ ID NO: 207278 - RNA, 19 nt, Homo sapiens
ggcgguggcuguaccaguu

SEQ ID NO: 207279 - RNA, 19 nt, Homo sapiens
gcaugaagaccgucaccaa

SEQ ID NO: 207280 - RNA, 19 nt, Homo sapiens
gcaagcucaucguggcuau

SEQ ID NO: 207281 - RNA, 19 nt, Homo sapiens
gcaacuccgccgugcugua

SEQ ID NO: 207282 - RNA, 19 nt, Homo sapiens
gcuaucuccuacuucauca

SEQ ID NO: 207283 - RNA, 19 nt, Homo sapiens
ccagugcgugcuagucuuu

SEQ ID NO: 207284 - RNA, 19 nt, Homo sapiens
ccaucaacaucgccgacuu

SEQ ID NO: 207285 - RNA, 19 nt, Homo sapiens
uccgccagcugauaacuug

SEQ ID NO: 207286 - RNA, 19 nt, Homo sapiens
ucaccaaccuguucauccu

SEQ ID NO: 207287 - RNA, 19 nt, Homo sapiens
gaccgucaccaaccuguuc

SEQ ID NO: 207288 - RNA, 19 nt, Homo sapiens
ccaucuguguccucuauac

SEQ ID NO: 207289 - RNA, 19 nt, Homo sapiens
ucaucgcuaucuccuacuu

SEQ ID NO: 207290 - RNA, 19 nt, Homo sapiens
gccagugcgugcuagucuu

SEQ ID NO: 207291 - RNA, 19 nt, Homo sapiens
caucaacaucgccgacuuc

SEQ ID NO: 207292 - RNA, 19 nt, Homo sapiens
caacuccgccgugcuguac

SEQ ID NO: 207293 - RNA, 19 nt, Homo sapiens
ucguggcuaucgaccagua

SEQ ID NO: 207294 - RNA, 19 nt, Homo sapiens
ccgccgugcuguacguguu

SEQ ID NO: 207295 - RNA, 19 nt, Homo sapiens
ugaagaccgucaccaaccu

SEQ ID NO: 207296 - RNA, 19 nt, Homo sapiens
gaacuuccgcagcauauug

SEQ ID NO: 207297 - RNA, 19 nt, Homo sapiens
caacgucucucaggacaau

SEQ ID NO: 207298 - RNA, 19 nt, Homo sapiens
gaaggucgccagccugugu

SEQ ID NO: 207299 - RNA, 19 nt, Homo sapiens
caacacggccgucauccuu

SEQ ID NO: 207300 - RNA, 19 nt, Homo sapiens
cgucauccuuguaauccua

SEQ ID NO: 207301 - RNA, 19 nt, Homo sapiens
ccacugccguuccucuaug

SEQ ID NO: 207302 - RNA, 19 nt, Homo sapiens
guucugcccuucuucucuu

SEQ ID NO: 207303 - RNA, 19 nt, Homo sapiens
ugaugagcguggaccgaua

SEQ ID NO: 207304 - RNA, 19 nt, Homo sapiens
ugaagacggugaccaacgu

SEQ ID NO: 207305 - RNA, 19 nt, Homo sapiens
acacggccgucauccuugu

SEQ ID NO: 207306 - RNA, 19 nt, Homo sapiens
cuuucuagaugacaacuuc

SEQ ID NO: 207307 - RNA, 19 nt, Homo sapiens
gguacugcccgucaacauc

SEQ ID NO: 207308 - RNA, 19 nt, Homo sapiens
caguauguccuacgucauc

SEQ ID NO: 207309 - RNA, 19 nt, Homo sapiens
ccgagcaggucugguucaa

SEQ ID NO: 207310 - RNA, 19 nt, Homo sapiens
ccacugcccuucucauuug

SEQ ID NO: 207311 - RNA, 19 nt, Homo sapiens
cccaagaccucuauauuug

SEQ ID NO: 207312 - RNA, 19 nt, Homo sapiens
gaacuucagcucuuccuau

SEQ ID NO: 207313 - RNA, 19 nt, Homo sapiens
ggucauggccuacugcuau

SEQ ID NO: 207314 - RNA, 19 nt, Homo sapiens
ucugaggacugcaccauug

SEQ ID NO: 207315 - RNA, 19 nt, Homo sapiens
gcaccauugcugcuccuua

SEQ ID NO: 207316 - RNA, 19 nt, Homo sapiens
ggauguggaugcugcucuu

SEQ ID NO: 207317 - RNA, 19 nt, Homo sapiens
gcugcucuaugccuuugua

SEQ ID NO: 207318 - RNA, 19 nt, Homo sapiens
gcccagccaugguccuuga

SEQ ID NO: 207319 - RNA, 19 nt, Homo sapiens
gcugguggcuggcuuucug

SEQ ID NO: 207320 - RNA, 19 nt, Homo sapiens
cuucucauuuggaaacuaa

SEQ ID NO: 207321 - RNA, 19 nt, Homo sapiens
gcaggugcccucuucaaca

SEQ ID NO: 207322 - RNA, 19 nt, Homo sapiens
gcucuggccucugcaaagu

SEQ ID NO: 207323 - RNA, 19 nt, Homo sapiens
caccauugcugcuccuuag

SEQ ID NO: 207324 - RNA, 19 nt, Homo sapiens
ucauggaccugggcgcuuu

SEQ ID NO: 207325 - RNA, 19 nt, Homo sapiens
ccgcaacuguggccgagaa

SEQ ID NO: 207326 - RNA, 19 nt, Homo sapiens
guacaaggcauggcguaga

SEQ ID NO: 207327 - RNA, 19 nt, Homo sapiens
ggguagacguggccaaguc

SEQ ID NO: 207328 - RNA, 19 nt, Homo sapiens
gcuaaaugacgccgagguu

SEQ ID NO: 207329 - RNA, 19 nt, Homo sapiens
caagaccucuauauuugcu

SEQ ID NO: 207330 - RNA, 19 nt, Homo sapiens
caggugcccucuucaacau

SEQ ID NO: 207331 - RNA, 19 nt, Homo sapiens
cuggagaacuucagcucuu

SEQ ID NO: 207332 - RNA, 19 nt, Homo sapiens
gauucauccuggucugaga

SEQ ID NO: 207333 - RNA, 19 nt, Homo sapiens
ucaacccgcugcucuaugc

SEQ ID NO: 207334 - RNA, 19 nt, Homo sapiens
ggugcccucuucaacauca

SEQ ID NO: 207335 - RNA, 19 nt, Homo sapiens
ccucuacagccuccucuuu

SEQ ID NO: 207336 - RNA, 19 nt, Homo sapiens
gaccaccaagugcuaaaug

SEQ ID NO: 207337 - RNA, 19 nt, Homo sapiens
ccacugccaauacaacuuc

SEQ ID NO: 207338 - RNA, 19 nt, Homo sapiens
ugucuaaaauccugcuuaa

SEQ ID NO: 207339 - RNA, 19 nt, Homo sapiens
gagugaccaccaagugcua

SEQ ID NO: 207340 - RNA, 19 nt, Homo sapiens
ucuucaacaucaacuucua

SEQ ID NO: 207341 - RNA, 19 nt, Homo sapiens
uacaaggcauggcguagag

SEQ ID NO: 207342 - RNA, 19 nt, Homo sapiens
ccucaggccugggcuacau

SEQ ID NO: 207343 - RNA, 19 nt, Homo sapiens
gucauggccuacugcuaug

SEQ ID NO: 207344 - RNA, 19 nt, Homo sapiens
ugaccgcuaccugaacaua

SEQ ID NO: 207345 - RNA, 19 nt, Homo sapiens
caagaucgucaggaccaaa

SEQ ID NO: 207346 - RNA, 19 nt, Homo sapiens
cuucagcucuuccuaugac

SEQ ID NO: 207347 - RNA, 19 nt, Homo sapiens
cagcucuuccuaugacuau

SEQ ID NO: 207348 - RNA, 19 nt, Homo sapiens
accaccaagugcuaaauga

SEQ ID NO: 207349 - RNA, 19 nt, Homo sapiens
aacuucagcucuuccuaug

SEQ ID NO: 207350 - RNA, 19 nt, Homo sapiens
cuaaaauccugcuuaaaac

SEQ ID NO: 207351 - RNA, 19 nt, Homo sapiens
ccccaagaccucuauauuu

SEQ ID NO: 207352 - RNA, 19 nt, Homo sapiens
gccuccagcucagcaguga

SEQ ID NO: 207353 - RNA, 19 nt, Homo sapiens
cccacugcccuucucauuu

SEQ ID NO: 207354 - RNA, 19 nt, Homo sapiens
agaggcagccaucgucuuc

SEQ ID NO: 207355 - RNA, 19 nt, Homo sapiens
gcuuugaccgcuaccugaa

SEQ ID NO: 207356 - RNA, 19 nt, Homo sapiens
caggguuucugacuuauuu

SEQ ID NO: 207357 - RNA, 19 nt, Homo sapiens
caucgacccuuacgccuuu

SEQ ID NO: 207358 - RNA, 19 nt, Homo sapiens
gcgaggagcugcgcaaacu

SEQ ID NO: 207359 - RNA, 19 nt, Homo sapiens
gaggagcugcgcaaacugu

SEQ ID NO: 207360 - RNA, 19 nt, Homo sapiens
ucacaacucccgccaacca

SEQ ID NO: 207361 - RNA, 19 nt, Homo sapiens
ccccaggguuucugacuua

SEQ ID NO: 207362 - RNA, 19 nt, Homo sapiens
cccacgccaucgacccuua

SEQ ID NO: 207363 - RNA, 19 nt, Homo sapiens
uggucauccuccugucuua

SEQ ID NO: 207364 - RNA, 19 nt, Homo sapiens
ggagcugcgcaaacuguug

SEQ ID NO: 207365 - RNA, 19 nt, Homo sapiens
gcacaacgugacgaacuuc

SEQ ID NO: 207366 - RNA, 19 nt, Homo sapiens
ccuaucacguggagcucaa

SEQ ID NO: 207367 - RNA, 19 nt, Homo sapiens
ugcacaacgugacgaacuu

SEQ ID NO: 207368 - RNA, 19 nt, Homo sapiens
caucaacccugucauauau

SEQ ID NO: 207369 - RNA, 19 nt, Homo sapiens
gcacccauguuccugcuaa

SEQ ID NO: 207370 - RNA, 19 nt, Homo sapiens
ucagaccgcucaccaagaa

SEQ ID NO: 207371 - RNA, 19 nt, Homo sapiens
aaagcgcucugucucauuu

SEQ ID NO: 207372 - RNA, 19 nt, Homo sapiens
ugucauauaugcuuucaga

SEQ ID NO: 207373 - RNA, 19 nt, Homo sapiens
gagaggacggucacguuua

SEQ ID NO: 207374 - RNA, 19 nt, Homo sapiens
ggagaggacggucacguuu

SEQ ID NO: 207375 - RNA, 19 nt, Homo sapiens
caucaucaacccugucaua

SEQ ID NO: 207376 - RNA, 19 nt, Homo sapiens
gaggcacgcccaucagaua

SEQ ID NO: 207377 - RNA, 19 nt, Homo sapiens
gaacccucaucuccuguga

SEQ ID NO: 207378 - RNA, 19 nt, Homo sapiens
gaaagcgcucugucucauu

SEQ ID NO: 207379 - RNA, 19 nt, Homo sapiens
cacccucuauuccuugaua

SEQ ID NO: 207380 - RNA, 19 nt, Homo sapiens
gaaaccaagagauccagaa

SEQ ID NO: 207381 - RNA, 19 nt, Homo sapiens
ucaucaacccugucauaua

SEQ ID NO: 207382 - RNA, 19 nt, Homo sapiens
ggacggucacguuuaccua

SEQ ID NO: 207383 - RNA, 19 nt, Homo sapiens
aaaccaagagauccagaaa

SEQ ID NO: 207384 - RNA, 19 nt, Homo sapiens
agaaagcgcucugucucau

SEQ ID NO: 207385 - RNA, 19 nt, Homo sapiens
ggacucaucaccaauuuug

SEQ ID NO: 207386 - RNA, 19 nt, Homo sapiens
acccucaucuccugugaaa

SEQ ID NO: 207387 - RNA, 19 nt, Homo sapiens
caccuacaauuccaucauc

SEQ ID NO: 207388 - RNA, 19 nt, Homo sapiens
ucacuguacuacgcucuga

SEQ ID NO: 207389 - RNA, 19 nt, Homo sapiens
ucuguaagauugugaugag

SEQ ID NO: 207390 - RNA, 19 nt, Homo sapiens
agaggacggucacguuuac

SEQ ID NO: 207391 - RNA, 19 nt, Homo sapiens
agccugagcucguagucaa

SEQ ID NO: 207392 - RNA, 19 nt, Homo sapiens
ggaugccuuucacccucua

SEQ ID NO: 207393 - RNA, 19 nt, Homo sapiens
ugauagcggauuacaccua

SEQ ID NO: 207394 - RNA, 19 nt, Homo sapiens
accaagagauccagaaagc

SEQ ID NO: 207395 - RNA, 19 nt, Homo sapiens
gcucaugcuucagcucuac

SEQ ID NO: 207396 - RNA, 19 nt, Homo sapiens
uguuugcgcucaugcuuca

SEQ ID NO: 207397 - RNA, 19 nt, Homo sapiens
gacggucacguuuaccuau

SEQ ID NO: 207398 - RNA, 19 nt, Homo sapiens
ccuaccugcuucagucaga

SEQ ID NO: 207399 - RNA, 19 nt, Homo sapiens
gccucgggauuauuuagau

SEQ ID NO: 207400 - RNA, 19 nt, Homo sapiens
ggucacgaucggccucauu

SEQ ID NO: 207401 - RNA, 19 nt, Homo sapiens
ucaacccugucauauaugc

SEQ ID NO: 207402 - RNA, 19 nt, Homo sapiens
ccucgggauuauuuagaug

SEQ ID NO: 207403 - RNA, 19 nt, Homo sapiens
uguccuuccucuucauguu

SEQ ID NO: 207404 - RNA, 19 nt, Homo sapiens
auuccuugauagcggauua

SEQ ID NO: 207405 - RNA, 19 nt, Homo sapiens
gccauugugguccuuauca

SEQ ID NO: 207406 - RNA, 19 nt, Homo sapiens
ccauugugguccuuaucau

SEQ ID NO: 207407 - RNA, 19 nt, Homo sapiens
guccuuccucuucauguuu

SEQ ID NO: 207408 - RNA, 19 nt, Homo sapiens
ccauguuccugcuaauagg

SEQ ID NO: 207409 - RNA, 19 nt, Homo sapiens
ccaccuacgucaccaagga

SEQ ID NO: 207410 - RNA, 19 nt, Homo sapiens
acacgcugcucaccaggaa

SEQ ID NO: 207411 - RNA, 19 nt, Homo sapiens
gcaucgugcugcucuucug

SEQ ID NO: 207412 - RNA, 19 nt, Homo sapiens
gugcgguggccuccaugua

SEQ ID NO: 207413 - RNA, 19 nt, Homo sapiens
gcucuucggccuggacuuc

SEQ ID NO: 207414 - RNA, 19 nt, Homo sapiens
aaagggagcuccuacauga

SEQ ID NO: 207415 - RNA, 19 nt, Homo sapiens
aaaggcaacuccaauuaaa

SEQ ID NO: 207416 - RNA, 19 nt, Homo sapiens
uaaagaagcaucucuagga

SEQ ID NO: 207417 - RNA, 19 nt, Homo sapiens
uacaugaucuccgucaaua

SEQ ID NO: 207418 - RNA, 19 nt, Homo sapiens
ucacgcugauugaugauaa

SEQ ID NO: 207419 - RNA, 19 nt, Homo sapiens
ggauaaagaagcaucucua

SEQ ID NO: 207420 - RNA, 19 nt, Homo sapiens
gcggcaagaacacuauuua

SEQ ID NO: 207421 - RNA, 19 nt, Homo sapiens
ccagggagcucacgcugau

SEQ ID NO: 207422 - RNA, 19 nt, Homo sapiens
gccauacugugcagagaaa

SEQ ID NO: 207423 - RNA, 19 nt, Homo sapiens
cgacaucuuuaucaucaau

SEQ ID NO: 207424 - RNA, 19 nt, Homo sapiens
agacugaucgacaucuuua

SEQ ID NO: 207425 - RNA, 19 nt, Homo sapiens
gaguagcacugagacauca

SEQ ID NO: 207426 - RNA, 19 nt, Homo sapiens
gaagcugugugcccauuac

SEQ ID NO: 207427 - RNA, 19 nt, Homo sapiens
gcaaagggagcuccuacau

SEQ ID NO: 207428 - RNA, 19 nt, Homo sapiens
gagacccacucccauguuc

SEQ ID NO: 207429 - RNA, 19 nt, Homo sapiens
ugucaacccuuucauuuac

SEQ ID NO: 207430 - RNA, 19 nt, Homo sapiens
gugucaacccuuucauuua

SEQ ID NO: 207431 - RNA, 19 nt, Homo sapiens
gauaaagaagcaucucuag

SEQ ID NO: 207432 - RNA, 19 nt, Homo sapiens
ucaaguuccuggccauugu

SEQ ID NO: 207433 - RNA, 19 nt, Homo sapiens
ggaagcugugugcccauua

SEQ ID NO: 207434 - RNA, 19 nt, Homo sapiens
uuacaccucugucuuccuu

SEQ ID NO: 207435 - RNA, 19 nt, Homo sapiens
caaagggagcuccuacaug

SEQ ID NO: 207436 - RNA, 19 nt, Homo sapiens
gaguggacccuuggcauuu

SEQ ID NO: 207437 - RNA, 19 nt, Homo sapiens
uggcugcccuucaauacuu

SEQ ID NO: 207438 - RNA, 19 nt, Homo sapiens
caugaucuccgucaauaug

SEQ ID NO: 207439 - RNA, 19 nt, Homo sapiens
ucaacccuuucauuuacua

SEQ ID NO: 207440 - RNA, 19 nt, Homo sapiens
ccaauuaaacucauauggu

SEQ ID NO: 207441 - RNA, 19 nt, Homo sapiens
caacuccaauuaaacucau

SEQ ID NO: 207442 - RNA, 19 nt, Homo sapiens
gagcucacgcugauugaug

SEQ ID NO: 207443 - RNA, 19 nt, Homo sapiens
gcaacuccaauuaaacuca

SEQ ID NO: 207444 - RNA, 19 nt, Homo sapiens
uccaggaaauucagaagga

SEQ ID NO: 207445 - RNA, 19 nt, Homo sapiens
ggaguagcacugagacauc

SEQ ID NO: 207446 - RNA, 19 nt, Homo sapiens
cuugugcccuugccugaaa

SEQ ID NO: 207447 - RNA, 19 nt, Homo sapiens
ugugucaacccuuucauuu

SEQ ID NO: 207448 - RNA, 19 nt, Homo sapiens
cuauuuacccucagcuauu

SEQ ID NO: 207449 - RNA, 19 nt, Homo sapiens
ccagucguauccaggaaau

SEQ ID NO: 207450 - RNA, 19 nt, Homo sapiens
gccgaagacugaucgacau

SEQ ID NO: 207451 - RNA, 19 nt, Homo sapiens
ugauugaugauaagccaua

SEQ ID NO: 207452 - RNA, 19 nt, Homo sapiens
acagcugugucaacccuuu

SEQ ID NO: 207453 - RNA, 19 nt, Homo sapiens
cuacgagcccaaacucuga

SEQ ID NO: 207454 - RNA, 19 nt, Homo sapiens
gaccugcuacuguugcauu

SEQ ID NO: 207455 - RNA, 19 nt, Homo sapiens
gaucgacaucuuuaucauc

SEQ ID NO: 207456 - RNA, 19 nt, Homo sapiens
caccuucauucaugcagaa

SEQ ID NO: 207457 - RNA, 19 nt, Homo sapiens
ggaagaggucugugucacu

SEQ ID NO: 207458 - RNA, 19 nt, Homo sapiens
gaggaagaggucuguguca

SEQ ID NO: 207459 - RNA, 19 nt, Homo sapiens
ugaguggacccuuggcauu

SEQ ID NO: 207460 - RNA, 19 nt, Homo sapiens
uauuuacccucagcuauuc

SEQ ID NO: 207461 - RNA, 19 nt, Homo sapiens
gcugaagaaaucuauaaag

SEQ ID NO: 207462 - RNA, 19 nt, Homo sapiens
gcuauucuucagcuuggua

SEQ ID NO: 207463 - RNA, 19 nt, Homo sapiens
gauuauuacuaugcuacga

SEQ ID NO: 207464 - RNA, 19 nt, Homo sapiens
ggcugccucugacuucauu

SEQ ID NO: 207465 - RNA, 19 nt, Homo sapiens
ucuccuggcugcccuucaa

SEQ ID NO: 207466 - RNA, 19 nt, Homo sapiens
aacuaugacuuugggagua

SEQ ID NO: 207467 - RNA, 19 nt, Homo sapiens
ggccuuaauuuucaccuuu

SEQ ID NO: 207468 - RNA, 19 nt, Homo sapiens
ccacucccauguuccuuac

SEQ ID NO: 207469 - RNA, 19 nt, Homo sapiens
gcccuucaauacuuucaag

SEQ ID NO: 207470 - RNA, 19 nt, Homo sapiens
ucaugggagcguugcauuu

SEQ ID NO: 207471 - RNA, 19 nt, Homo sapiens
ucauucaugcagaagauuu

SEQ ID NO: 207472 - RNA, 19 nt, Homo sapiens
ugggagcguugcauuucaa

SEQ ID NO: 207473 - RNA, 19 nt, Homo sapiens
aaaaggcaacuccaauuaa

SEQ ID NO: 207474 - RNA, 19 nt, Homo sapiens
ggccagucguauccaggaa

SEQ ID NO: 207475 - RNA, 19 nt, Homo sapiens
cuacaugaucuccgucaau

SEQ ID NO: 207476 - RNA, 19 nt, Homo sapiens
caugggagcguugcauuuc

SEQ ID NO: 207477 - RNA, 19 nt, Homo sapiens
aucgacaucuuuaucauca

SEQ ID NO: 207478 - RNA, 19 nt, Homo sapiens
auugugaccugcuacuguu

SEQ ID NO: 207479 - RNA, 19 nt, Homo sapiens
gagcccaaacucugacauc

SEQ ID NO: 207480 - RNA, 19 nt, Homo sapiens
ucaaucuggcugccucuga

SEQ ID NO: 207481 - RNA, 19 nt, Homo sapiens
ggaggaggaagaggucugu

SEQ ID NO: 207482 - RNA, 19 nt, Homo sapiens
gggaguagcacugagacau

SEQ ID NO: 207483 - RNA, 19 nt, Homo sapiens
guggcagccuuucuugucu

SEQ ID NO: 207484 - RNA, 19 nt, Homo sapiens
ggaaauucagaaggacaga

SEQ ID NO: 207485 - RNA, 19 nt, Homo sapiens
guacggaccauaaauauaa

SEQ ID NO: 207486 - RNA, 19 nt, Homo sapiens
caagagagaugcugaaacu

SEQ ID NO: 207487 - RNA, 19 nt, Homo sapiens
caagcaaccugaaaucuca

SEQ ID NO: 207488 - RNA, 19 nt, Homo sapiens
gcagauauuucccuaacau

SEQ ID NO: 207489 - RNA, 19 nt, Homo sapiens
gaaaucgcaugccgucuca

SEQ ID NO: 207490 - RNA, 19 nt, Homo sapiens
gggaaccacuggccauuug

SEQ ID NO: 207491 - RNA, 19 nt, Homo sapiens
ggacaagcaugugcaguca

SEQ ID NO: 207492 - RNA, 19 nt, Homo sapiens
cagcagaugcccaccauuu

SEQ ID NO: 207493 - RNA, 19 nt, Homo sapiens
agacacaggccacacauuu

SEQ ID NO: 207494 - RNA, 19 nt, Homo sapiens
gacacacacugccugaguu

SEQ ID NO: 207495 - RNA, 19 nt, Homo sapiens
gaacaaccccugaacaaug

SEQ ID NO: 207496 - RNA, 19 nt, Homo sapiens
gagcgcagacuguuuagga

SEQ ID NO: 207497 - RNA, 19 nt, Homo sapiens
aacuguagcuuuaagacua

SEQ ID NO: 207498 - RNA, 19 nt, Homo sapiens
cgccuagucucaacccaua

SEQ ID NO: 207499 - RNA, 19 nt, Homo sapiens
ccuucuaccuucuggauuu

SEQ ID NO: 207500 - RNA, 19 nt, Homo sapiens
gccgagcgcagacuguuua

SEQ ID NO: 207501 - RNA, 19 nt, Homo sapiens
ucaccacggucaccugcua

SEQ ID NO: 207502 - RNA, 19 nt, Homo sapiens
cagcacagcucuggauucu

SEQ ID NO: 207503 - RNA, 19 nt, Homo sapiens
aagcaugaauggccuugaa

SEQ ID NO: 207504 - RNA, 19 nt, Homo sapiens
gaacaauggaggccuuucu

SEQ ID NO: 207505 - RNA, 19 nt, Homo sapiens
ccauagugcuggccaucuu

SEQ ID NO: 207506 - RNA, 19 nt, Homo sapiens
cggcgaggcucagcagaaa

SEQ ID NO: 207507 - RNA, 19 nt, Homo sapiens
ccuagacacucaacgacuu

SEQ ID NO: 207508 - RNA, 19 nt, Homo sapiens
gcaagcaaccugaaaucuc

SEQ ID NO: 207509 - RNA, 19 nt, Homo sapiens
gcuagaggauguccaaacg

SEQ ID NO: 207510 - RNA, 19 nt, Homo sapiens
ucuucuaccucaacaugua

SEQ ID NO: 207511 - RNA, 19 nt, Homo sapiens
gugcagauauuucccuaac

SEQ ID NO: 207512 - RNA, 19 nt, Homo sapiens
ugagcuauuucccuugcua

SEQ ID NO: 207513 - RNA, 19 nt, Homo sapiens
cuggaucucuccugcugua

SEQ ID NO: 207514 - RNA, 19 nt, Homo sapiens
caauggaggccuuucuuuc

SEQ ID NO: 207515 - RNA, 19 nt, Homo sapiens
gaggaggccggaagaacaa

SEQ ID NO: 207516 - RNA, 19 nt, Homo sapiens
caucagcgccgaccguuuc

SEQ ID NO: 207517 - RNA, 19 nt, Homo sapiens
cuauuucccuugcuagugu

SEQ ID NO: 207518 - RNA, 19 nt, Homo sapiens
gcgaggcucagcagaaaga

SEQ ID NO: 207519 - RNA, 19 nt, Homo sapiens
gcagaugcccaccauuucu

SEQ ID NO: 207520 - RNA, 19 nt, Homo sapiens
gcagcuagaggauguccaa

SEQ ID NO: 207521 - RNA, 19 nt, Homo sapiens
gagagaggaggccggaaga

SEQ ID NO: 207522 - RNA, 19 nt, Homo sapiens
agaagcgccucaagaccaa

SEQ ID NO: 207523 - RNA, 19 nt, Homo sapiens
gcagacuguuuaggacuca

SEQ ID NO: 207524 - RNA, 19 nt, Homo sapiens
gauauuucccuaacauguc

SEQ ID NO: 207525 - RNA, 19 nt, Homo sapiens
cagcggacgucagcacuca

SEQ ID NO: 207526 - RNA, 19 nt, Homo sapiens
acacaggccacacauuuca

SEQ ID NO: 207527 - RNA, 19 nt, Homo sapiens
acaauggaggccuuucuuu

SEQ ID NO: 207528 - RNA, 19 nt, Homo sapiens
acuguagcuuuaagacuaa

SEQ ID NO: 207529 - RNA, 19 nt, Homo sapiens
uugcuagugugcagauauu

SEQ ID NO: 207530 - RNA, 19 nt, Homo sapiens
acacacugccugaguugaa

SEQ ID NO: 207531 - RNA, 19 nt, Homo sapiens
agacgccacuggagaacau

SEQ ID NO: 207532 - RNA, 19 nt, Homo sapiens
gggagggagucucaauacu

SEQ ID NO: 207533 - RNA, 19 nt, Homo sapiens
ucaccggcuuccucuucua

SEQ ID NO: 207534 - RNA, 19 nt, Homo sapiens
ggcaauacccuggcucugu

SEQ ID NO: 207535 - RNA, 19 nt, Homo sapiens
gcuguucgccuccuucuac

SEQ ID NO: 207536 - RNA, 19 nt, Homo sapiens
uguacggaccauaaauaua

SEQ ID NO: 207537 - RNA, 19 nt, Homo sapiens
gacacaggccacacauuuc

SEQ ID NO: 207538 - RNA, 19 nt, Homo sapiens
gcccaccauuucucuagau

SEQ ID NO: 207539 - RNA, 19 nt, Homo sapiens
guggagaagcgccucaaga

SEQ ID NO: 207540 - RNA, 19 nt, Homo sapiens
ggaccauaaauauaacugu

SEQ ID NO: 207541 - RNA, 19 nt, Homo sapiens
gagacacaggccacacauu

SEQ ID NO: 207542 - RNA, 19 nt, Homo sapiens
ggucugaucaccaacuucu

SEQ ID NO: 207543 - RNA, 19 nt, Homo sapiens
gcgcaugaucgccauagug

SEQ ID NO: 207544 - RNA, 19 nt, Homo sapiens
gcuagugugcagauauuuc

SEQ ID NO: 207545 - RNA, 19 nt, Homo sapiens
gcaugaauggccuugaagu

SEQ ID NO: 207546 - RNA, 19 nt, Homo sapiens
ccagcaagcaaccugaaau

SEQ ID NO: 207547 - RNA, 19 nt, Homo sapiens
uuuguacggaccauaaaua

SEQ ID NO: 207548 - RNA, 19 nt, Homo sapiens
cagcaagcaaccugaaauc

SEQ ID NO: 207549 - RNA, 19 nt, Homo sapiens
ccaaggcagugcgcaugau

SEQ ID NO: 207550 - RNA, 19 nt, Homo sapiens
gcuccuagacacucaacga

SEQ ID NO: 207551 - RNA, 19 nt, Homo sapiens
caggucugaucaccaacuu

SEQ ID NO: 207552 - RNA, 19 nt, Homo sapiens
cacagaccgugcagaccaa

SEQ ID NO: 207553 - RNA, 19 nt, Homo sapiens
caugaauggccuugaagug

SEQ ID NO: 207554 - RNA, 19 nt, Homo sapiens
ugccugaguugaagagaca

SEQ ID NO: 207555 - RNA, 19 nt, Homo sapiens
ggcugcaaaugacccagaa

SEQ ID NO: 207556 - RNA, 19 nt, Homo sapiens
acucaacgacuucaucugu

SEQ ID NO: 207557 - RNA, 19 nt, Homo sapiens
cuacaauggcuccuagaca

SEQ ID NO: 207558 - RNA, 19 nt, Homo sapiens
gaagaacaaccccugaaca

SEQ ID NO: 207559 - RNA, 19 nt, Homo sapiens
agaggaggccggaagaaca

SEQ ID NO: 207560 - RNA, 19 nt, Homo sapiens
gccuucaccuucccguuca

SEQ ID NO: 207561 - RNA, 19 nt, Homo sapiens
gcaucagcgccgaccguuu

SEQ ID NO: 207562 - RNA, 19 nt, Homo sapiens
gaucucuccugcuguaacc

SEQ ID NO: 207563 - RNA, 19 nt, Homo sapiens
gagaggaggccggaagaac

SEQ ID NO: 207564 - RNA, 19 nt, Homo sapiens
ccuagucucaacccauaaa

SEQ ID NO: 207565 - RNA, 19 nt, Homo sapiens
gccacgcccugugcaacuu

SEQ ID NO: 207566 - RNA, 19 nt, Homo sapiens
ccugcuaccugcugaucau

SEQ ID NO: 207567 - RNA, 19 nt, Homo sapiens
ggacaggaguuucuaagua

SEQ ID NO: 207568 - RNA, 19 nt, Homo sapiens
uaacaucacugcauuaugg

SEQ ID NO: 207569 - RNA, 19 nt, Homo sapiens
gaaccacgguaaccaucua

SEQ ID NO: 207570 - RNA, 19 nt, Homo sapiens
gacaggaguuucuaaguau

SEQ ID NO: 207571 - RNA, 19 nt, Homo sapiens
gaaccucacucgacugaca

SEQ ID NO: 207572 - RNA, 19 nt, Homo sapiens
agacaaagcagcaauuaaa

SEQ ID NO: 207573 - RNA, 19 nt, Homo sapiens
uaacuacucuggcgucaau

SEQ ID NO: 207574 - RNA, 19 nt, Homo sapiens
ccaacaagcuguaaaauga

SEQ ID NO: 207575 - RNA, 19 nt, Homo sapiens
agaagcaacucaaagauau

SEQ ID NO: 207576 - RNA, 19 nt, Homo sapiens
gcacgugucuggaugugau

SEQ ID NO: 207577 - RNA, 19 nt, Homo sapiens
caagauuucugacaucauc

SEQ ID NO: 207578 - RNA, 19 nt, Homo sapiens
gugggagucuggauaauga

SEQ ID NO: 207579 - RNA, 19 nt, Homo sapiens
cagaagcaacucaaagaua

SEQ ID NO: 207580 - RNA, 19 nt, Homo sapiens
ccacaucuguuucgcuuuc

SEQ ID NO: 207581 - RNA, 19 nt, Homo sapiens
guaauuaccuucgaagcau

SEQ ID NO: 207582 - RNA, 19 nt, Homo sapiens
ccaccugccucaagauuuc

SEQ ID NO: 207583 - RNA, 19 nt, Homo sapiens
acagauacauggccauugu

SEQ ID NO: 207584 - RNA, 19 nt, Homo sapiens
gucaauggauauucuguau

SEQ ID NO: 207585 - RNA, 19 nt, Homo sapiens
gagacaaagcagcaauuaa

SEQ ID NO: 207586 - RNA, 19 nt, Homo sapiens
cuauagcuguaucuucaua

SEQ ID NO: 207587 - RNA, 19 nt, Homo sapiens
ucauuagugucaugcuaua

SEQ ID NO: 207588 - RNA, 19 nt, Homo sapiens
cuauaaagacccagauaaa

SEQ ID NO: 207589 - RNA, 19 nt, Homo sapiens
auaaagacccagauaaaga

SEQ ID NO: 207590 - RNA, 19 nt, Homo sapiens
ucauuucaaucccaucaaa

SEQ ID NO: 207591 - RNA, 19 nt, Homo sapiens
ucuacuacaucguuucaaa

SEQ ID NO: 207592 - RNA, 19 nt, Homo sapiens
aaggagaaguccauaagga

SEQ ID NO: 207593 - RNA, 19 nt, Homo sapiens
ggcauuaguggacuugaua

SEQ ID NO: 207594 - RNA, 19 nt, Homo sapiens
caaagcagcaauuaaaguc

SEQ ID NO: 207595 - RNA, 19 nt, Homo sapiens
ucacuucacuaacuacucu

SEQ ID NO: 207596 - RNA, 19 nt, Homo sapiens
uggaugugauucucuacua

SEQ ID NO: 207597 - RNA, 19 nt, Homo sapiens
gcuacuuggucauuauuca

SEQ ID NO: 207598 - RNA, 19 nt, Homo sapiens
cuucuugccuuuauuagug

SEQ ID NO: 207599 - RNA, 19 nt, Homo sapiens
aagaagagaaccacgguaa

SEQ ID NO: 207600 - RNA, 19 nt, Homo sapiens
gcuauaccguaauuaccuu

SEQ ID NO: 207601 - RNA, 19 nt, Homo sapiens
gagaaguccauaaggauca

SEQ ID NO: 207602 - RNA, 19 nt, Homo sapiens
uugcagcccuugucuucua

SEQ ID NO: 207603 - RNA, 19 nt, Homo sapiens
uaacagaagcaacucaaag

SEQ ID NO: 207604 - RNA, 19 nt, Homo sapiens
ggugcuacuuggucauuau

SEQ ID NO: 207605 - RNA, 19 nt, Homo sapiens
uaacagcucacauccagau

SEQ ID NO: 207606 - RNA, 19 nt, Homo sapiens
uaucaugccuaccaacaag

SEQ ID NO: 207607 - RNA, 19 nt, Homo sapiens
gucaugcuauaccguaauu

SEQ ID NO: 207608 - RNA, 19 nt, Homo sapiens
ccagaaagagcuauuuuaa

SEQ ID NO: 207609 - RNA, 19 nt, Homo sapiens
agcuguaucuucauaauug

SEQ ID NO: 207610 - RNA, 19 nt, Homo sapiens
gccaagcguuacacuggaa

SEQ ID NO: 207611 - RNA, 19 nt, Homo sapiens
gacuuuacccuuucgaaug

SEQ ID NO: 207612 - RNA, 19 nt, Homo sapiens
agagacaaagcagcaauua

SEQ ID NO: 207613 - RNA, 19 nt, Homo sapiens
ccagaugaauacaaaauug

SEQ ID NO: 207614 - RNA, 19 nt, Homo sapiens
ggaugugauucucuacuac

SEQ ID NO: 207615 - RNA, 19 nt, Homo sapiens
ucugacaucaucuaucuaa

SEQ ID NO: 207616 - RNA, 19 nt, Homo sapiens
ccacgguaaccaucuauau

SEQ ID NO: 207617 - RNA, 19 nt, Homo sapiens
ccugaacaaucaagaucaa

SEQ ID NO: 207618 - RNA, 19 nt, Homo sapiens
uaaguaucaugccuaccaa

SEQ ID NO: 207619 - RNA, 19 nt, Homo sapiens
acucuggcgucaauggaua

SEQ ID NO: 207620 - RNA, 19 nt, Homo sapiens
caggugcucgucugcuuua

SEQ ID NO: 207621 - RNA, 19 nt, Homo sapiens
ucuauaaagacccagauaa

SEQ ID NO: 207622 - RNA, 19 nt, Homo sapiens
gcguuacacuggaaacuac

SEQ ID NO: 207623 - RNA, 19 nt, Homo sapiens
gcucgagucauuaguguca

SEQ ID NO: 207624 - RNA, 19 nt, Homo sapiens
gcugaaacccaaagucaag

SEQ ID NO: 207625 - RNA, 19 nt, Homo sapiens
gcaggacgucuaagcugaa

SEQ ID NO: 207626 - RNA, 19 nt, Homo sapiens
auaaugacuuuacccuuuc

SEQ ID NO: 207627 - RNA, 19 nt, Homo sapiens
gcccuugucuucuauagcu

SEQ ID NO: 207628 - RNA, 19 nt, Homo sapiens
aagaucaaccugucccuuu

SEQ ID NO: 207629 - RNA, 19 nt, Homo sapiens
guaaaaugaucacccugaa

SEQ ID NO: 207630 - RNA, 19 nt, Homo sapiens
cuacggucacuaagcaaua

SEQ ID NO: 207631 - RNA, 19 nt, Homo sapiens
gggugcuacuuggucauua

SEQ ID NO: 207632 - RNA, 19 nt, Homo sapiens
gacaaagcagcaauuaaag

SEQ ID NO: 207633 - RNA, 19 nt, Homo sapiens
guacgccaaagaacuuaaa

SEQ ID NO: 207634 - RNA, 19 nt, Homo sapiens
agauaucccuucgacagaa

SEQ ID NO: 207635 - RNA, 19 nt, Homo sapiens
uuucugacaucaucuaucu

SEQ ID NO: 207636 - RNA, 19 nt, Homo sapiens
ccucaagauuucugacauc

SEQ ID NO: 207637 - RNA, 19 nt, Homo sapiens
uauuagugcugacagauac

SEQ ID NO: 207638 - RNA, 19 nt, Homo sapiens
gauggacaggaguuucuaa

SEQ ID NO: 207639 - RNA, 19 nt, Homo sapiens
uuuaccaccuuccucauga

SEQ ID NO: 207640 - RNA, 19 nt, Homo sapiens
ucaaggagaaguccauaag

SEQ ID NO: 207641 - RNA, 19 nt, Homo sapiens
ucaguuguaccaccaagaa

SEQ ID NO: 207642 - RNA, 19 nt, Homo sapiens
uuuccgaucugguagucua

SEQ ID NO: 207643 - RNA, 19 nt, Homo sapiens
agucauuagugucaugcua

SEQ ID NO: 207644 - RNA, 19 nt, Homo sapiens
gaagcaacucaaagauauc

SEQ ID NO: 207645 - RNA, 19 nt, Homo sapiens
uggcuucuugccuuuauua

SEQ ID NO: 207646 - RNA, 19 nt, Homo sapiens
uucuauagcuguaucuuca

SEQ ID NO: 207647 - RNA, 19 nt, Homo sapiens
gugcucgucugcuuuaugc

SEQ ID NO: 207648 - RNA, 19 nt, Homo sapiens
caggacgucuaagcugaaa

SEQ ID NO: 207649 - RNA, 19 nt, Homo sapiens
uauaaagacccagauaaag

SEQ ID NO: 207650 - RNA, 19 nt, Homo sapiens
acgguaaccaucuauauga

SEQ ID NO: 207651 - RNA, 19 nt, Homo sapiens
guuaacaucacugcauuau

SEQ ID NO: 207652 - RNA, 19 nt, Homo sapiens
cuguuucgcuuuccugaug

SEQ ID NO: 207653 - RNA, 19 nt, Homo sapiens
uaaagacccagauaaagac

SEQ ID NO: 207654 - RNA, 19 nt, Homo sapiens
ccucugcuacugcucuaua

SEQ ID NO: 207655 - RNA, 19 nt, Homo sapiens
gaucaaccugucccuuuua

SEQ ID NO: 207656 - RNA, 19 nt, Homo sapiens
aacagaagcaacucaaaga

SEQ ID NO: 207657 - RNA, 19 nt, Homo sapiens
cgaaguacgccaaagaacu

SEQ ID NO: 207658 - RNA, 19 nt, Homo sapiens
gccgaaguacgccaaagaa

SEQ ID NO: 207659 - RNA, 19 nt, Homo sapiens
uauggcuucuugccuuuau

SEQ ID NO: 207660 - RNA, 19 nt, Homo sapiens
gaagagaaccacgguaacc

SEQ ID NO: 207661 - RNA, 19 nt, Homo sapiens
cauuauggguuuucaguug

SEQ ID NO: 207662 - RNA, 19 nt, Homo sapiens
ggucacuaagcaauauaaa

SEQ ID NO: 207663 - RNA, 19 nt, Homo sapiens
cuucgaagcaugcgcagaa

SEQ ID NO: 207664 - RNA, 19 nt, Homo sapiens
uaccguaauuaccuucgaa

SEQ ID NO: 207665 - RNA, 19 nt, Homo sapiens
acaaagcagcaauuaaagu

SEQ ID NO: 207666 - RNA, 19 nt, Homo sapiens
ccauaaggaucaucaucac

SEQ ID NO: 207667 - RNA, 19 nt, Homo sapiens
gcaauucccugguuuguuu

SEQ ID NO: 207668 - RNA, 19 nt, Homo sapiens
aaacagaccuucacuaugu

SEQ ID NO: 207669 - RNA, 19 nt, Homo sapiens
gccaauaccugauggaauu

SEQ ID NO: 207670 - RNA, 19 nt, Homo sapiens
ggacagucauuguaacuau

SEQ ID NO: 207671 - RNA, 19 nt, Homo sapiens
ggacaaaagugaaaacuau

SEQ ID NO: 207672 - RNA, 19 nt, Homo sapiens
gaucuuugaugcaggcuuu

SEQ ID NO: 207673 - RNA, 19 nt, Homo sapiens
gcaagguugugcgauauuu

SEQ ID NO: 207674 - RNA, 19 nt, Homo sapiens
gauuccaucuguccucaua

SEQ ID NO: 207675 - RNA, 19 nt, Homo sapiens
ccaaagacucgaucuauga

SEQ ID NO: 207676 - RNA, 19 nt, Homo sapiens
uaacucaaauccaccaaau

SEQ ID NO: 207677 - RNA, 19 nt, Homo sapiens
gaagcaaugccuauacuau

SEQ ID NO: 207678 - RNA, 19 nt, Homo sapiens
gauaacagcaagccacauu

SEQ ID NO: 207679 - RNA, 19 nt, Homo sapiens
ccaaacagaccuucacuau

SEQ ID NO: 207680 - RNA, 19 nt, Homo sapiens
caaauccaccaaauacuuu

SEQ ID NO: 207681 - RNA, 19 nt, Homo sapiens
ucacauggauauccuuuag

SEQ ID NO: 207682 - RNA, 19 nt, Homo sapiens
aaacuacguuggcauuuca

SEQ ID NO: 207683 - RNA, 19 nt, Homo sapiens
uguccucuaugaaauguua

SEQ ID NO: 207684 - RNA, 19 nt, Homo sapiens
gcaagccacauuugauuau

SEQ ID NO: 207685 - RNA, 19 nt, Homo sapiens
gcauucauuuguuuacugu

SEQ ID NO: 207686 - RNA, 19 nt, Homo sapiens
ccaaaacuauuaccaaaga

SEQ ID NO: 207687 - RNA, 19 nt, Homo sapiens
acauggauauccuuuaguu

SEQ ID NO: 207688 - RNA, 19 nt, Homo sapiens
ucacagcuaucacauggau

SEQ ID NO: 207689 - RNA, 19 nt, Homo sapiens
gacagucauuguaacuauu

SEQ ID NO: 207690 - RNA, 19 nt, Homo sapiens
ugacagagaagccaaggaa

SEQ ID NO: 207691 - RNA, 19 nt, Homo sapiens
gaggagcacaguuggauga

SEQ ID NO: 207692 - RNA, 19 nt, Homo sapiens
ugacucauuugacagagaa

SEQ ID NO: 207693 - RNA, 19 nt, Homo sapiens
uaacagcaagccacauuug

SEQ ID NO: 207694 - RNA, 19 nt, Homo sapiens
ccucuaaaccuacucugua

SEQ ID NO: 207695 - RNA, 19 nt, Homo sapiens
cgugcaagguugugcgaua

SEQ ID NO: 207696 - RNA, 19 nt, Homo sapiens
uaagugaggagcacaguug

SEQ ID NO: 207697 - RNA, 19 nt, Homo sapiens
aaccgcagcugcacugaaa

SEQ ID NO: 207698 - RNA, 19 nt, Homo sapiens
cagcaagccacauuugauu

SEQ ID NO: 207699 - RNA, 19 nt, Homo sapiens
ucaaauccaccaaauacuu

SEQ ID NO: 207700 - RNA, 19 nt, Homo sapiens
caagccacauuugauuauu

SEQ ID NO: 207701 - RNA, 19 nt, Homo sapiens
ccuacucuguauucaauuu

SEQ ID NO: 207702 - RNA, 19 nt, Homo sapiens
uaagaaaaguucccuuguu

SEQ ID NO: 207703 - RNA, 19 nt, Homo sapiens
ccaucuguccucauaauuu

SEQ ID NO: 207704 - RNA, 19 nt, Homo sapiens
gaaauguuaccgaagcaau

SEQ ID NO: 207705 - RNA, 19 nt, Homo sapiens
ggauauccuuuaguucuuc

SEQ ID NO: 207706 - RNA, 19 nt, Homo sapiens
aucaagauguuccucauuu

SEQ ID NO: 207707 - RNA, 19 nt, Homo sapiens
guuaugcaccagagauuaa

SEQ ID NO: 207708 - RNA, 19 nt, Homo sapiens
aagaaaaguucccuuguuu

SEQ ID NO: 207709 - RNA, 19 nt, Homo sapiens
ugucuaaguucucauucuu

SEQ ID NO: 207710 - RNA, 19 nt, Homo sapiens
gcuucaagguguccagaga

SEQ ID NO: 207711 - RNA, 19 nt, Homo sapiens
caaacagaccuucacuaug

SEQ ID NO: 207712 - RNA, 19 nt, Homo sapiens
ucuaaguucucauucuuuc

SEQ ID NO: 207713 - RNA, 19 nt, Homo sapiens
ggccaaaacuauuaccaaa

SEQ ID NO: 207714 - RNA, 19 nt, Homo sapiens
aaccuacucuguauucaau

SEQ ID NO: 207715 - RNA, 19 nt, Homo sapiens
gugcaagguugugcgauau

SEQ ID NO: 207716 - RNA, 19 nt, Homo sapiens
caagauguuccucauuuua

SEQ ID NO: 207717 - RNA, 19 nt, Homo sapiens
ccacauuugauuauuccua

SEQ ID NO: 207718 - RNA, 19 nt, Homo sapiens
cccaugaacaagacuauaa

SEQ ID NO: 207719 - RNA, 19 nt, Homo sapiens
guucucauucuuucaauug

SEQ ID NO: 207720 - RNA, 19 nt, Homo sapiens
cuaaaccuacucuguauuc

SEQ ID NO: 207721 - RNA, 19 nt, Homo sapiens
caucuguccucauaauuuu

SEQ ID NO: 207722 - RNA, 19 nt, Homo sapiens
agcaaugccuauacuauca

SEQ ID NO: 207723 - RNA, 19 nt, Homo sapiens
ccuauacuaucacaacaag

SEQ ID NO: 207724 - RNA, 19 nt, Homo sapiens
gcauguccucuaugaaaug

SEQ ID NO: 207725 - RNA, 19 nt, Homo sapiens
cgaagcaaugccuauacua

SEQ ID NO: 207726 - RNA, 19 nt, Homo sapiens
uugcauguccucuaugaaa

SEQ ID NO: 207727 - RNA, 19 nt, Homo sapiens
gauauccuuuaguucuuca

SEQ ID NO: 207728 - RNA, 19 nt, Homo sapiens
ggccacagccagcaucuuc

SEQ ID NO: 207729 - RNA, 19 nt, Homo sapiens
uaccaaagacucgaucuau

SEQ ID NO: 207730 - RNA, 19 nt, Homo sapiens
gauuauuccuacacuucug

SEQ ID NO: 207731 - RNA, 19 nt, Homo sapiens
ccaauaccugauggaauua

SEQ ID NO: 207732 - RNA, 19 nt, Homo sapiens
gcuuugugauuccaucugu

SEQ ID NO: 207733 - RNA, 19 nt, Homo sapiens
gggauucugugguuguuuu

SEQ ID NO: 207734 - RNA, 19 nt, Homo sapiens
uggauauccuuuaguucuu

SEQ ID NO: 207735 - RNA, 19 nt, Homo sapiens
accaaagacucgaucuaug

SEQ ID NO: 207736 - RNA, 19 nt, Homo sapiens
guucuacaccaucgucuau

SEQ ID NO: 207737 - RNA, 19 nt, Homo sapiens
aagccacauuugauuauuc

SEQ ID NO: 207738 - RNA, 19 nt, Homo sapiens
uaaaccuacucuguauuca

SEQ ID NO: 207739 - RNA, 19 nt, Homo sapiens
gcucacagaauggauaaca

SEQ ID NO: 207740 - RNA, 19 nt, Homo sapiens
cagcaucuucuuugggauu

SEQ ID NO: 207741 - RNA, 19 nt, Homo sapiens
ucaagauguuccucauuuu

SEQ ID NO: 207742 - RNA, 19 nt, Homo sapiens
gaacggugaggaggacaau

SEQ ID NO: 207743 - RNA, 19 nt, Homo sapiens
uucaagguguccagagaaa

SEQ ID NO: 207744 - RNA, 19 nt, Homo sapiens
acucaaauccaccaaauac

SEQ ID NO: 207745 - RNA, 19 nt, Homo sapiens
cucuaaaccuacucuguau

SEQ ID NO: 207746 - RNA, 19 nt, Homo sapiens
ggaugagcaaccaaacaga

SEQ ID NO: 207747 - RNA, 19 nt, Homo sapiens
ucacaacaaguucaaggau

SEQ ID NO: 207748 - RNA, 19 nt, Homo sapiens
ccgaagcaaugccuauacu

SEQ ID NO: 207749 - RNA, 19 nt, Homo sapiens
ccacagccagcaucuucuu

SEQ ID NO: 207750 - RNA, 19 nt, Homo sapiens
uaucaagauguuccucauu

SEQ ID NO: 207751 - RNA, 19 nt, Homo sapiens
acacugucauccacuucuu

SEQ ID NO: 207752 - RNA, 19 nt, Homo sapiens
gacagagaagccaaggaaa

SEQ ID NO: 207753 - RNA, 19 nt, Homo sapiens
aaaccuacucuguauucaa

SEQ ID NO: 207754 - RNA, 19 nt, Homo sapiens
caugaacaagacuauaaga

SEQ ID NO: 207755 - RNA, 19 nt, Homo sapiens
ucuuugggauucugugguu

SEQ ID NO: 207756 - RNA, 19 nt, Homo sapiens
gugaggaggacaaugaaca

SEQ ID NO: 207757 - RNA, 19 nt, Homo sapiens
gggacagucauuguaacua

SEQ ID NO: 207758 - RNA, 19 nt, Homo sapiens
cuccagguguccagaucua

SEQ ID NO: 207759 - RNA, 19 nt, Homo sapiens
caaugccuauacuaucaca

SEQ ID NO: 207760 - RNA, 19 nt, Homo sapiens
gagcaaccaaacagaccuu

SEQ ID NO: 207761 - RNA, 19 nt, Homo sapiens
cauguccucuaugaaaugu

SEQ ID NO: 207762 - RNA, 19 nt, Homo sapiens
gcaaccaaacagaccuuca

SEQ ID NO: 207763 - RNA, 19 nt, Homo sapiens
agcaagccacauuugauua

SEQ ID NO: 207764 - RNA, 19 nt, Homo sapiens
caauaccugauggaauuaa

SEQ ID NO: 207765 - RNA, 19 nt, Homo sapiens
ggcaugugcugaccuucuc

SEQ ID NO: 207766 - RNA, 19 nt, Homo sapiens
cuucggcaauucccugguu

SEQ ID NO: 207767 - RNA, 19 nt, Homo sapiens
ggugaccgaucuacuggua

SEQ ID NO: 207768 - RNA, 19 nt, Homo sapiens
ucaacgggcuggcgcugua

SEQ ID NO: 207769 - RNA, 19 nt, Homo sapiens
ucacggugcucaucaucuu

SEQ ID NO: 207770 - RNA, 19 nt, Homo sapiens
gcacugcuccauccucuuc

SEQ ID NO: 207771 - RNA, 19 nt, Homo sapiens
caagacacccucagucauc

SEQ ID NO: 207772 - RNA, 19 nt, Homo sapiens
ucagucaucuacaccauca

SEQ ID NO: 207773 - RNA, 19 nt, Homo sapiens
gcgcuucgcuguguacuac

SEQ ID NO: 207774 - RNA, 19 nt, Homo sapiens
gcacguccucgguuacuuc

SEQ ID NO: 207775 - RNA, 19 nt, Homo sapiens
uggcagggcuggugcucaa

SEQ ID NO: 207776 - RNA, 19 nt, Homo sapiens
caacagugcggaccaaugc

SEQ ID NO: 207777 - RNA, 19 nt, Homo sapiens
gccaagacacccucaguca

SEQ ID NO: 207778 - RNA, 19 nt, Homo sapiens
ugacaacagugcggaccaa

SEQ ID NO: 207779 - RNA, 19 nt, Homo sapiens
ccacgcgcuucgcugugua

SEQ ID NO: 207780 - RNA, 19 nt, Homo sapiens
ucccgcacguccucgguua

SEQ ID NO: 207781 - RNA, 19 nt, Homo sapiens
ccaccgcagugacaacagu

SEQ ID NO: 207782 - RNA, 19 nt, Homo sapiens
gcccugcugccgugucuuu

SEQ ID NO: 207783 - RNA, 19 nt, Homo sapiens
gguggugaccgaucuacug

SEQ ID NO: 207784 - RNA, 19 nt, Homo sapiens
gcucaggccgucaucacau

SEQ ID NO: 207785 - RNA, 19 nt, Homo sapiens
ggcuggcgcuguacgucuu

SEQ ID NO: 207786 - RNA, 19 nt, Homo sapiens
ccaagacacccucagucau

SEQ ID NO: 207787 - RNA, 19 nt, Homo sapiens
caacgacccuuacacaguu

SEQ ID NO: 207788 - RNA, 19 nt, Homo sapiens
gcauuuggcuauuuggaaa

SEQ ID NO: 207789 - RNA, 19 nt, Homo sapiens
caaaggcccucuuaaugga

SEQ ID NO: 207790 - RNA, 19 nt, Homo sapiens
caacagcacacaaaggaua

SEQ ID NO: 207791 - RNA, 19 nt, Homo sapiens
ucgaaucacuaguguauuu

SEQ ID NO: 207792 - RNA, 19 nt, Homo sapiens
uaauggaugucauaucuga

SEQ ID NO: 207793 - RNA, 19 nt, Homo sapiens
agacuacgccuguguauuu

SEQ ID NO: 207794 - RNA, 19 nt, Homo sapiens
gcaaaggcccucuuaaugg

SEQ ID NO: 207795 - RNA, 19 nt, Homo sapiens
gggcaaaccuggauaucau

SEQ ID NO: 207796 - RNA, 19 nt, Homo sapiens
gcaacuguguaauuuauag

SEQ ID NO: 207797 - RNA, 19 nt, Homo sapiens
guccuugacuugccagaua

SEQ ID NO: 207798 - RNA, 19 nt, Homo sapiens
ccaccuggcuugcuauuag

SEQ ID NO: 207799 - RNA, 19 nt, Homo sapiens
cagcauugauagauacauu

SEQ ID NO: 207800 - RNA, 19 nt, Homo sapiens
caaaggauaucagcgaaag

SEQ ID NO: 207801 - RNA, 19 nt, Homo sapiens
gcacaccgacuccuacuuc

SEQ ID NO: 207802 - RNA, 19 nt, Homo sapiens
gaagcaaaggcccucuuaa

SEQ ID NO: 207803 - RNA, 19 nt, Homo sapiens
gauagauacauugccauua

SEQ ID NO: 207804 - RNA, 19 nt, Homo sapiens
gauuauuucuggcaacauc

SEQ ID NO: 207805 - RNA, 19 nt, Homo sapiens
cuuaauggaugucauaucu

SEQ ID NO: 207806 - RNA, 19 nt, Homo sapiens
ugccauauaucaucuacuu

SEQ ID NO: 207807 - RNA, 19 nt, Homo sapiens
uuacacaguuagaagcaaa

SEQ ID NO: 207808 - RNA, 19 nt, Homo sapiens
cugcaacuguguaauuuau

SEQ ID NO: 207809 - RNA, 19 nt, Homo sapiens
ccagauauuugguuuugua

SEQ ID NO: 207810 - RNA, 19 nt, Homo sapiens
cguggucccuucuuuauca

SEQ ID NO: 207811 - RNA, 19 nt, Homo sapiens
caacaguguauuccaaaga

SEQ ID NO: 207812 - RNA, 19 nt, Homo sapiens
uaucaucuacuucuuguug

SEQ ID NO: 207813 - RNA, 19 nt, Homo sapiens
gcuaugccaugguccuguu

SEQ ID NO: 207814 - RNA, 19 nt, Homo sapiens
gauacauugccauuacuaa

SEQ ID NO: 207815 - RNA, 19 nt, Homo sapiens
uggcuucucuggccuguau

SEQ ID NO: 207816 - RNA, 19 nt, Homo sapiens
gccaacagcacacaaagga

SEQ ID NO: 207817 - RNA, 19 nt, Homo sapiens
ucaccuauuucaacaucuu

SEQ ID NO: 207818 - RNA, 19 nt, Homo sapiens
agaagcaaaggcccucuua

SEQ ID NO: 207819 - RNA, 19 nt, Homo sapiens
cuacagccaacgacccuua

SEQ ID NO: 207820 - RNA, 19 nt, Homo sapiens
auagauacauugccauuac

SEQ ID NO: 207821 - RNA, 19 nt, Homo sapiens
aagcaaaggcccucuuaau

SEQ ID NO: 207822 - RNA, 19 nt, Homo sapiens
gcugcguggucccuucuuu

SEQ ID NO: 207823 - RNA, 19 nt, Homo sapiens
ucacugugcaccuuuguug

SEQ ID NO: 207824 - RNA, 19 nt, Homo sapiens
ccucuuaauggaugucaua

SEQ ID NO: 207825 - RNA, 19 nt, Homo sapiens
ccaacgacccuuacacagu

SEQ ID NO: 207826 - RNA, 19 nt, Homo sapiens
guauuucacugugcaccuu

SEQ ID NO: 207827 - RNA, 19 nt, Homo sapiens
gccaugguccuguuucgaa

SEQ ID NO: 207828 - RNA, 19 nt, Homo sapiens
ggagacuacgccuguguau

SEQ ID NO: 207829 - RNA, 19 nt, Homo sapiens
ccgcuucgcauccuucuug

SEQ ID NO: 207830 - RNA, 19 nt, Homo sapiens
caucacacuacaaguuauu

SEQ ID NO: 207831 - RNA, 19 nt, Homo sapiens
ccaucacacuacaaguuau

SEQ ID NO: 207832 - RNA, 19 nt, Homo sapiens
agcaaaggcccucuuaaug

SEQ ID NO: 207833 - RNA, 19 nt, Homo sapiens
ggaaguauugauuauuguc

SEQ ID NO: 207834 - RNA, 19 nt, Homo sapiens
guuacacccuggagacuac

SEQ ID NO: 207835 - RNA, 19 nt, Homo sapiens
cuuuaucacuccuccauca

SEQ ID NO: 207836 - RNA, 19 nt, Homo sapiens
guugaaccaucacacuaca

SEQ ID NO: 207837 - RNA, 19 nt, Homo sapiens
ccaacaguguauuccaaag

SEQ ID NO: 207838 - RNA, 19 nt, Homo sapiens
gcaaccgcuucgcauccuu

SEQ ID NO: 207839 - RNA, 19 nt, Homo sapiens
ccauauaucaucuacuucu

SEQ ID NO: 207840 - RNA, 19 nt, Homo sapiens
ugauagauacauugccauu

SEQ ID NO: 207841 - RNA, 19 nt, Homo sapiens
ccucuuggcauuuggcuau

SEQ ID NO: 207842 - RNA, 19 nt, Homo sapiens
ccaugguccuguuucgaau

SEQ ID NO: 207843 - RNA, 19 nt, Homo sapiens
gagacuacgccuguguauu

SEQ ID NO: 207844 - RNA, 19 nt, Homo sapiens
caccuuuguugaaccauca

SEQ ID NO: 207845 - RNA, 19 nt, Homo sapiens
ccuuuaaccuauaauacuc

SEQ ID NO: 207846 - RNA, 19 nt, Homo sapiens
accaucacacuacaaguua

SEQ ID NO: 207847 - RNA, 19 nt, Homo sapiens
aaccaucacacuacaaguu

SEQ ID NO: 207848 - RNA, 19 nt, Homo sapiens
ggcauuuggcuauuuggaa

SEQ ID NO: 207849 - RNA, 19 nt, Homo sapiens
uuucgaaucacuaguguau

SEQ ID NO: 207850 - RNA, 19 nt, Homo sapiens
ugacuugccagauauuugg

SEQ ID NO: 207851 - RNA, 19 nt, Homo sapiens
cuucaccuauuucaacauc

SEQ ID NO: 207852 - RNA, 19 nt, Homo sapiens
gauaucauggagauguguu

SEQ ID NO: 207853 - RNA, 19 nt, Homo sapiens
cuccaacaguguauuccaa

SEQ ID NO: 207854 - RNA, 19 nt, Homo sapiens
uuucugcaacuguguaauu

SEQ ID NO: 207855 - RNA, 19 nt, Homo sapiens
uugaccaccuggcuugcua

SEQ ID NO: 207856 - RNA, 19 nt, Homo sapiens
ucaucuacuucuuguugga

SEQ ID NO: 207857 - RNA, 19 nt, Homo sapiens
gguuacacccuggagacua

SEQ ID NO: 207858 - RNA, 19 nt, Homo sapiens
cugcguggucccuucuuua

SEQ ID NO: 207859 - RNA, 19 nt, Homo sapiens
aacgacccuuacacaguua

SEQ ID NO: 207860 - RNA, 19 nt, Homo sapiens
gggcuauguguacuucuug

SEQ ID NO: 207861 - RNA, 19 nt, Homo sapiens
gcuauuaguaacaguuucu

SEQ ID NO: 207862 - RNA, 19 nt, Homo sapiens
gaaccaucacacuacaagu

SEQ ID NO: 207863 - RNA, 19 nt, Homo sapiens
acaaaggauaucagcgaaa

SEQ ID NO: 207864 - RNA, 19 nt, Homo sapiens
ggucuuccugccuuccuuu

SEQ ID NO: 207865 - RNA, 19 nt, Homo sapiens
caccuuggaugguaaucag

SEQ ID NO: 207866 - RNA, 19 nt, Homo sapiens
cuugccagauauuugguuu

SEQ ID NO: 207867 - RNA, 19 nt, Homo sapiens
uuuauagucucuccaacag

SEQ ID NO: 207868 - RNA, 19 nt, Homo sapiens
uucaacaucuuccgcaucu

SEQ ID NO: 207869 - RNA, 19 nt, Homo sapiens
cuauaauacucugguuaca

SEQ ID NO: 207870 - RNA, 19 nt, Homo sapiens
gggcagagcuguaauguua

SEQ ID NO: 207871 - RNA, 19 nt, Homo sapiens
gaagaaagcaagaaagaaa

SEQ ID NO: 207872 - RNA, 19 nt, Homo sapiens
gauaugacaucucuguaaa

SEQ ID NO: 207873 - RNA, 19 nt, Homo sapiens
caaaaggucuugaaaagua

SEQ ID NO: 207874 - RNA, 19 nt, Homo sapiens
caaccucacuguauuggua

SEQ ID NO: 207875 - RNA, 19 nt, Homo sapiens
gcaagugucucaacagcaa

SEQ ID NO: 207876 - RNA, 19 nt, Homo sapiens
gaaauuguguugggacuug

SEQ ID NO: 207877 - RNA, 19 nt, Homo sapiens
gcagcaaccucacuguauu

SEQ ID NO: 207878 - RNA, 19 nt, Homo sapiens
caggaugucuuuauugauu

SEQ ID NO: 207879 - RNA, 19 nt, Homo sapiens
caacagggcagaagaagaa

SEQ ID NO: 207880 - RNA, 19 nt, Homo sapiens
gaguaacacugcucucauu

SEQ ID NO: 207881 - RNA, 19 nt, Homo sapiens
caccggauuucuuauguua

SEQ ID NO: 207882 - RNA, 19 nt, Homo sapiens
gcgaguuguuucuauagua

SEQ ID NO: 207883 - RNA, 19 nt, Homo sapiens
ggagaaauguagucuuugg

SEQ ID NO: 207884 - RNA, 19 nt, Homo sapiens
guacuuuacugcaugaaau

SEQ ID NO: 207885 - RNA, 19 nt, Homo sapiens
guacagaucccaauauucu

SEQ ID NO: 207886 - RNA, 19 nt, Homo sapiens
acacugaacugggaaugua

SEQ ID NO: 207887 - RNA, 19 nt, Homo sapiens
aaagcgaguuguuucuaua

SEQ ID NO: 207888 - RNA, 19 nt, Homo sapiens
gcagagcuguaauguuaau

SEQ ID NO: 207889 - RNA, 19 nt, Homo sapiens
gaacgacgagaaagacaaa

SEQ ID NO: 207890 - RNA, 19 nt, Homo sapiens
ugggagaaauguagucuuu

SEQ ID NO: 207891 - RNA, 19 nt, Homo sapiens
gagaugacauugaugacau

SEQ ID NO: 207892 - RNA, 19 nt, Homo sapiens
gaacugggaauguauuauc

SEQ ID NO: 207893 - RNA, 19 nt, Homo sapiens
ggaaauaccugggaaaaca

SEQ ID NO: 207894 - RNA, 19 nt, Homo sapiens
cuacagacaugucacaaag

SEQ ID NO: 207895 - RNA, 19 nt, Homo sapiens
uuaaucaacucugucagua

SEQ ID NO: 207896 - RNA, 19 nt, Homo sapiens
auacacaacucuuggauag

SEQ ID NO: 207897 - RNA, 19 nt, Homo sapiens
caaaugaauacuacacuga

SEQ ID NO: 207898 - RNA, 19 nt, Homo sapiens
caacagcaaucaacguuuu

SEQ ID NO: 207899 - RNA, 19 nt, Homo sapiens
ucacuguauugguacuuua

SEQ ID NO: 207900 - RNA, 19 nt, Homo sapiens
gccuaauaaugcuguaaua

SEQ ID NO: 207901 - RNA, 19 nt, Homo sapiens
uaguacagaucccaauauu

SEQ ID NO: 207902 - RNA, 19 nt, Homo sapiens
ccaugaggcuuguguaucu

SEQ ID NO: 207903 - RNA, 19 nt, Homo sapiens
guaccaaccacuaucauau

SEQ ID NO: 207904 - RNA, 19 nt, Homo sapiens
gaagauagugaaauaagag

SEQ ID NO: 207905 - RNA, 19 nt, Homo sapiens
ggacaccaauuucuguuuu

SEQ ID NO: 207906 - RNA, 19 nt, Homo sapiens
gaaacgacaccgugaacga

SEQ ID NO: 207907 - RNA, 19 nt, Homo sapiens
cagucugaaucuaacauua

SEQ ID NO: 207908 - RNA, 19 nt, Homo sapiens
ggauguauuccucuaacua

SEQ ID NO: 207909 - RNA, 19 nt, Homo sapiens
uaucauauccguuaagcuu

SEQ ID NO: 207910 - RNA, 19 nt, Homo sapiens
acacaacucuuggauagau

SEQ ID NO: 207911 - RNA, 19 nt, Homo sapiens
ccguuaagcuuucaagugu

SEQ ID NO: 207912 - RNA, 19 nt, Homo sapiens
uaacacugcucucauuugc

SEQ ID NO: 207913 - RNA, 19 nt, Homo sapiens
agucauggcuuauggaaca

SEQ ID NO: 207914 - RNA, 19 nt, Homo sapiens
ucgaauaggcacaagauuu

SEQ ID NO: 207915 - RNA, 19 nt, Homo sapiens
gaagaagaaagcaagaaag

SEQ ID NO: 207916 - RNA, 19 nt, Homo sapiens
aaaucaacaugcagucuga

SEQ ID NO: 207917 - RNA, 19 nt, Homo sapiens
gagcuguaauguuaaugau

SEQ ID NO: 207918 - RNA, 19 nt, Homo sapiens
gcaaaccgaauucugacaa

SEQ ID NO: 207919 - RNA, 19 nt, Homo sapiens
ugcaugaaauccaacuuaa

SEQ ID NO: 207920 - RNA, 19 nt, Homo sapiens
ccacuaucauauccguuaa

SEQ ID NO: 207921 - RNA, 19 nt, Homo sapiens
caaaccgaauucugacaau

SEQ ID NO: 207922 - RNA, 19 nt, Homo sapiens
caugaaauccaacuuaauc

SEQ ID NO: 207923 - RNA, 19 nt, Homo sapiens
aauguagucuuugguguaa

SEQ ID NO: 207924 - RNA, 19 nt, Homo sapiens
caauuucucuaaccacaca

SEQ ID NO: 207925 - RNA, 19 nt, Homo sapiens
caauauguaccaaccacua

SEQ ID NO: 207926 - RNA, 19 nt, Homo sapiens
gauguauuccucuaacuau

SEQ ID NO: 207927 - RNA, 19 nt, Homo sapiens
guuaaucacauacaccaaa

SEQ ID NO: 207928 - RNA, 19 nt, Homo sapiens
ucucuuuccugauuccuuu

SEQ ID NO: 207929 - RNA, 19 nt, Homo sapiens
ccggauuucuuauguuaga

SEQ ID NO: 207930 - RNA, 19 nt, Homo sapiens
cgaguuguuucuauaguag

SEQ ID NO: 207931 - RNA, 19 nt, Homo sapiens
gcuuauggaacaacuauau

SEQ ID NO: 207932 - RNA, 19 nt, Homo sapiens
caacaugcagucugaaucu

SEQ ID NO: 207933 - RNA, 19 nt, Homo sapiens
auaguuauccuucugcuuu

SEQ ID NO: 207934 - RNA, 19 nt, Homo sapiens
gaaauccaacuuaaucaac

SEQ ID NO: 207935 - RNA, 19 nt, Homo sapiens
ucucucaccggauuucuua

SEQ ID NO: 207936 - RNA, 19 nt, Homo sapiens
aagaagaaagcaagaaaga

SEQ ID NO: 207937 - RNA, 19 nt, Homo sapiens
agaagaagaaagcaagaaa

SEQ ID NO: 207938 - RNA, 19 nt, Homo sapiens
gacaaugggcagagcugua

SEQ ID NO: 207939 - RNA, 19 nt, Homo sapiens
guaacacugcucucauuug

SEQ ID NO: 207940 - RNA, 19 nt, Homo sapiens
gcaugaaauccaacuuaau

SEQ ID NO: 207941 - RNA, 19 nt, Homo sapiens
ccaagugaccuuuuaguaa

SEQ ID NO: 207942 - RNA, 19 nt, Homo sapiens
ucauauccguuaagcuuuc

SEQ ID NO: 207943 - RNA, 19 nt, Homo sapiens
acagacaugucacaaagca

SEQ ID NO: 207944 - RNA, 19 nt, Homo sapiens
gcagaagaagaaagcaaga

SEQ ID NO: 207945 - RNA, 19 nt, Homo sapiens
caacaccaauauguaccaa

SEQ ID NO: 207946 - RNA, 19 nt, Homo sapiens
acagaucccaauauucuuu

SEQ ID NO: 207947 - RNA, 19 nt, Homo sapiens
guuaguacagaucccaaua

SEQ ID NO: 207948 - RNA, 19 nt, Homo sapiens
aaauguagucuuuggugua

SEQ ID NO: 207949 - RNA, 19 nt, Homo sapiens
caacaugaggcuacagaca

SEQ ID NO: 207950 - RNA, 19 nt, Homo sapiens
auacuucaggcucuuaaua

SEQ ID NO: 207951 - RNA, 19 nt, Homo sapiens
uaauuugugugggauguau

SEQ ID NO: 207952 - RNA, 19 nt, Homo sapiens
gaaucuucauguacuugau

SEQ ID NO: 207953 - RNA, 19 nt, Homo sapiens
ccaacuuaaucaacucugu

SEQ ID NO: 207954 - RNA, 19 nt, Homo sapiens
cugcaugaaauccaacuua

SEQ ID NO: 207955 - RNA, 19 nt, Homo sapiens
uucaggaugucuuuauuga

SEQ ID NO: 207956 - RNA, 19 nt, Homo sapiens
gcuacagacaugucacaaa

SEQ ID NO: 207957 - RNA, 19 nt, Homo sapiens
cgaauaggcacaagauuuu

SEQ ID NO: 207958 - RNA, 19 nt, Homo sapiens
gaauguauuaucaccuguu

SEQ ID NO: 207959 - RNA, 19 nt, Homo sapiens
gcugauccccugccuaaua

SEQ ID NO: 207960 - RNA, 19 nt, Homo sapiens
ucacuguuguaguaauguu

SEQ ID NO: 207961 - RNA, 19 nt, Homo sapiens
acaaugggcagagcuguaa

SEQ ID NO: 207962 - RNA, 19 nt, Homo sapiens
guuaagcuuucaagugucu

SEQ ID NO: 207963 - RNA, 19 nt, Homo sapiens
ggcagcaaccucacuguau

SEQ ID NO: 207964 - RNA, 19 nt, Homo sapiens
ucaccggauuucuuauguu

SEQ ID NO: 207965 - RNA, 19 nt, Homo sapiens
gacaccaauuucuguuuua

SEQ ID NO: 207966 - RNA, 19 nt, Homo sapiens
gcagucugaaucuaacauu

SEQ ID NO: 207967 - RNA, 19 nt, Homo sapiens
aaaccgaauucugacaaug

SEQ ID NO: 207968 - RNA, 19 nt, Homo sapiens
aaucaacucugucaguaac

SEQ ID NO: 207969 - RNA, 19 nt, Homo sapiens
uaaucaacucugucaguaa

SEQ ID NO: 207970 - RNA, 19 nt, Homo sapiens
gguaaaagcuggaaaauua

SEQ ID NO: 207971 - RNA, 19 nt, Homo sapiens
gccaggagcugcugaauuu

SEQ ID NO: 207972 - RNA, 19 nt, Homo sapiens
ccagaaagcugcuaaauac

SEQ ID NO: 207973 - RNA, 19 nt, Homo sapiens
gagaugacuuugaaacuuu

SEQ ID NO: 207974 - RNA, 19 nt, Homo sapiens
gauaugguuucuccuauaa

SEQ ID NO: 207975 - RNA, 19 nt, Homo sapiens
ggaaagauuugcaaagauc

SEQ ID NO: 207976 - RNA, 19 nt, Homo sapiens
gaugauuccuucaaguaua

SEQ ID NO: 207977 - RNA, 19 nt, Homo sapiens
gagcaacaccaacauauuu

SEQ ID NO: 207978 - RNA, 19 nt, Homo sapiens
gcaaugcuacugccaauaa

SEQ ID NO: 207979 - RNA, 19 nt, Homo sapiens
ggaagugagugaucaaaca

SEQ ID NO: 207980 - RNA, 19 nt, Homo sapiens
ggagggaggaguagagaua

SEQ ID NO: 207981 - RNA, 19 nt, Homo sapiens
gaagguauacuguagaguu

SEQ ID NO: 207982 - RNA, 19 nt, Homo sapiens
gaauggagucccuguuuaa

SEQ ID NO: 207983 - RNA, 19 nt, Homo sapiens
gaacugcauuccuuaccaa

SEQ ID NO: 207984 - RNA, 19 nt, Homo sapiens
ggucaaaucuaauuacaac

SEQ ID NO: 207985 - RNA, 19 nt, Homo sapiens
cuacaacucuguccucuuc

SEQ ID NO: 207986 - RNA, 19 nt, Homo sapiens
caaauugcguuggcaugua

SEQ ID NO: 207987 - RNA, 19 nt, Homo sapiens
caagauggauugccaaacu

SEQ ID NO: 207988 - RNA, 19 nt, Homo sapiens
agaauggagucccuguuua

SEQ ID NO: 207989 - RNA, 19 nt, Homo sapiens
gggaaacuagguucuauaa

SEQ ID NO: 207990 - RNA, 19 nt, Homo sapiens
acaggaaagugucaauaaa

SEQ ID NO: 207991 - RNA, 19 nt, Homo sapiens
gccagaaagcugcuaaaua

SEQ ID NO: 207992 - RNA, 19 nt, Homo sapiens
gaaaggggcugcauuugug

SEQ ID NO: 207993 - RNA, 19 nt, Homo sapiens
guacgugggugggaagaaa

SEQ ID NO: 207994 - RNA, 19 nt, Homo sapiens
gcuacucugucucaaauug

SEQ ID NO: 207995 - RNA, 19 nt, Homo sapiens
ccacuaaugucaacaaugc

SEQ ID NO: 207996 - RNA, 19 nt, Homo sapiens
gaagugagacugcuauuuu

SEQ ID NO: 207997 - RNA, 19 nt, Homo sapiens
gacagaagauucauugacu

SEQ ID NO: 207998 - RNA, 19 nt, Homo sapiens
gaaacaccuuugaccacaa

SEQ ID NO: 207999 - RNA, 19 nt, Homo sapiens
uagaacaaauucagggauu

SEQ ID NO: 208000 - RNA, 19 nt, Homo sapiens
caccaaauccagucagaua

SEQ ID NO: 208001 - RNA, 19 nt, Homo sapiens
gaaugucucuugcucuucu

SEQ ID NO: 208002 - RNA, 19 nt, Homo sapiens
guauuaguguggaucguuu

SEQ ID NO: 208003 - RNA, 19 nt, Homo sapiens
caacaaccaagauggauug

SEQ ID NO: 208004 - RNA, 19 nt, Homo sapiens
gaggaauucugccauugug

SEQ ID NO: 208005 - RNA, 19 nt, Homo sapiens
ccagucagauacauuuguu

SEQ ID NO: 208006 - RNA, 19 nt, Homo sapiens
agauaugguuucuccuaua

SEQ ID NO: 208007 - RNA, 19 nt, Homo sapiens
caaucuagcugucucugau

SEQ ID NO: 208008 - RNA, 19 nt, Homo sapiens
auacgugucuggcagguaa

SEQ ID NO: 208009 - RNA, 19 nt, Homo sapiens
gaggaguagagauauauaa

SEQ ID NO: 208010 - RNA, 19 nt, Homo sapiens
gaagugagugaucaaacaa

SEQ ID NO: 208011 - RNA, 19 nt, Homo sapiens
guauucaucuugggucuga

SEQ ID NO: 208012 - RNA, 19 nt, Homo sapiens
auauuuauccucccuguua

SEQ ID NO: 208013 - RNA, 19 nt, Homo sapiens
cagaauggagucccuguuu

SEQ ID NO: 208014 - RNA, 19 nt, Homo sapiens
guuguuggguuuaucauuc

SEQ ID NO: 208015 - RNA, 19 nt, Homo sapiens
auacuugcauuguugauga

SEQ ID NO: 208016 - RNA, 19 nt, Homo sapiens
ggaggaguagagauauaua

SEQ ID NO: 208017 - RNA, 19 nt, Homo sapiens
agagaugacuuugaaacuu

SEQ ID NO: 208018 - RNA, 19 nt, Homo sapiens
gguuggaauuucauuguau

SEQ ID NO: 208019 - RNA, 19 nt, Homo sapiens
gagaauaaugcaccaaauc

SEQ ID NO: 208020 - RNA, 19 nt, Homo sapiens
caaauaaugguggugaauu

SEQ ID NO: 208021 - RNA, 19 nt, Homo sapiens
caaagaucauguacccaau

SEQ ID NO: 208022 - RNA, 19 nt, Homo sapiens
ggguuuaucauuccucuaa

SEQ ID NO: 208023 - RNA, 19 nt, Homo sapiens
guccaugggugacagaaga

SEQ ID NO: 208024 - RNA, 19 nt, Homo sapiens
caccagcagugugaguuua

SEQ ID NO: 208025 - RNA, 19 nt, Homo sapiens
uauugaaguuguuggguuu

SEQ ID NO: 208026 - RNA, 19 nt, Homo sapiens
gcacagcacagccagaaag

SEQ ID NO: 208027 - RNA, 19 nt, Homo sapiens
cuacugauauaugcuaguu

SEQ ID NO: 208028 - RNA, 19 nt, Homo sapiens
aagguauacuguagaguuu

SEQ ID NO: 208029 - RNA, 19 nt, Homo sapiens
cagauaugguuucuccuau

SEQ ID NO: 208030 - RNA, 19 nt, Homo sapiens
ccagauaugguuucuccua

SEQ ID NO: 208031 - RNA, 19 nt, Homo sapiens
cuacaucaaugcccacauc

SEQ ID NO: 208032 - RNA, 19 nt, Homo sapiens
gaaguuguuggguuuauca

SEQ ID NO: 208033 - RNA, 19 nt, Homo sapiens
uauccucccuguuauacuu

SEQ ID NO: 208034 - RNA, 19 nt, Homo sapiens
ggaaacuagguucuauaaa

SEQ ID NO: 208035 - RNA, 19 nt, Homo sapiens
ccucuaauauugaaugucu

SEQ ID NO: 208036 - RNA, 19 nt, Homo sapiens
ggugacagaagauucauug

SEQ ID NO: 208037 - RNA, 19 nt, Homo sapiens
caucaaugcccacaucaga

SEQ ID NO: 208038 - RNA, 19 nt, Homo sapiens
uauuucagccucuuuguuu

SEQ ID NO: 208039 - RNA, 19 nt, Homo sapiens
gaguagagauauauaaccu

SEQ ID NO: 208040 - RNA, 19 nt, Homo sapiens
aaacaggaaagugucaaua

SEQ ID NO: 208041 - RNA, 19 nt, Homo sapiens
ggucaggagcaaauugaaa

SEQ ID NO: 208042 - RNA, 19 nt, Homo sapiens
gagcacagcacagccagaa

SEQ ID NO: 208043 - RNA, 19 nt, Homo sapiens
ugagaauaaugcaccaaau

SEQ ID NO: 208044 - RNA, 19 nt, Homo sapiens
uaggaggaauucugccauu

SEQ ID NO: 208045 - RNA, 19 nt, Homo sapiens
uuggaaagauuugcaaaga

SEQ ID NO: 208046 - RNA, 19 nt, Homo sapiens
gcucccaagcuauuacuaa

SEQ ID NO: 208047 - RNA, 19 nt, Homo sapiens
ggaggaauucugccauugu

SEQ ID NO: 208048 - RNA, 19 nt, Homo sapiens
gugaauuaaugcuagaauc

SEQ ID NO: 208049 - RNA, 19 nt, Homo sapiens
ugagugaucaaacaacaaa

SEQ ID NO: 208050 - RNA, 19 nt, Homo sapiens
guacauauggcagucuuug

SEQ ID NO: 208051 - RNA, 19 nt, Homo sapiens
ucuauuacuucacccuuga

SEQ ID NO: 208052 - RNA, 19 nt, Homo sapiens
gaaagauuugcaaagauca

SEQ ID NO: 208053 - RNA, 19 nt, Homo sapiens
gcaaccaccaccugcuuug

SEQ ID NO: 208054 - RNA, 19 nt, Homo sapiens
ucaaguauaaucucaaugg

SEQ ID NO: 208055 - RNA, 19 nt, Homo sapiens
cuaauuacaacaaccaaga

SEQ ID NO: 208056 - RNA, 19 nt, Homo sapiens
acucuguccucuucuugua

SEQ ID NO: 208057 - RNA, 19 nt, Homo sapiens
cugcuacucugucucaaau

SEQ ID NO: 208058 - RNA, 19 nt, Homo sapiens
ggaagacuuauuuauccaa

SEQ ID NO: 208059 - RNA, 19 nt, Homo sapiens
uuucucaccuguauuagug

SEQ ID NO: 208060 - RNA, 19 nt, Homo sapiens
caaguauaaucucaauggu

SEQ ID NO: 208061 - RNA, 19 nt, Homo sapiens
guuugaagguauacuguag

SEQ ID NO: 208062 - RNA, 19 nt, Homo sapiens
cagauacauuuguuugaag

SEQ ID NO: 208063 - RNA, 19 nt, Homo sapiens
gcuaaugauacugagaaua

SEQ ID NO: 208064 - RNA, 19 nt, Homo sapiens
acagaagauucauugacuu

SEQ ID NO: 208065 - RNA, 19 nt, Homo sapiens
caaugcuacugccaauaau

SEQ ID NO: 208066 - RNA, 19 nt, Homo sapiens
gacuuccaauuccaagauu

SEQ ID NO: 208067 - RNA, 19 nt, Homo sapiens
aacaggaaagugucaauaa

SEQ ID NO: 208068 - RNA, 19 nt, Homo sapiens
caaauccagucagauacau

SEQ ID NO: 208069 - RNA, 19 nt, Homo sapiens
uggaaagauuugcaaagau

SEQ ID NO: 208070 - RNA, 19 nt, Homo sapiens
gguaguagaucuccucuuu

SEQ ID NO: 208071 - RNA, 19 nt, Homo sapiens
gauaaccgguugcacuaua

SEQ ID NO: 208072 - RNA, 19 nt, Homo sapiens
gaacagaagcugagcaaga

SEQ ID NO: 208073 - RNA, 19 nt, Homo sapiens
ggagaucccuuuccugaug

SEQ ID NO: 208074 - RNA, 19 nt, Homo sapiens
gaggaugcauguuuauuug

SEQ ID NO: 208075 - RNA, 19 nt, Homo sapiens
gaugagaccuuuggauaga

SEQ ID NO: 208076 - RNA, 19 nt, Homo sapiens
caagagaacauguugguuu

SEQ ID NO: 208077 - RNA, 19 nt, Homo sapiens
gaacauguugguuuggaua

SEQ ID NO: 208078 - RNA, 19 nt, Homo sapiens
acacugaccucuacugguu

SEQ ID NO: 208079 - RNA, 19 nt, Homo sapiens
ucuagaggaugcauguuua

SEQ ID NO: 208080 - RNA, 19 nt, Homo sapiens
cgggagagaugcugagaaa

SEQ ID NO: 208081 - RNA, 19 nt, Homo sapiens
caagaccgcucgggaaaug

SEQ ID NO: 208082 - RNA, 19 nt, Homo sapiens
ggacugaagagguuaaugu

SEQ ID NO: 208083 - RNA, 19 nt, Homo sapiens
uaggaggucugcuuacuga

SEQ ID NO: 208084 - RNA, 19 nt, Homo sapiens
ccaagcugguggauaauga

SEQ ID NO: 208085 - RNA, 19 nt, Homo sapiens
gcucucaaaugucuucuuc

SEQ ID NO: 208086 - RNA, 19 nt, Homo sapiens
caaaggcaccugauacuuc

SEQ ID NO: 208087 - RNA, 19 nt, Homo sapiens
gcacagccaucgccaucug

SEQ ID NO: 208088 - RNA, 19 nt, Homo sapiens
ggagaggacagaaagcaaa

SEQ ID NO: 208089 - RNA, 19 nt, Homo sapiens
ccucaccuuugucuacuua

SEQ ID NO: 208090 - RNA, 19 nt, Homo sapiens
gagaacauguugguuugga

SEQ ID NO: 208091 - RNA, 19 nt, Homo sapiens
ggagcaggaugagaccuuu

SEQ ID NO: 208092 - RNA, 19 nt, Homo sapiens
ucaccuuugucuacuuaua

SEQ ID NO: 208093 - RNA, 19 nt, Homo sapiens
ggaggucugcuuacugaaa

SEQ ID NO: 208094 - RNA, 19 nt, Homo sapiens
ugacuggguuuguuuaaag

SEQ ID NO: 208095 - RNA, 19 nt, Homo sapiens
guacugacuggguuuguuu

SEQ ID NO: 208096 - RNA, 19 nt, Homo sapiens
gaacuccacggucaucuuc

SEQ ID NO: 208097 - RNA, 19 nt, Homo sapiens
aagagaacauguugguuug

SEQ ID NO: 208098 - RNA, 19 nt, Homo sapiens
gggcacauuugcucaguca

SEQ ID NO: 208099 - RNA, 19 nt, Homo sapiens
cucccaagcugguggauaa

SEQ ID NO: 208100 - RNA, 19 nt, Homo sapiens
caucaugccuucgguguuc

SEQ ID NO: 208101 - RNA, 19 nt, Homo sapiens
ggccauggaugccaauagu

SEQ ID NO: 208102 - RNA, 19 nt, Homo sapiens
uugcagcucuggugacauu

SEQ ID NO: 208103 - RNA, 19 nt, Homo sapiens
gcaaaggcaccugauacuu

SEQ ID NO: 208104 - RNA, 19 nt, Homo sapiens
gagcaucuccuacaucaac

SEQ ID NO: 208105 - RNA, 19 nt, Homo sapiens
agaggaugcauguuuauuu

SEQ ID NO: 208106 - RNA, 19 nt, Homo sapiens
uaguagaucuccucuuucu

SEQ ID NO: 208107 - RNA, 19 nt, Homo sapiens
ggaugcauguuuauuugag

SEQ ID NO: 208108 - RNA, 19 nt, Homo sapiens
ggaugagaccuuuggauag

SEQ ID NO: 208109 - RNA, 19 nt, Homo sapiens
ugucuggucuucuuugugu

SEQ ID NO: 208110 - RNA, 19 nt, Homo sapiens
caucugccuccgaauguua

SEQ ID NO: 208111 - RNA, 19 nt, Homo sapiens
gcccgacccucaccuuugu

SEQ ID NO: 208112 - RNA, 19 nt, Homo sapiens
ugaccgccauggccauuga

SEQ ID NO: 208113 - RNA, 19 nt, Homo sapiens
gguacugacuggguuuguu

SEQ ID NO: 208114 - RNA, 19 nt, Homo sapiens
aggaugagaccuuuggaua

SEQ ID NO: 208115 - RNA, 19 nt, Homo sapiens
guuaaugugucuaggugau

SEQ ID NO: 208116 - RNA, 19 nt, Homo sapiens
cccgacaucuucaucauca

SEQ ID NO: 208117 - RNA, 19 nt, Homo sapiens
cacauuugcucagucacua

SEQ ID NO: 208118 - RNA, 19 nt, Homo sapiens
ccagggccauguugcacaa

SEQ ID NO: 208119 - RNA, 19 nt, Homo sapiens
gcaucugccuccgaauguu

SEQ ID NO: 208120 - RNA, 19 nt, Homo sapiens
aaagcaaaggcaccugaua

SEQ ID NO: 208121 - RNA, 19 nt, Homo sapiens
gccaucagcuugggcuaug

SEQ ID NO: 208122 - RNA, 19 nt, Homo sapiens
gcuaggaggucugcuuacu

SEQ ID NO: 208123 - RNA, 19 nt, Homo sapiens
aauaaagcaucccaucucu

SEQ ID NO: 208124 - RNA, 19 nt, Homo sapiens
gaaagcaaaggcaccugau

SEQ ID NO: 208125 - RNA, 19 nt, Homo sapiens
ucacuaauccagcuugagu

SEQ ID NO: 208126 - RNA, 19 nt, Homo sapiens
gguuugggguuuucagaua

SEQ ID NO: 208127 - RNA, 19 nt, Homo sapiens
gcugggcacccuacuaugu

SEQ ID NO: 208128 - RNA, 19 nt, Homo sapiens
caaccucucgguaguagau

SEQ ID NO: 208129 - RNA, 19 nt, Homo sapiens
gguucacccuguaccaguu

SEQ ID NO: 208130 - RNA, 19 nt, Homo sapiens
ggaugccaauagucaguuc

SEQ ID NO: 208131 - RNA, 19 nt, Homo sapiens
cugcaggcauucagaagug

SEQ ID NO: 208132 - RNA, 19 nt, Homo sapiens
gagcagccagggccauguu

SEQ ID NO: 208133 - RNA, 19 nt, Homo sapiens
ggagucagguuugggguuu

SEQ ID NO: 208134 - RNA, 19 nt, Homo sapiens
gaggucugcuuacugaaaa

SEQ ID NO: 208135 - RNA, 19 nt, Homo sapiens
gcaagagaacauguugguu

SEQ ID NO: 208136 - RNA, 19 nt, Homo sapiens
ccaucugucuggucuucuu

SEQ ID NO: 208137 - RNA, 19 nt, Homo sapiens
ggaacuccacggucaucuu

SEQ ID NO: 208138 - RNA, 19 nt, Homo sapiens
gccugggacugaagagguu

SEQ ID NO: 208139 - RNA, 19 nt, Homo sapiens
cuacaucaacaucaucaug

SEQ ID NO: 208140 - RNA, 19 nt, Homo sapiens
gcacauuugcucagucacu

SEQ ID NO: 208141 - RNA, 19 nt, Homo sapiens
uggauaaccgguugcacua

SEQ ID NO: 208142 - RNA, 19 nt, Homo sapiens
aacagaagcugagcaagag

SEQ ID NO: 208143 - RNA, 19 nt, Homo sapiens
uaaugugucuaggugaugu

SEQ ID NO: 208144 - RNA, 19 nt, Homo sapiens
caucaaccucucgguagua

SEQ ID NO: 208145 - RNA, 19 nt, Homo sapiens
ugaagagguuaaugugcau

SEQ ID NO: 208146 - RNA, 19 nt, Homo sapiens
guuccagcauccugucaau

SEQ ID NO: 208147 - RNA, 19 nt, Homo sapiens
aaauaaagcaucccaucuc

SEQ ID NO: 208148 - RNA, 19 nt, Homo sapiens
ugcuacagcugacccaguu

SEQ ID NO: 208149 - RNA, 19 nt, Homo sapiens
ggucaucacagccgcauac

SEQ ID NO: 208150 - RNA, 19 nt, Homo sapiens
ccauggaugccaauaguca

SEQ ID NO: 208151 - RNA, 19 nt, Homo sapiens
gcaagcagcagccccugua

SEQ ID NO: 208152 - RNA, 19 nt, Homo sapiens
guaaaagcccaguuugcua

SEQ ID NO: 208153 - RNA, 19 nt, Homo sapiens
auaaccgguugcacuauau

SEQ ID NO: 208154 - RNA, 19 nt, Homo sapiens
cagaagcugagcaagagaa

SEQ ID NO: 208155 - RNA, 19 nt, Homo sapiens
gaggagaggacagaaagca

SEQ ID NO: 208156 - RNA, 19 nt, Homo sapiens
gacgaggagaggacagaaa

SEQ ID NO: 208157 - RNA, 19 nt, Homo sapiens
guccguguguucugcaugu

SEQ ID NO: 208158 - RNA, 19 nt, Homo sapiens
gacuggguuuguuuaaagu

SEQ ID NO: 208159 - RNA, 19 nt, Homo sapiens
uagaacagaagcugagcaa

SEQ ID NO: 208160 - RNA, 19 nt, Homo sapiens
gugcaucugccuccgaaug

SEQ ID NO: 208161 - RNA, 19 nt, Homo sapiens
ucuacugguucacccugua

SEQ ID NO: 208162 - RNA, 19 nt, Homo sapiens
ucaucaaccucucgguagu

SEQ ID NO: 208163 - RNA, 19 nt, Homo sapiens
ucuagugcccgguguguug

SEQ ID NO: 208164 - RNA, 19 nt, Homo sapiens
cugacuggguuuguuuaaa

SEQ ID NO: 208165 - RNA, 19 nt, Homo sapiens
gagaggacagaaagcaaag

SEQ ID NO: 208166 - RNA, 19 nt, Homo sapiens
gagggcaguugggcuugga

SEQ ID NO: 208167 - RNA, 19 nt, Homo sapiens
ggauaaccgguugcacuau

SEQ ID NO: 208168 - RNA, 19 nt, Homo sapiens
ugagcaagagaacauguug

SEQ ID NO: 208169 - RNA, 19 nt, Homo sapiens
ggguuguugcaaugaaaua

SEQ ID NO: 208170 - RNA, 19 nt, Homo sapiens
ggacgacaguuccguguuc

SEQ ID NO: 208171 - RNA, 19 nt, Homo sapiens
ggaacucgcugcgcaucau

SEQ ID NO: 208172 - RNA, 19 nt, Homo sapiens
gcgccaacccgcucaucua

SEQ ID NO: 208173 - RNA, 19 nt, Homo sapiens
ucugcaagcucagcacguu

SEQ ID NO: 208174 - RNA, 19 nt, Homo sapiens
ccaacccgcucaucuaccu

SEQ ID NO: 208175 - RNA, 19 nt, Homo sapiens
gcgauggccucugcaagcu

SEQ ID NO: 208176 - RNA, 19 nt, Homo sapiens
gaacucgcugcgcaucauc

SEQ ID NO: 208177 - RNA, 19 nt, Homo sapiens
cagcugaccugggcuucgu

SEQ ID NO: 208178 - RNA, 19 nt, Homo sapiens
gccauuagcucuuaaauua

SEQ ID NO: 208179 - RNA, 19 nt, Homo sapiens
gaacuuagcuggugggaaa

SEQ ID NO: 208180 - RNA, 19 nt, Homo sapiens
gcacaauccuucccaauuu

SEQ ID NO: 208181 - RNA, 19 nt, Homo sapiens
caaaggcugugcauuguua

SEQ ID NO: 208182 - RNA, 19 nt, Homo sapiens
agaaguaucugcaucuuua

SEQ ID NO: 208183 - RNA, 19 nt, Homo sapiens
gaaaugaucuuagacacuu

SEQ ID NO: 208184 - RNA, 19 nt, Homo sapiens
acucuuagcuccucaguua

SEQ ID NO: 208185 - RNA, 19 nt, Homo sapiens
caaauugacuugugaauac

SEQ ID NO: 208186 - RNA, 19 nt, Homo sapiens
aaagauggcucaccaauca

SEQ ID NO: 208187 - RNA, 19 nt, Homo sapiens
aaacugaucucuccaugaa

SEQ ID NO: 208188 - RNA, 19 nt, Homo sapiens
ggagaaaguuguuugagau

SEQ ID NO: 208189 - RNA, 19 nt, Homo sapiens
ccagaccaauggccuauua

SEQ ID NO: 208190 - RNA, 19 nt, Homo sapiens
gagagaaagugguaugaga

SEQ ID NO: 208191 - RNA, 19 nt, Homo sapiens
ggaaggaacucuggcauuc

SEQ ID NO: 208192 - RNA, 19 nt, Homo sapiens
gaagagagaaggaagaaug

SEQ ID NO: 208193 - RNA, 19 nt, Homo sapiens
gcugaagaguuuagaauga

SEQ ID NO: 208194 - RNA, 19 nt, Homo sapiens
gcaaggagauucugaacag

SEQ ID NO: 208195 - RNA, 19 nt, Homo sapiens
caauaaaacucucuccuua

SEQ ID NO: 208196 - RNA, 19 nt, Homo sapiens
uaaacuagcuugccugagu

SEQ ID NO: 208197 - RNA, 19 nt, Homo sapiens
ggugagacuugaccuuuaa

SEQ ID NO: 208198 - RNA, 19 nt, Homo sapiens
acagagagcugauugugaa

SEQ ID NO: 208199 - RNA, 19 nt, Homo sapiens
gaaaguagaggcuauucaa

SEQ ID NO: 208200 - RNA, 19 nt, Homo sapiens
ggagauggaugggcaagaa

SEQ ID NO: 208201 - RNA, 19 nt, Homo sapiens
gggaaucuaucuaauuguu

SEQ ID NO: 208202 - RNA, 19 nt, Homo sapiens
ggaaggaagugaagagucu

SEQ ID NO: 208203 - RNA, 19 nt, Homo sapiens
caacuugucuuaugcaucu

SEQ ID NO: 208204 - RNA, 19 nt, Homo sapiens
ggagacaggucauuacucu

SEQ ID NO: 208205 - RNA, 19 nt, Homo sapiens
cagggaaucuaucuaauug

SEQ ID NO: 208206 - RNA, 19 nt, Homo sapiens
gaucuuagacacuuggaua

SEQ ID NO: 208207 - RNA, 19 nt, Homo sapiens
gggagaaaguuguuugaga

SEQ ID NO: 208208 - RNA, 19 nt, Homo sapiens
gaauuuacaggaaguguuu

SEQ ID NO: 208209 - RNA, 19 nt, Homo sapiens
guccugacuugauuuaaua

SEQ ID NO: 208210 - RNA, 19 nt, Homo sapiens
gggugagacuugaccuuua

SEQ ID NO: 208211 - RNA, 19 nt, Homo sapiens
uagaggcuauucaagguua

SEQ ID NO: 208212 - RNA, 19 nt, Homo sapiens
ccacaaaugcggagugaaa

SEQ ID NO: 208213 - RNA, 19 nt, Homo sapiens
cgacagggaaucuaucuaa

SEQ ID NO: 208214 - RNA, 19 nt, Homo sapiens
ggucuuggaucaaacucua

SEQ ID NO: 208215 - RNA, 19 nt, Homo sapiens
gauuagagacagugaaauu

SEQ ID NO: 208216 - RNA, 19 nt, Homo sapiens
gagaugggcugaacgugau

SEQ ID NO: 208217 - RNA, 19 nt, Homo sapiens
aaucagaggucccaaggaa

SEQ ID NO: 208218 - RNA, 19 nt, Homo sapiens
ugauguaggugcuguuauu

SEQ ID NO: 208219 - RNA, 19 nt, Homo sapiens
aaucaucgaugcccaggua

SEQ ID NO: 208220 - RNA, 19 nt, Homo sapiens
cauagaaacaccaagauuu

SEQ ID NO: 208221 - RNA, 19 nt, Homo sapiens
ugucagagaugggcucaua

SEQ ID NO: 208222 - RNA, 19 nt, Homo sapiens
gaacauacggcucacaagu

SEQ ID NO: 208223 - RNA, 19 nt, Homo sapiens
ccuaacagcugguggguau

SEQ ID NO: 208224 - RNA, 19 nt, Homo sapiens
aaauugaccucuccaugaa

SEQ ID NO: 208225 - RNA, 19 nt, Homo sapiens
gaaagugcccugugcuaau

SEQ ID NO: 208226 - RNA, 19 nt, Homo sapiens
gaaauaagaagagaagcaa

SEQ ID NO: 208227 - RNA, 19 nt, Homo sapiens
ggacuggguagaaaucuuu

SEQ ID NO: 208228 - RNA, 19 nt, Homo sapiens
gaacguccauuugcaugug

SEQ ID NO: 208229 - RNA, 19 nt, Homo sapiens
ccaaagggaacguccauuu

SEQ ID NO: 208230 - RNA, 19 nt, Homo sapiens
caagaucugucacccacaa

SEQ ID NO: 208231 - RNA, 19 nt, Homo sapiens
caauaucacuuugggagaa

SEQ ID NO: 208232 - RNA, 19 nt, Homo sapiens
gaaauggucaauuggauuc

SEQ ID NO: 208233 - RNA, 19 nt, Homo sapiens
gauaggaguuuucuucaaa

SEQ ID NO: 208234 - RNA, 19 nt, Homo sapiens
cacggaagguuguuuaaga

SEQ ID NO: 208235 - RNA, 19 nt, Homo sapiens
cacaugcucuuucugcuuu

SEQ ID NO: 208236 - RNA, 19 nt, Homo sapiens
gcacaccacugccagacau

SEQ ID NO: 208237 - RNA, 19 nt, Homo sapiens
cauccuaacuuuggaggua

SEQ ID NO: 208238 - RNA, 19 nt, Homo sapiens
gcaggagccagacacauuu

SEQ ID NO: 208239 - RNA, 19 nt, Homo sapiens
gagcuuggccucugcaguu

SEQ ID NO: 208240 - RNA, 19 nt, Homo sapiens
gugcuggccuuucuuucua

SEQ ID NO: 208241 - RNA, 19 nt, Homo sapiens
ugauagaagucuugagguu

SEQ ID NO: 208242 - RNA, 19 nt, Homo sapiens
gcagugugguuuguaaguu

SEQ ID NO: 208243 - RNA, 19 nt, Homo sapiens
guuauuaucucuacguuac

SEQ ID NO: 208244 - RNA, 19 nt, Homo sapiens
cauggugccuuucuuucua

SEQ ID NO: 208245 - RNA, 19 nt, Homo sapiens
acuaguggcugcccaauug

SEQ ID NO: 208246 - RNA, 19 nt, Homo sapiens
gcaccaaaguggaccucuu

SEQ ID NO: 208247 - RNA, 19 nt, Homo sapiens
ccaagaagaucagcaccuu

SEQ ID NO: 208248 - RNA, 19 nt, Homo sapiens
acacuuggauaaacucuau

SEQ ID NO: 208249 - RNA, 19 nt, Homo sapiens
aaacaauucaccuggcuua

SEQ ID NO: 208250 - RNA, 19 nt, Homo sapiens
gacgucuuauuaacucuua

SEQ ID NO: 208251 - RNA, 19 nt, Homo sapiens
gugaagagucuauugguuu

SEQ ID NO: 208252 - RNA, 19 nt, Homo sapiens
ggaauacugcaccuauaaa

SEQ ID NO: 208253 - RNA, 19 nt, Homo sapiens
gcagacaaucuuagcauga

SEQ ID NO: 208254 - RNA, 19 nt, Homo sapiens
gcaaaggaaggaagaagga

SEQ ID NO: 208255 - RNA, 19 nt, Homo sapiens
ggaaggaauucuccagacu

SEQ ID NO: 208256 - RNA, 19 nt, Homo sapiens
gcucuaggcucagcagaug

SEQ ID NO: 208257 - RNA, 19 nt, Homo sapiens
gagccaggaagccuuguua

SEQ ID NO: 208258 - RNA, 19 nt, Homo sapiens
ucuuagaaauggucaauug

SEQ ID NO: 208259 - RNA, 19 nt, Homo sapiens
gggcugaacgugaugauga

SEQ ID NO: 208260 - RNA, 19 nt, Homo sapiens
gaacuuacaguagggaaga

SEQ ID NO: 208261 - RNA, 19 nt, Homo sapiens
aaggagaaaugaucuuaga

SEQ ID NO: 208262 - RNA, 19 nt, Homo sapiens
uagcccagaugcaggauaa

SEQ ID NO: 208263 - RNA, 19 nt, Homo sapiens
gcaucugaaucaaacuaaa

SEQ ID NO: 208264 - RNA, 19 nt, Homo sapiens
aaacccaucuucauuccuu

SEQ ID NO: 208265 - RNA, 19 nt, Homo sapiens
ggagaaaugaucuuagaca

SEQ ID NO: 208266 - RNA, 19 nt, Homo sapiens
gagguccgagucauauuua

SEQ ID NO: 208267 - RNA, 19 nt, Homo sapiens
caacaccacauaucuugaa

SEQ ID NO: 208268 - RNA, 19 nt, Homo sapiens
ucacacaaacgcuuucaaa

SEQ ID NO: 208269 - RNA, 19 nt, Homo sapiens
gaagagaagcaagacagaa

SEQ ID NO: 208270 - RNA, 19 nt, Homo sapiens
ggaaaggaggguucuggaa

SEQ ID NO: 208271 - RNA, 19 nt, Homo sapiens
gaagguuguuuaagaugca

SEQ ID NO: 208272 - RNA, 19 nt, Homo sapiens
ggaccuuccuugugugcuu

SEQ ID NO: 208273 - RNA, 19 nt, Homo sapiens
caauucaccuggcuuaguc

SEQ ID NO: 208274 - RNA, 19 nt, Homo sapiens
ggaagugaagagucuauug

SEQ ID NO: 208275 - RNA, 19 nt, Homo sapiens
ggccaucucuucuuugucu

SEQ ID NO: 208276 - RNA, 19 nt, Homo sapiens
gcaccuccauuuccuuagu

SEQ ID NO: 208277 - RNA, 19 nt, Homo sapiens
cagccuagauuucccugaa

SEQ ID NO: 208278 - RNA, 19 nt, Homo sapiens
gaaaggcauugguuuauga

SEQ ID NO: 208279 - RNA, 19 nt, Homo sapiens
gagaagaggcugugcaaga

SEQ ID NO: 208280 - RNA, 19 nt, Homo sapiens
ugaaaggcauugguuuaug

SEQ ID NO: 208281 - RNA, 19 nt, Homo sapiens
ccugaaaggcauugguuua

SEQ ID NO: 208282 - RNA, 19 nt, Homo sapiens
agaagaggcugugcaagau

SEQ ID NO: 208283 - RNA, 19 nt, Homo sapiens
gaagaggcugugcaagaug

SEQ ID NO: 208284 - RNA, 19 nt, Homo sapiens
gaccugaaaggcauugguu

SEQ ID NO: 208285 - RNA, 19 nt, Homo sapiens
ccacgcaccucgucuaccu

SEQ ID NO: 208286 - RNA, 19 nt, Homo sapiens
aagaggcugugcaagaugu

SEQ ID NO: 208287 - RNA, 19 nt, Homo sapiens
gagcugagggacugcuuca

SEQ ID NO: 208288 - RNA, 19 nt, Homo sapiens
gcaagcugcucgccuuccu

SEQ ID NO: 208289 - RNA, 19 nt, Homo sapiens
gcgcaccaccgcuucuaug

SEQ ID NO: 208290 - RNA, 19 nt, Homo sapiens
gaauucaagacggagaaga

SEQ ID NO: 208291 - RNA, 19 nt, Homo sapiens
cugaaaggcauugguuuau

SEQ ID NO: 208292 - RNA, 19 nt, Homo sapiens
gcaccaccgcuucuaugca

SEQ ID NO: 208293 - RNA, 19 nt, Homo sapiens
gucgugugcuuccucuuca

SEQ ID NO: 208294 - RNA, 19 nt, Homo sapiens
gaaucacgcuucuuucuaa

SEQ ID NO: 208295 - RNA, 19 nt, Homo sapiens
caacugcggugaugaugua

SEQ ID NO: 208296 - RNA, 19 nt, Homo sapiens
guucagccuuugucaauaa

SEQ ID NO: 208297 - RNA, 19 nt, Homo sapiens
gggacaagcugaggcugua

SEQ ID NO: 208298 - RNA, 19 nt, Homo sapiens
gcagguacccagagaguga

SEQ ID NO: 208299 - RNA, 19 nt, Homo sapiens
gggugaagcgccucaguua

SEQ ID NO: 208300 - RNA, 19 nt, Homo sapiens
ggagugagauucgcugaag

SEQ ID NO: 208301 - RNA, 19 nt, Homo sapiens
ucaauaaaccugucaugug

SEQ ID NO: 208302 - RNA, 19 nt, Homo sapiens
gacgaggccugcuucuguu

SEQ ID NO: 208303 - RNA, 19 nt, Homo sapiens
ggaagaggccaccaacauc

SEQ ID NO: 208304 - RNA, 19 nt, Homo sapiens
ugaugaggcuggugacguu

SEQ ID NO: 208305 - RNA, 19 nt, Homo sapiens
gcgugggccuggagaugua

SEQ ID NO: 208306 - RNA, 19 nt, Homo sapiens
gaagaggccaccaacaucu

SEQ ID NO: 208307 - RNA, 19 nt, Homo sapiens
ggacaacugcggugaugau

SEQ ID NO: 208308 - RNA, 19 nt, Homo sapiens
caggaacccuaaagcaaau

SEQ ID NO: 208309 - RNA, 19 nt, Homo sapiens
guacagcagcgucuucuuc

SEQ ID NO: 208310 - RNA, 19 nt, Homo sapiens
gcacgagacugugaaaucc

SEQ ID NO: 208311 - RNA, 19 nt, Homo sapiens
cgacgaggccugcuucugu

SEQ ID NO: 208312 - RNA, 19 nt, Homo sapiens
ugacgaauuuguuucuaca

SEQ ID NO: 208313 - RNA, 19 nt, Homo sapiens
gggaagaggccaccaacau

SEQ ID NO: 208314 - RNA, 19 nt, Homo sapiens
uaacaaacccaacccaaac

SEQ ID NO: 208315 - RNA, 19 nt, Homo sapiens
acaggaacccuaaagcaaa

SEQ ID NO: 208316 - RNA, 19 nt, Homo sapiens
guucagcagugccguguag

SEQ ID NO: 208317 - RNA, 19 nt, Homo sapiens
aagcugaggcuguacauug

SEQ ID NO: 208318 - RNA, 19 nt, Homo sapiens
gcuguggccucaucuggau

SEQ ID NO: 208319 - RNA, 19 nt, Homo sapiens
gugaagcgccucaguuaca

SEQ ID NO: 208320 - RNA, 19 nt, Homo sapiens
ucucuaaacugcggucaga

SEQ ID NO: 208321 - RNA, 19 nt, Homo sapiens
gcugacgaauuuguuucua

SEQ ID NO: 208322 - RNA, 19 nt, Homo sapiens
gugccaggacaaugaaaua

SEQ ID NO: 208323 - RNA, 19 nt, Homo sapiens
gagcuucgaccgcuacauc

SEQ ID NO: 208324 - RNA, 19 nt, Homo sapiens
ucucggagcaccagcagua

SEQ ID NO: 208325 - RNA, 19 nt, Homo sapiens
ccaggacaaugaaauacuc

SEQ ID NO: 208326 - RNA, 19 nt, Homo sapiens
uuaacaaacccaacccaaa

SEQ ID NO: 208327 - RNA, 19 nt, Homo sapiens
gacaucaacauggcaauug

SEQ ID NO: 208328 - RNA, 19 nt, Homo sapiens
ggcuguacauugagcagaa

SEQ ID NO: 208329 - RNA, 19 nt, Homo sapiens
gugaggagcaucuguucuu

SEQ ID NO: 208330 - RNA, 19 nt, Homo sapiens
aaauucaaauggccaguag

SEQ ID NO: 208331 - RNA, 19 nt, Homo sapiens
ggccacgucaugucucuaa

SEQ ID NO: 208332 - RNA, 19 nt, Homo sapiens
cuagcgcaccgccgaguua

SEQ ID NO: 208333 - RNA, 19 nt, Homo sapiens
gaaguaggagugagauucg

SEQ ID NO: 208334 - RNA, 19 nt, Homo sapiens
cagaaggcgcuccgcauga

SEQ ID NO: 208335 - RNA, 19 nt, Homo sapiens
caaaugccaggcucacuuc

SEQ ID NO: 208336 - RNA, 19 nt, Homo sapiens
gacggcagguacccagaga

SEQ ID NO: 208337 - RNA, 19 nt, Homo sapiens
cuggugacguucagccuuu

SEQ ID NO: 208338 - RNA, 19 nt, Homo sapiens
caucuguucuucccacucu

SEQ ID NO: 208339 - RNA, 19 nt, Homo sapiens
cacaggaacccuaaagcaa

SEQ ID NO: 208340 - RNA, 19 nt, Homo sapiens
gcuguacauugagcagaaa

SEQ ID NO: 208341 - RNA, 19 nt, Homo sapiens
agaaggcgcuccgcaugau

SEQ ID NO: 208342 - RNA, 19 nt, Homo sapiens
gcaccuucaugucgcucuu

SEQ ID NO: 208343 - RNA, 19 nt, Homo sapiens
acgaauuuguuucuacaga

SEQ ID NO: 208344 - RNA, 19 nt, Homo sapiens
cgagcugccguguggguua

SEQ ID NO: 208345 - RNA, 19 nt, Homo sapiens
gcacggccacgucaugucu

SEQ ID NO: 208346 - RNA, 19 nt, Homo sapiens
aaucacgcuucuuucuaaa

SEQ ID NO: 208347 - RNA, 19 nt, Homo sapiens
gugaaauccgcaaccauga

SEQ ID NO: 208348 - RNA, 19 nt, Homo sapiens
ucacacagaauugcuacaa

SEQ ID NO: 208349 - RNA, 19 nt, Homo sapiens
aaacgacaccuagaaguag

SEQ ID NO: 208350 - RNA, 19 nt, Homo sapiens
gaguuaaagaggagaagga

SEQ ID NO: 208351 - RNA, 19 nt, Homo sapiens
gagcugccguguggguuag

SEQ ID NO: 208352 - RNA, 19 nt, Homo sapiens
ccggagaacgucuucauca

SEQ ID NO: 208353 - RNA, 19 nt, Homo sapiens
cguucagccuuugucaaua

SEQ ID NO: 208354 - RNA, 19 nt, Homo sapiens
ugaggagcaucuguucuuc

SEQ ID NO: 208355 - RNA, 19 nt, Homo sapiens
acaaaugccaggcucacuu

SEQ ID NO: 208356 - RNA, 19 nt, Homo sapiens
ugacaucaacauggcaauu

SEQ ID NO: 208357 - RNA, 19 nt, Homo sapiens
ggugugaggagcaucuguu

SEQ ID NO: 208358 - RNA, 19 nt, Homo sapiens
guacgugaucggccuguuc

SEQ ID NO: 208359 - RNA, 19 nt, Homo sapiens
gcgcaccgccgaguuaaag

SEQ ID NO: 208360 - RNA, 19 nt, Homo sapiens
ggaacugacgcuggagaug

SEQ ID NO: 208361 - RNA, 19 nt, Homo sapiens
ucugcuggcugccggagaa

SEQ ID NO: 208362 - RNA, 19 nt, Homo sapiens
cugggagccuuucggcaaa

SEQ ID NO: 208363 - RNA, 19 nt, Homo sapiens
aaaacgacaccuagaagua

SEQ ID NO: 208364 - RNA, 19 nt, Homo sapiens
acacaggaacccuaaagca

SEQ ID NO: 208365 - RNA, 19 nt, Homo sapiens
agcugaggcuguacauuga

SEQ ID NO: 208366 - RNA, 19 nt, Homo sapiens
gagugagauucgcugaagu

SEQ ID NO: 208367 - RNA, 19 nt, Homo sapiens
uuaaagaggagaaggaaaa

SEQ ID NO: 208368 - RNA, 19 nt, Homo sapiens
agaaguaggagugagauuc

SEQ ID NO: 208369 - RNA, 19 nt, Homo sapiens
guggccgacucccucauug

SEQ ID NO: 208370 - RNA, 19 nt, Homo sapiens
uccugcaggucaacaugua

SEQ ID NO: 208371 - RNA, 19 nt, Homo sapiens
gguggccgacucccucauu

SEQ ID NO: 208372 - RNA, 19 nt, Homo sapiens
ucucgugccucuacaccau

SEQ ID NO: 208373 - RNA, 19 nt, Homo sapiens
cuaaacugcggucagaugu

SEQ ID NO: 208374 - RNA, 19 nt, Homo sapiens
gccacgucaugucucuaaa

SEQ ID NO: 208375 - RNA, 19 nt, Homo sapiens
cggagaacgucuucaucag

SEQ ID NO: 208376 - RNA, 19 nt, Homo sapiens
gccaggcucacuucaagga

SEQ ID NO: 208377 - RNA, 19 nt, Homo sapiens
uucccacucucugcaguua

SEQ ID NO: 208378 - RNA, 19 nt, Homo sapiens
gcaccagcaguacgugauc

SEQ ID NO: 208379 - RNA, 19 nt, Homo sapiens
gucaauaaaccugucaugu

SEQ ID NO: 208380 - RNA, 19 nt, Homo sapiens
guuaaagaggagaaggaaa

SEQ ID NO: 208381 - RNA, 19 nt, Homo sapiens
ucuaaacugcggucagaug

SEQ ID NO: 208382 - RNA, 19 nt, Homo sapiens
uccaacagcugccuaaacc

SEQ ID NO: 208383 - RNA, 19 nt, Homo sapiens
caucagggcucuccagaaa

SEQ ID NO: 208384 - RNA, 19 nt, Homo sapiens
gcucauaccucggauguca

SEQ ID NO: 208385 - RNA, 19 nt, Homo sapiens
ucaccuaccugcacagugu

SEQ ID NO: 208386 - RNA, 19 nt, Homo sapiens
gcuguuugcucugugcuuu

SEQ ID NO: 208387 - RNA, 19 nt, Homo sapiens
agaaacagcccaagcuuca

SEQ ID NO: 208388 - RNA, 19 nt, Homo sapiens
gcacucuccugccuucagu

SEQ ID NO: 208389 - RNA, 19 nt, Homo sapiens
ccagaguccugaugcacau

SEQ ID NO: 208390 - RNA, 19 nt, Homo sapiens
gcuguggaccuuccuguuc

SEQ ID NO: 208391 - RNA, 19 nt, Homo sapiens
cgggcuugcucaucucuga

SEQ ID NO: 208392 - RNA, 19 nt, Homo sapiens
augcacaucuuccagaauc

SEQ ID NO: 208393 - RNA, 19 nt, Homo sapiens
ucuccugccuucaguuugu

SEQ ID NO: 208394 - RNA, 19 nt, Homo sapiens
ugagaaacagcccaagcuu

SEQ ID NO: 208395 - RNA, 19 nt, Homo sapiens
gacggcuccuucagcauca

SEQ ID NO: 208396 - RNA, 19 nt, Homo sapiens
ggaagccguacgcugucua

SEQ ID NO: 208397 - RNA, 19 nt, Homo sapiens
gagcugcagggcccuuugu

SEQ ID NO: 208398 - RNA, 19 nt, Homo sapiens
ccuuuggccucaucguguu

SEQ ID NO: 208399 - RNA, 19 nt, Homo sapiens
gguccacccucggcuuaag

SEQ ID NO: 208400 - RNA, 19 nt, Homo sapiens
uggcagagauuuccaagaa

SEQ ID NO: 208401 - RNA, 19 nt, Homo sapiens
ggugagcgcuuucuuuauc

SEQ ID NO: 208402 - RNA, 19 nt, Homo sapiens
caaugagacugcccagauu

SEQ ID NO: 208403 - RNA, 19 nt, Homo sapiens
gcucugcgcaccugaaauu

SEQ ID NO: 208404 - RNA, 19 nt, Homo sapiens
ccauugccauguacuauau

SEQ ID NO: 208405 - RNA, 19 nt, Homo sapiens
ggaugacugucuuccguau

SEQ ID NO: 208406 - RNA, 19 nt, Homo sapiens
cuacaucaccuuuguguuc

SEQ ID NO: 208407 - RNA, 19 nt, Homo sapiens
guucaacucugacaaugag

SEQ ID NO: 208408 - RNA, 19 nt, Homo sapiens
guaacugccuccuugucuu

SEQ ID NO: 208409 - RNA, 19 nt, Homo sapiens
gcccagauuuggauugaag

SEQ ID NO: 208410 - RNA, 19 nt, Homo sapiens
caccugaaauuccggacaa

SEQ ID NO: 208411 - RNA, 19 nt, Homo sapiens
gggugaugcucaaggaaau

SEQ ID NO: 208412 - RNA, 19 nt, Homo sapiens
cuggugagcgcuuucuuua

SEQ ID NO: 208413 - RNA, 19 nt, Homo sapiens
caaacucuacaucaccuuu

SEQ ID NO: 208414 - RNA, 19 nt, Homo sapiens
gaggaggaguuucugucau

SEQ ID NO: 208415 - RNA, 19 nt, Homo sapiens
gcuggugagcgcuuucuuu

SEQ ID NO: 208416 - RNA, 19 nt, Homo sapiens
gacgggugaugcucaagga

SEQ ID NO: 208417 - RNA, 19 nt, Homo sapiens
ggucguggagggacacauu

SEQ ID NO: 208418 - RNA, 19 nt, Homo sapiens
cgugaucgcucuuguucca

SEQ ID NO: 208419 - RNA, 19 nt, Homo sapiens
acaaugagacugcccagau

SEQ ID NO: 208420 - RNA, 19 nt, Homo sapiens
gggcuggugcuguggauga

SEQ ID NO: 208421 - RNA, 19 nt, Homo sapiens
gcguucaacucugacaaug

SEQ ID NO: 208422 - RNA, 19 nt, Homo sapiens
cacauuauagggaccauug

SEQ ID NO: 208423 - RNA, 19 nt, Homo sapiens
uugcaucucuguccucuac

SEQ ID NO: 208424 - RNA, 19 nt, Homo sapiens
uaacugccuccuugucuuc

SEQ ID NO: 208425 - RNA, 19 nt, Homo sapiens
aggaggaguuucugucauc

SEQ ID NO: 208426 - RNA, 19 nt, Homo sapiens
ggagaggaggaguuucugu

SEQ ID NO: 208427 - RNA, 19 nt, Homo sapiens
cguggagggacacauuaua

SEQ ID NO: 208428 - RNA, 19 nt, Homo sapiens
uauccugucugcguccauu

SEQ ID NO: 208429 - RNA, 19 nt, Homo sapiens
cuacuuggcguucaacucu

SEQ ID NO: 208430 - RNA, 19 nt, Homo sapiens
gccauguacuauauugucu

SEQ ID NO: 208431 - RNA, 19 nt, Homo sapiens
cgucuucguuggcagagau

SEQ ID NO: 208432 - RNA, 19 nt, Homo sapiens
guggagggacacauuauag

SEQ ID NO: 208433 - RNA, 19 nt, Homo sapiens
gacacgugaucgcucuugu

SEQ ID NO: 208434 - RNA, 19 nt, Homo sapiens
gagacugcccagauuugga

SEQ ID NO: 208435 - RNA, 19 nt, Homo sapiens
cccauugccauguacuaua

SEQ ID NO: 208436 - RNA, 19 nt, Homo sapiens
gauuucaugcucucacugu

SEQ ID NO: 208437 - RNA, 19 nt, Homo sapiens
aaugagacugcccagauuu

SEQ ID NO: 208438 - RNA, 19 nt, Homo sapiens
gcgcuuucuuuaucuucug

SEQ ID NO: 208439 - RNA, 19 nt, Homo sapiens
accagaggcugcagugaca

SEQ ID NO: 208440 - RNA, 19 nt, Homo sapiens
ggcgacgggugaugcucaa

SEQ ID NO: 208441 - RNA, 19 nt, Homo sapiens
ugagcgcuuucuuuaucuu

SEQ ID NO: 208442 - RNA, 19 nt, Homo sapiens
gugagcgcuuucuuuaucu

SEQ ID NO: 208443 - RNA, 19 nt, Homo sapiens
gaaacaaguucuagcauuu

SEQ ID NO: 208444 - RNA, 19 nt, Homo sapiens
gcucguaacuccuuuauug

SEQ ID NO: 208445 - RNA, 19 nt, Homo sapiens
gaaagcacuucagaauuua

SEQ ID NO: 208446 - RNA, 19 nt, Homo sapiens
guaauguucuggcuaauuu

SEQ ID NO: 208447 - RNA, 19 nt, Homo sapiens
ggaaacaaguucuagcauu

SEQ ID NO: 208448 - RNA, 19 nt, Homo sapiens
ggaagaaucuauugaggau

SEQ ID NO: 208449 - RNA, 19 nt, Homo sapiens
gaacauaaucgcccucuau

SEQ ID NO: 208450 - RNA, 19 nt, Homo sapiens
ggugaaagguugcgacuau

SEQ ID NO: 208451 - RNA, 19 nt, Homo sapiens
gagauaagcauaacgcaaa

SEQ ID NO: 208452 - RNA, 19 nt, Homo sapiens
gcaauaacaaccaaacaaa

SEQ ID NO: 208453 - RNA, 19 nt, Homo sapiens
uaacuucauucuuguggua

SEQ ID NO: 208454 - RNA, 19 nt, Homo sapiens
gggcauaauuccacaaugu

SEQ ID NO: 208455 - RNA, 19 nt, Homo sapiens
gaacauguacauuagcauu

SEQ ID NO: 208456 - RNA, 19 nt, Homo sapiens
cuacauuucuucacagcua

SEQ ID NO: 208457 - RNA, 19 nt, Homo sapiens
uaucaugccuuucgauuca

SEQ ID NO: 208458 - RNA, 19 nt, Homo sapiens
aggcgaaccugaacuuuaa

SEQ ID NO: 208459 - RNA, 19 nt, Homo sapiens
gaaccaaguaggagugaaa

SEQ ID NO: 208460 - RNA, 19 nt, Homo sapiens
uguaaaccauuucaaggua

SEQ ID NO: 208461 - RNA, 19 nt, Homo sapiens
caguuuggaucgcuauaua

SEQ ID NO: 208462 - RNA, 19 nt, Homo sapiens
ggaaggcaauaacaaccaa

SEQ ID NO: 208463 - RNA, 19 nt, Homo sapiens
uagauccagucauguauuu

SEQ ID NO: 208464 - RNA, 19 nt, Homo sapiens
ccacagaaugcgcuuuaua

SEQ ID NO: 208465 - RNA, 19 nt, Homo sapiens
gaagucauaccauaacaau

SEQ ID NO: 208466 - RNA, 19 nt, Homo sapiens
ugaaagguugcgacuauua

SEQ ID NO: 208467 - RNA, 19 nt, Homo sapiens
gcuuaacuguaaaccauuu

SEQ ID NO: 208468 - RNA, 19 nt, Homo sapiens
gugguaauguucuggcuaa

SEQ ID NO: 208469 - RNA, 19 nt, Homo sapiens
agaaugcgcuuuauaacca

SEQ ID NO: 208470 - RNA, 19 nt, Homo sapiens
uauauaaugcagccucuua

SEQ ID NO: 208471 - RNA, 19 nt, Homo sapiens
cacagaaugcgcuuuauaa

SEQ ID NO: 208472 - RNA, 19 nt, Homo sapiens
uaaugcagccucuuaauuc

SEQ ID NO: 208473 - RNA, 19 nt, Homo sapiens
gauacucccugcaugauac

SEQ ID NO: 208474 - RNA, 19 nt, Homo sapiens
ccacaaaacuucucagcaa

SEQ ID NO: 208475 - RNA, 19 nt, Homo sapiens
gagaagucauaccauaaca

SEQ ID NO: 208476 - RNA, 19 nt, Homo sapiens
gcacuugauacuaauuuga

SEQ ID NO: 208477 - RNA, 19 nt, Homo sapiens
caacggaaggcaauaacaa

SEQ ID NO: 208478 - RNA, 19 nt, Homo sapiens
gcuaauacucuuaacauag

SEQ ID NO: 208479 - RNA, 19 nt, Homo sapiens
ggacugguugggaacauaa

SEQ ID NO: 208480 - RNA, 19 nt, Homo sapiens
uaacaaugacgacaacuuc

SEQ ID NO: 208481 - RNA, 19 nt, Homo sapiens
ggauacucccugcaugaua

SEQ ID NO: 208482 - RNA, 19 nt, Homo sapiens
gcuuagauccagucaugua

SEQ ID NO: 208483 - RNA, 19 nt, Homo sapiens
aaaaggaggucaaaauuuc

SEQ ID NO: 208484 - RNA, 19 nt, Homo sapiens
ggauuccuaacuaugauua

SEQ ID NO: 208485 - RNA, 19 nt, Homo sapiens
aaacucagaucucaaagcu

SEQ ID NO: 208486 - RNA, 19 nt, Homo sapiens
aaccugaacuuuaaugcaa

SEQ ID NO: 208487 - RNA, 19 nt, Homo sapiens
ucucaucuuucaauaguug

SEQ ID NO: 208488 - RNA, 19 nt, Homo sapiens
guucucucaucuuucaaua

SEQ ID NO: 208489 - RNA, 19 nt, Homo sapiens
ggaacauaaucgcccucua

SEQ ID NO: 208490 - RNA, 19 nt, Homo sapiens
uguauaauuugccacugua

SEQ ID NO: 208491 - RNA, 19 nt, Homo sapiens
gccauaguuucucaaguga

SEQ ID NO: 208492 - RNA, 19 nt, Homo sapiens
gaaaggagggcauaauucc

SEQ ID NO: 208493 - RNA, 19 nt, Homo sapiens
uaaucgcccucuauguauu

SEQ ID NO: 208494 - RNA, 19 nt, Homo sapiens
ccaaauagaagacaaugag

SEQ ID NO: 208495 - RNA, 19 nt, Homo sapiens
gccuaaaucucuauaacag

SEQ ID NO: 208496 - RNA, 19 nt, Homo sapiens
gggacugguugggaacaua

SEQ ID NO: 208497 - RNA, 19 nt, Homo sapiens
ugccauaguuucucaagug

SEQ ID NO: 208498 - RNA, 19 nt, Homo sapiens
uugcuuagauccagucaug

SEQ ID NO: 208499 - RNA, 19 nt, Homo sapiens
gguggauuccuaacuauga

SEQ ID NO: 208500 - RNA, 19 nt, Homo sapiens
cugccucccuuuccgaaua

SEQ ID NO: 208501 - RNA, 19 nt, Homo sapiens
gaaugcgcuuuauaaccaa

SEQ ID NO: 208502 - RNA, 19 nt, Homo sapiens
ugcagccucuuaauucuuu

SEQ ID NO: 208503 - RNA, 19 nt, Homo sapiens
gaaccugaacuuuaaugca

SEQ ID NO: 208504 - RNA, 19 nt, Homo sapiens
aagaaaggagggcauaauu

SEQ ID NO: 208505 - RNA, 19 nt, Homo sapiens
cuugguggauuccuaacua

SEQ ID NO: 208506 - RNA, 19 nt, Homo sapiens
aaaauaaugugccaacuuc

SEQ ID NO: 208507 - RNA, 19 nt, Homo sapiens
ucucucaucuuucaauagu

SEQ ID NO: 208508 - RNA, 19 nt, Homo sapiens
cgauucaucuacauuucuu

SEQ ID NO: 208509 - RNA, 19 nt, Homo sapiens
ggcaauaacaaccaaacaa

SEQ ID NO: 208510 - RNA, 19 nt, Homo sapiens
auugcuaucuacuguguua

SEQ ID NO: 208511 - RNA, 19 nt, Homo sapiens
gaaagguugcgacuauuac

SEQ ID NO: 208512 - RNA, 19 nt, Homo sapiens
agucauguauuuccugaug

SEQ ID NO: 208513 - RNA, 19 nt, Homo sapiens
aaauugcuaucuacugugu

SEQ ID NO: 208514 - RNA, 19 nt, Homo sapiens
gccacuguauucauuuaug

SEQ ID NO: 208515 - RNA, 19 nt, Homo sapiens
aaagugccauaguuucuca

SEQ ID NO: 208516 - RNA, 19 nt, Homo sapiens
gaaauuuauggcucuaaca

SEQ ID NO: 208517 - RNA, 19 nt, Homo sapiens
caaguucuagcauuuacaa

SEQ ID NO: 208518 - RNA, 19 nt, Homo sapiens
caaggugaaccaaguagga

SEQ ID NO: 208519 - RNA, 19 nt, Homo sapiens
gugaaagguugcgacuauu

SEQ ID NO: 208520 - RNA, 19 nt, Homo sapiens
gcagaccuccuacucaucu

SEQ ID NO: 208521 - RNA, 19 nt, Homo sapiens
caaauagaagacaaugaga

SEQ ID NO: 208522 - RNA, 19 nt, Homo sapiens
auacaucuguggcagugaa

SEQ ID NO: 208523 - RNA, 19 nt, Homo sapiens
cuucacagcuaaauguauc

SEQ ID NO: 208524 - RNA, 19 nt, Homo sapiens
gguaauguucuggcuaauu

SEQ ID NO: 208525 - RNA, 19 nt, Homo sapiens
gaagcaugcccugaauaga

SEQ ID NO: 208526 - RNA, 19 nt, Homo sapiens
cuaaauguaucaucuugcu

SEQ ID NO: 208527 - RNA, 19 nt, Homo sapiens
agcaugcccugaauagauu

SEQ ID NO: 208528 - RNA, 19 nt, Homo sapiens
uaagaaaggagggcauaau

SEQ ID NO: 208529 - RNA, 19 nt, Homo sapiens
uugcuuggauucaucaguu

SEQ ID NO: 208530 - RNA, 19 nt, Homo sapiens
ccugaacuuuaaugcaauu

SEQ ID NO: 208531 - RNA, 19 nt, Homo sapiens
auaaugcagccucuuaauu

SEQ ID NO: 208532 - RNA, 19 nt, Homo sapiens
agaagacaaugagaaguca

SEQ ID NO: 208533 - RNA, 19 nt, Homo sapiens
gcucuugguggauuccuaa

SEQ ID NO: 208534 - RNA, 19 nt, Homo sapiens
caauaacaaccaaacaaag

SEQ ID NO: 208535 - RNA, 19 nt, Homo sapiens
uugcuuaacuguaaaccau

SEQ ID NO: 208536 - RNA, 19 nt, Homo sapiens
ugaagcaugcccugaauag

SEQ ID NO: 208537 - RNA, 19 nt, Homo sapiens
auaaugugccaacuucuuu

SEQ ID NO: 208538 - RNA, 19 nt, Homo sapiens
agaaaggagggcauaauuc

SEQ ID NO: 208539 - RNA, 19 nt, Homo sapiens
guuuggaucgcuauauaaa

SEQ ID NO: 208540 - RNA, 19 nt, Homo sapiens
uugccacuguauucauuua

SEQ ID NO: 208541 - RNA, 19 nt, Homo sapiens
cauaguuucucaagugacu

SEQ ID NO: 208542 - RNA, 19 nt, Homo sapiens
aagcaugcccugaauagau

SEQ ID NO: 208543 - RNA, 19 nt, Homo sapiens
ggacggagacccgcaucua

SEQ ID NO: 208544 - RNA, 19 nt, Homo sapiens
ggagcacccggcacaauuu

SEQ ID NO: 208545 - RNA, 19 nt, Homo sapiens
gggccaaccuccugguguu

SEQ ID NO: 208546 - RNA, 19 nt, Homo sapiens
gcaucuaccugaccaacag

SEQ ID NO: 208547 - RNA, 19 nt, Homo sapiens
gagacccgcaucuacauga

SEQ ID NO: 208548 - RNA, 19 nt, Homo sapiens
gggcuucuacgccuacuug

SEQ ID NO: 208549 - RNA, 19 nt, Homo sapiens
gugcgugacccucgccuaa

SEQ ID NO: 208550 - RNA, 19 nt, Homo sapiens
gcacccggcacaauuucaa

SEQ ID NO: 208551 - RNA, 19 nt, Homo sapiens
caucugcuacuacuacaug

SEQ ID NO: 208552 - RNA, 19 nt, Homo sapiens
cuacauggccaaggaguuc

SEQ ID NO: 208553 - RNA, 19 nt, Homo sapiens
gcaucuacaugaccaaccu

SEQ ID NO: 208554 - RNA, 19 nt, Homo sapiens
acuacuacauggccaagga

SEQ ID NO: 208555 - RNA, 19 nt, Homo sapiens
ggagacccgcaucuacaug

SEQ ID NO: 208556 - RNA, 19 nt, Homo sapiens
gagcacccggcacaauuuc

SEQ ID NO: 208557 - RNA, 19 nt, Homo sapiens
uaaccagcaagcucucaga

SEQ ID NO: 208558 - RNA, 19 nt, Homo sapiens
ggcacaauuucaacuccau

SEQ ID NO: 208559 - RNA, 19 nt, Homo sapiens
gcagaaaggugcauuauua

SEQ ID NO: 208560 - RNA, 19 nt, Homo sapiens
uaagaucucuccugauuua

SEQ ID NO: 208561 - RNA, 19 nt, Homo sapiens
ggugggagcucuauuguua

SEQ ID NO: 208562 - RNA, 19 nt, Homo sapiens
gaaaauaucugcaacauug

SEQ ID NO: 208563 - RNA, 19 nt, Homo sapiens
caauggaccuccuuaauau

SEQ ID NO: 208564 - RNA, 19 nt, Homo sapiens
gaaaggugcauuauuaaga

SEQ ID NO: 208565 - RNA, 19 nt, Homo sapiens
gcaagaucgugcccuauau

SEQ ID NO: 208566 - RNA, 19 nt, Homo sapiens
caaacuugcuguuauaugg

SEQ ID NO: 208567 - RNA, 19 nt, Homo sapiens
acaauggaccuccuuaaua

SEQ ID NO: 208568 - RNA, 19 nt, Homo sapiens
gccgugaaauguccacuuu

SEQ ID NO: 208569 - RNA, 19 nt, Homo sapiens
auuaagaucucuccugauu

SEQ ID NO: 208570 - RNA, 19 nt, Homo sapiens
caagaucgugcccuauaua

SEQ ID NO: 208571 - RNA, 19 nt, Homo sapiens
cacgaaggguggacaauug

SEQ ID NO: 208572 - RNA, 19 nt, Homo sapiens
ggacuucuccugcaagauc

SEQ ID NO: 208573 - RNA, 19 nt, Homo sapiens
ugccaaacuugcuguuaua

SEQ ID NO: 208574 - RNA, 19 nt, Homo sapiens
gcacgaaggguggacaauu

SEQ ID NO: 208575 - RNA, 19 nt, Homo sapiens
ggagagcugugcaccuaca

SEQ ID NO: 208576 - RNA, 19 nt, Homo sapiens
gaacucucgccuuucagua

SEQ ID NO: 208577 - RNA, 19 nt, Homo sapiens
cuucaacggugaccaguga

SEQ ID NO: 208578 - RNA, 19 nt, Homo sapiens
cagaaaggugcauuauuaa

SEQ ID NO: 208579 - RNA, 19 nt, Homo sapiens
gacaauggaccuccuuaau

SEQ ID NO: 208580 - RNA, 19 nt, Homo sapiens
caacuagagagucagauga

SEQ ID NO: 208581 - RNA, 19 nt, Homo sapiens
uccacgagcugaccaagaa

SEQ ID NO: 208582 - RNA, 19 nt, Homo sapiens
caaggugucugccucuucu

SEQ ID NO: 208583 - RNA, 19 nt, Homo sapiens
gaucgugcccuauauagag

SEQ ID NO: 208584 - RNA, 19 nt, Homo sapiens
gaauggauccuugggugaa

SEQ ID NO: 208585 - RNA, 19 nt, Homo sapiens
ggagccuucugaaacuuug

SEQ ID NO: 208586 - RNA, 19 nt, Homo sapiens
cagauguacuacgaaauga

SEQ ID NO: 208587 - RNA, 19 nt, Homo sapiens
guacaccacggaacucgaa

SEQ ID NO: 208588 - RNA, 19 nt, Homo sapiens
gagagucagaugaacugua

SEQ ID NO: 208589 - RNA, 19 nt, Homo sapiens
ggugaccagugaugacaau

SEQ ID NO: 208590 - RNA, 19 nt, Homo sapiens
gcacugaccauuuuauaug

SEQ ID NO: 208591 - RNA, 19 nt, Homo sapiens
ccagacaccaucuauguuc

SEQ ID NO: 208592 - RNA, 19 nt, Homo sapiens
ggaccuccuuaauaucauc

SEQ ID NO: 208593 - RNA, 19 nt, Homo sapiens
gaucucuccugauuuacca

SEQ ID NO: 208594 - RNA, 19 nt, Homo sapiens
cucaacaacugccaaacuu

SEQ ID NO: 208595 - RNA, 19 nt, Homo sapiens
agagucagaugaacuguac

SEQ ID NO: 208596 - RNA, 19 nt, Homo sapiens
cugccaaacuugcuguuau

SEQ ID NO: 208597 - RNA, 19 nt, Homo sapiens
gggacuuucucaucaucuu

SEQ ID NO: 208598 - RNA, 19 nt, Homo sapiens
acagauguacuacgaaaug

SEQ ID NO: 208599 - RNA, 19 nt, Homo sapiens
gaaaugaucgaaaacuguu

SEQ ID NO: 208600 - RNA, 19 nt, Homo sapiens
uaccauacgccgugaaaug

SEQ ID NO: 208601 - RNA, 19 nt, Homo sapiens
uaccagacaccaucuaugu

SEQ ID NO: 208602 - RNA, 19 nt, Homo sapiens
ggcagaaaggugcauuauu

SEQ ID NO: 208603 - RNA, 19 nt, Homo sapiens
ggggagagcugugcaccua

SEQ ID NO: 208604 - RNA, 19 nt, Homo sapiens
cuccagcucuuccuucaga

SEQ ID NO: 208605 - RNA, 19 nt, Homo sapiens
caacggugaccagugauga

SEQ ID NO: 208606 - RNA, 19 nt, Homo sapiens
gauguacuacgaaaugauc

SEQ ID NO: 208607 - RNA, 19 nt, Homo sapiens
agucaccaccuucaccuua

SEQ ID NO: 208608 - RNA, 19 nt, Homo sapiens
ugcaagaucgugcccuaua

SEQ ID NO: 208609 - RNA, 19 nt, Homo sapiens
gaccagugaugacaaugac

SEQ ID NO: 208610 - RNA, 19 nt, Homo sapiens
agauucaacuagagaguca

SEQ ID NO: 208611 - RNA, 19 nt, Homo sapiens
cagaggcgcuggcauuucc

SEQ ID NO: 208612 - RNA, 19 nt, Homo sapiens
agacaauggaccuccuuaa

SEQ ID NO: 208613 - RNA, 19 nt, Homo sapiens
cauuguuacugccuacaug

SEQ ID NO: 208614 - RNA, 19 nt, Homo sapiens
caccaucaccugcucucua

SEQ ID NO: 208615 - RNA, 19 nt, Homo sapiens
gcucuauuguuagcacuuc

SEQ ID NO: 208616 - RNA, 19 nt, Homo sapiens
gcucuuccuucagaucuca

SEQ ID NO: 208617 - RNA, 19 nt, Homo sapiens
ucuagugacugcgaggaaa

SEQ ID NO: 208618 - RNA, 19 nt, Homo sapiens
ggugguauuuuggcuguua

SEQ ID NO: 208619 - RNA, 19 nt, Homo sapiens
ucaccaccuucaccuuaug

SEQ ID NO: 208620 - RNA, 19 nt, Homo sapiens
gucaccaccuucaccuuau

SEQ ID NO: 208621 - RNA, 19 nt, Homo sapiens
ugaccagugaugacaauga

SEQ ID NO: 208622 - RNA, 19 nt, Homo sapiens
gacaccaucuauguucuag

SEQ ID NO: 208623 - RNA, 19 nt, Homo sapiens
caaggaggauuugggguuu

SEQ ID NO: 208624 - RNA, 19 nt, Homo sapiens
ccaaacuugcuguuauaug

SEQ ID NO: 208625 - RNA, 19 nt, Homo sapiens
ggagcagagugugaagaca

SEQ ID NO: 208626 - RNA, 19 nt, Homo sapiens
cgugaaauguccacuuuug

SEQ ID NO: 208627 - RNA, 19 nt, Homo sapiens
ccagugaugacaaugacaa

SEQ ID NO: 208628 - RNA, 19 nt, Homo sapiens
cagacaauggaccuccuua

SEQ ID NO: 208629 - RNA, 19 nt, Homo sapiens
uaaacggcagauucaacua

SEQ ID NO: 208630 - RNA, 19 nt, Homo sapiens
gagccuacgcggucaugug

SEQ ID NO: 208631 - RNA, 19 nt, Homo sapiens
gcagacaauggaccuccuu

SEQ ID NO: 208632 - RNA, 19 nt, Homo sapiens
caccugcucucuagugacu

SEQ ID NO: 208633 - RNA, 19 nt, Homo sapiens
ucaacuagagagucagaug

SEQ ID NO: 208634 - RNA, 19 nt, Homo sapiens
gcagauucaacuagagagu

SEQ ID NO: 208635 - RNA, 19 nt, Homo sapiens
gccuguacccgagggaaua

SEQ ID NO: 208636 - RNA, 19 nt, Homo sapiens
guacuacgaaaugaucgaa

SEQ ID NO: 208637 - RNA, 19 nt, Homo sapiens
guccagaaacgaaacuugu

SEQ ID NO: 208638 - RNA, 19 nt, Homo sapiens
ggacuuucucaucaucuuc

SEQ ID NO: 208639 - RNA, 19 nt, Homo sapiens
cucgaacucucgccuuuca

SEQ ID NO: 208640 - RNA, 19 nt, Homo sapiens
aacucgaacucucgccuuu

SEQ ID NO: 208641 - RNA, 19 nt, Homo sapiens
aaacggcagauucaacuag

SEQ ID NO: 208642 - RNA, 19 nt, Homo sapiens
ggaccgggaaauucugcaa

SEQ ID NO: 208643 - RNA, 19 nt, Homo sapiens
ucaacaacugccaaacuug

SEQ ID NO: 208644 - RNA, 19 nt, Homo sapiens
caucaccugcucucuagug

SEQ ID NO: 208645 - RNA, 19 nt, Homo sapiens
agacaccaucuauguucua

SEQ ID NO: 208646 - RNA, 19 nt, Homo sapiens
caggagccuucugaaacuu

SEQ ID NO: 208647 - RNA, 19 nt, Homo sapiens
gugaugacaaugacaacga

SEQ ID NO: 208648 - RNA, 19 nt, Homo sapiens
uuaauaucaucagccaguu

SEQ ID NO: 208649 - RNA, 19 nt, Homo sapiens
aacggcagauucaacuaga

SEQ ID NO: 208650 - RNA, 19 nt, Homo sapiens
cagcugagcaaggaggauu

SEQ ID NO: 208651 - RNA, 19 nt, Homo sapiens
cgggaaauucugcaagaga

SEQ ID NO: 208652 - RNA, 19 nt, Homo sapiens
gccuuccgcuggucaucuu

SEQ ID NO: 208653 - RNA, 19 nt, Homo sapiens
caucuccaacucccucuug

SEQ ID NO: 208654 - RNA, 19 nt, Homo sapiens
accaucaccugcucucuag

SEQ ID NO: 208655 - RNA, 19 nt, Homo sapiens
cagacaccaucuauguucu

SEQ ID NO: 208656 - RNA, 19 nt, Homo sapiens
uuaagaucucuccugauuu

SEQ ID NO: 208657 - RNA, 19 nt, Homo sapiens
agaaaggugcauuauuaag

SEQ ID NO: 208658 - RNA, 19 nt, Homo sapiens
ggcagaaucauuuacauaa

SEQ ID NO: 208659 - RNA, 19 nt, Homo sapiens
ucuacaaccucauuucaaa

SEQ ID NO: 208660 - RNA, 19 nt, Homo sapiens
gacaagcgcuaacgugaag

SEQ ID NO: 208661 - RNA, 19 nt, Homo sapiens
ccgagaggcuuccacagaa

SEQ ID NO: 208662 - RNA, 19 nt, Homo sapiens
gcgcaucuaucaacccaau

SEQ ID NO: 208663 - RNA, 19 nt, Homo sapiens
gcgcuaacgugaagacgau

SEQ ID NO: 208664 - RNA, 19 nt, Homo sapiens
uaucugagcgcaucuauca

SEQ ID NO: 208665 - RNA, 19 nt, Homo sapiens
ggaccaccaccaacuugua

SEQ ID NO: 208666 - RNA, 19 nt, Homo sapiens
caucgucgcucugcaacuu

SEQ ID NO: 208667 - RNA, 19 nt, Homo sapiens
gaagauucgcggaugaugu

SEQ ID NO: 208668 - RNA, 19 nt, Homo sapiens
caaccucauuucaaagaag

SEQ ID NO: 208669 - RNA, 19 nt, Homo sapiens
gguggugguucuggcauuu

SEQ ID NO: 208670 - RNA, 19 nt, Homo sapiens
uaacaucgucgcucugcaa

SEQ ID NO: 208671 - RNA, 19 nt, Homo sapiens
aagauucgcggaugaugua

SEQ ID NO: 208672 - RNA, 19 nt, Homo sapiens
gguucuggcauuuauaauu

SEQ ID NO: 208673 - RNA, 19 nt, Homo sapiens
uggcagaaucauuuacaua

SEQ ID NO: 208674 - RNA, 19 nt, Homo sapiens
cacguuggcagaaucauuu

SEQ ID NO: 208675 - RNA, 19 nt, Homo sapiens
gcaacguggugaccgugau

SEQ ID NO: 208676 - RNA, 19 nt, Homo sapiens
gccgagaggcuuccacaga

SEQ ID NO: 208677 - RNA, 19 nt, Homo sapiens
ggucaccaccgccuacuuc

SEQ ID NO: 208678 - RNA, 19 nt, Homo sapiens
gugguucuggcauuuauaa

SEQ ID NO: 208679 - RNA, 19 nt, Homo sapiens
ucaacccaauccucuacaa

SEQ ID NO: 208680 - RNA, 19 nt, Homo sapiens
acauaaacacggaagauuc

SEQ ID NO: 208681 - RNA, 19 nt, Homo sapiens
ccacguuggcagaaucauu

SEQ ID NO: 208682 - RNA, 19 nt, Homo sapiens
caccaccgccuacuucuuc

SEQ ID NO: 208683 - RNA, 19 nt, Homo sapiens
acaaccucauuucaaagaa

SEQ ID NO: 208684 - RNA, 19 nt, Homo sapiens
agacaagcgcuaacgugaa

SEQ ID NO: 208685 - RNA, 19 nt, Homo sapiens
uacaaccucauuucaaaga

SEQ ID NO: 208686 - RNA, 19 nt, Homo sapiens
ggaagauucgcggaugaug

SEQ ID NO: 208687 - RNA, 19 nt, Homo sapiens
uacauaaacacggaagauu

SEQ ID NO: 208688 - RNA, 19 nt, Homo sapiens
gcggaccaccaccaacuug

SEQ ID NO: 208689 - RNA, 19 nt, Homo sapiens
cauaaacacggaagauucg

SEQ ID NO: 208690 - RNA, 19 nt, Homo sapiens
caacguggugaccgugaug

SEQ ID NO: 208691 - RNA, 19 nt, Homo sapiens
ccacgcugcugcacaugac

SEQ ID NO: 208692 - RNA, 19 nt, Homo sapiens
acggaagauucgcggauga

SEQ ID NO: 208693 - RNA, 19 nt, Homo sapiens
ccucuacaaccucauuuca

SEQ ID NO: 208694 - RNA, 19 nt, Homo sapiens
gcacugcccuugcuguuug

SEQ ID NO: 208695 - RNA, 19 nt, Homo sapiens
gcucggacaucuugguguu

SEQ ID NO: 208696 - RNA, 19 nt, Homo sapiens
gcagaagaaaggauacuug

SEQ ID NO: 208697 - RNA, 19 nt, Homo sapiens
aaggagaacugagaagauu

SEQ ID NO: 208698 - RNA, 19 nt, Homo sapiens
ucaggagcaugaaguuuga

SEQ ID NO: 208699 - RNA, 19 nt, Homo sapiens
ugacugcucccaaaucauu

SEQ ID NO: 208700 - RNA, 19 nt, Homo sapiens
gcaaggagaacugagaaga

SEQ ID NO: 208701 - RNA, 19 nt, Homo sapiens
uccaauauguccaucugua

SEQ ID NO: 208702 - RNA, 19 nt, Homo sapiens
cccgagaccuccaauaugu

SEQ ID NO: 208703 - RNA, 19 nt, Homo sapiens
gaaaggauacuugcagaag

SEQ ID NO: 208704 - RNA, 19 nt, Homo sapiens
gcgcgaaaccagccaauuc

SEQ ID NO: 208705 - RNA, 19 nt, Homo sapiens
gggaacagcgccaccauuc

SEQ ID NO: 208706 - RNA, 19 nt, Homo sapiens
gcugcacacuuuccucuuc

SEQ ID NO: 208707 - RNA, 19 nt, Homo sapiens
ggaggcagaccaucaucuu

SEQ ID NO: 208708 - RNA, 19 nt, Homo sapiens
gcuacacccuguccugcaa

SEQ ID NO: 208709 - RNA, 19 nt, Homo sapiens
ugaugcaggugcucaugaa

SEQ ID NO: 208710 - RNA, 19 nt, Homo sapiens
ggaggugacagaccacaug

SEQ ID NO: 208711 - RNA, 19 nt, Homo sapiens
aaggauacuugcagaagga

SEQ ID NO: 208712 - RNA, 19 nt, Homo sapiens
gcugauuguugugacauug

SEQ ID NO: 208713 - RNA, 19 nt, Homo sapiens
cccaggugcugcagaagaa

SEQ ID NO: 208714 - RNA, 19 nt, Homo sapiens
caaggagaacugagaagau

SEQ ID NO: 208715 - RNA, 19 nt, Homo sapiens
caggugaagcugcugauug

SEQ ID NO: 208716 - RNA, 19 nt, Homo sapiens
gucauugagucucgaguca

SEQ ID NO: 208717 - RNA, 19 nt, Homo sapiens
ggagaacugagaagauuuu

SEQ ID NO: 208718 - RNA, 19 nt, Homo sapiens
uaccucagcucggucauca

SEQ ID NO: 208719 - RNA, 19 nt, Homo sapiens
ccauggaguucuacagcau

SEQ ID NO: 208720 - RNA, 19 nt, Homo sapiens
ugguguaccugaucaucuu

SEQ ID NO: 208721 - RNA, 19 nt, Homo sapiens
ccaaccagauucggaggau

SEQ ID NO: 208722 - RNA, 19 nt, Homo sapiens
gcccgagaccuccaauaug

SEQ ID NO: 208723 - RNA, 19 nt, Homo sapiens
agugacugcucccaaauca

SEQ ID NO: 208724 - RNA, 19 nt, Homo sapiens
guugugacauuggccguau

SEQ ID NO: 208725 - RNA, 19 nt, Homo sapiens
ggaguucuacagcaucauc

SEQ ID NO: 208726 - RNA, 19 nt, Homo sapiens
gcccaacucaggcgcgaaa

SEQ ID NO: 208727 - RNA, 19 nt, Homo sapiens
caaaaucacccuuauucug

SEQ ID NO: 208728 - RNA, 19 nt, Homo sapiens
gaggcugauuguugugaca

SEQ ID NO: 208729 - RNA, 19 nt, Homo sapiens
agucuaagucccagucauu

SEQ ID NO: 208730 - RNA, 19 nt, Homo sapiens
ggaucaaaaucacccuuau

SEQ ID NO: 208731 - RNA, 19 nt, Homo sapiens
ucuacagcaucaucuggaa

SEQ ID NO: 208732 - RNA, 19 nt, Homo sapiens
gaucaaaaucacccuuauu

SEQ ID NO: 208733 - RNA, 19 nt, Homo sapiens
ucaucaacccgcuccugua

SEQ ID NO: 208734 - RNA, 19 nt, Homo sapiens
ggaaguccgagagcgaaga

SEQ ID NO: 208735 - RNA, 19 nt, Homo sapiens
ccuccaauauguccaucug

SEQ ID NO: 208736 - RNA, 19 nt, Homo sapiens
aggugaagcugcugauugg

SEQ ID NO: 208737 - RNA, 19 nt, Homo sapiens
gcacgccaaccacgagaag

SEQ ID NO: 208738 - RNA, 19 nt, Homo sapiens
gccaggaggcagaccauca

SEQ ID NO: 208739 - RNA, 19 nt, Homo sapiens
gaugcaggugcucaugaaa

SEQ ID NO: 208740 - RNA, 19 nt, Homo sapiens
caucaacccgcuccuguac

SEQ ID NO: 208741 - RNA, 19 nt, Homo sapiens
ggcugauuguugugacauu

SEQ ID NO: 208742 - RNA, 19 nt, Homo sapiens
gaggcagaccaucaucuuc

SEQ ID NO: 208743 - RNA, 19 nt, Homo sapiens
agaaaggauacuugcagaa

SEQ ID NO: 208744 - RNA, 19 nt, Homo sapiens
cauugagucucgagucacu

SEQ ID NO: 208745 - RNA, 19 nt, Homo sapiens
gggcaagucccagaaguaa

SEQ ID NO: 208746 - RNA, 19 nt, Homo sapiens
ucaccugggucuggucuuu

SEQ ID NO: 208747 - RNA, 19 nt, Homo sapiens
gcuggugaccgguuacuug

SEQ ID NO: 208748 - RNA, 19 nt, Homo sapiens
ggaguguggugcuuaaucc

SEQ ID NO: 208749 - RNA, 19 nt, Homo sapiens
ccuggaguguggugcuuaa

SEQ ID NO: 208750 - RNA, 19 nt, Homo sapiens
gacagugugugcggcaaga

SEQ ID NO: 208751 - RNA, 19 nt, Homo sapiens
ccacuucuucccacucuau

SEQ ID NO: 208752 - RNA, 19 nt, Homo sapiens
guccuggccugaagacagu

SEQ ID NO: 208753 - RNA, 19 nt, Homo sapiens
ccuccaacguggccagcuu

SEQ ID NO: 208754 - RNA, 19 nt, Homo sapiens
gcccacuucuucccacucu

SEQ ID NO: 208755 - RNA, 19 nt, Homo sapiens
caacuuccuugucugcuuu

SEQ ID NO: 208756 - RNA, 19 nt, Homo sapiens
ggaccgaccagcugaaaga

SEQ ID NO: 208757 - RNA, 19 nt, Homo sapiens
cgguguaccuucucacuuu

SEQ ID NO: 208758 - RNA, 19 nt, Homo sapiens
gaaagaaagaccagugaac

SEQ ID NO: 208759 - RNA, 19 nt, Homo sapiens
ggcuauaucugcggugaaa

SEQ ID NO: 208760 - RNA, 19 nt, Homo sapiens
gcaccaaugggaccugcua

SEQ ID NO: 208761 - RNA, 19 nt, Homo sapiens
cagcguggucuacgucaua

SEQ ID NO: 208762 - RNA, 19 nt, Homo sapiens
gcaggcaggucuggugagu

SEQ ID NO: 208763 - RNA, 19 nt, Homo sapiens
cggccacgcugcucaacuu

SEQ ID NO: 208764 - RNA, 19 nt, Homo sapiens
aaagaaagaccagugaaca

SEQ ID NO: 208765 - RNA, 19 nt, Homo sapiens
ccgaccagcugaaagaaag

SEQ ID NO: 208766 - RNA, 19 nt, Homo sapiens
aggcaggucuggugagugu

SEQ ID NO: 208767 - RNA, 19 nt, Homo sapiens
ucaacuuccuugucugcuu

SEQ ID NO: 208768 - RNA, 19 nt, Homo sapiens
ccuacaacgugucccaugu

SEQ ID NO: 208769 - RNA, 19 nt, Homo sapiens
ggaucuacgugacgcuucu

SEQ ID NO: 208770 - RNA, 19 nt, Homo sapiens
ugaaagaaagaccagugaa

SEQ ID NO: 208771 - RNA, 19 nt, Homo sapiens
ccuggcagcugugagcauu

SEQ ID NO: 208772 - RNA, 19 nt, Homo sapiens
uggcagcugugagcauuga

SEQ ID NO: 208773 - RNA, 19 nt, Homo sapiens
gguguaccuucucacuuuc

SEQ ID NO: 208774 - RNA, 19 nt, Homo sapiens
cugcucaacuuccuugucu

SEQ ID NO: 208775 - RNA, 19 nt, Homo sapiens
guuccaagccgacuuucau

SEQ ID NO: 208776 - RNA, 19 nt, Homo sapiens
uggcugugguccucuuugu

SEQ ID NO: 208777 - RNA, 19 nt, Homo sapiens
gcaaucacugguucgucuu

SEQ ID NO: 208778 - RNA, 19 nt, Homo sapiens
gcagcguggucuacgucau

SEQ ID NO: 208779 - RNA, 19 nt, Homo sapiens
ucucuggauucaucuucuu

SEQ ID NO: 208780 - RNA, 19 nt, Homo sapiens
caacuuccuugucugcuuu

SEQ ID NO: 208781 - RNA, 19 nt, Homo sapiens
ggaccgaccagcugaaaga

SEQ ID NO: 208782 - RNA, 19 nt, Homo sapiens
cgguguaccuucucacuuu

SEQ ID NO: 208783 - RNA, 19 nt, Homo sapiens
gaaagaaagaccagugaac

SEQ ID NO: 208784 - RNA, 19 nt, Homo sapiens
ggcuauaucugcggugaaa

SEQ ID NO: 208785 - RNA, 19 nt, Homo sapiens
gcaccaaugggaccugcua

SEQ ID NO: 208786 - RNA, 19 nt, Homo sapiens
cagcguggucuacgucaua

SEQ ID NO: 208787 - RNA, 19 nt, Homo sapiens
gcaggcaggucuggugagu

SEQ ID NO: 208788 - RNA, 19 nt, Homo sapiens
cggccacgcugcucaacuu

SEQ ID NO: 208789 - RNA, 19 nt, Homo sapiens
aaagaaagaccagugaaca

SEQ ID NO: 208790 - RNA, 19 nt, Homo sapiens
ccgaccagcugaaagaaag

SEQ ID NO: 208791 - RNA, 19 nt, Homo sapiens
aggcaggucuggugagugu

SEQ ID NO: 208792 - RNA, 19 nt, Homo sapiens
ucaacuuccuugucugcuu

SEQ ID NO: 208793 - RNA, 19 nt, Homo sapiens
ccuacaacgugucccaugu

SEQ ID NO: 208794 - RNA, 19 nt, Homo sapiens
ggaucuacgugacgcuucu

SEQ ID NO: 208795 - RNA, 19 nt, Homo sapiens
ugaaagaaagaccagugaa

SEQ ID NO: 208796 - RNA, 19 nt, Homo sapiens
ccuggcagcugugagcauu

SEQ ID NO: 208797 - RNA, 19 nt, Homo sapiens
uggcagcugugagcauuga

SEQ ID NO: 208798 - RNA, 19 nt, Homo sapiens
gguguaccuucucacuuuc

SEQ ID NO: 208799 - RNA, 19 nt, Homo sapiens
cugcucaacuuccuugucu

SEQ ID NO: 208800 - RNA, 19 nt, Homo sapiens
guuccaagccgacuuucau

SEQ ID NO: 208801 - RNA, 19 nt, Homo sapiens
uggcugugguccucuuugu

SEQ ID NO: 208802 - RNA, 19 nt, Homo sapiens
gcaaucacugguucgucuu

SEQ ID NO: 208803 - RNA, 19 nt, Homo sapiens
gcagcguggucuacgucau

SEQ ID NO: 208804 - RNA, 19 nt, Homo sapiens
ucucuggauucaucuucuu

SEQ ID NO: 208805 - RNA, 19 nt, Homo sapiens
gcaaugaaauuaccugcua

SEQ ID NO: 208806 - RNA, 19 nt, Homo sapiens
gaucaucguucaauacuug

SEQ ID NO: 208807 - RNA, 19 nt, Homo sapiens
gagaagggaugccaaguuc

SEQ ID NO: 208808 - RNA, 19 nt, Homo sapiens
ggucagaaguggcaaugaa

SEQ ID NO: 208809 - RNA, 19 nt, Homo sapiens
uacgagaacuucaccgaua

SEQ ID NO: 208810 - RNA, 19 nt, Homo sapiens
ccucauggcuuacaucauc

SEQ ID NO: 208811 - RNA, 19 nt, Homo sapiens
ggagaagggaugccaaguu

SEQ ID NO: 208812 - RNA, 19 nt, Homo sapiens
uggugacgcugcucaauuu

SEQ ID NO: 208813 - RNA, 19 nt, Homo sapiens
agaaguggcaaugaaauua

SEQ ID NO: 208814 - RNA, 19 nt, Homo sapiens
guucggacuucacuacaga

SEQ ID NO: 208815 - RNA, 19 nt, Homo sapiens
ucaauuuccuggugugcuu

SEQ ID NO: 208816 - RNA, 19 nt, Homo sapiens
acgagaacuucaccgauaa

SEQ ID NO: 208817 - RNA, 19 nt, Homo sapiens
gcucuucuauuucucuucu

SEQ ID NO: 208818 - RNA, 19 nt, Homo sapiens
cagaaguggcaaugaaauu

SEQ ID NO: 208819 - RNA, 19 nt, Homo sapiens
gggugugggucaaggagaa

SEQ ID NO: 208820 - RNA, 19 nt, Homo sapiens
ggacgcagaggcaaagaca

SEQ ID NO: 208821 - RNA, 19 nt, Homo sapiens
uggcuuacaucaucaucuu

SEQ ID NO: 208822 - RNA, 19 nt, Homo sapiens
gaaguggcaaugaaauuac

SEQ ID NO: 208823 - RNA, 19 nt, Homo sapiens
ccuugauccucauggcuua

SEQ ID NO: 208824 - RNA, 19 nt, Homo sapiens
gcucugguggccuggguua

SEQ ID NO: 208825 - RNA, 19 nt, Homo sapiens
gucaauagccgugguguuc

SEQ ID NO: 208826 - RNA, 19 nt, Homo sapiens
cugcugcccuucaagauca

SEQ ID NO: 208827 - RNA, 19 nt, Homo sapiens
cuucaccgauaaccaguug

SEQ ID NO: 208828 - RNA, 19 nt, Homo sapiens
ucugcgcccucacgaguuu

SEQ ID NO: 208829 - RNA, 19 nt, Homo sapiens
cgucgaacuuccgcuggua

SEQ ID NO: 208830 - RNA, 19 nt, Homo sapiens
gguguucaguucacucaac

SEQ ID NO: 208831 - RNA, 19 nt, Homo sapiens
guggugacgcugcucaauu

SEQ ID NO: 208832 - RNA, 19 nt, Homo sapiens
cagcagaggggacaaauga

SEQ ID NO: 208833 - RNA, 19 nt, Homo sapiens
caauagccgugguguucag

SEQ ID NO: 208834 - RNA, 19 nt, Homo sapiens
gucagaaguggcaaugaaa

SEQ ID NO: 208835 - RNA, 19 nt, Homo sapiens
ucagaaguggcaaugaaau

SEQ ID NO: 208836 - RNA, 19 nt, Homo sapiens
ucgugaucaucguucaaua

SEQ ID NO: 208837 - RNA, 19 nt, Homo sapiens
uagccgugguguucaguuc

SEQ ID NO: 208838 - RNA, 19 nt, Homo sapiens
ggccuggguuauguccuuu

SEQ ID NO: 208839 - RNA, 19 nt, Homo sapiens
ggacaggggugugggucaa

SEQ ID NO: 208840 - RNA, 19 nt, Homo sapiens
cagucaccaucuucugcua

SEQ ID NO: 208841 - RNA, 19 nt, Homo sapiens
gcaccaucgugaucaucgu

SEQ ID NO: 208842 - RNA, 19 nt, Homo sapiens
gccucuguauggagugauu

SEQ ID NO: 208843 - RNA, 19 nt, Homo sapiens
ggucaauagccgugguguu

SEQ ID NO: 208844 - RNA, 19 nt, Homo sapiens
uggccuggguuauguccuu

SEQ ID NO: 208845 - RNA, 19 nt, Homo sapiens
ggaaagaauuguauacaga

SEQ ID NO: 208846 - RNA, 19 nt, Homo sapiens
guacuagaguugcccauaa

SEQ ID NO: 208847 - RNA, 19 nt, Homo sapiens
gaauguagauugggacuga

SEQ ID NO: 208848 - RNA, 19 nt, Homo sapiens
agaaauaccuccagauguu

SEQ ID NO: 208849 - RNA, 19 nt, Homo sapiens
ggacuuggcugucugaucu

SEQ ID NO: 208850 - RNA, 19 nt, Homo sapiens
gaggaaaggugaagcuaug

SEQ ID NO: 208851 - RNA, 19 nt, Homo sapiens
caccugaaguugucaauaa

SEQ ID NO: 208852 - RNA, 19 nt, Homo sapiens
gaucaaagaaucaagaaug

SEQ ID NO: 208853 - RNA, 19 nt, Homo sapiens
gcaguucugugauaccaaa

SEQ ID NO: 208854 - RNA, 19 nt, Homo sapiens
ggacagaggguucgaggaa

SEQ ID NO: 208855 - RNA, 19 nt, Homo sapiens
gaacacauuuagacauuac

SEQ ID NO: 208856 - RNA, 19 nt, Homo sapiens
ggaggucgaucaaagaauc

SEQ ID NO: 208857 - RNA, 19 nt, Homo sapiens
gggaaccauuugaagaaua

SEQ ID NO: 208858 - RNA, 19 nt, Homo sapiens
uaaagaggcacauugaauu

SEQ ID NO: 208859 - RNA, 19 nt, Homo sapiens
ggauguuacucaccaagaa

SEQ ID NO: 208860 - RNA, 19 nt, Homo sapiens
caauggaaauggcuggaaa

SEQ ID NO: 208861 - RNA, 19 nt, Homo sapiens
gcugaaagcgcgucaagaa

SEQ ID NO: 208862 - RNA, 19 nt, Homo sapiens
gaugaggaccgaagugauu

SEQ ID NO: 208863 - RNA, 19 nt, Homo sapiens
aauaugaaguugccgauga

SEQ ID NO: 208864 - RNA, 19 nt, Homo sapiens
ucaggaggcuggaggcaaa

SEQ ID NO: 208865 - RNA, 19 nt, Homo sapiens
gggaggaggucgaucaaag

SEQ ID NO: 208866 - RNA, 19 nt, Homo sapiens
gcagagagccguuuucuau

SEQ ID NO: 208867 - RNA, 19 nt, Homo sapiens
ccaacucgcugcugcugaa

SEQ ID NO: 208868 - RNA, 19 nt, Homo sapiens
ggaaccauuugaagaauac

SEQ ID NO: 208869 - RNA, 19 nt, Homo sapiens
aaacaugccuugggagugu

SEQ ID NO: 208870 - RNA, 19 nt, Homo sapiens
agacuucuaugcucgguuu

SEQ ID NO: 208871 - RNA, 19 nt, Homo sapiens
gaagcuauggcucuaaaug

SEQ ID NO: 208872 - RNA, 19 nt, Homo sapiens
gugaagcuauggcucuaaa

SEQ ID NO: 208873 - RNA, 19 nt, Homo sapiens
caggaaggagcauguguua

SEQ ID NO: 208874 - RNA, 19 nt, Homo sapiens
gggacauucuccauucaaa

SEQ ID NO: 208875 - RNA, 19 nt, Homo sapiens
gcccauaacuaccuaagag

SEQ ID NO: 208876 - RNA, 19 nt, Homo sapiens
gauuauagcagucuuugug

SEQ ID NO: 208877 - RNA, 19 nt, Homo sapiens
caccuggaauuguaauaaa

SEQ ID NO: 208878 - RNA, 19 nt, Homo sapiens
ucagggacauucuccauuc

SEQ ID NO: 208879 - RNA, 19 nt, Homo sapiens
ugucugaucuaugaaauga

SEQ ID NO: 208880 - RNA, 19 nt, Homo sapiens
cuacauggcaccugaaguu

SEQ ID NO: 208881 - RNA, 19 nt, Homo sapiens
ggagaaagugcaaaguaga

SEQ ID NO: 208882 - RNA, 19 nt, Homo sapiens
gggaaagaauuguauacag

SEQ ID NO: 208883 - RNA, 19 nt, Homo sapiens
gauaccaaacccacucuaa

SEQ ID NO: 208884 - RNA, 19 nt, Homo sapiens
agaaugauaccgaggagua

SEQ ID NO: 208885 - RNA, 19 nt, Homo sapiens
ggaggaggucgaucaaaga

SEQ ID NO: 208886 - RNA, 19 nt, Homo sapiens
ccaaagaugccuugugcuu

SEQ ID NO: 208887 - RNA, 19 nt, Homo sapiens
uggaugcaguggcagaaua

SEQ ID NO: 208888 - RNA, 19 nt, Homo sapiens
aaaucuaucugcaggaugu

SEQ ID NO: 208889 - RNA, 19 nt, Homo sapiens
acaaagagaaagucaaaug

SEQ ID NO: 208890 - RNA, 19 nt, Homo sapiens
uuacagagggaaagaauug

SEQ ID NO: 208891 - RNA, 19 nt, Homo sapiens
gaaagugcaaaguagauuc

SEQ ID NO: 208892 - RNA, 19 nt, Homo sapiens
ugaggaauguacuagaguu

SEQ ID NO: 208893 - RNA, 19 nt, Homo sapiens
gaaauaccuccagauguug

SEQ ID NO: 208894 - RNA, 19 nt, Homo sapiens
ccagaaauaccuccagaug

SEQ ID NO: 208895 - RNA, 19 nt, Homo sapiens
cgucccaccuggaauugua

SEQ ID NO: 208896 - RNA, 19 nt, Homo sapiens
ggaaggagcauguguuagc

SEQ ID NO: 208897 - RNA, 19 nt, Homo sapiens
cugaaguugucaauaauga

SEQ ID NO: 208898 - RNA, 19 nt, Homo sapiens
caaagaacacauuuagaca

SEQ ID NO: 208899 - RNA, 19 nt, Homo sapiens
gaaaggcaacccguaacaa

SEQ ID NO: 208900 - RNA, 19 nt, Homo sapiens
ggaaaggcaacccguaaca

SEQ ID NO: 208901 - RNA, 19 nt, Homo sapiens
gaagauuuacagagggaaa

SEQ ID NO: 208902 - RNA, 19 nt, Homo sapiens
aaaggcaacccguaacaaa

SEQ ID NO: 208903 - RNA, 19 nt, Homo sapiens
cuaaagaggcacauugaau

SEQ ID NO: 208904 - RNA, 19 nt, Homo sapiens
acauggagcucgagaacau

SEQ ID NO: 208905 - RNA, 19 nt, Homo sapiens
ggacacauccggauuucag

SEQ ID NO: 208906 - RNA, 19 nt, Homo sapiens
gcacauugaauucuuggau

SEQ ID NO: 208907 - RNA, 19 nt, Homo sapiens
gaggcacauugaauucuug

SEQ ID NO: 208908 - RNA, 19 nt, Homo sapiens
ggaaguggaacccaagcaa

SEQ ID NO: 208909 - RNA, 19 nt, Homo sapiens
ccaaaucuaucugcaggau

SEQ ID NO: 208910 - RNA, 19 nt, Homo sapiens
cagaggaugccaaaucuau

SEQ ID NO: 208911 - RNA, 19 nt, Homo sapiens
gaaguggaacccaagcaau

SEQ ID NO: 208912 - RNA, 19 nt, Homo sapiens
gaggaggucgaucaaagaa

SEQ ID NO: 208913 - RNA, 19 nt, Homo sapiens
gagaaagugcaaaguagau

SEQ ID NO: 208914 - RNA, 19 nt, Homo sapiens
gaauaaagaagaggaaagg

SEQ ID NO: 208915 - RNA, 19 nt, Homo sapiens
uuacagaguucuaggaaaa

SEQ ID NO: 208916 - RNA, 19 nt, Homo sapiens
ggaggagaacccuuccaaa

SEQ ID NO: 208917 - RNA, 19 nt, Homo sapiens
acagaggguucgaggaaga

SEQ ID NO: 208918 - RNA, 19 nt, Homo sapiens
gacaagcaaccgauaggaa

SEQ ID NO: 208919 - RNA, 19 nt, Homo sapiens
uggagaaagugcaaaguag

SEQ ID NO: 208920 - RNA, 19 nt, Homo sapiens
gcaccugaaguugucaaua

SEQ ID NO: 208921 - RNA, 19 nt, Homo sapiens
gaggagaacccuuccaaaa

SEQ ID NO: 208922 - RNA, 19 nt, Homo sapiens
ccaccuggaauuguaauaa

SEQ ID NO: 208923 - RNA, 19 nt, Homo sapiens
caaagagaaagucaaaugg

SEQ ID NO: 208924 - RNA, 19 nt, Homo sapiens
gcaaucccggcuuugauga

SEQ ID NO: 208925 - RNA, 19 nt, Homo sapiens
ggacaccgcagaugaagac

SEQ ID NO: 208926 - RNA, 19 nt, Homo sapiens
ucaaggacaucaacuucag

SEQ ID NO: 208927 - RNA, 19 nt, Homo sapiens
ggacauggagcucgagaac

SEQ ID NO: 208928 - RNA, 19 nt, Homo sapiens
ggcaacccguaacaaagaa

SEQ ID NO: 208929 - RNA, 19 nt, Homo sapiens
ccaagaaagcucauauuuu

SEQ ID NO: 208930 - RNA, 19 nt, Homo sapiens
gaggaagaguuggaacagu

SEQ ID NO: 208931 - RNA, 19 nt, Homo sapiens
cagauguugugacagaaug

SEQ ID NO: 208932 - RNA, 19 nt, Homo sapiens
acaaagaacacauuuagac

SEQ ID NO: 208933 - RNA, 19 nt, Homo sapiens
cuccagauguugugacaga

SEQ ID NO: 208934 - RNA, 19 nt, Homo sapiens
gaaagcgcgucaagaaaag

SEQ ID NO: 208935 - RNA, 19 nt, Homo sapiens
gcaggauguuacucaccaa

SEQ ID NO: 208936 - RNA, 19 nt, Homo sapiens
cuugaagccugagaauauu

SEQ ID NO: 208937 - RNA, 19 nt, Homo sapiens
cuauggcucuaaaugagaa

SEQ ID NO: 208938 - RNA, 19 nt, Homo sapiens
ggaugcaguggcagaauau

SEQ ID NO: 208939 - RNA, 19 nt, Homo sapiens
gcaguucucggcggugaaa

SEQ ID NO: 208940 - RNA, 19 nt, Homo sapiens
ccucaugccguuuacugua

SEQ ID NO: 208941 - RNA, 19 nt, Homo sapiens
gcugucugaucuaugaaau

SEQ ID NO: 208942 - RNA, 19 nt, Homo sapiens
uaguuuagccuacgcuuau

SEQ ID NO: 208943 - RNA, 19 nt, Homo sapiens
aaagaggcacauugaauuc

SEQ ID NO: 208944 - RNA, 19 nt, Homo sapiens
accaagaaagcucauauuu

SEQ ID NO: 208945 - RNA, 19 nt, Homo sapiens
ggaaagaaauccugaaguu

SEQ ID NO: 208946 - RNA, 19 nt, Homo sapiens
ggaaggaaauuaugaccaa

SEQ ID NO: 208947 - RNA, 19 nt, Homo sapiens
ggccugggcuggaguguua

SEQ ID NO: 208948 - RNA, 19 nt, Homo sapiens
gcaagaugcugcucacgaa

SEQ ID NO: 208949 - RNA, 19 nt, Homo sapiens
ucaaagaaauuuccacuca

SEQ ID NO: 208950 - RNA, 19 nt, Homo sapiens
gauagaaacagaaugcuuu

SEQ ID NO: 208951 - RNA, 19 nt, Homo sapiens
gaacauugcaauagaaauc

SEQ ID NO: 208952 - RNA, 19 nt, Homo sapiens
gcccagacccuucuccuua

SEQ ID NO: 208953 - RNA, 19 nt, Homo sapiens
gaaacagaaugcuuuaagg

SEQ ID NO: 208954 - RNA, 19 nt, Homo sapiens
guaaauuucucuacugucu

SEQ ID NO: 208955 - RNA, 19 nt, Homo sapiens
uuaaggagcugaacguguu

SEQ ID NO: 208956 - RNA, 19 nt, Homo sapiens
gaacguguuuggaccuaau

SEQ ID NO: 208957 - RNA, 19 nt, Homo sapiens
gaacuucaagcgcuuagaa

SEQ ID NO: 208958 - RNA, 19 nt, Homo sapiens
gagaaagggaaggaaauua

SEQ ID NO: 208959 - RNA, 19 nt, Homo sapiens
gaaggaccauagacagaga

SEQ ID NO: 208960 - RNA, 19 nt, Homo sapiens
gaaggucaacagucaguuu

SEQ ID NO: 208961 - RNA, 19 nt, Homo sapiens
gaaguucccucacauuagc

SEQ ID NO: 208962 - RNA, 19 nt, Homo sapiens
cgucauaacuagaacugaa

SEQ ID NO: 208963 - RNA, 19 nt, Homo sapiens
ggugaacauugcaauagaa

SEQ ID NO: 208964 - RNA, 19 nt, Homo sapiens
gaaagggaaggaaauuaug

SEQ ID NO: 208965 - RNA, 19 nt, Homo sapiens
gaccugggcuuggcuguga

SEQ ID NO: 208966 - RNA, 19 nt, Homo sapiens
gcaagaaguggaaagaaau

SEQ ID NO: 208967 - RNA, 19 nt, Homo sapiens
ggagagaaagggaaggaaa

SEQ ID NO: 208968 - RNA, 19 nt, Homo sapiens
ugaaguuacuccagaugaa

SEQ ID NO: 208969 - RNA, 19 nt, Homo sapiens
agaagcagauccucgagaa

SEQ ID NO: 208970 - RNA, 19 nt, Homo sapiens
agagauuacugcaguuuau

SEQ ID NO: 208971 - RNA, 19 nt, Homo sapiens
gaaagaaauccugaaguuc

SEQ ID NO: 208972 - RNA, 19 nt, Homo sapiens
gaaguuacuccagaugaaa

SEQ ID NO: 208973 - RNA, 19 nt, Homo sapiens
cagaacaauuccaagaguu

SEQ ID NO: 208974 - RNA, 19 nt, Homo sapiens
aaaugugacucaagacuuc

SEQ ID NO: 208975 - RNA, 19 nt, Homo sapiens
cgacaacuugcacguauuu

SEQ ID NO: 208976 - RNA, 19 nt, Homo sapiens
guaaggacgugcuggacau

SEQ ID NO: 208977 - RNA, 19 nt, Homo sapiens
gggcuggaguguuacauuc

SEQ ID NO: 208978 - RNA, 19 nt, Homo sapiens
gaccugaaguuccacaucu

SEQ ID NO: 208979 - RNA, 19 nt, Homo sapiens
ucgagaaggucaacaguca

SEQ ID NO: 208980 - RNA, 19 nt, Homo sapiens
ccacacagacgacgacuuc

SEQ ID NO: 208981 - RNA, 19 nt, Homo sapiens
aggaaauuaugaccaagua

SEQ ID NO: 208982 - RNA, 19 nt, Homo sapiens
gggcuuggcugugaagauc

SEQ ID NO: 208983 - RNA, 19 nt, Homo sapiens
gauuauggccacauuagga

SEQ ID NO: 208984 - RNA, 19 nt, Homo sapiens
ccaacacggucuugcugaa

SEQ ID NO: 208985 - RNA, 19 nt, Homo sapiens
agcaagaaguggaaagaaa

SEQ ID NO: 208986 - RNA, 19 nt, Homo sapiens
ccucgagguuucucaaaga

SEQ ID NO: 208987 - RNA, 19 nt, Homo sapiens
ucagaacaauuccaagagu

SEQ ID NO: 208988 - RNA, 19 nt, Homo sapiens
gaacaccgucuaccgagau

SEQ ID NO: 208989 - RNA, 19 nt, Homo sapiens
ccaaguaccucaccccaaa

SEQ ID NO: 208990 - RNA, 19 nt, Homo sapiens
uuaauagcgucauaacuag

SEQ ID NO: 208991 - RNA, 19 nt, Homo sapiens
ccacauaaacucaaaccau

SEQ ID NO: 208992 - RNA, 19 nt, Homo sapiens
caucagaacaauuccaaga

SEQ ID NO: 208993 - RNA, 19 nt, Homo sapiens
gggagaaccauuccacgaa

SEQ ID NO: 208994 - RNA, 19 nt, Homo sapiens
aaacagaaugcuuuaagga

SEQ ID NO: 208995 - RNA, 19 nt, Homo sapiens
cugcagaggucaagagaca

SEQ ID NO: 208996 - RNA, 19 nt, Homo sapiens
gaugauuauggccacauua

SEQ ID NO: 208997 - RNA, 19 nt, Homo sapiens
agaaagggaaggaaauuau

SEQ ID NO: 208998 - RNA, 19 nt, Homo sapiens
gagagaaagggaaggaaau

SEQ ID NO: 208999 - RNA, 19 nt, Homo sapiens
aaauuucucuacugucuca

SEQ ID NO: 209000 - RNA, 19 nt, Homo sapiens
ggccuuggcugccucaucu

SEQ ID NO: 209001 - RNA, 19 nt, Homo sapiens
cugaaguucccucacauua

SEQ ID NO: 209002 - RNA, 19 nt, Homo sapiens
caaaccaugucagcucgaa

SEQ ID NO: 209003 - RNA, 19 nt, Homo sapiens
gaccauagacagagauuac

SEQ ID NO: 209004 - RNA, 19 nt, Homo sapiens
ggucaacagucaguuugug

SEQ ID NO: 209005 - RNA, 19 nt, Homo sapiens
acgaauaucuggacagcau

SEQ ID NO: 209006 - RNA, 19 nt, Homo sapiens
ggacuccguggcagaauau

SEQ ID NO: 209007 - RNA, 19 nt, Homo sapiens
gagaugauagaaacagaau

SEQ ID NO: 209008 - RNA, 19 nt, Homo sapiens
guuggacccucccuucguu

SEQ ID NO: 209009 - RNA, 19 nt, Homo sapiens
gagguguacucccacaagu

SEQ ID NO: 209010 - RNA, 19 nt, Homo sapiens
caguggaagugguuggaaa

SEQ ID NO: 209011 - RNA, 19 nt, Homo sapiens
aaagggaaggaaauuauga

SEQ ID NO: 209012 - RNA, 19 nt, Homo sapiens
ggcagaauaugaaguuacu

SEQ ID NO: 209013 - RNA, 19 nt, Homo sapiens
gaaagggcugcuccagaga

SEQ ID NO: 209014 - RNA, 19 nt, Homo sapiens
gaugauagaaacagaaugc

SEQ ID NO: 209015 - RNA, 19 nt, Homo sapiens
caauggagcuggaaaacau

SEQ ID NO: 209016 - RNA, 19 nt, Homo sapiens
cagagauuacugcaguuua

SEQ ID NO: 209017 - RNA, 19 nt, Homo sapiens
uguagaaagugauccauac

SEQ ID NO: 209018 - RNA, 19 nt, Homo sapiens
caacuugcacguauuuuaa

SEQ ID NO: 209019 - RNA, 19 nt, Homo sapiens
ggauuggauuugucuuugg

SEQ ID NO: 209020 - RNA, 19 nt, Homo sapiens
aaaguccccuguuuucaua

SEQ ID NO: 209021 - RNA, 19 nt, Homo sapiens
ggauuugucuuuggugaac

SEQ ID NO: 209022 - RNA, 19 nt, Homo sapiens
acacagacgacgacuucua

SEQ ID NO: 209023 - RNA, 19 nt, Homo sapiens
caacacggucuugcugaaa

SEQ ID NO: 209024 - RNA, 19 nt, Homo sapiens
gauccucugcggcuuagaa

SEQ ID NO: 209025 - RNA, 19 nt, Homo sapiens
gacagagauuacugcaguu

SEQ ID NO: 209026 - RNA, 19 nt, Homo sapiens
uggacuccguggcagaaua

SEQ ID NO: 209027 - RNA, 19 nt, Homo sapiens
ccagacccuucuccuuaga

SEQ ID NO: 209028 - RNA, 19 nt, Homo sapiens
ggaccauagacagagauua

SEQ ID NO: 209029 - RNA, 19 nt, Homo sapiens
gguguacucccacaaguuc

SEQ ID NO: 209030 - RNA, 19 nt, Homo sapiens
gagaagaagaggaucaaaa

SEQ ID NO: 209031 - RNA, 19 nt, Homo sapiens
cagaagccgugcaaagaac

SEQ ID NO: 209032 - RNA, 19 nt, Homo sapiens
acagaagccgugcaaagaa

SEQ ID NO: 209033 - RNA, 19 nt, Homo sapiens
guuaagccauguguuccaa

SEQ ID NO: 209034 - RNA, 19 nt, Homo sapiens
gauuggauuugucuuuggu

SEQ ID NO: 209035 - RNA, 19 nt, Homo sapiens
gcggguggauuggauuugu

SEQ ID NO: 209036 - RNA, 19 nt, Homo sapiens
gggcacuguuggcuacaug

SEQ ID NO: 209037 - RNA, 19 nt, Homo sapiens
uacagaagccgugcaaaga

SEQ ID NO: 209038 - RNA, 19 nt, Homo sapiens
uggauuggauuugucuuug

SEQ ID NO: 209039 - RNA, 19 nt, Homo sapiens
ggcagcaucagaacaauuc

SEQ ID NO: 209040 - RNA, 19 nt, Homo sapiens
ggaaacucuugggcugaga

SEQ ID NO: 209041 - RNA, 19 nt, Homo sapiens
gagauccucugcggcuuag

SEQ ID NO: 209042 - RNA, 19 nt, Homo sapiens
gagaaggucaacagucagu

SEQ ID NO: 209043 - RNA, 19 nt, Homo sapiens
gaauaucuggacagcaugu

SEQ ID NO: 209044 - RNA, 19 nt, Homo sapiens
caagaaguggaaagaaauc

SEQ ID NO: 209045 - RNA, 19 nt, Homo sapiens
gcagacaccucuuucagaa

SEQ ID NO: 209046 - RNA, 19 nt, Homo sapiens
gaccagagcauucuuaauu

SEQ ID NO: 209047 - RNA, 19 nt, Homo sapiens
ggucaacccucaaacauuc

SEQ ID NO: 209048 - RNA, 19 nt, Homo sapiens
gcucacagcuccucugcaa

SEQ ID NO: 209049 - RNA, 19 nt, Homo sapiens
gaaagugaacaguagguuu

SEQ ID NO: 209050 - RNA, 19 nt, Homo sapiens
ccaaagcugucccuucuca

SEQ ID NO: 209051 - RNA, 19 nt, Homo sapiens
gcccaaagcugucccuucu

SEQ ID NO: 209052 - RNA, 19 nt, Homo sapiens
ccauggagcucgagaacau

SEQ ID NO: 209053 - RNA, 19 nt, Homo sapiens
gcaucuacuucaaccguuu

SEQ ID NO: 209054 - RNA, 19 nt, Homo sapiens
gagauugggcugccuguga

SEQ ID NO: 209055 - RNA, 19 nt, Homo sapiens
gagcuuggccuacgccuau

SEQ ID NO: 209056 - RNA, 19 nt, Homo sapiens
agaagcagauccuggagaa

SEQ ID NO: 209057 - RNA, 19 nt, Homo sapiens
ccauggcgcugaacgagaa

SEQ ID NO: 209058 - RNA, 19 nt, Homo sapiens
gaacaguagguuuguagug

SEQ ID NO: 209059 - RNA, 19 nt, Homo sapiens
acacaugugcccagcaaua

SEQ ID NO: 209060 - RNA, 19 nt, Homo sapiens
cgagcgccguuuacaguuu

SEQ ID NO: 209061 - RNA, 19 nt, Homo sapiens
caagauugcuguggaaacu

SEQ ID NO: 209062 - RNA, 19 nt, Homo sapiens
cggagguggugaagaauga

SEQ ID NO: 209063 - RNA, 19 nt, Homo sapiens
gggacuagcugugcaugug

SEQ ID NO: 209064 - RNA, 19 nt, Homo sapiens
ggucacaccugagccuuca

SEQ ID NO: 209065 - RNA, 19 nt, Homo sapiens
agacacaugugcccagcaa

SEQ ID NO: 209066 - RNA, 19 nt, Homo sapiens
caaaguggccagagauugg

SEQ ID NO: 209067 - RNA, 19 nt, Homo sapiens
cagaggagccacugccaaa

SEQ ID NO: 209068 - RNA, 19 nt, Homo sapiens
aacaguagguuuguaguga

SEQ ID NO: 209069 - RNA, 19 nt, Homo sapiens
aaagugaacaguagguuug

SEQ ID NO: 209070 - RNA, 19 nt, Homo sapiens
uggagaaagugaacaguag

SEQ ID NO: 209071 - RNA, 19 nt, Homo sapiens
gcucggggcuuucuguauu

SEQ ID NO: 209072 - RNA, 19 nt, Homo sapiens
gaccucaaguuccacaucu

SEQ ID NO: 209073 - RNA, 19 nt, Homo sapiens
cgaacacggugcuacucaa

SEQ ID NO: 209074 - RNA, 19 nt, Homo sapiens
ggccacagguaagauguau

SEQ ID NO: 209075 - RNA, 19 nt, Homo sapiens
ucauaacaauagacacaug

SEQ ID NO: 209076 - RNA, 19 nt, Homo sapiens
ggacuccccucauaacaau

SEQ ID NO: 209077 - RNA, 19 nt, Homo sapiens
cuccggagguggugaagaa

SEQ ID NO: 209078 - RNA, 19 nt, Homo sapiens
gaacacggugcuacucaag

SEQ ID NO: 209079 - RNA, 19 nt, Homo sapiens
gcccuaggccugugccaaa

SEQ ID NO: 209080 - RNA, 19 nt, Homo sapiens
cagcagaggaagaagaaga

SEQ ID NO: 209081 - RNA, 19 nt, Homo sapiens
caguggaaguggcuggaaa

SEQ ID NO: 209082 - RNA, 19 nt, Homo sapiens
gcacguaacgcagaauuuu

SEQ ID NO: 209083 - RNA, 19 nt, Homo sapiens
ggcggcagaugcuccaguu

SEQ ID NO: 209084 - RNA, 19 nt, Homo sapiens
ggcuuucuguauuuaugua

SEQ ID NO: 209085 - RNA, 19 nt, Homo sapiens
ggagcucgagaacaucgua

SEQ ID NO: 209086 - RNA, 19 nt, Homo sapiens
gugcgucccuucagcucuu

SEQ ID NO: 209087 - RNA, 19 nt, Homo sapiens
acagugaucuuccccauug

SEQ ID NO: 209088 - RNA, 19 nt, Homo sapiens
ggaguauuccgagcgcuuu

SEQ ID NO: 209089 - RNA, 19 nt, Homo sapiens
uggagcggcuggugaagga

SEQ ID NO: 209090 - RNA, 19 nt, Homo sapiens
ccaaaguggccagagauug

SEQ ID NO: 209091 - RNA, 19 nt, Homo sapiens
gcgaccagagcauucuuaa

SEQ ID NO: 209092 - RNA, 19 nt, Homo sapiens
gauguaugccugcaagaag

SEQ ID NO: 209093 - RNA, 19 nt, Homo sapiens
cacaugugcccagcaauaa

SEQ ID NO: 209094 - RNA, 19 nt, Homo sapiens
ggagaccgagugcuuccaa

SEQ ID NO: 209095 - RNA, 19 nt, Homo sapiens
gagaacaucguagcgaaca

SEQ ID NO: 209096 - RNA, 19 nt, Homo sapiens
caagaaauggcggcagaug

SEQ ID NO: 209097 - RNA, 19 nt, Homo sapiens
cuacuccgagcgccguuua

SEQ ID NO: 209098 - RNA, 19 nt, Homo sapiens
gcagcgacagcgaggaaga

SEQ ID NO: 209099 - RNA, 19 nt, Homo sapiens
gaaugucuuugggcuggau

SEQ ID NO: 209100 - RNA, 19 nt, Homo sapiens
cuaccgaccaggacuucua

SEQ ID NO: 209101 - RNA, 19 nt, Homo sapiens
ccucauaacaauagacaca

SEQ ID NO: 209102 - RNA, 19 nt, Homo sapiens
accagagcauucuuaauuc

SEQ ID NO: 209103 - RNA, 19 nt, Homo sapiens
gagcgccguuuacaguuuu

SEQ ID NO: 209104 - RNA, 19 nt, Homo sapiens
ggaaaucgcaaaggcaaaa

SEQ ID NO: 209105 - RNA, 19 nt, Homo sapiens
gaagcccgagaacaucuug

SEQ ID NO: 209106 - RNA, 19 nt, Homo sapiens
gcgaacacggugcuacuca

SEQ ID NO: 209107 - RNA, 19 nt, Homo sapiens
guagguuuguagugagcuu

SEQ ID NO: 209108 - RNA, 19 nt, Homo sapiens
gaagcagauccuggagaaa

SEQ ID NO: 209109 - RNA, 19 nt, Homo sapiens
ccacagguaagauguaugc

SEQ ID NO: 209110 - RNA, 19 nt, Homo sapiens
ccgacuaccucgacagcau

SEQ ID NO: 209111 - RNA, 19 nt, Homo sapiens
agauugggcugccugugau

SEQ ID NO: 209112 - RNA, 19 nt, Homo sapiens
cgccaagauugcuguggaa

SEQ ID NO: 209113 - RNA, 19 nt, Homo sapiens
agaggaagaagaagaucaa

SEQ ID NO: 209114 - RNA, 19 nt, Homo sapiens
aaaggcagccagugaccaa

SEQ ID NO: 209115 - RNA, 19 nt, Homo sapiens
ccagagcauucuuaauucc

SEQ ID NO: 209116 - RNA, 19 nt, Homo sapiens
gagaaagugaacaguaggu

SEQ ID NO: 209117 - RNA, 19 nt, Homo sapiens
cuggagaaagugaacagua

SEQ ID NO: 209118 - RNA, 19 nt, Homo sapiens
cauaacaauagacacaugu

SEQ ID NO: 209119 - RNA, 19 nt, Homo sapiens
gaggagccacugccaaacu

SEQ ID NO: 209120 - RNA, 19 nt, Homo sapiens
gggccacagguaagaugua

SEQ ID NO: 209121 - RNA, 19 nt, Homo sapiens
gugaacaguagguuuguag

SEQ ID NO: 209122 - RNA, 19 nt, Homo sapiens
gauugggcugccugugaua

SEQ ID NO: 209123 - RNA, 19 nt, Homo sapiens
cuaggccugugccaaagug

SEQ ID NO: 209124 - RNA, 19 nt, Homo sapiens
ggcacguaacgcagaauuu

SEQ ID NO: 209125 - RNA, 19 nt, Homo sapiens
caugugcccagcaauaauc

SEQ ID NO: 209126 - RNA, 19 nt, Homo sapiens
cagaggaagaagaagauca

SEQ ID NO: 209127 - RNA, 19 nt, Homo sapiens
ccaaagaccucaucuccaa

SEQ ID NO: 209128 - RNA, 19 nt, Homo sapiens
ugacggagcucagaaguuu

SEQ ID NO: 209129 - RNA, 19 nt, Homo sapiens
gcacuuuaauuccaaugua

SEQ ID NO: 209130 - RNA, 19 nt, Homo sapiens
gaacggccauguguuaaug

SEQ ID NO: 209131 - RNA, 19 nt, Homo sapiens
gacagaagauggugcagaa

SEQ ID NO: 209132 - RNA, 19 nt, Homo sapiens
gaagaaaccagccgaacuu

SEQ ID NO: 209133 - RNA, 19 nt, Homo sapiens
ggacuggucagaaccguua

SEQ ID NO: 209134 - RNA, 19 nt, Homo sapiens
ccacggagacucugacuuu

SEQ ID NO: 209135 - RNA, 19 nt, Homo sapiens
gcucagaaguuuuccuuua

SEQ ID NO: 209136 - RNA, 19 nt, Homo sapiens
ggugaacggccauguguua

SEQ ID NO: 209137 - RNA, 19 nt, Homo sapiens
cagccgaacuucaggguuu

SEQ ID NO: 209138 - RNA, 19 nt, Homo sapiens
gaaccguuacugugaauga

SEQ ID NO: 209139 - RNA, 19 nt, Homo sapiens
aaacauccaagcacuuuaa

SEQ ID NO: 209140 - RNA, 19 nt, Homo sapiens
gcuucuaccugguguuuga

SEQ ID NO: 209141 - RNA, 19 nt, Homo sapiens
ggaguacgccgucaagauc

SEQ ID NO: 209142 - RNA, 19 nt, Homo sapiens
cauccaagcacuuuaauuc

SEQ ID NO: 209143 - RNA, 19 nt, Homo sapiens
agaagauggugcagaagaa

SEQ ID NO: 209144 - RNA, 19 nt, Homo sapiens
gaagauggugcagaagaaa

SEQ ID NO: 209145 - RNA, 19 nt, Homo sapiens
ccaagcacuuuaauuccaa

SEQ ID NO: 209146 - RNA, 19 nt, Homo sapiens
gccuuggacuuucugcaua

SEQ ID NO: 209147 - RNA, 19 nt, Homo sapiens
ucagaaccguuacugugaa

SEQ ID NO: 209148 - RNA, 19 nt, Homo sapiens
uccuagagcugauugaguu

SEQ ID NO: 209149 - RNA, 19 nt, Homo sapiens
gaagcagccaggccacauu

SEQ ID NO: 209150 - RNA, 19 nt, Homo sapiens
gaaaccagccgaacuucag

SEQ ID NO: 209151 - RNA, 19 nt, Homo sapiens
guguuaauguuacgauguu

SEQ ID NO: 209152 - RNA, 19 nt, Homo sapiens
cgaggaggcuagcaucuac

SEQ ID NO: 209153 - RNA, 19 nt, Homo sapiens
ggccagcgccuuggacuuu

SEQ ID NO: 209154 - RNA, 19 nt, Homo sapiens
gagccugggcgucaucuug

SEQ ID NO: 209155 - RNA, 19 nt, Homo sapiens
ucuaccagcugcaggaaga

SEQ ID NO: 209156 - RNA, 19 nt, Homo sapiens
cagaagauggugcagaaga

SEQ ID NO: 209157 - RNA, 19 nt, Homo sapiens
ccuuggacuuucugcauaa

SEQ ID NO: 209158 - RNA, 19 nt, Homo sapiens
ggccauguguuaauguuac

SEQ ID NO: 209159 - RNA, 19 nt, Homo sapiens
gcagcggcaucaaacucaa

SEQ ID NO: 209160 - RNA, 19 nt, Homo sapiens
gcgaggaggcuagcaucua

SEQ ID NO: 209161 - RNA, 19 nt, Homo sapiens
ggacuuucugcauaacaaa

SEQ ID NO: 209162 - RNA, 19 nt, Homo sapiens
gucagaaccguuacuguga

SEQ ID NO: 209163 - RNA, 19 nt, Homo sapiens
cggaaaacauccucuguga

SEQ ID NO: 209164 - RNA, 19 nt, Homo sapiens
ggaggaggaccgcuucuac

SEQ ID NO: 209165 - RNA, 19 nt, Homo sapiens
gaacguccuagagcugauu

SEQ ID NO: 209166 - RNA, 19 nt, Homo sapiens
cagaaccguuacugugaau

SEQ ID NO: 209167 - RNA, 19 nt, Homo sapiens
caauguaccaggugaacug

SEQ ID NO: 209168 - RNA, 19 nt, Homo sapiens
cagcuucucgggcagguuu

SEQ ID NO: 209169 - RNA, 19 nt, Homo sapiens
ggagggcaaguacgaguuc

SEQ ID NO: 209170 - RNA, 19 nt, Homo sapiens
ggaacguccuagagcugau

SEQ ID NO: 209171 - RNA, 19 nt, Homo sapiens
gccugggcgucaucuugua

SEQ ID NO: 209172 - RNA, 19 nt, Homo sapiens
caucuuguauauccuacuc

SEQ ID NO: 209173 - RNA, 19 nt, Homo sapiens
ucagggagguggagaugcu

SEQ ID NO: 209174 - RNA, 19 nt, Homo sapiens
gaggugggacagucacuuc

SEQ ID NO: 209175 - RNA, 19 nt, Homo sapiens
ggcgucaucuuguauaucc

SEQ ID NO: 209176 - RNA, 19 nt, Homo sapiens
caagcacuuuaauuccaau

SEQ ID NO: 209177 - RNA, 19 nt, Homo sapiens
uggacuuucugcauaacaa

SEQ ID NO: 209178 - RNA, 19 nt, Homo sapiens
uccaagcacuuuaauucca

SEQ ID NO: 209179 - RNA, 19 nt, Homo sapiens
gugaacggccauguguuaa

SEQ ID NO: 209180 - RNA, 19 nt, Homo sapiens
uagagcugauugaguucuu

SEQ ID NO: 209181 - RNA, 19 nt, Homo sapiens
cacggagacucugacuuug

SEQ ID NO: 209182 - RNA, 19 nt, Homo sapiens
gcauccaggagggcaagua

SEQ ID NO: 209183 - RNA, 19 nt, Homo sapiens
cacauucggagcaggguuu

SEQ ID NO: 209184 - RNA, 19 nt, Homo sapiens
gaguacgccgucaagauca

SEQ ID NO: 209185 - RNA, 19 nt, Homo sapiens
ugaacggccauguguuaau

SEQ ID NO: 209186 - RNA, 19 nt, Homo sapiens
gugaaugagugaagauccu

SEQ ID NO: 209187 - RNA, 19 nt, Homo sapiens
cgucaucuuguauauccua

SEQ ID NO: 209188 - RNA, 19 nt, Homo sapiens
gggagguggagaugcugua

SEQ ID NO: 209189 - RNA, 19 nt, Homo sapiens
acacagaccugaagaacua

SEQ ID NO: 209190 - RNA, 19 nt, Homo sapiens
gcaacgcccucaagugcua

SEQ ID NO: 209191 - RNA, 19 nt, Homo sapiens
gagacaucaucuucaaauu

SEQ ID NO: 209192 - RNA, 19 nt, Homo sapiens
uggagaagcuggacacaga

SEQ ID NO: 209193 - RNA, 19 nt, Homo sapiens
ggaagaaggcgcugcugaa

SEQ ID NO: 209194 - RNA, 19 nt, Homo sapiens
gacaucaucuucaaauucu

SEQ ID NO: 209195 - RNA, 19 nt, Homo sapiens
gcaaccagauccaugucaa

SEQ ID NO: 209196 - RNA, 19 nt, Homo sapiens
ccaaacacgucaucaacau

SEQ ID NO: 209197 - RNA, 19 nt, Homo sapiens
ggucucaugugcucagcua

SEQ ID NO: 209198 - RNA, 19 nt, Homo sapiens
gccuggaucuggaacagua

SEQ ID NO: 209199 - RNA, 19 nt, Homo sapiens
gaaugcaccugacgucaac

SEQ ID NO: 209200 - RNA, 19 nt, Homo sapiens
gaugagcaccaacauguga

SEQ ID NO: 209201 - RNA, 19 nt, Homo sapiens
cagcagcuccuucaaguug

SEQ ID NO: 209202 - RNA, 19 nt, Homo sapiens
ucaacuacgugguggagaa

SEQ ID NO: 209203 - RNA, 19 nt, Homo sapiens
ucaagaugcuggacgagau

SEQ ID NO: 209204 - RNA, 19 nt, Homo sapiens
ccagcaacguggccaucua

SEQ ID NO: 209205 - RNA, 19 nt, Homo sapiens
caagggcaacuccaucaaa

SEQ ID NO: 209206 - RNA, 19 nt, Homo sapiens
gcagcuccuucaaguuguu

SEQ ID NO: 209207 - RNA, 19 nt, Homo sapiens
ccuuuaacguggacaugua

SEQ ID NO: 209208 - RNA, 19 nt, Homo sapiens
gcaccaccuuugagaaguc

SEQ ID NO: 209209 - RNA, 19 nt, Homo sapiens
gaagaaggcgcugcugaag

SEQ ID NO: 209210 - RNA, 19 nt, Homo sapiens
cgagacaucaucuucaaau

SEQ ID NO: 209211 - RNA, 19 nt, Homo sapiens
ucacacagcaagauccuau

SEQ ID NO: 209212 - RNA, 19 nt, Homo sapiens
gcgucuacuugcagaauug

SEQ ID NO: 209213 - RNA, 19 nt, Homo sapiens
agacaucaucuucaaauuc

SEQ ID NO: 209214 - RNA, 19 nt, Homo sapiens
agaaggcgcugcugaagcu

SEQ ID NO: 209215 - RNA, 19 nt, Homo sapiens
ucagucaggugcagacaag

SEQ ID NO: 209216 - RNA, 19 nt, Homo sapiens
agugggcgguguccauuaa

SEQ ID NO: 209217 - RNA, 19 nt, Homo sapiens
ggacauguacgaggagauc

SEQ ID NO: 209218 - RNA, 19 nt, Homo sapiens
ccacagguccgagacauca

SEQ ID NO: 209219 - RNA, 19 nt, Homo sapiens
gagcugcagcgcaauguca

SEQ ID NO: 209220 - RNA, 19 nt, Homo sapiens
aaacacgucaucaacaugu

SEQ ID NO: 209221 - RNA, 19 nt, Homo sapiens
ggacacagaccugaagaac

SEQ ID NO: 209222 - RNA, 19 nt, Homo sapiens
cggaugagcaccaacaugu

SEQ ID NO: 209223 - RNA, 19 nt, Homo sapiens
uggacgagaugaaggacaa

SEQ ID NO: 209224 - RNA, 19 nt, Homo sapiens
cagccgacaugcauaggau

SEQ ID NO: 209225 - RNA, 19 nt, Homo sapiens
gcagcaccaccuuugagaa

SEQ ID NO: 209226 - RNA, 19 nt, Homo sapiens
ggacucacacagcaagauc

SEQ ID NO: 209227 - RNA, 19 nt, Homo sapiens
ccaaguacgccucaugucu

SEQ ID NO: 209228 - RNA, 19 nt, Homo sapiens
uugcagaauuggucucaug

SEQ ID NO: 209229 - RNA, 19 nt, Homo sapiens
caggaagacccgcagaaug

SEQ ID NO: 209230 - RNA, 19 nt, Homo sapiens
ccucaugucucaagaugcu

SEQ ID NO: 209231 - RNA, 19 nt, Homo sapiens
cgguucagguguuuaacuu

SEQ ID NO: 209232 - RNA, 19 nt, Homo sapiens
gcaucgaacggcugcaguu

SEQ ID NO: 209233 - RNA, 19 nt, Homo sapiens
gguccgagacaucaucuuc

SEQ ID NO: 209234 - RNA, 19 nt, Homo sapiens
gggcaacuccaucaaagag

SEQ ID NO: 209235 - RNA, 19 nt, Homo sapiens
caagugggcgguguccauu

SEQ ID NO: 209236 - RNA, 19 nt, Homo sapiens
cagcgcagcaccaccuuug

SEQ ID NO: 209237 - RNA, 19 nt, Homo sapiens
gugcccucauccaguauuu

SEQ ID NO: 209238 - RNA, 19 nt, Homo sapiens
uccagcagcuccuucaagu

SEQ ID NO: 209239 - RNA, 19 nt, Homo sapiens
caaacacgucaucaacaug

SEQ ID NO: 209240 - RNA, 19 nt, Homo sapiens
uccgagacaucaucuucaa

SEQ ID NO: 209241 - RNA, 19 nt, Homo sapiens
gccaaacacgucaucaaca

SEQ ID NO: 209242 - RNA, 19 nt, Homo sapiens
gggcgguguccauuaaaga

SEQ ID NO: 209243 - RNA, 19 nt, Homo sapiens
ccugcuggcuuccuuugau

SEQ ID NO: 209244 - RNA, 19 nt, Homo sapiens
gcgccaaacacgucaucaa

SEQ ID NO: 209245 - RNA, 19 nt, Homo sapiens
aagggcaacuccaucaaag

SEQ ID NO: 209246 - RNA, 19 nt, Homo sapiens
gcggcagccuucaauacca

SEQ ID NO: 209247 - RNA, 19 nt, Homo sapiens
gauggcggcagccuucaau

SEQ ID NO: 209248 - RNA, 19 nt, Homo sapiens
caagaugcuggacgagaug

SEQ ID NO: 209249 - RNA, 19 nt, Homo sapiens
cgccucaugucucaagaug

SEQ ID NO: 209250 - RNA, 19 nt, Homo sapiens
gcagaauuggucucaugug

SEQ ID NO: 209251 - RNA, 19 nt, Homo sapiens
ggaugagcaccaacaugug

SEQ ID NO: 209252 - RNA, 19 nt, Homo sapiens
ccaggaagacccgcagaau

SEQ ID NO: 209253 - RNA, 19 nt, Homo sapiens
cagcaccaccuuugagaag

SEQ ID NO: 209254 - RNA, 19 nt, Homo sapiens
gcccucauccaguauuuca

SEQ ID NO: 209255 - RNA, 19 nt, Homo sapiens
accgugcccucauccagua

SEQ ID NO: 209256 - RNA, 19 nt, Homo sapiens
ucgcaaccgugcccucauc

SEQ ID NO: 209257 - RNA, 19 nt, Homo sapiens
gguggaggcccugaagaug

SEQ ID NO: 209258 - RNA, 19 nt, Homo sapiens
aaguacgccucaugucuca

SEQ ID NO: 209259 - RNA, 19 nt, Homo sapiens
gcaguucauugcugaucac

SEQ ID NO: 209260 - RNA, 19 nt, Homo sapiens
ucaucaaggucagcgucua

SEQ ID NO: 209261 - RNA, 19 nt, Homo sapiens
ccauuaaagagcagacuca

SEQ ID NO: 209262 - RNA, 19 nt, Homo sapiens
agaaugcaccugacgucaa

SEQ ID NO: 209263 - RNA, 19 nt, Homo sapiens
gcgccuuggcuaccuuuga

SEQ ID NO: 209264 - RNA, 19 nt, Homo sapiens
gugccucaaugucaucaag

SEQ ID NO: 209265 - RNA, 19 nt, Homo sapiens
gugcagagaaccuuuaacg

SEQ ID NO: 209266 - RNA, 19 nt, Homo sapiens
cuacugcaccagcgccaaa

SEQ ID NO: 209267 - RNA, 19 nt, Homo sapiens
ggguggaggcccugaagau

SEQ ID NO: 209268 - RNA, 19 nt, Homo sapiens
guacgccucaugucucaag

SEQ ID NO: 209269 - RNA, 19 nt, Homo sapiens
ggaagacccgcagaaugca

SEQ ID NO: 209270 - RNA, 19 nt, Homo sapiens
ugacagacauugacuauga

SEQ ID NO: 209271 - RNA, 19 nt, Homo sapiens
gcaagaacgucacucuaga

SEQ ID NO: 209272 - RNA, 19 nt, Homo sapiens
gaacucaucuccucagcau

SEQ ID NO: 209273 - RNA, 19 nt, Homo sapiens
gaaauugucauucagaaga

SEQ ID NO: 209274 - RNA, 19 nt, Homo sapiens
gaaugaaguggguauuaua

SEQ ID NO: 209275 - RNA, 19 nt, Homo sapiens
guacagccaucaugcaaga

SEQ ID NO: 209276 - RNA, 19 nt, Homo sapiens
gcucaccgauuccacagua

SEQ ID NO: 209277 - RNA, 19 nt, Homo sapiens
ugacagagccaaacaaaug

SEQ ID NO: 209278 - RNA, 19 nt, Homo sapiens
ccacaacggucucaagauc

SEQ ID NO: 209279 - RNA, 19 nt, Homo sapiens
uggaagagcuagaugagaa

SEQ ID NO: 209280 - RNA, 19 nt, Homo sapiens
aagaagagguggauaagau

SEQ ID NO: 209281 - RNA, 19 nt, Homo sapiens
ggaacaaauucugaaguug

SEQ ID NO: 209282 - RNA, 19 nt, Homo sapiens
gaacaggagagaaggaaga

SEQ ID NO: 209283 - RNA, 19 nt, Homo sapiens
gcgcugcaccggcacauua

SEQ ID NO: 209284 - RNA, 19 nt, Homo sapiens
cagcagagccugacuguuc

SEQ ID NO: 209285 - RNA, 19 nt, Homo sapiens
ggacgaagaccacuuggau

SEQ ID NO: 209286 - RNA, 19 nt, Homo sapiens
ggaagucuuugaggugaaa

SEQ ID NO: 209287 - RNA, 19 nt, Homo sapiens
caagugaccaucagauuau

SEQ ID NO: 209288 - RNA, 19 nt, Homo sapiens
acacgaugcgcaacaauua

SEQ ID NO: 209289 - RNA, 19 nt, Homo sapiens
acaagugaccaucagauua

SEQ ID NO: 209290 - RNA, 19 nt, Homo sapiens
ccacacagccagcuuauag

SEQ ID NO: 209291 - RNA, 19 nt, Homo sapiens
gaugagaagugggcagguu

SEQ ID NO: 209292 - RNA, 19 nt, Homo sapiens
gaagagguggauaagauga

SEQ ID NO: 209293 - RNA, 19 nt, Homo sapiens
ggagaaccaugggaagaau

SEQ ID NO: 209294 - RNA, 19 nt, Homo sapiens
gaacgugugggcuguguug

SEQ ID NO: 209295 - RNA, 19 nt, Homo sapiens
gagccugacuguucacaca

SEQ ID NO: 209296 - RNA, 19 nt, Homo sapiens
gaccugcacuacuucauca

SEQ ID NO: 209297 - RNA, 19 nt, Homo sapiens
gaauaugcacugcccuuug

SEQ ID NO: 209298 - RNA, 19 nt, Homo sapiens
agaaugaaguggguauuau

SEQ ID NO: 209299 - RNA, 19 nt, Homo sapiens
ggagaccaaggaacaaauu

SEQ ID NO: 209300 - RNA, 19 nt, Homo sapiens
gaaggaagaacaggagaga

SEQ ID NO: 209301 - RNA, 19 nt, Homo sapiens
aacagaagaugaaggaaga

SEQ ID NO: 209302 - RNA, 19 nt, Homo sapiens
caauaaacaccgucucaga

SEQ ID NO: 209303 - RNA, 19 nt, Homo sapiens
gggcugcaucuucauguua

SEQ ID NO: 209304 - RNA, 19 nt, Homo sapiens
cagaaugaaguggguauua

SEQ ID NO: 209305 - RNA, 19 nt, Homo sapiens
aggaacaaauucugaaguu

SEQ ID NO: 209306 - RNA, 19 nt, Homo sapiens
uggauaagaugauggaaca

SEQ ID NO: 209307 - RNA, 19 nt, Homo sapiens
gaagaagagguggauaaga

SEQ ID NO: 209308 - RNA, 19 nt, Homo sapiens
cgucggagccgcugagaaa

SEQ ID NO: 209309 - RNA, 19 nt, Homo sapiens
caagaucugcgagaaguuu

SEQ ID NO: 209310 - RNA, 19 nt, Homo sapiens
agaaguggcacauggcaua

SEQ ID NO: 209311 - RNA, 19 nt, Homo sapiens
ggcugcaucuucauguuaa

SEQ ID NO: 209312 - RNA, 19 nt, Homo sapiens
guauccagcugugaaguga

SEQ ID NO: 209313 - RNA, 19 nt, Homo sapiens
gcaagcggcaggaggaaga

SEQ ID NO: 209314 - RNA, 19 nt, Homo sapiens
gagcugccguccuuugaag

SEQ ID NO: 209315 - RNA, 19 nt, Homo sapiens
gaaaguggaagagcuagau

SEQ ID NO: 209316 - RNA, 19 nt, Homo sapiens
guaacacgaugcgcaacaa

SEQ ID NO: 209317 - RNA, 19 nt, Homo sapiens
gauaagaugauggaacaga

SEQ ID NO: 209318 - RNA, 19 nt, Homo sapiens
ggaauaugcacugcccuuu

SEQ ID NO: 209319 - RNA, 19 nt, Homo sapiens
gaacuauggccggaaccua

SEQ ID NO: 209320 - RNA, 19 nt, Homo sapiens
gaagaacaggagagaagga

SEQ ID NO: 209321 - RNA, 19 nt, Homo sapiens
gcugagggcugaggaaguc

SEQ ID NO: 209322 - RNA, 19 nt, Homo sapiens
gcugacagagccaaacaaa

SEQ ID NO: 209323 - RNA, 19 nt, Homo sapiens
gcauaucacgggagcaaug

SEQ ID NO: 209324 - RNA, 19 nt, Homo sapiens
gggcagcuccagaggauga

SEQ ID NO: 209325 - RNA, 19 nt, Homo sapiens
uggcguggcucaccgauuc

SEQ ID NO: 209326 - RNA, 19 nt, Homo sapiens
aaaucuaccugccacugaa

SEQ ID NO: 209327 - RNA, 19 nt, Homo sapiens
gcgaguaccaugcccuuug

SEQ ID NO: 209328 - RNA, 19 nt, Homo sapiens
ccagagcuccggacgaaga

SEQ ID NO: 209329 - RNA, 19 nt, Homo sapiens
ggugaaaguggaagagcua

SEQ ID NO: 209330 - RNA, 19 nt, Homo sapiens
ccaaggaacaaauucugaa

SEQ ID NO: 209331 - RNA, 19 nt, Homo sapiens
auaagaugauggaacagaa

SEQ ID NO: 209332 - RNA, 19 nt, Homo sapiens
gaugguauccagcugugaa

SEQ ID NO: 209333 - RNA, 19 nt, Homo sapiens
ggcaagaacgucacucuag

SEQ ID NO: 209334 - RNA, 19 nt, Homo sapiens
ucagagcuccuucggcauu

SEQ ID NO: 209335 - RNA, 19 nt, Homo sapiens
caccagagcauggacaauu

SEQ ID NO: 209336 - RNA, 19 nt, Homo sapiens
ggagauggaagagagaaug

SEQ ID NO: 209337 - RNA, 19 nt, Homo sapiens
gaagaugaaggaagaacag

SEQ ID NO: 209338 - RNA, 19 nt, Homo sapiens
ggaagaagagguggauaag

SEQ ID NO: 209339 - RNA, 19 nt, Homo sapiens
ggaccucuaugggcagugu

SEQ ID NO: 209340 - RNA, 19 nt, Homo sapiens
gggcugaggaagucuuuga

SEQ ID NO: 209341 - RNA, 19 nt, Homo sapiens
gaggagaccaaggaacaaa

SEQ ID NO: 209342 - RNA, 19 nt, Homo sapiens
gauggaagagagaauguca

SEQ ID NO: 209343 - RNA, 19 nt, Homo sapiens
ugccagagcuccggacgaa

SEQ ID NO: 209344 - RNA, 19 nt, Homo sapiens
gcucauggccuugucuuca

SEQ ID NO: 209345 - RNA, 19 nt, Homo sapiens
gcaacacugccaccgagaa

SEQ ID NO: 209346 - RNA, 19 nt, Homo sapiens
caagaaaguuuuacaugag

SEQ ID NO: 209347 - RNA, 19 nt, Homo sapiens
ggccuugucuucaguacca

SEQ ID NO: 209348 - RNA, 19 nt, Homo sapiens
caugacagacauugacuau

SEQ ID NO: 209349 - RNA, 19 nt, Homo sapiens
caugguggacgguaucaaa

SEQ ID NO: 209350 - RNA, 19 nt, Homo sapiens
gggcuguguuggaucucua

SEQ ID NO: 209351 - RNA, 19 nt, Homo sapiens
gcugagaaagcgcagagaa

SEQ ID NO: 209352 - RNA, 19 nt, Homo sapiens
gcugggacacuaaccaaga

SEQ ID NO: 209353 - RNA, 19 nt, Homo sapiens
aauaugcacugcccuuugg

SEQ ID NO: 209354 - RNA, 19 nt, Homo sapiens
ggguagcugugccagaugu

SEQ ID NO: 209355 - RNA, 19 nt, Homo sapiens
ccucauggcagcugacaga

SEQ ID NO: 209356 - RNA, 19 nt, Homo sapiens
aacaaauucugaaguugga

SEQ ID NO: 209357 - RNA, 19 nt, Homo sapiens
gacccuggccuccaaagug

SEQ ID NO: 209358 - RNA, 19 nt, Homo sapiens
gaaguuggaggagaagcuu

SEQ ID NO: 209359 - RNA, 19 nt, Homo sapiens
aggaagaagagguggauaa

SEQ ID NO: 209360 - RNA, 19 nt, Homo sapiens
cacaagugaccaucagauu

SEQ ID NO: 209361 - RNA, 19 nt, Homo sapiens
cagcuuauaguccuaguca

SEQ ID NO: 209362 - RNA, 19 nt, Homo sapiens
uagaggagaccaaggaaca

SEQ ID NO: 209363 - RNA, 19 nt, Homo sapiens
gaugauggaacagaagaug

SEQ ID NO: 209364 - RNA, 19 nt, Homo sapiens
gccaauaaacaccgucuca

SEQ ID NO: 209365 - RNA, 19 nt, Homo sapiens
gaaguggcacauggcauau

SEQ ID NO: 209366 - RNA, 19 nt, Homo sapiens
ccuggaggcugggacacua

SEQ ID NO: 209367 - RNA, 19 nt, Homo sapiens
gguggacgguaucaaagag

SEQ ID NO: 209368 - RNA, 19 nt, Homo sapiens
gcaacaauuauggguguga

SEQ ID NO: 209369 - RNA, 19 nt, Homo sapiens
gacagagccaaacaaaugu

SEQ ID NO: 209370 - RNA, 19 nt, Homo sapiens
ugacagacauugacuauga

SEQ ID NO: 209371 - RNA, 19 nt, Homo sapiens
gcccuacacuucuucauua

SEQ ID NO: 209372 - RNA, 19 nt, Homo sapiens
gcaagaacgucacucuaga

SEQ ID NO: 209373 - RNA, 19 nt, Homo sapiens
ggagagcuguuugaaauug

SEQ ID NO: 209374 - RNA, 19 nt, Homo sapiens
ggacgggacucuccacuuc

SEQ ID NO: 209375 - RNA, 19 nt, Homo sapiens
gaaauugucauucagaaga

SEQ ID NO: 209376 - RNA, 19 nt, Homo sapiens
gcaggagggugaccacauu

SEQ ID NO: 209377 - RNA, 19 nt, Homo sapiens
gaaugaaguggguauuaua

SEQ ID NO: 209378 - RNA, 19 nt, Homo sapiens
guacagccaucaugcaaga

SEQ ID NO: 209379 - RNA, 19 nt, Homo sapiens
gcucaccgauuccacagua

SEQ ID NO: 209380 - RNA, 19 nt, Homo sapiens
guaacgcagucaucacuaa

SEQ ID NO: 209381 - RNA, 19 nt, Homo sapiens
gcggauagauuuccuaaac

SEQ ID NO: 209382 - RNA, 19 nt, Homo sapiens
ccacaacggucucaagauc

SEQ ID NO: 209383 - RNA, 19 nt, Homo sapiens
uggaagagcuagaugagaa

SEQ ID NO: 209384 - RNA, 19 nt, Homo sapiens
acaaugagauguuugagau

SEQ ID NO: 209385 - RNA, 19 nt, Homo sapiens
gaacaugacucccuuuuac

SEQ ID NO: 209386 - RNA, 19 nt, Homo sapiens
ggacgaagaccacuuggau

SEQ ID NO: 209387 - RNA, 19 nt, Homo sapiens
ggaagucuuugaggugaaa

SEQ ID NO: 209388 - RNA, 19 nt, Homo sapiens
acacgaugcgcaacaauua

SEQ ID NO: 209389 - RNA, 19 nt, Homo sapiens
cuacacuucuucauuaaug

SEQ ID NO: 209390 - RNA, 19 nt, Homo sapiens
gaugagaagugggcagguu

SEQ ID NO: 209391 - RNA, 19 nt, Homo sapiens
ggagaaccaugggaagaau

SEQ ID NO: 209392 - RNA, 19 nt, Homo sapiens
gaacgugugggcuguguug

SEQ ID NO: 209393 - RNA, 19 nt, Homo sapiens
gaccugcacuacuucauca

SEQ ID NO: 209394 - RNA, 19 nt, Homo sapiens
gaauaugcacugcccuuug

SEQ ID NO: 209395 - RNA, 19 nt, Homo sapiens
agaaugaaguggguauuau

SEQ ID NO: 209396 - RNA, 19 nt, Homo sapiens
ugaccaucguccacaauaa

SEQ ID NO: 209397 - RNA, 19 nt, Homo sapiens
gcucuguguuggaggagua

SEQ ID NO: 209398 - RNA, 19 nt, Homo sapiens
gggcugcaucuucauguua

SEQ ID NO: 209399 - RNA, 19 nt, Homo sapiens
cagaaugaaguggguauua

SEQ ID NO: 209400 - RNA, 19 nt, Homo sapiens
ucugggaccuggaugauga

SEQ ID NO: 209401 - RNA, 19 nt, Homo sapiens
acaagaugguggacaaaug

SEQ ID NO: 209402 - RNA, 19 nt, Homo sapiens
caacgaugcccugcucuuu

SEQ ID NO: 209403 - RNA, 19 nt, Homo sapiens
cauaaugacuuugccaaca

SEQ ID NO: 209404 - RNA, 19 nt, Homo sapiens
caagaucugcgagaaguuu

SEQ ID NO: 209405 - RNA, 19 nt, Homo sapiens
agaaguggcacauggcaua

SEQ ID NO: 209406 - RNA, 19 nt, Homo sapiens
ggcugcaucuucauguuaa

SEQ ID NO: 209407 - RNA, 19 nt, Homo sapiens
guauccagcugugaaguga

SEQ ID NO: 209408 - RNA, 19 nt, Homo sapiens
auggagagcuguuugaaau

SEQ ID NO: 209409 - RNA, 19 nt, Homo sapiens
gggaaggccugggaucuag

SEQ ID NO: 209410 - RNA, 19 nt, Homo sapiens
gagcugccguccuuugaag

SEQ ID NO: 209411 - RNA, 19 nt, Homo sapiens
gaaaguggaagagcuagau

SEQ ID NO: 209412 - RNA, 19 nt, Homo sapiens
guaacacgaugcgcaacaa

SEQ ID NO: 209413 - RNA, 19 nt, Homo sapiens
ggccggagacguuuccuaa

SEQ ID NO: 209414 - RNA, 19 nt, Homo sapiens
ggaauaugcacugcccuuu

SEQ ID NO: 209415 - RNA, 19 nt, Homo sapiens
gaacuauggccggaaccua

SEQ ID NO: 209416 - RNA, 19 nt, Homo sapiens
gauggagagcuguuugaaa

SEQ ID NO: 209417 - RNA, 19 nt, Homo sapiens
ggaagaauauccuuuuguc

SEQ ID NO: 209418 - RNA, 19 nt, Homo sapiens
gagaaccaugggaagaaua

SEQ ID NO: 209419 - RNA, 19 nt, Homo sapiens
gcugagggcugaggaaguc

SEQ ID NO: 209420 - RNA, 19 nt, Homo sapiens
ccggagacguuuccuaaca

SEQ ID NO: 209421 - RNA, 19 nt, Homo sapiens
cauccugucugccuacaau

SEQ ID NO: 209422 - RNA, 19 nt, Homo sapiens
gcauaucacgggagcaaug

SEQ ID NO: 209423 - RNA, 19 nt, Homo sapiens
gggcugcucugugcugaga

SEQ ID NO: 209424 - RNA, 19 nt, Homo sapiens
gggcagcuccagaggauga

SEQ ID NO: 209425 - RNA, 19 nt, Homo sapiens
uggcguggcucaccgauuc

SEQ ID NO: 209426 - RNA, 19 nt, Homo sapiens
gagagcuguuugaaauugu

SEQ ID NO: 209427 - RNA, 19 nt, Homo sapiens
ggaauggggugaugcacaa

SEQ ID NO: 209428 - RNA, 19 nt, Homo sapiens
caguugcccuccaccauga

SEQ ID NO: 209429 - RNA, 19 nt, Homo sapiens
ugucugagguggugagcaa

SEQ ID NO: 209430 - RNA, 19 nt, Homo sapiens
gcgaguaccaugcccuuug

SEQ ID NO: 209431 - RNA, 19 nt, Homo sapiens
ccagagcuccggacgaaga

SEQ ID NO: 209432 - RNA, 19 nt, Homo sapiens
ggugaaaguggaagagcua

SEQ ID NO: 209433 - RNA, 19 nt, Homo sapiens
caacucugcccuacacuuc

SEQ ID NO: 209434 - RNA, 19 nt, Homo sapiens
gggccgucguggaccuuua

SEQ ID NO: 209435 - RNA, 19 nt, Homo sapiens
gaugguauccagcugugaa

SEQ ID NO: 209436 - RNA, 19 nt, Homo sapiens
ggcaagaacgucacucuag

SEQ ID NO: 209437 - RNA, 19 nt, Homo sapiens
acaauaacaaccacaguga

SEQ ID NO: 209438 - RNA, 19 nt, Homo sapiens
ggaccucuaugggcagugu

SEQ ID NO: 209439 - RNA, 19 nt, Homo sapiens
gggcugaggaagucuuuga

SEQ ID NO: 209440 - RNA, 19 nt, Homo sapiens
gaugagcggcuguggaauc

SEQ ID NO: 209441 - RNA, 19 nt, Homo sapiens
gacaaugagauguuugaga

SEQ ID NO: 209442 - RNA, 19 nt, Homo sapiens
ugccagagcuccggacgaa

SEQ ID NO: 209443 - RNA, 19 nt, Homo sapiens
gcucauggccuugucuuca

SEQ ID NO: 209444 - RNA, 19 nt, Homo sapiens
gcaacacugccaccgagaa

SEQ ID NO: 209445 - RNA, 19 nt, Homo sapiens
ugggcuggcuccauugaaa

SEQ ID NO: 209446 - RNA, 19 nt, Homo sapiens
acauuggccucacaaggaa

SEQ ID NO: 209447 - RNA, 19 nt, Homo sapiens
ucaaacucagcaacaauaa

SEQ ID NO: 209448 - RNA, 19 nt, Homo sapiens
gcgggacccucaucaaacu

SEQ ID NO: 209449 - RNA, 19 nt, Homo sapiens
guaggcaggcucucagaug

SEQ ID NO: 209450 - RNA, 19 nt, Homo sapiens
uaaugacuuugccaacaug

SEQ ID NO: 209451 - RNA, 19 nt, Homo sapiens
gagcaacaccauccugucu

SEQ ID NO: 209452 - RNA, 19 nt, Homo sapiens
ggccuugucuucaguacca

SEQ ID NO: 209453 - RNA, 19 nt, Homo sapiens
ggagguguaugcgguaguc

SEQ ID NO: 209454 - RNA, 19 nt, Homo sapiens
gcuguggaauccugaccaa

SEQ ID NO: 209455 - RNA, 19 nt, Homo sapiens
ggaacaugacucccuuuua

SEQ ID NO: 209456 - RNA, 19 nt, Homo sapiens
uaggcaggcucucagaugu

SEQ ID NO: 209457 - RNA, 19 nt, Homo sapiens
ugagacaccacuacuacaa

SEQ ID NO: 209458 - RNA, 19 nt, Homo sapiens
caugguggacgguaucaaa

SEQ ID NO: 209459 - RNA, 19 nt, Homo sapiens
gagauggacgcucuguguu

SEQ ID NO: 209460 - RNA, 19 nt, Homo sapiens
gggcuguguuggaucucua

SEQ ID NO: 209461 - RNA, 19 nt, Homo sapiens
caugacagacauugacuau

SEQ ID NO: 209462 - RNA, 19 nt, Homo sapiens
cacauuggccucacaagga

SEQ ID NO: 209463 - RNA, 19 nt, Homo sapiens
guggaauccugaccaaugg

SEQ ID NO: 209464 - RNA, 19 nt, Homo sapiens
gggacaaugagauguuuga

SEQ ID NO: 209465 - RNA, 19 nt, Homo sapiens
uggaugaauucaacaaugg

SEQ ID NO: 209466 - RNA, 19 nt, Homo sapiens
gugcgggacccucaucaaa

SEQ ID NO: 209467 - RNA, 19 nt, Homo sapiens
gcugggacacuaaccaaga

SEQ ID NO: 209468 - RNA, 19 nt, Homo sapiens
aauaugcacugcccuuugg

SEQ ID NO: 209469 - RNA, 19 nt, Homo sapiens
ggguagcugugccagaugu

SEQ ID NO: 209470 - RNA, 19 nt, Homo sapiens
gaacucaucuccucagcau

SEQ ID NO: 209471 - RNA, 19 nt, Homo sapiens
ugacagagccaaacaaaug

SEQ ID NO: 209472 - RNA, 19 nt, Homo sapiens
ccacaacggucucaagauc

SEQ ID NO: 209473 - RNA, 19 nt, Homo sapiens
aagaagagguggauaagau

SEQ ID NO: 209474 - RNA, 19 nt, Homo sapiens
ggaacaaauucugaaguug

SEQ ID NO: 209475 - RNA, 19 nt, Homo sapiens
gaacaggagagaaggaaga

SEQ ID NO: 209476 - RNA, 19 nt, Homo sapiens
gcgcugcaccggcacauua

SEQ ID NO: 209477 - RNA, 19 nt, Homo sapiens
cagcagagccugacuguuc

SEQ ID NO: 209478 - RNA, 19 nt, Homo sapiens
caagugaccaucagauuau

SEQ ID NO: 209479 - RNA, 19 nt, Homo sapiens
acaagugaccaucagauua

SEQ ID NO: 209480 - RNA, 19 nt, Homo sapiens
ccacacagccagcuuauag

SEQ ID NO: 209481 - RNA, 19 nt, Homo sapiens
gaagagguggauaagauga

SEQ ID NO: 209482 - RNA, 19 nt, Homo sapiens
gagccugacuguucacaca

SEQ ID NO: 209483 - RNA, 19 nt, Homo sapiens
gaauaugcacugcccuuug

SEQ ID NO: 209484 - RNA, 19 nt, Homo sapiens
ggagaccaaggaacaaauu

SEQ ID NO: 209485 - RNA, 19 nt, Homo sapiens
gaaggaagaacaggagaga

SEQ ID NO: 209486 - RNA, 19 nt, Homo sapiens
aacagaagaugaaggaaga

SEQ ID NO: 209487 - RNA, 19 nt, Homo sapiens
caauaaacaccgucucaga

SEQ ID NO: 209488 - RNA, 19 nt, Homo sapiens
gggcugcaucuucauguua

SEQ ID NO: 209489 - RNA, 19 nt, Homo sapiens
aggaacaaauucugaaguu

SEQ ID NO: 209490 - RNA, 19 nt, Homo sapiens
uggauaagaugauggaaca

SEQ ID NO: 209491 - RNA, 19 nt, Homo sapiens
gaagaagagguggauaaga

SEQ ID NO: 209492 - RNA, 19 nt, Homo sapiens
caagaucugcgagaaguuu

SEQ ID NO: 209493 - RNA, 19 nt, Homo sapiens
cgucggagccgcugagaaa

SEQ ID NO: 209494 - RNA, 19 nt, Homo sapiens
ggcugcaucuucauguuaa

SEQ ID NO: 209495 - RNA, 19 nt, Homo sapiens
agaaguggcacauggcaua

SEQ ID NO: 209496 - RNA, 19 nt, Homo sapiens
gcaagcggcaggaggaaga

SEQ ID NO: 209497 - RNA, 19 nt, Homo sapiens
gagcugccguccuuugaag

SEQ ID NO: 209498 - RNA, 19 nt, Homo sapiens
gauaagaugauggaacaga

SEQ ID NO: 209499 - RNA, 19 nt, Homo sapiens
ggaauaugcacugcccuuu

SEQ ID NO: 209500 - RNA, 19 nt, Homo sapiens
gaagaacaggagagaagga

SEQ ID NO: 209501 - RNA, 19 nt, Homo sapiens
gcugacagagccaaacaaa

SEQ ID NO: 209502 - RNA, 19 nt, Homo sapiens
gcauaucacgggagcaaug

SEQ ID NO: 209503 - RNA, 19 nt, Homo sapiens
aaaucuaccugccacugaa

SEQ ID NO: 209504 - RNA, 19 nt, Homo sapiens
gcgaguaccaugcccuuug

SEQ ID NO: 209505 - RNA, 19 nt, Homo sapiens
ccaaggaacaaauucugaa

SEQ ID NO: 209506 - RNA, 19 nt, Homo sapiens
auaagaugauggaacagaa

SEQ ID NO: 209507 - RNA, 19 nt, Homo sapiens
ucagagcuccuucggcauu

SEQ ID NO: 209508 - RNA, 19 nt, Homo sapiens
caccagagcauggacaauu

SEQ ID NO: 209509 - RNA, 19 nt, Homo sapiens
ggagauggaagagagaaug

SEQ ID NO: 209510 - RNA, 19 nt, Homo sapiens
ggaccucuaugggcagugu

SEQ ID NO: 209511 - RNA, 19 nt, Homo sapiens
gaagaugaaggaagaacag

SEQ ID NO: 209512 - RNA, 19 nt, Homo sapiens
ggaagaagagguggauaag

SEQ ID NO: 209513 - RNA, 19 nt, Homo sapiens
gaggagaccaaggaacaaa

SEQ ID NO: 209514 - RNA, 19 nt, Homo sapiens
gauggaagagagaauguca

SEQ ID NO: 209515 - RNA, 19 nt, Homo sapiens
caagaaaguuuuacaugag

SEQ ID NO: 209516 - RNA, 19 nt, Homo sapiens
caugguggacgguaucaaa

SEQ ID NO: 209517 - RNA, 19 nt, Homo sapiens
gcugagaaagcgcagagaa

SEQ ID NO: 209518 - RNA, 19 nt, Homo sapiens
ggguagcugugccagaugu

SEQ ID NO: 209519 - RNA, 19 nt, Homo sapiens
gcugggacacuaaccaaga

SEQ ID NO: 209520 - RNA, 19 nt, Homo sapiens
aauaugcacugcccuuugg

SEQ ID NO: 209521 - RNA, 19 nt, Homo sapiens
ccucauggcagcugacaga

SEQ ID NO: 209522 - RNA, 19 nt, Homo sapiens
aacaaauucugaaguugga

SEQ ID NO: 209523 - RNA, 19 nt, Homo sapiens
gacccuggccuccaaagug

SEQ ID NO: 209524 - RNA, 19 nt, Homo sapiens
gaaguuggaggagaagcuu

SEQ ID NO: 209525 - RNA, 19 nt, Homo sapiens
aggaagaagagguggauaa

SEQ ID NO: 209526 - RNA, 19 nt, Homo sapiens
cacaagugaccaucagauu

SEQ ID NO: 209527 - RNA, 19 nt, Homo sapiens
cagcuuauaguccuaguca

SEQ ID NO: 209528 - RNA, 19 nt, Homo sapiens
uagaggagaccaaggaaca

SEQ ID NO: 209529 - RNA, 19 nt, Homo sapiens
gaugauggaacagaagaug

SEQ ID NO: 209530 - RNA, 19 nt, Homo sapiens
gccaauaaacaccgucuca

SEQ ID NO: 209531 - RNA, 19 nt, Homo sapiens
gaaguggcacauggcauau

SEQ ID NO: 209532 - RNA, 19 nt, Homo sapiens
ccuggaggcugggacacua

SEQ ID NO: 209533 - RNA, 19 nt, Homo sapiens
gguggacgguaucaaagag

SEQ ID NO: 209534 - RNA, 19 nt, Homo sapiens
gacagagccaaacaaaugu

SEQ ID NO: 209535 - RNA, 19 nt, Homo sapiens
acaacggucucaagaucug

SEQ ID NO: 209536 - RNA, 19 nt, Homo sapiens
gagauggaagagagaaugu

SEQ ID NO: 209537 - RNA, 19 nt, Homo sapiens
ugauggaacagaagaugaa

SEQ ID NO: 209538 - RNA, 19 nt, Homo sapiens
gcagugcaguaccuaucuc

SEQ ID NO: 209539 - RNA, 19 nt, Homo sapiens
ggcgaaaggaacagaguga

SEQ ID NO: 209540 - RNA, 19 nt, Homo sapiens
gaccaaggaacaaauucug

SEQ ID NO: 209541 - RNA, 19 nt, Homo sapiens
gcaccggcacauuaugaug

SEQ ID NO: 209542 - RNA, 19 nt, Homo sapiens
gcagauggaacaugcuaac

SEQ ID NO: 209543 - RNA, 19 nt, Homo sapiens
cauuagaggagaccaagga

SEQ ID NO: 209544 - RNA, 19 nt, Homo sapiens
caaagcgaagccugugcua

SEQ ID NO: 209545 - RNA, 19 nt, Homo sapiens
cagacaugguggacgguau

SEQ ID NO: 209546 - RNA, 19 nt, Homo sapiens
ggaggaagaagagguggau

SEQ ID NO: 209547 - RNA, 19 nt, Homo sapiens
gcgcgcuuccgccuucuuu

SEQ ID NO: 209548 - RNA, 19 nt, Homo sapiens
cugggacacuaaccaagaa

SEQ ID NO: 209549 - RNA, 19 nt, Homo sapiens
aagugaccaucagauuaua

SEQ ID NO: 209550 - RNA, 19 nt, Homo sapiens
ccacaagugaccaucagau

SEQ ID NO: 209551 - RNA, 19 nt, Homo sapiens
ccagcucccugugcagaug

SEQ ID NO: 209552 - RNA, 19 nt, Homo sapiens
gcuuuuggcucuacaggaa

SEQ ID NO: 209553 - RNA, 19 nt, Homo sapiens
gcgcuuccgccuucuuuca

SEQ ID NO: 209554 - RNA, 19 nt, Homo sapiens
cgaguaccaugcccuuugc

SEQ ID NO: 209555 - RNA, 19 nt, Homo sapiens
ggcccacacagccagcuua

SEQ ID NO: 209556 - RNA, 19 nt, Homo sapiens
uaucacgggagcaauguug

SEQ ID NO: 209557 - RNA, 19 nt, Homo sapiens
gugugucccaggccaauaa

SEQ ID NO: 209558 - RNA, 19 nt, Homo sapiens
gugagcaggugacaaucgu

SEQ ID NO: 209559 - RNA, 19 nt, Homo sapiens
cugcagcucaagaaaguuu

SEQ ID NO: 209560 - RNA, 19 nt, Homo sapiens
caaggaacaaauucugaag

SEQ ID NO: 209561 - RNA, 19 nt, Homo sapiens
uggaacagaagaugaagga

SEQ ID NO: 209562 - RNA, 19 nt, Homo sapiens
ugacaucagcugcauacca

SEQ ID NO: 209563 - RNA, 19 nt, Homo sapiens
gagaccaaggaacaaauuc

SEQ ID NO: 209564 - RNA, 19 nt, Homo sapiens
agagguggauaagaugaug

SEQ ID NO: 209565 - RNA, 19 nt, Homo sapiens
cucaagaucugcgagaagu

SEQ ID NO: 209566 - RNA, 19 nt, Homo sapiens
ccuuugcucucgcuuccaa

SEQ ID NO: 209567 - RNA, 19 nt, Homo sapiens
aguggcacauggcauauca

SEQ ID NO: 209568 - RNA, 19 nt, Homo sapiens
caucgugggugaggguauc

SEQ ID NO: 209569 - RNA, 19 nt, Homo sapiens
guggugcccuguccuugca

SEQ ID NO: 209570 - RNA, 19 nt, Homo sapiens
ucaagaaggugcucaugga

SEQ ID NO: 209571 - RNA, 19 nt, Homo sapiens
gcgcagugcagguggauua

SEQ ID NO: 209572 - RNA, 19 nt, Homo sapiens
ccgagcaggucuucaauga

SEQ ID NO: 209573 - RNA, 19 nt, Homo sapiens
ccacuguacuugcucuuga

SEQ ID NO: 209574 - RNA, 19 nt, Homo sapiens
guucgcaguuccacucauu

SEQ ID NO: 209575 - RNA, 19 nt, Homo sapiens
ggucauccgugccaacauc

SEQ ID NO: 209576 - RNA, 19 nt, Homo sapiens
cagugcagguggauuacua

SEQ ID NO: 209577 - RNA, 19 nt, Homo sapiens
gcaggucccuaauaaagcu

SEQ ID NO: 209578 - RNA, 19 nt, Homo sapiens
uggagaagcugagcagguu

SEQ ID NO: 209579 - RNA, 19 nt, Homo sapiens
agaaggugcucauggagau

SEQ ID NO: 209580 - RNA, 19 nt, Homo sapiens
ggucuuggcccucuguguu

SEQ ID NO: 209581 - RNA, 19 nt, Homo sapiens
gcagguuccaugccaaguu

SEQ ID NO: 209582 - RNA, 19 nt, Homo sapiens
caaguucacccucgaguac

SEQ ID NO: 209583 - RNA, 19 nt, Homo sapiens
cagguuccaugccaaguuc

SEQ ID NO: 209584 - RNA, 19 nt, Homo sapiens
gcaguuccacucauucaag

SEQ ID NO: 209585 - RNA, 19 nt, Homo sapiens
ccaaguucacccucgagua

SEQ ID NO: 209586 - RNA, 19 nt, Homo sapiens
caguuccacucauucaaga

SEQ ID NO: 209587 - RNA, 19 nt, Homo sapiens
ucaccgagcaggucuucaa

SEQ ID NO: 209588 - RNA, 19 nt, Homo sapiens
cagacccacugucgccauu

SEQ ID NO: 209589 - RNA, 19 nt, Homo sapiens
ugcugaagcugaugagugu

SEQ ID NO: 209590 - RNA, 19 nt, Homo sapiens
gggaaggcaccuaccacuu

SEQ ID NO: 209591 - RNA, 19 nt, Homo sapiens
cucugcaggucccuaauaa

SEQ ID NO: 209592 - RNA, 19 nt, Homo sapiens
ggcagaggcccaucaccuu

SEQ ID NO: 209593 - RNA, 19 nt, Homo sapiens
ucucugcaggucccuaaua

SEQ ID NO: 209594 - RNA, 19 nt, Homo sapiens
gucuuggcccucuguguua

SEQ ID NO: 209595 - RNA, 19 nt, Homo sapiens
cugcaggucccuaauaaag

SEQ ID NO: 209596 - RNA, 19 nt, Homo sapiens
cucccacccugcccacuaa

SEQ ID NO: 209597 - RNA, 19 nt, Homo sapiens
cccugacgaugccaagaaa

SEQ ID NO: 209598 - RNA, 19 nt, Homo sapiens
ggagcccacuguacuugcu

SEQ ID NO: 209599 - RNA, 19 nt, Homo sapiens
uguuaacccugaucuucug

SEQ ID NO: 209600 - RNA, 19 nt, Homo sapiens
gcaguuccaggcugagaag

SEQ ID NO: 209601 - RNA, 19 nt, Homo sapiens
gcggugaggcauggacuga

SEQ ID NO: 209602 - RNA, 19 nt, Homo sapiens
gaggaacaccuugaucuua

SEQ ID NO: 209603 - RNA, 19 nt, Homo sapiens
gauguugccuggaacuuug

SEQ ID NO: 209604 - RNA, 19 nt, Homo sapiens
gaauguggcgucccucuga

SEQ ID NO: 209605 - RNA, 19 nt, Homo sapiens
gcaagguacuacuuaucga

SEQ ID NO: 209606 - RNA, 19 nt, Homo sapiens
gaugggugcugguccuguu

SEQ ID NO: 209607 - RNA, 19 nt, Homo sapiens
ggaacaccuugaucuuaca

SEQ ID NO: 209608 - RNA, 19 nt, Homo sapiens
ggaggaacaccuugaucuu

SEQ ID NO: 209609 - RNA, 19 nt, Homo sapiens
ugaauucccucaaguacgu

SEQ ID NO: 209610 - RNA, 19 nt, Homo sapiens
ggagaacgccaagaacgaa

SEQ ID NO: 209611 - RNA, 19 nt, Homo sapiens
ucgaagcccugcugucuca

SEQ ID NO: 209612 - RNA, 19 nt, Homo sapiens
gcaaccaguuugggcauca

SEQ ID NO: 209613 - RNA, 19 nt, Homo sapiens
ggacaauugcgccaugugu

SEQ ID NO: 209614 - RNA, 19 nt, Homo sapiens
acaccuugaucuuacagaa

SEQ ID NO: 209615 - RNA, 19 nt, Homo sapiens
gguacuacuuaucgagaau

SEQ ID NO: 209616 - RNA, 19 nt, Homo sapiens
ggcgcacucuccagccuuu

SEQ ID NO: 209617 - RNA, 19 nt, Homo sapiens
gggaggaacaccuugaucu

SEQ ID NO: 209618 - RNA, 19 nt, Homo sapiens
gggacuacacccagaugaa

SEQ ID NO: 209619 - RNA, 19 nt, Homo sapiens
aggaacaccuugaucuuac

SEQ ID NO: 209620 - RNA, 19 nt, Homo sapiens
ugacaucgagccugacauc

SEQ ID NO: 209621 - RNA, 19 nt, Homo sapiens
ggacuacacccagaugaac

SEQ ID NO: 209622 - RNA, 19 nt, Homo sapiens
gcgaguuuccccacuaaua

SEQ ID NO: 209623 - RNA, 19 nt, Homo sapiens
gcuggcuucuuggacaauu

SEQ ID NO: 209624 - RNA, 19 nt, Homo sapiens
cgauguugccuggaacuuu

SEQ ID NO: 209625 - RNA, 19 nt, Homo sapiens
caucgaagcccugcugucu

SEQ ID NO: 209626 - RNA, 19 nt, Homo sapiens
gggcaagguacuacuuauc

SEQ ID NO: 209627 - RNA, 19 nt, Homo sapiens
cgagggaggaacaccuuga

SEQ ID NO: 209628 - RNA, 19 nt, Homo sapiens
cgccaagaacgaagagauu

SEQ ID NO: 209629 - RNA, 19 nt, Homo sapiens
gccagaccaaggcgaguuu

SEQ ID NO: 209630 - RNA, 19 nt, Homo sapiens
gacgccaccgcgcuuauga

SEQ ID NO: 209631 - RNA, 19 nt, Homo sapiens
cgaguuuccccacuaauaa

SEQ ID NO: 209632 - RNA, 19 nt, Homo sapiens
caccuugaucuuacagaaa

SEQ ID NO: 209633 - RNA, 19 nt, Homo sapiens
ccaacuucaugcucuucga

SEQ ID NO: 209634 - RNA, 19 nt, Homo sapiens
guucgagcccaacuucaug

SEQ ID NO: 209635 - RNA, 19 nt, Homo sapiens
gccaagaacgaagagauuc

SEQ ID NO: 209636 - RNA, 19 nt, Homo sapiens
gagggaggaacaccuugau

SEQ ID NO: 209637 - RNA, 19 nt, Homo sapiens
ggcaagguacuacuuaucg

SEQ ID NO: 209638 - RNA, 19 nt, Homo sapiens
gaacgagcauccugucuuc

SEQ ID NO: 209639 - RNA, 19 nt, Homo sapiens
gaauguggcuucgcucuga

SEQ ID NO: 209640 - RNA, 19 nt, Homo sapiens
gaagguagauuucaauacg

SEQ ID NO: 209641 - RNA, 19 nt, Homo sapiens
caggagaacugucagaaug

SEQ ID NO: 209642 - RNA, 19 nt, Homo sapiens
gcucagauguggccuggaa

SEQ ID NO: 209643 - RNA, 19 nt, Homo sapiens
gauguggccuggaacuuug

SEQ ID NO: 209644 - RNA, 19 nt, Homo sapiens
gcagggccgugcugauuga

SEQ ID NO: 209645 - RNA, 19 nt, Homo sapiens
ugaacagucucaaguaugu

SEQ ID NO: 209646 - RNA, 19 nt, Homo sapiens
gagaagguagauuucaaua

SEQ ID NO: 209647 - RNA, 19 nt, Homo sapiens
gggagaagguagauuucaa

SEQ ID NO: 209648 - RNA, 19 nt, Homo sapiens
ccucauggguggugucuga

SEQ ID NO: 209649 - RNA, 19 nt, Homo sapiens
ccucagcauucccuugaua

SEQ ID NO: 209650 - RNA, 19 nt, Homo sapiens
gaacugcucaacacacaga

SEQ ID NO: 209651 - RNA, 19 nt, Homo sapiens
gaugugaacugcucaacac

SEQ ID NO: 209652 - RNA, 19 nt, Homo sapiens
gaucccaagcucaucauuu

SEQ ID NO: 209653 - RNA, 19 nt, Homo sapiens
gagcugcaaugccgcuuuc

SEQ ID NO: 209654 - RNA, 19 nt, Homo sapiens
ccuuaaaguugccauauag

SEQ ID NO: 209655 - RNA, 19 nt, Homo sapiens
gacaucaagcgccuccuua

SEQ ID NO: 209656 - RNA, 19 nt, Homo sapiens
acacacagaucuccuacuc

SEQ ID NO: 209657 - RNA, 19 nt, Homo sapiens
ucaagcgccuccuuaaagu

SEQ ID NO: 209658 - RNA, 19 nt, Homo sapiens
gggccgugcugauugagaa

SEQ ID NO: 209659 - RNA, 19 nt, Homo sapiens
uaaaguugccauauagaug

SEQ ID NO: 209660 - RNA, 19 nt, Homo sapiens
ggagaagguagauuucaau

SEQ ID NO: 209661 - RNA, 19 nt, Homo sapiens
gguaagcucugggccuuca

SEQ ID NO: 209662 - RNA, 19 nt, Homo sapiens
ccugaacagucucaaguau

SEQ ID NO: 209663 - RNA, 19 nt, Homo sapiens
gaccucagcauucccuuga

SEQ ID NO: 209664 - RNA, 19 nt, Homo sapiens
caucaagcgccuccuuaaa

SEQ ID NO: 209665 - RNA, 19 nt, Homo sapiens
gugaacugcucaacacaca

SEQ ID NO: 209666 - RNA, 19 nt, Homo sapiens
ggagaacugucagaaugag

SEQ ID NO: 209667 - RNA, 19 nt, Homo sapiens
uccuuaaaguugccauaua

SEQ ID NO: 209668 - RNA, 19 nt, Homo sapiens
aaugauggcaccuuccuaa

SEQ ID NO: 209669 - RNA, 19 nt, Homo sapiens
gauggcaccuuccuaaacc

SEQ ID NO: 209670 - RNA, 19 nt, Homo sapiens
caacauugagccugacauc

SEQ ID NO: 209671 - RNA, 19 nt, Homo sapiens
auaaagggcagguguggaa

SEQ ID NO: 209672 - RNA, 19 nt, Homo sapiens
gaaugauggcaccuuccua

SEQ ID NO: 209673 - RNA, 19 nt, Homo sapiens
aucccaagcucaucauuug

SEQ ID NO: 209674 - RNA, 19 nt, Homo sapiens
ucgccuaccugaaggacaa

SEQ ID NO: 209675 - RNA, 19 nt, Homo sapiens
uggcuucccuugcaaccaa

SEQ ID NO: 209676 - RNA, 19 nt, Homo sapiens
aaaguugccauauagaugu

SEQ ID NO: 209677 - RNA, 19 nt, Homo sapiens
guccuuggcuucccuugca

SEQ ID NO: 209678 - RNA, 19 nt, Homo sapiens
gcacaaccacccgggacuu

SEQ ID NO: 209679 - RNA, 19 nt, Homo sapiens
ucaacacacagaucuccua

SEQ ID NO: 209680 - RNA, 19 nt, Homo sapiens
cagcauucccuugauauca

SEQ ID NO: 209681 - RNA, 19 nt, Homo sapiens
gcauucccuugauaucagu

SEQ ID NO: 209682 - RNA, 19 nt, Homo sapiens
ggacuucacccagcucaac

SEQ ID NO: 209683 - RNA, 19 nt, Homo sapiens
acaucaagcgccuccuuaa

SEQ ID NO: 209684 - RNA, 19 nt, Homo sapiens
agauguggccuggaacuuu

SEQ ID NO: 209685 - RNA, 19 nt, Homo sapiens
agguagauuucaauacguu

SEQ ID NO: 209686 - RNA, 19 nt, Homo sapiens
caagcgccuccuuaaaguu

SEQ ID NO: 209687 - RNA, 19 nt, Homo sapiens
cccuuaugaugacccauuu

SEQ ID NO: 209688 - RNA, 19 nt, Homo sapiens
uggagccacucugcuagaa

SEQ ID NO: 209689 - RNA, 19 nt, Homo sapiens
aagcgccuccuuaaaguug

SEQ ID NO: 209690 - RNA, 19 nt, Homo sapiens
guccuucuaugaccucagu

SEQ ID NO: 209691 - RNA, 19 nt, Homo sapiens
gccuggagccacucugcua

SEQ ID NO: 209692 - RNA, 19 nt, Homo sapiens
gcaccuucccaaccaucaa

SEQ ID NO: 209693 - RNA, 19 nt, Homo sapiens
agaacgagcauccugucuu

SEQ ID NO: 209694 - RNA, 19 nt, Homo sapiens
ucaggagaacugucagaau

SEQ ID NO: 209695 - RNA, 19 nt, Homo sapiens
ugaggagccuuaggaugca

SEQ ID NO: 209696 - RNA, 19 nt, Homo sapiens
ugacaucaagcgccuccuu

SEQ ID NO: 209697 - RNA, 19 nt, Homo sapiens
guacggagcccucaccauu

SEQ ID NO: 209698 - RNA, 19 nt, Homo sapiens
guucuccacuccaaugaua

SEQ ID NO: 209699 - RNA, 19 nt, Homo sapiens
ggaugucaauggagagaaa

SEQ ID NO: 209700 - RNA, 19 nt, Homo sapiens
aggaagagcuugcaccauu

SEQ ID NO: 209701 - RNA, 19 nt, Homo sapiens
ccacugccuccaaauauua

SEQ ID NO: 209702 - RNA, 19 nt, Homo sapiens
gagagaaagagcagaaauu

SEQ ID NO: 209703 - RNA, 19 nt, Homo sapiens
gcauaaguggcaccauuua

SEQ ID NO: 209704 - RNA, 19 nt, Homo sapiens
ggaagagcuugcaccauuc

SEQ ID NO: 209705 - RNA, 19 nt, Homo sapiens
gacauccgcuggaacuuug

SEQ ID NO: 209706 - RNA, 19 nt, Homo sapiens
caacguggccagcuacuga

SEQ ID NO: 209707 - RNA, 19 nt, Homo sapiens
ggacuuuguucaggaagaa

SEQ ID NO: 209708 - RNA, 19 nt, Homo sapiens
ugaaugcacuacaggaaga

SEQ ID NO: 209709 - RNA, 19 nt, Homo sapiens
gaggcuuugucccuaauuu

SEQ ID NO: 209710 - RNA, 19 nt, Homo sapiens
gaaaggggaugucaaugga

SEQ ID NO: 209711 - RNA, 19 nt, Homo sapiens
gagaucaaccucccugaga

SEQ ID NO: 209712 - RNA, 19 nt, Homo sapiens
uggcauaaguggcaccauu

SEQ ID NO: 209713 - RNA, 19 nt, Homo sapiens
gacaagagaagucgaagau

SEQ ID NO: 209714 - RNA, 19 nt, Homo sapiens
gggaauguguaccaucugu

SEQ ID NO: 209715 - RNA, 19 nt, Homo sapiens
ggugcaauguggguguuua

SEQ ID NO: 209716 - RNA, 19 nt, Homo sapiens
uaacugauaccucaaccuu

SEQ ID NO: 209717 - RNA, 19 nt, Homo sapiens
cuacagguaugcgugauug

SEQ ID NO: 209718 - RNA, 19 nt, Homo sapiens
uggcaaauacguccucuuu

SEQ ID NO: 209719 - RNA, 19 nt, Homo sapiens
guguagugcuggacaguga

SEQ ID NO: 209720 - RNA, 19 nt, Homo sapiens
acacaugccuacagguaug

SEQ ID NO: 209721 - RNA, 19 nt, Homo sapiens
gagggacuuuguucaggaa

SEQ ID NO: 209722 - RNA, 19 nt, Homo sapiens
acacacaugccuacaggua

SEQ ID NO: 209723 - RNA, 19 nt, Homo sapiens
ggagagaaagagcagaaau

SEQ ID NO: 209724 - RNA, 19 nt, Homo sapiens
ggccagcccuuagugcauu

SEQ ID NO: 209725 - RNA, 19 nt, Homo sapiens
gaauguguaccaucugugu

SEQ ID NO: 209726 - RNA, 19 nt, Homo sapiens
ggacaagagaagucgaaga

SEQ ID NO: 209727 - RNA, 19 nt, Homo sapiens
ccacuccaaugauaauagu

SEQ ID NO: 209728 - RNA, 19 nt, Homo sapiens
cgacauccgcuggaacuuu

SEQ ID NO: 209729 - RNA, 19 nt, Homo sapiens
cagauuugcuuaugucacu

SEQ ID NO: 209730 - RNA, 19 nt, Homo sapiens
ggcauaaguggcaccauuu

SEQ ID NO: 209731 - RNA, 19 nt, Homo sapiens
ggucagcaacgucaagaug

SEQ ID NO: 209732 - RNA, 19 nt, Homo sapiens
gaucaaccaaggcagaugu

SEQ ID NO: 209733 - RNA, 19 nt, Homo sapiens
caauuguucugcucuaacu

SEQ ID NO: 209734 - RNA, 19 nt, Homo sapiens
uaccuaaacccaaaggaaa

SEQ ID NO: 209735 - RNA, 19 nt, Homo sapiens
guggaggcuuugucccuaa

SEQ ID NO: 209736 - RNA, 19 nt, Homo sapiens
gcccagauuugcuuauguc

SEQ ID NO: 209737 - RNA, 19 nt, Homo sapiens
ggacagugacaacccuuuc

SEQ ID NO: 209738 - RNA, 19 nt, Homo sapiens
acggagcccucaccauuga

SEQ ID NO: 209739 - RNA, 19 nt, Homo sapiens
guucugcucuaacugauac

SEQ ID NO: 209740 - RNA, 19 nt, Homo sapiens
acuuauaccuaaacccaaa

SEQ ID NO: 209741 - RNA, 19 nt, Homo sapiens
ugacgggccaguacauuga

SEQ ID NO: 209742 - RNA, 19 nt, Homo sapiens
guggcaccauuuacgagua

SEQ ID NO: 209743 - RNA, 19 nt, Homo sapiens
ucagcaacgucaagaugga

SEQ ID NO: 209744 - RNA, 19 nt, Homo sapiens
ccgaccagguggaggcuuu

SEQ ID NO: 209745 - RNA, 19 nt, Homo sapiens
cccacugccuccaaauauu

SEQ ID NO: 209746 - RNA, 19 nt, Homo sapiens
gcucuagguccaauuguuc

SEQ ID NO: 209747 - RNA, 19 nt, Homo sapiens
cuaccuaugugucuuucug

SEQ ID NO: 209748 - RNA, 19 nt, Homo sapiens
agagaaagagcagaaauuc

SEQ ID NO: 209749 - RNA, 19 nt, Homo sapiens
gggacuuuguucaggaaga

SEQ ID NO: 209750 - RNA, 19 nt, Homo sapiens
gucaagaggaaguaacuga

SEQ ID NO: 209751 - RNA, 19 nt, Homo sapiens
caaccucccugagaucaac

SEQ ID NO: 209752 - RNA, 19 nt, Homo sapiens
caagaggaaguaacugaag

SEQ ID NO: 209753 - RNA, 19 nt, Homo sapiens
ucaagaggaaguaacugaa

SEQ ID NO: 209754 - RNA, 19 nt, Homo sapiens
cuaauuuccagcucuuuga

SEQ ID NO: 209755 - RNA, 19 nt, Homo sapiens
guccaauuguucugcucua

SEQ ID NO: 209756 - RNA, 19 nt, Homo sapiens
aaauacguccucuuuguca

SEQ ID NO: 209757 - RNA, 19 nt, Homo sapiens
uaaguggcaccauuuacga

SEQ ID NO: 209758 - RNA, 19 nt, Homo sapiens
ccaguucuccacuccaaug

SEQ ID NO: 209759 - RNA, 19 nt, Homo sapiens
uuccuacccucaaguaugu

SEQ ID NO: 209760 - RNA, 19 nt, Homo sapiens
gauccuuccuacccucaag

SEQ ID NO: 209761 - RNA, 19 nt, Homo sapiens
caggagagaacucagagau

SEQ ID NO: 209762 - RNA, 19 nt, Homo sapiens
aaacaggaaccaggagaga

SEQ ID NO: 209763 - RNA, 19 nt, Homo sapiens
agaucaaccucccugagau

SEQ ID NO: 209764 - RNA, 19 nt, Homo sapiens
ugaacugaaugcacuacag

SEQ ID NO: 209765 - RNA, 19 nt, Homo sapiens
ggaaccaggagagaacuca

SEQ ID NO: 209766 - RNA, 19 nt, Homo sapiens
uccaauuguucugcucuaa

SEQ ID NO: 209767 - RNA, 19 nt, Homo sapiens
ggcuuucccugcaaccaau

SEQ ID NO: 209768 - RNA, 19 nt, Homo sapiens
ccagcucuagguccaauug

SEQ ID NO: 209769 - RNA, 19 nt, Homo sapiens
aagagaagucgaagaugga

SEQ ID NO: 209770 - RNA, 19 nt, Homo sapiens
gggcuuucccugcaaccaa

SEQ ID NO: 209771 - RNA, 19 nt, Homo sapiens
gaagagcuugcaccauucg

SEQ ID NO: 209772 - RNA, 19 nt, Homo sapiens
ggagcccucaccauugaug

SEQ ID NO: 209773 - RNA, 19 nt, Homo sapiens
auaccuaaacccaaaggaa

SEQ ID NO: 209774 - RNA, 19 nt, Homo sapiens
caucugaccgccucuucug

SEQ ID NO: 209775 - RNA, 19 nt, Homo sapiens
gaaaugccaucaaguggaa

SEQ ID NO: 209776 - RNA, 19 nt, Homo sapiens
gcaagggcauccugggaaa

SEQ ID NO: 209777 - RNA, 19 nt, Homo sapiens
caacguggccucccaguga

SEQ ID NO: 209778 - RNA, 19 nt, Homo sapiens
gggaauaaacagacaaauu

SEQ ID NO: 209779 - RNA, 19 nt, Homo sapiens
acgaagagaucaaagaguu

SEQ ID NO: 209780 - RNA, 19 nt, Homo sapiens
ugguuaaccuggacaagua

SEQ ID NO: 209781 - RNA, 19 nt, Homo sapiens
gcaagaccgaaguaaacua

SEQ ID NO: 209782 - RNA, 19 nt, Homo sapiens
ggacaucgacgggcacaug

SEQ ID NO: 209783 - RNA, 19 nt, Homo sapiens
guaacgaagagaucaaaga

SEQ ID NO: 209784 - RNA, 19 nt, Homo sapiens
gaggcaagaccgaaguaaa

SEQ ID NO: 209785 - RNA, 19 nt, Homo sapiens
caacgucaaauucgauaug

SEQ ID NO: 209786 - RNA, 19 nt, Homo sapiens
uaacgaagagaucaaagag

SEQ ID NO: 209787 - RNA, 19 nt, Homo sapiens
cgucaaauucgauauguuc

SEQ ID NO: 209788 - RNA, 19 nt, Homo sapiens
agaaggaccugccccacua

SEQ ID NO: 209789 - RNA, 19 nt, Homo sapiens
gaguaacgaagagaucaaa

SEQ ID NO: 209790 - RNA, 19 nt, Homo sapiens
ggaguaacgaagagaucaa

SEQ ID NO: 209791 - RNA, 19 nt, Homo sapiens
ucagcaagaucugcgugaa

SEQ ID NO: 209792 - RNA, 19 nt, Homo sapiens
caagaccgaaguaaacuac

SEQ ID NO: 209793 - RNA, 19 nt, Homo sapiens
gaacggcugcguggugaag

SEQ ID NO: 209794 - RNA, 19 nt, Homo sapiens
ccugggaaaugccaucaag

SEQ ID NO: 209795 - RNA, 19 nt, Homo sapiens
uucgauauguucagcaaga

SEQ ID NO: 209796 - RNA, 19 nt, Homo sapiens
gauauguucagcaagaucu

SEQ ID NO: 209797 - RNA, 19 nt, Homo sapiens
uggcuaccuugugggaaua

SEQ ID NO: 209798 - RNA, 19 nt, Homo sapiens
guaaccaguucgggaagca

SEQ ID NO: 209799 - RNA, 19 nt, Homo sapiens
ugggaaaugccaucaagug

SEQ ID NO: 209800 - RNA, 19 nt, Homo sapiens
caucgacgggcacaugguu

SEQ ID NO: 209801 - RNA, 19 nt, Homo sapiens
gggaguaacgaagagauca

SEQ ID NO: 209802 - RNA, 19 nt, Homo sapiens
cgaagagaucaaagaguuc

SEQ ID NO: 209803 - RNA, 19 nt, Homo sapiens
cuguggaaguggaugaaga

SEQ ID NO: 209804 - RNA, 19 nt, Homo sapiens
uacaacgucaaauucgaua

SEQ ID NO: 209805 - RNA, 19 nt, Homo sapiens
ggagccagggaguaacgaa

SEQ ID NO: 209806 - RNA, 19 nt, Homo sapiens
gaagauggauugccacaaa

SEQ ID NO: 209807 - RNA, 19 nt, Homo sapiens
gcaauauccugaacuaaau

SEQ ID NO: 209808 - RNA, 19 nt, Homo sapiens
gaacagaaagucuucaguu

SEQ ID NO: 209809 - RNA, 19 nt, Homo sapiens
guaccuaguuuccagcuuu

SEQ ID NO: 209810 - RNA, 19 nt, Homo sapiens
ugacauccguuggaacuuu

SEQ ID NO: 209811 - RNA, 19 nt, Homo sapiens
gaggauuuguaccuaguuu

SEQ ID NO: 209812 - RNA, 19 nt, Homo sapiens
gaagcccuauggucuaguu

SEQ ID NO: 209813 - RNA, 19 nt, Homo sapiens
aacagaaagucuucaguuu

SEQ ID NO: 209814 - RNA, 19 nt, Homo sapiens
gagaaaggcaccaucuaug

SEQ ID NO: 209815 - RNA, 19 nt, Homo sapiens
gaggccaucgcacuuaaua

SEQ ID NO: 209816 - RNA, 19 nt, Homo sapiens
agaaaggcaccaucuauga

SEQ ID NO: 209817 - RNA, 19 nt, Homo sapiens
cgagaaaggcaccaucuau

SEQ ID NO: 209818 - RNA, 19 nt, Homo sapiens
gagaagaugaagauggauu

SEQ ID NO: 209819 - RNA, 19 nt, Homo sapiens
ggagauaacaaagagauuc

SEQ ID NO: 209820 - RNA, 19 nt, Homo sapiens
gcaagaaccaggagauaac

SEQ ID NO: 209821 - RNA, 19 nt, Homo sapiens
caacguggccaccuacugu

SEQ ID NO: 209822 - RNA, 19 nt, Homo sapiens
cgcaauauccugaacuaaa

SEQ ID NO: 209823 - RNA, 19 nt, Homo sapiens
gcaagcacauccucuucgu

SEQ ID NO: 209824 - RNA, 19 nt, Homo sapiens
uggcguacuugaagcaauu

SEQ ID NO: 209825 - RNA, 19 nt, Homo sapiens
gacauccguuggaacuuug

SEQ ID NO: 209826 - RNA, 19 nt, Homo sapiens
aggagaagaugaagaugga

SEQ ID NO: 209827 - RNA, 19 nt, Homo sapiens
gggcacauucaaaucuaua

SEQ ID NO: 209828 - RNA, 19 nt, Homo sapiens
gcugaagcccuauggucua

SEQ ID NO: 209829 - RNA, 19 nt, Homo sapiens
gggaggauuuguaccuagu

SEQ ID NO: 209830 - RNA, 19 nt, Homo sapiens
gaaaggcaccaucuaugac

SEQ ID NO: 209831 - RNA, 19 nt, Homo sapiens
ccaagcaggagaagaugaa

SEQ ID NO: 209832 - RNA, 19 nt, Homo sapiens
ccuauggucuaguuguguu

SEQ ID NO: 209833 - RNA, 19 nt, Homo sapiens
gaaccaggagauaacaaag

SEQ ID NO: 209834 - RNA, 19 nt, Homo sapiens
ggucagcucagucaagaca

SEQ ID NO: 209835 - RNA, 19 nt, Homo sapiens
uuccugggcucaaguaugu

SEQ ID NO: 209836 - RNA, 19 nt, Homo sapiens
ucagcucagucaagacaga

SEQ ID NO: 209837 - RNA, 19 nt, Homo sapiens
uaugaggccaucgcacuua

SEQ ID NO: 209838 - RNA, 19 nt, Homo sapiens
cagacauccuggcguacuu

SEQ ID NO: 209839 - RNA, 19 nt, Homo sapiens
gcacauccucuucgucaac

SEQ ID NO: 209840 - RNA, 19 nt, Homo sapiens
gcacauucaaaucuauauc

SEQ ID NO: 209841 - RNA, 19 nt, Homo sapiens
gcccuauggucuaguugug

SEQ ID NO: 209842 - RNA, 19 nt, Homo sapiens
caccaucuaugacuaugag

SEQ ID NO: 209843 - RNA, 19 nt, Homo sapiens
gggcuacggucagcucagu

SEQ ID NO: 209844 - RNA, 19 nt, Homo sapiens
gagauaacaaagagauucu

SEQ ID NO: 209845 - RNA, 19 nt, Homo sapiens
gcaccaucuaugacuauga

SEQ ID NO: 209846 - RNA, 19 nt, Homo sapiens
aagcaagaaccaggagaua

SEQ ID NO: 209847 - RNA, 19 nt, Homo sapiens
gaaaggggaugugaauggu

SEQ ID NO: 209848 - RNA, 19 nt, Homo sapiens
agaaccaggagauaacaaa

SEQ ID NO: 209849 - RNA, 19 nt, Homo sapiens
gaagcacuccuguccucau

SEQ ID NO: 209850 - RNA, 19 nt, Homo sapiens
gggcaagcacauccucuuc

SEQ ID NO: 209851 - RNA, 19 nt, Homo sapiens
agaagaugaagauggauug

SEQ ID NO: 209852 - RNA, 19 nt, Homo sapiens
ggucugacagcgcaauauc

SEQ ID NO: 209853 - RNA, 19 nt, Homo sapiens
caccuacuguggucugaca

SEQ ID NO: 209854 - RNA, 19 nt, Homo sapiens
ggaggauuuguaccuaguu

SEQ ID NO: 209855 - RNA, 19 nt, Homo sapiens
caggagauaacaaagagau

SEQ ID NO: 209856 - RNA, 19 nt, Homo sapiens
caagaaccaggagauaaca

SEQ ID NO: 209857 - RNA, 19 nt, Homo sapiens
gcgcaauauccugaacuaa

SEQ ID NO: 209858 - RNA, 19 nt, Homo sapiens
ggcuuucccugcaaccaau

SEQ ID NO: 209859 - RNA, 19 nt, Homo sapiens
caauauccugaacuaaaug

SEQ ID NO: 209860 - RNA, 19 nt, Homo sapiens
cuguaaagguccaugacau

SEQ ID NO: 209861 - RNA, 19 nt, Homo sapiens
ucuccuagccugcuuugug

SEQ ID NO: 209862 - RNA, 19 nt, Homo sapiens
aaggcaccaucuaugacua

SEQ ID NO: 209863 - RNA, 19 nt, Homo sapiens
acggucagcucagucaaga

SEQ ID NO: 209864 - RNA, 19 nt, Homo sapiens
augaggccaucgcacuuaa

SEQ ID NO: 209865 - RNA, 19 nt, Homo sapiens
uugggcacauucaaaucua

SEQ ID NO: 209866 - RNA, 19 nt, Homo sapiens
gggcuuucccugcaaccaa

SEQ ID NO: 209867 - RNA, 19 nt, Homo sapiens
aagcacuccuguccucauc

SEQ ID NO: 209868 - RNA, 19 nt, Homo sapiens
agcgcaauauccugaacua

SEQ ID NO: 209869 - RNA, 19 nt, Homo sapiens
gaagauggauugccacaaa

SEQ ID NO: 209870 - RNA, 19 nt, Homo sapiens
gaacagaaagucuucaguu

SEQ ID NO: 209871 - RNA, 19 nt, Homo sapiens
guaccuaguuuccagcuuu

SEQ ID NO: 209872 - RNA, 19 nt, Homo sapiens
ugacauccguuggaacuuu

SEQ ID NO: 209873 - RNA, 19 nt, Homo sapiens
gaggauuuguaccuaguuu

SEQ ID NO: 209874 - RNA, 19 nt, Homo sapiens
aacagaaagucuucaguuu

SEQ ID NO: 209875 - RNA, 19 nt, Homo sapiens
gagaaaggcaccaucuaug

SEQ ID NO: 209876 - RNA, 19 nt, Homo sapiens
gaggccaucgcacuuaaua

SEQ ID NO: 209877 - RNA, 19 nt, Homo sapiens
agaaaggcaccaucuauga

SEQ ID NO: 209878 - RNA, 19 nt, Homo sapiens
cgagaaaggcaccaucuau

SEQ ID NO: 209879 - RNA, 19 nt, Homo sapiens
gagaagaugaagauggauu

SEQ ID NO: 209880 - RNA, 19 nt, Homo sapiens
caacguggccaccuacugu

SEQ ID NO: 209881 - RNA, 19 nt, Homo sapiens
gcaagcacauccucuucgu

SEQ ID NO: 209882 - RNA, 19 nt, Homo sapiens
uggcguacuugaagcaauu

SEQ ID NO: 209883 - RNA, 19 nt, Homo sapiens
gacauccguuggaacuuug

SEQ ID NO: 209884 - RNA, 19 nt, Homo sapiens
aggagaagaugaagaugga

SEQ ID NO: 209885 - RNA, 19 nt, Homo sapiens
gggcacauucaaaucuaua

SEQ ID NO: 209886 - RNA, 19 nt, Homo sapiens
gggaggauuuguaccuagu

SEQ ID NO: 209887 - RNA, 19 nt, Homo sapiens
gaaaggcaccaucuaugac

SEQ ID NO: 209888 - RNA, 19 nt, Homo sapiens
ccaagcaggagaagaugaa

SEQ ID NO: 209889 - RNA, 19 nt, Homo sapiens
ggucagcucagucaagaca

SEQ ID NO: 209890 - RNA, 19 nt, Homo sapiens
ucagcucagucaagacaga

SEQ ID NO: 209891 - RNA, 19 nt, Homo sapiens
uaugaggccaucgcacuua

SEQ ID NO: 209892 - RNA, 19 nt, Homo sapiens
cagacauccuggcguacuu

SEQ ID NO: 209893 - RNA, 19 nt, Homo sapiens
gcacauccucuucgucaac

SEQ ID NO: 209894 - RNA, 19 nt, Homo sapiens
gcacauucaaaucuauauc

SEQ ID NO: 209895 - RNA, 19 nt, Homo sapiens
caccaucuaugacuaugag

SEQ ID NO: 209896 - RNA, 19 nt, Homo sapiens
gggcuacggucagcucagu

SEQ ID NO: 209897 - RNA, 19 nt, Homo sapiens
gcaccaucuaugacuauga

SEQ ID NO: 209898 - RNA, 19 nt, Homo sapiens
gaaaggggaugugaauggu

SEQ ID NO: 209899 - RNA, 19 nt, Homo sapiens
gaagcacuccuguccucau

SEQ ID NO: 209900 - RNA, 19 nt, Homo sapiens
acagcgcaauauccuggua

SEQ ID NO: 209901 - RNA, 19 nt, Homo sapiens
gggcaagcacauccucuuc

SEQ ID NO: 209902 - RNA, 19 nt, Homo sapiens
ggucugacagcgcaauauc

SEQ ID NO: 209903 - RNA, 19 nt, Homo sapiens
caccuacuguggucugaca

SEQ ID NO: 209904 - RNA, 19 nt, Homo sapiens
agaagaugaagauggauug

SEQ ID NO: 209905 - RNA, 19 nt, Homo sapiens
ggaggauuuguaccuaguu

SEQ ID NO: 209906 - RNA, 19 nt, Homo sapiens
cuguaaagguccaugacau

SEQ ID NO: 209907 - RNA, 19 nt, Homo sapiens
ucuccuagccugcuuugug

SEQ ID NO: 209908 - RNA, 19 nt, Homo sapiens
aaggcaccaucuaugacua

SEQ ID NO: 209909 - RNA, 19 nt, Homo sapiens
acggucagcucagucaaga

SEQ ID NO: 209910 - RNA, 19 nt, Homo sapiens
uugggcacauucaaaucua

SEQ ID NO: 209911 - RNA, 19 nt, Homo sapiens
augaggccaucgcacuuaa

SEQ ID NO: 209912 - RNA, 19 nt, Homo sapiens
aagcacuccuguccucauc

SEQ ID NO: 209913 - RNA, 19 nt, Homo sapiens
ugaaugagcugguggauua

SEQ ID NO: 209914 - RNA, 19 nt, Homo sapiens
aggcagagcuuaauggaaa

SEQ ID NO: 209915 - RNA, 19 nt, Homo sapiens
uggaagccaucgccaaaua

SEQ ID NO: 209916 - RNA, 19 nt, Homo sapiens
cccaagaacuacauagaaa

SEQ ID NO: 209917 - RNA, 19 nt, Homo sapiens
cgccaaauaugacuucaaa

SEQ ID NO: 209918 - RNA, 19 nt, Homo sapiens
ccagaaaccagcagauauu

SEQ ID NO: 209919 - RNA, 19 nt, Homo sapiens
uagcugacgccaauaauaa

SEQ ID NO: 209920 - RNA, 19 nt, Homo sapiens
gcugguggauuaucacaga

SEQ ID NO: 209921 - RNA, 19 nt, Homo sapiens
caucagugcaugacguuua

SEQ ID NO: 209922 - RNA, 19 nt, Homo sapiens
cgaagaaugugaucagaac

SEQ ID NO: 209923 - RNA, 19 nt, Homo sapiens
ucacuuugguuggaacuuu

SEQ ID NO: 209924 - RNA, 19 nt, Homo sapiens
caagaacuacauagaaaug

SEQ ID NO: 209925 - RNA, 19 nt, Homo sapiens
ugccaaaacuuaccuauaa

SEQ ID NO: 209926 - RNA, 19 nt, Homo sapiens
gaacgaagaaugugaucag

SEQ ID NO: 209927 - RNA, 19 nt, Homo sapiens
gaagccaucgccaaauaug

SEQ ID NO: 209928 - RNA, 19 nt, Homo sapiens
guacaaggcagagcuuaau

SEQ ID NO: 209929 - RNA, 19 nt, Homo sapiens
ggaagccaucgccaaauau

SEQ ID NO: 209930 - RNA, 19 nt, Homo sapiens
cacuuugguuggaacuuua

SEQ ID NO: 209931 - RNA, 19 nt, Homo sapiens
gaacgucuaagagucaaga

SEQ ID NO: 209932 - RNA, 19 nt, Homo sapiens
gguacaaggcagagcuuaa

SEQ ID NO: 209933 - RNA, 19 nt, Homo sapiens
gggcagaccggcauguuuc

SEQ ID NO: 209934 - RNA, 19 nt, Homo sapiens
gagauggagccgggaagua

SEQ ID NO: 209935 - RNA, 19 nt, Homo sapiens
gagucaagaagcaauuauu

SEQ ID NO: 209936 - RNA, 19 nt, Homo sapiens
cuagcugacgccaauaaua

SEQ ID NO: 209937 - RNA, 19 nt, Homo sapiens
gaaccggaacgucuaagag

SEQ ID NO: 209938 - RNA, 19 nt, Homo sapiens
gagccaaggcagaagaaau

SEQ ID NO: 209939 - RNA, 19 nt, Homo sapiens
aaugugaucagaacuggua

SEQ ID NO: 209940 - RNA, 19 nt, Homo sapiens
ccaaauaugacuucaaagc

SEQ ID NO: 209941 - RNA, 19 nt, Homo sapiens
ccaagaacuacauagaaau

SEQ ID NO: 209942 - RNA, 19 nt, Homo sapiens
caaggcagaagaaaugcuu

SEQ ID NO: 209943 - RNA, 19 nt, Homo sapiens
ggaaaagacggcuucauuc

SEQ ID NO: 209944 - RNA, 19 nt, Homo sapiens
aguccuagcugacgccaau

SEQ ID NO: 209945 - RNA, 19 nt, Homo sapiens
uaagagucaagaagcaauu

SEQ ID NO: 209946 - RNA, 19 nt, Homo sapiens
ugccacagcagccgacaua

SEQ ID NO: 209947 - RNA, 19 nt, Homo sapiens
gauuaucacagaucuacau

SEQ ID NO: 209948 - RNA, 19 nt, Homo sapiens
caaauaugacuucaaagcu

SEQ ID NO: 209949 - RNA, 19 nt, Homo sapiens
caaggcagagcuuaaugga

SEQ ID NO: 209950 - RNA, 19 nt, Homo sapiens
gaaaccagcagauauuccu

SEQ ID NO: 209951 - RNA, 19 nt, Homo sapiens
cucccucucugucaaguuu

SEQ ID NO: 209952 - RNA, 19 nt, Homo sapiens
gauauuccugcgggacaua

SEQ ID NO: 209953 - RNA, 19 nt, Homo sapiens
gccaaaacuuaccuauaaa

SEQ ID NO: 209954 - RNA, 19 nt, Homo sapiens
ggggagauuuuauccaugu

SEQ ID NO: 209955 - RNA, 19 nt, Homo sapiens
gguggauuaucacagaucu

SEQ ID NO: 209956 - RNA, 19 nt, Homo sapiens
cguuuaaggccacguauag

SEQ ID NO: 209957 - RNA, 19 nt, Homo sapiens
aucagugcaugacguuuaa

SEQ ID NO: 209958 - RNA, 19 nt, Homo sapiens
ccagagccaaggcagaaga

SEQ ID NO: 209959 - RNA, 19 nt, Homo sapiens
ucccaagaacuacauagaa

SEQ ID NO: 209960 - RNA, 19 nt, Homo sapiens
uccaggcccucuuugacuu

SEQ ID NO: 209961 - RNA, 19 nt, Homo sapiens
cagaaaccagcagauauuc

SEQ ID NO: 209962 - RNA, 19 nt, Homo sapiens
agaauuaaacccacaagcu

SEQ ID NO: 209963 - RNA, 19 nt, Homo sapiens
aagagucaagaagcaauua

SEQ ID NO: 209964 - RNA, 19 nt, Homo sapiens
agccaaggcagaagaaaug

SEQ ID NO: 209965 - RNA, 19 nt, Homo sapiens
ucacugcugcuccucuuuc

SEQ ID NO: 209966 - RNA, 19 nt, Homo sapiens
ccaggcccucuuugacuuu

SEQ ID NO: 209967 - RNA, 19 nt, Homo sapiens
gggaguggaucugaaauaa

SEQ ID NO: 209968 - RNA, 19 nt, Homo sapiens
agaagugccucagauaaua

SEQ ID NO: 209969 - RNA, 19 nt, Homo sapiens
caguugaucugcucuguuu

SEQ ID NO: 209970 - RNA, 19 nt, Homo sapiens
uaguaaagguguacaguga

SEQ ID NO: 209971 - RNA, 19 nt, Homo sapiens
ugcagaaagugaagcauua

SEQ ID NO: 209972 - RNA, 19 nt, Homo sapiens
gaaauaaaauccaggaauc

SEQ ID NO: 209973 - RNA, 19 nt, Homo sapiens
gggugcagcuguacaagaa

SEQ ID NO: 209974 - RNA, 19 nt, Homo sapiens
ccaacaagcuucgaaaugg

SEQ ID NO: 209975 - RNA, 19 nt, Homo sapiens
gaucuggccucuauuacuc

SEQ ID NO: 209976 - RNA, 19 nt, Homo sapiens
gcgccgaucuggccucuau

SEQ ID NO: 209977 - RNA, 19 nt, Homo sapiens
gagaagugccucagauaau

SEQ ID NO: 209978 - RNA, 19 nt, Homo sapiens
gaguggaucugaaauaaaa

SEQ ID NO: 209979 - RNA, 19 nt, Homo sapiens
ggacuucucuggccaugcu

SEQ ID NO: 209980 - RNA, 19 nt, Homo sapiens
gugcagcuguacaagaauu

SEQ ID NO: 209981 - RNA, 19 nt, Homo sapiens
gaacgaguccaacguguac

SEQ ID NO: 209982 - RNA, 19 nt, Homo sapiens
ggaguggaucugaaauaaa

SEQ ID NO: 209983 - RNA, 19 nt, Homo sapiens
gaacggguguccugcuacu

SEQ ID NO: 209984 - RNA, 19 nt, Homo sapiens
gcucuagggcagggaauua

SEQ ID NO: 209985 - RNA, 19 nt, Homo sapiens
ccaccaagggcaccucuaa

SEQ ID NO: 209986 - RNA, 19 nt, Homo sapiens
ggacaagggcacacaacug

SEQ ID NO: 209987 - RNA, 19 nt, Homo sapiens
gaucugcucuguuuuauac

SEQ ID NO: 209988 - RNA, 19 nt, Homo sapiens
acacugguauaucccauga

SEQ ID NO: 209989 - RNA, 19 nt, Homo sapiens
gccgaucuggccucuauua

SEQ ID NO: 209990 - RNA, 19 nt, Homo sapiens
ggacggaagcuuuggaaac

SEQ ID NO: 209991 - RNA, 19 nt, Homo sapiens
gcagggaauuaugggagaa

SEQ ID NO: 209992 - RNA, 19 nt, Homo sapiens
cggaacggguguccugcua

SEQ ID NO: 209993 - RNA, 19 nt, Homo sapiens
ggaggaagaagacaaacca

SEQ ID NO: 209994 - RNA, 19 nt, Homo sapiens
gcagaaagugaagcauuau

SEQ ID NO: 209995 - RNA, 19 nt, Homo sapiens
gaaagugaagcauuaucuc

SEQ ID NO: 209996 - RNA, 19 nt, Homo sapiens
gacggaagcuuuggaaacg

SEQ ID NO: 209997 - RNA, 19 nt, Homo sapiens
auccagaacuuccugaaug

SEQ ID NO: 209998 - RNA, 19 nt, Homo sapiens
caagggcacacaacugguu

SEQ ID NO: 209999 - RNA, 19 nt, Homo sapiens
caagggcaccucuaaggau

SEQ ID NO: 210000 - RNA, 19 nt, Homo sapiens
ugaacgaguccaacgugua

SEQ ID NO: 210001 - RNA, 19 nt, Homo sapiens
acacaacugguuccguuaa

SEQ ID NO: 210002 - RNA, 19 nt, Homo sapiens
cgaggcaccugcaguacgu

SEQ ID NO: 210003 - RNA, 19 nt, Homo sapiens
gaagaccucauccagaacu

SEQ ID NO: 210004 - RNA, 19 nt, Homo sapiens
aaagugaagcauuaucuca

SEQ ID NO: 210005 - RNA, 19 nt, Homo sapiens
gaagugccucagauaauac

SEQ ID NO: 210006 - RNA, 19 nt, Homo sapiens
ucuacgggaugcccacuga

SEQ ID NO: 210007 - RNA, 19 nt, Homo sapiens
guacguggcagaugugaac

SEQ ID NO: 210008 - RNA, 19 nt, Homo sapiens
ccaagggcaccucuaagga

SEQ ID NO: 210009 - RNA, 19 nt, Homo sapiens
gaagcgggaguggaucuga

SEQ ID NO: 210010 - RNA, 19 nt, Homo sapiens
guucaggacggaagcuuug

SEQ ID NO: 210011 - RNA, 19 nt, Homo sapiens
gcacccaacucugguucca

SEQ ID NO: 210012 - RNA, 19 nt, Homo sapiens
cgggaguggaucugaaaua

SEQ ID NO: 210013 - RNA, 19 nt, Homo sapiens
uagagaagcgggaguggau

SEQ ID NO: 210014 - RNA, 19 nt, Homo sapiens
gagauagccgcuucgucuu

SEQ ID NO: 210015 - RNA, 19 nt, Homo sapiens
gcucgccacgugugugaaa

SEQ ID NO: 210016 - RNA, 19 nt, Homo sapiens
gcuuuguccucucuuugug

SEQ ID NO: 210017 - RNA, 19 nt, Homo sapiens
ggaucugucuccaccucau

SEQ ID NO: 210018 - RNA, 19 nt, Homo sapiens
gccagacccgcuucacuga

SEQ ID NO: 210019 - RNA, 19 nt, Homo sapiens
ccacugacuucgguuucug

SEQ ID NO: 210020 - RNA, 19 nt, Homo sapiens
cugcauccaucuuguuugg

SEQ ID NO: 210021 - RNA, 19 nt, Homo sapiens
ccuuccgccucuucaagua

SEQ ID NO: 210022 - RNA, 19 nt, Homo sapiens
ugcaguacguggcagaugu

SEQ ID NO: 210023 - RNA, 19 nt, Homo sapiens
uuucuccucugcuucuuug

SEQ ID NO: 210024 - RNA, 19 nt, Homo sapiens
agugaagcauuaucucauc

SEQ ID NO: 210025 - RNA, 19 nt, Homo sapiens
aagcgggaguggaucugaa

SEQ ID NO: 210026 - RNA, 19 nt, Homo sapiens
gaugcacacacugguauau

SEQ ID NO: 210027 - RNA, 19 nt, Homo sapiens
gagaagcgggaguggaucu

SEQ ID NO: 210028 - RNA, 19 nt, Homo sapiens
agaaagugaagcauuaucu

SEQ ID NO: 210029 - RNA, 19 nt, Homo sapiens
cccaacaagcuucgaaaug

SEQ ID NO: 210030 - RNA, 19 nt, Homo sapiens
gcaguacguggcagaugug

SEQ ID NO: 210031 - RNA, 19 nt, Homo sapiens
guugaucugcucuguuuua

SEQ ID NO: 210032 - RNA, 19 nt, Homo sapiens
gacuucgguuucuguguca

SEQ ID NO: 210033 - RNA, 19 nt, Homo sapiens
cugcagaaagugaagcauu

SEQ ID NO: 210034 - RNA, 19 nt, Homo sapiens
ccagggcuuuguccucucu

SEQ ID NO: 210035 - RNA, 19 nt, Homo sapiens
gacagcagggcuugguaga

SEQ ID NO: 210036 - RNA, 19 nt, Homo sapiens
ggcacagucucgccaucug

SEQ ID NO: 210037 - RNA, 19 nt, Homo sapiens
uagcagcucuccggaagac

SEQ ID NO: 210038 - RNA, 19 nt, Homo sapiens
ccaccucccuccccucuau

SEQ ID NO: 210039 - RNA, 19 nt, Homo sapiens
gccaguugaucugcucugu

SEQ ID NO: 210040 - RNA, 19 nt, Homo sapiens
agaccgagaggccaguuga

SEQ ID NO: 210041 - RNA, 19 nt, Homo sapiens
caucugcauccaucuuguu

SEQ ID NO: 210042 - RNA, 19 nt, Homo sapiens
gcccaacaagcuucgaaau

SEQ ID NO: 210043 - RNA, 19 nt, Homo sapiens
cacaacugguuccguuaag

SEQ ID NO: 210044 - RNA, 19 nt, Homo sapiens
uggcagcuuuccugagauc

SEQ ID NO: 210045 - RNA, 19 nt, Homo sapiens
acugguauaucccaugaag

SEQ ID NO: 210046 - RNA, 19 nt, Homo sapiens
ggauucagcucccaaauga

SEQ ID NO: 210047 - RNA, 19 nt, Homo sapiens
ggagagaagugauuggaaa

SEQ ID NO: 210048 - RNA, 19 nt, Homo sapiens
ugaaagagcugggaaagaa

SEQ ID NO: 210049 - RNA, 19 nt, Homo sapiens
caagggaacuucaaaggaa

SEQ ID NO: 210050 - RNA, 19 nt, Homo sapiens
guugagggcucgcggauua

SEQ ID NO: 210051 - RNA, 19 nt, Homo sapiens
gaagugaauuguuggagaa

SEQ ID NO: 210052 - RNA, 19 nt, Homo sapiens
gauaagagcgguaccguuu

SEQ ID NO: 210053 - RNA, 19 nt, Homo sapiens
gauguucuguuucuuguaa

SEQ ID NO: 210054 - RNA, 19 nt, Homo sapiens
ggaaagaaaucauggaaaa

SEQ ID NO: 210055 - RNA, 19 nt, Homo sapiens
cgaccaagauugacuaguu

SEQ ID NO: 210056 - RNA, 19 nt, Homo sapiens
gcaaacaggacgcgugaua

SEQ ID NO: 210057 - RNA, 19 nt, Homo sapiens
gcggagaucuggccuuuau

SEQ ID NO: 210058 - RNA, 19 nt, Homo sapiens
cagaacagaugguuacuug

SEQ ID NO: 210059 - RNA, 19 nt, Homo sapiens
gacaacagcuggacacuag

SEQ ID NO: 210060 - RNA, 19 nt, Homo sapiens
gagaagugauuggaaauga

SEQ ID NO: 210061 - RNA, 19 nt, Homo sapiens
ggacugauguucuguuucu

SEQ ID NO: 210062 - RNA, 19 nt, Homo sapiens
ggacuuaaacgacgauuug

SEQ ID NO: 210063 - RNA, 19 nt, Homo sapiens
caaauucucugaccugauc

SEQ ID NO: 210064 - RNA, 19 nt, Homo sapiens
caugaaagguauacaaaug

SEQ ID NO: 210065 - RNA, 19 nt, Homo sapiens
gagaguggccauuuccuua

SEQ ID NO: 210066 - RNA, 19 nt, Homo sapiens
caaacaaagucaggaauga

SEQ ID NO: 210067 - RNA, 19 nt, Homo sapiens
ggcacaggcugauauuuaa

SEQ ID NO: 210068 - RNA, 19 nt, Homo sapiens
gaccaagauugacuaguuu

SEQ ID NO: 210069 - RNA, 19 nt, Homo sapiens
ggacgaaguugagaaggaa

SEQ ID NO: 210070 - RNA, 19 nt, Homo sapiens
ggaagucagucuaccguau

SEQ ID NO: 210071 - RNA, 19 nt, Homo sapiens
guaggcauuuggcauauuu

SEQ ID NO: 210072 - RNA, 19 nt, Homo sapiens
gauuggaaaugaacucuug

SEQ ID NO: 210073 - RNA, 19 nt, Homo sapiens
ccagagaccugugccaauu

SEQ ID NO: 210074 - RNA, 19 nt, Homo sapiens
gaagucagucuaccguaua

SEQ ID NO: 210075 - RNA, 19 nt, Homo sapiens
gaagaacacacaucgauuc

SEQ ID NO: 210076 - RNA, 19 nt, Homo sapiens
ggaaauuucugaugcaacu

SEQ ID NO: 210077 - RNA, 19 nt, Homo sapiens
cagaagguauuaaugaaga

SEQ ID NO: 210078 - RNA, 19 nt, Homo sapiens
gaaggacauuugacuuuua

SEQ ID NO: 210079 - RNA, 19 nt, Homo sapiens
gcuuguauuugcaguauuu

SEQ ID NO: 210080 - RNA, 19 nt, Homo sapiens
gaugucagauccucuuguu

SEQ ID NO: 210081 - RNA, 19 nt, Homo sapiens
gcauaaagccaaacaaagu

SEQ ID NO: 210082 - RNA, 19 nt, Homo sapiens
gcaaagugguggagauucu

SEQ ID NO: 210083 - RNA, 19 nt, Homo sapiens
gcagacaccucgcagucaa

SEQ ID NO: 210084 - RNA, 19 nt, Homo sapiens
gaaggaaauuucugaugca

SEQ ID NO: 210085 - RNA, 19 nt, Homo sapiens
gccaauugcugguuuacaa

SEQ ID NO: 210086 - RNA, 19 nt, Homo sapiens
ggacggacauugcaguuac

SEQ ID NO: 210087 - RNA, 19 nt, Homo sapiens
gaggaagaccagcaguuua

SEQ ID NO: 210088 - RNA, 19 nt, Homo sapiens
ggaggaagaccagcaguuu

SEQ ID NO: 210089 - RNA, 19 nt, Homo sapiens
ggacagcucaggguuguuu

SEQ ID NO: 210090 - RNA, 19 nt, Homo sapiens
agagagaccuccuaugcaa

SEQ ID NO: 210091 - RNA, 19 nt, Homo sapiens
guaagauaauucucacguu

SEQ ID NO: 210092 - RNA, 19 nt, Homo sapiens
ggagaucuggccuuuauug

SEQ ID NO: 210093 - RNA, 19 nt, Homo sapiens
gcuaaaccuugaagaaaca

SEQ ID NO: 210094 - RNA, 19 nt, Homo sapiens
gaugguggcuugaguuguc

SEQ ID NO: 210095 - RNA, 19 nt, Homo sapiens
gaacagaugguuacuuggu

SEQ ID NO: 210096 - RNA, 19 nt, Homo sapiens
ugacucugauucacaguuu

SEQ ID NO: 210097 - RNA, 19 nt, Homo sapiens
gaacucuugcccuggaaua

SEQ ID NO: 210098 - RNA, 19 nt, Homo sapiens
gaacaagaaccggagagaa

SEQ ID NO: 210099 - RNA, 19 nt, Homo sapiens
ccgcaaagcaggauguuaa

SEQ ID NO: 210100 - RNA, 19 nt, Homo sapiens
uaaaugaaacuccauguag

SEQ ID NO: 210101 - RNA, 19 nt, Homo sapiens
gaaugcuccuuuaccagaa

SEQ ID NO: 210102 - RNA, 19 nt, Homo sapiens
gcaguggugugagucguuu

SEQ ID NO: 210103 - RNA, 19 nt, Homo sapiens
gaaagagcugggaaagaaa

SEQ ID NO: 210104 - RNA, 19 nt, Homo sapiens
gauacccacuguagagaga

SEQ ID NO: 210105 - RNA, 19 nt, Homo sapiens
uaauagguaagcucuguua

SEQ ID NO: 210106 - RNA, 19 nt, Homo sapiens
gacguagucuuuuguauuu

SEQ ID NO: 210107 - RNA, 19 nt, Homo sapiens
guggugagcagaaugauuu

SEQ ID NO: 210108 - RNA, 19 nt, Homo sapiens
gccauuuccuuaccuuuga

SEQ ID NO: 210109 - RNA, 19 nt, Homo sapiens
gauguggcguuucaacuca

SEQ ID NO: 210110 - RNA, 19 nt, Homo sapiens
aaacuggaaugaucaucuu

SEQ ID NO: 210111 - RNA, 19 nt, Homo sapiens
ggacacagcacugguuuca

SEQ ID NO: 210112 - RNA, 19 nt, Homo sapiens
gcaugugcguuauggaaau

SEQ ID NO: 210113 - RNA, 19 nt, Homo sapiens
caaauaagggacugauguu

SEQ ID NO: 210114 - RNA, 19 nt, Homo sapiens
ugaauggccucgccucuag

SEQ ID NO: 210115 - RNA, 19 nt, Homo sapiens
gcugaagacuggaggaagu

SEQ ID NO: 210116 - RNA, 19 nt, Homo sapiens
gagcaugugcguuauggaa

SEQ ID NO: 210117 - RNA, 19 nt, Homo sapiens
gugcuuugcuucauucugu

SEQ ID NO: 210118 - RNA, 19 nt, Homo sapiens
ggaaaacgccaaaugcuuu

SEQ ID NO: 210119 - RNA, 19 nt, Homo sapiens
aagauugacuaguuuguug

SEQ ID NO: 210120 - RNA, 19 nt, Homo sapiens
gcagucaaauggcagucaa

SEQ ID NO: 210121 - RNA, 19 nt, Homo sapiens
gaagaugggacaagcaaag

SEQ ID NO: 210122 - RNA, 19 nt, Homo sapiens
gaagaccagcaguuuagaa

SEQ ID NO: 210123 - RNA, 19 nt, Homo sapiens
guagagagagggagagaga

SEQ ID NO: 210124 - RNA, 19 nt, Homo sapiens
gcaagcuggcgguagauuu

SEQ ID NO: 210125 - RNA, 19 nt, Homo sapiens
ggaaggacauuugacuuuu

SEQ ID NO: 210126 - RNA, 19 nt, Homo sapiens
gagaacaagucccgcaaac

SEQ ID NO: 210127 - RNA, 19 nt, Homo sapiens
aggcacaggcugauauuua

SEQ ID NO: 210128 - RNA, 19 nt, Homo sapiens
cagauccucuuguuauuag

SEQ ID NO: 210129 - RNA, 19 nt, Homo sapiens
uaaauuggccuggcgugua

SEQ ID NO: 210130 - RNA, 19 nt, Homo sapiens
caucagugcucaauugcau

SEQ ID NO: 210131 - RNA, 19 nt, Homo sapiens
guacuucagccuugcguuu

SEQ ID NO: 210132 - RNA, 19 nt, Homo sapiens
aguauggaaugcuccuuua

SEQ ID NO: 210133 - RNA, 19 nt, Homo sapiens
gcucgugaaccuaauugua

SEQ ID NO: 210134 - RNA, 19 nt, Homo sapiens
aaauuggccuggcguguau

SEQ ID NO: 210135 - RNA, 19 nt, Homo sapiens
gugaauuguuggagaaugu

SEQ ID NO: 210136 - RNA, 19 nt, Homo sapiens
aaccaucagugcucaauug

SEQ ID NO: 210137 - RNA, 19 nt, Homo sapiens
gaaccggagagaagugauu

SEQ ID NO: 210138 - RNA, 19 nt, Homo sapiens
gaccacgggcucugcauaa

SEQ ID NO: 210139 - RNA, 19 nt, Homo sapiens
caaagcaggauguuaaagu

SEQ ID NO: 210140 - RNA, 19 nt, Homo sapiens
gaaugcagaagguauuaau

SEQ ID NO: 210141 - RNA, 19 nt, Homo sapiens
gaauuccaccugagaacaa

SEQ ID NO: 210142 - RNA, 19 nt, Homo sapiens
agaccacacucuaguuguu

SEQ ID NO: 210143 - RNA, 19 nt, Homo sapiens
gagcagaaugauuuccuuu

SEQ ID NO: 210144 - RNA, 19 nt, Homo sapiens
ucagauccucuuguuauua

SEQ ID NO: 210145 - RNA, 19 nt, Homo sapiens
caagcaaagugguggagau

SEQ ID NO: 210146 - RNA, 19 nt, Homo sapiens
ucacauagguguagaaaga

SEQ ID NO: 210147 - RNA, 19 nt, Homo sapiens
cagcagggcuuuagaugua

SEQ ID NO: 210148 - RNA, 19 nt, Homo sapiens
gaccacagcuggacccuuu

SEQ ID NO: 210149 - RNA, 19 nt, Homo sapiens
gcucagcgauugauuauuc

SEQ ID NO: 210150 - RNA, 19 nt, Homo sapiens
gaaaugccaucuauuccaa

SEQ ID NO: 210151 - RNA, 19 nt, Homo sapiens
gcgauuagauugcuuaagu

SEQ ID NO: 210152 - RNA, 19 nt, Homo sapiens
caaagcaaauucaaggaaa

SEQ ID NO: 210153 - RNA, 19 nt, Homo sapiens
gcaaauaagcaaagacuug

SEQ ID NO: 210154 - RNA, 19 nt, Homo sapiens
gcaugcagcuguaccagaa

SEQ ID NO: 210155 - RNA, 19 nt, Homo sapiens
uaauacagcugguggaguu

SEQ ID NO: 210156 - RNA, 19 nt, Homo sapiens
gaauuuggcaauagugaua

SEQ ID NO: 210157 - RNA, 19 nt, Homo sapiens
ucacagagcauaucaccua

SEQ ID NO: 210158 - RNA, 19 nt, Homo sapiens
cagagcauaugguaucuuu

SEQ ID NO: 210159 - RNA, 19 nt, Homo sapiens
gcaaagacuuggauugacu

SEQ ID NO: 210160 - RNA, 19 nt, Homo sapiens
guauuucaccugcaaguua

SEQ ID NO: 210161 - RNA, 19 nt, Homo sapiens
cauaacggcucgagauguu

SEQ ID NO: 210162 - RNA, 19 nt, Homo sapiens
gagcuaugcuguucuccaa

SEQ ID NO: 210163 - RNA, 19 nt, Homo sapiens
gaauguauuucaccugcaa

SEQ ID NO: 210164 - RNA, 19 nt, Homo sapiens
aagcacauauccugaaauu

SEQ ID NO: 210165 - RNA, 19 nt, Homo sapiens
gcuaugcuguucuccaauu

SEQ ID NO: 210166 - RNA, 19 nt, Homo sapiens
cuaagaagaucugguuuau

SEQ ID NO: 210167 - RNA, 19 nt, Homo sapiens
uaaaggaacaucaaaggaa

SEQ ID NO: 210168 - RNA, 19 nt, Homo sapiens
gaagaugacggugaaaugu

SEQ ID NO: 210169 - RNA, 19 nt, Homo sapiens
cgauuagauugcuuaagua

SEQ ID NO: 210170 - RNA, 19 nt, Homo sapiens
gaaagaacagggaaagaag

SEQ ID NO: 210171 - RNA, 19 nt, Homo sapiens
ggauugcucucuagacaag

SEQ ID NO: 210172 - RNA, 19 nt, Homo sapiens
cgaaagaacagggaaagaa

SEQ ID NO: 210173 - RNA, 19 nt, Homo sapiens
ccugaagaaucauuacauu

SEQ ID NO: 210174 - RNA, 19 nt, Homo sapiens
ggaaaaggacucaagaaaa

SEQ ID NO: 210175 - RNA, 19 nt, Homo sapiens
gcaaguugaaacauuauug

SEQ ID NO: 210176 - RNA, 19 nt, Homo sapiens
cuugcaaguugaaacauua

SEQ ID NO: 210177 - RNA, 19 nt, Homo sapiens
gauggccacacaagauuua

SEQ ID NO: 210178 - RNA, 19 nt, Homo sapiens
ccacaaacauggcuaucca

SEQ ID NO: 210179 - RNA, 19 nt, Homo sapiens
uuagauugcuuaaguaugg

SEQ ID NO: 210180 - RNA, 19 nt, Homo sapiens
ucaagcacauauccugaaa

SEQ ID NO: 210181 - RNA, 19 nt, Homo sapiens
gaagaagagcagaguagga

SEQ ID NO: 210182 - RNA, 19 nt, Homo sapiens
gcagaccuauuucccaaag

SEQ ID NO: 210183 - RNA, 19 nt, Homo sapiens
guagaaagaacaauagaag

SEQ ID NO: 210184 - RNA, 19 nt, Homo sapiens
uggauugacuuuacauuca

SEQ ID NO: 210185 - RNA, 19 nt, Homo sapiens
ugagaaguauaucagagaa

SEQ ID NO: 210186 - RNA, 19 nt, Homo sapiens
gugcuaggauugcucucua

SEQ ID NO: 210187 - RNA, 19 nt, Homo sapiens
gaugauggccacacaagau

SEQ ID NO: 210188 - RNA, 19 nt, Homo sapiens
gaggcucagcgauugauua

SEQ ID NO: 210189 - RNA, 19 nt, Homo sapiens
aacuauggauucugcuuua

SEQ ID NO: 210190 - RNA, 19 nt, Homo sapiens
guugucagcagaccuauuu

SEQ ID NO: 210191 - RNA, 19 nt, Homo sapiens
ccaauuacaucuguguugu

SEQ ID NO: 210192 - RNA, 19 nt, Homo sapiens
agacuuggauugacuuuac

SEQ ID NO: 210193 - RNA, 19 nt, Homo sapiens
ggauggaguuuucuuggua

SEQ ID NO: 210194 - RNA, 19 nt, Homo sapiens
agaauucccugguagcaau

SEQ ID NO: 210195 - RNA, 19 nt, Homo sapiens
ucuaagaagaucugguuua

SEQ ID NO: 210196 - RNA, 19 nt, Homo sapiens
ugccaaauaugaguucuuu

SEQ ID NO: 210197 - RNA, 19 nt, Homo sapiens
gaagaaggacucgcuugga

SEQ ID NO: 210198 - RNA, 19 nt, Homo sapiens
ggauugacuuuacauucau

SEQ ID NO: 210199 - RNA, 19 nt, Homo sapiens
gaaaagcagaguuauagaa

SEQ ID NO: 210200 - RNA, 19 nt, Homo sapiens
gcagaagaagagcagagua

SEQ ID NO: 210201 - RNA, 19 nt, Homo sapiens
aaacauggagcaccgacua

SEQ ID NO: 210202 - RNA, 19 nt, Homo sapiens
cacacaagauuuacagauc

SEQ ID NO: 210203 - RNA, 19 nt, Homo sapiens
gagcaccgacuaacuaugg

SEQ ID NO: 210204 - RNA, 19 nt, Homo sapiens
ccaaagcaaauucaaggaa

SEQ ID NO: 210205 - RNA, 19 nt, Homo sapiens
uaggauugcucucuagaca

SEQ ID NO: 210206 - RNA, 19 nt, Homo sapiens
guaccagaauuauaugcau

SEQ ID NO: 210207 - RNA, 19 nt, Homo sapiens
uaacuauggauucugcuuu

SEQ ID NO: 210208 - RNA, 19 nt, Homo sapiens
aguagaagaugacggugaa

SEQ ID NO: 210209 - RNA, 19 nt, Homo sapiens
cuaugcuguucuccaauua

SEQ ID NO: 210210 - RNA, 19 nt, Homo sapiens
ugauugaagugcuauccaa

SEQ ID NO: 210211 - RNA, 19 nt, Homo sapiens
ugacauaacggcucgagau

SEQ ID NO: 210212 - RNA, 19 nt, Homo sapiens
aagcaaagacuuggauuga

SEQ ID NO: 210213 - RNA, 19 nt, Homo sapiens
caaauuauaccaguagaag

SEQ ID NO: 210214 - RNA, 19 nt, Homo sapiens
gcauccauaucaagguaga

SEQ ID NO: 210215 - RNA, 19 nt, Homo sapiens
gaaaccagcagggcuuuag

SEQ ID NO: 210216 - RNA, 19 nt, Homo sapiens
ucaccuaugagaaguauau

SEQ ID NO: 210217 - RNA, 19 nt, Homo sapiens
cagcgaauuuggcaauagu

SEQ ID NO: 210218 - RNA, 19 nt, Homo sapiens
cagcuguaccagaauuaua

SEQ ID NO: 210219 - RNA, 19 nt, Homo sapiens
guucuuccuugcaaguuga

SEQ ID NO: 210220 - RNA, 19 nt, Homo sapiens
agaugacggugaaauguuc

SEQ ID NO: 210221 - RNA, 19 nt, Homo sapiens
gaaguauaucagagaauuc

SEQ ID NO: 210222 - RNA, 19 nt, Homo sapiens
ccacacagauuuugcagau

SEQ ID NO: 210223 - RNA, 19 nt, Homo sapiens
guucuccaauuacaucugu

SEQ ID NO: 210224 - RNA, 19 nt, Homo sapiens
ccggaaaugccaucuauuc

SEQ ID NO: 210225 - RNA, 19 nt, Homo sapiens
uaucaccuaugagaaguau

SEQ ID NO: 210226 - RNA, 19 nt, Homo sapiens
uaagcaaagacuuggauug

SEQ ID NO: 210227 - RNA, 19 nt, Homo sapiens
aaacauuauugugcuagga

SEQ ID NO: 210228 - RNA, 19 nt, Homo sapiens
aaacuuucguacugucaau

SEQ ID NO: 210229 - RNA, 19 nt, Homo sapiens
guacgggauagucagagua

SEQ ID NO: 210230 - RNA, 19 nt, Homo sapiens
gcgauugauuauucagcaa

SEQ ID NO: 210231 - RNA, 19 nt, Homo sapiens
ccacaaaauuucuagagau

SEQ ID NO: 210232 - RNA, 19 nt, Homo sapiens
cuacuaaaggaacaucaaa

SEQ ID NO: 210233 - RNA, 19 nt, Homo sapiens
aguauacagugaagaugaa

SEQ ID NO: 210234 - RNA, 19 nt, Homo sapiens
gagcauaugguaucuuuug

SEQ ID NO: 210235 - RNA, 19 nt, Homo sapiens
ggacuuguggauggaguuu

SEQ ID NO: 210236 - RNA, 19 nt, Homo sapiens
gguagaaguggcugcaguu

SEQ ID NO: 210237 - RNA, 19 nt, Homo sapiens
cagaagaagagcagaguag

SEQ ID NO: 210238 - RNA, 19 nt, Homo sapiens
gcgaauuuggcaauaguga

SEQ ID NO: 210239 - RNA, 19 nt, Homo sapiens
ccuugcaaguugaaacauu

SEQ ID NO: 210240 - RNA, 19 nt, Homo sapiens
ccacacaagauuuacagau

SEQ ID NO: 210241 - RNA, 19 nt, Homo sapiens
cggcgacaaugaccacuuc

SEQ ID NO: 210242 - RNA, 19 nt, Homo sapiens
gacauaacggcucgagaug

SEQ ID NO: 210243 - RNA, 19 nt, Homo sapiens
cuaaaggaacaucaaagga

SEQ ID NO: 210244 - RNA, 19 nt, Homo sapiens
uaacggcucgagauguuug

SEQ ID NO: 210245 - RNA, 19 nt, Homo sapiens
gagcaccugccucacauag

SEQ ID NO: 210246 - RNA, 19 nt, Homo sapiens
ggaaagauuugguguugua

SEQ ID NO: 210247 - RNA, 19 nt, Homo sapiens
gcagaacgauccucgaauu

SEQ ID NO: 210248 - RNA, 19 nt, Homo sapiens
cagaggagcucaucaagaa

SEQ ID NO: 210249 - RNA, 19 nt, Homo sapiens
guacgcaggugacgccuua

SEQ ID NO: 210250 - RNA, 19 nt, Homo sapiens
guacagauaugagaaauuc

SEQ ID NO: 210251 - RNA, 19 nt, Homo sapiens
ggaagaacauccuggacaa

SEQ ID NO: 210252 - RNA, 19 nt, Homo sapiens
gaggaacgacgacauuaua

SEQ ID NO: 210253 - RNA, 19 nt, Homo sapiens
augcugagcucuucuauaa

SEQ ID NO: 210254 - RNA, 19 nt, Homo sapiens
guagagauccuaaacaaga

SEQ ID NO: 210255 - RNA, 19 nt, Homo sapiens
gggaggauccuuucacuuu

SEQ ID NO: 210256 - RNA, 19 nt, Homo sapiens
gcauucgggugguugauaa

SEQ ID NO: 210257 - RNA, 19 nt, Homo sapiens
gggaacggcugcucuugaa

SEQ ID NO: 210258 - RNA, 19 nt, Homo sapiens
gcagcaggcaguagaauuu

SEQ ID NO: 210259 - RNA, 19 nt, Homo sapiens
ucaagaagcugcaguacag

SEQ ID NO: 210260 - RNA, 19 nt, Homo sapiens
cagcugagguguccguaaa

SEQ ID NO: 210261 - RNA, 19 nt, Homo sapiens
caggaaagauuugguguug

SEQ ID NO: 210262 - RNA, 19 nt, Homo sapiens
cuucugaaaucucaaauga

SEQ ID NO: 210263 - RNA, 19 nt, Homo sapiens
cagacggccuggaaccuua

SEQ ID NO: 210264 - RNA, 19 nt, Homo sapiens
gugaaacacuagaccacua

SEQ ID NO: 210265 - RNA, 19 nt, Homo sapiens
agaacaagcuccucaugga

SEQ ID NO: 210266 - RNA, 19 nt, Homo sapiens
gcccugcgcuacuuuaaga

SEQ ID NO: 210267 - RNA, 19 nt, Homo sapiens
cagagaagccugugaacaa

SEQ ID NO: 210268 - RNA, 19 nt, Homo sapiens
ccacuaugaucccgacuau

SEQ ID NO: 210269 - RNA, 19 nt, Homo sapiens
ggaggauccuuucacuuuc

SEQ ID NO: 210270 - RNA, 19 nt, Homo sapiens
ggaacgacgacauuauaaa

SEQ ID NO: 210271 - RNA, 19 nt, Homo sapiens
aaacagaccgggaagagaa

SEQ ID NO: 210272 - RNA, 19 nt, Homo sapiens
gaacgacgacauuauaaac

SEQ ID NO: 210273 - RNA, 19 nt, Homo sapiens
cagaagagauccugaagcu

SEQ ID NO: 210274 - RNA, 19 nt, Homo sapiens
gaacgauccucgaauucag

SEQ ID NO: 210275 - RNA, 19 nt, Homo sapiens
ugaagcugauggacaaauu

SEQ ID NO: 210276 - RNA, 19 nt, Homo sapiens
gcugagcucuucuauaaaa

SEQ ID NO: 210277 - RNA, 19 nt, Homo sapiens
gacgagcugucccucauug

SEQ ID NO: 210278 - RNA, 19 nt, Homo sapiens
gaagaacaagcuccucaug

SEQ ID NO: 210279 - RNA, 19 nt, Homo sapiens
uaacuucaacuccuacuug

SEQ ID NO: 210280 - RNA, 19 nt, Homo sapiens
ucacggagcacuucaacaa

SEQ ID NO: 210281 - RNA, 19 nt, Homo sapiens
ccguaaagauuccagagaa

SEQ ID NO: 210282 - RNA, 19 nt, Homo sapiens
ggaggauggugugagcuuu

SEQ ID NO: 210283 - RNA, 19 nt, Homo sapiens
gggaagagaagaccuagga

SEQ ID NO: 210284 - RNA, 19 nt, Homo sapiens
cagagaagcuugucuaacc

SEQ ID NO: 210285 - RNA, 19 nt, Homo sapiens
agagaagccugugaacaaa

SEQ ID NO: 210286 - RNA, 19 nt, Homo sapiens
uaugggaacugucucugaa

SEQ ID NO: 210287 - RNA, 19 nt, Homo sapiens
caaauuccacucacccaaa

SEQ ID NO: 210288 - RNA, 19 nt, Homo sapiens
guucucaucucucuuccuu

SEQ ID NO: 210289 - RNA, 19 nt, Homo sapiens
gaacugucucugaaaauua

SEQ ID NO: 210290 - RNA, 19 nt, Homo sapiens
gagaagagccccaacuuga

SEQ ID NO: 210291 - RNA, 19 nt, Homo sapiens
gcaguacagauaugagaaa

SEQ ID NO: 210292 - RNA, 19 nt, Homo sapiens
ggagaaagagaaggaaguu

SEQ ID NO: 210293 - RNA, 19 nt, Homo sapiens
caagagaacgccaucaaag

SEQ ID NO: 210294 - RNA, 19 nt, Homo sapiens
ggaggaacgacgacauuau

SEQ ID NO: 210295 - RNA, 19 nt, Homo sapiens
gaacggcugcucuugaagu

SEQ ID NO: 210296 - RNA, 19 nt, Homo sapiens
ggaggcagccacucauaug

SEQ ID NO: 210297 - RNA, 19 nt, Homo sapiens
caagacgacugggauguca

SEQ ID NO: 210298 - RNA, 19 nt, Homo sapiens
caucaaggcugugcuggau

SEQ ID NO: 210299 - RNA, 19 nt, Homo sapiens
caaagaggcaacagacaga

SEQ ID NO: 210300 - RNA, 19 nt, Homo sapiens
ugaaucuucugaaaucuca

SEQ ID NO: 210301 - RNA, 19 nt, Homo sapiens
ggaacugucucugaaaauu

SEQ ID NO: 210302 - RNA, 19 nt, Homo sapiens
cuacugagacugacaggaa

SEQ ID NO: 210303 - RNA, 19 nt, Homo sapiens
ugagcuggcuggaggagaa

SEQ ID NO: 210304 - RNA, 19 nt, Homo sapiens
ugcggaagcugaauaacuu

SEQ ID NO: 210305 - RNA, 19 nt, Homo sapiens
ucaacaacauguccuacug

SEQ ID NO: 210306 - RNA, 19 nt, Homo sapiens
agacugacaggaaagauuu

SEQ ID NO: 210307 - RNA, 19 nt, Homo sapiens
ugucuaaccuagcacaguu

SEQ ID NO: 210308 - RNA, 19 nt, Homo sapiens
ucucaucucucuuccuuca

SEQ ID NO: 210309 - RNA, 19 nt, Homo sapiens
uaaccuagcacaguuucua

SEQ ID NO: 210310 - RNA, 19 nt, Homo sapiens
gccgaguacugcacacuga

SEQ ID NO: 210311 - RNA, 19 nt, Homo sapiens
acuaugaucccgacuauga

SEQ ID NO: 210312 - RNA, 19 nt, Homo sapiens
agagaacgccaucaaagaa

SEQ ID NO: 210313 - RNA, 19 nt, Homo sapiens
cgacgacauuauaaacuuc

SEQ ID NO: 210314 - RNA, 19 nt, Homo sapiens
ucaagaagcgcgucagcaa

SEQ ID NO: 210315 - RNA, 19 nt, Homo sapiens
gagacugacaggaaagauu

SEQ ID NO: 210316 - RNA, 19 nt, Homo sapiens
agaagccugugaacaaaga

SEQ ID NO: 210317 - RNA, 19 nt, Homo sapiens
gcugagguguccguaaaga

SEQ ID NO: 210318 - RNA, 19 nt, Homo sapiens
gaacauaacaaggagaaaa

SEQ ID NO: 210319 - RNA, 19 nt, Homo sapiens
gaccacaacgaaauuaugu

SEQ ID NO: 210320 - RNA, 19 nt, Homo sapiens
ugagguguccguaaagauu

SEQ ID NO: 210321 - RNA, 19 nt, Homo sapiens
cggcaucccucgcaguaug

SEQ ID NO: 210322 - RNA, 19 nt, Homo sapiens
gcacagcucagcccucucu

SEQ ID NO: 210323 - RNA, 19 nt, Homo sapiens
ggcaauugauaagaaggua

SEQ ID NO: 210324 - RNA, 19 nt, Homo sapiens
gaaagagaaggaaguuguc

SEQ ID NO: 210325 - RNA, 19 nt, Homo sapiens
gaagcugcaguacagauau

SEQ ID NO: 210326 - RNA, 19 nt, Homo sapiens
agacggacaucccagagau

SEQ ID NO: 210327 - RNA, 19 nt, Homo sapiens
gagaagcuugucuaaccua

SEQ ID NO: 210328 - RNA, 19 nt, Homo sapiens
agguagagauccuaaacaa

SEQ ID NO: 210329 - RNA, 19 nt, Homo sapiens
ucaagagaacgccaucaaa

SEQ ID NO: 210330 - RNA, 19 nt, Homo sapiens
ggaguugacagaagagauc

SEQ ID NO: 210331 - RNA, 19 nt, Homo sapiens
ugacagaccgcgagguaga

SEQ ID NO: 210332 - RNA, 19 nt, Homo sapiens
cagcaggcaguagaauuua

SEQ ID NO: 210333 - RNA, 19 nt, Homo sapiens
caggucuuguugccaauuu

SEQ ID NO: 210334 - RNA, 19 nt, Homo sapiens
uggacaagguggaccagaa

SEQ ID NO: 210335 - RNA, 19 nt, Homo sapiens
gagucugggucuccauuuc

SEQ ID NO: 210336 - RNA, 19 nt, Homo sapiens
gagauggugacgacuguga

SEQ ID NO: 210337 - RNA, 19 nt, Homo sapiens
gacaaaauggcaauugaua

SEQ ID NO: 210338 - RNA, 19 nt, Homo sapiens
agaaagagaaggaaguugu

SEQ ID NO: 210339 - RNA, 19 nt, Homo sapiens
gugcugccauggacacaga

SEQ ID NO: 210340 - RNA, 19 nt, Homo sapiens
gaugcugagcucuucuaua

SEQ ID NO: 210341 - RNA, 19 nt, Homo sapiens
uggaaggcgugaacucaga

SEQ ID NO: 210342 - RNA, 19 nt, Homo sapiens
auaagaagguacuggagau

SEQ ID NO: 210343 - RNA, 19 nt, Homo sapiens
gcaggcaguagaauuuaug

SEQ ID NO: 210344 - RNA, 19 nt, Homo sapiens
gcaacagacagauuucuac

SEQ ID NO: 210345 - RNA, 19 nt, Homo sapiens
ggcaacagacagauuucua

SEQ ID NO: 210346 - RNA, 19 nt, Homo sapiens
gggaagaaguuauagauuu

SEQ ID NO: 210347 - RNA, 19 nt, Homo sapiens
gcagaaauuugucuacauu

SEQ ID NO: 210348 - RNA, 19 nt, Homo sapiens
gaagaacgccaaucaguuu

SEQ ID NO: 210349 - RNA, 19 nt, Homo sapiens
gaacauacaucgucacaac

SEQ ID NO: 210350 - RNA, 19 nt, Homo sapiens
gaguaacccugucuaauga

SEQ ID NO: 210351 - RNA, 19 nt, Homo sapiens
ggaagaaguuauagauuuc

SEQ ID NO: 210352 - RNA, 19 nt, Homo sapiens
gcagagaauugauauaucu

SEQ ID NO: 210353 - RNA, 19 nt, Homo sapiens
gaacaucagcgacagcuuu

SEQ ID NO: 210354 - RNA, 19 nt, Homo sapiens
ggacauugacuuaaacaaa

SEQ ID NO: 210355 - RNA, 19 nt, Homo sapiens
ggaaacaccaaaucuauga

SEQ ID NO: 210356 - RNA, 19 nt, Homo sapiens
caagaaggaugauucaaca

SEQ ID NO: 210357 - RNA, 19 nt, Homo sapiens
gguaguaggugccaauuuc

SEQ ID NO: 210358 - RNA, 19 nt, Homo sapiens
ggaaugaagaugauaaguu

SEQ ID NO: 210359 - RNA, 19 nt, Homo sapiens
gaacuacacagacacuauu

SEQ ID NO: 210360 - RNA, 19 nt, Homo sapiens
gagaugaccuauagauucu

SEQ ID NO: 210361 - RNA, 19 nt, Homo sapiens
ucacaacaauccuagaaga

SEQ ID NO: 210362 - RNA, 19 nt, Homo sapiens
ggaucuccaucaugauuaa

SEQ ID NO: 210363 - RNA, 19 nt, Homo sapiens
gaagcaggaucuacuaagg

SEQ ID NO: 210364 - RNA, 19 nt, Homo sapiens
ccacgugauugaaaugaaa

SEQ ID NO: 210365 - RNA, 19 nt, Homo sapiens
gcuuugagaugaccuauag

SEQ ID NO: 210366 - RNA, 19 nt, Homo sapiens
ccaagcggaugaaggguuu

SEQ ID NO: 210367 - RNA, 19 nt, Homo sapiens
gaaauccaaaggcaaauau

SEQ ID NO: 210368 - RNA, 19 nt, Homo sapiens
uagagucacuggaacacua

SEQ ID NO: 210369 - RNA, 19 nt, Homo sapiens
gauuguaacuggagcagau

SEQ ID NO: 210370 - RNA, 19 nt, Homo sapiens
gaggaaauccaaaggcaaa

SEQ ID NO: 210371 - RNA, 19 nt, Homo sapiens
gcgccaaugugacagguuu

SEQ ID NO: 210372 - RNA, 19 nt, Homo sapiens
gaaggaagcaagcaagcaa

SEQ ID NO: 210373 - RNA, 19 nt, Homo sapiens
gaaggugggagguaacuug

SEQ ID NO: 210374 - RNA, 19 nt, Homo sapiens
ggaaauccaaaggcaaaua

SEQ ID NO: 210375 - RNA, 19 nt, Homo sapiens
ggugcgauuugaagguuua

SEQ ID NO: 210376 - RNA, 19 nt, Homo sapiens
gagaguggcgccaauguga

SEQ ID NO: 210377 - RNA, 19 nt, Homo sapiens
ucauggacauugacuuaaa

SEQ ID NO: 210378 - RNA, 19 nt, Homo sapiens
aaauaacacuguacugcaa

SEQ ID NO: 210379 - RNA, 19 nt, Homo sapiens
gagaguagagucacuggaa

SEQ ID NO: 210380 - RNA, 19 nt, Homo sapiens
ggagaguaacccugucuaa

SEQ ID NO: 210381 - RNA, 19 nt, Homo sapiens
gaagcaagcaagcaaggaa

SEQ ID NO: 210382 - RNA, 19 nt, Homo sapiens
ucagaacgccucaaugcua

SEQ ID NO: 210383 - RNA, 19 nt, Homo sapiens
guaacccugucuaaugaaa

SEQ ID NO: 210384 - RNA, 19 nt, Homo sapiens
gaucggaggacuuggacua

SEQ ID NO: 210385 - RNA, 19 nt, Homo sapiens
ccuagaagauccuuaugug

SEQ ID NO: 210386 - RNA, 19 nt, Homo sapiens
ccagugaccaguccaauga

SEQ ID NO: 210387 - RNA, 19 nt, Homo sapiens
ugggagagcuggucuaugg

SEQ ID NO: 210388 - RNA, 19 nt, Homo sapiens
cagaacgccucaaugcuau

SEQ ID NO: 210389 - RNA, 19 nt, Homo sapiens
ccaaucaguuuguccuuca

SEQ ID NO: 210390 - RNA, 19 nt, Homo sapiens
caguaaaccuggcaguguu

SEQ ID NO: 210391 - RNA, 19 nt, Homo sapiens
cuccacgucugcuucauua

SEQ ID NO: 210392 - RNA, 19 nt, Homo sapiens
caaaggcuauggcauugca

SEQ ID NO: 210393 - RNA, 19 nt, Homo sapiens
ccacuacauucuugcaaau

SEQ ID NO: 210394 - RNA, 19 nt, Homo sapiens
ucagcaucauugaccauua

SEQ ID NO: 210395 - RNA, 19 nt, Homo sapiens
ccaugaaggugggagguaa

SEQ ID NO: 210396 - RNA, 19 nt, Homo sapiens
ucaagaagaacgccaauca

SEQ ID NO: 210397 - RNA, 19 nt, Homo sapiens
agaagauccuuaugugaug

SEQ ID NO: 210398 - RNA, 19 nt, Homo sapiens
gauaccggaugcucuuuca

SEQ ID NO: 210399 - RNA, 19 nt, Homo sapiens
gaacguaggacugucaaca

SEQ ID NO: 210400 - RNA, 19 nt, Homo sapiens
ggcgauaauucaaguguuc

SEQ ID NO: 210401 - RNA, 19 nt, Homo sapiens
aaagauugguuacuggaau

SEQ ID NO: 210402 - RNA, 19 nt, Homo sapiens
gaaagauugguuacuggaa

SEQ ID NO: 210403 - RNA, 19 nt, Homo sapiens
ugagaugaccuauagauuc

SEQ ID NO: 210404 - RNA, 19 nt, Homo sapiens
agaguaacccugucuaaug

SEQ ID NO: 210405 - RNA, 19 nt, Homo sapiens
ccaaguccaugcaaucgau

SEQ ID NO: 210406 - RNA, 19 nt, Homo sapiens
ggugauggcugaggcuuuc

SEQ ID NO: 210407 - RNA, 19 nt, Homo sapiens
gguggacugugaaucagaa

SEQ ID NO: 210408 - RNA, 19 nt, Homo sapiens
gaagucagcagagccauca

SEQ ID NO: 210409 - RNA, 19 nt, Homo sapiens
acacacggguggacuggaa

SEQ ID NO: 210410 - RNA, 19 nt, Homo sapiens
cuucauggacauugacuua

SEQ ID NO: 210411 - RNA, 19 nt, Homo sapiens
gaaaagaacaggcagaaca

SEQ ID NO: 210412 - RNA, 19 nt, Homo sapiens
gaacacuaaugaggaaacu

SEQ ID NO: 210413 - RNA, 19 nt, Homo sapiens
gcaguuuaaugagaaagga

SEQ ID NO: 210414 - RNA, 19 nt, Homo sapiens
guuuccagcuggugaacua

SEQ ID NO: 210415 - RNA, 19 nt, Homo sapiens
gaugaccuauagauucugu

SEQ ID NO: 210416 - RNA, 19 nt, Homo sapiens
aaauugcuguguuugagaa

SEQ ID NO: 210417 - RNA, 19 nt, Homo sapiens
cagaggaccuagcgaagca

SEQ ID NO: 210418 - RNA, 19 nt, Homo sapiens
caucaucuccucauauaca

SEQ ID NO: 210419 - RNA, 19 nt, Homo sapiens
uaaucaucaucuccucaua

SEQ ID NO: 210420 - RNA, 19 nt, Homo sapiens
ccucugcgcucaccuacga

SEQ ID NO: 210421 - RNA, 19 nt, Homo sapiens
ggagagcuggucuauggaa

SEQ ID NO: 210422 - RNA, 19 nt, Homo sapiens
augcagcaguggaagaaua

SEQ ID NO: 210423 - RNA, 19 nt, Homo sapiens
aaaggaauaugcagcacau

SEQ ID NO: 210424 - RNA, 19 nt, Homo sapiens
uagauucuguucccaguuc

SEQ ID NO: 210425 - RNA, 19 nt, Homo sapiens
ggaacaugcugcuuuuaga

SEQ ID NO: 210426 - RNA, 19 nt, Homo sapiens
gagaguaacccugucuaau

SEQ ID NO: 210427 - RNA, 19 nt, Homo sapiens
gaaacgcaaccaccaccaa

SEQ ID NO: 210428 - RNA, 19 nt, Homo sapiens
ggugggagguaacuuggau

SEQ ID NO: 210429 - RNA, 19 nt, Homo sapiens
gggaucuccaucaugauua

SEQ ID NO: 210430 - RNA, 19 nt, Homo sapiens
gucuggagauugucaguga

SEQ ID NO: 210431 - RNA, 19 nt, Homo sapiens
uagaagauccuuaugugau

SEQ ID NO: 210432 - RNA, 19 nt, Homo sapiens
ggcagagaauugauauauc

SEQ ID NO: 210433 - RNA, 19 nt, Homo sapiens
ggaggcagagaauugauau

SEQ ID NO: 210434 - RNA, 19 nt, Homo sapiens
gcuuauccguccugcagaa

SEQ ID NO: 210435 - RNA, 19 nt, Homo sapiens
aggagucuaugccaucuuu

SEQ ID NO: 210436 - RNA, 19 nt, Homo sapiens
ccugagaaauccaguaaac

SEQ ID NO: 210437 - RNA, 19 nt, Homo sapiens
uagcgaagcagacagaaau

SEQ ID NO: 210438 - RNA, 19 nt, Homo sapiens
aucaucaucuccucauaua

SEQ ID NO: 210439 - RNA, 19 nt, Homo sapiens
gagauuuggaugugcauug

SEQ ID NO: 210440 - RNA, 19 nt, Homo sapiens
gguccgggaagaaguuaua

SEQ ID NO: 210441 - RNA, 19 nt, Homo sapiens
guggcucccuuaacuauca

SEQ ID NO: 210442 - RNA, 19 nt, Homo sapiens
uaacaggaaacgugcaguu

SEQ ID NO: 210443 - RNA, 19 nt, Homo sapiens
caaggagaguggcgccaau

SEQ ID NO: 210444 - RNA, 19 nt, Homo sapiens
ucaacaugcugaccuccuu

SEQ ID NO: 210445 - RNA, 19 nt, Homo sapiens
ggaauaugcagcacauuuu

SEQ ID NO: 210446 - RNA, 19 nt, Homo sapiens
gaaggucucucaggaaaua

SEQ ID NO: 210447 - RNA, 19 nt, Homo sapiens
gaaugaagguggcaaagaa

SEQ ID NO: 210448 - RNA, 19 nt, Homo sapiens
gggacaagguguagaaaua

SEQ ID NO: 210449 - RNA, 19 nt, Homo sapiens
gacaagaagucuguaaaua

SEQ ID NO: 210450 - RNA, 19 nt, Homo sapiens
uaaggaagguuacaacgua

SEQ ID NO: 210451 - RNA, 19 nt, Homo sapiens
gagaagaggugauugacuu

SEQ ID NO: 210452 - RNA, 19 nt, Homo sapiens
gaaauaugccuacuuguug

SEQ ID NO: 210453 - RNA, 19 nt, Homo sapiens
gcaagugacugcuaucaau

SEQ ID NO: 210454 - RNA, 19 nt, Homo sapiens
gaaaagaaauggcaaguga

SEQ ID NO: 210455 - RNA, 19 nt, Homo sapiens
gcaaacagcuucgcaguca

SEQ ID NO: 210456 - RNA, 19 nt, Homo sapiens
guuagucucuugauucaua

SEQ ID NO: 210457 - RNA, 19 nt, Homo sapiens
ugacugaucucucgugauu

SEQ ID NO: 210458 - RNA, 19 nt, Homo sapiens
caacguauauggcaucgaa

SEQ ID NO: 210459 - RNA, 19 nt, Homo sapiens
caacguugcuggaguauuc

SEQ ID NO: 210460 - RNA, 19 nt, Homo sapiens
ccucugggcuugagaauaa

SEQ ID NO: 210461 - RNA, 19 nt, Homo sapiens
gcaaagaaugcacagaaua

SEQ ID NO: 210462 - RNA, 19 nt, Homo sapiens
ggaaauaugccuacuuguu

SEQ ID NO: 210463 - RNA, 19 nt, Homo sapiens
aaacagaaauugcuuaugg

SEQ ID NO: 210464 - RNA, 19 nt, Homo sapiens
gggaugaccuugaaugaug

SEQ ID NO: 210465 - RNA, 19 nt, Homo sapiens
gcagaaaucgccaaacauu

SEQ ID NO: 210466 - RNA, 19 nt, Homo sapiens
caacuuauaaggaagguua

SEQ ID NO: 210467 - RNA, 19 nt, Homo sapiens
gaauaagacuguuguuguc

SEQ ID NO: 210468 - RNA, 19 nt, Homo sapiens
gaaagcugauauugcaauu

SEQ ID NO: 210469 - RNA, 19 nt, Homo sapiens
gcucacacaacaacaauua

SEQ ID NO: 210470 - RNA, 19 nt, Homo sapiens
gaucuaauuugcagaggaa

SEQ ID NO: 210471 - RNA, 19 nt, Homo sapiens
gacaucaacugcaucaaga

SEQ ID NO: 210472 - RNA, 19 nt, Homo sapiens
ggaagagaaacacaaagua

SEQ ID NO: 210473 - RNA, 19 nt, Homo sapiens
caguaaaucuugcaguauu

SEQ ID NO: 210474 - RNA, 19 nt, Homo sapiens
caagaaagaugagauguac

SEQ ID NO: 210475 - RNA, 19 nt, Homo sapiens
caaagaaugcacagaauau

SEQ ID NO: 210476 - RNA, 19 nt, Homo sapiens
gcagcuuggugcuaaauug

SEQ ID NO: 210477 - RNA, 19 nt, Homo sapiens
gaagagaaacacaaaguag

SEQ ID NO: 210478 - RNA, 19 nt, Homo sapiens
gugcaaaugucucuggauu

SEQ ID NO: 210479 - RNA, 19 nt, Homo sapiens
gccaaggacucuggaagua

SEQ ID NO: 210480 - RNA, 19 nt, Homo sapiens
uguuaugacuccagaauuu

SEQ ID NO: 210481 - RNA, 19 nt, Homo sapiens
agaaauugcuuauggaaca

SEQ ID NO: 210482 - RNA, 19 nt, Homo sapiens
cggcaaggaugcgauauuu

SEQ ID NO: 210483 - RNA, 19 nt, Homo sapiens
gaguagggaugguucaguu

SEQ ID NO: 210484 - RNA, 19 nt, Homo sapiens
gaucucucgugauugauaa

SEQ ID NO: 210485 - RNA, 19 nt, Homo sapiens
gaggaucuuucuaagcaaa

SEQ ID NO: 210486 - RNA, 19 nt, Homo sapiens
gguguguggugguucuuua

SEQ ID NO: 210487 - RNA, 19 nt, Homo sapiens
gcaauugcuccauuaacua

SEQ ID NO: 210488 - RNA, 19 nt, Homo sapiens
gagauguaccgaucacuuu

SEQ ID NO: 210489 - RNA, 19 nt, Homo sapiens
caucuugaauuguaaggaa

SEQ ID NO: 210490 - RNA, 19 nt, Homo sapiens
ggaaugaaugucaguguga

SEQ ID NO: 210491 - RNA, 19 nt, Homo sapiens
uaugagggcuacuguguug

SEQ ID NO: 210492 - RNA, 19 nt, Homo sapiens
gcauauuucuguccuccuu

SEQ ID NO: 210493 - RNA, 19 nt, Homo sapiens
ugaccuggcugcagaaauc

SEQ ID NO: 210494 - RNA, 19 nt, Homo sapiens
gacaagguguagaaauaga

SEQ ID NO: 210495 - RNA, 19 nt, Homo sapiens
ugaaagggauaaaguaaac

SEQ ID NO: 210496 - RNA, 19 nt, Homo sapiens
uucaagaucuggaguuaaa

SEQ ID NO: 210497 - RNA, 19 nt, Homo sapiens
gagaggagucuaugcuauu

SEQ ID NO: 210498 - RNA, 19 nt, Homo sapiens
gaaaauggacguguuauga

SEQ ID NO: 210499 - RNA, 19 nt, Homo sapiens
ucaagaagccucagaaguc

SEQ ID NO: 210500 - RNA, 19 nt, Homo sapiens
cgagaggagucuaugcuau

SEQ ID NO: 210501 - RNA, 19 nt, Homo sapiens
cccaguaaaucuugcagua

SEQ ID NO: 210502 - RNA, 19 nt, Homo sapiens
gaaaacagccaaagaagga

SEQ ID NO: 210503 - RNA, 19 nt, Homo sapiens
cuucugcucugaccuauga

SEQ ID NO: 210504 - RNA, 19 nt, Homo sapiens
ggucaacacuggaagaaaa

SEQ ID NO: 210505 - RNA, 19 nt, Homo sapiens
ugacagaggcuuaucaaca

SEQ ID NO: 210506 - RNA, 19 nt, Homo sapiens
guaaauaccaucacaucau

SEQ ID NO: 210507 - RNA, 19 nt, Homo sapiens
ucaagaauacagugcauuu

SEQ ID NO: 210508 - RNA, 19 nt, Homo sapiens
gaacaaggcaaggcuguca

SEQ ID NO: 210509 - RNA, 19 nt, Homo sapiens
uggcaaugcugguggcuuu

SEQ ID NO: 210510 - RNA, 19 nt, Homo sapiens
gaacuuguauaugggaaag

SEQ ID NO: 210511 - RNA, 19 nt, Homo sapiens
ucauggagcucaaaacuaa

SEQ ID NO: 210512 - RNA, 19 nt, Homo sapiens
ggcaaagaaugcacagaau

SEQ ID NO: 210513 - RNA, 19 nt, Homo sapiens
caaggacucuggaaguaag

SEQ ID NO: 210514 - RNA, 19 nt, Homo sapiens
gugcugaggaucuuucuaa

SEQ ID NO: 210515 - RNA, 19 nt, Homo sapiens
cgaaagugcugaggaucuu

SEQ ID NO: 210516 - RNA, 19 nt, Homo sapiens
guuugaagauggaagagaa

SEQ ID NO: 210517 - RNA, 19 nt, Homo sapiens
gagaauaagacuguuguug

SEQ ID NO: 210518 - RNA, 19 nt, Homo sapiens
caaauggugguacgauaaa

SEQ ID NO: 210519 - RNA, 19 nt, Homo sapiens
ugggaaagcugauauugca

SEQ ID NO: 210520 - RNA, 19 nt, Homo sapiens
cuccuuagcuugauugaau

SEQ ID NO: 210521 - RNA, 19 nt, Homo sapiens
aaggcaaggcugucaauua

SEQ ID NO: 210522 - RNA, 19 nt, Homo sapiens
gauggaagagaaacacaaa

SEQ ID NO: 210523 - RNA, 19 nt, Homo sapiens
ggagugaaguggacaaaau

SEQ ID NO: 210524 - RNA, 19 nt, Homo sapiens
ggauaaaguaaacgacauu

SEQ ID NO: 210525 - RNA, 19 nt, Homo sapiens
caagaagucuguaaauacc

SEQ ID NO: 210526 - RNA, 19 nt, Homo sapiens
gaucaagaauacagugcau

SEQ ID NO: 210527 - RNA, 19 nt, Homo sapiens
cuaaauugcugucucaaaa

SEQ ID NO: 210528 - RNA, 19 nt, Homo sapiens
gaacgaguacauugagcaa

SEQ ID NO: 210529 - RNA, 19 nt, Homo sapiens
ggaaagcugauauugcaau

SEQ ID NO: 210530 - RNA, 19 nt, Homo sapiens
gaaucuccguauguuauga

SEQ ID NO: 210531 - RNA, 19 nt, Homo sapiens
gacagaggcuuaucaacac

SEQ ID NO: 210532 - RNA, 19 nt, Homo sapiens
agaggagucuaugcuauuu

SEQ ID NO: 210533 - RNA, 19 nt, Homo sapiens
acugaucucucgugauuga

SEQ ID NO: 210534 - RNA, 19 nt, Homo sapiens
ugaguucuguuacaaguca

SEQ ID NO: 210535 - RNA, 19 nt, Homo sapiens
caucgaaagugcugaggau

SEQ ID NO: 210536 - RNA, 19 nt, Homo sapiens
gaaacacaaaguagugaau

SEQ ID NO: 210537 - RNA, 19 nt, Homo sapiens
ggaagguuacaacguauau

SEQ ID NO: 210538 - RNA, 19 nt, Homo sapiens
aacaaauggugguacgaua

SEQ ID NO: 210539 - RNA, 19 nt, Homo sapiens
agggaaauaugccuacuug

SEQ ID NO: 210540 - RNA, 19 nt, Homo sapiens
ggaaguccaaagggaaaua

SEQ ID NO: 210541 - RNA, 19 nt, Homo sapiens
gugcuaaauugcugucuca

SEQ ID NO: 210542 - RNA, 19 nt, Homo sapiens
uauugcaauugcuccauua

SEQ ID NO: 210543 - RNA, 19 nt, Homo sapiens
aaguacaaguugacaauug

SEQ ID NO: 210544 - RNA, 19 nt, Homo sapiens
cuaaggaagcaaagaauug

SEQ ID NO: 210545 - RNA, 19 nt, Homo sapiens
caaguuugcauaccucuau

SEQ ID NO: 210546 - RNA, 19 nt, Homo sapiens
gaacgaguaugaaagguuu

SEQ ID NO: 210547 - RNA, 19 nt, Homo sapiens
ggaaggaaaugaacgauau

SEQ ID NO: 210548 - RNA, 19 nt, Homo sapiens
gcaugaaacucacaaagaa

SEQ ID NO: 210549 - RNA, 19 nt, Homo sapiens
ucagacagcugcauuguaa

SEQ ID NO: 210550 - RNA, 19 nt, Homo sapiens
ggacguaggacaaauuaua

SEQ ID NO: 210551 - RNA, 19 nt, Homo sapiens
gugaagaagucauagauuu

SEQ ID NO: 210552 - RNA, 19 nt, Homo sapiens
uaaaggacguccaagaauu

SEQ ID NO: 210553 - RNA, 19 nt, Homo sapiens
agagagugcugaagacuua

SEQ ID NO: 210554 - RNA, 19 nt, Homo sapiens
ugaaauagccaaacaugua

SEQ ID NO: 210555 - RNA, 19 nt, Homo sapiens
gaaauagccaaacauguaa

SEQ ID NO: 210556 - RNA, 19 nt, Homo sapiens
gcaaggaugugauauuucu

SEQ ID NO: 210557 - RNA, 19 nt, Homo sapiens
cagcaaggaugugauauuu

SEQ ID NO: 210558 - RNA, 19 nt, Homo sapiens
gaugaaaguugguggaaau

SEQ ID NO: 210559 - RNA, 19 nt, Homo sapiens
uaaagaagccucagaaauc

SEQ ID NO: 210560 - RNA, 19 nt, Homo sapiens
agaccuagccuaugaaaua

SEQ ID NO: 210561 - RNA, 19 nt, Homo sapiens
caaaacaacuggcaaguaa

SEQ ID NO: 210562 - RNA, 19 nt, Homo sapiens
gaagaaacaggauggcuuu

SEQ ID NO: 210563 - RNA, 19 nt, Homo sapiens
gggaaacacucaagagguu

SEQ ID NO: 210564 - RNA, 19 nt, Homo sapiens
gagccaacauuacagguuu

SEQ ID NO: 210565 - RNA, 19 nt, Homo sapiens
ccaccaacacucagaauua

SEQ ID NO: 210566 - RNA, 19 nt, Homo sapiens
gaugguggcuuugauagaa

SEQ ID NO: 210567 - RNA, 19 nt, Homo sapiens
gaaaagcgauacuugauug

SEQ ID NO: 210568 - RNA, 19 nt, Homo sapiens
gaagggcgcuauucugagu

SEQ ID NO: 210569 - RNA, 19 nt, Homo sapiens
ggaaucaccauauguaaug

SEQ ID NO: 210570 - RNA, 19 nt, Homo sapiens
gaaaguugguggaaaucug

SEQ ID NO: 210571 - RNA, 19 nt, Homo sapiens
ccacguagaucacuuggau

SEQ ID NO: 210572 - RNA, 19 nt, Homo sapiens
gaccagaugucaaugaaca

SEQ ID NO: 210573 - RNA, 19 nt, Homo sapiens
uguaagagccagcgaauaa

SEQ ID NO: 210574 - RNA, 19 nt, Homo sapiens
ggagagagaagaagaggaa

SEQ ID NO: 210575 - RNA, 19 nt, Homo sapiens
caagggauccagagacuaa

SEQ ID NO: 210576 - RNA, 19 nt, Homo sapiens
cugcacacauccuuuguua

SEQ ID NO: 210577 - RNA, 19 nt, Homo sapiens
caaauuauaccaucgaugu

SEQ ID NO: 210578 - RNA, 19 nt, Homo sapiens
gggcaucuccaucaugaua

SEQ ID NO: 210579 - RNA, 19 nt, Homo sapiens
cgaaaggauuaacacaauu

SEQ ID NO: 210580 - RNA, 19 nt, Homo sapiens
aaagaagccucagaaauca

SEQ ID NO: 210581 - RNA, 19 nt, Homo sapiens
guauacaucugcauugaca

SEQ ID NO: 210582 - RNA, 19 nt, Homo sapiens
aggaaugacuggaaauauu

SEQ ID NO: 210583 - RNA, 19 nt, Homo sapiens
cgaauaagagagagaguaa

SEQ ID NO: 210584 - RNA, 19 nt, Homo sapiens
gaauucaggcgcaucauug

SEQ ID NO: 210585 - RNA, 19 nt, Homo sapiens
guguagaccuagccuauga

SEQ ID NO: 210586 - RNA, 19 nt, Homo sapiens
cauuacagguuuccagauu

SEQ ID NO: 210587 - RNA, 19 nt, Homo sapiens
ugacgcagaugugcaguuu

SEQ ID NO: 210588 - RNA, 19 nt, Homo sapiens
agacugaaauugcauaugg

SEQ ID NO: 210589 - RNA, 19 nt, Homo sapiens
ggaaaugaacgauaugaag

SEQ ID NO: 210590 - RNA, 19 nt, Homo sapiens
ggucauagcagaagcuuuc

SEQ ID NO: 210591 - RNA, 19 nt, Homo sapiens
cagagaguguuaagaucua

SEQ ID NO: 210592 - RNA, 19 nt, Homo sapiens
ggaagacaacaaugaagaa

SEQ ID NO: 210593 - RNA, 19 nt, Homo sapiens
ggagucagcguaguucuuu

SEQ ID NO: 210594 - RNA, 19 nt, Homo sapiens
gauaaagaagccucagaaa

SEQ ID NO: 210595 - RNA, 19 nt, Homo sapiens
gcaucuccaucaugauaaa

SEQ ID NO: 210596 - RNA, 19 nt, Homo sapiens
gagaagaagaggaagaaga

SEQ ID NO: 210597 - RNA, 19 nt, Homo sapiens
ccauuugaauuaccacgua

SEQ ID NO: 210598 - RNA, 19 nt, Homo sapiens
cgauguguaugaaaugaaa

SEQ ID NO: 210599 - RNA, 19 nt, Homo sapiens
cauaaaggacguccaagaa

SEQ ID NO: 210600 - RNA, 19 nt, Homo sapiens
ugacacagaacgaggauuu

SEQ ID NO: 210601 - RNA, 19 nt, Homo sapiens
guaccucuaugacacagaa

SEQ ID NO: 210602 - RNA, 19 nt, Homo sapiens
gcggagccaucuguguuua

SEQ ID NO: 210603 - RNA, 19 nt, Homo sapiens
caaggaaugacuggaaaua

SEQ ID NO: 210604 - RNA, 19 nt, Homo sapiens
guacaaggaaugacuggaa

SEQ ID NO: 210605 - RNA, 19 nt, Homo sapiens
gaaugcaccacuaaaguau

SEQ ID NO: 210606 - RNA, 19 nt, Homo sapiens
ucgaaaggauuaacacaau

SEQ ID NO: 210607 - RNA, 19 nt, Homo sapiens
uaaacagacugaaauugca

SEQ ID NO: 210608 - RNA, 19 nt, Homo sapiens
gcagcaaggaugugauauu

SEQ ID NO: 210609 - RNA, 19 nt, Homo sapiens
uaacauugguccgugaaga

SEQ ID NO: 210610 - RNA, 19 nt, Homo sapiens
uaugaaggcuauuguguag

SEQ ID NO: 210611 - RNA, 19 nt, Homo sapiens
ugaacgauaugaaggcuau

SEQ ID NO: 210612 - RNA, 19 nt, Homo sapiens
agagugagcgagcaaguua

SEQ ID NO: 210613 - RNA, 19 nt, Homo sapiens
gagaggaaaucaccgaaaa

SEQ ID NO: 210614 - RNA, 19 nt, Homo sapiens
gcacuuggaagacaacaau

SEQ ID NO: 210615 - RNA, 19 nt, Homo sapiens
ggaacagguugugauccua

SEQ ID NO: 210616 - RNA, 19 nt, Homo sapiens
gcuuugccgugcaguuaua

SEQ ID NO: 210617 - RNA, 19 nt, Homo sapiens
agucaaccaugaaugagua

SEQ ID NO: 210618 - RNA, 19 nt, Homo sapiens
agacuuagcuaaacagacu

SEQ ID NO: 210619 - RNA, 19 nt, Homo sapiens
gaauggcacuuggaagaca

SEQ ID NO: 210620 - RNA, 19 nt, Homo sapiens
caccaacacucagaauuau

SEQ ID NO: 210621 - RNA, 19 nt, Homo sapiens
gacagugcauccucagaga

SEQ ID NO: 210622 - RNA, 19 nt, Homo sapiens
gaaaucuggaugugcauug

SEQ ID NO: 210623 - RNA, 19 nt, Homo sapiens
ccacuaaaguauacaucug

SEQ ID NO: 210624 - RNA, 19 nt, Homo sapiens
agaaugcaccacuaaagua

SEQ ID NO: 210625 - RNA, 19 nt, Homo sapiens
ggaaacacucaagagguua

SEQ ID NO: 210626 - RNA, 19 nt, Homo sapiens
gagagaagaagaggaagaa

SEQ ID NO: 210627 - RNA, 19 nt, Homo sapiens
ggacuccgguucaacaaaa

SEQ ID NO: 210628 - RNA, 19 nt, Homo sapiens
gauaugaaggcuauugugu

SEQ ID NO: 210629 - RNA, 19 nt, Homo sapiens
gagaaucggaccauaguag

SEQ ID NO: 210630 - RNA, 19 nt, Homo sapiens
ugaauuaccacguagauca

SEQ ID NO: 210631 - RNA, 19 nt, Homo sapiens
gaaaguccaagggaaaguu

SEQ ID NO: 210632 - RNA, 19 nt, Homo sapiens
gagaaaauguggucuuaca

SEQ ID NO: 210633 - RNA, 19 nt, Homo sapiens
uguaagagccagcgaauuc

SEQ ID NO: 210634 - RNA, 19 nt, Homo sapiens
ggaacgaguaugaaagguu

SEQ ID NO: 210635 - RNA, 19 nt, Homo sapiens
gcccuggagucaaggaauu

SEQ ID NO: 210636 - RNA, 19 nt, Homo sapiens
ccacaaaguccuccugauc

SEQ ID NO: 210637 - RNA, 19 nt, Homo sapiens
gcaacuggaaggaaaugaa

SEQ ID NO: 210638 - RNA, 19 nt, Homo sapiens
ggacaaauuauaccaucga

SEQ ID NO: 210639 - RNA, 19 nt, Homo sapiens
gcacacauccuuuguuacg

SEQ ID NO: 210640 - RNA, 19 nt, Homo sapiens
uaaaggcucagcauuagga

SEQ ID NO: 210641 - RNA, 19 nt, Homo sapiens
gaucagcaaaucagcaaug

SEQ ID NO: 210642 - RNA, 19 nt, Homo sapiens
uacaaggaaugacuggaaa

SEQ ID NO: 210643 - RNA, 19 nt, Homo sapiens
gaaacacucaagagguuau

SEQ ID NO: 210644 - RNA, 19 nt, Homo sapiens
gaaaucagcggagccaucu

SEQ ID NO: 210645 - RNA, 19 nt, Homo sapiens
gcucuugucagcuucguuu

SEQ ID NO: 210646 - RNA, 19 nt, Homo sapiens
gaacgaguaugaaagguuu

SEQ ID NO: 210647 - RNA, 19 nt, Homo sapiens
ggaaggaaaugaacgauau

SEQ ID NO: 210648 - RNA, 19 nt, Homo sapiens
gcaugaaacucacaaagaa

SEQ ID NO: 210649 - RNA, 19 nt, Homo sapiens
ggacguaggacaaauuaua

SEQ ID NO: 210650 - RNA, 19 nt, Homo sapiens
gugaagaagucauagauuu

SEQ ID NO: 210651 - RNA, 19 nt, Homo sapiens
uaaaggacguccaagaauu

SEQ ID NO: 210652 - RNA, 19 nt, Homo sapiens
gcaaugaccuuucaauagg

SEQ ID NO: 210653 - RNA, 19 nt, Homo sapiens
agagagugcugaagacuua

SEQ ID NO: 210654 - RNA, 19 nt, Homo sapiens
ugaaauagccaaacaugua

SEQ ID NO: 210655 - RNA, 19 nt, Homo sapiens
gaaauagccaaacauguaa

SEQ ID NO: 210656 - RNA, 19 nt, Homo sapiens
gaacaaggcaucuuagaca

SEQ ID NO: 210657 - RNA, 19 nt, Homo sapiens
gcaaggaugugauauuucu

SEQ ID NO: 210658 - RNA, 19 nt, Homo sapiens
cagcaaggaugugauauuu

SEQ ID NO: 210659 - RNA, 19 nt, Homo sapiens
gaugaaaguugguggaaau

SEQ ID NO: 210660 - RNA, 19 nt, Homo sapiens
uaaagaagccucagaaauc

SEQ ID NO: 210661 - RNA, 19 nt, Homo sapiens
agaccuagccuaugaaaua

SEQ ID NO: 210662 - RNA, 19 nt, Homo sapiens
caaaacaacuggcaaguaa

SEQ ID NO: 210663 - RNA, 19 nt, Homo sapiens
gggaaacacucaagagguu

SEQ ID NO: 210664 - RNA, 19 nt, Homo sapiens
gagccaacauuacagguuu

SEQ ID NO: 210665 - RNA, 19 nt, Homo sapiens
ccaccaacacucagaauua

SEQ ID NO: 210666 - RNA, 19 nt, Homo sapiens
gaugguggcuuugauagaa

SEQ ID NO: 210667 - RNA, 19 nt, Homo sapiens
gaaaagcgauacuugauug

SEQ ID NO: 210668 - RNA, 19 nt, Homo sapiens
gaagggcgcuauucugagu

SEQ ID NO: 210669 - RNA, 19 nt, Homo sapiens
ggaaucaccauauguaaug

SEQ ID NO: 210670 - RNA, 19 nt, Homo sapiens
gaaaguugguggaaaucug

SEQ ID NO: 210671 - RNA, 19 nt, Homo sapiens
ccacguagaucacuuggau

SEQ ID NO: 210672 - RNA, 19 nt, Homo sapiens
gaccagaugucaaugaaca

SEQ ID NO: 210673 - RNA, 19 nt, Homo sapiens
caagggauccagagacuaa

SEQ ID NO: 210674 - RNA, 19 nt, Homo sapiens
cugcacacauccuuuguua

SEQ ID NO: 210675 - RNA, 19 nt, Homo sapiens
caaauuauaccaucgaugu

SEQ ID NO: 210676 - RNA, 19 nt, Homo sapiens
gggcaucuccaucaugaua

SEQ ID NO: 210677 - RNA, 19 nt, Homo sapiens
cgaaaggauuaacacaauu

SEQ ID NO: 210678 - RNA, 19 nt, Homo sapiens
aaagaagccucagaaauca

SEQ ID NO: 210679 - RNA, 19 nt, Homo sapiens
guauacaucugcauugaca

SEQ ID NO: 210680 - RNA, 19 nt, Homo sapiens
gaagaaccaugagcaacug

SEQ ID NO: 210681 - RNA, 19 nt, Homo sapiens
aggaaugacuggaaauauu

SEQ ID NO: 210682 - RNA, 19 nt, Homo sapiens
gaauucaggcgcaucauug

SEQ ID NO: 210683 - RNA, 19 nt, Homo sapiens
gggcaugacacgaauauug

SEQ ID NO: 210684 - RNA, 19 nt, Homo sapiens
guguagaccuagccuauga

SEQ ID NO: 210685 - RNA, 19 nt, Homo sapiens
cauuacagguuuccagauu

SEQ ID NO: 210686 - RNA, 19 nt, Homo sapiens
ugacgcagaugugcaguuu

SEQ ID NO: 210687 - RNA, 19 nt, Homo sapiens
agacugaaauugcauaugg

SEQ ID NO: 210688 - RNA, 19 nt, Homo sapiens
ggaaaugaacgauaugaag

SEQ ID NO: 210689 - RNA, 19 nt, Homo sapiens
ggucauagcagaagcuuuc

SEQ ID NO: 210690 - RNA, 19 nt, Homo sapiens
cagagaguguuaagaucua

SEQ ID NO: 210691 - RNA, 19 nt, Homo sapiens
ggaagacaacaaugaagaa

SEQ ID NO: 210692 - RNA, 19 nt, Homo sapiens
ggagucagcguaguucuuu

SEQ ID NO: 210693 - RNA, 19 nt, Homo sapiens
gauaaagaagccucagaaa

SEQ ID NO: 210694 - RNA, 19 nt, Homo sapiens
gcaucuccaucaugauaaa

SEQ ID NO: 210695 - RNA, 19 nt, Homo sapiens
ccauuugaauuaccacgua

SEQ ID NO: 210696 - RNA, 19 nt, Homo sapiens
cgauguguaugaaaugaaa

SEQ ID NO: 210697 - RNA, 19 nt, Homo sapiens
cauaaaggacguccaagaa

SEQ ID NO: 210698 - RNA, 19 nt, Homo sapiens
ugacacagaacgaggauuu

SEQ ID NO: 210699 - RNA, 19 nt, Homo sapiens
guaccucuaugacacagaa

SEQ ID NO: 210700 - RNA, 19 nt, Homo sapiens
gcggagccaucuguguuua

SEQ ID NO: 210701 - RNA, 19 nt, Homo sapiens
caaggaaugacuggaaaua

SEQ ID NO: 210702 - RNA, 19 nt, Homo sapiens
guacaaggaaugacuggaa

SEQ ID NO: 210703 - RNA, 19 nt, Homo sapiens
gaaugcaccacuaaaguau

SEQ ID NO: 210704 - RNA, 19 nt, Homo sapiens
ucgaaaggauuaacacaau

SEQ ID NO: 210705 - RNA, 19 nt, Homo sapiens
uaaacagacugaaauugca

SEQ ID NO: 210706 - RNA, 19 nt, Homo sapiens
gcagcaaggaugugauauu

SEQ ID NO: 210707 - RNA, 19 nt, Homo sapiens
uaacauugguccgugaaga

SEQ ID NO: 210708 - RNA, 19 nt, Homo sapiens
uaugaaggcuauuguguag

SEQ ID NO: 210709 - RNA, 19 nt, Homo sapiens
ugaacgauaugaaggcuau

SEQ ID NO: 210710 - RNA, 19 nt, Homo sapiens
gugcaaugaccuuucaaua

SEQ ID NO: 210711 - RNA, 19 nt, Homo sapiens
gagaggaaaucaccgaaaa

SEQ ID NO: 210712 - RNA, 19 nt, Homo sapiens
gcacuuggaagacaacaau

SEQ ID NO: 210713 - RNA, 19 nt, Homo sapiens
ggaacagguugugauccua

SEQ ID NO: 210714 - RNA, 19 nt, Homo sapiens
gcuuugccgugcaguuaua

SEQ ID NO: 210715 - RNA, 19 nt, Homo sapiens
agucaaccaugaaugagua

SEQ ID NO: 210716 - RNA, 19 nt, Homo sapiens
agacuuagcuaaacagacu

SEQ ID NO: 210717 - RNA, 19 nt, Homo sapiens
gaauggcacuuggaagaca

SEQ ID NO: 210718 - RNA, 19 nt, Homo sapiens
caccaacacucagaauuau

SEQ ID NO: 210719 - RNA, 19 nt, Homo sapiens
uguaaaccuugcaguauug

SEQ ID NO: 210720 - RNA, 19 nt, Homo sapiens
gacagugcauccucagaga

SEQ ID NO: 210721 - RNA, 19 nt, Homo sapiens
gcauuaggaacgccuguaa

SEQ ID NO: 210722 - RNA, 19 nt, Homo sapiens
gaaaucuggaugugcauug

SEQ ID NO: 210723 - RNA, 19 nt, Homo sapiens
ccacuaaaguauacaucug

SEQ ID NO: 210724 - RNA, 19 nt, Homo sapiens
agaaugcaccacuaaagua

SEQ ID NO: 210725 - RNA, 19 nt, Homo sapiens
ggaaacacucaagagguua

SEQ ID NO: 210726 - RNA, 19 nt, Homo sapiens
ggacuccgguucaacaaaa

SEQ ID NO: 210727 - RNA, 19 nt, Homo sapiens
gauaugaaggcuauugugu

SEQ ID NO: 210728 - RNA, 19 nt, Homo sapiens
gagaaucggaccauaguag

SEQ ID NO: 210729 - RNA, 19 nt, Homo sapiens
ugaauuaccacguagauca

SEQ ID NO: 210730 - RNA, 19 nt, Homo sapiens
gaaaguccaagggaaaguu

SEQ ID NO: 210731 - RNA, 19 nt, Homo sapiens
gagaaaauguggucuuaca

SEQ ID NO: 210732 - RNA, 19 nt, Homo sapiens
ggaacgaguaugaaagguu

SEQ ID NO: 210733 - RNA, 19 nt, Homo sapiens
gcccuggagucaaggaauu

SEQ ID NO: 210734 - RNA, 19 nt, Homo sapiens
aacaaauggugguacgaua

SEQ ID NO: 210735 - RNA, 19 nt, Homo sapiens
ccacaaaguccuccugauc

SEQ ID NO: 210736 - RNA, 19 nt, Homo sapiens
gcaacuggaaggaaaugaa

SEQ ID NO: 210737 - RNA, 19 nt, Homo sapiens
ggacaaauuauaccaucga

SEQ ID NO: 210738 - RNA, 19 nt, Homo sapiens
gcacacauccuuuguuacg

SEQ ID NO: 210739 - RNA, 19 nt, Homo sapiens
caaugaccuuucaauagga

SEQ ID NO: 210740 - RNA, 19 nt, Homo sapiens
acaaauggugguacgauaa

SEQ ID NO: 210741 - RNA, 19 nt, Homo sapiens
uaaaggcucagcauuagga

SEQ ID NO: 210742 - RNA, 19 nt, Homo sapiens
gaucagcaaaucagcaaug

SEQ ID NO: 210743 - RNA, 19 nt, Homo sapiens
uacaaggaaugacuggaaa

SEQ ID NO: 210744 - RNA, 19 nt, Homo sapiens
gaaacacucaagagguuau

SEQ ID NO: 210745 - RNA, 19 nt, Homo sapiens
cuguaaaccuugcaguauu

SEQ ID NO: 210746 - RNA, 19 nt, Homo sapiens
gcaaauagguggucucuuc

SEQ ID NO: 210747 - RNA, 19 nt, Homo sapiens
ggaaugauauggauaaguu

SEQ ID NO: 210748 - RNA, 19 nt, Homo sapiens
gauaagaggucgguacaua

SEQ ID NO: 210749 - RNA, 19 nt, Homo sapiens
guuaaaggcuaccauuaua

SEQ ID NO: 210750 - RNA, 19 nt, Homo sapiens
gcccaaggguuccucauua

SEQ ID NO: 210751 - RNA, 19 nt, Homo sapiens
gaacagaacagugguugua

SEQ ID NO: 210752 - RNA, 19 nt, Homo sapiens
gagaagaaguuuguaauag

SEQ ID NO: 210753 - RNA, 19 nt, Homo sapiens
aaacagaaauugccuaugg

SEQ ID NO: 210754 - RNA, 19 nt, Homo sapiens
uuacauaucucccucauca

SEQ ID NO: 210755 - RNA, 19 nt, Homo sapiens
ugaaggaaaugacaaguau

SEQ ID NO: 210756 - RNA, 19 nt, Homo sapiens
cagaagaccuggccaaaca

SEQ ID NO: 210757 - RNA, 19 nt, Homo sapiens
gggcauaucuaucaugauc

SEQ ID NO: 210758 - RNA, 19 nt, Homo sapiens
gaaggauacuguguagauu

SEQ ID NO: 210759 - RNA, 19 nt, Homo sapiens
guacauaccuugaccucau

SEQ ID NO: 210760 - RNA, 19 nt, Homo sapiens
gacagggaauguucaguuu

SEQ ID NO: 210761 - RNA, 19 nt, Homo sapiens
uguaauagacugugagaua

SEQ ID NO: 210762 - RNA, 19 nt, Homo sapiens
gagccaauguuacuggauu

SEQ ID NO: 210763 - RNA, 19 nt, Homo sapiens
uagaagaacuugacagaag

SEQ ID NO: 210764 - RNA, 19 nt, Homo sapiens
gcaacuaagaccuucguua

SEQ ID NO: 210765 - RNA, 19 nt, Homo sapiens
gaaacacagaucaggaaua

SEQ ID NO: 210766 - RNA, 19 nt, Homo sapiens
gaaugaagcugaccuuuuc

SEQ ID NO: 210767 - RNA, 19 nt, Homo sapiens
gcauaucuaucaugaucaa

SEQ ID NO: 210768 - RNA, 19 nt, Homo sapiens
uaggagaacuuguuuaugg

SEQ ID NO: 210769 - RNA, 19 nt, Homo sapiens
ccucugcucugacuuauga

SEQ ID NO: 210770 - RNA, 19 nt, Homo sapiens
gaagacaagagaagaaguu

SEQ ID NO: 210771 - RNA, 19 nt, Homo sapiens
gguguuuggugguucuuua

SEQ ID NO: 210772 - RNA, 19 nt, Homo sapiens
gaucugagacuccuccaaa

SEQ ID NO: 210773 - RNA, 19 nt, Homo sapiens
uagaacagauuguaagugu

SEQ ID NO: 210774 - RNA, 19 nt, Homo sapiens
gaagaaguuuguaauagac

SEQ ID NO: 210775 - RNA, 19 nt, Homo sapiens
gcaggcgucuucuacauuc

SEQ ID NO: 210776 - RNA, 19 nt, Homo sapiens
ugacacagcugcuauugag

SEQ ID NO: 210777 - RNA, 19 nt, Homo sapiens
guaauagacugugagauag

SEQ ID NO: 210778 - RNA, 19 nt, Homo sapiens
gaagaaacuagaucagaga

SEQ ID NO: 210779 - RNA, 19 nt, Homo sapiens
caagagaagaaguuuguaa

SEQ ID NO: 210780 - RNA, 19 nt, Homo sapiens
gaacugcaaucagacaaag

SEQ ID NO: 210781 - RNA, 19 nt, Homo sapiens
cagggaauguucaguuuga

SEQ ID NO: 210782 - RNA, 19 nt, Homo sapiens
ggacguagagucaauuaca

SEQ ID NO: 210783 - RNA, 19 nt, Homo sapiens
cagacaaaguucaggauug

SEQ ID NO: 210784 - RNA, 19 nt, Homo sapiens
caaugaguuuggcaucuuu

SEQ ID NO: 210785 - RNA, 19 nt, Homo sapiens
guugguuacuggaaugaua

SEQ ID NO: 210786 - RNA, 19 nt, Homo sapiens
aaacacagaucaggaauac

SEQ ID NO: 210787 - RNA, 19 nt, Homo sapiens
ucaaacagguucgaauuca

SEQ ID NO: 210788 - RNA, 19 nt, Homo sapiens
gacuacagcugagggagua

SEQ ID NO: 210789 - RNA, 19 nt, Homo sapiens
gcagagccaucaguauuca

SEQ ID NO: 210790 - RNA, 19 nt, Homo sapiens
gaaaagauguggaccuaca

SEQ ID NO: 210791 - RNA, 19 nt, Homo sapiens
gaucaggaauacacugcuu

SEQ ID NO: 210792 - RNA, 19 nt, Homo sapiens
cagcagagccaucaguauu

SEQ ID NO: 210793 - RNA, 19 nt, Homo sapiens
guuaguagauuuaguccau

SEQ ID NO: 210794 - RNA, 19 nt, Homo sapiens
ucuaagcccuucaugaguu

SEQ ID NO: 210795 - RNA, 19 nt, Homo sapiens
gacaaucacuuugguacga

SEQ ID NO: 210796 - RNA, 19 nt, Homo sapiens
caaacagguucgaauucaa

SEQ ID NO: 210797 - RNA, 19 nt, Homo sapiens
gcaaauccaagggcaaauu

SEQ ID NO: 210798 - RNA, 19 nt, Homo sapiens
cugcuaaccuggcugcuuu

SEQ ID NO: 210799 - RNA, 19 nt, Homo sapiens
gguaggagaacuuguuuau

SEQ ID NO: 210800 - RNA, 19 nt, Homo sapiens
caugaaauguuugaaggaa

SEQ ID NO: 210801 - RNA, 19 nt, Homo sapiens
cuugagagguuuauacaug

SEQ ID NO: 210802 - RNA, 19 nt, Homo sapiens
uggcaaugcugguggcuuu

SEQ ID NO: 210803 - RNA, 19 nt, Homo sapiens
agaagaacuugacagaaga

SEQ ID NO: 210804 - RNA, 19 nt, Homo sapiens
ccaguauucuagaggagua

SEQ ID NO: 210805 - RNA, 19 nt, Homo sapiens
gcagaaaauugauaucuca

SEQ ID NO: 210806 - RNA, 19 nt, Homo sapiens
caacuaagaccuucguuac

SEQ ID NO: 210807 - RNA, 19 nt, Homo sapiens
caaauggugguacgauaaa

SEQ ID NO: 210808 - RNA, 19 nt, Homo sapiens
cccaaggguuccucauuaa

SEQ ID NO: 210809 - RNA, 19 nt, Homo sapiens
gaagaccuggccaaacaaa

SEQ ID NO: 210810 - RNA, 19 nt, Homo sapiens
gcgaccagccucccaauga

SEQ ID NO: 210811 - RNA, 19 nt, Homo sapiens
cauagucuuugccuacauu

SEQ ID NO: 210812 - RNA, 19 nt, Homo sapiens
uaaccacaauuauggaauc

SEQ ID NO: 210813 - RNA, 19 nt, Homo sapiens
gcaaugacacagcugcuau

SEQ ID NO: 210814 - RNA, 19 nt, Homo sapiens
gauuguaaguguuggaaag

SEQ ID NO: 210815 - RNA, 19 nt, Homo sapiens
ggaaaugacaaguaugaag

SEQ ID NO: 210816 - RNA, 19 nt, Homo sapiens
uagagucaauuacacaaug

SEQ ID NO: 210817 - RNA, 19 nt, Homo sapiens
aaagccagauuauccauca

SEQ ID NO: 210818 - RNA, 19 nt, Homo sapiens
aaacaaagccagauuaucc

SEQ ID NO: 210819 - RNA, 19 nt, Homo sapiens
gcagaagcgaagagaauga

SEQ ID NO: 210820 - RNA, 19 nt, Homo sapiens
guacaccucugcucugacu

SEQ ID NO: 210821 - RNA, 19 nt, Homo sapiens
aagaaacaaagccagauua

SEQ ID NO: 210822 - RNA, 19 nt, Homo sapiens
caaggguuccucauuaaga

SEQ ID NO: 210823 - RNA, 19 nt, Homo sapiens
gaaagugggaggaaaucug

SEQ ID NO: 210824 - RNA, 19 nt, Homo sapiens
ccucucaggucgaauuguu

SEQ ID NO: 210825 - RNA, 19 nt, Homo sapiens
gaugguaggagaacuuguu

SEQ ID NO: 210826 - RNA, 19 nt, Homo sapiens
cuagaaagguugguuacug

SEQ ID NO: 210827 - RNA, 19 nt, Homo sapiens
gagauagagagacuucaaa

SEQ ID NO: 210828 - RNA, 19 nt, Homo sapiens
uuaaugaugucagcuauag

SEQ ID NO: 210829 - RNA, 19 nt, Homo sapiens
gaauggaacuguuuugucu

SEQ ID NO: 210830 - RNA, 19 nt, Homo sapiens
gggcagaagcgaagagaau

SEQ ID NO: 210831 - RNA, 19 nt, Homo sapiens
caauguagcaggcgucuuc

SEQ ID NO: 210832 - RNA, 19 nt, Homo sapiens
aacaaauggugguacgaua

SEQ ID NO: 210833 - RNA, 19 nt, Homo sapiens
ucauuaagaacuccuguaa

SEQ ID NO: 210834 - RNA, 19 nt, Homo sapiens
gaaauugccuauggaacac

SEQ ID NO: 210835 - RNA, 19 nt, Homo sapiens
gaaacaaagccagauuauc

SEQ ID NO: 210836 - RNA, 19 nt, Homo sapiens
uaagaaacaaagccagauu

SEQ ID NO: 210837 - RNA, 19 nt, Homo sapiens
ugauagaguucuguuacaa

SEQ ID NO: 210838 - RNA, 19 nt, Homo sapiens
acaaauggugguacgauaa

SEQ ID NO: 210839 - RNA, 19 nt, Homo sapiens
guagauuuaguccauauga

SEQ ID NO: 210840 - RNA, 19 nt, Homo sapiens
caagggaugcagacacaaa

SEQ ID NO: 210841 - RNA, 19 nt, Homo sapiens
gaaagguugguuacuggaa

SEQ ID NO: 210842 - RNA, 19 nt, Homo sapiens
caugguggagccaauguua

SEQ ID NO: 210843 - RNA, 19 nt, Homo sapiens
caaaaugguuggcauguca

SEQ ID NO: 210844 - RNA, 19 nt, Homo sapiens
ggaacugcaaucagacaaa

SEQ ID NO: 210845 - RNA, 19 nt, Homo sapiens
gaugaaagugggaggaaau

SEQ ID NO: 210846 - RNA, 19 nt, Homo sapiens
caagaagccugugaacuua

SEQ ID NO: 210847 - RNA, 19 nt, Homo sapiens
guaagaaggucaauuggaa

SEQ ID NO: 210848 - RNA, 19 nt, Homo sapiens
gagcagauccagacucuua

SEQ ID NO: 210849 - RNA, 19 nt, Homo sapiens
uaggagaacuugucuuuaa

SEQ ID NO: 210850 - RNA, 19 nt, Homo sapiens
gacaagaaauuggagaaua

SEQ ID NO: 210851 - RNA, 19 nt, Homo sapiens
gcaagucugucauguauca

SEQ ID NO: 210852 - RNA, 19 nt, Homo sapiens
ggaauugcauuacaacaug

SEQ ID NO: 210853 - RNA, 19 nt, Homo sapiens
ucgaauaucuucaacauug

SEQ ID NO: 210854 - RNA, 19 nt, Homo sapiens
caacaacccuuuccaagca

SEQ ID NO: 210855 - RNA, 19 nt, Homo sapiens
ggaugcagcuguauuggaa

SEQ ID NO: 210856 - RNA, 19 nt, Homo sapiens
aaacagaaaucccuuaugg

SEQ ID NO: 210857 - RNA, 19 nt, Homo sapiens
gacugucacuggaucauua

SEQ ID NO: 210858 - RNA, 19 nt, Homo sapiens
ccaaauccuucauuacuga

SEQ ID NO: 210859 - RNA, 19 nt, Homo sapiens
cggcaaaccucgcugcuuu

SEQ ID NO: 210860 - RNA, 19 nt, Homo sapiens
uaagaguggucacagagua

SEQ ID NO: 210861 - RNA, 19 nt, Homo sapiens
caggaucccuccagucuuu

SEQ ID NO: 210862 - RNA, 19 nt, Homo sapiens
gacaagcacuggagcaaau

SEQ ID NO: 210863 - RNA, 19 nt, Homo sapiens
gaauggauguugcacuuca

SEQ ID NO: 210864 - RNA, 19 nt, Homo sapiens
ggaagaaccuuuugugaug

SEQ ID NO: 210865 - RNA, 19 nt, Homo sapiens
uaacaugcguggagugguu

SEQ ID NO: 210866 - RNA, 19 nt, Homo sapiens
gagaauagaagaacugaau

SEQ ID NO: 210867 - RNA, 19 nt, Homo sapiens
caacaggaaugaugacuac

SEQ ID NO: 210868 - RNA, 19 nt, Homo sapiens
cagcauguauucccaaaug

SEQ ID NO: 210869 - RNA, 19 nt, Homo sapiens
uguguaagccgaagaaaua

SEQ ID NO: 210870 - RNA, 19 nt, Homo sapiens
gagcgauccuuguuaugaa

SEQ ID NO: 210871 - RNA, 19 nt, Homo sapiens
gggaauggauguugcacuu

SEQ ID NO: 210872 - RNA, 19 nt, Homo sapiens
ugacuacacucucucaguu

SEQ ID NO: 210873 - RNA, 19 nt, Homo sapiens
gacauggaauggcuuggua

SEQ ID NO: 210874 - RNA, 19 nt, Homo sapiens
caagaaggguggaguuagu

SEQ ID NO: 210875 - RNA, 19 nt, Homo sapiens
cggcagacauuuccaauuc

SEQ ID NO: 210876 - RNA, 19 nt, Homo sapiens
ccugugaacuuaugaauca

SEQ ID NO: 210877 - RNA, 19 nt, Homo sapiens
ucaagaagccugugaacuu

SEQ ID NO: 210878 - RNA, 19 nt, Homo sapiens
gauauggaauugcauuaca

SEQ ID NO: 210879 - RNA, 19 nt, Homo sapiens
uaccagggcuucuccauug

SEQ ID NO: 210880 - RNA, 19 nt, Homo sapiens
cauagggauuucugcuuua

SEQ ID NO: 210881 - RNA, 19 nt, Homo sapiens
gguaggagaacuugucuuu

SEQ ID NO: 210882 - RNA, 19 nt, Homo sapiens
gaagaugggacauggaaug

SEQ ID NO: 210883 - RNA, 19 nt, Homo sapiens
gaaauuggagaauaacaug

SEQ ID NO: 210884 - RNA, 19 nt, Homo sapiens
gagcuagaauuuggagaaa

SEQ ID NO: 210885 - RNA, 19 nt, Homo sapiens
gaaggucaauuggaagguu

SEQ ID NO: 210886 - RNA, 19 nt, Homo sapiens
agacuaauuugguugcuuu

SEQ ID NO: 210887 - RNA, 19 nt, Homo sapiens
uguaguaacuguucuggaa

SEQ ID NO: 210888 - RNA, 19 nt, Homo sapiens
ugacccagauuguuccuuu

SEQ ID NO: 210889 - RNA, 19 nt, Homo sapiens
uggaauauguggcuaucua

SEQ ID NO: 210890 - RNA, 19 nt, Homo sapiens
auuggaagguuaacgauua

SEQ ID NO: 210891 - RNA, 19 nt, Homo sapiens
gaaaaugucuuguguaagc

SEQ ID NO: 210892 - RNA, 19 nt, Homo sapiens
uggcaagucugucauguau

SEQ ID NO: 210893 - RNA, 19 nt, Homo sapiens
uauccuggcugcuggaauu

SEQ ID NO: 210894 - RNA, 19 nt, Homo sapiens
gcuauuugcuuugauuguu

SEQ ID NO: 210895 - RNA, 19 nt, Homo sapiens
acauagggauuucugcuuu

SEQ ID NO: 210896 - RNA, 19 nt, Homo sapiens
acagccaaauccuucauua

SEQ ID NO: 210897 - RNA, 19 nt, Homo sapiens
caucgaauaucuucaacau

SEQ ID NO: 210898 - RNA, 19 nt, Homo sapiens
aaaggaugaugagguauuu

SEQ ID NO: 210899 - RNA, 19 nt, Homo sapiens
ugucaucuauuccuuauca

SEQ ID NO: 210900 - RNA, 19 nt, Homo sapiens
gaauuguccucuccugcuu

SEQ ID NO: 210901 - RNA, 19 nt, Homo sapiens
aaacuugggugcuggaauc

SEQ ID NO: 210902 - RNA, 19 nt, Homo sapiens
aauaaacgauguggacgua

SEQ ID NO: 210903 - RNA, 19 nt, Homo sapiens
gcaccgaacuggcccuuuu

SEQ ID NO: 210904 - RNA, 19 nt, Homo sapiens
gcaccuccauagacgugua

SEQ ID NO: 210905 - RNA, 19 nt, Homo sapiens
gcaaacagaaaucccuuau

SEQ ID NO: 210906 - RNA, 19 nt, Homo sapiens
uuacaaaugggaucaauga

SEQ ID NO: 210907 - RNA, 19 nt, Homo sapiens
gcaacaggaaugaugacua

SEQ ID NO: 210908 - RNA, 19 nt, Homo sapiens
cacaaaugguggccuaaga

SEQ ID NO: 210909 - RNA, 19 nt, Homo sapiens
cguaugggaugcagcugua

SEQ ID NO: 210910 - RNA, 19 nt, Homo sapiens
gcugcuuuccucacuauua

SEQ ID NO: 210911 - RNA, 19 nt, Homo sapiens
ucaaugacgucuacuacuc

SEQ ID NO: 210912 - RNA, 19 nt, Homo sapiens
cauuugaucucucucuaug

SEQ ID NO: 210913 - RNA, 19 nt, Homo sapiens
aaauuaugcuuucguaugg

SEQ ID NO: 210914 - RNA, 19 nt, Homo sapiens
cuacuggucuaccucuuga

SEQ ID NO: 210915 - RNA, 19 nt, Homo sapiens
gacuggagagcuagaauuu

SEQ ID NO: 210916 - RNA, 19 nt, Homo sapiens
gaucuuacagacugagaaa

SEQ ID NO: 210917 - RNA, 19 nt, Homo sapiens
gaauacaggaguucuugga

SEQ ID NO: 210918 - RNA, 19 nt, Homo sapiens
gagacgugguggaacaaga

SEQ ID NO: 210919 - RNA, 19 nt, Homo sapiens
aaagacaguggauauguuu

SEQ ID NO: 210920 - RNA, 19 nt, Homo sapiens
gucacuggaucauuauaaa

SEQ ID NO: 210921 - RNA, 19 nt, Homo sapiens
uaaccagaaugaagagauc

SEQ ID NO: 210922 - RNA, 19 nt, Homo sapiens
gccaaauccuucauuacug

SEQ ID NO: 210923 - RNA, 19 nt, Homo sapiens
ggacucacccggagcaaca

SEQ ID NO: 210924 - RNA, 19 nt, Homo sapiens
caaugucaucuauuccuua

SEQ ID NO: 210925 - RNA, 19 nt, Homo sapiens
gacagcauguauucccaaa

SEQ ID NO: 210926 - RNA, 19 nt, Homo sapiens
cuacuacucucuacaacuc

SEQ ID NO: 210927 - RNA, 19 nt, Homo sapiens
uaaacgauguggacguaca

SEQ ID NO: 210928 - RNA, 19 nt, Homo sapiens
ggcgagcgauccuuguuau

SEQ ID NO: 210929 - RNA, 19 nt, Homo sapiens
ucccaaauguggcggauga

SEQ ID NO: 210930 - RNA, 19 nt, Homo sapiens
ccuagacucugcgguauau

SEQ ID NO: 210931 - RNA, 19 nt, Homo sapiens
uagcaccggaucacaaaua

SEQ ID NO: 210932 - RNA, 19 nt, Homo sapiens
gaacuuguaagaaggucaa

SEQ ID NO: 210933 - RNA, 19 nt, Homo sapiens
gcaugauguuauccuaaga

SEQ ID NO: 210934 - RNA, 19 nt, Homo sapiens
ggaaugaugacuacacucu

SEQ ID NO: 210935 - RNA, 19 nt, Homo sapiens
ggagcaacaggaaugauga

SEQ ID NO: 210936 - RNA, 19 nt, Homo sapiens
gcucccggguuccaucaaa

SEQ ID NO: 210937 - RNA, 19 nt, Homo sapiens
gcaauggaucggagaacaa

SEQ ID NO: 210938 - RNA, 19 nt, Homo sapiens
gagagggacagcauguauu

SEQ ID NO: 210939 - RNA, 19 nt, Homo sapiens
ggaagguuaacgauuauuc

SEQ ID NO: 210940 - RNA, 19 nt, Homo sapiens
cuacuugcaugauguuauc

SEQ ID NO: 210941 - RNA, 19 nt, Homo sapiens
uucaggaacacucauauua

SEQ ID NO: 210942 - RNA, 19 nt, Homo sapiens
gggauauggaauugcauua

SEQ ID NO: 210943 - RNA, 19 nt, Homo sapiens
uuacacgcauugaaaguuc

SEQ ID NO: 210944 - RNA, 19 nt, Homo sapiens
guauggaucuuuuguacaa

SEQ ID NO: 210945 - RNA, 19 nt, Homo sapiens
gauuacaaaugggaucaau

SEQ ID NO: 210946 - RNA, 19 nt, Homo sapiens
ggacacuucugccaugaua

SEQ ID NO: 210947 - RNA, 19 nt, Homo sapiens
ccacggaccuccucacuaa

SEQ ID NO: 210948 - RNA, 19 nt, Homo sapiens
gaggugagcugcccagaug

SEQ ID NO: 210949 - RNA, 19 nt, Homo sapiens
guaagugccucuccaagga

SEQ ID NO: 210950 - RNA, 19 nt, Homo sapiens
ggacaguacugaagacucu

SEQ ID NO: 210951 - RNA, 19 nt, Homo sapiens
gcagaaggguaccugugaa

SEQ ID NO: 210952 - RNA, 19 nt, Homo sapiens
ccagagacaucggcuguga

SEQ ID NO: 210953 - RNA, 19 nt, Homo sapiens
ggccacuccugcaucuuua

SEQ ID NO: 210954 - RNA, 19 nt, Homo sapiens
ggacaaauggcccacaaca

SEQ ID NO: 210955 - RNA, 19 nt, Homo sapiens
gcgcgugugcguuucaaua

SEQ ID NO: 210956 - RNA, 19 nt, Homo sapiens
gggcgauccugcuuccaaa

SEQ ID NO: 210957 - RNA, 19 nt, Homo sapiens
gauaccugcugccaacuca

SEQ ID NO: 210958 - RNA, 19 nt, Homo sapiens
gcgugugcguuucaauaaa

SEQ ID NO: 210959 - RNA, 19 nt, Homo sapiens
ccaaagaucagguaacaac

SEQ ID NO: 210960 - RNA, 19 nt, Homo sapiens
ggacgcaggcagaccaugu

SEQ ID NO: 210961 - RNA, 19 nt, Homo sapiens
gaccugauccagaguaagu

SEQ ID NO: 210962 - RNA, 19 nt, Homo sapiens
uggcuggacuggagaagau

SEQ ID NO: 210963 - RNA, 19 nt, Homo sapiens
gagcugcccagauggcuau

SEQ ID NO: 210964 - RNA, 19 nt, Homo sapiens
gugcccagauggucaguuc

SEQ ID NO: 210965 - RNA, 19 nt, Homo sapiens
guucacacccgcugcauca

SEQ ID NO: 210966 - RNA, 19 nt, Homo sapiens
gugaccugauccagaguaa

SEQ ID NO: 210967 - RNA, 19 nt, Homo sapiens
ucucagggacuuccaguug

SEQ ID NO: 210968 - RNA, 19 nt, Homo sapiens
acaaauggcccacaacacu

SEQ ID NO: 210969 - RNA, 19 nt, Homo sapiens
gcguuucaauaaaguuugu

SEQ ID NO: 210970 - RNA, 19 nt, Homo sapiens
gggcgucuguugugcugau

SEQ ID NO: 210971 - RNA, 19 nt, Homo sapiens
cgugugcguuucaauaaag

SEQ ID NO: 210972 - RNA, 19 nt, Homo sapiens
gagggacccagccuugaga

SEQ ID NO: 210973 - RNA, 19 nt, Homo sapiens
agagagauguccccuguga

SEQ ID NO: 210974 - RNA, 19 nt, Homo sapiens
gcgauccugcuuccaaaga

SEQ ID NO: 210975 - RNA, 19 nt, Homo sapiens
cggccacuccugcaucuuu

SEQ ID NO: 210976 - RNA, 19 nt, Homo sapiens
uuccaaagaucagguaaca

SEQ ID NO: 210977 - RNA, 19 nt, Homo sapiens
gagcuggguggccuuaaca

SEQ ID NO: 210978 - RNA, 19 nt, Homo sapiens
gugcguuucaauaaaguuu

SEQ ID NO: 210979 - RNA, 19 nt, Homo sapiens
gcaaaagccacauuacaag

SEQ ID NO: 210980 - RNA, 19 nt, Homo sapiens
ggcaaaagccacauuacaa

SEQ ID NO: 210981 - RNA, 19 nt, Homo sapiens
ugagggacaguacugaaga

SEQ ID NO: 210982 - RNA, 19 nt, Homo sapiens
ggaggugagcugcccagau

SEQ ID NO: 210983 - RNA, 19 nt, Homo sapiens
gguugcugcugcccaagga

SEQ ID NO: 210984 - RNA, 19 nt, Homo sapiens
aaauggcccacaacacuga

SEQ ID NO: 210985 - RNA, 19 nt, Homo sapiens
gagggacaguacugaagac

SEQ ID NO: 210986 - RNA, 19 nt, Homo sapiens
agagauguccccugugaua

SEQ ID NO: 210987 - RNA, 19 nt, Homo sapiens
cgcagaaggguaccuguga

SEQ ID NO: 210988 - RNA, 19 nt, Homo sapiens
uaagcugccugcgcacaca

SEQ ID NO: 210989 - RNA, 19 nt, Homo sapiens
cgauccugcuuccaaagau

SEQ ID NO: 210990 - RNA, 19 nt, Homo sapiens
cgcgugugcguuucaauaa

SEQ ID NO: 210991 - RNA, 19 nt, Homo sapiens
ggugagcuggguggccuua

SEQ ID NO: 210992 - RNA, 19 nt, Homo sapiens
ggaagaagauugggauuug

SEQ ID NO: 210993 - RNA, 19 nt, Homo sapiens
gggcauaucaccuuuaaua

SEQ ID NO: 210994 - RNA, 19 nt, Homo sapiens
cagaauaguuggagggaua

SEQ ID NO: 210995 - RNA, 19 nt, Homo sapiens
ggaguucuaugugauauuu

SEQ ID NO: 210996 - RNA, 19 nt, Homo sapiens
gaagggaagcugcauauga

SEQ ID NO: 210997 - RNA, 19 nt, Homo sapiens
ucacaacccuggacuuauu

SEQ ID NO: 210998 - RNA, 19 nt, Homo sapiens
ggacugcaauguaagcaaa

SEQ ID NO: 210999 - RNA, 19 nt, Homo sapiens
gaagaacccuauguuaugu

SEQ ID NO: 211000 - RNA, 19 nt, Homo sapiens
ggaagaacccuauguuaug

SEQ ID NO: 211001 - RNA, 19 nt, Homo sapiens
ggaggcaucuucauuguuc

SEQ ID NO: 211002 - RNA, 19 nt, Homo sapiens
aaagacaaguccagcaaua

SEQ ID NO: 211003 - RNA, 19 nt, Homo sapiens
agagauggaucaacaauga

SEQ ID NO: 211004 - RNA, 19 nt, Homo sapiens
cuaaauaguuucugguuug

SEQ ID NO: 211005 - RNA, 19 nt, Homo sapiens
gcugggcacuccucuauuu

SEQ ID NO: 211006 - RNA, 19 nt, Homo sapiens
ugacagauuugaaggauau

SEQ ID NO: 211007 - RNA, 19 nt, Homo sapiens
ggacuuauuugcuuuggau

SEQ ID NO: 211008 - RNA, 19 nt, Homo sapiens
aaacaguccucaguucaua

SEQ ID NO: 211009 - RNA, 19 nt, Homo sapiens
gaucaacaaugaccuucuu

SEQ ID NO: 211010 - RNA, 19 nt, Homo sapiens
gcaaggaguucuaugugau

SEQ ID NO: 211011 - RNA, 19 nt, Homo sapiens
ucaaagcucccuccagaua

SEQ ID NO: 211012 - RNA, 19 nt, Homo sapiens
acaaaucacggaagaauaa

SEQ ID NO: 211013 - RNA, 19 nt, Homo sapiens
gagaagaugugggcuuuca

SEQ ID NO: 211014 - RNA, 19 nt, Homo sapiens
aaagcucccuccagauaua

SEQ ID NO: 211015 - RNA, 19 nt, Homo sapiens
gaagaagggaagcugcaua

SEQ ID NO: 211016 - RNA, 19 nt, Homo sapiens
gccuagaccuguugaaaga

SEQ ID NO: 211017 - RNA, 19 nt, Homo sapiens
ucaaggagaugaagaaagg

SEQ ID NO: 211018 - RNA, 19 nt, Homo sapiens
ucucgaaguuccacacaua

SEQ ID NO: 211019 - RNA, 19 nt, Homo sapiens
gaauuagcuuucaaguuug

SEQ ID NO: 211020 - RNA, 19 nt, Homo sapiens
caaucuggcugccuucuug

SEQ ID NO: 211021 - RNA, 19 nt, Homo sapiens
uaugacauccagagaauua

SEQ ID NO: 211022 - RNA, 19 nt, Homo sapiens
ggcaaggaguucuauguga

SEQ ID NO: 211023 - RNA, 19 nt, Homo sapiens
gguccuuucuguauuugua

SEQ ID NO: 211024 - RNA, 19 nt, Homo sapiens
gauauugccuagaccuguu

SEQ ID NO: 211025 - RNA, 19 nt, Homo sapiens
gguuagagauggaucaaca

SEQ ID NO: 211026 - RNA, 19 nt, Homo sapiens
uauaaaguguggaagaaga

SEQ ID NO: 211027 - RNA, 19 nt, Homo sapiens
uuaugaaccugaucaaaga

SEQ ID NO: 211028 - RNA, 19 nt, Homo sapiens
aaaccaagauagaauaugg

SEQ ID NO: 211029 - RNA, 19 nt, Homo sapiens
ccagauauuuggauguaug

SEQ ID NO: 211030 - RNA, 19 nt, Homo sapiens
gaaagaauugucaaacauc

SEQ ID NO: 211031 - RNA, 19 nt, Homo sapiens
gaagaaaggcaaggaguuc

SEQ ID NO: 211032 - RNA, 19 nt, Homo sapiens
uuuauggacugcaauguaa

SEQ ID NO: 211033 - RNA, 19 nt, Homo sapiens
ggagugggaacaccuauug

SEQ ID NO: 211034 - RNA, 19 nt, Homo sapiens
caacagaacacucauuguc

SEQ ID NO: 211035 - RNA, 19 nt, Homo sapiens
cagcugcccucugggaaua

SEQ ID NO: 211036 - RNA, 19 nt, Homo sapiens
cauccuggguuucauuuau

SEQ ID NO: 211037 - RNA, 19 nt, Homo sapiens
uacaagagcucaucaaagc

SEQ ID NO: 211038 - RNA, 19 nt, Homo sapiens
gaagaugugggcuuucaug

SEQ ID NO: 211039 - RNA, 19 nt, Homo sapiens
ucaccagcauuaacagaaa

SEQ ID NO: 211040 - RNA, 19 nt, Homo sapiens
aaaugagccuguuaauguu

SEQ ID NO: 211041 - RNA, 19 nt, Homo sapiens
gaggagagagggauucgaa

SEQ ID NO: 211042 - RNA, 19 nt, Homo sapiens
caaagcaaaccaagauaga

SEQ ID NO: 211043 - RNA, 19 nt, Homo sapiens
gcaaagcaaaccaagauag

SEQ ID NO: 211044 - RNA, 19 nt, Homo sapiens
caaggaguucuaugugaua

SEQ ID NO: 211045 - RNA, 19 nt, Homo sapiens
uggaucugguccucuauua

SEQ ID NO: 211046 - RNA, 19 nt, Homo sapiens
gaagcugcauaugaugaaa

SEQ ID NO: 211047 - RNA, 19 nt, Homo sapiens
gcaaaccaagauagaauau

SEQ ID NO: 211048 - RNA, 19 nt, Homo sapiens
ugauaagccucuauaugga

SEQ ID NO: 211049 - RNA, 19 nt, Homo sapiens
uuaagaagcuaggaagaug

SEQ ID NO: 211050 - RNA, 19 nt, Homo sapiens
agagagugcucaccacaga

SEQ ID NO: 211051 - RNA, 19 nt, Homo sapiens
caacaaugaccuucuucaa

SEQ ID NO: 211052 - RNA, 19 nt, Homo sapiens
ggagggauauggugguuuu

SEQ ID NO: 211053 - RNA, 19 nt, Homo sapiens
agucagcuguguacucuuu

SEQ ID NO: 211054 - RNA, 19 nt, Homo sapiens
gaagaagauugggauuugg

SEQ ID NO: 211055 - RNA, 19 nt, Homo sapiens
cgaggaagacaacaaagaa

SEQ ID NO: 211056 - RNA, 19 nt, Homo sapiens
agaccgcccugguaagaaa

SEQ ID NO: 211057 - RNA, 19 nt, Homo sapiens
gauaagccucuauauggaa

SEQ ID NO: 211058 - RNA, 19 nt, Homo sapiens
ucacggaagaauaaugaua

SEQ ID NO: 211059 - RNA, 19 nt, Homo sapiens
aagggaagcugcauaugau

SEQ ID NO: 211060 - RNA, 19 nt, Homo sapiens
cagcagaccgcccugguaa

SEQ ID NO: 211061 - RNA, 19 nt, Homo sapiens
gaucugguccucuauuaca

SEQ ID NO: 211062 - RNA, 19 nt, Homo sapiens
ccuaugacauccagagaau

SEQ ID NO: 211063 - RNA, 19 nt, Homo sapiens
gcagaccgcccugguaaga

SEQ ID NO: 211064 - RNA, 19 nt, Homo sapiens
ugucauccaucauugagaa

SEQ ID NO: 211065 - RNA, 19 nt, Homo sapiens
guacaguggcguaaacaug

SEQ ID NO: 211066 - RNA, 19 nt, Homo sapiens
gaaguuccacacauacaga

SEQ ID NO: 211067 - RNA, 19 nt, Homo sapiens
ugaaggauauugccuagac

SEQ ID NO: 211068 - RNA, 19 nt, Homo sapiens
gaaaucugauaagccucua

SEQ ID NO: 211069 - RNA, 19 nt, Homo sapiens
uugcaaugcucucgaaguu

SEQ ID NO: 211070 - RNA, 19 nt, Homo sapiens
ggaagcugcauaugaugaa

SEQ ID NO: 211071 - RNA, 19 nt, Homo sapiens
aaaaugagccuguuaaugu

SEQ ID NO: 211072 - RNA, 19 nt, Homo sapiens
gaaaggcaaggaguucuau

SEQ ID NO: 211073 - RNA, 19 nt, Homo sapiens
ucagugcugugcagucuau

SEQ ID NO: 211074 - RNA, 19 nt, Homo sapiens
uaacaccacauuaaccuau

SEQ ID NO: 211075 - RNA, 19 nt, Homo sapiens
gcagucaccagcauuaaca

SEQ ID NO: 211076 - RNA, 19 nt, Homo sapiens
uggaagaacccuauguuau

SEQ ID NO: 211077 - RNA, 19 nt, Homo sapiens
uguauaaaguguggaagaa

SEQ ID NO: 211078 - RNA, 19 nt, Homo sapiens
ugguguggcugcucucuuu

SEQ ID NO: 211079 - RNA, 19 nt, Homo sapiens
caacagugggcuuaacaug

SEQ ID NO: 211080 - RNA, 19 nt, Homo sapiens
caaagaggaaggaacugaa

SEQ ID NO: 211081 - RNA, 19 nt, Homo sapiens
gcagugccauagacauaag

SEQ ID NO: 211082 - RNA, 19 nt, Homo sapiens
gaagcccaaugguaccaau

SEQ ID NO: 211083 - RNA, 19 nt, Homo sapiens
ggcauaucaccuuuaauaa

SEQ ID NO: 211084 - RNA, 19 nt, Homo sapiens
ucacgugucauccaucauu

SEQ ID NO: 211085 - RNA, 19 nt, Homo sapiens
gcaugaugaccgaguacua

SEQ ID NO: 211086 - RNA, 19 nt, Homo sapiens
ccaaccaacuccacuucug

SEQ ID NO: 211087 - RNA, 19 nt, Homo sapiens
gggaagcugcauaugauga

SEQ ID NO: 211088 - RNA, 19 nt, Homo sapiens
gaaacugcaaccucacuca

SEQ ID NO: 211089 - RNA, 19 nt, Homo sapiens
ucaccaccauucuggaaga

SEQ ID NO: 211090 - RNA, 19 nt, Homo sapiens
ggacagcaacaaagacaag

SEQ ID NO: 211091 - RNA, 19 nt, Homo sapiens
ccgcugaaauccuuaagca

SEQ ID NO: 211092 - RNA, 19 nt, Homo sapiens
gggcauaucaccuuuaaua

SEQ ID NO: 211093 - RNA, 19 nt, Homo sapiens
ggaaacgccuguaggaaga

SEQ ID NO: 211094 - RNA, 19 nt, Homo sapiens
cagaauaguuggagggaua

SEQ ID NO: 211095 - RNA, 19 nt, Homo sapiens
ggaguucuaugugauauuu

SEQ ID NO: 211096 - RNA, 19 nt, Homo sapiens
gaagggaagcugcauauga

SEQ ID NO: 211097 - RNA, 19 nt, Homo sapiens
ucacaacccuggacuuauu

SEQ ID NO: 211098 - RNA, 19 nt, Homo sapiens
gaagaacccuauguuaugu

SEQ ID NO: 211099 - RNA, 19 nt, Homo sapiens
ggaagaacccuauguuaug

SEQ ID NO: 211100 - RNA, 19 nt, Homo sapiens
ggaggcaucuucauuguuc

SEQ ID NO: 211101 - RNA, 19 nt, Homo sapiens
aaagacaaguccagcaaua

SEQ ID NO: 211102 - RNA, 19 nt, Homo sapiens
ggaaggaacugaaaagauu

SEQ ID NO: 211103 - RNA, 19 nt, Homo sapiens
gaaucucacugaagaauca

SEQ ID NO: 211104 - RNA, 19 nt, Homo sapiens
agagauggaucaacaauga

SEQ ID NO: 211105 - RNA, 19 nt, Homo sapiens
cuaaauaguuucugguuug

SEQ ID NO: 211106 - RNA, 19 nt, Homo sapiens
gcugggcacuccucuauuu

SEQ ID NO: 211107 - RNA, 19 nt, Homo sapiens
ugacagauuugaaggauau

SEQ ID NO: 211108 - RNA, 19 nt, Homo sapiens
gaacugggaaucucacuga

SEQ ID NO: 211109 - RNA, 19 nt, Homo sapiens
ggacuuauuugcuuuggau

SEQ ID NO: 211110 - RNA, 19 nt, Homo sapiens
gaucaacaaugaccuucuu

SEQ ID NO: 211111 - RNA, 19 nt, Homo sapiens
gcaaggaguucuaugugau

SEQ ID NO: 211112 - RNA, 19 nt, Homo sapiens
ucaaagcucccuccagaua

SEQ ID NO: 211113 - RNA, 19 nt, Homo sapiens
gaagugacaccaguucuuu

SEQ ID NO: 211114 - RNA, 19 nt, Homo sapiens
acaaaucacggaagaauaa

SEQ ID NO: 211115 - RNA, 19 nt, Homo sapiens
ggacauuauuagucucaaa

SEQ ID NO: 211116 - RNA, 19 nt, Homo sapiens
ugugugugcuuucuaaaua

SEQ ID NO: 211117 - RNA, 19 nt, Homo sapiens
gagaagaugugggcuuuca

SEQ ID NO: 211118 - RNA, 19 nt, Homo sapiens
aaagcucccuccagauaua

SEQ ID NO: 211119 - RNA, 19 nt, Homo sapiens
gaagaagggaagcugcaua

SEQ ID NO: 211120 - RNA, 19 nt, Homo sapiens
gccuagaccuguugaaaga

SEQ ID NO: 211121 - RNA, 19 nt, Homo sapiens
ucaaggagaugaagaaagg

SEQ ID NO: 211122 - RNA, 19 nt, Homo sapiens
ucucgaaguuccacacaua

SEQ ID NO: 211123 - RNA, 19 nt, Homo sapiens
gaauuagcuuucaaguuug

SEQ ID NO: 211124 - RNA, 19 nt, Homo sapiens
caaucuggcugccuucuug

SEQ ID NO: 211125 - RNA, 19 nt, Homo sapiens
uaugacauccagagaauua

SEQ ID NO: 211126 - RNA, 19 nt, Homo sapiens
ggcaaggaguucuauguga

SEQ ID NO: 211127 - RNA, 19 nt, Homo sapiens
gguccuuucuguauuugua

SEQ ID NO: 211128 - RNA, 19 nt, Homo sapiens
gauauugccuagaccuguu

SEQ ID NO: 211129 - RNA, 19 nt, Homo sapiens
gaacagugucucucuuuca

SEQ ID NO: 211130 - RNA, 19 nt, Homo sapiens
gguuagagauggaucaaca

SEQ ID NO: 211131 - RNA, 19 nt, Homo sapiens
uuaugaaccugaucaaaga

SEQ ID NO: 211132 - RNA, 19 nt, Homo sapiens
ugugauguguuuccauaua

SEQ ID NO: 211133 - RNA, 19 nt, Homo sapiens
aaaccaagauagaauaugg

SEQ ID NO: 211134 - RNA, 19 nt, Homo sapiens
ccagauauuuggauguaug

SEQ ID NO: 211135 - RNA, 19 nt, Homo sapiens
caucagagacgaacucaga

SEQ ID NO: 211136 - RNA, 19 nt, Homo sapiens
gaaagaauugucaaacauc

SEQ ID NO: 211137 - RNA, 19 nt, Homo sapiens
gaagaaaggcaaggaguuc

SEQ ID NO: 211138 - RNA, 19 nt, Homo sapiens
ggagugggaacaccuauug

SEQ ID NO: 211139 - RNA, 19 nt, Homo sapiens
caacagaacacucauuguc

SEQ ID NO: 211140 - RNA, 19 nt, Homo sapiens
cagcugcccucugggaaua

SEQ ID NO: 211141 - RNA, 19 nt, Homo sapiens
cauccuggguuucauuuau

SEQ ID NO: 211142 - RNA, 19 nt, Homo sapiens
uacaagagcucaucaaagc

SEQ ID NO: 211143 - RNA, 19 nt, Homo sapiens
gaagaugugggcuuucaug

SEQ ID NO: 211144 - RNA, 19 nt, Homo sapiens
ucaccagcauuaacagaaa

SEQ ID NO: 211145 - RNA, 19 nt, Homo sapiens
aaaugagccuguuaauguu

SEQ ID NO: 211146 - RNA, 19 nt, Homo sapiens
caaagcaaaccaagauaga

SEQ ID NO: 211147 - RNA, 19 nt, Homo sapiens
gcaaagcaaaccaagauag

SEQ ID NO: 211148 - RNA, 19 nt, Homo sapiens
caaggaguucuaugugaua

SEQ ID NO: 211149 - RNA, 19 nt, Homo sapiens
uggaucugguccucuauua

SEQ ID NO: 211150 - RNA, 19 nt, Homo sapiens
ugugugauguguuuccaua

SEQ ID NO: 211151 - RNA, 19 nt, Homo sapiens
gaagcugcauaugaugaaa

SEQ ID NO: 211152 - RNA, 19 nt, Homo sapiens
gcaaaccaagauagaauau

SEQ ID NO: 211153 - RNA, 19 nt, Homo sapiens
ugauaagccucuauaugga

SEQ ID NO: 211154 - RNA, 19 nt, Homo sapiens
uuaagaagcuaggaagaug

SEQ ID NO: 211155 - RNA, 19 nt, Homo sapiens
agagagugcucaccacaga

SEQ ID NO: 211156 - RNA, 19 nt, Homo sapiens
caacaaugaccuucuucaa

SEQ ID NO: 211157 - RNA, 19 nt, Homo sapiens
ggagggauauggugguuuu

SEQ ID NO: 211158 - RNA, 19 nt, Homo sapiens
agucagcuguguacucuuu

SEQ ID NO: 211159 - RNA, 19 nt, Homo sapiens
gugauguguuuccauauau

SEQ ID NO: 211160 - RNA, 19 nt, Homo sapiens
caaggaaacgccuguagga

SEQ ID NO: 211161 - RNA, 19 nt, Homo sapiens
aaaucuuccuucacaagua

SEQ ID NO: 211162 - RNA, 19 nt, Homo sapiens
cgaggaagacaacaaagaa

SEQ ID NO: 211163 - RNA, 19 nt, Homo sapiens
agaccgcccugguaagaaa

SEQ ID NO: 211164 - RNA, 19 nt, Homo sapiens
gauaagccucuauauggaa

SEQ ID NO: 211165 - RNA, 19 nt, Homo sapiens
ucacggaagaauaaugaua

SEQ ID NO: 211166 - RNA, 19 nt, Homo sapiens
aagggaagcugcauaugau

SEQ ID NO: 211167 - RNA, 19 nt, Homo sapiens
cagcagaccgcccugguaa

SEQ ID NO: 211168 - RNA, 19 nt, Homo sapiens
gaucugguccucuauuaca

SEQ ID NO: 211169 - RNA, 19 nt, Homo sapiens
ccuaugacauccagagaau

SEQ ID NO: 211170 - RNA, 19 nt, Homo sapiens
ggaagugacaccaguucuu

SEQ ID NO: 211171 - RNA, 19 nt, Homo sapiens
gcagaccgcccugguaaga

SEQ ID NO: 211172 - RNA, 19 nt, Homo sapiens
ugucauccaucauugagaa

SEQ ID NO: 211173 - RNA, 19 nt, Homo sapiens
guacaguggcguaaacaug

SEQ ID NO: 211174 - RNA, 19 nt, Homo sapiens
gaaguuccacacauacaga

SEQ ID NO: 211175 - RNA, 19 nt, Homo sapiens
gaaaucuuccuucacaagu

SEQ ID NO: 211176 - RNA, 19 nt, Homo sapiens
uuucaacgcuaucauggaa

SEQ ID NO: 211177 - RNA, 19 nt, Homo sapiens
ugaaggauauugccuagac

SEQ ID NO: 211178 - RNA, 19 nt, Homo sapiens
gaaaucugauaagccucua

SEQ ID NO: 211179 - RNA, 19 nt, Homo sapiens
uugcaaugcucucgaaguu

SEQ ID NO: 211180 - RNA, 19 nt, Homo sapiens
gugugugcuuucuaaauaa

SEQ ID NO: 211181 - RNA, 19 nt, Homo sapiens
aaaaugagccuguuaaugu

SEQ ID NO: 211182 - RNA, 19 nt, Homo sapiens
gaacuaaggggaaaucuuc

SEQ ID NO: 211183 - RNA, 19 nt, Homo sapiens
ggaagaacugggaaucuca

SEQ ID NO: 211184 - RNA, 19 nt, Homo sapiens
ggaagcugcauaugaugaa

SEQ ID NO: 211185 - RNA, 19 nt, Homo sapiens
gaaaggcaaggaguucuau

SEQ ID NO: 211186 - RNA, 19 nt, Homo sapiens
ucagugcugugcagucuau

SEQ ID NO: 211187 - RNA, 19 nt, Homo sapiens
uaacaccacauuaaccuau

SEQ ID NO: 211188 - RNA, 19 nt, Homo sapiens
gcagucaccagcauuaaca

SEQ ID NO: 211189 - RNA, 19 nt, Homo sapiens
ucaacgcuaucauggaaga

SEQ ID NO: 211190 - RNA, 19 nt, Homo sapiens
uggaagaacccuauguuau

SEQ ID NO: 211191 - RNA, 19 nt, Homo sapiens
gaucuggacauuauuaguc

SEQ ID NO: 211192 - RNA, 19 nt, Homo sapiens
caacaaagauuccuucuau

SEQ ID NO: 211193 - RNA, 19 nt, Homo sapiens
gaacaucacagauuccuua

SEQ ID NO: 211194 - RNA, 19 nt, Homo sapiens
gaacuugcauucagauuug

SEQ ID NO: 211195 - RNA, 19 nt, Homo sapiens
gcacuggucucauucguuu

SEQ ID NO: 211196 - RNA, 19 nt, Homo sapiens
gauagaauauggagcagua

SEQ ID NO: 211197 - RNA, 19 nt, Homo sapiens
gaaaagagguccuucugua

SEQ ID NO: 211198 - RNA, 19 nt, Homo sapiens
gaaacaccaugaagauuau

SEQ ID NO: 211199 - RNA, 19 nt, Homo sapiens
gacagaagguugccaggua

SEQ ID NO: 211200 - RNA, 19 nt, Homo sapiens
guaaagaaaccauggcaua

SEQ ID NO: 211201 - RNA, 19 nt, Homo sapiens
ugacucugcugaugauuua

SEQ ID NO: 211202 - RNA, 19 nt, Homo sapiens
gcaaggaguuucauguaau

SEQ ID NO: 211203 - RNA, 19 nt, Homo sapiens
ccugauaucuggauguaua

SEQ ID NO: 211204 - RNA, 19 nt, Homo sapiens
ggaagagccuuauguccuu

SEQ ID NO: 211205 - RNA, 19 nt, Homo sapiens
ugacagcacuggucucauu

SEQ ID NO: 211206 - RNA, 19 nt, Homo sapiens
gagagaaggucaucgacuu

SEQ ID NO: 211207 - RNA, 19 nt, Homo sapiens
ggaguuucauguaaucuuu

SEQ ID NO: 211208 - RNA, 19 nt, Homo sapiens
gcaguccagugagaaauua

SEQ ID NO: 211209 - RNA, 19 nt, Homo sapiens
cuaaauaguuucugguuug

SEQ ID NO: 211210 - RNA, 19 nt, Homo sapiens
gaaggaagaaggucuagaa

SEQ ID NO: 211211 - RNA, 19 nt, Homo sapiens
ucacacagcucaucagcaa

SEQ ID NO: 211212 - RNA, 19 nt, Homo sapiens
caauuuagccagaauguuu

SEQ ID NO: 211213 - RNA, 19 nt, Homo sapiens
gaauauugguggcaucuuc

SEQ ID NO: 211214 - RNA, 19 nt, Homo sapiens
gaaggcaaacugcauauga

SEQ ID NO: 211215 - RNA, 19 nt, Homo sapiens
ccacacauguauuaagauu

SEQ ID NO: 211216 - RNA, 19 nt, Homo sapiens
ggcaaggaguuucauguaa

SEQ ID NO: 211217 - RNA, 19 nt, Homo sapiens
gccaggagauggaauauca

SEQ ID NO: 211218 - RNA, 19 nt, Homo sapiens
guauuaagauuugguggua

SEQ ID NO: 211219 - RNA, 19 nt, Homo sapiens
agaaacaccaugaagauua

SEQ ID NO: 211220 - RNA, 19 nt, Homo sapiens
gaucuaagcaguugcaaug

SEQ ID NO: 211221 - RNA, 19 nt, Homo sapiens
acaaaccucucuaugguaa

SEQ ID NO: 211222 - RNA, 19 nt, Homo sapiens
caaaugcaguccagugaga

SEQ ID NO: 211223 - RNA, 19 nt, Homo sapiens
gcuaaauaguuucugguuu

SEQ ID NO: 211224 - RNA, 19 nt, Homo sapiens
gaacaugcagcgauugcua

SEQ ID NO: 211225 - RNA, 19 nt, Homo sapiens
gcacacauuuaacgacaga

SEQ ID NO: 211226 - RNA, 19 nt, Homo sapiens
ugacaaaccucucuauggu

SEQ ID NO: 211227 - RNA, 19 nt, Homo sapiens
caacagggcaaccaauaaa

SEQ ID NO: 211228 - RNA, 19 nt, Homo sapiens
gagaacagauuuugauuug

SEQ ID NO: 211229 - RNA, 19 nt, Homo sapiens
gcaguguaaucgacauaaa

SEQ ID NO: 211230 - RNA, 19 nt, Homo sapiens
auacuacccuuaccuauga

SEQ ID NO: 211231 - RNA, 19 nt, Homo sapiens
cagaagaaguuaucaacau

SEQ ID NO: 211232 - RNA, 19 nt, Homo sapiens
ugaagaacaugcagcgauu

SEQ ID NO: 211233 - RNA, 19 nt, Homo sapiens
gcaaaacccuuacuaaaag

SEQ ID NO: 211234 - RNA, 19 nt, Homo sapiens
uaacagaaacagaacauug

SEQ ID NO: 211235 - RNA, 19 nt, Homo sapiens
gaacagauuuugauuugga

SEQ ID NO: 211236 - RNA, 19 nt, Homo sapiens
gaacacaauuaacagaaac

SEQ ID NO: 211237 - RNA, 19 nt, Homo sapiens
ggaacuugcauucagauuu

SEQ ID NO: 211238 - RNA, 19 nt, Homo sapiens
gauuggauauucucaagga

SEQ ID NO: 211239 - RNA, 19 nt, Homo sapiens
ggaagaaggucuagaaaag

SEQ ID NO: 211240 - RNA, 19 nt, Homo sapiens
gcauucagauuugcuguga

SEQ ID NO: 211241 - RNA, 19 nt, Homo sapiens
uaaagaaaccauggcauaa

SEQ ID NO: 211242 - RNA, 19 nt, Homo sapiens
aaagauuccuucuauguca

SEQ ID NO: 211243 - RNA, 19 nt, Homo sapiens
ucauaaagcugaccuugca

SEQ ID NO: 211244 - RNA, 19 nt, Homo sapiens
caucauggaucaaccaagu

SEQ ID NO: 211245 - RNA, 19 nt, Homo sapiens
gaagugccagcgucgguua

SEQ ID NO: 211246 - RNA, 19 nt, Homo sapiens
gguggcaucuucauuguuc

SEQ ID NO: 211247 - RNA, 19 nt, Homo sapiens
aaaccaagauagaauaugg

SEQ ID NO: 211248 - RNA, 19 nt, Homo sapiens
gaagagccuuauguccuuu

SEQ ID NO: 211249 - RNA, 19 nt, Homo sapiens
cagcgaacaucacagauuc

SEQ ID NO: 211250 - RNA, 19 nt, Homo sapiens
gaauaucaaugcccaacag

SEQ ID NO: 211251 - RNA, 19 nt, Homo sapiens
gcaaacugcauaugaugaa

SEQ ID NO: 211252 - RNA, 19 nt, Homo sapiens
caaggaaccacacauguau

SEQ ID NO: 211253 - RNA, 19 nt, Homo sapiens
gaggaaggcaaacugcaua

SEQ ID NO: 211254 - RNA, 19 nt, Homo sapiens
uaacuuagccgccuuucug

SEQ ID NO: 211255 - RNA, 19 nt, Homo sapiens
uguauauucugcuggcuua

SEQ ID NO: 211256 - RNA, 19 nt, Homo sapiens
aaauuagacuuguggaaga

SEQ ID NO: 211257 - RNA, 19 nt, Homo sapiens
ucagagaguuaucuacaau

SEQ ID NO: 211258 - RNA, 19 nt, Homo sapiens
ccaagucuccuccaucauu

SEQ ID NO: 211259 - RNA, 19 nt, Homo sapiens
ugacaggguucagaauauu

SEQ ID NO: 211260 - RNA, 19 nt, Homo sapiens
uaugauacccagaagauaa

SEQ ID NO: 211261 - RNA, 19 nt, Homo sapiens
ucaaggaaccacacaugua

SEQ ID NO: 211262 - RNA, 19 nt, Homo sapiens
guagugccaugguagaaga

SEQ ID NO: 211263 - RNA, 19 nt, Homo sapiens
gcaagguucugagcucaug

SEQ ID NO: 211264 - RNA, 19 nt, Homo sapiens
gguauaaucuucgacucaa

SEQ ID NO: 211265 - RNA, 19 nt, Homo sapiens
ucaaagcuccaucaaggua

SEQ ID NO: 211266 - RNA, 19 nt, Homo sapiens
agaagaaguuaucaacaug

SEQ ID NO: 211267 - RNA, 19 nt, Homo sapiens
caagucuccuccaucauug

SEQ ID NO: 211268 - RNA, 19 nt, Homo sapiens
caaggaguuucauguaauc

SEQ ID NO: 211269 - RNA, 19 nt, Homo sapiens
uuacaagcaucauggauca

SEQ ID NO: 211270 - RNA, 19 nt, Homo sapiens
acagaagguugccagguaa

SEQ ID NO: 211271 - RNA, 19 nt, Homo sapiens
ugggaaugaugacagaaua

SEQ ID NO: 211272 - RNA, 19 nt, Homo sapiens
cgacgcauccucauuucua

SEQ ID NO: 211273 - RNA, 19 nt, Homo sapiens
caagaaagccugugaucag

SEQ ID NO: 211274 - RNA, 19 nt, Homo sapiens
caaacaauuuagccagaau

SEQ ID NO: 211275 - RNA, 19 nt, Homo sapiens
gcacagaaacaccaugaag

SEQ ID NO: 211276 - RNA, 19 nt, Homo sapiens
acaauggaauggaaugguu

SEQ ID NO: 211277 - RNA, 19 nt, Homo sapiens
gcagaauaacuuucaacaa

SEQ ID NO: 211278 - RNA, 19 nt, Homo sapiens
ucaguuccuugcaguguaa

SEQ ID NO: 211279 - RNA, 19 nt, Homo sapiens
gacaggguucagaauauua

SEQ ID NO: 211280 - RNA, 19 nt, Homo sapiens
gaaaagaggcaaggaguuu

SEQ ID NO: 211281 - RNA, 19 nt, Homo sapiens
aaagcuccaucaagguaua

SEQ ID NO: 211282 - RNA, 19 nt, Homo sapiens
ccaaacaauuuagccagaa

SEQ ID NO: 211283 - RNA, 19 nt, Homo sapiens
agaguuaucuacaauccuu

SEQ ID NO: 211284 - RNA, 19 nt, Homo sapiens
uaagaagucugacaaaccu

SEQ ID NO: 211285 - RNA, 19 nt, Homo sapiens
ggaaagccagcgaacauca

SEQ ID NO: 211286 - RNA, 19 nt, Homo sapiens
caugacaggguucagaaua

SEQ ID NO: 211287 - RNA, 19 nt, Homo sapiens
ccucuuugcucuugauguu

SEQ ID NO: 211288 - RNA, 19 nt, Homo sapiens
gaaugaugacagaauacua

SEQ ID NO: 211289 - RNA, 19 nt, Homo sapiens
ucacgguuguguaugauga

SEQ ID NO: 211290 - RNA, 19 nt, Homo sapiens
gaaauuacagguuccuuuu

SEQ ID NO: 211291 - RNA, 19 nt, Homo sapiens
gcagccggcuuggugcuuu

SEQ ID NO: 211292 - RNA, 19 nt, Homo sapiens
caacaaagauuccuucuau

SEQ ID NO: 211293 - RNA, 19 nt, Homo sapiens
gaacaucacagauuccuua

SEQ ID NO: 211294 - RNA, 19 nt, Homo sapiens
gaacuugcauucagauuug

SEQ ID NO: 211295 - RNA, 19 nt, Homo sapiens
gcacuggucucauucguuu

SEQ ID NO: 211296 - RNA, 19 nt, Homo sapiens
gauagaauauggagcagua

SEQ ID NO: 211297 - RNA, 19 nt, Homo sapiens
gaaacaccaugaagauuau

SEQ ID NO: 211298 - RNA, 19 nt, Homo sapiens
gacagaagguugccaggua

SEQ ID NO: 211299 - RNA, 19 nt, Homo sapiens
ggaaucuucuauuugguua

SEQ ID NO: 211300 - RNA, 19 nt, Homo sapiens
guaaagaaaccauggcaua

SEQ ID NO: 211301 - RNA, 19 nt, Homo sapiens
ugacucugcugaugauuua

SEQ ID NO: 211302 - RNA, 19 nt, Homo sapiens
gcaaggaguuucauguaau

SEQ ID NO: 211303 - RNA, 19 nt, Homo sapiens
ccugauaucuggauguaua

SEQ ID NO: 211304 - RNA, 19 nt, Homo sapiens
ggaagagccuuauguccuu

SEQ ID NO: 211305 - RNA, 19 nt, Homo sapiens
ugacagcacuggucucauu

SEQ ID NO: 211306 - RNA, 19 nt, Homo sapiens
gagagaaggucaucgacuu

SEQ ID NO: 211307 - RNA, 19 nt, Homo sapiens
ggaguuucauguaaucuuu

SEQ ID NO: 211308 - RNA, 19 nt, Homo sapiens
gcaguccagugagaaauua

SEQ ID NO: 211309 - RNA, 19 nt, Homo sapiens
cuaaauaguuucugguuug

SEQ ID NO: 211310 - RNA, 19 nt, Homo sapiens
gaaggaagaaggucuagaa

SEQ ID NO: 211311 - RNA, 19 nt, Homo sapiens
ucacacagcucaucagcaa

SEQ ID NO: 211312 - RNA, 19 nt, Homo sapiens
caauuuagccagaauguuu

SEQ ID NO: 211313 - RNA, 19 nt, Homo sapiens
gaauauugguggcaucuuc

SEQ ID NO: 211314 - RNA, 19 nt, Homo sapiens
gaaggcaaacugcauauga

SEQ ID NO: 211315 - RNA, 19 nt, Homo sapiens
ccacacauguauuaagauu

SEQ ID NO: 211316 - RNA, 19 nt, Homo sapiens
ggcaaggaguuucauguaa

SEQ ID NO: 211317 - RNA, 19 nt, Homo sapiens
gccaggagauggaauauca

SEQ ID NO: 211318 - RNA, 19 nt, Homo sapiens
guauuaagauuugguggua

SEQ ID NO: 211319 - RNA, 19 nt, Homo sapiens
agaaacaccaugaagauua

SEQ ID NO: 211320 - RNA, 19 nt, Homo sapiens
gaucuaagcaguugcaaug

SEQ ID NO: 211321 - RNA, 19 nt, Homo sapiens
acaaaccucucuaugguaa

SEQ ID NO: 211322 - RNA, 19 nt, Homo sapiens
caaaugcaguccagugaga

SEQ ID NO: 211323 - RNA, 19 nt, Homo sapiens
gcuaaauaguuucugguuu

SEQ ID NO: 211324 - RNA, 19 nt, Homo sapiens
gaacaugcagcgauugcua

SEQ ID NO: 211325 - RNA, 19 nt, Homo sapiens
gcacacauuuaacgacaga

SEQ ID NO: 211326 - RNA, 19 nt, Homo sapiens
ugacaaaccucucuauggu

SEQ ID NO: 211327 - RNA, 19 nt, Homo sapiens
caacagggcaaccaauaaa

SEQ ID NO: 211328 - RNA, 19 nt, Homo sapiens
aaaggaaucuucuauuugg

SEQ ID NO: 211329 - RNA, 19 nt, Homo sapiens
gagaacagauuuugauuug

SEQ ID NO: 211330 - RNA, 19 nt, Homo sapiens
gcaguguaaucgacauaaa

SEQ ID NO: 211331 - RNA, 19 nt, Homo sapiens
auacuacccuuaccuauga

SEQ ID NO: 211332 - RNA, 19 nt, Homo sapiens
cagaagaaguuaucaacau

SEQ ID NO: 211333 - RNA, 19 nt, Homo sapiens
ugaagaacaugcagcgauu

SEQ ID NO: 211334 - RNA, 19 nt, Homo sapiens
gcaaaacccuuacuaaaag

SEQ ID NO: 211335 - RNA, 19 nt, Homo sapiens
uaacagaaacagaacauug

SEQ ID NO: 211336 - RNA, 19 nt, Homo sapiens
auaaugagguccuucugua

SEQ ID NO: 211337 - RNA, 19 nt, Homo sapiens
gaacagauuuugauuugga

SEQ ID NO: 211338 - RNA, 19 nt, Homo sapiens
gaacacaauuaacagaaac

SEQ ID NO: 211339 - RNA, 19 nt, Homo sapiens
ggaacuugcauucagauuu

SEQ ID NO: 211340 - RNA, 19 nt, Homo sapiens
gauuggauauucucaagga

SEQ ID NO: 211341 - RNA, 19 nt, Homo sapiens
ggaagaaggucuagaaaag

SEQ ID NO: 211342 - RNA, 19 nt, Homo sapiens
gcauucagauuugcuguga

SEQ ID NO: 211343 - RNA, 19 nt, Homo sapiens
uaaagaaaccauggcauaa

SEQ ID NO: 211344 - RNA, 19 nt, Homo sapiens
aaagauuccuucuauguca

SEQ ID NO: 211345 - RNA, 19 nt, Homo sapiens
ucauaaagcugaccuugca

SEQ ID NO: 211346 - RNA, 19 nt, Homo sapiens
caucauggaucaaccaagu

SEQ ID NO: 211347 - RNA, 19 nt, Homo sapiens
gaagugccagcgucgguua

SEQ ID NO: 211348 - RNA, 19 nt, Homo sapiens
gguggcaucuucauuguuc

SEQ ID NO: 211349 - RNA, 19 nt, Homo sapiens
aaaccaagauagaauaugg

SEQ ID NO: 211350 - RNA, 19 nt, Homo sapiens
gaagagccuuauguccuuu

SEQ ID NO: 211351 - RNA, 19 nt, Homo sapiens
cagcgaacaucacagauuc

SEQ ID NO: 211352 - RNA, 19 nt, Homo sapiens
gaauaucaaugcccaacag

SEQ ID NO: 211353 - RNA, 19 nt, Homo sapiens
gcaaacugcauaugaugaa

SEQ ID NO: 211354 - RNA, 19 nt, Homo sapiens
caaggaaccacacauguau

SEQ ID NO: 211355 - RNA, 19 nt, Homo sapiens
gaggaaggcaaacugcaua

SEQ ID NO: 211356 - RNA, 19 nt, Homo sapiens
uaacuuagccgccuuucug

SEQ ID NO: 211357 - RNA, 19 nt, Homo sapiens
uguauauucugcuggcuua

SEQ ID NO: 211358 - RNA, 19 nt, Homo sapiens
aaauuagacuuguggaaga

SEQ ID NO: 211359 - RNA, 19 nt, Homo sapiens
ucagagaguuaucuacaau

SEQ ID NO: 211360 - RNA, 19 nt, Homo sapiens
ccaagucuccuccaucauu

SEQ ID NO: 211361 - RNA, 19 nt, Homo sapiens
ugacaggguucagaauauu

SEQ ID NO: 211362 - RNA, 19 nt, Homo sapiens
uaugauacccagaagauaa

SEQ ID NO: 211363 - RNA, 19 nt, Homo sapiens
ucaaggaaccacacaugua

SEQ ID NO: 211364 - RNA, 19 nt, Homo sapiens
guagugccaugguagaaga

SEQ ID NO: 211365 - RNA, 19 nt, Homo sapiens
gcaagguucugagcucaug

SEQ ID NO: 211366 - RNA, 19 nt, Homo sapiens
gguauaaucuucgacucaa

SEQ ID NO: 211367 - RNA, 19 nt, Homo sapiens
ucaaagcuccaucaaggua

SEQ ID NO: 211368 - RNA, 19 nt, Homo sapiens
agaagaaguuaucaacaug

SEQ ID NO: 211369 - RNA, 19 nt, Homo sapiens
uccagacacuguuuaguaa

SEQ ID NO: 211370 - RNA, 19 nt, Homo sapiens
caagucuccuccaucauug

SEQ ID NO: 211371 - RNA, 19 nt, Homo sapiens
caaggaguuucauguaauc

SEQ ID NO: 211372 - RNA, 19 nt, Homo sapiens
uuacaagcaucauggauca

SEQ ID NO: 211373 - RNA, 19 nt, Homo sapiens
acagaagguugccagguaa

SEQ ID NO: 211374 - RNA, 19 nt, Homo sapiens
cgacgcauccucauuucua

SEQ ID NO: 211375 - RNA, 19 nt, Homo sapiens
ugggaaugaugacagaaua

SEQ ID NO: 211376 - RNA, 19 nt, Homo sapiens
caagaaagccugugaucag

SEQ ID NO: 211377 - RNA, 19 nt, Homo sapiens
caaacaauuuagccagaau

SEQ ID NO: 211378 - RNA, 19 nt, Homo sapiens
gcacagaaacaccaugaag

SEQ ID NO: 211379 - RNA, 19 nt, Homo sapiens
acaauggaauggaaugguu

SEQ ID NO: 211380 - RNA, 19 nt, Homo sapiens
gcagaauaacuuucaacaa

SEQ ID NO: 211381 - RNA, 19 nt, Homo sapiens
ucaguuccuugcaguguaa

SEQ ID NO: 211382 - RNA, 19 nt, Homo sapiens
gacaggguucagaauauua

SEQ ID NO: 211383 - RNA, 19 nt, Homo sapiens
gaaaagaggcaaggaguuu

SEQ ID NO: 211384 - RNA, 19 nt, Homo sapiens
aaagcuccaucaagguaua

SEQ ID NO: 211385 - RNA, 19 nt, Homo sapiens
ccaaacaauuuagccagaa

SEQ ID NO: 211386 - RNA, 19 nt, Homo sapiens
agaguuaucuacaauccuu

SEQ ID NO: 211387 - RNA, 19 nt, Homo sapiens
uaagaagucugacaaaccu

SEQ ID NO: 211388 - RNA, 19 nt, Homo sapiens
ggaaagccagcgaacauca

SEQ ID NO: 211389 - RNA, 19 nt, Homo sapiens
caugacaggguucagaaua

SEQ ID NO: 211390 - RNA, 19 nt, Homo sapiens
ccucuuugcucuugauguu

SEQ ID NO: 211391 - RNA, 19 nt, Homo sapiens
gaaugaugacagaauacua

SEQ ID NO: 211392 - RNA, 19 nt, Homo sapiens
uaggaggucucuaagaaua

SEQ ID NO: 211393 - RNA, 19 nt, Homo sapiens
caaaggagauuggaaggaa

SEQ ID NO: 211394 - RNA, 19 nt, Homo sapiens
acaaacagaucacucauug

SEQ ID NO: 211395 - RNA, 19 nt, Homo sapiens
ggaggucucuaagaauaua

SEQ ID NO: 211396 - RNA, 19 nt, Homo sapiens
gcucuuauauugccauuuc

SEQ ID NO: 211397 - RNA, 19 nt, Homo sapiens
caucggcgcuggugaagaa

SEQ ID NO: 211398 - RNA, 19 nt, Homo sapiens
uaaaggagcuggcccacau

SEQ ID NO: 211399 - RNA, 19 nt, Homo sapiens
gaugacugaugcagccuua

SEQ ID NO: 211400 - RNA, 19 nt, Homo sapiens
gagcaugccuuucgauuuu

SEQ ID NO: 211401 - RNA, 19 nt, Homo sapiens
gcacaaggccuggcgcuuu

SEQ ID NO: 211402 - RNA, 19 nt, Homo sapiens
ggaggaaucuucgaguaug

SEQ ID NO: 211403 - RNA, 19 nt, Homo sapiens
gcaagggucugagcugaug

SEQ ID NO: 211404 - RNA, 19 nt, Homo sapiens
gcaucgaccugcuaaagga

SEQ ID NO: 211405 - RNA, 19 nt, Homo sapiens
cacaaaggaugcccaaaga

SEQ ID NO: 211406 - RNA, 19 nt, Homo sapiens
ucuaggaggucucuaagaa

SEQ ID NO: 211407 - RNA, 19 nt, Homo sapiens
acacaaccuugaccuauga

SEQ ID NO: 211408 - RNA, 19 nt, Homo sapiens
gaaaauucuucuccacuuu

SEQ ID NO: 211409 - RNA, 19 nt, Homo sapiens
guccuaaucuucugaacuu

SEQ ID NO: 211410 - RNA, 19 nt, Homo sapiens
cuuaacagcuucugguuug

SEQ ID NO: 211411 - RNA, 19 nt, Homo sapiens
aggauuaacuggacgaauu

SEQ ID NO: 211412 - RNA, 19 nt, Homo sapiens
ggaacggcauggucaagga

SEQ ID NO: 211413 - RNA, 19 nt, Homo sapiens
caaaggaugcccaaagaug

SEQ ID NO: 211414 - RNA, 19 nt, Homo sapiens
ggucagcuguguccucuuc

SEQ ID NO: 211415 - RNA, 19 nt, Homo sapiens
ucacugagguugccaaagg

SEQ ID NO: 211416 - RNA, 19 nt, Homo sapiens
ggagcaugccuuucgauuu

SEQ ID NO: 211417 - RNA, 19 nt, Homo sapiens
ggacaaugacccagugguu

SEQ ID NO: 211418 - RNA, 19 nt, Homo sapiens
caaccuggcugccuuucug

SEQ ID NO: 211419 - RNA, 19 nt, Homo sapiens
ggagucugguuugggaaua

SEQ ID NO: 211420 - RNA, 19 nt, Homo sapiens
gaucuucuguggguuucua

SEQ ID NO: 211421 - RNA, 19 nt, Homo sapiens
ggauucuuauggacaauga

SEQ ID NO: 211422 - RNA, 19 nt, Homo sapiens
gagagaaggccaucgacuu

SEQ ID NO: 211423 - RNA, 19 nt, Homo sapiens
uggcagaguugaagacaga

SEQ ID NO: 211424 - RNA, 19 nt, Homo sapiens
caacacaaccuugaccuau

SEQ ID NO: 211425 - RNA, 19 nt, Homo sapiens
gaggagcccuucgucaugu

SEQ ID NO: 211426 - RNA, 19 nt, Homo sapiens
ccacacgucucggccauug

SEQ ID NO: 211427 - RNA, 19 nt, Homo sapiens
gaggaaagcaaaggagauu

SEQ ID NO: 211428 - RNA, 19 nt, Homo sapiens
agaagagaaugcacaaaca

SEQ ID NO: 211429 - RNA, 19 nt, Homo sapiens
gaggacaagcugcauauca

SEQ ID NO: 211430 - RNA, 19 nt, Homo sapiens
ucaccacucuggaucucua

SEQ ID NO: 211431 - RNA, 19 nt, Homo sapiens
gagaagagaaugcacaaac

SEQ ID NO: 211432 - RNA, 19 nt, Homo sapiens
ggaggagcccuucgucaug

SEQ ID NO: 211433 - RNA, 19 nt, Homo sapiens
cacaaggccuggcgcuuug

SEQ ID NO: 211434 - RNA, 19 nt, Homo sapiens
caacaugcacacauucaau

SEQ ID NO: 211435 - RNA, 19 nt, Homo sapiens
ggagugaugaugacugaug

SEQ ID NO: 211436 - RNA, 19 nt, Homo sapiens
ggaauuccgcauuaucuuc

SEQ ID NO: 211437 - RNA, 19 nt, Homo sapiens
aaacagaucacucauuguc

SEQ ID NO: 211438 - RNA, 19 nt, Homo sapiens
caccacagaugaccgugaa

SEQ ID NO: 211439 - RNA, 19 nt, Homo sapiens
guacuaccacuucaucuuc

SEQ ID NO: 211440 - RNA, 19 nt, Homo sapiens
gcaugaugacugaguacua

SEQ ID NO: 211441 - RNA, 19 nt, Homo sapiens
caaagaugcagccgguauu

SEQ ID NO: 211442 - RNA, 19 nt, Homo sapiens
ucaucaacaugcacacauu

SEQ ID NO: 211443 - RNA, 19 nt, Homo sapiens
ggacaagcugcauaucaug

SEQ ID NO: 211444 - RNA, 19 nt, Homo sapiens
ucacucugcuuaacagcuu

SEQ ID NO: 211445 - RNA, 19 nt, Homo sapiens
gacaaacagaucacucauu

SEQ ID NO: 211446 - RNA, 19 nt, Homo sapiens
ggauuaacuggacgaauug

SEQ ID NO: 211447 - RNA, 19 nt, Homo sapiens
ucggaggaaucuucgagua

SEQ ID NO: 211448 - RNA, 19 nt, Homo sapiens
caagagcccaggccuccua

SEQ ID NO: 211449 - RNA, 19 nt, Homo sapiens
gaggaggacaagcugcaua

SEQ ID NO: 211450 - RNA, 19 nt, Homo sapiens
uaacuucacucugcuuaac

SEQ ID NO: 211451 - RNA, 19 nt, Homo sapiens
cugaauuucucacaaagga

SEQ ID NO: 211452 - RNA, 19 nt, Homo sapiens
cgagauagccaaggccaaa

SEQ ID NO: 211453 - RNA, 19 nt, Homo sapiens
ggaaagcaaaggagauugg

SEQ ID NO: 211454 - RNA, 19 nt, Homo sapiens
gacaagcugcauaucauga

SEQ ID NO: 211455 - RNA, 19 nt, Homo sapiens
ggaaucacccauugacucu

SEQ ID NO: 211456 - RNA, 19 nt, Homo sapiens
gauacaacauccgccugaa

SEQ ID NO: 211457 - RNA, 19 nt, Homo sapiens
gagagaagagaaugcacaa

SEQ ID NO: 211458 - RNA, 19 nt, Homo sapiens
uuaacuggacgaauuguuu

SEQ ID NO: 211459 - RNA, 19 nt, Homo sapiens
ccaaagaugcagccgguau

SEQ ID NO: 211460 - RNA, 19 nt, Homo sapiens
gaagagaaugcacaaacag

SEQ ID NO: 211461 - RNA, 19 nt, Homo sapiens
ucacaaaggaugcccaaag

SEQ ID NO: 211462 - RNA, 19 nt, Homo sapiens
gcaaaggagauuggaagga

SEQ ID NO: 211463 - RNA, 19 nt, Homo sapiens
aauccaagaucuccaccuu

SEQ ID NO: 211464 - RNA, 19 nt, Homo sapiens
ggagcuggcccacauccuu

SEQ ID NO: 211465 - RNA, 19 nt, Homo sapiens
gauuccggauucucaaugu

SEQ ID NO: 211466 - RNA, 19 nt, Homo sapiens
ccaacaucaucaacaggaa

SEQ ID NO: 211467 - RNA, 19 nt, Homo sapiens
aaucagacaggacgcuaua

SEQ ID NO: 211468 - RNA, 19 nt, Homo sapiens
ggacucugcugcccaacac

SEQ ID NO: 211469 - RNA, 19 nt, Homo sapiens
caugaugacugaguacuac

SEQ ID NO: 211470 - RNA, 19 nt, Homo sapiens
gaaagcaaaggagauugga

SEQ ID NO: 211471 - RNA, 19 nt, Homo sapiens
gugagcauccuguaucgaa

SEQ ID NO: 211472 - RNA, 19 nt, Homo sapiens
gaccaucacccauguucga

SEQ ID NO: 211473 - RNA, 19 nt, Homo sapiens
gagagcagcguuccuucug

SEQ ID NO: 211474 - RNA, 19 nt, Homo sapiens
cugaugaccuggccaagca

SEQ ID NO: 211475 - RNA, 19 nt, Homo sapiens
gcuuaacagcuucugguuu

SEQ ID NO: 211476 - RNA, 19 nt, Homo sapiens
ugagcauccuguaucgaaa

SEQ ID NO: 211477 - RNA, 19 nt, Homo sapiens
gcuccgaggugguggaaaa

SEQ ID NO: 211478 - RNA, 19 nt, Homo sapiens
ccaaugccguccaguccau

SEQ ID NO: 211479 - RNA, 19 nt, Homo sapiens
cauccuugguuucuccuau

SEQ ID NO: 211480 - RNA, 19 nt, Homo sapiens
aaagaugcagccgguauuu

SEQ ID NO: 211481 - RNA, 19 nt, Homo sapiens
ccuuaaggauguucuagca

SEQ ID NO: 211482 - RNA, 19 nt, Homo sapiens
ccaacacaaccuugaccua

SEQ ID NO: 211483 - RNA, 19 nt, Homo sapiens
gguggcaucuggugguucu

SEQ ID NO: 211484 - RNA, 19 nt, Homo sapiens
aggauucacuuccaugaca

SEQ ID NO: 211485 - RNA, 19 nt, Homo sapiens
aacacaaccuugaccuaug

SEQ ID NO: 211486 - RNA, 19 nt, Homo sapiens
gaggaaucuucgaguaugc

SEQ ID NO: 211487 - RNA, 19 nt, Homo sapiens
ucacgugguccuaaucuuc

SEQ ID NO: 211488 - RNA, 19 nt, Homo sapiens
aggacaagcugcauaucau

SEQ ID NO: 211489 - RNA, 19 nt, Homo sapiens
ggugugagcauccuguauc

SEQ ID NO: 211490 - RNA, 19 nt, Homo sapiens
caucaaggaggcucaaugg

SEQ ID NO: 211491 - RNA, 19 nt, Homo sapiens
uacaacauccgccugaaga

SEQ ID NO: 211492 - RNA, 19 nt, Homo sapiens
gaauauugguggaaucuuu

SEQ ID NO: 211493 - RNA, 19 nt, Homo sapiens
gggagaaggugauugauuu

SEQ ID NO: 211494 - RNA, 19 nt, Homo sapiens
gaggaucgcugcuaucuug

SEQ ID NO: 211495 - RNA, 19 nt, Homo sapiens
acacauacaucuucacuaa

SEQ ID NO: 211496 - RNA, 19 nt, Homo sapiens
gcaccagccucaugaacua

SEQ ID NO: 211497 - RNA, 19 nt, Homo sapiens
gcagagauccuccgauuca

SEQ ID NO: 211498 - RNA, 19 nt, Homo sapiens
ucaaggagcuggcagagau

SEQ ID NO: 211499 - RNA, 19 nt, Homo sapiens
gcagaaaccaugugucaga

SEQ ID NO: 211500 - RNA, 19 nt, Homo sapiens
cagaggaguucgucaaguu

SEQ ID NO: 211501 - RNA, 19 nt, Homo sapiens
caacaucuguggagagaag

SEQ ID NO: 211502 - RNA, 19 nt, Homo sapiens
ggagaacugugaccaugug

SEQ ID NO: 211503 - RNA, 19 nt, Homo sapiens
caacgcauguggaauuaca

SEQ ID NO: 211504 - RNA, 19 nt, Homo sapiens
gaaggugauugauuucucu

SEQ ID NO: 211505 - RNA, 19 nt, Homo sapiens
uggcagagauccuccgauu

SEQ ID NO: 211506 - RNA, 19 nt, Homo sapiens
ucacuaaucuggaguucuc

SEQ ID NO: 211507 - RNA, 19 nt, Homo sapiens
acauacaucuucacuaauc

SEQ ID NO: 211508 - RNA, 19 nt, Homo sapiens
caaccaaucccaugcuuuc

SEQ ID NO: 211509 - RNA, 19 nt, Homo sapiens
ggucgaaguggacaucuuu

SEQ ID NO: 211510 - RNA, 19 nt, Homo sapiens
gcuguuugaugcugucuau

SEQ ID NO: 211511 - RNA, 19 nt, Homo sapiens
gaagaucacagagcuaaag

SEQ ID NO: 211512 - RNA, 19 nt, Homo sapiens
ggaaaacccauauuuaaug

SEQ ID NO: 211513 - RNA, 19 nt, Homo sapiens
ccucggcccugcuguuuga

SEQ ID NO: 211514 - RNA, 19 nt, Homo sapiens
ggcaauuccuuaucuccaa

SEQ ID NO: 211515 - RNA, 19 nt, Homo sapiens
uagcugggauccugaacuu

SEQ ID NO: 211516 - RNA, 19 nt, Homo sapiens
ggagaauauugguggaauc

SEQ ID NO: 211517 - RNA, 19 nt, Homo sapiens
ccagaccgccauugaauau

SEQ ID NO: 211518 - RNA, 19 nt, Homo sapiens
gaccagaccgccauugaau

SEQ ID NO: 211519 - RNA, 19 nt, Homo sapiens
ccaaucccaugcuuucuuc

SEQ ID NO: 211520 - RNA, 19 nt, Homo sapiens
gacaagaccgccaccauca

SEQ ID NO: 211521 - RNA, 19 nt, Homo sapiens
guucuuauuuguggcuuaa

SEQ ID NO: 211522 - RNA, 19 nt, Homo sapiens
caacuacgcuuugaaaauc

SEQ ID NO: 211523 - RNA, 19 nt, Homo sapiens
gaaucuuugugguucuuau

SEQ ID NO: 211524 - RNA, 19 nt, Homo sapiens
ggugcaaccuccuggugaa

SEQ ID NO: 211525 - RNA, 19 nt, Homo sapiens
gccaagagaucggcgugaa

SEQ ID NO: 211526 - RNA, 19 nt, Homo sapiens
gggcaacagccucugguuu

SEQ ID NO: 211527 - RNA, 19 nt, Homo sapiens
guggcaggccucaccauua

SEQ ID NO: 211528 - RNA, 19 nt, Homo sapiens
guacagcccacacccaugu

SEQ ID NO: 211529 - RNA, 19 nt, Homo sapiens
gagcugaucgcuaggaaag

SEQ ID NO: 211530 - RNA, 19 nt, Homo sapiens
ggacagccuuguggaugau

SEQ ID NO: 211531 - RNA, 19 nt, Homo sapiens
ggauggugucagccuauua

SEQ ID NO: 211532 - RNA, 19 nt, Homo sapiens
guacgagacugcagaaacc

SEQ ID NO: 211533 - RNA, 19 nt, Homo sapiens
cuaaaggccugggaaugga

SEQ ID NO: 211534 - RNA, 19 nt, Homo sapiens
gaacaaccgccuggagauc

SEQ ID NO: 211535 - RNA, 19 nt, Homo sapiens
gcagcauuauccuguguca

SEQ ID NO: 211536 - RNA, 19 nt, Homo sapiens
gaaacugcaaccucacuca

SEQ ID NO: 211537 - RNA, 19 nt, Homo sapiens
agcaugaccuucuuccaaa

SEQ ID NO: 211538 - RNA, 19 nt, Homo sapiens
cagcaugaccuucuuccaa

SEQ ID NO: 211539 - RNA, 19 nt, Homo sapiens
cgucagcuguguccucuuc

SEQ ID NO: 211540 - RNA, 19 nt, Homo sapiens
ccaucacccuggccaagaa

SEQ ID NO: 211541 - RNA, 19 nt, Homo sapiens
gcuaaaggccugggaaugg

SEQ ID NO: 211542 - RNA, 19 nt, Homo sapiens
ggcaacagccucugguuuc

SEQ ID NO: 211543 - RNA, 19 nt, Homo sapiens
ggugauugauuucucuaag

SEQ ID NO: 211544 - RNA, 19 nt, Homo sapiens
gagaauggacagccuugug

SEQ ID NO: 211545 - RNA, 19 nt, Homo sapiens
caaggaggaagaucacaga

SEQ ID NO: 211546 - RNA, 19 nt, Homo sapiens
uaccaacgcauguggaauu

SEQ ID NO: 211547 - RNA, 19 nt, Homo sapiens
gcugaucgcuaggaaagca

SEQ ID NO: 211548 - RNA, 19 nt, Homo sapiens
aauccaccaugaacgagua

SEQ ID NO: 211549 - RNA, 19 nt, Homo sapiens
gacgcaaacccggcuauuu

SEQ ID NO: 211550 - RNA, 19 nt, Homo sapiens
gaaccggagccaagagauc

SEQ ID NO: 211551 - RNA, 19 nt, Homo sapiens
uggacagccuuguggauga

SEQ ID NO: 211552 - RNA, 19 nt, Homo sapiens
gcgcagcauuauccugugu

SEQ ID NO: 211553 - RNA, 19 nt, Homo sapiens
gggaaucgccaggguguug

SEQ ID NO: 211554 - RNA, 19 nt, Homo sapiens
ggagaaggugauugauuuc

SEQ ID NO: 211555 - RNA, 19 nt, Homo sapiens
gaaaacccauauuuaaugc

SEQ ID NO: 211556 - RNA, 19 nt, Homo sapiens
gcaaaggccagagguccaa

SEQ ID NO: 211557 - RNA, 19 nt, Homo sapiens
gggagcugaucgcuaggaa

SEQ ID NO: 211558 - RNA, 19 nt, Homo sapiens
ggacaucuuugagcuucuc

SEQ ID NO: 211559 - RNA, 19 nt, Homo sapiens
gggauggugucagccuauu

SEQ ID NO: 211560 - RNA, 19 nt, Homo sapiens
ccucaucugugccaaagca

SEQ ID NO: 211561 - RNA, 19 nt, Homo sapiens
gccugggaauggagaauau

SEQ ID NO: 211562 - RNA, 19 nt, Homo sapiens
gcgcaugguagaauuggaa

SEQ ID NO: 211563 - RNA, 19 nt, Homo sapiens
gagaagcugcuccggcaau

SEQ ID NO: 211564 - RNA, 19 nt, Homo sapiens
ggaagaucacagagcuaaa

SEQ ID NO: 211565 - RNA, 19 nt, Homo sapiens
ucgccaggguguugaauuc

SEQ ID NO: 211566 - RNA, 19 nt, Homo sapiens
cagaaaccaugugucagau

SEQ ID NO: 211567 - RNA, 19 nt, Homo sapiens
uggcaggccucaccauuac

SEQ ID NO: 211568 - RNA, 19 nt, Homo sapiens
gggcuucuguguggacaug

SEQ ID NO: 211569 - RNA, 19 nt, Homo sapiens
accaacgcauguggaauua

SEQ ID NO: 211570 - RNA, 19 nt, Homo sapiens
gcuccagcaugaccuucuu

SEQ ID NO: 211571 - RNA, 19 nt, Homo sapiens
guguggacaugcucaagga

SEQ ID NO: 211572 - RNA, 19 nt, Homo sapiens
ggaaccaccaggagaugga

SEQ ID NO: 211573 - RNA, 19 nt, Homo sapiens
caagaccgccaccaucauc

SEQ ID NO: 211574 - RNA, 19 nt, Homo sapiens
gagcuaaaggccugggaau

SEQ ID NO: 211575 - RNA, 19 nt, Homo sapiens
cgaguuugaucuggccauu

SEQ ID NO: 211576 - RNA, 19 nt, Homo sapiens
caccaagggcuaugggauu

SEQ ID NO: 211577 - RNA, 19 nt, Homo sapiens
ggaugugcccauugaguca

SEQ ID NO: 211578 - RNA, 19 nt, Homo sapiens
acgcaaacccggcuauuuc

SEQ ID NO: 211579 - RNA, 19 nt, Homo sapiens
ggacgcaaacccggcuauu

SEQ ID NO: 211580 - RNA, 19 nt, Homo sapiens
gaacgggagaaggugauug

SEQ ID NO: 211581 - RNA, 19 nt, Homo sapiens
guccaacuacgcuuugaaa

SEQ ID NO: 211582 - RNA, 19 nt, Homo sapiens
ccaggguguugaauuccaa

SEQ ID NO: 211583 - RNA, 19 nt, Homo sapiens
caaguuccaguuccagaga

SEQ ID NO: 211584 - RNA, 19 nt, Homo sapiens
gggcaaggccaaggucgaa

SEQ ID NO: 211585 - RNA, 19 nt, Homo sapiens
agaagcugcuccggcaauu

SEQ ID NO: 211586 - RNA, 19 nt, Homo sapiens
ggaaucuuugugguucuua

SEQ ID NO: 211587 - RNA, 19 nt, Homo sapiens
gagaauauugguggaaucu

SEQ ID NO: 211588 - RNA, 19 nt, Homo sapiens
ccagcuccaucaucagcaa

SEQ ID NO: 211589 - RNA, 19 nt, Homo sapiens
ccagaggaguucgucaagu

SEQ ID NO: 211590 - RNA, 19 nt, Homo sapiens
gguucuuauuuguggcuua

SEQ ID NO: 211591 - RNA, 19 nt, Homo sapiens
gccuccagcuccaucauca

SEQ ID NO: 211592 - RNA, 19 nt, Homo sapiens
ggaccagccucaugaacua

SEQ ID NO: 211593 - RNA, 19 nt, Homo sapiens
ggaacuacaugcagucgaa

SEQ ID NO: 211594 - RNA, 19 nt, Homo sapiens
guacaucggccaacauuug

SEQ ID NO: 211595 - RNA, 19 nt, Homo sapiens
ggagaacauugguggcauu

SEQ ID NO: 211596 - RNA, 19 nt, Homo sapiens
gggagaaggucaucgacuu

SEQ ID NO: 211597 - RNA, 19 nt, Homo sapiens
ucaaggagauccgugauga

SEQ ID NO: 211598 - RNA, 19 nt, Homo sapiens
gggagaaaccucggaauuu

SEQ ID NO: 211599 - RNA, 19 nt, Homo sapiens
ggaggaccaucgagcuaaa

SEQ ID NO: 211600 - RNA, 19 nt, Homo sapiens
ccacaccacugcucaagga

SEQ ID NO: 211601 - RNA, 19 nt, Homo sapiens
ucacaaccauccuggagaa

SEQ ID NO: 211602 - RNA, 19 nt, Homo sapiens
ggagauccgugaugacaag

SEQ ID NO: 211603 - RNA, 19 nt, Homo sapiens
gggaaugaccucagcguuu

SEQ ID NO: 211604 - RNA, 19 nt, Homo sapiens
caccaugugucagaucuua

SEQ ID NO: 211605 - RNA, 19 nt, Homo sapiens
ggagaaggucaucgacuuu

SEQ ID NO: 211606 - RNA, 19 nt, Homo sapiens
ggaaugaccucagcguuuu

SEQ ID NO: 211607 - RNA, 19 nt, Homo sapiens
ugucagaucuuacccaaag

SEQ ID NO: 211608 - RNA, 19 nt, Homo sapiens
ccgaugaccuggcagauca

SEQ ID NO: 211609 - RNA, 19 nt, Homo sapiens
ggagaacccauacgucaug

SEQ ID NO: 211610 - RNA, 19 nt, Homo sapiens
cagcagggcucggagauca

SEQ ID NO: 211611 - RNA, 19 nt, Homo sapiens
gcucaucuguggccucauc

SEQ ID NO: 211612 - RNA, 19 nt, Homo sapiens
ccaucgagcuaaagguuug

SEQ ID NO: 211613 - RNA, 19 nt, Homo sapiens
gcaaagggcagagaaccaa

SEQ ID NO: 211614 - RNA, 19 nt, Homo sapiens
ggaaguagacaucuuugag

SEQ ID NO: 211615 - RNA, 19 nt, Homo sapiens
ccaccacccuggacaucaa

SEQ ID NO: 211616 - RNA, 19 nt, Homo sapiens
gugcguggcuuccucaucu

SEQ ID NO: 211617 - RNA, 19 nt, Homo sapiens
ccucggaauuucuaugaga

SEQ ID NO: 211618 - RNA, 19 nt, Homo sapiens
ggucauggaauucauaugg

SEQ ID NO: 211619 - RNA, 19 nt, Homo sapiens
gaccaucgagcuaaagguu

SEQ ID NO: 211620 - RNA, 19 nt, Homo sapiens
gaggaggaccaucgagcua

SEQ ID NO: 211621 - RNA, 19 nt, Homo sapiens
gcagggccaccgugagauu

SEQ ID NO: 211622 - RNA, 19 nt, Homo sapiens
agaccaacaucgaguaugg

SEQ ID NO: 211623 - RNA, 19 nt, Homo sapiens
ccaaggagacgcugucagu

SEQ ID NO: 211624 - RNA, 19 nt, Homo sapiens
gaguggaaguagacaucuu

SEQ ID NO: 211625 - RNA, 19 nt, Homo sapiens
ccucaucauugcugucuuc

SEQ ID NO: 211626 - RNA, 19 nt, Homo sapiens
ccaaagggguugugucugu

SEQ ID NO: 211627 - RNA, 19 nt, Homo sapiens
gccaggagaucggugugaa

SEQ ID NO: 211628 - RNA, 19 nt, Homo sapiens
ccucagcguuuuacaagua

SEQ ID NO: 211629 - RNA, 19 nt, Homo sapiens
ccauaucuguggagagaag

SEQ ID NO: 211630 - RNA, 19 nt, Homo sapiens
gagaacauugguggcauuu

SEQ ID NO: 211631 - RNA, 19 nt, Homo sapiens
aguccaccaugaacgaaua

SEQ ID NO: 211632 - RNA, 19 nt, Homo sapiens
gaagcagcccagcguguuc

SEQ ID NO: 211633 - RNA, 19 nt, Homo sapiens
gggcagagaaccaacuaca

SEQ ID NO: 211634 - RNA, 19 nt, Homo sapiens
ugaagccucuggccuguac

SEQ ID NO: 211635 - RNA, 19 nt, Homo sapiens
gaacaaccggcuggagauc

SEQ ID NO: 211636 - RNA, 19 nt, Homo sapiens
gagcacagaagagggcauu

SEQ ID NO: 211637 - RNA, 19 nt, Homo sapiens
cgcagacacuggccaacaa

SEQ ID NO: 211638 - RNA, 19 nt, Homo sapiens
acacggaggucagcugagu

SEQ ID NO: 211639 - RNA, 19 nt, Homo sapiens
gcuccaccaugaccuucuu

SEQ ID NO: 211640 - RNA, 19 nt, Homo sapiens
cugagugccugcugcgauu

SEQ ID NO: 211641 - RNA, 19 nt, Homo sapiens
guaacgaggacgucagcuu

SEQ ID NO: 211642 - RNA, 19 nt, Homo sapiens
agccauaucuguggagaga

SEQ ID NO: 211643 - RNA, 19 nt, Homo sapiens
caucuguggccucaucauu

SEQ ID NO: 211644 - RNA, 19 nt, Homo sapiens
ugucagcugcguccuguuu

SEQ ID NO: 211645 - RNA, 19 nt, Homo sapiens
cagcugagcgggagaaggu

SEQ ID NO: 211646 - RNA, 19 nt, Homo sapiens
caccacugcucaaggagau

SEQ ID NO: 211647 - RNA, 19 nt, Homo sapiens
aaggagacgcugucaguga

SEQ ID NO: 211648 - RNA, 19 nt, Homo sapiens
caccaagggcuacggcauu

SEQ ID NO: 211649 - RNA, 19 nt, Homo sapiens
gcugccaggugcucucauc

SEQ ID NO: 211650 - RNA, 19 nt, Homo sapiens
cagcgcauguggaacuaca

SEQ ID NO: 211651 - RNA, 19 nt, Homo sapiens
caacagcaaagggcagaga

SEQ ID NO: 211652 - RNA, 19 nt, Homo sapiens
ccucaaguccuucaacuac

SEQ ID NO: 211653 - RNA, 19 nt, Homo sapiens
cgaagcagcccagcguguu

SEQ ID NO: 211654 - RNA, 19 nt, Homo sapiens
gggucgaguucaacagcaa

SEQ ID NO: 211655 - RNA, 19 nt, Homo sapiens
ugaacuaccugcgcauggu

SEQ ID NO: 211656 - RNA, 19 nt, Homo sapiens
gccaggugcucucaucacu

SEQ ID NO: 211657 - RNA, 19 nt, Homo sapiens
acucuucucuuccucucuu

SEQ ID NO: 211658 - RNA, 19 nt, Homo sapiens
ucguggcggucauggaauu

SEQ ID NO: 211659 - RNA, 19 nt, Homo sapiens
gcuuggcggucucccgaau

SEQ ID NO: 211660 - RNA, 19 nt, Homo sapiens
cuaaagguuugggcaugga

SEQ ID NO: 211661 - RNA, 19 nt, Homo sapiens
gcacagaagagggcauugc

SEQ ID NO: 211662 - RNA, 19 nt, Homo sapiens
gcagggcucggagaucaug

SEQ ID NO: 211663 - RNA, 19 nt, Homo sapiens
guccgcagccucaacaugu

SEQ ID NO: 211664 - RNA, 19 nt, Homo sapiens
cagaucagaccaacaucga

SEQ ID NO: 211665 - RNA, 19 nt, Homo sapiens
gcaucuggacgguauugug

SEQ ID NO: 211666 - RNA, 19 nt, Homo sapiens
gucauggaauucauauggu

SEQ ID NO: 211667 - RNA, 19 nt, Homo sapiens
uggcagaucagaccaacau

SEQ ID NO: 211668 - RNA, 19 nt, Homo sapiens
gguggaggaugggcuguac

SEQ ID NO: 211669 - RNA, 19 nt, Homo sapiens
accaagggcuacggcauug

SEQ ID NO: 211670 - RNA, 19 nt, Homo sapiens
aaacguaccagcgcaugug

SEQ ID NO: 211671 - RNA, 19 nt, Homo sapiens
cacgggaccagccucauga

SEQ ID NO: 211672 - RNA, 19 nt, Homo sapiens
gaaccgcagccaggagauc

SEQ ID NO: 211673 - RNA, 19 nt, Homo sapiens
ggacgaugcugccacugua

SEQ ID NO: 211674 - RNA, 19 nt, Homo sapiens
gcugaugucuuccaaguau

SEQ ID NO: 211675 - RNA, 19 nt, Homo sapiens
gccgggaucuuccugauuu

SEQ ID NO: 211676 - RNA, 19 nt, Homo sapiens
aagcagagcuccguggaua

SEQ ID NO: 211677 - RNA, 19 nt, Homo sapiens
ggagcacgcuggacucguu

SEQ ID NO: 211678 - RNA, 19 nt, Homo sapiens
gcacccacgucaucccuaa

SEQ ID NO: 211679 - RNA, 19 nt, Homo sapiens
cagagaaggugcugcaguu

SEQ ID NO: 211680 - RNA, 19 nt, Homo sapiens
agaaggugcugcaguuuga

SEQ ID NO: 211681 - RNA, 19 nt, Homo sapiens
ggugaugccuaaaggaaug

SEQ ID NO: 211682 - RNA, 19 nt, Homo sapiens
gcaucgaccugcucaucaa

SEQ ID NO: 211683 - RNA, 19 nt, Homo sapiens
ccacgagaauggcuucaug

SEQ ID NO: 211684 - RNA, 19 nt, Homo sapiens
gcaacaagaaggaguggaa

SEQ ID NO: 211685 - RNA, 19 nt, Homo sapiens
ccaccagacugaagauugu

SEQ ID NO: 211686 - RNA, 19 nt, Homo sapiens
gaacaacagcaacaagaag

SEQ ID NO: 211687 - RNA, 19 nt, Homo sapiens
agagagugcugaugucuuc

SEQ ID NO: 211688 - RNA, 19 nt, Homo sapiens
gcaaggaggaguucacagu

SEQ ID NO: 211689 - RNA, 19 nt, Homo sapiens
gcacggcuccuggaagauu

SEQ ID NO: 211690 - RNA, 19 nt, Homo sapiens
gguggcagauggcaaguuc

SEQ ID NO: 211691 - RNA, 19 nt, Homo sapiens
ggacaugcaaggaggaguu

SEQ ID NO: 211692 - RNA, 19 nt, Homo sapiens
caagugggcaucuacaaug

SEQ ID NO: 211693 - RNA, 19 nt, Homo sapiens
gcaagugggcaucuacaau

SEQ ID NO: 211694 - RNA, 19 nt, Homo sapiens
gaacgagucggcccacauc

SEQ ID NO: 211695 - RNA, 19 nt, Homo sapiens
gagaaggugcugcaguuug

SEQ ID NO: 211696 - RNA, 19 nt, Homo sapiens
ggucuacgccauccuaguu

SEQ ID NO: 211697 - RNA, 19 nt, Homo sapiens
ggaguggaaugggaugaug

SEQ ID NO: 211698 - RNA, 19 nt, Homo sapiens
gacugaagauugugacgau

SEQ ID NO: 211699 - RNA, 19 nt, Homo sapiens
ugacggcccugcugaugga

SEQ ID NO: 211700 - RNA, 19 nt, Homo sapiens
ucaucgagauugccuacaa

SEQ ID NO: 211701 - RNA, 19 nt, Homo sapiens
gugcugaugucuuccaagu

SEQ ID NO: 211702 - RNA, 19 nt, Homo sapiens
cuaguuagccauccaccua

SEQ ID NO: 211703 - RNA, 19 nt, Homo sapiens
gcucgggacugucuucaac

SEQ ID NO: 211704 - RNA, 19 nt, Homo sapiens
uuuccaagcccuucaagua

SEQ ID NO: 211705 - RNA, 19 nt, Homo sapiens
agacguggguucgguauca

SEQ ID NO: 211706 - RNA, 19 nt, Homo sapiens
uggaagaccuggacaagac

SEQ ID NO: 211707 - RNA, 19 nt, Homo sapiens
ggaagcacgagcagauguu

SEQ ID NO: 211708 - RNA, 19 nt, Homo sapiens
agagucaggagccgaaaua

SEQ ID NO: 211709 - RNA, 19 nt, Homo sapiens
guuaacguguggcggaaga

SEQ ID NO: 211710 - RNA, 19 nt, Homo sapiens
cuacacagccggcuucuac

SEQ ID NO: 211711 - RNA, 19 nt, Homo sapiens
ccucauuucugaaccuugu

SEQ ID NO: 211712 - RNA, 19 nt, Homo sapiens
gugaacaacagcaacaaga

SEQ ID NO: 211713 - RNA, 19 nt, Homo sapiens
cccaagaucgucaacauug

SEQ ID NO: 211714 - RNA, 19 nt, Homo sapiens
caagcugcaugccuucauc

SEQ ID NO: 211715 - RNA, 19 nt, Homo sapiens
ccuggaagauucagcucaa

SEQ ID NO: 211716 - RNA, 19 nt, Homo sapiens
cgagaauggcuucauggaa

SEQ ID NO: 211717 - RNA, 19 nt, Homo sapiens
gcagagcuccguggauauc

SEQ ID NO: 211718 - RNA, 19 nt, Homo sapiens
ggaagcugagggugugaaa

SEQ ID NO: 211719 - RNA, 19 nt, Homo sapiens
ugaacaacagcaacaagaa

SEQ ID NO: 211720 - RNA, 19 nt, Homo sapiens
caacggcgacccagucaag

SEQ ID NO: 211721 - RNA, 19 nt, Homo sapiens
ucaagagagugcugauguc

SEQ ID NO: 211722 - RNA, 19 nt, Homo sapiens
cgcguucgguccuauuaaa

SEQ ID NO: 211723 - RNA, 19 nt, Homo sapiens
gcaacaccaacaucuggaa

SEQ ID NO: 211724 - RNA, 19 nt, Homo sapiens
cacaggagcgggugaacaa

SEQ ID NO: 211725 - RNA, 19 nt, Homo sapiens
ccacccgcauguccaucua

SEQ ID NO: 211726 - RNA, 19 nt, Homo sapiens
gaagcacaacuacgagagu

SEQ ID NO: 211727 - RNA, 19 nt, Homo sapiens
aaggaggaguucacaguca

SEQ ID NO: 211728 - RNA, 19 nt, Homo sapiens
ccaacuacagcaucaugaa

SEQ ID NO: 211729 - RNA, 19 nt, Homo sapiens
ggaagauucagcucaaugc

SEQ ID NO: 211730 - RNA, 19 nt, Homo sapiens
gacgcguucgguccuauua

SEQ ID NO: 211731 - RNA, 19 nt, Homo sapiens
gccucucccucauuucuga

SEQ ID NO: 211732 - RNA, 19 nt, Homo sapiens
gcagaugcagcuggccuuu

SEQ ID NO: 211733 - RNA, 19 nt, Homo sapiens
ccucaagucccacgagaau

SEQ ID NO: 211734 - RNA, 19 nt, Homo sapiens
gcacacaggagcgggugaa

SEQ ID NO: 211735 - RNA, 19 nt, Homo sapiens
ccuaaugacaggaagauca

SEQ ID NO: 211736 - RNA, 19 nt, Homo sapiens
ccaccuccgucacgcacaa

SEQ ID NO: 211737 - RNA, 19 nt, Homo sapiens
gcaguggugaugccuaaag

SEQ ID NO: 211738 - RNA, 19 nt, Homo sapiens
agagcuccguggauaucua

SEQ ID NO: 211739 - RNA, 19 nt, Homo sapiens
gucaggagccgaaauaucg

SEQ ID NO: 211740 - RNA, 19 nt, Homo sapiens
ccucgaggguaccagaugu

SEQ ID NO: 211741 - RNA, 19 nt, Homo sapiens
augcaguggugaugccuaa

SEQ ID NO: 211742 - RNA, 19 nt, Homo sapiens
caucgagauugccuacaag

SEQ ID NO: 211743 - RNA, 19 nt, Homo sapiens
gcaaagacagccccuggaa

SEQ ID NO: 211744 - RNA, 19 nt, Homo sapiens
uggagaagcacaacuacga

SEQ ID NO: 211745 - RNA, 19 nt, Homo sapiens
ugacuggucgcguggaguu

SEQ ID NO: 211746 - RNA, 19 nt, Homo sapiens
ccaggucuacgccauccua

SEQ ID NO: 211747 - RNA, 19 nt, Homo sapiens
guggugaugccuaaaggaa

SEQ ID NO: 211748 - RNA, 19 nt, Homo sapiens
ccuacaagcggcacaagga

SEQ ID NO: 211749 - RNA, 19 nt, Homo sapiens
ucaagucccacgagaaugg

SEQ ID NO: 211750 - RNA, 19 nt, Homo sapiens
gaagcagagcuccguggau

SEQ ID NO: 211751 - RNA, 19 nt, Homo sapiens
ccucggacaaguuuaucua

SEQ ID NO: 211752 - RNA, 19 nt, Homo sapiens
gaagcacgagcagauguuc

SEQ ID NO: 211753 - RNA, 19 nt, Homo sapiens
caauggcacccacgucauc

SEQ ID NO: 211754 - RNA, 19 nt, Homo sapiens
caacaagaaggaguggaau

SEQ ID NO: 211755 - RNA, 19 nt, Homo sapiens
gacugugggugacgacucu

SEQ ID NO: 211756 - RNA, 19 nt, Homo sapiens
accaggagcccuucgugua

SEQ ID NO: 211757 - RNA, 19 nt, Homo sapiens
gagugcugaugucuuccaa

SEQ ID NO: 211758 - RNA, 19 nt, Homo sapiens
gcgugugguuugagaugau

SEQ ID NO: 211759 - RNA, 19 nt, Homo sapiens
gaaccccucggacaaguuu

SEQ ID NO: 211760 - RNA, 19 nt, Homo sapiens
agaugcagcuggccuuugc

SEQ ID NO: 211761 - RNA, 19 nt, Homo sapiens
aggaggaguucacagucaa

SEQ ID NO: 211762 - RNA, 19 nt, Homo sapiens
ucaagcccacgcugaguga

SEQ ID NO: 211763 - RNA, 19 nt, Homo sapiens
cagauguccaccagacuga

SEQ ID NO: 211764 - RNA, 19 nt, Homo sapiens
gcucaucaacggcaagaac

SEQ ID NO: 211765 - RNA, 19 nt, Homo sapiens
caagacguggguucgguau

SEQ ID NO: 211766 - RNA, 19 nt, Homo sapiens
gagcuccagucugcaagag

SEQ ID NO: 211767 - RNA, 19 nt, Homo sapiens
auauggagaagcacaacua

SEQ ID NO: 211768 - RNA, 19 nt, Homo sapiens
ccaggagcccuucguguac

SEQ ID NO: 211769 - RNA, 19 nt, Homo sapiens
caacuacagcaucaugaac

SEQ ID NO: 211770 - RNA, 19 nt, Homo sapiens
caagagagugcugaugucu

SEQ ID NO: 211771 - RNA, 19 nt, Homo sapiens
ggagcuccagucugcaaga

SEQ ID NO: 211772 - RNA, 19 nt, Homo sapiens
gagcgcaucacgggcauca

SEQ ID NO: 211773 - RNA, 19 nt, Homo sapiens
ggaagaaccugcaggauag

SEQ ID NO: 211774 - RNA, 19 nt, Homo sapiens
gagcagagccugacccuaa

SEQ ID NO: 211775 - RNA, 19 nt, Homo sapiens
ggacgaugcugccacugua

SEQ ID NO: 211776 - RNA, 19 nt, Homo sapiens
gcugaugucuuccaaguau

SEQ ID NO: 211777 - RNA, 19 nt, Homo sapiens
gccgggaucuuccugauuu

SEQ ID NO: 211778 - RNA, 19 nt, Homo sapiens
aagcagagcuccguggaua

SEQ ID NO: 211779 - RNA, 19 nt, Homo sapiens
ggagcacgcuggacucguu

SEQ ID NO: 211780 - RNA, 19 nt, Homo sapiens
gcacccacgucaucccuaa

SEQ ID NO: 211781 - RNA, 19 nt, Homo sapiens
cagagaaggugcugcaguu

SEQ ID NO: 211782 - RNA, 19 nt, Homo sapiens
agaaggugcugcaguuuga

SEQ ID NO: 211783 - RNA, 19 nt, Homo sapiens
cggaagaaccugcaggaua

SEQ ID NO: 211784 - RNA, 19 nt, Homo sapiens
ggugaugccuaaaggaaug

SEQ ID NO: 211785 - RNA, 19 nt, Homo sapiens
gcaucgaccugcucaucaa

SEQ ID NO: 211786 - RNA, 19 nt, Homo sapiens
ccacgagaauggcuucaug

SEQ ID NO: 211787 - RNA, 19 nt, Homo sapiens
gcaacaagaaggaguggaa

SEQ ID NO: 211788 - RNA, 19 nt, Homo sapiens
ccaccagacugaagauugu

SEQ ID NO: 211789 - RNA, 19 nt, Homo sapiens
gaacaacagcaacaagaag

SEQ ID NO: 211790 - RNA, 19 nt, Homo sapiens
agagagugcugaugucuuc

SEQ ID NO: 211791 - RNA, 19 nt, Homo sapiens
gcaaggaggaguucacagu

SEQ ID NO: 211792 - RNA, 19 nt, Homo sapiens
gcacggcuccuggaagauu

SEQ ID NO: 211793 - RNA, 19 nt, Homo sapiens
cagcuguguucccgucaua

SEQ ID NO: 211794 - RNA, 19 nt, Homo sapiens
gguggcagauggcaaguuc

SEQ ID NO: 211795 - RNA, 19 nt, Homo sapiens
ggacaugcaaggaggaguu

SEQ ID NO: 211796 - RNA, 19 nt, Homo sapiens
caagugggcaucuacaaug

SEQ ID NO: 211797 - RNA, 19 nt, Homo sapiens
gcaagugggcaucuacaau

SEQ ID NO: 211798 - RNA, 19 nt, Homo sapiens
gaacgagucggcccacauc

SEQ ID NO: 211799 - RNA, 19 nt, Homo sapiens
gagaaggugcugcaguuug

SEQ ID NO: 211800 - RNA, 19 nt, Homo sapiens
ggucuacgccauccuaguu

SEQ ID NO: 211801 - RNA, 19 nt, Homo sapiens
ggaguggaaugggaugaug

SEQ ID NO: 211802 - RNA, 19 nt, Homo sapiens
gacugaagauugugacgau

SEQ ID NO: 211803 - RNA, 19 nt, Homo sapiens
ugacggcccugcugaugga

SEQ ID NO: 211804 - RNA, 19 nt, Homo sapiens
ucaucgagauugccuacaa

SEQ ID NO: 211805 - RNA, 19 nt, Homo sapiens
gugcugaugucuuccaagu

SEQ ID NO: 211806 - RNA, 19 nt, Homo sapiens
cuaguuagccauccaccua

SEQ ID NO: 211807 - RNA, 19 nt, Homo sapiens
gcucgggacugucuucaac

SEQ ID NO: 211808 - RNA, 19 nt, Homo sapiens
aaagaaagccacauuuagg

SEQ ID NO: 211809 - RNA, 19 nt, Homo sapiens
caggauagaaagaguggua

SEQ ID NO: 211810 - RNA, 19 nt, Homo sapiens
uuuccaagcccuucaagua

SEQ ID NO: 211811 - RNA, 19 nt, Homo sapiens
agacguggguucgguauca

SEQ ID NO: 211812 - RNA, 19 nt, Homo sapiens
uggaagaccuggacaagac

SEQ ID NO: 211813 - RNA, 19 nt, Homo sapiens
ggaagcacgagcagauguu

SEQ ID NO: 211814 - RNA, 19 nt, Homo sapiens
agagucaggagccgaaaua

SEQ ID NO: 211815 - RNA, 19 nt, Homo sapiens
ccucauuucugaaccuugu

SEQ ID NO: 211816 - RNA, 19 nt, Homo sapiens
guuaacguguggcggaaga

SEQ ID NO: 211817 - RNA, 19 nt, Homo sapiens
cuacacagccggcuucuac

SEQ ID NO: 211818 - RNA, 19 nt, Homo sapiens
gugaacaacagcaacaaga

SEQ ID NO: 211819 - RNA, 19 nt, Homo sapiens
cccaagaucgucaacauug

SEQ ID NO: 211820 - RNA, 19 nt, Homo sapiens
caagcugcaugccuucauc

SEQ ID NO: 211821 - RNA, 19 nt, Homo sapiens
ccuggaagauucagcucaa

SEQ ID NO: 211822 - RNA, 19 nt, Homo sapiens
cgagaauggcuucauggaa

SEQ ID NO: 211823 - RNA, 19 nt, Homo sapiens
gcagagcuccguggauauc

SEQ ID NO: 211824 - RNA, 19 nt, Homo sapiens
ugaacaacagcaacaagaa

SEQ ID NO: 211825 - RNA, 19 nt, Homo sapiens
caacggcgacccagucaag

SEQ ID NO: 211826 - RNA, 19 nt, Homo sapiens
ggaagcugagggugugaaa

SEQ ID NO: 211827 - RNA, 19 nt, Homo sapiens
ucaagagagugcugauguc

SEQ ID NO: 211828 - RNA, 19 nt, Homo sapiens
cgcguucgguccuauuaaa

SEQ ID NO: 211829 - RNA, 19 nt, Homo sapiens
gcaacaccaacaucuggaa

SEQ ID NO: 211830 - RNA, 19 nt, Homo sapiens
cacaggagcgggugaacaa

SEQ ID NO: 211831 - RNA, 19 nt, Homo sapiens
ccacccgcauguccaucua

SEQ ID NO: 211832 - RNA, 19 nt, Homo sapiens
gaaccugcaggauagaaag

SEQ ID NO: 211833 - RNA, 19 nt, Homo sapiens
gaagcacaacuacgagagu

SEQ ID NO: 211834 - RNA, 19 nt, Homo sapiens
aaggaggaguucacaguca

SEQ ID NO: 211835 - RNA, 19 nt, Homo sapiens
ccaacuacagcaucaugaa

SEQ ID NO: 211836 - RNA, 19 nt, Homo sapiens
ggaagauucagcucaaugc

SEQ ID NO: 211837 - RNA, 19 nt, Homo sapiens
gacgcguucgguccuauua

SEQ ID NO: 211838 - RNA, 19 nt, Homo sapiens
gcgccuugucuguguauuu

SEQ ID NO: 211839 - RNA, 19 nt, Homo sapiens
ggauagaaagagugguaga

SEQ ID NO: 211840 - RNA, 19 nt, Homo sapiens
gcagaugcagcuggccuuu

SEQ ID NO: 211841 - RNA, 19 nt, Homo sapiens
ccucaagucccacgagaau

SEQ ID NO: 211842 - RNA, 19 nt, Homo sapiens
gcacacaggagcgggugaa

SEQ ID NO: 211843 - RNA, 19 nt, Homo sapiens
ccuaaugacaggaagauca

SEQ ID NO: 211844 - RNA, 19 nt, Homo sapiens
gccucucccucauuucuga

SEQ ID NO: 211845 - RNA, 19 nt, Homo sapiens
ccaccuccgucacgcacaa

SEQ ID NO: 211846 - RNA, 19 nt, Homo sapiens
ccuugucuguguauuucua

SEQ ID NO: 211847 - RNA, 19 nt, Homo sapiens
gaagaaccugcaggauaga

SEQ ID NO: 211848 - RNA, 19 nt, Homo sapiens
gcaguggugaugccuaaag

SEQ ID NO: 211849 - RNA, 19 nt, Homo sapiens
aggcguagguccuccaaag

SEQ ID NO: 211850 - RNA, 19 nt, Homo sapiens
agagcuccguggauaucua

SEQ ID NO: 211851 - RNA, 19 nt, Homo sapiens
gucaggagccgaaauaucg

SEQ ID NO: 211852 - RNA, 19 nt, Homo sapiens
ccucgaggguaccagaugu

SEQ ID NO: 211853 - RNA, 19 nt, Homo sapiens
augcaguggugaugccuaa

SEQ ID NO: 211854 - RNA, 19 nt, Homo sapiens
caucgagauugccuacaag

SEQ ID NO: 211855 - RNA, 19 nt, Homo sapiens
gcaaagacagccccuggaa

SEQ ID NO: 211856 - RNA, 19 nt, Homo sapiens
uggagaagcacaacuacga

SEQ ID NO: 211857 - RNA, 19 nt, Homo sapiens
ugacuggucgcguggaguu

SEQ ID NO: 211858 - RNA, 19 nt, Homo sapiens
ccaggucuacgccauccua

SEQ ID NO: 211859 - RNA, 19 nt, Homo sapiens
guggugaugccuaaaggaa

SEQ ID NO: 211860 - RNA, 19 nt, Homo sapiens
cguagguccuccaaagaca

SEQ ID NO: 211861 - RNA, 19 nt, Homo sapiens
ccuacaagcggcacaagga

SEQ ID NO: 211862 - RNA, 19 nt, Homo sapiens
ucaagucccacgagaaugg

SEQ ID NO: 211863 - RNA, 19 nt, Homo sapiens
gaagcagagcuccguggau

SEQ ID NO: 211864 - RNA, 19 nt, Homo sapiens
ccucggacaaguuuaucua

SEQ ID NO: 211865 - RNA, 19 nt, Homo sapiens
gaagcacgagcagauguuc

SEQ ID NO: 211866 - RNA, 19 nt, Homo sapiens
caauggcacccacgucauc

SEQ ID NO: 211867 - RNA, 19 nt, Homo sapiens
cgccuugucuguguauuuc

SEQ ID NO: 211868 - RNA, 19 nt, Homo sapiens
caacaagaaggaguggaau

SEQ ID NO: 211869 - RNA, 19 nt, Homo sapiens
accaggagcccuucgugua

SEQ ID NO: 211870 - RNA, 19 nt, Homo sapiens
gagugcugaugucuuccaa

SEQ ID NO: 211871 - RNA, 19 nt, Homo sapiens
gacugugggugacgacucu

SEQ ID NO: 211872 - RNA, 19 nt, Homo sapiens
gcgugugguuugagaugau

SEQ ID NO: 211873 - RNA, 19 nt, Homo sapiens
ggacgaugcugccacugua

SEQ ID NO: 211874 - RNA, 19 nt, Homo sapiens
gcugaugucuuccaaguau

SEQ ID NO: 211875 - RNA, 19 nt, Homo sapiens
gccgggaucuuccugauuu

SEQ ID NO: 211876 - RNA, 19 nt, Homo sapiens
aagcagagcuccguggaua

SEQ ID NO: 211877 - RNA, 19 nt, Homo sapiens
ggagcacgcuggacucguu

SEQ ID NO: 211878 - RNA, 19 nt, Homo sapiens
gcacccacgucaucccuaa

SEQ ID NO: 211879 - RNA, 19 nt, Homo sapiens
cagagaaggugcugcaguu

SEQ ID NO: 211880 - RNA, 19 nt, Homo sapiens
agaaggugcugcaguuuga

SEQ ID NO: 211881 - RNA, 19 nt, Homo sapiens
ggugaugccuaaaggaaug

SEQ ID NO: 211882 - RNA, 19 nt, Homo sapiens
gcaucgaccugcucaucaa

SEQ ID NO: 211883 - RNA, 19 nt, Homo sapiens
ccacgagaauggcuucaug

SEQ ID NO: 211884 - RNA, 19 nt, Homo sapiens
gcaacaagaaggaguggaa

SEQ ID NO: 211885 - RNA, 19 nt, Homo sapiens
ccaccagacugaagauugu

SEQ ID NO: 211886 - RNA, 19 nt, Homo sapiens
gaacaacagcaacaagaag

SEQ ID NO: 211887 - RNA, 19 nt, Homo sapiens
agagagugcugaugucuuc

SEQ ID NO: 211888 - RNA, 19 nt, Homo sapiens
gcaaggaggaguucacagu

SEQ ID NO: 211889 - RNA, 19 nt, Homo sapiens
gcacggcuccuggaagauu

SEQ ID NO: 211890 - RNA, 19 nt, Homo sapiens
cagcuguguucccgucaua

SEQ ID NO: 211891 - RNA, 19 nt, Homo sapiens
gguggcagauggcaaguuc

SEQ ID NO: 211892 - RNA, 19 nt, Homo sapiens
ggacaugcaaggaggaguu

SEQ ID NO: 211893 - RNA, 19 nt, Homo sapiens
caagugggcaucuacaaug

SEQ ID NO: 211894 - RNA, 19 nt, Homo sapiens
gcaagugggcaucuacaau

SEQ ID NO: 211895 - RNA, 19 nt, Homo sapiens
gaacgagucggcccacauc

SEQ ID NO: 211896 - RNA, 19 nt, Homo sapiens
gagaaggugcugcaguuug

SEQ ID NO: 211897 - RNA, 19 nt, Homo sapiens
ggucuacgccauccuaguu

SEQ ID NO: 211898 - RNA, 19 nt, Homo sapiens
ggaguggaaugggaugaug

SEQ ID NO: 211899 - RNA, 19 nt, Homo sapiens
gacugaagauugugacgau

SEQ ID NO: 211900 - RNA, 19 nt, Homo sapiens
ugacggcccugcugaugga

SEQ ID NO: 211901 - RNA, 19 nt, Homo sapiens
ucaucgagauugccuacaa

SEQ ID NO: 211902 - RNA, 19 nt, Homo sapiens
gugcugaugucuuccaagu

SEQ ID NO: 211903 - RNA, 19 nt, Homo sapiens
cuaguuagccauccaccua

SEQ ID NO: 211904 - RNA, 19 nt, Homo sapiens
gcucgggacugucuucaac

SEQ ID NO: 211905 - RNA, 19 nt, Homo sapiens
uuuccaagcccuucaagua

SEQ ID NO: 211906 - RNA, 19 nt, Homo sapiens
agacguggguucgguauca

SEQ ID NO: 211907 - RNA, 19 nt, Homo sapiens
uggaagaccuggacaagac

SEQ ID NO: 211908 - RNA, 19 nt, Homo sapiens
ggaagcacgagcagauguu

SEQ ID NO: 211909 - RNA, 19 nt, Homo sapiens
agagucaggagccgaaaua

SEQ ID NO: 211910 - RNA, 19 nt, Homo sapiens
guuaacguguggcggaaga

SEQ ID NO: 211911 - RNA, 19 nt, Homo sapiens
cuacacagccggcuucuac

SEQ ID NO: 211912 - RNA, 19 nt, Homo sapiens
ccucauuucugaaccuugu

SEQ ID NO: 211913 - RNA, 19 nt, Homo sapiens
gugaacaacagcaacaaga

SEQ ID NO: 211914 - RNA, 19 nt, Homo sapiens
cccaagaucgucaacauug

SEQ ID NO: 211915 - RNA, 19 nt, Homo sapiens
caagcugcaugccuucauc

SEQ ID NO: 211916 - RNA, 19 nt, Homo sapiens
ccuggaagauucagcucaa

SEQ ID NO: 211917 - RNA, 19 nt, Homo sapiens
cgagaauggcuucauggaa

SEQ ID NO: 211918 - RNA, 19 nt, Homo sapiens
gcagagcuccguggauauc

SEQ ID NO: 211919 - RNA, 19 nt, Homo sapiens
ggaagcugagggugugaaa

SEQ ID NO: 211920 - RNA, 19 nt, Homo sapiens
ugaacaacagcaacaagaa

SEQ ID NO: 211921 - RNA, 19 nt, Homo sapiens
caacggcgacccagucaag

SEQ ID NO: 211922 - RNA, 19 nt, Homo sapiens
ucaagagagugcugauguc

SEQ ID NO: 211923 - RNA, 19 nt, Homo sapiens
cgcguucgguccuauuaaa

SEQ ID NO: 211924 - RNA, 19 nt, Homo sapiens
gcaacaccaacaucuggaa

SEQ ID NO: 211925 - RNA, 19 nt, Homo sapiens
cacaggagcgggugaacaa

SEQ ID NO: 211926 - RNA, 19 nt, Homo sapiens
ccacccgcauguccaucua

SEQ ID NO: 211927 - RNA, 19 nt, Homo sapiens
gaagcacaacuacgagagu

SEQ ID NO: 211928 - RNA, 19 nt, Homo sapiens
aaggaggaguucacaguca

SEQ ID NO: 211929 - RNA, 19 nt, Homo sapiens
ccaacuacagcaucaugaa

SEQ ID NO: 211930 - RNA, 19 nt, Homo sapiens
ggaagauucagcucaaugc

SEQ ID NO: 211931 - RNA, 19 nt, Homo sapiens
gacgcguucgguccuauua

SEQ ID NO: 211932 - RNA, 19 nt, Homo sapiens
gcgccuugucuguguauuu

SEQ ID NO: 211933 - RNA, 19 nt, Homo sapiens
gcagaugcagcuggccuuu

SEQ ID NO: 211934 - RNA, 19 nt, Homo sapiens
ccucaagucccacgagaau

SEQ ID NO: 211935 - RNA, 19 nt, Homo sapiens
gcacacaggagcgggugaa

SEQ ID NO: 211936 - RNA, 19 nt, Homo sapiens
ccuaaugacaggaagauca

SEQ ID NO: 211937 - RNA, 19 nt, Homo sapiens
gccucucccucauuucuga

SEQ ID NO: 211938 - RNA, 19 nt, Homo sapiens
ccaccuccgucacgcacaa

SEQ ID NO: 211939 - RNA, 19 nt, Homo sapiens
ccuugucuguguauuucua

SEQ ID NO: 211940 - RNA, 19 nt, Homo sapiens
gcaguggugaugccuaaag

SEQ ID NO: 211941 - RNA, 19 nt, Homo sapiens
agagcuccguggauaucua

SEQ ID NO: 211942 - RNA, 19 nt, Homo sapiens
ccucgaggguaccagaugu

SEQ ID NO: 211943 - RNA, 19 nt, Homo sapiens
gucaggagccgaaauaucg

SEQ ID NO: 211944 - RNA, 19 nt, Homo sapiens
augcaguggugaugccuaa

SEQ ID NO: 211945 - RNA, 19 nt, Homo sapiens
caucgagauugccuacaag

SEQ ID NO: 211946 - RNA, 19 nt, Homo sapiens
gcaaagacagccccuggaa

SEQ ID NO: 211947 - RNA, 19 nt, Homo sapiens
uggagaagcacaacuacga

SEQ ID NO: 211948 - RNA, 19 nt, Homo sapiens
ugacuggucgcguggaguu

SEQ ID NO: 211949 - RNA, 19 nt, Homo sapiens
ccaggucuacgccauccua

SEQ ID NO: 211950 - RNA, 19 nt, Homo sapiens
guggugaugccuaaaggaa

SEQ ID NO: 211951 - RNA, 19 nt, Homo sapiens
ccuacaagcggcacaagga

SEQ ID NO: 211952 - RNA, 19 nt, Homo sapiens
ucaagucccacgagaaugg

SEQ ID NO: 211953 - RNA, 19 nt, Homo sapiens
gaagcagagcuccguggau

SEQ ID NO: 211954 - RNA, 19 nt, Homo sapiens
ccucggacaaguuuaucua

SEQ ID NO: 211955 - RNA, 19 nt, Homo sapiens
gaagcacgagcagauguuc

SEQ ID NO: 211956 - RNA, 19 nt, Homo sapiens
caauggcacccacgucauc

SEQ ID NO: 211957 - RNA, 19 nt, Homo sapiens
cgccuugucuguguauuuc

SEQ ID NO: 211958 - RNA, 19 nt, Homo sapiens
gacugugggugacgacucu

SEQ ID NO: 211959 - RNA, 19 nt, Homo sapiens
caacaagaaggaguggaau

SEQ ID NO: 211960 - RNA, 19 nt, Homo sapiens
accaggagcccuucgugua

SEQ ID NO: 211961 - RNA, 19 nt, Homo sapiens
gagugcugaugucuuccaa

SEQ ID NO: 211962 - RNA, 19 nt, Homo sapiens
gcgugugguuugagaugau

SEQ ID NO: 211963 - RNA, 19 nt, Homo sapiens
gcagcuguguucccgucau

SEQ ID NO: 211964 - RNA, 19 nt, Homo sapiens
gaaccccucggacaaguuu

SEQ ID NO: 211965 - RNA, 19 nt, Homo sapiens
agaugcagcuggccuuugc

SEQ ID NO: 211966 - RNA, 19 nt, Homo sapiens
aggaggaguucacagucaa

SEQ ID NO: 211967 - RNA, 19 nt, Homo sapiens
ucaagcccacgcugaguga

SEQ ID NO: 211968 - RNA, 19 nt, Homo sapiens
cagauguccaccagacuga

SEQ ID NO: 211969 - RNA, 19 nt, Homo sapiens
gcucaucaacggcaagaac

SEQ ID NO: 211970 - RNA, 19 nt, Homo sapiens
caagacguggguucgguau

SEQ ID NO: 211971 - RNA, 19 nt, Homo sapiens
ggagcuccagucugcaaga

SEQ ID NO: 211972 - RNA, 19 nt, Homo sapiens
auauggagaagcacaacua

SEQ ID NO: 211973 - RNA, 19 nt, Homo sapiens
gaacaaugcccuucaauua

SEQ ID NO: 211974 - RNA, 19 nt, Homo sapiens
gcaagaaaguuaacaaugu

SEQ ID NO: 211975 - RNA, 19 nt, Homo sapiens
gaacgaacuccaaacauuu

SEQ ID NO: 211976 - RNA, 19 nt, Homo sapiens
ccagauaggugaguccuua

SEQ ID NO: 211977 - RNA, 19 nt, Homo sapiens
gacaagaucuacacuauag

SEQ ID NO: 211978 - RNA, 19 nt, Homo sapiens
gagacaagaucuacacuau

SEQ ID NO: 211979 - RNA, 19 nt, Homo sapiens
gaucauggcugacaaggau

SEQ ID NO: 211980 - RNA, 19 nt, Homo sapiens
ccuaaugguuucucuaaua

SEQ ID NO: 211981 - RNA, 19 nt, Homo sapiens
gugcauauaugacaugaaa

SEQ ID NO: 211982 - RNA, 19 nt, Homo sapiens
ucagagaccucaugacuau

SEQ ID NO: 211983 - RNA, 19 nt, Homo sapiens
ggaauuugauguacucaga

SEQ ID NO: 211984 - RNA, 19 nt, Homo sapiens
gaauaacuaucccuacaug

SEQ ID NO: 211985 - RNA, 19 nt, Homo sapiens
ggaugaaugugaagaaaug

SEQ ID NO: 211986 - RNA, 19 nt, Homo sapiens
caacagagauguaggaaaa

SEQ ID NO: 211987 - RNA, 19 nt, Homo sapiens
gaacaugugcaagagauua

SEQ ID NO: 211988 - RNA, 19 nt, Homo sapiens
ggacaugccuacuggguau

SEQ ID NO: 211989 - RNA, 19 nt, Homo sapiens
ccucaaaccugugcauaua

SEQ ID NO: 211990 - RNA, 19 nt, Homo sapiens
ugaacgaacuccaaacauu

SEQ ID NO: 211991 - RNA, 19 nt, Homo sapiens
caaaagagcugcugacuuc

SEQ ID NO: 211992 - RNA, 19 nt, Homo sapiens
ggacuucucugugcccuuu

SEQ ID NO: 211993 - RNA, 19 nt, Homo sapiens
gaaguacaaugccaucugu

SEQ ID NO: 211994 - RNA, 19 nt, Homo sapiens
uuaaauuccugcagcaaua

SEQ ID NO: 211995 - RNA, 19 nt, Homo sapiens
ggacaugguuucagauaag

SEQ ID NO: 211996 - RNA, 19 nt, Homo sapiens
acacggagcucaucccaaa

SEQ ID NO: 211997 - RNA, 19 nt, Homo sapiens
guucagagcugcauaaacu

SEQ ID NO: 211998 - RNA, 19 nt, Homo sapiens
caacagaaacuuagccaaa

SEQ ID NO: 211999 - RNA, 19 nt, Homo sapiens
gcagaaggauaaccucaau

SEQ ID NO: 212000 - RNA, 19 nt, Homo sapiens
agacgaggcuguucucauu

SEQ ID NO: 212001 - RNA, 19 nt, Homo sapiens
gaagacgccuauguacgua

SEQ ID NO: 212002 - RNA, 19 nt, Homo sapiens
gcaauauggugugcaugua

SEQ ID NO: 212003 - RNA, 19 nt, Homo sapiens
gaacaaagaccgggaaugg

SEQ ID NO: 212004 - RNA, 19 nt, Homo sapiens
ugaagaucaugcaggauua

SEQ ID NO: 212005 - RNA, 19 nt, Homo sapiens
ccaaacuccucaaaucaaa

SEQ ID NO: 212006 - RNA, 19 nt, Homo sapiens
caagaaaguuaacaaugug

SEQ ID NO: 212007 - RNA, 19 nt, Homo sapiens
ccauggugguguccaauua

SEQ ID NO: 212008 - RNA, 19 nt, Homo sapiens
gaaaaugccuaguaucgaa

SEQ ID NO: 212009 - RNA, 19 nt, Homo sapiens
aggauaaccucaauaacua

SEQ ID NO: 212010 - RNA, 19 nt, Homo sapiens
ugaagaagcuuuccagaac

SEQ ID NO: 212011 - RNA, 19 nt, Homo sapiens
caucagaaaugccuaaugg

SEQ ID NO: 212012 - RNA, 19 nt, Homo sapiens
agacacaucuggagccaaa

SEQ ID NO: 212013 - RNA, 19 nt, Homo sapiens
gaggguaaauguuggaugu

SEQ ID NO: 212014 - RNA, 19 nt, Homo sapiens
ccaauguucuggaggguaa

SEQ ID NO: 212015 - RNA, 19 nt, Homo sapiens
gcucauuguuucugccaua

SEQ ID NO: 212016 - RNA, 19 nt, Homo sapiens
cgacaaaccuagggagcua

SEQ ID NO: 212017 - RNA, 19 nt, Homo sapiens
gaaccucuaugacaucgau

SEQ ID NO: 212018 - RNA, 19 nt, Homo sapiens
guacguaaguuugcauuuc

SEQ ID NO: 212019 - RNA, 19 nt, Homo sapiens
gaagcugccuuuccaacau

SEQ ID NO: 212020 - RNA, 19 nt, Homo sapiens
ggagccugguuuccacuua

SEQ ID NO: 212021 - RNA, 19 nt, Homo sapiens
gggaaucagugucaugguu

SEQ ID NO: 212022 - RNA, 19 nt, Homo sapiens
aguuucagcuuucuuguua

SEQ ID NO: 212023 - RNA, 19 nt, Homo sapiens
caacaacgaccaguauaaa

SEQ ID NO: 212024 - RNA, 19 nt, Homo sapiens
ggacggcauuggcauccua

SEQ ID NO: 212025 - RNA, 19 nt, Homo sapiens
ggucaguggccuccaaaua

SEQ ID NO: 212026 - RNA, 19 nt, Homo sapiens
aaacuuagccaaagggaaa

SEQ ID NO: 212027 - RNA, 19 nt, Homo sapiens
gcauauaugacaugaaaug

SEQ ID NO: 212028 - RNA, 19 nt, Homo sapiens
caauggugauguuaugauu

SEQ ID NO: 212029 - RNA, 19 nt, Homo sapiens
gcaagagauuaggaaguuu

SEQ ID NO: 212030 - RNA, 19 nt, Homo sapiens
aacaugaacuccucaagaa

SEQ ID NO: 212031 - RNA, 19 nt, Homo sapiens
caacaugaacuccucaaga

SEQ ID NO: 212032 - RNA, 19 nt, Homo sapiens
ggcaaagacuuauccuuca

SEQ ID NO: 212033 - RNA, 19 nt, Homo sapiens
guacugugaucuguaagaa

SEQ ID NO: 212034 - RNA, 19 nt, Homo sapiens
ugacugugcuaccuucauu

SEQ ID NO: 212035 - RNA, 19 nt, Homo sapiens
cagaaaugccuaaugguuu

SEQ ID NO: 212036 - RNA, 19 nt, Homo sapiens
cuucuucgcugucauauuc

SEQ ID NO: 212037 - RNA, 19 nt, Homo sapiens
gcaauagacgcguguacaa

SEQ ID NO: 212038 - RNA, 19 nt, Homo sapiens
aagaacaagcuaaggauua

SEQ ID NO: 212039 - RNA, 19 nt, Homo sapiens
gauccacucuucugucauc

SEQ ID NO: 212040 - RNA, 19 nt, Homo sapiens
gccauaaucuuccacucaa

SEQ ID NO: 212041 - RNA, 19 nt, Homo sapiens
gaagauguagggagguauu

SEQ ID NO: 212042 - RNA, 19 nt, Homo sapiens
aaaccaaggacaacuuuaa

SEQ ID NO: 212043 - RNA, 19 nt, Homo sapiens
agaaggauaaccucaauaa

SEQ ID NO: 212044 - RNA, 19 nt, Homo sapiens
ggaaucagugucaugguuu

SEQ ID NO: 212045 - RNA, 19 nt, Homo sapiens
gaagaagcuuuccagaacu

SEQ ID NO: 212046 - RNA, 19 nt, Homo sapiens
caucgggacucauuucugu

SEQ ID NO: 212047 - RNA, 19 nt, Homo sapiens
uaugauuucuucuggauug

SEQ ID NO: 212048 - RNA, 19 nt, Homo sapiens
gacaugaaaugauauccau

SEQ ID NO: 212049 - RNA, 19 nt, Homo sapiens
ggaauugcccuucagaaag

SEQ ID NO: 212050 - RNA, 19 nt, Homo sapiens
caaucuggcugccuucaug

SEQ ID NO: 212051 - RNA, 19 nt, Homo sapiens
aagcauggcaagaaaguua

SEQ ID NO: 212052 - RNA, 19 nt, Homo sapiens
gauuaugacuggcaugucu

SEQ ID NO: 212053 - RNA, 19 nt, Homo sapiens
gaucaggauuuucuaguuu

SEQ ID NO: 212054 - RNA, 19 nt, Homo sapiens
ucaaaccugugcauauaug

SEQ ID NO: 212055 - RNA, 19 nt, Homo sapiens
gacucaggguuguauagua

SEQ ID NO: 212056 - RNA, 19 nt, Homo sapiens
gcacuguagucggauuuga

SEQ ID NO: 212057 - RNA, 19 nt, Homo sapiens
caacaugcccaccuauuca

SEQ ID NO: 212058 - RNA, 19 nt, Homo sapiens
gaaccugacaacaguaaga

SEQ ID NO: 212059 - RNA, 19 nt, Homo sapiens
gcuggacgcuuucaucuac

SEQ ID NO: 212060 - RNA, 19 nt, Homo sapiens
ccacucuucugucaucuug

SEQ ID NO: 212061 - RNA, 19 nt, Homo sapiens
gguuguauaguaucuguua

SEQ ID NO: 212062 - RNA, 19 nt, Homo sapiens
acaaugcccuucaauuaca

SEQ ID NO: 212063 - RNA, 19 nt, Homo sapiens
ccaacaacgaccaguauaa

SEQ ID NO: 212064 - RNA, 19 nt, Homo sapiens
ucaaugaguccaacccuaa

SEQ ID NO: 212065 - RNA, 19 nt, Homo sapiens
gggagcaccucuucuacug

SEQ ID NO: 212066 - RNA, 19 nt, Homo sapiens
ugaggaacguucugaagug

SEQ ID NO: 212067 - RNA, 19 nt, Homo sapiens
cuacaggaaucucuuugga

SEQ ID NO: 212068 - RNA, 19 nt, Homo sapiens
ccuaaagaauagcaaauca

SEQ ID NO: 212069 - RNA, 19 nt, Homo sapiens
cuaaagagcccuagguauc

SEQ ID NO: 212070 - RNA, 19 nt, Homo sapiens
caacaugaacgaacuccaa

SEQ ID NO: 212071 - RNA, 19 nt, Homo sapiens
gguaugauuucuucuggau

SEQ ID NO: 212072 - RNA, 19 nt, Homo sapiens
gaaucucuuuggauguuga

SEQ ID NO: 212073 - RNA, 19 nt, Homo sapiens
caacuuagcugccuucaug

SEQ ID NO: 212074 - RNA, 19 nt, Homo sapiens
gaaaugagcugcacuccau

SEQ ID NO: 212075 - RNA, 19 nt, Homo sapiens
gaaaguacguuaugauagu

SEQ ID NO: 212076 - RNA, 19 nt, Homo sapiens
gaacauggcuaaccugucu

SEQ ID NO: 212077 - RNA, 19 nt, Homo sapiens
cagcuacacugccaacuua

SEQ ID NO: 212078 - RNA, 19 nt, Homo sapiens
gcucaucucuguaucauau

SEQ ID NO: 212079 - RNA, 19 nt, Homo sapiens
agacagagauggccaugua

SEQ ID NO: 212080 - RNA, 19 nt, Homo sapiens
gcaaugggcauguuuauga

SEQ ID NO: 212081 - RNA, 19 nt, Homo sapiens
gaacggaccuuugaagaag

SEQ ID NO: 212082 - RNA, 19 nt, Homo sapiens
uggaagagcuccuugauau

SEQ ID NO: 212083 - RNA, 19 nt, Homo sapiens
ccaauaugcuaaauaggua

SEQ ID NO: 212084 - RNA, 19 nt, Homo sapiens
gaauaugacugguacaucu

SEQ ID NO: 212085 - RNA, 19 nt, Homo sapiens
caacaggucucacaucaag

SEQ ID NO: 212086 - RNA, 19 nt, Homo sapiens
cuaaauagguaucugauca

SEQ ID NO: 212087 - RNA, 19 nt, Homo sapiens
caauaacuaugcagaaaug

SEQ ID NO: 212088 - RNA, 19 nt, Homo sapiens
gaaguaaggagucguguau

SEQ ID NO: 212089 - RNA, 19 nt, Homo sapiens
guauugacauccuuaagaa

SEQ ID NO: 212090 - RNA, 19 nt, Homo sapiens
gaacagcaagcuuccguaa

SEQ ID NO: 212091 - RNA, 19 nt, Homo sapiens
ccagagaccuaaugacuuc

SEQ ID NO: 212092 - RNA, 19 nt, Homo sapiens
gaucggagguggucgacuu

SEQ ID NO: 212093 - RNA, 19 nt, Homo sapiens
ccacugggcucaucucugu

SEQ ID NO: 212094 - RNA, 19 nt, Homo sapiens
ccucagagcccgacuaauu

SEQ ID NO: 212095 - RNA, 19 nt, Homo sapiens
ggaagagacuuggaaaugg

SEQ ID NO: 212096 - RNA, 19 nt, Homo sapiens
cuacagagcagacaguuaa

SEQ ID NO: 212097 - RNA, 19 nt, Homo sapiens
gacaagagcagguggauug

SEQ ID NO: 212098 - RNA, 19 nt, Homo sapiens
gaacagaacccaaggucau

SEQ ID NO: 212099 - RNA, 19 nt, Homo sapiens
ccuccaagcugcacaacua

SEQ ID NO: 212100 - RNA, 19 nt, Homo sapiens
ggccauuuguguuuauaua

SEQ ID NO: 212101 - RNA, 19 nt, Homo sapiens
gauccucgauuucauuuca

SEQ ID NO: 212102 - RNA, 19 nt, Homo sapiens
ggagcggagugaugacuuu

SEQ ID NO: 212103 - RNA, 19 nt, Homo sapiens
gaagccaccuacaucuuug

SEQ ID NO: 212104 - RNA, 19 nt, Homo sapiens
ggaagaagccaccuacauc

SEQ ID NO: 212105 - RNA, 19 nt, Homo sapiens
uuugaucccuucucacuua

SEQ ID NO: 212106 - RNA, 19 nt, Homo sapiens
ggguguagaugaugcauug

SEQ ID NO: 212107 - RNA, 19 nt, Homo sapiens
acagcaagcuuccguaaug

SEQ ID NO: 212108 - RNA, 19 nt, Homo sapiens
gcaagagcaagguacauaa

SEQ ID NO: 212109 - RNA, 19 nt, Homo sapiens
gcagggaguuugacgagau

SEQ ID NO: 212110 - RNA, 19 nt, Homo sapiens
ggcguaagcagcaauauaa

SEQ ID NO: 212111 - RNA, 19 nt, Homo sapiens
gaggagcgccagucuguaa

SEQ ID NO: 212112 - RNA, 19 nt, Homo sapiens
aauggaaccuggaauggua

SEQ ID NO: 212113 - RNA, 19 nt, Homo sapiens
guagucaggugccucaaga

SEQ ID NO: 212114 - RNA, 19 nt, Homo sapiens
cagcaaauccuacuucuuc

SEQ ID NO: 212115 - RNA, 19 nt, Homo sapiens
ucaaacgccuccaccacua

SEQ ID NO: 212116 - RNA, 19 nt, Homo sapiens
gaaguucaccuaugaccuu

SEQ ID NO: 212117 - RNA, 19 nt, Homo sapiens
gaaucuaccaguccaauau

SEQ ID NO: 212118 - RNA, 19 nt, Homo sapiens
gcgaacaccuuuucuauug

SEQ ID NO: 212119 - RNA, 19 nt, Homo sapiens
cauagucacugagaauaaa

SEQ ID NO: 212120 - RNA, 19 nt, Homo sapiens
caggaaggcuaaagggaaa

SEQ ID NO: 212121 - RNA, 19 nt, Homo sapiens
gcaacuguuucaacuuguu

SEQ ID NO: 212122 - RNA, 19 nt, Homo sapiens
cagagauggccauguauua

SEQ ID NO: 212123 - RNA, 19 nt, Homo sapiens
ggagggcccuguaccaaca

SEQ ID NO: 212124 - RNA, 19 nt, Homo sapiens
uaaccugucuggugugaau

SEQ ID NO: 212125 - RNA, 19 nt, Homo sapiens
gaauuugcaucucuucaag

SEQ ID NO: 212126 - RNA, 19 nt, Homo sapiens
auagguaucugaucaaugu

SEQ ID NO: 212127 - RNA, 19 nt, Homo sapiens
gauaauggcagauaaggau

SEQ ID NO: 212128 - RNA, 19 nt, Homo sapiens
gagcagacaguuaagagaa

SEQ ID NO: 212129 - RNA, 19 nt, Homo sapiens
gaauuucacagccaugauu

SEQ ID NO: 212130 - RNA, 19 nt, Homo sapiens
ugaacaaacuggaaaguac

SEQ ID NO: 212131 - RNA, 19 nt, Homo sapiens
gggaggccauuuguguuua

SEQ ID NO: 212132 - RNA, 19 nt, Homo sapiens
gcuaaauucaugcugcuua

SEQ ID NO: 212133 - RNA, 19 nt, Homo sapiens
gaagaagaaccggaacaaa

SEQ ID NO: 212134 - RNA, 19 nt, Homo sapiens
ggagccggguuacaucaaa

SEQ ID NO: 212135 - RNA, 19 nt, Homo sapiens
gcauagucacugagaauaa

SEQ ID NO: 212136 - RNA, 19 nt, Homo sapiens
agaaucagcucaagaaacu

SEQ ID NO: 212137 - RNA, 19 nt, Homo sapiens
gcagcaccauugagaauag

SEQ ID NO: 212138 - RNA, 19 nt, Homo sapiens
caagguacauaaacaaguc

SEQ ID NO: 212139 - RNA, 19 nt, Homo sapiens
ucauuuauccuucgucuuu

SEQ ID NO: 212140 - RNA, 19 nt, Homo sapiens
ucugugaucucaugucuga

SEQ ID NO: 212141 - RNA, 19 nt, Homo sapiens
gagugcagcucuggaggua

SEQ ID NO: 212142 - RNA, 19 nt, Homo sapiens
aaacaaguccucagugguu

SEQ ID NO: 212143 - RNA, 19 nt, Homo sapiens
ggaaaguacguuaugauag

SEQ ID NO: 212144 - RNA, 19 nt, Homo sapiens
ggcaaauucuccuucaaga

SEQ ID NO: 212145 - RNA, 19 nt, Homo sapiens
aggagaaccucuucaguga

SEQ ID NO: 212146 - RNA, 19 nt, Homo sapiens
acaagucccugcagaugaa

SEQ ID NO: 212147 - RNA, 19 nt, Homo sapiens
caacaucauggaagaauau

SEQ ID NO: 212148 - RNA, 19 nt, Homo sapiens
gggaagagacuuggaaaug

SEQ ID NO: 212149 - RNA, 19 nt, Homo sapiens
gaagaacgaacggaccuuu

SEQ ID NO: 212150 - RNA, 19 nt, Homo sapiens
ggagauggaagaacuggaa

SEQ ID NO: 212151 - RNA, 19 nt, Homo sapiens
cgauggagauucuaagauc

SEQ ID NO: 212152 - RNA, 19 nt, Homo sapiens
ucaacaucauggaagaaua

SEQ ID NO: 212153 - RNA, 19 nt, Homo sapiens
gaacgaacggaccuuugaa

SEQ ID NO: 212154 - RNA, 19 nt, Homo sapiens
ggacaacucccugcaggaa

SEQ ID NO: 212155 - RNA, 19 nt, Homo sapiens
caacaugcucacucccuua

SEQ ID NO: 212156 - RNA, 19 nt, Homo sapiens
ggaggcaccauuugucauu

SEQ ID NO: 212157 - RNA, 19 nt, Homo sapiens
gaagaagggacuggacauu

SEQ ID NO: 212158 - RNA, 19 nt, Homo sapiens
gaacugguagccaugaaug

SEQ ID NO: 212159 - RNA, 19 nt, Homo sapiens
gagcuugacauuuaagaga

SEQ ID NO: 212160 - RNA, 19 nt, Homo sapiens
ggugagcaauccugcaaga

SEQ ID NO: 212161 - RNA, 19 nt, Homo sapiens
gugauuguuuggcuuauau

SEQ ID NO: 212162 - RNA, 19 nt, Homo sapiens
ucacaguucucuccuucuu

SEQ ID NO: 212163 - RNA, 19 nt, Homo sapiens
gugugaggcuugcaagaaa

SEQ ID NO: 212164 - RNA, 19 nt, Homo sapiens
gagaaccucuucagugacu

SEQ ID NO: 212165 - RNA, 19 nt, Homo sapiens
gaauguguccagagacuga

SEQ ID NO: 212166 - RNA, 19 nt, Homo sapiens
ggaauuuguccuucaguga

SEQ ID NO: 212167 - RNA, 19 nt, Homo sapiens
ugaaguggccaacucagua

SEQ ID NO: 212168 - RNA, 19 nt, Homo sapiens
ccucucagauuguaccauu

SEQ ID NO: 212169 - RNA, 19 nt, Homo sapiens
ccaagggagucgacgaguu

SEQ ID NO: 212170 - RNA, 19 nt, Homo sapiens
ggccauguauuaccugaau

SEQ ID NO: 212171 - RNA, 19 nt, Homo sapiens
cagaguggauucuugaaca

SEQ ID NO: 212172 - RNA, 19 nt, Homo sapiens
ggacaucaccaccacaaca

SEQ ID NO: 212173 - RNA, 19 nt, Homo sapiens
ucagagcacugggacauua

SEQ ID NO: 212174 - RNA, 19 nt, Homo sapiens
ccacguucccuaugaauua

SEQ ID NO: 212175 - RNA, 19 nt, Homo sapiens
gaucguagacuucucugua

SEQ ID NO: 212176 - RNA, 19 nt, Homo sapiens
ucaaggugcuggaagagua

SEQ ID NO: 212177 - RNA, 19 nt, Homo sapiens
ucaagaagcuggccagagu

SEQ ID NO: 212178 - RNA, 19 nt, Homo sapiens
agacuucucuguacccuuu

SEQ ID NO: 212179 - RNA, 19 nt, Homo sapiens
acaccaagcucugcuguaa

SEQ ID NO: 212180 - RNA, 19 nt, Homo sapiens
gcaucgacauccucaagaa

SEQ ID NO: 212181 - RNA, 19 nt, Homo sapiens
uaauaagauuugccacgua

SEQ ID NO: 212182 - RNA, 19 nt, Homo sapiens
caacauggcaggcgucuuc

SEQ ID NO: 212183 - RNA, 19 nt, Homo sapiens
ggacggagagacacagaaa

SEQ ID NO: 212184 - RNA, 19 nt, Homo sapiens
gaugguggcucgcagcaau

SEQ ID NO: 212185 - RNA, 19 nt, Homo sapiens
ucaguagccucaaaucaug

SEQ ID NO: 212186 - RNA, 19 nt, Homo sapiens
gaugccacguucccuauga

SEQ ID NO: 212187 - RNA, 19 nt, Homo sapiens
gcuccgagaucguagacuu

SEQ ID NO: 212188 - RNA, 19 nt, Homo sapiens
gagcauggcguccuauaca

SEQ ID NO: 212189 - RNA, 19 nt, Homo sapiens
ggacauuaaacccaccuuu

SEQ ID NO: 212190 - RNA, 19 nt, Homo sapiens
gggagcaccuggucuacug

SEQ ID NO: 212191 - RNA, 19 nt, Homo sapiens
gaacauccgcaguaacuac

SEQ ID NO: 212192 - RNA, 19 nt, Homo sapiens
gagaagaacgaggugauga

SEQ ID NO: 212193 - RNA, 19 nt, Homo sapiens
ccauagaccuggcgcucuu

SEQ ID NO: 212194 - RNA, 19 nt, Homo sapiens
caagaucaguacccaccuu

SEQ ID NO: 212195 - RNA, 19 nt, Homo sapiens
ucagaagugugaguuauca

SEQ ID NO: 212196 - RNA, 19 nt, Homo sapiens
cauggaggcuggaacuugu

SEQ ID NO: 212197 - RNA, 19 nt, Homo sapiens
gagacgggcaucaguguga

SEQ ID NO: 212198 - RNA, 19 nt, Homo sapiens
ggcuggaacuugugguuga

SEQ ID NO: 212199 - RNA, 19 nt, Homo sapiens
ggaacgcuccgagaucgua

SEQ ID NO: 212200 - RNA, 19 nt, Homo sapiens
gggcccagcuuucacuauc

SEQ ID NO: 212201 - RNA, 19 nt, Homo sapiens
guauggaacggcaugauug

SEQ ID NO: 212202 - RNA, 19 nt, Homo sapiens
gcgcuggucuucaacaacu

SEQ ID NO: 212203 - RNA, 19 nt, Homo sapiens
gcuagaguuucuucucauc

SEQ ID NO: 212204 - RNA, 19 nt, Homo sapiens
gcauggaggcuggaacuug

SEQ ID NO: 212205 - RNA, 19 nt, Homo sapiens
cgagccagcuggauucucu

SEQ ID NO: 212206 - RNA, 19 nt, Homo sapiens
ccagauccuugacuucauc

SEQ ID NO: 212207 - RNA, 19 nt, Homo sapiens
acacccacauggucaaguu

SEQ ID NO: 212208 - RNA, 19 nt, Homo sapiens
gauccaagagcaauacauc

SEQ ID NO: 212209 - RNA, 19 nt, Homo sapiens
acaggcaccuacugaaugu

SEQ ID NO: 212210 - RNA, 19 nt, Homo sapiens
cuucuuugcugucaucuuc

SEQ ID NO: 212211 - RNA, 19 nt, Homo sapiens
ccagcaagaucaugguucu

SEQ ID NO: 212212 - RNA, 19 nt, Homo sapiens
ggccaucaccgucuucaug

SEQ ID NO: 212213 - RNA, 19 nt, Homo sapiens
ccauauagcccugcagugu

SEQ ID NO: 212214 - RNA, 19 nt, Homo sapiens
ggccagaguggucaaauuc

SEQ ID NO: 212215 - RNA, 19 nt, Homo sapiens
ugaccucaguagccucaaa

SEQ ID NO: 212216 - RNA, 19 nt, Homo sapiens
cagugugggugaugauguu

SEQ ID NO: 212217 - RNA, 19 nt, Homo sapiens
gggcgcuggucuucaacaa

SEQ ID NO: 212218 - RNA, 19 nt, Homo sapiens
uggcuagaguuucuucuca

SEQ ID NO: 212219 - RNA, 19 nt, Homo sapiens
gagucagaagugugaguua

SEQ ID NO: 212220 - RNA, 19 nt, Homo sapiens
agcaauacaucgacacugu

SEQ ID NO: 212221 - RNA, 19 nt, Homo sapiens
uggccagaguggucaaauu

SEQ ID NO: 212222 - RNA, 19 nt, Homo sapiens
cuaccuggcuagaguuucu

SEQ ID NO: 212223 - RNA, 19 nt, Homo sapiens
ccagaguggucaaauucuc

SEQ ID NO: 212224 - RNA, 19 nt, Homo sapiens
gcaggcaggauugggcuuu

SEQ ID NO: 212225 - RNA, 19 nt, Homo sapiens
agucagaagugugaguuau

SEQ ID NO: 212226 - RNA, 19 nt, Homo sapiens
ggagucagaagugugaguu

SEQ ID NO: 212227 - RNA, 19 nt, Homo sapiens
ugugggcgcuggucuucaa

SEQ ID NO: 212228 - RNA, 19 nt, Homo sapiens
gggagcauggcguccuaua

SEQ ID NO: 212229 - RNA, 19 nt, Homo sapiens
cuacaggcaccuacugaau

SEQ ID NO: 212230 - RNA, 19 nt, Homo sapiens
gauccagccgcucacaguu

SEQ ID NO: 212231 - RNA, 19 nt, Homo sapiens
ggcacaggcuacagagaca

SEQ ID NO: 212232 - RNA, 19 nt, Homo sapiens
cgaugugcuugccgaucua

SEQ ID NO: 212233 - RNA, 19 nt, Homo sapiens
guaacuaccgugacaugca

SEQ ID NO: 212234 - RNA, 19 nt, Homo sapiens
ggaacauccgcaguaacua

SEQ ID NO: 212235 - RNA, 19 nt, Homo sapiens
gcccagauccuugacuuca

SEQ ID NO: 212236 - RNA, 19 nt, Homo sapiens
cguucccuaugaauuauuu

SEQ ID NO: 212237 - RNA, 19 nt, Homo sapiens
gcgcucaccagccucaaga

SEQ ID NO: 212238 - RNA, 19 nt, Homo sapiens
cgcaguaacuaccgugaca

SEQ ID NO: 212239 - RNA, 19 nt, Homo sapiens
ccacggcauugucuuugag

SEQ ID NO: 212240 - RNA, 19 nt, Homo sapiens
ucagugacaagaaguuuca

SEQ ID NO: 212241 - RNA, 19 nt, Homo sapiens
gggccucagugacaagaag

SEQ ID NO: 212242 - RNA, 19 nt, Homo sapiens
ccaucaccgucuucauguu

SEQ ID NO: 212243 - RNA, 19 nt, Homo sapiens
gcagugugggugaugaugu

SEQ ID NO: 212244 - RNA, 19 nt, Homo sapiens
ggugagggcugggcuuuug

SEQ ID NO: 212245 - RNA, 19 nt, Homo sapiens
gcucaccagccucaagaug

SEQ ID NO: 212246 - RNA, 19 nt, Homo sapiens
gcucugcuguaagggauuc

SEQ ID NO: 212247 - RNA, 19 nt, Homo sapiens
uggcaggcgucuucuacau

SEQ ID NO: 212248 - RNA, 19 nt, Homo sapiens
caucaccgucuucauguuc

SEQ ID NO: 212249 - RNA, 19 nt, Homo sapiens
cguauggaacggcaugauu

SEQ ID NO: 212250 - RNA, 19 nt, Homo sapiens
gacauuaaacccaccuuuu

SEQ ID NO: 212251 - RNA, 19 nt, Homo sapiens
ucgaugugcuugccgaucu

SEQ ID NO: 212252 - RNA, 19 nt, Homo sapiens
uggacuuccugcuggcuuu

SEQ ID NO: 212253 - RNA, 19 nt, Homo sapiens
gcaaggacgagggcugcaa

SEQ ID NO: 212254 - RNA, 19 nt, Homo sapiens
augcugcuguccucaacua

SEQ ID NO: 212255 - RNA, 19 nt, Homo sapiens
ggccuucuuugcugucauc

SEQ ID NO: 212256 - RNA, 19 nt, Homo sapiens
guaagggauucugcaucga

SEQ ID NO: 212257 - RNA, 19 nt, Homo sapiens
cagagcacugggacauuaa

SEQ ID NO: 212258 - RNA, 19 nt, Homo sapiens
ggaccccagugacagauga

SEQ ID NO: 212259 - RNA, 19 nt, Homo sapiens
agaaggacucccacuggaa

SEQ ID NO: 212260 - RNA, 19 nt, Homo sapiens
uguucaaggugcuggaaga

SEQ ID NO: 212261 - RNA, 19 nt, Homo sapiens
gcagccuccucacccagau

SEQ ID NO: 212262 - RNA, 19 nt, Homo sapiens
cacguucccuaugaauuau

SEQ ID NO: 212263 - RNA, 19 nt, Homo sapiens
caucagagcacugggacau

SEQ ID NO: 212264 - RNA, 19 nt, Homo sapiens
ggcuagaguuucuucucau

SEQ ID NO: 212265 - RNA, 19 nt, Homo sapiens
cuuccauggucaucaguga

SEQ ID NO: 212266 - RNA, 19 nt, Homo sapiens
uuucuggcuucuaccauga

SEQ ID NO: 212267 - RNA, 19 nt, Homo sapiens
ggucugggccuucuuugcu

SEQ ID NO: 212268 - RNA, 19 nt, Homo sapiens
cguguggccucgcuacagu

SEQ ID NO: 212269 - RNA, 19 nt, Homo sapiens
agaguuucuucucaucaga

SEQ ID NO: 212270 - RNA, 19 nt, Homo sapiens
gaggcuggaacuugugguu

SEQ ID NO: 212271 - RNA, 19 nt, Homo sapiens
ggagcauggcguccuauac

SEQ ID NO: 212272 - RNA, 19 nt, Homo sapiens
uacaggcaccuacugaaug

SEQ ID NO: 212273 - RNA, 19 nt, Homo sapiens
gcgagagucugcauaggua

SEQ ID NO: 212274 - RNA, 19 nt, Homo sapiens
cgacuucccuuacccguau

SEQ ID NO: 212275 - RNA, 19 nt, Homo sapiens
gaacauccgcagcaacuau

SEQ ID NO: 212276 - RNA, 19 nt, Homo sapiens
caacagaacagggucauga

SEQ ID NO: 212277 - RNA, 19 nt, Homo sapiens
gcccugguguucaauaauu

SEQ ID NO: 212278 - RNA, 19 nt, Homo sapiens
gaggaaaggccguuuguca

SEQ ID NO: 212279 - RNA, 19 nt, Homo sapiens
cugcauagguacuucauga

SEQ ID NO: 212280 - RNA, 19 nt, Homo sapiens
ggaaaggccguuugucauc

SEQ ID NO: 212281 - RNA, 19 nt, Homo sapiens
gggauuacuccuucaauga

SEQ ID NO: 212282 - RNA, 19 nt, Homo sapiens
acauugaggugcugacuga

SEQ ID NO: 212283 - RNA, 19 nt, Homo sapiens
cagcaacuaucccgacaug

SEQ ID NO: 212284 - RNA, 19 nt, Homo sapiens
gcuccgagaucguggacuu

SEQ ID NO: 212285 - RNA, 19 nt, Homo sapiens
caacguggcgcucguguuc

SEQ ID NO: 212286 - RNA, 19 nt, Homo sapiens
augcugcagugcucaauua

SEQ ID NO: 212287 - RNA, 19 nt, Homo sapiens
guacguggauacugugucu

SEQ ID NO: 212288 - RNA, 19 nt, Homo sapiens
gggcccugguguucaauaa

SEQ ID NO: 212289 - RNA, 19 nt, Homo sapiens
gcugcaagcuugucaccau

SEQ ID NO: 212290 - RNA, 19 nt, Homo sapiens
ggacgagggcugcaagcuu

SEQ ID NO: 212291 - RNA, 19 nt, Homo sapiens
gcaacuaucccgacaugca

SEQ ID NO: 212292 - RNA, 19 nt, Homo sapiens
ggauuuggucccucaacua

SEQ ID NO: 212293 - RNA, 19 nt, Homo sapiens
cauagguacuucaugaaca

SEQ ID NO: 212294 - RNA, 19 nt, Homo sapiens
ugacuggacguccuuugua

SEQ ID NO: 212295 - RNA, 19 nt, Homo sapiens
gaucugccacaaugacaaa

SEQ ID NO: 212296 - RNA, 19 nt, Homo sapiens
gauuuggucccucaacuau

SEQ ID NO: 212297 - RNA, 19 nt, Homo sapiens
ucugggaucugccacaaug

SEQ ID NO: 212298 - RNA, 19 nt, Homo sapiens
ugaagcggcuggcgcauac

SEQ ID NO: 212299 - RNA, 19 nt, Homo sapiens
gaacaucacgugggauaac

SEQ ID NO: 212300 - RNA, 19 nt, Homo sapiens
cgggauuacuccuucaaug

SEQ ID NO: 212301 - RNA, 19 nt, Homo sapiens
gacuggacguccuuuguag

SEQ ID NO: 212302 - RNA, 19 nt, Homo sapiens
uugaggugcuggaggagua

SEQ ID NO: 212303 - RNA, 19 nt, Homo sapiens
cugcagugcucaauuacau

SEQ ID NO: 212304 - RNA, 19 nt, Homo sapiens
gaaggaaagcaguggaacu

SEQ ID NO: 212305 - RNA, 19 nt, Homo sapiens
gcucggcgcacuucucuag

SEQ ID NO: 212306 - RNA, 19 nt, Homo sapiens
agaagaacauccgcagcaa

SEQ ID NO: 212307 - RNA, 19 nt, Homo sapiens
gcucagugaccgcaaguuc

SEQ ID NO: 212308 - RNA, 19 nt, Homo sapiens
ggcaagcacggaaagaaga

SEQ ID NO: 212309 - RNA, 19 nt, Homo sapiens
gcaaggguuucugcaucga

SEQ ID NO: 212310 - RNA, 19 nt, Homo sapiens
uuuggucccucaacuauca

SEQ ID NO: 212311 - RNA, 19 nt, Homo sapiens
gggaaggaaagcaguggaa

SEQ ID NO: 212312 - RNA, 19 nt, Homo sapiens
guucaaccuucaccauugg

SEQ ID NO: 212313 - RNA, 19 nt, Homo sapiens
ggauuacuccuucaaugag

SEQ ID NO: 212314 - RNA, 19 nt, Homo sapiens
gcuggacgccuucaucuac

SEQ ID NO: 212315 - RNA, 19 nt, Homo sapiens
caggaggaguacguggaua

SEQ ID NO: 212316 - RNA, 19 nt, Homo sapiens
guaccucaguccuguuggu

SEQ ID NO: 212317 - RNA, 19 nt, Homo sapiens
gcaagcacggaaagaagau

SEQ ID NO: 212318 - RNA, 19 nt, Homo sapiens
gggauaaccgggauuacuc

SEQ ID NO: 212319 - RNA, 19 nt, Homo sapiens
gcaagccggagaggauuug

SEQ ID NO: 212320 - RNA, 19 nt, Homo sapiens
gaguaccucaguccuguug

SEQ ID NO: 212321 - RNA, 19 nt, Homo sapiens
gcaacagcuucaggucauc

SEQ ID NO: 212322 - RNA, 19 nt, Homo sapiens
gcauagguacuucaugaac

SEQ ID NO: 212323 - RNA, 19 nt, Homo sapiens
uagaggaagcgcucacuca

SEQ ID NO: 212324 - RNA, 19 nt, Homo sapiens
acagaacagggucaugaaa

SEQ ID NO: 212325 - RNA, 19 nt, Homo sapiens
ccaauggcaagcacggaaa

SEQ ID NO: 212326 - RNA, 19 nt, Homo sapiens
gcgcauaccaucggcuuca

SEQ ID NO: 212327 - RNA, 19 nt, Homo sapiens
gggaugaugagaucgagau

SEQ ID NO: 212328 - RNA, 19 nt, Homo sapiens
cuucuucgccgucaucuuc

SEQ ID NO: 212329 - RNA, 19 nt, Homo sapiens
ccucaguccuguugguuac

SEQ ID NO: 212330 - RNA, 19 nt, Homo sapiens
ccgugugggugaugauguu

SEQ ID NO: 212331 - RNA, 19 nt, Homo sapiens
gggccuuccuguccuacau

SEQ ID NO: 212332 - RNA, 19 nt, Homo sapiens
gcugcgugauuaugguuuc

SEQ ID NO: 212333 - RNA, 19 nt, Homo sapiens
ccaccgagcaacagcuuca

SEQ ID NO: 212334 - RNA, 19 nt, Homo sapiens
gcaaggacgagggcugcaa

SEQ ID NO: 212335 - RNA, 19 nt, Homo sapiens
gaacagggucaugaaaaga

SEQ ID NO: 212336 - RNA, 19 nt, Homo sapiens
gcuacauggugcgcuacaa

SEQ ID NO: 212337 - RNA, 19 nt, Homo sapiens
ggugcugacugacgguagu

SEQ ID NO: 212338 - RNA, 19 nt, Homo sapiens
auagguacuucaugaacau

SEQ ID NO: 212339 - RNA, 19 nt, Homo sapiens
gaugcugcagugcucaauu

SEQ ID NO: 212340 - RNA, 19 nt, Homo sapiens
uggccacgcuggaggaaag

SEQ ID NO: 212341 - RNA, 19 nt, Homo sapiens
gcaagcuggacaucgacaa

SEQ ID NO: 212342 - RNA, 19 nt, Homo sapiens
gaucuggcuacgucugguu

SEQ ID NO: 212343 - RNA, 19 nt, Homo sapiens
ucaucuuccucgccagcua

SEQ ID NO: 212344 - RNA, 19 nt, Homo sapiens
ucugggcccugguguucaa

SEQ ID NO: 212345 - RNA, 19 nt, Homo sapiens
ggaucugccacaaugacaa

SEQ ID NO: 212346 - RNA, 19 nt, Homo sapiens
agaccucgcugcccaucgu

SEQ ID NO: 212347 - RNA, 19 nt, Homo sapiens
ucaguccuguugguuacaa

SEQ ID NO: 212348 - RNA, 19 nt, Homo sapiens
gcacggaaagaagaucgau

SEQ ID NO: 212349 - RNA, 19 nt, Homo sapiens
ggacggcuuccuagugaac

SEQ ID NO: 212350 - RNA, 19 nt, Homo sapiens
gaacuacgcuugcucauuu

SEQ ID NO: 212351 - RNA, 19 nt, Homo sapiens
caagaaagcugguaaacua

SEQ ID NO: 212352 - RNA, 19 nt, Homo sapiens
gagaguagauggugaaauu

SEQ ID NO: 212353 - RNA, 19 nt, Homo sapiens
gaaacagacuuaaagcuuu

SEQ ID NO: 212354 - RNA, 19 nt, Homo sapiens
gcacuuagcuaucagaaga

SEQ ID NO: 212355 - RNA, 19 nt, Homo sapiens
ucucauagguugccaauaa

SEQ ID NO: 212356 - RNA, 19 nt, Homo sapiens
gaaagcugguaaacuauuu

SEQ ID NO: 212357 - RNA, 19 nt, Homo sapiens
gccaagagcuauuugauga

SEQ ID NO: 212358 - RNA, 19 nt, Homo sapiens
gauaagaccaugaguauug

SEQ ID NO: 212359 - RNA, 19 nt, Homo sapiens
gaacuucccuggucgaaca

SEQ ID NO: 212360 - RNA, 19 nt, Homo sapiens
uauugaaccugaaguguua

SEQ ID NO: 212361 - RNA, 19 nt, Homo sapiens
gaggacagauguaccacua

SEQ ID NO: 212362 - RNA, 19 nt, Homo sapiens
gaagacgauucauuccuuu

SEQ ID NO: 212363 - RNA, 19 nt, Homo sapiens
aagaaaugcugauggauaa

SEQ ID NO: 212364 - RNA, 19 nt, Homo sapiens
uguggaagcuguaaaguuu

SEQ ID NO: 212365 - RNA, 19 nt, Homo sapiens
ggacagauguaccacuaug

SEQ ID NO: 212366 - RNA, 19 nt, Homo sapiens
guucguagcuuucccaaau

SEQ ID NO: 212367 - RNA, 19 nt, Homo sapiens
aaagaaggauggcaccuaa

SEQ ID NO: 212368 - RNA, 19 nt, Homo sapiens
ugacuacgcucaacauguu

SEQ ID NO: 212369 - RNA, 19 nt, Homo sapiens
gaaaucaucaccaaucaga

SEQ ID NO: 212370 - RNA, 19 nt, Homo sapiens
ggaaacagacuuaaagcuu

SEQ ID NO: 212371 - RNA, 19 nt, Homo sapiens
gcugauggauaaccuauau

SEQ ID NO: 212372 - RNA, 19 nt, Homo sapiens
ucaaagaaaugcugaugga

SEQ ID NO: 212373 - RNA, 19 nt, Homo sapiens
uaacacagcugagagacuu

SEQ ID NO: 212374 - RNA, 19 nt, Homo sapiens
gaaaugggcaaaggcaaua

SEQ ID NO: 212375 - RNA, 19 nt, Homo sapiens
acucaaaucuccaguauuc

SEQ ID NO: 212376 - RNA, 19 nt, Homo sapiens
gaguagauggugaaauuua

SEQ ID NO: 212377 - RNA, 19 nt, Homo sapiens
caagagcuauuugaugaaa

SEQ ID NO: 212378 - RNA, 19 nt, Homo sapiens
gauguaagcucuccuccau

SEQ ID NO: 212379 - RNA, 19 nt, Homo sapiens
caaagcaguuucacucuca

SEQ ID NO: 212380 - RNA, 19 nt, Homo sapiens
gagaucauauagacaauca

SEQ ID NO: 212381 - RNA, 19 nt, Homo sapiens
aaaagugacugccuuaaua

SEQ ID NO: 212382 - RNA, 19 nt, Homo sapiens
gaaauuagaaugaccuaca

SEQ ID NO: 212383 - RNA, 19 nt, Homo sapiens
caaaggcaauaccagguuu

SEQ ID NO: 212384 - RNA, 19 nt, Homo sapiens
gagaugugauggacuucua

SEQ ID NO: 212385 - RNA, 19 nt, Homo sapiens
gacguaaucuccacaguca

SEQ ID NO: 212386 - RNA, 19 nt, Homo sapiens
ggacuccaaagaaucauua

SEQ ID NO: 212387 - RNA, 19 nt, Homo sapiens
gcacuaaaguauguaaagu

SEQ ID NO: 212388 - RNA, 19 nt, Homo sapiens
aaagaaaugcugauggaua

SEQ ID NO: 212389 - RNA, 19 nt, Homo sapiens
ucuaauagcggguuacuuu

SEQ ID NO: 212390 - RNA, 19 nt, Homo sapiens
gaccaugaguauugaauuc

SEQ ID NO: 212391 - RNA, 19 nt, Homo sapiens
gcauagagguaccagcaau

SEQ ID NO: 212392 - RNA, 19 nt, Homo sapiens
guuuguacaugcauucaua

SEQ ID NO: 212393 - RNA, 19 nt, Homo sapiens
cugcuucaguggagaauua

SEQ ID NO: 212394 - RNA, 19 nt, Homo sapiens
cuccugaucugauuauuaa

SEQ ID NO: 212395 - RNA, 19 nt, Homo sapiens
caacaagaguuuauuucca

SEQ ID NO: 212396 - RNA, 19 nt, Homo sapiens
uuaaaggcaccaucuaaua

SEQ ID NO: 212397 - RNA, 19 nt, Homo sapiens
gaguugauauucacugaug

SEQ ID NO: 212398 - RNA, 19 nt, Homo sapiens
caaaauagaagcuguagua

SEQ ID NO: 212399 - RNA, 19 nt, Homo sapiens
gaagagccaagagcuauuu

SEQ ID NO: 212400 - RNA, 19 nt, Homo sapiens
caagcuaaguuguuuaucu

SEQ ID NO: 212401 - RNA, 19 nt, Homo sapiens
ggaagguggugcuuacauc

SEQ ID NO: 212402 - RNA, 19 nt, Homo sapiens
ugacucaaaucuccaguau

SEQ ID NO: 212403 - RNA, 19 nt, Homo sapiens
ggauguuucuuauggcauu

SEQ ID NO: 212404 - RNA, 19 nt, Homo sapiens
ccaaucagauaccaaaaua

SEQ ID NO: 212405 - RNA, 19 nt, Homo sapiens
cagcaucccuuucucaaca

SEQ ID NO: 212406 - RNA, 19 nt, Homo sapiens
gaagggcuacugcagcuuu

SEQ ID NO: 212407 - RNA, 19 nt, Homo sapiens
ccagaaauuagaaaccuua

SEQ ID NO: 212408 - RNA, 19 nt, Homo sapiens
aauaguuccugcaacguua

SEQ ID NO: 212409 - RNA, 19 nt, Homo sapiens
acaggagucucacaagaaa

SEQ ID NO: 212410 - RNA, 19 nt, Homo sapiens
uagaaugaccuacaucaaa

SEQ ID NO: 212411 - RNA, 19 nt, Homo sapiens
uggaaggacagcacaauua

SEQ ID NO: 212412 - RNA, 19 nt, Homo sapiens
acaguuggcuggaugaaau

SEQ ID NO: 212413 - RNA, 19 nt, Homo sapiens
ugacaaaacucuuggauuc

SEQ ID NO: 212414 - RNA, 19 nt, Homo sapiens
gcaguacuccuggauguuu

SEQ ID NO: 212415 - RNA, 19 nt, Homo sapiens
cuacaggagucucacaaga

SEQ ID NO: 212416 - RNA, 19 nt, Homo sapiens
gaugacaacuugacuucuc

SEQ ID NO: 212417 - RNA, 19 nt, Homo sapiens
gagcuacugugaagguuuc

SEQ ID NO: 212418 - RNA, 19 nt, Homo sapiens
gauaauggagaucugguuu

SEQ ID NO: 212419 - RNA, 19 nt, Homo sapiens
caaauuaacaguccuaacu

SEQ ID NO: 212420 - RNA, 19 nt, Homo sapiens
gggagaagacgauucauuc

SEQ ID NO: 212421 - RNA, 19 nt, Homo sapiens
ccauagaguuuaacacaag

SEQ ID NO: 212422 - RNA, 19 nt, Homo sapiens
caaaguaauuccucucacu

SEQ ID NO: 212423 - RNA, 19 nt, Homo sapiens
guauguuuccucugaguua

SEQ ID NO: 212424 - RNA, 19 nt, Homo sapiens
gcauguacgaccaauguaa

SEQ ID NO: 212425 - RNA, 19 nt, Homo sapiens
ggacagcacaauuaccuau

SEQ ID NO: 212426 - RNA, 19 nt, Homo sapiens
guaccacuaugacaugaau

SEQ ID NO: 212427 - RNA, 19 nt, Homo sapiens
gcuccugaucugauuauua

SEQ ID NO: 212428 - RNA, 19 nt, Homo sapiens
gcaaaggcaauaccagguu

SEQ ID NO: 212429 - RNA, 19 nt, Homo sapiens
gaauacagcaucccuuucu

SEQ ID NO: 212430 - RNA, 19 nt, Homo sapiens
agaagacgauucauuccuu

SEQ ID NO: 212431 - RNA, 19 nt, Homo sapiens
gagauuacagaggaaguua

SEQ ID NO: 212432 - RNA, 19 nt, Homo sapiens
ccaacuuucuguaaacuca

SEQ ID NO: 212433 - RNA, 19 nt, Homo sapiens
gaaagucgaauuaauagcu

SEQ ID NO: 212434 - RNA, 19 nt, Homo sapiens
gaaaagccauugucaagag

SEQ ID NO: 212435 - RNA, 19 nt, Homo sapiens
agaaugaccuacaucaaag

SEQ ID NO: 212436 - RNA, 19 nt, Homo sapiens
cagcuuuacaugcaauuua

SEQ ID NO: 212437 - RNA, 19 nt, Homo sapiens
gguaaacuauuugucuuuc

SEQ ID NO: 212438 - RNA, 19 nt, Homo sapiens
aaucaucaccaaucagaua

SEQ ID NO: 212439 - RNA, 19 nt, Homo sapiens
uagcugaaaucaucaccaa

SEQ ID NO: 212440 - RNA, 19 nt, Homo sapiens
aaacaaaagugaugggaaa

SEQ ID NO: 212441 - RNA, 19 nt, Homo sapiens
uaaaggcaccaucuaauag

SEQ ID NO: 212442 - RNA, 19 nt, Homo sapiens
gcucugacccagugagauu

SEQ ID NO: 212443 - RNA, 19 nt, Homo sapiens
uauucaagguggccaaauu

SEQ ID NO: 212444 - RNA, 19 nt, Homo sapiens
ggagaauuauauagguugu

SEQ ID NO: 212445 - RNA, 19 nt, Homo sapiens
uaaauacgcacuacaugug

SEQ ID NO: 212446 - RNA, 19 nt, Homo sapiens
gaguaucucuguaugaaaa

SEQ ID NO: 212447 - RNA, 19 nt, Homo sapiens
acaccuggaugaccaaaug

SEQ ID NO: 212448 - RNA, 19 nt, Homo sapiens
gaacuuucucuucauacuu

SEQ ID NO: 212449 - RNA, 19 nt, Homo sapiens
ggcugucgcuucucaauca

SEQ ID NO: 212450 - RNA, 19 nt, Homo sapiens
ggagauugcucaagaaauu

SEQ ID NO: 212451 - RNA, 19 nt, Homo sapiens
gaugggcugucuuucauua

SEQ ID NO: 212452 - RNA, 19 nt, Homo sapiens
gaaaugaugggcugucuuu

SEQ ID NO: 212453 - RNA, 19 nt, Homo sapiens
guacaaaugaugacaagua

SEQ ID NO: 212454 - RNA, 19 nt, Homo sapiens
ggagcagacugaauuuauu

SEQ ID NO: 212455 - RNA, 19 nt, Homo sapiens
gaaaguauagagaagagua

SEQ ID NO: 212456 - RNA, 19 nt, Homo sapiens
gauagaaucaacuugguua

SEQ ID NO: 212457 - RNA, 19 nt, Homo sapiens
gcagauagcuacagcaaaa

SEQ ID NO: 212458 - RNA, 19 nt, Homo sapiens
gcauaaacuugagaucuuu

SEQ ID NO: 212459 - RNA, 19 nt, Homo sapiens
gggaggagauugcucaaga

SEQ ID NO: 212460 - RNA, 19 nt, Homo sapiens
gaacggauucccuuugauu

SEQ ID NO: 212461 - RNA, 19 nt, Homo sapiens
cuacucauauguacgauaa

SEQ ID NO: 212462 - RNA, 19 nt, Homo sapiens
guucauggguacauuguuu

SEQ ID NO: 212463 - RNA, 19 nt, Homo sapiens
ggaagaauuucaggaguug

SEQ ID NO: 212464 - RNA, 19 nt, Homo sapiens
ggacgcaacauuaaugaaa

SEQ ID NO: 212465 - RNA, 19 nt, Homo sapiens
gaagauggguguuauucag

SEQ ID NO: 212466 - RNA, 19 nt, Homo sapiens
ucagcgagauccaauguaa

SEQ ID NO: 212467 - RNA, 19 nt, Homo sapiens
cgaagggcguuuaaagaaa

SEQ ID NO: 212468 - RNA, 19 nt, Homo sapiens
agaguaaacugaacaacaa

SEQ ID NO: 212469 - RNA, 19 nt, Homo sapiens
ggagaggaacagcgauuua

SEQ ID NO: 212470 - RNA, 19 nt, Homo sapiens
ucaaguaugucaucucuca

SEQ ID NO: 212471 - RNA, 19 nt, Homo sapiens
gaagaggcccguaguuuua

SEQ ID NO: 212472 - RNA, 19 nt, Homo sapiens
cagaauaccaggacuauga

SEQ ID NO: 212473 - RNA, 19 nt, Homo sapiens
aaagcaagauguccgaauu

SEQ ID NO: 212474 - RNA, 19 nt, Homo sapiens
gagcguugaugcccuuauu

SEQ ID NO: 212475 - RNA, 19 nt, Homo sapiens
acagcaaggucaacaaauu

SEQ ID NO: 212476 - RNA, 19 nt, Homo sapiens
gccaaggaaugaagaagaa

SEQ ID NO: 212477 - RNA, 19 nt, Homo sapiens
ggaggagauugcucaagaa

SEQ ID NO: 212478 - RNA, 19 nt, Homo sapiens
gcgaagggcguuuaaagaa

SEQ ID NO: 212479 - RNA, 19 nt, Homo sapiens
gaaguugcaugcccuuaag

SEQ ID NO: 212480 - RNA, 19 nt, Homo sapiens
gagggcgaguggucaauaa

SEQ ID NO: 212481 - RNA, 19 nt, Homo sapiens
caaagccuccuguccauuu

SEQ ID NO: 212482 - RNA, 19 nt, Homo sapiens
gaucaccgcucucgaacuc

SEQ ID NO: 212483 - RNA, 19 nt, Homo sapiens
ugagaucuuucacccauuu

SEQ ID NO: 212484 - RNA, 19 nt, Homo sapiens
gaaauugacggaagguuca

SEQ ID NO: 212485 - RNA, 19 nt, Homo sapiens
caaaugaugacaaguaugu

SEQ ID NO: 212486 - RNA, 19 nt, Homo sapiens
gaaucuguauacacggaua

SEQ ID NO: 212487 - RNA, 19 nt, Homo sapiens
gaagugguuuguugugcuu

SEQ ID NO: 212488 - RNA, 19 nt, Homo sapiens
gaaugguucugacagugaa

SEQ ID NO: 212489 - RNA, 19 nt, Homo sapiens
uaugucaucucucaccuaa

SEQ ID NO: 212490 - RNA, 19 nt, Homo sapiens
ugaaagauguauugaguac

SEQ ID NO: 212491 - RNA, 19 nt, Homo sapiens
aagcaaaucagucaaguuu

SEQ ID NO: 212492 - RNA, 19 nt, Homo sapiens
uugauuaguucucgguuua

SEQ ID NO: 212493 - RNA, 19 nt, Homo sapiens
gagaggaacagcgauuuaa

SEQ ID NO: 212494 - RNA, 19 nt, Homo sapiens
uugaagcucuuauaccuaa

SEQ ID NO: 212495 - RNA, 19 nt, Homo sapiens
uagugcaacucauugauaa

SEQ ID NO: 212496 - RNA, 19 nt, Homo sapiens
acucaaaccugcaggauuc

SEQ ID NO: 212497 - RNA, 19 nt, Homo sapiens
caaucggacugcacaagaa

SEQ ID NO: 212498 - RNA, 19 nt, Homo sapiens
gggaagaggcccguaguuu

SEQ ID NO: 212499 - RNA, 19 nt, Homo sapiens
gaagggcguuuaaagaaaa

SEQ ID NO: 212500 - RNA, 19 nt, Homo sapiens
cggauucccuuugauuuaa

SEQ ID NO: 212501 - RNA, 19 nt, Homo sapiens
gcaggccucuccagaauac

SEQ ID NO: 212502 - RNA, 19 nt, Homo sapiens
ggcgaguggucaauaauga

SEQ ID NO: 212503 - RNA, 19 nt, Homo sapiens
gaguuucacuuggaccaua

SEQ ID NO: 212504 - RNA, 19 nt, Homo sapiens
guagggaacagcuaacuga

SEQ ID NO: 212505 - RNA, 19 nt, Homo sapiens
guugaucugcgaauuguua

SEQ ID NO: 212506 - RNA, 19 nt, Homo sapiens
gcagcagagucagcagaua

SEQ ID NO: 212507 - RNA, 19 nt, Homo sapiens
ucuccaaucucuacaauca

SEQ ID NO: 212508 - RNA, 19 nt, Homo sapiens
gggcaugaauaggaacuuu

SEQ ID NO: 212509 - RNA, 19 nt, Homo sapiens
acggaaagcugcugguuga

SEQ ID NO: 212510 - RNA, 19 nt, Homo sapiens
gcaaacaaaggaacacuag

SEQ ID NO: 212511 - RNA, 19 nt, Homo sapiens
ggaagaaagaggaggauca

SEQ ID NO: 212512 - RNA, 19 nt, Homo sapiens
gaacuggagggaaaugaug

SEQ ID NO: 212513 - RNA, 19 nt, Homo sapiens
gaaagagccgguugguuca

SEQ ID NO: 212514 - RNA, 19 nt, Homo sapiens
gagcagacugaauuuauug

SEQ ID NO: 212515 - RNA, 19 nt, Homo sapiens
ggaaugguucugacaguga

SEQ ID NO: 212516 - RNA, 19 nt, Homo sapiens
ccgaagagguguuuaacuc

SEQ ID NO: 212517 - RNA, 19 nt, Homo sapiens
gacggaagguucacaagca

SEQ ID NO: 212518 - RNA, 19 nt, Homo sapiens
gaaucgcuauccuauguag

SEQ ID NO: 212519 - RNA, 19 nt, Homo sapiens
cagcuuguguggacgcuaa

SEQ ID NO: 212520 - RNA, 19 nt, Homo sapiens
gagcauaucgagcguagga

SEQ ID NO: 212521 - RNA, 19 nt, Homo sapiens
agagacaguuugaucaaga

SEQ ID NO: 212522 - RNA, 19 nt, Homo sapiens
gcagagacaguuugaucaa

SEQ ID NO: 212523 - RNA, 19 nt, Homo sapiens
gagaguaaacugaacaaca

SEQ ID NO: 212524 - RNA, 19 nt, Homo sapiens
acacaucacugccuucucu

SEQ ID NO: 212525 - RNA, 19 nt, Homo sapiens
ggacuaugacuaccuggaa

SEQ ID NO: 212526 - RNA, 19 nt, Homo sapiens
gguguugagcgguacauua

SEQ ID NO: 212527 - RNA, 19 nt, Homo sapiens
uaaacaaggucagccacaa

SEQ ID NO: 212528 - RNA, 19 nt, Homo sapiens
gagcgagggcgcaagguuu

SEQ ID NO: 212529 - RNA, 19 nt, Homo sapiens
cuauggaacuggagggaaa

SEQ ID NO: 212530 - RNA, 19 nt, Homo sapiens
uagagaagcugaggaacga

SEQ ID NO: 212531 - RNA, 19 nt, Homo sapiens
ggacucagaaagccaagaa

SEQ ID NO: 212532 - RNA, 19 nt, Homo sapiens
gcacauacuuuugccuuaa

SEQ ID NO: 212533 - RNA, 19 nt, Homo sapiens
gcaugaauaggaacuuuga

SEQ ID NO: 212534 - RNA, 19 nt, Homo sapiens
ucccaaaccuguaaaucuu

SEQ ID NO: 212535 - RNA, 19 nt, Homo sapiens
cuagcaaacuucagugugu

SEQ ID NO: 212536 - RNA, 19 nt, Homo sapiens
ugacaaguaugugauagau

SEQ ID NO: 212537 - RNA, 19 nt, Homo sapiens
ccacagccuucccgaaaca

SEQ ID NO: 212538 - RNA, 19 nt, Homo sapiens
ugacagcacccaaggcaaa

SEQ ID NO: 212539 - RNA, 19 nt, Homo sapiens
gguuacggacgcaacauua

SEQ ID NO: 212540 - RNA, 19 nt, Homo sapiens
gcuauccuauguaguggaa

SEQ ID NO: 212541 - RNA, 19 nt, Homo sapiens
gagaagauggguguuauuc

SEQ ID NO: 212542 - RNA, 19 nt, Homo sapiens
gaacuggagcuggaugcua

SEQ ID NO: 212543 - RNA, 19 nt, Homo sapiens
gcucuuauaccuaaucuag

SEQ ID NO: 212544 - RNA, 19 nt, Homo sapiens
ugaauaggaacuuugauga

SEQ ID NO: 212545 - RNA, 19 nt, Homo sapiens
gcaggacuuugagcagaaa

SEQ ID NO: 212546 - RNA, 19 nt, Homo sapiens
cugcuagcaucaaagauuu

SEQ ID NO: 212547 - RNA, 19 nt, Homo sapiens
gcagaucgacuugguggaa

SEQ ID NO: 212548 - RNA, 19 nt, Homo sapiens
gaucgagagucugcagaga

SEQ ID NO: 212549 - RNA, 19 nt, Homo sapiens
aggauuguguggaauguaa

SEQ ID NO: 212550 - RNA, 19 nt, Homo sapiens
ggagauugcucaagaaauu

SEQ ID NO: 212551 - RNA, 19 nt, Homo sapiens
ggaggaaucuguauacaug

SEQ ID NO: 212552 - RNA, 19 nt, Homo sapiens
gaacagcgauuuaaagcau

SEQ ID NO: 212553 - RNA, 19 nt, Homo sapiens
caacgaaggugcuuggaaa

SEQ ID NO: 212554 - RNA, 19 nt, Homo sapiens
gaugggcugucuuucauua

SEQ ID NO: 212555 - RNA, 19 nt, Homo sapiens
gaaaugaugggcugucuuu

SEQ ID NO: 212556 - RNA, 19 nt, Homo sapiens
gacagagggugacaucaua

SEQ ID NO: 212557 - RNA, 19 nt, Homo sapiens
guacaaaugaugacaagua

SEQ ID NO: 212558 - RNA, 19 nt, Homo sapiens
ggagcagacugaauuuauu

SEQ ID NO: 212559 - RNA, 19 nt, Homo sapiens
caccuaaccuugcaaguuu

SEQ ID NO: 212560 - RNA, 19 nt, Homo sapiens
ggaagaaaccacagaaaga

SEQ ID NO: 212561 - RNA, 19 nt, Homo sapiens
gaaaguauagagaagagua

SEQ ID NO: 212562 - RNA, 19 nt, Homo sapiens
gaagaaaccacagaaagaa

SEQ ID NO: 212563 - RNA, 19 nt, Homo sapiens
gauagaaucaacuugguua

SEQ ID NO: 212564 - RNA, 19 nt, Homo sapiens
gcagauagcuacagcaaaa

SEQ ID NO: 212565 - RNA, 19 nt, Homo sapiens
ugacaucuguguuucguuu

SEQ ID NO: 212566 - RNA, 19 nt, Homo sapiens
gaaggugacaucuguguuu

SEQ ID NO: 212567 - RNA, 19 nt, Homo sapiens
gcauaaacuugagaucuuu

SEQ ID NO: 212568 - RNA, 19 nt, Homo sapiens
gggaggagauugcucaaga

SEQ ID NO: 212569 - RNA, 19 nt, Homo sapiens
gaacggauucccuuugauu

SEQ ID NO: 212570 - RNA, 19 nt, Homo sapiens
gcagaaacguucccaaacu

SEQ ID NO: 212571 - RNA, 19 nt, Homo sapiens
gaacacaaaucggagaaca

SEQ ID NO: 212572 - RNA, 19 nt, Homo sapiens
cuacucauauguacgauaa

SEQ ID NO: 212573 - RNA, 19 nt, Homo sapiens
guucauggguacauuguuu

SEQ ID NO: 212574 - RNA, 19 nt, Homo sapiens
ggaagaauuucaggaguug

SEQ ID NO: 212575 - RNA, 19 nt, Homo sapiens
ggacaucucggucguuuga

SEQ ID NO: 212576 - RNA, 19 nt, Homo sapiens
ggaggaggaugcucugaga

SEQ ID NO: 212577 - RNA, 19 nt, Homo sapiens
ggacgcaacauuaaugaaa

SEQ ID NO: 212578 - RNA, 19 nt, Homo sapiens
gaagauggguguuauucag

SEQ ID NO: 212579 - RNA, 19 nt, Homo sapiens
ucagcgagauccaauguaa

SEQ ID NO: 212580 - RNA, 19 nt, Homo sapiens
cgaagggcguuuaaagaaa

SEQ ID NO: 212581 - RNA, 19 nt, Homo sapiens
ggaaacaccuaaccuugca

SEQ ID NO: 212582 - RNA, 19 nt, Homo sapiens
agaguaaacugaacaacaa

SEQ ID NO: 212583 - RNA, 19 nt, Homo sapiens
ggagaggaacagcgauuua

SEQ ID NO: 212584 - RNA, 19 nt, Homo sapiens
ucaaguaugucaucucuca

SEQ ID NO: 212585 - RNA, 19 nt, Homo sapiens
aaagcaagauguccgaauu

SEQ ID NO: 212586 - RNA, 19 nt, Homo sapiens
gaagaggcccguaguuuua

SEQ ID NO: 212587 - RNA, 19 nt, Homo sapiens
gaaccgguccucucucuga

SEQ ID NO: 212588 - RNA, 19 nt, Homo sapiens
gaggacaucucggucguuu

SEQ ID NO: 212589 - RNA, 19 nt, Homo sapiens
acagcaaggucaacaaauu

SEQ ID NO: 212590 - RNA, 19 nt, Homo sapiens
gaacacaguccauuacgau

SEQ ID NO: 212591 - RNA, 19 nt, Homo sapiens
caaaggaacacuaggagaa

SEQ ID NO: 212592 - RNA, 19 nt, Homo sapiens
gaacaacggaggauagcuu

SEQ ID NO: 212593 - RNA, 19 nt, Homo sapiens
gccaaggaaugaagaagaa

SEQ ID NO: 212594 - RNA, 19 nt, Homo sapiens
ggaggagauugcucaagaa

SEQ ID NO: 212595 - RNA, 19 nt, Homo sapiens
gaaucuguauacauggaua

SEQ ID NO: 212596 - RNA, 19 nt, Homo sapiens
gcgaagggcguuuaaagaa

SEQ ID NO: 212597 - RNA, 19 nt, Homo sapiens
ccacaggguuccucuuguu

SEQ ID NO: 212598 - RNA, 19 nt, Homo sapiens
gaaguugcaugcccuuaag

SEQ ID NO: 212599 - RNA, 19 nt, Homo sapiens
gagggcgaguggucaauaa

SEQ ID NO: 212600 - RNA, 19 nt, Homo sapiens
caaagccuccuguccauuu

SEQ ID NO: 212601 - RNA, 19 nt, Homo sapiens
ugagaucuuucacccauuu

SEQ ID NO: 212602 - RNA, 19 nt, Homo sapiens
gcuggaaggugacaucugu

SEQ ID NO: 212603 - RNA, 19 nt, Homo sapiens
gaaauugacggaagguuca

SEQ ID NO: 212604 - RNA, 19 nt, Homo sapiens
caaaugaugacaaguaugu

SEQ ID NO: 212605 - RNA, 19 nt, Homo sapiens
gaagugguuuguugugcuu

SEQ ID NO: 212606 - RNA, 19 nt, Homo sapiens
gaaugguucugacagugaa

SEQ ID NO: 212607 - RNA, 19 nt, Homo sapiens
gugcaaagccagagacuga

SEQ ID NO: 212608 - RNA, 19 nt, Homo sapiens
uaugucaucucucaccuaa

SEQ ID NO: 212609 - RNA, 19 nt, Homo sapiens
ugaaagauguauugaguac

SEQ ID NO: 212610 - RNA, 19 nt, Homo sapiens
aagcaaaucagucaaguuu

SEQ ID NO: 212611 - RNA, 19 nt, Homo sapiens
uugauuaguucucgguuua

SEQ ID NO: 212612 - RNA, 19 nt, Homo sapiens
gagaggaacagcgauuuaa

SEQ ID NO: 212613 - RNA, 19 nt, Homo sapiens
gcuauacgaggcccacuua

SEQ ID NO: 212614 - RNA, 19 nt, Homo sapiens
uugaagcucuuauaccuaa

SEQ ID NO: 212615 - RNA, 19 nt, Homo sapiens
gcaaguggcucuccccauu

SEQ ID NO: 212616 - RNA, 19 nt, Homo sapiens
uagugcaacucauugauaa

SEQ ID NO: 212617 - RNA, 19 nt, Homo sapiens
ggaggaugcucugagauuc

SEQ ID NO: 212618 - RNA, 19 nt, Homo sapiens
gaguuucacuuggaccaua

SEQ ID NO: 212619 - RNA, 19 nt, Homo sapiens
acucaaaccugcaggauuc

SEQ ID NO: 212620 - RNA, 19 nt, Homo sapiens
caaucggacugcacaagaa

SEQ ID NO: 212621 - RNA, 19 nt, Homo sapiens
gggaagaggcccguaguuu

SEQ ID NO: 212622 - RNA, 19 nt, Homo sapiens
gaagggcguuuaaagaaaa

SEQ ID NO: 212623 - RNA, 19 nt, Homo sapiens
cggauucccuuugauuuaa

SEQ ID NO: 212624 - RNA, 19 nt, Homo sapiens
gcaggccucuccagaauac

SEQ ID NO: 212625 - RNA, 19 nt, Homo sapiens
ggcgaguggucaauaauga

SEQ ID NO: 212626 - RNA, 19 nt, Homo sapiens
gcucgugaauccacuuaga

SEQ ID NO: 212627 - RNA, 19 nt, Homo sapiens
guagggaacagcuaacuga

SEQ ID NO: 212628 - RNA, 19 nt, Homo sapiens
guugaucugcgaauuguua

SEQ ID NO: 212629 - RNA, 19 nt, Homo sapiens
cagaauaccaggacuaugu

SEQ ID NO: 212630 - RNA, 19 nt, Homo sapiens
gcagcagagucagcagaua

SEQ ID NO: 212631 - RNA, 19 nt, Homo sapiens
ucuccaaucucuacaauca

SEQ ID NO: 212632 - RNA, 19 nt, Homo sapiens
gggcaugaauaggaacuuu

SEQ ID NO: 212633 - RNA, 19 nt, Homo sapiens
acggaaagcugcugguuga

SEQ ID NO: 212634 - RNA, 19 nt, Homo sapiens
ggagcugacccucgucuuu

SEQ ID NO: 212635 - RNA, 19 nt, Homo sapiens
gcaaacaaaggaacacuag

SEQ ID NO: 212636 - RNA, 19 nt, Homo sapiens
ggacagugcccuggccuuu

SEQ ID NO: 212637 - RNA, 19 nt, Homo sapiens
ggaagaaagaggaggauca

SEQ ID NO: 212638 - RNA, 19 nt, Homo sapiens
gaacuggagggaaaugaug

SEQ ID NO: 212639 - RNA, 19 nt, Homo sapiens
gaaagagccgguugguuca

SEQ ID NO: 212640 - RNA, 19 nt, Homo sapiens
gagcagacugaauuuauug

SEQ ID NO: 212641 - RNA, 19 nt, Homo sapiens
uagcugagguuggcagaaa

SEQ ID NO: 212642 - RNA, 19 nt, Homo sapiens
ggaaugguucugacaguga

SEQ ID NO: 212643 - RNA, 19 nt, Homo sapiens
ccgaagagguguuuaacuc

SEQ ID NO: 212644 - RNA, 19 nt, Homo sapiens
gacggaagguucacaagca

SEQ ID NO: 212645 - RNA, 19 nt, Homo sapiens
gaaucgcuauccuauguag

SEQ ID NO: 212646 - RNA, 19 nt, Homo sapiens
cagcuuguguggacgcuaa

SEQ ID NO: 212647 - RNA, 19 nt, Homo sapiens
gagcauaucgagcguagga

SEQ ID NO: 212648 - RNA, 19 nt, Homo sapiens
ggacagagggugacaucau

SEQ ID NO: 212649 - RNA, 19 nt, Homo sapiens
ggaugugucugucuuuguc

SEQ ID NO: 212650 - RNA, 19 nt, Homo sapiens
ggaaggagcuagaaauaga

SEQ ID NO: 212651 - RNA, 19 nt, Homo sapiens
gaacaaaccaugugacaaa

SEQ ID NO: 212652 - RNA, 19 nt, Homo sapiens
gaaaagaucucaugacuga

SEQ ID NO: 212653 - RNA, 19 nt, Homo sapiens
gaaagggaauucugacaaa

SEQ ID NO: 212654 - RNA, 19 nt, Homo sapiens
gaacugcauuuccuuuaaa

SEQ ID NO: 212655 - RNA, 19 nt, Homo sapiens
caaauaaucuugacaaugc

SEQ ID NO: 212656 - RNA, 19 nt, Homo sapiens
ggacuuugguuccauguuu

SEQ ID NO: 212657 - RNA, 19 nt, Homo sapiens
gcaaacagcugggaggaaa

SEQ ID NO: 212658 - RNA, 19 nt, Homo sapiens
gcaaagagaaugaauaugu

SEQ ID NO: 212659 - RNA, 19 nt, Homo sapiens
gcuauuugcuguuguguaa

SEQ ID NO: 212660 - RNA, 19 nt, Homo sapiens
caacugugaucacuuuauu

SEQ ID NO: 212661 - RNA, 19 nt, Homo sapiens
cugcaaagcuugugacuug

SEQ ID NO: 212662 - RNA, 19 nt, Homo sapiens
ccauugaccuucaguuaaa

SEQ ID NO: 212663 - RNA, 19 nt, Homo sapiens
ugacugagauguggacuuu

SEQ ID NO: 212664 - RNA, 19 nt, Homo sapiens
gagaggaggugugguuuga

SEQ ID NO: 212665 - RNA, 19 nt, Homo sapiens
gaacaauccaucagcauga

SEQ ID NO: 212666 - RNA, 19 nt, Homo sapiens
gaggaaggagcuagaaaua

SEQ ID NO: 212667 - RNA, 19 nt, Homo sapiens
caaagagaaugaauaugug

SEQ ID NO: 212668 - RNA, 19 nt, Homo sapiens
gcagugagccuugcuuaaa

SEQ ID NO: 212669 - RNA, 19 nt, Homo sapiens
uagcaacuauuacugguuu

SEQ ID NO: 212670 - RNA, 19 nt, Homo sapiens
gagaaacaaauccaucuuu

SEQ ID NO: 212671 - RNA, 19 nt, Homo sapiens
cauccuagcuggcaucuuc

SEQ ID NO: 212672 - RNA, 19 nt, Homo sapiens
gaaugaauaugugcaagau

SEQ ID NO: 212673 - RNA, 19 nt, Homo sapiens
gaggucaggucauuugaug

SEQ ID NO: 212674 - RNA, 19 nt, Homo sapiens
ugaacugcauuuccuuuaa

SEQ ID NO: 212675 - RNA, 19 nt, Homo sapiens
cauauucuauugccaaguu

SEQ ID NO: 212676 - RNA, 19 nt, Homo sapiens
cauguuccauauucacuua

SEQ ID NO: 212677 - RNA, 19 nt, Homo sapiens
gcaccaagacccuuuacaa

SEQ ID NO: 212678 - RNA, 19 nt, Homo sapiens
gcaaugaaagcuuagaaga

SEQ ID NO: 212679 - RNA, 19 nt, Homo sapiens
ggaaggguccacauagaaa

SEQ ID NO: 212680 - RNA, 19 nt, Homo sapiens
caacuaacccuggugguaa

SEQ ID NO: 212681 - RNA, 19 nt, Homo sapiens
caagacccuuuacaacgua

SEQ ID NO: 212682 - RNA, 19 nt, Homo sapiens
gaaggagugcugaacauug

SEQ ID NO: 212683 - RNA, 19 nt, Homo sapiens
ccgaaacucuucaccuuga

SEQ ID NO: 212684 - RNA, 19 nt, Homo sapiens
gaaauagaacaauccauca

SEQ ID NO: 212685 - RNA, 19 nt, Homo sapiens
gcuuugagauugcacuuga

SEQ ID NO: 212686 - RNA, 19 nt, Homo sapiens
gaggaggugugguuugaug

SEQ ID NO: 212687 - RNA, 19 nt, Homo sapiens
caucaaguccucauucauu

SEQ ID NO: 212688 - RNA, 19 nt, Homo sapiens
gagacggccugcaaccaaa

SEQ ID NO: 212689 - RNA, 19 nt, Homo sapiens
gcaacuaacccugguggua

SEQ ID NO: 212690 - RNA, 19 nt, Homo sapiens
cacaggcaaugaaagcuua

SEQ ID NO: 212691 - RNA, 19 nt, Homo sapiens
uauugaagcugcugauuuc

SEQ ID NO: 212692 - RNA, 19 nt, Homo sapiens
caaaucaaauagugacauc

SEQ ID NO: 212693 - RNA, 19 nt, Homo sapiens
uagauugacuuguguuugu

SEQ ID NO: 212694 - RNA, 19 nt, Homo sapiens
gaucaucacaacuugcuuu

SEQ ID NO: 212695 - RNA, 19 nt, Homo sapiens
gcacaugggcugcagaaca

SEQ ID NO: 212696 - RNA, 19 nt, Homo sapiens
ggccgaaacucuucaccuu

SEQ ID NO: 212697 - RNA, 19 nt, Homo sapiens
acaucuaacucagcuaaua

SEQ ID NO: 212698 - RNA, 19 nt, Homo sapiens
uaacaucuaacucagcuaa

SEQ ID NO: 212699 - RNA, 19 nt, Homo sapiens
cacauaagauugaacaaag

SEQ ID NO: 212700 - RNA, 19 nt, Homo sapiens
acaauuuggugccauuauu

SEQ ID NO: 212701 - RNA, 19 nt, Homo sapiens
gaacuucuaagaugcguau

SEQ ID NO: 212702 - RNA, 19 nt, Homo sapiens
gaguucaccugaugcauuc

SEQ ID NO: 212703 - RNA, 19 nt, Homo sapiens
ucaacgaggccaaauauau

SEQ ID NO: 212704 - RNA, 19 nt, Homo sapiens
gaugugcuacucugcuuua

SEQ ID NO: 212705 - RNA, 19 nt, Homo sapiens
cuugauguauguucugaua

SEQ ID NO: 212706 - RNA, 19 nt, Homo sapiens
acacauacauacccuauac

SEQ ID NO: 212707 - RNA, 19 nt, Homo sapiens
gcagauucccuuuauuuag

SEQ ID NO: 212708 - RNA, 19 nt, Homo sapiens
caucacaacuugcuuugca

SEQ ID NO: 212709 - RNA, 19 nt, Homo sapiens
gggagcaacuacaagauca

SEQ ID NO: 212710 - RNA, 19 nt, Homo sapiens
gugcuacucugcuuuagug

SEQ ID NO: 212711 - RNA, 19 nt, Homo sapiens
gcuggcaucuuccuugguu

SEQ ID NO: 212712 - RNA, 19 nt, Homo sapiens
gcuaaucgcuaugacuaug

SEQ ID NO: 212713 - RNA, 19 nt, Homo sapiens
caaugaaagcuuagaagaa

SEQ ID NO: 212714 - RNA, 19 nt, Homo sapiens
gaagcucuuugacgguuug

SEQ ID NO: 212715 - RNA, 19 nt, Homo sapiens
gcacaauuccauaugguau

SEQ ID NO: 212716 - RNA, 19 nt, Homo sapiens
gcaaauaauaccuacaagu

SEQ ID NO: 212717 - RNA, 19 nt, Homo sapiens
gauuaagguuauacggaaa

SEQ ID NO: 212718 - RNA, 19 nt, Homo sapiens
aaggagugcugaacauuga

SEQ ID NO: 212719 - RNA, 19 nt, Homo sapiens
ggaggaaggagcuagaaau

SEQ ID NO: 212720 - RNA, 19 nt, Homo sapiens
ccaagacccuuuacaacgu

SEQ ID NO: 212721 - RNA, 19 nt, Homo sapiens
caacgaggccaaauauauc

SEQ ID NO: 212722 - RNA, 19 nt, Homo sapiens
gugagcugcugcuggauuu

SEQ ID NO: 212723 - RNA, 19 nt, Homo sapiens
ugaagcugcugauuucuca

SEQ ID NO: 212724 - RNA, 19 nt, Homo sapiens
guaacuagcgagugaaugu

SEQ ID NO: 212725 - RNA, 19 nt, Homo sapiens
ucuaagaugcguauaugua

SEQ ID NO: 212726 - RNA, 19 nt, Homo sapiens
gaccuucaguuaaagaaca

SEQ ID NO: 212727 - RNA, 19 nt, Homo sapiens
cauguucacucccaagaug

SEQ ID NO: 212728 - RNA, 19 nt, Homo sapiens
augaauaugugcaagauga

SEQ ID NO: 212729 - RNA, 19 nt, Homo sapiens
ggaaaaggccggaacaaga

SEQ ID NO: 212730 - RNA, 19 nt, Homo sapiens
ugacaaagcacaauuccau

SEQ ID NO: 212731 - RNA, 19 nt, Homo sapiens
gacgacagcgagagguuua

SEQ ID NO: 212732 - RNA, 19 nt, Homo sapiens
gcaagagccugaccuuuuc

SEQ ID NO: 212733 - RNA, 19 nt, Homo sapiens
ccucaauucugauuagugu

SEQ ID NO: 212734 - RNA, 19 nt, Homo sapiens
ugucaucaaugccaucuau

SEQ ID NO: 212735 - RNA, 19 nt, Homo sapiens
caucuaacucagcuaauaa

SEQ ID NO: 212736 - RNA, 19 nt, Homo sapiens
gaagugguuugaaaauuug

SEQ ID NO: 212737 - RNA, 19 nt, Homo sapiens
caauuuggugccauuauuu

SEQ ID NO: 212738 - RNA, 19 nt, Homo sapiens
gaaggagcuagaaauagaa

SEQ ID NO: 212739 - RNA, 19 nt, Homo sapiens
gacaaagcacaauuccaua

SEQ ID NO: 212740 - RNA, 19 nt, Homo sapiens
cauuauagccaucgccuuu

SEQ ID NO: 212741 - RNA, 19 nt, Homo sapiens
gaguucaccugcaaagcuu

SEQ ID NO: 212742 - RNA, 19 nt, Homo sapiens
uaaagaacaaaccauguga

SEQ ID NO: 212743 - RNA, 19 nt, Homo sapiens
cagauucccuuuauuuagg

SEQ ID NO: 212744 - RNA, 19 nt, Homo sapiens
gggaaggguccacauagaa

SEQ ID NO: 212745 - RNA, 19 nt, Homo sapiens
ccaaauauaucgcguucac

SEQ ID NO: 212746 - RNA, 19 nt, Homo sapiens
ugcugaacauugaugauua

SEQ ID NO: 212747 - RNA, 19 nt, Homo sapiens
ggugugguuugaugagaaa

SEQ ID NO: 212748 - RNA, 19 nt, Homo sapiens
caaccuaguagucaaucua

SEQ ID NO: 212749 - RNA, 19 nt, Homo sapiens
guuccuguguccuuguaua

SEQ ID NO: 212750 - RNA, 19 nt, Homo sapiens
gaacaggaguccaagauca

SEQ ID NO: 212751 - RNA, 19 nt, Homo sapiens
agaaugaggugaagagugu

SEQ ID NO: 212752 - RNA, 19 nt, Homo sapiens
gcuacaacaucuucaccua

SEQ ID NO: 212753 - RNA, 19 nt, Homo sapiens
uuucagaucccacagauua

SEQ ID NO: 212754 - RNA, 19 nt, Homo sapiens
gugcuuggcugccucuuug

SEQ ID NO: 212755 - RNA, 19 nt, Homo sapiens
guacagaccaccaccaugu

SEQ ID NO: 212756 - RNA, 19 nt, Homo sapiens
acaaugagguccgcuuuga

SEQ ID NO: 212757 - RNA, 19 nt, Homo sapiens
gcacacauccucgacaguu

SEQ ID NO: 212758 - RNA, 19 nt, Homo sapiens
ccaucgagcuggccuccua

SEQ ID NO: 212759 - RNA, 19 nt, Homo sapiens
cgaauucacuugcgcugau

SEQ ID NO: 212760 - RNA, 19 nt, Homo sapiens
cagauuagcuacgccucua

SEQ ID NO: 212761 - RNA, 19 nt, Homo sapiens
cagcugacacccacaauga

SEQ ID NO: 212762 - RNA, 19 nt, Homo sapiens
gaucauguuuguggucaau

SEQ ID NO: 212763 - RNA, 19 nt, Homo sapiens
ugccaucacugguguuauu

SEQ ID NO: 212764 - RNA, 19 nt, Homo sapiens
caacgaggccaaguucauu

SEQ ID NO: 212765 - RNA, 19 nt, Homo sapiens
gaauucacuugcgcugauu

SEQ ID NO: 212766 - RNA, 19 nt, Homo sapiens
ucagugacuuugccuccua

SEQ ID NO: 212767 - RNA, 19 nt, Homo sapiens
gguauuggccgcuacaaca

SEQ ID NO: 212768 - RNA, 19 nt, Homo sapiens
ccaccgcgaugcaaguaug

SEQ ID NO: 212769 - RNA, 19 nt, Homo sapiens
cacagugccuccugacuuc

SEQ ID NO: 212770 - RNA, 19 nt, Homo sapiens
ucaucuggcuggcauuguu

SEQ ID NO: 212771 - RNA, 19 nt, Homo sapiens
guacaccaccugcaucauc

SEQ ID NO: 212772 - RNA, 19 nt, Homo sapiens
uacaacaucuucaccuauc

SEQ ID NO: 212773 - RNA, 19 nt, Homo sapiens
ccaaggccauggcugagau

SEQ ID NO: 212774 - RNA, 19 nt, Homo sapiens
gacgcgaugcggccaguua

SEQ ID NO: 212775 - RNA, 19 nt, Homo sapiens
gugccaagcugagugacaa

SEQ ID NO: 212776 - RNA, 19 nt, Homo sapiens
ucgacaacgucaucgcuuu

SEQ ID NO: 212777 - RNA, 19 nt, Homo sapiens
ggagcaggcacuggacuuu

SEQ ID NO: 212778 - RNA, 19 nt, Homo sapiens
ccacaaugagguccgcuuu

SEQ ID NO: 212779 - RNA, 19 nt, Homo sapiens
ugacuuugccuccuacuuc

SEQ ID NO: 212780 - RNA, 19 nt, Homo sapiens
aguccaagaucauguuugu

SEQ ID NO: 212781 - RNA, 19 nt, Homo sapiens
gggcgacuauggcgagaca

SEQ ID NO: 212782 - RNA, 19 nt, Homo sapiens
ucauuggcuucaccaugua

SEQ ID NO: 212783 - RNA, 19 nt, Homo sapiens
gucccgcuaugacuacuuu

SEQ ID NO: 212784 - RNA, 19 nt, Homo sapiens
ccgcuuuggugaugguauu

SEQ ID NO: 212785 - RNA, 19 nt, Homo sapiens
cauugaggccuuugagcua

SEQ ID NO: 212786 - RNA, 19 nt, Homo sapiens
cgacaacgucaucgcuuug

SEQ ID NO: 212787 - RNA, 19 nt, Homo sapiens
ccucacagguggccaucug

SEQ ID NO: 212788 - RNA, 19 nt, Homo sapiens
acucagcccugcucaccaa

SEQ ID NO: 212789 - RNA, 19 nt, Homo sapiens
ggaguccaagaucauguuu

SEQ ID NO: 212790 - RNA, 19 nt, Homo sapiens
aaagugggccgugccauga

SEQ ID NO: 212791 - RNA, 19 nt, Homo sapiens
cccaugcgcuccacaacau

SEQ ID NO: 212792 - RNA, 19 nt, Homo sapiens
gagcaggcacuggacuuug

SEQ ID NO: 212793 - RNA, 19 nt, Homo sapiens
uucauuggcuucaccaugu

SEQ ID NO: 212794 - RNA, 19 nt, Homo sapiens
guaccgauuggacgaauuc

SEQ ID NO: 212795 - RNA, 19 nt, Homo sapiens
ccacggcaguguguaccuu

SEQ ID NO: 212796 - RNA, 19 nt, Homo sapiens
cacacauccucgacaguug

SEQ ID NO: 212797 - RNA, 19 nt, Homo sapiens
cuacaacaucuucaccuau

SEQ ID NO: 212798 - RNA, 19 nt, Homo sapiens
caacaccacccggcucugu

SEQ ID NO: 212799 - RNA, 19 nt, Homo sapiens
guucacccguucugaggau

SEQ ID NO: 212800 - RNA, 19 nt, Homo sapiens
gaguaccgauuggacgaau

SEQ ID NO: 212801 - RNA, 19 nt, Homo sapiens
cgugccagcccuaugagua

SEQ ID NO: 212802 - RNA, 19 nt, Homo sapiens
gggcagaaggcuugacucu

SEQ ID NO: 212803 - RNA, 19 nt, Homo sapiens
gugcucaacgucaaguuug

SEQ ID NO: 212804 - RNA, 19 nt, Homo sapiens
uauuucagaucccacagau

SEQ ID NO: 212805 - RNA, 19 nt, Homo sapiens
gacaacgucaucgcuuuga

SEQ ID NO: 212806 - RNA, 19 nt, Homo sapiens
gauuggacgaauucacuug

SEQ ID NO: 212807 - RNA, 19 nt, Homo sapiens
cgcccaagcugcacaucau

SEQ ID NO: 212808 - RNA, 19 nt, Homo sapiens
ugggcucgcuggccuacaa

SEQ ID NO: 212809 - RNA, 19 nt, Homo sapiens
agcccugccuccagaauga

SEQ ID NO: 212810 - RNA, 19 nt, Homo sapiens
gcucgugcccgcaacaucu

SEQ ID NO: 212811 - RNA, 19 nt, Homo sapiens
uugcccaucuucuauguca

SEQ ID NO: 212812 - RNA, 19 nt, Homo sapiens
cauuguugcccaucuucua

SEQ ID NO: 212813 - RNA, 19 nt, Homo sapiens
caccaagaccaaccgcauu

SEQ ID NO: 212814 - RNA, 19 nt, Homo sapiens
gucgggagcucugcuacau

SEQ ID NO: 212815 - RNA, 19 nt, Homo sapiens
caacaucuucaccuaucug

SEQ ID NO: 212816 - RNA, 19 nt, Homo sapiens
acugugguccugucaauga

SEQ ID NO: 212817 - RNA, 19 nt, Homo sapiens
gugguggacucgacaacgu

SEQ ID NO: 212818 - RNA, 19 nt, Homo sapiens
ugacaagucccgcuaugac

SEQ ID NO: 212819 - RNA, 19 nt, Homo sapiens
ccagugccaagcugaguga

SEQ ID NO: 212820 - RNA, 19 nt, Homo sapiens
ucaacgaggccaaguucau

SEQ ID NO: 212821 - RNA, 19 nt, Homo sapiens
gagcccugccuccagaaug

SEQ ID NO: 212822 - RNA, 19 nt, Homo sapiens
ggugcuuggcugccucuuu

SEQ ID NO: 212823 - RNA, 19 nt, Homo sapiens
cuuuaugccuucaauacuc

SEQ ID NO: 212824 - RNA, 19 nt, Homo sapiens
ccgcauugcacgcaucuuc

SEQ ID NO: 212825 - RNA, 19 nt, Homo sapiens
ccugcuggguggugucuuc

SEQ ID NO: 212826 - RNA, 19 nt, Homo sapiens
guuauuggcgguuccuaca

SEQ ID NO: 212827 - RNA, 19 nt, Homo sapiens
uauuggcgguuccuacagu

SEQ ID NO: 212828 - RNA, 19 nt, Homo sapiens
gugacaagucccgcuauga

SEQ ID NO: 212829 - RNA, 19 nt, Homo sapiens
caacaaagaugauuacuug

SEQ ID NO: 212830 - RNA, 19 nt, Homo sapiens
gaacaacccuaguaccuuu

SEQ ID NO: 212831 - RNA, 19 nt, Homo sapiens
caacgaagcuaaguucaua

SEQ ID NO: 212832 - RNA, 19 nt, Homo sapiens
gauacaacguguucaauuu

SEQ ID NO: 212833 - RNA, 19 nt, Homo sapiens
gaaguuggguguucacauu

SEQ ID NO: 212834 - RNA, 19 nt, Homo sapiens
gaccauaacuuucuaagga

SEQ ID NO: 212835 - RNA, 19 nt, Homo sapiens
ggaagaaguuguacaagga

SEQ ID NO: 212836 - RNA, 19 nt, Homo sapiens
gaaacaggauucaugaaga

SEQ ID NO: 212837 - RNA, 19 nt, Homo sapiens
ggacuagcaugacacauug

SEQ ID NO: 212838 - RNA, 19 nt, Homo sapiens
gaagcuaaguucauagguu

SEQ ID NO: 212839 - RNA, 19 nt, Homo sapiens
caaagaugauuacuugcua

SEQ ID NO: 212840 - RNA, 19 nt, Homo sapiens
ggaugaagcugaguauaug

SEQ ID NO: 212841 - RNA, 19 nt, Homo sapiens
gaguuuaccuguauggauu

SEQ ID NO: 212842 - RNA, 19 nt, Homo sapiens
ggaaauaaccauuguuuac

SEQ ID NO: 212843 - RNA, 19 nt, Homo sapiens
gaacucugcuacaucuuau

SEQ ID NO: 212844 - RNA, 19 nt, Homo sapiens
ggagagagauuaaaauaga

SEQ ID NO: 212845 - RNA, 19 nt, Homo sapiens
gagcaagaguccaagauca

SEQ ID NO: 212846 - RNA, 19 nt, Homo sapiens
gaagccauguuguuugcua

SEQ ID NO: 212847 - RNA, 19 nt, Homo sapiens
gguauacccuugcagagaa

SEQ ID NO: 212848 - RNA, 19 nt, Homo sapiens
gggaaacagucauccuaaa

SEQ ID NO: 212849 - RNA, 19 nt, Homo sapiens
gaagacgccugggccauug

SEQ ID NO: 212850 - RNA, 19 nt, Homo sapiens
gaugucugcugcuggauuu

SEQ ID NO: 212851 - RNA, 19 nt, Homo sapiens
aaauguagguggaaaguau

SEQ ID NO: 212852 - RNA, 19 nt, Homo sapiens
gcgccaaacucagugauaa

SEQ ID NO: 212853 - RNA, 19 nt, Homo sapiens
gaguauauguguccugaug

SEQ ID NO: 212854 - RNA, 19 nt, Homo sapiens
acgaauaccuggcugauga

SEQ ID NO: 212855 - RNA, 19 nt, Homo sapiens
gcugaugaguuuaccugua

SEQ ID NO: 212856 - RNA, 19 nt, Homo sapiens
cacauuggcuccaccauug

SEQ ID NO: 212857 - RNA, 19 nt, Homo sapiens
gcaguucaguucuuguguu

SEQ ID NO: 212858 - RNA, 19 nt, Homo sapiens
gaauugcaguucaguucuu

SEQ ID NO: 212859 - RNA, 19 nt, Homo sapiens
aagcuaaguucauagguuu

SEQ ID NO: 212860 - RNA, 19 nt, Homo sapiens
ucacugggcagaaaccuua

SEQ ID NO: 212861 - RNA, 19 nt, Homo sapiens
auaccuggcugaugaguuu

SEQ ID NO: 212862 - RNA, 19 nt, Homo sapiens
caacacacccuuggucaaa

SEQ ID NO: 212863 - RNA, 19 nt, Homo sapiens
ggucuugggcuguuuguuu

SEQ ID NO: 212864 - RNA, 19 nt, Homo sapiens
gauacauguucaagggaua

SEQ ID NO: 212865 - RNA, 19 nt, Homo sapiens
ggagugaaguuggguguuc

SEQ ID NO: 212866 - RNA, 19 nt, Homo sapiens
gacaucaagugacuacaga

SEQ ID NO: 212867 - RNA, 19 nt, Homo sapiens
cgagaacucugcuacaucu

SEQ ID NO: 212868 - RNA, 19 nt, Homo sapiens
auaagucgcgcuaugauua

SEQ ID NO: 212869 - RNA, 19 nt, Homo sapiens
aaacaggauucaugaagau

SEQ ID NO: 212870 - RNA, 19 nt, Homo sapiens
agaccuaacuggaugcuau

SEQ ID NO: 212871 - RNA, 19 nt, Homo sapiens
ggucauugguggcucuuau

SEQ ID NO: 212872 - RNA, 19 nt, Homo sapiens
aaacaucccacuucucauu

SEQ ID NO: 212873 - RNA, 19 nt, Homo sapiens
ccacgugcaucaucugguu

SEQ ID NO: 212874 - RNA, 19 nt, Homo sapiens
gaugaaaucaacaaagaug

SEQ ID NO: 212875 - RNA, 19 nt, Homo sapiens
uuacagagcugagcauugg

SEQ ID NO: 212876 - RNA, 19 nt, Homo sapiens
gaacugggaccacauacuc

SEQ ID NO: 212877 - RNA, 19 nt, Homo sapiens
gcagauagcauagucaagu

SEQ ID NO: 212878 - RNA, 19 nt, Homo sapiens
caaauaaagaugcagauag

SEQ ID NO: 212879 - RNA, 19 nt, Homo sapiens
gcugagaucuugcgcuucu

SEQ ID NO: 212880 - RNA, 19 nt, Homo sapiens
gcacuggaacugaagaaug

SEQ ID NO: 212881 - RNA, 19 nt, Homo sapiens
ugacaagacugcaaguucu

SEQ ID NO: 212882 - RNA, 19 nt, Homo sapiens
gacauggucagucuacuaa

SEQ ID NO: 212883 - RNA, 19 nt, Homo sapiens
agaagaauguugucacaca

SEQ ID NO: 212884 - RNA, 19 nt, Homo sapiens
ccagaagaauguugucaca

SEQ ID NO: 212885 - RNA, 19 nt, Homo sapiens
gaaaacaucccacuucuca

SEQ ID NO: 212886 - RNA, 19 nt, Homo sapiens
gaaugugggcgaaucaaug

SEQ ID NO: 212887 - RNA, 19 nt, Homo sapiens
guucuuaccuuagcuuugu

SEQ ID NO: 212888 - RNA, 19 nt, Homo sapiens
gaaaccuuaucgcuagaug

SEQ ID NO: 212889 - RNA, 19 nt, Homo sapiens
caagggauaccuaugcauu

SEQ ID NO: 212890 - RNA, 19 nt, Homo sapiens
ggaagacgccugggccauu

SEQ ID NO: 212891 - RNA, 19 nt, Homo sapiens
ccugugaacccuacgaaua

SEQ ID NO: 212892 - RNA, 19 nt, Homo sapiens
ccaaauaaagaugcagaua

SEQ ID NO: 212893 - RNA, 19 nt, Homo sapiens
aggaugaguuucuauguug

SEQ ID NO: 212894 - RNA, 19 nt, Homo sapiens
caaaagaacaacccuagua

SEQ ID NO: 212895 - RNA, 19 nt, Homo sapiens
cagauagcauagucaaguu

SEQ ID NO: 212896 - RNA, 19 nt, Homo sapiens
ugagagaggacuagcauga

SEQ ID NO: 212897 - RNA, 19 nt, Homo sapiens
uuauagcaguguuuccaua

SEQ ID NO: 212898 - RNA, 19 nt, Homo sapiens
uaggaugaguuucuauguu

SEQ ID NO: 212899 - RNA, 19 nt, Homo sapiens
caguucaguucuuguguuu

SEQ ID NO: 212900 - RNA, 19 nt, Homo sapiens
ucucugugauugugaauug

SEQ ID NO: 212901 - RNA, 19 nt, Homo sapiens
gauaagucgcgcuaugauu

SEQ ID NO: 212902 - RNA, 19 nt, Homo sapiens
guauauguguccugaugga

SEQ ID NO: 212903 - RNA, 19 nt, Homo sapiens
cugaugaguuuaccuguau

SEQ ID NO: 212904 - RNA, 19 nt, Homo sapiens
gauccuaugccauucaaga

SEQ ID NO: 212905 - RNA, 19 nt, Homo sapiens
caaugaagaccgagggauu

SEQ ID NO: 212906 - RNA, 19 nt, Homo sapiens
ucaugaagauguugacaag

SEQ ID NO: 212907 - RNA, 19 nt, Homo sapiens
ugaggacuguauauaguga

SEQ ID NO: 212908 - RNA, 19 nt, Homo sapiens
ggaagugcccagaaaauuu

SEQ ID NO: 212909 - RNA, 19 nt, Homo sapiens
aaauaaagaugcagauagc

SEQ ID NO: 212910 - RNA, 19 nt, Homo sapiens
caacuucacggcuccauuc

SEQ ID NO: 212911 - RNA, 19 nt, Homo sapiens
ggagcaaucacuggaguuu

SEQ ID NO: 212912 - RNA, 19 nt, Homo sapiens
gaagaaugugggcgaauca

SEQ ID NO: 212913 - RNA, 19 nt, Homo sapiens
cacuggaacugaagaaugu

SEQ ID NO: 212914 - RNA, 19 nt, Homo sapiens
caaagauuccagcauguug

SEQ ID NO: 212915 - RNA, 19 nt, Homo sapiens
gccaagccaucaccaguca

SEQ ID NO: 212916 - RNA, 19 nt, Homo sapiens
agaacucugcuacaucuua

SEQ ID NO: 212917 - RNA, 19 nt, Homo sapiens
uccgagaacuguugcagaa

SEQ ID NO: 212918 - RNA, 19 nt, Homo sapiens
cauuauguguaacagauug

SEQ ID NO: 212919 - RNA, 19 nt, Homo sapiens
cgauacaacguguucaauu

SEQ ID NO: 212920 - RNA, 19 nt, Homo sapiens
guuguuugcuauugaugaa

SEQ ID NO: 212921 - RNA, 19 nt, Homo sapiens
acugcaaguucuuaccuua

SEQ ID NO: 212922 - RNA, 19 nt, Homo sapiens
gaugaguuucuauguugua

SEQ ID NO: 212923 - RNA, 19 nt, Homo sapiens
ggaugaguuucuauguugu

SEQ ID NO: 212924 - RNA, 19 nt, Homo sapiens
gaauauggaaacagagcaa

SEQ ID NO: 212925 - RNA, 19 nt, Homo sapiens
caccucaucucugugauug

SEQ ID NO: 212926 - RNA, 19 nt, Homo sapiens
gauagcauagucaaguuug

SEQ ID NO: 212927 - RNA, 19 nt, Homo sapiens
acagaaacaggauucauga

SEQ ID NO: 212928 - RNA, 19 nt, Homo sapiens
caggauucaugaagauguu

SEQ ID NO: 212929 - RNA, 19 nt, Homo sapiens
gcacccagcugcuuaagua

SEQ ID NO: 212930 - RNA, 19 nt, Homo sapiens
gcuaugacaucuaccaaua

SEQ ID NO: 212931 - RNA, 19 nt, Homo sapiens
aaacaaaucucgagugugu

SEQ ID NO: 212932 - RNA, 19 nt, Homo sapiens
caccaaaccuuacauguug

SEQ ID NO: 212933 - RNA, 19 nt, Homo sapiens
guggagaacuuaagaagga

SEQ ID NO: 212934 - RNA, 19 nt, Homo sapiens
gaaaacaaaucucgagugu

SEQ ID NO: 212935 - RNA, 19 nt, Homo sapiens
caacauccuucgccucuuc

SEQ ID NO: 212936 - RNA, 19 nt, Homo sapiens
gacaauguguagcgcauga

SEQ ID NO: 212937 - RNA, 19 nt, Homo sapiens
ccaacaaguucacgcagaa

SEQ ID NO: 212938 - RNA, 19 nt, Homo sapiens
ucuguucucuuaucucuuu

SEQ ID NO: 212939 - RNA, 19 nt, Homo sapiens
ucucuuaucucuuuguuuc

SEQ ID NO: 212940 - RNA, 19 nt, Homo sapiens
ccugugaccuucaaugaga

SEQ ID NO: 212941 - RNA, 19 nt, Homo sapiens
gggcaucugugugugguuu

SEQ ID NO: 212942 - RNA, 19 nt, Homo sapiens
caaacagacuuacgucacu

SEQ ID NO: 212943 - RNA, 19 nt, Homo sapiens
cgagaugccugggaagaga

SEQ ID NO: 212944 - RNA, 19 nt, Homo sapiens
guaagacgugucccuauga

SEQ ID NO: 212945 - RNA, 19 nt, Homo sapiens
gauggcacccagcugcuua

SEQ ID NO: 212946 - RNA, 19 nt, Homo sapiens
gcagccacgucaagaagug

SEQ ID NO: 212947 - RNA, 19 nt, Homo sapiens
caacagccgcuacgacuuc

SEQ ID NO: 212948 - RNA, 19 nt, Homo sapiens
ucaccaaaccuuacauguu

SEQ ID NO: 212949 - RNA, 19 nt, Homo sapiens
gccaccaccuuccucauga

SEQ ID NO: 212950 - RNA, 19 nt, Homo sapiens
ccaccugcaccuuagaaua

SEQ ID NO: 212951 - RNA, 19 nt, Homo sapiens
gagggcagcuauggugaga

SEQ ID NO: 212952 - RNA, 19 nt, Homo sapiens
guucuccucugcuucauuc

SEQ ID NO: 212953 - RNA, 19 nt, Homo sapiens
ccagacaggccauuucuuc

SEQ ID NO: 212954 - RNA, 19 nt, Homo sapiens
ucaugggucucuagggauu

SEQ ID NO: 212955 - RNA, 19 nt, Homo sapiens
cccauuggcuucaccaugu

SEQ ID NO: 212956 - RNA, 19 nt, Homo sapiens
uguaagacgugucccuaug

SEQ ID NO: 212957 - RNA, 19 nt, Homo sapiens
gguguuuggugaugguuau

SEQ ID NO: 212958 - RNA, 19 nt, Homo sapiens
caccaaccaugcaaucuag

SEQ ID NO: 212959 - RNA, 19 nt, Homo sapiens
ggaacccugugaccuucaa

SEQ ID NO: 212960 - RNA, 19 nt, Homo sapiens
gcgcauggacccuguagau

SEQ ID NO: 212961 - RNA, 19 nt, Homo sapiens
guguagcgcaugauuguuu

SEQ ID NO: 212962 - RNA, 19 nt, Homo sapiens
gggcaaaccgggugagcaa

SEQ ID NO: 212963 - RNA, 19 nt, Homo sapiens
ccucagcuccuccugcuuu

SEQ ID NO: 212964 - RNA, 19 nt, Homo sapiens
agucugagcucugcgagaa

SEQ ID NO: 212965 - RNA, 19 nt, Homo sapiens
ccauuggcuucaccaugua

SEQ ID NO: 212966 - RNA, 19 nt, Homo sapiens
gcaccaaccgugagcgaau

SEQ ID NO: 212967 - RNA, 19 nt, Homo sapiens
caaaggccacccucacaug

SEQ ID NO: 212968 - RNA, 19 nt, Homo sapiens
ugaauuccauccgcauaga

SEQ ID NO: 212969 - RNA, 19 nt, Homo sapiens
caacggagaggccaagucu

SEQ ID NO: 212970 - RNA, 19 nt, Homo sapiens
gagcggaagaagacaguga

SEQ ID NO: 212971 - RNA, 19 nt, Homo sapiens
gugccaggcuaccacaaga

SEQ ID NO: 212972 - RNA, 19 nt, Homo sapiens
gcaaaccgggugagcaaca

SEQ ID NO: 212973 - RNA, 19 nt, Homo sapiens
gaaggugcaguuugugauc

SEQ ID NO: 212974 - RNA, 19 nt, Homo sapiens
gggaaggugcaguuuguga

SEQ ID NO: 212975 - RNA, 19 nt, Homo sapiens
ccagggcagucaucaucuu

SEQ ID NO: 212976 - RNA, 19 nt, Homo sapiens
gccgcacgcuggacaacaa

SEQ ID NO: 212977 - RNA, 19 nt, Homo sapiens
ugcaggcgcucaucgagaa

SEQ ID NO: 212978 - RNA, 19 nt, Homo sapiens
guucagugccuggguguuu

SEQ ID NO: 212979 - RNA, 19 nt, Homo sapiens
acaaaucucgaguguguug

SEQ ID NO: 212980 - RNA, 19 nt, Homo sapiens
aaacagacuuacgucacuu

SEQ ID NO: 212981 - RNA, 19 nt, Homo sapiens
gcccaaagucuacaucauc

SEQ ID NO: 212982 - RNA, 19 nt, Homo sapiens
acccggaccugcugccuaa

SEQ ID NO: 212983 - RNA, 19 nt, Homo sapiens
guuuggugaugguuauuga

SEQ ID NO: 212984 - RNA, 19 nt, Homo sapiens
gaccuucaaugagaaugga

SEQ ID NO: 212985 - RNA, 19 nt, Homo sapiens
ggaaggugcaguuugugau

SEQ ID NO: 212986 - RNA, 19 nt, Homo sapiens
gggcaggauucagcuuaug

SEQ ID NO: 212987 - RNA, 19 nt, Homo sapiens
caucugguuugccgaguuc

SEQ ID NO: 212988 - RNA, 19 nt, Homo sapiens
gcaggcgaguucgacaaga

SEQ ID NO: 212989 - RNA, 19 nt, Homo sapiens
ccgacaagcuguacaucca

SEQ ID NO: 212990 - RNA, 19 nt, Homo sapiens
caccaaccgugagcgaauu

SEQ ID NO: 212991 - RNA, 19 nt, Homo sapiens
gaagggcagccacgucaag

SEQ ID NO: 212992 - RNA, 19 nt, Homo sapiens
caaccagacaggccauuuc

SEQ ID NO: 212993 - RNA, 19 nt, Homo sapiens
gcccucaaguggaacuaug

SEQ ID NO: 212994 - RNA, 19 nt, Homo sapiens
acaccaaccaugcaaucua

SEQ ID NO: 212995 - RNA, 19 nt, Homo sapiens
agacuuacgucacuuacac

SEQ ID NO: 212996 - RNA, 19 nt, Homo sapiens
caagcccuguggagaacuu

SEQ ID NO: 212997 - RNA, 19 nt, Homo sapiens
gagcgaauugggcaggauu

SEQ ID NO: 212998 - RNA, 19 nt, Homo sapiens
gagcagucgcugaccuuug

SEQ ID NO: 212999 - RNA, 19 nt, Homo sapiens
ggagaacuuaagaaggaaa

SEQ ID NO: 213000 - RNA, 19 nt, Homo sapiens
caccugcaccuuagaauag

SEQ ID NO: 213001 - RNA, 19 nt, Homo sapiens
caggcgaguucgacaagau

SEQ ID NO: 213002 - RNA, 19 nt, Homo sapiens
cgccagaccugagugacaa

SEQ ID NO: 213003 - RNA, 19 nt, Homo sapiens
gaacgugugguggguguca

SEQ ID NO: 213004 - RNA, 19 nt, Homo sapiens
aaaggccacccucacauga

SEQ ID NO: 213005 - RNA, 19 nt, Homo sapiens
caugaauuccauccgcaua

SEQ ID NO: 213006 - RNA, 19 nt, Homo sapiens
ggcaggauucagcuuauga

SEQ ID NO: 213007 - RNA, 19 nt, Homo sapiens
gggcagucaucaucuuugc

SEQ ID NO: 213008 - RNA, 19 nt, Homo sapiens
gcccacccaucaucaccaa

SEQ ID NO: 213009 - RNA, 19 nt, Homo sapiens
caauguguagcgcaugauu

SEQ ID NO: 213010 - RNA, 19 nt, Homo sapiens
ucgaguguguugccaagug

SEQ ID NO: 213011 - RNA, 19 nt, Homo sapiens
guucucuuaucucuuuguu

SEQ ID NO: 213012 - RNA, 19 nt, Homo sapiens
cugucuuucuguucucuua

SEQ ID NO: 213013 - RNA, 19 nt, Homo sapiens
gcgcuggccaccaaacaga

SEQ ID NO: 213014 - RNA, 19 nt, Homo sapiens
gaccugcugccuaacauca

SEQ ID NO: 213015 - RNA, 19 nt, Homo sapiens
agcagucgcugaccuuugu

SEQ ID NO: 213016 - RNA, 19 nt, Homo sapiens
gagugggccugccguucau

SEQ ID NO: 213017 - RNA, 19 nt, Homo sapiens
acggagaggccaagucuga

SEQ ID NO: 213018 - RNA, 19 nt, Homo sapiens
cauccgaaacgucaacuuc

SEQ ID NO: 213019 - RNA, 19 nt, Homo sapiens
ugugaucgaugccguguac

SEQ ID NO: 213020 - RNA, 19 nt, Homo sapiens
caucguccgugcccucaag

SEQ ID NO: 213021 - RNA, 19 nt, Homo sapiens
caccauguccaacaaguuc

SEQ ID NO: 213022 - RNA, 19 nt, Homo sapiens
ccucacagcuggccaucac

SEQ ID NO: 213023 - RNA, 19 nt, Homo sapiens
gaacgccagggcagucauc

SEQ ID NO: 213024 - RNA, 19 nt, Homo sapiens
gagcucggucuccaucaug

SEQ ID NO: 213025 - RNA, 19 nt, Homo sapiens
ccucaaagccgucguuacg

SEQ ID NO: 213026 - RNA, 19 nt, Homo sapiens
cuacaugcccaaagucuac

SEQ ID NO: 213027 - RNA, 19 nt, Homo sapiens
ggggugugcucaaguguga

SEQ ID NO: 213028 - RNA, 19 nt, Homo sapiens
gcaucugugugugguuugu

SEQ ID NO: 213029 - RNA, 19 nt, Homo sapiens
gaaacacggugauaucuuu

SEQ ID NO: 213030 - RNA, 19 nt, Homo sapiens
ccaauuggguugugaaaua

SEQ ID NO: 213031 - RNA, 19 nt, Homo sapiens
uaacuuggguccaguauuu

SEQ ID NO: 213032 - RNA, 19 nt, Homo sapiens
acaagacucuguucaaaua

SEQ ID NO: 213033 - RNA, 19 nt, Homo sapiens
gaagucagcuguuguugga

SEQ ID NO: 213034 - RNA, 19 nt, Homo sapiens
cauaagagauucccucauu

SEQ ID NO: 213035 - RNA, 19 nt, Homo sapiens
ccaaacagauuuacugcua

SEQ ID NO: 213036 - RNA, 19 nt, Homo sapiens
ugaagaagcucacaaguca

SEQ ID NO: 213037 - RNA, 19 nt, Homo sapiens
ccagaaauguuccagcuaa

SEQ ID NO: 213038 - RNA, 19 nt, Homo sapiens
gaaaagaccuugaaaagca

SEQ ID NO: 213039 - RNA, 19 nt, Homo sapiens
gagauucccucauuucuuc

SEQ ID NO: 213040 - RNA, 19 nt, Homo sapiens
gagcauaguuaauaagcaa

SEQ ID NO: 213041 - RNA, 19 nt, Homo sapiens
gaaugugucccaugcauaa

SEQ ID NO: 213042 - RNA, 19 nt, Homo sapiens
gugaagagcauaguuaaua

SEQ ID NO: 213043 - RNA, 19 nt, Homo sapiens
ccaaggcgcuguaugaugu

SEQ ID NO: 213044 - RNA, 19 nt, Homo sapiens
gcauugaguucauaagaga

SEQ ID NO: 213045 - RNA, 19 nt, Homo sapiens
guacacgaccugcauuaua

SEQ ID NO: 213046 - RNA, 19 nt, Homo sapiens
ccaggaagguaugaaauaa

SEQ ID NO: 213047 - RNA, 19 nt, Homo sapiens
uaacaaagaccaaccguau

SEQ ID NO: 213048 - RNA, 19 nt, Homo sapiens
gaaggcaacuauggagaaa

SEQ ID NO: 213049 - RNA, 19 nt, Homo sapiens
gcagagcauugaguucaua

SEQ ID NO: 213050 - RNA, 19 nt, Homo sapiens
caucaucguugcccucuuu

SEQ ID NO: 213051 - RNA, 19 nt, Homo sapiens
ugacaagacucuguucaaa

SEQ ID NO: 213052 - RNA, 19 nt, Homo sapiens
gaaaaccaguggaagauuu

SEQ ID NO: 213053 - RNA, 19 nt, Homo sapiens
gaugaaguaugguccaaga

SEQ ID NO: 213054 - RNA, 19 nt, Homo sapiens
caacuggaccuauguauca

SEQ ID NO: 213055 - RNA, 19 nt, Homo sapiens
agggaacucugcuacauua

SEQ ID NO: 213056 - RNA, 19 nt, Homo sapiens
uugauaagcugcugaagaa

SEQ ID NO: 213057 - RNA, 19 nt, Homo sapiens
gcacacagaaggcaacuau

SEQ ID NO: 213058 - RNA, 19 nt, Homo sapiens
acacugggcugugagauaa

SEQ ID NO: 213059 - RNA, 19 nt, Homo sapiens
ggauuccaccuacuuauuu

SEQ ID NO: 213060 - RNA, 19 nt, Homo sapiens
ggagaaugaguaugucuuu

SEQ ID NO: 213061 - RNA, 19 nt, Homo sapiens
guaaggagaaugaguaugu

SEQ ID NO: 213062 - RNA, 19 nt, Homo sapiens
gagauacgauccuauucga

SEQ ID NO: 213063 - RNA, 19 nt, Homo sapiens
gaucaguagugcuaucuca

SEQ ID NO: 213064 - RNA, 19 nt, Homo sapiens
gaaugaguaugucuuugau

SEQ ID NO: 213065 - RNA, 19 nt, Homo sapiens
gaagaagaucuguaccaaa

SEQ ID NO: 213066 - RNA, 19 nt, Homo sapiens
caucugaauugcuggcuaa

SEQ ID NO: 213067 - RNA, 19 nt, Homo sapiens
caagugguuugaugauuau

SEQ ID NO: 213068 - RNA, 19 nt, Homo sapiens
ucaaacaguuccauaccaa

SEQ ID NO: 213069 - RNA, 19 nt, Homo sapiens
gcccuaggcugcauguuug

SEQ ID NO: 213070 - RNA, 19 nt, Homo sapiens
gcuagugauugcuuucauu

SEQ ID NO: 213071 - RNA, 19 nt, Homo sapiens
ggucuuggcccacugauga

SEQ ID NO: 213072 - RNA, 19 nt, Homo sapiens
caacauaccucagauugcu

SEQ ID NO: 213073 - RNA, 19 nt, Homo sapiens
acaagaaaccgacgacaaa

SEQ ID NO: 213074 - RNA, 19 nt, Homo sapiens
uacacgaccugcauuauau

SEQ ID NO: 213075 - RNA, 19 nt, Homo sapiens
gcaagaagaagaucuguac

SEQ ID NO: 213076 - RNA, 19 nt, Homo sapiens
ccaccaugcuaucuuuauu

SEQ ID NO: 213077 - RNA, 19 nt, Homo sapiens
gaacagcaaauacaacaag

SEQ ID NO: 213078 - RNA, 19 nt, Homo sapiens
uggaaaggaucaauucaga

SEQ ID NO: 213079 - RNA, 19 nt, Homo sapiens
guauaucgccuucacaaug

SEQ ID NO: 213080 - RNA, 19 nt, Homo sapiens
gaaauguuccagcuaacuu

SEQ ID NO: 213081 - RNA, 19 nt, Homo sapiens
caucguugcccucuuuaua

SEQ ID NO: 213082 - RNA, 19 nt, Homo sapiens
gcauggaucugagugacaa

SEQ ID NO: 213083 - RNA, 19 nt, Homo sapiens
ggagaagucagcuguuguu

SEQ ID NO: 213084 - RNA, 19 nt, Homo sapiens
cauaacacacuacuggaua

SEQ ID NO: 213085 - RNA, 19 nt, Homo sapiens
ugacagguaugaugugaca

SEQ ID NO: 213086 - RNA, 19 nt, Homo sapiens
ggugagaggucugcugaug

SEQ ID NO: 213087 - RNA, 19 nt, Homo sapiens
gagcauugaguucauaaga

SEQ ID NO: 213088 - RNA, 19 nt, Homo sapiens
acacagaucaguagugcua

SEQ ID NO: 213089 - RNA, 19 nt, Homo sapiens
ccaaauaugacacucuuau

SEQ ID NO: 213090 - RNA, 19 nt, Homo sapiens
ucaacgaggccaaguauau

SEQ ID NO: 213091 - RNA, 19 nt, Homo sapiens
gagcuacucagcccuugua

SEQ ID NO: 213092 - RNA, 19 nt, Homo sapiens
gaacucugcuacauuaucc

SEQ ID NO: 213093 - RNA, 19 nt, Homo sapiens
gagaaugaguaugucuuug

SEQ ID NO: 213094 - RNA, 19 nt, Homo sapiens
gaaguaugguccaagaaaa

SEQ ID NO: 213095 - RNA, 19 nt, Homo sapiens
ggcuugaacuccuuuccua

SEQ ID NO: 213096 - RNA, 19 nt, Homo sapiens
aagcauagucgccugguua

SEQ ID NO: 213097 - RNA, 19 nt, Homo sapiens
acaaagaccaaccguauug

SEQ ID NO: 213098 - RNA, 19 nt, Homo sapiens
acuguagucuucaucauuu

SEQ ID NO: 213099 - RNA, 19 nt, Homo sapiens
ggaugaugaugaaguaugg

SEQ ID NO: 213100 - RNA, 19 nt, Homo sapiens
gaaauacucuuccaaaagc

SEQ ID NO: 213101 - RNA, 19 nt, Homo sapiens
uauaucgccuucacaaugu

SEQ ID NO: 213102 - RNA, 19 nt, Homo sapiens
gccaauugauggacggaaa

SEQ ID NO: 213103 - RNA, 19 nt, Homo sapiens
gagaacagcaaauacaaca

SEQ ID NO: 213104 - RNA, 19 nt, Homo sapiens
gggagcagagcuuugauaa

SEQ ID NO: 213105 - RNA, 19 nt, Homo sapiens
gagcagagcauugaguuca

SEQ ID NO: 213106 - RNA, 19 nt, Homo sapiens
guaaagaccuugaaaagac

SEQ ID NO: 213107 - RNA, 19 nt, Homo sapiens
ggaagcagugcgugugaaa

SEQ ID NO: 213108 - RNA, 19 nt, Homo sapiens
ccacuuggauacaauggau

SEQ ID NO: 213109 - RNA, 19 nt, Homo sapiens
gaagucuaccugaucugua

SEQ ID NO: 213110 - RNA, 19 nt, Homo sapiens
aagaagaucuguaccaaaa

SEQ ID NO: 213111 - RNA, 19 nt, Homo sapiens
agaagaagaucuguaccaa

SEQ ID NO: 213112 - RNA, 19 nt, Homo sapiens
aauggaugaugaugaagua

SEQ ID NO: 213113 - RNA, 19 nt, Homo sapiens
uugggacaauggagaauua

SEQ ID NO: 213114 - RNA, 19 nt, Homo sapiens
aggaagguaugaaauaaug

SEQ ID NO: 213115 - RNA, 19 nt, Homo sapiens
ggagugcacaguccaguga

SEQ ID NO: 213116 - RNA, 19 nt, Homo sapiens
uggcuaauuucuugauuug

SEQ ID NO: 213117 - RNA, 19 nt, Homo sapiens
guagugcuaucucaugaca

SEQ ID NO: 213118 - RNA, 19 nt, Homo sapiens
ucacgugggcccagaauga

SEQ ID NO: 213119 - RNA, 19 nt, Homo sapiens
gcgaagcccaaacagauuu

SEQ ID NO: 213120 - RNA, 19 nt, Homo sapiens
cauugcagcugugguguuu

SEQ ID NO: 213121 - RNA, 19 nt, Homo sapiens
uaagaaacacggugauauc

SEQ ID NO: 213122 - RNA, 19 nt, Homo sapiens
aagucuaccugaucuguaa

SEQ ID NO: 213123 - RNA, 19 nt, Homo sapiens
gcugacagguaugauguga

SEQ ID NO: 213124 - RNA, 19 nt, Homo sapiens
caguagugcuaucucauga

SEQ ID NO: 213125 - RNA, 19 nt, Homo sapiens
cgagaagucuaccugaucu

SEQ ID NO: 213126 - RNA, 19 nt, Homo sapiens
ugaaguaugguccaagaaa

SEQ ID NO: 213127 - RNA, 19 nt, Homo sapiens
uaucagccgugcacacaga

SEQ ID NO: 213128 - RNA, 19 nt, Homo sapiens
cguaggacaucgcuuguuc

SEQ ID NO: 213129 - RNA, 19 nt, Homo sapiens
gaaagggacuaaacuuauu

SEQ ID NO: 213130 - RNA, 19 nt, Homo sapiens
gaucauagcucacugaagu

SEQ ID NO: 213131 - RNA, 19 nt, Homo sapiens
gauagggucuugcucaauu

SEQ ID NO: 213132 - RNA, 19 nt, Homo sapiens
ugaaugcuuuccagaauua

SEQ ID NO: 213133 - RNA, 19 nt, Homo sapiens
ggaguagaauuuacauuug

SEQ ID NO: 213134 - RNA, 19 nt, Homo sapiens
gaaacccugucucuacuaa

SEQ ID NO: 213135 - RNA, 19 nt, Homo sapiens
ccagguaacugacuuuaau

SEQ ID NO: 213136 - RNA, 19 nt, Homo sapiens
gcacugggauggaacuaug

SEQ ID NO: 213137 - RNA, 19 nt, Homo sapiens
guugacagcucccuaaaga

SEQ ID NO: 213138 - RNA, 19 nt, Homo sapiens
gcagcucucucauggguaa

SEQ ID NO: 213139 - RNA, 19 nt, Homo sapiens
gcagugagcugugauugug

SEQ ID NO: 213140 - RNA, 19 nt, Homo sapiens
gggaguagaauuuacauuu

SEQ ID NO: 213141 - RNA, 19 nt, Homo sapiens
ggagugagcugaggaacug

SEQ ID NO: 213142 - RNA, 19 nt, Homo sapiens
gguacgacaucuuccagua

SEQ ID NO: 213143 - RNA, 19 nt, Homo sapiens
gcauggguuugaauucuuu

SEQ ID NO: 213144 - RNA, 19 nt, Homo sapiens
aagauuacguucugaugua

SEQ ID NO: 213145 - RNA, 19 nt, Homo sapiens
gcaccuagccucuuugauc

SEQ ID NO: 213146 - RNA, 19 nt, Homo sapiens
gacgaggucucacuauguu

SEQ ID NO: 213147 - RNA, 19 nt, Homo sapiens
uagaaagggacuaaacuua

SEQ ID NO: 213148 - RNA, 19 nt, Homo sapiens
guuacuuccuguucaauaa

SEQ ID NO: 213149 - RNA, 19 nt, Homo sapiens
ugaaucuucugacacauuu

SEQ ID NO: 213150 - RNA, 19 nt, Homo sapiens
guacacaaauaacugacuu

SEQ ID NO: 213151 - RNA, 19 nt, Homo sapiens
ugaauucucuggcuucuag

SEQ ID NO: 213152 - RNA, 19 nt, Homo sapiens
gcugaaugcuuuccagaau

SEQ ID NO: 213153 - RNA, 19 nt, Homo sapiens
gcacgaccauacccagcua

SEQ ID NO: 213154 - RNA, 19 nt, Homo sapiens
cugaagauguugucauauu

SEQ ID NO: 213155 - RNA, 19 nt, Homo sapiens
ggacauccucuguuacuga

SEQ ID NO: 213156 - RNA, 19 nt, Homo sapiens
cuaaagcagaguaagauua

SEQ ID NO: 213157 - RNA, 19 nt, Homo sapiens
ugacagcucccuaaagauu

SEQ ID NO: 213158 - RNA, 19 nt, Homo sapiens
gaccugggcucaagcaauc

SEQ ID NO: 213159 - RNA, 19 nt, Homo sapiens
ggaggcuuauuccauguuu

SEQ ID NO: 213160 - RNA, 19 nt, Homo sapiens
guucuggguuggaggcuua

SEQ ID NO: 213161 - RNA, 19 nt, Homo sapiens
gaucauuucugugguguuc

SEQ ID NO: 213162 - RNA, 19 nt, Homo sapiens
caucgcaccuagccucuuu

SEQ ID NO: 213163 - RNA, 19 nt, Homo sapiens
gagauagggucuugcucaa

SEQ ID NO: 213164 - RNA, 19 nt, Homo sapiens
uacugaagauguugucaua

SEQ ID NO: 213165 - RNA, 19 nt, Homo sapiens
gcagaugcacgcacauuug

SEQ ID NO: 213166 - RNA, 19 nt, Homo sapiens
gaccauacccagcuaaugu

SEQ ID NO: 213167 - RNA, 19 nt, Homo sapiens
gccaagaccucacccaucu

SEQ ID NO: 213168 - RNA, 19 nt, Homo sapiens
gggcaacuauggcgaaagu

SEQ ID NO: 213169 - RNA, 19 nt, Homo sapiens
gggcucuucuccuguauga

SEQ ID NO: 213170 - RNA, 19 nt, Homo sapiens
uaacugacuuccacaagag

SEQ ID NO: 213171 - RNA, 19 nt, Homo sapiens
gagggugaaccacacuuua

SEQ ID NO: 213172 - RNA, 19 nt, Homo sapiens
gaugcacgcacauuuguuu

SEQ ID NO: 213173 - RNA, 19 nt, Homo sapiens
guucugauguaagcuuuaa

SEQ ID NO: 213174 - RNA, 19 nt, Homo sapiens
gcagggaguuugccaagac

SEQ ID NO: 213175 - RNA, 19 nt, Homo sapiens
gagaacaaccgcaggaaca

SEQ ID NO: 213176 - RNA, 19 nt, Homo sapiens
gacauccucuguuacugaa

SEQ ID NO: 213177 - RNA, 19 nt, Homo sapiens
gugugaaguuucuggcaua

SEQ ID NO: 213178 - RNA, 19 nt, Homo sapiens
gauggugggugccuguaau

SEQ ID NO: 213179 - RNA, 19 nt, Homo sapiens
ggcggaugcuucugcagua

SEQ ID NO: 213180 - RNA, 19 nt, Homo sapiens
guacugggaaguccauuug

SEQ ID NO: 213181 - RNA, 19 nt, Homo sapiens
caccgaaguuugucccauu

SEQ ID NO: 213182 - RNA, 19 nt, Homo sapiens
caccuagccucuuugauca

SEQ ID NO: 213183 - RNA, 19 nt, Homo sapiens
agaaagggacuaaacuuau

SEQ ID NO: 213184 - RNA, 19 nt, Homo sapiens
aagagcuucuguauaguaa

SEQ ID NO: 213185 - RNA, 19 nt, Homo sapiens
gaggcuuauuccauguuua

SEQ ID NO: 213186 - RNA, 19 nt, Homo sapiens
gaaguuugucccauuuguu

SEQ ID NO: 213187 - RNA, 19 nt, Homo sapiens
ggucuugcucaauuucuua

SEQ ID NO: 213188 - RNA, 19 nt, Homo sapiens
caguauacauucucuaguc

SEQ ID NO: 213189 - RNA, 19 nt, Homo sapiens
gguccacggugaacaguca

SEQ ID NO: 213190 - RNA, 19 nt, Homo sapiens
caaaugcacaggcgaggaa

SEQ ID NO: 213191 - RNA, 19 nt, Homo sapiens
ccagugugguuucucuuau

SEQ ID NO: 213192 - RNA, 19 nt, Homo sapiens
gcuucuagcugaaaacuuu

SEQ ID NO: 213193 - RNA, 19 nt, Homo sapiens
uacauucucuagucuguga

SEQ ID NO: 213194 - RNA, 19 nt, Homo sapiens
ugaccacuguuuaagauca

SEQ ID NO: 213195 - RNA, 19 nt, Homo sapiens
cgacggauuugaccaguac

SEQ ID NO: 213196 - RNA, 19 nt, Homo sapiens
cgaaguuugucccauuugu

SEQ ID NO: 213197 - RNA, 19 nt, Homo sapiens
ucuuugagguccaauuuau

SEQ ID NO: 213198 - RNA, 19 nt, Homo sapiens
gauguacacaaauaacuga

SEQ ID NO: 213199 - RNA, 19 nt, Homo sapiens
uguaugaacucugagauca

SEQ ID NO: 213200 - RNA, 19 nt, Homo sapiens
gcaggagaaucgcuugaac

SEQ ID NO: 213201 - RNA, 19 nt, Homo sapiens
caaaguguucggauuacaa

SEQ ID NO: 213202 - RNA, 19 nt, Homo sapiens
ccccaaaccugaagaaauu

SEQ ID NO: 213203 - RNA, 19 nt, Homo sapiens
ggugaaacccugucucuac

SEQ ID NO: 213204 - RNA, 19 nt, Homo sapiens
caaggucagacuuagagua

SEQ ID NO: 213205 - RNA, 19 nt, Homo sapiens
uuauagcuuugucccauuu

SEQ ID NO: 213206 - RNA, 19 nt, Homo sapiens
ugaaguuucuggcauagag

SEQ ID NO: 213207 - RNA, 19 nt, Homo sapiens
aagcuugguuuaaguuaug

SEQ ID NO: 213208 - RNA, 19 nt, Homo sapiens
gugcauuuguguuguguuc

SEQ ID NO: 213209 - RNA, 19 nt, Homo sapiens
auaacugacuuccacaaga

SEQ ID NO: 213210 - RNA, 19 nt, Homo sapiens
cauccucuguuacugaaga

SEQ ID NO: 213211 - RNA, 19 nt, Homo sapiens
gaucuccaagggaaaguuu

SEQ ID NO: 213212 - RNA, 19 nt, Homo sapiens
gcucaggacggguauggaa

SEQ ID NO: 213213 - RNA, 19 nt, Homo sapiens
gacuaaacuuauucucuca

SEQ ID NO: 213214 - RNA, 19 nt, Homo sapiens
aaaccuacgucauccucuu

SEQ ID NO: 213215 - RNA, 19 nt, Homo sapiens
guacaccaccugcaucauc

SEQ ID NO: 213216 - RNA, 19 nt, Homo sapiens
gcuuuaaccaccuauuuau

SEQ ID NO: 213217 - RNA, 19 nt, Homo sapiens
ucccaaaguguucggauua

SEQ ID NO: 213218 - RNA, 19 nt, Homo sapiens
caggguaucuccacagcau

SEQ ID NO: 213219 - RNA, 19 nt, Homo sapiens
auagggcucuucuccugua

SEQ ID NO: 213220 - RNA, 19 nt, Homo sapiens
cacauuaggacguuucauu

SEQ ID NO: 213221 - RNA, 19 nt, Homo sapiens
acagcgugauugacuauga

SEQ ID NO: 213222 - RNA, 19 nt, Homo sapiens
gagggcaacuauggcgaaa

SEQ ID NO: 213223 - RNA, 19 nt, Homo sapiens
ucuucuauguguggaauua

SEQ ID NO: 213224 - RNA, 19 nt, Homo sapiens
ccucuuugaucauuucugu

SEQ ID NO: 213225 - RNA, 19 nt, Homo sapiens
cugaaugcuuuccagaauu

SEQ ID NO: 213226 - RNA, 19 nt, Homo sapiens
uuaggacguuucauuuguu

SEQ ID NO: 213227 - RNA, 19 nt, Homo sapiens
ggaaguccauuugcaagcu

SEQ ID NO: 213228 - RNA, 19 nt, Homo sapiens
caaggugcaguuugugauu

SEQ ID NO: 213229 - RNA, 19 nt, Homo sapiens
gggcugaccugucuuauua

SEQ ID NO: 213230 - RNA, 19 nt, Homo sapiens
gaaaguaguuggagugauu

SEQ ID NO: 213231 - RNA, 19 nt, Homo sapiens
ggaagacccucaguuauuu

SEQ ID NO: 213232 - RNA, 19 nt, Homo sapiens
gaauagaggucuugaucuu

SEQ ID NO: 213233 - RNA, 19 nt, Homo sapiens
ggcaaucacuuccaguuua

SEQ ID NO: 213234 - RNA, 19 nt, Homo sapiens
gcaaucacuuccaguuuaa

SEQ ID NO: 213235 - RNA, 19 nt, Homo sapiens
caaaagagcugaccaaguu

SEQ ID NO: 213236 - RNA, 19 nt, Homo sapiens
cagaagaaauguaugguuu

SEQ ID NO: 213237 - RNA, 19 nt, Homo sapiens
caacuuggcugcaauugug

SEQ ID NO: 213238 - RNA, 19 nt, Homo sapiens
gaaaagcucuacauacaaa

SEQ ID NO: 213239 - RNA, 19 nt, Homo sapiens
caacagugaucccaaccua

SEQ ID NO: 213240 - RNA, 19 nt, Homo sapiens
gguauuggcugaacugaau

SEQ ID NO: 213241 - RNA, 19 nt, Homo sapiens
guaccucgguucacuguuu

SEQ ID NO: 213242 - RNA, 19 nt, Homo sapiens
guuaugacaucuuucagua

SEQ ID NO: 213243 - RNA, 19 nt, Homo sapiens
caucagcacugccaacuug

SEQ ID NO: 213244 - RNA, 19 nt, Homo sapiens
gaacuucagcucaauauag

SEQ ID NO: 213245 - RNA, 19 nt, Homo sapiens
agaaguugcugaaguauau

SEQ ID NO: 213246 - RNA, 19 nt, Homo sapiens
gcaaagacaggaccauuga

SEQ ID NO: 213247 - RNA, 19 nt, Homo sapiens
ccaccuaucuuugguauau

SEQ ID NO: 213248 - RNA, 19 nt, Homo sapiens
aaacugugcugagaaagua

SEQ ID NO: 213249 - RNA, 19 nt, Homo sapiens
ggauauagcauucuucuca

SEQ ID NO: 213250 - RNA, 19 nt, Homo sapiens
uaaaggaguccgagagaua

SEQ ID NO: 213251 - RNA, 19 nt, Homo sapiens
ucacgcagauuuccaaaga

SEQ ID NO: 213252 - RNA, 19 nt, Homo sapiens
ugaccugucuuauuacgua

SEQ ID NO: 213253 - RNA, 19 nt, Homo sapiens
guccaagaauguaucaaua

SEQ ID NO: 213254 - RNA, 19 nt, Homo sapiens
cugcuuaugugccaauuua

SEQ ID NO: 213255 - RNA, 19 nt, Homo sapiens
gauaaggacuuuaggaaaa

SEQ ID NO: 213256 - RNA, 19 nt, Homo sapiens
uaucuaaccuguuccauuc

SEQ ID NO: 213257 - RNA, 19 nt, Homo sapiens
gcaugaagauaucgcagaa

SEQ ID NO: 213258 - RNA, 19 nt, Homo sapiens
caacugcagucauucuuau

SEQ ID NO: 213259 - RNA, 19 nt, Homo sapiens
gaaaguguacaucaucauu

SEQ ID NO: 213260 - RNA, 19 nt, Homo sapiens
gaucauugccaccaucuuu

SEQ ID NO: 213261 - RNA, 19 nt, Homo sapiens
ggauuuaucgcauauuuga

SEQ ID NO: 213262 - RNA, 19 nt, Homo sapiens
gaccagaggcccaaugaaa

SEQ ID NO: 213263 - RNA, 19 nt, Homo sapiens
gugaggaccuuugcacuuu

SEQ ID NO: 213264 - RNA, 19 nt, Homo sapiens
gaaagaagacacagaaagg

SEQ ID NO: 213265 - RNA, 19 nt, Homo sapiens
gaaaagauuccaacuauga

SEQ ID NO: 213266 - RNA, 19 nt, Homo sapiens
gaaggaaguuauggagaga

SEQ ID NO: 213267 - RNA, 19 nt, Homo sapiens
gcccuaggcuggaauuaug

SEQ ID NO: 213268 - RNA, 19 nt, Homo sapiens
ucguuaaucuugcugcuua

SEQ ID NO: 213269 - RNA, 19 nt, Homo sapiens
gcaugccaguaauguauuu

SEQ ID NO: 213270 - RNA, 19 nt, Homo sapiens
uuacagaucuccaaaucau

SEQ ID NO: 213271 - RNA, 19 nt, Homo sapiens
guucucaagugugacauua

SEQ ID NO: 213272 - RNA, 19 nt, Homo sapiens
caucgaggcugucacacaa

SEQ ID NO: 213273 - RNA, 19 nt, Homo sapiens
aaacagcugcuuuaugaaa

SEQ ID NO: 213274 - RNA, 19 nt, Homo sapiens
gcacaggacaggagagaau

SEQ ID NO: 213275 - RNA, 19 nt, Homo sapiens
gaaaacaacagaagaaaug

SEQ ID NO: 213276 - RNA, 19 nt, Homo sapiens
ccaagaauguaucaauaag

SEQ ID NO: 213277 - RNA, 19 nt, Homo sapiens
caaagggaguguugaaacu

SEQ ID NO: 213278 - RNA, 19 nt, Homo sapiens
gaugaacacaagacaauga

SEQ ID NO: 213279 - RNA, 19 nt, Homo sapiens
gaagaaauguaugguuugc

SEQ ID NO: 213280 - RNA, 19 nt, Homo sapiens
aaacaacccuugcugaaaa

SEQ ID NO: 213281 - RNA, 19 nt, Homo sapiens
gcaccagcaugaagauauc

SEQ ID NO: 213282 - RNA, 19 nt, Homo sapiens
gaaggaaagaauauggauu

SEQ ID NO: 213283 - RNA, 19 nt, Homo sapiens
ugaacucaauguccagaaa

SEQ ID NO: 213284 - RNA, 19 nt, Homo sapiens
ccagccaacugcagucauu

SEQ ID NO: 213285 - RNA, 19 nt, Homo sapiens
ggacaggagagaauuggaa

SEQ ID NO: 213286 - RNA, 19 nt, Homo sapiens
caaacuaccacgcuuacaa

SEQ ID NO: 213287 - RNA, 19 nt, Homo sapiens
cauuacagaucuccaaauc

SEQ ID NO: 213288 - RNA, 19 nt, Homo sapiens
cgaaccggaugccaggaua

SEQ ID NO: 213289 - RNA, 19 nt, Homo sapiens
agacacagaucgcaaaugc

SEQ ID NO: 213290 - RNA, 19 nt, Homo sapiens
gcaacaccaagcauucuaa

SEQ ID NO: 213291 - RNA, 19 nt, Homo sapiens
auagaggucuugaucuuug

SEQ ID NO: 213292 - RNA, 19 nt, Homo sapiens
ugacgggcaucuuucuuug

SEQ ID NO: 213293 - RNA, 19 nt, Homo sapiens
agacaggaccauugacuuu

SEQ ID NO: 213294 - RNA, 19 nt, Homo sapiens
ccagauuaguuaugcauca

SEQ ID NO: 213295 - RNA, 19 nt, Homo sapiens
gauauuguccaagaaugua

SEQ ID NO: 213296 - RNA, 19 nt, Homo sapiens
gaacugaauagaggucuug

SEQ ID NO: 213297 - RNA, 19 nt, Homo sapiens
cucagacgguggaauauuu

SEQ ID NO: 213298 - RNA, 19 nt, Homo sapiens
acagcugcuuuaugaaaua

SEQ ID NO: 213299 - RNA, 19 nt, Homo sapiens
ucggauuuaucgcauauuu

SEQ ID NO: 213300 - RNA, 19 nt, Homo sapiens
ugaaguauauacgcaaugu

SEQ ID NO: 213301 - RNA, 19 nt, Homo sapiens
caacagaagaaauguaugg

SEQ ID NO: 213302 - RNA, 19 nt, Homo sapiens
ccaacugcagucauucuua

SEQ ID NO: 213303 - RNA, 19 nt, Homo sapiens
gauauagcauucuucucau

SEQ ID NO: 213304 - RNA, 19 nt, Homo sapiens
ccauuggauucacuaugua

SEQ ID NO: 213305 - RNA, 19 nt, Homo sapiens
agacuacgaugaacacaag

SEQ ID NO: 213306 - RNA, 19 nt, Homo sapiens
gagaaagaagacacagaaa

SEQ ID NO: 213307 - RNA, 19 nt, Homo sapiens
acaggaccauugacuuuga

SEQ ID NO: 213308 - RNA, 19 nt, Homo sapiens
acacaaacccagugacaga

SEQ ID NO: 213309 - RNA, 19 nt, Homo sapiens
uaacgaagccaagcccauu

SEQ ID NO: 213310 - RNA, 19 nt, Homo sapiens
uccaggcauucuaauaaua

SEQ ID NO: 213311 - RNA, 19 nt, Homo sapiens
ccaacaucaucauagacua

SEQ ID NO: 213312 - RNA, 19 nt, Homo sapiens
ggauauucccaucaucaaa

SEQ ID NO: 213313 - RNA, 19 nt, Homo sapiens
guaccaguuugaugagaug

SEQ ID NO: 213314 - RNA, 19 nt, Homo sapiens
guaaaggaguccgagagau

SEQ ID NO: 213315 - RNA, 19 nt, Homo sapiens
cagacgaacuucagcucaa

SEQ ID NO: 213316 - RNA, 19 nt, Homo sapiens
ggagagaauuggaaaagau

SEQ ID NO: 213317 - RNA, 19 nt, Homo sapiens
ccauugacuuugauagaau

SEQ ID NO: 213318 - RNA, 19 nt, Homo sapiens
aggaagacccucaguuauu

SEQ ID NO: 213319 - RNA, 19 nt, Homo sapiens
cccauuggauucacuaugu

SEQ ID NO: 213320 - RNA, 19 nt, Homo sapiens
ggaacuccuugcuguugga

SEQ ID NO: 213321 - RNA, 19 nt, Homo sapiens
ugccaacgaugaggauaua

SEQ ID NO: 213322 - RNA, 19 nt, Homo sapiens
gaccauugacuuugauaga

SEQ ID NO: 213323 - RNA, 19 nt, Homo sapiens
gauccaagcgaccuaaaca

SEQ ID NO: 213324 - RNA, 19 nt, Homo sapiens
cacccaaccuggcauagga

SEQ ID NO: 213325 - RNA, 19 nt, Homo sapiens
gcaguggacagacgaacuu

SEQ ID NO: 213326 - RNA, 19 nt, Homo sapiens
uaaaguccaguucgugauu

SEQ ID NO: 213327 - RNA, 19 nt, Homo sapiens
uaaaggcccuaggcuggaa

SEQ ID NO: 213328 - RNA, 19 nt, Homo sapiens
aaaauucccucuuuccauu

SEQ ID NO: 213329 - RNA, 19 nt, Homo sapiens
ggaaagagcuacuugguua

SEQ ID NO: 213330 - RNA, 19 nt, Homo sapiens
caagauuucuggcgucaua

SEQ ID NO: 213331 - RNA, 19 nt, Homo sapiens
ccaaucagcuucaucuaaa

SEQ ID NO: 213332 - RNA, 19 nt, Homo sapiens
gcagugggcucauagagaa

SEQ ID NO: 213333 - RNA, 19 nt, Homo sapiens
ggaaagguccaauuuguaa

SEQ ID NO: 213334 - RNA, 19 nt, Homo sapiens
gcacagggcuggagcgaau

SEQ ID NO: 213335 - RNA, 19 nt, Homo sapiens
gcacugggauggaauuaug

SEQ ID NO: 213336 - RNA, 19 nt, Homo sapiens
gaucagagacccaacauga

SEQ ID NO: 213337 - RNA, 19 nt, Homo sapiens
gcuaaaguauugcuuauuc

SEQ ID NO: 213338 - RNA, 19 nt, Homo sapiens
ggaaggaaagguccaauuu

SEQ ID NO: 213339 - RNA, 19 nt, Homo sapiens
gccgaacucuugccaauaa

SEQ ID NO: 213340 - RNA, 19 nt, Homo sapiens
guuaugauaucuuccagua

SEQ ID NO: 213341 - RNA, 19 nt, Homo sapiens
ccacauuguuuaacuugua

SEQ ID NO: 213342 - RNA, 19 nt, Homo sapiens
ggaaaugacagaccaaaug

SEQ ID NO: 213343 - RNA, 19 nt, Homo sapiens
gaguuuaagugcuucagua

SEQ ID NO: 213344 - RNA, 19 nt, Homo sapiens
gaauaaacuuugggucuug

SEQ ID NO: 213345 - RNA, 19 nt, Homo sapiens
uguaauggcugaccagauu

SEQ ID NO: 213346 - RNA, 19 nt, Homo sapiens
ggaaauggcacaaucugaa

SEQ ID NO: 213347 - RNA, 19 nt, Homo sapiens
ggaauuauguuucgacacu

SEQ ID NO: 213348 - RNA, 19 nt, Homo sapiens
accaagaccuggagaauuu

SEQ ID NO: 213349 - RNA, 19 nt, Homo sapiens
caucaugguugcuaacauu

SEQ ID NO: 213350 - RNA, 19 nt, Homo sapiens
gaaagaugcuucggaugug

SEQ ID NO: 213351 - RNA, 19 nt, Homo sapiens
gaaggaaagguccaauuug

SEQ ID NO: 213352 - RNA, 19 nt, Homo sapiens
gaagugugcuaauggagau

SEQ ID NO: 213353 - RNA, 19 nt, Homo sapiens
ucugaucucucacucauuu

SEQ ID NO: 213354 - RNA, 19 nt, Homo sapiens
ugacauuucugaucucuca

SEQ ID NO: 213355 - RNA, 19 nt, Homo sapiens
ggacuuggcauguguuuca

SEQ ID NO: 213356 - RNA, 19 nt, Homo sapiens
gaagaaaugugugguuugc

SEQ ID NO: 213357 - RNA, 19 nt, Homo sapiens
caacauauaucaguuacag

SEQ ID NO: 213358 - RNA, 19 nt, Homo sapiens
gauggucacuuguacuguu

SEQ ID NO: 213359 - RNA, 19 nt, Homo sapiens
ggaacagucauauaaagaa

SEQ ID NO: 213360 - RNA, 19 nt, Homo sapiens
uauaccaccugcaucauuu

SEQ ID NO: 213361 - RNA, 19 nt, Homo sapiens
gagcuguccugugaacuuu

SEQ ID NO: 213362 - RNA, 19 nt, Homo sapiens
gaugugaagugugcuaaug

SEQ ID NO: 213363 - RNA, 19 nt, Homo sapiens
gcaauugaccagauuaaca

SEQ ID NO: 213364 - RNA, 19 nt, Homo sapiens
cagcaaucauucaaucuga

SEQ ID NO: 213365 - RNA, 19 nt, Homo sapiens
ucaauagucagucuuguaa

SEQ ID NO: 213366 - RNA, 19 nt, Homo sapiens
gagaugcuccuggacguua

SEQ ID NO: 213367 - RNA, 19 nt, Homo sapiens
aaggaaagguccaauuugu

SEQ ID NO: 213368 - RNA, 19 nt, Homo sapiens
gugcaggcauuaauagaga

SEQ ID NO: 213369 - RNA, 19 nt, Homo sapiens
caaugagucuguuucuugu

SEQ ID NO: 213370 - RNA, 19 nt, Homo sapiens
gugucaagcuaaaguauug

SEQ ID NO: 213371 - RNA, 19 nt, Homo sapiens
ucacucauuuguucacuug

SEQ ID NO: 213372 - RNA, 19 nt, Homo sapiens
gaaaaggaacagucauaua

SEQ ID NO: 213373 - RNA, 19 nt, Homo sapiens
caaugagugucaagcuaaa

SEQ ID NO: 213374 - RNA, 19 nt, Homo sapiens
gaaaccaacacuuccucua

SEQ ID NO: 213375 - RNA, 19 nt, Homo sapiens
gaaaugacagaccaaaugg

SEQ ID NO: 213376 - RNA, 19 nt, Homo sapiens
caaagcaaacugauccaaa

SEQ ID NO: 213377 - RNA, 19 nt, Homo sapiens
caaugaagccaaaccuauu

SEQ ID NO: 213378 - RNA, 19 nt, Homo sapiens
aaagaucucugcccuggau

SEQ ID NO: 213379 - RNA, 19 nt, Homo sapiens
gagcagugauuauguuugc

SEQ ID NO: 213380 - RNA, 19 nt, Homo sapiens
ugacagcacugggauggaa

SEQ ID NO: 213381 - RNA, 19 nt, Homo sapiens
gcucaagugugacauuucu

SEQ ID NO: 213382 - RNA, 19 nt, Homo sapiens
gacaugcagugggcucaua

SEQ ID NO: 213383 - RNA, 19 nt, Homo sapiens
ggauuugaucgauacuuua

SEQ ID NO: 213384 - RNA, 19 nt, Homo sapiens
gaaccaagaccuggagaau

SEQ ID NO: 213385 - RNA, 19 nt, Homo sapiens
ggccaugcuuuaugcaauu

SEQ ID NO: 213386 - RNA, 19 nt, Homo sapiens
ccaaugagugucaagcuaa

SEQ ID NO: 213387 - RNA, 19 nt, Homo sapiens
gugagagucuugaaaccaa

SEQ ID NO: 213388 - RNA, 19 nt, Homo sapiens
ccuauuggauuuaccaugu

SEQ ID NO: 213389 - RNA, 19 nt, Homo sapiens
gacacuagauccagagaag

SEQ ID NO: 213390 - RNA, 19 nt, Homo sapiens
gcuccuggacguuaugaua

SEQ ID NO: 213391 - RNA, 19 nt, Homo sapiens
uggauuugaucgauacuuu

SEQ ID NO: 213392 - RNA, 19 nt, Homo sapiens
uuacagcaaucauucaauc

SEQ ID NO: 213393 - RNA, 19 nt, Homo sapiens
ucucugcccuggauacauu

SEQ ID NO: 213394 - RNA, 19 nt, Homo sapiens
ucgaagaaaugugugguuu

SEQ ID NO: 213395 - RNA, 19 nt, Homo sapiens
ggagauuggugguguuugc

SEQ ID NO: 213396 - RNA, 19 nt, Homo sapiens
uaagugauaacaccaggua

SEQ ID NO: 213397 - RNA, 19 nt, Homo sapiens
caauugaccagauuaacaa

SEQ ID NO: 213398 - RNA, 19 nt, Homo sapiens
acaaugagucuguuucuug

SEQ ID NO: 213399 - RNA, 19 nt, Homo sapiens
gcuuauucaugagcaguua

SEQ ID NO: 213400 - RNA, 19 nt, Homo sapiens
gcacuccugucacuuuuaa

SEQ ID NO: 213401 - RNA, 19 nt, Homo sapiens
uaacaccagguaugacuuu

SEQ ID NO: 213402 - RNA, 19 nt, Homo sapiens
gacuggaggccaugcuuua

SEQ ID NO: 213403 - RNA, 19 nt, Homo sapiens
caagacaacauauaucagu

SEQ ID NO: 213404 - RNA, 19 nt, Homo sapiens
ccaccugcaucauuugguu

SEQ ID NO: 213405 - RNA, 19 nt, Homo sapiens
ucccagagacuuucaauga

SEQ ID NO: 213406 - RNA, 19 nt, Homo sapiens
uggauuggcucagauaguu

SEQ ID NO: 213407 - RNA, 19 nt, Homo sapiens
caucaucauugacuaugga

SEQ ID NO: 213408 - RNA, 19 nt, Homo sapiens
guguuugucugguuuguug

SEQ ID NO: 213409 - RNA, 19 nt, Homo sapiens
agaauaaacuuugggucuu

SEQ ID NO: 213410 - RNA, 19 nt, Homo sapiens
gccaauaaucgaagaaaug

SEQ ID NO: 213411 - RNA, 19 nt, Homo sapiens
ucaaaucaauagucagucu

SEQ ID NO: 213412 - RNA, 19 nt, Homo sapiens
gugcucaagugugacauuu

SEQ ID NO: 213413 - RNA, 19 nt, Homo sapiens
gaaagagcuacuugguuau

SEQ ID NO: 213414 - RNA, 19 nt, Homo sapiens
gugauuauguuugccaaug

SEQ ID NO: 213415 - RNA, 19 nt, Homo sapiens
gaucuccuuuccaacauca

SEQ ID NO: 213416 - RNA, 19 nt, Homo sapiens
gacaaugagucuguuucuu

SEQ ID NO: 213417 - RNA, 19 nt, Homo sapiens
gaaauggcacaaucugaag

SEQ ID NO: 213418 - RNA, 19 nt, Homo sapiens
cuaccaagacaacauauau

SEQ ID NO: 213419 - RNA, 19 nt, Homo sapiens
ucuauaugcccaagguuua

SEQ ID NO: 213420 - RNA, 19 nt, Homo sapiens
ucaaugaagccaaaccuau

SEQ ID NO: 213421 - RNA, 19 nt, Homo sapiens
aaagagcuacuugguuaua

SEQ ID NO: 213422 - RNA, 19 nt, Homo sapiens
gcucgggauucaucuuaug

SEQ ID NO: 213423 - RNA, 19 nt, Homo sapiens
ucacaaugaugcaaagaac

SEQ ID NO: 213424 - RNA, 19 nt, Homo sapiens
gauuggugguguuugcauu

SEQ ID NO: 213425 - RNA, 19 nt, Homo sapiens
ucaccaagcccgacaagau

SEQ ID NO: 213426 - RNA, 19 nt, Homo sapiens
gagagcagcggacacuaga

SEQ ID NO: 213427 - RNA, 19 nt, Homo sapiens
ggaccaaucagcuucaucu

SEQ ID NO: 213428 - RNA, 19 nt, Homo sapiens
gggaaagagcuacuugguu

SEQ ID NO: 213429 - RNA, 19 nt, Homo sapiens
gaacaaaggggcuuaauua

SEQ ID NO: 213430 - RNA, 19 nt, Homo sapiens
gcggaaagcuugccucaau

SEQ ID NO: 213431 - RNA, 19 nt, Homo sapiens
caaaggggcuuaauuauug

SEQ ID NO: 213432 - RNA, 19 nt, Homo sapiens
gaacagaagaggaaagaga

SEQ ID NO: 213433 - RNA, 19 nt, Homo sapiens
ccaagcaaauggccaauga

SEQ ID NO: 213434 - RNA, 19 nt, Homo sapiens
ccaagaacauccaaagugu

SEQ ID NO: 213435 - RNA, 19 nt, Homo sapiens
gcaaauggccaaugagauc

SEQ ID NO: 213436 - RNA, 19 nt, Homo sapiens
gagcaucgcuuaggagaag

SEQ ID NO: 213437 - RNA, 19 nt, Homo sapiens
ccugcacacuguccuauua

SEQ ID NO: 213438 - RNA, 19 nt, Homo sapiens
cauacugccuuguuuaaug

SEQ ID NO: 213439 - RNA, 19 nt, Homo sapiens
uuacaguguuucuggcuua

SEQ ID NO: 213440 - RNA, 19 nt, Homo sapiens
agaugaaugucaguuguua

SEQ ID NO: 213441 - RNA, 19 nt, Homo sapiens
gcacacuguccuauuauau

SEQ ID NO: 213442 - RNA, 19 nt, Homo sapiens
gggcuuaauuauugauguu

SEQ ID NO: 213443 - RNA, 19 nt, Homo sapiens
gugcacaucuguuuuguaa

SEQ ID NO: 213444 - RNA, 19 nt, Homo sapiens
gguagaauguuuucaaaug

SEQ ID NO: 213445 - RNA, 19 nt, Homo sapiens
acacuguccuauuauauuc

SEQ ID NO: 213446 - RNA, 19 nt, Homo sapiens
aggaggcccugcccuuaua

SEQ ID NO: 213447 - RNA, 19 nt, Homo sapiens
cuaaauaucccuuggacau

SEQ ID NO: 213448 - RNA, 19 nt, Homo sapiens
aaaagaugcugaacaguga

SEQ ID NO: 213449 - RNA, 19 nt, Homo sapiens
gaagucauagccacacuca

SEQ ID NO: 213450 - RNA, 19 nt, Homo sapiens
gcacaucuguuuuguaacu

SEQ ID NO: 213451 - RNA, 19 nt, Homo sapiens
guaacuguuuagaugaaug

SEQ ID NO: 213452 - RNA, 19 nt, Homo sapiens
gcuggcggauccaagcaaa

SEQ ID NO: 213453 - RNA, 19 nt, Homo sapiens
uauaggaacagaagaggaa

SEQ ID NO: 213454 - RNA, 19 nt, Homo sapiens
caaauccaacugaccagaa

SEQ ID NO: 213455 - RNA, 19 nt, Homo sapiens
uaaauaucccuuggacauu

SEQ ID NO: 213456 - RNA, 19 nt, Homo sapiens
uuagaugaaugucaguugu

SEQ ID NO: 213457 - RNA, 19 nt, Homo sapiens
aagaacauccaaaguguga

SEQ ID NO: 213458 - RNA, 19 nt, Homo sapiens
guucuccagucauuauguu

SEQ ID NO: 213459 - RNA, 19 nt, Homo sapiens
uagccacacucaagaaugg

SEQ ID NO: 213460 - RNA, 19 nt, Homo sapiens
gaacauccaaagugugaac

SEQ ID NO: 213461 - RNA, 19 nt, Homo sapiens
gaagguagaauguuuucaa

SEQ ID NO: 213462 - RNA, 19 nt, Homo sapiens
gcugaacagugacaaaucc

SEQ ID NO: 213463 - RNA, 19 nt, Homo sapiens
cgcccaaaccgaagucaua

SEQ ID NO: 213464 - RNA, 19 nt, Homo sapiens
caugccagccacugugaua

SEQ ID NO: 213465 - RNA, 19 nt, Homo sapiens
ugcacacuguccuauuaua

SEQ ID NO: 213466 - RNA, 19 nt, Homo sapiens
cugaggagccugcaacaug

SEQ ID NO: 213467 - RNA, 19 nt, Homo sapiens
cacacuguccuauuauauu

SEQ ID NO: 213468 - RNA, 19 nt, Homo sapiens
gcaacaugccagccacugu

SEQ ID NO: 213469 - RNA, 19 nt, Homo sapiens
cccaagaacauccaaagug

SEQ ID NO: 213470 - RNA, 19 nt, Homo sapiens
aagcaaauggccaaugaga

SEQ ID NO: 213471 - RNA, 19 nt, Homo sapiens
acugguggcuguuccugaa

SEQ ID NO: 213472 - RNA, 19 nt, Homo sapiens
gcauacugccuuguuuaau

SEQ ID NO: 213473 - RNA, 19 nt, Homo sapiens
aaauccaacugaccagaag

SEQ ID NO: 213474 - RNA, 19 nt, Homo sapiens
cggaaagcuugccucaauc

SEQ ID NO: 213475 - RNA, 19 nt, Homo sapiens
auacugccuuguuuaaugg

SEQ ID NO: 213476 - RNA, 19 nt, Homo sapiens
uccaaagugugaacgugaa

SEQ ID NO: 213477 - RNA, 19 nt, Homo sapiens
acaaaggggcuuaauuauu

SEQ ID NO: 213478 - RNA, 19 nt, Homo sapiens
gaugaaugucaguuguuau

SEQ ID NO: 213479 - RNA, 19 nt, Homo sapiens
caaauggccaaugagauca

SEQ ID NO: 213480 - RNA, 19 nt, Homo sapiens
ggaauucaccccaagaaca

SEQ ID NO: 213481 - RNA, 19 nt, Homo sapiens
guuugagcaucgcuuagga

SEQ ID NO: 213482 - RNA, 19 nt, Homo sapiens
aagaaugggcggaaagcuu

SEQ ID NO: 213483 - RNA, 19 nt, Homo sapiens
agucauagccacacucaag

SEQ ID NO: 213484 - RNA, 19 nt, Homo sapiens
gaugcugaacagugacaaa

SEQ ID NO: 213485 - RNA, 19 nt, Homo sapiens
gaccagaagggaggaggaa

SEQ ID NO: 213486 - RNA, 19 nt, Homo sapiens
uagaugaaugucaguuguu

SEQ ID NO: 213487 - RNA, 19 nt, Homo sapiens
ggaaagcuugccucaaucc

SEQ ID NO: 213488 - RNA, 19 nt, Homo sapiens
acucaagaaugggcggaaa

SEQ ID NO: 213489 - RNA, 19 nt, Homo sapiens
guggucaacauuucucaug

SEQ ID NO: 213490 - RNA, 19 nt, Homo sapiens
ucuccagucauuauguuaa

SEQ ID NO: 213491 - RNA, 19 nt, Homo sapiens
ggcccugcccuuauaggaa

SEQ ID NO: 213492 - RNA, 19 nt, Homo sapiens
ucauagccacacucaagaa

SEQ ID NO: 213493 - RNA, 19 nt, Homo sapiens
gcagagagguuucgauauu

SEQ ID NO: 213494 - RNA, 19 nt, Homo sapiens
gauagaagguuugcagaua

SEQ ID NO: 213495 - RNA, 19 nt, Homo sapiens
gcagaaagcuugucucaac

SEQ ID NO: 213496 - RNA, 19 nt, Homo sapiens
gaaggaaggaggaagcuua

SEQ ID NO: 213497 - RNA, 19 nt, Homo sapiens
guaagauacugccuuguuu

SEQ ID NO: 213498 - RNA, 19 nt, Homo sapiens
gauauucucuagucauuug

SEQ ID NO: 213499 - RNA, 19 nt, Homo sapiens
gauacugccuuguuuaaug

SEQ ID NO: 213500 - RNA, 19 nt, Homo sapiens
gaacagaagaggaaagaga

SEQ ID NO: 213501 - RNA, 19 nt, Homo sapiens
gagcagagagguuucgaua

SEQ ID NO: 213502 - RNA, 19 nt, Homo sapiens
ggaaauguaugugugucua

SEQ ID NO: 213503 - RNA, 19 nt, Homo sapiens
gaauucaccucaagaacau

SEQ ID NO: 213504 - RNA, 19 nt, Homo sapiens
agagagguuucgauauuua

SEQ ID NO: 213505 - RNA, 19 nt, Homo sapiens
ggaaggaggaagcuuauug

SEQ ID NO: 213506 - RNA, 19 nt, Homo sapiens
ucaagaacauccaaagugu

SEQ ID NO: 213507 - RNA, 19 nt, Homo sapiens
cuaaauaucccuuggcauu

SEQ ID NO: 213508 - RNA, 19 nt, Homo sapiens
cagauauucucuagucauu

SEQ ID NO: 213509 - RNA, 19 nt, Homo sapiens
ggaauucaccucaagaaca

SEQ ID NO: 213510 - RNA, 19 nt, Homo sapiens
cagagagguuucgauauuu

SEQ ID NO: 213511 - RNA, 19 nt, Homo sapiens
uaagauacugccuuguuua

SEQ ID NO: 213512 - RNA, 19 nt, Homo sapiens
agaugaaugucaguuguua

SEQ ID NO: 213513 - RNA, 19 nt, Homo sapiens
guugaagcuuuaagaacua

SEQ ID NO: 213514 - RNA, 19 nt, Homo sapiens
uagaagguuugcagauauu

SEQ ID NO: 213515 - RNA, 19 nt, Homo sapiens
gcagggaauucaccucaag

SEQ ID NO: 213516 - RNA, 19 nt, Homo sapiens
aaagaugaaugucaguugu

SEQ ID NO: 213517 - RNA, 19 nt, Homo sapiens
ccuaauguguuugagcaua

SEQ ID NO: 213518 - RNA, 19 nt, Homo sapiens
ggucaaacccaaguuaguu

SEQ ID NO: 213519 - RNA, 19 nt, Homo sapiens
ccgcaucgcccaugguuaa

SEQ ID NO: 213520 - RNA, 19 nt, Homo sapiens
caugucagccacugugaua

SEQ ID NO: 213521 - RNA, 19 nt, Homo sapiens
gauagaggcugaggaaucc

SEQ ID NO: 213522 - RNA, 19 nt, Homo sapiens
auagaagguuugcagauau

SEQ ID NO: 213523 - RNA, 19 nt, Homo sapiens
cuugcacacucucccauua

SEQ ID NO: 213524 - RNA, 19 nt, Homo sapiens
gaaauguaugugugucuau

SEQ ID NO: 213525 - RNA, 19 nt, Homo sapiens
gaaucuacuugcacacucu

SEQ ID NO: 213526 - RNA, 19 nt, Homo sapiens
gaagucauagccacacuca

SEQ ID NO: 213527 - RNA, 19 nt, Homo sapiens
caucgcccaugguuaagaa

SEQ ID NO: 213528 - RNA, 19 nt, Homo sapiens
gaacauccaaagugugaag

SEQ ID NO: 213529 - RNA, 19 nt, Homo sapiens
uaaagaugaaugucaguug

SEQ ID NO: 213530 - RNA, 19 nt, Homo sapiens
gaaggaggaagcuuauugg

SEQ ID NO: 213531 - RNA, 19 nt, Homo sapiens
gcacacucucccauuauau

SEQ ID NO: 213532 - RNA, 19 nt, Homo sapiens
ugcacacucucccauuaua

SEQ ID NO: 213533 - RNA, 19 nt, Homo sapiens
gggcagaaagcuugucuca

SEQ ID NO: 213534 - RNA, 19 nt, Homo sapiens
caaauccaacugaccagaa

SEQ ID NO: 213535 - RNA, 19 nt, Homo sapiens
aagaacauccaaaguguga

SEQ ID NO: 213536 - RNA, 19 nt, Homo sapiens
uugcagauauucucuaguc

SEQ ID NO: 213537 - RNA, 19 nt, Homo sapiens
uagccacacucaagaaugg

SEQ ID NO: 213538 - RNA, 19 nt, Homo sapiens
aagauacugccuuguuuaa

SEQ ID NO: 213539 - RNA, 19 nt, Homo sapiens
uuucucauguugaagcuuu

SEQ ID NO: 213540 - RNA, 19 nt, Homo sapiens
gagguuucgauauuuauug

SEQ ID NO: 213541 - RNA, 19 nt, Homo sapiens
auacugccuuguuuaaugu

SEQ ID NO: 213542 - RNA, 19 nt, Homo sapiens
uguaagauacugccuuguu

SEQ ID NO: 213543 - RNA, 19 nt, Homo sapiens
guaaagaugaaugucaguu

SEQ ID NO: 213544 - RNA, 19 nt, Homo sapiens
gcagauauucucuagucau

SEQ ID NO: 213545 - RNA, 19 nt, Homo sapiens
cgcccaaaccgaagucaua

SEQ ID NO: 213546 - RNA, 19 nt, Homo sapiens
uguugaagcuuuaagaacu

SEQ ID NO: 213547 - RNA, 19 nt, Homo sapiens
gcugaggaauccaagaaaa

SEQ ID NO: 213548 - RNA, 19 nt, Homo sapiens
gagagguuucgauauuuau

SEQ ID NO: 213549 - RNA, 19 nt, Homo sapiens
ugauagaggcugaggaauc

SEQ ID NO: 213550 - RNA, 19 nt, Homo sapiens
aaacccaaguuaguucaau

SEQ ID NO: 213551 - RNA, 19 nt, Homo sapiens
uuaggucaaacccaaguua

SEQ ID NO: 213552 - RNA, 19 nt, Homo sapiens
acacucucccauuauauuu

SEQ ID NO: 213553 - RNA, 19 nt, Homo sapiens
cacacucucccauuauauu

SEQ ID NO: 213554 - RNA, 19 nt, Homo sapiens
cuaauguguuugagcauac

SEQ ID NO: 213555 - RNA, 19 nt, Homo sapiens
acucaagaaugggcagaaa

SEQ ID NO: 213556 - RNA, 19 nt, Homo sapiens
caaugugacggcagggaaa

SEQ ID NO: 213557 - RNA, 19 nt, Homo sapiens
cauguugaagcuuuaagaa

SEQ ID NO: 213558 - RNA, 19 nt, Homo sapiens
aaauccaacugaccagaag

SEQ ID NO: 213559 - RNA, 19 nt, Homo sapiens
uccaaagugugaaggugaa

SEQ ID NO: 213560 - RNA, 19 nt, Homo sapiens
guuugcagauauucucuag

SEQ ID NO: 213561 - RNA, 19 nt, Homo sapiens
uacaggaacagaagaggaa

SEQ ID NO: 213562 - RNA, 19 nt, Homo sapiens
gaugaaugucaguuguuau

SEQ ID NO: 213563 - RNA, 19 nt, Homo sapiens
ugacggcagggaaauguau

SEQ ID NO: 213564 - RNA, 19 nt, Homo sapiens
aguguuucccucuguguua

SEQ ID NO: 213565 - RNA, 19 nt, Homo sapiens
agucauagccacacucaag

SEQ ID NO: 213566 - RNA, 19 nt, Homo sapiens
ugugauagaggcugaggaa

SEQ ID NO: 213567 - RNA, 19 nt, Homo sapiens
gaagguuugcagauauucu

SEQ ID NO: 213568 - RNA, 19 nt, Homo sapiens
cacucucccauuauauuua

SEQ ID NO: 213569 - RNA, 19 nt, Homo sapiens
uguuugagcauacuuagga

SEQ ID NO: 213570 - RNA, 19 nt, Homo sapiens
cucaagaacauccaaagug

SEQ ID NO: 213571 - RNA, 19 nt, Homo sapiens
guaacuguaaagaugaaug

SEQ ID NO: 213572 - RNA, 19 nt, Homo sapiens
guggucaacauuucucaug

SEQ ID NO: 213573 - RNA, 19 nt, Homo sapiens
ucauagccacacucaagaa

SEQ ID NO: 213574 - RNA, 19 nt, Homo sapiens
ugucagccacugugauaga

SEQ ID NO: 213575 - RNA, 19 nt, Homo sapiens
auugguggcuguuccugaa

SEQ ID NO: 213576 - RNA, 19 nt, Homo sapiens
gaagaaagcuugucucaac

SEQ ID NO: 213577 - RNA, 19 nt, Homo sapiens
gaaagggacuuaauguguu

SEQ ID NO: 213578 - RNA, 19 nt, Homo sapiens
cauaaugccuuguuuaaug

SEQ ID NO: 213579 - RNA, 19 nt, Homo sapiens
ggaaagggacuuaaugugu

SEQ ID NO: 213580 - RNA, 19 nt, Homo sapiens
gaauucaccucaagaacau

SEQ ID NO: 213581 - RNA, 19 nt, Homo sapiens
cgaggguucuacuuauuua

SEQ ID NO: 213582 - RNA, 19 nt, Homo sapiens
gaaguuucccuuagacauu

SEQ ID NO: 213583 - RNA, 19 nt, Homo sapiens
ucaagaacauccaaagugu

SEQ ID NO: 213584 - RNA, 19 nt, Homo sapiens
gagcguccguggucacuga

SEQ ID NO: 213585 - RNA, 19 nt, Homo sapiens
gaaaugcaagcaauuagug

SEQ ID NO: 213586 - RNA, 19 nt, Homo sapiens
ggaauucaccucaagaaca

SEQ ID NO: 213587 - RNA, 19 nt, Homo sapiens
gacuuaauguguuugacua

SEQ ID NO: 213588 - RNA, 19 nt, Homo sapiens
aaagggacuuaauguguuu

SEQ ID NO: 213589 - RNA, 19 nt, Homo sapiens
gugaguguguuucaucaaa

SEQ ID NO: 213590 - RNA, 19 nt, Homo sapiens
gcaagcaauuaguggauca

SEQ ID NO: 213591 - RNA, 19 nt, Homo sapiens
ggagagaaguaagaagcuu

SEQ ID NO: 213592 - RNA, 19 nt, Homo sapiens
gcagggaauucaccucaag

SEQ ID NO: 213593 - RNA, 19 nt, Homo sapiens
ucagccaccuugauaaaug

SEQ ID NO: 213594 - RNA, 19 nt, Homo sapiens
gaacauccaaagugugaau

SEQ ID NO: 213595 - RNA, 19 nt, Homo sapiens
uuacgaggguucuacuuau

SEQ ID NO: 213596 - RNA, 19 nt, Homo sapiens
cauccaaagugugaaugua

SEQ ID NO: 213597 - RNA, 19 nt, Homo sapiens
ggaauaugauggguuuuaa

SEQ ID NO: 213598 - RNA, 19 nt, Homo sapiens
cagccaccuugauaaauga

SEQ ID NO: 213599 - RNA, 19 nt, Homo sapiens
uuaaagaugugaguguguu

SEQ ID NO: 213600 - RNA, 19 nt, Homo sapiens
uaccagagcugaaaaugaa

SEQ ID NO: 213601 - RNA, 19 nt, Homo sapiens
gggaagaaagcuugucuca

SEQ ID NO: 213602 - RNA, 19 nt, Homo sapiens
gaagucauagccacacuca

SEQ ID NO: 213603 - RNA, 19 nt, Homo sapiens
gggagaccauaauguguca

SEQ ID NO: 213604 - RNA, 19 nt, Homo sapiens
uacgaggguucuacuuauu

SEQ ID NO: 213605 - RNA, 19 nt, Homo sapiens
ugacaggagagaaguaaga

SEQ ID NO: 213606 - RNA, 19 nt, Homo sapiens
gcuguuauuuaaagaugug

SEQ ID NO: 213607 - RNA, 19 nt, Homo sapiens
ggaagaaagcuugucucaa

SEQ ID NO: 213608 - RNA, 19 nt, Homo sapiens
aagaacauccaaaguguga

SEQ ID NO: 213609 - RNA, 19 nt, Homo sapiens
uagccacacucaagaaugg

SEQ ID NO: 213610 - RNA, 19 nt, Homo sapiens
ggguucuacuuauuuaugu

SEQ ID NO: 213611 - RNA, 19 nt, Homo sapiens
cuuacgaggguucuacuua

SEQ ID NO: 213612 - RNA, 19 nt, Homo sapiens
gguaagggaauguauguac

SEQ ID NO: 213613 - RNA, 19 nt, Homo sapiens
aaguuucccuuagacauuu

SEQ ID NO: 213614 - RNA, 19 nt, Homo sapiens
gcuggaaagggacuuaaug

SEQ ID NO: 213615 - RNA, 19 nt, Homo sapiens
gcuuaucagcguaucauug

SEQ ID NO: 213616 - RNA, 19 nt, Homo sapiens
cgcccaaaccgaagucaua

SEQ ID NO: 213617 - RNA, 19 nt, Homo sapiens
cuuaucagcguaucauuga

SEQ ID NO: 213618 - RNA, 19 nt, Homo sapiens
auuggaauaugauggguuu

SEQ ID NO: 213619 - RNA, 19 nt, Homo sapiens
ggacuuaauguguuugacu

SEQ ID NO: 213620 - RNA, 19 nt, Homo sapiens
acucaagaaugggaagaaa

SEQ ID NO: 213621 - RNA, 19 nt, Homo sapiens
ugugucagccaccuugaua

SEQ ID NO: 213622 - RNA, 19 nt, Homo sapiens
uaaagaugugaguguguuu

SEQ ID NO: 213623 - RNA, 19 nt, Homo sapiens
ugucagccaccuugauaaa

SEQ ID NO: 213624 - RNA, 19 nt, Homo sapiens
gacaggagagaaguaagaa

SEQ ID NO: 213625 - RNA, 19 nt, Homo sapiens
uguccauucugcagcguuu

SEQ ID NO: 213626 - RNA, 19 nt, Homo sapiens
gcugaaguuucccuuagac

SEQ ID NO: 213627 - RNA, 19 nt, Homo sapiens
ugaaaugcaagcaauuagu

SEQ ID NO: 213628 - RNA, 19 nt, Homo sapiens
guuugacuauuucuuacga

SEQ ID NO: 213629 - RNA, 19 nt, Homo sapiens
ucgaaaagauacugaacaa

SEQ ID NO: 213630 - RNA, 19 nt, Homo sapiens
gcccuuaccagagcugaaa

SEQ ID NO: 213631 - RNA, 19 nt, Homo sapiens
agucauagccacacucaag

SEQ ID NO: 213632 - RNA, 19 nt, Homo sapiens
caacugacaggagagaagu

SEQ ID NO: 213633 - RNA, 19 nt, Homo sapiens
gggauugaaaugcaagcaa

SEQ ID NO: 213634 - RNA, 19 nt, Homo sapiens
acgaggguucuacuuauuu

SEQ ID NO: 213635 - RNA, 19 nt, Homo sapiens
cucaagaacauccaaagug

SEQ ID NO: 213636 - RNA, 19 nt, Homo sapiens
cagcguaucauugacacuu

SEQ ID NO: 213637 - RNA, 19 nt, Homo sapiens
ucauagccacacucaagaa

SEQ ID NO: 213638 - RNA, 19 nt, Homo sapiens
ggaagaagcugcaaggaau

SEQ ID NO: 213639 - RNA, 19 nt, Homo sapiens
gcuguuaccauucacaaua

SEQ ID NO: 213640 - RNA, 19 nt, Homo sapiens
gaaccagcaaugauaauga

SEQ ID NO: 213641 - RNA, 19 nt, Homo sapiens
ggaccgugcugaccaagau

SEQ ID NO: 213642 - RNA, 19 nt, Homo sapiens
gaggauagcagcaacuuca

SEQ ID NO: 213643 - RNA, 19 nt, Homo sapiens
gaagaagcugcaaggaauu

SEQ ID NO: 213644 - RNA, 19 nt, Homo sapiens
ugacuauucuguaucuuuc

SEQ ID NO: 213645 - RNA, 19 nt, Homo sapiens
gggaagaagcugcaaggaa

SEQ ID NO: 213646 - RNA, 19 nt, Homo sapiens
agcagcaucuucugguuua

SEQ ID NO: 213647 - RNA, 19 nt, Homo sapiens
caagcagcaucuucugguu

SEQ ID NO: 213648 - RNA, 19 nt, Homo sapiens
aagcaaaggagaacagaaa

SEQ ID NO: 213649 - RNA, 19 nt, Homo sapiens
gaauuugcugggucucaua

SEQ ID NO: 213650 - RNA, 19 nt, Homo sapiens
aaugauggccucucucaaa

SEQ ID NO: 213651 - RNA, 19 nt, Homo sapiens
caaaguugguagacucucu

SEQ ID NO: 213652 - RNA, 19 nt, Homo sapiens
ggauagcagcaacuucaaa

SEQ ID NO: 213653 - RNA, 19 nt, Homo sapiens
ggagucuucuucuguuucu

SEQ ID NO: 213654 - RNA, 19 nt, Homo sapiens
gaacaauugucgaaaagag

SEQ ID NO: 213655 - RNA, 19 nt, Homo sapiens
ggaauuugcugggucucau

SEQ ID NO: 213656 - RNA, 19 nt, Homo sapiens
uaucuuucauccuugacua

SEQ ID NO: 213657 - RNA, 19 nt, Homo sapiens
cagcagccuucgugggauu

SEQ ID NO: 213658 - RNA, 19 nt, Homo sapiens
cuguuaccauucacaauaa

SEQ ID NO: 213659 - RNA, 19 nt, Homo sapiens
aaacaaaaccccuaagaga

SEQ ID NO: 213660 - RNA, 19 nt, Homo sapiens
gaagcaaaggagaacagaa

SEQ ID NO: 213661 - RNA, 19 nt, Homo sapiens
gagggaccgugcugaccaa

SEQ ID NO: 213662 - RNA, 19 nt, Homo sapiens
gauagcagcaacuucaaag

SEQ ID NO: 213663 - RNA, 19 nt, Homo sapiens
gcagcaucuucugguuuaa

SEQ ID NO: 213664 - RNA, 19 nt, Homo sapiens
guacaucaggugggaagaa

SEQ ID NO: 213665 - RNA, 19 nt, Homo sapiens
uaggcuaccuguugguuag

SEQ ID NO: 213666 - RNA, 19 nt, Homo sapiens
gcugugaacaauugucgaa

SEQ ID NO: 213667 - RNA, 19 nt, Homo sapiens
ccuaagagacugaguucug

SEQ ID NO: 213668 - RNA, 19 nt, Homo sapiens
agacugaguucugcaagca

SEQ ID NO: 213669 - RNA, 19 nt, Homo sapiens
gauggccucucucaaaaga

SEQ ID NO: 213670 - RNA, 19 nt, Homo sapiens
gcuaccuguugguuagauu

SEQ ID NO: 213671 - RNA, 19 nt, Homo sapiens
aaccagcaaugauaaugau

SEQ ID NO: 213672 - RNA, 19 nt, Homo sapiens
caaaggagaacagaaacca

SEQ ID NO: 213673 - RNA, 19 nt, Homo sapiens
gagcuguuaccauucacaa

SEQ ID NO: 213674 - RNA, 19 nt, Homo sapiens
gccccgagcuguuaccauu

SEQ ID NO: 213675 - RNA, 19 nt, Homo sapiens
caucuucugguuuaaacuu

SEQ ID NO: 213676 - RNA, 19 nt, Homo sapiens
ugauaaugauggccucucu

SEQ ID NO: 213677 - RNA, 19 nt, Homo sapiens
cagcugagagaguacauca

SEQ ID NO: 213678 - RNA, 19 nt, Homo sapiens
ucauagaagcaaaggagaa

SEQ ID NO: 213679 - RNA, 19 nt, Homo sapiens
cuaggcuaccuguugguua

SEQ ID NO: 213680 - RNA, 19 nt, Homo sapiens
cagcaucuucugguuuaaa

SEQ ID NO: 213681 - RNA, 19 nt, Homo sapiens
gcacaggggagucuucuuc

SEQ ID NO: 213682 - RNA, 19 nt, Homo sapiens
cccgagcuguuaccauuca

SEQ ID NO: 213683 - RNA, 19 nt, Homo sapiens
aagaagcugcaaggaauuu

SEQ ID NO: 213684 - RNA, 19 nt, Homo sapiens
aagcagcaucuucugguuu

SEQ ID NO: 213685 - RNA, 19 nt, Homo sapiens
ucugcaagcaucaguucua

SEQ ID NO: 213686 - RNA, 19 nt, Homo sapiens
uuugcugggucucauagaa

SEQ ID NO: 213687 - RNA, 19 nt, Homo sapiens
gucuuccaauuaaugcuuu

SEQ ID NO: 213688 - RNA, 19 nt, Homo sapiens
gaagcuaaauccaaagaaa

SEQ ID NO: 213689 - RNA, 19 nt, Homo sapiens
gccaugaacuuucugauuu

SEQ ID NO: 213690 - RNA, 19 nt, Homo sapiens
ggacaagacuguggcauau

SEQ ID NO: 213691 - RNA, 19 nt, Homo sapiens
gaacagugacaauaaauga

SEQ ID NO: 213692 - RNA, 19 nt, Homo sapiens
ggcaaggacuuacuuauug

SEQ ID NO: 213693 - RNA, 19 nt, Homo sapiens
ugauaaagaugccucuaua

SEQ ID NO: 213694 - RNA, 19 nt, Homo sapiens
gaggaucucuaaagcagua

SEQ ID NO: 213695 - RNA, 19 nt, Homo sapiens
agagauaccugaagucuga

SEQ ID NO: 213696 - RNA, 19 nt, Homo sapiens
uaucagaacugcuaaagga

SEQ ID NO: 213697 - RNA, 19 nt, Homo sapiens
acaagaagcuaaauccaaa

SEQ ID NO: 213698 - RNA, 19 nt, Homo sapiens
gcgagaagcucagcaaaga

SEQ ID NO: 213699 - RNA, 19 nt, Homo sapiens
ggaaauaccaggaccaguu

SEQ ID NO: 213700 - RNA, 19 nt, Homo sapiens
uaaagaugccucuauagua

SEQ ID NO: 213701 - RNA, 19 nt, Homo sapiens
ggacugaggaagaauuuaa

SEQ ID NO: 213702 - RNA, 19 nt, Homo sapiens
gaaauaccaggaccaguuu

SEQ ID NO: 213703 - RNA, 19 nt, Homo sapiens
auaaagaugugcugauuga

SEQ ID NO: 213704 - RNA, 19 nt, Homo sapiens
aaagaugccucuauaguag

SEQ ID NO: 213705 - RNA, 19 nt, Homo sapiens
gccagcaacuugagggaua

SEQ ID NO: 213706 - RNA, 19 nt, Homo sapiens
gaagauauuuagagauggu

SEQ ID NO: 213707 - RNA, 19 nt, Homo sapiens
ggaauagucccauuagcaa

SEQ ID NO: 213708 - RNA, 19 nt, Homo sapiens
gagagaaguuugucaugca

SEQ ID NO: 213709 - RNA, 19 nt, Homo sapiens
gggcaaggacuuacuuauu

SEQ ID NO: 213710 - RNA, 19 nt, Homo sapiens
aaaggacucuuccaucaga

SEQ ID NO: 213711 - RNA, 19 nt, Homo sapiens
gaaaagaacgcuaaagguu

SEQ ID NO: 213712 - RNA, 19 nt, Homo sapiens
aagaugugcugauugaauu

SEQ ID NO: 213713 - RNA, 19 nt, Homo sapiens
acuaugauguggacuauga

SEQ ID NO: 213714 - RNA, 19 nt, Homo sapiens
ugacagaagacaauaaaga

SEQ ID NO: 213715 - RNA, 19 nt, Homo sapiens
ggaauugucagccacuuga

SEQ ID NO: 213716 - RNA, 19 nt, Homo sapiens
gaggacagaauggauauaa

SEQ ID NO: 213717 - RNA, 19 nt, Homo sapiens
auaaagaacuuggcgagaa

SEQ ID NO: 213718 - RNA, 19 nt, Homo sapiens
gaaacaggguaaugauggu

SEQ ID NO: 213719 - RNA, 19 nt, Homo sapiens
cugaagauauuuagagaug

SEQ ID NO: 213720 - RNA, 19 nt, Homo sapiens
cuucacaucucacuaacaa

SEQ ID NO: 213721 - RNA, 19 nt, Homo sapiens
uaaaaggacucuuccauca

SEQ ID NO: 213722 - RNA, 19 nt, Homo sapiens
uaaagaacuuggcgagaag

SEQ ID NO: 213723 - RNA, 19 nt, Homo sapiens
gaaccuggagcccaaguau

SEQ ID NO: 213724 - RNA, 19 nt, Homo sapiens
aaacucaacuuugcuguag

SEQ ID NO: 213725 - RNA, 19 nt, Homo sapiens
ggacuuacuuauugcuuac

SEQ ID NO: 213726 - RNA, 19 nt, Homo sapiens
cgagaggacagaauggaua

SEQ ID NO: 213727 - RNA, 19 nt, Homo sapiens
uaaugaugguggcaaagaa

SEQ ID NO: 213728 - RNA, 19 nt, Homo sapiens
acacuaacaccuguaauaa

SEQ ID NO: 213729 - RNA, 19 nt, Homo sapiens
ugaugugccuucuccauau

SEQ ID NO: 213730 - RNA, 19 nt, Homo sapiens
gaagagauaccugaagucu

SEQ ID NO: 213731 - RNA, 19 nt, Homo sapiens
ggagagauuccuguuguug

SEQ ID NO: 213732 - RNA, 19 nt, Homo sapiens
gaauagucccauuagcaaa

SEQ ID NO: 213733 - RNA, 19 nt, Homo sapiens
ggagaaacaggguaaugau

SEQ ID NO: 213734 - RNA, 19 nt, Homo sapiens
gacagaagacaauaaagau

SEQ ID NO: 213735 - RNA, 19 nt, Homo sapiens
ggaacagugacaauaaaug

SEQ ID NO: 213736 - RNA, 19 nt, Homo sapiens
gcaaugaugggccugugaa

SEQ ID NO: 213737 - RNA, 19 nt, Homo sapiens
gagaaacaggguaaugaug

SEQ ID NO: 213738 - RNA, 19 nt, Homo sapiens
caucuuauuucguccuuca

SEQ ID NO: 213739 - RNA, 19 nt, Homo sapiens
agggauaacuaccgauuug

SEQ ID NO: 213740 - RNA, 19 nt, Homo sapiens
cuaaagcaguagccaaaca

SEQ ID NO: 213741 - RNA, 19 nt, Homo sapiens
gaagaaggcacaggaggau

SEQ ID NO: 213742 - RNA, 19 nt, Homo sapiens
gcagagaauuuugaugaaa

SEQ ID NO: 213743 - RNA, 19 nt, Homo sapiens
ugaacgaguaugaugauaa

SEQ ID NO: 213744 - RNA, 19 nt, Homo sapiens
gcaacuugagggauaacua

SEQ ID NO: 213745 - RNA, 19 nt, Homo sapiens
gaugugccuucuccauaug

SEQ ID NO: 213746 - RNA, 19 nt, Homo sapiens
gcacaggaggaucucuaaa

SEQ ID NO: 213747 - RNA, 19 nt, Homo sapiens
caugacagaagacaauaaa

SEQ ID NO: 213748 - RNA, 19 nt, Homo sapiens
ucacaugacagaagacaau

SEQ ID NO: 213749 - RNA, 19 nt, Homo sapiens
uaucugcccucacaugaca

SEQ ID NO: 213750 - RNA, 19 nt, Homo sapiens
acaagacuguggcauauac

SEQ ID NO: 213751 - RNA, 19 nt, Homo sapiens
gauaaagaugccucuauag

SEQ ID NO: 213752 - RNA, 19 nt, Homo sapiens
ggguaaugaugguggcaaa

SEQ ID NO: 213753 - RNA, 19 nt, Homo sapiens
aggacuuacuuauugcuua

SEQ ID NO: 213754 - RNA, 19 nt, Homo sapiens
gauacagggcaaggacuua

SEQ ID NO: 213755 - RNA, 19 nt, Homo sapiens
gcccucacaugacagaaga

SEQ ID NO: 213756 - RNA, 19 nt, Homo sapiens
caguuuauguuugugguuu

SEQ ID NO: 213757 - RNA, 19 nt, Homo sapiens
gagaggacagaauggauau

SEQ ID NO: 213758 - RNA, 19 nt, Homo sapiens
ggauuacuuugauggcaau

SEQ ID NO: 213759 - RNA, 19 nt, Homo sapiens
caggaccaguuuauguuug

SEQ ID NO: 213760 - RNA, 19 nt, Homo sapiens
ggacgacaacuucgagagu

SEQ ID NO: 213761 - RNA, 19 nt, Homo sapiens
gacuugcaccugaguauga

SEQ ID NO: 213762 - RNA, 19 nt, Homo sapiens
guaaugaugguggcaaaga

SEQ ID NO: 213763 - RNA, 19 nt, Homo sapiens
gugaacgaguaugaugaua

SEQ ID NO: 213764 - RNA, 19 nt, Homo sapiens
ccagcaacuugagggauaa

SEQ ID NO: 213765 - RNA, 19 nt, Homo sapiens
auuuagagauggugaagaa

SEQ ID NO: 213766 - RNA, 19 nt, Homo sapiens
gcuaaagguuccaacuacu

SEQ ID NO: 213767 - RNA, 19 nt, Homo sapiens
aacacuaacaccuguaaua

SEQ ID NO: 213768 - RNA, 19 nt, Homo sapiens
gacaagacuguggcauaua

SEQ ID NO: 213769 - RNA, 19 nt, Homo sapiens
gagggauaacuaccgauuu

SEQ ID NO: 213770 - RNA, 19 nt, Homo sapiens
ccaggaccaguuuauguuu

SEQ ID NO: 213771 - RNA, 19 nt, Homo sapiens
aaagaugugcugauugaau

SEQ ID NO: 213772 - RNA, 19 nt, Homo sapiens
cugaagagauaccugaagu

SEQ ID NO: 213773 - RNA, 19 nt, Homo sapiens
gcaaaaccuuuagccauga

SEQ ID NO: 213774 - RNA, 19 nt, Homo sapiens
gguaucugcccucacauga

SEQ ID NO: 213775 - RNA, 19 nt, Homo sapiens
aauauggagucaguggaua

SEQ ID NO: 213776 - RNA, 19 nt, Homo sapiens
ggaggacuaggacccauau

SEQ ID NO: 213777 - RNA, 19 nt, Homo sapiens
ugaugggccugugaaggua

SEQ ID NO: 213778 - RNA, 19 nt, Homo sapiens
gcuaaaggagagaaguuug

SEQ ID NO: 213779 - RNA, 19 nt, Homo sapiens
cuggagagauuccuguugu

SEQ ID NO: 213780 - RNA, 19 nt, Homo sapiens
ucacaucucacuaacaagu

SEQ ID NO: 213781 - RNA, 19 nt, Homo sapiens
auacgaauguugagucucu

SEQ ID NO: 213782 - RNA, 19 nt, Homo sapiens
uuggaacagugacaauaaa

SEQ ID NO: 213783 - RNA, 19 nt, Homo sapiens
ccugaagucugaaccuauc

SEQ ID NO: 213784 - RNA, 19 nt, Homo sapiens
ccaacacuaacaccuguaa

SEQ ID NO: 213785 - RNA, 19 nt, Homo sapiens
ggauauccaacccugaaga

SEQ ID NO: 213786 - RNA, 19 nt, Homo sapiens
auccaacccugaagauauu

SEQ ID NO: 213787 - RNA, 19 nt, Homo sapiens
gagacuugcaccugaguau

SEQ ID NO: 213788 - RNA, 19 nt, Homo sapiens
gaucuuaucuucaucuuca

SEQ ID NO: 213789 - RNA, 19 nt, Homo sapiens
ggaaacaguucaacacuca

SEQ ID NO: 213790 - RNA, 19 nt, Homo sapiens
gaauauacaugucaagaag

SEQ ID NO: 213791 - RNA, 19 nt, Homo sapiens
gaucaucucuguuuacuac

SEQ ID NO: 213792 - RNA, 19 nt, Homo sapiens
ccaaagagccuucagaaug

SEQ ID NO: 213793 - RNA, 19 nt, Homo sapiens
ggaaagacgcugugggaaa

SEQ ID NO: 213794 - RNA, 19 nt, Homo sapiens
gcugacagauggcuauuug

SEQ ID NO: 213795 - RNA, 19 nt, Homo sapiens
acacucagcugcucuguug

SEQ ID NO: 213796 - RNA, 19 nt, Homo sapiens
caaagagccuucagaaugc

SEQ ID NO: 213797 - RNA, 19 nt, Homo sapiens
cagaguggguuuaauucua

SEQ ID NO: 213798 - RNA, 19 nt, Homo sapiens
gaccugcuccuccuaauaa

SEQ ID NO: 213799 - RNA, 19 nt, Homo sapiens
gaaagacgcugugggaaaa

SEQ ID NO: 213800 - RNA, 19 nt, Homo sapiens
ccagagugcuuacaaucuu

SEQ ID NO: 213801 - RNA, 19 nt, Homo sapiens
ggaauauacaugucaagaa

SEQ ID NO: 213802 - RNA, 19 nt, Homo sapiens
gaaaauagcaggccaaaag

SEQ ID NO: 213803 - RNA, 19 nt, Homo sapiens
agaguggguuuaauucuaa

SEQ ID NO: 213804 - RNA, 19 nt, Homo sapiens
gaauggagguagaaagaac

SEQ ID NO: 213805 - RNA, 19 nt, Homo sapiens
agacagugcugguguuugu

SEQ ID NO: 213806 - RNA, 19 nt, Homo sapiens
ugucaucccugcaguuuau

SEQ ID NO: 213807 - RNA, 19 nt, Homo sapiens
gagcagcaccagugucaaa

SEQ ID NO: 213808 - RNA, 19 nt, Homo sapiens
aggauuggcugcaaacuga

SEQ ID NO: 213809 - RNA, 19 nt, Homo sapiens
guuccaaaccuguucauuu

SEQ ID NO: 213810 - RNA, 19 nt, Homo sapiens
ggccaaaaguucuuaguaa

SEQ ID NO: 213811 - RNA, 19 nt, Homo sapiens
ggaagggaauauacauguc

SEQ ID NO: 213812 - RNA, 19 nt, Homo sapiens
gauccagagugcuuacaau

SEQ ID NO: 213813 - RNA, 19 nt, Homo sapiens
ggagguggaccauuucaug

SEQ ID NO: 213814 - RNA, 19 nt, Homo sapiens
gagggacgguuuugcuuua

SEQ ID NO: 213815 - RNA, 19 nt, Homo sapiens
gaagggaauauacauguca

SEQ ID NO: 213816 - RNA, 19 nt, Homo sapiens
ccaagacagugcugguguu

SEQ ID NO: 213817 - RNA, 19 nt, Homo sapiens
guauugcacuggucaugug

SEQ ID NO: 213818 - RNA, 19 nt, Homo sapiens
ugacagagaguuuugaaua

SEQ ID NO: 213819 - RNA, 19 nt, Homo sapiens
cgagcgguaugucuagauu

SEQ ID NO: 213820 - RNA, 19 nt, Homo sapiens
uuccaaaccuguucauuuc

SEQ ID NO: 213821 - RNA, 19 nt, Homo sapiens
gaucuucuguacagucaag

SEQ ID NO: 213822 - RNA, 19 nt, Homo sapiens
caacaucuccagucacagu

SEQ ID NO: 213823 - RNA, 19 nt, Homo sapiens
gaugaagaucugccucaaa

SEQ ID NO: 213824 - RNA, 19 nt, Homo sapiens
cuagauugacccuugauuu

SEQ ID NO: 213825 - RNA, 19 nt, Homo sapiens
ccucaucaauggaaacauc

SEQ ID NO: 213826 - RNA, 19 nt, Homo sapiens
ugucgaucaucucuguuua

SEQ ID NO: 213827 - RNA, 19 nt, Homo sapiens
uagaauggagguagaaaga

SEQ ID NO: 213828 - RNA, 19 nt, Homo sapiens
gcuccuaccacuacucuga

SEQ ID NO: 213829 - RNA, 19 nt, Homo sapiens
gcaaacugauccccuuuau

SEQ ID NO: 213830 - RNA, 19 nt, Homo sapiens
agacuagaauggagguaga

SEQ ID NO: 213831 - RNA, 19 nt, Homo sapiens
ugcaugaccucccucaaga

SEQ ID NO: 213832 - RNA, 19 nt, Homo sapiens
ucaucucuguuuacuacua

SEQ ID NO: 213833 - RNA, 19 nt, Homo sapiens
gccaaaaguucuuaguaaa

SEQ ID NO: 213834 - RNA, 19 nt, Homo sapiens
cagcaccagugucaaaaua

SEQ ID NO: 213835 - RNA, 19 nt, Homo sapiens
ccagggagacucagacuag

SEQ ID NO: 213836 - RNA, 19 nt, Homo sapiens
acuuggagguggaccauuu

SEQ ID NO: 213837 - RNA, 19 nt, Homo sapiens
uaagaaauagcaucuaagg

SEQ ID NO: 213838 - RNA, 19 nt, Homo sapiens
agacagauacaaagccauu

SEQ ID NO: 213839 - RNA, 19 nt, Homo sapiens
caggaacccuugcauccau

SEQ ID NO: 213840 - RNA, 19 nt, Homo sapiens
ugaccucccucaagaguac

SEQ ID NO: 213841 - RNA, 19 nt, Homo sapiens
gccuuuaucuggaucaucu

SEQ ID NO: 213842 - RNA, 19 nt, Homo sapiens
caucuucacucgguugcaa

SEQ ID NO: 213843 - RNA, 19 nt, Homo sapiens
caagacagugcugguguuu

SEQ ID NO: 213844 - RNA, 19 nt, Homo sapiens
aaccagaccuucauuagcu

SEQ ID NO: 213845 - RNA, 19 nt, Homo sapiens
augaagaucugccucaaag

SEQ ID NO: 213846 - RNA, 19 nt, Homo sapiens
gggaauauacaugucaaga

SEQ ID NO: 213847 - RNA, 19 nt, Homo sapiens
gagaccugcuccuccuaau

SEQ ID NO: 213848 - RNA, 19 nt, Homo sapiens
ccaaaccuguucauuucca

SEQ ID NO: 213849 - RNA, 19 nt, Homo sapiens
gaaacguuccaaaccuguu

SEQ ID NO: 213850 - RNA, 19 nt, Homo sapiens
gcacuggucaugugaaagc

SEQ ID NO: 213851 - RNA, 19 nt, Homo sapiens
ccaaucaugucaucuaccu

SEQ ID NO: 213852 - RNA, 19 nt, Homo sapiens
acuacuacuucauugcuaa

SEQ ID NO: 213853 - RNA, 19 nt, Homo sapiens
gcaccaaccagaccuucau

SEQ ID NO: 213854 - RNA, 19 nt, Homo sapiens
gguuuaauucuaagccuuu

SEQ ID NO: 213855 - RNA, 19 nt, Homo sapiens
gggagacucagacuagaau

SEQ ID NO: 213856 - RNA, 19 nt, Homo sapiens
ccaaccagaccuucauuag

SEQ ID NO: 213857 - RNA, 19 nt, Homo sapiens
cccaugcccugaugaagau

SEQ ID NO: 213858 - RNA, 19 nt, Homo sapiens
ugcaacaucuccagucaca

SEQ ID NO: 213859 - RNA, 19 nt, Homo sapiens
cuuuauggcuagacaggaa

SEQ ID NO: 213860 - RNA, 19 nt, Homo sapiens
gcagaguggguuuaauucu

SEQ ID NO: 213861 - RNA, 19 nt, Homo sapiens
gaauuuagaguuguauugc

SEQ ID NO: 213862 - RNA, 19 nt, Homo sapiens
aaauagugacagagaguuu

SEQ ID NO: 213863 - RNA, 19 nt, Homo sapiens
cagagcagcaccaguguca

SEQ ID NO: 213864 - RNA, 19 nt, Homo sapiens
cagagugcuuacaaucuuc

SEQ ID NO: 213865 - RNA, 19 nt, Homo sapiens
ggagguagaaagaacugau

SEQ ID NO: 213866 - RNA, 19 nt, Homo sapiens
ccuccaugcuccacuuugu

SEQ ID NO: 213867 - RNA, 19 nt, Homo sapiens
ggaucaccauuauauuuug

SEQ ID NO: 213868 - RNA, 19 nt, Homo sapiens
ccuuuagccucaucaaugg

SEQ ID NO: 213869 - RNA, 19 nt, Homo sapiens
gagguagaaagaacugaug

SEQ ID NO: 213870 - RNA, 19 nt, Homo sapiens
agaccugcuccuccuaaua

SEQ ID NO: 213871 - RNA, 19 nt, Homo sapiens
gcuccugagugguguaggu

SEQ ID NO: 213872 - RNA, 19 nt, Homo sapiens
agcgguaugucuagauuga

SEQ ID NO: 213873 - RNA, 19 nt, Homo sapiens
ugagcaagaguuucaggaa

SEQ ID NO: 213874 - RNA, 19 nt, Homo sapiens
guuuacuacuacuucauug

SEQ ID NO: 213875 - RNA, 19 nt, Homo sapiens
gaugcagaguggguuuaau

SEQ ID NO: 213876 - RNA, 19 nt, Homo sapiens
aagaucuucuguacaguca

SEQ ID NO: 213877 - RNA, 19 nt, Homo sapiens
gaacuuggagguggaccau

SEQ ID NO: 213878 - RNA, 19 nt, Homo sapiens
ugucuagauugacccuuga

SEQ ID NO: 213879 - RNA, 19 nt, Homo sapiens
ucaauggaaacaucuguca

SEQ ID NO: 213880 - RNA, 19 nt, Homo sapiens
guaccgcuccuaccacuac

SEQ ID NO: 213881 - RNA, 19 nt, Homo sapiens
cauacccacacucuaauga

SEQ ID NO: 213882 - RNA, 19 nt, Homo sapiens
cagggagacucagacuaga

SEQ ID NO: 213883 - RNA, 19 nt, Homo sapiens
ugaugaagaucugccucaa

SEQ ID NO: 213884 - RNA, 19 nt, Homo sapiens
gaaggaguacaaccugcau

SEQ ID NO: 213885 - RNA, 19 nt, Homo sapiens
uugcacuggucaugugaaa

SEQ ID NO: 213886 - RNA, 19 nt, Homo sapiens
aaacugauccccuuuauac

SEQ ID NO: 213887 - RNA, 19 nt, Homo sapiens
uaugucaucccugcaguuu

SEQ ID NO: 213888 - RNA, 19 nt, Homo sapiens
ggaaguggaugaugucuuu

SEQ ID NO: 213889 - RNA, 19 nt, Homo sapiens
gauauacaguuccaguuua

SEQ ID NO: 213890 - RNA, 19 nt, Homo sapiens
gcaagaagcauuucauuug

SEQ ID NO: 213891 - RNA, 19 nt, Homo sapiens
ggauaaagcuguacuucug

SEQ ID NO: 213892 - RNA, 19 nt, Homo sapiens
ggugaugccuuaauugaaa

SEQ ID NO: 213893 - RNA, 19 nt, Homo sapiens
gaaagacauuguagacuuc

SEQ ID NO: 213894 - RNA, 19 nt, Homo sapiens
cgaaaucacuguacuguag

SEQ ID NO: 213895 - RNA, 19 nt, Homo sapiens
gaaauagaauugccuaagg

SEQ ID NO: 213896 - RNA, 19 nt, Homo sapiens
gaaaugaaagauccaguuu

SEQ ID NO: 213897 - RNA, 19 nt, Homo sapiens
ggagugaaacagugauuua

SEQ ID NO: 213898 - RNA, 19 nt, Homo sapiens
caaaauggcuggcuucaaa

SEQ ID NO: 213899 - RNA, 19 nt, Homo sapiens
gcagaaagccuuagagaag

SEQ ID NO: 213900 - RNA, 19 nt, Homo sapiens
gauaaacaaugaagaugug

SEQ ID NO: 213901 - RNA, 19 nt, Homo sapiens
gaccuaaggguguuuguua

SEQ ID NO: 213902 - RNA, 19 nt, Homo sapiens
gguggugccuaucuacuua

SEQ ID NO: 213903 - RNA, 19 nt, Homo sapiens
ggaagccuaugugcaauuu

SEQ ID NO: 213904 - RNA, 19 nt, Homo sapiens
gucaauaaaugaagacuug

SEQ ID NO: 213905 - RNA, 19 nt, Homo sapiens
gcacaucuuucuuggacuu

SEQ ID NO: 213906 - RNA, 19 nt, Homo sapiens
ggaagaaauugguaaucga

SEQ ID NO: 213907 - RNA, 19 nt, Homo sapiens
ggaaguauaugagauaaac

SEQ ID NO: 213908 - RNA, 19 nt, Homo sapiens
gcauucuagucuuaacuua

SEQ ID NO: 213909 - RNA, 19 nt, Homo sapiens
gguaugguuuggcagaaua

SEQ ID NO: 213910 - RNA, 19 nt, Homo sapiens
guauauaacugagccagaa

SEQ ID NO: 213911 - RNA, 19 nt, Homo sapiens
guacuguagucaauaaaug

SEQ ID NO: 213912 - RNA, 19 nt, Homo sapiens
aguaguacaucccauauuu

SEQ ID NO: 213913 - RNA, 19 nt, Homo sapiens
ggauauacaguuccaguuu

SEQ ID NO: 213914 - RNA, 19 nt, Homo sapiens
uaauaagggugaagcaaga

SEQ ID NO: 213915 - RNA, 19 nt, Homo sapiens
agaaagacauuguagacuu

SEQ ID NO: 213916 - RNA, 19 nt, Homo sapiens
ggaaugaaguucgaacaca

SEQ ID NO: 213917 - RNA, 19 nt, Homo sapiens
aaacagagaugggaaacga

SEQ ID NO: 213918 - RNA, 19 nt, Homo sapiens
gaaugaaguucgaacacau

SEQ ID NO: 213919 - RNA, 19 nt, Homo sapiens
gaaacacagggaagaaauu

SEQ ID NO: 213920 - RNA, 19 nt, Homo sapiens
cagcuaagaugcgaaauca

SEQ ID NO: 213921 - RNA, 19 nt, Homo sapiens
uaauugaaauggagucaga

SEQ ID NO: 213922 - RNA, 19 nt, Homo sapiens
uaacgguggugccuaucua

SEQ ID NO: 213923 - RNA, 19 nt, Homo sapiens
acacaugucgguucuuaua

SEQ ID NO: 213924 - RNA, 19 nt, Homo sapiens
guauaacgguggugccuau

SEQ ID NO: 213925 - RNA, 19 nt, Homo sapiens
ggacuugggauauacaguu

SEQ ID NO: 213926 - RNA, 19 nt, Homo sapiens
caucauagguauauugaac

SEQ ID NO: 213927 - RNA, 19 nt, Homo sapiens
cccaagacauuauaaacuu

SEQ ID NO: 213928 - RNA, 19 nt, Homo sapiens
uggaagaugugcuuaacuu

SEQ ID NO: 213929 - RNA, 19 nt, Homo sapiens
caucuuugauuaccagcua

SEQ ID NO: 213930 - RNA, 19 nt, Homo sapiens
uaaaccagcucuagauagg

SEQ ID NO: 213931 - RNA, 19 nt, Homo sapiens
gaagaagaaaugaaagauc

SEQ ID NO: 213932 - RNA, 19 nt, Homo sapiens
caagaagcauuucauuugc

SEQ ID NO: 213933 - RNA, 19 nt, Homo sapiens
aagcugaugugcacuuuga

SEQ ID NO: 213934 - RNA, 19 nt, Homo sapiens
ugaauugagugcucugaug

SEQ ID NO: 213935 - RNA, 19 nt, Homo sapiens
aaauagaauugccuaagga

SEQ ID NO: 213936 - RNA, 19 nt, Homo sapiens
gaagaaauugguaaucgau

SEQ ID NO: 213937 - RNA, 19 nt, Homo sapiens
ggaagaugugcuuaacuuu

SEQ ID NO: 213938 - RNA, 19 nt, Homo sapiens
ucacuguacuguagucaau

SEQ ID NO: 213939 - RNA, 19 nt, Homo sapiens
uaaccaaacauucaccaaa

SEQ ID NO: 213940 - RNA, 19 nt, Homo sapiens
uaccacagcuuaguguaaa

SEQ ID NO: 213941 - RNA, 19 nt, Homo sapiens
cauaguggacuguuuagaa

SEQ ID NO: 213942 - RNA, 19 nt, Homo sapiens
ggaauacauuuucuccuaa

SEQ ID NO: 213943 - RNA, 19 nt, Homo sapiens
aaugaaagauccaguuugg

SEQ ID NO: 213944 - RNA, 19 nt, Homo sapiens
gggaagaaauugguaaucg

SEQ ID NO: 213945 - RNA, 19 nt, Homo sapiens
gaaggccacuggagaagcu

SEQ ID NO: 213946 - RNA, 19 nt, Homo sapiens
gcaauuugaagaaccagaa

SEQ ID NO: 213947 - RNA, 19 nt, Homo sapiens
ccaaagcaaagaacgguuu

SEQ ID NO: 213948 - RNA, 19 nt, Homo sapiens
aagccuaugugcaauuuga

SEQ ID NO: 213949 - RNA, 19 nt, Homo sapiens
gagaugcaguucuaguucu

SEQ ID NO: 213950 - RNA, 19 nt, Homo sapiens
aauccuguaugcuuucuuu

SEQ ID NO: 213951 - RNA, 19 nt, Homo sapiens
gaagaugugcuuaacuuuu

SEQ ID NO: 213952 - RNA, 19 nt, Homo sapiens
ggaaauagaauugccuaag

SEQ ID NO: 213953 - RNA, 19 nt, Homo sapiens
ccuuauaguugcaaugaga

SEQ ID NO: 213954 - RNA, 19 nt, Homo sapiens
ggagaugcaguucuaguuc

SEQ ID NO: 213955 - RNA, 19 nt, Homo sapiens
ccuuugaacugguaugguu

SEQ ID NO: 213956 - RNA, 19 nt, Homo sapiens
ucagaccuuugaacuggua

SEQ ID NO: 213957 - RNA, 19 nt, Homo sapiens
gaauugagugcucugaugu

SEQ ID NO: 213958 - RNA, 19 nt, Homo sapiens
auucagcaguguucuuuaa

SEQ ID NO: 213959 - RNA, 19 nt, Homo sapiens
ccacguucaucauagguau

SEQ ID NO: 213960 - RNA, 19 nt, Homo sapiens
uaacugagccagaaauggu

SEQ ID NO: 213961 - RNA, 19 nt, Homo sapiens
cagaaggaaugaaguucga

SEQ ID NO: 213962 - RNA, 19 nt, Homo sapiens
gcuugcaggucaaaucuuc

SEQ ID NO: 213963 - RNA, 19 nt, Homo sapiens
ggucaugcacuauggaaga

SEQ ID NO: 213964 - RNA, 19 nt, Homo sapiens
aaagugagaaggaaauaga

SEQ ID NO: 213965 - RNA, 19 nt, Homo sapiens
agccagaaauggucuuuga

SEQ ID NO: 213966 - RNA, 19 nt, Homo sapiens
aagaggaaguggaugaugu

SEQ ID NO: 213967 - RNA, 19 nt, Homo sapiens
gagaagcaccgcauguaca

SEQ ID NO: 213968 - RNA, 19 nt, Homo sapiens
ucaaaauccuguaugcuuu

SEQ ID NO: 213969 - RNA, 19 nt, Homo sapiens
ugagaaggaaauagaauug

SEQ ID NO: 213970 - RNA, 19 nt, Homo sapiens
gaauuuaaaccagcucuag

SEQ ID NO: 213971 - RNA, 19 nt, Homo sapiens
ugagugcucugauguaaaa

SEQ ID NO: 213972 - RNA, 19 nt, Homo sapiens
ggugaagcaagaagcauuu

SEQ ID NO: 213973 - RNA, 19 nt, Homo sapiens
cuaaggaggugccagaaaa

SEQ ID NO: 213974 - RNA, 19 nt, Homo sapiens
gaaauugguaaucgauaca

SEQ ID NO: 213975 - RNA, 19 nt, Homo sapiens
guggaaguauaugagauaa

SEQ ID NO: 213976 - RNA, 19 nt, Homo sapiens
ggaguaguacaucccauau

SEQ ID NO: 213977 - RNA, 19 nt, Homo sapiens
gaagcaagaagcauuucau

SEQ ID NO: 213978 - RNA, 19 nt, Homo sapiens
acucaagccuguuagaauc

SEQ ID NO: 213979 - RNA, 19 nt, Homo sapiens
ggacuuccuuauaguugca

SEQ ID NO: 213980 - RNA, 19 nt, Homo sapiens
uagaagaggaaguggauga

SEQ ID NO: 213981 - RNA, 19 nt, Homo sapiens
gagauaaacaaugaagaug

SEQ ID NO: 213982 - RNA, 19 nt, Homo sapiens
caaaacuacuuaccuggaa

SEQ ID NO: 213983 - RNA, 19 nt, Homo sapiens
gacuaugucuucucuuacu

SEQ ID NO: 213984 - RNA, 19 nt, Homo sapiens
gugcaccuguguaggagaa

SEQ ID NO: 213985 - RNA, 19 nt, Homo sapiens
aaacauucaccaaagcaaa

SEQ ID NO: 213986 - RNA, 19 nt, Homo sapiens
gcauuucauuugcacaucu

SEQ ID NO: 213987 - RNA, 19 nt, Homo sapiens
gaagaggaaguggaugaug

SEQ ID NO: 213988 - RNA, 19 nt, Homo sapiens
guggaggucugguucaaga

SEQ ID NO: 213989 - RNA, 19 nt, Homo sapiens
ccaaauggcgacaccagaa

SEQ ID NO: 213990 - RNA, 19 nt, Homo sapiens
ccaguauccugacgugagu

SEQ ID NO: 213991 - RNA, 19 nt, Homo sapiens
gcguggaggucugguucaa

SEQ ID NO: 213992 - RNA, 19 nt, Homo sapiens
caaauggcgacaccagaag

SEQ ID NO: 213993 - RNA, 19 nt, Homo sapiens
ggacaaagguguucaaauc

SEQ ID NO: 213994 - RNA, 19 nt, Homo sapiens
gaacccagcugccuaacaa

SEQ ID NO: 213995 - RNA, 19 nt, Homo sapiens
gaacaaauccgagagauga

SEQ ID NO: 213996 - RNA, 19 nt, Homo sapiens
gcgcacagcuucuuugaug

SEQ ID NO: 213997 - RNA, 19 nt, Homo sapiens
guacagaccuccguucaau

SEQ ID NO: 213998 - RNA, 19 nt, Homo sapiens
gcucuagccugcuggagua

SEQ ID NO: 213999 - RNA, 19 nt, Homo sapiens
ggguguaaauagauuguua

SEQ ID NO: 214000 - RNA, 19 nt, Homo sapiens
uaaaucuggugcuggaaua

SEQ ID NO: 214001 - RNA, 19 nt, Homo sapiens
caaguucccucagauuaaa

SEQ ID NO: 214002 - RNA, 19 nt, Homo sapiens
gaacuagucgccaucaaga

SEQ ID NO: 214003 - RNA, 19 nt, Homo sapiens
gaccaucccuauccucuau

SEQ ID NO: 214004 - RNA, 19 nt, Homo sapiens
gaaggugaccacagucgua

SEQ ID NO: 214005 - RNA, 19 nt, Homo sapiens
gaccuccguucaauaaauu

SEQ ID NO: 214006 - RNA, 19 nt, Homo sapiens
ccagagcgcucccaagaag

SEQ ID NO: 214007 - RNA, 19 nt, Homo sapiens
ucacaagcuuuaacugaga

SEQ ID NO: 214008 - RNA, 19 nt, Homo sapiens
ucucaucccuccucacuug

SEQ ID NO: 214009 - RNA, 19 nt, Homo sapiens
gcacagcuucuuugaugaa

SEQ ID NO: 214010 - RNA, 19 nt, Homo sapiens
acagaccuccguucaauaa

SEQ ID NO: 214011 - RNA, 19 nt, Homo sapiens
ucaaguucccucagauuaa

SEQ ID NO: 214012 - RNA, 19 nt, Homo sapiens
ccacaccuacccucacuaa

SEQ ID NO: 214013 - RNA, 19 nt, Homo sapiens
gcgggaaggugaccacagu

SEQ ID NO: 214014 - RNA, 19 nt, Homo sapiens
gaguucaaguucccucaga

SEQ ID NO: 214015 - RNA, 19 nt, Homo sapiens
ggaacaaauccgagagaug

SEQ ID NO: 214016 - RNA, 19 nt, Homo sapiens
ccaagcacccuuccacuuc

SEQ ID NO: 214017 - RNA, 19 nt, Homo sapiens
agaccuccguucaauaaau

SEQ ID NO: 214018 - RNA, 19 nt, Homo sapiens
cuggaccacugcaauauug

SEQ ID NO: 214019 - RNA, 19 nt, Homo sapiens
gcagagaccagggaacuag

SEQ ID NO: 214020 - RNA, 19 nt, Homo sapiens
ccuccugugucccuuguaa

SEQ ID NO: 214021 - RNA, 19 nt, Homo sapiens
ggaacuagucgccaucaag

SEQ ID NO: 214022 - RNA, 19 nt, Homo sapiens
ccucacaagcuuuaacuga

SEQ ID NO: 214023 - RNA, 19 nt, Homo sapiens
ggccauagcccaucaagcu

SEQ ID NO: 214024 - RNA, 19 nt, Homo sapiens
gggaacaaauccgagagau

SEQ ID NO: 214025 - RNA, 19 nt, Homo sapiens
acaaagguguucaaaucuc

SEQ ID NO: 214026 - RNA, 19 nt, Homo sapiens
caucuguucucgcuacuac

SEQ ID NO: 214027 - RNA, 19 nt, Homo sapiens
gaaccgagagcugcagauc

SEQ ID NO: 214028 - RNA, 19 nt, Homo sapiens
caguaagguuugccugugu

SEQ ID NO: 214029 - RNA, 19 nt, Homo sapiens
cagcuucuuugaugaacug

SEQ ID NO: 214030 - RNA, 19 nt, Homo sapiens
ccuaacaaccgcccacuuc

SEQ ID NO: 214031 - RNA, 19 nt, Homo sapiens
gacaaagguguucaaaucu

SEQ ID NO: 214032 - RNA, 19 nt, Homo sapiens
aagcuggaccacugcaaua

SEQ ID NO: 214033 - RNA, 19 nt, Homo sapiens
aguaagguuugccugugua

SEQ ID NO: 214034 - RNA, 19 nt, Homo sapiens
guucaaguucccucagauu

SEQ ID NO: 214035 - RNA, 19 nt, Homo sapiens
ccaaguugaccaucccuau

SEQ ID NO: 214036 - RNA, 19 nt, Homo sapiens
gcuggaccacugcaauauu

SEQ ID NO: 214037 - RNA, 19 nt, Homo sapiens
caccuacccucacuaacuc

SEQ ID NO: 214038 - RNA, 19 nt, Homo sapiens
gaacaccaacccgggaaca

SEQ ID NO: 214039 - RNA, 19 nt, Homo sapiens
gaccacugcaauauuguga

SEQ ID NO: 214040 - RNA, 19 nt, Homo sapiens
gggaacuagucgccaucaa

SEQ ID NO: 214041 - RNA, 19 nt, Homo sapiens
uucaaguucccucagauua

SEQ ID NO: 214042 - RNA, 19 nt, Homo sapiens
cugugucccuuguaaauag

SEQ ID NO: 214043 - RNA, 19 nt, Homo sapiens
cuagagggcagagguaaau

SEQ ID NO: 214044 - RNA, 19 nt, Homo sapiens
cuacacggaguucaaguuc

SEQ ID NO: 214045 - RNA, 19 nt, Homo sapiens
acaccaacccgggaacaaa

SEQ ID NO: 214046 - RNA, 19 nt, Homo sapiens
ggaccacugcaauauugug

SEQ ID NO: 214047 - RNA, 19 nt, Homo sapiens
gacuagagggcagagguaa

SEQ ID NO: 214048 - RNA, 19 nt, Homo sapiens
agacuagagggcagaggua

SEQ ID NO: 214049 - RNA, 19 nt, Homo sapiens
ggaacccagcugccuaaca

SEQ ID NO: 214050 - RNA, 19 nt, Homo sapiens
ccacagucguagccacucu

SEQ ID NO: 214051 - RNA, 19 nt, Homo sapiens
accgagagcugcagaucau

SEQ ID NO: 214052 - RNA, 19 nt, Homo sapiens
caaguugaccaucccuauc

SEQ ID NO: 214053 - RNA, 19 nt, Homo sapiens
ccaguggcgagaagaaaga

SEQ ID NO: 214054 - RNA, 19 nt, Homo sapiens
ucucaacgccauucucauc

SEQ ID NO: 214055 - RNA, 19 nt, Homo sapiens
ccugugucccuuguaaaua

SEQ ID NO: 214056 - RNA, 19 nt, Homo sapiens
acaccuacccucacuaacu

SEQ ID NO: 214057 - RNA, 19 nt, Homo sapiens
ccaucgcgcucugcucuag

SEQ ID NO: 214058 - RNA, 19 nt, Homo sapiens
ugguggagaucaucaaggu

SEQ ID NO: 214059 - RNA, 19 nt, Homo sapiens
ccacugauuacaccucauc

SEQ ID NO: 214060 - RNA, 19 nt, Homo sapiens
uccucaagcucugcgauuu

SEQ ID NO: 214061 - RNA, 19 nt, Homo sapiens
uacagaccuccguucaaua

SEQ ID NO: 214062 - RNA, 19 nt, Homo sapiens
agagggcagagguaaauga

SEQ ID NO: 214063 - RNA, 19 nt, Homo sapiens
ucaaggcucuccccacuag

SEQ ID NO: 214064 - RNA, 19 nt, Homo sapiens
caccaacccgggaacaaau

SEQ ID NO: 214065 - RNA, 19 nt, Homo sapiens
ucuuuggagccacugauua

SEQ ID NO: 214066 - RNA, 19 nt, Homo sapiens
acacugcuguccucaagcu

SEQ ID NO: 214067 - RNA, 19 nt, Homo sapiens
ccaucccuauccucuaugu

SEQ ID NO: 214068 - RNA, 19 nt, Homo sapiens
ggaauaugugcccgagaca

SEQ ID NO: 214069 - RNA, 19 nt, Homo sapiens
cgagaagaaagacgagcuu

SEQ ID NO: 214070 - RNA, 19 nt, Homo sapiens
ccccagagcucaucuuugg

SEQ ID NO: 214071 - RNA, 19 nt, Homo sapiens
gcucccaagaaguggcuua

SEQ ID NO: 214072 - RNA, 19 nt, Homo sapiens
gaagaaagaugaggucuau

SEQ ID NO: 214073 - RNA, 19 nt, Homo sapiens
gaagucagcuauacagaca

SEQ ID NO: 214074 - RNA, 19 nt, Homo sapiens
ggacccaaaugucaaacua

SEQ ID NO: 214075 - RNA, 19 nt, Homo sapiens
gaaaugaacccaaacuaca

SEQ ID NO: 214076 - RNA, 19 nt, Homo sapiens
gaaacaguauacagaguug

SEQ ID NO: 214077 - RNA, 19 nt, Homo sapiens
caagaacugucaaguaauc

SEQ ID NO: 214078 - RNA, 19 nt, Homo sapiens
gagcaaaucagagaaauga

SEQ ID NO: 214079 - RNA, 19 nt, Homo sapiens
gaugaggucuaucuuaauc

SEQ ID NO: 214080 - RNA, 19 nt, Homo sapiens
ggagaaauauaucgcuugu

SEQ ID NO: 214081 - RNA, 19 nt, Homo sapiens
cucaagaacugucaaguaa

SEQ ID NO: 214082 - RNA, 19 nt, Homo sapiens
ucagagaaaugaacccaaa

SEQ ID NO: 214083 - RNA, 19 nt, Homo sapiens
gcauuuaucguuaaccuaa

SEQ ID NO: 214084 - RNA, 19 nt, Homo sapiens
cagcaacacuggucacguu

SEQ ID NO: 214085 - RNA, 19 nt, Homo sapiens
gcaccagaguugaucuuug

SEQ ID NO: 214086 - RNA, 19 nt, Homo sapiens
gaacuggucgccaucaaga

SEQ ID NO: 214087 - RNA, 19 nt, Homo sapiens
agacacaccugcacucuuc

SEQ ID NO: 214088 - RNA, 19 nt, Homo sapiens
cuagaucacuguaacauag

SEQ ID NO: 214089 - RNA, 19 nt, Homo sapiens
gcagcaaggugacaacagu

SEQ ID NO: 214090 - RNA, 19 nt, Homo sapiens
ggaaacaguauacagaguu

SEQ ID NO: 214091 - RNA, 19 nt, Homo sapiens
caacuucaccacucaagaa

SEQ ID NO: 214092 - RNA, 19 nt, Homo sapiens
gaggagaacccaauguuuc

SEQ ID NO: 214093 - RNA, 19 nt, Homo sapiens
uaucagcuguuccgaaguu

SEQ ID NO: 214094 - RNA, 19 nt, Homo sapiens
ggacaagagauuuaagaau

SEQ ID NO: 214095 - RNA, 19 nt, Homo sapiens
gaacccaaacuacacagaa

SEQ ID NO: 214096 - RNA, 19 nt, Homo sapiens
gagaaaugaacccaaacua

SEQ ID NO: 214097 - RNA, 19 nt, Homo sapiens
gaagagagugaucauguca

SEQ ID NO: 214098 - RNA, 19 nt, Homo sapiens
uguguuggcugagcuguua

SEQ ID NO: 214099 - RNA, 19 nt, Homo sapiens
gcaugaaaguuagcagaga

SEQ ID NO: 214100 - RNA, 19 nt, Homo sapiens
uaaagugauuggaaaugga

SEQ ID NO: 214101 - RNA, 19 nt, Homo sapiens
ccacaagaagucagcuaua

SEQ ID NO: 214102 - RNA, 19 nt, Homo sapiens
gcgaagagagugaucaugu

SEQ ID NO: 214103 - RNA, 19 nt, Homo sapiens
caagggagcaaaucagaga

SEQ ID NO: 214104 - RNA, 19 nt, Homo sapiens
gaacccaauguuucguaua

SEQ ID NO: 214105 - RNA, 19 nt, Homo sapiens
gaaagcuagaucacuguaa

SEQ ID NO: 214106 - RNA, 19 nt, Homo sapiens
guagccgucugcuggagua

SEQ ID NO: 214107 - RNA, 19 nt, Homo sapiens
ggaggcaauugcacugugu

SEQ ID NO: 214108 - RNA, 19 nt, Homo sapiens
ggaaucugccaucgggaua

SEQ ID NO: 214109 - RNA, 19 nt, Homo sapiens
ggaagcuugugcacauuca

SEQ ID NO: 214110 - RNA, 19 nt, Homo sapiens
caacacuggucacguuugg

SEQ ID NO: 214111 - RNA, 19 nt, Homo sapiens
caccugcacucuucaacuu

SEQ ID NO: 214112 - RNA, 19 nt, Homo sapiens
guuacuaggacaaccaaua

SEQ ID NO: 214113 - RNA, 19 nt, Homo sapiens
gagaacuggucgccaucaa

SEQ ID NO: 214114 - RNA, 19 nt, Homo sapiens
gaucauuuggugugguaua

SEQ ID NO: 214115 - RNA, 19 nt, Homo sapiens
gaccguggacagaccaaua

SEQ ID NO: 214116 - RNA, 19 nt, Homo sapiens
gaucaguugguagaaauaa

SEQ ID NO: 214117 - RNA, 19 nt, Homo sapiens
gagaacccaauguuucgua

SEQ ID NO: 214118 - RNA, 19 nt, Homo sapiens
gcuagaucacuguaacaua

SEQ ID NO: 214119 - RNA, 19 nt, Homo sapiens
guauaucaagccaaacuuu

SEQ ID NO: 214120 - RNA, 19 nt, Homo sapiens
gaucugucuugaaggagaa

SEQ ID NO: 214121 - RNA, 19 nt, Homo sapiens
caccagaguugaucuuugg

SEQ ID NO: 214122 - RNA, 19 nt, Homo sapiens
gcccagaaccaccuccuuu

SEQ ID NO: 214123 - RNA, 19 nt, Homo sapiens
ccaaacuacacagaauuua

SEQ ID NO: 214124 - RNA, 19 nt, Homo sapiens
cgagagcuccagaucauga

SEQ ID NO: 214125 - RNA, 19 nt, Homo sapiens
cgaggagaacccaauguuu

SEQ ID NO: 214126 - RNA, 19 nt, Homo sapiens
guuccgaaguuuagccuau

SEQ ID NO: 214127 - RNA, 19 nt, Homo sapiens
guauauguaucagcuguuc

SEQ ID NO: 214128 - RNA, 19 nt, Homo sapiens
cgaagagagugaucauguc

SEQ ID NO: 214129 - RNA, 19 nt, Homo sapiens
ggucacguuuggaaagaau

SEQ ID NO: 214130 - RNA, 19 nt, Homo sapiens
gccgaucugucuugaagga

SEQ ID NO: 214131 - RNA, 19 nt, Homo sapiens
aacccaauguuucguauau

SEQ ID NO: 214132 - RNA, 19 nt, Homo sapiens
ccgauugcguuauuucuuc

SEQ ID NO: 214133 - RNA, 19 nt, Homo sapiens
gcaaaucagagaaaugaac

SEQ ID NO: 214134 - RNA, 19 nt, Homo sapiens
cgcagaaccucuuguugga

SEQ ID NO: 214135 - RNA, 19 nt, Homo sapiens
gugccgaucugucuugaag

SEQ ID NO: 214136 - RNA, 19 nt, Homo sapiens
ugugguauaucaagccaaa

SEQ ID NO: 214137 - RNA, 19 nt, Homo sapiens
gaauuacgggacccaaaug

SEQ ID NO: 214138 - RNA, 19 nt, Homo sapiens
cauuuggugugguauauca

SEQ ID NO: 214139 - RNA, 19 nt, Homo sapiens
cuaaagugauuggaaaugg

SEQ ID NO: 214140 - RNA, 19 nt, Homo sapiens
cacaagaagucagcuauac

SEQ ID NO: 214141 - RNA, 19 nt, Homo sapiens
gggagcaaaucagagaaau

SEQ ID NO: 214142 - RNA, 19 nt, Homo sapiens
guggaucaguugguagaaa

SEQ ID NO: 214143 - RNA, 19 nt, Homo sapiens
uagccuauauccauuccuu

SEQ ID NO: 214144 - RNA, 19 nt, Homo sapiens
acucaagaacugucaagua

SEQ ID NO: 214145 - RNA, 19 nt, Homo sapiens
ccaaaugucaaacuaccaa

SEQ ID NO: 214146 - RNA, 19 nt, Homo sapiens
gcagcagccuucagcuuuu

SEQ ID NO: 214147 - RNA, 19 nt, Homo sapiens
ggaucaguugguagaaaua

SEQ ID NO: 214148 - RNA, 19 nt, Homo sapiens
uuacuaggacaaccaauau

SEQ ID NO: 214149 - RNA, 19 nt, Homo sapiens
agacgcucccugugauuua

SEQ ID NO: 214150 - RNA, 19 nt, Homo sapiens
guggugagaagaaagauga

SEQ ID NO: 214151 - RNA, 19 nt, Homo sapiens
uggaucauuugguguggua

SEQ ID NO: 214152 - RNA, 19 nt, Homo sapiens
acuaggacaaccaauauuu

SEQ ID NO: 214153 - RNA, 19 nt, Homo sapiens
ugugauuuaugucaaguug

SEQ ID NO: 214154 - RNA, 19 nt, Homo sapiens
acacuauagucgagccaaa

SEQ ID NO: 214155 - RNA, 19 nt, Homo sapiens
ggagcaaaucagagaaaug

SEQ ID NO: 214156 - RNA, 19 nt, Homo sapiens
auaguccgauugcguuauu

SEQ ID NO: 214157 - RNA, 19 nt, Homo sapiens
aaagcuagaucacuguaac

SEQ ID NO: 214158 - RNA, 19 nt, Homo sapiens
uuuggcagcaugaaaguua

SEQ ID NO: 214159 - RNA, 19 nt, Homo sapiens
ccaacaagggagcaaauca

SEQ ID NO: 214160 - RNA, 19 nt, Homo sapiens
uggaucaguugguagaaau

SEQ ID NO: 214161 - RNA, 19 nt, Homo sapiens
uaucuguucucgguacuau

SEQ ID NO: 214162 - RNA, 19 nt, Homo sapiens
ugaggucuaucuuaaucug

SEQ ID NO: 214163 - RNA, 19 nt, Homo sapiens
gaaucgagagcuccagauc

SEQ ID NO: 214164 - RNA, 19 nt, Homo sapiens
caagaagucagcuauacag

SEQ ID NO: 214165 - RNA, 19 nt, Homo sapiens
cccaaacuacacagaauuu

SEQ ID NO: 214166 - RNA, 19 nt, Homo sapiens
gacgcucccugugauuuau

SEQ ID NO: 214167 - RNA, 19 nt, Homo sapiens
uuaaucuggugcuggacua

SEQ ID NO: 214168 - RNA, 19 nt, Homo sapiens
gagaaagcuagaucacugu

SEQ ID NO: 214169 - RNA, 19 nt, Homo sapiens
gaaaguauugcaggacaag

SEQ ID NO: 214170 - RNA, 19 nt, Homo sapiens
ucagcuauacagacacuaa

SEQ ID NO: 214171 - RNA, 19 nt, Homo sapiens
gcaacacuggucacguuug

SEQ ID NO: 214172 - RNA, 19 nt, Homo sapiens
gaacuguccuucccucaaa

SEQ ID NO: 214173 - RNA, 19 nt, Homo sapiens
gaacggaaaucugcaguau

SEQ ID NO: 214174 - RNA, 19 nt, Homo sapiens
gaaaggagguguggcauca

SEQ ID NO: 214175 - RNA, 19 nt, Homo sapiens
aaacagaucuggagaaucg

SEQ ID NO: 214176 - RNA, 19 nt, Homo sapiens
ggaagcccaugaucaucua

SEQ ID NO: 214177 - RNA, 19 nt, Homo sapiens
acggaaaucugcaguauga

SEQ ID NO: 214178 - RNA, 19 nt, Homo sapiens
caacagcaaucgguaugaa

SEQ ID NO: 214179 - RNA, 19 nt, Homo sapiens
ugggagagcuucaacaaug

SEQ ID NO: 214180 - RNA, 19 nt, Homo sapiens
gaaaaucuuugucuggaaa

SEQ ID NO: 214181 - RNA, 19 nt, Homo sapiens
gaacuccaacgaugccuuu

SEQ ID NO: 214182 - RNA, 19 nt, Homo sapiens
gcacaggccagaaacagau

SEQ ID NO: 214183 - RNA, 19 nt, Homo sapiens
ggaaaggcaagcaggcaaa

SEQ ID NO: 214184 - RNA, 19 nt, Homo sapiens
agaaacagaucuggagaau

SEQ ID NO: 214185 - RNA, 19 nt, Homo sapiens
gucaguguuugggaaauua

SEQ ID NO: 214186 - RNA, 19 nt, Homo sapiens
caacaagauuggacguuuu

SEQ ID NO: 214187 - RNA, 19 nt, Homo sapiens
gaaggcagcgagccagaug

SEQ ID NO: 214188 - RNA, 19 nt, Homo sapiens
aaucgaagguuccaacaag

SEQ ID NO: 214189 - RNA, 19 nt, Homo sapiens
caaccuuuauggagacuuc

SEQ ID NO: 214190 - RNA, 19 nt, Homo sapiens
ggaacggaaaucugcagua

SEQ ID NO: 214191 - RNA, 19 nt, Homo sapiens
ccacauauggacaguucua

SEQ ID NO: 214192 - RNA, 19 nt, Homo sapiens
caaaacagccucugacuuc

SEQ ID NO: 214193 - RNA, 19 nt, Homo sapiens
caacgaugccuuuguucug

SEQ ID NO: 214194 - RNA, 19 nt, Homo sapiens
ucaagucuggccugaagua

SEQ ID NO: 214195 - RNA, 19 nt, Homo sapiens
uggccaagcucuacaaggu

SEQ ID NO: 214196 - RNA, 19 nt, Homo sapiens
gggagagcuucaacaaugg

SEQ ID NO: 214197 - RNA, 19 nt, Homo sapiens
ccgugcagcuggaugacua

SEQ ID NO: 214198 - RNA, 19 nt, Homo sapiens
ugacugcucagcuggauga

SEQ ID NO: 214199 - RNA, 19 nt, Homo sapiens
gaaucgaagguuccaacaa

SEQ ID NO: 214200 - RNA, 19 nt, Homo sapiens
ucuacaaggucuccaaugg

SEQ ID NO: 214201 - RNA, 19 nt, Homo sapiens
ucagaguccuugcaaaauu

SEQ ID NO: 214202 - RNA, 19 nt, Homo sapiens
agucuggccugaaguacaa

SEQ ID NO: 214203 - RNA, 19 nt, Homo sapiens
ggaaaaucuuugucuggaa

SEQ ID NO: 214204 - RNA, 19 nt, Homo sapiens
ccucguggcugaugagaac

SEQ ID NO: 214205 - RNA, 19 nt, Homo sapiens
gcuaugagugugugugugu

SEQ ID NO: 214206 - RNA, 19 nt, Homo sapiens
gcuuugagccucccuccuu

SEQ ID NO: 214207 - RNA, 19 nt, Homo sapiens
cuccaacgaugccuuuguu

SEQ ID NO: 214208 - RNA, 19 nt, Homo sapiens
gaugaggagcugggaggua

SEQ ID NO: 214209 - RNA, 19 nt, Homo sapiens
acaucauucuguacaacua

SEQ ID NO: 214210 - RNA, 19 nt, Homo sapiens
ccucugacuucaucaccaa

SEQ ID NO: 214211 - RNA, 19 nt, Homo sapiens
caaacacggaggagaggaa

SEQ ID NO: 214212 - RNA, 19 nt, Homo sapiens
ggccugaaguacaagaaag

SEQ ID NO: 214213 - RNA, 19 nt, Homo sapiens
guugagguauugccuaagg

SEQ ID NO: 214214 - RNA, 19 nt, Homo sapiens
acuacuggcugggcaauga

SEQ ID NO: 214215 - RNA, 19 nt, Homo sapiens
ugucaguguuugggaaauu

SEQ ID NO: 214216 - RNA, 19 nt, Homo sapiens
aacgaugccuuuguucuga

SEQ ID NO: 214217 - RNA, 19 nt, Homo sapiens
gaucuggcguguggagaag

SEQ ID NO: 214218 - RNA, 19 nt, Homo sapiens
gagccuggccugcagaucu

SEQ ID NO: 214219 - RNA, 19 nt, Homo sapiens
uggcugggaugaugauuac

SEQ ID NO: 214220 - RNA, 19 nt, Homo sapiens
cgaugccuuuguucugaaa

SEQ ID NO: 214221 - RNA, 19 nt, Homo sapiens
cuguugagguauugccuaa

SEQ ID NO: 214222 - RNA, 19 nt, Homo sapiens
gggaagcccaugaucaucu

SEQ ID NO: 214223 - RNA, 19 nt, Homo sapiens
guacaacuaccgccauggu

SEQ ID NO: 214224 - RNA, 19 nt, Homo sapiens
agacagugcagcugaggaa

SEQ ID NO: 214225 - RNA, 19 nt, Homo sapiens
ugccacauauggacaguuc

SEQ ID NO: 214226 - RNA, 19 nt, Homo sapiens
ugaaggacaagaagaugga

SEQ ID NO: 214227 - RNA, 19 nt, Homo sapiens
gcaguaugaccuccacuac

SEQ ID NO: 214228 - RNA, 19 nt, Homo sapiens
ggaccugggcaacaacauc

SEQ ID NO: 214229 - RNA, 19 nt, Homo sapiens
ccagagccgugugguccaa

SEQ ID NO: 214230 - RNA, 19 nt, Homo sapiens
ggacaccgccaaggaggau

SEQ ID NO: 214231 - RNA, 19 nt, Homo sapiens
ccaagggcauccgggacaa

SEQ ID NO: 214232 - RNA, 19 nt, Homo sapiens
guguguguguguguuguuu

SEQ ID NO: 214233 - RNA, 19 nt, Homo sapiens
ccacggcaaagaugggaaa

SEQ ID NO: 214234 - RNA, 19 nt, Homo sapiens
caauggcgacugcuucauc

SEQ ID NO: 214235 - RNA, 19 nt, Homo sapiens
gguguggcaucaggauuca

SEQ ID NO: 214236 - RNA, 19 nt, Homo sapiens
cagcaaucgguaugaaaga

SEQ ID NO: 214237 - RNA, 19 nt, Homo sapiens
ccauccuccucgccucuuu

SEQ ID NO: 214238 - RNA, 19 nt, Homo sapiens
cgagucggccaccuuccua

SEQ ID NO: 214239 - RNA, 19 nt, Homo sapiens
cagaguccuugcaaaauug

SEQ ID NO: 214240 - RNA, 19 nt, Homo sapiens
gaaacagaucuggagaauc

SEQ ID NO: 214241 - RNA, 19 nt, Homo sapiens
ugucuggguuggaaaggau

SEQ ID NO: 214242 - RNA, 19 nt, Homo sapiens
cuggugcacugaacuccaa

SEQ ID NO: 214243 - RNA, 19 nt, Homo sapiens
ggacccagaccagacagau

SEQ ID NO: 214244 - RNA, 19 nt, Homo sapiens
cauccuggaccacggcaaa

SEQ ID NO: 214245 - RNA, 19 nt, Homo sapiens
caacagcauggugguggaa

SEQ ID NO: 214246 - RNA, 19 nt, Homo sapiens
gcugggaugaugauuacug

SEQ ID NO: 214247 - RNA, 19 nt, Homo sapiens
gaaaagacagaagccuuga

SEQ ID NO: 214248 - RNA, 19 nt, Homo sapiens
cagauggccugggcuuguc

SEQ ID NO: 214249 - RNA, 19 nt, Homo sapiens
cggcaaagaugggaaaauc

SEQ ID NO: 214250 - RNA, 19 nt, Homo sapiens
ggagguguggcaucaggau

SEQ ID NO: 214251 - RNA, 19 nt, Homo sapiens
gaaagagcauguaaaugua

SEQ ID NO: 214252 - RNA, 19 nt, Homo sapiens
gaaacaagaucaaguaugc

SEQ ID NO: 214253 - RNA, 19 nt, Homo sapiens
gcaacuaccauguuaauaa

SEQ ID NO: 214254 - RNA, 19 nt, Homo sapiens
gaaucaggaucuauuugua

SEQ ID NO: 214255 - RNA, 19 nt, Homo sapiens
gcauguaaauguaguauuc

SEQ ID NO: 214256 - RNA, 19 nt, Homo sapiens
ggaaauaacagccuuaauc

SEQ ID NO: 214257 - RNA, 19 nt, Homo sapiens
gcaauagcuuuguaaguga

SEQ ID NO: 214258 - RNA, 19 nt, Homo sapiens
gaaaggaauugaagaagag

SEQ ID NO: 214259 - RNA, 19 nt, Homo sapiens
ucaaagagcagucggauuu

SEQ ID NO: 214260 - RNA, 19 nt, Homo sapiens
guacuugucuugggccuua

SEQ ID NO: 214261 - RNA, 19 nt, Homo sapiens
gcacaaagaagaaauaagu

SEQ ID NO: 214262 - RNA, 19 nt, Homo sapiens
agaaaugucuccagaagaa

SEQ ID NO: 214263 - RNA, 19 nt, Homo sapiens
aaaggcaacuaccauguua

SEQ ID NO: 214264 - RNA, 19 nt, Homo sapiens
ggaaagugcccaugaaaug

SEQ ID NO: 214265 - RNA, 19 nt, Homo sapiens
ugagagauaugaagaaugu

SEQ ID NO: 214266 - RNA, 19 nt, Homo sapiens
ggcaauagcuuuguaagug

SEQ ID NO: 214267 - RNA, 19 nt, Homo sapiens
ggaaccaucugccuugaga

SEQ ID NO: 214268 - RNA, 19 nt, Homo sapiens
aagagaagcuaaagagaaa

SEQ ID NO: 214269 - RNA, 19 nt, Homo sapiens
gaacagucauugugugaag

SEQ ID NO: 214270 - RNA, 19 nt, Homo sapiens
ugaaaggaauugaagaaga

SEQ ID NO: 214271 - RNA, 19 nt, Homo sapiens
agagaaagacuaagcauuu

SEQ ID NO: 214272 - RNA, 19 nt, Homo sapiens
gaaauaacagccuuaaucu

SEQ ID NO: 214273 - RNA, 19 nt, Homo sapiens
agaaagagcauguaaaugu

SEQ ID NO: 214274 - RNA, 19 nt, Homo sapiens
uacauuggauuaccguuua

SEQ ID NO: 214275 - RNA, 19 nt, Homo sapiens
gaaagugcccaugaaauga

SEQ ID NO: 214276 - RNA, 19 nt, Homo sapiens
gcacugugguccugggaaa

SEQ ID NO: 214277 - RNA, 19 nt, Homo sapiens
cagagaaacuugguacuug

SEQ ID NO: 214278 - RNA, 19 nt, Homo sapiens
gcaaagacagcagguguaa

SEQ ID NO: 214279 - RNA, 19 nt, Homo sapiens
gauuaccguuuauuccaua

SEQ ID NO: 214280 - RNA, 19 nt, Homo sapiens
gagcacaaauccaucaucu

SEQ ID NO: 214281 - RNA, 19 nt, Homo sapiens
cguggaaguucuuggaaua

SEQ ID NO: 214282 - RNA, 19 nt, Homo sapiens
gcaaugagagauaugaaga

SEQ ID NO: 214283 - RNA, 19 nt, Homo sapiens
gaugggucguuucaccuua

SEQ ID NO: 214284 - RNA, 19 nt, Homo sapiens
guggauaaguacaaggaua

SEQ ID NO: 214285 - RNA, 19 nt, Homo sapiens
gaaagagaagcuaaagaga

SEQ ID NO: 214286 - RNA, 19 nt, Homo sapiens
guauuugacuggaaugguu

SEQ ID NO: 214287 - RNA, 19 nt, Homo sapiens
ggagauucuuccaggguuu

SEQ ID NO: 214288 - RNA, 19 nt, Homo sapiens
ggacagauuuggcaauagc

SEQ ID NO: 214289 - RNA, 19 nt, Homo sapiens
gguaagaccauugcaauug

SEQ ID NO: 214290 - RNA, 19 nt, Homo sapiens
aaaggacgcuugaaaagua

SEQ ID NO: 214291 - RNA, 19 nt, Homo sapiens
gccaggugcuccuaagaaa

SEQ ID NO: 214292 - RNA, 19 nt, Homo sapiens
ggaaucaggaucuauuugu

SEQ ID NO: 214293 - RNA, 19 nt, Homo sapiens
ggagcacaaagaagaaaua

SEQ ID NO: 214294 - RNA, 19 nt, Homo sapiens
cuaugccacuguugaauuu

SEQ ID NO: 214295 - RNA, 19 nt, Homo sapiens
guaagaccauugcaauugg

SEQ ID NO: 214296 - RNA, 19 nt, Homo sapiens
cacauuugaugcccagaua

SEQ ID NO: 214297 - RNA, 19 nt, Homo sapiens
gacaagagaacaugcaaug

SEQ ID NO: 214298 - RNA, 19 nt, Homo sapiens
aaagagaagcuaaagagaa

SEQ ID NO: 214299 - RNA, 19 nt, Homo sapiens
ugaagaauguaaggagaaa

SEQ ID NO: 214300 - RNA, 19 nt, Homo sapiens
gaggaaagugcccaugaaa

SEQ ID NO: 214301 - RNA, 19 nt, Homo sapiens
caagaucaaguaugcauug

SEQ ID NO: 214302 - RNA, 19 nt, Homo sapiens
guacauuggauuaccguuu

SEQ ID NO: 214303 - RNA, 19 nt, Homo sapiens
agacacaaaucaggaagaa

SEQ ID NO: 214304 - RNA, 19 nt, Homo sapiens
ugucagcuuucucauauug

SEQ ID NO: 214305 - RNA, 19 nt, Homo sapiens
gccagcagcuugugaugau

SEQ ID NO: 214306 - RNA, 19 nt, Homo sapiens
gcuguuagcauggaacuuu

SEQ ID NO: 214307 - RNA, 19 nt, Homo sapiens
gcuggcaagucaaccauug

SEQ ID NO: 214308 - RNA, 19 nt, Homo sapiens
gaacuuucagaaccuauug

SEQ ID NO: 214309 - RNA, 19 nt, Homo sapiens
ugauuuggcugugcuggua

SEQ ID NO: 214310 - RNA, 19 nt, Homo sapiens
gaaacuugguacuugucuu

SEQ ID NO: 214311 - RNA, 19 nt, Homo sapiens
caaaggcaacuaccauguu

SEQ ID NO: 214312 - RNA, 19 nt, Homo sapiens
gagaaagacuaagcauuuu

SEQ ID NO: 214313 - RNA, 19 nt, Homo sapiens
gaugauguagagacugaua

SEQ ID NO: 214314 - RNA, 19 nt, Homo sapiens
ggacagacaagagaacaug

SEQ ID NO: 214315 - RNA, 19 nt, Homo sapiens
aagaagcauuucacaauuc

SEQ ID NO: 214316 - RNA, 19 nt, Homo sapiens
gagcacaaagaagaaauaa

SEQ ID NO: 214317 - RNA, 19 nt, Homo sapiens
acaccgccuucucuuauuu

SEQ ID NO: 214318 - RNA, 19 nt, Homo sapiens
uuuaaagacuucccucaga

SEQ ID NO: 214319 - RNA, 19 nt, Homo sapiens
ccgaugauguagagacuga

SEQ ID NO: 214320 - RNA, 19 nt, Homo sapiens
ggagaaacuagugccauuu

SEQ ID NO: 214321 - RNA, 19 nt, Homo sapiens
agaagugggucgugccuau

SEQ ID NO: 214322 - RNA, 19 nt, Homo sapiens
ugacuggaaugguugacaa

SEQ ID NO: 214323 - RNA, 19 nt, Homo sapiens
ggaccaggcggacauggaa

SEQ ID NO: 214324 - RNA, 19 nt, Homo sapiens
acagaaaugucuccagaag

SEQ ID NO: 214325 - RNA, 19 nt, Homo sapiens
uaacagccuuaaucugcuu

SEQ ID NO: 214326 - RNA, 19 nt, Homo sapiens
cuuccaggguuuauacuuu

SEQ ID NO: 214327 - RNA, 19 nt, Homo sapiens
gguaaucucagccaggaaa

SEQ ID NO: 214328 - RNA, 19 nt, Homo sapiens
agaggaaagugcccaugaa

SEQ ID NO: 214329 - RNA, 19 nt, Homo sapiens
ccagaucauucgugagugu

SEQ ID NO: 214330 - RNA, 19 nt, Homo sapiens
ugauaaaccucuccccaua

SEQ ID NO: 214331 - RNA, 19 nt, Homo sapiens
ucacaccgccuucucuuau

SEQ ID NO: 214332 - RNA, 19 nt, Homo sapiens
gcacaacguggaaguucuu

SEQ ID NO: 214333 - RNA, 19 nt, Homo sapiens
ugaaagagaagcuaaagag

SEQ ID NO: 214334 - RNA, 19 nt, Homo sapiens
gcuaugccacuguugaauu

SEQ ID NO: 214335 - RNA, 19 nt, Homo sapiens
gcucugcuaugccacuguu

SEQ ID NO: 214336 - RNA, 19 nt, Homo sapiens
agaggaaauucacagcaaa

SEQ ID NO: 214337 - RNA, 19 nt, Homo sapiens
aagaggaaauucacagcaa

SEQ ID NO: 214338 - RNA, 19 nt, Homo sapiens
uuaaagacuucccucagau

SEQ ID NO: 214339 - RNA, 19 nt, Homo sapiens
cagcaaaaguccacauuau

SEQ ID NO: 214340 - RNA, 19 nt, Homo sapiens
uugaugacccugcacaaua

SEQ ID NO: 214341 - RNA, 19 nt, Homo sapiens
gaaaauggagagacagaaa

SEQ ID NO: 214342 - RNA, 19 nt, Homo sapiens
ggauuaccguuuauuccau

SEQ ID NO: 214343 - RNA, 19 nt, Homo sapiens
gguucaaauucagcuguua

SEQ ID NO: 214344 - RNA, 19 nt, Homo sapiens
cguagaugcuggcaaguca

SEQ ID NO: 214345 - RNA, 19 nt, Homo sapiens
caugggagcacaaagaaga

SEQ ID NO: 214346 - RNA, 19 nt, Homo sapiens
gcccagauagugauuauag

SEQ ID NO: 214347 - RNA, 19 nt, Homo sapiens
gcuggaaucaggaucuauu

SEQ ID NO: 214348 - RNA, 19 nt, Homo sapiens
ugccaauuguggauaagua

SEQ ID NO: 214349 - RNA, 19 nt, Homo sapiens
gaugauccaacaguaaauu

SEQ ID NO: 214350 - RNA, 19 nt, Homo sapiens
agagaaacuugguacuugu

SEQ ID NO: 214351 - RNA, 19 nt, Homo sapiens
gaacacagcuguccacucu

SEQ ID NO: 214352 - RNA, 19 nt, Homo sapiens
gauuauggcuuuccaaguu

SEQ ID NO: 214353 - RNA, 19 nt, Homo sapiens
ccauagaucuucugaaaug

SEQ ID NO: 214354 - RNA, 19 nt, Homo sapiens
ggaccugaguuuaaacaaa

SEQ ID NO: 214355 - RNA, 19 nt, Homo sapiens
ggacuugggugugaugaaa

SEQ ID NO: 214356 - RNA, 19 nt, Homo sapiens
ccaaggaccugaguuuaaa

SEQ ID NO: 214357 - RNA, 19 nt, Homo sapiens
gauacggcaugauaaggua

SEQ ID NO: 214358 - RNA, 19 nt, Homo sapiens
ucaauuggcguguuauuaa

SEQ ID NO: 214359 - RNA, 19 nt, Homo sapiens
cagaagagcuggucacacu

SEQ ID NO: 214360 - RNA, 19 nt, Homo sapiens
caacgaaggcagacuuuga

SEQ ID NO: 214361 - RNA, 19 nt, Homo sapiens
ggugccagcuuaggaauaa

SEQ ID NO: 214362 - RNA, 19 nt, Homo sapiens
acacagcuguccacucuga

SEQ ID NO: 214363 - RNA, 19 nt, Homo sapiens
acccauagaucuucugaaa

SEQ ID NO: 214364 - RNA, 19 nt, Homo sapiens
gcguggaggugcugaaguu

SEQ ID NO: 214365 - RNA, 19 nt, Homo sapiens
gcacggaggagcuggagaa

SEQ ID NO: 214366 - RNA, 19 nt, Homo sapiens
ggucacacuucguugagaa

SEQ ID NO: 214367 - RNA, 19 nt, Homo sapiens
ggucugugcuaacaaggaa

SEQ ID NO: 214368 - RNA, 19 nt, Homo sapiens
gaccaugauuccagauguu

SEQ ID NO: 214369 - RNA, 19 nt, Homo sapiens
aaacuugcccaucgacuuu

SEQ ID NO: 214370 - RNA, 19 nt, Homo sapiens
caagggucauaucaucgua

SEQ ID NO: 214371 - RNA, 19 nt, Homo sapiens
cacggaagaugaagccauu

SEQ ID NO: 214372 - RNA, 19 nt, Homo sapiens
ugucagcccuggguucuaa

SEQ ID NO: 214373 - RNA, 19 nt, Homo sapiens
caccaagucccauauagaa

SEQ ID NO: 214374 - RNA, 19 nt, Homo sapiens
gaauaaccagcgauggauu

SEQ ID NO: 214375 - RNA, 19 nt, Homo sapiens
gaaggcagacuuugacaac

SEQ ID NO: 214376 - RNA, 19 nt, Homo sapiens
cagcaugguuacugcaguu

SEQ ID NO: 214377 - RNA, 19 nt, Homo sapiens
uuacauugcuguggagaug

SEQ ID NO: 214378 - RNA, 19 nt, Homo sapiens
caacgucaaaggcaucuau

SEQ ID NO: 214379 - RNA, 19 nt, Homo sapiens
gaagucagcaugguuacug

SEQ ID NO: 214380 - RNA, 19 nt, Homo sapiens
gagcuggucacacuucguu

SEQ ID NO: 214381 - RNA, 19 nt, Homo sapiens
caagucccauauagaaauc

SEQ ID NO: 214382 - RNA, 19 nt, Homo sapiens
ccaagucccauauagaaau

SEQ ID NO: 214383 - RNA, 19 nt, Homo sapiens
caauuggcguguuauuaag

SEQ ID NO: 214384 - RNA, 19 nt, Homo sapiens
ugacaacacagucgccauu

SEQ ID NO: 214385 - RNA, 19 nt, Homo sapiens
gagcaacgaaggcagacuu

SEQ ID NO: 214386 - RNA, 19 nt, Homo sapiens
augaaaugcugcaggguuu

SEQ ID NO: 214387 - RNA, 19 nt, Homo sapiens
uagaaaaugugaagaccua

SEQ ID NO: 214388 - RNA, 19 nt, Homo sapiens
ggaauaaccagcgauggau

SEQ ID NO: 214389 - RNA, 19 nt, Homo sapiens
uaugugagccgccugaaug

SEQ ID NO: 214390 - RNA, 19 nt, Homo sapiens
gaaaacaaaaugugugaug

SEQ ID NO: 214391 - RNA, 19 nt, Homo sapiens
cugaugauacggcaugaua

SEQ ID NO: 214392 - RNA, 19 nt, Homo sapiens
ccagaauaccaacgucaaa

SEQ ID NO: 214393 - RNA, 19 nt, Homo sapiens
ugaccaugauuccagaugu

SEQ ID NO: 214394 - RNA, 19 nt, Homo sapiens
gaaguucucccaggucaag

SEQ ID NO: 214395 - RNA, 19 nt, Homo sapiens
gaugauacggcaugauaag

SEQ ID NO: 214396 - RNA, 19 nt, Homo sapiens
ggguggcacuugcgugaau

SEQ ID NO: 214397 - RNA, 19 nt, Homo sapiens
auaacaacaucccaacugu

SEQ ID NO: 214398 - RNA, 19 nt, Homo sapiens
uguccacucugaauucaug

SEQ ID NO: 214399 - RNA, 19 nt, Homo sapiens
ugaaugccaucuaucaaaa

SEQ ID NO: 214400 - RNA, 19 nt, Homo sapiens
cauagaucuucugaaauga

SEQ ID NO: 214401 - RNA, 19 nt, Homo sapiens
cagugggacucacggaaga

SEQ ID NO: 214402 - RNA, 19 nt, Homo sapiens
ggccgcagcgucauuguug

SEQ ID NO: 214403 - RNA, 19 nt, Homo sapiens
uaccaaggaccugaguuua

SEQ ID NO: 214404 - RNA, 19 nt, Homo sapiens
cgugaauguuggaugugua

SEQ ID NO: 214405 - RNA, 19 nt, Homo sapiens
ucaccaagucccauauaga

SEQ ID NO: 214406 - RNA, 19 nt, Homo sapiens
ggacccauagaucuucuga

SEQ ID NO: 214407 - RNA, 19 nt, Homo sapiens
caaguugugaggguaaauu

SEQ ID NO: 214408 - RNA, 19 nt, Homo sapiens
gaucccaagcccacaauag

SEQ ID NO: 214409 - RNA, 19 nt, Homo sapiens
aaagcgggaugccuaugug

SEQ ID NO: 214410 - RNA, 19 nt, Homo sapiens
acaacacagucgccauuca

SEQ ID NO: 214411 - RNA, 19 nt, Homo sapiens
ggauucaaaccgaugacaa

SEQ ID NO: 214412 - RNA, 19 nt, Homo sapiens
accaaggaccugaguuuaa

SEQ ID NO: 214413 - RNA, 19 nt, Homo sapiens
aauaaccagcgauggauuu

SEQ ID NO: 214414 - RNA, 19 nt, Homo sapiens
ucaugcugauuauggcuuu

SEQ ID NO: 214415 - RNA, 19 nt, Homo sapiens
aaaacaaucucaccaaguc

SEQ ID NO: 214416 - RNA, 19 nt, Homo sapiens
cugaaugccaucuaucaaa

SEQ ID NO: 214417 - RNA, 19 nt, Homo sapiens
gaucuucugaaaugaaaca

SEQ ID NO: 214418 - RNA, 19 nt, Homo sapiens
caucccaacuguggucuuc

SEQ ID NO: 214419 - RNA, 19 nt, Homo sapiens
gcuguccacucugaauuca

SEQ ID NO: 214420 - RNA, 19 nt, Homo sapiens
gcaguuaccaaaaggaaaa

SEQ ID NO: 214421 - RNA, 19 nt, Homo sapiens
uauaacaacaucccaacug

SEQ ID NO: 214422 - RNA, 19 nt, Homo sapiens
auaccaaggaccugaguuu

SEQ ID NO: 214423 - RNA, 19 nt, Homo sapiens
gauccccggugccagcuua

SEQ ID NO: 214424 - RNA, 19 nt, Homo sapiens
gcgugaauguuggaugugu

SEQ ID NO: 214425 - RNA, 19 nt, Homo sapiens
guaucacgcaguuaccaaa

SEQ ID NO: 214426 - RNA, 19 nt, Homo sapiens
gauucaaaccgaugacaag

SEQ ID NO: 214427 - RNA, 19 nt, Homo sapiens
uaaacaaacuggggauuca

SEQ ID NO: 214428 - RNA, 19 nt, Homo sapiens
ccgccugaaugccaucuau

SEQ ID NO: 214429 - RNA, 19 nt, Homo sapiens
ccauucacccuaccucuuc

SEQ ID NO: 214430 - RNA, 19 nt, Homo sapiens
gcaacgaaggcagacuuug

SEQ ID NO: 214431 - RNA, 19 nt, Homo sapiens
gcagggacuugggugugau

SEQ ID NO: 214432 - RNA, 19 nt, Homo sapiens
gaaaaugugaagaccuauu

SEQ ID NO: 214433 - RNA, 19 nt, Homo sapiens
gcuggucacacuucguuga

SEQ ID NO: 214434 - RNA, 19 nt, Homo sapiens
ggcagacuuugacaacaca

SEQ ID NO: 214435 - RNA, 19 nt, Homo sapiens
ucaaugaucagcaccaacu

SEQ ID NO: 214436 - RNA, 19 nt, Homo sapiens
cccgauguaucacgcaguu

SEQ ID NO: 214437 - RNA, 19 nt, Homo sapiens
uggaaaagcucuucuuacu

SEQ ID NO: 214438 - RNA, 19 nt, Homo sapiens
guugugaggguaaauucaa

SEQ ID NO: 214439 - RNA, 19 nt, Homo sapiens
ugaaaauggucugugcuaa

SEQ ID NO: 214440 - RNA, 19 nt, Homo sapiens
gggacucacggaagaugaa

SEQ ID NO: 214441 - RNA, 19 nt, Homo sapiens
uuggaagucagcaugguua

SEQ ID NO: 214442 - RNA, 19 nt, Homo sapiens
cagcuguccacucugaauu

SEQ ID NO: 214443 - RNA, 19 nt, Homo sapiens
gcucuucuuacuccaguug

SEQ ID NO: 214444 - RNA, 19 nt, Homo sapiens
ugaugauacggcaugauaa

SEQ ID NO: 214445 - RNA, 19 nt, Homo sapiens
gcccuggguucuaagacau

SEQ ID NO: 214446 - RNA, 19 nt, Homo sapiens
aaucauccguggccaugca

SEQ ID NO: 214447 - RNA, 19 nt, Homo sapiens
cgaaggcagacuuugacaa

SEQ ID NO: 214448 - RNA, 19 nt, Homo sapiens
gcagugaagaugggagcaa

SEQ ID NO: 214449 - RNA, 19 nt, Homo sapiens
aaaauggucugugcuaaca

SEQ ID NO: 214450 - RNA, 19 nt, Homo sapiens
gaauaccaaggaccugagu

SEQ ID NO: 214451 - RNA, 19 nt, Homo sapiens
gcaagauccucucuaauaa

SEQ ID NO: 214452 - RNA, 19 nt, Homo sapiens
cuaaagaccuccaaaguuu

SEQ ID NO: 214453 - RNA, 19 nt, Homo sapiens
caaagaagcuggcaagauc

SEQ ID NO: 214454 - RNA, 19 nt, Homo sapiens
ggcaagauccucucuaaua

SEQ ID NO: 214455 - RNA, 19 nt, Homo sapiens
gggcauagccuuucccuaa

SEQ ID NO: 214456 - RNA, 19 nt, Homo sapiens
cgacgaacauuugaagaua

SEQ ID NO: 214457 - RNA, 19 nt, Homo sapiens
ugaaacagaucgaaaucaa

SEQ ID NO: 214458 - RNA, 19 nt, Homo sapiens
gcauagccuuucccuaauu

SEQ ID NO: 214459 - RNA, 19 nt, Homo sapiens
gaaaggcgaacuaguguug

SEQ ID NO: 214460 - RNA, 19 nt, Homo sapiens
ggaaauugcugugguuuac

SEQ ID NO: 214461 - RNA, 19 nt, Homo sapiens
caccaucucugccagcuuu

SEQ ID NO: 214462 - RNA, 19 nt, Homo sapiens
gggagccucuugcaggaua

SEQ ID NO: 214463 - RNA, 19 nt, Homo sapiens
gcaccgacauguucucagu

SEQ ID NO: 214464 - RNA, 19 nt, Homo sapiens
gaggaaaggcgaacuagug

SEQ ID NO: 214465 - RNA, 19 nt, Homo sapiens
gaccuucuauccucuguau

SEQ ID NO: 214466 - RNA, 19 nt, Homo sapiens
gacgaacauuugaagauau

SEQ ID NO: 214467 - RNA, 19 nt, Homo sapiens
gagaaggaaagaaacauau

SEQ ID NO: 214468 - RNA, 19 nt, Homo sapiens
ggacuggcccugggaauug

SEQ ID NO: 214469 - RNA, 19 nt, Homo sapiens
guaagcugcucugagguaa

SEQ ID NO: 214470 - RNA, 19 nt, Homo sapiens
gaagauaucucugaaaagg

SEQ ID NO: 214471 - RNA, 19 nt, Homo sapiens
gggauaggacugaguggua

SEQ ID NO: 214472 - RNA, 19 nt, Homo sapiens
cuacaugccucgucaguac

SEQ ID NO: 214473 - RNA, 19 nt, Homo sapiens
gguaagcugcucugaggua

SEQ ID NO: 214474 - RNA, 19 nt, Homo sapiens
ccaggaaauugcugugguu

SEQ ID NO: 214475 - RNA, 19 nt, Homo sapiens
gcaucuacuucgaaccaaa

SEQ ID NO: 214476 - RNA, 19 nt, Homo sapiens
ggaaggguaaauacuggua

SEQ ID NO: 214477 - RNA, 19 nt, Homo sapiens
ccuaaagaccuccaaaguu

SEQ ID NO: 214478 - RNA, 19 nt, Homo sapiens
aaacugcauugcugauuca

SEQ ID NO: 214479 - RNA, 19 nt, Homo sapiens
gaaaagacacucgugauga

SEQ ID NO: 214480 - RNA, 19 nt, Homo sapiens
ggaaagaaacauauuugac

SEQ ID NO: 214481 - RNA, 19 nt, Homo sapiens
gaucgaaccugagccuuuu

SEQ ID NO: 214482 - RNA, 19 nt, Homo sapiens
aaacagaucgaaaucaaca

SEQ ID NO: 214483 - RNA, 19 nt, Homo sapiens
ggcauagccuuucccuaau

SEQ ID NO: 214484 - RNA, 19 nt, Homo sapiens
ucaguacagucuacagaau

SEQ ID NO: 214485 - RNA, 19 nt, Homo sapiens
aagauccucucuaauaauc

SEQ ID NO: 214486 - RNA, 19 nt, Homo sapiens
cuggcaagauccucucuaa

SEQ ID NO: 214487 - RNA, 19 nt, Homo sapiens
aaauugcugugguuuacuu

SEQ ID NO: 214488 - RNA, 19 nt, Homo sapiens
caagagaaggaaagaaaca

SEQ ID NO: 214489 - RNA, 19 nt, Homo sapiens
caacccauacccuguguga

SEQ ID NO: 214490 - RNA, 19 nt, Homo sapiens
cgagugguccagugcauuu

SEQ ID NO: 214491 - RNA, 19 nt, Homo sapiens
gagagaggguggagguaac

SEQ ID NO: 214492 - RNA, 19 nt, Homo sapiens
agagaaggaaagaaacaua

SEQ ID NO: 214493 - RNA, 19 nt, Homo sapiens
caagauccucucuaauaau

SEQ ID NO: 214494 - RNA, 19 nt, Homo sapiens
cuuuaccgcucgucucuuu

SEQ ID NO: 214495 - RNA, 19 nt, Homo sapiens
ggguauagcucaggguaag

SEQ ID NO: 214496 - RNA, 19 nt, Homo sapiens
gaauugggaagcacgucua

SEQ ID NO: 214497 - RNA, 19 nt, Homo sapiens
aaaagacacucgugaugaa

SEQ ID NO: 214498 - RNA, 19 nt, Homo sapiens
gcucuggugcuacugauug

SEQ ID NO: 214499 - RNA, 19 nt, Homo sapiens
ccaaugcucuggugcuacu

SEQ ID NO: 214500 - RNA, 19 nt, Homo sapiens
ccuucuauccucuguauuu

SEQ ID NO: 214501 - RNA, 19 nt, Homo sapiens
ccaaagaagcuggcaagau

SEQ ID NO: 214502 - RNA, 19 nt, Homo sapiens
cauagccuuucccuaauuc

SEQ ID NO: 214503 - RNA, 19 nt, Homo sapiens
aaaguugugucucccuuag

SEQ ID NO: 214504 - RNA, 19 nt, Homo sapiens
uuucagagcugggcaucuu

SEQ ID NO: 214505 - RNA, 19 nt, Homo sapiens
ggucacaugcugccaagug

SEQ ID NO: 214506 - RNA, 19 nt, Homo sapiens
ggacuucaaccugcuagug

SEQ ID NO: 214507 - RNA, 19 nt, Homo sapiens
aguacagucuacagaauug

SEQ ID NO: 214508 - RNA, 19 nt, Homo sapiens
ggaaaggcgaacuaguguu

SEQ ID NO: 214509 - RNA, 19 nt, Homo sapiens
gaaucgcucagacuacaug

SEQ ID NO: 214510 - RNA, 19 nt, Homo sapiens
gacaacccauacccugugu

SEQ ID NO: 214511 - RNA, 19 nt, Homo sapiens
ggagccucuugcaggauaa

SEQ ID NO: 214512 - RNA, 19 nt, Homo sapiens
caaacaggaugacuuuacc

SEQ ID NO: 214513 - RNA, 19 nt, Homo sapiens
ucaaacaggaugacuuuac

SEQ ID NO: 214514 - RNA, 19 nt, Homo sapiens
agacacucgugaugaacaa

SEQ ID NO: 214515 - RNA, 19 nt, Homo sapiens
ggaaaagacacucgugaug

SEQ ID NO: 214516 - RNA, 19 nt, Homo sapiens
caagaccgaaggcuguuug

SEQ ID NO: 214517 - RNA, 19 nt, Homo sapiens
guuuguggauggccaggaa

SEQ ID NO: 214518 - RNA, 19 nt, Homo sapiens
gcugugcaccgacauguuc

SEQ ID NO: 214519 - RNA, 19 nt, Homo sapiens
ccuaauucugccuuaaaua

SEQ ID NO: 214520 - RNA, 19 nt, Homo sapiens
gaaacagaucgaaaucaac

SEQ ID NO: 214521 - RNA, 19 nt, Homo sapiens
ccuccuacauccucaugga

SEQ ID NO: 214522 - RNA, 19 nt, Homo sapiens
caguacagucuacagaauu

SEQ ID NO: 214523 - RNA, 19 nt, Homo sapiens
guggauggccaggaaauug

SEQ ID NO: 214524 - RNA, 19 nt, Homo sapiens
ccuaugcugugcagaugga

SEQ ID NO: 214525 - RNA, 19 nt, Homo sapiens
cucaagagaaggaaagaaa

SEQ ID NO: 214526 - RNA, 19 nt, Homo sapiens
gcggaggaaaggcgaacua

SEQ ID NO: 214527 - RNA, 19 nt, Homo sapiens
cccaaauccuugagaugug

SEQ ID NO: 214528 - RNA, 19 nt, Homo sapiens
ccuacauccucauggagaa

SEQ ID NO: 214529 - RNA, 19 nt, Homo sapiens
caccuuugcuggccucuac

SEQ ID NO: 214530 - RNA, 19 nt, Homo sapiens
gaaggugcagcaggagcua

SEQ ID NO: 214531 - RNA, 19 nt, Homo sapiens
gugauccgacgaacauuug

SEQ ID NO: 214532 - RNA, 19 nt, Homo sapiens
cauagagaaugagcuacug

SEQ ID NO: 214533 - RNA, 19 nt, Homo sapiens
ugagguaaagguccaugaa

SEQ ID NO: 214534 - RNA, 19 nt, Homo sapiens
gccaagugcccagacauug

SEQ ID NO: 214535 - RNA, 19 nt, Homo sapiens
cauuugaagauaucucuga

SEQ ID NO: 214536 - RNA, 19 nt, Homo sapiens
gaccagcgugccauagaga

SEQ ID NO: 214537 - RNA, 19 nt, Homo sapiens
gcucuacggcucacccaau

SEQ ID NO: 214538 - RNA, 19 nt, Homo sapiens
gggacuggcccugggaauu

SEQ ID NO: 214539 - RNA, 19 nt, Homo sapiens
cugcauugcugauucaaaa

SEQ ID NO: 214540 - RNA, 19 nt, Homo sapiens
aagcugcucugagguaaag

SEQ ID NO: 214541 - RNA, 19 nt, Homo sapiens
agagagaggguggagguaa

SEQ ID NO: 214542 - RNA, 19 nt, Homo sapiens
gcuacaugccucgucagua

SEQ ID NO: 214543 - RNA, 19 nt, Homo sapiens
ggaggaaaggcgaacuagu

SEQ ID NO: 214544 - RNA, 19 nt, Homo sapiens
gauccgacgaacauuugaa

SEQ ID NO: 214545 - RNA, 19 nt, Homo sapiens
acaagcaaguccuaaaaga

SEQ ID NO: 214546 - RNA, 19 nt, Homo sapiens
acugauugcucaagagaag

SEQ ID NO: 214547 - RNA, 19 nt, Homo sapiens
cgaaaucaacaccaucucu

SEQ ID NO: 214548 - RNA, 19 nt, Homo sapiens
gcauugcccagacuguguu

SEQ ID NO: 214549 - RNA, 19 nt, Homo sapiens
cccuaauucugccuuaaau

SEQ ID NO: 214550 - RNA, 19 nt, Homo sapiens
aggaaauugcugugguuua

SEQ ID NO: 214551 - RNA, 19 nt, Homo sapiens
uaacaaagcuuagagaaac

SEQ ID NO: 214552 - RNA, 19 nt, Homo sapiens
gaugagaaaucuuuagaag

SEQ ID NO: 214553 - RNA, 19 nt, Homo sapiens
gaguagaguuugaagagaa

SEQ ID NO: 214554 - RNA, 19 nt, Homo sapiens
gcaaauacaaccucuaugg

SEQ ID NO: 214555 - RNA, 19 nt, Homo sapiens
uagaagguauagcagauuu

SEQ ID NO: 214556 - RNA, 19 nt, Homo sapiens
cuacuucccugccuuugaa

SEQ ID NO: 214557 - RNA, 19 nt, Homo sapiens
ggaagccucccauggauga

SEQ ID NO: 214558 - RNA, 19 nt, Homo sapiens
caaggaagccucccaugga

SEQ ID NO: 214559 - RNA, 19 nt, Homo sapiens
ggaguagaguuugaagaga

SEQ ID NO: 214560 - RNA, 19 nt, Homo sapiens
caaggaagauuuucagguu

SEQ ID NO: 214561 - RNA, 19 nt, Homo sapiens
ugguggaacuucucuacua

SEQ ID NO: 214562 - RNA, 19 nt, Homo sapiens
cagcaaauacaaccucuau

SEQ ID NO: 214563 - RNA, 19 nt, Homo sapiens
cagcuggaguagaguuuga

SEQ ID NO: 214564 - RNA, 19 nt, Homo sapiens
ggaugagaaaucuuuagaa

SEQ ID NO: 214565 - RNA, 19 nt, Homo sapiens
ccauggaugagaaaucuuu

SEQ ID NO: 214566 - RNA, 19 nt, Homo sapiens
ggaagauuuucagguuuua

SEQ ID NO: 214567 - RNA, 19 nt, Homo sapiens
gaccuggaauucaguuguc

SEQ ID NO: 214568 - RNA, 19 nt, Homo sapiens
gguggaacuucucuacuac

SEQ ID NO: 214569 - RNA, 19 nt, Homo sapiens
ugauggauauuugauguuc

SEQ ID NO: 214570 - RNA, 19 nt, Homo sapiens
uuggacaaguuaagaaaug

SEQ ID NO: 214571 - RNA, 19 nt, Homo sapiens
uauagcagauuugggugaa

SEQ ID NO: 214572 - RNA, 19 nt, Homo sapiens
gaagguauagcagauuugg

SEQ ID NO: 214573 - RNA, 19 nt, Homo sapiens
uacauuaggaccuggaauu

SEQ ID NO: 214574 - RNA, 19 nt, Homo sapiens
gauuuggacaaguuaagaa

SEQ ID NO: 214575 - RNA, 19 nt, Homo sapiens
aguagaguuugaagagaaa

SEQ ID NO: 214576 - RNA, 19 nt, Homo sapiens
ggaccuggaauucaguugu

SEQ ID NO: 214577 - RNA, 19 nt, Homo sapiens
aaggaagccucccauggau

SEQ ID NO: 214578 - RNA, 19 nt, Homo sapiens
caaguuaagaaaugaugga

SEQ ID NO: 214579 - RNA, 19 nt, Homo sapiens
ggacaaguuaagaaaugau

SEQ ID NO: 214580 - RNA, 19 nt, Homo sapiens
uggacaaguuaagaaauga

SEQ ID NO: 214581 - RNA, 19 nt, Homo sapiens
gacaaguuaagaaaugaug

SEQ ID NO: 214582 - RNA, 19 nt, Homo sapiens
gcuacuucccugccuuuga

SEQ ID NO: 214583 - RNA, 19 nt, Homo sapiens
ggcugcagcuggaguagag

SEQ ID NO: 214584 - RNA, 19 nt, Homo sapiens
cauggaugagaaaucuuua

SEQ ID NO: 214585 - RNA, 19 nt, Homo sapiens
gcccugauugauauguaua

SEQ ID NO: 214586 - RNA, 19 nt, Homo sapiens
caaccucuaugggaaagac

SEQ ID NO: 214587 - RNA, 19 nt, Homo sapiens
uggaugagaaaucuuuaga

SEQ ID NO: 214588 - RNA, 19 nt, Homo sapiens
ucccauggaugagaaaucu

SEQ ID NO: 214589 - RNA, 19 nt, Homo sapiens
ggaacaagaugccaagcuu

SEQ ID NO: 214590 - RNA, 19 nt, Homo sapiens
uaacaaagcuuagagaaac

SEQ ID NO: 214591 - RNA, 19 nt, Homo sapiens
gaugagaaaucuuuagaag

SEQ ID NO: 214592 - RNA, 19 nt, Homo sapiens
gaguagaguuugaagagaa

SEQ ID NO: 214593 - RNA, 19 nt, Homo sapiens
gcaaauacaaccucuaugg

SEQ ID NO: 214594 - RNA, 19 nt, Homo sapiens
gaccaguauucuaaaguuu

SEQ ID NO: 214595 - RNA, 19 nt, Homo sapiens
uagaagguauagcagauuu

SEQ ID NO: 214596 - RNA, 19 nt, Homo sapiens
ggaacaaagagcuuauaaa

SEQ ID NO: 214597 - RNA, 19 nt, Homo sapiens
ggugacagcauuuaacaaa

SEQ ID NO: 214598 - RNA, 19 nt, Homo sapiens
cuacuucccugccuuugaa

SEQ ID NO: 214599 - RNA, 19 nt, Homo sapiens
ggaagccucccauggauga

SEQ ID NO: 214600 - RNA, 19 nt, Homo sapiens
caaggaagccucccaugga

SEQ ID NO: 214601 - RNA, 19 nt, Homo sapiens
ggaguagaguuugaagaga

SEQ ID NO: 214602 - RNA, 19 nt, Homo sapiens
caaggaagauuuucagguu

SEQ ID NO: 214603 - RNA, 19 nt, Homo sapiens
gagaggaacaaagagcuua

SEQ ID NO: 214604 - RNA, 19 nt, Homo sapiens
gcaagaccaguauucuaaa

SEQ ID NO: 214605 - RNA, 19 nt, Homo sapiens
ugaagcuaaugaacucuuu

SEQ ID NO: 214606 - RNA, 19 nt, Homo sapiens
agaccaguauucuaaaguu

SEQ ID NO: 214607 - RNA, 19 nt, Homo sapiens
uuagaagaaucaaggaaga

SEQ ID NO: 214608 - RNA, 19 nt, Homo sapiens
ugguggaacuucucuacua

SEQ ID NO: 214609 - RNA, 19 nt, Homo sapiens
caagaccaguauucuaaag

SEQ ID NO: 214610 - RNA, 19 nt, Homo sapiens
gauugugccuguugugaag

SEQ ID NO: 214611 - RNA, 19 nt, Homo sapiens
cagcaaauacaaccucuau

SEQ ID NO: 214612 - RNA, 19 nt, Homo sapiens
uuaccuaaguguugauugu

SEQ ID NO: 214613 - RNA, 19 nt, Homo sapiens
cagcuggaguagaguuuga

SEQ ID NO: 214614 - RNA, 19 nt, Homo sapiens
ugcaagaccaguauucuaa

SEQ ID NO: 214615 - RNA, 19 nt, Homo sapiens
cagcauuuaacaaagcuua

SEQ ID NO: 214616 - RNA, 19 nt, Homo sapiens
ggaugagaaaucuuuagaa

SEQ ID NO: 214617 - RNA, 19 nt, Homo sapiens
gaggaacaaagagcuuaua

SEQ ID NO: 214618 - RNA, 19 nt, Homo sapiens
uuaauaaaccagccauaga

SEQ ID NO: 214619 - RNA, 19 nt, Homo sapiens
ccauggaugagaaaucuuu

SEQ ID NO: 214620 - RNA, 19 nt, Homo sapiens
ggaagauuuucagguuuua

SEQ ID NO: 214621 - RNA, 19 nt, Homo sapiens
ggugaaaugauccuucuuc

SEQ ID NO: 214622 - RNA, 19 nt, Homo sapiens
ugacagcauuuaacaaagc

SEQ ID NO: 214623 - RNA, 19 nt, Homo sapiens
uaagugcuuuaccuaagug

SEQ ID NO: 214624 - RNA, 19 nt, Homo sapiens
uaauaaaccagccauagag

SEQ ID NO: 214625 - RNA, 19 nt, Homo sapiens
gguggaacuucucuacuac

SEQ ID NO: 214626 - RNA, 19 nt, Homo sapiens
ugauggauauuugauguuc

SEQ ID NO: 214627 - RNA, 19 nt, Homo sapiens
uuggacaaguuaagaaaug

SEQ ID NO: 214628 - RNA, 19 nt, Homo sapiens
uuaagugcuuuaccuaagu

SEQ ID NO: 214629 - RNA, 19 nt, Homo sapiens
gugaaaugauccuucuucu

SEQ ID NO: 214630 - RNA, 19 nt, Homo sapiens
uauagcagauuugggugaa

SEQ ID NO: 214631 - RNA, 19 nt, Homo sapiens
gaagguauagcagauuugg

SEQ ID NO: 214632 - RNA, 19 nt, Homo sapiens
uacauuaggaccuggaauu

SEQ ID NO: 214633 - RNA, 19 nt, Homo sapiens
gugcuuuaccuaaguguug

SEQ ID NO: 214634 - RNA, 19 nt, Homo sapiens
gauuuggacaaguuaagaa

SEQ ID NO: 214635 - RNA, 19 nt, Homo sapiens
aguagaguuugaagagaaa

SEQ ID NO: 214636 - RNA, 19 nt, Homo sapiens
gauuucuucucauuaggau

SEQ ID NO: 214637 - RNA, 19 nt, Homo sapiens
gcauuuaacaaagcuuaga

SEQ ID NO: 214638 - RNA, 19 nt, Homo sapiens
aaggaagccucccauggau

SEQ ID NO: 214639 - RNA, 19 nt, Homo sapiens
caaguuaagaaaugaugga

SEQ ID NO: 214640 - RNA, 19 nt, Homo sapiens
ggacaaguuaagaaaugau

SEQ ID NO: 214641 - RNA, 19 nt, Homo sapiens
uggacaaguuaagaaauga

SEQ ID NO: 214642 - RNA, 19 nt, Homo sapiens
ggaccuggaauucgguugu

SEQ ID NO: 214643 - RNA, 19 nt, Homo sapiens
gugacagcauuuaacaaag

SEQ ID NO: 214644 - RNA, 19 nt, Homo sapiens
gacaaguuaagaaaugaug

SEQ ID NO: 214645 - RNA, 19 nt, Homo sapiens
gcuacuucccugccuuuga

SEQ ID NO: 214646 - RNA, 19 nt, Homo sapiens
ggcugcagcuggaguagag

SEQ ID NO: 214647 - RNA, 19 nt, Homo sapiens
aggaacaaagagcuuauaa

SEQ ID NO: 214648 - RNA, 19 nt, Homo sapiens
gaagcuaaugaacucuuuc

SEQ ID NO: 214649 - RNA, 19 nt, Homo sapiens
cauggaugagaaaucuuua

SEQ ID NO: 214650 - RNA, 19 nt, Homo sapiens
gcccugauugauauguaua

SEQ ID NO: 214651 - RNA, 19 nt, Homo sapiens
caaccucuaugggaaagac

SEQ ID NO: 214652 - RNA, 19 nt, Homo sapiens
auuaagugcuuuaccuaag

SEQ ID NO: 214653 - RNA, 19 nt, Homo sapiens
ccaguauucuaaaguuuug

SEQ ID NO: 214654 - RNA, 19 nt, Homo sapiens
uggaugagaaaucuuuaga

SEQ ID NO: 214655 - RNA, 19 nt, Homo sapiens
ucccauggaugagaaaucu

SEQ ID NO: 214656 - RNA, 19 nt, Homo sapiens
ugaaaugauccuucuucug

SEQ ID NO: 214657 - RNA, 19 nt, Homo sapiens
gaccuggaauucgguuguc

SEQ ID NO: 214658 - RNA, 19 nt, Homo sapiens
gagcuugacuccagccuua

SEQ ID NO: 214659 - RNA, 19 nt, Homo sapiens
aaugaacccuuuccaauua

SEQ ID NO: 214660 - RNA, 19 nt, Homo sapiens
gaagaagccagaaagauuu

SEQ ID NO: 214661 - RNA, 19 nt, Homo sapiens
gaacaugcaagaccaauau

SEQ ID NO: 214662 - RNA, 19 nt, Homo sapiens
gagagagcccuaauugaua

SEQ ID NO: 214663 - RNA, 19 nt, Homo sapiens
ggagagagcccuaauugau

SEQ ID NO: 214664 - RNA, 19 nt, Homo sapiens
cagaagguauggcagauuu

SEQ ID NO: 214665 - RNA, 19 nt, Homo sapiens
cggcuagacuuuacucaaa

SEQ ID NO: 214666 - RNA, 19 nt, Homo sapiens
gaguggaguuugaagagaa

SEQ ID NO: 214667 - RNA, 19 nt, Homo sapiens
uaaugaacccuuuccaauu

SEQ ID NO: 214668 - RNA, 19 nt, Homo sapiens
gcaacaaugaagugcuuua

SEQ ID NO: 214669 - RNA, 19 nt, Homo sapiens
agaagaagccagaaagauu

SEQ ID NO: 214670 - RNA, 19 nt, Homo sapiens
gaagauuugggaaaguuaa

SEQ ID NO: 214671 - RNA, 19 nt, Homo sapiens
gugcuuuacuuaaguguug

SEQ ID NO: 214672 - RNA, 19 nt, Homo sapiens
gauugugccuguuguaaag

SEQ ID NO: 214673 - RNA, 19 nt, Homo sapiens
agagagcccuaauugauau

SEQ ID NO: 214674 - RNA, 19 nt, Homo sapiens
cagaagauuugggaaaguu

SEQ ID NO: 214675 - RNA, 19 nt, Homo sapiens
gcaagaccaauauucuaaa

SEQ ID NO: 214676 - RNA, 19 nt, Homo sapiens
gguggaacuucucuacuau

SEQ ID NO: 214677 - RNA, 19 nt, Homo sapiens
ggagaccggcuagacuuua

SEQ ID NO: 214678 - RNA, 19 nt, Homo sapiens
gaagguauggcagauuuga

SEQ ID NO: 214679 - RNA, 19 nt, Homo sapiens
gggaugaaguugguacaga

SEQ ID NO: 214680 - RNA, 19 nt, Homo sapiens
ggaguggaguuugaagaga

SEQ ID NO: 214681 - RNA, 19 nt, Homo sapiens
cagcuggaguggaguuuga

SEQ ID NO: 214682 - RNA, 19 nt, Homo sapiens
acuccuauuugcuaacuua

SEQ ID NO: 214683 - RNA, 19 nt, Homo sapiens
caagaccaauauucuaaag

SEQ ID NO: 214684 - RNA, 19 nt, Homo sapiens
ugaaugaaaugauccuucu

SEQ ID NO: 214685 - RNA, 19 nt, Homo sapiens
ggaaaguuaagaaaugaug

SEQ ID NO: 214686 - RNA, 19 nt, Homo sapiens
ugguggaacuucucuacua

SEQ ID NO: 214687 - RNA, 19 nt, Homo sapiens
uaagaaaugaugggaguuu

SEQ ID NO: 214688 - RNA, 19 nt, Homo sapiens
gcagaagauuugggaaagu

SEQ ID NO: 214689 - RNA, 19 nt, Homo sapiens
ggaguuugaagagaaauuu

SEQ ID NO: 214690 - RNA, 19 nt, Homo sapiens
ugaacccuuuccaauuaua

SEQ ID NO: 214691 - RNA, 19 nt, Homo sapiens
ugcaaaagcuuuagaagaa

SEQ ID NO: 214692 - RNA, 19 nt, Homo sapiens
gagcccuaauugauaugua

SEQ ID NO: 214693 - RNA, 19 nt, Homo sapiens
cuaaugaacccuuuccaau

SEQ ID NO: 214694 - RNA, 19 nt, Homo sapiens
gaaaugaugggaguuugau

SEQ ID NO: 214695 - RNA, 19 nt, Homo sapiens
aagauugccuugaucaaag

SEQ ID NO: 214696 - RNA, 19 nt, Homo sapiens
aagcuucacuacuucaaug

SEQ ID NO: 214697 - RNA, 19 nt, Homo sapiens
ugggaaaguuaagaaauga

SEQ ID NO: 214698 - RNA, 19 nt, Homo sapiens
gcuaaugaacccuuuccaa

SEQ ID NO: 214699 - RNA, 19 nt, Homo sapiens
cuauuucccugccuucgaa

SEQ ID NO: 214700 - RNA, 19 nt, Homo sapiens
gagguggccuugagaagcu

SEQ ID NO: 214701 - RNA, 19 nt, Homo sapiens
gcccaagcuucacuacuuc

SEQ ID NO: 214702 - RNA, 19 nt, Homo sapiens
aaggagagagcccuaauug

SEQ ID NO: 214703 - RNA, 19 nt, Homo sapiens
gaacccuuuccaauuauau

SEQ ID NO: 214704 - RNA, 19 nt, Homo sapiens
gagaccggcuagacuuuac

SEQ ID NO: 214705 - RNA, 19 nt, Homo sapiens
uggaacuucucuacuaugu

SEQ ID NO: 214706 - RNA, 19 nt, Homo sapiens
aaagaaaccaagagacugu

SEQ ID NO: 214707 - RNA, 19 nt, Homo sapiens
uugggaaaguuaagaaaug

SEQ ID NO: 214708 - RNA, 19 nt, Homo sapiens
ugcaagaccaauauucuaa

SEQ ID NO: 214709 - RNA, 19 nt, Homo sapiens
uauggcagauuugaaugaa

SEQ ID NO: 214710 - RNA, 19 nt, Homo sapiens
ucaaagaaaccaagagacu

SEQ ID NO: 214711 - RNA, 19 nt, Homo sapiens
agaaaccaagagacuguua

SEQ ID NO: 214712 - RNA, 19 nt, Homo sapiens
gauccuucuucugcccuua

SEQ ID NO: 214713 - RNA, 19 nt, Homo sapiens
guauggcagauuugaauga

SEQ ID NO: 214714 - RNA, 19 nt, Homo sapiens
agcccaagcuucacuacuu

SEQ ID NO: 214715 - RNA, 19 nt, Homo sapiens
gcggagaccggcuagacuu

SEQ ID NO: 214716 - RNA, 19 nt, Homo sapiens
uaaaggagagagcccuaau

SEQ ID NO: 214717 - RNA, 19 nt, Homo sapiens
aaaggagagagcccuaauu

SEQ ID NO: 214718 - RNA, 19 nt, Homo sapiens
aagaaaugaugggaguuug

SEQ ID NO: 214719 - RNA, 19 nt, Homo sapiens
gauuugggaaaguuaagaa

SEQ ID NO: 214720 - RNA, 19 nt, Homo sapiens
agauugccuugaucaaaga

SEQ ID NO: 214721 - RNA, 19 nt, Homo sapiens
aaggaagccucccgcagau

SEQ ID NO: 214722 - RNA, 19 nt, Homo sapiens
ugauauguauacagaaggu

SEQ ID NO: 214723 - RNA, 19 nt, Homo sapiens
agaagauuugggaaaguua

SEQ ID NO: 214724 - RNA, 19 nt, Homo sapiens
cagcaaauacaaccucuac

SEQ ID NO: 214725 - RNA, 19 nt, Homo sapiens
agaaaugaugggaguuuga

SEQ ID NO: 214726 - RNA, 19 nt, Homo sapiens
gaaaccaagagacuguuac

SEQ ID NO: 214727 - RNA, 19 nt, Homo sapiens
uugcaacaaugaagugcuu

SEQ ID NO: 214728 - RNA, 19 nt, Homo sapiens
ccauggaggcuaagaacau

SEQ ID NO: 214729 - RNA, 19 nt, Homo sapiens
ccucuacgggaaagacaua

SEQ ID NO: 214730 - RNA, 19 nt, Homo sapiens
ugauugugccuguuguaaa

SEQ ID NO: 214731 - RNA, 19 nt, Homo sapiens
agaacaugcaagaccaaua

SEQ ID NO: 214732 - RNA, 19 nt, Homo sapiens
uagaagaagccagaaagau

SEQ ID NO: 214733 - RNA, 19 nt, Homo sapiens
gaaugaaaugauccuucuu

SEQ ID NO: 214734 - RNA, 19 nt, Homo sapiens
gcccuaauugauauguaua

SEQ ID NO: 214735 - RNA, 19 nt, Homo sapiens
gaaagacauaaaggagaga

SEQ ID NO: 214736 - RNA, 19 nt, Homo sapiens
ugagauugaugggaugaag

SEQ ID NO: 214737 - RNA, 19 nt, Homo sapiens
uuagaagaagccagaaaga

SEQ ID NO: 214738 - RNA, 19 nt, Homo sapiens
aaugaaaugauccuucuuc

SEQ ID NO: 214739 - RNA, 19 nt, Homo sapiens
aaacuccuauuugcuaacu

SEQ ID NO: 214740 - RNA, 19 nt, Homo sapiens
ccuuuccaauuauaugcua

SEQ ID NO: 214741 - RNA, 19 nt, Homo sapiens
ugcccacggugaagaaguu

SEQ ID NO: 214742 - RNA, 19 nt, Homo sapiens
acagagccauggacaagac

SEQ ID NO: 214743 - RNA, 19 nt, Homo sapiens
uuacagagccauggacaag

SEQ ID NO: 214744 - RNA, 19 nt, Homo sapiens
caacaaugaagugcuuuac

SEQ ID NO: 214745 - RNA, 19 nt, Homo sapiens
gcaaaagcuuuagaagaag

SEQ ID NO: 214746 - RNA, 19 nt, Homo sapiens
acucaaagaaaccaagaga

SEQ ID NO: 214747 - RNA, 19 nt, Homo sapiens
caugcaagaccaauauucu

SEQ ID NO: 214748 - RNA, 19 nt, Homo sapiens
uaagaacaugcaagaccaa

SEQ ID NO: 214749 - RNA, 19 nt, Homo sapiens
ugaaaugauccuucuucug

SEQ ID NO: 214750 - RNA, 19 nt, Homo sapiens
cugcagaagauuugggaaa

SEQ ID NO: 214751 - RNA, 19 nt, Homo sapiens
aguggaguuugaagagaaa

SEQ ID NO: 214752 - RNA, 19 nt, Homo sapiens
ugaugggaguuugauguuc

SEQ ID NO: 214753 - RNA, 19 nt, Homo sapiens
aggcuaagaacaugcaaga

SEQ ID NO: 214754 - RNA, 19 nt, Homo sapiens
acuccagccuuaucuccaa

SEQ ID NO: 214755 - RNA, 19 nt, Homo sapiens
agauugaugggaugaaguu

SEQ ID NO: 214756 - RNA, 19 nt, Homo sapiens
gaucaucucuucuagaaau

SEQ ID NO: 214757 - RNA, 19 nt, Homo sapiens
uaucaugcauccuuucuua

SEQ ID NO: 214758 - RNA, 19 nt, Homo sapiens
ccucugagcuguaauaaau

SEQ ID NO: 214759 - RNA, 19 nt, Homo sapiens
cgaguuugaugaagaauuu

SEQ ID NO: 214760 - RNA, 19 nt, Homo sapiens
ccagaaggcuauaauuaga

SEQ ID NO: 214761 - RNA, 19 nt, Homo sapiens
gaacccugauugacaugua

SEQ ID NO: 214762 - RNA, 19 nt, Homo sapiens
uaaguuggguccuaaguug

SEQ ID NO: 214763 - RNA, 19 nt, Homo sapiens
uggagaggcugguauuuaa

SEQ ID NO: 214764 - RNA, 19 nt, Homo sapiens
gcccagaaggcuauaauua

SEQ ID NO: 214765 - RNA, 19 nt, Homo sapiens
guacagacccgaagcauuc

SEQ ID NO: 214766 - RNA, 19 nt, Homo sapiens
gaauacacagugaaacuaa

SEQ ID NO: 214767 - RNA, 19 nt, Homo sapiens
ugucuacagucaugucuua

SEQ ID NO: 214768 - RNA, 19 nt, Homo sapiens
caacaucuuuaggccauaa

SEQ ID NO: 214769 - RNA, 19 nt, Homo sapiens
gaaccuggcagcaagaaga

SEQ ID NO: 214770 - RNA, 19 nt, Homo sapiens
gguauugucuacagucaug

SEQ ID NO: 214771 - RNA, 19 nt, Homo sapiens
ggaauacacagugaaacua

SEQ ID NO: 214772 - RNA, 19 nt, Homo sapiens
gaaauugacgggaugaagu

SEQ ID NO: 214773 - RNA, 19 nt, Homo sapiens
aagaacaguuguacaaguu

SEQ ID NO: 214774 - RNA, 19 nt, Homo sapiens
gagagaacccugauugaca

SEQ ID NO: 214775 - RNA, 19 nt, Homo sapiens
guaaugaaugcaaucagua

SEQ ID NO: 214776 - RNA, 19 nt, Homo sapiens
uccagucucugccuaauuu

SEQ ID NO: 214777 - RNA, 19 nt, Homo sapiens
ggugcuaucuauguauuaa

SEQ ID NO: 214778 - RNA, 19 nt, Homo sapiens
cuacagucaugucuuaaug

SEQ ID NO: 214779 - RNA, 19 nt, Homo sapiens
gguccuaaguugggucuuu

SEQ ID NO: 214780 - RNA, 19 nt, Homo sapiens
guauuaaguuggguccuaa

SEQ ID NO: 214781 - RNA, 19 nt, Homo sapiens
gacaguguguuccuagaga

SEQ ID NO: 214782 - RNA, 19 nt, Homo sapiens
uagauacuuuccuguguuu

SEQ ID NO: 214783 - RNA, 19 nt, Homo sapiens
gaagcauucuccacuacau

SEQ ID NO: 214784 - RNA, 19 nt, Homo sapiens
gcaaucaguauuagccaaa

SEQ ID NO: 214785 - RNA, 19 nt, Homo sapiens
cuaauauccugucugcauu

SEQ ID NO: 214786 - RNA, 19 nt, Homo sapiens
gggaugaaguugguacaga

SEQ ID NO: 214787 - RNA, 19 nt, Homo sapiens
aaagaacaguuguacaagu

SEQ ID NO: 214788 - RNA, 19 nt, Homo sapiens
caguucauccucauaauaa

SEQ ID NO: 214789 - RNA, 19 nt, Homo sapiens
ccaguucauccucauaaua

SEQ ID NO: 214790 - RNA, 19 nt, Homo sapiens
aaagcuuucuuguugguaa

SEQ ID NO: 214791 - RNA, 19 nt, Homo sapiens
gagaugguauugucuacag

SEQ ID NO: 214792 - RNA, 19 nt, Homo sapiens
gagucgaguuugaugaaga

SEQ ID NO: 214793 - RNA, 19 nt, Homo sapiens
gaggcugguauuuaaguua

SEQ ID NO: 214794 - RNA, 19 nt, Homo sapiens
ucauggugcuaucuaugua

SEQ ID NO: 214795 - RNA, 19 nt, Homo sapiens
gauacuuuccuguguuuga

SEQ ID NO: 214796 - RNA, 19 nt, Homo sapiens
caaaagaacaguuguacaa

SEQ ID NO: 214797 - RNA, 19 nt, Homo sapiens
ccuguucucuuauccuuau

SEQ ID NO: 214798 - RNA, 19 nt, Homo sapiens
gaucugcuggaacugcuua

SEQ ID NO: 214799 - RNA, 19 nt, Homo sapiens
cagaaagccugaaaagcua

SEQ ID NO: 214800 - RNA, 19 nt, Homo sapiens
ugagaaccgucuacaacau

SEQ ID NO: 214801 - RNA, 19 nt, Homo sapiens
uuagauacuuuccuguguu

SEQ ID NO: 214802 - RNA, 19 nt, Homo sapiens
agacaagcacaaucucuuu

SEQ ID NO: 214803 - RNA, 19 nt, Homo sapiens
ugaaugcaaucaguauuag

SEQ ID NO: 214804 - RNA, 19 nt, Homo sapiens
ggcaggaucucuuguucuc

SEQ ID NO: 214805 - RNA, 19 nt, Homo sapiens
agagaacccugauugacau

SEQ ID NO: 214806 - RNA, 19 nt, Homo sapiens
aauaacaaccgaaugucua

SEQ ID NO: 214807 - RNA, 19 nt, Homo sapiens
ccaggaauacacagugaaa

SEQ ID NO: 214808 - RNA, 19 nt, Homo sapiens
gaaugggcaggaucucuug

SEQ ID NO: 214809 - RNA, 19 nt, Homo sapiens
ggauggaguccgugagaug

SEQ ID NO: 214810 - RNA, 19 nt, Homo sapiens
caauuaagagauuccuuga

SEQ ID NO: 214811 - RNA, 19 nt, Homo sapiens
ucaugcauccuuucuuaaa

SEQ ID NO: 214812 - RNA, 19 nt, Homo sapiens
gggcuacucauguccugua

SEQ ID NO: 214813 - RNA, 19 nt, Homo sapiens
uguauuaaguuggguccua

SEQ ID NO: 214814 - RNA, 19 nt, Homo sapiens
gagccuugcagaugugauu

SEQ ID NO: 214815 - RNA, 19 nt, Homo sapiens
cagcugagccuugcagaug

SEQ ID NO: 214816 - RNA, 19 nt, Homo sapiens
ucccuacaauuaagagauu

SEQ ID NO: 214817 - RNA, 19 nt, Homo sapiens
guaaccaccugcuguucca

SEQ ID NO: 214818 - RNA, 19 nt, Homo sapiens
ggcccaagcuccacuaucc

SEQ ID NO: 214819 - RNA, 19 nt, Homo sapiens
acagucaugucuuaaugga

SEQ ID NO: 214820 - RNA, 19 nt, Homo sapiens
gacaagcacaaucucuuug

SEQ ID NO: 214821 - RNA, 19 nt, Homo sapiens
gaucugauugggcuacuca

SEQ ID NO: 214822 - RNA, 19 nt, Homo sapiens
ccuaauauccugucugcau

SEQ ID NO: 214823 - RNA, 19 nt, Homo sapiens
ggaaacaaaagaacaguug

SEQ ID NO: 214824 - RNA, 19 nt, Homo sapiens
acaaguugcaggaugguaa

SEQ ID NO: 214825 - RNA, 19 nt, Homo sapiens
gacacuggaucugcuggaa

SEQ ID NO: 214826 - RNA, 19 nt, Homo sapiens
gagaggcugguauuuaagu

SEQ ID NO: 214827 - RNA, 19 nt, Homo sapiens
gagugacaguguguuccua

SEQ ID NO: 214828 - RNA, 19 nt, Homo sapiens
gagaaccgucuacaacauc

SEQ ID NO: 214829 - RNA, 19 nt, Homo sapiens
auuaagagauuccuugaac

SEQ ID NO: 214830 - RNA, 19 nt, Homo sapiens
acacagugaaacuaaguaa

SEQ ID NO: 214831 - RNA, 19 nt, Homo sapiens
uaauauccugucugcauuu

SEQ ID NO: 214832 - RNA, 19 nt, Homo sapiens
aguaaugaaugcaaucagu

SEQ ID NO: 214833 - RNA, 19 nt, Homo sapiens
uccuuauccuguucucuua

SEQ ID NO: 214834 - RNA, 19 nt, Homo sapiens
uuggagaggcugguauuua

SEQ ID NO: 214835 - RNA, 19 nt, Homo sapiens
aaaggaagugguuaacaug

SEQ ID NO: 214836 - RNA, 19 nt, Homo sapiens
ggagagaacccugauugac

SEQ ID NO: 214837 - RNA, 19 nt, Homo sapiens
caagugcccaugguugaaa

SEQ ID NO: 214838 - RNA, 19 nt, Homo sapiens
gguacagacccgaagcauu

SEQ ID NO: 214839 - RNA, 19 nt, Homo sapiens
uaaguugggucuuuugugu

SEQ ID NO: 214840 - RNA, 19 nt, Homo sapiens
gcugagccuugcagaugug

SEQ ID NO: 214841 - RNA, 19 nt, Homo sapiens
aaggagagaacccugauug

SEQ ID NO: 214842 - RNA, 19 nt, Homo sapiens
gcagacaagcacaaucucu

SEQ ID NO: 214843 - RNA, 19 nt, Homo sapiens
uaauaagaaugggcaggau

SEQ ID NO: 214844 - RNA, 19 nt, Homo sapiens
cccgaagcauucuccacua

SEQ ID NO: 214845 - RNA, 19 nt, Homo sapiens
gccaguucauccucauaau

SEQ ID NO: 214846 - RNA, 19 nt, Homo sapiens
agucgaguuugaugaagaa

SEQ ID NO: 214847 - RNA, 19 nt, Homo sapiens
uaggggaucuuuauuggaa

SEQ ID NO: 214848 - RNA, 19 nt, Homo sapiens
ggagucgaguuugaugaag

SEQ ID NO: 214849 - RNA, 19 nt, Homo sapiens
aaaaggaagugguuaacau

SEQ ID NO: 214850 - RNA, 19 nt, Homo sapiens
guucauccucauaauaaga

SEQ ID NO: 214851 - RNA, 19 nt, Homo sapiens
gugagaaccgucuacaaca

SEQ ID NO: 214852 - RNA, 19 nt, Homo sapiens
aaauugacgggaugaaguu

SEQ ID NO: 214853 - RNA, 19 nt, Homo sapiens
ggaacugcuuaucaugcau

SEQ ID NO: 214854 - RNA, 19 nt, Homo sapiens
ucuccugagugucuuucua

SEQ ID NO: 214855 - RNA, 19 nt, Homo sapiens
cuuguucucuccugagugu

SEQ ID NO: 214856 - RNA, 19 nt, Homo sapiens
gaagaucucugccuacaug

SEQ ID NO: 214857 - RNA, 19 nt, Homo sapiens
gagcagcauugacugguuu

SEQ ID NO: 214858 - RNA, 19 nt, Homo sapiens
gaagauucguguggacauu

SEQ ID NO: 214859 - RNA, 19 nt, Homo sapiens
ggcaugaucugcuacaauc

SEQ ID NO: 214860 - RNA, 19 nt, Homo sapiens
cugcuacaauccagaauuu

SEQ ID NO: 214861 - RNA, 19 nt, Homo sapiens
ggagcagcauugacugguu

SEQ ID NO: 214862 - RNA, 19 nt, Homo sapiens
caagaucacuuuuguagau

SEQ ID NO: 214863 - RNA, 19 nt, Homo sapiens
ggccaugguuugcaggaaa

SEQ ID NO: 214864 - RNA, 19 nt, Homo sapiens
caaaguacuuggaggaacu

SEQ ID NO: 214865 - RNA, 19 nt, Homo sapiens
gcaugaaggagcagcauug

SEQ ID NO: 214866 - RNA, 19 nt, Homo sapiens
uugagaaacugaagccaaa

SEQ ID NO: 214867 - RNA, 19 nt, Homo sapiens
gcuacaauccagaauuuga

SEQ ID NO: 214868 - RNA, 19 nt, Homo sapiens
cagcauggucccugccuua

SEQ ID NO: 214869 - RNA, 19 nt, Homo sapiens
ggacuucaucucccgcuuu

SEQ ID NO: 214870 - RNA, 19 nt, Homo sapiens
caggaaacaagaucacuuu

SEQ ID NO: 214871 - RNA, 19 nt, Homo sapiens
ucccaaaucugaaggacuu

SEQ ID NO: 214872 - RNA, 19 nt, Homo sapiens
ggaacucccugaaaagcua

SEQ ID NO: 214873 - RNA, 19 nt, Homo sapiens
gguugugucugcuuuaaag

SEQ ID NO: 214874 - RNA, 19 nt, Homo sapiens
ugaccuccaccguauauuu

SEQ ID NO: 214875 - RNA, 19 nt, Homo sapiens
gcaggaaacaagaucacuu

SEQ ID NO: 214876 - RNA, 19 nt, Homo sapiens
gggaagcggccaugguuug

SEQ ID NO: 214877 - RNA, 19 nt, Homo sapiens
gacuucaucucccgcuuug

SEQ ID NO: 214878 - RNA, 19 nt, Homo sapiens
ggccuggacuuucccaauc

SEQ ID NO: 214879 - RNA, 19 nt, Homo sapiens
ggaaguaaagccucaacca

SEQ ID NO: 214880 - RNA, 19 nt, Homo sapiens
guuccuuucuccuguuuau

SEQ ID NO: 214881 - RNA, 19 nt, Homo sapiens
gaccuccaccguauauuug

SEQ ID NO: 214882 - RNA, 19 nt, Homo sapiens
gacagaagaggagaagauu

SEQ ID NO: 214883 - RNA, 19 nt, Homo sapiens
gugguugugucugcuuuaa

SEQ ID NO: 214884 - RNA, 19 nt, Homo sapiens
gaaacugaagccaaaguac

SEQ ID NO: 214885 - RNA, 19 nt, Homo sapiens
ggaaacaagaucacuuuug

SEQ ID NO: 214886 - RNA, 19 nt, Homo sapiens
agaaacugaagccaaagua

SEQ ID NO: 214887 - RNA, 19 nt, Homo sapiens
caauccagaauuugagaaa

SEQ ID NO: 214888 - RNA, 19 nt, Homo sapiens
ugaaggagcagcauugacu

SEQ ID NO: 214889 - RNA, 19 nt, Homo sapiens
agacagaagaggagaagau

SEQ ID NO: 214890 - RNA, 19 nt, Homo sapiens
gaccuuccuuccuguuagu

SEQ ID NO: 214891 - RNA, 19 nt, Homo sapiens
gaucucugccuacaugaag

SEQ ID NO: 214892 - RNA, 19 nt, Homo sapiens
gagaaacugaagccaaagu

SEQ ID NO: 214893 - RNA, 19 nt, Homo sapiens
caagcugggccuggacuuu

SEQ ID NO: 214894 - RNA, 19 nt, Homo sapiens
gggcaugaucugcuacaau

SEQ ID NO: 214895 - RNA, 19 nt, Homo sapiens
ugaccuuccuuccuguuag

SEQ ID NO: 214896 - RNA, 19 nt, Homo sapiens
ccuguuuauucccaucuuu

SEQ ID NO: 214897 - RNA, 19 nt, Homo sapiens
ggagugaggagcccauacu

SEQ ID NO: 214898 - RNA, 19 nt, Homo sapiens
uuugagggcuuggagaaga

SEQ ID NO: 214899 - RNA, 19 nt, Homo sapiens
cagaagaggagaagauucg

SEQ ID NO: 214900 - RNA, 19 nt, Homo sapiens
gcuuugagggcuuggagaa

SEQ ID NO: 214901 - RNA, 19 nt, Homo sapiens
ggagacagaagaggagaag

SEQ ID NO: 214902 - RNA, 19 nt, Homo sapiens
ccaaucugcccuacuugau

SEQ ID NO: 214903 - RNA, 19 nt, Homo sapiens
aggccuaccugauggaagu

SEQ ID NO: 214904 - RNA, 19 nt, Homo sapiens
aaacugaagccaaaguacu

SEQ ID NO: 214905 - RNA, 19 nt, Homo sapiens
caugaaggagcagcauuga

SEQ ID NO: 214906 - RNA, 19 nt, Homo sapiens
uucccaaucugcccuacuu

SEQ ID NO: 214907 - RNA, 19 nt, Homo sapiens
gaagaucucugccuacaug

SEQ ID NO: 214908 - RNA, 19 nt, Homo sapiens
gagcagcauugacugguuu

SEQ ID NO: 214909 - RNA, 19 nt, Homo sapiens
caagaccuguguucucaaa

SEQ ID NO: 214910 - RNA, 19 nt, Homo sapiens
gaagauucguguggacauu

SEQ ID NO: 214911 - RNA, 19 nt, Homo sapiens
ggcaugaucugcuacaauc

SEQ ID NO: 214912 - RNA, 19 nt, Homo sapiens
cugcuacaauccagaauuu

SEQ ID NO: 214913 - RNA, 19 nt, Homo sapiens
ggagcagcauugacugguu

SEQ ID NO: 214914 - RNA, 19 nt, Homo sapiens
ggccaugguuugcaggaaa

SEQ ID NO: 214915 - RNA, 19 nt, Homo sapiens
caaaguacuuggaggaacu

SEQ ID NO: 214916 - RNA, 19 nt, Homo sapiens
gcaugaaggagcagcauug

SEQ ID NO: 214917 - RNA, 19 nt, Homo sapiens
uugagaaacugaagccaaa

SEQ ID NO: 214918 - RNA, 19 nt, Homo sapiens
gcuacaauccagaauuuga

SEQ ID NO: 214919 - RNA, 19 nt, Homo sapiens
cagcauggucccugccuua

SEQ ID NO: 214920 - RNA, 19 nt, Homo sapiens
ggaacucccugaaaagcua

SEQ ID NO: 214921 - RNA, 19 nt, Homo sapiens
gguugugucugcuuuaaag

SEQ ID NO: 214922 - RNA, 19 nt, Homo sapiens
agaccuguguucucaaaga

SEQ ID NO: 214923 - RNA, 19 nt, Homo sapiens
gggaagcggccaugguuug

SEQ ID NO: 214924 - RNA, 19 nt, Homo sapiens
ggccuggacuuucccaauc

SEQ ID NO: 214925 - RNA, 19 nt, Homo sapiens
ggaaguaaagccucaacca

SEQ ID NO: 214926 - RNA, 19 nt, Homo sapiens
guuccuuucuccuguuuau

SEQ ID NO: 214927 - RNA, 19 nt, Homo sapiens
cccaagaccuguguucuca

SEQ ID NO: 214928 - RNA, 19 nt, Homo sapiens
gaccuguguucucaaagau

SEQ ID NO: 214929 - RNA, 19 nt, Homo sapiens
gacagaagaggagaagauu

SEQ ID NO: 214930 - RNA, 19 nt, Homo sapiens
gugguugugucugcuuuaa

SEQ ID NO: 214931 - RNA, 19 nt, Homo sapiens
gaaacugaagccaaaguac

SEQ ID NO: 214932 - RNA, 19 nt, Homo sapiens
agaaacugaagccaaagua

SEQ ID NO: 214933 - RNA, 19 nt, Homo sapiens
caauccagaauuugagaaa

SEQ ID NO: 214934 - RNA, 19 nt, Homo sapiens
ugaaggagcagcauugacu

SEQ ID NO: 214935 - RNA, 19 nt, Homo sapiens
agacagaagaggagaagau

SEQ ID NO: 214936 - RNA, 19 nt, Homo sapiens
gaccuuccuuccuguuagu

SEQ ID NO: 214937 - RNA, 19 nt, Homo sapiens
gaucucugccuacaugaag

SEQ ID NO: 214938 - RNA, 19 nt, Homo sapiens
gagaaacugaagccaaagu

SEQ ID NO: 214939 - RNA, 19 nt, Homo sapiens
caagcugggccuggacuuu

SEQ ID NO: 214940 - RNA, 19 nt, Homo sapiens
gggcaugaucugcuacaau

SEQ ID NO: 214941 - RNA, 19 nt, Homo sapiens
ugaccuuccuuccuguuag

SEQ ID NO: 214942 - RNA, 19 nt, Homo sapiens
ccuguuuauucccaucuuu

SEQ ID NO: 214943 - RNA, 19 nt, Homo sapiens
ggagugaggagcccauacu

SEQ ID NO: 214944 - RNA, 19 nt, Homo sapiens
cagaagaggagaagauucg

SEQ ID NO: 214945 - RNA, 19 nt, Homo sapiens
ggagacagaagaggagaag

SEQ ID NO: 214946 - RNA, 19 nt, Homo sapiens
ccaaucugcccuacuugau

SEQ ID NO: 214947 - RNA, 19 nt, Homo sapiens
aggccuaccugauggaagu

SEQ ID NO: 214948 - RNA, 19 nt, Homo sapiens
aaacugaagccaaaguacu

SEQ ID NO: 214949 - RNA, 19 nt, Homo sapiens
caugaaggagcagcauuga

SEQ ID NO: 214950 - RNA, 19 nt, Homo sapiens
uucccaaucugcccuacuu

SEQ ID NO: 214951 - RNA, 19 nt, Homo sapiens
gaagaucucugccuacaug

SEQ ID NO: 214952 - RNA, 19 nt, Homo sapiens
ugagagaaaccaaguauuu

SEQ ID NO: 214953 - RNA, 19 nt, Homo sapiens
gagcagcauugacugguuu

SEQ ID NO: 214954 - RNA, 19 nt, Homo sapiens
gagagaaaccaaguauuug

SEQ ID NO: 214955 - RNA, 19 nt, Homo sapiens
ggagcagcauugacugguu

SEQ ID NO: 214956 - RNA, 19 nt, Homo sapiens
caagaucaccuuuguggau

SEQ ID NO: 214957 - RNA, 19 nt, Homo sapiens
gcaugaaggagcagcauug

SEQ ID NO: 214958 - RNA, 19 nt, Homo sapiens
aagcagccaugguuucuug

SEQ ID NO: 214959 - RNA, 19 nt, Homo sapiens
cagcauggucccugccuua

SEQ ID NO: 214960 - RNA, 19 nt, Homo sapiens
guaugcagcuggccaaacu

SEQ ID NO: 214961 - RNA, 19 nt, Homo sapiens
gcagauucgcgaagacauu

SEQ ID NO: 214962 - RNA, 19 nt, Homo sapiens
gguugugucugcuuuaaag

SEQ ID NO: 214963 - RNA, 19 nt, Homo sapiens
gcgaagacauuuuggagaa

SEQ ID NO: 214964 - RNA, 19 nt, Homo sapiens
agagaaaccaaguauuuga

SEQ ID NO: 214965 - RNA, 19 nt, Homo sapiens
uggccaaacucugcuauga

SEQ ID NO: 214966 - RNA, 19 nt, Homo sapiens
aguaaagccucaaccacaa

SEQ ID NO: 214967 - RNA, 19 nt, Homo sapiens
ggccuggacuuucccaauc

SEQ ID NO: 214968 - RNA, 19 nt, Homo sapiens
guaaagccucaaccacaaa

SEQ ID NO: 214969 - RNA, 19 nt, Homo sapiens
ggaaguaaagccucaacca

SEQ ID NO: 214970 - RNA, 19 nt, Homo sapiens
guuccuuucuccuguuuau

SEQ ID NO: 214971 - RNA, 19 nt, Homo sapiens
gaucaccuuuguggauuuc

SEQ ID NO: 214972 - RNA, 19 nt, Homo sapiens
gugguugugucugcuuuaa

SEQ ID NO: 214973 - RNA, 19 nt, Homo sapiens
aagaucaccuuuguggauu

SEQ ID NO: 214974 - RNA, 19 nt, Homo sapiens
ugaaggagcagcauugacu

SEQ ID NO: 214975 - RNA, 19 nt, Homo sapiens
ggaagcagccaugguuucu

SEQ ID NO: 214976 - RNA, 19 nt, Homo sapiens
gaccuuccuuccuguuagu

SEQ ID NO: 214977 - RNA, 19 nt, Homo sapiens
cagauucgcgaagacauuu

SEQ ID NO: 214978 - RNA, 19 nt, Homo sapiens
gaucucugccuacaugaag

SEQ ID NO: 214979 - RNA, 19 nt, Homo sapiens
gagaaaccaaguauuugag

SEQ ID NO: 214980 - RNA, 19 nt, Homo sapiens
caagcugggccuggacuuu

SEQ ID NO: 214981 - RNA, 19 nt, Homo sapiens
gggaagcagccaugguuuc

SEQ ID NO: 214982 - RNA, 19 nt, Homo sapiens
ugaccuuccuuccuguuag

SEQ ID NO: 214983 - RNA, 19 nt, Homo sapiens
ccuguuuauucccaucuuu

SEQ ID NO: 214984 - RNA, 19 nt, Homo sapiens
ggagugaggagcccauacu

SEQ ID NO: 214985 - RNA, 19 nt, Homo sapiens
uuugagggcuuggagaaga

SEQ ID NO: 214986 - RNA, 19 nt, Homo sapiens
uuguggauuucaucgcuua

SEQ ID NO: 214987 - RNA, 19 nt, Homo sapiens
augauguccuugagagaaa

SEQ ID NO: 214988 - RNA, 19 nt, Homo sapiens
gagcagauucgcgaagaca

SEQ ID NO: 214989 - RNA, 19 nt, Homo sapiens
agaucaccuuuguggauuu

SEQ ID NO: 214990 - RNA, 19 nt, Homo sapiens
uaugauguccuugagagaa

SEQ ID NO: 214991 - RNA, 19 nt, Homo sapiens
ccaaucugcccuacuugau

SEQ ID NO: 214992 - RNA, 19 nt, Homo sapiens
aggccuaccugauggaagu

SEQ ID NO: 214993 - RNA, 19 nt, Homo sapiens
gaagcagccaugguuucuu

SEQ ID NO: 214994 - RNA, 19 nt, Homo sapiens
caugaaggagcagcauuga

SEQ ID NO: 214995 - RNA, 19 nt, Homo sapiens
uggagaaccaguuuaugga

SEQ ID NO: 214996 - RNA, 19 nt, Homo sapiens
ggagcagauucgcgaagac

SEQ ID NO: 214997 - RNA, 19 nt, Homo sapiens
uucccaaucugcccuacuu

SEQ ID NO: 214998 - RNA, 19 nt, Homo sapiens
acacaaagcuguugaaaua

SEQ ID NO: 214999 - RNA, 19 nt, Homo sapiens
gaaaaucgcugccuacuua

SEQ ID NO: 215000 - RNA, 19 nt, Homo sapiens
gacaauugcuuacucauua

SEQ ID NO: 215001 - RNA, 19 nt, Homo sapiens
ggagagagcagguguguua

SEQ ID NO: 215002 - RNA, 19 nt, Homo sapiens
gaucagaaccguauauuug

SEQ ID NO: 215003 - RNA, 19 nt, Homo sapiens
ggucagcgcucuugcuuug

SEQ ID NO: 215004 - RNA, 19 nt, Homo sapiens
gagcagguguguuaaaugg

SEQ ID NO: 215005 - RNA, 19 nt, Homo sapiens
gaguuucucuuggguauaa

SEQ ID NO: 215006 - RNA, 19 nt, Homo sapiens
ggagaaucaucaagauaug

SEQ ID NO: 215007 - RNA, 19 nt, Homo sapiens
ggaauaggcagacauuuca

SEQ ID NO: 215008 - RNA, 19 nt, Homo sapiens
ccaagugccuggaugaguu

SEQ ID NO: 215009 - RNA, 19 nt, Homo sapiens
gggaagcuccugacuauga

SEQ ID NO: 215010 - RNA, 19 nt, Homo sapiens
gggaaauucucaugguuug

SEQ ID NO: 215011 - RNA, 19 nt, Homo sapiens
caauagaguugggacaauu

SEQ ID NO: 215012 - RNA, 19 nt, Homo sapiens
gagagcagguguguuaaau

SEQ ID NO: 215013 - RNA, 19 nt, Homo sapiens
gaccuggacuuuccuaauc

SEQ ID NO: 215014 - RNA, 19 nt, Homo sapiens
ggacaauugcuuacucauu

SEQ ID NO: 215015 - RNA, 19 nt, Homo sapiens
ccagagcaaugccaucuug

SEQ ID NO: 215016 - RNA, 19 nt, Homo sapiens
gauaggcuguggaaauuag

SEQ ID NO: 215017 - RNA, 19 nt, Homo sapiens
caucauagagaaccaagua

SEQ ID NO: 215018 - RNA, 19 nt, Homo sapiens
uuacagcucugaccacgaa

SEQ ID NO: 215019 - RNA, 19 nt, Homo sapiens
gaguggacaucauagagaa

SEQ ID NO: 215020 - RNA, 19 nt, Homo sapiens
ucacggauaccucuuauga

SEQ ID NO: 215021 - RNA, 19 nt, Homo sapiens
gaauuuaaggcccaacauu

SEQ ID NO: 215022 - RNA, 19 nt, Homo sapiens
aaggauauguggagaauca

SEQ ID NO: 215023 - RNA, 19 nt, Homo sapiens
gaagacugggugaggauaa

SEQ ID NO: 215024 - RNA, 19 nt, Homo sapiens
caacauguguggugagacu

SEQ ID NO: 215025 - RNA, 19 nt, Homo sapiens
ggaaggauaggcuguggaa

SEQ ID NO: 215026 - RNA, 19 nt, Homo sapiens
aaacgagauugcacaguug

SEQ ID NO: 215027 - RNA, 19 nt, Homo sapiens
gcucacaguuucccuaguc

SEQ ID NO: 215028 - RNA, 19 nt, Homo sapiens
cuggacaacugaaacaauu

SEQ ID NO: 215029 - RNA, 19 nt, Homo sapiens
ggaucagaaccguauauuu

SEQ ID NO: 215030 - RNA, 19 nt, Homo sapiens
ggaagcuccugacuaugau

SEQ ID NO: 215031 - RNA, 19 nt, Homo sapiens
aauuuaaggcccaacauua

SEQ ID NO: 215032 - RNA, 19 nt, Homo sapiens
caaggaauaggcagacauu

SEQ ID NO: 215033 - RNA, 19 nt, Homo sapiens
aggauaggcuguggaaauu

SEQ ID NO: 215034 - RNA, 19 nt, Homo sapiens
gaggauaacacaaguaaaa

SEQ ID NO: 215035 - RNA, 19 nt, Homo sapiens
gcccaacauuaaacacaaa

SEQ ID NO: 215036 - RNA, 19 nt, Homo sapiens
agaaccaaguaauggauuu

SEQ ID NO: 215037 - RNA, 19 nt, Homo sapiens
caagcuagaccuggacuuu

SEQ ID NO: 215038 - RNA, 19 nt, Homo sapiens
gaguugggacaauugcuua

SEQ ID NO: 215039 - RNA, 19 nt, Homo sapiens
gugaggauaacacaaguaa

SEQ ID NO: 215040 - RNA, 19 nt, Homo sapiens
ggauaggcuguggaaauua

SEQ ID NO: 215041 - RNA, 19 nt, Homo sapiens
gauaaaggcaguauuucag

SEQ ID NO: 215042 - RNA, 19 nt, Homo sapiens
ugugauaaaggcaguauuu

SEQ ID NO: 215043 - RNA, 19 nt, Homo sapiens
ucucaccuaugauaucuug

SEQ ID NO: 215044 - RNA, 19 nt, Homo sapiens
caacugauaaggcucuguu

SEQ ID NO: 215045 - RNA, 19 nt, Homo sapiens
ggcccaacauuaaacacaa

SEQ ID NO: 215046 - RNA, 19 nt, Homo sapiens
gagaguggguacuagaaaa

SEQ ID NO: 215047 - RNA, 19 nt, Homo sapiens
guucucggguacugggaua

SEQ ID NO: 215048 - RNA, 19 nt, Homo sapiens
cauagagaaccaaguaaug

SEQ ID NO: 215049 - RNA, 19 nt, Homo sapiens
ggaagcccgucaccauguc

SEQ ID NO: 215050 - RNA, 19 nt, Homo sapiens
guguacacaugggaguuua

SEQ ID NO: 215051 - RNA, 19 nt, Homo sapiens
cugaaacaauucuccaugu

SEQ ID NO: 215052 - RNA, 19 nt, Homo sapiens
gagaaccaaguaauggauu

SEQ ID NO: 215053 - RNA, 19 nt, Homo sapiens
guucacggauaccucuuau

SEQ ID NO: 215054 - RNA, 19 nt, Homo sapiens
guggagaaucaucaagaua

SEQ ID NO: 215055 - RNA, 19 nt, Homo sapiens
ugauaaaggcaguauuuca

SEQ ID NO: 215056 - RNA, 19 nt, Homo sapiens
acaugggaguuuaguguga

SEQ ID NO: 215057 - RNA, 19 nt, Homo sapiens
aaaacgagauugcacaguu

SEQ ID NO: 215058 - RNA, 19 nt, Homo sapiens
uggagaaucaucaagauau

SEQ ID NO: 215059 - RNA, 19 nt, Homo sapiens
gcuuugcucuuuucaauga

SEQ ID NO: 215060 - RNA, 19 nt, Homo sapiens
agagcuaccuggacaacug

SEQ ID NO: 215061 - RNA, 19 nt, Homo sapiens
gauucgaguggacaucaua

SEQ ID NO: 215062 - RNA, 19 nt, Homo sapiens
aaacugugguacugaugga

SEQ ID NO: 215063 - RNA, 19 nt, Homo sapiens
caaggcugcugaggaagga

SEQ ID NO: 215064 - RNA, 19 nt, Homo sapiens
gauauguggagaaucauca

SEQ ID NO: 215065 - RNA, 19 nt, Homo sapiens
ucugaucaguucugcaaga

SEQ ID NO: 215066 - RNA, 19 nt, Homo sapiens
guggugagacugaagaaga

SEQ ID NO: 215067 - RNA, 19 nt, Homo sapiens
ggacaacugaaacaauucu

SEQ ID NO: 215068 - RNA, 19 nt, Homo sapiens
uggugagacugaagaagaa

SEQ ID NO: 215069 - RNA, 19 nt, Homo sapiens
caagauaugaauugaaucg

SEQ ID NO: 215070 - RNA, 19 nt, Homo sapiens
aagcucaccuuuguggauu

SEQ ID NO: 215071 - RNA, 19 nt, Homo sapiens
gauuuccgcacacaacuga

SEQ ID NO: 215072 - RNA, 19 nt, Homo sapiens
gaaccaaguaauggauuuc

SEQ ID NO: 215073 - RNA, 19 nt, Homo sapiens
cgaguggacaucauagaga

SEQ ID NO: 215074 - RNA, 19 nt, Homo sapiens
caagaucacccagagcaau

SEQ ID NO: 215075 - RNA, 19 nt, Homo sapiens
aaggauaggcuguggaaau

SEQ ID NO: 215076 - RNA, 19 nt, Homo sapiens
acuugacacuauucacuaa

SEQ ID NO: 215077 - RNA, 19 nt, Homo sapiens
gcuccugacuaugaucgaa

SEQ ID NO: 215078 - RNA, 19 nt, Homo sapiens
cuuacagucugaucaguuc

SEQ ID NO: 215079 - RNA, 19 nt, Homo sapiens
gggcuagccaauagaguug

SEQ ID NO: 215080 - RNA, 19 nt, Homo sapiens
cggaaaccguccuguguac

SEQ ID NO: 215081 - RNA, 19 nt, Homo sapiens
uucaagggcuguagguuca

SEQ ID NO: 215082 - RNA, 19 nt, Homo sapiens
gagcuaccuggacaacuga

SEQ ID NO: 215083 - RNA, 19 nt, Homo sapiens
ugagaguggguacuagaaa

SEQ ID NO: 215084 - RNA, 19 nt, Homo sapiens
caagggcuguagguucaug

SEQ ID NO: 215085 - RNA, 19 nt, Homo sapiens
ggaggcaagggacggagaa

SEQ ID NO: 215086 - RNA, 19 nt, Homo sapiens
ucauagagaaccaaguaau

SEQ ID NO: 215087 - RNA, 19 nt, Homo sapiens
guaaaacugugguacugau

SEQ ID NO: 215088 - RNA, 19 nt, Homo sapiens
gagagagcagguguguuaa

SEQ ID NO: 215089 - RNA, 19 nt, Homo sapiens
cggggaagcuccugacuau

SEQ ID NO: 215090 - RNA, 19 nt, Homo sapiens
ccaauggcuggaugugaaa

SEQ ID NO: 215091 - RNA, 19 nt, Homo sapiens
gaugggaagaacaagauca

SEQ ID NO: 215092 - RNA, 19 nt, Homo sapiens
cuggugggcuagccaauag

SEQ ID NO: 215093 - RNA, 19 nt, Homo sapiens
ucggaaaccguccugugua

SEQ ID NO: 215094 - RNA, 19 nt, Homo sapiens
ggugaggauaacacaagua

SEQ ID NO: 215095 - RNA, 19 nt, Homo sapiens
cugaguuucucuuggguau

SEQ ID NO: 215096 - RNA, 19 nt, Homo sapiens
gaagagcuaccuggacaac

SEQ ID NO: 215097 - RNA, 19 nt, Homo sapiens
agagagcagguguguuaaa

SEQ ID NO: 215098 - RNA, 19 nt, Homo sapiens
gaagaucucugccuacaug

SEQ ID NO: 215099 - RNA, 19 nt, Homo sapiens
gaagauucguguggacauu

SEQ ID NO: 215100 - RNA, 19 nt, Homo sapiens
ccaaucagcuggccagagu

SEQ ID NO: 215101 - RNA, 19 nt, Homo sapiens
ugacagcauugacugguuu

SEQ ID NO: 215102 - RNA, 19 nt, Homo sapiens
ggaccuugcucccugaaca

SEQ ID NO: 215103 - RNA, 19 nt, Homo sapiens
gaagugacgaccuugaaga

SEQ ID NO: 215104 - RNA, 19 nt, Homo sapiens
gaagugacgaccuugaaga

SEQ ID NO: 215105 - RNA, 19 nt, Homo sapiens
cagaggaggucgcaguuca

SEQ ID NO: 215106 - RNA, 19 nt, Homo sapiens
gguuguaucugcuuugaag

SEQ ID NO: 215107 - RNA, 19 nt, Homo sapiens
ucccaaaucugaaggacuu

SEQ ID NO: 215108 - RNA, 19 nt, Homo sapiens
ugaccuccaccguauauuu

SEQ ID NO: 215109 - RNA, 19 nt, Homo sapiens
gaaacugaagccagaauac

SEQ ID NO: 215110 - RNA, 19 nt, Homo sapiens
ggccuggacuuucccaauc

SEQ ID NO: 215111 - RNA, 19 nt, Homo sapiens
guuccuuucuccuguuuau

SEQ ID NO: 215112 - RNA, 19 nt, Homo sapiens
gaccuccaccguauauuug

SEQ ID NO: 215113 - RNA, 19 nt, Homo sapiens
cagaauacuuggaggaacu

SEQ ID NO: 215114 - RNA, 19 nt, Homo sapiens
gacagaagaggagaagauu

SEQ ID NO: 215115 - RNA, 19 nt, Homo sapiens
gguuggaagugacgaccuu

SEQ ID NO: 215116 - RNA, 19 nt, Homo sapiens
gguuggaagugacgaccuu

SEQ ID NO: 215117 - RNA, 19 nt, Homo sapiens
agaaacugaagccagaaua

SEQ ID NO: 215118 - RNA, 19 nt, Homo sapiens
agacagaagaggagaagau

SEQ ID NO: 215119 - RNA, 19 nt, Homo sapiens
ggaagugacgaccuugaag

SEQ ID NO: 215120 - RNA, 19 nt, Homo sapiens
ggaagugacgaccuugaag

SEQ ID NO: 215121 - RNA, 19 nt, Homo sapiens
gaccuuccuuccuguuagu

SEQ ID NO: 215122 - RNA, 19 nt, Homo sapiens
cguguugcaugacagcauu

SEQ ID NO: 215123 - RNA, 19 nt, Homo sapiens
gugguuguaucugcuuuga

SEQ ID NO: 215124 - RNA, 19 nt, Homo sapiens
gaucucugccuacaugaag

SEQ ID NO: 215125 - RNA, 19 nt, Homo sapiens
gagguggcgguggaucuua

SEQ ID NO: 215126 - RNA, 19 nt, Homo sapiens
gagaaacugaagccagaau

SEQ ID NO: 215127 - RNA, 19 nt, Homo sapiens
caagcugggccuggacuuu

SEQ ID NO: 215128 - RNA, 19 nt, Homo sapiens
ugaccuuccuuccuguuag

SEQ ID NO: 215129 - RNA, 19 nt, Homo sapiens
ccuguuuauucccaucuuu

SEQ ID NO: 215130 - RNA, 19 nt, Homo sapiens
ggagugaggagcccauacu

SEQ ID NO: 215131 - RNA, 19 nt, Homo sapiens
uauuugagcccaacugcuu

SEQ ID NO: 215132 - RNA, 19 nt, Homo sapiens
uuugagggcuuggagaaga

SEQ ID NO: 215133 - RNA, 19 nt, Homo sapiens
cagaagaggagaagauucg

SEQ ID NO: 215134 - RNA, 19 nt, Homo sapiens
gacagcauugacugguuua

SEQ ID NO: 215135 - RNA, 19 nt, Homo sapiens
ggagguggcgguggaucuu

SEQ ID NO: 215136 - RNA, 19 nt, Homo sapiens
gcuuugagggcuuggagaa

SEQ ID NO: 215137 - RNA, 19 nt, Homo sapiens
ggagacagaagaggagaag

SEQ ID NO: 215138 - RNA, 19 nt, Homo sapiens
ccaaucugcccuacuugau

SEQ ID NO: 215139 - RNA, 19 nt, Homo sapiens
gccagaauacuuggaggaa

SEQ ID NO: 215140 - RNA, 19 nt, Homo sapiens
uucccaaucugcccuacuu

SEQ ID NO: 215141 - RNA, 19 nt, Homo sapiens
gaagagauuugccuuugaa

SEQ ID NO: 215142 - RNA, 19 nt, Homo sapiens
caaauuuccuacagccuua

SEQ ID NO: 215143 - RNA, 19 nt, Homo sapiens
gcuaagggaugcucagaug

SEQ ID NO: 215144 - RNA, 19 nt, Homo sapiens
ccaauucccauaacagaua

SEQ ID NO: 215145 - RNA, 19 nt, Homo sapiens
cagaagagauuugccuuug

SEQ ID NO: 215146 - RNA, 19 nt, Homo sapiens
gaagauucguguggacauu

SEQ ID NO: 215147 - RNA, 19 nt, Homo sapiens
gaaggaggcauccaccaaa

SEQ ID NO: 215148 - RNA, 19 nt, Homo sapiens
ccaaucagcuggccagagu

SEQ ID NO: 215149 - RNA, 19 nt, Homo sapiens
cagaagacagcaaagauuu

SEQ ID NO: 215150 - RNA, 19 nt, Homo sapiens
ggaccuugcucccugaaca

SEQ ID NO: 215151 - RNA, 19 nt, Homo sapiens
gaagugacgaccuugaaga

SEQ ID NO: 215152 - RNA, 19 nt, Homo sapiens
gaagugacgaccuugaaga

SEQ ID NO: 215153 - RNA, 19 nt, Homo sapiens
cagcaaagauuuccuucag

SEQ ID NO: 215154 - RNA, 19 nt, Homo sapiens
gagguuuccuguggcauaa

SEQ ID NO: 215155 - RNA, 19 nt, Homo sapiens
cagaggaggucgcaguuca

SEQ ID NO: 215156 - RNA, 19 nt, Homo sapiens
gccuuuagccucugaauga

SEQ ID NO: 215157 - RNA, 19 nt, Homo sapiens
caacuugacugggcuaagg

SEQ ID NO: 215158 - RNA, 19 nt, Homo sapiens
agaagagauuugccuuuga

SEQ ID NO: 215159 - RNA, 19 nt, Homo sapiens
ggacuucaucucccgcuuu

SEQ ID NO: 215160 - RNA, 19 nt, Homo sapiens
agacaggaagggugaauuu

SEQ ID NO: 215161 - RNA, 19 nt, Homo sapiens
ucccaaaucugaaggacuu

SEQ ID NO: 215162 - RNA, 19 nt, Homo sapiens
ucagaagacagcaaagauu

SEQ ID NO: 215163 - RNA, 19 nt, Homo sapiens
ggcauaaugugauggucaa

SEQ ID NO: 215164 - RNA, 19 nt, Homo sapiens
gaucagggacuaacaccau

SEQ ID NO: 215165 - RNA, 19 nt, Homo sapiens
ugaccuccaccguauauuu

SEQ ID NO: 215166 - RNA, 19 nt, Homo sapiens
gaaugauaccacuggcuuu

SEQ ID NO: 215167 - RNA, 19 nt, Homo sapiens
gacuucaucucccgcuuug

SEQ ID NO: 215168 - RNA, 19 nt, Homo sapiens
gaaacugaagccagaauac

SEQ ID NO: 215169 - RNA, 19 nt, Homo sapiens
ggccuggacuuucccaauc

SEQ ID NO: 215170 - RNA, 19 nt, Homo sapiens
acacacaaauuuccuacag

SEQ ID NO: 215171 - RNA, 19 nt, Homo sapiens
gaccuccaccguauauuug

SEQ ID NO: 215172 - RNA, 19 nt, Homo sapiens
cagaauacuuggaggaacu

SEQ ID NO: 215173 - RNA, 19 nt, Homo sapiens
aagauuuccuucagcaaug

SEQ ID NO: 215174 - RNA, 19 nt, Homo sapiens
ccagaagagauuugccuuu

SEQ ID NO: 215175 - RNA, 19 nt, Homo sapiens
gacagaagaggagaagauu

SEQ ID NO: 215176 - RNA, 19 nt, Homo sapiens
gaauuugaccucucugacu

SEQ ID NO: 215177 - RNA, 19 nt, Homo sapiens
acaggaagggugaauuuga

SEQ ID NO: 215178 - RNA, 19 nt, Homo sapiens
ugaaucagaagacagcaaa

SEQ ID NO: 215179 - RNA, 19 nt, Homo sapiens
gguuggaagugacgaccuu

SEQ ID NO: 215180 - RNA, 19 nt, Homo sapiens
gguuggaagugacgaccuu

SEQ ID NO: 215181 - RNA, 19 nt, Homo sapiens
gauggcagguaaaaucauu

SEQ ID NO: 215182 - RNA, 19 nt, Homo sapiens
agaaacugaagccagaaua

SEQ ID NO: 215183 - RNA, 19 nt, Homo sapiens
ggaagugacgaccuugaag

SEQ ID NO: 215184 - RNA, 19 nt, Homo sapiens
ggaggcauccaccaaacug

SEQ ID NO: 215185 - RNA, 19 nt, Homo sapiens
ggaagugacgaccuugaag

SEQ ID NO: 215186 - RNA, 19 nt, Homo sapiens
ugagguuuccuguggcaua

SEQ ID NO: 215187 - RNA, 19 nt, Homo sapiens
agacagaagaggagaagau

SEQ ID NO: 215188 - RNA, 19 nt, Homo sapiens
caggaagggugaauuugac

SEQ ID NO: 215189 - RNA, 19 nt, Homo sapiens
gaggguguuuccagaagag

SEQ ID NO: 215190 - RNA, 19 nt, Homo sapiens
augcucagauggcagguaa

SEQ ID NO: 215191 - RNA, 19 nt, Homo sapiens
gguuuccuguggcauaaug

SEQ ID NO: 215192 - RNA, 19 nt, Homo sapiens
ugaaggaggcauccaccaa

SEQ ID NO: 215193 - RNA, 19 nt, Homo sapiens
aaagauuuccuucagcaau

SEQ ID NO: 215194 - RNA, 19 nt, Homo sapiens
ugaggguguuuccagaaga

SEQ ID NO: 215195 - RNA, 19 nt, Homo sapiens
gagaaacugaagccagaau

SEQ ID NO: 215196 - RNA, 19 nt, Homo sapiens
gagguggcgguggaucuua

SEQ ID NO: 215197 - RNA, 19 nt, Homo sapiens
caauucccauaacagauag

SEQ ID NO: 215198 - RNA, 19 nt, Homo sapiens
gugaggguguuuccagaag

SEQ ID NO: 215199 - RNA, 19 nt, Homo sapiens
caagcugggccuggacuuu

SEQ ID NO: 215200 - RNA, 19 nt, Homo sapiens
uauuugagcccaacugcuu

SEQ ID NO: 215201 - RNA, 19 nt, Homo sapiens
cuucuucacuccaaaauug

SEQ ID NO: 215202 - RNA, 19 nt, Homo sapiens
gcagaucaugggacuucuu

SEQ ID NO: 215203 - RNA, 19 nt, Homo sapiens
uggcuuuccugcuucucua

SEQ ID NO: 215204 - RNA, 19 nt, Homo sapiens
cauaaugugauggucaauu

SEQ ID NO: 215205 - RNA, 19 nt, Homo sapiens
gacaggaagggugaauuug

SEQ ID NO: 215206 - RNA, 19 nt, Homo sapiens
cagaagaggagaagauucg

SEQ ID NO: 215207 - RNA, 19 nt, Homo sapiens
ggagguggcgguggaucuu

SEQ ID NO: 215208 - RNA, 19 nt, Homo sapiens
gguguuuccagaagagauu

SEQ ID NO: 215209 - RNA, 19 nt, Homo sapiens
guaaaaucauugugcuugu

SEQ ID NO: 215210 - RNA, 19 nt, Homo sapiens
ggagacagaagaggagaag

SEQ ID NO: 215211 - RNA, 19 nt, Homo sapiens
gggugaauuugaccucucu

SEQ ID NO: 215212 - RNA, 19 nt, Homo sapiens
caaagauuuccuucagcaa

SEQ ID NO: 215213 - RNA, 19 nt, Homo sapiens
gaagacagcaaagauuucc

SEQ ID NO: 215214 - RNA, 19 nt, Homo sapiens
ccaaucugcccuacuugau

SEQ ID NO: 215215 - RNA, 19 nt, Homo sapiens
ugagccaauucccauaaca

SEQ ID NO: 215216 - RNA, 19 nt, Homo sapiens
gggacuucuucacuccaaa

SEQ ID NO: 215217 - RNA, 19 nt, Homo sapiens
cagacuugaucagggacua

SEQ ID NO: 215218 - RNA, 19 nt, Homo sapiens
agauuuccuucagcaauga

SEQ ID NO: 215219 - RNA, 19 nt, Homo sapiens
agacagcaaagauuuccuu

SEQ ID NO: 215220 - RNA, 19 nt, Homo sapiens
aaucagaagacagcaaaga

SEQ ID NO: 215221 - RNA, 19 nt, Homo sapiens
gugaauuugaccucucuga

SEQ ID NO: 215222 - RNA, 19 nt, Homo sapiens
ugucagggcccagagagaa

SEQ ID NO: 215223 - RNA, 19 nt, Homo sapiens
gccagaauacuuggaggaa

SEQ ID NO: 215224 - RNA, 19 nt, Homo sapiens
ugugagccaauucccauaa

SEQ ID NO: 215225 - RNA, 19 nt, Homo sapiens
uucccaaucugcccuacuu

SEQ ID NO: 215226 - RNA, 19 nt, Homo sapiens
ccuguggcauaaugugaug

SEQ ID NO: 215227 - RNA, 19 nt, Homo sapiens
gaagaucucugccuacaug

SEQ ID NO: 215228 - RNA, 19 nt, Homo sapiens
gaagauucguguggacauu

SEQ ID NO: 215229 - RNA, 19 nt, Homo sapiens
ccaaucagcuggccagagu

SEQ ID NO: 215230 - RNA, 19 nt, Homo sapiens
ugacagcauugacugguuu

SEQ ID NO: 215231 - RNA, 19 nt, Homo sapiens
ggaccuugcucccugaaca

SEQ ID NO: 215232 - RNA, 19 nt, Homo sapiens
gaagugacgaccuugaaga

SEQ ID NO: 215233 - RNA, 19 nt, Homo sapiens
gaagugacgaccuugaaga

SEQ ID NO: 215234 - RNA, 19 nt, Homo sapiens
cagaggaggucgcaguuca

SEQ ID NO: 215235 - RNA, 19 nt, Homo sapiens
gguuguaucugcuuugaag

SEQ ID NO: 215236 - RNA, 19 nt, Homo sapiens
ggccuggacuuucccaaug

SEQ ID NO: 215237 - RNA, 19 nt, Homo sapiens
ucccaaaucugaaggacuu

SEQ ID NO: 215238 - RNA, 19 nt, Homo sapiens
ugaccuccaccguauauuu

SEQ ID NO: 215239 - RNA, 19 nt, Homo sapiens
gaaacugaagccagaauac

SEQ ID NO: 215240 - RNA, 19 nt, Homo sapiens
guuccuuucuccuguuuau

SEQ ID NO: 215241 - RNA, 19 nt, Homo sapiens
gaccuccaccguauauuug

SEQ ID NO: 215242 - RNA, 19 nt, Homo sapiens
cagaauacuuggaggaacu

SEQ ID NO: 215243 - RNA, 19 nt, Homo sapiens
gacagaagaggagaagauu

SEQ ID NO: 215244 - RNA, 19 nt, Homo sapiens
gguuggaagugacgaccuu

SEQ ID NO: 215245 - RNA, 19 nt, Homo sapiens
gguuggaagugacgaccuu

SEQ ID NO: 215246 - RNA, 19 nt, Homo sapiens
agaaacugaagccagaaua

SEQ ID NO: 215247 - RNA, 19 nt, Homo sapiens
agacagaagaggagaagau

SEQ ID NO: 215248 - RNA, 19 nt, Homo sapiens
ggaagugacgaccuugaag

SEQ ID NO: 215249 - RNA, 19 nt, Homo sapiens
ggaagugacgaccuugaag

SEQ ID NO: 215250 - RNA, 19 nt, Homo sapiens
gaccuuccuuccuguuagu

SEQ ID NO: 215251 - RNA, 19 nt, Homo sapiens
cguguugcaugacagcauu

SEQ ID NO: 215252 - RNA, 19 nt, Homo sapiens
gugguuguaucugcuuuga

SEQ ID NO: 215253 - RNA, 19 nt, Homo sapiens
gaucucugccuacaugaag

SEQ ID NO: 215254 - RNA, 19 nt, Homo sapiens
gagaaacugaagccagaau

SEQ ID NO: 215255 - RNA, 19 nt, Homo sapiens
gagguggcgguggaucuua

SEQ ID NO: 215256 - RNA, 19 nt, Homo sapiens
caagcugggccuggacuuu

SEQ ID NO: 215257 - RNA, 19 nt, Homo sapiens
ugaccuuccuuccuguuag

SEQ ID NO: 215258 - RNA, 19 nt, Homo sapiens
ccuguuuauucccaucuuu

SEQ ID NO: 215259 - RNA, 19 nt, Homo sapiens
ggagugaggagcccauacu

SEQ ID NO: 215260 - RNA, 19 nt, Homo sapiens
uauuugagcccaacugcuu

SEQ ID NO: 215261 - RNA, 19 nt, Homo sapiens
uuugagggcuuggagaaga

SEQ ID NO: 215262 - RNA, 19 nt, Homo sapiens
cagaagaggagaagauucg

SEQ ID NO: 215263 - RNA, 19 nt, Homo sapiens
gccuggacuuucccaaugu

SEQ ID NO: 215264 - RNA, 19 nt, Homo sapiens
gacagcauugacugguuua

SEQ ID NO: 215265 - RNA, 19 nt, Homo sapiens
ggagguggcgguggaucuu

SEQ ID NO: 215266 - RNA, 19 nt, Homo sapiens
gcuuugagggcuuggagaa

SEQ ID NO: 215267 - RNA, 19 nt, Homo sapiens
ggagacagaagaggagaag

SEQ ID NO: 215268 - RNA, 19 nt, Homo sapiens
gccagaauacuuggaggaa

SEQ ID NO: 215269 - RNA, 19 nt, Homo sapiens
gaagaucucugccuacaug

SEQ ID NO: 215270 - RNA, 19 nt, Homo sapiens
ggaccugccuucuuccuuu

SEQ ID NO: 215271 - RNA, 19 nt, Homo sapiens
ucaugacacuucucaauaa

SEQ ID NO: 215272 - RNA, 19 nt, Homo sapiens
ucaggcagguucauaaauu

SEQ ID NO: 215273 - RNA, 19 nt, Homo sapiens
gaaagucagcuacauggaa

SEQ ID NO: 215274 - RNA, 19 nt, Homo sapiens
gaagauucguguggacauu

SEQ ID NO: 215275 - RNA, 19 nt, Homo sapiens
ugacaugaagcguauauuu

SEQ ID NO: 215276 - RNA, 19 nt, Homo sapiens
aaacguaucccaccguauu

SEQ ID NO: 215277 - RNA, 19 nt, Homo sapiens
ccaaguuccucacucauuc

SEQ ID NO: 215278 - RNA, 19 nt, Homo sapiens
ggucauuucugcccucuag

SEQ ID NO: 215279 - RNA, 19 nt, Homo sapiens
gacaugaagcguauauuug

SEQ ID NO: 215280 - RNA, 19 nt, Homo sapiens
agacuucccugaucuagau

SEQ ID NO: 215281 - RNA, 19 nt, Homo sapiens
caggcagguucauaaauuu

SEQ ID NO: 215282 - RNA, 19 nt, Homo sapiens
caugacacuucucaauaaa

SEQ ID NO: 215283 - RNA, 19 nt, Homo sapiens
guucauaaauuuccuuggu

SEQ ID NO: 215284 - RNA, 19 nt, Homo sapiens
ccucaaagaccaucuguau

SEQ ID NO: 215285 - RNA, 19 nt, Homo sapiens
gaucaggcagguucauaaa

SEQ ID NO: 215286 - RNA, 19 nt, Homo sapiens
ugccaugucuugucuuauu

SEQ ID NO: 215287 - RNA, 19 nt, Homo sapiens
caaauagggcccagugaug

SEQ ID NO: 215288 - RNA, 19 nt, Homo sapiens
gcaaauagggcccagugau

SEQ ID NO: 215289 - RNA, 19 nt, Homo sapiens
cuagauauccuucgucaug

SEQ ID NO: 215290 - RNA, 19 nt, Homo sapiens
caucgaggcucuuuaaagc

SEQ ID NO: 215291 - RNA, 19 nt, Homo sapiens
cuacauggaacagcaaaua

SEQ ID NO: 215292 - RNA, 19 nt, Homo sapiens
caagaucaccuuuguggau

SEQ ID NO: 215293 - RNA, 19 nt, Homo sapiens
uugagaaacugaagccaaa

SEQ ID NO: 215294 - RNA, 19 nt, Homo sapiens
ggacuucaucucccgcuuu

SEQ ID NO: 215295 - RNA, 19 nt, Homo sapiens
uggauuuccuugccuauga

SEQ ID NO: 215296 - RNA, 19 nt, Homo sapiens
gucaugacacuucucaaua

SEQ ID NO: 215297 - RNA, 19 nt, Homo sapiens
uguaugcccugcucccuuu

SEQ ID NO: 215298 - RNA, 19 nt, Homo sapiens
ggaacucccugaaaagcua

SEQ ID NO: 215299 - RNA, 19 nt, Homo sapiens
ccugccaugucuugucuua

SEQ ID NO: 215300 - RNA, 19 nt, Homo sapiens
acaugaagcguauauuuga

SEQ ID NO: 215301 - RNA, 19 nt, Homo sapiens
gucuagaacuggcaugguu

SEQ ID NO: 215302 - RNA, 19 nt, Homo sapiens
ucaaagaccaucuguaugc

SEQ ID NO: 215303 - RNA, 19 nt, Homo sapiens
gcccagugaugccagaaga

SEQ ID NO: 215304 - RNA, 19 nt, Homo sapiens
ggagacaagaucaccuuug

SEQ ID NO: 215305 - RNA, 19 nt, Homo sapiens
ccacuguccuccaucaaag

SEQ ID NO: 215306 - RNA, 19 nt, Homo sapiens
gggaagcggccaugguuug

SEQ ID NO: 215307 - RNA, 19 nt, Homo sapiens
gacuucaucucccgcuuug

SEQ ID NO: 215308 - RNA, 19 nt, Homo sapiens
ggccuggacuuucccaauc

SEQ ID NO: 215309 - RNA, 19 nt, Homo sapiens
acgccaaccugacugcuuu

SEQ ID NO: 215310 - RNA, 19 nt, Homo sapiens
gcaucgaggcucuuuaaag

SEQ ID NO: 215311 - RNA, 19 nt, Homo sapiens
caagcuauguggaaaagaa

SEQ ID NO: 215312 - RNA, 19 nt, Homo sapiens
uagauauccuucgucauga

SEQ ID NO: 215313 - RNA, 19 nt, Homo sapiens
gugccaaguuccucacuca

SEQ ID NO: 215314 - RNA, 19 nt, Homo sapiens
ucgaggcucuuuaaagcuu

SEQ ID NO: 215315 - RNA, 19 nt, Homo sapiens
ccgcaucgaggcucuuuaa

SEQ ID NO: 215316 - RNA, 19 nt, Homo sapiens
ggagggaggagccaaccuu

SEQ ID NO: 215317 - RNA, 19 nt, Homo sapiens
gaucaccuuuguggauuuc

SEQ ID NO: 215318 - RNA, 19 nt, Homo sapiens
gacagaagaggagaagauu

SEQ ID NO: 215319 - RNA, 19 nt, Homo sapiens
gccaaguuccucacucauu

SEQ ID NO: 215320 - RNA, 19 nt, Homo sapiens
uuucuacucucuucucuuc

SEQ ID NO: 215321 - RNA, 19 nt, Homo sapiens
gcuuugaggguuugaagaa

SEQ ID NO: 215322 - RNA, 19 nt, Homo sapiens
aagaagaucucugccuaca

SEQ ID NO: 215323 - RNA, 19 nt, Homo sapiens
ggauuuccuugccuaugau

SEQ ID NO: 215324 - RNA, 19 nt, Homo sapiens
aagaucaccuuuguggauu

SEQ ID NO: 215325 - RNA, 19 nt, Homo sapiens
cuagcacuguccucaaaga

SEQ ID NO: 215326 - RNA, 19 nt, Homo sapiens
ggaaagucagcuacaugga

SEQ ID NO: 215327 - RNA, 19 nt, Homo sapiens
caugaaguccagccaauuc

SEQ ID NO: 215328 - RNA, 19 nt, Homo sapiens
gacucaagcuauguggaaa

SEQ ID NO: 215329 - RNA, 19 nt, Homo sapiens
cccuagcacuguccucaaa

SEQ ID NO: 215330 - RNA, 19 nt, Homo sapiens
auacacagacucaagcuau

SEQ ID NO: 215331 - RNA, 19 nt, Homo sapiens
acauggagcuggucagacu

SEQ ID NO: 215332 - RNA, 19 nt, Homo sapiens
cucauuggcuuccuuucuu

SEQ ID NO: 215333 - RNA, 19 nt, Homo sapiens
uacaugaaguccagccaau

SEQ ID NO: 215334 - RNA, 19 nt, Homo sapiens
agacagaagaggagaagau

SEQ ID NO: 215335 - RNA, 19 nt, Homo sapiens
caagaucacccagagcaau

SEQ ID NO: 215336 - RNA, 19 nt, Homo sapiens
ugauagacuucccugaucu

SEQ ID NO: 215337 - RNA, 19 nt, Homo sapiens
cugauagacuucccugauc

SEQ ID NO: 215338 - RNA, 19 nt, Homo sapiens
gccaugucuugucuuauuc

SEQ ID NO: 215339 - RNA, 19 nt, Homo sapiens
ugacccagauuuugagaaa

SEQ ID NO: 215340 - RNA, 19 nt, Homo sapiens
ugaucaggcagguucauaa

SEQ ID NO: 215341 - RNA, 19 nt, Homo sapiens
gaucucugccuacaugaag

SEQ ID NO: 215342 - RNA, 19 nt, Homo sapiens
caagcugggccuggacuuu

SEQ ID NO: 215343 - RNA, 19 nt, Homo sapiens
ggugcucugugccaaguuc

SEQ ID NO: 215344 - RNA, 19 nt, Homo sapiens
ccuccuaacgucuuccuuu

SEQ ID NO: 215345 - RNA, 19 nt, Homo sapiens
cgucaugacacuucucaau

SEQ ID NO: 215346 - RNA, 19 nt, Homo sapiens
uauuugagcccaagugcuu

SEQ ID NO: 215347 - RNA, 19 nt, Homo sapiens
agacucaagcuauguggaa

SEQ ID NO: 215348 - RNA, 19 nt, Homo sapiens
cuuucacccuguccugaua

SEQ ID NO: 215349 - RNA, 19 nt, Homo sapiens
ccacauggagcuggucaga

SEQ ID NO: 215350 - RNA, 19 nt, Homo sapiens
uuugaggguuugaagaaga

SEQ ID NO: 215351 - RNA, 19 nt, Homo sapiens
uacacagacucaagcuaug

SEQ ID NO: 215352 - RNA, 19 nt, Homo sapiens
cagaagaggagaagauucg

SEQ ID NO: 215353 - RNA, 19 nt, Homo sapiens
ggagacagaagaggagaag

SEQ ID NO: 215354 - RNA, 19 nt, Homo sapiens
uccgcuugcuccuggaaua

SEQ ID NO: 215355 - RNA, 19 nt, Homo sapiens
gugaucaggcagguucaua

SEQ ID NO: 215356 - RNA, 19 nt, Homo sapiens
ucauuggcuuccuuucuuc

SEQ ID NO: 215357 - RNA, 19 nt, Homo sapiens
caugaagcguauauuugag

SEQ ID NO: 215358 - RNA, 19 nt, Homo sapiens
agaucaccuuuguggauuu

SEQ ID NO: 215359 - RNA, 19 nt, Homo sapiens
gcuaugacccagauuuuga

SEQ ID NO: 215360 - RNA, 19 nt, Homo sapiens
ccaaucugcccuacuugau

SEQ ID NO: 215361 - RNA, 19 nt, Homo sapiens
gugcuuuucucuucuuuga

SEQ ID NO: 215362 - RNA, 19 nt, Homo sapiens
gcagaauccgcaccaacca

SEQ ID NO: 215363 - RNA, 19 nt, Homo sapiens
cccuggaccugccuucuuc

SEQ ID NO: 215364 - RNA, 19 nt, Homo sapiens
ccagugaugccagaagaug

SEQ ID NO: 215365 - RNA, 19 nt, Homo sapiens
ccugauagacuucccugau

SEQ ID NO: 215366 - RNA, 19 nt, Homo sapiens
uguaggccgucuagaacug

SEQ ID NO: 215367 - RNA, 19 nt, Homo sapiens
ccacagccagagcuuagug

SEQ ID NO: 215368 - RNA, 19 nt, Homo sapiens
uccgugugaugcccaguaa

SEQ ID NO: 215369 - RNA, 19 nt, Homo sapiens
gggcaaggaugacuaugug

SEQ ID NO: 215370 - RNA, 19 nt, Homo sapiens
gcaggagggcucacucaaa

SEQ ID NO: 215371 - RNA, 19 nt, Homo sapiens
gcaaggaugacuaugugaa

SEQ ID NO: 215372 - RNA, 19 nt, Homo sapiens
caggagggcucacucaaag

SEQ ID NO: 215373 - RNA, 19 nt, Homo sapiens
ccuacaccguggucuauuu

SEQ ID NO: 215374 - RNA, 19 nt, Homo sapiens
acggagaccucacccugua

SEQ ID NO: 215375 - RNA, 19 nt, Homo sapiens
ccgggcaacugaagccuuu

SEQ ID NO: 215376 - RNA, 19 nt, Homo sapiens
gcugauccaugagguccua

SEQ ID NO: 215377 - RNA, 19 nt, Homo sapiens
gaggcaagaccuucauugu

SEQ ID NO: 215378 - RNA, 19 nt, Homo sapiens
ggaggcaagaccuucauug

SEQ ID NO: 215379 - RNA, 19 nt, Homo sapiens
caaagccuccugccuauac

SEQ ID NO: 215380 - RNA, 19 nt, Homo sapiens
ugguggacauggugaauga

SEQ ID NO: 215381 - RNA, 19 nt, Homo sapiens
gaguuugccuuccuuucuc

SEQ ID NO: 215382 - RNA, 19 nt, Homo sapiens
ggaccuccgcugcaaauac

SEQ ID NO: 215383 - RNA, 19 nt, Homo sapiens
gcagaguuugccuuccuuu

SEQ ID NO: 215384 - RNA, 19 nt, Homo sapiens
cguggucuauuucccaguu

SEQ ID NO: 215385 - RNA, 19 nt, Homo sapiens
cucaaagccuccugccuau

SEQ ID NO: 215386 - RNA, 19 nt, Homo sapiens
acuacaaccugcuggacuu

SEQ ID NO: 215387 - RNA, 19 nt, Homo sapiens
caacugaagccuuuugaga

SEQ ID NO: 215388 - RNA, 19 nt, Homo sapiens
caaggaugacuaugugaag

SEQ ID NO: 215389 - RNA, 19 nt, Homo sapiens
agacccugcugucccagaa

SEQ ID NO: 215390 - RNA, 19 nt, Homo sapiens
ucaaagccuccugccuaua

SEQ ID NO: 215391 - RNA, 19 nt, Homo sapiens
caucaauggcaacgggaaa

SEQ ID NO: 215392 - RNA, 19 nt, Homo sapiens
ccucaucuacaccaacuau

SEQ ID NO: 215393 - RNA, 19 nt, Homo sapiens
ugagcgggaggcagaguuu

SEQ ID NO: 215394 - RNA, 19 nt, Homo sapiens
gauuaaaggucagcacuua

SEQ ID NO: 215395 - RNA, 19 nt, Homo sapiens
gcacuuaagcgaugccuuu

SEQ ID NO: 215396 - RNA, 19 nt, Homo sapiens
aggaauggcuugcuuaaga

SEQ ID NO: 215397 - RNA, 19 nt, Homo sapiens
gacccaagcuggccacaug

SEQ ID NO: 215398 - RNA, 19 nt, Homo sapiens
aauauaaggucccugacua

SEQ ID NO: 215399 - RNA, 19 nt, Homo sapiens
ccacaaagcauuuucauuu

SEQ ID NO: 215400 - RNA, 19 nt, Homo sapiens
ugagaaugaugcacacuga

SEQ ID NO: 215401 - RNA, 19 nt, Homo sapiens
cuccuuagcugaccucgua

SEQ ID NO: 215402 - RNA, 19 nt, Homo sapiens
gcaggaauggcuugcuuaa

SEQ ID NO: 215403 - RNA, 19 nt, Homo sapiens
caucguggaucugauuaaa

SEQ ID NO: 215404 - RNA, 19 nt, Homo sapiens
ggaauggcuugcuuaagac

SEQ ID NO: 215405 - RNA, 19 nt, Homo sapiens
ggccuuguguccuuuaauc

SEQ ID NO: 215406 - RNA, 19 nt, Homo sapiens
ccugaaagccacaaugaga

SEQ ID NO: 215407 - RNA, 19 nt, Homo sapiens
uaccugacgcgcaaauaua

SEQ ID NO: 215408 - RNA, 19 nt, Homo sapiens
gcgcaucguggaucugauu

SEQ ID NO: 215409 - RNA, 19 nt, Homo sapiens
gaggccuuguguccuuuaa

SEQ ID NO: 215410 - RNA, 19 nt, Homo sapiens
ccauaaagcagaagcugau

SEQ ID NO: 215411 - RNA, 19 nt, Homo sapiens
aaggugauguucccugugu

SEQ ID NO: 215412 - RNA, 19 nt, Homo sapiens
gaaagccacaaugagaaug

SEQ ID NO: 215413 - RNA, 19 nt, Homo sapiens
ugaaagccacaaugagaau

SEQ ID NO: 215414 - RNA, 19 nt, Homo sapiens
agaacgacauucccuucga

SEQ ID NO: 215415 - RNA, 19 nt, Homo sapiens
ccgcgcuguuuacaucuuu

SEQ ID NO: 215416 - RNA, 19 nt, Homo sapiens
gcaucguggaucugauuaa

SEQ ID NO: 215417 - RNA, 19 nt, Homo sapiens
guccucagcaguccacaaa

SEQ ID NO: 215418 - RNA, 19 nt, Homo sapiens
cuaccugacgcgcaaauau

SEQ ID NO: 215419 - RNA, 19 nt, Homo sapiens
ucguggaucugauuaaagg

SEQ ID NO: 215420 - RNA, 19 nt, Homo sapiens
gugcccguguggaugagua

SEQ ID NO: 215421 - RNA, 19 nt, Homo sapiens
ucacugcauuucauuuuga

SEQ ID NO: 215422 - RNA, 19 nt, Homo sapiens
guccuuuaaucacugcauu

SEQ ID NO: 215423 - RNA, 19 nt, Homo sapiens
acugaggccuuguguccuu

SEQ ID NO: 215424 - RNA, 19 nt, Homo sapiens
aaagccacaaugagaauga

SEQ ID NO: 215425 - RNA, 19 nt, Homo sapiens
cagcaguccacaaagcauu

SEQ ID NO: 215426 - RNA, 19 nt, Homo sapiens
acacgacucugcggagaag

SEQ ID NO: 215427 - RNA, 19 nt, Homo sapiens
ccucagcaguccacaaagc

SEQ ID NO: 215428 - RNA, 19 nt, Homo sapiens
cugaaagccacaaugagaa

SEQ ID NO: 215429 - RNA, 19 nt, Homo sapiens
cgccugaaagccacaauga

SEQ ID NO: 215430 - RNA, 19 nt, Homo sapiens
cacaaagcauuuucauuuc

SEQ ID NO: 215431 - RNA, 19 nt, Homo sapiens
ggugauguucccuguguuc

SEQ ID NO: 215432 - RNA, 19 nt, Homo sapiens
ccaagaagaacgacauucc

SEQ ID NO: 215433 - RNA, 19 nt, Homo sapiens
gagccaggcccagaaagca

SEQ ID NO: 215434 - RNA, 19 nt, Homo sapiens
ugcaguugcucgaggacaa

SEQ ID NO: 215435 - RNA, 19 nt, Homo sapiens
gccaguaucuccccagaca

SEQ ID NO: 215436 - RNA, 19 nt, Homo sapiens
caacaaggauucauucugu

SEQ ID NO: 215437 - RNA, 19 nt, Homo sapiens
gcaaaugucaucaguguuu

SEQ ID NO: 215438 - RNA, 19 nt, Homo sapiens
auaaagagcuccuacaaau

SEQ ID NO: 215439 - RNA, 19 nt, Homo sapiens
cagcauacauaaccaguaa

SEQ ID NO: 215440 - RNA, 19 nt, Homo sapiens
gcucaaggauggugauuuc

SEQ ID NO: 215441 - RNA, 19 nt, Homo sapiens
gagacuaaaucugcaauau

SEQ ID NO: 215442 - RNA, 19 nt, Homo sapiens
gccuagagcuguuucuuga

SEQ ID NO: 215443 - RNA, 19 nt, Homo sapiens
cuacaaaucaguaacauga

SEQ ID NO: 215444 - RNA, 19 nt, Homo sapiens
gagauuagcaacaaggauu

SEQ ID NO: 215445 - RNA, 19 nt, Homo sapiens
ggauucauucuguuacuua

SEQ ID NO: 215446 - RNA, 19 nt, Homo sapiens
gacacuggcugaucucaug

SEQ ID NO: 215447 - RNA, 19 nt, Homo sapiens
aaagagcuccuacaaauca

SEQ ID NO: 215448 - RNA, 19 nt, Homo sapiens
uggcaaaugucaucagugu

SEQ ID NO: 215449 - RNA, 19 nt, Homo sapiens
acaaggauucauucuguua

SEQ ID NO: 215450 - RNA, 19 nt, Homo sapiens
gccaggagauuagcaacaa

SEQ ID NO: 215451 - RNA, 19 nt, Homo sapiens
gcauacauaaccaguaaga

SEQ ID NO: 215452 - RNA, 19 nt, Homo sapiens
uauaaagagcuccuacaaa

SEQ ID NO: 215453 - RNA, 19 nt, Homo sapiens
auacauaaccaguaagaga

SEQ ID NO: 215454 - RNA, 19 nt, Homo sapiens
gcaacaaggauucauucug

SEQ ID NO: 215455 - RNA, 19 nt, Homo sapiens
gcccacagcaucaucuuga

SEQ ID NO: 215456 - RNA, 19 nt, Homo sapiens
acaaaucaguaacaugaag

SEQ ID NO: 215457 - RNA, 19 nt, Homo sapiens
ugcaauggcuggaggacaa

SEQ ID NO: 215458 - RNA, 19 nt, Homo sapiens
gcaacaggacugccaugga

SEQ ID NO: 215459 - RNA, 19 nt, Homo sapiens
ggaaacugccgacgcucaa

SEQ ID NO: 215460 - RNA, 19 nt, Homo sapiens
gcagcauacauaaccagua

SEQ ID NO: 215461 - RNA, 19 nt, Homo sapiens
caaaucaguaacaugaaga

SEQ ID NO: 215462 - RNA, 19 nt, Homo sapiens
gagcuccuacaaaucagua

SEQ ID NO: 215463 - RNA, 19 nt, Homo sapiens
cugcauccguggcaccuuu

SEQ ID NO: 215464 - RNA, 19 nt, Homo sapiens
ucaaagggcagcacaagag

SEQ ID NO: 215465 - RNA, 19 nt, Homo sapiens
gaagaauggcauccccuua

SEQ ID NO: 215466 - RNA, 19 nt, Homo sapiens
uaaagagcuccuacaaauc

SEQ ID NO: 215467 - RNA, 19 nt, Homo sapiens
aaggaguucuugcagauca

SEQ ID NO: 215468 - RNA, 19 nt, Homo sapiens
ucaguaacaugaagaacac

SEQ ID NO: 215469 - RNA, 19 nt, Homo sapiens
guggacgaguggaggcuuu

SEQ ID NO: 215470 - RNA, 19 nt, Homo sapiens
gcacaagagcaaggaguuc

SEQ ID NO: 215471 - RNA, 19 nt, Homo sapiens
ucaggugcagcauacauaa

SEQ ID NO: 215472 - RNA, 19 nt, Homo sapiens
ccaguaagagacuaaaucu

SEQ ID NO: 215473 - RNA, 19 nt, Homo sapiens
cauaaccaguaagagacua

SEQ ID NO: 215474 - RNA, 19 nt, Homo sapiens
gagcugcgcaccguggauu

SEQ ID NO: 215475 - RNA, 19 nt, Homo sapiens
gugcccguguucaugagua

SEQ ID NO: 215476 - RNA, 19 nt, Homo sapiens
ggccuagagcuguuucuug

SEQ ID NO: 215477 - RNA, 19 nt, Homo sapiens
caagaaaacccucccaaca

SEQ ID NO: 215478 - RNA, 19 nt, Homo sapiens
ccaugggccuagagcuguu

SEQ ID NO: 215479 - RNA, 19 nt, Homo sapiens
uagcaacaaggauucauuc

SEQ ID NO: 215480 - RNA, 19 nt, Homo sapiens
uaacaugaagaacacucaa

SEQ ID NO: 215481 - RNA, 19 nt, Homo sapiens
guaacaugaagaacacuca

SEQ ID NO: 215482 - RNA, 19 nt, Homo sapiens
gauucauucuguuacuuac

SEQ ID NO: 215483 - RNA, 19 nt, Homo sapiens
caaaugucaucaguguuuu

SEQ ID NO: 215484 - RNA, 19 nt, Homo sapiens
auauaaagagcuccuacaa

SEQ ID NO: 215485 - RNA, 19 nt, Homo sapiens
uaagagacuaaaucugcaa

SEQ ID NO: 215486 - RNA, 19 nt, Homo sapiens
ggagauuagcaacaaggau

SEQ ID NO: 215487 - RNA, 19 nt, Homo sapiens
aggcuaugcugcuucgaau

SEQ ID NO: 215488 - RNA, 19 nt, Homo sapiens
ggucaaagggcagcacaag

SEQ ID NO: 215489 - RNA, 19 nt, Homo sapiens
gcucgugcccguguucaug

SEQ ID NO: 215490 - RNA, 19 nt, Homo sapiens
ucccuucucuccagcuuca

SEQ ID NO: 215491 - RNA, 19 nt, Homo sapiens
uuacuuacuugccccuuuu

SEQ ID NO: 215492 - RNA, 19 nt, Homo sapiens
gagaagguggaacgcaaca

SEQ ID NO: 215493 - RNA, 19 nt, Homo sapiens
ucaaggauggugauuucau

SEQ ID NO: 215494 - RNA, 19 nt, Homo sapiens
uuuccugggugcugagcua

SEQ ID NO: 215495 - RNA, 19 nt, Homo sapiens
cguggcaccuuugguauac

SEQ ID NO: 215496 - RNA, 19 nt, Homo sapiens
ggaauacuguuaucuaugu

SEQ ID NO: 215497 - RNA, 19 nt, Homo sapiens
gaaacgagagucuuaauug

SEQ ID NO: 215498 - RNA, 19 nt, Homo sapiens
gagaugagaaugcggauua

SEQ ID NO: 215499 - RNA, 19 nt, Homo sapiens
gaauugcucuggccuugaa

SEQ ID NO: 215500 - RNA, 19 nt, Homo sapiens
aaacgagagucuuaauuga

SEQ ID NO: 215501 - RNA, 19 nt, Homo sapiens
gaaccugucuguccugaag

SEQ ID NO: 215502 - RNA, 19 nt, Homo sapiens
ccaggaccaucuuuacuuu

SEQ ID NO: 215503 - RNA, 19 nt, Homo sapiens
uaaggaagauccaguugug

SEQ ID NO: 215504 - RNA, 19 nt, Homo sapiens
gcaggaauacuguuaucua

SEQ ID NO: 215505 - RNA, 19 nt, Homo sapiens
ggcaaaugcugaaagauuc

SEQ ID NO: 215506 - RNA, 19 nt, Homo sapiens
ggaaacgagagucuuaauu

SEQ ID NO: 215507 - RNA, 19 nt, Homo sapiens
caggaauacuguuaucuau

SEQ ID NO: 215508 - RNA, 19 nt, Homo sapiens
ccaucaaucucauaaagga

SEQ ID NO: 215509 - RNA, 19 nt, Homo sapiens
gcugaaauuuggcgugaau

SEQ ID NO: 215510 - RNA, 19 nt, Homo sapiens
gggcauauacuguguagga

SEQ ID NO: 215511 - RNA, 19 nt, Homo sapiens
gguggcaaaugcugaaaga

SEQ ID NO: 215512 - RNA, 19 nt, Homo sapiens
gagcacagcgggcauauac

SEQ ID NO: 215513 - RNA, 19 nt, Homo sapiens
gcccaucaaucucauaaag

SEQ ID NO: 215514 - RNA, 19 nt, Homo sapiens
gcacagcgggcauauacug

SEQ ID NO: 215515 - RNA, 19 nt, Homo sapiens
ugccaacccugaagauuga

SEQ ID NO: 215516 - RNA, 19 nt, Homo sapiens
gggccuagcucccaaaucc

SEQ ID NO: 215517 - RNA, 19 nt, Homo sapiens
gggcaggaauacuguuauc

SEQ ID NO: 215518 - RNA, 19 nt, Homo sapiens
gaucugccuuccugcugaa

SEQ ID NO: 215519 - RNA, 19 nt, Homo sapiens
uggcaaaugcugaaagauu

SEQ ID NO: 215520 - RNA, 19 nt, Homo sapiens
cauccucuauuccuauuuc

SEQ ID NO: 215521 - RNA, 19 nt, Homo sapiens
gaguugcaucuccaaauaa

SEQ ID NO: 215522 - RNA, 19 nt, Homo sapiens
gaauacuguuaucuaugug

SEQ ID NO: 215523 - RNA, 19 nt, Homo sapiens
ucauggagaguucgaauug

SEQ ID NO: 215524 - RNA, 19 nt, Homo sapiens
ccuggaaacgagagucuua

SEQ ID NO: 215525 - RNA, 19 nt, Homo sapiens
gugccaacccugaagauug

SEQ ID NO: 215526 - RNA, 19 nt, Homo sapiens
gaagcugggugggcugaag

SEQ ID NO: 215527 - RNA, 19 nt, Homo sapiens
ggacuuccaggcacugaau

SEQ ID NO: 215528 - RNA, 19 nt, Homo sapiens
ccucaggacccaaagaaga

SEQ ID NO: 215529 - RNA, 19 nt, Homo sapiens
gccaggaccaucuuuacuu

SEQ ID NO: 215530 - RNA, 19 nt, Homo sapiens
gugugugacuccaaagaau

SEQ ID NO: 215531 - RNA, 19 nt, Homo sapiens
ccagaacgccaucacuugu

SEQ ID NO: 215532 - RNA, 19 nt, Homo sapiens
ggccaucauugaguaucua

SEQ ID NO: 215533 - RNA, 19 nt, Homo sapiens
ccacuaaggcuuccaaacg

SEQ ID NO: 215534 - RNA, 19 nt, Homo sapiens
gaugagaaugcggauuaaa

SEQ ID NO: 215535 - RNA, 19 nt, Homo sapiens
gcgugcguaugauuucuga

SEQ ID NO: 215536 - RNA, 19 nt, Homo sapiens
cgaagcuccugcucaugga

SEQ ID NO: 215537 - RNA, 19 nt, Homo sapiens
cccaucaccugcuuucugu

SEQ ID NO: 215538 - RNA, 19 nt, Homo sapiens
gcccagaacgccaucacuu

SEQ ID NO: 215539 - RNA, 19 nt, Homo sapiens
gcaagugggagaggagaug

SEQ ID NO: 215540 - RNA, 19 nt, Homo sapiens
caauuccuccucuucgaaa

SEQ ID NO: 215541 - RNA, 19 nt, Homo sapiens
uggcgugaauuaaacugaa

SEQ ID NO: 215542 - RNA, 19 nt, Homo sapiens
aaauaaggaagauccaguu

SEQ ID NO: 215543 - RNA, 19 nt, Homo sapiens
agaugagaaugcggauuaa

SEQ ID NO: 215544 - RNA, 19 nt, Homo sapiens
cagcgggcauauacugugu

SEQ ID NO: 215545 - RNA, 19 nt, Homo sapiens
gugggcaggaauacuguua

SEQ ID NO: 215546 - RNA, 19 nt, Homo sapiens
cacuaaggcuuccaaacgu

SEQ ID NO: 215547 - RNA, 19 nt, Homo sapiens
gcgggcauauacuguguag

SEQ ID NO: 215548 - RNA, 19 nt, Homo sapiens
cacuggccaucauugagua

SEQ ID NO: 215549 - RNA, 19 nt, Homo sapiens
uccaggcacugaauccuau

SEQ ID NO: 215550 - RNA, 19 nt, Homo sapiens
ccaauuccuccucuucgaa

SEQ ID NO: 215551 - RNA, 19 nt, Homo sapiens
guaaggaaagggaguugca

SEQ ID NO: 215552 - RNA, 19 nt, Homo sapiens
ugaagaggccuggaaacga

SEQ ID NO: 215553 - RNA, 19 nt, Homo sapiens
gggcugaagaggccuggaa

SEQ ID NO: 215554 - RNA, 19 nt, Homo sapiens
accaucagcuccaucaaca

SEQ ID NO: 215555 - RNA, 19 nt, Homo sapiens
gccccaagccucccaauuu

SEQ ID NO: 215556 - RNA, 19 nt, Homo sapiens
caaaagcccauccucuauu

SEQ ID NO: 215557 - RNA, 19 nt, Homo sapiens
cugaagcccaggccucuaa

SEQ ID NO: 215558 - RNA, 19 nt, Homo sapiens
caucagcuccaucaacaag

SEQ ID NO: 215559 - RNA, 19 nt, Homo sapiens
uuaacgcccuggagcagau

SEQ ID NO: 215560 - RNA, 19 nt, Homo sapiens
ccuucaugcucuucucuug

SEQ ID NO: 215561 - RNA, 19 nt, Homo sapiens
gccaacaguuuucuaagga

SEQ ID NO: 215562 - RNA, 19 nt, Homo sapiens
gaugggagacucgaacucu

SEQ ID NO: 215563 - RNA, 19 nt, Homo sapiens
gccagcgugcguaugauuu

SEQ ID NO: 215564 - RNA, 19 nt, Homo sapiens
ggccagcgugcguaugauu

SEQ ID NO: 215565 - RNA, 19 nt, Homo sapiens
aaucaccauucaccaguca

SEQ ID NO: 215566 - RNA, 19 nt, Homo sapiens
ggaaagggaguugcaucuc

SEQ ID NO: 215567 - RNA, 19 nt, Homo sapiens
gagcagggugggcaggaau

SEQ ID NO: 215568 - RNA, 19 nt, Homo sapiens
gaacucuagcccuggaucu

SEQ ID NO: 215569 - RNA, 19 nt, Homo sapiens
ggcacugaauccuaugaag

SEQ ID NO: 215570 - RNA, 19 nt, Homo sapiens
agacggugcccaucaaucu

SEQ ID NO: 215571 - RNA, 19 nt, Homo sapiens
gcucauggagaguucgaau

SEQ ID NO: 215572 - RNA, 19 nt, Homo sapiens
gcccaucaccugcuuucug

SEQ ID NO: 215573 - RNA, 19 nt, Homo sapiens
ucacuggccaucauugagu

SEQ ID NO: 215574 - RNA, 19 nt, Homo sapiens
cccugaagauugauggaau

SEQ ID NO: 215575 - RNA, 19 nt, Homo sapiens
gugcccaucaaucucauaa

SEQ ID NO: 215576 - RNA, 19 nt, Homo sapiens
cacaaaagcccauccucua

SEQ ID NO: 215577 - RNA, 19 nt, Homo sapiens
ggaccaucuuuacuuucuc

SEQ ID NO: 215578 - RNA, 19 nt, Homo sapiens
agaggcugcuggucuugga

SEQ ID NO: 215579 - RNA, 19 nt, Homo sapiens
ucagcuccaucaacaagag

SEQ ID NO: 215580 - RNA, 19 nt, Homo sapiens
cccauccucuauuccuauu

SEQ ID NO: 215581 - RNA, 19 nt, Homo sapiens
cccagaacgccaucacuug

SEQ ID NO: 215582 - RNA, 19 nt, Homo sapiens
ugucuguccugaagcaagu

SEQ ID NO: 215583 - RNA, 19 nt, Homo sapiens
caucauugaguaucuagag

SEQ ID NO: 215584 - RNA, 19 nt, Homo sapiens
ccacccaauuccuccucuu

SEQ ID NO: 215585 - RNA, 19 nt, Homo sapiens
gcccauccucuauuccuau

SEQ ID NO: 215586 - RNA, 19 nt, Homo sapiens
aaaagcccauccucuauuc

SEQ ID NO: 215587 - RNA, 19 nt, Homo sapiens
ucuuuacuuucuccacaaa

SEQ ID NO: 215588 - RNA, 19 nt, Homo sapiens
ggaauacuguuaucuaugu

SEQ ID NO: 215589 - RNA, 19 nt, Homo sapiens
gaaacgagagucuuaauug

SEQ ID NO: 215590 - RNA, 19 nt, Homo sapiens
gagaugagaaugcggauua

SEQ ID NO: 215591 - RNA, 19 nt, Homo sapiens
gaauugcucuggccuugaa

SEQ ID NO: 215592 - RNA, 19 nt, Homo sapiens
aaacgagagucuuaauuga

SEQ ID NO: 215593 - RNA, 19 nt, Homo sapiens
gaaccugucuguccugaag

SEQ ID NO: 215594 - RNA, 19 nt, Homo sapiens
gaaagacacgggccugauu

SEQ ID NO: 215595 - RNA, 19 nt, Homo sapiens
ggaagcccauccucuauuc

SEQ ID NO: 215596 - RNA, 19 nt, Homo sapiens
gcaggaauacuguuaucua

SEQ ID NO: 215597 - RNA, 19 nt, Homo sapiens
ggcaaaugcugaaagauuc

SEQ ID NO: 215598 - RNA, 19 nt, Homo sapiens
ggaaacgagagucuuaauu

SEQ ID NO: 215599 - RNA, 19 nt, Homo sapiens
caggaauacuguuaucuau

SEQ ID NO: 215600 - RNA, 19 nt, Homo sapiens
ccaucaaucucauaaagga

SEQ ID NO: 215601 - RNA, 19 nt, Homo sapiens
gcugaaauuuggcgugaau

SEQ ID NO: 215602 - RNA, 19 nt, Homo sapiens
gggcauauacuguguagga

SEQ ID NO: 215603 - RNA, 19 nt, Homo sapiens
gguggcaaaugcugaaaga

SEQ ID NO: 215604 - RNA, 19 nt, Homo sapiens
gagcacagcgggcauauac

SEQ ID NO: 215605 - RNA, 19 nt, Homo sapiens
gcccaucaaucucauaaag

SEQ ID NO: 215606 - RNA, 19 nt, Homo sapiens
gcacagcgggcauauacug

SEQ ID NO: 215607 - RNA, 19 nt, Homo sapiens
ugccaacccugaagauuga

SEQ ID NO: 215608 - RNA, 19 nt, Homo sapiens
gggccuagcucccaaaucc

SEQ ID NO: 215609 - RNA, 19 nt, Homo sapiens
gggcaggaauacuguuauc

SEQ ID NO: 215610 - RNA, 19 nt, Homo sapiens
gaucugccuuccugcugaa

SEQ ID NO: 215611 - RNA, 19 nt, Homo sapiens
uggcaaaugcugaaagauu

SEQ ID NO: 215612 - RNA, 19 nt, Homo sapiens
cauccucuauuccuauuuc

SEQ ID NO: 215613 - RNA, 19 nt, Homo sapiens
gggaagcccauccucuauu

SEQ ID NO: 215614 - RNA, 19 nt, Homo sapiens
gaauacuguuaucuaugug

SEQ ID NO: 215615 - RNA, 19 nt, Homo sapiens
ucauggagaguucgaauug

SEQ ID NO: 215616 - RNA, 19 nt, Homo sapiens
ccuggaaacgagagucuua

SEQ ID NO: 215617 - RNA, 19 nt, Homo sapiens
gugccaacccugaagauug

SEQ ID NO: 215618 - RNA, 19 nt, Homo sapiens
gaagcugggugggcugaag

SEQ ID NO: 215619 - RNA, 19 nt, Homo sapiens
ggacuuccaggcacugaau

SEQ ID NO: 215620 - RNA, 19 nt, Homo sapiens
ccucaggacccaaagaaga

SEQ ID NO: 215621 - RNA, 19 nt, Homo sapiens
gugugugacuccaaagaau

SEQ ID NO: 215622 - RNA, 19 nt, Homo sapiens
ccagaacgccaucacuugu

SEQ ID NO: 215623 - RNA, 19 nt, Homo sapiens
ggccaucauugaguaucua

SEQ ID NO: 215624 - RNA, 19 nt, Homo sapiens
gaugagaaugcggauuaaa

SEQ ID NO: 215625 - RNA, 19 nt, Homo sapiens
gcgugcguaugauuucuga

SEQ ID NO: 215626 - RNA, 19 nt, Homo sapiens
cgaagcuccugcucaugga

SEQ ID NO: 215627 - RNA, 19 nt, Homo sapiens
gcccagaacgccaucacuu

SEQ ID NO: 215628 - RNA, 19 nt, Homo sapiens
gcaagugggagaggagaug

SEQ ID NO: 215629 - RNA, 19 nt, Homo sapiens
uggcgugaauuaaacugaa

SEQ ID NO: 215630 - RNA, 19 nt, Homo sapiens
agaugagaaugcggauuaa

SEQ ID NO: 215631 - RNA, 19 nt, Homo sapiens
ccggaaggaucuuucuagu

SEQ ID NO: 215632 - RNA, 19 nt, Homo sapiens
cagcgggcauauacugugu

SEQ ID NO: 215633 - RNA, 19 nt, Homo sapiens
gugggcaggaauacuguua

SEQ ID NO: 215634 - RNA, 19 nt, Homo sapiens
gcgggcauauacuguguag

SEQ ID NO: 215635 - RNA, 19 nt, Homo sapiens
cacuggccaucauugagua

SEQ ID NO: 215636 - RNA, 19 nt, Homo sapiens
uccaggcacugaauccuau

SEQ ID NO: 215637 - RNA, 19 nt, Homo sapiens
ugaagaggccuggaaacga

SEQ ID NO: 215638 - RNA, 19 nt, Homo sapiens
gggcugaagaggccuggaa

SEQ ID NO: 215639 - RNA, 19 nt, Homo sapiens
accaucagcuccaucaaca

SEQ ID NO: 215640 - RNA, 19 nt, Homo sapiens
gaccggaaggaucuuucua

SEQ ID NO: 215641 - RNA, 19 nt, Homo sapiens
cugaagcccaggccucuaa

SEQ ID NO: 215642 - RNA, 19 nt, Homo sapiens
caucagcuccaucaacaag

SEQ ID NO: 215643 - RNA, 19 nt, Homo sapiens
uuaacgcccuggagcagau

SEQ ID NO: 215644 - RNA, 19 nt, Homo sapiens
gccaacaguuuucuaagga

SEQ ID NO: 215645 - RNA, 19 nt, Homo sapiens
gaugggagacucgaacucu

SEQ ID NO: 215646 - RNA, 19 nt, Homo sapiens
gccagcgugcguaugauuu

SEQ ID NO: 215647 - RNA, 19 nt, Homo sapiens
ggccagcgugcguaugauu

SEQ ID NO: 215648 - RNA, 19 nt, Homo sapiens
aaucaccauucaccaguca

SEQ ID NO: 215649 - RNA, 19 nt, Homo sapiens
gcucauggagaguucgaau

SEQ ID NO: 215650 - RNA, 19 nt, Homo sapiens
gagcagggugggcaggaau

SEQ ID NO: 215651 - RNA, 19 nt, Homo sapiens
gaacucuagcccuggaucu

SEQ ID NO: 215652 - RNA, 19 nt, Homo sapiens
agacggugcccaucaaucu

SEQ ID NO: 215653 - RNA, 19 nt, Homo sapiens
ggcacugaauccuaugaag

SEQ ID NO: 215654 - RNA, 19 nt, Homo sapiens
ccugauucgucgagucuca

SEQ ID NO: 215655 - RNA, 19 nt, Homo sapiens
ucacuggccaucauugagu

SEQ ID NO: 215656 - RNA, 19 nt, Homo sapiens
gugcccaucaaucucauaa

SEQ ID NO: 215657 - RNA, 19 nt, Homo sapiens
cccugaagauugauggaau

SEQ ID NO: 215658 - RNA, 19 nt, Homo sapiens
agaggcugcuggucuugga

SEQ ID NO: 215659 - RNA, 19 nt, Homo sapiens
ucagcuccaucaacaagag

SEQ ID NO: 215660 - RNA, 19 nt, Homo sapiens
cccauccucuauuccuauu

SEQ ID NO: 215661 - RNA, 19 nt, Homo sapiens
aaagacacgggccugauuc

SEQ ID NO: 215662 - RNA, 19 nt, Homo sapiens
gcccauccucuauuccuau

SEQ ID NO: 215663 - RNA, 19 nt, Homo sapiens
cccagaacgccaucacuug

SEQ ID NO: 215664 - RNA, 19 nt, Homo sapiens
ugucuguccugaagcaagu

SEQ ID NO: 215665 - RNA, 19 nt, Homo sapiens
caucauugaguaucuagag

SEQ ID NO: 215666 - RNA, 19 nt, Homo sapiens
ggaauacuguuaucuaugu

SEQ ID NO: 215667 - RNA, 19 nt, Homo sapiens
gaaacgagagucuuaauug

SEQ ID NO: 215668 - RNA, 19 nt, Homo sapiens
gagaugagaaugcggauua

SEQ ID NO: 215669 - RNA, 19 nt, Homo sapiens
gaauugcucuggccuugaa

SEQ ID NO: 215670 - RNA, 19 nt, Homo sapiens
aaacgagagucuuaauuga

SEQ ID NO: 215671 - RNA, 19 nt, Homo sapiens
gaaagacacgggccugauu

SEQ ID NO: 215672 - RNA, 19 nt, Homo sapiens
ggaagcccauccucuauuc

SEQ ID NO: 215673 - RNA, 19 nt, Homo sapiens
gcaggaauacuguuaucua

SEQ ID NO: 215674 - RNA, 19 nt, Homo sapiens
ggcaaaugcugaaagauuc

SEQ ID NO: 215675 - RNA, 19 nt, Homo sapiens
ggaaacgagagucuuaauu

SEQ ID NO: 215676 - RNA, 19 nt, Homo sapiens
caggaauacuguuaucuau

SEQ ID NO: 215677 - RNA, 19 nt, Homo sapiens
ccaucaaucucauaaagga

SEQ ID NO: 215678 - RNA, 19 nt, Homo sapiens
gcugaaauuuggcgugaau

SEQ ID NO: 215679 - RNA, 19 nt, Homo sapiens
gggcauauacuguguagga

SEQ ID NO: 215680 - RNA, 19 nt, Homo sapiens
gguggcaaaugcugaaaga

SEQ ID NO: 215681 - RNA, 19 nt, Homo sapiens
gagcacagcgggcauauac

SEQ ID NO: 215682 - RNA, 19 nt, Homo sapiens
gcccaucaaucucauaaag

SEQ ID NO: 215683 - RNA, 19 nt, Homo sapiens
gcacagcgggcauauacug

SEQ ID NO: 215684 - RNA, 19 nt, Homo sapiens
ugccaacccugaagauuga

SEQ ID NO: 215685 - RNA, 19 nt, Homo sapiens
gggccuagcucccaaaucc

SEQ ID NO: 215686 - RNA, 19 nt, Homo sapiens
gggcaggaauacuguuauc

SEQ ID NO: 215687 - RNA, 19 nt, Homo sapiens
gaucugccuuccugcugaa

SEQ ID NO: 215688 - RNA, 19 nt, Homo sapiens
uggcaaaugcugaaagauu

SEQ ID NO: 215689 - RNA, 19 nt, Homo sapiens
aaaccugucuguccugaag

SEQ ID NO: 215690 - RNA, 19 nt, Homo sapiens
cauccucuauuccuauuuc

SEQ ID NO: 215691 - RNA, 19 nt, Homo sapiens
gggaagcccauccucuauu

SEQ ID NO: 215692 - RNA, 19 nt, Homo sapiens
gaauacuguuaucuaugug

SEQ ID NO: 215693 - RNA, 19 nt, Homo sapiens
ucauggagaguucgaauug

SEQ ID NO: 215694 - RNA, 19 nt, Homo sapiens
ccuggaaacgagagucuua

SEQ ID NO: 215695 - RNA, 19 nt, Homo sapiens
gugccaacccugaagauug

SEQ ID NO: 215696 - RNA, 19 nt, Homo sapiens
gaagcugggugggcugaag

SEQ ID NO: 215697 - RNA, 19 nt, Homo sapiens
ggacuuccaggcacugaau

SEQ ID NO: 215698 - RNA, 19 nt, Homo sapiens
gugugugacuccaaagaau

SEQ ID NO: 215699 - RNA, 19 nt, Homo sapiens
ccagaacgccaucacuugu

SEQ ID NO: 215700 - RNA, 19 nt, Homo sapiens
gaugagaaugcggauuaaa

SEQ ID NO: 215701 - RNA, 19 nt, Homo sapiens
cgaagcuccugcucaugga

SEQ ID NO: 215702 - RNA, 19 nt, Homo sapiens
gcccagaacgccaucacuu

SEQ ID NO: 215703 - RNA, 19 nt, Homo sapiens
gcaagugggagaggagaug

SEQ ID NO: 215704 - RNA, 19 nt, Homo sapiens
uggcgugaauuaaacugaa

SEQ ID NO: 215705 - RNA, 19 nt, Homo sapiens
agaugagaaugcggauuaa

SEQ ID NO: 215706 - RNA, 19 nt, Homo sapiens
ccggaaggaucuuucuagu

SEQ ID NO: 215707 - RNA, 19 nt, Homo sapiens
cagcgggcauauacugugu

SEQ ID NO: 215708 - RNA, 19 nt, Homo sapiens
gugggcaggaauacuguua

SEQ ID NO: 215709 - RNA, 19 nt, Homo sapiens
gcgggcauauacuguguag

SEQ ID NO: 215710 - RNA, 19 nt, Homo sapiens
uccaggcacugaauccuau

SEQ ID NO: 215711 - RNA, 19 nt, Homo sapiens
ugaagaggccuggaaacga

SEQ ID NO: 215712 - RNA, 19 nt, Homo sapiens
gggcugaagaggccuggaa

SEQ ID NO: 215713 - RNA, 19 nt, Homo sapiens
accaucagcuccaucaaca

SEQ ID NO: 215714 - RNA, 19 nt, Homo sapiens
gaccggaaggaucuuucua

SEQ ID NO: 215715 - RNA, 19 nt, Homo sapiens
cugaagcccaggccucuaa

SEQ ID NO: 215716 - RNA, 19 nt, Homo sapiens
caucagcuccaucaacaag

SEQ ID NO: 215717 - RNA, 19 nt, Homo sapiens
uuaacgcccuggagcagau

SEQ ID NO: 215718 - RNA, 19 nt, Homo sapiens
gccaacaguuuucuaagga

SEQ ID NO: 215719 - RNA, 19 nt, Homo sapiens
gaugggagacucgaacucu

SEQ ID NO: 215720 - RNA, 19 nt, Homo sapiens
aaucaccauucaccaguca

SEQ ID NO: 215721 - RNA, 19 nt, Homo sapiens
gagcagggugggcaggaau

SEQ ID NO: 215722 - RNA, 19 nt, Homo sapiens
agacggugcccaucaaucu

SEQ ID NO: 215723 - RNA, 19 nt, Homo sapiens
gaacucuagcccuggaucu

SEQ ID NO: 215724 - RNA, 19 nt, Homo sapiens
gcucauggagaguucgaau

SEQ ID NO: 215725 - RNA, 19 nt, Homo sapiens
ggcacugaauccuaugaag

SEQ ID NO: 215726 - RNA, 19 nt, Homo sapiens
ccugauucgucgagucuca

SEQ ID NO: 215727 - RNA, 19 nt, Homo sapiens
gugcccaucaaucucauaa

SEQ ID NO: 215728 - RNA, 19 nt, Homo sapiens
cccugaagauugauggaau

SEQ ID NO: 215729 - RNA, 19 nt, Homo sapiens
cccauccucuauuccuauu

SEQ ID NO: 215730 - RNA, 19 nt, Homo sapiens
aaagacacgggccugauuc

SEQ ID NO: 215731 - RNA, 19 nt, Homo sapiens
agaggcugcuggucuugga

SEQ ID NO: 215732 - RNA, 19 nt, Homo sapiens
ucagcuccaucaacaagag

SEQ ID NO: 215733 - RNA, 19 nt, Homo sapiens
gcccauccucuauuccuau

SEQ ID NO: 215734 - RNA, 19 nt, Homo sapiens
cccagaacgccaucacuug

SEQ ID NO: 215735 - RNA, 19 nt, Homo sapiens
ugucuguccugaagcaagu

SEQ ID NO: 215736 - RNA, 19 nt, Homo sapiens
ucaccauucaccagucaaa

SEQ ID NO: 215737 - RNA, 19 nt, Homo sapiens
gaaguuggcuaaucucaua

SEQ ID NO: 215738 - RNA, 19 nt, Homo sapiens
gagacaggcuggcuuauua

SEQ ID NO: 215739 - RNA, 19 nt, Homo sapiens
ggaaaucucucaaaggaaa

SEQ ID NO: 215740 - RNA, 19 nt, Homo sapiens
guagaaagauggcacauau

SEQ ID NO: 215741 - RNA, 19 nt, Homo sapiens
ggaaauggcucucuuaaaa

SEQ ID NO: 215742 - RNA, 19 nt, Homo sapiens
cgaaguagccgccaaauaa

SEQ ID NO: 215743 - RNA, 19 nt, Homo sapiens
caacuuacguaacagauaa

SEQ ID NO: 215744 - RNA, 19 nt, Homo sapiens
gaacagagccuccuggaau

SEQ ID NO: 215745 - RNA, 19 nt, Homo sapiens
uaagggagcuuguccuaaa

SEQ ID NO: 215746 - RNA, 19 nt, Homo sapiens
gcucugauguggaauuuaa

SEQ ID NO: 215747 - RNA, 19 nt, Homo sapiens
uaaagaagcuuccagaucu

SEQ ID NO: 215748 - RNA, 19 nt, Homo sapiens
gcagaagggcuauaaagua

SEQ ID NO: 215749 - RNA, 19 nt, Homo sapiens
ccacauggaugcucuuauu

SEQ ID NO: 215750 - RNA, 19 nt, Homo sapiens
caaaugcaguuguuaaaga

SEQ ID NO: 215751 - RNA, 19 nt, Homo sapiens
gcaagaagaagauuauuga

SEQ ID NO: 215752 - RNA, 19 nt, Homo sapiens
gaauugaaccgaugggaua

SEQ ID NO: 215753 - RNA, 19 nt, Homo sapiens
gaugaagccuuaaauaaag

SEQ ID NO: 215754 - RNA, 19 nt, Homo sapiens
gaaacuacauacagcaaga

SEQ ID NO: 215755 - RNA, 19 nt, Homo sapiens
gaagaugaaucagucacua

SEQ ID NO: 215756 - RNA, 19 nt, Homo sapiens
gaacuuugaucuugucauc

SEQ ID NO: 215757 - RNA, 19 nt, Homo sapiens
cgaaagacuggacuuauua

SEQ ID NO: 215758 - RNA, 19 nt, Homo sapiens
gaaggaacccuacuagaga

SEQ ID NO: 215759 - RNA, 19 nt, Homo sapiens
gggccaagauggaggguua

SEQ ID NO: 215760 - RNA, 19 nt, Homo sapiens
gcagaugaagccuuaaaua

SEQ ID NO: 215761 - RNA, 19 nt, Homo sapiens
gaauacgaguugaaaucua

SEQ ID NO: 215762 - RNA, 19 nt, Homo sapiens
caacuagcauuucaucaga

SEQ ID NO: 215763 - RNA, 19 nt, Homo sapiens
caagagaauuugagaagau

SEQ ID NO: 215764 - RNA, 19 nt, Homo sapiens
gcagggcuauaauguauga

SEQ ID NO: 215765 - RNA, 19 nt, Homo sapiens
cagcagggcuauaauguau

SEQ ID NO: 215766 - RNA, 19 nt, Homo sapiens
gaagagguacugcaacauu

SEQ ID NO: 215767 - RNA, 19 nt, Homo sapiens
gaaggaagcagugaugaaa

SEQ ID NO: 215768 - RNA, 19 nt, Homo sapiens
ggagggauguaucauugaa

SEQ ID NO: 215769 - RNA, 19 nt, Homo sapiens
cagaugaagccuuaaauaa

SEQ ID NO: 215770 - RNA, 19 nt, Homo sapiens
ucucauaaaugcugaagaa

SEQ ID NO: 215771 - RNA, 19 nt, Homo sapiens
gcaagagaauuugagaaga

SEQ ID NO: 215772 - RNA, 19 nt, Homo sapiens
ugauuugacuguagaauug

SEQ ID NO: 215773 - RNA, 19 nt, Homo sapiens
cagaagggcuauaaaguag

SEQ ID NO: 215774 - RNA, 19 nt, Homo sapiens
gaaguagccgccaaauaaa

SEQ ID NO: 215775 - RNA, 19 nt, Homo sapiens
uaaaguagcacgaguggaa

SEQ ID NO: 215776 - RNA, 19 nt, Homo sapiens
aggaagcagugaugaaaua

SEQ ID NO: 215777 - RNA, 19 nt, Homo sapiens
gaacauucauccgcgagaa

SEQ ID NO: 215778 - RNA, 19 nt, Homo sapiens
ucgaaagacuggacuuauu

SEQ ID NO: 215779 - RNA, 19 nt, Homo sapiens
uagaagaccucaugguugu

SEQ ID NO: 215780 - RNA, 19 nt, Homo sapiens
aaggaaaucucucaaagga

SEQ ID NO: 215781 - RNA, 19 nt, Homo sapiens
gaguugaaaucuaccaaga

SEQ ID NO: 215782 - RNA, 19 nt, Homo sapiens
gcagugacauuaaacaacu

SEQ ID NO: 215783 - RNA, 19 nt, Homo sapiens
gaacuugcugagacuauaa

SEQ ID NO: 215784 - RNA, 19 nt, Homo sapiens
guaagcggcuccuaaagca

SEQ ID NO: 215785 - RNA, 19 nt, Homo sapiens
ggugugugcuuuguugaua

SEQ ID NO: 215786 - RNA, 19 nt, Homo sapiens
gaggcacgauguagaaaga

SEQ ID NO: 215787 - RNA, 19 nt, Homo sapiens
ucucagaacuuugaucuug

SEQ ID NO: 215788 - RNA, 19 nt, Homo sapiens
cagacaacauuaugaucua

SEQ ID NO: 215789 - RNA, 19 nt, Homo sapiens
caaaggugguaaauucaga

SEQ ID NO: 215790 - RNA, 19 nt, Homo sapiens
gaaaagaaguuggcuaauc

SEQ ID NO: 215791 - RNA, 19 nt, Homo sapiens
uagagaggguugauacuug

SEQ ID NO: 215792 - RNA, 19 nt, Homo sapiens
ucaugaaacuuuagaaugg

SEQ ID NO: 215793 - RNA, 19 nt, Homo sapiens
aaacagcgcaacagaauug

SEQ ID NO: 215794 - RNA, 19 nt, Homo sapiens
caaagccuaucaacgaaug

SEQ ID NO: 215795 - RNA, 19 nt, Homo sapiens
ggaagugguggcagauuaa

SEQ ID NO: 215796 - RNA, 19 nt, Homo sapiens
ggaaaucaguccguguuca

SEQ ID NO: 215797 - RNA, 19 nt, Homo sapiens
gcuuugaguugacuucuga

SEQ ID NO: 215798 - RNA, 19 nt, Homo sapiens
cuggaaggauucaaaguaa

SEQ ID NO: 215799 - RNA, 19 nt, Homo sapiens
uuaaagguaugacuucaga

SEQ ID NO: 215800 - RNA, 19 nt, Homo sapiens
agaauaaugucaggugaaa

SEQ ID NO: 215801 - RNA, 19 nt, Homo sapiens
ggaaggauucaaaguaaug

SEQ ID NO: 215802 - RNA, 19 nt, Homo sapiens
ggagggagaucuguaggau

SEQ ID NO: 215803 - RNA, 19 nt, Homo sapiens
cagauucccuggugcagaa

SEQ ID NO: 215804 - RNA, 19 nt, Homo sapiens
aagaagggcuguaaacgau

SEQ ID NO: 215805 - RNA, 19 nt, Homo sapiens
uggaauaccuagagaaaca

SEQ ID NO: 215806 - RNA, 19 nt, Homo sapiens
uagaugcagugacauuaaa

SEQ ID NO: 215807 - RNA, 19 nt, Homo sapiens
aggaagugguggcagauua

SEQ ID NO: 215808 - RNA, 19 nt, Homo sapiens
ugacuacauuggaagcuuu

SEQ ID NO: 215809 - RNA, 19 nt, Homo sapiens
cugaagcuguccauaaauu

SEQ ID NO: 215810 - RNA, 19 nt, Homo sapiens
gguggcagauuaagucuca

SEQ ID NO: 215811 - RNA, 19 nt, Homo sapiens
aaacaagcaacuagcauuu

SEQ ID NO: 215812 - RNA, 19 nt, Homo sapiens
uggcacauauauccaagua

SEQ ID NO: 215813 - RNA, 19 nt, Homo sapiens
agaaagauggcacauauau

SEQ ID NO: 215814 - RNA, 19 nt, Homo sapiens
caaacaagcaacuagcauu

SEQ ID NO: 215815 - RNA, 19 nt, Homo sapiens
ggaaggaagcagugaugaa

SEQ ID NO: 215816 - RNA, 19 nt, Homo sapiens
gaagggucauaucagauuc

SEQ ID NO: 215817 - RNA, 19 nt, Homo sapiens
aagagguacugcaacauuu

SEQ ID NO: 215818 - RNA, 19 nt, Homo sapiens
gaaacugccagcauacuca

SEQ ID NO: 215819 - RNA, 19 nt, Homo sapiens
cgacuguucuauaacuuug

SEQ ID NO: 215820 - RNA, 19 nt, Homo sapiens
gaagggcuguaaacgauac

SEQ ID NO: 215821 - RNA, 19 nt, Homo sapiens
gagaaacagcgcaacagaa

SEQ ID NO: 215822 - RNA, 19 nt, Homo sapiens
aacagagccuccuggaaua

SEQ ID NO: 215823 - RNA, 19 nt, Homo sapiens
ccagacagcagggcuauaa

SEQ ID NO: 215824 - RNA, 19 nt, Homo sapiens
ccaaggguacacagacuua

SEQ ID NO: 215825 - RNA, 19 nt, Homo sapiens
aagugaaacugccagcaua

SEQ ID NO: 215826 - RNA, 19 nt, Homo sapiens
gauagaguguuuacuagac

SEQ ID NO: 215827 - RNA, 19 nt, Homo sapiens
gaaggucguuuuccugauu

SEQ ID NO: 215828 - RNA, 19 nt, Homo sapiens
caaaaucuccgaaguugua

SEQ ID NO: 215829 - RNA, 19 nt, Homo sapiens
cgccauuguucgagauuua

SEQ ID NO: 215830 - RNA, 19 nt, Homo sapiens
gacugagacuccagaaaug

SEQ ID NO: 215831 - RNA, 19 nt, Homo sapiens
gcgaaguagccgccaaaua

SEQ ID NO: 215832 - RNA, 19 nt, Homo sapiens
ggaagaagagauggaggua

SEQ ID NO: 215833 - RNA, 19 nt, Homo sapiens
ugaguugacuucugaccaa

SEQ ID NO: 215834 - RNA, 19 nt, Homo sapiens
guccauaaauugcugacuu

SEQ ID NO: 215835 - RNA, 19 nt, Homo sapiens
gaagaacggagggauguau

SEQ ID NO: 215836 - RNA, 19 nt, Homo sapiens
guugaaaucuaccaagaag

SEQ ID NO: 215837 - RNA, 19 nt, Homo sapiens
ggaaauaagacucaaguua

SEQ ID NO: 215838 - RNA, 19 nt, Homo sapiens
ugaagaagaugaagaugaa

SEQ ID NO: 215839 - RNA, 19 nt, Homo sapiens
gauaagauacacagaagua

SEQ ID NO: 215840 - RNA, 19 nt, Homo sapiens
gcagaauggugaagaguug

SEQ ID NO: 215841 - RNA, 19 nt, Homo sapiens
gaagaagacuaugaugaug

SEQ ID NO: 215842 - RNA, 19 nt, Homo sapiens
caaacaccgugccuaaauu

SEQ ID NO: 215843 - RNA, 19 nt, Homo sapiens
ggaaggacaggaacucuuu

SEQ ID NO: 215844 - RNA, 19 nt, Homo sapiens
aguacaagcuccuguuaua

SEQ ID NO: 215845 - RNA, 19 nt, Homo sapiens
gaaauuucaucucaaggau

SEQ ID NO: 215846 - RNA, 19 nt, Homo sapiens
ggaggaagacaaagagaaa

SEQ ID NO: 215847 - RNA, 19 nt, Homo sapiens
ggagggauuucaccacaga

SEQ ID NO: 215848 - RNA, 19 nt, Homo sapiens
agaugaagaugaagaagaa

SEQ ID NO: 215849 - RNA, 19 nt, Homo sapiens
uggaguggaugaacaagua

SEQ ID NO: 215850 - RNA, 19 nt, Homo sapiens
agagaaagauggagcugaa

SEQ ID NO: 215851 - RNA, 19 nt, Homo sapiens
ccauuggucuuacaaguug

SEQ ID NO: 215852 - RNA, 19 nt, Homo sapiens
cuuguuggcucgcuauaua

SEQ ID NO: 215853 - RNA, 19 nt, Homo sapiens
aaacaccgugccuaaauua

SEQ ID NO: 215854 - RNA, 19 nt, Homo sapiens
ggaaauuucaucucaagga

SEQ ID NO: 215855 - RNA, 19 nt, Homo sapiens
ggauacaucaucugaagaa

SEQ ID NO: 215856 - RNA, 19 nt, Homo sapiens
ggaacucuuugacacagaa

SEQ ID NO: 215857 - RNA, 19 nt, Homo sapiens
ggacaggaacucuuugaca

SEQ ID NO: 215858 - RNA, 19 nt, Homo sapiens
guagauggauuucauucag

SEQ ID NO: 215859 - RNA, 19 nt, Homo sapiens
ucucaaggauggcauuaug

SEQ ID NO: 215860 - RNA, 19 nt, Homo sapiens
gauggcauuaugaaucuua

SEQ ID NO: 215861 - RNA, 19 nt, Homo sapiens
ccaauggugcccaauauau

SEQ ID NO: 215862 - RNA, 19 nt, Homo sapiens
ugcuacagcugcuaccuua

SEQ ID NO: 215863 - RNA, 19 nt, Homo sapiens
ccugaagggucguggcuuu

SEQ ID NO: 215864 - RNA, 19 nt, Homo sapiens
gaagacaaagagaaagaug

SEQ ID NO: 215865 - RNA, 19 nt, Homo sapiens
gaagaagaagacuaugaug

SEQ ID NO: 215866 - RNA, 19 nt, Homo sapiens
caacagguuauaccacaaa

SEQ ID NO: 215867 - RNA, 19 nt, Homo sapiens
gaagaagagccccucaaua

SEQ ID NO: 215868 - RNA, 19 nt, Homo sapiens
gaaagauggagcugaagau

SEQ ID NO: 215869 - RNA, 19 nt, Homo sapiens
ggcaguagauggauuucau

SEQ ID NO: 215870 - RNA, 19 nt, Homo sapiens
gaagaugaugugagugaug

SEQ ID NO: 215871 - RNA, 19 nt, Homo sapiens
caaguuauuguuccagauu

SEQ ID NO: 215872 - RNA, 19 nt, Homo sapiens
cuaaguugauacagcauau

SEQ ID NO: 215873 - RNA, 19 nt, Homo sapiens
acaccgugccuaaauuaua

SEQ ID NO: 215874 - RNA, 19 nt, Homo sapiens
aagaugaugugagugauga

SEQ ID NO: 215875 - RNA, 19 nt, Homo sapiens
gugaagaugaugugaguga

SEQ ID NO: 215876 - RNA, 19 nt, Homo sapiens
ccacagcaccacaaguuau

SEQ ID NO: 215877 - RNA, 19 nt, Homo sapiens
auacaaacaccgugccuaa

SEQ ID NO: 215878 - RNA, 19 nt, Homo sapiens
agaagacuaugaugaugau

SEQ ID NO: 215879 - RNA, 19 nt, Homo sapiens
agaagaagacuaugaugau

SEQ ID NO: 215880 - RNA, 19 nt, Homo sapiens
gugccuaaauuauacagau

SEQ ID NO: 215881 - RNA, 19 nt, Homo sapiens
aagaagaagacuaugauga

SEQ ID NO: 215882 - RNA, 19 nt, Homo sapiens
gcacagauaacugcaacug

SEQ ID NO: 215883 - RNA, 19 nt, Homo sapiens
gccaauggugcccaauaua

SEQ ID NO: 215884 - RNA, 19 nt, Homo sapiens
ggucagagcagccaauggu

SEQ ID NO: 215885 - RNA, 19 nt, Homo sapiens
uagauggauuucauucaga

SEQ ID NO: 215886 - RNA, 19 nt, Homo sapiens
acaaacaccgugccuaaau

SEQ ID NO: 215887 - RNA, 19 nt, Homo sapiens
guuguaugccaauaugaua

SEQ ID NO: 215888 - RNA, 19 nt, Homo sapiens
guuguuguaugccaauaug

SEQ ID NO: 215889 - RNA, 19 nt, Homo sapiens
ucaaacacaagcuccauug

SEQ ID NO: 215890 - RNA, 19 nt, Homo sapiens
augaaugcaucaaacauga

SEQ ID NO: 215891 - RNA, 19 nt, Homo sapiens
gcaguagauggauuucauu

SEQ ID NO: 215892 - RNA, 19 nt, Homo sapiens
ucaaggauggcauuaugaa

SEQ ID NO: 215893 - RNA, 19 nt, Homo sapiens
gaagagccccucaauagug

SEQ ID NO: 215894 - RNA, 19 nt, Homo sapiens
ugaagaagaagacuaugau

SEQ ID NO: 215895 - RNA, 19 nt, Homo sapiens
ggaugaacaaguacugaug

SEQ ID NO: 215896 - RNA, 19 nt, Homo sapiens
guucuacaacaacagguua

SEQ ID NO: 215897 - RNA, 19 nt, Homo sapiens
gaacucggcaaauacaaac

SEQ ID NO: 215898 - RNA, 19 nt, Homo sapiens
cagaaaauguuguuguaug

SEQ ID NO: 215899 - RNA, 19 nt, Homo sapiens
uagugaagaugaugugagu

SEQ ID NO: 215900 - RNA, 19 nt, Homo sapiens
cgaacucggcaaauacaaa

SEQ ID NO: 215901 - RNA, 19 nt, Homo sapiens
caccgugccuaaauuauac

SEQ ID NO: 215902 - RNA, 19 nt, Homo sapiens
gcagucagugguucuacaa

SEQ ID NO: 215903 - RNA, 19 nt, Homo sapiens
caugagugcugcugcuaca

SEQ ID NO: 215904 - RNA, 19 nt, Homo sapiens
agauggauuucauucagaa

SEQ ID NO: 215905 - RNA, 19 nt, Homo sapiens
ggugaccgguggugguuuc

SEQ ID NO: 215906 - RNA, 19 nt, Homo sapiens
cacagaaaauguuguugua

SEQ ID NO: 215907 - RNA, 19 nt, Homo sapiens
ugaugugagugaugaggaa

SEQ ID NO: 215908 - RNA, 19 nt, Homo sapiens
gucagugguucuacaacaa

SEQ ID NO: 215909 - RNA, 19 nt, Homo sapiens
gccacagcaccacaaguua

SEQ ID NO: 215910 - RNA, 19 nt, Homo sapiens
ccagggcaguagauggauu

SEQ ID NO: 215911 - RNA, 19 nt, Homo sapiens
gaaggacaggaacucuuug

SEQ ID NO: 215912 - RNA, 19 nt, Homo sapiens
gcagccugguggaguacaa

SEQ ID NO: 215913 - RNA, 19 nt, Homo sapiens
aaugcagccugguggagua

SEQ ID NO: 215914 - RNA, 19 nt, Homo sapiens
gcagacaguaccucagcaa

SEQ ID NO: 215915 - RNA, 19 nt, Homo sapiens
caaguacugauggaacuaa

SEQ ID NO: 215916 - RNA, 19 nt, Homo sapiens
gaugcagaauggugaagag

SEQ ID NO: 215917 - RNA, 19 nt, Homo sapiens
gccaauaugauaagauaca

SEQ ID NO: 215918 - RNA, 19 nt, Homo sapiens
cuccggguguuaauaguuu

SEQ ID NO: 215919 - RNA, 19 nt, Homo sapiens
agacaaagagaaagaugga

SEQ ID NO: 215920 - RNA, 19 nt, Homo sapiens
ggcccagccugcucaaaca

SEQ ID NO: 215921 - RNA, 19 nt, Homo sapiens
cagccaauggugcccaaua

SEQ ID NO: 215922 - RNA, 19 nt, Homo sapiens
ggucuuacaaguugaugga

SEQ ID NO: 215923 - RNA, 19 nt, Homo sapiens
gguggugguuucccuccuu

SEQ ID NO: 215924 - RNA, 19 nt, Homo sapiens
gcaagccacagcaccacaa

SEQ ID NO: 215925 - RNA, 19 nt, Homo sapiens
ggaagacaaagagaaagau

SEQ ID NO: 215926 - RNA, 19 nt, Homo sapiens
aagaagacuaugaugauga

SEQ ID NO: 215927 - RNA, 19 nt, Homo sapiens
cugaagaagaugaagauga

SEQ ID NO: 215928 - RNA, 19 nt, Homo sapiens
gaguacaagcuccuguuau

SEQ ID NO: 215929 - RNA, 19 nt, Homo sapiens
guucagcagauauuaacaa

SEQ ID NO: 215930 - RNA, 19 nt, Homo sapiens
caaagccauuggagaugca

SEQ ID NO: 215931 - RNA, 19 nt, Homo sapiens
uaaggcgauucucgagguu

SEQ ID NO: 215932 - RNA, 19 nt, Homo sapiens
caauggugcccaauauauc

SEQ ID NO: 215933 - RNA, 19 nt, Homo sapiens
gaaugcaucaaacaugagu

SEQ ID NO: 215934 - RNA, 19 nt, Homo sapiens
guugauacagcauaugaau

SEQ ID NO: 215935 - RNA, 19 nt, Homo sapiens
guuccagauucuaaguuga

SEQ ID NO: 215936 - RNA, 19 nt, Homo sapiens
gcagcagcaucaccaccau

SEQ ID NO: 215937 - RNA, 19 nt, Homo sapiens
gaaagaaacuuguaacucu

SEQ ID NO: 215938 - RNA, 19 nt, Homo sapiens
gcauaucaguuauacagaa

SEQ ID NO: 215939 - RNA, 19 nt, Homo sapiens
gaaauacuacuuugggaaa

SEQ ID NO: 215940 - RNA, 19 nt, Homo sapiens
ccagagaauuccaguagaa

SEQ ID NO: 215941 - RNA, 19 nt, Homo sapiens
gcgauaauguguggacuuu

SEQ ID NO: 215942 - RNA, 19 nt, Homo sapiens
caucuucuguuauucauug

SEQ ID NO: 215943 - RNA, 19 nt, Homo sapiens
aaugcaagcuugaauaaga

SEQ ID NO: 215944 - RNA, 19 nt, Homo sapiens
aauacuggcuccaauacua

SEQ ID NO: 215945 - RNA, 19 nt, Homo sapiens
gaauuccaguagaaagaaa

SEQ ID NO: 215946 - RNA, 19 nt, Homo sapiens
ccucuuacaucaccuuuau

SEQ ID NO: 215947 - RNA, 19 nt, Homo sapiens
guuguugccuuccuaagaa

SEQ ID NO: 215948 - RNA, 19 nt, Homo sapiens
aaacaaauucuuccuccua

SEQ ID NO: 215949 - RNA, 19 nt, Homo sapiens
gagaauuccaguagaaaga

SEQ ID NO: 215950 - RNA, 19 nt, Homo sapiens
gcagaaaugacuacacugu

SEQ ID NO: 215951 - RNA, 19 nt, Homo sapiens
gaagagaagcauagaagag

SEQ ID NO: 215952 - RNA, 19 nt, Homo sapiens
gauaauguguggacuuuug

SEQ ID NO: 215953 - RNA, 19 nt, Homo sapiens
ccuaagccauggcauauca

SEQ ID NO: 215954 - RNA, 19 nt, Homo sapiens
cuaaauacguacagauucu

SEQ ID NO: 215955 - RNA, 19 nt, Homo sapiens
aacaaauucuuccuccuaa

SEQ ID NO: 215956 - RNA, 19 nt, Homo sapiens
ugacuacacugugcuauac

SEQ ID NO: 215957 - RNA, 19 nt, Homo sapiens
uacaccaucuucuguuauu

SEQ ID NO: 215958 - RNA, 19 nt, Homo sapiens
uuuacaccaucuucuguua

SEQ ID NO: 215959 - RNA, 19 nt, Homo sapiens
ugauaaggcuauaaaugca

SEQ ID NO: 215960 - RNA, 19 nt, Homo sapiens
cauacagucucaacagauc

SEQ ID NO: 215961 - RNA, 19 nt, Homo sapiens
agccauggcauaucaguua

SEQ ID NO: 215962 - RNA, 19 nt, Homo sapiens
ccacaggacaucaaugcaa

SEQ ID NO: 215963 - RNA, 19 nt, Homo sapiens
ggaacagagucaauuucag

SEQ ID NO: 215964 - RNA, 19 nt, Homo sapiens
ucaggaacagagucaauuu

SEQ ID NO: 215965 - RNA, 19 nt, Homo sapiens
gcucagagggucaggaaca

SEQ ID NO: 215966 - RNA, 19 nt, Homo sapiens
gcuccaauacuacagaaug

SEQ ID NO: 215967 - RNA, 19 nt, Homo sapiens
cuccaauacuacagaauga

SEQ ID NO: 215968 - RNA, 19 nt, Homo sapiens
ucaguuugauaaggcuaua

SEQ ID NO: 215969 - RNA, 19 nt, Homo sapiens
agaaacuuguaacucugua

SEQ ID NO: 215970 - RNA, 19 nt, Homo sapiens
ccaauacuacagaaugaau

SEQ ID NO: 215971 - RNA, 19 nt, Homo sapiens
gccauggcauaucaguuau

SEQ ID NO: 215972 - RNA, 19 nt, Homo sapiens
agagguggucggagaagua

SEQ ID NO: 215973 - RNA, 19 nt, Homo sapiens
gaagcauagaagagacuuu

SEQ ID NO: 215974 - RNA, 19 nt, Homo sapiens
guucuacuucaguuugaua

SEQ ID NO: 215975 - RNA, 19 nt, Homo sapiens
ugaagagaagcauagaaga

SEQ ID NO: 215976 - RNA, 19 nt, Homo sapiens
augcaagcuugaauaagaa

SEQ ID NO: 215977 - RNA, 19 nt, Homo sapiens
caguagaaagaaacuugua

SEQ ID NO: 215978 - RNA, 19 nt, Homo sapiens
uaccagagaauuccaguag

SEQ ID NO: 215979 - RNA, 19 nt, Homo sapiens
aagagaagcauagaagaga

SEQ ID NO: 215980 - RNA, 19 nt, Homo sapiens
ggucaggaacagagucaau

SEQ ID NO: 215981 - RNA, 19 nt, Homo sapiens
gagagguggucggagaagu

SEQ ID NO: 215982 - RNA, 19 nt, Homo sapiens
cagagaauuccaguagaaa

SEQ ID NO: 215983 - RNA, 19 nt, Homo sapiens
ccuccuaagccauggcaua

SEQ ID NO: 215984 - RNA, 19 nt, Homo sapiens
cuacuucaguuugauaagg

SEQ ID NO: 215985 - RNA, 19 nt, Homo sapiens
gcucauacagucucaacag

SEQ ID NO: 215986 - RNA, 19 nt, Homo sapiens
guagaaagaaacuuguaac

SEQ ID NO: 215987 - RNA, 19 nt, Homo sapiens
cauggcauaucaguuauac

SEQ ID NO: 215988 - RNA, 19 nt, Homo sapiens
uucaggggcucucuaaaua

SEQ ID NO: 215989 - RNA, 19 nt, Homo sapiens
uugcagaaaugacuacacu

SEQ ID NO: 215990 - RNA, 19 nt, Homo sapiens
uguagccugugaugguaaa

SEQ ID NO: 215991 - RNA, 19 nt, Homo sapiens
agaaagaaacuuguaacuc

SEQ ID NO: 215992 - RNA, 19 nt, Homo sapiens
ccauggcauaucaguuaua

SEQ ID NO: 215993 - RNA, 19 nt, Homo sapiens
caaauucuuccuccuaagc

SEQ ID NO: 215994 - RNA, 19 nt, Homo sapiens
aaaguuguugccuuccuaa

SEQ ID NO: 215995 - RNA, 19 nt, Homo sapiens
uggcauaucaguuauacag

SEQ ID NO: 215996 - RNA, 19 nt, Homo sapiens
gugcuauaccagagaauuc

SEQ ID NO: 215997 - RNA, 19 nt, Homo sapiens
gguggucggagaaguagga

SEQ ID NO: 215998 - RNA, 19 nt, Homo sapiens
cucauacagucucaacaga

SEQ ID NO: 215999 - RNA, 19 nt, Homo sapiens
caccaucuucuguuauuca

SEQ ID NO: 216000 - RNA, 19 nt, Homo sapiens
ucuaaauacguacagauuc

SEQ ID NO: 216001 - RNA, 19 nt, Homo sapiens
caggaacagagucaauuuc

SEQ ID NO: 216002 - RNA, 19 nt, Homo sapiens
gucaggaacagagucaauu

SEQ ID NO: 216003 - RNA, 19 nt, Homo sapiens
gauaugaucuguccugaau

SEQ ID NO: 216004 - RNA, 19 nt, Homo sapiens
gauggcagcuacacauaua

SEQ ID NO: 216005 - RNA, 19 nt, Homo sapiens
caaucuaccucgaaauaua

SEQ ID NO: 216006 - RNA, 19 nt, Homo sapiens
gcaaguauaugaacagaag

SEQ ID NO: 216007 - RNA, 19 nt, Homo sapiens
agaaauaugugccguauca

SEQ ID NO: 216008 - RNA, 19 nt, Homo sapiens
gcacaggagcugcaaguuu

SEQ ID NO: 216009 - RNA, 19 nt, Homo sapiens
ggagauuugucuaccauga

SEQ ID NO: 216010 - RNA, 19 nt, Homo sapiens
gaaucaaucuaccucgaaa

SEQ ID NO: 216011 - RNA, 19 nt, Homo sapiens
guaaagcuguggaauugga

SEQ ID NO: 216012 - RNA, 19 nt, Homo sapiens
ccuaggacauuuaaagaaa

SEQ ID NO: 216013 - RNA, 19 nt, Homo sapiens
gaauguggcuugguuguag

SEQ ID NO: 216014 - RNA, 19 nt, Homo sapiens
uaccacagcuauaaauuga

SEQ ID NO: 216015 - RNA, 19 nt, Homo sapiens
cuacagagccggugauaug

SEQ ID NO: 216016 - RNA, 19 nt, Homo sapiens
caaacuaccacagcuauaa

SEQ ID NO: 216017 - RNA, 19 nt, Homo sapiens
gaaauuggucgguguuuua

SEQ ID NO: 216018 - RNA, 19 nt, Homo sapiens
ucaaagaaaucacuaccau

SEQ ID NO: 216019 - RNA, 19 nt, Homo sapiens
ugaggcagcuaacgucaaa

SEQ ID NO: 216020 - RNA, 19 nt, Homo sapiens
ccguaaagcuguggaauug

SEQ ID NO: 216021 - RNA, 19 nt, Homo sapiens
ggacaaacuaccacagcua

SEQ ID NO: 216022 - RNA, 19 nt, Homo sapiens
gcaaugacaaagcaacaaa

SEQ ID NO: 216023 - RNA, 19 nt, Homo sapiens
gggaagagcuaaugaugcu

SEQ ID NO: 216024 - RNA, 19 nt, Homo sapiens
cagcuaacgucaaauucuu

SEQ ID NO: 216025 - RNA, 19 nt, Homo sapiens
cuacacauauagcccguaa

SEQ ID NO: 216026 - RNA, 19 nt, Homo sapiens
gaagagcuaaugaugcuau

SEQ ID NO: 216027 - RNA, 19 nt, Homo sapiens
aaagaaauaugugccguau

SEQ ID NO: 216028 - RNA, 19 nt, Homo sapiens
cagaaucggagaacaauga

SEQ ID NO: 216029 - RNA, 19 nt, Homo sapiens
ccuacagacuucaaauuug

SEQ ID NO: 216030 - RNA, 19 nt, Homo sapiens
ucacaggcaucagcugaaa

SEQ ID NO: 216031 - RNA, 19 nt, Homo sapiens
gaaacuguauuuuggaaga

SEQ ID NO: 216032 - RNA, 19 nt, Homo sapiens
caaccuuugucuuccuaaa

SEQ ID NO: 216033 - RNA, 19 nt, Homo sapiens
uaugaucuguccugaaugu

SEQ ID NO: 216034 - RNA, 19 nt, Homo sapiens
uauauugccuguagacaag

SEQ ID NO: 216035 - RNA, 19 nt, Homo sapiens
gaagggaagagcuaaugau

SEQ ID NO: 216036 - RNA, 19 nt, Homo sapiens
gcagacagaaucaaucuac

SEQ ID NO: 216037 - RNA, 19 nt, Homo sapiens
ggcauucuguauguauaua

SEQ ID NO: 216038 - RNA, 19 nt, Homo sapiens
uuccagggcugaauacuau

SEQ ID NO: 216039 - RNA, 19 nt, Homo sapiens
cgaaauauaguugaucgaa

SEQ ID NO: 216040 - RNA, 19 nt, Homo sapiens
cacaggagcugcaaguuuu

SEQ ID NO: 216041 - RNA, 19 nt, Homo sapiens
ggaucugaauggcgaacuu

SEQ ID NO: 216042 - RNA, 19 nt, Homo sapiens
acaaugagcaguucugauc

SEQ ID NO: 216043 - RNA, 19 nt, Homo sapiens
agauuugucuaccaugauu

SEQ ID NO: 216044 - RNA, 19 nt, Homo sapiens
gacaaacuaccacagcuau

SEQ ID NO: 216045 - RNA, 19 nt, Homo sapiens
ucaagcaaguauaugaaca

SEQ ID NO: 216046 - RNA, 19 nt, Homo sapiens
gaacuuucagcaaugacaa

SEQ ID NO: 216047 - RNA, 19 nt, Homo sapiens
guaggugaccggguuauug

SEQ ID NO: 216048 - RNA, 19 nt, Homo sapiens
acaaucagacaguccuaua

SEQ ID NO: 216049 - RNA, 19 nt, Homo sapiens
uggcagcggcagcuauuua

SEQ ID NO: 216050 - RNA, 19 nt, Homo sapiens
uagaaaccaguguggauuu

SEQ ID NO: 216051 - RNA, 19 nt, Homo sapiens
ggagauauugcugguguug

SEQ ID NO: 216052 - RNA, 19 nt, Homo sapiens
gaaaccaguguggauuuga

SEQ ID NO: 216053 - RNA, 19 nt, Homo sapiens
gcagcuaacgucaaauucu

SEQ ID NO: 216054 - RNA, 19 nt, Homo sapiens
aaacuaccacagcuauaaa

SEQ ID NO: 216055 - RNA, 19 nt, Homo sapiens
ucugagugauggagauuug

SEQ ID NO: 216056 - RNA, 19 nt, Homo sapiens
gaucugaauggcgaacuuu

SEQ ID NO: 216057 - RNA, 19 nt, Homo sapiens
cagauggcagcuacacaua

SEQ ID NO: 216058 - RNA, 19 nt, Homo sapiens
aaaccaguguggauuugau

SEQ ID NO: 216059 - RNA, 19 nt, Homo sapiens
agaaaccaguguggauuug

SEQ ID NO: 216060 - RNA, 19 nt, Homo sapiens
guagcaaucuaggaaacug

SEQ ID NO: 216061 - RNA, 19 nt, Homo sapiens
cuaccacagcuauaaauug

SEQ ID NO: 216062 - RNA, 19 nt, Homo sapiens
cagagccggugauaugauc

SEQ ID NO: 216063 - RNA, 19 nt, Homo sapiens
gcuagaaaccaguguggau

SEQ ID NO: 216064 - RNA, 19 nt, Homo sapiens
ugcuauagcuucugcuugu

SEQ ID NO: 216065 - RNA, 19 nt, Homo sapiens
ggcgaacuuucagcaauga

SEQ ID NO: 216066 - RNA, 19 nt, Homo sapiens
acacauauagcccguaaag

SEQ ID NO: 216067 - RNA, 19 nt, Homo sapiens
ccaagagucacauguccaa

SEQ ID NO: 216068 - RNA, 19 nt, Homo sapiens
gaucgggcaaugaugaaug

SEQ ID NO: 216069 - RNA, 19 nt, Homo sapiens
cuauuuacauggccucaca

SEQ ID NO: 216070 - RNA, 19 nt, Homo sapiens
uaggugaccggguuauuga

SEQ ID NO: 216071 - RNA, 19 nt, Homo sapiens
uggcgaacuuucagcaaug

SEQ ID NO: 216072 - RNA, 19 nt, Homo sapiens
gauggagauuugucuacca

SEQ ID NO: 216073 - RNA, 19 nt, Homo sapiens
aaugcuggguugagccuuu

SEQ ID NO: 216074 - RNA, 19 nt, Homo sapiens
aaacuuugccuguuguaca

SEQ ID NO: 216075 - RNA, 19 nt, Homo sapiens
gauguuacaaucagacagu

SEQ ID NO: 216076 - RNA, 19 nt, Homo sapiens
aaucagacaguccuauaga

SEQ ID NO: 216077 - RNA, 19 nt, Homo sapiens
uuauugaugugggaucuga

SEQ ID NO: 216078 - RNA, 19 nt, Homo sapiens
aagagcuaaugaugcuaua

SEQ ID NO: 216079 - RNA, 19 nt, Homo sapiens
uccuacagacuucaaauuu

SEQ ID NO: 216080 - RNA, 19 nt, Homo sapiens
guaucacgaauuucuaaga

SEQ ID NO: 216081 - RNA, 19 nt, Homo sapiens
gcuucugcuugucucuaua

SEQ ID NO: 216082 - RNA, 19 nt, Homo sapiens
ugaagggaagagcuaauga

SEQ ID NO: 216083 - RNA, 19 nt, Homo sapiens
gcauucaaagaaaucacua

SEQ ID NO: 216084 - RNA, 19 nt, Homo sapiens
acauauagcccguaaagcu

SEQ ID NO: 216085 - RNA, 19 nt, Homo sapiens
gugaccggguuauugaugu

SEQ ID NO: 216086 - RNA, 19 nt, Homo sapiens
guaccagaaucggagaaca

SEQ ID NO: 216087 - RNA, 19 nt, Homo sapiens
acaaacuaccacagcuaua

SEQ ID NO: 216088 - RNA, 19 nt, Homo sapiens
cuagaaaccaguguggauu

SEQ ID NO: 216089 - RNA, 19 nt, Homo sapiens
uaaugaugcuauagcuucu

SEQ ID NO: 216090 - RNA, 19 nt, Homo sapiens
aagcaaguauaugaacaga

SEQ ID NO: 216091 - RNA, 19 nt, Homo sapiens
ggguugagccuuucaugag

SEQ ID NO: 216092 - RNA, 19 nt, Homo sapiens
uuucagcaaugacaaagca

SEQ ID NO: 216093 - RNA, 19 nt, Homo sapiens
ugaauguggcuugguugua

SEQ ID NO: 216094 - RNA, 19 nt, Homo sapiens
caaucuaggaaacuguauu

SEQ ID NO: 216095 - RNA, 19 nt, Homo sapiens
gcuuggcauucuguaugua

SEQ ID NO: 216096 - RNA, 19 nt, Homo sapiens
caaucagacaguccuauag

SEQ ID NO: 216097 - RNA, 19 nt, Homo sapiens
ugugccguaucacgaauuu

SEQ ID NO: 216098 - RNA, 19 nt, Homo sapiens
guuccuaggacauuuaaag

SEQ ID NO: 216099 - RNA, 19 nt, Homo sapiens
aucaaucuaccucgaaaua

SEQ ID NO: 216100 - RNA, 19 nt, Homo sapiens
gagauuugucuaccaugau

SEQ ID NO: 216101 - RNA, 19 nt, Homo sapiens
guucugaucgggcaaugau

SEQ ID NO: 216102 - RNA, 19 nt, Homo sapiens
cuaggaaacuguauuuugg

SEQ ID NO: 216103 - RNA, 19 nt, Homo sapiens
gaacuuggccuaugaaaua

SEQ ID NO: 216104 - RNA, 19 nt, Homo sapiens
gagauauacuugagucuua

SEQ ID NO: 216105 - RNA, 19 nt, Homo sapiens
guagagagcuugacuuuua

SEQ ID NO: 216106 - RNA, 19 nt, Homo sapiens
uaacauggaugaccaagaa

SEQ ID NO: 216107 - RNA, 19 nt, Homo sapiens
gcagaaaucaacagaauaa

SEQ ID NO: 216108 - RNA, 19 nt, Homo sapiens
cuacguugcuuguauauuu

SEQ ID NO: 216109 - RNA, 19 nt, Homo sapiens
guacagaccucuugucagu

SEQ ID NO: 216110 - RNA, 19 nt, Homo sapiens
caaccgggcuuccuucaaa

SEQ ID NO: 216111 - RNA, 19 nt, Homo sapiens
ugagauggaucaauaugua

SEQ ID NO: 216112 - RNA, 19 nt, Homo sapiens
gagggaaguucauaaggua

SEQ ID NO: 216113 - RNA, 19 nt, Homo sapiens
gagacaaguuuaucaaaug

SEQ ID NO: 216114 - RNA, 19 nt, Homo sapiens
ggagacaaguuuaucaaau

SEQ ID NO: 216115 - RNA, 19 nt, Homo sapiens
caccaugccuggcuaauuu

SEQ ID NO: 216116 - RNA, 19 nt, Homo sapiens
gacugaauguugacaauaa

SEQ ID NO: 216117 - RNA, 19 nt, Homo sapiens
guuaaugacugaauguuga

SEQ ID NO: 216118 - RNA, 19 nt, Homo sapiens
agaggaagaugacgaguuu

SEQ ID NO: 216119 - RNA, 19 nt, Homo sapiens
gcauaugguucugaagaua

SEQ ID NO: 216120 - RNA, 19 nt, Homo sapiens
ugaaggcugucucucuuua

SEQ ID NO: 216121 - RNA, 19 nt, Homo sapiens
ccacuacguugcuuguaua

SEQ ID NO: 216122 - RNA, 19 nt, Homo sapiens
ggagugauguuucauuuac

SEQ ID NO: 216123 - RNA, 19 nt, Homo sapiens
gguaaacccuuaggaagaa

SEQ ID NO: 216124 - RNA, 19 nt, Homo sapiens
ggaagcauauauagcaaug

SEQ ID NO: 216125 - RNA, 19 nt, Homo sapiens
acaagggucuguaacaauu

SEQ ID NO: 216126 - RNA, 19 nt, Homo sapiens
cagcagaaaucaacagaau

SEQ ID NO: 216127 - RNA, 19 nt, Homo sapiens
gaugaagucucacucuugu

SEQ ID NO: 216128 - RNA, 19 nt, Homo sapiens
gaauauaugagccuuguau

SEQ ID NO: 216129 - RNA, 19 nt, Homo sapiens
ugagugagcuuucccuaau

SEQ ID NO: 216130 - RNA, 19 nt, Homo sapiens
ugacgaguuugaagaagua

SEQ ID NO: 216131 - RNA, 19 nt, Homo sapiens
ggaguucguugcuaaagau

SEQ ID NO: 216132 - RNA, 19 nt, Homo sapiens
ggcugucucucuuuaauuu

SEQ ID NO: 216133 - RNA, 19 nt, Homo sapiens
ucacugaucacauccauuu

SEQ ID NO: 216134 - RNA, 19 nt, Homo sapiens
ggauuuaggaugauagaaa

SEQ ID NO: 216135 - RNA, 19 nt, Homo sapiens
gagcuuucccuaauucuuu

SEQ ID NO: 216136 - RNA, 19 nt, Homo sapiens
gugaaggguugaagaguga

SEQ ID NO: 216137 - RNA, 19 nt, Homo sapiens
aggaaugucucaucuuuga

SEQ ID NO: 216138 - RNA, 19 nt, Homo sapiens
gaagggaaaucugccaaag

SEQ ID NO: 216139 - RNA, 19 nt, Homo sapiens
agaagaggaugaagaggaa

SEQ ID NO: 216140 - RNA, 19 nt, Homo sapiens
caauggcgaugacucagaa

SEQ ID NO: 216141 - RNA, 19 nt, Homo sapiens
aaccagaauuugugucuuu

SEQ ID NO: 216142 - RNA, 19 nt, Homo sapiens
gaagacuuauacacucaga

SEQ ID NO: 216143 - RNA, 19 nt, Homo sapiens
gaauuugugucuuuagaac

SEQ ID NO: 216144 - RNA, 19 nt, Homo sapiens
gaugugaacuuggccuaug

SEQ ID NO: 216145 - RNA, 19 nt, Homo sapiens
gacagaggaugugaacuug

SEQ ID NO: 216146 - RNA, 19 nt, Homo sapiens
gguagaagaggaugaauca

SEQ ID NO: 216147 - RNA, 19 nt, Homo sapiens
gaacuuuccgcuguacuuu

SEQ ID NO: 216148 - RNA, 19 nt, Homo sapiens
uguccugucuguaguagua

SEQ ID NO: 216149 - RNA, 19 nt, Homo sapiens
cagaauuugugucuuuaga

SEQ ID NO: 216150 - RNA, 19 nt, Homo sapiens
ugaaauacuugagccagaa

SEQ ID NO: 216151 - RNA, 19 nt, Homo sapiens
ggagugcaauggcgugauc

SEQ ID NO: 216152 - RNA, 19 nt, Homo sapiens
gaagaauugagaccgauga

SEQ ID NO: 216153 - RNA, 19 nt, Homo sapiens
acacaagggucuguaacaa

SEQ ID NO: 216154 - RNA, 19 nt, Homo sapiens
aaacauggacguaagacaa

SEQ ID NO: 216155 - RNA, 19 nt, Homo sapiens
gagugagcuuucccuaauu

SEQ ID NO: 216156 - RNA, 19 nt, Homo sapiens
caaauguccugucuguagu

SEQ ID NO: 216157 - RNA, 19 nt, Homo sapiens
ucaaauguccugucuguag

SEQ ID NO: 216158 - RNA, 19 nt, Homo sapiens
ucugauauguagcauggua

SEQ ID NO: 216159 - RNA, 19 nt, Homo sapiens
ccuauuugguugagagaaa

SEQ ID NO: 216160 - RNA, 19 nt, Homo sapiens
gaaaugagugagggaaguu

SEQ ID NO: 216161 - RNA, 19 nt, Homo sapiens
gaaggcugucucucuuuaa

SEQ ID NO: 216162 - RNA, 19 nt, Homo sapiens
caguuagucugauuuggaa

SEQ ID NO: 216163 - RNA, 19 nt, Homo sapiens
gagauggaucaauauguaa

SEQ ID NO: 216164 - RNA, 19 nt, Homo sapiens
ggaaguucauaagguaaau

SEQ ID NO: 216165 - RNA, 19 nt, Homo sapiens
caagguagggugcugagaa

SEQ ID NO: 216166 - RNA, 19 nt, Homo sapiens
aaaggaagcauauauagca

SEQ ID NO: 216167 - RNA, 19 nt, Homo sapiens
ccagaugacaccagaagaa

SEQ ID NO: 216168 - RNA, 19 nt, Homo sapiens
gaagaugacgaguuugaag

SEQ ID NO: 216169 - RNA, 19 nt, Homo sapiens
ugaagcgguuagccaagua

SEQ ID NO: 216170 - RNA, 19 nt, Homo sapiens
cacaugagaagaagaauug

SEQ ID NO: 216171 - RNA, 19 nt, Homo sapiens
aauauaaacuggaccacau

SEQ ID NO: 216172 - RNA, 19 nt, Homo sapiens
auaauucacugaucacauc

SEQ ID NO: 216173 - RNA, 19 nt, Homo sapiens
gaacuccugugugaaagag

SEQ ID NO: 216174 - RNA, 19 nt, Homo sapiens
guaaauccuucccauccau

SEQ ID NO: 216175 - RNA, 19 nt, Homo sapiens
gcaaugggacaacgcaugu

SEQ ID NO: 216176 - RNA, 19 nt, Homo sapiens
gggcauaugguucugaaga

SEQ ID NO: 216177 - RNA, 19 nt, Homo sapiens
gcucuuugauccuaugaca

SEQ ID NO: 216178 - RNA, 19 nt, Homo sapiens
cuucaaauguccugucugu

SEQ ID NO: 216179 - RNA, 19 nt, Homo sapiens
ugagggaaguucauaaggu

SEQ ID NO: 216180 - RNA, 19 nt, Homo sapiens
guauuuaaguggcuuucug

SEQ ID NO: 216181 - RNA, 19 nt, Homo sapiens
ggaagggaaaucugccaaa

SEQ ID NO: 216182 - RNA, 19 nt, Homo sapiens
agacagaggaugugaacuu

SEQ ID NO: 216183 - RNA, 19 nt, Homo sapiens
gacaagcauugguaacagu

SEQ ID NO: 216184 - RNA, 19 nt, Homo sapiens
ugagucagaugaugauucu

SEQ ID NO: 216185 - RNA, 19 nt, Homo sapiens
ugucagugcuauaaauugu

SEQ ID NO: 216186 - RNA, 19 nt, Homo sapiens
ccgaguagcugggauuaca

SEQ ID NO: 216187 - RNA, 19 nt, Homo sapiens
gaaaaggaagcauauauag

SEQ ID NO: 216188 - RNA, 19 nt, Homo sapiens
uugaagaaguagcagauga

SEQ ID NO: 216189 - RNA, 19 nt, Homo sapiens
gccaaagagaggccuauuu

SEQ ID NO: 216190 - RNA, 19 nt, Homo sapiens
guaguacuuucacagacuu

SEQ ID NO: 216191 - RNA, 19 nt, Homo sapiens
ucaauuaucguacucuugu

SEQ ID NO: 216192 - RNA, 19 nt, Homo sapiens
cgccauaacuacuacuuca

SEQ ID NO: 216193 - RNA, 19 nt, Homo sapiens
agaaaucccagcccugaaa

SEQ ID NO: 216194 - RNA, 19 nt, Homo sapiens
gaccacaugagaagaagaa

SEQ ID NO: 216195 - RNA, 19 nt, Homo sapiens
uaaacuggaccacaugaga

SEQ ID NO: 216196 - RNA, 19 nt, Homo sapiens
cauaacuacuacuucauca

SEQ ID NO: 216197 - RNA, 19 nt, Homo sapiens
ggugggagcguguguggaa

SEQ ID NO: 216198 - RNA, 19 nt, Homo sapiens
gaaugucucaucuuugaag

SEQ ID NO: 216199 - RNA, 19 nt, Homo sapiens
guucugaagauaugaaaga

SEQ ID NO: 216200 - RNA, 19 nt, Homo sapiens
gaaaaccacucgccauaac

SEQ ID NO: 216201 - RNA, 19 nt, Homo sapiens
cucccaaagugcuguauuu

SEQ ID NO: 216202 - RNA, 19 nt, Homo sapiens
ggcauaugguucugaagau

SEQ ID NO: 216203 - RNA, 19 nt, Homo sapiens
gaacagaguuacagauaca

SEQ ID NO: 216204 - RNA, 19 nt, Homo sapiens
gauaagagcugucaguuuu

SEQ ID NO: 216205 - RNA, 19 nt, Homo sapiens
gcuaaugacugaggcuuua

SEQ ID NO: 216206 - RNA, 19 nt, Homo sapiens
ggaugaaacacaacauuua

SEQ ID NO: 216207 - RNA, 19 nt, Homo sapiens
uuaccaaacucaaagcuua

SEQ ID NO: 216208 - RNA, 19 nt, Homo sapiens
gagaggagcaguucaguuu

SEQ ID NO: 216209 - RNA, 19 nt, Homo sapiens
ucaggaagcucuggauaua

SEQ ID NO: 216210 - RNA, 19 nt, Homo sapiens
cagaaacaauggcuaauga

SEQ ID NO: 216211 - RNA, 19 nt, Homo sapiens
gaccagauacuauuuguaa

SEQ ID NO: 216212 - RNA, 19 nt, Homo sapiens
gcaggaaucuggaccaaag

SEQ ID NO: 216213 - RNA, 19 nt, Homo sapiens
gaagaagcacugcccaauu

SEQ ID NO: 216214 - RNA, 19 nt, Homo sapiens
ggagauacgcauccucuaa

SEQ ID NO: 216215 - RNA, 19 nt, Homo sapiens
aaugugauguucccuguua

SEQ ID NO: 216216 - RNA, 19 nt, Homo sapiens
gcaaauuaccaaacucaaa

SEQ ID NO: 216217 - RNA, 19 nt, Homo sapiens
ugacauuacuuccagcaaa

SEQ ID NO: 216218 - RNA, 19 nt, Homo sapiens
ggauauaaguuugguguuc

SEQ ID NO: 216219 - RNA, 19 nt, Homo sapiens
gauguucccuguuaaccuu

SEQ ID NO: 216220 - RNA, 19 nt, Homo sapiens
cuggagugcugaaggauua

SEQ ID NO: 216221 - RNA, 19 nt, Homo sapiens
aagaagcacugcccaauuc

SEQ ID NO: 216222 - RNA, 19 nt, Homo sapiens
aacaauggcuaaugacuga

SEQ ID NO: 216223 - RNA, 19 nt, Homo sapiens
gcaggugucuuugcugugu

SEQ ID NO: 216224 - RNA, 19 nt, Homo sapiens
ggaacagaguuacagauac

SEQ ID NO: 216225 - RNA, 19 nt, Homo sapiens
gacauuacuuccagcaaau

SEQ ID NO: 216226 - RNA, 19 nt, Homo sapiens
ggauuaggaggaauucuuu

SEQ ID NO: 216227 - RNA, 19 nt, Homo sapiens
gagcaguucaguuuacaaa

SEQ ID NO: 216228 - RNA, 19 nt, Homo sapiens
ccaagccuguugagagaaa

SEQ ID NO: 216229 - RNA, 19 nt, Homo sapiens
gaaggauuacucugacauu

SEQ ID NO: 216230 - RNA, 19 nt, Homo sapiens
aaggauuacucugacauua

SEQ ID NO: 216231 - RNA, 19 nt, Homo sapiens
gaggagcaguucaguuuac

SEQ ID NO: 216232 - RNA, 19 nt, Homo sapiens
ggauuacucugacauuacu

SEQ ID NO: 216233 - RNA, 19 nt, Homo sapiens
gcagaaacaauggcuaaug

SEQ ID NO: 216234 - RNA, 19 nt, Homo sapiens
gcaugaccagcgaggauua

SEQ ID NO: 216235 - RNA, 19 nt, Homo sapiens
gaugaaacacaacauuuag

SEQ ID NO: 216236 - RNA, 19 nt, Homo sapiens
gauauaaguuugguguucu

SEQ ID NO: 216237 - RNA, 19 nt, Homo sapiens
caaauuaccaaacucaaag

SEQ ID NO: 216238 - RNA, 19 nt, Homo sapiens
uggaacagaguuacagaua

SEQ ID NO: 216239 - RNA, 19 nt, Homo sapiens
gcaaauagggaacaguuuu

SEQ ID NO: 216240 - RNA, 19 nt, Homo sapiens
gagaaagggagcuguucaa

SEQ ID NO: 216241 - RNA, 19 nt, Homo sapiens
gauugugaauuacaugaag

SEQ ID NO: 216242 - RNA, 19 nt, Homo sapiens
guuccuuucuuccucguuu

SEQ ID NO: 216243 - RNA, 19 nt, Homo sapiens
caaagaaaguggccccuau

SEQ ID NO: 216244 - RNA, 19 nt, Homo sapiens
gggaccagauacuauuugu

SEQ ID NO: 216245 - RNA, 19 nt, Homo sapiens
cuacuuaggcucuuagauc

SEQ ID NO: 216246 - RNA, 19 nt, Homo sapiens
ggacucaagcagaaacaau

SEQ ID NO: 216247 - RNA, 19 nt, Homo sapiens
caaaacaagugcaaauuac

SEQ ID NO: 216248 - RNA, 19 nt, Homo sapiens
cagcaaauagggaacaguu

SEQ ID NO: 216249 - RNA, 19 nt, Homo sapiens
ggaaucuggaccaaagaaa

SEQ ID NO: 216250 - RNA, 19 nt, Homo sapiens
ggaccagauacuauuugua

SEQ ID NO: 216251 - RNA, 19 nt, Homo sapiens
gaugggaaguaugcuuuca

SEQ ID NO: 216252 - RNA, 19 nt, Homo sapiens
gaaagggagcuguucaaaa

SEQ ID NO: 216253 - RNA, 19 nt, Homo sapiens
ggagaggagcaguucaguu

SEQ ID NO: 216254 - RNA, 19 nt, Homo sapiens
ugauaagagcugucaguuu

SEQ ID NO: 216255 - RNA, 19 nt, Homo sapiens
cagcgaggauuaggaggaa

SEQ ID NO: 216256 - RNA, 19 nt, Homo sapiens
ccaaguacaacgugagaga

SEQ ID NO: 216257 - RNA, 19 nt, Homo sapiens
gaaacaauggcuaaugacu

SEQ ID NO: 216258 - RNA, 19 nt, Homo sapiens
caucaucaucgucaaagaa

SEQ ID NO: 216259 - RNA, 19 nt, Homo sapiens
gcucaugggcaaugugaug

SEQ ID NO: 216260 - RNA, 19 nt, Homo sapiens
cuuuaagacucauaacgaa

SEQ ID NO: 216261 - RNA, 19 nt, Homo sapiens
caucaucgucaaagaagaa

SEQ ID NO: 216262 - RNA, 19 nt, Homo sapiens
gaacaguuuugcccuggaa

SEQ ID NO: 216263 - RNA, 19 nt, Homo sapiens
gacaggguauuucuuccau

SEQ ID NO: 216264 - RNA, 19 nt, Homo sapiens
uaacuugaaagcuuuguca

SEQ ID NO: 216265 - RNA, 19 nt, Homo sapiens
cccauagucuugaaugcaa

SEQ ID NO: 216266 - RNA, 19 nt, Homo sapiens
cuuccucguuuguuacuuu

SEQ ID NO: 216267 - RNA, 19 nt, Homo sapiens
uacuuaggcucuuagauca

SEQ ID NO: 216268 - RNA, 19 nt, Homo sapiens
aagcagaaacaauggcuaa

SEQ ID NO: 216269 - RNA, 19 nt, Homo sapiens
gaagcucuggauauaaguu

SEQ ID NO: 216270 - RNA, 19 nt, Homo sapiens
aggaagcucuggauauaag

SEQ ID NO: 216271 - RNA, 19 nt, Homo sapiens
gcuuuaagacucauaacga

SEQ ID NO: 216272 - RNA, 19 nt, Homo sapiens
gcuaagauugugaauuaca

SEQ ID NO: 216273 - RNA, 19 nt, Homo sapiens
caaguuugcccauagucuu

SEQ ID NO: 216274 - RNA, 19 nt, Homo sapiens
aaugguuccugguuccuuu

SEQ ID NO: 216275 - RNA, 19 nt, Homo sapiens
gaaucuggaccaaagaaag

SEQ ID NO: 216276 - RNA, 19 nt, Homo sapiens
gcucuuagaucagcaugac

SEQ ID NO: 216277 - RNA, 19 nt, Homo sapiens
uggaugaaacacaacauuu

SEQ ID NO: 216278 - RNA, 19 nt, Homo sapiens
gaagaaaacaaagguagaa

SEQ ID NO: 216279 - RNA, 19 nt, Homo sapiens
gcaugcaggugucuuugcu

SEQ ID NO: 216280 - RNA, 19 nt, Homo sapiens
ucgucaggcucuaaacaaa

SEQ ID NO: 216281 - RNA, 19 nt, Homo sapiens
ccucguuuguuacuuuaga

SEQ ID NO: 216282 - RNA, 19 nt, Homo sapiens
guuccugguuccuuucuuc

SEQ ID NO: 216283 - RNA, 19 nt, Homo sapiens
ccaaacucaaagcuuauuu

SEQ ID NO: 216284 - RNA, 19 nt, Homo sapiens
gcgaggauuaggaggaauu

SEQ ID NO: 216285 - RNA, 19 nt, Homo sapiens
gaucgucaggcucuaaaca

SEQ ID NO: 216286 - RNA, 19 nt, Homo sapiens
auauuggacucaagcagaa

SEQ ID NO: 216287 - RNA, 19 nt, Homo sapiens
caucgucaaagaagaagaa

SEQ ID NO: 216288 - RNA, 19 nt, Homo sapiens
gaagcgacaggguauuucu

SEQ ID NO: 216289 - RNA, 19 nt, Homo sapiens
aguacaacgugagagauaa

SEQ ID NO: 216290 - RNA, 19 nt, Homo sapiens
uacgcauccucuaaccuua

SEQ ID NO: 216291 - RNA, 19 nt, Homo sapiens
gaagaagaaaacaaaggua

SEQ ID NO: 216292 - RNA, 19 nt, Homo sapiens
aaguacaacgugagagaua

SEQ ID NO: 216293 - RNA, 19 nt, Homo sapiens
gaggaucgucaggcucuaa

SEQ ID NO: 216294 - RNA, 19 nt, Homo sapiens
caucaucaucaucgucaaa

SEQ ID NO: 216295 - RNA, 19 nt, Homo sapiens
caacgugagagauaagaag

SEQ ID NO: 216296 - RNA, 19 nt, Homo sapiens
aggcugcccuucucacuca

SEQ ID NO: 216297 - RNA, 19 nt, Homo sapiens
agaaagggagcuguucaaa

SEQ ID NO: 216298 - RNA, 19 nt, Homo sapiens
gagauacgcauccucuaac

SEQ ID NO: 216299 - RNA, 19 nt, Homo sapiens
cuuucuuccucguuuguua

SEQ ID NO: 216300 - RNA, 19 nt, Homo sapiens
gggcucaugggcaauguga

SEQ ID NO: 216301 - RNA, 19 nt, Homo sapiens
gugcaaauuaccaaacuca

SEQ ID NO: 216302 - RNA, 19 nt, Homo sapiens
agaggagcaguucaguuua

SEQ ID NO: 216303 - RNA, 19 nt, Homo sapiens
gccagaaugucacugaaua

SEQ ID NO: 216304 - RNA, 19 nt, Homo sapiens
ggaagcccaugaccacuaa

SEQ ID NO: 216305 - RNA, 19 nt, Homo sapiens
gugcacaacugguacaauu

SEQ ID NO: 216306 - RNA, 19 nt, Homo sapiens
gacucugucucaauaaaua

SEQ ID NO: 216307 - RNA, 19 nt, Homo sapiens
gcaagaugaucaacgacaa

SEQ ID NO: 216308 - RNA, 19 nt, Homo sapiens
uaacagagaacacguccua

SEQ ID NO: 216309 - RNA, 19 nt, Homo sapiens
ggaacaaggugcugaacca

SEQ ID NO: 216310 - RNA, 19 nt, Homo sapiens
gaacacguccuacuacauc

SEQ ID NO: 216311 - RNA, 19 nt, Homo sapiens
gagcgggacuugagcaaca

SEQ ID NO: 216312 - RNA, 19 nt, Homo sapiens
gagcagagcgacaguagug

SEQ ID NO: 216313 - RNA, 19 nt, Homo sapiens
gccaagagguggacuacau

SEQ ID NO: 216314 - RNA, 19 nt, Homo sapiens
cccaguaagucuucaguuu

SEQ ID NO: 216315 - RNA, 19 nt, Homo sapiens
gcacaacugguacaauuuc

SEQ ID NO: 216316 - RNA, 19 nt, Homo sapiens
gagaacacguccuacuaca

SEQ ID NO: 216317 - RNA, 19 nt, Homo sapiens
ccacauagcccaguaaguc

SEQ ID NO: 216318 - RNA, 19 nt, Homo sapiens
guaguuagcaauucuggaa

SEQ ID NO: 216319 - RNA, 19 nt, Homo sapiens
gaagacgccacccaagaga

SEQ ID NO: 216320 - RNA, 19 nt, Homo sapiens
gagaagaagcgcaggaaag

SEQ ID NO: 216321 - RNA, 19 nt, Homo sapiens
cagagaacacguccuacua

SEQ ID NO: 216322 - RNA, 19 nt, Homo sapiens
gugaggcucuguccaauac

SEQ ID NO: 216323 - RNA, 19 nt, Homo sapiens
aagaagagccugagagcaa

SEQ ID NO: 216324 - RNA, 19 nt, Homo sapiens
acaaggugcugaaccacuu

SEQ ID NO: 216325 - RNA, 19 nt, Homo sapiens
gcaaaucaggcaggaaguu

SEQ ID NO: 216326 - RNA, 19 nt, Homo sapiens
gcagcgagcagacagugaa

SEQ ID NO: 216327 - RNA, 19 nt, Homo sapiens
gaggagagcgacauugaca

SEQ ID NO: 216328 - RNA, 19 nt, Homo sapiens
gaauacgucguucgaguuc

SEQ ID NO: 216329 - RNA, 19 nt, Homo sapiens
cagaggagagcgacauuga

SEQ ID NO: 216330 - RNA, 19 nt, Homo sapiens
ggagaagaagcgcaggaaa

SEQ ID NO: 216331 - RNA, 19 nt, Homo sapiens
ugacuuauccaccacauag

SEQ ID NO: 216332 - RNA, 19 nt, Homo sapiens
caacuuugcuacguggaau

SEQ ID NO: 216333 - RNA, 19 nt, Homo sapiens
caagaagggaggcguaaca

SEQ ID NO: 216334 - RNA, 19 nt, Homo sapiens
cagccugggugacagaaug

SEQ ID NO: 216335 - RNA, 19 nt, Homo sapiens
aggcugcagugaacuauga

SEQ ID NO: 216336 - RNA, 19 nt, Homo sapiens
ucucuucagcugugacuua

SEQ ID NO: 216337 - RNA, 19 nt, Homo sapiens
caagaugaucaacgacaaa

SEQ ID NO: 216338 - RNA, 19 nt, Homo sapiens
agaagaagcgcaggaaaga

SEQ ID NO: 216339 - RNA, 19 nt, Homo sapiens
gcagccagaaugucacuga

SEQ ID NO: 216340 - RNA, 19 nt, Homo sapiens
ccuguuaggccuucuuauu

SEQ ID NO: 216341 - RNA, 19 nt, Homo sapiens
gcagacagugaacguguug

SEQ ID NO: 216342 - RNA, 19 nt, Homo sapiens
ccacuaaggaccugcugaa

SEQ ID NO: 216343 - RNA, 19 nt, Homo sapiens
uccaguagcucccaagaag

SEQ ID NO: 216344 - RNA, 19 nt, Homo sapiens
ggaagcgggugagcgagau

SEQ ID NO: 216345 - RNA, 19 nt, Homo sapiens
guucgaguuccuaagaaua

SEQ ID NO: 216346 - RNA, 19 nt, Homo sapiens
gagugaggcucuguccaau

SEQ ID NO: 216347 - RNA, 19 nt, Homo sapiens
gagcgccucuuccgguuac

SEQ ID NO: 216348 - RNA, 19 nt, Homo sapiens
ggaggaacaaggugcugaa

SEQ ID NO: 216349 - RNA, 19 nt, Homo sapiens
caucauggcuuuuaaugca

SEQ ID NO: 216350 - RNA, 19 nt, Homo sapiens
aaugaaauccuggcacaaa

SEQ ID NO: 216351 - RNA, 19 nt, Homo sapiens
uguuaggccuucuuauugu

SEQ ID NO: 216352 - RNA, 19 nt, Homo sapiens
gcccaagggugucgaugag

SEQ ID NO: 216353 - RNA, 19 nt, Homo sapiens
ucagacggcuccaguagcu

SEQ ID NO: 216354 - RNA, 19 nt, Homo sapiens
ggacuucgagggccaagag

SEQ ID NO: 216355 - RNA, 19 nt, Homo sapiens
gaaguucaagggcaucaag

SEQ ID NO: 216356 - RNA, 19 nt, Homo sapiens
ucagugacccuucgacauc

SEQ ID NO: 216357 - RNA, 19 nt, Homo sapiens
gaucggaaccacugaccau

SEQ ID NO: 216358 - RNA, 19 nt, Homo sapiens
ugaauacgucguucgaguu

SEQ ID NO: 216359 - RNA, 19 nt, Homo sapiens
caacugguacaauuucaca

SEQ ID NO: 216360 - RNA, 19 nt, Homo sapiens
acaagaaaaucuaccaaga

SEQ ID NO: 216361 - RNA, 19 nt, Homo sapiens
uaaugcagccgacaaaguc

SEQ ID NO: 216362 - RNA, 19 nt, Homo sapiens
gaggcucuguccaauacau

SEQ ID NO: 216363 - RNA, 19 nt, Homo sapiens
uagcaauucuggaaaaguu

SEQ ID NO: 216364 - RNA, 19 nt, Homo sapiens
gaaccacuucagcaucaug

SEQ ID NO: 216365 - RNA, 19 nt, Homo sapiens
aggaggagaugcccgaauc

SEQ ID NO: 216366 - RNA, 19 nt, Homo sapiens
ucaaggcugcagugaacua

SEQ ID NO: 216367 - RNA, 19 nt, Homo sapiens
gaacguguuggcccagauc

SEQ ID NO: 216368 - RNA, 19 nt, Homo sapiens
aagaagacgccacccaaga

SEQ ID NO: 216369 - RNA, 19 nt, Homo sapiens
ggaggacgaccuggagaug

SEQ ID NO: 216370 - RNA, 19 nt, Homo sapiens
cagccagaaugucacugaa

SEQ ID NO: 216371 - RNA, 19 nt, Homo sapiens
caaaucaggcaggaaguuc

SEQ ID NO: 216372 - RNA, 19 nt, Homo sapiens
caguaagucuucaguuuug

SEQ ID NO: 216373 - RNA, 19 nt, Homo sapiens
cggaagcccaugaccacua

SEQ ID NO: 216374 - RNA, 19 nt, Homo sapiens
gaugagcagagcgacagua

SEQ ID NO: 216375 - RNA, 19 nt, Homo sapiens
gaaugaaauccuggcacaa

SEQ ID NO: 216376 - RNA, 19 nt, Homo sapiens
cuguuaggccuucuuauug

SEQ ID NO: 216377 - RNA, 19 nt, Homo sapiens
ccagaggagacgaaaggaa

SEQ ID NO: 216378 - RNA, 19 nt, Homo sapiens
ggcccuagcagccagaaug

SEQ ID NO: 216379 - RNA, 19 nt, Homo sapiens
ccaagagguggacuacaug

SEQ ID NO: 216380 - RNA, 19 nt, Homo sapiens
gcacgccagaggagacgaa

SEQ ID NO: 216381 - RNA, 19 nt, Homo sapiens
aagaagcgcaggaaagaca

SEQ ID NO: 216382 - RNA, 19 nt, Homo sapiens
ccuagcagccagaauguca

SEQ ID NO: 216383 - RNA, 19 nt, Homo sapiens
cgacaguagugaggagagu

SEQ ID NO: 216384 - RNA, 19 nt, Homo sapiens
cacaacugguacaauuuca

SEQ ID NO: 216385 - RNA, 19 nt, Homo sapiens
gaggaggcucggaggaaga

SEQ ID NO: 216386 - RNA, 19 nt, Homo sapiens
gaugaucaacgacaaaaug

SEQ ID NO: 216387 - RNA, 19 nt, Homo sapiens
ggcccaagggugucgauga

SEQ ID NO: 216388 - RNA, 19 nt, Homo sapiens
agagguggacuacauguca

SEQ ID NO: 216389 - RNA, 19 nt, Homo sapiens
caagagguggacuacaugu

SEQ ID NO: 216390 - RNA, 19 nt, Homo sapiens
agaagaagaaggguucaga

SEQ ID NO: 216391 - RNA, 19 nt, Homo sapiens
cggaaccacugaccauugc

SEQ ID NO: 216392 - RNA, 19 nt, Homo sapiens
gaagaagaagaaggguuca

SEQ ID NO: 216393 - RNA, 19 nt, Homo sapiens
guuaggccuucuuauuguc

SEQ ID NO: 216394 - RNA, 19 nt, Homo sapiens
gcgacgugcaggugacuga

SEQ ID NO: 216395 - RNA, 19 nt, Homo sapiens
gcaagacaacacccaacag

SEQ ID NO: 216396 - RNA, 19 nt, Homo sapiens
ggcaagacaacacccaaca

SEQ ID NO: 216397 - RNA, 19 nt, Homo sapiens
ccaguaagucuucaguuuu

SEQ ID NO: 216398 - RNA, 19 nt, Homo sapiens
ccaccacauagcccaguaa

SEQ ID NO: 216399 - RNA, 19 nt, Homo sapiens
acaguucucccuuccacuu

SEQ ID NO: 216400 - RNA, 19 nt, Homo sapiens
gcaauucuggaaaaguuaa

SEQ ID NO: 216401 - RNA, 19 nt, Homo sapiens
agacgccacccaagagaga

SEQ ID NO: 216402 - RNA, 19 nt, Homo sapiens
aggaggaggaggagaagaa

SEQ ID NO: 216403 - RNA, 19 nt, Homo sapiens
ggacagacauuaacaguau

SEQ ID NO: 216404 - RNA, 19 nt, Homo sapiens
cuaaggagcugagguaaua

SEQ ID NO: 216405 - RNA, 19 nt, Homo sapiens
ggacugaggugucauuuac

SEQ ID NO: 216406 - RNA, 19 nt, Homo sapiens
cagauaagcugucauugga

SEQ ID NO: 216407 - RNA, 19 nt, Homo sapiens
gaaugaggaucuugcaaau

SEQ ID NO: 216408 - RNA, 19 nt, Homo sapiens
uuacaaaccuguugcuaau

SEQ ID NO: 216409 - RNA, 19 nt, Homo sapiens
gagcugagguaauacagau

SEQ ID NO: 216410 - RNA, 19 nt, Homo sapiens
guacagacacuaucaagga

SEQ ID NO: 216411 - RNA, 19 nt, Homo sapiens
uagucaagguuccuaaaua

SEQ ID NO: 216412 - RNA, 19 nt, Homo sapiens
uuaaacaggugaucacguu

SEQ ID NO: 216413 - RNA, 19 nt, Homo sapiens
cacaacagcuggacaaagu

SEQ ID NO: 216414 - RNA, 19 nt, Homo sapiens
caagguuccuaaauauuug

SEQ ID NO: 216415 - RNA, 19 nt, Homo sapiens
ggagaaagaacagauuuau

SEQ ID NO: 216416 - RNA, 19 nt, Homo sapiens
gaaauugguguucagaaug

SEQ ID NO: 216417 - RNA, 19 nt, Homo sapiens
ggagaauuguauagcaaga

SEQ ID NO: 216418 - RNA, 19 nt, Homo sapiens
caaggagaauuguauagca

SEQ ID NO: 216419 - RNA, 19 nt, Homo sapiens
gaggugucauuuacuuuga

SEQ ID NO: 216420 - RNA, 19 nt, Homo sapiens
gaggagaaagaacagauuu

SEQ ID NO: 216421 - RNA, 19 nt, Homo sapiens
agaaauugguguucagaau

SEQ ID NO: 216422 - RNA, 19 nt, Homo sapiens
guaccugaaggaaaucuua

SEQ ID NO: 216423 - RNA, 19 nt, Homo sapiens
gaaggaauagugguacaaa

SEQ ID NO: 216424 - RNA, 19 nt, Homo sapiens
augaggaucuugcaaauau

SEQ ID NO: 216425 - RNA, 19 nt, Homo sapiens
uguaaggcuuguaaaguuu

SEQ ID NO: 216426 - RNA, 19 nt, Homo sapiens
acaaaccuguugcuaauca

SEQ ID NO: 216427 - RNA, 19 nt, Homo sapiens
aacccaaaguuccuuauuu

SEQ ID NO: 216428 - RNA, 19 nt, Homo sapiens
gauccaaggagaauuguau

SEQ ID NO: 216429 - RNA, 19 nt, Homo sapiens
agucaagguuccuaaauau

SEQ ID NO: 216430 - RNA, 19 nt, Homo sapiens
cuguaaggcuuguaaaguu

SEQ ID NO: 216431 - RNA, 19 nt, Homo sapiens
gaaggacugaggugucauu

SEQ ID NO: 216432 - RNA, 19 nt, Homo sapiens
caucagauaagcugucauu

SEQ ID NO: 216433 - RNA, 19 nt, Homo sapiens
caggugaucacguuucuuu

SEQ ID NO: 216434 - RNA, 19 nt, Homo sapiens
ugaaugaggaucuugcaaa

SEQ ID NO: 216435 - RNA, 19 nt, Homo sapiens
gaucacguuucuuuucaua

SEQ ID NO: 216436 - RNA, 19 nt, Homo sapiens
cagaaacucuuaaaaggaa

SEQ ID NO: 216437 - RNA, 19 nt, Homo sapiens
ucaacuacagaaacucuua

SEQ ID NO: 216438 - RNA, 19 nt, Homo sapiens
aaauugguguucagaaugu

SEQ ID NO: 216439 - RNA, 19 nt, Homo sapiens
uaucuaaggagcugaggua

SEQ ID NO: 216440 - RNA, 19 nt, Homo sapiens
gagaacauccauuugucuu

SEQ ID NO: 216441 - RNA, 19 nt, Homo sapiens
caacuacagaaacucuuaa

SEQ ID NO: 216442 - RNA, 19 nt, Homo sapiens
agucagugcuccuagagaa

SEQ ID NO: 216443 - RNA, 19 nt, Homo sapiens
uagagaacauccauuuguc

SEQ ID NO: 216444 - RNA, 19 nt, Homo sapiens
cagacacuaucaaggagaa

SEQ ID NO: 216445 - RNA, 19 nt, Homo sapiens
gaguguggcuagucaaggu

SEQ ID NO: 216446 - RNA, 19 nt, Homo sapiens
gaaaacuacaugcgauuaa

SEQ ID NO: 216447 - RNA, 19 nt, Homo sapiens
gacagacauuaacaguauu

SEQ ID NO: 216448 - RNA, 19 nt, Homo sapiens
cuagagaacauccauuugu

SEQ ID NO: 216449 - RNA, 19 nt, Homo sapiens
ucacagcaaugggcuaaag

SEQ ID NO: 216450 - RNA, 19 nt, Homo sapiens
gguaauacagauccaagga

SEQ ID NO: 216451 - RNA, 19 nt, Homo sapiens
ugacaguacuuugauuucu

SEQ ID NO: 216452 - RNA, 19 nt, Homo sapiens
gaagacuccuagccagcau

SEQ ID NO: 216453 - RNA, 19 nt, Homo sapiens
aaagaaagaagacggaaag

SEQ ID NO: 216454 - RNA, 19 nt, Homo sapiens
aaggagaauuguauagcaa

SEQ ID NO: 216455 - RNA, 19 nt, Homo sapiens
gacaguacuuugauuucuc

SEQ ID NO: 216456 - RNA, 19 nt, Homo sapiens
agaaaagagugacuaagaa

SEQ ID NO: 216457 - RNA, 19 nt, Homo sapiens
ggaauagugguacaaagag

SEQ ID NO: 216458 - RNA, 19 nt, Homo sapiens
gaggaucuugcaaauauuc

SEQ ID NO: 216459 - RNA, 19 nt, Homo sapiens
gagcugauaaacaacaugu

SEQ ID NO: 216460 - RNA, 19 nt, Homo sapiens
aaacagucaacuacagaaa

SEQ ID NO: 216461 - RNA, 19 nt, Homo sapiens
gaauagggguuggaggauu

SEQ ID NO: 216462 - RNA, 19 nt, Homo sapiens
gaggacagacauuaacagu

SEQ ID NO: 216463 - RNA, 19 nt, Homo sapiens
ugaggaucuugcaaauauu

SEQ ID NO: 216464 - RNA, 19 nt, Homo sapiens
aaaccuguaaggcuuguaa

SEQ ID NO: 216465 - RNA, 19 nt, Homo sapiens
ugguguaccugaaggaaau

SEQ ID NO: 216466 - RNA, 19 nt, Homo sapiens
ggacuugguggacaucaca

SEQ ID NO: 216467 - RNA, 19 nt, Homo sapiens
ccgaccagcugccagugaa

SEQ ID NO: 216468 - RNA, 19 nt, Homo sapiens
ggaaggaauagugguacaa

SEQ ID NO: 216469 - RNA, 19 nt, Homo sapiens
ucagauaagcugucauugg

SEQ ID NO: 216470 - RNA, 19 nt, Homo sapiens
guaaaagggauccacaaaa

SEQ ID NO: 216471 - RNA, 19 nt, Homo sapiens
gaucuugcaaauauucaug

SEQ ID NO: 216472 - RNA, 19 nt, Homo sapiens
gagaauuguauagcaagaa

SEQ ID NO: 216473 - RNA, 19 nt, Homo sapiens
ggugucauuuacuuugaau

SEQ ID NO: 216474 - RNA, 19 nt, Homo sapiens
acagauccaaggagaauug

SEQ ID NO: 216475 - RNA, 19 nt, Homo sapiens
acaggaguguggcuaguca

SEQ ID NO: 216476 - RNA, 19 nt, Homo sapiens
aauagggguuggaggauua

SEQ ID NO: 216477 - RNA, 19 nt, Homo sapiens
acugaggugucauuuacuu

SEQ ID NO: 216478 - RNA, 19 nt, Homo sapiens
ugaggugucauuuacuuug

SEQ ID NO: 216479 - RNA, 19 nt, Homo sapiens
guuggaggacagacauuaa

SEQ ID NO: 216480 - RNA, 19 nt, Homo sapiens
acagucaacuacagaaacu

SEQ ID NO: 216481 - RNA, 19 nt, Homo sapiens
aggagaaagaacagauuua

SEQ ID NO: 216482 - RNA, 19 nt, Homo sapiens
guugggaaacugcggauug

SEQ ID NO: 216483 - RNA, 19 nt, Homo sapiens
gcuagucaagguuccuaaa

SEQ ID NO: 216484 - RNA, 19 nt, Homo sapiens
aggaauagugguacaaaga

SEQ ID NO: 216485 - RNA, 19 nt, Homo sapiens
gcugucauuggaaggaaua

SEQ ID NO: 216486 - RNA, 19 nt, Homo sapiens
aaggagagaguuuguagug

SEQ ID NO: 216487 - RNA, 19 nt, Homo sapiens
aaacccaaaguuccuuauu

SEQ ID NO: 216488 - RNA, 19 nt, Homo sapiens
uuugauuucucucgguaaa

SEQ ID NO: 216489 - RNA, 19 nt, Homo sapiens
ggagcugagguaauacaga

SEQ ID NO: 216490 - RNA, 19 nt, Homo sapiens
cagaguacagacacuauca

SEQ ID NO: 216491 - RNA, 19 nt, Homo sapiens
uaucacaacagcuggacaa

SEQ ID NO: 216492 - RNA, 19 nt, Homo sapiens
gucaagguuccuaaauauu

SEQ ID NO: 216493 - RNA, 19 nt, Homo sapiens
aggaaggacugagguguca

SEQ ID NO: 216494 - RNA, 19 nt, Homo sapiens
gaaaagagugacuaagaag

SEQ ID NO: 216495 - RNA, 19 nt, Homo sapiens
ucucuacccuugccguauc

SEQ ID NO: 216496 - RNA, 19 nt, Homo sapiens
cagauuauucacaguagga

SEQ ID NO: 216497 - RNA, 19 nt, Homo sapiens
ugaggagaaagaacagauu

SEQ ID NO: 216498 - RNA, 19 nt, Homo sapiens
uuaaggacuugguggacau

SEQ ID NO: 216499 - RNA, 19 nt, Homo sapiens
acccaaaguuccuuauuuu

SEQ ID NO: 216500 - RNA, 19 nt, Homo sapiens
aaccagauuauucacagua

SEQ ID NO: 216501 - RNA, 19 nt, Homo sapiens
aaaaccagcuucagucagu

SEQ ID NO: 216502 - RNA, 19 nt, Homo sapiens
uaauagggguuaagugaca

SEQ ID NO: 216503 - RNA, 19 nt, Homo sapiens
gacaagaaauggaagcuua

SEQ ID NO: 216504 - RNA, 19 nt, Homo sapiens
gggaucaacuuaauguuua

SEQ ID NO: 216505 - RNA, 19 nt, Homo sapiens
gcacaaauuugguaaguca

SEQ ID NO: 216506 - RNA, 19 nt, Homo sapiens
ggaaacaguugucagaaga

SEQ ID NO: 216507 - RNA, 19 nt, Homo sapiens
ggagguaaauuaagacaga

SEQ ID NO: 216508 - RNA, 19 nt, Homo sapiens
gaagauaaaccauuagaug

SEQ ID NO: 216509 - RNA, 19 nt, Homo sapiens
uaacagcuuuggaagauaa

SEQ ID NO: 216510 - RNA, 19 nt, Homo sapiens
gaacacagcaagccauaaa

SEQ ID NO: 216511 - RNA, 19 nt, Homo sapiens
gauaaucauugcauaguga

SEQ ID NO: 216512 - RNA, 19 nt, Homo sapiens
gggaauauauuugcagaaa

SEQ ID NO: 216513 - RNA, 19 nt, Homo sapiens
ggguagaccuuaaguauuc

SEQ ID NO: 216514 - RNA, 19 nt, Homo sapiens
ggaaagaagggacuaaaug

SEQ ID NO: 216515 - RNA, 19 nt, Homo sapiens
auaaagaacuggaagagaa

SEQ ID NO: 216516 - RNA, 19 nt, Homo sapiens
gaaagcaaauaaagaacug

SEQ ID NO: 216517 - RNA, 19 nt, Homo sapiens
caucauugguucuguguuu

SEQ ID NO: 216518 - RNA, 19 nt, Homo sapiens
caaaugagcuaaguugcaa

SEQ ID NO: 216519 - RNA, 19 nt, Homo sapiens
gaugagggcuauggcauuu

SEQ ID NO: 216520 - RNA, 19 nt, Homo sapiens
gauccaacccaguuaguua

SEQ ID NO: 216521 - RNA, 19 nt, Homo sapiens
gcaagaagauccuguuuug

SEQ ID NO: 216522 - RNA, 19 nt, Homo sapiens
gaggaaagcaaauaaagaa

SEQ ID NO: 216523 - RNA, 19 nt, Homo sapiens
uggagucccugaauaauaa

SEQ ID NO: 216524 - RNA, 19 nt, Homo sapiens
gaagucagauagguauuau

SEQ ID NO: 216525 - RNA, 19 nt, Homo sapiens
gcacuaaaccucaagaagu

SEQ ID NO: 216526 - RNA, 19 nt, Homo sapiens
guaacggucuaagauauaa

SEQ ID NO: 216527 - RNA, 19 nt, Homo sapiens
ggacacaacuaacuuccau

SEQ ID NO: 216528 - RNA, 19 nt, Homo sapiens
gaaggcaaagauagauuua

SEQ ID NO: 216529 - RNA, 19 nt, Homo sapiens
gccaaucguuuaaauguga

SEQ ID NO: 216530 - RNA, 19 nt, Homo sapiens
gacuuuagaugucuuguau

SEQ ID NO: 216531 - RNA, 19 nt, Homo sapiens
guaaagaaagugcgucaaa

SEQ ID NO: 216532 - RNA, 19 nt, Homo sapiens
gauggcaugugcuuugaaa

SEQ ID NO: 216533 - RNA, 19 nt, Homo sapiens
uuuaaagggugcauugaua

SEQ ID NO: 216534 - RNA, 19 nt, Homo sapiens
acaacaagcuccacacaug

SEQ ID NO: 216535 - RNA, 19 nt, Homo sapiens
caacaagucaggacauuau

SEQ ID NO: 216536 - RNA, 19 nt, Homo sapiens
gaaagagcgagaugcagua

SEQ ID NO: 216537 - RNA, 19 nt, Homo sapiens
ugagcuaaguugcaaauau

SEQ ID NO: 216538 - RNA, 19 nt, Homo sapiens
uaacucagguucucucaag

SEQ ID NO: 216539 - RNA, 19 nt, Homo sapiens
caagucaggacauuauuaa

SEQ ID NO: 216540 - RNA, 19 nt, Homo sapiens
ucccagagcugaugcuauu

SEQ ID NO: 216541 - RNA, 19 nt, Homo sapiens
uuacgaagcucuguccauu

SEQ ID NO: 216542 - RNA, 19 nt, Homo sapiens
gaacagaaugcugcaagaa

SEQ ID NO: 216543 - RNA, 19 nt, Homo sapiens
ccaugaugcuuacagguuu

SEQ ID NO: 216544 - RNA, 19 nt, Homo sapiens
aagaguccauugaauauga

SEQ ID NO: 216545 - RNA, 19 nt, Homo sapiens
gaaauuacaagaguccauu

SEQ ID NO: 216546 - RNA, 19 nt, Homo sapiens
ccaauuauaccuuacauca

SEQ ID NO: 216547 - RNA, 19 nt, Homo sapiens
gaagcucuguccauuccaa

SEQ ID NO: 216548 - RNA, 19 nt, Homo sapiens
acacuuauauguagcuguu

SEQ ID NO: 216549 - RNA, 19 nt, Homo sapiens
gcaacaagucaggacauua

SEQ ID NO: 216550 - RNA, 19 nt, Homo sapiens
acagaaugcugcaagaaga

SEQ ID NO: 216551 - RNA, 19 nt, Homo sapiens
gaaagaagggacuaaaugc

SEQ ID NO: 216552 - RNA, 19 nt, Homo sapiens
cauugaauaugaagacuug

SEQ ID NO: 216553 - RNA, 19 nt, Homo sapiens
uacaagaguccauugaaua

SEQ ID NO: 216554 - RNA, 19 nt, Homo sapiens
uggcauuucugcugcauuu

SEQ ID NO: 216555 - RNA, 19 nt, Homo sapiens
gagauugagagaacuauga

SEQ ID NO: 216556 - RNA, 19 nt, Homo sapiens
gaaaagguagugaaaauga

SEQ ID NO: 216557 - RNA, 19 nt, Homo sapiens
gaacuucuacgacauuucu

SEQ ID NO: 216558 - RNA, 19 nt, Homo sapiens
ggaccuauccagcaguaaa

SEQ ID NO: 216559 - RNA, 19 nt, Homo sapiens
gaagaaguuuugcugauug

SEQ ID NO: 216560 - RNA, 19 nt, Homo sapiens
ugaacuucgugccauauuu

SEQ ID NO: 216561 - RNA, 19 nt, Homo sapiens
uaagauggcaugugcuuug

SEQ ID NO: 216562 - RNA, 19 nt, Homo sapiens
gguuuggagucccugaaua

SEQ ID NO: 216563 - RNA, 19 nt, Homo sapiens
gaaaauuaguccagaagga

SEQ ID NO: 216564 - RNA, 19 nt, Homo sapiens
gagguggccaugaugcuua

SEQ ID NO: 216565 - RNA, 19 nt, Homo sapiens
auauguagcuguuggagaa

SEQ ID NO: 216566 - RNA, 19 nt, Homo sapiens
uuacaagaguccauugaau

SEQ ID NO: 216567 - RNA, 19 nt, Homo sapiens
uaagcaggauguuggcauu

SEQ ID NO: 216568 - RNA, 19 nt, Homo sapiens
caagaggaaagcaaauaaa

SEQ ID NO: 216569 - RNA, 19 nt, Homo sapiens
gcaccugaaggcaaagaua

SEQ ID NO: 216570 - RNA, 19 nt, Homo sapiens
caagaagucagauagguau

SEQ ID NO: 216571 - RNA, 19 nt, Homo sapiens
gcuauggcauuuccucugu

SEQ ID NO: 216572 - RNA, 19 nt, Homo sapiens
ugaaagcacagcagugaaa

SEQ ID NO: 216573 - RNA, 19 nt, Homo sapiens
ggaauauauuugcagaaag

SEQ ID NO: 216574 - RNA, 19 nt, Homo sapiens
cagguucucucaaguagug

SEQ ID NO: 216575 - RNA, 19 nt, Homo sapiens
ccagcaacauggauggaaa

SEQ ID NO: 216576 - RNA, 19 nt, Homo sapiens
ucaagaggaaagcaaauaa

SEQ ID NO: 216577 - RNA, 19 nt, Homo sapiens
gcacugaauguuugugguu

SEQ ID NO: 216578 - RNA, 19 nt, Homo sapiens
caagaaauggaagcuuaua

SEQ ID NO: 216579 - RNA, 19 nt, Homo sapiens
ucaagagauuuaaccauca

SEQ ID NO: 216580 - RNA, 19 nt, Homo sapiens
gcuguaacggucuaagaua

SEQ ID NO: 216581 - RNA, 19 nt, Homo sapiens
cagauggugccaaaugaua

SEQ ID NO: 216582 - RNA, 19 nt, Homo sapiens
gcuuauacacccaaguuaa

SEQ ID NO: 216583 - RNA, 19 nt, Homo sapiens
ucaagaagucagauaggua

SEQ ID NO: 216584 - RNA, 19 nt, Homo sapiens
caacccaguuaguuacuuc

SEQ ID NO: 216585 - RNA, 19 nt, Homo sapiens
ccucauggcagaaagaauu

SEQ ID NO: 216586 - RNA, 19 nt, Homo sapiens
gcgaaucgauaaucauugc

SEQ ID NO: 216587 - RNA, 19 nt, Homo sapiens
cagagcugaugcuauugua

SEQ ID NO: 216588 - RNA, 19 nt, Homo sapiens
aaccucaucugaagaaguu

SEQ ID NO: 216589 - RNA, 19 nt, Homo sapiens
caaauaaagaacuggaaga

SEQ ID NO: 216590 - RNA, 19 nt, Homo sapiens
gaugggaucaacuuaaugu

SEQ ID NO: 216591 - RNA, 19 nt, Homo sapiens
gcucaaccaucaggaaaca

SEQ ID NO: 216592 - RNA, 19 nt, Homo sapiens
gaaccaaaugagcuaaguu

SEQ ID NO: 216593 - RNA, 19 nt, Homo sapiens
gaaaggaaagaagggacua

SEQ ID NO: 216594 - RNA, 19 nt, Homo sapiens
caaguuaacucagguucuc

SEQ ID NO: 216595 - RNA, 19 nt, Homo sapiens
acaagucaggacauuauua

SEQ ID NO: 216596 - RNA, 19 nt, Homo sapiens
gccaucaucaagagauuua

SEQ ID NO: 216597 - RNA, 19 nt, Homo sapiens
ucacagggaucggcugaau

SEQ ID NO: 216598 - RNA, 19 nt, Homo sapiens
caacaugacagagaaggaa

SEQ ID NO: 216599 - RNA, 19 nt, Homo sapiens
acacaacuaacuuccauuu

SEQ ID NO: 216600 - RNA, 19 nt, Homo sapiens
guuaguuacuuccugucua

SEQ ID NO: 216601 - RNA, 19 nt, Homo sapiens
caggguagaccuuaaguau

SEQ ID NO: 216602 - RNA, 19 nt, Homo sapiens
acaagcagaugaccucaca

SEQ ID NO: 216603 - RNA, 19 nt, Homo sapiens
gaagaaagcuguggauaug

SEQ ID NO: 216604 - RNA, 19 nt, Homo sapiens
gaacaugggagauucuuaa

SEQ ID NO: 216605 - RNA, 19 nt, Homo sapiens
gcacaccauugcuucuuua

SEQ ID NO: 216606 - RNA, 19 nt, Homo sapiens
gaaagaacaugggagauuc

SEQ ID NO: 216607 - RNA, 19 nt, Homo sapiens
ggaaggaggcuaugaaaga

SEQ ID NO: 216608 - RNA, 19 nt, Homo sapiens
gaaggaggcuaugaaagaa

SEQ ID NO: 216609 - RNA, 19 nt, Homo sapiens
gguaguagauggaucaaga

SEQ ID NO: 216610 - RNA, 19 nt, Homo sapiens
guagauggaucaagaacaa

SEQ ID NO: 216611 - RNA, 19 nt, Homo sapiens
agacugacguguacuuuaa

SEQ ID NO: 216612 - RNA, 19 nt, Homo sapiens
ggaauacuuuguagaggaa

SEQ ID NO: 216613 - RNA, 19 nt, Homo sapiens
ggagaaagauuuuguuaug

SEQ ID NO: 216614 - RNA, 19 nt, Homo sapiens
ugaaagaccaacauguuua

SEQ ID NO: 216615 - RNA, 19 nt, Homo sapiens
ggaaugaugcgccaccuuu

SEQ ID NO: 216616 - RNA, 19 nt, Homo sapiens
uagaguaucuguuauugga

SEQ ID NO: 216617 - RNA, 19 nt, Homo sapiens
gaaagaccaacauguuuau

SEQ ID NO: 216618 - RNA, 19 nt, Homo sapiens
gaaucuggaucacuuaaag

SEQ ID NO: 216619 - RNA, 19 nt, Homo sapiens
gaguaucuguuauuggauu

SEQ ID NO: 216620 - RNA, 19 nt, Homo sapiens
gagaaguacuaaucaucuu

SEQ ID NO: 216621 - RNA, 19 nt, Homo sapiens
gaaugaugcgccaccuuua

SEQ ID NO: 216622 - RNA, 19 nt, Homo sapiens
ugagcuaccuguugaaugu

SEQ ID NO: 216623 - RNA, 19 nt, Homo sapiens
gaugaaagccauuacaaag

SEQ ID NO: 216624 - RNA, 19 nt, Homo sapiens
gaucuaaucaagacccuaa

SEQ ID NO: 216625 - RNA, 19 nt, Homo sapiens
aauggaagaccaagauuua

SEQ ID NO: 216626 - RNA, 19 nt, Homo sapiens
ugaagaaccugaaagaacu

SEQ ID NO: 216627 - RNA, 19 nt, Homo sapiens
acaaagaguugcucacaca

SEQ ID NO: 216628 - RNA, 19 nt, Homo sapiens
gguggcacguaccauguua

SEQ ID NO: 216629 - RNA, 19 nt, Homo sapiens
acauacaagucgagaagua

SEQ ID NO: 216630 - RNA, 19 nt, Homo sapiens
ggaugaagaaccugaaaga

SEQ ID NO: 216631 - RNA, 19 nt, Homo sapiens
ugaaagccauuacaaagag

SEQ ID NO: 216632 - RNA, 19 nt, Homo sapiens
caacuugcgauccaucuaa

SEQ ID NO: 216633 - RNA, 19 nt, Homo sapiens
acacaugccuggacauaca

SEQ ID NO: 216634 - RNA, 19 nt, Homo sapiens
ccuaauagacugacgugua

SEQ ID NO: 216635 - RNA, 19 nt, Homo sapiens
caccauugcuucuuuaucu

SEQ ID NO: 216636 - RNA, 19 nt, Homo sapiens
gcacguaccauguuauuuu

SEQ ID NO: 216637 - RNA, 19 nt, Homo sapiens
ggucuuaccaucauuuguu

SEQ ID NO: 216638 - RNA, 19 nt, Homo sapiens
uggauugucugcagaaguu

SEQ ID NO: 216639 - RNA, 19 nt, Homo sapiens
ggacauacaagucgagaag

SEQ ID NO: 216640 - RNA, 19 nt, Homo sapiens
gaacaauggaagaccaaga

SEQ ID NO: 216641 - RNA, 19 nt, Homo sapiens
uguaaaaucuguggucuua

SEQ ID NO: 216642 - RNA, 19 nt, Homo sapiens
ugcgauccaucuaauauuu

SEQ ID NO: 216643 - RNA, 19 nt, Homo sapiens
gaagaaccugaaagaacua

SEQ ID NO: 216644 - RNA, 19 nt, Homo sapiens
agccaucucuuuauaauuc

SEQ ID NO: 216645 - RNA, 19 nt, Homo sapiens
ugaagaaagcuguggauau

SEQ ID NO: 216646 - RNA, 19 nt, Homo sapiens
cuaauagacugacguguac

SEQ ID NO: 216647 - RNA, 19 nt, Homo sapiens
ugcccuggcuguauucaua

SEQ ID NO: 216648 - RNA, 19 nt, Homo sapiens
ugaaagaacaugggagauu

SEQ ID NO: 216649 - RNA, 19 nt, Homo sapiens
gcgauccaucuaauauuua

SEQ ID NO: 216650 - RNA, 19 nt, Homo sapiens
caauggaagaccaagauuu

SEQ ID NO: 216651 - RNA, 19 nt, Homo sapiens
gaucaagaacaauggaaga

SEQ ID NO: 216652 - RNA, 19 nt, Homo sapiens
gcacggucuuaccaucauu

SEQ ID NO: 216653 - RNA, 19 nt, Homo sapiens
gaaagccauuacaaagagu

SEQ ID NO: 216654 - RNA, 19 nt, Homo sapiens
aaacacaugccuggacaua

SEQ ID NO: 216655 - RNA, 19 nt, Homo sapiens
gcauuuggauggcaauacu

SEQ ID NO: 216656 - RNA, 19 nt, Homo sapiens
ggaagaccaagauuuaaag

SEQ ID NO: 216657 - RNA, 19 nt, Homo sapiens
ggauaugaccugccaugga

SEQ ID NO: 216658 - RNA, 19 nt, Homo sapiens
ucacuuaaagcuacaauag

SEQ ID NO: 216659 - RNA, 19 nt, Homo sapiens
aagaguugcucacacauca

SEQ ID NO: 216660 - RNA, 19 nt, Homo sapiens
gaugaaucuggaucacuua

SEQ ID NO: 216661 - RNA, 19 nt, Homo sapiens
gaugaagaaccugaaagaa

SEQ ID NO: 216662 - RNA, 19 nt, Homo sapiens
uuagcagccuuacaacuug

SEQ ID NO: 216663 - RNA, 19 nt, Homo sapiens
gaauugaaagaccaacaug

SEQ ID NO: 216664 - RNA, 19 nt, Homo sapiens
ggaauugaaagaccaacau

SEQ ID NO: 216665 - RNA, 19 nt, Homo sapiens
caucauuuguuuccuuugg

SEQ ID NO: 216666 - RNA, 19 nt, Homo sapiens
acugugagcuaccuguuga

SEQ ID NO: 216667 - RNA, 19 nt, Homo sapiens
ugagcaccauggacaaguu

SEQ ID NO: 216668 - RNA, 19 nt, Homo sapiens
uggaagaccaagauuuaaa

SEQ ID NO: 216669 - RNA, 19 nt, Homo sapiens
gucuuaccaucauuuguuu

SEQ ID NO: 216670 - RNA, 19 nt, Homo sapiens
aaucuguggucuuacuuug

SEQ ID NO: 216671 - RNA, 19 nt, Homo sapiens
ggcaaaguacugugagcua

SEQ ID NO: 216672 - RNA, 19 nt, Homo sapiens
uaucugaccaggaugcaaa

SEQ ID NO: 216673 - RNA, 19 nt, Homo sapiens
uagacugacguguacuuua

SEQ ID NO: 216674 - RNA, 19 nt, Homo sapiens
cuaaaggcagcuaaaauua

SEQ ID NO: 216675 - RNA, 19 nt, Homo sapiens
cacagugucgggcaaagua

SEQ ID NO: 216676 - RNA, 19 nt, Homo sapiens
cagcauggcgcauuuggau

SEQ ID NO: 216677 - RNA, 19 nt, Homo sapiens
ggaaacccaagaaaacaua

SEQ ID NO: 216678 - RNA, 19 nt, Homo sapiens
guuguuggaauacuuugua

SEQ ID NO: 216679 - RNA, 19 nt, Homo sapiens
ucaugauucucuacacugu

SEQ ID NO: 216680 - RNA, 19 nt, Homo sapiens
ucaagaaauuccccuagaa

SEQ ID NO: 216681 - RNA, 19 nt, Homo sapiens
ccugcuagcucaaguucug

SEQ ID NO: 216682 - RNA, 19 nt, Homo sapiens
uauaauucccuaagcauag

SEQ ID NO: 216683 - RNA, 19 nt, Homo sapiens
uugaaagaccaacauguuu

SEQ ID NO: 216684 - RNA, 19 nt, Homo sapiens
ccuagaagaauauaaugga

SEQ ID NO: 216685 - RNA, 19 nt, Homo sapiens
aaugcucacuuauucguau

SEQ ID NO: 216686 - RNA, 19 nt, Homo sapiens
uagcucaaguucugaaugc

SEQ ID NO: 216687 - RNA, 19 nt, Homo sapiens
agaugaaagccauuacaaa

SEQ ID NO: 216688 - RNA, 19 nt, Homo sapiens
gagccaucucuuuauaauu

SEQ ID NO: 216689 - RNA, 19 nt, Homo sapiens
uagaugaaagccauuacaa

SEQ ID NO: 216690 - RNA, 19 nt, Homo sapiens
cgagaaguacuaaucaucu

SEQ ID NO: 216691 - RNA, 19 nt, Homo sapiens
accaagauuuaaagccuaa

SEQ ID NO: 216692 - RNA, 19 nt, Homo sapiens
uaccaucauuuguuuccuu

SEQ ID NO: 216693 - RNA, 19 nt, Homo sapiens
cacguaccauguuauuuua

SEQ ID NO: 216694 - RNA, 19 nt, Homo sapiens
agaaagcuguggauaugac

SEQ ID NO: 216695 - RNA, 19 nt, Homo sapiens
guaguagauggaucaagaa

SEQ ID NO: 216696 - RNA, 19 nt, Homo sapiens
agucagauuggaauaauug

SEQ ID NO: 216697 - RNA, 19 nt, Homo sapiens
augauucucuacacuguug

SEQ ID NO: 216698 - RNA, 19 nt, Homo sapiens
guucaugauucucuacacu

SEQ ID NO: 216699 - RNA, 19 nt, Homo sapiens
cugcagaaguucgcguuug

SEQ ID NO: 216700 - RNA, 19 nt, Homo sapiens
gcuaccuguugaauguaaa

SEQ ID NO: 216701 - RNA, 19 nt, Homo sapiens
gaaccugaaagaacuaagc

SEQ ID NO: 216702 - RNA, 19 nt, Homo sapiens
aguucugaaugcucacuua

SEQ ID NO: 216703 - RNA, 19 nt, Homo sapiens
caacaaacuugcugugaua

SEQ ID NO: 216704 - RNA, 19 nt, Homo sapiens
gcacagaaacagaauauuu

SEQ ID NO: 216705 - RNA, 19 nt, Homo sapiens
ucaaggauauuggugauua

SEQ ID NO: 216706 - RNA, 19 nt, Homo sapiens
ggacagccaugguuucaga

SEQ ID NO: 216707 - RNA, 19 nt, Homo sapiens
gaaagccgauucuuauauc

SEQ ID NO: 216708 - RNA, 19 nt, Homo sapiens
ggaaaugaaaucaaggaua

SEQ ID NO: 216709 - RNA, 19 nt, Homo sapiens
gagacagccucagauauuu

SEQ ID NO: 216710 - RNA, 19 nt, Homo sapiens
gaauugaaucuucugguua

SEQ ID NO: 216711 - RNA, 19 nt, Homo sapiens
uggcaacccuccugaauuu

SEQ ID NO: 216712 - RNA, 19 nt, Homo sapiens
gcaaaugaaguuauuguug

SEQ ID NO: 216713 - RNA, 19 nt, Homo sapiens
gcaagucacauucaagaaa

SEQ ID NO: 216714 - RNA, 19 nt, Homo sapiens
agacgaagaugaauugaau

SEQ ID NO: 216715 - RNA, 19 nt, Homo sapiens
ccucagauauuugcagaua

SEQ ID NO: 216716 - RNA, 19 nt, Homo sapiens
gaaauuugaacguagcuuu

SEQ ID NO: 216717 - RNA, 19 nt, Homo sapiens
uauagcagauucuuuguug

SEQ ID NO: 216718 - RNA, 19 nt, Homo sapiens
ucaguucacuuuauccaaa

SEQ ID NO: 216719 - RNA, 19 nt, Homo sapiens
gaaucucaguucacuuuau

SEQ ID NO: 216720 - RNA, 19 nt, Homo sapiens
ucagagaucucaguuaauc

SEQ ID NO: 216721 - RNA, 19 nt, Homo sapiens
gacagugcguugcaguaua

SEQ ID NO: 216722 - RNA, 19 nt, Homo sapiens
caaggaaguuaaagacaau

SEQ ID NO: 216723 - RNA, 19 nt, Homo sapiens
gcccuuugcuacauucaua

SEQ ID NO: 216724 - RNA, 19 nt, Homo sapiens
gagacagccuuuaaaauuu

SEQ ID NO: 216725 - RNA, 19 nt, Homo sapiens
ugaaauugguuaugucugu

SEQ ID NO: 216726 - RNA, 19 nt, Homo sapiens
cauaaagggucaacauaca

SEQ ID NO: 216727 - RNA, 19 nt, Homo sapiens
ggaaagaauggcagacuug

SEQ ID NO: 216728 - RNA, 19 nt, Homo sapiens
gauagcaagucacauucaa

SEQ ID NO: 216729 - RNA, 19 nt, Homo sapiens
gaaugaacaaggaaguuaa

SEQ ID NO: 216730 - RNA, 19 nt, Homo sapiens
gcaacccuccugaauuuaa

SEQ ID NO: 216731 - RNA, 19 nt, Homo sapiens
ugaauugaaucuucugguu

SEQ ID NO: 216732 - RNA, 19 nt, Homo sapiens
uaaagacaaucaggaaaug

SEQ ID NO: 216733 - RNA, 19 nt, Homo sapiens
gaaauugguuaugucuguu

SEQ ID NO: 216734 - RNA, 19 nt, Homo sapiens
caaggauauuggugauuaa

SEQ ID NO: 216735 - RNA, 19 nt, Homo sapiens
gaacaaggaaguuaaagac

SEQ ID NO: 216736 - RNA, 19 nt, Homo sapiens
gacauaaagggucaacaua

SEQ ID NO: 216737 - RNA, 19 nt, Homo sapiens
gaaagcaagcauuaaagga

SEQ ID NO: 216738 - RNA, 19 nt, Homo sapiens
gaaaucucauugaaauugg

SEQ ID NO: 216739 - RNA, 19 nt, Homo sapiens
ccaacaggcuugugacauc

SEQ ID NO: 216740 - RNA, 19 nt, Homo sapiens
acaaggaaguuaaagacaa

SEQ ID NO: 216741 - RNA, 19 nt, Homo sapiens
acaguuaacuucaguaguc

SEQ ID NO: 216742 - RNA, 19 nt, Homo sapiens
cgaaaucucauugaaauug

SEQ ID NO: 216743 - RNA, 19 nt, Homo sapiens
ugaaaugcaugccauacga

SEQ ID NO: 216744 - RNA, 19 nt, Homo sapiens
cuggaggacugauuuguuu

SEQ ID NO: 216745 - RNA, 19 nt, Homo sapiens
gguuaugucuguucugugu

SEQ ID NO: 216746 - RNA, 19 nt, Homo sapiens
gauuaaggcugcagaagac

SEQ ID NO: 216747 - RNA, 19 nt, Homo sapiens
ucaguagucaugugaauaa

SEQ ID NO: 216748 - RNA, 19 nt, Homo sapiens
ccaacaaacuugcugugau

SEQ ID NO: 216749 - RNA, 19 nt, Homo sapiens
caagucacauucaagaaag

SEQ ID NO: 216750 - RNA, 19 nt, Homo sapiens
caacaggcuugugacauca

SEQ ID NO: 216751 - RNA, 19 nt, Homo sapiens
gggacuauuuguggaguaa

SEQ ID NO: 216752 - RNA, 19 nt, Homo sapiens
gaaaugcaugccauacgaa

SEQ ID NO: 216753 - RNA, 19 nt, Homo sapiens
acagugcguugcaguauau

SEQ ID NO: 216754 - RNA, 19 nt, Homo sapiens
uuaaaggaaucucaguuca

SEQ ID NO: 216755 - RNA, 19 nt, Homo sapiens
caugaaucguuccaacaaa

SEQ ID NO: 216756 - RNA, 19 nt, Homo sapiens
uaacuucaguagucaugug

SEQ ID NO: 216757 - RNA, 19 nt, Homo sapiens
ggaggacugauuuguuuga

SEQ ID NO: 216758 - RNA, 19 nt, Homo sapiens
cgagacagccuuuaaaauu

SEQ ID NO: 216759 - RNA, 19 nt, Homo sapiens
ggaaagcaagcauuaaagg

SEQ ID NO: 216760 - RNA, 19 nt, Homo sapiens
aaagcaagcauuaaaggaa

SEQ ID NO: 216761 - RNA, 19 nt, Homo sapiens
agaaugaacaaggaaguua

SEQ ID NO: 216762 - RNA, 19 nt, Homo sapiens
gaguaaagauggaaaauac

SEQ ID NO: 216763 - RNA, 19 nt, Homo sapiens
ggaaucucaguucacuuua

SEQ ID NO: 216764 - RNA, 19 nt, Homo sapiens
caucgaaaucucauugaaa

SEQ ID NO: 216765 - RNA, 19 nt, Homo sapiens
caacccuccugaauuuaau

SEQ ID NO: 216766 - RNA, 19 nt, Homo sapiens
gaauccggguccucauugu

SEQ ID NO: 216767 - RNA, 19 nt, Homo sapiens
ugccuucucuucugcagua

SEQ ID NO: 216768 - RNA, 19 nt, Homo sapiens
ugaaucuucugguuauugu

SEQ ID NO: 216769 - RNA, 19 nt, Homo sapiens
caaagucagcuugucauga

SEQ ID NO: 216770 - RNA, 19 nt, Homo sapiens
ugaaucaacaguuaacuuc

SEQ ID NO: 216771 - RNA, 19 nt, Homo sapiens
gacuauuuguggaguaaug

SEQ ID NO: 216772 - RNA, 19 nt, Homo sapiens
cuucucuucugcaguauuu

SEQ ID NO: 216773 - RNA, 19 nt, Homo sapiens
gaaguuauuguugaagaga

SEQ ID NO: 216774 - RNA, 19 nt, Homo sapiens
aagcaagcauuaaaggaau

SEQ ID NO: 216775 - RNA, 19 nt, Homo sapiens
ucaucgaaaucucauugaa

SEQ ID NO: 216776 - RNA, 19 nt, Homo sapiens
cagcacagaaacagaauau

SEQ ID NO: 216777 - RNA, 19 nt, Homo sapiens
acucagggcuccuccaaca

SEQ ID NO: 216778 - RNA, 19 nt, Homo sapiens
aaaggaaucucaguucacu

SEQ ID NO: 216779 - RNA, 19 nt, Homo sapiens
cgggaggacuguaccugaa

SEQ ID NO: 216780 - RNA, 19 nt, Homo sapiens
uaaagggucaacauacaga

SEQ ID NO: 216781 - RNA, 19 nt, Homo sapiens
uggcagacuuggagacuuc

SEQ ID NO: 216782 - RNA, 19 nt, Homo sapiens
uagcaagucacauucaaga

SEQ ID NO: 216783 - RNA, 19 nt, Homo sapiens
uggcauuaaucaacauaga

SEQ ID NO: 216784 - RNA, 19 nt, Homo sapiens
uauggugaccuuacagaaa

SEQ ID NO: 216785 - RNA, 19 nt, Homo sapiens
caucuuugcagcacagaaa

SEQ ID NO: 216786 - RNA, 19 nt, Homo sapiens
ugaacaaggaaguuaaaga

SEQ ID NO: 216787 - RNA, 19 nt, Homo sapiens
caacaguuaacuucaguag

SEQ ID NO: 216788 - RNA, 19 nt, Homo sapiens
gaaucaacaguuaacuuca

SEQ ID NO: 216789 - RNA, 19 nt, Homo sapiens
uuaauauggugaccuuaca

SEQ ID NO: 216790 - RNA, 19 nt, Homo sapiens
gcagcacagaaacagaaua

SEQ ID NO: 216791 - RNA, 19 nt, Homo sapiens
aggaaucucaguucacuuu

SEQ ID NO: 216792 - RNA, 19 nt, Homo sapiens
ugauuaaggcugcagaaga

SEQ ID NO: 216793 - RNA, 19 nt, Homo sapiens
uggaaagaauggcagacuu

SEQ ID NO: 216794 - RNA, 19 nt, Homo sapiens
aaucucaguucacuuuauc

SEQ ID NO: 216795 - RNA, 19 nt, Homo sapiens
ccucagaugccuucucuuc

SEQ ID NO: 216796 - RNA, 19 nt, Homo sapiens
caacauacagaaacuuugc

SEQ ID NO: 216797 - RNA, 19 nt, Homo sapiens
gcugcuugcuucugucauc

SEQ ID NO: 216798 - RNA, 19 nt, Homo sapiens
guuaaagacaaucaggaaa

SEQ ID NO: 216799 - RNA, 19 nt, Homo sapiens
gucaacauacagaaacuuu

SEQ ID NO: 216800 - RNA, 19 nt, Homo sapiens
ggaguaaagauggaaaaua

SEQ ID NO: 216801 - RNA, 19 nt, Homo sapiens
gggaaagcaagcauuaaag

SEQ ID NO: 216802 - RNA, 19 nt, Homo sapiens
ggcauuaaucaacauagaa

SEQ ID NO: 216803 - RNA, 19 nt, Homo sapiens
gcucagcucugguacuuua

SEQ ID NO: 216804 - RNA, 19 nt, Homo sapiens
caucagaacucagguguuu

SEQ ID NO: 216805 - RNA, 19 nt, Homo sapiens
gauaauccauuuccuaagg

SEQ ID NO: 216806 - RNA, 19 nt, Homo sapiens
gcagauaauccauuuccua

SEQ ID NO: 216807 - RNA, 19 nt, Homo sapiens
gggaaggccuggucugaug

SEQ ID NO: 216808 - RNA, 19 nt, Homo sapiens
gcauggaccugguagagau

SEQ ID NO: 216809 - RNA, 19 nt, Homo sapiens
ggaaaucucggcguuacua

SEQ ID NO: 216810 - RNA, 19 nt, Homo sapiens
gugauucucuguugaacuu

SEQ ID NO: 216811 - RNA, 19 nt, Homo sapiens
ccacaugucuggcugucuu

SEQ ID NO: 216812 - RNA, 19 nt, Homo sapiens
cagauaauccauuuccuaa

SEQ ID NO: 216813 - RNA, 19 nt, Homo sapiens
caucacagcccagcagaua

SEQ ID NO: 216814 - RNA, 19 nt, Homo sapiens
cagcaaggcucaggaggaa

SEQ ID NO: 216815 - RNA, 19 nt, Homo sapiens
gggcuuuucuuguuuaaua

SEQ ID NO: 216816 - RNA, 19 nt, Homo sapiens
gagguggucuugcacuuca

SEQ ID NO: 216817 - RNA, 19 nt, Homo sapiens
gaugggagguggucuugca

SEQ ID NO: 216818 - RNA, 19 nt, Homo sapiens
gaaccgaguacaccuacaa

SEQ ID NO: 216819 - RNA, 19 nt, Homo sapiens
ucauugcccucuucucuga

SEQ ID NO: 216820 - RNA, 19 nt, Homo sapiens
gaaaccaauuaccgacugu

SEQ ID NO: 216821 - RNA, 19 nt, Homo sapiens
ggccaucaaucucucauca

SEQ ID NO: 216822 - RNA, 19 nt, Homo sapiens
ccacacgccuggccaucaa

SEQ ID NO: 216823 - RNA, 19 nt, Homo sapiens
uaugagugauucucuguug

SEQ ID NO: 216824 - RNA, 19 nt, Homo sapiens
gguauuggaccgauuguau

SEQ ID NO: 216825 - RNA, 19 nt, Homo sapiens
gaggaaaucucggcguuac

SEQ ID NO: 216826 - RNA, 19 nt, Homo sapiens
ggaagcggcagaaacauag

SEQ ID NO: 216827 - RNA, 19 nt, Homo sapiens
cugaggguguccuguauaa

SEQ ID NO: 216828 - RNA, 19 nt, Homo sapiens
gcucugguacuuuauguug

SEQ ID NO: 216829 - RNA, 19 nt, Homo sapiens
cccagcagauaauccauuu

SEQ ID NO: 216830 - RNA, 19 nt, Homo sapiens
ucacugaggguguccugua

SEQ ID NO: 216831 - RNA, 19 nt, Homo sapiens
cgaggaggaucgacagagu

SEQ ID NO: 216832 - RNA, 19 nt, Homo sapiens
uaaagaaggaauucagcaa

SEQ ID NO: 216833 - RNA, 19 nt, Homo sapiens
ccagugaugcucaaacaga

SEQ ID NO: 216834 - RNA, 19 nt, Homo sapiens
ggauuacucuguggaaggu

SEQ ID NO: 216835 - RNA, 19 nt, Homo sapiens
gacguucccucccuugaca

SEQ ID NO: 216836 - RNA, 19 nt, Homo sapiens
ggccuggucugaugacaca

SEQ ID NO: 216837 - RNA, 19 nt, Homo sapiens
caacaucugcgugaguuug

SEQ ID NO: 216838 - RNA, 19 nt, Homo sapiens
gcaaggcucaggaggaaag

SEQ ID NO: 216839 - RNA, 19 nt, Homo sapiens
cggcucagcucugguacuu

SEQ ID NO: 216840 - RNA, 19 nt, Homo sapiens
gggagguggucuugcacuu

SEQ ID NO: 216841 - RNA, 19 nt, Homo sapiens
ggaaggccuggucugauga

SEQ ID NO: 216842 - RNA, 19 nt, Homo sapiens
uggaagcggcagaaacaua

SEQ ID NO: 216843 - RNA, 19 nt, Homo sapiens
gcugggcucaugaagagua

SEQ ID NO: 216844 - RNA, 19 nt, Homo sapiens
cgucagggcuuuucuuguu

SEQ ID NO: 216845 - RNA, 19 nt, Homo sapiens
ucacagcccagcagauaau

SEQ ID NO: 216846 - RNA, 19 nt, Homo sapiens
guagcucuguggguaaaga

SEQ ID NO: 216847 - RNA, 19 nt, Homo sapiens
caucagccagguuucauug

SEQ ID NO: 216848 - RNA, 19 nt, Homo sapiens
agucggagcugcagauugc

SEQ ID NO: 216849 - RNA, 19 nt, Homo sapiens
gcaucagccagguuucauu

SEQ ID NO: 216850 - RNA, 19 nt, Homo sapiens
ccaauuaccgacuguaugc

SEQ ID NO: 216851 - RNA, 19 nt, Homo sapiens
guauuggaccgauuguaug

SEQ ID NO: 216852 - RNA, 19 nt, Homo sapiens
gcugcagauugcccucauu

SEQ ID NO: 216853 - RNA, 19 nt, Homo sapiens
gaacuuccugcaacaucug

SEQ ID NO: 216854 - RNA, 19 nt, Homo sapiens
ugaacuuccugcaacaucu

SEQ ID NO: 216855 - RNA, 19 nt, Homo sapiens
ugagugauucucuguugaa

SEQ ID NO: 216856 - RNA, 19 nt, Homo sapiens
caaggauuacucuguggaa

SEQ ID NO: 216857 - RNA, 19 nt, Homo sapiens
cuacucugggcaaggauua

SEQ ID NO: 216858 - RNA, 19 nt, Homo sapiens
cagcucugguacuuuaugu

SEQ ID NO: 216859 - RNA, 19 nt, Homo sapiens
aggcugggcucaugaagag

SEQ ID NO: 216860 - RNA, 19 nt, Homo sapiens
caccuacaaugcaggaauc

SEQ ID NO: 216861 - RNA, 19 nt, Homo sapiens
agaaacauagcuccugaga

SEQ ID NO: 216862 - RNA, 19 nt, Homo sapiens
uggaagguaugagugauuc

SEQ ID NO: 216863 - RNA, 19 nt, Homo sapiens
caccaucuuucccucaauc

SEQ ID NO: 216864 - RNA, 19 nt, Homo sapiens
cacugaggguguccuguau

SEQ ID NO: 216865 - RNA, 19 nt, Homo sapiens
ucccauccuuggcuaagaa

SEQ ID NO: 216866 - RNA, 19 nt, Homo sapiens
acaagagcccacccaguga

SEQ ID NO: 216867 - RNA, 19 nt, Homo sapiens
ggagccaaugcgagacuuu

SEQ ID NO: 216868 - RNA, 19 nt, Homo sapiens
ucagccagguuucauuguc

SEQ ID NO: 216869 - RNA, 19 nt, Homo sapiens
gcaacaucugcgugaguuu

SEQ ID NO: 216870 - RNA, 19 nt, Homo sapiens
ugcaacaucugcgugaguu

SEQ ID NO: 216871 - RNA, 19 nt, Homo sapiens
gguaugagugauucucugu

SEQ ID NO: 216872 - RNA, 19 nt, Homo sapiens
ucucuacucugggcaagga

SEQ ID NO: 216873 - RNA, 19 nt, Homo sapiens
ucagggcuuuucuuguuua

SEQ ID NO: 216874 - RNA, 19 nt, Homo sapiens
gauucucuccuuccucuuc

SEQ ID NO: 216875 - RNA, 19 nt, Homo sapiens
cgaguacaccuacaaugca

SEQ ID NO: 216876 - RNA, 19 nt, Homo sapiens
caagagcccacccagugau

SEQ ID NO: 216877 - RNA, 19 nt, Homo sapiens
ggagguggucuugcacuuc

SEQ ID NO: 216878 - RNA, 19 nt, Homo sapiens
gcccagcagauaauccauu

SEQ ID NO: 216879 - RNA, 19 nt, Homo sapiens
guggaagguaugagugauu

SEQ ID NO: 216880 - RNA, 19 nt, Homo sapiens
ggacagacuccgguucacu

SEQ ID NO: 216881 - RNA, 19 nt, Homo sapiens
gcuguagcucuguggguaa

SEQ ID NO: 216882 - RNA, 19 nt, Homo sapiens
ggagucggagcugcagauu

SEQ ID NO: 216883 - RNA, 19 nt, Homo sapiens
agaggaaaucucggcguua

SEQ ID NO: 216884 - RNA, 19 nt, Homo sapiens
gaagguaugagugauucuc

SEQ ID NO: 216885 - RNA, 19 nt, Homo sapiens
gcucaugaagaguacugaa

SEQ ID NO: 216886 - RNA, 19 nt, Homo sapiens
ccucauugcccucuucucu

SEQ ID NO: 216887 - RNA, 19 nt, Homo sapiens
gaaaucucggcguuacuac

SEQ ID NO: 216888 - RNA, 19 nt, Homo sapiens
gaaaucagcuccaugagaa

SEQ ID NO: 216889 - RNA, 19 nt, Homo sapiens
gaaagacucucgaaaguug

SEQ ID NO: 216890 - RNA, 19 nt, Homo sapiens
cagaagauccugauuauua

SEQ ID NO: 216891 - RNA, 19 nt, Homo sapiens
gaaauuuggugaagcuauu

SEQ ID NO: 216892 - RNA, 19 nt, Homo sapiens
gauggaagcucucagauca

SEQ ID NO: 216893 - RNA, 19 nt, Homo sapiens
guaaagaacuggccaaguc

SEQ ID NO: 216894 - RNA, 19 nt, Homo sapiens
uaagaaagaugguggauca

SEQ ID NO: 216895 - RNA, 19 nt, Homo sapiens
uaaaccagcuucaggagua

SEQ ID NO: 216896 - RNA, 19 nt, Homo sapiens
gaaauuugcucaagcucuu

SEQ ID NO: 216897 - RNA, 19 nt, Homo sapiens
ucacggcucuccuuaauga

SEQ ID NO: 216898 - RNA, 19 nt, Homo sapiens
gggauuucauucaucauua

SEQ ID NO: 216899 - RNA, 19 nt, Homo sapiens
gauauuacuugcaaaggaa

SEQ ID NO: 216900 - RNA, 19 nt, Homo sapiens
gaguguagaugcuguagaa

SEQ ID NO: 216901 - RNA, 19 nt, Homo sapiens
caagugggcaaucgaauua

SEQ ID NO: 216902 - RNA, 19 nt, Homo sapiens
gagaggauauuacuugcaa

SEQ ID NO: 216903 - RNA, 19 nt, Homo sapiens
uaucucagcgugugaauua

SEQ ID NO: 216904 - RNA, 19 nt, Homo sapiens
guuccuaucuguauauuug

SEQ ID NO: 216905 - RNA, 19 nt, Homo sapiens
gaagauacucagaaacaaa

SEQ ID NO: 216906 - RNA, 19 nt, Homo sapiens
gaaggugccguucgcguua

SEQ ID NO: 216907 - RNA, 19 nt, Homo sapiens
ggauauuacuugcaaagga

SEQ ID NO: 216908 - RNA, 19 nt, Homo sapiens
uaagcuaucucucaugguu

SEQ ID NO: 216909 - RNA, 19 nt, Homo sapiens
ggaauguacuaucaggauu

SEQ ID NO: 216910 - RNA, 19 nt, Homo sapiens
cagcagaagaugaugauua

SEQ ID NO: 216911 - RNA, 19 nt, Homo sapiens
gugaagauaucuccuacuu

SEQ ID NO: 216912 - RNA, 19 nt, Homo sapiens
gcaguucugugaauuaaag

SEQ ID NO: 216913 - RNA, 19 nt, Homo sapiens
gaacuucugacucacagua

SEQ ID NO: 216914 - RNA, 19 nt, Homo sapiens
ugggaaagcuuuaggcaaa

SEQ ID NO: 216915 - RNA, 19 nt, Homo sapiens
gagaagauacucagaaaca

SEQ ID NO: 216916 - RNA, 19 nt, Homo sapiens
gaagauuuacagcuugaua

SEQ ID NO: 216917 - RNA, 19 nt, Homo sapiens
gcucucagaucaagcaaga

SEQ ID NO: 216918 - RNA, 19 nt, Homo sapiens
uaagagaacaagugaauga

SEQ ID NO: 216919 - RNA, 19 nt, Homo sapiens
gcaggaugguggugacauu

SEQ ID NO: 216920 - RNA, 19 nt, Homo sapiens
gaagaauuguuugaaagga

SEQ ID NO: 216921 - RNA, 19 nt, Homo sapiens
guagaccucuucccuccua

SEQ ID NO: 216922 - RNA, 19 nt, Homo sapiens
gggaagcucuuggccuuaa

SEQ ID NO: 216923 - RNA, 19 nt, Homo sapiens
ggaauuccacgacuugaaa

SEQ ID NO: 216924 - RNA, 19 nt, Homo sapiens
ggaaaucagcuccaugaga

SEQ ID NO: 216925 - RNA, 19 nt, Homo sapiens
ggagagaguuuuccuuuga

SEQ ID NO: 216926 - RNA, 19 nt, Homo sapiens
ggaagcaaguggaagagau

SEQ ID NO: 216927 - RNA, 19 nt, Homo sapiens
gaaaggaaauaugcucaag

SEQ ID NO: 216928 - RNA, 19 nt, Homo sapiens
gaaauugaaacacucagaa

SEQ ID NO: 216929 - RNA, 19 nt, Homo sapiens
caaaggaaaggauucguuu

SEQ ID NO: 216930 - RNA, 19 nt, Homo sapiens
ggaaguaccagcagaagau

SEQ ID NO: 216931 - RNA, 19 nt, Homo sapiens
ggaaauggcagcugugaca

SEQ ID NO: 216932 - RNA, 19 nt, Homo sapiens
uguagaugcuguagaaauu

SEQ ID NO: 216933 - RNA, 19 nt, Homo sapiens
gaaauaggcccuuuuaugu

SEQ ID NO: 216934 - RNA, 19 nt, Homo sapiens
ugacaugguagcagaaaua

SEQ ID NO: 216935 - RNA, 19 nt, Homo sapiens
ucucaugguuccuauguuu

SEQ ID NO: 216936 - RNA, 19 nt, Homo sapiens
uggaauggcugguguacuu

SEQ ID NO: 216937 - RNA, 19 nt, Homo sapiens
cagcaguucugugaauuaa

SEQ ID NO: 216938 - RNA, 19 nt, Homo sapiens
gccagaaucacuaaauuaa

SEQ ID NO: 216939 - RNA, 19 nt, Homo sapiens
gaauuaaagagcagaguga

SEQ ID NO: 216940 - RNA, 19 nt, Homo sapiens
caaagguuccugaaauuga

SEQ ID NO: 216941 - RNA, 19 nt, Homo sapiens
cgaagucccucaugguaug

SEQ ID NO: 216942 - RNA, 19 nt, Homo sapiens
aaacugaacccacagaaga

SEQ ID NO: 216943 - RNA, 19 nt, Homo sapiens
gcaaaucggaugaguguag

SEQ ID NO: 216944 - RNA, 19 nt, Homo sapiens
aauaccagcucuacaagaa

SEQ ID NO: 216945 - RNA, 19 nt, Homo sapiens
gaauguacuaucaggauuu

SEQ ID NO: 216946 - RNA, 19 nt, Homo sapiens
gauuggaaugucagaauua

SEQ ID NO: 216947 - RNA, 19 nt, Homo sapiens
gaagaaugguaugccagaa

SEQ ID NO: 216948 - RNA, 19 nt, Homo sapiens
guucacggcucuccuuaau

SEQ ID NO: 216949 - RNA, 19 nt, Homo sapiens
ggaaggcccuaauaacaac

SEQ ID NO: 216950 - RNA, 19 nt, Homo sapiens
uuacauguguugagauuuc

SEQ ID NO: 216951 - RNA, 19 nt, Homo sapiens
gcuaagagaacaagugaau

SEQ ID NO: 216952 - RNA, 19 nt, Homo sapiens
aaacauuccuuuccgaagu

SEQ ID NO: 216953 - RNA, 19 nt, Homo sapiens
gcaaaggaaaggauucguu

SEQ ID NO: 216954 - RNA, 19 nt, Homo sapiens
ugaggacuauuucugcuuu

SEQ ID NO: 216955 - RNA, 19 nt, Homo sapiens
caggacuugugauuaauaa

SEQ ID NO: 216956 - RNA, 19 nt, Homo sapiens
ggaggagggugagagagaa

SEQ ID NO: 216957 - RNA, 19 nt, Homo sapiens
uggagaagauacucagaaa

SEQ ID NO: 216958 - RNA, 19 nt, Homo sapiens
gaagcaaguggaagagauu

SEQ ID NO: 216959 - RNA, 19 nt, Homo sapiens
gaaguuacucagccaagaa

SEQ ID NO: 216960 - RNA, 19 nt, Homo sapiens
gcaaugaaggcacagaaau

SEQ ID NO: 216961 - RNA, 19 nt, Homo sapiens
ugaguuacgguguuuauuu

SEQ ID NO: 216962 - RNA, 19 nt, Homo sapiens
gaaaugacagggaaaauga

SEQ ID NO: 216963 - RNA, 19 nt, Homo sapiens
uaccauauccuguguuuga

SEQ ID NO: 216964 - RNA, 19 nt, Homo sapiens
gaucauggcccaaguugca

SEQ ID NO: 216965 - RNA, 19 nt, Homo sapiens
cagaagaugaugauuauuc

SEQ ID NO: 216966 - RNA, 19 nt, Homo sapiens
gcagaaauaggcccuuuua

SEQ ID NO: 216967 - RNA, 19 nt, Homo sapiens
ccucaaaccucagcuguuc

SEQ ID NO: 216968 - RNA, 19 nt, Homo sapiens
gaacgaauacaccagucaa

SEQ ID NO: 216969 - RNA, 19 nt, Homo sapiens
ucacugaucuacguaaaca

SEQ ID NO: 216970 - RNA, 19 nt, Homo sapiens
ugugauaguucaguucuuu

SEQ ID NO: 216971 - RNA, 19 nt, Homo sapiens
gaguaaaggaagaauggua

SEQ ID NO: 216972 - RNA, 19 nt, Homo sapiens
caaggaagccaccauucuu

SEQ ID NO: 216973 - RNA, 19 nt, Homo sapiens
uuccaggacuugugauuaa

SEQ ID NO: 216974 - RNA, 19 nt, Homo sapiens
ucuaagagcccucccagaa

SEQ ID NO: 216975 - RNA, 19 nt, Homo sapiens
guucuaacguucccuucaa

SEQ ID NO: 216976 - RNA, 19 nt, Homo sapiens
ccgaagcccuaccugguuu

SEQ ID NO: 216977 - RNA, 19 nt, Homo sapiens
gugaagauuuacagcuuga

SEQ ID NO: 216978 - RNA, 19 nt, Homo sapiens
ggaaagcuuuaggcaaauc

SEQ ID NO: 216979 - RNA, 19 nt, Homo sapiens
gaagaucggguugaggauu

SEQ ID NO: 216980 - RNA, 19 nt, Homo sapiens
aaacaguugaggacuauuu

SEQ ID NO: 216981 - RNA, 19 nt, Homo sapiens
ggaagcucuuggccuuaaa

SEQ ID NO: 216982 - RNA, 19 nt, Homo sapiens
caaaucggaugaguguaga

SEQ ID NO: 216983 - RNA, 19 nt, Homo sapiens
guagauauaggguaaucaa

SEQ ID NO: 216984 - RNA, 19 nt, Homo sapiens
gaaaaugacaggaaugaau

SEQ ID NO: 216985 - RNA, 19 nt, Homo sapiens
cugccgaguuuaucaaauu

SEQ ID NO: 216986 - RNA, 19 nt, Homo sapiens
ugaagaccuuaacaucauu

SEQ ID NO: 216987 - RNA, 19 nt, Homo sapiens
uaagagcccucccagaaaa

SEQ ID NO: 216988 - RNA, 19 nt, Homo sapiens
gaaaucagcuccaugagaa

SEQ ID NO: 216989 - RNA, 19 nt, Homo sapiens
gaaagacucucgaaaguug

SEQ ID NO: 216990 - RNA, 19 nt, Homo sapiens
cagaagauccugauuauua

SEQ ID NO: 216991 - RNA, 19 nt, Homo sapiens
gaaauuuggugaagcuauu

SEQ ID NO: 216992 - RNA, 19 nt, Homo sapiens
gauggaagcucucagauca

SEQ ID NO: 216993 - RNA, 19 nt, Homo sapiens
guaaagaacuggccaaguc

SEQ ID NO: 216994 - RNA, 19 nt, Homo sapiens
uaagaaagaugguggauca

SEQ ID NO: 216995 - RNA, 19 nt, Homo sapiens
gaaauuugcucaagcucuu

SEQ ID NO: 216996 - RNA, 19 nt, Homo sapiens
ucacggcucuccuuaauga

SEQ ID NO: 216997 - RNA, 19 nt, Homo sapiens
caacaugucccuucagaaa

SEQ ID NO: 216998 - RNA, 19 nt, Homo sapiens
gggauuucauucaucauua

SEQ ID NO: 216999 - RNA, 19 nt, Homo sapiens
gauauuacuugcaaaggaa

SEQ ID NO: 217000 - RNA, 19 nt, Homo sapiens
gaguguagaugcuguagaa

SEQ ID NO: 217001 - RNA, 19 nt, Homo sapiens
caagugggcaaucgaauua

SEQ ID NO: 217002 - RNA, 19 nt, Homo sapiens
gagaggauauuacuugcaa

SEQ ID NO: 217003 - RNA, 19 nt, Homo sapiens
uaucucagcgugugaauua

SEQ ID NO: 217004 - RNA, 19 nt, Homo sapiens
guuccuaucuguauauuug

SEQ ID NO: 217005 - RNA, 19 nt, Homo sapiens
gaagauacucagaaacaaa

SEQ ID NO: 217006 - RNA, 19 nt, Homo sapiens
gaaggugccguucgcguua

SEQ ID NO: 217007 - RNA, 19 nt, Homo sapiens
ggauauuacuugcaaagga

SEQ ID NO: 217008 - RNA, 19 nt, Homo sapiens
uaagcuaucucucaugguu

SEQ ID NO: 217009 - RNA, 19 nt, Homo sapiens
ggaauguacuaucaggauu

SEQ ID NO: 217010 - RNA, 19 nt, Homo sapiens
gugaagauaucuccuacuu

SEQ ID NO: 217011 - RNA, 19 nt, Homo sapiens
gcaguucugugaauuaaag

SEQ ID NO: 217012 - RNA, 19 nt, Homo sapiens
gaacuucugacucacagua

SEQ ID NO: 217013 - RNA, 19 nt, Homo sapiens
ugggaaagcuuuaggcaaa

SEQ ID NO: 217014 - RNA, 19 nt, Homo sapiens
gagaagauacucagaaaca

SEQ ID NO: 217015 - RNA, 19 nt, Homo sapiens
gaagauuuacagcuugaua

SEQ ID NO: 217016 - RNA, 19 nt, Homo sapiens
gcucucagaucaagcaaga

SEQ ID NO: 217017 - RNA, 19 nt, Homo sapiens
uaagagaacaagugaauga

SEQ ID NO: 217018 - RNA, 19 nt, Homo sapiens
gaagaauuguuugaaagga

SEQ ID NO: 217019 - RNA, 19 nt, Homo sapiens
gcaggaugguggugacauu

SEQ ID NO: 217020 - RNA, 19 nt, Homo sapiens
guagaccucuucccuccua

SEQ ID NO: 217021 - RNA, 19 nt, Homo sapiens
gggaagcucuuggccuuaa

SEQ ID NO: 217022 - RNA, 19 nt, Homo sapiens
ggaauuccacgacuugaaa

SEQ ID NO: 217023 - RNA, 19 nt, Homo sapiens
ggaaaucagcuccaugaga

SEQ ID NO: 217024 - RNA, 19 nt, Homo sapiens
ggagagaguuuuccuuuga

SEQ ID NO: 217025 - RNA, 19 nt, Homo sapiens
ggaagcaaguggaagagau

SEQ ID NO: 217026 - RNA, 19 nt, Homo sapiens
gaaaggaaauaugcucaag

SEQ ID NO: 217027 - RNA, 19 nt, Homo sapiens
gaaauugaaacacucagaa

SEQ ID NO: 217028 - RNA, 19 nt, Homo sapiens
caaaggaaaggauucguuu

SEQ ID NO: 217029 - RNA, 19 nt, Homo sapiens
gaaguugaggugacuauug

SEQ ID NO: 217030 - RNA, 19 nt, Homo sapiens
ggaaguaccagcagaagau

SEQ ID NO: 217031 - RNA, 19 nt, Homo sapiens
ggaaauggcagcugugaca

SEQ ID NO: 217032 - RNA, 19 nt, Homo sapiens
uguagaugcuguagaaauu

SEQ ID NO: 217033 - RNA, 19 nt, Homo sapiens
gaaauaggcccuuuuaugu

SEQ ID NO: 217034 - RNA, 19 nt, Homo sapiens
ugacaugguagcagaaaua

SEQ ID NO: 217035 - RNA, 19 nt, Homo sapiens
ucucaugguuccuauguuu

SEQ ID NO: 217036 - RNA, 19 nt, Homo sapiens
uggaauggcugguguacuu

SEQ ID NO: 217037 - RNA, 19 nt, Homo sapiens
cagcaguucugugaauuaa

SEQ ID NO: 217038 - RNA, 19 nt, Homo sapiens
gccagaaucacuaaauuaa

SEQ ID NO: 217039 - RNA, 19 nt, Homo sapiens
gaauuaaagagcagaguga

SEQ ID NO: 217040 - RNA, 19 nt, Homo sapiens
caaagguuccugaaauuga

SEQ ID NO: 217041 - RNA, 19 nt, Homo sapiens
cgaagucccucaugguaug

SEQ ID NO: 217042 - RNA, 19 nt, Homo sapiens
aaacugaacccacagaaga

SEQ ID NO: 217043 - RNA, 19 nt, Homo sapiens
gcaaaucggaugaguguag

SEQ ID NO: 217044 - RNA, 19 nt, Homo sapiens
aauaccagcucuacaagaa

SEQ ID NO: 217045 - RNA, 19 nt, Homo sapiens
gaauguacuaucaggauuu

SEQ ID NO: 217046 - RNA, 19 nt, Homo sapiens
gauuggaaugucagaauua

SEQ ID NO: 217047 - RNA, 19 nt, Homo sapiens
gaagaaugguaugccagaa

SEQ ID NO: 217048 - RNA, 19 nt, Homo sapiens
guucacggcucuccuuaau

SEQ ID NO: 217049 - RNA, 19 nt, Homo sapiens
ggaaggcccuaauaacaac

SEQ ID NO: 217050 - RNA, 19 nt, Homo sapiens
uuacauguguugagauuuc

SEQ ID NO: 217051 - RNA, 19 nt, Homo sapiens
gcuaagagaacaagugaau

SEQ ID NO: 217052 - RNA, 19 nt, Homo sapiens
aaacauuccuuuccgaagu

SEQ ID NO: 217053 - RNA, 19 nt, Homo sapiens
gcaaaggaaaggauucguu

SEQ ID NO: 217054 - RNA, 19 nt, Homo sapiens
ugaggacuauuucugcuuu

SEQ ID NO: 217055 - RNA, 19 nt, Homo sapiens
caggacuugugauuaauaa

SEQ ID NO: 217056 - RNA, 19 nt, Homo sapiens
ggaggagggugagagagaa

SEQ ID NO: 217057 - RNA, 19 nt, Homo sapiens
uggagaagauacucagaaa

SEQ ID NO: 217058 - RNA, 19 nt, Homo sapiens
gaagcaaguggaagagauu

SEQ ID NO: 217059 - RNA, 19 nt, Homo sapiens
gaaguuacucagccaagaa

SEQ ID NO: 217060 - RNA, 19 nt, Homo sapiens
gcaaugaaggcacagaaau

SEQ ID NO: 217061 - RNA, 19 nt, Homo sapiens
ugaguuacgguguuuauuu

SEQ ID NO: 217062 - RNA, 19 nt, Homo sapiens
gaaaugacagggaaaauga

SEQ ID NO: 217063 - RNA, 19 nt, Homo sapiens
uaccauauccuguguuuga

SEQ ID NO: 217064 - RNA, 19 nt, Homo sapiens
gaucauggcccaaguugca

SEQ ID NO: 217065 - RNA, 19 nt, Homo sapiens
caagcaggcccuucugaaa

SEQ ID NO: 217066 - RNA, 19 nt, Homo sapiens
gcagaaauaggcccuuuua

SEQ ID NO: 217067 - RNA, 19 nt, Homo sapiens
ccucaaaccucagcuguuc

SEQ ID NO: 217068 - RNA, 19 nt, Homo sapiens
gaacgaauacaccagucaa

SEQ ID NO: 217069 - RNA, 19 nt, Homo sapiens
ucacugaucuacguaaaca

SEQ ID NO: 217070 - RNA, 19 nt, Homo sapiens
aaacugaugauguugauga

SEQ ID NO: 217071 - RNA, 19 nt, Homo sapiens
gagaaccucuuccacuuuu

SEQ ID NO: 217072 - RNA, 19 nt, Homo sapiens
ugugauaguucaguucuuu

SEQ ID NO: 217073 - RNA, 19 nt, Homo sapiens
gaguaaaggaagaauggua

SEQ ID NO: 217074 - RNA, 19 nt, Homo sapiens
caaggaagccaccauucuu

SEQ ID NO: 217075 - RNA, 19 nt, Homo sapiens
uuccaggacuugugauuaa

SEQ ID NO: 217076 - RNA, 19 nt, Homo sapiens
ucuaagagcccucccagaa

SEQ ID NO: 217077 - RNA, 19 nt, Homo sapiens
guucuaacguucccuucaa

SEQ ID NO: 217078 - RNA, 19 nt, Homo sapiens
ccgaagcccuaccugguuu

SEQ ID NO: 217079 - RNA, 19 nt, Homo sapiens
gugaagauuuacagcuuga

SEQ ID NO: 217080 - RNA, 19 nt, Homo sapiens
ggaaagcuuuaggcaaauc

SEQ ID NO: 217081 - RNA, 19 nt, Homo sapiens
gaagaucggguugaggauu

SEQ ID NO: 217082 - RNA, 19 nt, Homo sapiens
aaguugaggugacuauuga

SEQ ID NO: 217083 - RNA, 19 nt, Homo sapiens
aaacaguugaggacuauuu

SEQ ID NO: 217084 - RNA, 19 nt, Homo sapiens
acaagaagcuaggcucugu

SEQ ID NO: 217085 - RNA, 19 nt, Homo sapiens
uagaggaaauacagagaga

SEQ ID NO: 217086 - RNA, 19 nt, Homo sapiens
ggaagcucuuggccuuaaa

SEQ ID NO: 217087 - RNA, 19 nt, Homo sapiens
gcaaggaagccaccauucu

SEQ ID NO: 217088 - RNA, 19 nt, Homo sapiens
gaaaucagcuccaugagaa

SEQ ID NO: 217089 - RNA, 19 nt, Homo sapiens
gaaagacucucgaaaguug

SEQ ID NO: 217090 - RNA, 19 nt, Homo sapiens
cagaagauccugauuauua

SEQ ID NO: 217091 - RNA, 19 nt, Homo sapiens
gaaauuuggugaagcuauu

SEQ ID NO: 217092 - RNA, 19 nt, Homo sapiens
gauggaagcucucagauca

SEQ ID NO: 217093 - RNA, 19 nt, Homo sapiens
guaaagaacuggccaaguc

SEQ ID NO: 217094 - RNA, 19 nt, Homo sapiens
uaagaaagaugguggauca

SEQ ID NO: 217095 - RNA, 19 nt, Homo sapiens
gaaauuugcucaagcucuu

SEQ ID NO: 217096 - RNA, 19 nt, Homo sapiens
ucacggcucuccuuaauga

SEQ ID NO: 217097 - RNA, 19 nt, Homo sapiens
caacaugucccuucagaaa

SEQ ID NO: 217098 - RNA, 19 nt, Homo sapiens
gggauuucauucaucauua

SEQ ID NO: 217099 - RNA, 19 nt, Homo sapiens
gauauuacuugcaaaggaa

SEQ ID NO: 217100 - RNA, 19 nt, Homo sapiens
gaguguagaugcuguagaa

SEQ ID NO: 217101 - RNA, 19 nt, Homo sapiens
caagugggcaaucgaauua

SEQ ID NO: 217102 - RNA, 19 nt, Homo sapiens
gagaggauauuacuugcaa

SEQ ID NO: 217103 - RNA, 19 nt, Homo sapiens
uaucucagcgugugaauua

SEQ ID NO: 217104 - RNA, 19 nt, Homo sapiens
guuccuaucuguauauuug

SEQ ID NO: 217105 - RNA, 19 nt, Homo sapiens
gaagauacucagaaacaaa

SEQ ID NO: 217106 - RNA, 19 nt, Homo sapiens
gaaggugccguucgcguua

SEQ ID NO: 217107 - RNA, 19 nt, Homo sapiens
ggauauuacuugcaaagga

SEQ ID NO: 217108 - RNA, 19 nt, Homo sapiens
uaagcuaucucucaugguu

SEQ ID NO: 217109 - RNA, 19 nt, Homo sapiens
ggaauguacuaucaggauu

SEQ ID NO: 217110 - RNA, 19 nt, Homo sapiens
gugaagauaucuccuacuu

SEQ ID NO: 217111 - RNA, 19 nt, Homo sapiens
gcaguucugugaauuaaag

SEQ ID NO: 217112 - RNA, 19 nt, Homo sapiens
gaacuucugacucacagua

SEQ ID NO: 217113 - RNA, 19 nt, Homo sapiens
ugggaaagcuuuaggcaaa

SEQ ID NO: 217114 - RNA, 19 nt, Homo sapiens
gagaagauacucagaaaca

SEQ ID NO: 217115 - RNA, 19 nt, Homo sapiens
gaagauuuacagcuugaua

SEQ ID NO: 217116 - RNA, 19 nt, Homo sapiens
gcucucagaucaagcaaga

SEQ ID NO: 217117 - RNA, 19 nt, Homo sapiens
uaagagaacaagugaauga

SEQ ID NO: 217118 - RNA, 19 nt, Homo sapiens
gaagaauuguuugaaagga

SEQ ID NO: 217119 - RNA, 19 nt, Homo sapiens
gcaggaugguggugacauu

SEQ ID NO: 217120 - RNA, 19 nt, Homo sapiens
guagaccucuucccuccua

SEQ ID NO: 217121 - RNA, 19 nt, Homo sapiens
gggaagcucuuggccuuaa

SEQ ID NO: 217122 - RNA, 19 nt, Homo sapiens
ggaauuccacgacuugaaa

SEQ ID NO: 217123 - RNA, 19 nt, Homo sapiens
ggaaaucagcuccaugaga

SEQ ID NO: 217124 - RNA, 19 nt, Homo sapiens
ggagagaguuuuccuuuga

SEQ ID NO: 217125 - RNA, 19 nt, Homo sapiens
ggaagcaaguggaagagau

SEQ ID NO: 217126 - RNA, 19 nt, Homo sapiens
gaaaggaaauaugcucaag

SEQ ID NO: 217127 - RNA, 19 nt, Homo sapiens
gaaauugaaacacucagaa

SEQ ID NO: 217128 - RNA, 19 nt, Homo sapiens
caaaggaaaggauucguuu

SEQ ID NO: 217129 - RNA, 19 nt, Homo sapiens
gaaguugaggugacuauug

SEQ ID NO: 217130 - RNA, 19 nt, Homo sapiens
ggaaguaccagcagaagau

SEQ ID NO: 217131 - RNA, 19 nt, Homo sapiens
ggaaauggcagcugugaca

SEQ ID NO: 217132 - RNA, 19 nt, Homo sapiens
uguagaugcuguagaaauu

SEQ ID NO: 217133 - RNA, 19 nt, Homo sapiens
gaaauaggcccuuuuaugu

SEQ ID NO: 217134 - RNA, 19 nt, Homo sapiens
ugacaugguagcagaaaua

SEQ ID NO: 217135 - RNA, 19 nt, Homo sapiens
ucucaugguuccuauguuu

SEQ ID NO: 217136 - RNA, 19 nt, Homo sapiens
uggaauggcugguguacuu

SEQ ID NO: 217137 - RNA, 19 nt, Homo sapiens
cagcaguucugugaauuaa

SEQ ID NO: 217138 - RNA, 19 nt, Homo sapiens
gccagaaucacuaaauuaa

SEQ ID NO: 217139 - RNA, 19 nt, Homo sapiens
gaauuaaagagcagaguga

SEQ ID NO: 217140 - RNA, 19 nt, Homo sapiens
caaagguuccugaaauuga

SEQ ID NO: 217141 - RNA, 19 nt, Homo sapiens
cgaagucccucaugguaug

SEQ ID NO: 217142 - RNA, 19 nt, Homo sapiens
aaacugaacccacagaaga

SEQ ID NO: 217143 - RNA, 19 nt, Homo sapiens
gcaaaucggaugaguguag

SEQ ID NO: 217144 - RNA, 19 nt, Homo sapiens
aauaccagcucuacaagaa

SEQ ID NO: 217145 - RNA, 19 nt, Homo sapiens
gaauguacuaucaggauuu

SEQ ID NO: 217146 - RNA, 19 nt, Homo sapiens
gauuggaaugucagaauua

SEQ ID NO: 217147 - RNA, 19 nt, Homo sapiens
gaagaaugguaugccagaa

SEQ ID NO: 217148 - RNA, 19 nt, Homo sapiens
guucacggcucuccuuaau

SEQ ID NO: 217149 - RNA, 19 nt, Homo sapiens
ggaaggcccuaauaacaac

SEQ ID NO: 217150 - RNA, 19 nt, Homo sapiens
uuacauguguugagauuuc

SEQ ID NO: 217151 - RNA, 19 nt, Homo sapiens
gcuaagagaacaagugaau

SEQ ID NO: 217152 - RNA, 19 nt, Homo sapiens
aaacauuccuuuccgaagu

SEQ ID NO: 217153 - RNA, 19 nt, Homo sapiens
gcaaaggaaaggauucguu

SEQ ID NO: 217154 - RNA, 19 nt, Homo sapiens
ugaggacuauuucugcuuu

SEQ ID NO: 217155 - RNA, 19 nt, Homo sapiens
caggacuugugauuaauaa

SEQ ID NO: 217156 - RNA, 19 nt, Homo sapiens
ggaggagggugagagagaa

SEQ ID NO: 217157 - RNA, 19 nt, Homo sapiens
uggagaagauacucagaaa

SEQ ID NO: 217158 - RNA, 19 nt, Homo sapiens
gaagcaaguggaagagauu

SEQ ID NO: 217159 - RNA, 19 nt, Homo sapiens
gaaguuacucagccaagaa

SEQ ID NO: 217160 - RNA, 19 nt, Homo sapiens
gcaaugaaggcacagaaau

SEQ ID NO: 217161 - RNA, 19 nt, Homo sapiens
ugaguuacgguguuuauuu

SEQ ID NO: 217162 - RNA, 19 nt, Homo sapiens
gaaaugacagggaaaauga

SEQ ID NO: 217163 - RNA, 19 nt, Homo sapiens
uaccauauccuguguuuga

SEQ ID NO: 217164 - RNA, 19 nt, Homo sapiens
gaucauggcccaaguugca

SEQ ID NO: 217165 - RNA, 19 nt, Homo sapiens
gcagaaauaggcccuuuua

SEQ ID NO: 217166 - RNA, 19 nt, Homo sapiens
ccucaaaccucagcuguuc

SEQ ID NO: 217167 - RNA, 19 nt, Homo sapiens
gaacgaauacaccagucaa

SEQ ID NO: 217168 - RNA, 19 nt, Homo sapiens
ucacugaucuacguaaaca

SEQ ID NO: 217169 - RNA, 19 nt, Homo sapiens
gagaaccucuuccacuuuu

SEQ ID NO: 217170 - RNA, 19 nt, Homo sapiens
ugugauaguucaguucuuu

SEQ ID NO: 217171 - RNA, 19 nt, Homo sapiens
gaguaaaggaagaauggua

SEQ ID NO: 217172 - RNA, 19 nt, Homo sapiens
caaggaagccaccauucuu

SEQ ID NO: 217173 - RNA, 19 nt, Homo sapiens
uuccaggacuugugauuaa

SEQ ID NO: 217174 - RNA, 19 nt, Homo sapiens
ucuaagagcccucccagaa

SEQ ID NO: 217175 - RNA, 19 nt, Homo sapiens
guucuaacguucccuucaa

SEQ ID NO: 217176 - RNA, 19 nt, Homo sapiens
ccgaagcccuaccugguuu

SEQ ID NO: 217177 - RNA, 19 nt, Homo sapiens
gugaagauuuacagcuuga

SEQ ID NO: 217178 - RNA, 19 nt, Homo sapiens
ggaaagcuuuaggcaaauc

SEQ ID NO: 217179 - RNA, 19 nt, Homo sapiens
gaagaucggguugaggauu

SEQ ID NO: 217180 - RNA, 19 nt, Homo sapiens
aaguugaggugacuauuga

SEQ ID NO: 217181 - RNA, 19 nt, Homo sapiens
aaacaguugaggacuauuu

SEQ ID NO: 217182 - RNA, 19 nt, Homo sapiens
acaagaagcuaggcucugu

SEQ ID NO: 217183 - RNA, 19 nt, Homo sapiens
uagaggaaauacagagaga

SEQ ID NO: 217184 - RNA, 19 nt, Homo sapiens
ggaagcucuuggccuuaaa

SEQ ID NO: 217185 - RNA, 19 nt, Homo sapiens
caaaucggaugaguguaga

SEQ ID NO: 217186 - RNA, 19 nt, Homo sapiens
guagauauaggguaaucaa

SEQ ID NO: 217187 - RNA, 19 nt, Homo sapiens
gaaaaugacaggaaugaau

SEQ ID NO: 217188 - RNA, 19 nt, Homo sapiens
gaaaucagcuccaugagaa

SEQ ID NO: 217189 - RNA, 19 nt, Homo sapiens
gaaagacucucgaaaguug

SEQ ID NO: 217190 - RNA, 19 nt, Homo sapiens
cagaagauccugauuauua

SEQ ID NO: 217191 - RNA, 19 nt, Homo sapiens
gaaauuuggugaagcuauu

SEQ ID NO: 217192 - RNA, 19 nt, Homo sapiens
gauggaagcucucagauca

SEQ ID NO: 217193 - RNA, 19 nt, Homo sapiens
guaaagaacuggccaaguc

SEQ ID NO: 217194 - RNA, 19 nt, Homo sapiens
uaagaaagaugguggauca

SEQ ID NO: 217195 - RNA, 19 nt, Homo sapiens
gaaauuugcucaagcucuu

SEQ ID NO: 217196 - RNA, 19 nt, Homo sapiens
ucacggcucuccuuaauga

SEQ ID NO: 217197 - RNA, 19 nt, Homo sapiens
gggauuucauucaucauua

SEQ ID NO: 217198 - RNA, 19 nt, Homo sapiens
gauauuacuugcaaaggaa

SEQ ID NO: 217199 - RNA, 19 nt, Homo sapiens
gaguguagaugcuguagaa

SEQ ID NO: 217200 - RNA, 19 nt, Homo sapiens
caagugggcaaucgaauua

SEQ ID NO: 217201 - RNA, 19 nt, Homo sapiens
gagaggauauuacuugcaa

SEQ ID NO: 217202 - RNA, 19 nt, Homo sapiens
uaucucagcgugugaauua

SEQ ID NO: 217203 - RNA, 19 nt, Homo sapiens
guuccuaucuguauauuug

SEQ ID NO: 217204 - RNA, 19 nt, Homo sapiens
gaagauacucagaaacaaa

SEQ ID NO: 217205 - RNA, 19 nt, Homo sapiens
gaaggugccguucgcguua

SEQ ID NO: 217206 - RNA, 19 nt, Homo sapiens
ggauauuacuugcaaagga

SEQ ID NO: 217207 - RNA, 19 nt, Homo sapiens
uaagcuaucucucaugguu

SEQ ID NO: 217208 - RNA, 19 nt, Homo sapiens
ggaauguacuaucaggauu

SEQ ID NO: 217209 - RNA, 19 nt, Homo sapiens
cagcagaagaugaugauua

SEQ ID NO: 217210 - RNA, 19 nt, Homo sapiens
gugaagauaucuccuacuu

SEQ ID NO: 217211 - RNA, 19 nt, Homo sapiens
gcaguucugugaauuaaag

SEQ ID NO: 217212 - RNA, 19 nt, Homo sapiens
gaacuucugacucacagua

SEQ ID NO: 217213 - RNA, 19 nt, Homo sapiens
ugggaaagcuuuaggcaaa

SEQ ID NO: 217214 - RNA, 19 nt, Homo sapiens
gagaagauacucagaaaca

SEQ ID NO: 217215 - RNA, 19 nt, Homo sapiens
gaagauuuacagcuugaua

SEQ ID NO: 217216 - RNA, 19 nt, Homo sapiens
gcucucagaucaagcaaga

SEQ ID NO: 217217 - RNA, 19 nt, Homo sapiens
uaagagaacaagugaauga

SEQ ID NO: 217218 - RNA, 19 nt, Homo sapiens
gaagaauuguuugaaagga

SEQ ID NO: 217219 - RNA, 19 nt, Homo sapiens
gcaggaugguggugacauu

SEQ ID NO: 217220 - RNA, 19 nt, Homo sapiens
guagaccucuucccuccua

SEQ ID NO: 217221 - RNA, 19 nt, Homo sapiens
gggaagcucuuggccuuaa

SEQ ID NO: 217222 - RNA, 19 nt, Homo sapiens
ggaauuccacgacuugaaa

SEQ ID NO: 217223 - RNA, 19 nt, Homo sapiens
ggaaaucagcuccaugaga

SEQ ID NO: 217224 - RNA, 19 nt, Homo sapiens
ggagagaguuuuccuuuga

SEQ ID NO: 217225 - RNA, 19 nt, Homo sapiens
ggaagcaaguggaagagau

SEQ ID NO: 217226 - RNA, 19 nt, Homo sapiens
gaaaggaaauaugcucaag

SEQ ID NO: 217227 - RNA, 19 nt, Homo sapiens
gaaauugaaacacucagaa

SEQ ID NO: 217228 - RNA, 19 nt, Homo sapiens
caaaggaaaggauucguuu

SEQ ID NO: 217229 - RNA, 19 nt, Homo sapiens
ggaaguaccagcagaagau

SEQ ID NO: 217230 - RNA, 19 nt, Homo sapiens
ggaaauggcagcugugaca

SEQ ID NO: 217231 - RNA, 19 nt, Homo sapiens
uguagaugcuguagaaauu

SEQ ID NO: 217232 - RNA, 19 nt, Homo sapiens
gaaauaggcccuuuuaugu

SEQ ID NO: 217233 - RNA, 19 nt, Homo sapiens
ugacaugguagcagaaaua

SEQ ID NO: 217234 - RNA, 19 nt, Homo sapiens
ucucaugguuccuauguuu

SEQ ID NO: 217235 - RNA, 19 nt, Homo sapiens
uggaauggcugguguacuu

SEQ ID NO: 217236 - RNA, 19 nt, Homo sapiens
cagcaguucugugaauuaa

SEQ ID NO: 217237 - RNA, 19 nt, Homo sapiens
gccagaaucacuaaauuaa

SEQ ID NO: 217238 - RNA, 19 nt, Homo sapiens
gaauuaaagagcagaguga

SEQ ID NO: 217239 - RNA, 19 nt, Homo sapiens
caaagguuccugaaauuga

SEQ ID NO: 217240 - RNA, 19 nt, Homo sapiens
cgaagucccucaugguaug

SEQ ID NO: 217241 - RNA, 19 nt, Homo sapiens
aaacugaacccacagaaga

SEQ ID NO: 217242 - RNA, 19 nt, Homo sapiens
gcaaaucggaugaguguag

SEQ ID NO: 217243 - RNA, 19 nt, Homo sapiens
aauaccagcucuacaagaa

SEQ ID NO: 217244 - RNA, 19 nt, Homo sapiens
gaauguacuaucaggauuu

SEQ ID NO: 217245 - RNA, 19 nt, Homo sapiens
gauuggaaugucagaauua

SEQ ID NO: 217246 - RNA, 19 nt, Homo sapiens
gaagaaugguaugccagaa

SEQ ID NO: 217247 - RNA, 19 nt, Homo sapiens
guucacggcucuccuuaau

SEQ ID NO: 217248 - RNA, 19 nt, Homo sapiens
ggaaggcccuaauaacaac

SEQ ID NO: 217249 - RNA, 19 nt, Homo sapiens
uuacauguguugagauuuc

SEQ ID NO: 217250 - RNA, 19 nt, Homo sapiens
gcuaagagaacaagugaau

SEQ ID NO: 217251 - RNA, 19 nt, Homo sapiens
aaacauuccuuuccgaagu

SEQ ID NO: 217252 - RNA, 19 nt, Homo sapiens
gcaaaggaaaggauucguu

SEQ ID NO: 217253 - RNA, 19 nt, Homo sapiens
ugaggacuauuucugcuuu

SEQ ID NO: 217254 - RNA, 19 nt, Homo sapiens
caggacuugugauuaauaa

SEQ ID NO: 217255 - RNA, 19 nt, Homo sapiens
ggaggagggugagagagaa

SEQ ID NO: 217256 - RNA, 19 nt, Homo sapiens
uggagaagauacucagaaa

SEQ ID NO: 217257 - RNA, 19 nt, Homo sapiens
gaagcaaguggaagagauu

SEQ ID NO: 217258 - RNA, 19 nt, Homo sapiens
gaaguuacucagccaagaa

SEQ ID NO: 217259 - RNA, 19 nt, Homo sapiens
gcaaugaaggcacagaaau

SEQ ID NO: 217260 - RNA, 19 nt, Homo sapiens
ugaguuacgguguuuauuu

SEQ ID NO: 217261 - RNA, 19 nt, Homo sapiens
gaaaugacagggaaaauga

SEQ ID NO: 217262 - RNA, 19 nt, Homo sapiens
uaccauauccuguguuuga

SEQ ID NO: 217263 - RNA, 19 nt, Homo sapiens
gaucauggcccaaguugca

SEQ ID NO: 217264 - RNA, 19 nt, Homo sapiens
cagaagaugaugauuauuc

SEQ ID NO: 217265 - RNA, 19 nt, Homo sapiens
caagcaggcccuucugaaa

SEQ ID NO: 217266 - RNA, 19 nt, Homo sapiens
gcagaaauaggcccuuuua

SEQ ID NO: 217267 - RNA, 19 nt, Homo sapiens
ccucaaaccucagcuguuc

SEQ ID NO: 217268 - RNA, 19 nt, Homo sapiens
gaacgaauacaccagucaa

SEQ ID NO: 217269 - RNA, 19 nt, Homo sapiens
ucacugaucuacguaaaca

SEQ ID NO: 217270 - RNA, 19 nt, Homo sapiens
aaacugaugauguugauga

SEQ ID NO: 217271 - RNA, 19 nt, Homo sapiens
gagaaccucuuccacuuuu

SEQ ID NO: 217272 - RNA, 19 nt, Homo sapiens
ugugauaguucaguucuuu

SEQ ID NO: 217273 - RNA, 19 nt, Homo sapiens
gaguaaaggaagaauggua

SEQ ID NO: 217274 - RNA, 19 nt, Homo sapiens
caaggaagccaccauucuu

SEQ ID NO: 217275 - RNA, 19 nt, Homo sapiens
uuccaggacuugugauuaa

SEQ ID NO: 217276 - RNA, 19 nt, Homo sapiens
ucuaagagcccucccagaa

SEQ ID NO: 217277 - RNA, 19 nt, Homo sapiens
guucuaacguucccuucaa

SEQ ID NO: 217278 - RNA, 19 nt, Homo sapiens
ccgaagcccuaccugguuu

SEQ ID NO: 217279 - RNA, 19 nt, Homo sapiens
gugaagauuuacagcuuga

SEQ ID NO: 217280 - RNA, 19 nt, Homo sapiens
ggaaagcuuuaggcaaauc

SEQ ID NO: 217281 - RNA, 19 nt, Homo sapiens
gaagaucggguugaggauu

SEQ ID NO: 217282 - RNA, 19 nt, Homo sapiens
aaacaguugaggacuauuu

SEQ ID NO: 217283 - RNA, 19 nt, Homo sapiens
acaagaagcuaggcucugu

SEQ ID NO: 217284 - RNA, 19 nt, Homo sapiens
uagaggaaauacagagaga

SEQ ID NO: 217285 - RNA, 19 nt, Homo sapiens
ggaagcucuuggccuuaaa

SEQ ID NO: 217286 - RNA, 19 nt, Homo sapiens
gcaaggaagccaccauucu

SEQ ID NO: 217287 - RNA, 19 nt, Homo sapiens
caaaucggaugaguguaga

SEQ ID NO: 217288 - RNA, 19 nt, Homo sapiens
cagaagauccugauuauua

SEQ ID NO: 217289 - RNA, 19 nt, Homo sapiens
guaaagaacuggccaaguc

SEQ ID NO: 217290 - RNA, 19 nt, Homo sapiens
gggauuucauucaucauua

SEQ ID NO: 217291 - RNA, 19 nt, Homo sapiens
gaguguagaugcuguagaa

SEQ ID NO: 217292 - RNA, 19 nt, Homo sapiens
ugggaaagcuuuaggcaaa

SEQ ID NO: 217293 - RNA, 19 nt, Homo sapiens
gcaggaugguggugacauu

SEQ ID NO: 217294 - RNA, 19 nt, Homo sapiens
gaaauugaaacacucagaa

SEQ ID NO: 217295 - RNA, 19 nt, Homo sapiens
ggaaauggcagcugugaca

SEQ ID NO: 217296 - RNA, 19 nt, Homo sapiens
uguagaugcuguagaaauu

SEQ ID NO: 217297 - RNA, 19 nt, Homo sapiens
aaacugaacccacagaaga

SEQ ID NO: 217298 - RNA, 19 nt, Homo sapiens
gcaaaucggaugaguguag

SEQ ID NO: 217299 - RNA, 19 nt, Homo sapiens
ugaggacuauuucugcuuu

SEQ ID NO: 217300 - RNA, 19 nt, Homo sapiens
gcaaugaaggcacagaaau

SEQ ID NO: 217301 - RNA, 19 nt, Homo sapiens
gaucauggcccaaguugca

SEQ ID NO: 217302 - RNA, 19 nt, Homo sapiens
ggaaguaccagcagaaggu

SEQ ID NO: 217303 - RNA, 19 nt, Homo sapiens
caaggaagccaccauucuu

SEQ ID NO: 217304 - RNA, 19 nt, Homo sapiens
ggaaagcuuuaggcaaauc

SEQ ID NO: 217305 - RNA, 19 nt, Homo sapiens
aaacaguugaggacuauuu

SEQ ID NO: 217306 - RNA, 19 nt, Homo sapiens
caaaucggaugaguguaga

SEQ ID NO: 217307 - RNA, 19 nt, Homo sapiens
caaugaaggcacagaaaug

SEQ ID NO: 217308 - RNA, 19 nt, Homo sapiens
gacaguaaaggaagaauca

SEQ ID NO: 217309 - RNA, 19 nt, Homo sapiens
uagaugcuguagaaauuga

SEQ ID NO: 217310 - RNA, 19 nt, Homo sapiens
cgagaacuaugaucuugca

SEQ ID NO: 217311 - RNA, 19 nt, Homo sapiens
gcucucgaguccaugugua

SEQ ID NO: 217312 - RNA, 19 nt, Homo sapiens
gcagagaugcauaaaauga

SEQ ID NO: 217313 - RNA, 19 nt, Homo sapiens
aaaggaagaaucagaagau

SEQ ID NO: 217314 - RNA, 19 nt, Homo sapiens
uaaaggaagaaucagaaga

SEQ ID NO: 217315 - RNA, 19 nt, Homo sapiens
gucaauaccagaaaggauu

SEQ ID NO: 217316 - RNA, 19 nt, Homo sapiens
gcauugcaguguaugaaac

SEQ ID NO: 217317 - RNA, 19 nt, Homo sapiens
gaacuggccaaguccaaag

SEQ ID NO: 217318 - RNA, 19 nt, Homo sapiens
cagcagaagguuaggagaa

SEQ ID NO: 217319 - RNA, 19 nt, Homo sapiens
ggacgugcuuuugucaaua

SEQ ID NO: 217320 - RNA, 19 nt, Homo sapiens
gggaaagcuuuaggcaaau

SEQ ID NO: 217321 - RNA, 19 nt, Homo sapiens
ugaaggcacagaaauggaa

SEQ ID NO: 217322 - RNA, 19 nt, Homo sapiens
ccagucggcugugguagug

SEQ ID NO: 217323 - RNA, 19 nt, Homo sapiens
gaagauccugauuauuauc

SEQ ID NO: 217324 - RNA, 19 nt, Homo sapiens
ggaagaaucagaagauccu

SEQ ID NO: 217325 - RNA, 19 nt, Homo sapiens
ucaauaccagaaaggauuu

SEQ ID NO: 217326 - RNA, 19 nt, Homo sapiens
uugcaacccugaaauggau

SEQ ID NO: 217327 - RNA, 19 nt, Homo sapiens
gaucuugcaacccugaaau

SEQ ID NO: 217328 - RNA, 19 nt, Homo sapiens
cccgagaacuaugaucuug

SEQ ID NO: 217329 - RNA, 19 nt, Homo sapiens
guagaaauugaaacacuca

SEQ ID NO: 217330 - RNA, 19 nt, Homo sapiens
ggcaaugaaggcacagaaa

SEQ ID NO: 217331 - RNA, 19 nt, Homo sapiens
agcagaagguuaggagaaa

SEQ ID NO: 217332 - RNA, 19 nt, Homo sapiens
gaaguaccagcagaagguu

SEQ ID NO: 217333 - RNA, 19 nt, Homo sapiens
ugucagcucucgaguccau

SEQ ID NO: 217334 - RNA, 19 nt, Homo sapiens
guagaugcuguagaaauug

SEQ ID NO: 217335 - RNA, 19 nt, Homo sapiens
gggcaaugaaggcacagaa

SEQ ID NO: 217336 - RNA, 19 nt, Homo sapiens
gaugaguguagaugcugua

SEQ ID NO: 217337 - RNA, 19 nt, Homo sapiens
gcagaagguuaggagaaaa

SEQ ID NO: 217338 - RNA, 19 nt, Homo sapiens
ucaaggaagccaccauucu

SEQ ID NO: 217339 - RNA, 19 nt, Homo sapiens
guaaaggaagaaucagaag

SEQ ID NO: 217340 - RNA, 19 nt, Homo sapiens
gggaucauggcccaaguug

SEQ ID NO: 217341 - RNA, 19 nt, Homo sapiens
ucgaguccauguguaaaga

SEQ ID NO: 217342 - RNA, 19 nt, Homo sapiens
gauugcauauuuuccacua

SEQ ID NO: 217343 - RNA, 19 nt, Homo sapiens
guccauguguaaagaacug

SEQ ID NO: 217344 - RNA, 19 nt, Homo sapiens
gguggugacauuccucaug

SEQ ID NO: 217345 - RNA, 19 nt, Homo sapiens
uguagguggucgugugaug

SEQ ID NO: 217346 - RNA, 19 nt, Homo sapiens
guguagaugcuguagaaau

SEQ ID NO: 217347 - RNA, 19 nt, Homo sapiens
uccacuauuuguuguaugu

SEQ ID NO: 217348 - RNA, 19 nt, Homo sapiens
aguaaaggaagaaucagaa

SEQ ID NO: 217349 - RNA, 19 nt, Homo sapiens
caguaaaggaagaaucaga

SEQ ID NO: 217350 - RNA, 19 nt, Homo sapiens
aggcaaaucggaugagugu

SEQ ID NO: 217351 - RNA, 19 nt, Homo sapiens
gguggucgugugaugguaa

SEQ ID NO: 217352 - RNA, 19 nt, Homo sapiens
ccaucaaagugaaaacuga

SEQ ID NO: 217353 - RNA, 19 nt, Homo sapiens
gucgugugaugguaacaga

SEQ ID NO: 217354 - RNA, 19 nt, Homo sapiens
gaugcuguagaaauugaaa

SEQ ID NO: 217355 - RNA, 19 nt, Homo sapiens
uuaaacaccccgagaacua

SEQ ID NO: 217356 - RNA, 19 nt, Homo sapiens
ccaggcaaaucggaugagu

SEQ ID NO: 217357 - RNA, 19 nt, Homo sapiens
cuacaacccaggcaaaucg

SEQ ID NO: 217358 - RNA, 19 nt, Homo sapiens
gaaaacugaacccacagaa

SEQ ID NO: 217359 - RNA, 19 nt, Homo sapiens
gagccaaagaagcauguag

SEQ ID NO: 217360 - RNA, 19 nt, Homo sapiens
agaaauugaaacacucaga

SEQ ID NO: 217361 - RNA, 19 nt, Homo sapiens
gaacugcacugcuuuguuu

SEQ ID NO: 217362 - RNA, 19 nt, Homo sapiens
ggacggaacuucugaaaca

SEQ ID NO: 217363 - RNA, 19 nt, Homo sapiens
gaaacaagggcaaggcuua

SEQ ID NO: 217364 - RNA, 19 nt, Homo sapiens
gaaccucuauucaagugua

SEQ ID NO: 217365 - RNA, 19 nt, Homo sapiens
ggaagaaccuauacaacug

SEQ ID NO: 217366 - RNA, 19 nt, Homo sapiens
gggcaaggcuuaucuuugu

SEQ ID NO: 217367 - RNA, 19 nt, Homo sapiens
guaagaagaccuuuaagaa

SEQ ID NO: 217368 - RNA, 19 nt, Homo sapiens
gcuaagaacugcacugcuu

SEQ ID NO: 217369 - RNA, 19 nt, Homo sapiens
ggagagaccauuuguuugu

SEQ ID NO: 217370 - RNA, 19 nt, Homo sapiens
gaauaccaaugaaccucua

SEQ ID NO: 217371 - RNA, 19 nt, Homo sapiens
aaaugaagcucaaagucaa

SEQ ID NO: 217372 - RNA, 19 nt, Homo sapiens
gcaaugaaacaaagucuca

SEQ ID NO: 217373 - RNA, 19 nt, Homo sapiens
ccauaaagaggaaauacua

SEQ ID NO: 217374 - RNA, 19 nt, Homo sapiens
agagaaggcuguggaagaa

SEQ ID NO: 217375 - RNA, 19 nt, Homo sapiens
gagagaaacccauaaagag

SEQ ID NO: 217376 - RNA, 19 nt, Homo sapiens
aagauuaccuuaagcaaca

SEQ ID NO: 217377 - RNA, 19 nt, Homo sapiens
gaacuucugaaacauguga

SEQ ID NO: 217378 - RNA, 19 nt, Homo sapiens
uuaaaggacugcagaccaa

SEQ ID NO: 217379 - RNA, 19 nt, Homo sapiens
aagaagaccuuuaagaaac

SEQ ID NO: 217380 - RNA, 19 nt, Homo sapiens
ugagagaaacccauaaaga

SEQ ID NO: 217381 - RNA, 19 nt, Homo sapiens
gagaaaagccguuuguuug

SEQ ID NO: 217382 - RNA, 19 nt, Homo sapiens
aagaugcucucgacaguug

SEQ ID NO: 217383 - RNA, 19 nt, Homo sapiens
caucugagccgccacauuc

SEQ ID NO: 217384 - RNA, 19 nt, Homo sapiens
gcaaagauuaccuuaagca

SEQ ID NO: 217385 - RNA, 19 nt, Homo sapiens
aagaggaaauacuauguga

SEQ ID NO: 217386 - RNA, 19 nt, Homo sapiens
gaaccuauacaacuguguu

SEQ ID NO: 217387 - RNA, 19 nt, Homo sapiens
gaggaaauacuaugugaag

SEQ ID NO: 217388 - RNA, 19 nt, Homo sapiens
ggagaaaagccguuuguuu

SEQ ID NO: 217389 - RNA, 19 nt, Homo sapiens
gagagucacccaacugugu

SEQ ID NO: 217390 - RNA, 19 nt, Homo sapiens
acgcaaagauuaccuuaag

SEQ ID NO: 217391 - RNA, 19 nt, Homo sapiens
ccucucaucucaguggaua

SEQ ID NO: 217392 - RNA, 19 nt, Homo sapiens
ccacgagggcuauguaugu

SEQ ID NO: 217393 - RNA, 19 nt, Homo sapiens
gaagaaccuauacaacugu

SEQ ID NO: 217394 - RNA, 19 nt, Homo sapiens
gagcaugcuuuucuuuauu

SEQ ID NO: 217395 - RNA, 19 nt, Homo sapiens
uacaugauccugacaagaa

SEQ ID NO: 217396 - RNA, 19 nt, Homo sapiens
gaccauuuguuugugacua

SEQ ID NO: 217397 - RNA, 19 nt, Homo sapiens
gagagaccauuuguuugug

SEQ ID NO: 217398 - RNA, 19 nt, Homo sapiens
acaagaugcucucgacagu

SEQ ID NO: 217399 - RNA, 19 nt, Homo sapiens
ccuauacaacuguguuuaa

SEQ ID NO: 217400 - RNA, 19 nt, Homo sapiens
aaacgcaaagauuaccuua

SEQ ID NO: 217401 - RNA, 19 nt, Homo sapiens
agaagaccuuuaagaaaca

SEQ ID NO: 217402 - RNA, 19 nt, Homo sapiens
uuugaagacuguaagaaga

SEQ ID NO: 217403 - RNA, 19 nt, Homo sapiens
ccaacuguguggaagacaa

SEQ ID NO: 217404 - RNA, 19 nt, Homo sapiens
ggaaggaugugggaaacac

SEQ ID NO: 217405 - RNA, 19 nt, Homo sapiens
gaaaagccguuuguuugug

SEQ ID NO: 217406 - RNA, 19 nt, Homo sapiens
agaaacccauaaagaggaa

SEQ ID NO: 217407 - RNA, 19 nt, Homo sapiens
agagaccauuuguuuguga

SEQ ID NO: 217408 - RNA, 19 nt, Homo sapiens
ccaggaaggaugugggaaa

SEQ ID NO: 217409 - RNA, 19 nt, Homo sapiens
uguaagaagaccuuuaaga

SEQ ID NO: 217410 - RNA, 19 nt, Homo sapiens
cagcgccaauuacagcaaa

SEQ ID NO: 217411 - RNA, 19 nt, Homo sapiens
cacuaggcaugcuguugua

SEQ ID NO: 217412 - RNA, 19 nt, Homo sapiens
gaaaacucaugccccagaa

SEQ ID NO: 217413 - RNA, 19 nt, Homo sapiens
caaagauuaccuuaagcaa

SEQ ID NO: 217414 - RNA, 19 nt, Homo sapiens
ggggagagaccauuuguuu

SEQ ID NO: 217415 - RNA, 19 nt, Homo sapiens
gggagagaccauuuguuug

SEQ ID NO: 217416 - RNA, 19 nt, Homo sapiens
cggaacuucugaaacaugu

SEQ ID NO: 217417 - RNA, 19 nt, Homo sapiens
cgagggcuauguaugucaa

SEQ ID NO: 217418 - RNA, 19 nt, Homo sapiens
gcucucgacaguugcagua

SEQ ID NO: 217419 - RNA, 19 nt, Homo sapiens
gcaaggcuuaucuuugugu

SEQ ID NO: 217420 - RNA, 19 nt, Homo sapiens
aagagaaggcuguggaaga

SEQ ID NO: 217421 - RNA, 19 nt, Homo sapiens
caugugagagaaacccaua

SEQ ID NO: 217422 - RNA, 19 nt, Homo sapiens
ucugaaacaugugagagaa

SEQ ID NO: 217423 - RNA, 19 nt, Homo sapiens
ugaaacaaagucucacuag

SEQ ID NO: 217424 - RNA, 19 nt, Homo sapiens
aaacauggacggaacuucu

SEQ ID NO: 217425 - RNA, 19 nt, Homo sapiens
ugaaacaugugagagaaac

SEQ ID NO: 217426 - RNA, 19 nt, Homo sapiens
auccaucagugccagaaua

SEQ ID NO: 217427 - RNA, 19 nt, Homo sapiens
gaccaaggagucgagcuuu

SEQ ID NO: 217428 - RNA, 19 nt, Homo sapiens
cugcacugcuuuguuuaaa

SEQ ID NO: 217429 - RNA, 19 nt, Homo sapiens
uaagaacugcacugcuuug

SEQ ID NO: 217430 - RNA, 19 nt, Homo sapiens
ucacuaggcaugcuguugu

SEQ ID NO: 217431 - RNA, 19 nt, Homo sapiens
ucucaucucaguggauaua

SEQ ID NO: 217432 - RNA, 19 nt, Homo sapiens
guacaugauccugacaaga

SEQ ID NO: 217433 - RNA, 19 nt, Homo sapiens
uuuaaucuccaaagccaua

SEQ ID NO: 217434 - RNA, 19 nt, Homo sapiens
caacacaaaaucaaacuug

SEQ ID NO: 217435 - RNA, 19 nt, Homo sapiens
acuguaagaagaccuuuaa

SEQ ID NO: 217436 - RNA, 19 nt, Homo sapiens
cuaagaacugcacugcuuu

SEQ ID NO: 217437 - RNA, 19 nt, Homo sapiens
gaaaaugaagcucaaaguc

SEQ ID NO: 217438 - RNA, 19 nt, Homo sapiens
aaagccauauccucuccuu

SEQ ID NO: 217439 - RNA, 19 nt, Homo sapiens
gagucggugucguccuuga

SEQ ID NO: 217440 - RNA, 19 nt, Homo sapiens
uggaagaaccuauacaacu

SEQ ID NO: 217441 - RNA, 19 nt, Homo sapiens
gacuguaagaagaccuuua

SEQ ID NO: 217442 - RNA, 19 nt, Homo sapiens
ccaagagaaggcuguggaa

SEQ ID NO: 217443 - RNA, 19 nt, Homo sapiens
gggaaacacuuugcaucac

SEQ ID NO: 217444 - RNA, 19 nt, Homo sapiens
caucagggacuaccaucug

SEQ ID NO: 217445 - RNA, 19 nt, Homo sapiens
ggaguuuggccucucaucu

SEQ ID NO: 217446 - RNA, 19 nt, Homo sapiens
aggcuuaucuuugugucaa

SEQ ID NO: 217447 - RNA, 19 nt, Homo sapiens
ggcaaggcuuaucuuugug

SEQ ID NO: 217448 - RNA, 19 nt, Homo sapiens
aaagaggaaauacuaugug

SEQ ID NO: 217449 - RNA, 19 nt, Homo sapiens
gugccagaauaccaaugaa

SEQ ID NO: 217450 - RNA, 19 nt, Homo sapiens
aaacaagggcaaggcuuau

SEQ ID NO: 217451 - RNA, 19 nt, Homo sapiens
uaccuuaagcaacacauga

SEQ ID NO: 217452 - RNA, 19 nt, Homo sapiens
ugugagagaaacccauaaa

SEQ ID NO: 217453 - RNA, 19 nt, Homo sapiens
ugggaaacacuuugcauca

SEQ ID NO: 217454 - RNA, 19 nt, Homo sapiens
ggaugugggaaacacuuug

SEQ ID NO: 217455 - RNA, 19 nt, Homo sapiens
gauauauccucccaaaagg

SEQ ID NO: 217456 - RNA, 19 nt, Homo sapiens
caagaugcucucgacaguu

SEQ ID NO: 217457 - RNA, 19 nt, Homo sapiens
gaaguaugccggaaaacau

SEQ ID NO: 217458 - RNA, 19 nt, Homo sapiens
gacggaacuucugaaacau

SEQ ID NO: 217459 - RNA, 19 nt, Homo sapiens
caagggcaaggcuuaucuu

SEQ ID NO: 217460 - RNA, 19 nt, Homo sapiens
uaggcaugcuguuguacau

SEQ ID NO: 217461 - RNA, 19 nt, Homo sapiens
gaagaucuguuguuacuua

SEQ ID NO: 217462 - RNA, 19 nt, Homo sapiens
gcaggaagaucuguuguua

SEQ ID NO: 217463 - RNA, 19 nt, Homo sapiens
ggaagaggcucacggaauu

SEQ ID NO: 217464 - RNA, 19 nt, Homo sapiens
gaagauggcccacgugauu

SEQ ID NO: 217465 - RNA, 19 nt, Homo sapiens
gaaugcaucuccucucaga

SEQ ID NO: 217466 - RNA, 19 nt, Homo sapiens
gaacuuaccauugggauug

SEQ ID NO: 217467 - RNA, 19 nt, Homo sapiens
gggcauagccugcauagug

SEQ ID NO: 217468 - RNA, 19 nt, Homo sapiens
ccagcaagaucaauuauag

SEQ ID NO: 217469 - RNA, 19 nt, Homo sapiens
aagaagaucuccagcaaga

SEQ ID NO: 217470 - RNA, 19 nt, Homo sapiens
ugaaggaggucaucagugu

SEQ ID NO: 217471 - RNA, 19 nt, Homo sapiens
ggacaccgccuucaacuuc

SEQ ID NO: 217472 - RNA, 19 nt, Homo sapiens
gggaagaauagauuuagua

SEQ ID NO: 217473 - RNA, 19 nt, Homo sapiens
agaagaagaucuccagcaa

SEQ ID NO: 217474 - RNA, 19 nt, Homo sapiens
agaaggagcucggcaucua

SEQ ID NO: 217475 - RNA, 19 nt, Homo sapiens
gaacacaagcccaagaagu

SEQ ID NO: 217476 - RNA, 19 nt, Homo sapiens
gcaagaauagcgaaagaga

SEQ ID NO: 217477 - RNA, 19 nt, Homo sapiens
aaggugaaauauccaguua

SEQ ID NO: 217478 - RNA, 19 nt, Homo sapiens
ggagguugaaggugaaaua

SEQ ID NO: 217479 - RNA, 19 nt, Homo sapiens
gggauuguguuucuauuca

SEQ ID NO: 217480 - RNA, 19 nt, Homo sapiens
gcucagugcuggaggacaa

SEQ ID NO: 217481 - RNA, 19 nt, Homo sapiens
gcgaaugcaucuccucuca

SEQ ID NO: 217482 - RNA, 19 nt, Homo sapiens
ggaccaagcgucugcaugu

SEQ ID NO: 217483 - RNA, 19 nt, Homo sapiens
ggaggagguugaaggugaa

SEQ ID NO: 217484 - RNA, 19 nt, Homo sapiens
ggucaucaguguggucaaa

SEQ ID NO: 217485 - RNA, 19 nt, Homo sapiens
gcaugugugugaucagaug

SEQ ID NO: 217486 - RNA, 19 nt, Homo sapiens
ccagccaccugaacaaaga

SEQ ID NO: 217487 - RNA, 19 nt, Homo sapiens
uugaugaccuggagauuga

SEQ ID NO: 217488 - RNA, 19 nt, Homo sapiens
gaaggugaaauauccaguu

SEQ ID NO: 217489 - RNA, 19 nt, Homo sapiens
ggcauagccugcauagugu

SEQ ID NO: 217490 - RNA, 19 nt, Homo sapiens
agaggaagcugcggaugaa

SEQ ID NO: 217491 - RNA, 19 nt, Homo sapiens
caacgacuauggcugugau

SEQ ID NO: 217492 - RNA, 19 nt, Homo sapiens
ggaccucaguggcauugau

SEQ ID NO: 217493 - RNA, 19 nt, Homo sapiens
cugaggaucuggcacuuga

SEQ ID NO: 217494 - RNA, 19 nt, Homo sapiens
gaagaggcucacggaauuu

SEQ ID NO: 217495 - RNA, 19 nt, Homo sapiens
gacgacggcuacugaagug

SEQ ID NO: 217496 - RNA, 19 nt, Homo sapiens
ggacgacggcuacugaagu

SEQ ID NO: 217497 - RNA, 19 nt, Homo sapiens
gaauagcgaaagagaagga

SEQ ID NO: 217498 - RNA, 19 nt, Homo sapiens
aagcaagaauagcgaaaga

SEQ ID NO: 217499 - RNA, 19 nt, Homo sapiens
ccaccugaacaaagacuua

SEQ ID NO: 217500 - RNA, 19 nt, Homo sapiens
gggaggccaucgagaagau

SEQ ID NO: 217501 - RNA, 19 nt, Homo sapiens
aggaagaucuguuguuacu

SEQ ID NO: 217502 - RNA, 19 nt, Homo sapiens
cuacgcagccagcaaagaa

SEQ ID NO: 217503 - RNA, 19 nt, Homo sapiens
ccagggaggccaucgagaa

SEQ ID NO: 217504 - RNA, 19 nt, Homo sapiens
caagaauagcgaaagagaa

SEQ ID NO: 217505 - RNA, 19 nt, Homo sapiens
ggaugaagcgggacuggau

SEQ ID NO: 217506 - RNA, 19 nt, Homo sapiens
cagaggaagcugcggauga

SEQ ID NO: 217507 - RNA, 19 nt, Homo sapiens
ucagugcccugcagaugau

SEQ ID NO: 217508 - RNA, 19 nt, Homo sapiens
gguugaaggugaaauaucc

SEQ ID NO: 217509 - RNA, 19 nt, Homo sapiens
gcuucacccuguguccuua

SEQ ID NO: 217510 - RNA, 19 nt, Homo sapiens
ccauugggauuguguuucu

SEQ ID NO: 217511 - RNA, 19 nt, Homo sapiens
ugagggagaacgccgagua

SEQ ID NO: 217512 - RNA, 19 nt, Homo sapiens
gcccugaggcuccuacaga

SEQ ID NO: 217513 - RNA, 19 nt, Homo sapiens
ggaacuuaccauugggauu

SEQ ID NO: 217514 - RNA, 19 nt, Homo sapiens
uugcgcaccugcuggaauu

SEQ ID NO: 217515 - RNA, 19 nt, Homo sapiens
ugaggacgacggcuacuga

SEQ ID NO: 217516 - RNA, 19 nt, Homo sapiens
ggugaaauauccaguuacc

SEQ ID NO: 217517 - RNA, 19 nt, Homo sapiens
gacccgugccuguauauuc

SEQ ID NO: 217518 - RNA, 19 nt, Homo sapiens
gaggaucuggcacuugaga

SEQ ID NO: 217519 - RNA, 19 nt, Homo sapiens
gaccaagcgucugcaugug

SEQ ID NO: 217520 - RNA, 19 nt, Homo sapiens
auagacccgugccuguaua

SEQ ID NO: 217521 - RNA, 19 nt, Homo sapiens
ccauagacccgugccugua

SEQ ID NO: 217522 - RNA, 19 nt, Homo sapiens
gcagugugguguugcuacu

SEQ ID NO: 217523 - RNA, 19 nt, Homo sapiens
aggaagcugucacgaagga

SEQ ID NO: 217524 - RNA, 19 nt, Homo sapiens
gaagcaagaauagcgaaag

SEQ ID NO: 217525 - RNA, 19 nt, Homo sapiens
ccuggacggugcuggcaaa

SEQ ID NO: 217526 - RNA, 19 nt, Homo sapiens
ccaguuaccaggaugcaau

SEQ ID NO: 217527 - RNA, 19 nt, Homo sapiens
aagaauagcgaaagagaag

SEQ ID NO: 217528 - RNA, 19 nt, Homo sapiens
cggaagaggcucacggaau

SEQ ID NO: 217529 - RNA, 19 nt, Homo sapiens
cauagacccgugccuguau

SEQ ID NO: 217530 - RNA, 19 nt, Homo sapiens
cauguggaacuuaccauug

SEQ ID NO: 217531 - RNA, 19 nt, Homo sapiens
gccaggaagcugucacgaa

SEQ ID NO: 217532 - RNA, 19 nt, Homo sapiens
ucuccagcaagaucaauua

SEQ ID NO: 217533 - RNA, 19 nt, Homo sapiens
ucaggaggacugugaagga

SEQ ID NO: 217534 - RNA, 19 nt, Homo sapiens
cagccagaaugcaugacuu

SEQ ID NO: 217535 - RNA, 19 nt, Homo sapiens
ccgaguaccugcgggaaca

SEQ ID NO: 217536 - RNA, 19 nt, Homo sapiens
ggaagcugcggaugaagca

SEQ ID NO: 217537 - RNA, 19 nt, Homo sapiens
uaaagcaggaagaucuguu

SEQ ID NO: 217538 - RNA, 19 nt, Homo sapiens
gcgggucuccucagcauca

SEQ ID NO: 217539 - RNA, 19 nt, Homo sapiens
gaaggagcucggcaucuac

SEQ ID NO: 217540 - RNA, 19 nt, Homo sapiens
ccaggaugcaauugagauu

SEQ ID NO: 217541 - RNA, 19 nt, Homo sapiens
gagguugaaggugaaauau

SEQ ID NO: 217542 - RNA, 19 nt, Homo sapiens
gaggcucacggaauuugaa

SEQ ID NO: 217543 - RNA, 19 nt, Homo sapiens
cagggccacuugaguugug

SEQ ID NO: 217544 - RNA, 19 nt, Homo sapiens
ggaagauggcccacgugau

SEQ ID NO: 217545 - RNA, 19 nt, Homo sapiens
gucagugcccugcagauga

SEQ ID NO: 217546 - RNA, 19 nt, Homo sapiens
gcaagcgacgggagccaau

SEQ ID NO: 217547 - RNA, 19 nt, Homo sapiens
guugaccauugaugaguuc

SEQ ID NO: 217548 - RNA, 19 nt, Homo sapiens
uaguaaagcaggaagaucu

SEQ ID NO: 217549 - RNA, 19 nt, Homo sapiens
gccggcaggugaacugagu

SEQ ID NO: 217550 - RNA, 19 nt, Homo sapiens
ucggguggcuugagagucu

SEQ ID NO: 217551 - RNA, 19 nt, Homo sapiens
gcaacgacuauggcuguga

SEQ ID NO: 217552 - RNA, 19 nt, Homo sapiens
gcauugaugaccuggagau

SEQ ID NO: 217553 - RNA, 19 nt, Homo sapiens
aaagcaggaagaucuguug

SEQ ID NO: 217554 - RNA, 19 nt, Homo sapiens
cauggaaugggcuguaugu

SEQ ID NO: 217555 - RNA, 19 nt, Homo sapiens
gugcuggcccugugacuca

SEQ ID NO: 217556 - RNA, 19 nt, Homo sapiens
gaugggcagcaacgacuau

SEQ ID NO: 217557 - RNA, 19 nt, Homo sapiens
cgugggagcugaggaucug

SEQ ID NO: 217558 - RNA, 19 nt, Homo sapiens
ugugguguugcuacuauua

SEQ ID NO: 217559 - RNA, 19 nt, Homo sapiens
agugugguguugcuacuau

SEQ ID NO: 217560 - RNA, 19 nt, Homo sapiens
ggauuguguuucuauucag

SEQ ID NO: 217561 - RNA, 19 nt, Homo sapiens
gaagaucuguuguuacuua

SEQ ID NO: 217562 - RNA, 19 nt, Homo sapiens
gcaggaagaucuguuguua

SEQ ID NO: 217563 - RNA, 19 nt, Homo sapiens
ggaagaggcucacggaauu

SEQ ID NO: 217564 - RNA, 19 nt, Homo sapiens
gaagauauuugcgguauuu

SEQ ID NO: 217565 - RNA, 19 nt, Homo sapiens
gaacagacaccaugcaaug

SEQ ID NO: 217566 - RNA, 19 nt, Homo sapiens
gaaugcaucuccucucaga

SEQ ID NO: 217567 - RNA, 19 nt, Homo sapiens
gaacuuaccauugggauug

SEQ ID NO: 217568 - RNA, 19 nt, Homo sapiens
gcacuggcuuugcugauga

SEQ ID NO: 217569 - RNA, 19 nt, Homo sapiens
gggcauagccugcauagug

SEQ ID NO: 217570 - RNA, 19 nt, Homo sapiens
ccagcaagaucaauuauag

SEQ ID NO: 217571 - RNA, 19 nt, Homo sapiens
aagaagaucuccagcaaga

SEQ ID NO: 217572 - RNA, 19 nt, Homo sapiens
caaaggacgugaacagaca

SEQ ID NO: 217573 - RNA, 19 nt, Homo sapiens
ugaaggaggucaucagugu

SEQ ID NO: 217574 - RNA, 19 nt, Homo sapiens
cggcugaacuugagacuug

SEQ ID NO: 217575 - RNA, 19 nt, Homo sapiens
ccacagcugcgauuucaua

SEQ ID NO: 217576 - RNA, 19 nt, Homo sapiens
gggaagaauagauuuagua

SEQ ID NO: 217577 - RNA, 19 nt, Homo sapiens
agaagaagaucuccagcaa

SEQ ID NO: 217578 - RNA, 19 nt, Homo sapiens
agaaggagcucggcaucua

SEQ ID NO: 217579 - RNA, 19 nt, Homo sapiens
ggaaagcuguagcauaugc

SEQ ID NO: 217580 - RNA, 19 nt, Homo sapiens
uuggaaagcuguagcauau

SEQ ID NO: 217581 - RNA, 19 nt, Homo sapiens
gaacacaagcccaagaagu

SEQ ID NO: 217582 - RNA, 19 nt, Homo sapiens
gcaagaauagcgaaagaga

SEQ ID NO: 217583 - RNA, 19 nt, Homo sapiens
aaggugaaauauccaguua

SEQ ID NO: 217584 - RNA, 19 nt, Homo sapiens
ccgccaggcuuuagacuuu

SEQ ID NO: 217585 - RNA, 19 nt, Homo sapiens
ggagguugaaggugaaaua

SEQ ID NO: 217586 - RNA, 19 nt, Homo sapiens
gggauuguguuucuauuca

SEQ ID NO: 217587 - RNA, 19 nt, Homo sapiens
gcgaaugcaucuccucuca

SEQ ID NO: 217588 - RNA, 19 nt, Homo sapiens
ggaccaagcgucugcaugu

SEQ ID NO: 217589 - RNA, 19 nt, Homo sapiens
cagcugcgauuucauagug

SEQ ID NO: 217590 - RNA, 19 nt, Homo sapiens
ggaggagguugaaggugaa

SEQ ID NO: 217591 - RNA, 19 nt, Homo sapiens
ggucaucaguguggucaaa

SEQ ID NO: 217592 - RNA, 19 nt, Homo sapiens
gcaugugugugaucagaug

SEQ ID NO: 217593 - RNA, 19 nt, Homo sapiens
ccagccaccugaacaaaga

SEQ ID NO: 217594 - RNA, 19 nt, Homo sapiens
cagaagauauuugcgguau

SEQ ID NO: 217595 - RNA, 19 nt, Homo sapiens
gaggagaccagacuucaga

SEQ ID NO: 217596 - RNA, 19 nt, Homo sapiens
acaaaggacucuccaggau

SEQ ID NO: 217597 - RNA, 19 nt, Homo sapiens
uugaugaccuggagauuga

SEQ ID NO: 217598 - RNA, 19 nt, Homo sapiens
aaagacccgugccuguaua

SEQ ID NO: 217599 - RNA, 19 nt, Homo sapiens
gaaggugaaauauccaguu

SEQ ID NO: 217600 - RNA, 19 nt, Homo sapiens
ggccacagcugcgauuuca

SEQ ID NO: 217601 - RNA, 19 nt, Homo sapiens
ggcauagccugcauagugu

SEQ ID NO: 217602 - RNA, 19 nt, Homo sapiens
agaggaagcugcggaugaa

SEQ ID NO: 217603 - RNA, 19 nt, Homo sapiens
caacgacuauggcugugau

SEQ ID NO: 217604 - RNA, 19 nt, Homo sapiens
ggaccucaguggcauugau

SEQ ID NO: 217605 - RNA, 19 nt, Homo sapiens
guccugggcuaaacaguga

SEQ ID NO: 217606 - RNA, 19 nt, Homo sapiens
ccagccgucuguuuccaua

SEQ ID NO: 217607 - RNA, 19 nt, Homo sapiens
cugaggaucuggcacuuga

SEQ ID NO: 217608 - RNA, 19 nt, Homo sapiens
gaagaggcucacggaauuu

SEQ ID NO: 217609 - RNA, 19 nt, Homo sapiens
caucauuucucccaggaau

SEQ ID NO: 217610 - RNA, 19 nt, Homo sapiens
gacgacggcuacugaagug

SEQ ID NO: 217611 - RNA, 19 nt, Homo sapiens
ggacgacggcuacugaagu

SEQ ID NO: 217612 - RNA, 19 nt, Homo sapiens
gaauagcgaaagagaagga

SEQ ID NO: 217613 - RNA, 19 nt, Homo sapiens
aagcaagaauagcgaaaga

SEQ ID NO: 217614 - RNA, 19 nt, Homo sapiens
ccaccugaacaaagacuua

SEQ ID NO: 217615 - RNA, 19 nt, Homo sapiens
gggaggccaucgagaagau

SEQ ID NO: 217616 - RNA, 19 nt, Homo sapiens
gaggagcaacuacaaguca

SEQ ID NO: 217617 - RNA, 19 nt, Homo sapiens
aggaagaucuguuguuacu

SEQ ID NO: 217618 - RNA, 19 nt, Homo sapiens
cuacgcagccagcaaagaa

SEQ ID NO: 217619 - RNA, 19 nt, Homo sapiens
ccagggaggccaucgagaa

SEQ ID NO: 217620 - RNA, 19 nt, Homo sapiens
caagaauagcgaaagagaa

SEQ ID NO: 217621 - RNA, 19 nt, Homo sapiens
ggaugaagcgggacuggau

SEQ ID NO: 217622 - RNA, 19 nt, Homo sapiens
gagaaaguguguggaugca

SEQ ID NO: 217623 - RNA, 19 nt, Homo sapiens
gaaaguuccgagagaaagu

SEQ ID NO: 217624 - RNA, 19 nt, Homo sapiens
cuacaagucaggaaggaaa

SEQ ID NO: 217625 - RNA, 19 nt, Homo sapiens
cagaggaagcugcggauga

SEQ ID NO: 217626 - RNA, 19 nt, Homo sapiens
ucagugcccugcagaugau

SEQ ID NO: 217627 - RNA, 19 nt, Homo sapiens
gguugaaggugaaauaucc

SEQ ID NO: 217628 - RNA, 19 nt, Homo sapiens
gcuucacccuguguccuua

SEQ ID NO: 217629 - RNA, 19 nt, Homo sapiens
ccauugggauuguguuucu

SEQ ID NO: 217630 - RNA, 19 nt, Homo sapiens
ugagggagaacgccgagua

SEQ ID NO: 217631 - RNA, 19 nt, Homo sapiens
gcccagagugcacaaauca

SEQ ID NO: 217632 - RNA, 19 nt, Homo sapiens
gauggaggagcaacuacaa

SEQ ID NO: 217633 - RNA, 19 nt, Homo sapiens
gcccugaggcuccuacaga

SEQ ID NO: 217634 - RNA, 19 nt, Homo sapiens
gcaggugggugcguaacuc

SEQ ID NO: 217635 - RNA, 19 nt, Homo sapiens
ggaacuuaccauugggauu

SEQ ID NO: 217636 - RNA, 19 nt, Homo sapiens
uugcgcaccugcuggaauu

SEQ ID NO: 217637 - RNA, 19 nt, Homo sapiens
ugaggacgacggcuacuga

SEQ ID NO: 217638 - RNA, 19 nt, Homo sapiens
ggcacuggcuuugcugaug

SEQ ID NO: 217639 - RNA, 19 nt, Homo sapiens
ggugaaauauccaguuacc

SEQ ID NO: 217640 - RNA, 19 nt, Homo sapiens
gacccgugccuguauauuc

SEQ ID NO: 217641 - RNA, 19 nt, Homo sapiens
gaggaucuggcacuugaga

SEQ ID NO: 217642 - RNA, 19 nt, Homo sapiens
gaccaagcgucugcaugug

SEQ ID NO: 217643 - RNA, 19 nt, Homo sapiens
gcaugagaguccggaaagu

SEQ ID NO: 217644 - RNA, 19 nt, Homo sapiens
acuugagacuugucacgua

SEQ ID NO: 217645 - RNA, 19 nt, Homo sapiens
ccaggcggcugaacuugag

SEQ ID NO: 217646 - RNA, 19 nt, Homo sapiens
gcagugugguguugcuacu

SEQ ID NO: 217647 - RNA, 19 nt, Homo sapiens
aggaagcugucacgaagga

SEQ ID NO: 217648 - RNA, 19 nt, Homo sapiens
gaagcaagaauagcgaaag

SEQ ID NO: 217649 - RNA, 19 nt, Homo sapiens
ccaguuaccaggaugcaau

SEQ ID NO: 217650 - RNA, 19 nt, Homo sapiens
gccagcaucucgggucaug

SEQ ID NO: 217651 - RNA, 19 nt, Homo sapiens
gcagagcagcuggagauca

SEQ ID NO: 217652 - RNA, 19 nt, Homo sapiens
agaagauauuugcgguauu

SEQ ID NO: 217653 - RNA, 19 nt, Homo sapiens
gaugaggagaccagacuuc

SEQ ID NO: 217654 - RNA, 19 nt, Homo sapiens
aagaauagcgaaagagaag

SEQ ID NO: 217655 - RNA, 19 nt, Homo sapiens
cggaagaggcucacggaau

SEQ ID NO: 217656 - RNA, 19 nt, Homo sapiens
cauguggaacuuaccauug

SEQ ID NO: 217657 - RNA, 19 nt, Homo sapiens
gccaggaagcugucacgaa

SEQ ID NO: 217658 - RNA, 19 nt, Homo sapiens
ucuccagcaagaucaauua

SEQ ID NO: 217659 - RNA, 19 nt, Homo sapiens
gggcaaaggacgugaacag

SEQ ID NO: 217660 - RNA, 19 nt, Homo sapiens
ucaggaggacugugaagga

SEQ ID NO: 217661 - RNA, 19 nt, Homo sapiens
gaagaucuguuguuacuua

SEQ ID NO: 217662 - RNA, 19 nt, Homo sapiens
gcaggaagaucuguuguua

SEQ ID NO: 217663 - RNA, 19 nt, Homo sapiens
ggaagaggcucacggaauu

SEQ ID NO: 217664 - RNA, 19 nt, Homo sapiens
gaagauauuugcgguauuu

SEQ ID NO: 217665 - RNA, 19 nt, Homo sapiens
gaacagacaccaugcaaug

SEQ ID NO: 217666 - RNA, 19 nt, Homo sapiens
gcacuggcuuugcugauga

SEQ ID NO: 217667 - RNA, 19 nt, Homo sapiens
caaaggacgugaacagaca

SEQ ID NO: 217668 - RNA, 19 nt, Homo sapiens
ucagaugcuucgcgauuua

SEQ ID NO: 217669 - RNA, 19 nt, Homo sapiens
ugaaggaggucaucagugu

SEQ ID NO: 217670 - RNA, 19 nt, Homo sapiens
cggcugaacuugagacuug

SEQ ID NO: 217671 - RNA, 19 nt, Homo sapiens
ccacagcugcgauuucaua

SEQ ID NO: 217672 - RNA, 19 nt, Homo sapiens
gggaagaauagauuuagua

SEQ ID NO: 217673 - RNA, 19 nt, Homo sapiens
ggaaagcuguagcauaugc

SEQ ID NO: 217674 - RNA, 19 nt, Homo sapiens
uuggaaagcuguagcauau

SEQ ID NO: 217675 - RNA, 19 nt, Homo sapiens
ccgccaggcuuuagacuuu

SEQ ID NO: 217676 - RNA, 19 nt, Homo sapiens
cagcugcgauuucauagug

SEQ ID NO: 217677 - RNA, 19 nt, Homo sapiens
ggucaucaguguggucaaa

SEQ ID NO: 217678 - RNA, 19 nt, Homo sapiens
cagaagauauuugcgguau

SEQ ID NO: 217679 - RNA, 19 nt, Homo sapiens
acaaaggacucuccaggau

SEQ ID NO: 217680 - RNA, 19 nt, Homo sapiens
gaggagaccagacuucaga

SEQ ID NO: 217681 - RNA, 19 nt, Homo sapiens
aaagacccgugccuguaua

SEQ ID NO: 217682 - RNA, 19 nt, Homo sapiens
ggccacagcugcgauuuca

SEQ ID NO: 217683 - RNA, 19 nt, Homo sapiens
ccagccgucuguuuccaua

SEQ ID NO: 217684 - RNA, 19 nt, Homo sapiens
guccugggcuaaacaguga

SEQ ID NO: 217685 - RNA, 19 nt, Homo sapiens
gaagaggcucacggaauuu

SEQ ID NO: 217686 - RNA, 19 nt, Homo sapiens
caucauuucucccaggaau

SEQ ID NO: 217687 - RNA, 19 nt, Homo sapiens
gaggaaauaggcacagaga

SEQ ID NO: 217688 - RNA, 19 nt, Homo sapiens
gaggagcaacuacaaguca

SEQ ID NO: 217689 - RNA, 19 nt, Homo sapiens
guucagaugcuucgcgauu

SEQ ID NO: 217690 - RNA, 19 nt, Homo sapiens
aggaagaucuguuguuacu

SEQ ID NO: 217691 - RNA, 19 nt, Homo sapiens
ggaugaagcgggacuggau

SEQ ID NO: 217692 - RNA, 19 nt, Homo sapiens
gagaaaguguguggaugca

SEQ ID NO: 217693 - RNA, 19 nt, Homo sapiens
gaaaguuccgagagaaagu

SEQ ID NO: 217694 - RNA, 19 nt, Homo sapiens
cuacaagucaggaaggaaa

SEQ ID NO: 217695 - RNA, 19 nt, Homo sapiens
gcuucacccuguguccuua

SEQ ID NO: 217696 - RNA, 19 nt, Homo sapiens
gcccagagugcacaaauca

SEQ ID NO: 217697 - RNA, 19 nt, Homo sapiens
gcccugaggcuccuacaga

SEQ ID NO: 217698 - RNA, 19 nt, Homo sapiens
gcaggugggugcguaacuc

SEQ ID NO: 217699 - RNA, 19 nt, Homo sapiens
gauggaggagcaacuacaa

SEQ ID NO: 217700 - RNA, 19 nt, Homo sapiens
uugcgcaccugcuggaauu

SEQ ID NO: 217701 - RNA, 19 nt, Homo sapiens
gacccgugccuguauauuc

SEQ ID NO: 217702 - RNA, 19 nt, Homo sapiens
ggcacuggcuuugcugaug

SEQ ID NO: 217703 - RNA, 19 nt, Homo sapiens
gcugcuauuucccggcauu

SEQ ID NO: 217704 - RNA, 19 nt, Homo sapiens
gcaugagaguccggaaagu

SEQ ID NO: 217705 - RNA, 19 nt, Homo sapiens
acuugagacuugucacgua

SEQ ID NO: 217706 - RNA, 19 nt, Homo sapiens
ccaggcggcugaacuugag

SEQ ID NO: 217707 - RNA, 19 nt, Homo sapiens
gcagagcagcuggagauca

SEQ ID NO: 217708 - RNA, 19 nt, Homo sapiens
gccagcaucucgggucaug

SEQ ID NO: 217709 - RNA, 19 nt, Homo sapiens
gcgguccacucugcucuga

SEQ ID NO: 217710 - RNA, 19 nt, Homo sapiens
cggaagaggcucacggaau

SEQ ID NO: 217711 - RNA, 19 nt, Homo sapiens
agaagauauuugcgguauu

SEQ ID NO: 217712 - RNA, 19 nt, Homo sapiens
gaugaggagaccagacuuc

SEQ ID NO: 217713 - RNA, 19 nt, Homo sapiens
ucaggaggacugugaagga

SEQ ID NO: 217714 - RNA, 19 nt, Homo sapiens
cagccagaaugcaugacuu

SEQ ID NO: 217715 - RNA, 19 nt, Homo sapiens
cgagagaaaguguguggau

SEQ ID NO: 217716 - RNA, 19 nt, Homo sapiens
caugagaguccggaaaguu

SEQ ID NO: 217717 - RNA, 19 nt, Homo sapiens
cagagcagcuggagaucac

SEQ ID NO: 217718 - RNA, 19 nt, Homo sapiens
ccagagugcacaaaucauc

SEQ ID NO: 217719 - RNA, 19 nt, Homo sapiens
gggcaaaggacgugaacag

SEQ ID NO: 217720 - RNA, 19 nt, Homo sapiens
uaaagcaggaagaucuguu

SEQ ID NO: 217721 - RNA, 19 nt, Homo sapiens
gaggcucacggaauuugaa

SEQ ID NO: 217722 - RNA, 19 nt, Homo sapiens
ugagacuugucacguagug

SEQ ID NO: 217723 - RNA, 19 nt, Homo sapiens
guugaccauugaugaguuc

SEQ ID NO: 217724 - RNA, 19 nt, Homo sapiens
acucugcucugagggcuuu

SEQ ID NO: 217725 - RNA, 19 nt, Homo sapiens
ggcccagagugcacaaauc

SEQ ID NO: 217726 - RNA, 19 nt, Homo sapiens
ggauggaggagcaacuaca

SEQ ID NO: 217727 - RNA, 19 nt, Homo sapiens
uaguaaagcaggaagaucu

SEQ ID NO: 217728 - RNA, 19 nt, Homo sapiens
ggcaaaggacgugaacaga

SEQ ID NO: 217729 - RNA, 19 nt, Homo sapiens
ggaggagcaacuacaaguc

SEQ ID NO: 217730 - RNA, 19 nt, Homo sapiens
aaagcaggaagaucuguug

SEQ ID NO: 217731 - RNA, 19 nt, Homo sapiens
cauggaaugggcuguaugu

SEQ ID NO: 217732 - RNA, 19 nt, Homo sapiens
gugaacagacaccaugcaa

SEQ ID NO: 217733 - RNA, 19 nt, Homo sapiens
cugcuuguuuggccauuug

SEQ ID NO: 217734 - RNA, 19 nt, Homo sapiens
aauaggcacagagagguua

SEQ ID NO: 217735 - RNA, 19 nt, Homo sapiens
agacuugucacguaguguu

SEQ ID NO: 217736 - RNA, 19 nt, Homo sapiens
ggacgugaacagacaccau

SEQ ID NO: 217737 - RNA, 19 nt, Homo sapiens
caggauggaggagcaacua

SEQ ID NO: 217738 - RNA, 19 nt, Homo sapiens
ucaucaguguggucaaagu

SEQ ID NO: 217739 - RNA, 19 nt, Homo sapiens
uucagaugcuucgcgauuu

SEQ ID NO: 217740 - RNA, 19 nt, Homo sapiens
gccgucuguuuccauagaa

SEQ ID NO: 217741 - RNA, 19 nt, Homo sapiens
uuuggaaagcuguagcaua

SEQ ID NO: 217742 - RNA, 19 nt, Homo sapiens
gccaggcuuuagacuuuua

SEQ ID NO: 217743 - RNA, 19 nt, Homo sapiens
caaguuaccuucaacauuu

SEQ ID NO: 217744 - RNA, 19 nt, Homo sapiens
gaacauguauggauuuauc

SEQ ID NO: 217745 - RNA, 19 nt, Homo sapiens
gaaggagcauguuguguuu

SEQ ID NO: 217746 - RNA, 19 nt, Homo sapiens
aaacagagaccuuacuuua

SEQ ID NO: 217747 - RNA, 19 nt, Homo sapiens
gaggaaaucucauggaguu

SEQ ID NO: 217748 - RNA, 19 nt, Homo sapiens
gaagaguucuacauacauu

SEQ ID NO: 217749 - RNA, 19 nt, Homo sapiens
gaaauuuggugaagaaaca

SEQ ID NO: 217750 - RNA, 19 nt, Homo sapiens
ggacuacacucaaacuuca

SEQ ID NO: 217751 - RNA, 19 nt, Homo sapiens
gcaggaacauguauggauu

SEQ ID NO: 217752 - RNA, 19 nt, Homo sapiens
gaacuuccauccaguccuu

SEQ ID NO: 217753 - RNA, 19 nt, Homo sapiens
gaaauugaagugaaaggua

SEQ ID NO: 217754 - RNA, 19 nt, Homo sapiens
gcacgcagucuauaaagua

SEQ ID NO: 217755 - RNA, 19 nt, Homo sapiens
caagaggccugcaacauuc

SEQ ID NO: 217756 - RNA, 19 nt, Homo sapiens
ccauuaagcucauccaaga

SEQ ID NO: 217757 - RNA, 19 nt, Homo sapiens
ggaaugauuuguaaugagu

SEQ ID NO: 217758 - RNA, 19 nt, Homo sapiens
ggaaaucucauggaguuua

SEQ ID NO: 217759 - RNA, 19 nt, Homo sapiens
gagaaugaccacauacuuu

SEQ ID NO: 217760 - RNA, 19 nt, Homo sapiens
gaagugacgaauccuguua

SEQ ID NO: 217761 - RNA, 19 nt, Homo sapiens
acagagaccuuacuuuaug

SEQ ID NO: 217762 - RNA, 19 nt, Homo sapiens
gaaaucucauggaguuuau

SEQ ID NO: 217763 - RNA, 19 nt, Homo sapiens
gaagaugucuggcuaugac

SEQ ID NO: 217764 - RNA, 19 nt, Homo sapiens
cacaucaccuugcaaauga

SEQ ID NO: 217765 - RNA, 19 nt, Homo sapiens
ccaaccagcuggaaaggaa

SEQ ID NO: 217766 - RNA, 19 nt, Homo sapiens
gaacucaauaugcaucuuu

SEQ ID NO: 217767 - RNA, 19 nt, Homo sapiens
gcagauuuaucaacaguca

SEQ ID NO: 217768 - RNA, 19 nt, Homo sapiens
gaacaccuuugagccaauu

SEQ ID NO: 217769 - RNA, 19 nt, Homo sapiens
ccacugggauguugugaga

SEQ ID NO: 217770 - RNA, 19 nt, Homo sapiens
ugacaugaaugaagaagug

SEQ ID NO: 217771 - RNA, 19 nt, Homo sapiens
ggagaaauauuugaauguc

SEQ ID NO: 217772 - RNA, 19 nt, Homo sapiens
gaaacucuuuggagaauac

SEQ ID NO: 217773 - RNA, 19 nt, Homo sapiens
gagaacugcugccgucaug

SEQ ID NO: 217774 - RNA, 19 nt, Homo sapiens
aaagguggcugcaggagaa

SEQ ID NO: 217775 - RNA, 19 nt, Homo sapiens
gagaggagcagaugggaaa

SEQ ID NO: 217776 - RNA, 19 nt, Homo sapiens
aauaggagaugcuuauaug

SEQ ID NO: 217777 - RNA, 19 nt, Homo sapiens
ccaagaggccugcaacauu

SEQ ID NO: 217778 - RNA, 19 nt, Homo sapiens
agagaaauuuggugaagaa

SEQ ID NO: 217779 - RNA, 19 nt, Homo sapiens
ucugcaaucucuugugaua

SEQ ID NO: 217780 - RNA, 19 nt, Homo sapiens
ccugaacacucuucucuug

SEQ ID NO: 217781 - RNA, 19 nt, Homo sapiens
gaguauuucuccaucauuc

SEQ ID NO: 217782 - RNA, 19 nt, Homo sapiens
gcauagucauguuuggaaa

SEQ ID NO: 217783 - RNA, 19 nt, Homo sapiens
guacaugaaacacguuaaa

SEQ ID NO: 217784 - RNA, 19 nt, Homo sapiens
ggaccagucuuagcagaug

SEQ ID NO: 217785 - RNA, 19 nt, Homo sapiens
caaaggaagugacgaaucc

SEQ ID NO: 217786 - RNA, 19 nt, Homo sapiens
gcucaaagaguggcuaauu

SEQ ID NO: 217787 - RNA, 19 nt, Homo sapiens
caucauucauccucaaguu

SEQ ID NO: 217788 - RNA, 19 nt, Homo sapiens
gaagaaggagcauguugug

SEQ ID NO: 217789 - RNA, 19 nt, Homo sapiens
gccgauagauccagcugaa

SEQ ID NO: 217790 - RNA, 19 nt, Homo sapiens
ccacgguacugcuuguuug

SEQ ID NO: 217791 - RNA, 19 nt, Homo sapiens
cugugaaccuauacaaaua

SEQ ID NO: 217792 - RNA, 19 nt, Homo sapiens
gaagaaaacagagaccuua

SEQ ID NO: 217793 - RNA, 19 nt, Homo sapiens
gaaaagggcaucucaugaa

SEQ ID NO: 217794 - RNA, 19 nt, Homo sapiens
ccaggcagcuuuccucaag

SEQ ID NO: 217795 - RNA, 19 nt, Homo sapiens
ggaagaaggagcauguugu

SEQ ID NO: 217796 - RNA, 19 nt, Homo sapiens
ggagaaugaccacauacuu

SEQ ID NO: 217797 - RNA, 19 nt, Homo sapiens
uggaagaacucaauaugca

SEQ ID NO: 217798 - RNA, 19 nt, Homo sapiens
gagaagcauagucauguuu

SEQ ID NO: 217799 - RNA, 19 nt, Homo sapiens
cauguuguguuucugauug

SEQ ID NO: 217800 - RNA, 19 nt, Homo sapiens
cuacauacauuagucuuca

SEQ ID NO: 217801 - RNA, 19 nt, Homo sapiens
cucaaagaguggcuaauuu

SEQ ID NO: 217802 - RNA, 19 nt, Homo sapiens
gaagacacgaagagaaaug

SEQ ID NO: 217803 - RNA, 19 nt, Homo sapiens
ggacuccaaacccagaaua

SEQ ID NO: 217804 - RNA, 19 nt, Homo sapiens
ucaagaugaaggagaaaua

SEQ ID NO: 217805 - RNA, 19 nt, Homo sapiens
caugaaacacguuaaaugu

SEQ ID NO: 217806 - RNA, 19 nt, Homo sapiens
guaaugaguacaugaaaca

SEQ ID NO: 217807 - RNA, 19 nt, Homo sapiens
gggugaaauugaagugaaa

SEQ ID NO: 217808 - RNA, 19 nt, Homo sapiens
uggaaaccaugcucaaaga

SEQ ID NO: 217809 - RNA, 19 nt, Homo sapiens
ugaauuccauguacuccaa

SEQ ID NO: 217810 - RNA, 19 nt, Homo sapiens
agauagagcuguccaacca

SEQ ID NO: 217811 - RNA, 19 nt, Homo sapiens
gaugaaggagaaauauuug

SEQ ID NO: 217812 - RNA, 19 nt, Homo sapiens
cagcuuuccucaagaugaa

SEQ ID NO: 217813 - RNA, 19 nt, Homo sapiens
ggauugaagagaagacauu

SEQ ID NO: 217814 - RNA, 19 nt, Homo sapiens
ggaaaugaagacaggagaa

SEQ ID NO: 217815 - RNA, 19 nt, Homo sapiens
gcugaagaguucuacauac

SEQ ID NO: 217816 - RNA, 19 nt, Homo sapiens
aaagguaaagggagaauga

SEQ ID NO: 217817 - RNA, 19 nt, Homo sapiens
cuccaaguuugacagauua

SEQ ID NO: 217818 - RNA, 19 nt, Homo sapiens
gacauuuacuaacaucugu

SEQ ID NO: 217819 - RNA, 19 nt, Homo sapiens
ucaauaugcaucuuucuga

SEQ ID NO: 217820 - RNA, 19 nt, Homo sapiens
gagccaauuuauccugaga

SEQ ID NO: 217821 - RNA, 19 nt, Homo sapiens
ugcaaucucuugugauaga

SEQ ID NO: 217822 - RNA, 19 nt, Homo sapiens
aagggagaaugaccacaua

SEQ ID NO: 217823 - RNA, 19 nt, Homo sapiens
caacaaagugcaccucagu

SEQ ID NO: 217824 - RNA, 19 nt, Homo sapiens
gcaaaggaagugacgaauc

SEQ ID NO: 217825 - RNA, 19 nt, Homo sapiens
auauucaacuggaugagua

SEQ ID NO: 217826 - RNA, 19 nt, Homo sapiens
ucaaccaucuugcccugaa

SEQ ID NO: 217827 - RNA, 19 nt, Homo sapiens
caauaggagaugcuuauau

SEQ ID NO: 217828 - RNA, 19 nt, Homo sapiens
ggaagaaggaggagcuaca

SEQ ID NO: 217829 - RNA, 19 nt, Homo sapiens
gagcuggaagaacucaaua

SEQ ID NO: 217830 - RNA, 19 nt, Homo sapiens
ucaaguuaccuucaacauu

SEQ ID NO: 217831 - RNA, 19 nt, Homo sapiens
guacguaccaggacuccaa

SEQ ID NO: 217832 - RNA, 19 nt, Homo sapiens
ugagaagcauagucauguu

SEQ ID NO: 217833 - RNA, 19 nt, Homo sapiens
gagcauguuguguuucuga

SEQ ID NO: 217834 - RNA, 19 nt, Homo sapiens
agucuuagcagauguugua

SEQ ID NO: 217835 - RNA, 19 nt, Homo sapiens
gaaaccaugcucaaagagu

SEQ ID NO: 217836 - RNA, 19 nt, Homo sapiens
ccaaacacguggccaacca

SEQ ID NO: 217837 - RNA, 19 nt, Homo sapiens
gccaauuuauccugagaga

SEQ ID NO: 217838 - RNA, 19 nt, Homo sapiens
guacaagaugccuucauga

SEQ ID NO: 217839 - RNA, 19 nt, Homo sapiens
cgacagaaacgcagcagau

SEQ ID NO: 217840 - RNA, 19 nt, Homo sapiens
cugaagaguucuacauaca

SEQ ID NO: 217841 - RNA, 19 nt, Homo sapiens
gaacacucuucucuugcau

SEQ ID NO: 217842 - RNA, 19 nt, Homo sapiens
caacaccugucugcaaucu

SEQ ID NO: 217843 - RNA, 19 nt, Homo sapiens
ggaagaagaucaagagaaa

SEQ ID NO: 217844 - RNA, 19 nt, Homo sapiens
ggauacaccuugcagaaua

SEQ ID NO: 217845 - RNA, 19 nt, Homo sapiens
gaacgacccucuagugaga

SEQ ID NO: 217846 - RNA, 19 nt, Homo sapiens
gcaggaaucugaucauaga

SEQ ID NO: 217847 - RNA, 19 nt, Homo sapiens
ggaaagaggaugaacuuaa

SEQ ID NO: 217848 - RNA, 19 nt, Homo sapiens
acgaagagcucgcuacaua

SEQ ID NO: 217849 - RNA, 19 nt, Homo sapiens
ucaaagaccaggauaauaa

SEQ ID NO: 217850 - RNA, 19 nt, Homo sapiens
gaaggucucuugcgauugu

SEQ ID NO: 217851 - RNA, 19 nt, Homo sapiens
gaaagaggaugaacuuaac

SEQ ID NO: 217852 - RNA, 19 nt, Homo sapiens
ggaagcggcugaagaagga

SEQ ID NO: 217853 - RNA, 19 nt, Homo sapiens
ggaccgguaugaagaaauu

SEQ ID NO: 217854 - RNA, 19 nt, Homo sapiens
ggaaugaccaugaugauga

SEQ ID NO: 217855 - RNA, 19 nt, Homo sapiens
gcucaaugguggagaauga

SEQ ID NO: 217856 - RNA, 19 nt, Homo sapiens
ccaacgaguuuaaagaauu

SEQ ID NO: 217857 - RNA, 19 nt, Homo sapiens
cagcaacaguggugacaua

SEQ ID NO: 217858 - RNA, 19 nt, Homo sapiens
cuucaaagauucaaaguug

SEQ ID NO: 217859 - RNA, 19 nt, Homo sapiens
ggacggcccuggaggaaau

SEQ ID NO: 217860 - RNA, 19 nt, Homo sapiens
cauagaagcugucaccaau

SEQ ID NO: 217861 - RNA, 19 nt, Homo sapiens
gaacuggccucaucacacu

SEQ ID NO: 217862 - RNA, 19 nt, Homo sapiens
gaucaggucuuuaucuucu

SEQ ID NO: 217863 - RNA, 19 nt, Homo sapiens
gaagaagacagucaaggaa

SEQ ID NO: 217864 - RNA, 19 nt, Homo sapiens
gaaagggaccgacgucaug

SEQ ID NO: 217865 - RNA, 19 nt, Homo sapiens
gaucuuggaagccauuaua

SEQ ID NO: 217866 - RNA, 19 nt, Homo sapiens
gcaauguccucaacaccaa

SEQ ID NO: 217867 - RNA, 19 nt, Homo sapiens
guacauuuccugcguguuu

SEQ ID NO: 217868 - RNA, 19 nt, Homo sapiens
gaagaggugacuaugauga

SEQ ID NO: 217869 - RNA, 19 nt, Homo sapiens
aggccuaucucaacuauaa

SEQ ID NO: 217870 - RNA, 19 nt, Homo sapiens
ggaccacugucauucaaga

SEQ ID NO: 217871 - RNA, 19 nt, Homo sapiens
guggaaaguuguaaaccua

SEQ ID NO: 217872 - RNA, 19 nt, Homo sapiens
gaaggaauuuaaacggaau

SEQ ID NO: 217873 - RNA, 19 nt, Homo sapiens
gaauguggaccuuguaaga

SEQ ID NO: 217874 - RNA, 19 nt, Homo sapiens
ggauaaagcacuuguugga

SEQ ID NO: 217875 - RNA, 19 nt, Homo sapiens
aacagcagguugaauauuu

SEQ ID NO: 217876 - RNA, 19 nt, Homo sapiens
ggcagcagcuucuguacaa

SEQ ID NO: 217877 - RNA, 19 nt, Homo sapiens
ggaccagccugaucguuuc

SEQ ID NO: 217878 - RNA, 19 nt, Homo sapiens
cggaagcgcuggcugagaa

SEQ ID NO: 217879 - RNA, 19 nt, Homo sapiens
gcucaugccgcuacuuuaa

SEQ ID NO: 217880 - RNA, 19 nt, Homo sapiens
ggaaagggacugugagagu

SEQ ID NO: 217881 - RNA, 19 nt, Homo sapiens
uacaagaggcguuacauuu

SEQ ID NO: 217882 - RNA, 19 nt, Homo sapiens
ucaagcugcugaaggaauu

SEQ ID NO: 217883 - RNA, 19 nt, Homo sapiens
gaccgaaaccggagaguga

SEQ ID NO: 217884 - RNA, 19 nt, Homo sapiens
ccacagggacuucggcuuu

SEQ ID NO: 217885 - RNA, 19 nt, Homo sapiens
gagaguuuauucacgauuc

SEQ ID NO: 217886 - RNA, 19 nt, Homo sapiens
gaggucaacuggaacaagu

SEQ ID NO: 217887 - RNA, 19 nt, Homo sapiens
acaaaccacacgaaacuua

SEQ ID NO: 217888 - RNA, 19 nt, Homo sapiens
gccgugaggugguggauga

SEQ ID NO: 217889 - RNA, 19 nt, Homo sapiens
gaacggagaacgauaaagc

SEQ ID NO: 217890 - RNA, 19 nt, Homo sapiens
gcagagggucccagaaaga

SEQ ID NO: 217891 - RNA, 19 nt, Homo sapiens
uuaagcgucuguaccagua

SEQ ID NO: 217892 - RNA, 19 nt, Homo sapiens
ggaugaagaggaugacuug

SEQ ID NO: 217893 - RNA, 19 nt, Homo sapiens
gaugaaguccuaccaguca

SEQ ID NO: 217894 - RNA, 19 nt, Homo sapiens
gaagagcucgcuacauagu

SEQ ID NO: 217895 - RNA, 19 nt, Homo sapiens
gaaagaagaaaggagaguu

SEQ ID NO: 217896 - RNA, 19 nt, Homo sapiens
gaaggacccugggaagaag

SEQ ID NO: 217897 - RNA, 19 nt, Homo sapiens
gcugagugcuuccucuaga

SEQ ID NO: 217898 - RNA, 19 nt, Homo sapiens
cagcagggacagccucuua

SEQ ID NO: 217899 - RNA, 19 nt, Homo sapiens
caagagauccacccugaau

SEQ ID NO: 217900 - RNA, 19 nt, Homo sapiens
acagucagaugaaguccua

SEQ ID NO: 217901 - RNA, 19 nt, Homo sapiens
cagugaggcuccagacauu

SEQ ID NO: 217902 - RNA, 19 nt, Homo sapiens
ucaaaguugucaagggauu

SEQ ID NO: 217903 - RNA, 19 nt, Homo sapiens
gaaauccgaguggcuauga

SEQ ID NO: 217904 - RNA, 19 nt, Homo sapiens
acaaugcagucccauguga

SEQ ID NO: 217905 - RNA, 19 nt, Homo sapiens
cugggaagcugcacuauca

SEQ ID NO: 217906 - RNA, 19 nt, Homo sapiens
gauaauaacgagcccacaa

SEQ ID NO: 217907 - RNA, 19 nt, Homo sapiens
guacaaggaccacguucuu

SEQ ID NO: 217908 - RNA, 19 nt, Homo sapiens
cgacugaaguagcaaugga

SEQ ID NO: 217909 - RNA, 19 nt, Homo sapiens
ucgaagaggugacuaugau

SEQ ID NO: 217910 - RNA, 19 nt, Homo sapiens
guacaagaggcguuacauu

SEQ ID NO: 217911 - RNA, 19 nt, Homo sapiens
ugucaccaaucuucgcuua

SEQ ID NO: 217912 - RNA, 19 nt, Homo sapiens
caacaguggugacauagcu

SEQ ID NO: 217913 - RNA, 19 nt, Homo sapiens
gaacccaacguguccuuug

SEQ ID NO: 217914 - RNA, 19 nt, Homo sapiens
gcacggagucauuccaguu

SEQ ID NO: 217915 - RNA, 19 nt, Homo sapiens
uaaccccgcuuagaaauua

SEQ ID NO: 217916 - RNA, 19 nt, Homo sapiens
gaaaguggacggaugaaaa

SEQ ID NO: 217917 - RNA, 19 nt, Homo sapiens
caagacaaaccacacgaaa

SEQ ID NO: 217918 - RNA, 19 nt, Homo sapiens
ccaaugacaucagaaccaa

SEQ ID NO: 217919 - RNA, 19 nt, Homo sapiens
gauacaccuugcagaauag

SEQ ID NO: 217920 - RNA, 19 nt, Homo sapiens
ugacgaggaugaagaggau

SEQ ID NO: 217921 - RNA, 19 nt, Homo sapiens
ggaccacguucuugugaag

SEQ ID NO: 217922 - RNA, 19 nt, Homo sapiens
ggaauucuaaccuugaaau

SEQ ID NO: 217923 - RNA, 19 nt, Homo sapiens
gaauuuguggagaagcuua

SEQ ID NO: 217924 - RNA, 19 nt, Homo sapiens
ggacaaccuggaggaauuu

SEQ ID NO: 217925 - RNA, 19 nt, Homo sapiens
uggacaaccuggaggaauu

SEQ ID NO: 217926 - RNA, 19 nt, Homo sapiens
gaggagguccggauggaaa

SEQ ID NO: 217927 - RNA, 19 nt, Homo sapiens
ucacaccacugcuuucaag

SEQ ID NO: 217928 - RNA, 19 nt, Homo sapiens
ggucaacuccugccagaug

SEQ ID NO: 217929 - RNA, 19 nt, Homo sapiens
ccaacuaccugcugaugag

SEQ ID NO: 217930 - RNA, 19 nt, Homo sapiens
uggagaagcuuaaagaaaa

SEQ ID NO: 217931 - RNA, 19 nt, Homo sapiens
gggaagaagaucaagagaa

SEQ ID NO: 217932 - RNA, 19 nt, Homo sapiens
ccauucauaugaucuuaga

SEQ ID NO: 217933 - RNA, 19 nt, Homo sapiens
ucaccaaucuucgcuuaau

SEQ ID NO: 217934 - RNA, 19 nt, Homo sapiens
caaauacgacauccucaug

SEQ ID NO: 217935 - RNA, 19 nt, Homo sapiens
gagcccaccuuggacugua

SEQ ID NO: 217936 - RNA, 19 nt, Homo sapiens
guggagaagcuuaaagaaa

SEQ ID NO: 217937 - RNA, 19 nt, Homo sapiens
ccacggagacaguguaugu

SEQ ID NO: 217938 - RNA, 19 nt, Homo sapiens
guaccaggauaaagcacuu

SEQ ID NO: 217939 - RNA, 19 nt, Homo sapiens
ggugaaggguccauuuguc

SEQ ID NO: 217940 - RNA, 19 nt, Homo sapiens
ugaacgacccgcugaagaa

SEQ ID NO: 217941 - RNA, 19 nt, Homo sapiens
gaaggcguguccaccaagu

SEQ ID NO: 217942 - RNA, 19 nt, Homo sapiens
aaaccuacacccauugaaa

SEQ ID NO: 217943 - RNA, 19 nt, Homo sapiens
gcucauugcugcuauauua

SEQ ID NO: 217944 - RNA, 19 nt, Homo sapiens
gagcgaagauuuccuauau

SEQ ID NO: 217945 - RNA, 19 nt, Homo sapiens
gacaagaggugcuaaauca

SEQ ID NO: 217946 - RNA, 19 nt, Homo sapiens
gcgaagauuuccuauauau

SEQ ID NO: 217947 - RNA, 19 nt, Homo sapiens
guagagaugucauuaccua

SEQ ID NO: 217948 - RNA, 19 nt, Homo sapiens
gacaauagcugcaggagau

SEQ ID NO: 217949 - RNA, 19 nt, Homo sapiens
gaacacuccugaacaguca

SEQ ID NO: 217950 - RNA, 19 nt, Homo sapiens
gaacuuacacugaaacugu

SEQ ID NO: 217951 - RNA, 19 nt, Homo sapiens
caugaaggcuccugucuga

SEQ ID NO: 217952 - RNA, 19 nt, Homo sapiens
gacuauggcucaugagaaa

SEQ ID NO: 217953 - RNA, 19 nt, Homo sapiens
gcccaaaccuggacuccua

SEQ ID NO: 217954 - RNA, 19 nt, Homo sapiens
gcugcuauauuaccagaua

SEQ ID NO: 217955 - RNA, 19 nt, Homo sapiens
caauauuacugccuucuga

SEQ ID NO: 217956 - RNA, 19 nt, Homo sapiens
gaacaugacugugguagac

SEQ ID NO: 217957 - RNA, 19 nt, Homo sapiens
gcaggagccucgcaauaug

SEQ ID NO: 217958 - RNA, 19 nt, Homo sapiens
acaccuagcugcuggauau

SEQ ID NO: 217959 - RNA, 19 nt, Homo sapiens
ccauagcuaucauguguuu

SEQ ID NO: 217960 - RNA, 19 nt, Homo sapiens
gagucaaacugcucauauu

SEQ ID NO: 217961 - RNA, 19 nt, Homo sapiens
gcacugaauccaauaaaug

SEQ ID NO: 217962 - RNA, 19 nt, Homo sapiens
gaaucucaaucuccaaaga

SEQ ID NO: 217963 - RNA, 19 nt, Homo sapiens
caacugcuaugccucuuau

SEQ ID NO: 217964 - RNA, 19 nt, Homo sapiens
gaaggcuccugucugacua

SEQ ID NO: 217965 - RNA, 19 nt, Homo sapiens
ugaagucggucaagaacaa

SEQ ID NO: 217966 - RNA, 19 nt, Homo sapiens
ccacugagccagcuucauu

SEQ ID NO: 217967 - RNA, 19 nt, Homo sapiens
ccacuucaaugcuauguuc

SEQ ID NO: 217968 - RNA, 19 nt, Homo sapiens
gcacagagccauaggaacu

SEQ ID NO: 217969 - RNA, 19 nt, Homo sapiens
gugaagggcuaccugaaga

SEQ ID NO: 217970 - RNA, 19 nt, Homo sapiens
gaacaguggcucagaucuu

SEQ ID NO: 217971 - RNA, 19 nt, Homo sapiens
guaaagccaaguaaaggua

SEQ ID NO: 217972 - RNA, 19 nt, Homo sapiens
ggagugaagucggucaaga

SEQ ID NO: 217973 - RNA, 19 nt, Homo sapiens
ggaaaguacugcuauucag

SEQ ID NO: 217974 - RNA, 19 nt, Homo sapiens
ggaguuugcugaguggauu

SEQ ID NO: 217975 - RNA, 19 nt, Homo sapiens
uaucauggcuccuguuugg

SEQ ID NO: 217976 - RNA, 19 nt, Homo sapiens
cuagucaucuucccuguga

SEQ ID NO: 217977 - RNA, 19 nt, Homo sapiens
aacaguggcucagaucuua

SEQ ID NO: 217978 - RNA, 19 nt, Homo sapiens
cuaagacuauggcucauga

SEQ ID NO: 217979 - RNA, 19 nt, Homo sapiens
guacuucuuugaccaagga

SEQ ID NO: 217980 - RNA, 19 nt, Homo sapiens
gguagacucuccuggacaa

SEQ ID NO: 217981 - RNA, 19 nt, Homo sapiens
gcucucugauggcuccuua

SEQ ID NO: 217982 - RNA, 19 nt, Homo sapiens
cagugaagccugccauaua

SEQ ID NO: 217983 - RNA, 19 nt, Homo sapiens
gagagcagaaacauucaua

SEQ ID NO: 217984 - RNA, 19 nt, Homo sapiens
cccaauggcuuaccaaauc

SEQ ID NO: 217985 - RNA, 19 nt, Homo sapiens
aaccauagcuaucaugugu

SEQ ID NO: 217986 - RNA, 19 nt, Homo sapiens
gugauugcccuguuaagua

SEQ ID NO: 217987 - RNA, 19 nt, Homo sapiens
ccacgagggugauaguaau

SEQ ID NO: 217988 - RNA, 19 nt, Homo sapiens
gcucgaacuuacacugaaa

SEQ ID NO: 217989 - RNA, 19 nt, Homo sapiens
ggagcucauugcugcuaua

SEQ ID NO: 217990 - RNA, 19 nt, Homo sapiens
uaacagccauuuccuuguc

SEQ ID NO: 217991 - RNA, 19 nt, Homo sapiens
ggccuucccuggacaguga

SEQ ID NO: 217992 - RNA, 19 nt, Homo sapiens
gcaaagcuaacagccauuu

SEQ ID NO: 217993 - RNA, 19 nt, Homo sapiens
caacagggcccacuuuguc

SEQ ID NO: 217994 - RNA, 19 nt, Homo sapiens
uaucauguguuucccaaau

SEQ ID NO: 217995 - RNA, 19 nt, Homo sapiens
auuccaggauccaauauua

SEQ ID NO: 217996 - RNA, 19 nt, Homo sapiens
ugauugcccuguuaaguau

SEQ ID NO: 217997 - RNA, 19 nt, Homo sapiens
uaggaaaucuagucaucuu

SEQ ID NO: 217998 - RNA, 19 nt, Homo sapiens
guuaggaaaucuagucauc

SEQ ID NO: 217999 - RNA, 19 nt, Homo sapiens
guaaagguacuggguguuu

SEQ ID NO: 218000 - RNA, 19 nt, Homo sapiens
ggacaagaggugcuaaauc

SEQ ID NO: 218001 - RNA, 19 nt, Homo sapiens
ucuaugggauugcuuguga

SEQ ID NO: 218002 - RNA, 19 nt, Homo sapiens
ccagaucuuucuucagaga

SEQ ID NO: 218003 - RNA, 19 nt, Homo sapiens
aaauuucacucauggaugu

SEQ ID NO: 218004 - RNA, 19 nt, Homo sapiens
ggagucaaacugcucauau

SEQ ID NO: 218005 - RNA, 19 nt, Homo sapiens
gaccuaggcuugggaguca

SEQ ID NO: 218006 - RNA, 19 nt, Homo sapiens
acacagauuuggguucauu

SEQ ID NO: 218007 - RNA, 19 nt, Homo sapiens
ucugugggauucauuauau

SEQ ID NO: 218008 - RNA, 19 nt, Homo sapiens
gggcaggagccucgcaaua

SEQ ID NO: 218009 - RNA, 19 nt, Homo sapiens
aaaccacacugccgaggaa

SEQ ID NO: 218010 - RNA, 19 nt, Homo sapiens
acucauggauguuaggaaa

SEQ ID NO: 218011 - RNA, 19 nt, Homo sapiens
gauaguaauucgugagacu

SEQ ID NO: 218012 - RNA, 19 nt, Homo sapiens
ugucaaccaucacuacuug

SEQ ID NO: 218013 - RNA, 19 nt, Homo sapiens
agccagaucuuucuucaga

SEQ ID NO: 218014 - RNA, 19 nt, Homo sapiens
guagagcgaagauuuccua

SEQ ID NO: 218015 - RNA, 19 nt, Homo sapiens
agugaagccugccauauau

SEQ ID NO: 218016 - RNA, 19 nt, Homo sapiens
cuucagagaugucaaaggu

SEQ ID NO: 218017 - RNA, 19 nt, Homo sapiens
cgacuggcuugggacaaua

SEQ ID NO: 218018 - RNA, 19 nt, Homo sapiens
agacugaaguugcuuagag

SEQ ID NO: 218019 - RNA, 19 nt, Homo sapiens
ggaggcuauucauaaggua

SEQ ID NO: 218020 - RNA, 19 nt, Homo sapiens
gcugcuggauauuauaaug

SEQ ID NO: 218021 - RNA, 19 nt, Homo sapiens
ugaagccugccauauauaa

SEQ ID NO: 218022 - RNA, 19 nt, Homo sapiens
gaaagugagggcccaagug

SEQ ID NO: 218023 - RNA, 19 nt, Homo sapiens
uauaucaagucagagagua

SEQ ID NO: 218024 - RNA, 19 nt, Homo sapiens
gaacagccagaucuuucuu

SEQ ID NO: 218025 - RNA, 19 nt, Homo sapiens
ccaauggcuuaccaaauca

SEQ ID NO: 218026 - RNA, 19 nt, Homo sapiens
gguugaggcugaagaugug

SEQ ID NO: 218027 - RNA, 19 nt, Homo sapiens
gcuggaggcuauucauaag

SEQ ID NO: 218028 - RNA, 19 nt, Homo sapiens
uaccagauauggcacugaa

SEQ ID NO: 218029 - RNA, 19 nt, Homo sapiens
gcugggauguguccuucuu

SEQ ID NO: 218030 - RNA, 19 nt, Homo sapiens
ccaccaaaccgaagaagau

SEQ ID NO: 218031 - RNA, 19 nt, Homo sapiens
ucagagaguauacuucuau

SEQ ID NO: 218032 - RNA, 19 nt, Homo sapiens
gcagaggcuuccguagaga

SEQ ID NO: 218033 - RNA, 19 nt, Homo sapiens
gggaaaguacugcuauuca

SEQ ID NO: 218034 - RNA, 19 nt, Homo sapiens
ggcaggagccucgcaauau

SEQ ID NO: 218035 - RNA, 19 nt, Homo sapiens
gaacccauaaacucuauca

SEQ ID NO: 218036 - RNA, 19 nt, Homo sapiens
gaccaaggaauaccacaga

SEQ ID NO: 218037 - RNA, 19 nt, Homo sapiens
gagugaagucggucaagaa

SEQ ID NO: 218038 - RNA, 19 nt, Homo sapiens
agacacagauuuggguuca

SEQ ID NO: 218039 - RNA, 19 nt, Homo sapiens
ggcacugaauccaauaaau

SEQ ID NO: 218040 - RNA, 19 nt, Homo sapiens
ccuagcugcuggauauuau

SEQ ID NO: 218041 - RNA, 19 nt, Homo sapiens
gcaacagggcccacuuugu

SEQ ID NO: 218042 - RNA, 19 nt, Homo sapiens
ggcacccucuaccgaauaa

SEQ ID NO: 218043 - RNA, 19 nt, Homo sapiens
gaaauaagauguguccauu

SEQ ID NO: 218044 - RNA, 19 nt, Homo sapiens
gaacaugggucaccaaugg

SEQ ID NO: 218045 - RNA, 19 nt, Homo sapiens
gaagaugucucaggaauuc

SEQ ID NO: 218046 - RNA, 19 nt, Homo sapiens
acaaguaucuuucccuaua

SEQ ID NO: 218047 - RNA, 19 nt, Homo sapiens
uaagauguguccauucaua

SEQ ID NO: 218048 - RNA, 19 nt, Homo sapiens
agaggacacugcaguauua

SEQ ID NO: 218049 - RNA, 19 nt, Homo sapiens
cagcagggcuccacagaaa

SEQ ID NO: 218050 - RNA, 19 nt, Homo sapiens
gacaguggaucuucuauau

SEQ ID NO: 218051 - RNA, 19 nt, Homo sapiens
gaucaaagacuccuccaaa

SEQ ID NO: 218052 - RNA, 19 nt, Homo sapiens
cccaaccacuuaccaauua

SEQ ID NO: 218053 - RNA, 19 nt, Homo sapiens
gauuguaucuccaaagguu

SEQ ID NO: 218054 - RNA, 19 nt, Homo sapiens
ccagaaaguuugaugaugu

SEQ ID NO: 218055 - RNA, 19 nt, Homo sapiens
gagaagcuaugcucugaug

SEQ ID NO: 218056 - RNA, 19 nt, Homo sapiens
gaacaucaaguuauugguu

SEQ ID NO: 218057 - RNA, 19 nt, Homo sapiens
gauugugucucuuucauug

SEQ ID NO: 218058 - RNA, 19 nt, Homo sapiens
ggacacugcaguauuauga

SEQ ID NO: 218059 - RNA, 19 nt, Homo sapiens
gcuaugcucugauguuuca

SEQ ID NO: 218060 - RNA, 19 nt, Homo sapiens
uggaacagguugcaaauga

SEQ ID NO: 218061 - RNA, 19 nt, Homo sapiens
ggacaaaugauccauguuc

SEQ ID NO: 218062 - RNA, 19 nt, Homo sapiens
gaagucaaaggacaaauga

SEQ ID NO: 218063 - RNA, 19 nt, Homo sapiens
gcugacaccugauggaaga

SEQ ID NO: 218064 - RNA, 19 nt, Homo sapiens
gaagaccgauucagaugag

SEQ ID NO: 218065 - RNA, 19 nt, Homo sapiens
ugauguagcccagcaauua

SEQ ID NO: 218066 - RNA, 19 nt, Homo sapiens
caguggaucuucuauauuc

SEQ ID NO: 218067 - RNA, 19 nt, Homo sapiens
gauuaaggcugcaggaaag

SEQ ID NO: 218068 - RNA, 19 nt, Homo sapiens
guuauugccuguuuggaaa

SEQ ID NO: 218069 - RNA, 19 nt, Homo sapiens
gaauuagcaucaacaccuu

SEQ ID NO: 218070 - RNA, 19 nt, Homo sapiens
ugauggaacuuucagaaga

SEQ ID NO: 218071 - RNA, 19 nt, Homo sapiens
gaacuguacaccagauuug

SEQ ID NO: 218072 - RNA, 19 nt, Homo sapiens
ucacaaagugcucaaguuu

SEQ ID NO: 218073 - RNA, 19 nt, Homo sapiens
gcagaccacuccaacaaag

SEQ ID NO: 218074 - RNA, 19 nt, Homo sapiens
aauaagauguguccauuca

SEQ ID NO: 218075 - RNA, 19 nt, Homo sapiens
ggugaugccuacuguguug

SEQ ID NO: 218076 - RNA, 19 nt, Homo sapiens
caagauggguugaagaaaa

SEQ ID NO: 218077 - RNA, 19 nt, Homo sapiens
gaacagguugcaaaugaga

SEQ ID NO: 218078 - RNA, 19 nt, Homo sapiens
gaagaucuaucggcuggau

SEQ ID NO: 218079 - RNA, 19 nt, Homo sapiens
gauggaagaccgauucaga

SEQ ID NO: 218080 - RNA, 19 nt, Homo sapiens
gaagcuaugcucugauguu

SEQ ID NO: 218081 - RNA, 19 nt, Homo sapiens
caaguaucuuucccuauau

SEQ ID NO: 218082 - RNA, 19 nt, Homo sapiens
gcaugucaguccuucaguu

SEQ ID NO: 218083 - RNA, 19 nt, Homo sapiens
aauuguagcugucuuacuu

SEQ ID NO: 218084 - RNA, 19 nt, Homo sapiens
gagaguccuucgagcugua

SEQ ID NO: 218085 - RNA, 19 nt, Homo sapiens
gcaguauuaugaacaucaa

SEQ ID NO: 218086 - RNA, 19 nt, Homo sapiens
ggaagucaaaggacaaaug

SEQ ID NO: 218087 - RNA, 19 nt, Homo sapiens
ggaagaccgauucagauga

SEQ ID NO: 218088 - RNA, 19 nt, Homo sapiens
guacaggccagaaaguuug

SEQ ID NO: 218089 - RNA, 19 nt, Homo sapiens
uaacggcuuugaugcuuug

SEQ ID NO: 218090 - RNA, 19 nt, Homo sapiens
gcuaauauacucgguuuga

SEQ ID NO: 218091 - RNA, 19 nt, Homo sapiens
ggaaauaagauguguccau

SEQ ID NO: 218092 - RNA, 19 nt, Homo sapiens
ggagucaccaucuuuccua

SEQ ID NO: 218093 - RNA, 19 nt, Homo sapiens
gaugauggaacuuucagaa

SEQ ID NO: 218094 - RNA, 19 nt, Homo sapiens
gaggacugcuucgagauug

SEQ ID NO: 218095 - RNA, 19 nt, Homo sapiens
gcaauaauccuacuaaaag

SEQ ID NO: 218096 - RNA, 19 nt, Homo sapiens
gauggaacuuucagaagag

SEQ ID NO: 218097 - RNA, 19 nt, Homo sapiens
gaagaugauggaacuuuca

SEQ ID NO: 218098 - RNA, 19 nt, Homo sapiens
gauccauguuccagaauca

SEQ ID NO: 218099 - RNA, 19 nt, Homo sapiens
cugauggccuugaagauga

SEQ ID NO: 218100 - RNA, 19 nt, Homo sapiens
guuaaugccaccuuugaaa

SEQ ID NO: 218101 - RNA, 19 nt, Homo sapiens
ugucuuacuuuccuuauca

SEQ ID NO: 218102 - RNA, 19 nt, Homo sapiens
aagcuaugcucugauguuu

SEQ ID NO: 218103 - RNA, 19 nt, Homo sapiens
uauacucgguuugaaguuu

SEQ ID NO: 218104 - RNA, 19 nt, Homo sapiens
ugaagaugauggaacuuuc

SEQ ID NO: 218105 - RNA, 19 nt, Homo sapiens
gauguguccauucauauga

SEQ ID NO: 218106 - RNA, 19 nt, Homo sapiens
gaggaugagggaaauaaga

SEQ ID NO: 218107 - RNA, 19 nt, Homo sapiens
gaggauaggaauucacuca

SEQ ID NO: 218108 - RNA, 19 nt, Homo sapiens
agacaucccuauccaugau

SEQ ID NO: 218109 - RNA, 19 nt, Homo sapiens
ggaacagguugcaaaugag

SEQ ID NO: 218110 - RNA, 19 nt, Homo sapiens
uaacagaugcuccuaugca

SEQ ID NO: 218111 - RNA, 19 nt, Homo sapiens
ucuaacagaugcuccuaug

SEQ ID NO: 218112 - RNA, 19 nt, Homo sapiens
caucaacaccuucuguaga

SEQ ID NO: 218113 - RNA, 19 nt, Homo sapiens
gccagaaaguuugaugaug

SEQ ID NO: 218114 - RNA, 19 nt, Homo sapiens
guacucucaugcuccacua

SEQ ID NO: 218115 - RNA, 19 nt, Homo sapiens
cggcuuugaugcuuuguug

SEQ ID NO: 218116 - RNA, 19 nt, Homo sapiens
gcagcaaaauuucuguauu

SEQ ID NO: 218117 - RNA, 19 nt, Homo sapiens
gcaaguacaggccagaaag

SEQ ID NO: 218118 - RNA, 19 nt, Homo sapiens
gauguagcccagcaauuau

SEQ ID NO: 218119 - RNA, 19 nt, Homo sapiens
aaugauccauguuccagaa

SEQ ID NO: 218120 - RNA, 19 nt, Homo sapiens
ucaagaggacacugcagua

SEQ ID NO: 218121 - RNA, 19 nt, Homo sapiens
aaagagcucccugaaggua

SEQ ID NO: 218122 - RNA, 19 nt, Homo sapiens
cugcuaauauacucgguuu

SEQ ID NO: 218123 - RNA, 19 nt, Homo sapiens
ucuaggcucugcuggaaug

SEQ ID NO: 218124 - RNA, 19 nt, Homo sapiens
ggacugcuucgagauugua

SEQ ID NO: 218125 - RNA, 19 nt, Homo sapiens
ccugcggaccucagaauua

SEQ ID NO: 218126 - RNA, 19 nt, Homo sapiens
guuugaaguuugaggaaau

SEQ ID NO: 218127 - RNA, 19 nt, Homo sapiens
cuaauauacucgguuugaa

SEQ ID NO: 218128 - RNA, 19 nt, Homo sapiens
agaagaaauugaagauguc

SEQ ID NO: 218129 - RNA, 19 nt, Homo sapiens
gcccaaccacuuaccaauu

SEQ ID NO: 218130 - RNA, 19 nt, Homo sapiens
gugcgaaugccacguuauu

SEQ ID NO: 218131 - RNA, 19 nt, Homo sapiens
gcuaaacccauugcucuga

SEQ ID NO: 218132 - RNA, 19 nt, Homo sapiens
ggcagcaugucucgaagga

SEQ ID NO: 218133 - RNA, 19 nt, Homo sapiens
ccaguguacucccaugcaa

SEQ ID NO: 218134 - RNA, 19 nt, Homo sapiens
ggcaauuguagcugucuua

SEQ ID NO: 218135 - RNA, 19 nt, Homo sapiens
gcaaugcuggggaugauua

SEQ ID NO: 218136 - RNA, 19 nt, Homo sapiens
gguuugaaguuugaggaaa

SEQ ID NO: 218137 - RNA, 19 nt, Homo sapiens
caggaauucuucaguguac

SEQ ID NO: 218138 - RNA, 19 nt, Homo sapiens
ccauucauaugagugguuu

SEQ ID NO: 218139 - RNA, 19 nt, Homo sapiens
gggugcgaaugccacguua

SEQ ID NO: 218140 - RNA, 19 nt, Homo sapiens
cagaaaguuugaugauguc

SEQ ID NO: 218141 - RNA, 19 nt, Homo sapiens
gggaaggucuaaggaagca

SEQ ID NO: 218142 - RNA, 19 nt, Homo sapiens
caagaggacacugcaguau

SEQ ID NO: 218143 - RNA, 19 nt, Homo sapiens
gcagaggaguucaccgaua

SEQ ID NO: 218144 - RNA, 19 nt, Homo sapiens
caacaaggacggcuacauu

SEQ ID NO: 218145 - RNA, 19 nt, Homo sapiens
acaagaaguucaugacuga

SEQ ID NO: 218146 - RNA, 19 nt, Homo sapiens
gcaacgugauggagggaaa

SEQ ID NO: 218147 - RNA, 19 nt, Homo sapiens
acacgaagccuggaccuua

SEQ ID NO: 218148 - RNA, 19 nt, Homo sapiens
gauacaguguucuccaaga

SEQ ID NO: 218149 - RNA, 19 nt, Homo sapiens
aacagaagcuccgcuggua

SEQ ID NO: 218150 - RNA, 19 nt, Homo sapiens
acauugauuucauggagua

SEQ ID NO: 218151 - RNA, 19 nt, Homo sapiens
acaguguucuccaagauug

SEQ ID NO: 218152 - RNA, 19 nt, Homo sapiens
cagaggaguucaccgauac

SEQ ID NO: 218153 - RNA, 19 nt, Homo sapiens
gcugguacuucaagcucua

SEQ ID NO: 218154 - RNA, 19 nt, Homo sapiens
aaggacggcuacauugauu

SEQ ID NO: 218155 - RNA, 19 nt, Homo sapiens
ggacggcuacauugauuuc

SEQ ID NO: 218156 - RNA, 19 nt, Homo sapiens
gccaguacguggaacagau

SEQ ID NO: 218157 - RNA, 19 nt, Homo sapiens
guucaccgauacaguguuc

SEQ ID NO: 218158 - RNA, 19 nt, Homo sapiens
gauggcaacggcugcauug

SEQ ID NO: 218159 - RNA, 19 nt, Homo sapiens
caaggacggcuacauugau

SEQ ID NO: 218160 - RNA, 19 nt, Homo sapiens
uagagggcguccagaagga

SEQ ID NO: 218161 - RNA, 19 nt, Homo sapiens
acaaggacggcuacauuga

SEQ ID NO: 218162 - RNA, 19 nt, Homo sapiens
ccugaaggccugagcaaug

SEQ ID NO: 218163 - RNA, 19 nt, Homo sapiens
ccgauacaguguucuccaa

SEQ ID NO: 218164 - RNA, 19 nt, Homo sapiens
aagcuccgcugguacuuca

SEQ ID NO: 218165 - RNA, 19 nt, Homo sapiens
cggcuacauugauuucaug

SEQ ID NO: 218166 - RNA, 19 nt, Homo sapiens
auacaguguucuccaagau

SEQ ID NO: 218167 - RNA, 19 nt, Homo sapiens
acuucaagcucuaugaugu

SEQ ID NO: 218168 - RNA, 19 nt, Homo sapiens
guacaagaaguucaugacu

SEQ ID NO: 218169 - RNA, 19 nt, Homo sapiens
guacuucaagcucuaugau

SEQ ID NO: 218170 - RNA, 19 nt, Homo sapiens
ucuaugaguuccgccaguu

SEQ ID NO: 218171 - RNA, 19 nt, Homo sapiens
cacgaagccuggaccuuac

SEQ ID NO: 218172 - RNA, 19 nt, Homo sapiens
gugcgcaggcuccagaaug

SEQ ID NO: 218173 - RNA, 19 nt, Homo sapiens
cugaaggccugagcaaugg

SEQ ID NO: 218174 - RNA, 19 nt, Homo sapiens
cuucaagcucuaugaugua

SEQ ID NO: 218175 - RNA, 19 nt, Homo sapiens
aacaaggacggcuacauug

SEQ ID NO: 218176 - RNA, 19 nt, Homo sapiens
ggccaacucacccucuaug

SEQ ID NO: 218177 - RNA, 19 nt, Homo sapiens
gccaacucacccucuauga

SEQ ID NO: 218178 - RNA, 19 nt, Homo sapiens
uuauagagggcguccagaa

SEQ ID NO: 218179 - RNA, 19 nt, Homo sapiens
ccaggccauucgcgccauu

SEQ ID NO: 218180 - RNA, 19 nt, Homo sapiens
gguacuucaagcucuauga

SEQ ID NO: 218181 - RNA, 19 nt, Homo sapiens
ggaggcagcuggcgagaua

SEQ ID NO: 218182 - RNA, 19 nt, Homo sapiens
gaauuuaccagcugaagaa

SEQ ID NO: 218183 - RNA, 19 nt, Homo sapiens
ggcgagagcuacagacuga

SEQ ID NO: 218184 - RNA, 19 nt, Homo sapiens
gaacgaguuuguugaaggu

SEQ ID NO: 218185 - RNA, 19 nt, Homo sapiens
caagaucuaugauaaggau

SEQ ID NO: 218186 - RNA, 19 nt, Homo sapiens
ggacauucaagaucuauga

SEQ ID NO: 218187 - RNA, 19 nt, Homo sapiens
gcacacucuuuaugcauga

SEQ ID NO: 218188 - RNA, 19 nt, Homo sapiens
ggacaacaccaucgacuuc

SEQ ID NO: 218189 - RNA, 19 nt, Homo sapiens
ugaagaugcugcagaugga

SEQ ID NO: 218190 - RNA, 19 nt, Homo sapiens
acaagugggugaugaagau

SEQ ID NO: 218191 - RNA, 19 nt, Homo sapiens
gaaguggacauucaagauc

SEQ ID NO: 218192 - RNA, 19 nt, Homo sapiens
ggaauuuaccagcugaaga

SEQ ID NO: 218193 - RNA, 19 nt, Homo sapiens
guacguggcagcucugaau

SEQ ID NO: 218194 - RNA, 19 nt, Homo sapiens
ugaugaagaugcugcagau

SEQ ID NO: 218195 - RNA, 19 nt, Homo sapiens
ccaucgacuuccuggagua

SEQ ID NO: 218196 - RNA, 19 nt, Homo sapiens
ggagugguacaagaaguuu

SEQ ID NO: 218197 - RNA, 19 nt, Homo sapiens
guauguagagggcauguuc

SEQ ID NO: 218198 - RNA, 19 nt, Homo sapiens
gaaaagugccauguucuga

SEQ ID NO: 218199 - RNA, 19 nt, Homo sapiens
gccuggagcuacucaacau

SEQ ID NO: 218200 - RNA, 19 nt, Homo sapiens
gacaagugggugaugaaga

SEQ ID NO: 218201 - RNA, 19 nt, Homo sapiens
gcagcuggcgagauagaug

SEQ ID NO: 218202 - RNA, 19 nt, Homo sapiens
gaguuuaagcgcuucuuca

SEQ ID NO: 218203 - RNA, 19 nt, Homo sapiens
caacauuguggagggaauu

SEQ ID NO: 218204 - RNA, 19 nt, Homo sapiens
gcggcacacucuuuaugca

SEQ ID NO: 218205 - RNA, 19 nt, Homo sapiens
guuccgagccuucgacaag

SEQ ID NO: 218206 - RNA, 19 nt, Homo sapiens
cgggacaagugggugauga

SEQ ID NO: 218207 - RNA, 19 nt, Homo sapiens
gauggccagcugucucuga

SEQ ID NO: 218208 - RNA, 19 nt, Homo sapiens
ggacaagugggugaugaag

SEQ ID NO: 218209 - RNA, 19 nt, Homo sapiens
ucucugaacgaguuuguug

SEQ ID NO: 218210 - RNA, 19 nt, Homo sapiens
cagcggcacacucuuuaug

SEQ ID NO: 218211 - RNA, 19 nt, Homo sapiens
gggacaacaccaucgacuu

SEQ ID NO: 218212 - RNA, 19 nt, Homo sapiens
caggagugguacaagaagu

SEQ ID NO: 218213 - RNA, 19 nt, Homo sapiens
gggacaagugggugaugaa

SEQ ID NO: 218214 - RNA, 19 nt, Homo sapiens
cagcagagacggaaaagug

SEQ ID NO: 218215 - RNA, 19 nt, Homo sapiens
cccagcggcacacucuuua

SEQ ID NO: 218216 - RNA, 19 nt, Homo sapiens
gcuacagacugagcaagac

SEQ ID NO: 218217 - RNA, 19 nt, Homo sapiens
ucaacauuguggagggaau

SEQ ID NO: 218218 - RNA, 19 nt, Homo sapiens
cagcccagcuccugaauaa

SEQ ID NO: 218219 - RNA, 19 nt, Homo sapiens
gcaaucggacauagaguug

SEQ ID NO: 218220 - RNA, 19 nt, Homo sapiens
guacaaagcaaucggacau

SEQ ID NO: 218221 - RNA, 19 nt, Homo sapiens
gcagcuggaucugguacaa

SEQ ID NO: 218222 - RNA, 19 nt, Homo sapiens
caaagcaaucggacauaga

SEQ ID NO: 218223 - RNA, 19 nt, Homo sapiens
gcacacagucagucuacau

SEQ ID NO: 218224 - RNA, 19 nt, Homo sapiens
acaaagcaaucggacauag

SEQ ID NO: 218225 - RNA, 19 nt, Homo sapiens
ccaugaagaagcugaguga

SEQ ID NO: 218226 - RNA, 19 nt, Homo sapiens
gcccagcuccugaauaaag

SEQ ID NO: 218227 - RNA, 19 nt, Homo sapiens
gcagcccagcuccugaaua

SEQ ID NO: 218228 - RNA, 19 nt, Homo sapiens
cgacgacugugagcugugu

SEQ ID NO: 218229 - RNA, 19 nt, Homo sapiens
ugaggaccaucgcuaacga

SEQ ID NO: 218230 - RNA, 19 nt, Homo sapiens
aaucggacauagaguugga

SEQ ID NO: 218231 - RNA, 19 nt, Homo sapiens
gagcacacagucagucuac

SEQ ID NO: 218232 - RNA, 19 nt, Homo sapiens
gaucugguacaaagcaauc

SEQ ID NO: 218233 - RNA, 19 nt, Homo sapiens
acugugagcugugugugaa

SEQ ID NO: 218234 - RNA, 19 nt, Homo sapiens
ucaagacccugaggaccau

SEQ ID NO: 218235 - RNA, 19 nt, Homo sapiens
cccagcuccugaauaaaga

SEQ ID NO: 218236 - RNA, 19 nt, Homo sapiens
ggccugagcagcuggaucu

SEQ ID NO: 218237 - RNA, 19 nt, Homo sapiens
gugugaacguugcguguac

SEQ ID NO: 218238 - RNA, 19 nt, Homo sapiens
aaagcaaucggacauagag

SEQ ID NO: 218239 - RNA, 19 nt, Homo sapiens
ggaaugccaugguuauuaa

SEQ ID NO: 218240 - RNA, 19 nt, Homo sapiens
ggacaacucugugaagaaa

SEQ ID NO: 218241 - RNA, 19 nt, Homo sapiens
gcacgaagcucaaggaucu

SEQ ID NO: 218242 - RNA, 19 nt, Homo sapiens
gauaguggcuucuguuugu

SEQ ID NO: 218243 - RNA, 19 nt, Homo sapiens
gagaagaacauacaagaaa

SEQ ID NO: 218244 - RNA, 19 nt, Homo sapiens
cccaacaacuuacagauua

SEQ ID NO: 218245 - RNA, 19 nt, Homo sapiens
gagaguauuugcaaacuga

SEQ ID NO: 218246 - RNA, 19 nt, Homo sapiens
gagcagccauugccaagaa

SEQ ID NO: 218247 - RNA, 19 nt, Homo sapiens
gagucuaucuucacacuuu

SEQ ID NO: 218248 - RNA, 19 nt, Homo sapiens
ucagagagcugcaaagcaa

SEQ ID NO: 218249 - RNA, 19 nt, Homo sapiens
aaaggcagcugcucacgua

SEQ ID NO: 218250 - RNA, 19 nt, Homo sapiens
ggagucaccugcaaucuca

SEQ ID NO: 218251 - RNA, 19 nt, Homo sapiens
ggagcucucugaugaaguu

SEQ ID NO: 218252 - RNA, 19 nt, Homo sapiens
gccaagaaguucaguaaug

SEQ ID NO: 218253 - RNA, 19 nt, Homo sapiens
gaggcacccuuaaagauuu

SEQ ID NO: 218254 - RNA, 19 nt, Homo sapiens
ugauggagcucucugauga

SEQ ID NO: 218255 - RNA, 19 nt, Homo sapiens
gacaaugacaucccaguua

SEQ ID NO: 218256 - RNA, 19 nt, Homo sapiens
ccacaucgcuauucugcaa

SEQ ID NO: 218257 - RNA, 19 nt, Homo sapiens
gcagcgaguuugugaauca

SEQ ID NO: 218258 - RNA, 19 nt, Homo sapiens
ggcagcugcucacguauua

SEQ ID NO: 218259 - RNA, 19 nt, Homo sapiens
gcucacguauuauaugaaa

SEQ ID NO: 218260 - RNA, 19 nt, Homo sapiens
guggagagcuggaugucua

SEQ ID NO: 218261 - RNA, 19 nt, Homo sapiens
caagauggccugaagaaga

SEQ ID NO: 218262 - RNA, 19 nt, Homo sapiens
ggagaucgcagcaggguaa

SEQ ID NO: 218263 - RNA, 19 nt, Homo sapiens
ccaccaaacuucccuagug

SEQ ID NO: 218264 - RNA, 19 nt, Homo sapiens
ggaagaugcaagccaauuu

SEQ ID NO: 218265 - RNA, 19 nt, Homo sapiens
ggaauagauuagcaaccua

SEQ ID NO: 218266 - RNA, 19 nt, Homo sapiens
aaagaaagauguggaagau

SEQ ID NO: 218267 - RNA, 19 nt, Homo sapiens
ccaagaaguucaguaaugu

SEQ ID NO: 218268 - RNA, 19 nt, Homo sapiens
gaauaugcaguuuguugua

SEQ ID NO: 218269 - RNA, 19 nt, Homo sapiens
gaucaugacuauguugaau

SEQ ID NO: 218270 - RNA, 19 nt, Homo sapiens
ggaggcacccuuaaagauu

SEQ ID NO: 218271 - RNA, 19 nt, Homo sapiens
ccaguggaguuaucaaaga

SEQ ID NO: 218272 - RNA, 19 nt, Homo sapiens
caaucuuucuccuguuuaa

SEQ ID NO: 218273 - RNA, 19 nt, Homo sapiens
aaacuucccuagugaaauc

SEQ ID NO: 218274 - RNA, 19 nt, Homo sapiens
caaagacuguccugguuuc

SEQ ID NO: 218275 - RNA, 19 nt, Homo sapiens
ggaaguggaagugucguua

SEQ ID NO: 218276 - RNA, 19 nt, Homo sapiens
aggcaaagcaucaggaaua

SEQ ID NO: 218277 - RNA, 19 nt, Homo sapiens
gaacaggagagacuuucaa

SEQ ID NO: 218278 - RNA, 19 nt, Homo sapiens
agaguguccuuucuccuua

SEQ ID NO: 218279 - RNA, 19 nt, Homo sapiens
ugugauaguugucgucaaa

SEQ ID NO: 218280 - RNA, 19 nt, Homo sapiens
cacaaucuuucuccuguuu

SEQ ID NO: 218281 - RNA, 19 nt, Homo sapiens
gaccuucugugcuccauau

SEQ ID NO: 218282 - RNA, 19 nt, Homo sapiens
gaaguggaagugucguuaa

SEQ ID NO: 218283 - RNA, 19 nt, Homo sapiens
gagaaccaccucccugauu

SEQ ID NO: 218284 - RNA, 19 nt, Homo sapiens
gucaagacauuccugagaa

SEQ ID NO: 218285 - RNA, 19 nt, Homo sapiens
caccaaacuucccuaguga

SEQ ID NO: 218286 - RNA, 19 nt, Homo sapiens
ggaacaagcccgagcucaa

SEQ ID NO: 218287 - RNA, 19 nt, Homo sapiens
guuugucagucucauauaa

SEQ ID NO: 218288 - RNA, 19 nt, Homo sapiens
ugaaucagcccuacuuguu

SEQ ID NO: 218289 - RNA, 19 nt, Homo sapiens
gaacauuggcaaagcacaa

SEQ ID NO: 218290 - RNA, 19 nt, Homo sapiens
cuuacuaccuguacucaaa

SEQ ID NO: 218291 - RNA, 19 nt, Homo sapiens
gguuucaguugcagaguuu

SEQ ID NO: 218292 - RNA, 19 nt, Homo sapiens
ggguuugacucauugaaga

SEQ ID NO: 218293 - RNA, 19 nt, Homo sapiens
ucucagacaucccaauuca

SEQ ID NO: 218294 - RNA, 19 nt, Homo sapiens
gaaucagcccuacuuguug

SEQ ID NO: 218295 - RNA, 19 nt, Homo sapiens
uaaaguguguuugugauag

SEQ ID NO: 218296 - RNA, 19 nt, Homo sapiens
uggcuaacaagcaguauua

SEQ ID NO: 218297 - RNA, 19 nt, Homo sapiens
caaagcaucaggaauagau

SEQ ID NO: 218298 - RNA, 19 nt, Homo sapiens
gaacaagcccgagcucaag

SEQ ID NO: 218299 - RNA, 19 nt, Homo sapiens
ugagggauguggucuuaau

SEQ ID NO: 218300 - RNA, 19 nt, Homo sapiens
guggacagauuagaagauu

SEQ ID NO: 218301 - RNA, 19 nt, Homo sapiens
ugaauccagugcaaucuug

SEQ ID NO: 218302 - RNA, 19 nt, Homo sapiens
gagccaagucacaaucuuu

SEQ ID NO: 218303 - RNA, 19 nt, Homo sapiens
ucaccaugcucuucucaga

SEQ ID NO: 218304 - RNA, 19 nt, Homo sapiens
gcagagaccaggacucagu

SEQ ID NO: 218305 - RNA, 19 nt, Homo sapiens
cagcugcucacguauuaua

SEQ ID NO: 218306 - RNA, 19 nt, Homo sapiens
gcuaacaagcaguauuaaa

SEQ ID NO: 218307 - RNA, 19 nt, Homo sapiens
caggagagacuuucaagga

SEQ ID NO: 218308 - RNA, 19 nt, Homo sapiens
gaagaacauacaagaaagu

SEQ ID NO: 218309 - RNA, 19 nt, Homo sapiens
gaagcagguuucaguugca

SEQ ID NO: 218310 - RNA, 19 nt, Homo sapiens
caacaaggaacaaacucaa

SEQ ID NO: 218311 - RNA, 19 nt, Homo sapiens
ggagaugggacaacucugu

SEQ ID NO: 218312 - RNA, 19 nt, Homo sapiens
gugggaguauuucuauuau

SEQ ID NO: 218313 - RNA, 19 nt, Homo sapiens
ggagccaagucacaaucuu

SEQ ID NO: 218314 - RNA, 19 nt, Homo sapiens
uggagaaccuaucaagaug

SEQ ID NO: 218315 - RNA, 19 nt, Homo sapiens
gaauguugcacuucagaga

SEQ ID NO: 218316 - RNA, 19 nt, Homo sapiens
uggaaugccaugguuauua

SEQ ID NO: 218317 - RNA, 19 nt, Homo sapiens
ucagcaccuuguacauaua

SEQ ID NO: 218318 - RNA, 19 nt, Homo sapiens
ugugggaguauuucuauua

SEQ ID NO: 218319 - RNA, 19 nt, Homo sapiens
uuagcaaccuauauaccua

SEQ ID NO: 218320 - RNA, 19 nt, Homo sapiens
ccaaacuucccuagugaaa

SEQ ID NO: 218321 - RNA, 19 nt, Homo sapiens
gaguuaaaaugccccguua

SEQ ID NO: 218322 - RNA, 19 nt, Homo sapiens
acugagggauguggucuua

SEQ ID NO: 218323 - RNA, 19 nt, Homo sapiens
caagacauuuccauuccau

SEQ ID NO: 218324 - RNA, 19 nt, Homo sapiens
caagaucacaggagagugu

SEQ ID NO: 218325 - RNA, 19 nt, Homo sapiens
cacucuggcuaacaaauuu

SEQ ID NO: 218326 - RNA, 19 nt, Homo sapiens
ccauugcgaugccuauugu

SEQ ID NO: 218327 - RNA, 19 nt, Homo sapiens
ggacagauuagaagauuuu

SEQ ID NO: 218328 - RNA, 19 nt, Homo sapiens
uccauuccauuucauguuu

SEQ ID NO: 218329 - RNA, 19 nt, Homo sapiens
agacauuuccauuccauuu

SEQ ID NO: 218330 - RNA, 19 nt, Homo sapiens
gcaagacauuuccauucca

SEQ ID NO: 218331 - RNA, 19 nt, Homo sapiens
uauaagaacuacagcucau

SEQ ID NO: 218332 - RNA, 19 nt, Homo sapiens
caucaggaauagauuagca

SEQ ID NO: 218333 - RNA, 19 nt, Homo sapiens
gcucucugaugaaguuaug

SEQ ID NO: 218334 - RNA, 19 nt, Homo sapiens
gauaugacaauucugcaau

SEQ ID NO: 218335 - RNA, 19 nt, Homo sapiens
agaagaacauacaagaaag

SEQ ID NO: 218336 - RNA, 19 nt, Homo sapiens
caguguccuugaauugaua

SEQ ID NO: 218337 - RNA, 19 nt, Homo sapiens
ggaacaaacucaaaaccau

SEQ ID NO: 218338 - RNA, 19 nt, Homo sapiens
ucaaagacuguccugguuu

SEQ ID NO: 218339 - RNA, 19 nt, Homo sapiens
gcaaagaaaugaagaaugu

SEQ ID NO: 218340 - RNA, 19 nt, Homo sapiens
gaaauagacaugaagguua

SEQ ID NO: 218341 - RNA, 19 nt, Homo sapiens
ggaaauugcuggccagguu

SEQ ID NO: 218342 - RNA, 19 nt, Homo sapiens
gcacugaaauagacaugaa

SEQ ID NO: 218343 - RNA, 19 nt, Homo sapiens
aaacaaagcaggaugauga

SEQ ID NO: 218344 - RNA, 19 nt, Homo sapiens
gauacacacuggagaggua

SEQ ID NO: 218345 - RNA, 19 nt, Homo sapiens
gagaaauccuccaaauguu

SEQ ID NO: 218346 - RNA, 19 nt, Homo sapiens
ccaagaaucugguuaugau

SEQ ID NO: 218347 - RNA, 19 nt, Homo sapiens
ggagagggcuguaucuaag

SEQ ID NO: 218348 - RNA, 19 nt, Homo sapiens
ccaaaucuguuuaguguuc

SEQ ID NO: 218349 - RNA, 19 nt, Homo sapiens
gaaauuagaaugugaggau

SEQ ID NO: 218350 - RNA, 19 nt, Homo sapiens
ucaugaaccuggacgauuu

SEQ ID NO: 218351 - RNA, 19 nt, Homo sapiens
gcaaaguccucaaucucaa

SEQ ID NO: 218352 - RNA, 19 nt, Homo sapiens
gaagaggaguacagacuag

SEQ ID NO: 218353 - RNA, 19 nt, Homo sapiens
uaccaaaucuguuuagugu

SEQ ID NO: 218354 - RNA, 19 nt, Homo sapiens
gaacagaggaaacaaagca

SEQ ID NO: 218355 - RNA, 19 nt, Homo sapiens
gagcaguucuucccuaugg

SEQ ID NO: 218356 - RNA, 19 nt, Homo sapiens
gcaugcaucuggagaagga

SEQ ID NO: 218357 - RNA, 19 nt, Homo sapiens
acaguuagaugaagaagga

SEQ ID NO: 218358 - RNA, 19 nt, Homo sapiens
ccaaugagcugcggcacaa

SEQ ID NO: 218359 - RNA, 19 nt, Homo sapiens
cuacaagcauuaccuaaca

SEQ ID NO: 218360 - RNA, 19 nt, Homo sapiens
gcaaugcuauauacagagu

SEQ ID NO: 218361 - RNA, 19 nt, Homo sapiens
ggauacagauuuucuuuug

SEQ ID NO: 218362 - RNA, 19 nt, Homo sapiens
gcggaugccucgauacugu

SEQ ID NO: 218363 - RNA, 19 nt, Homo sapiens
gacagcggaugccucgaua

SEQ ID NO: 218364 - RNA, 19 nt, Homo sapiens
ugucuuaugucuccagaaa

SEQ ID NO: 218365 - RNA, 19 nt, Homo sapiens
caaaagauaugacaaugug

SEQ ID NO: 218366 - RNA, 19 nt, Homo sapiens
guaguaggcacccaauaaa

SEQ ID NO: 218367 - RNA, 19 nt, Homo sapiens
gcaggaugaugacugaauc

SEQ ID NO: 218368 - RNA, 19 nt, Homo sapiens
aaagcaggaugaugacuga

SEQ ID NO: 218369 - RNA, 19 nt, Homo sapiens
ugaagcagauagcauacuu

SEQ ID NO: 218370 - RNA, 19 nt, Homo sapiens
gcacuacuacucagagaga

SEQ ID NO: 218371 - RNA, 19 nt, Homo sapiens
caagcaaaguccucaaucu

SEQ ID NO: 218372 - RNA, 19 nt, Homo sapiens
ucagauaacaauagggaua

SEQ ID NO: 218373 - RNA, 19 nt, Homo sapiens
gauccuuucucacaucaau

SEQ ID NO: 218374 - RNA, 19 nt, Homo sapiens
ccauauacauucugcaaag

SEQ ID NO: 218375 - RNA, 19 nt, Homo sapiens
ggagaaggagccaugaaga

SEQ ID NO: 218376 - RNA, 19 nt, Homo sapiens
aauacaaacucacccaaga

SEQ ID NO: 218377 - RNA, 19 nt, Homo sapiens
gaaccuggacgauuugaca

SEQ ID NO: 218378 - RNA, 19 nt, Homo sapiens
gaacugacugggacugaga

SEQ ID NO: 218379 - RNA, 19 nt, Homo sapiens
gggcuucaaugcuuucugu

SEQ ID NO: 218380 - RNA, 19 nt, Homo sapiens
guaggcacccaauaaauau

SEQ ID NO: 218381 - RNA, 19 nt, Homo sapiens
gcucugcuuucuauuacuu

SEQ ID NO: 218382 - RNA, 19 nt, Homo sapiens
gagaagcaaggaaggauug

SEQ ID NO: 218383 - RNA, 19 nt, Homo sapiens
uuaugaagaucuugacaga

SEQ ID NO: 218384 - RNA, 19 nt, Homo sapiens
gaagguuauucagcaaaga

SEQ ID NO: 218385 - RNA, 19 nt, Homo sapiens
ucacgcaucagcccauaua

SEQ ID NO: 218386 - RNA, 19 nt, Homo sapiens
ugaagaaugugaucauacu

SEQ ID NO: 218387 - RNA, 19 nt, Homo sapiens
acaaauccauggcacugaa

SEQ ID NO: 218388 - RNA, 19 nt, Homo sapiens
guccugggcucuaauguca

SEQ ID NO: 218389 - RNA, 19 nt, Homo sapiens
auacagaugucuuaugucu

SEQ ID NO: 218390 - RNA, 19 nt, Homo sapiens
aguaggcacccaauaaaua

SEQ ID NO: 218391 - RNA, 19 nt, Homo sapiens
gagaaggagccaugaagau

SEQ ID NO: 218392 - RNA, 19 nt, Homo sapiens
guuuaguguuccacauaua

SEQ ID NO: 218393 - RNA, 19 nt, Homo sapiens
ccuuagcucugcuuucuau

SEQ ID NO: 218394 - RNA, 19 nt, Homo sapiens
aaagaaccaaugcaaguuu

SEQ ID NO: 218395 - RNA, 19 nt, Homo sapiens
gaaaugaagaaugugauca

SEQ ID NO: 218396 - RNA, 19 nt, Homo sapiens
agaaauccuccaaauguuu

SEQ ID NO: 218397 - RNA, 19 nt, Homo sapiens
uauccguuauucaaccuua

SEQ ID NO: 218398 - RNA, 19 nt, Homo sapiens
gguaguuacaggugucaua

SEQ ID NO: 218399 - RNA, 19 nt, Homo sapiens
caaugugaccauccucuuu

SEQ ID NO: 218400 - RNA, 19 nt, Homo sapiens
ucucaagggucaaaugauc

SEQ ID NO: 218401 - RNA, 19 nt, Homo sapiens
uggcaaugcuauauacaga

SEQ ID NO: 218402 - RNA, 19 nt, Homo sapiens
gauauugucauuggaauca

SEQ ID NO: 218403 - RNA, 19 nt, Homo sapiens
ugacaucccucugcaugau

SEQ ID NO: 218404 - RNA, 19 nt, Homo sapiens
gaagcagauagcauacuuu

SEQ ID NO: 218405 - RNA, 19 nt, Homo sapiens
uuuauaagguggagacugu

SEQ ID NO: 218406 - RNA, 19 nt, Homo sapiens
ugaaauagacaugaagguu

SEQ ID NO: 218407 - RNA, 19 nt, Homo sapiens
gcuaccaucuacccaggaa

SEQ ID NO: 218408 - RNA, 19 nt, Homo sapiens
caagaaucugguuaugaua

SEQ ID NO: 218409 - RNA, 19 nt, Homo sapiens
ggaugaugacugaaucuug

SEQ ID NO: 218410 - RNA, 19 nt, Homo sapiens
ggacagcggaugccucgau

SEQ ID NO: 218411 - RNA, 19 nt, Homo sapiens
aaugugaccauccucuuua

SEQ ID NO: 218412 - RNA, 19 nt, Homo sapiens
uguuggauguggagaaauu

SEQ ID NO: 218413 - RNA, 19 nt, Homo sapiens
uuagcucugcuuucuauua

SEQ ID NO: 218414 - RNA, 19 nt, Homo sapiens
caucagcccauauacauuc

SEQ ID NO: 218415 - RNA, 19 nt, Homo sapiens
gaaucacgcccuggaguug

SEQ ID NO: 218416 - RNA, 19 nt, Homo sapiens
gaaacaaagcaggaugaug

SEQ ID NO: 218417 - RNA, 19 nt, Homo sapiens
gagcacagaggcccagugu

SEQ ID NO: 218418 - RNA, 19 nt, Homo sapiens
ggcuacagcucacguuaag

SEQ ID NO: 218419 - RNA, 19 nt, Homo sapiens
caaacucacccaagaacug

SEQ ID NO: 218420 - RNA, 19 nt, Homo sapiens
uggagaaauuagaauguga

SEQ ID NO: 218421 - RNA, 19 nt, Homo sapiens
aguaguaggcacccaauaa

SEQ ID NO: 218422 - RNA, 19 nt, Homo sapiens
ugaagaggaguacagacua

SEQ ID NO: 218423 - RNA, 19 nt, Homo sapiens
agagaggaauacaaacuca

SEQ ID NO: 218424 - RNA, 19 nt, Homo sapiens
ggauguggagaaauuagaa

SEQ ID NO: 218425 - RNA, 19 nt, Homo sapiens
gcaaggaaggauuguugga

SEQ ID NO: 218426 - RNA, 19 nt, Homo sapiens
gcugguucguccucauauu

SEQ ID NO: 218427 - RNA, 19 nt, Homo sapiens
cuugacagauuugaagaaa

SEQ ID NO: 218428 - RNA, 19 nt, Homo sapiens
gagcuucaugugucuuaaa

SEQ ID NO: 218429 - RNA, 19 nt, Homo sapiens
caaguuugguuucuaucca

SEQ ID NO: 218430 - RNA, 19 nt, Homo sapiens
aagaaccaaugcaaguuug

SEQ ID NO: 218431 - RNA, 19 nt, Homo sapiens
guggagaaauuagaaugug

SEQ ID NO: 218432 - RNA, 19 nt, Homo sapiens
gcaagcaaaguccucaauc

SEQ ID NO: 218433 - RNA, 19 nt, Homo sapiens
gacuguuggugacaaguau

SEQ ID NO: 218434 - RNA, 19 nt, Homo sapiens
ggagacuguuggugacaag

SEQ ID NO: 218435 - RNA, 19 nt, Homo sapiens
gaaucugguuaugauacaa

SEQ ID NO: 218436 - RNA, 19 nt, Homo sapiens
gccaagaaucugguuauga

SEQ ID NO: 218437 - RNA, 19 nt, Homo sapiens
agaaugugaucauacucaa

SEQ ID NO: 218438 - RNA, 19 nt, Homo sapiens
cagacaccauguacggauu

SEQ ID NO: 218439 - RNA, 19 nt, Homo sapiens
gaaucaagaugccucguua

SEQ ID NO: 218440 - RNA, 19 nt, Homo sapiens
ggaauucccuucuaaauag

SEQ ID NO: 218441 - RNA, 19 nt, Homo sapiens
ggacagggcugacagacuu

SEQ ID NO: 218442 - RNA, 19 nt, Homo sapiens
caagaucgaugaugacaaa

SEQ ID NO: 218443 - RNA, 19 nt, Homo sapiens
gauaaggaguuucaggaua

SEQ ID NO: 218444 - RNA, 19 nt, Homo sapiens
gcacaaugaugguaauuuc

SEQ ID NO: 218445 - RNA, 19 nt, Homo sapiens
ucaaagaucucaagcacaa

SEQ ID NO: 218446 - RNA, 19 nt, Homo sapiens
gaacgcuacuuucauguau

SEQ ID NO: 218447 - RNA, 19 nt, Homo sapiens
caaguguccugaaagcuua

SEQ ID NO: 218448 - RNA, 19 nt, Homo sapiens
gaaaugagacuaccuacug

SEQ ID NO: 218449 - RNA, 19 nt, Homo sapiens
caagaugccucguuauugu

SEQ ID NO: 218450 - RNA, 19 nt, Homo sapiens
caacaucucucagaaagga

SEQ ID NO: 218451 - RNA, 19 nt, Homo sapiens
gagaggagaaacauacuua

SEQ ID NO: 218452 - RNA, 19 nt, Homo sapiens
uaaggacucacacaaauua

SEQ ID NO: 218453 - RNA, 19 nt, Homo sapiens
caaauuugcucaugcuuuc

SEQ ID NO: 218454 - RNA, 19 nt, Homo sapiens
gcaaugugauuauuaugug

SEQ ID NO: 218455 - RNA, 19 nt, Homo sapiens
acucuaaacuuccuaauga

SEQ ID NO: 218456 - RNA, 19 nt, Homo sapiens
ggagaaacauacuuaaagg

SEQ ID NO: 218457 - RNA, 19 nt, Homo sapiens
ucacuacuaucugcaaaua

SEQ ID NO: 218458 - RNA, 19 nt, Homo sapiens
gaugggcuguguccucaua

SEQ ID NO: 218459 - RNA, 19 nt, Homo sapiens
gcugacagacuuaacuuua

SEQ ID NO: 218460 - RNA, 19 nt, Homo sapiens
cggauggucugauucauaa

SEQ ID NO: 218461 - RNA, 19 nt, Homo sapiens
gaacauggacuuucuugca

SEQ ID NO: 218462 - RNA, 19 nt, Homo sapiens
ucagugacauuguagguuu

SEQ ID NO: 218463 - RNA, 19 nt, Homo sapiens
acaaguugcuucagauuga

SEQ ID NO: 218464 - RNA, 19 nt, Homo sapiens
gcucgucgcucuccugaug

SEQ ID NO: 218465 - RNA, 19 nt, Homo sapiens
uauaaggacucacacaaau

SEQ ID NO: 218466 - RNA, 19 nt, Homo sapiens
gaacaaguugcuucagauu

SEQ ID NO: 218467 - RNA, 19 nt, Homo sapiens
gauccgacgucuacagcua

SEQ ID NO: 218468 - RNA, 19 nt, Homo sapiens
gcaaaaugcuggccuaaau

SEQ ID NO: 218469 - RNA, 19 nt, Homo sapiens
cuacuucagugacauugua

SEQ ID NO: 218470 - RNA, 19 nt, Homo sapiens
gaaaccuucuacacuuuga

SEQ ID NO: 218471 - RNA, 19 nt, Homo sapiens
gcuagugguuugccuaaga

SEQ ID NO: 218472 - RNA, 19 nt, Homo sapiens
aaagagaccagauuucaaa

SEQ ID NO: 218473 - RNA, 19 nt, Homo sapiens
uaucugcacuccaguaaga

SEQ ID NO: 218474 - RNA, 19 nt, Homo sapiens
gaucucagcuggaaguuuu

SEQ ID NO: 218475 - RNA, 19 nt, Homo sapiens
ggaugaaggaccagaaauu

SEQ ID NO: 218476 - RNA, 19 nt, Homo sapiens
gauagaauacugugagaga

SEQ ID NO: 218477 - RNA, 19 nt, Homo sapiens
gaauugagcuaccccauga

SEQ ID NO: 218478 - RNA, 19 nt, Homo sapiens
gaccucaaguguccugaaa

SEQ ID NO: 218479 - RNA, 19 nt, Homo sapiens
aaacgagacuuugcucuug

SEQ ID NO: 218480 - RNA, 19 nt, Homo sapiens
acaaggagagcaccuauuu

SEQ ID NO: 218481 - RNA, 19 nt, Homo sapiens
gaggagaaacauacuuaaa

SEQ ID NO: 218482 - RNA, 19 nt, Homo sapiens
gcucuugccuauuugaaug

SEQ ID NO: 218483 - RNA, 19 nt, Homo sapiens
ccaacgaucugcccuucaa

SEQ ID NO: 218484 - RNA, 19 nt, Homo sapiens
ggacaugcuuaaugacauc

SEQ ID NO: 218485 - RNA, 19 nt, Homo sapiens
ugacagacuuaacuuuaug

SEQ ID NO: 218486 - RNA, 19 nt, Homo sapiens
caagugggcacaaggagua

SEQ ID NO: 218487 - RNA, 19 nt, Homo sapiens
guagaaugguggugaagau

SEQ ID NO: 218488 - RNA, 19 nt, Homo sapiens
gauggcacauucauggauu

SEQ ID NO: 218489 - RNA, 19 nt, Homo sapiens
uuacaagaaugguacagaa

SEQ ID NO: 218490 - RNA, 19 nt, Homo sapiens
gaaacuugauaccaugauc

SEQ ID NO: 218491 - RNA, 19 nt, Homo sapiens
gaagauagaauugaacaag

SEQ ID NO: 218492 - RNA, 19 nt, Homo sapiens
ccagauuuauucuuggaaa

SEQ ID NO: 218493 - RNA, 19 nt, Homo sapiens
ggagauguguacagcuaug

SEQ ID NO: 218494 - RNA, 19 nt, Homo sapiens
agucagaacugccacaaug

SEQ ID NO: 218495 - RNA, 19 nt, Homo sapiens
ggaguuucaggauaucuua

SEQ ID NO: 218496 - RNA, 19 nt, Homo sapiens
auaaggaguuucaggauau

SEQ ID NO: 218497 - RNA, 19 nt, Homo sapiens
guauaaggacucacacaaa

SEQ ID NO: 218498 - RNA, 19 nt, Homo sapiens
ugccaacucuuuacagaaa

SEQ ID NO: 218499 - RNA, 19 nt, Homo sapiens
gcaaucggcaugcaauaga

SEQ ID NO: 218500 - RNA, 19 nt, Homo sapiens
ggaccggaaugagaagauu

SEQ ID NO: 218501 - RNA, 19 nt, Homo sapiens
gacuguuucugguaccuua

SEQ ID NO: 218502 - RNA, 19 nt, Homo sapiens
cuucguauguuuacaagaa

SEQ ID NO: 218503 - RNA, 19 nt, Homo sapiens
gaagugguggacaugcuua

SEQ ID NO: 218504 - RNA, 19 nt, Homo sapiens
gccaacaucucucagaaag

SEQ ID NO: 218505 - RNA, 19 nt, Homo sapiens
gaaccuuauuccagcaguu

SEQ ID NO: 218506 - RNA, 19 nt, Homo sapiens
ugcuucagauugacuauua

SEQ ID NO: 218507 - RNA, 19 nt, Homo sapiens
guaccauggugcuucugua

SEQ ID NO: 218508 - RNA, 19 nt, Homo sapiens
agacuuugcucuugccuau

SEQ ID NO: 218509 - RNA, 19 nt, Homo sapiens
gaggaaaugagacuaccua

SEQ ID NO: 218510 - RNA, 19 nt, Homo sapiens
gaacaucugguagaggaaa

SEQ ID NO: 218511 - RNA, 19 nt, Homo sapiens
cuacagcuauauucucgaa

SEQ ID NO: 218512 - RNA, 19 nt, Homo sapiens
aaggagauguguacagcua

SEQ ID NO: 218513 - RNA, 19 nt, Homo sapiens
ucacuuggaagaacucuaa

SEQ ID NO: 218514 - RNA, 19 nt, Homo sapiens
agauguaccuugacacaga

SEQ ID NO: 218515 - RNA, 19 nt, Homo sapiens
guauucggauggucugauu

SEQ ID NO: 218516 - RNA, 19 nt, Homo sapiens
ucaaugaagcagaaaugua

SEQ ID NO: 218517 - RNA, 19 nt, Homo sapiens
ggagaucauucugcggaaa

SEQ ID NO: 218518 - RNA, 19 nt, Homo sapiens
uaugauacccacguaaaua

SEQ ID NO: 218519 - RNA, 19 nt, Homo sapiens
gaccuaugauacccacgua

SEQ ID NO: 218520 - RNA, 19 nt, Homo sapiens
gcacuucguauguuuacaa

SEQ ID NO: 218521 - RNA, 19 nt, Homo sapiens
caugauugccaacucuuua

SEQ ID NO: 218522 - RNA, 19 nt, Homo sapiens
ggaggaagauccagaaaag

SEQ ID NO: 218523 - RNA, 19 nt, Homo sapiens
ugauguacuucuugguuaa

SEQ ID NO: 218524 - RNA, 19 nt, Homo sapiens
gauguaccuugacacagaa

SEQ ID NO: 218525 - RNA, 19 nt, Homo sapiens
guacagcuaugggaucauc

SEQ ID NO: 218526 - RNA, 19 nt, Homo sapiens
aggcuagcguuuccuauuu

SEQ ID NO: 218527 - RNA, 19 nt, Homo sapiens
gcaugaaucagaugugugu

SEQ ID NO: 218528 - RNA, 19 nt, Homo sapiens
ggacuuucuugcaugaauc

SEQ ID NO: 218529 - RNA, 19 nt, Homo sapiens
gcagggauaagaagccaaa

SEQ ID NO: 218530 - RNA, 19 nt, Homo sapiens
gaugaaggaccagaaauuc

SEQ ID NO: 218531 - RNA, 19 nt, Homo sapiens
ccaaauuugcucaugcuuu

SEQ ID NO: 218532 - RNA, 19 nt, Homo sapiens
cacaauggcagcuaugaaa

SEQ ID NO: 218533 - RNA, 19 nt, Homo sapiens
guacuucuugguuaacuuu

SEQ ID NO: 218534 - RNA, 19 nt, Homo sapiens
uugauguacuucuugguua

SEQ ID NO: 218535 - RNA, 19 nt, Homo sapiens
caugguggcuagugguuug

SEQ ID NO: 218536 - RNA, 19 nt, Homo sapiens
gaaaggacacagcuguaca

SEQ ID NO: 218537 - RNA, 19 nt, Homo sapiens
aaagcuauauggauaccuu

SEQ ID NO: 218538 - RNA, 19 nt, Homo sapiens
cuaagggaaugucauaucu

SEQ ID NO: 218539 - RNA, 19 nt, Homo sapiens
gcaaagggcuccaggauuu

SEQ ID NO: 218540 - RNA, 19 nt, Homo sapiens
gcaaacauguccuuagaua

SEQ ID NO: 218541 - RNA, 19 nt, Homo sapiens
gauggaaucuacaggcuua

SEQ ID NO: 218542 - RNA, 19 nt, Homo sapiens
cagaauaacucuccaguau

SEQ ID NO: 218543 - RNA, 19 nt, Homo sapiens
ggaagaagaccaauauuau

SEQ ID NO: 218544 - RNA, 19 nt, Homo sapiens
ggacaaagaugggcaagug

SEQ ID NO: 218545 - RNA, 19 nt, Homo sapiens
gaauaacucuccaguaucu

SEQ ID NO: 218546 - RNA, 19 nt, Homo sapiens
gggaagaagaccaauauua

SEQ ID NO: 218547 - RNA, 19 nt, Homo sapiens
aguguaagcuuccagauua

SEQ ID NO: 218548 - RNA, 19 nt, Homo sapiens
cugaagagcuggaaauuga

SEQ ID NO: 218549 - RNA, 19 nt, Homo sapiens
ggagaugucuauagcuuug

SEQ ID NO: 218550 - RNA, 19 nt, Homo sapiens
gaaaagaccuucuaucaag

SEQ ID NO: 218551 - RNA, 19 nt, Homo sapiens
gcaauauucuagcaacuug

SEQ ID NO: 218552 - RNA, 19 nt, Homo sapiens
aaauggagcugcuacguuu

SEQ ID NO: 218553 - RNA, 19 nt, Homo sapiens
ggaguucgaucaaguuuca

SEQ ID NO: 218554 - RNA, 19 nt, Homo sapiens
gcaaagaaauggacacacu

SEQ ID NO: 218555 - RNA, 19 nt, Homo sapiens
gcuaaagucucgaaacugu

SEQ ID NO: 218556 - RNA, 19 nt, Homo sapiens
ggaaacagcugggacaaag

SEQ ID NO: 218557 - RNA, 19 nt, Homo sapiens
gcacaagccaugaauaaug

SEQ ID NO: 218558 - RNA, 19 nt, Homo sapiens
gaugcaguguugaccauua

SEQ ID NO: 218559 - RNA, 19 nt, Homo sapiens
gaagacauuugggugcaua

SEQ ID NO: 218560 - RNA, 19 nt, Homo sapiens
gggcuugugugaauuauga

SEQ ID NO: 218561 - RNA, 19 nt, Homo sapiens
gcagacagaauucgcauaa

SEQ ID NO: 218562 - RNA, 19 nt, Homo sapiens
gcuuguaacugucaugaaa

SEQ ID NO: 218563 - RNA, 19 nt, Homo sapiens
caagugauguguucgaaau

SEQ ID NO: 218564 - RNA, 19 nt, Homo sapiens
caaaggacccaauagaauu

SEQ ID NO: 218565 - RNA, 19 nt, Homo sapiens
cauagaggaugcaaagaaa

SEQ ID NO: 218566 - RNA, 19 nt, Homo sapiens
ggacuugcgucaugagaau

SEQ ID NO: 218567 - RNA, 19 nt, Homo sapiens
gaggacagauucaaaugga

SEQ ID NO: 218568 - RNA, 19 nt, Homo sapiens
gaggugaaauuccugagaa

SEQ ID NO: 218569 - RNA, 19 nt, Homo sapiens
ccagauggccucaggauuu

SEQ ID NO: 218570 - RNA, 19 nt, Homo sapiens
gaaaggcaguuggugagaa

SEQ ID NO: 218571 - RNA, 19 nt, Homo sapiens
cagauggccucaggauuua

SEQ ID NO: 218572 - RNA, 19 nt, Homo sapiens
cgagggcucucuccaguuu

SEQ ID NO: 218573 - RNA, 19 nt, Homo sapiens
gaaaccuucuggcugauug

SEQ ID NO: 218574 - RNA, 19 nt, Homo sapiens
gaagacauacugacaaauc

SEQ ID NO: 218575 - RNA, 19 nt, Homo sapiens
gauguaacguuuaucaauc

SEQ ID NO: 218576 - RNA, 19 nt, Homo sapiens
ggaaugugcucaugaucug

SEQ ID NO: 218577 - RNA, 19 nt, Homo sapiens
agaggaaucuucuauggaa

SEQ ID NO: 218578 - RNA, 19 nt, Homo sapiens
uagaagacauacugacaaa

SEQ ID NO: 218579 - RNA, 19 nt, Homo sapiens
gaccuuaaguccaucaaau

SEQ ID NO: 218580 - RNA, 19 nt, Homo sapiens
gaucaaaggacccaauaga

SEQ ID NO: 218581 - RNA, 19 nt, Homo sapiens
ggaaagcucacuucaguuc

SEQ ID NO: 218582 - RNA, 19 nt, Homo sapiens
ucucagcacuguuacaauu

SEQ ID NO: 218583 - RNA, 19 nt, Homo sapiens
uaaagggcaugaaguacuu

SEQ ID NO: 218584 - RNA, 19 nt, Homo sapiens
ggaaccaucuacaauucaa

SEQ ID NO: 218585 - RNA, 19 nt, Homo sapiens
gcauaaucaucauguguau

SEQ ID NO: 218586 - RNA, 19 nt, Homo sapiens
caacuuggaagauuugauu

SEQ ID NO: 218587 - RNA, 19 nt, Homo sapiens
gaaauggagcugcuacguu

SEQ ID NO: 218588 - RNA, 19 nt, Homo sapiens
ggucguggaucuucugaau

SEQ ID NO: 218589 - RNA, 19 nt, Homo sapiens
ggacagauucaaauggaaa

SEQ ID NO: 218590 - RNA, 19 nt, Homo sapiens
cagcugagauugcaaacau

SEQ ID NO: 218591 - RNA, 19 nt, Homo sapiens
agacagaauucgcauaauc

SEQ ID NO: 218592 - RNA, 19 nt, Homo sapiens
gaacaacgaccaacuuuug

SEQ ID NO: 218593 - RNA, 19 nt, Homo sapiens
ugagguugcugcgcgauua

SEQ ID NO: 218594 - RNA, 19 nt, Homo sapiens
gcccagauacugcuuguuu

SEQ ID NO: 218595 - RNA, 19 nt, Homo sapiens
gaagagcuggaaauugaaa

SEQ ID NO: 218596 - RNA, 19 nt, Homo sapiens
ggaagucgugccaguguaa

SEQ ID NO: 218597 - RNA, 19 nt, Homo sapiens
gcucuacaguuuaccuuau

SEQ ID NO: 218598 - RNA, 19 nt, Homo sapiens
ucacuucaguucaagaaau

SEQ ID NO: 218599 - RNA, 19 nt, Homo sapiens
ugaaugaccuguacacacu

SEQ ID NO: 218600 - RNA, 19 nt, Homo sapiens
gacaccaacuugaaagaau

SEQ ID NO: 218601 - RNA, 19 nt, Homo sapiens
ggagucauuuccucagaug

SEQ ID NO: 218602 - RNA, 19 nt, Homo sapiens
gcagaauaacucuccagua

SEQ ID NO: 218603 - RNA, 19 nt, Homo sapiens
aaaggcaguuggugagaaa

SEQ ID NO: 218604 - RNA, 19 nt, Homo sapiens
gaucaaguuucaccguugu

SEQ ID NO: 218605 - RNA, 19 nt, Homo sapiens
aaacauguccuuagauauc

SEQ ID NO: 218606 - RNA, 19 nt, Homo sapiens
caggagaugucuauagcuu

SEQ ID NO: 218607 - RNA, 19 nt, Homo sapiens
ggauguaacguuuaucaau

SEQ ID NO: 218608 - RNA, 19 nt, Homo sapiens
uaaggcgucguauaaauaa

SEQ ID NO: 218609 - RNA, 19 nt, Homo sapiens
ugggaaagcucacuucagu

SEQ ID NO: 218610 - RNA, 19 nt, Homo sapiens
gauugcagccuuccaaaga

SEQ ID NO: 218611 - RNA, 19 nt, Homo sapiens
ucguggaucuucugaauga

SEQ ID NO: 218612 - RNA, 19 nt, Homo sapiens
gcagaacaacgaccaacuu

SEQ ID NO: 218613 - RNA, 19 nt, Homo sapiens
gaaugucuccagcugauga

SEQ ID NO: 218614 - RNA, 19 nt, Homo sapiens
ucaaaggacccaauagaau

SEQ ID NO: 218615 - RNA, 19 nt, Homo sapiens
ggacaagacagccaaagca

SEQ ID NO: 218616 - RNA, 19 nt, Homo sapiens
gaauucuacugacuuugga

SEQ ID NO: 218617 - RNA, 19 nt, Homo sapiens
gauggaaccuacgucuuug

SEQ ID NO: 218618 - RNA, 19 nt, Homo sapiens
aggcuuaccuuaucgcauu

SEQ ID NO: 218619 - RNA, 19 nt, Homo sapiens
ggacugaagagcuggaaau

SEQ ID NO: 218620 - RNA, 19 nt, Homo sapiens
gcccugcugucuauuaaug

SEQ ID NO: 218621 - RNA, 19 nt, Homo sapiens
ugauggaaccuacgucuuu

SEQ ID NO: 218622 - RNA, 19 nt, Homo sapiens
cagaaugucuccagcugau

SEQ ID NO: 218623 - RNA, 19 nt, Homo sapiens
cagccucgcuccugggaaa

SEQ ID NO: 218624 - RNA, 19 nt, Homo sapiens
cauuggagaugccuacaug

SEQ ID NO: 218625 - RNA, 19 nt, Homo sapiens
cuagcaacuuggaagauuu

SEQ ID NO: 218626 - RNA, 19 nt, Homo sapiens
agugacagauuauggcuuu

SEQ ID NO: 218627 - RNA, 19 nt, Homo sapiens
gugaauuacuuggcauuug

SEQ ID NO: 218628 - RNA, 19 nt, Homo sapiens
gggcaaaggcacagaggaa

SEQ ID NO: 218629 - RNA, 19 nt, Homo sapiens
ggacaccaacuugaaagaa

SEQ ID NO: 218630 - RNA, 19 nt, Homo sapiens
gaugaggacagauucaaau

SEQ ID NO: 218631 - RNA, 19 nt, Homo sapiens
gcaguuccauggauucaac

SEQ ID NO: 218632 - RNA, 19 nt, Homo sapiens
ugaauuacuuggcauuugg

SEQ ID NO: 218633 - RNA, 19 nt, Homo sapiens
uaacuccagcuaccuauga

SEQ ID NO: 218634 - RNA, 19 nt, Homo sapiens
auaaggcgucguauaaaua

SEQ ID NO: 218635 - RNA, 19 nt, Homo sapiens
gugauucgcuguuuucaaa

SEQ ID NO: 218636 - RNA, 19 nt, Homo sapiens
gaagugccgguccgaauuc

SEQ ID NO: 218637 - RNA, 19 nt, Homo sapiens
uugcaaacauguccuuaga

SEQ ID NO: 218638 - RNA, 19 nt, Homo sapiens
cagaacaacgaccaacuuu

SEQ ID NO: 218639 - RNA, 19 nt, Homo sapiens
gggcugacauccuaauaaa

SEQ ID NO: 218640 - RNA, 19 nt, Homo sapiens
gaggagaacggcaaagauu

SEQ ID NO: 218641 - RNA, 19 nt, Homo sapiens
ugaaggaggcgcucucuga

SEQ ID NO: 218642 - RNA, 19 nt, Homo sapiens
gaccagggcagcagcauug

SEQ ID NO: 218643 - RNA, 19 nt, Homo sapiens
ggacagacccaaacauagc

SEQ ID NO: 218644 - RNA, 19 nt, Homo sapiens
acccagggcugacauccua

SEQ ID NO: 218645 - RNA, 19 nt, Homo sapiens
caucgagcaugccgaguuc

SEQ ID NO: 218646 - RNA, 19 nt, Homo sapiens
ggugaugcagcgugacaua

SEQ ID NO: 218647 - RNA, 19 nt, Homo sapiens
ggagaacggcaaagauuac

SEQ ID NO: 218648 - RNA, 19 nt, Homo sapiens
gaggcgcucucugaggaaa

SEQ ID NO: 218649 - RNA, 19 nt, Homo sapiens
aggagaacggcaaagauua

SEQ ID NO: 218650 - RNA, 19 nt, Homo sapiens
ggaccagggcagcagcauu

SEQ ID NO: 218651 - RNA, 19 nt, Homo sapiens
gaugcagcgugacauagca

SEQ ID NO: 218652 - RNA, 19 nt, Homo sapiens
gcgaggagaacggcaaaga

SEQ ID NO: 218653 - RNA, 19 nt, Homo sapiens
gaggcuugcugucuguucu

SEQ ID NO: 218654 - RNA, 19 nt, Homo sapiens
cggcagcgcaacacugaaa

SEQ ID NO: 218655 - RNA, 19 nt, Homo sapiens
ucgaggacccugugcaaga

SEQ ID NO: 218656 - RNA, 19 nt, Homo sapiens
gcugacauccuaauaaaau

SEQ ID NO: 218657 - RNA, 19 nt, Homo sapiens
ccaugaaccgcaucugugu

SEQ ID NO: 218658 - RNA, 19 nt, Homo sapiens
ucucugaggaaaucaagaa

SEQ ID NO: 218659 - RNA, 19 nt, Homo sapiens
caucaaggccaccgaucug

SEQ ID NO: 218660 - RNA, 19 nt, Homo sapiens
cggcuugcucugcucuuua

SEQ ID NO: 218661 - RNA, 19 nt, Homo sapiens
auggacagacccaaacaua

SEQ ID NO: 218662 - RNA, 19 nt, Homo sapiens
cugaggaaaucaagaaagc

SEQ ID NO: 218663 - RNA, 19 nt, Homo sapiens
ggccaugaaccgcaucugu

SEQ ID NO: 218664 - RNA, 19 nt, Homo sapiens
ggcuucagcgugucccaua

SEQ ID NO: 218665 - RNA, 19 nt, Homo sapiens
ggcuugcucugcucuuuac

SEQ ID NO: 218666 - RNA, 19 nt, Homo sapiens
cgaggagaacggcaaagau

SEQ ID NO: 218667 - RNA, 19 nt, Homo sapiens
ccugaggcuugcugucugu

SEQ ID NO: 218668 - RNA, 19 nt, Homo sapiens
ucaucgagcaugccgaguu

SEQ ID NO: 218669 - RNA, 19 nt, Homo sapiens
gaggugaugcagcgugaca

SEQ ID NO: 218670 - RNA, 19 nt, Homo sapiens
gcaguaaccuguucaaguu

SEQ ID NO: 218671 - RNA, 19 nt, Homo sapiens
acagugggcuggugaauua

SEQ ID NO: 218672 - RNA, 19 nt, Homo sapiens
ccaaguaucccaaggguua

SEQ ID NO: 218673 - RNA, 19 nt, Homo sapiens
gagagauacuggaagauug

SEQ ID NO: 218674 - RNA, 19 nt, Homo sapiens
gaacugguauaagaaguau

SEQ ID NO: 218675 - RNA, 19 nt, Homo sapiens
auaaagaguuggcaugaaa

SEQ ID NO: 218676 - RNA, 19 nt, Homo sapiens
cgagagagauacuggaaga

SEQ ID NO: 218677 - RNA, 19 nt, Homo sapiens
gcagaugugugaccgcuau

SEQ ID NO: 218678 - RNA, 19 nt, Homo sapiens
ggagagcucauuuggaauu

SEQ ID NO: 218679 - RNA, 19 nt, Homo sapiens
cacuaaagguggaaauaaa

SEQ ID NO: 218680 - RNA, 19 nt, Homo sapiens
gagcgaguauggagcagaa

SEQ ID NO: 218681 - RNA, 19 nt, Homo sapiens
gagcaacucuaacuaugca

SEQ ID NO: 218682 - RNA, 19 nt, Homo sapiens
caacaacguuucucugcau

SEQ ID NO: 218683 - RNA, 19 nt, Homo sapiens
uuugagaacugguauaaga

SEQ ID NO: 218684 - RNA, 19 nt, Homo sapiens
ugacugacaccuccaagua

SEQ ID NO: 218685 - RNA, 19 nt, Homo sapiens
gaucuucacucggcagaga

SEQ ID NO: 218686 - RNA, 19 nt, Homo sapiens
uuggagagcucauuuggaa

SEQ ID NO: 218687 - RNA, 19 nt, Homo sapiens
gguauaagaaguaucagaa

SEQ ID NO: 218688 - RNA, 19 nt, Homo sapiens
gagagcucauuuggaauuu

SEQ ID NO: 218689 - RNA, 19 nt, Homo sapiens
uaucagaagcccauuauuc

SEQ ID NO: 218690 - RNA, 19 nt, Homo sapiens
cugccuaucuguauucauu

SEQ ID NO: 218691 - RNA, 19 nt, Homo sapiens
gcacgaacgcccugccuau

SEQ ID NO: 218692 - RNA, 19 nt, Homo sapiens
gugagcaacucuaacuaug

SEQ ID NO: 218693 - RNA, 19 nt, Homo sapiens
caccagggaccauccaaua

SEQ ID NO: 218694 - RNA, 19 nt, Homo sapiens
caagaguggugcugaggau

SEQ ID NO: 218695 - RNA, 19 nt, Homo sapiens
guauggagcagaaacgauu

SEQ ID NO: 218696 - RNA, 19 nt, Homo sapiens
gaaucacuaucgccaucaa

SEQ ID NO: 218697 - RNA, 19 nt, Homo sapiens
cagaggaagugaugcagau

SEQ ID NO: 218698 - RNA, 19 nt, Homo sapiens
ccaguucccuccagcuuca

SEQ ID NO: 218699 - RNA, 19 nt, Homo sapiens
guagccaagucacaauguu

SEQ ID NO: 218700 - RNA, 19 nt, Homo sapiens
ggacccagggccaacuuaa

SEQ ID NO: 218701 - RNA, 19 nt, Homo sapiens
gcagcggucuguacuucug

SEQ ID NO: 218702 - RNA, 19 nt, Homo sapiens
caagggcaguaaccuguuc

SEQ ID NO: 218703 - RNA, 19 nt, Homo sapiens
gagaacugguauaagaagu

SEQ ID NO: 218704 - RNA, 19 nt, Homo sapiens
acacuaaagguggaaauaa

SEQ ID NO: 218705 - RNA, 19 nt, Homo sapiens
cagaagcccauuauucaga

SEQ ID NO: 218706 - RNA, 19 nt, Homo sapiens
gaacacuaaagguggaaau

SEQ ID NO: 218707 - RNA, 19 nt, Homo sapiens
ccaccuacaucgaugacau

SEQ ID NO: 218708 - RNA, 19 nt, Homo sapiens
gcuaugggauuguggucau

SEQ ID NO: 218709 - RNA, 19 nt, Homo sapiens
cgagagugcuggggaauaa

SEQ ID NO: 218710 - RNA, 19 nt, Homo sapiens
ggauccaccucugauguuc

SEQ ID NO: 218711 - RNA, 19 nt, Homo sapiens
guauguggaugugaucugu

SEQ ID NO: 218712 - RNA, 19 nt, Homo sapiens
gcacuguggcugucaccaa

SEQ ID NO: 218713 - RNA, 19 nt, Homo sapiens
aauaaagaguuggcaugaa

SEQ ID NO: 218714 - RNA, 19 nt, Homo sapiens
aaauaaagaguuggcauga

SEQ ID NO: 218715 - RNA, 19 nt, Homo sapiens
ucgacacgcuagagcauga

SEQ ID NO: 218716 - RNA, 19 nt, Homo sapiens
gccaguuccucaucaaugg

SEQ ID NO: 218717 - RNA, 19 nt, Homo sapiens
caagucacaauguuuggaa

SEQ ID NO: 218718 - RNA, 19 nt, Homo sapiens
acaugcaggugauggaaga

SEQ ID NO: 218719 - RNA, 19 nt, Homo sapiens
ggcaguaaccuguucaagu

SEQ ID NO: 218720 - RNA, 19 nt, Homo sapiens
gagcucauuuggaauuuug

SEQ ID NO: 218721 - RNA, 19 nt, Homo sapiens
cgaacgcccugccuaucug

SEQ ID NO: 218722 - RNA, 19 nt, Homo sapiens
acaaagucguggcgaaugg

SEQ ID NO: 218723 - RNA, 19 nt, Homo sapiens
acacgacacccaccaccua

SEQ ID NO: 218724 - RNA, 19 nt, Homo sapiens
ggacugcagcggucuguac

SEQ ID NO: 218725 - RNA, 19 nt, Homo sapiens
agagagauacuggaagauu

SEQ ID NO: 218726 - RNA, 19 nt, Homo sapiens
gcgccgacuucucugacaa

SEQ ID NO: 218727 - RNA, 19 nt, Homo sapiens
caccucugauguucacuga

SEQ ID NO: 218728 - RNA, 19 nt, Homo sapiens
agaacugguauaagaagua

SEQ ID NO: 218729 - RNA, 19 nt, Homo sapiens
agaaucugcuggcuacuac

SEQ ID NO: 218730 - RNA, 19 nt, Homo sapiens
ggaagugcgucuuuuggau

SEQ ID NO: 218731 - RNA, 19 nt, Homo sapiens
gcagugcccauuccuaugc

SEQ ID NO: 218732 - RNA, 19 nt, Homo sapiens
guggucaucuauucuagca

SEQ ID NO: 218733 - RNA, 19 nt, Homo sapiens
uugaacagcuacuacucuu

SEQ ID NO: 218734 - RNA, 19 nt, Homo sapiens
uaacuaugcagcagacaag

SEQ ID NO: 218735 - RNA, 19 nt, Homo sapiens
gcuacuacuugaagauggu

SEQ ID NO: 218736 - RNA, 19 nt, Homo sapiens
gaggaagugaugcagaugu

SEQ ID NO: 218737 - RNA, 19 nt, Homo sapiens
gacagugggcuggugaauu

SEQ ID NO: 218738 - RNA, 19 nt, Homo sapiens
uagccaagucacaauguuu

SEQ ID NO: 218739 - RNA, 19 nt, Homo sapiens
aaacaaagucguggcgaau

SEQ ID NO: 218740 - RNA, 19 nt, Homo sapiens
gcaguucuucaacaacguu

SEQ ID NO: 218741 - RNA, 19 nt, Homo sapiens
gacugacaccuccaaguau

SEQ ID NO: 218742 - RNA, 19 nt, Homo sapiens
cagcuacuacucuugguau

SEQ ID NO: 218743 - RNA, 19 nt, Homo sapiens
uagaaucugcuggcuacua

SEQ ID NO: 218744 - RNA, 19 nt, Homo sapiens
caagagccaguuccucauc

SEQ ID NO: 218745 - RNA, 19 nt, Homo sapiens
cggcagaccagaacguuuc

SEQ ID NO: 218746 - RNA, 19 nt, Homo sapiens
gaauuuugccgauuucaug

SEQ ID NO: 218747 - RNA, 19 nt, Homo sapiens
cacagcagcagaacaagug

SEQ ID NO: 218748 - RNA, 19 nt, Homo sapiens
auguggaugugaucuguuu

SEQ ID NO: 218749 - RNA, 19 nt, Homo sapiens
gcuggcuacuacuugaaga

SEQ ID NO: 218750 - RNA, 19 nt, Homo sapiens
guaaccuguucaaguugga

SEQ ID NO: 218751 - RNA, 19 nt, Homo sapiens
ccacucaguagccaaguca

SEQ ID NO: 218752 - RNA, 19 nt, Homo sapiens
guggaugugaucuguuuga

SEQ ID NO: 218753 - RNA, 19 nt, Homo sapiens
ucugcuggcuacuacuuga

SEQ ID NO: 218754 - RNA, 19 nt, Homo sapiens
gcaggugauggaagaagug

SEQ ID NO: 218755 - RNA, 19 nt, Homo sapiens
gaacgcccugccuaucugu

SEQ ID NO: 218756 - RNA, 19 nt, Homo sapiens
cugcagcggucuguacuuc

SEQ ID NO: 218757 - RNA, 19 nt, Homo sapiens
ucccaaggguuacuuuguc

SEQ ID NO: 218758 - RNA, 19 nt, Homo sapiens
aggaagugaugcagaugug

SEQ ID NO: 218759 - RNA, 19 nt, Homo sapiens
gccugugucugacuucuac

SEQ ID NO: 218760 - RNA, 19 nt, Homo sapiens
ccacagcagcagaacaagu

SEQ ID NO: 218761 - RNA, 19 nt, Homo sapiens
acugacaccuccaaguauc

SEQ ID NO: 218762 - RNA, 19 nt, Homo sapiens
uugccgauuucaugacuga

SEQ ID NO: 218763 - RNA, 19 nt, Homo sapiens
guauaagaaguaucagaag

SEQ ID NO: 218764 - RNA, 19 nt, Homo sapiens
aagagccaguuccucauca

SEQ ID NO: 218765 - RNA, 19 nt, Homo sapiens
aggguuacuuuguccagaa

SEQ ID NO: 218766 - RNA, 19 nt, Homo sapiens
gcuucgaggagcaguggua

SEQ ID NO: 218767 - RNA, 19 nt, Homo sapiens
caggauccaccucugaugu

SEQ ID NO: 218768 - RNA, 19 nt, Homo sapiens
gaguggugcugaggauugg

SEQ ID NO: 218769 - RNA, 19 nt, Homo sapiens
ugugagcaacucuaacuau

SEQ ID NO: 218770 - RNA, 19 nt, Homo sapiens
agaggaaacuugacacuua

SEQ ID NO: 218771 - RNA, 19 nt, Homo sapiens
uaagauggcuguaucaguu

SEQ ID NO: 218772 - RNA, 19 nt, Homo sapiens
caucuaaccuuaaugaaga

SEQ ID NO: 218773 - RNA, 19 nt, Homo sapiens
acacuuaccuccaguagaa

SEQ ID NO: 218774 - RNA, 19 nt, Homo sapiens
ugaagaugcucaccaguuu

SEQ ID NO: 218775 - RNA, 19 nt, Homo sapiens
gcuggucgcuuacacagua

SEQ ID NO: 218776 - RNA, 19 nt, Homo sapiens
guaauucuccuuucaggua

SEQ ID NO: 218777 - RNA, 19 nt, Homo sapiens
cuauuuagcuuguuucaga

SEQ ID NO: 218778 - RNA, 19 nt, Homo sapiens
uaaaugugcuuucagacuu

SEQ ID NO: 218779 - RNA, 19 nt, Homo sapiens
aagcagcaauucuguuaua

SEQ ID NO: 218780 - RNA, 19 nt, Homo sapiens
gaacacauccacuucacaa

SEQ ID NO: 218781 - RNA, 19 nt, Homo sapiens
gucaaaccauggaauuaua

SEQ ID NO: 218782 - RNA, 19 nt, Homo sapiens
gaacagggccaggcugauu

SEQ ID NO: 218783 - RNA, 19 nt, Homo sapiens
aaagacaccugcucauaug

SEQ ID NO: 218784 - RNA, 19 nt, Homo sapiens
uaagcagcaucucuauaua

SEQ ID NO: 218785 - RNA, 19 nt, Homo sapiens
caaagacaccugcucauau

SEQ ID NO: 218786 - RNA, 19 nt, Homo sapiens
guucaguucuggauauuug

SEQ ID NO: 218787 - RNA, 19 nt, Homo sapiens
ugaagcagcaauucuguua

SEQ ID NO: 218788 - RNA, 19 nt, Homo sapiens
aagggaaacucaagauauu

SEQ ID NO: 218789 - RNA, 19 nt, Homo sapiens
caacaacagauaucagaaa

SEQ ID NO: 218790 - RNA, 19 nt, Homo sapiens
gggccaggcugauuauaug

SEQ ID NO: 218791 - RNA, 19 nt, Homo sapiens
gugccaaaguugugcauuu

SEQ ID NO: 218792 - RNA, 19 nt, Homo sapiens
caccugccguuuauuuaua

SEQ ID NO: 218793 - RNA, 19 nt, Homo sapiens
gggaaacucaagauauuaa

SEQ ID NO: 218794 - RNA, 19 nt, Homo sapiens
cagcaauucuguuauaugg

SEQ ID NO: 218795 - RNA, 19 nt, Homo sapiens
gacaccugcucauauguaa

SEQ ID NO: 218796 - RNA, 19 nt, Homo sapiens
guaagggaaacucaagaua

SEQ ID NO: 218797 - RNA, 19 nt, Homo sapiens
gcugagugauucauaaaca

SEQ ID NO: 218798 - RNA, 19 nt, Homo sapiens
ucaaagacaccugcucaua

SEQ ID NO: 218799 - RNA, 19 nt, Homo sapiens
acaaucagcuguugcaucu

SEQ ID NO: 218800 - RNA, 19 nt, Homo sapiens
uaagggaaacucaagauau

SEQ ID NO: 218801 - RNA, 19 nt, Homo sapiens
cuaagcagcaucucuauau

SEQ ID NO: 218802 - RNA, 19 nt, Homo sapiens
gcagauuccuuugacaaca

SEQ ID NO: 218803 - RNA, 19 nt, Homo sapiens
aaucagcuguugcaucuug

SEQ ID NO: 218804 - RNA, 19 nt, Homo sapiens
ggagccauaucacaucugu

SEQ ID NO: 218805 - RNA, 19 nt, Homo sapiens
gcagcaccaugacagauca

SEQ ID NO: 218806 - RNA, 19 nt, Homo sapiens
caugacagaucaggccuuu

SEQ ID NO: 218807 - RNA, 19 nt, Homo sapiens
gaguguaauucuccuuuca

SEQ ID NO: 218808 - RNA, 19 nt, Homo sapiens
gaaauucucacuuuuguug

SEQ ID NO: 218809 - RNA, 19 nt, Homo sapiens
gaggaaacuugacacuuac

SEQ ID NO: 218810 - RNA, 19 nt, Homo sapiens
gagcagauuccuuugacaa

SEQ ID NO: 218811 - RNA, 19 nt, Homo sapiens
guuccuugcuugcuuguug

SEQ ID NO: 218812 - RNA, 19 nt, Homo sapiens
gagucaaaccauggaauua

SEQ ID NO: 218813 - RNA, 19 nt, Homo sapiens
ugacagaucaggccuuugu

SEQ ID NO: 218814 - RNA, 19 nt, Homo sapiens
guccugggaucaucucuga

SEQ ID NO: 218815 - RNA, 19 nt, Homo sapiens
uaauucuccuuucagguaa

SEQ ID NO: 218816 - RNA, 19 nt, Homo sapiens
caacagauaucagaaaaca

SEQ ID NO: 218817 - RNA, 19 nt, Homo sapiens
uaaaguguuuggugcaagu

SEQ ID NO: 218818 - RNA, 19 nt, Homo sapiens
uaugggagcagauuccuuu

SEQ ID NO: 218819 - RNA, 19 nt, Homo sapiens
gcaucucuauauacuccua

SEQ ID NO: 218820 - RNA, 19 nt, Homo sapiens
gaccaaggcauacugaaca

SEQ ID NO: 218821 - RNA, 19 nt, Homo sapiens
gauauuaagauggcuguau

SEQ ID NO: 218822 - RNA, 19 nt, Homo sapiens
aaacgaugccuacgccaaa

SEQ ID NO: 218823 - RNA, 19 nt, Homo sapiens
gcaacaacagauaucagaa

SEQ ID NO: 218824 - RNA, 19 nt, Homo sapiens
ccagagugagugaguguaa

SEQ ID NO: 218825 - RNA, 19 nt, Homo sapiens
ucacgagaccugaauuuua

SEQ ID NO: 218826 - RNA, 19 nt, Homo sapiens
caaaguaagggaaacucaa

SEQ ID NO: 218827 - RNA, 19 nt, Homo sapiens
gcagcaauucuguuauaug

SEQ ID NO: 218828 - RNA, 19 nt, Homo sapiens
uaccucugcuucaacaauu

SEQ ID NO: 218829 - RNA, 19 nt, Homo sapiens
gcaguggcacccuguacaa

SEQ ID NO: 218830 - RNA, 19 nt, Homo sapiens
gcuagagguuuucauuaaa

SEQ ID NO: 218831 - RNA, 19 nt, Homo sapiens
gacagucuuugaugaaguc

SEQ ID NO: 218832 - RNA, 19 nt, Homo sapiens
cgagucaaaccauggaauu

SEQ ID NO: 218833 - RNA, 19 nt, Homo sapiens
ggcaacaacagauaucaga

SEQ ID NO: 218834 - RNA, 19 nt, Homo sapiens
uggccugacugcuucaauu

SEQ ID NO: 218835 - RNA, 19 nt, Homo sapiens
cugccaacauacaaaguaa

SEQ ID NO: 218836 - RNA, 19 nt, Homo sapiens
aaaugugcuuucagacuug

SEQ ID NO: 218837 - RNA, 19 nt, Homo sapiens
ggaacaucuuuaccaccaa

SEQ ID NO: 218838 - RNA, 19 nt, Homo sapiens
ccauggaauuauacuuaug

SEQ ID NO: 218839 - RNA, 19 nt, Homo sapiens
caguaaggcagcaugcuaa

SEQ ID NO: 218840 - RNA, 19 nt, Homo sapiens
cugcagagccugguucaaa

SEQ ID NO: 218841 - RNA, 19 nt, Homo sapiens
ggagcagauuccuuugaca

SEQ ID NO: 218842 - RNA, 19 nt, Homo sapiens
guaaaugugcuuucagacu

SEQ ID NO: 218843 - RNA, 19 nt, Homo sapiens
cuccacugcuggucgcuua

SEQ ID NO: 218844 - RNA, 19 nt, Homo sapiens
gaagcagcaauucuguuau

SEQ ID NO: 218845 - RNA, 19 nt, Homo sapiens
gggagcagauuccuuugac

SEQ ID NO: 218846 - RNA, 19 nt, Homo sapiens
agacaccugcucauaugua

SEQ ID NO: 218847 - RNA, 19 nt, Homo sapiens
ggacgagucaaaccaugga

SEQ ID NO: 218848 - RNA, 19 nt, Homo sapiens
uguugcaucuugcuucuga

SEQ ID NO: 218849 - RNA, 19 nt, Homo sapiens
caaaauguguauucaugga

SEQ ID NO: 218850 - RNA, 19 nt, Homo sapiens
uaaugaagaggccagaguu

SEQ ID NO: 218851 - RNA, 19 nt, Homo sapiens
gggaucaucucugaaacag

SEQ ID NO: 218852 - RNA, 19 nt, Homo sapiens
gggcaaaaguugugaagca

SEQ ID NO: 218853 - RNA, 19 nt, Homo sapiens
uagaaaggaagaugucuca

SEQ ID NO: 218854 - RNA, 19 nt, Homo sapiens
uggcgauucugcucaucua

SEQ ID NO: 218855 - RNA, 19 nt, Homo sapiens
gaaaauagcaguguguucu

SEQ ID NO: 218856 - RNA, 19 nt, Homo sapiens
uggcaucuguuccuugcuu

SEQ ID NO: 218857 - RNA, 19 nt, Homo sapiens
cagauuccuuugacaacau

SEQ ID NO: 218858 - RNA, 19 nt, Homo sapiens
gauuauaugggagcagauu

SEQ ID NO: 218859 - RNA, 19 nt, Homo sapiens
uacacuggcuuucucuugu

SEQ ID NO: 218860 - RNA, 19 nt, Homo sapiens
ggaccaaggcauacugaac

SEQ ID NO: 218861 - RNA, 19 nt, Homo sapiens
gacauggcaucuguuccuu

SEQ ID NO: 218862 - RNA, 19 nt, Homo sapiens
ggcuguaucaguucuuaaa

SEQ ID NO: 218863 - RNA, 19 nt, Homo sapiens
ggaaggaacgaugggaaca

SEQ ID NO: 218864 - RNA, 19 nt, Homo sapiens
acuccuaccucccggcauu

SEQ ID NO: 218865 - RNA, 19 nt, Homo sapiens
ccuaagcagcaucucuaua

SEQ ID NO: 218866 - RNA, 19 nt, Homo sapiens
ccugggaucaucucugaaa

SEQ ID NO: 218867 - RNA, 19 nt, Homo sapiens
gguccuagcaaauauugau

SEQ ID NO: 218868 - RNA, 19 nt, Homo sapiens
acaguaaggcagcaugcua

SEQ ID NO: 218869 - RNA, 19 nt, Homo sapiens
gcacagccguuuguauccu

SEQ ID NO: 218870 - RNA, 19 nt, Homo sapiens
acagaaagcucaacucuaa

SEQ ID NO: 218871 - RNA, 19 nt, Homo sapiens
gaacaggcaagauauaaua

SEQ ID NO: 218872 - RNA, 19 nt, Homo sapiens
ggaacgauccucuuaauuu

SEQ ID NO: 218873 - RNA, 19 nt, Homo sapiens
gaacgauccucuuaauuuc

SEQ ID NO: 218874 - RNA, 19 nt, Homo sapiens
gagugaaugugccuucuua

SEQ ID NO: 218875 - RNA, 19 nt, Homo sapiens
gaacuuacgaccuuucuuu

SEQ ID NO: 218876 - RNA, 19 nt, Homo sapiens
ggaaauugcuuuaaaccau

SEQ ID NO: 218877 - RNA, 19 nt, Homo sapiens
ggaaagaacacaaagaaga

SEQ ID NO: 218878 - RNA, 19 nt, Homo sapiens
ggugauggcugguguuauu

SEQ ID NO: 218879 - RNA, 19 nt, Homo sapiens
aaccagagcuacagaauuu

SEQ ID NO: 218880 - RNA, 19 nt, Homo sapiens
gagaggaaaugaagccaaa

SEQ ID NO: 218881 - RNA, 19 nt, Homo sapiens
caagagagggugagauuaa

SEQ ID NO: 218882 - RNA, 19 nt, Homo sapiens
ggagaaaggguacaacuug

SEQ ID NO: 218883 - RNA, 19 nt, Homo sapiens
caauuucucuguacuucua

SEQ ID NO: 218884 - RNA, 19 nt, Homo sapiens
acacuaaaguccuaucauu

SEQ ID NO: 218885 - RNA, 19 nt, Homo sapiens
gguauucgccgacugauaa

SEQ ID NO: 218886 - RNA, 19 nt, Homo sapiens
ccagagauaacacucauua

SEQ ID NO: 218887 - RNA, 19 nt, Homo sapiens
ugaaauaccuagaugaagu

SEQ ID NO: 218888 - RNA, 19 nt, Homo sapiens
cuaaaggacugugacuaua

SEQ ID NO: 218889 - RNA, 19 nt, Homo sapiens
gcacaaacgggacacauau

SEQ ID NO: 218890 - RNA, 19 nt, Homo sapiens
gaccauuucccuuguauuu

SEQ ID NO: 218891 - RNA, 19 nt, Homo sapiens
gaagagagaggaaaugaag

SEQ ID NO: 218892 - RNA, 19 nt, Homo sapiens
cgacagacuggguaauuua

SEQ ID NO: 218893 - RNA, 19 nt, Homo sapiens
acacaaacacacacauuua

SEQ ID NO: 218894 - RNA, 19 nt, Homo sapiens
gaaaugccauacacacaca

SEQ ID NO: 218895 - RNA, 19 nt, Homo sapiens
uuauauaccugccuaaguu

SEQ ID NO: 218896 - RNA, 19 nt, Homo sapiens
cuuacgaccuuucuuuaua

SEQ ID NO: 218897 - RNA, 19 nt, Homo sapiens
gacaagugaucaaugagaa

SEQ ID NO: 218898 - RNA, 19 nt, Homo sapiens
agagacaagugaucaauga

SEQ ID NO: 218899 - RNA, 19 nt, Homo sapiens
uauaaggcguuacuacauu

SEQ ID NO: 218900 - RNA, 19 nt, Homo sapiens
gaagagaucagagugaaug

SEQ ID NO: 218901 - RNA, 19 nt, Homo sapiens
ccaaacacauccuuucauc

SEQ ID NO: 218902 - RNA, 19 nt, Homo sapiens
gaaugugccuucuuaacca

SEQ ID NO: 218903 - RNA, 19 nt, Homo sapiens
gagaauggaguccucauga

SEQ ID NO: 218904 - RNA, 19 nt, Homo sapiens
gaaaugaagccaaacacau

SEQ ID NO: 218905 - RNA, 19 nt, Homo sapiens
ugccuaaguuguacaauuu

SEQ ID NO: 218906 - RNA, 19 nt, Homo sapiens
gaacacaaagaagacauaa

SEQ ID NO: 218907 - RNA, 19 nt, Homo sapiens
acacaaagaagacauaaga

SEQ ID NO: 218908 - RNA, 19 nt, Homo sapiens
gaaauaccuagaugaaguu

SEQ ID NO: 218909 - RNA, 19 nt, Homo sapiens
ggaaccagcucaugaucuc

SEQ ID NO: 218910 - RNA, 19 nt, Homo sapiens
gaauucaucuacguuuguu

SEQ ID NO: 218911 - RNA, 19 nt, Homo sapiens
caaagaagacauaagacuu

SEQ ID NO: 218912 - RNA, 19 nt, Homo sapiens
gaccuaaucgugaccuuaa

SEQ ID NO: 218913 - RNA, 19 nt, Homo sapiens
gagaaucuguucaccaaac

SEQ ID NO: 218914 - RNA, 19 nt, Homo sapiens
gcacugacaucugccuugu

SEQ ID NO: 218915 - RNA, 19 nt, Homo sapiens
acugacaucugccuuguaa

SEQ ID NO: 218916 - RNA, 19 nt, Homo sapiens
ugaugauucugucaaauga

SEQ ID NO: 218917 - RNA, 19 nt, Homo sapiens
caaaccaaauguggaaaga

SEQ ID NO: 218918 - RNA, 19 nt, Homo sapiens
cgaaucagcaaugaaauuu

SEQ ID NO: 218919 - RNA, 19 nt, Homo sapiens
gaagcccauucccucuaua

SEQ ID NO: 218920 - RNA, 19 nt, Homo sapiens
gagucugguuucauuguuu

SEQ ID NO: 218921 - RNA, 19 nt, Homo sapiens
caaaugaaaggcuugaaau

SEQ ID NO: 218922 - RNA, 19 nt, Homo sapiens
gcucaacucuaaauucaac

SEQ ID NO: 218923 - RNA, 19 nt, Homo sapiens
aagcucaacucuaaauuca

SEQ ID NO: 218924 - RNA, 19 nt, Homo sapiens
cugaaagaguuauuuguug

SEQ ID NO: 218925 - RNA, 19 nt, Homo sapiens
caaacacacacauuuauca

SEQ ID NO: 218926 - RNA, 19 nt, Homo sapiens
uaaagcuuaugcucagaaa

SEQ ID NO: 218927 - RNA, 19 nt, Homo sapiens
acaaauguuuccuugaaug

SEQ ID NO: 218928 - RNA, 19 nt, Homo sapiens
ugacccaaaugccaaggua

SEQ ID NO: 218929 - RNA, 19 nt, Homo sapiens
gaaagcucaacucuaaauu

SEQ ID NO: 218930 - RNA, 19 nt, Homo sapiens
uccuagagcucaugaaguu

SEQ ID NO: 218931 - RNA, 19 nt, Homo sapiens
acacagacgugccuuuaag

SEQ ID NO: 218932 - RNA, 19 nt, Homo sapiens
ugacacagacgugccuuua

SEQ ID NO: 218933 - RNA, 19 nt, Homo sapiens
ggguacaacuugcccauca

SEQ ID NO: 218934 - RNA, 19 nt, Homo sapiens
acacauccuuucaucagaa

SEQ ID NO: 218935 - RNA, 19 nt, Homo sapiens
gaaccuucuuacugcauga

SEQ ID NO: 218936 - RNA, 19 nt, Homo sapiens
gucccaguuucucuuauua

SEQ ID NO: 218937 - RNA, 19 nt, Homo sapiens
gacaugcaggugaauauuu

SEQ ID NO: 218938 - RNA, 19 nt, Homo sapiens
guagaguuaucccggagaa

SEQ ID NO: 218939 - RNA, 19 nt, Homo sapiens
cacaaagaguuacaucuca

SEQ ID NO: 218940 - RNA, 19 nt, Homo sapiens
gaaagaacacaaagaagac

SEQ ID NO: 218941 - RNA, 19 nt, Homo sapiens
gcuacagaauuuagugaau

SEQ ID NO: 218942 - RNA, 19 nt, Homo sapiens
ggaaaugaagccaaacaca

SEQ ID NO: 218943 - RNA, 19 nt, Homo sapiens
gcucagaaaugccauacac

SEQ ID NO: 218944 - RNA, 19 nt, Homo sapiens
ugaaugucuuagccaauuu

SEQ ID NO: 218945 - RNA, 19 nt, Homo sapiens
ggacaugcaggugaauauu

SEQ ID NO: 218946 - RNA, 19 nt, Homo sapiens
auaccuagaugaaguuuag

SEQ ID NO: 218947 - RNA, 19 nt, Homo sapiens
gaucucaggauguauggaa

SEQ ID NO: 218948 - RNA, 19 nt, Homo sapiens
guggaaagaacacaaagaa

SEQ ID NO: 218949 - RNA, 19 nt, Homo sapiens
gacaaaugauacgcacaaa

SEQ ID NO: 218950 - RNA, 19 nt, Homo sapiens
auaaggcguuacuacauuu

SEQ ID NO: 218951 - RNA, 19 nt, Homo sapiens
ccaauuuucugcuacuaua

SEQ ID NO: 218952 - RNA, 19 nt, Homo sapiens
gcaugguaacagaaauuua

SEQ ID NO: 218953 - RNA, 19 nt, Homo sapiens
gaagaggaaaccggagaaa

SEQ ID NO: 218954 - RNA, 19 nt, Homo sapiens
gacagacuggguaauuuaa

SEQ ID NO: 218955 - RNA, 19 nt, Homo sapiens
cugcuacuauaacagaaua

SEQ ID NO: 218956 - RNA, 19 nt, Homo sapiens
agaguuacaucucaucaca

SEQ ID NO: 218957 - RNA, 19 nt, Homo sapiens
gcacuaacuucaggaacca

SEQ ID NO: 218958 - RNA, 19 nt, Homo sapiens
gaaaggcuugaaauaccua

SEQ ID NO: 218959 - RNA, 19 nt, Homo sapiens
gaaccagagauaacacuca

SEQ ID NO: 218960 - RNA, 19 nt, Homo sapiens
guuguacaauuucagaaug

SEQ ID NO: 218961 - RNA, 19 nt, Homo sapiens
gaagccaaacacauccuuu

SEQ ID NO: 218962 - RNA, 19 nt, Homo sapiens
uaacagaaagcucaacucu

SEQ ID NO: 218963 - RNA, 19 nt, Homo sapiens
ucacugaagcuucgauuuc

SEQ ID NO: 218964 - RNA, 19 nt, Homo sapiens
aaaguccuaucauucauuc

SEQ ID NO: 218965 - RNA, 19 nt, Homo sapiens
ccacugaaagaguuauuug

SEQ ID NO: 218966 - RNA, 19 nt, Homo sapiens
guacaacuugcccaucauu

SEQ ID NO: 218967 - RNA, 19 nt, Homo sapiens
gccuuuaaguucuguugaa

SEQ ID NO: 218968 - RNA, 19 nt, Homo sapiens
ccaagcaauuucucuguac

SEQ ID NO: 218969 - RNA, 19 nt, Homo sapiens
uaaccagagcuacagaauu

SEQ ID NO: 218970 - RNA, 19 nt, Homo sapiens
ggaacgauccucuuaauuu

SEQ ID NO: 218971 - RNA, 19 nt, Homo sapiens
gaacgauccucuuaauuuc

SEQ ID NO: 218972 - RNA, 19 nt, Homo sapiens
ugugauggcugguauuauu

SEQ ID NO: 218973 - RNA, 19 nt, Homo sapiens
gauaaaggcaugaggaugu

SEQ ID NO: 218974 - RNA, 19 nt, Homo sapiens
ggagaaacgggacaacuug

SEQ ID NO: 218975 - RNA, 19 nt, Homo sapiens
ggaaccagcucaugaucuc

SEQ ID NO: 218976 - RNA, 19 nt, Homo sapiens
cacaaagaguuacaucuca

SEQ ID NO: 218977 - RNA, 19 nt, Homo sapiens
caacuuguccaucguuuca

SEQ ID NO: 218978 - RNA, 19 nt, Homo sapiens
gaucucaggauguauggaa

SEQ ID NO: 218979 - RNA, 19 nt, Homo sapiens
gcacuaacuucaggaacca

SEQ ID NO: 218980 - RNA, 19 nt, Homo sapiens
agaguuacaucucaucaca

SEQ ID NO: 218981 - RNA, 19 nt, Homo sapiens
uguaccagcuccuguagug

SEQ ID NO: 218982 - RNA, 19 nt, Homo sapiens
gcuauuccuuugcuuaugc

SEQ ID NO: 218983 - RNA, 19 nt, Homo sapiens
cucaugaucucaggaugua

SEQ ID NO: 218984 - RNA, 19 nt, Homo sapiens
acaaagaguuacaucucau

SEQ ID NO: 218985 - RNA, 19 nt, Homo sapiens
uauuggaacgauccucuua

SEQ ID NO: 218986 - RNA, 19 nt, Homo sapiens
ucacaaagaguuacaucuc

SEQ ID NO: 218987 - RNA, 19 nt, Homo sapiens
aguuacaucucaucacaga

SEQ ID NO: 218988 - RNA, 19 nt, Homo sapiens
gcugccugaucuugcgaua

SEQ ID NO: 218989 - RNA, 19 nt, Homo sapiens
uuggaacgauccucuuaau

SEQ ID NO: 218990 - RNA, 19 nt, Homo sapiens
gcucaugaucucaggaugu

SEQ ID NO: 218991 - RNA, 19 nt, Homo sapiens
guccaucguuucacuguac

SEQ ID NO: 218992 - RNA, 19 nt, Homo sapiens
acuguauucucuacuucua

SEQ ID NO: 218993 - RNA, 19 nt, Homo sapiens
ucacagacaaauggagaaa

SEQ ID NO: 218994 - RNA, 19 nt, Homo sapiens
gcaaugcacacuucaaccu

SEQ ID NO: 218995 - RNA, 19 nt, Homo sapiens
acgauccucuuaauuucuu

SEQ ID NO: 218996 - RNA, 19 nt, Homo sapiens
gauggcugguauuauugga

SEQ ID NO: 218997 - RNA, 19 nt, Homo sapiens
acagacaaauggagaaacg

SEQ ID NO: 218998 - RNA, 19 nt, Homo sapiens
uuacaucucaucacagaca

SEQ ID NO: 218999 - RNA, 19 nt, Homo sapiens
acacuucaaccucuucuuc

SEQ ID NO: 219000 - RNA, 19 nt, Homo sapiens
uuacuguauucucuacuuc

SEQ ID NO: 219001 - RNA, 19 nt, Homo sapiens
caaagaguuacaucucauc

SEQ ID NO: 219002 - RNA, 19 nt, Homo sapiens
cugccucacuauuacugua

SEQ ID NO: 219003 - RNA, 19 nt, Homo sapiens
ugugugauggcugguauua

SEQ ID NO: 219004 - RNA, 19 nt, Homo sapiens
caugaucucaggauguaug

SEQ ID NO: 219005 - RNA, 19 nt, Homo sapiens
ugccugaucuugcgauaac

SEQ ID NO: 219006 - RNA, 19 nt, Homo sapiens
ccugcaugcugccuguauu

SEQ ID NO: 219007 - RNA, 19 nt, Homo sapiens
cagcuccuguagugauaau

SEQ ID NO: 219008 - RNA, 19 nt, Homo sapiens
uggagaaacgggacaacuu

SEQ ID NO: 219009 - RNA, 19 nt, Homo sapiens
cuucagucacaaagaguua

SEQ ID NO: 219010 - RNA, 19 nt, Homo sapiens
ccugcuauuccuuugcuua

SEQ ID NO: 219011 - RNA, 19 nt, Homo sapiens
ucaggaaccagcucaugau

SEQ ID NO: 219012 - RNA, 19 nt, Homo sapiens
cacuauuacuguauucucu

SEQ ID NO: 219013 - RNA, 19 nt, Homo sapiens
auaaaggcaugaggaugug

SEQ ID NO: 219014 - RNA, 19 nt, Homo sapiens
gugauggcugguauuauug

SEQ ID NO: 219015 - RNA, 19 nt, Homo sapiens
ucucaucacagacaaaugg

SEQ ID NO: 219016 - RNA, 19 nt, Homo sapiens
ucuccugccucacuauuac

SEQ ID NO: 219017 - RNA, 19 nt, Homo sapiens
accagcuccuguagugaua

SEQ ID NO: 219018 - RNA, 19 nt, Homo sapiens
gccucacuauuacuguauu

SEQ ID NO: 219019 - RNA, 19 nt, Homo sapiens
cgauccucuuaauuucuua

SEQ ID NO: 219020 - RNA, 19 nt, Homo sapiens
ggaaauaagucaucuguau

SEQ ID NO: 219021 - RNA, 19 nt, Homo sapiens
gcacguaccacaccaauga

SEQ ID NO: 219022 - RNA, 19 nt, Homo sapiens
ucagaacgauuggaaauaa

SEQ ID NO: 219023 - RNA, 19 nt, Homo sapiens
ggaauguggucgacgagaa

SEQ ID NO: 219024 - RNA, 19 nt, Homo sapiens
gaaauaagucaucuguaug

SEQ ID NO: 219025 - RNA, 19 nt, Homo sapiens
agagagcacuugauucuuc

SEQ ID NO: 219026 - RNA, 19 nt, Homo sapiens
cgagauagccaccuggaaa

SEQ ID NO: 219027 - RNA, 19 nt, Homo sapiens
gcaaggaaauaagucaucu

SEQ ID NO: 219028 - RNA, 19 nt, Homo sapiens
ggacaacagacuucacuuc

SEQ ID NO: 219029 - RNA, 19 nt, Homo sapiens
cagaacgauuggaaauaaa

SEQ ID NO: 219030 - RNA, 19 nt, Homo sapiens
gaagcaaggaaauaaguca

SEQ ID NO: 219031 - RNA, 19 nt, Homo sapiens
gagaaaaucugggcacaug

SEQ ID NO: 219032 - RNA, 19 nt, Homo sapiens
gcucagaacgauuggaaau

SEQ ID NO: 219033 - RNA, 19 nt, Homo sapiens
agagagagagcacuugauu

SEQ ID NO: 219034 - RNA, 19 nt, Homo sapiens
gcugauaccaccagacaga

SEQ ID NO: 219035 - RNA, 19 nt, Homo sapiens
ggugauagcagcagaaagg

SEQ ID NO: 219036 - RNA, 19 nt, Homo sapiens
ucagcucacuggcaggaaa

SEQ ID NO: 219037 - RNA, 19 nt, Homo sapiens
ccaagaugcuggugauagc

SEQ ID NO: 219038 - RNA, 19 nt, Homo sapiens
ccaccacaaugcauacuac

SEQ ID NO: 219039 - RNA, 19 nt, Homo sapiens
agagagagcacuugauucu

SEQ ID NO: 219040 - RNA, 19 nt, Homo sapiens
gggaagcaaggaaauaagu

SEQ ID NO: 219041 - RNA, 19 nt, Homo sapiens
gagagagagcacuugauuc

SEQ ID NO: 219042 - RNA, 19 nt, Homo sapiens
cgucauugcaggugugauu

SEQ ID NO: 219043 - RNA, 19 nt, Homo sapiens
gaaauguaaccgagcaaaa

SEQ ID NO: 219044 - RNA, 19 nt, Homo sapiens
ccauugauccagcucagaa

SEQ ID NO: 219045 - RNA, 19 nt, Homo sapiens
guaccuuugucugccauug

SEQ ID NO: 219046 - RNA, 19 nt, Homo sapiens
ggaagcaaggaaauaaguc

SEQ ID NO: 219047 - RNA, 19 nt, Homo sapiens
gaauguggucgacgagaag

SEQ ID NO: 219048 - RNA, 19 nt, Homo sapiens
cagcucagaacgauuggaa

SEQ ID NO: 219049 - RNA, 19 nt, Homo sapiens
ggaggacucgcgcuacaag

SEQ ID NO: 219050 - RNA, 19 nt, Homo sapiens
ccuccaagaugcuggugau

SEQ ID NO: 219051 - RNA, 19 nt, Homo sapiens
cuugauucuucccgagaua

SEQ ID NO: 219052 - RNA, 19 nt, Homo sapiens
agagagagagagcacuuga

SEQ ID NO: 219053 - RNA, 19 nt, Homo sapiens
gggcagugcaggacaacau

SEQ ID NO: 219054 - RNA, 19 nt, Homo sapiens
gagauagccaccuggaaac

SEQ ID NO: 219055 - RNA, 19 nt, Homo sapiens
aaggaguacuuuauuugag

SEQ ID NO: 219056 - RNA, 19 nt, Homo sapiens
gcagcagaaaggaguacuu

SEQ ID NO: 219057 - RNA, 19 nt, Homo sapiens
gacccugcccuccaagaug

SEQ ID NO: 219058 - RNA, 19 nt, Homo sapiens
ccuagucucccuccucuuc

SEQ ID NO: 219059 - RNA, 19 nt, Homo sapiens
cagcaggugccagagcuaa

SEQ ID NO: 219060 - RNA, 19 nt, Homo sapiens
aaauaagucaucuguaugc

SEQ ID NO: 219061 - RNA, 19 nt, Homo sapiens
gagagagcacuugauucuu

SEQ ID NO: 219062 - RNA, 19 nt, Homo sapiens
ugaaauguaaccgagcaaa

SEQ ID NO: 219063 - RNA, 19 nt, Homo sapiens
gcagugcaggacaacauca

SEQ ID NO: 219064 - RNA, 19 nt, Homo sapiens
gagagagagagcacuugau

SEQ ID NO: 219065 - RNA, 19 nt, Homo sapiens
aaggaaauaagucaucugu

SEQ ID NO: 219066 - RNA, 19 nt, Homo sapiens
ggccaagggcacggaguuu

SEQ ID NO: 219067 - RNA, 19 nt, Homo sapiens
gccaagggcacggaguuug

SEQ ID NO: 219068 - RNA, 19 nt, Homo sapiens
ggaaauaagucaucuguau

SEQ ID NO: 219069 - RNA, 19 nt, Homo sapiens
gcacguaccacaccaauga

SEQ ID NO: 219070 - RNA, 19 nt, Homo sapiens
ucagaacgauuggaaauaa

SEQ ID NO: 219071 - RNA, 19 nt, Homo sapiens
ggaauguggucgacgagaa

SEQ ID NO: 219072 - RNA, 19 nt, Homo sapiens
gaaauaagucaucuguaug

SEQ ID NO: 219073 - RNA, 19 nt, Homo sapiens
agagagcacuugauucuuc

SEQ ID NO: 219074 - RNA, 19 nt, Homo sapiens
cgagauagccaccuggaaa

SEQ ID NO: 219075 - RNA, 19 nt, Homo sapiens
gcaaggaaauaagucaucu

SEQ ID NO: 219076 - RNA, 19 nt, Homo sapiens
ggacaacagacuucacuuc

SEQ ID NO: 219077 - RNA, 19 nt, Homo sapiens
cagaacgauuggaaauaaa

SEQ ID NO: 219078 - RNA, 19 nt, Homo sapiens
gaagcaaggaaauaaguca

SEQ ID NO: 219079 - RNA, 19 nt, Homo sapiens
gagaaaaucugggcacaug

SEQ ID NO: 219080 - RNA, 19 nt, Homo sapiens
gcucagaacgauuggaaau

SEQ ID NO: 219081 - RNA, 19 nt, Homo sapiens
agagagagagcacuugauu

SEQ ID NO: 219082 - RNA, 19 nt, Homo sapiens
gcugauaccaccagacaga

SEQ ID NO: 219083 - RNA, 19 nt, Homo sapiens
ggugauagcagcagaaagg

SEQ ID NO: 219084 - RNA, 19 nt, Homo sapiens
ucagcucacuggcaggaaa

SEQ ID NO: 219085 - RNA, 19 nt, Homo sapiens
ccaagaugcuggugauagc

SEQ ID NO: 219086 - RNA, 19 nt, Homo sapiens
agagagagcacuugauucu

SEQ ID NO: 219087 - RNA, 19 nt, Homo sapiens
gggaagcaaggaaauaagu

SEQ ID NO: 219088 - RNA, 19 nt, Homo sapiens
gagagagagcacuugauuc

SEQ ID NO: 219089 - RNA, 19 nt, Homo sapiens
cgucauugcaggugugauu

SEQ ID NO: 219090 - RNA, 19 nt, Homo sapiens
gaaauguaaccgagcaaaa

SEQ ID NO: 219091 - RNA, 19 nt, Homo sapiens
ccauugauccagcucagaa

SEQ ID NO: 219092 - RNA, 19 nt, Homo sapiens
guaccuuugucugccauug

SEQ ID NO: 219093 - RNA, 19 nt, Homo sapiens
ggaagcaaggaaauaaguc

SEQ ID NO: 219094 - RNA, 19 nt, Homo sapiens
gaauguggucgacgagaag

SEQ ID NO: 219095 - RNA, 19 nt, Homo sapiens
cagcucagaacgauuggaa

SEQ ID NO: 219096 - RNA, 19 nt, Homo sapiens
ggaggacucgcgcuacaag

SEQ ID NO: 219097 - RNA, 19 nt, Homo sapiens
ccuccaagaugcuggugau

SEQ ID NO: 219098 - RNA, 19 nt, Homo sapiens
cuugauucuucccgagaua

SEQ ID NO: 219099 - RNA, 19 nt, Homo sapiens
agagagagagagcacuuga

SEQ ID NO: 219100 - RNA, 19 nt, Homo sapiens
ccuagucucccuccucuuc

SEQ ID NO: 219101 - RNA, 19 nt, Homo sapiens
gggcagugcaggacaacau

SEQ ID NO: 219102 - RNA, 19 nt, Homo sapiens
gagauagccaccuggaaac

SEQ ID NO: 219103 - RNA, 19 nt, Homo sapiens
aaggaguacuuuauuugag

SEQ ID NO: 219104 - RNA, 19 nt, Homo sapiens
gcagcagaaaggaguacuu

SEQ ID NO: 219105 - RNA, 19 nt, Homo sapiens
gacccugcccuccaagaug

SEQ ID NO: 219106 - RNA, 19 nt, Homo sapiens
cagcaggugccagagcuaa

SEQ ID NO: 219107 - RNA, 19 nt, Homo sapiens
aaauaagucaucuguaugc

SEQ ID NO: 219108 - RNA, 19 nt, Homo sapiens
gagagagcacuugauucuu

SEQ ID NO: 219109 - RNA, 19 nt, Homo sapiens
ugaaauguaaccgagcaaa

SEQ ID NO: 219110 - RNA, 19 nt, Homo sapiens
gcagugcaggacaacauca

SEQ ID NO: 219111 - RNA, 19 nt, Homo sapiens
gagagagagagcacuugau

SEQ ID NO: 219112 - RNA, 19 nt, Homo sapiens
ggccaagggcacggaguuu

SEQ ID NO: 219113 - RNA, 19 nt, Homo sapiens
aaggaaauaagucaucugu

SEQ ID NO: 219114 - RNA, 19 nt, Homo sapiens
gccaagggcacggaguuug

SEQ ID NO: 219115 - RNA, 19 nt, Homo sapiens
ggauaacacucauuaauug

SEQ ID NO: 219116 - RNA, 19 nt, Homo sapiens
ggcgauggcucguguuauu

SEQ ID NO: 219117 - RNA, 19 nt, Homo sapiens
gggauaacacucauuaauu

SEQ ID NO: 219118 - RNA, 19 nt, Homo sapiens
uguauucgaugacugauaa

SEQ ID NO: 219119 - RNA, 19 nt, Homo sapiens
gauaaaggcaugaggaugu

SEQ ID NO: 219120 - RNA, 19 nt, Homo sapiens
ccuguucuccugccuauua

SEQ ID NO: 219121 - RNA, 19 nt, Homo sapiens
ugccugaucuugccuagaa

SEQ ID NO: 219122 - RNA, 19 nt, Homo sapiens
cacaaagaguuacaucuca

SEQ ID NO: 219123 - RNA, 19 nt, Homo sapiens
ggugaugcuuguuguuguu

SEQ ID NO: 219124 - RNA, 19 nt, Homo sapiens
gaucucaggauguauggaa

SEQ ID NO: 219125 - RNA, 19 nt, Homo sapiens
caaaugggauaacacucau

SEQ ID NO: 219126 - RNA, 19 nt, Homo sapiens
gcuguucucuuguuaugca

SEQ ID NO: 219127 - RNA, 19 nt, Homo sapiens
agaguuacaucucaucaca

SEQ ID NO: 219128 - RNA, 19 nt, Homo sapiens
gcuauuccuuugcuuaugc

SEQ ID NO: 219129 - RNA, 19 nt, Homo sapiens
gaggugaugcuuguuguug

SEQ ID NO: 219130 - RNA, 19 nt, Homo sapiens
acaaaugggauaacacuca

SEQ ID NO: 219131 - RNA, 19 nt, Homo sapiens
acaaagaguuacaucucau

SEQ ID NO: 219132 - RNA, 19 nt, Homo sapiens
caccugcuguucucuuguu

SEQ ID NO: 219133 - RNA, 19 nt, Homo sapiens
ucacagacaaaugggauaa

SEQ ID NO: 219134 - RNA, 19 nt, Homo sapiens
uauccuaacucccuguucu

SEQ ID NO: 219135 - RNA, 19 nt, Homo sapiens
ucacaaagaguuacaucuc

SEQ ID NO: 219136 - RNA, 19 nt, Homo sapiens
acagacaaaugggauaaca

SEQ ID NO: 219137 - RNA, 19 nt, Homo sapiens
aguuacaucucaucacaga

SEQ ID NO: 219138 - RNA, 19 nt, Homo sapiens
guuggaaugaucaucuuaa

SEQ ID NO: 219139 - RNA, 19 nt, Homo sapiens
gcgauggcucguguuauuu

SEQ ID NO: 219140 - RNA, 19 nt, Homo sapiens
gauaacacucauuaauugg

SEQ ID NO: 219141 - RNA, 19 nt, Homo sapiens
ucuccugccuauuacugua

SEQ ID NO: 219142 - RNA, 19 nt, Homo sapiens
acuguauucucuacuucua

SEQ ID NO: 219143 - RNA, 19 nt, Homo sapiens
cugcuguucucuuguuaug

SEQ ID NO: 219144 - RNA, 19 nt, Homo sapiens
gaugcuuguuguuguugga

SEQ ID NO: 219145 - RNA, 19 nt, Homo sapiens
ugggauaacacucauuaau

SEQ ID NO: 219146 - RNA, 19 nt, Homo sapiens
uuacaucucaucacagaca

SEQ ID NO: 219147 - RNA, 19 nt, Homo sapiens
uuacuguauucucuacuuc

SEQ ID NO: 219148 - RNA, 19 nt, Homo sapiens
gccuauuacuguauucucu

SEQ ID NO: 219149 - RNA, 19 nt, Homo sapiens
caaagaguuacaucucauc

SEQ ID NO: 219150 - RNA, 19 nt, Homo sapiens
gcuuguuguuguuggaaug

SEQ ID NO: 219151 - RNA, 19 nt, Homo sapiens
cucgugaucucaggaugua

SEQ ID NO: 219152 - RNA, 19 nt, Homo sapiens
ccugcuauuccuuugcuua

SEQ ID NO: 219153 - RNA, 19 nt, Homo sapiens
ucucaucacagacaaaugg

SEQ ID NO: 219154 - RNA, 19 nt, Homo sapiens
auaaaggcaugaggaugug

SEQ ID NO: 219155 - RNA, 19 nt, Homo sapiens
agacaaaugggauaacacu

SEQ ID NO: 219156 - RNA, 19 nt, Homo sapiens
caacgacgcuguccucuuu

SEQ ID NO: 219157 - RNA, 19 nt, Homo sapiens
ggaggaagcuuuaugaauc

SEQ ID NO: 219158 - RNA, 19 nt, Homo sapiens
ugaacaagaugcuggauaa

SEQ ID NO: 219159 - RNA, 19 nt, Homo sapiens
gaagcuuuaugaauccuua

SEQ ID NO: 219160 - RNA, 19 nt, Homo sapiens
ggacaagaccuuauacuuc

SEQ ID NO: 219161 - RNA, 19 nt, Homo sapiens
ccaaugggcugaaugugaa

SEQ ID NO: 219162 - RNA, 19 nt, Homo sapiens
gacaagaccuuauacuucu

SEQ ID NO: 219163 - RNA, 19 nt, Homo sapiens
ccacugcgcucacgucuuc

SEQ ID NO: 219164 - RNA, 19 nt, Homo sapiens
caacugcucugcccacugu

SEQ ID NO: 219165 - RNA, 19 nt, Homo sapiens
gcuaugaguucuccaacaa

SEQ ID NO: 219166 - RNA, 19 nt, Homo sapiens
gaaucggccucuucaauag

SEQ ID NO: 219167 - RNA, 19 nt, Homo sapiens
cgaaucggccucuucaaua

SEQ ID NO: 219168 - RNA, 19 nt, Homo sapiens
caacgcagcggcagucuuu

SEQ ID NO: 219169 - RNA, 19 nt, Homo sapiens
ccacguuacugcauacuga

SEQ ID NO: 219170 - RNA, 19 nt, Homo sapiens
gccaggaaaucugccauua

SEQ ID NO: 219171 - RNA, 19 nt, Homo sapiens
gcucgcagcucaccuccuu

SEQ ID NO: 219172 - RNA, 19 nt, Homo sapiens
acaacaaccuggagaacuu

SEQ ID NO: 219173 - RNA, 19 nt, Homo sapiens
ggacugggaggaugaauuc

SEQ ID NO: 219174 - RNA, 19 nt, Homo sapiens
acaagaugcuggauaagga

SEQ ID NO: 219175 - RNA, 19 nt, Homo sapiens
gcucacgucuucacuacug

SEQ ID NO: 219176 - RNA, 19 nt, Homo sapiens
ggaaaucugccauuacucu

SEQ ID NO: 219177 - RNA, 19 nt, Homo sapiens
cagaugccuuccugucuuu

SEQ ID NO: 219178 - RNA, 19 nt, Homo sapiens
ccagaugccuuccugucuu

SEQ ID NO: 219179 - RNA, 19 nt, Homo sapiens
caggaaaucugccauuacu

SEQ ID NO: 219180 - RNA, 19 nt, Homo sapiens
gaggaaaccagauauugug

SEQ ID NO: 219181 - RNA, 19 nt, Homo sapiens
gaacgcagugcucuucgaa

SEQ ID NO: 219182 - RNA, 19 nt, Homo sapiens
gcgaggagcguaacuaagu

SEQ ID NO: 219183 - RNA, 19 nt, Homo sapiens
caagguggguggcaucuac

SEQ ID NO: 219184 - RNA, 19 nt, Homo sapiens
gguccuggcuucuagaucu

SEQ ID NO: 219185 - RNA, 19 nt, Homo sapiens
gacagugguugccuucuuc

SEQ ID NO: 219186 - RNA, 19 nt, Homo sapiens
caagaggaaaccagauauu

SEQ ID NO: 219187 - RNA, 19 nt, Homo sapiens
ccguguggcuuacaaauuc

SEQ ID NO: 219188 - RNA, 19 nt, Homo sapiens
acacggugcugcagacgaa

SEQ ID NO: 219189 - RNA, 19 nt, Homo sapiens
uucuagaucuggaaccuua

SEQ ID NO: 219190 - RNA, 19 nt, Homo sapiens
uccagaauaugcauaauca

SEQ ID NO: 219191 - RNA, 19 nt, Homo sapiens
uacgguaucuacauucuug

SEQ ID NO: 219192 - RNA, 19 nt, Homo sapiens
guccggagaugagaugaaa

SEQ ID NO: 219193 - RNA, 19 nt, Homo sapiens
acugaucccuuucccauga

SEQ ID NO: 219194 - RNA, 19 nt, Homo sapiens
ucuggaaccuuaccacguu

SEQ ID NO: 219195 - RNA, 19 nt, Homo sapiens
ccacuuggcugcucauucc

SEQ ID NO: 219196 - RNA, 19 nt, Homo sapiens
gugguugccuucuucauca

SEQ ID NO: 219197 - RNA, 19 nt, Homo sapiens
ggcugaaugugaagaaguu

SEQ ID NO: 219198 - RNA, 19 nt, Homo sapiens
gggcgaggagcguaacuaa

SEQ ID NO: 219199 - RNA, 19 nt, Homo sapiens
gggaggaagcuuuaugaau

SEQ ID NO: 219200 - RNA, 19 nt, Homo sapiens
gaccuuauacuucuuuauc

SEQ ID NO: 219201 - RNA, 19 nt, Homo sapiens
ccugggagguggcuaacaa

SEQ ID NO: 219202 - RNA, 19 nt, Homo sapiens
ggagaacgcagugcucuuc

SEQ ID NO: 219203 - RNA, 19 nt, Homo sapiens
cauuucaacuccagaagug

SEQ ID NO: 219204 - RNA, 19 nt, Homo sapiens
cagcuccaguuuccaaguu

SEQ ID NO: 219205 - RNA, 19 nt, Homo sapiens
caacguggaaacccucaaa

SEQ ID NO: 219206 - RNA, 19 nt, Homo sapiens
cagcgcggaccaacaauuu

SEQ ID NO: 219207 - RNA, 19 nt, Homo sapiens
ccuccuuccucuacaguuu

SEQ ID NO: 219208 - RNA, 19 nt, Homo sapiens
agacagugguugccuucuu

SEQ ID NO: 219209 - RNA, 19 nt, Homo sapiens
gcaucuggacuucaacuug

SEQ ID NO: 219210 - RNA, 19 nt, Homo sapiens
cgccagccaugccuuuaaa

SEQ ID NO: 219211 - RNA, 19 nt, Homo sapiens
cccaguaucuccaccaauc

SEQ ID NO: 219212 - RNA, 19 nt, Homo sapiens
ucacuacugugucccagau

SEQ ID NO: 219213 - RNA, 19 nt, Homo sapiens
gcagaucuaccaccgauac

SEQ ID NO: 219214 - RNA, 19 nt, Homo sapiens
gcgcucacgucuucacuac

SEQ ID NO: 219215 - RNA, 19 nt, Homo sapiens
ccgcuugguuugcaguuga

SEQ ID NO: 219216 - RNA, 19 nt, Homo sapiens
cccacaauaugcuggauga

SEQ ID NO: 219217 - RNA, 19 nt, Homo sapiens
gaggaagcuuuaugaaucc

SEQ ID NO: 219218 - RNA, 19 nt, Homo sapiens
caccgauacugcauggaaa

SEQ ID NO: 219219 - RNA, 19 nt, Homo sapiens
gaacuucaacguggacaag

SEQ ID NO: 219220 - RNA, 19 nt, Homo sapiens
gaguuccucuccuccacaa

SEQ ID NO: 219221 - RNA, 19 nt, Homo sapiens
ggggugcggucuugcaaua

SEQ ID NO: 219222 - RNA, 19 nt, Homo sapiens
ccaccgauacugcauggaa

SEQ ID NO: 219223 - RNA, 19 nt, Homo sapiens
gccguggacuucuacaaca

SEQ ID NO: 219224 - RNA, 19 nt, Homo sapiens
gcgccagccaugccuuuaa

SEQ ID NO: 219225 - RNA, 19 nt, Homo sapiens
gcaagggcugcaaggugua

SEQ ID NO: 219226 - RNA, 19 nt, Homo sapiens
ugaggucacuggguucuag

SEQ ID NO: 219227 - RNA, 19 nt, Homo sapiens
caagaugcuggauaaggaa

SEQ ID NO: 219228 - RNA, 19 nt, Homo sapiens
ccaacacggugaaggaaaa

SEQ ID NO: 219229 - RNA, 19 nt, Homo sapiens
uggcucggcucaacuaucu

SEQ ID NO: 219230 - RNA, 19 nt, Homo sapiens
cuuaccacguuacugcaua

SEQ ID NO: 219231 - RNA, 19 nt, Homo sapiens
caagcaagaggugguagaa

SEQ ID NO: 219232 - RNA, 19 nt, Homo sapiens
uuaugaauccuuacugguu

SEQ ID NO: 219233 - RNA, 19 nt, Homo sapiens
gcgcggaccaacaauuuca

SEQ ID NO: 219234 - RNA, 19 nt, Homo sapiens
ggaccagauccuacucuuc

SEQ ID NO: 219235 - RNA, 19 nt, Homo sapiens
gcacuccugaauccacaaa

SEQ ID NO: 219236 - RNA, 19 nt, Homo sapiens
cuaggccgguacuauaugu

SEQ ID NO: 219237 - RNA, 19 nt, Homo sapiens
ugaagaggacacuggauuc

SEQ ID NO: 219238 - RNA, 19 nt, Homo sapiens
ccggcugagugcacgguua

SEQ ID NO: 219239 - RNA, 19 nt, Homo sapiens
gaacaagaugcuggauaag

SEQ ID NO: 219240 - RNA, 19 nt, Homo sapiens
gccaagcugugcgcaaaca

SEQ ID NO: 219241 - RNA, 19 nt, Homo sapiens
caacaauuucaacguggaa

SEQ ID NO: 219242 - RNA, 19 nt, Homo sapiens
ggaccaacaauuucaacgu

SEQ ID NO: 219243 - RNA, 19 nt, Homo sapiens
gaacggcagcgagcagaca

SEQ ID NO: 219244 - RNA, 19 nt, Homo sapiens
agaggaaaccagauauugu

SEQ ID NO: 219245 - RNA, 19 nt, Homo sapiens
aagaggaaaccagauauug

SEQ ID NO: 219246 - RNA, 19 nt, Homo sapiens
ucaagaggaaaccagauau

SEQ ID NO: 219247 - RNA, 19 nt, Homo sapiens
cgaggagcguaacuaaguc

SEQ ID NO: 219248 - RNA, 19 nt, Homo sapiens
cagagcacuucaccuacga

SEQ ID NO: 219249 - RNA, 19 nt, Homo sapiens
acgcagugcucuucgaagu

SEQ ID NO: 219250 - RNA, 19 nt, Homo sapiens
gcucgaauccaggaguuug

SEQ ID NO: 219251 - RNA, 19 nt, Homo sapiens
ugucugcaccgcuugguuu

SEQ ID NO: 219252 - RNA, 19 nt, Homo sapiens
cagauccuacucuuccuuu

SEQ ID NO: 219253 - RNA, 19 nt, Homo sapiens
gcucaccuccuuccucuac

SEQ ID NO: 219254 - RNA, 19 nt, Homo sapiens
gugaggagaagccacaugu

SEQ ID NO: 219255 - RNA, 19 nt, Homo sapiens
caugugugcugugcugugu

SEQ ID NO: 219256 - RNA, 19 nt, Homo sapiens
ccaaacggcuugaauguua

SEQ ID NO: 219257 - RNA, 19 nt, Homo sapiens
gcaaucagcugacuaaguu

SEQ ID NO: 219258 - RNA, 19 nt, Homo sapiens
caaaggagcugacaucuuc

SEQ ID NO: 219259 - RNA, 19 nt, Homo sapiens
gagaaagccugauguaguu

SEQ ID NO: 219260 - RNA, 19 nt, Homo sapiens
gaacuaacaucaccaccaa

SEQ ID NO: 219261 - RNA, 19 nt, Homo sapiens
gaacauaugcugaagagaa

SEQ ID NO: 219262 - RNA, 19 nt, Homo sapiens
gcagugauguggaagauga

SEQ ID NO: 219263 - RNA, 19 nt, Homo sapiens
gaaagggaucgguuaaaua

SEQ ID NO: 219264 - RNA, 19 nt, Homo sapiens
gcugauauuuggaucuuua

SEQ ID NO: 219265 - RNA, 19 nt, Homo sapiens
gaagagaaagccugaugua

SEQ ID NO: 219266 - RNA, 19 nt, Homo sapiens
ggaggcaucuauacuguga

SEQ ID NO: 219267 - RNA, 19 nt, Homo sapiens
aauagaagcugaacauaug

SEQ ID NO: 219268 - RNA, 19 nt, Homo sapiens
ggaauuggacugauccuuu

SEQ ID NO: 219269 - RNA, 19 nt, Homo sapiens
cgacagaaggauuuaaaua

SEQ ID NO: 219270 - RNA, 19 nt, Homo sapiens
ggagauacuuaggcagaua

SEQ ID NO: 219271 - RNA, 19 nt, Homo sapiens
gaauuggacugauccuuuc

SEQ ID NO: 219272 - RNA, 19 nt, Homo sapiens
gaagugaccaauaaaguug

SEQ ID NO: 219273 - RNA, 19 nt, Homo sapiens
gaagagcaguggacgcaau

SEQ ID NO: 219274 - RNA, 19 nt, Homo sapiens
gagcugacaucuuccuaga

SEQ ID NO: 219275 - RNA, 19 nt, Homo sapiens
ggaagugaccaauaaaguu

SEQ ID NO: 219276 - RNA, 19 nt, Homo sapiens
gcaguggacgcaaugaaua

SEQ ID NO: 219277 - RNA, 19 nt, Homo sapiens
gcugacaucuuccuagaau

SEQ ID NO: 219278 - RNA, 19 nt, Homo sapiens
ugacuaaguuucucuaugg

SEQ ID NO: 219279 - RNA, 19 nt, Homo sapiens
gaaauaacagcaauagaag

SEQ ID NO: 219280 - RNA, 19 nt, Homo sapiens
ugaaagggaucgguuaaau

SEQ ID NO: 219281 - RNA, 19 nt, Homo sapiens
gaaaacagcugugggaugu

SEQ ID NO: 219282 - RNA, 19 nt, Homo sapiens
gcacguggcugauccuacu

SEQ ID NO: 219283 - RNA, 19 nt, Homo sapiens
ggagcgagcuuccguucau

SEQ ID NO: 219284 - RNA, 19 nt, Homo sapiens
acaaccaucuugauaaguu

SEQ ID NO: 219285 - RNA, 19 nt, Homo sapiens
uaaaagaggugacagauca

SEQ ID NO: 219286 - RNA, 19 nt, Homo sapiens
caaacggcuugaauguuaa

SEQ ID NO: 219287 - RNA, 19 nt, Homo sapiens
ucaugcagaugguaaauau

SEQ ID NO: 219288 - RNA, 19 nt, Homo sapiens
cauggacuaugaagaguuu

SEQ ID NO: 219289 - RNA, 19 nt, Homo sapiens
caauagaagcugaacauau

SEQ ID NO: 219290 - RNA, 19 nt, Homo sapiens
ccagacaccugacauuaag

SEQ ID NO: 219291 - RNA, 19 nt, Homo sapiens
gaaguugcuugggaaguga

SEQ ID NO: 219292 - RNA, 19 nt, Homo sapiens
aaagggaucgguuaaauau

SEQ ID NO: 219293 - RNA, 19 nt, Homo sapiens
caaccaucuugauaaguuu

SEQ ID NO: 219294 - RNA, 19 nt, Homo sapiens
aagaugaaguggaggauga

SEQ ID NO: 219295 - RNA, 19 nt, Homo sapiens
cuaaguuucucuauggauu

SEQ ID NO: 219296 - RNA, 19 nt, Homo sapiens
caacucagcgacagucauu

SEQ ID NO: 219297 - RNA, 19 nt, Homo sapiens
guacaaggccagaauccaa

SEQ ID NO: 219298 - RNA, 19 nt, Homo sapiens
gcaauagaagcugaacaua

SEQ ID NO: 219299 - RNA, 19 nt, Homo sapiens
guuagagguugucaucuug

SEQ ID NO: 219300 - RNA, 19 nt, Homo sapiens
ggugacagaucaugcagau

SEQ ID NO: 219301 - RNA, 19 nt, Homo sapiens
uggcugauccuacugcuua

SEQ ID NO: 219302 - RNA, 19 nt, Homo sapiens
cggcuugaauguuaagaaa

SEQ ID NO: 219303 - RNA, 19 nt, Homo sapiens
ucagagcagugauguggaa

SEQ ID NO: 219304 - RNA, 19 nt, Homo sapiens
gcagagcuuuuccagauaa

SEQ ID NO: 219305 - RNA, 19 nt, Homo sapiens
aaagcugcauggugaauau

SEQ ID NO: 219306 - RNA, 19 nt, Homo sapiens
gagcagugauguggaagau

SEQ ID NO: 219307 - RNA, 19 nt, Homo sapiens
gccagacaccugacauuaa

SEQ ID NO: 219308 - RNA, 19 nt, Homo sapiens
ucauugcgcucacguguuc

SEQ ID NO: 219309 - RNA, 19 nt, Homo sapiens
uuacugcucuuugaaguug

SEQ ID NO: 219310 - RNA, 19 nt, Homo sapiens
cuacaaccaucuugauaag

SEQ ID NO: 219311 - RNA, 19 nt, Homo sapiens
aaaugaugcugucagaaga

SEQ ID NO: 219312 - RNA, 19 nt, Homo sapiens
aacauaugcugaagagaaa

SEQ ID NO: 219313 - RNA, 19 nt, Homo sapiens
gagauacgaugaggaagag

SEQ ID NO: 219314 - RNA, 19 nt, Homo sapiens
gagaaauuccugaccugaa

SEQ ID NO: 219315 - RNA, 19 nt, Homo sapiens
aaacaaaggagcugacauc

SEQ ID NO: 219316 - RNA, 19 nt, Homo sapiens
agggaucgguuaaauauca

SEQ ID NO: 219317 - RNA, 19 nt, Homo sapiens
ucccaggccuuccucagua

SEQ ID NO: 219318 - RNA, 19 nt, Homo sapiens
auacugugauucagacaaa

SEQ ID NO: 219319 - RNA, 19 nt, Homo sapiens
ugagagauacgaugaggaa

SEQ ID NO: 219320 - RNA, 19 nt, Homo sapiens
uaaaugaugcugucagaag

SEQ ID NO: 219321 - RNA, 19 nt, Homo sapiens
ccagcugaaugcacuguga

SEQ ID NO: 219322 - RNA, 19 nt, Homo sapiens
caacaaccgcacagauaga

SEQ ID NO: 219323 - RNA, 19 nt, Homo sapiens
caucucgacuuugaucuug

SEQ ID NO: 219324 - RNA, 19 nt, Homo sapiens
ucggaggacuguaagaaga

SEQ ID NO: 219325 - RNA, 19 nt, Homo sapiens
ugaaguugcuugggaagug

SEQ ID NO: 219326 - RNA, 19 nt, Homo sapiens
uguaaaugaugcugucaga

SEQ ID NO: 219327 - RNA, 19 nt, Homo sapiens
gcugaaagggaucgguuaa

SEQ ID NO: 219328 - RNA, 19 nt, Homo sapiens
gcacagauagagucaaggu

SEQ ID NO: 219329 - RNA, 19 nt, Homo sapiens
caacguggaaacccugaaa

SEQ ID NO: 219330 - RNA, 19 nt, Homo sapiens
aaaguuggaggcaucuaua

SEQ ID NO: 219331 - RNA, 19 nt, Homo sapiens
gagcgagcuuccguucauu

SEQ ID NO: 219332 - RNA, 19 nt, Homo sapiens
gaccgagaagccaaugaua

SEQ ID NO: 219333 - RNA, 19 nt, Homo sapiens
ucugauagguccauauuuu

SEQ ID NO: 219334 - RNA, 19 nt, Homo sapiens
cagaggaacagaacugaga

SEQ ID NO: 219335 - RNA, 19 nt, Homo sapiens
ggauuggacuuuucaacaa

SEQ ID NO: 219336 - RNA, 19 nt, Homo sapiens
gaaggaaaaguuuggaaaa

SEQ ID NO: 219337 - RNA, 19 nt, Homo sapiens
gaauccuuauccaggcuaa

SEQ ID NO: 219338 - RNA, 19 nt, Homo sapiens
agagaaagccugauguagu

SEQ ID NO: 219339 - RNA, 19 nt, Homo sapiens
ggaguuacugcucuuugaa

SEQ ID NO: 219340 - RNA, 19 nt, Homo sapiens
gugugaaccuguaaaugau

SEQ ID NO: 219341 - RNA, 19 nt, Homo sapiens
uaugaagacucagguggaa

SEQ ID NO: 219342 - RNA, 19 nt, Homo sapiens
gauagagucaaggugauuu

SEQ ID NO: 219343 - RNA, 19 nt, Homo sapiens
cgcacaacaugauugauga

SEQ ID NO: 219344 - RNA, 19 nt, Homo sapiens
cauuaugccugccaagaca

SEQ ID NO: 219345 - RNA, 19 nt, Homo sapiens
cuacacuacuugggaggua

SEQ ID NO: 219346 - RNA, 19 nt, Homo sapiens
gcagugucggcauuccuua

SEQ ID NO: 219347 - RNA, 19 nt, Homo sapiens
ggaagauggcugauagaag

SEQ ID NO: 219348 - RNA, 19 nt, Homo sapiens
agugugaaccuguaaauga

SEQ ID NO: 219349 - RNA, 19 nt, Homo sapiens
gcaucuauacugugauuca

SEQ ID NO: 219350 - RNA, 19 nt, Homo sapiens
gggaagugaccaauaaagu

SEQ ID NO: 219351 - RNA, 19 nt, Homo sapiens
uguuagagguugucaucuu

SEQ ID NO: 219352 - RNA, 19 nt, Homo sapiens
ggaggacuguaagaagaau

SEQ ID NO: 219353 - RNA, 19 nt, Homo sapiens
gggaaaggcagauuuacca

SEQ ID NO: 219354 - RNA, 19 nt, Homo sapiens
ccgagaagccaaugauaug

SEQ ID NO: 219355 - RNA, 19 nt, Homo sapiens
ggaagaggaggcugaaagg

SEQ ID NO: 219356 - RNA, 19 nt, Homo sapiens
ggguuuggcugaagaaauu

SEQ ID NO: 219357 - RNA, 19 nt, Homo sapiens
aaauaaagcuggacuggau

SEQ ID NO: 219358 - RNA, 19 nt, Homo sapiens
gcucaacgaucucuacaca

SEQ ID NO: 219359 - RNA, 19 nt, Homo sapiens
ggaagacgaacaucauuga

SEQ ID NO: 219360 - RNA, 19 nt, Homo sapiens
gcagagaucgccaacaugu

SEQ ID NO: 219361 - RNA, 19 nt, Homo sapiens
gagggugggugaaauaaag

SEQ ID NO: 219362 - RNA, 19 nt, Homo sapiens
cauaguggauggcagauuc

SEQ ID NO: 219363 - RNA, 19 nt, Homo sapiens
caacauuggugucuaugag

SEQ ID NO: 219364 - RNA, 19 nt, Homo sapiens
gaguguauccuccugauga

SEQ ID NO: 219365 - RNA, 19 nt, Homo sapiens
caaccuggcuguggucuca

SEQ ID NO: 219366 - RNA, 19 nt, Homo sapiens
cggcagagaucgccaacau

SEQ ID NO: 219367 - RNA, 19 nt, Homo sapiens
gcagauucguacucaagau

SEQ ID NO: 219368 - RNA, 19 nt, Homo sapiens
guacuuuagugacauugug

SEQ ID NO: 219369 - RNA, 19 nt, Homo sapiens
gauggcagauucguacuca

SEQ ID NO: 219370 - RNA, 19 nt, Homo sapiens
ugaaauaaaggcauacugu

SEQ ID NO: 219371 - RNA, 19 nt, Homo sapiens
cuaguaaccuggaggaucu

SEQ ID NO: 219372 - RNA, 19 nt, Homo sapiens
gaagucacggaacugcaua

SEQ ID NO: 219373 - RNA, 19 nt, Homo sapiens
ucaacgaucucuacacacu

SEQ ID NO: 219374 - RNA, 19 nt, Homo sapiens
caaaccgccugaccugcaa

SEQ ID NO: 219375 - RNA, 19 nt, Homo sapiens
caccaucucugccaugagu

SEQ ID NO: 219376 - RNA, 19 nt, Homo sapiens
gaagacagaccggcugcuu

SEQ ID NO: 219377 - RNA, 19 nt, Homo sapiens
gggaucagcacauagcuau

SEQ ID NO: 219378 - RNA, 19 nt, Homo sapiens
caucauugguucccacgau

SEQ ID NO: 219379 - RNA, 19 nt, Homo sapiens
caucaucaugcaagaagua

SEQ ID NO: 219380 - RNA, 19 nt, Homo sapiens
ugggugaaauaaaggcaua

SEQ ID NO: 219381 - RNA, 19 nt, Homo sapiens
gacaggguuuggcugaaga

SEQ ID NO: 219382 - RNA, 19 nt, Homo sapiens
ggagggugggugaaauaaa

SEQ ID NO: 219383 - RNA, 19 nt, Homo sapiens
ucuacaagguggagacaau

SEQ ID NO: 219384 - RNA, 19 nt, Homo sapiens
gcaucagccugcaggagau

SEQ ID NO: 219385 - RNA, 19 nt, Homo sapiens
ccuucgaccuguucaagaa

SEQ ID NO: 219386 - RNA, 19 nt, Homo sapiens
gagacaggguuuggcugaa

SEQ ID NO: 219387 - RNA, 19 nt, Homo sapiens
aagcuggacuggauguuca

SEQ ID NO: 219388 - RNA, 19 nt, Homo sapiens
uccaggagcuccggcauga

SEQ ID NO: 219389 - RNA, 19 nt, Homo sapiens
ccaagacggccuucuccaa

SEQ ID NO: 219390 - RNA, 19 nt, Homo sapiens
agagaucgccaacauguca

SEQ ID NO: 219391 - RNA, 19 nt, Homo sapiens
ggaccuugcaccguggaua

SEQ ID NO: 219392 - RNA, 19 nt, Homo sapiens
cuacaagguggagacaaua

SEQ ID NO: 219393 - RNA, 19 nt, Homo sapiens
caguggagcccgaguacuu

SEQ ID NO: 219394 - RNA, 19 nt, Homo sapiens
cagaccggcugcuuacaca

SEQ ID NO: 219395 - RNA, 19 nt, Homo sapiens
gcaggucuccccacucuuu

SEQ ID NO: 219396 - RNA, 19 nt, Homo sapiens
aagacagaccggcugcuua

SEQ ID NO: 219397 - RNA, 19 nt, Homo sapiens
uagcuuggccaucaucaug

SEQ ID NO: 219398 - RNA, 19 nt, Homo sapiens
caggagcuccggcaugaga

SEQ ID NO: 219399 - RNA, 19 nt, Homo sapiens
gggagggugggugaaauaa

SEQ ID NO: 219400 - RNA, 19 nt, Homo sapiens
gcagagcagccggaacuuc

SEQ ID NO: 219401 - RNA, 19 nt, Homo sapiens
caucaugcaagaaguagug

SEQ ID NO: 219402 - RNA, 19 nt, Homo sapiens
gucuuuagcuuggccauca

SEQ ID NO: 219403 - RNA, 19 nt, Homo sapiens
gcucagagagaaauaaagc

SEQ ID NO: 219404 - RNA, 19 nt, Homo sapiens
ccuccucgcucagagagaa

SEQ ID NO: 219405 - RNA, 19 nt, Homo sapiens
aauaaaggcauacugucuu

SEQ ID NO: 219406 - RNA, 19 nt, Homo sapiens
aaauaaaggcauacugucu

SEQ ID NO: 219407 - RNA, 19 nt, Homo sapiens
ggauuugugacacugcauu

SEQ ID NO: 219408 - RNA, 19 nt, Homo sapiens
gcagacgcggcuucaacaa

SEQ ID NO: 219409 - RNA, 19 nt, Homo sapiens
ccgcgguacugccuguuug

SEQ ID NO: 219410 - RNA, 19 nt, Homo sapiens
gcgccacugucccucugaa

SEQ ID NO: 219411 - RNA, 19 nt, Homo sapiens
cuacuucacaugcaaaugg

SEQ ID NO: 219412 - RNA, 19 nt, Homo sapiens
gaccggcugcuuacacaga

SEQ ID NO: 219413 - RNA, 19 nt, Homo sapiens
cgaacaucauugacucgau

SEQ ID NO: 219414 - RNA, 19 nt, Homo sapiens
caaccaagacggccuucuc

SEQ ID NO: 219415 - RNA, 19 nt, Homo sapiens
gcugcccucugaccucaau

SEQ ID NO: 219416 - RNA, 19 nt, Homo sapiens
gaucucuacacacucuuug

SEQ ID NO: 219417 - RNA, 19 nt, Homo sapiens
cggaagacgaacaucauug

SEQ ID NO: 219418 - RNA, 19 nt, Homo sapiens
ucaagggaauaagguaucu

SEQ ID NO: 219419 - RNA, 19 nt, Homo sapiens
ggaccuccucgcucagaga

SEQ ID NO: 219420 - RNA, 19 nt, Homo sapiens
gugaggcaccggcuacuuc

SEQ ID NO: 219421 - RNA, 19 nt, Homo sapiens
ugggagggugggugaaaua

SEQ ID NO: 219422 - RNA, 19 nt, Homo sapiens
uaucaagggaauaagguau

SEQ ID NO: 219423 - RNA, 19 nt, Homo sapiens
agacaggguuuggcugaag

SEQ ID NO: 219424 - RNA, 19 nt, Homo sapiens
cuaugacgcggucuucuug

SEQ ID NO: 219425 - RNA, 19 nt, Homo sapiens
gcauccacgugaacuugag

SEQ ID NO: 219426 - RNA, 19 nt, Homo sapiens
aggcaccugucgaguguau

SEQ ID NO: 219427 - RNA, 19 nt, Homo sapiens
cggcugaagucacggaacu

SEQ ID NO: 219428 - RNA, 19 nt, Homo sapiens
guggauaccaggccaugug

SEQ ID NO: 219429 - RNA, 19 nt, Homo sapiens
caacaagcccauccccaaa

SEQ ID NO: 219430 - RNA, 19 nt, Homo sapiens
gagugagcccauugagguu

SEQ ID NO: 219431 - RNA, 19 nt, Homo sapiens
agacagaccggcugcuuac

SEQ ID NO: 219432 - RNA, 19 nt, Homo sapiens
gcauaguggauggcagauu

SEQ ID NO: 219433 - RNA, 19 nt, Homo sapiens
gauuugugacacugcauug

SEQ ID NO: 219434 - RNA, 19 nt, Homo sapiens
gcauugcugggcuguguuc

SEQ ID NO: 219435 - RNA, 19 nt, Homo sapiens
cugcauugcugggcugugu

SEQ ID NO: 219436 - RNA, 19 nt, Homo sapiens
ccacaccuucgaccuguuc

SEQ ID NO: 219437 - RNA, 19 nt, Homo sapiens
caagggagcaguuuaaaua

SEQ ID NO: 219438 - RNA, 19 nt, Homo sapiens
caccucaacuggauaauua

SEQ ID NO: 219439 - RNA, 19 nt, Homo sapiens
ggaagagacucgugcaaug

SEQ ID NO: 219440 - RNA, 19 nt, Homo sapiens
ggaaccaugugccaaguug

SEQ ID NO: 219441 - RNA, 19 nt, Homo sapiens
gcagcucacuguaacuuga

SEQ ID NO: 219442 - RNA, 19 nt, Homo sapiens
cauuuacuguggcuucuua

SEQ ID NO: 219443 - RNA, 19 nt, Homo sapiens
agaaacaccucaacuggau

SEQ ID NO: 219444 - RNA, 19 nt, Homo sapiens
uaaauaaccguuuccuuuc

SEQ ID NO: 219445 - RNA, 19 nt, Homo sapiens
caaagaaacaccucaacug

SEQ ID NO: 219446 - RNA, 19 nt, Homo sapiens
gaaguaacuccucauucaa

SEQ ID NO: 219447 - RNA, 19 nt, Homo sapiens
gaacuccuauagauuucug

SEQ ID NO: 219448 - RNA, 19 nt, Homo sapiens
gcuaauuccugaagauguc

SEQ ID NO: 219449 - RNA, 19 nt, Homo sapiens
aaauaaccguuuccuuuca

SEQ ID NO: 219450 - RNA, 19 nt, Homo sapiens
uaucaagggagcaguuuaa

SEQ ID NO: 219451 - RNA, 19 nt, Homo sapiens
gcaaaagacuggguguuga

SEQ ID NO: 219452 - RNA, 19 nt, Homo sapiens
gaaacaccucaacuggaua

SEQ ID NO: 219453 - RNA, 19 nt, Homo sapiens
ugacugcagcucacuguaa

SEQ ID NO: 219454 - RNA, 19 nt, Homo sapiens
aaacaccucaacuggauaa

SEQ ID NO: 219455 - RNA, 19 nt, Homo sapiens
ggcauccucucucucaguu

SEQ ID NO: 219456 - RNA, 19 nt, Homo sapiens
gaagagacucgugcaaugg

SEQ ID NO: 219457 - RNA, 19 nt, Homo sapiens
caaaacagauaaugcuugu

SEQ ID NO: 219458 - RNA, 19 nt, Homo sapiens
gcaguuuaaauaaccguuu

SEQ ID NO: 219459 - RNA, 19 nt, Homo sapiens
gaagucaauaucaccauca

SEQ ID NO: 219460 - RNA, 19 nt, Homo sapiens
cagauaaugcuuguuaaga

SEQ ID NO: 219461 - RNA, 19 nt, Homo sapiens
uacuuagucuugacagaaa

SEQ ID NO: 219462 - RNA, 19 nt, Homo sapiens
ggacagcagccacaaugag

SEQ ID NO: 219463 - RNA, 19 nt, Homo sapiens
cauccucucucucaguugu

SEQ ID NO: 219464 - RNA, 19 nt, Homo sapiens
acaaauaugugacuauccu

SEQ ID NO: 219465 - RNA, 19 nt, Homo sapiens
gucaauaucaccaucauag

SEQ ID NO: 219466 - RNA, 19 nt, Homo sapiens
aaccguuuccuuucauuua

SEQ ID NO: 219467 - RNA, 19 nt, Homo sapiens
ccuggugucuauauucuuc

SEQ ID NO: 219468 - RNA, 19 nt, Homo sapiens
ugagagaagucaauaucac

SEQ ID NO: 219469 - RNA, 19 nt, Homo sapiens
ugucguuucucuccugcua

SEQ ID NO: 219470 - RNA, 19 nt, Homo sapiens
ccagggaagagccaacaaa

SEQ ID NO: 219471 - RNA, 19 nt, Homo sapiens
uggaggaaaugaaguaacu

SEQ ID NO: 219472 - RNA, 19 nt, Homo sapiens
uacuguggcuucuuaaucu

SEQ ID NO: 219473 - RNA, 19 nt, Homo sapiens
agaaaagucugcaaugauc

SEQ ID NO: 219474 - RNA, 19 nt, Homo sapiens
caguuuaaauaaccguuuc

SEQ ID NO: 219475 - RNA, 19 nt, Homo sapiens
gggagcaguuuaaauaacc

SEQ ID NO: 219476 - RNA, 19 nt, Homo sapiens
ggccuggugucuauauucu

SEQ ID NO: 219477 - RNA, 19 nt, Homo sapiens
ucaccaucauagacagaaa

SEQ ID NO: 219478 - RNA, 19 nt, Homo sapiens
gggaagagccaacaaaaca

SEQ ID NO: 219479 - RNA, 19 nt, Homo sapiens
uaaccguuuccuuucauuu

SEQ ID NO: 219480 - RNA, 19 nt, Homo sapiens
ggaaugaauaugguuugug

SEQ ID NO: 219481 - RNA, 19 nt, Homo sapiens
cuacuuagucuugacagaa

SEQ ID NO: 219482 - RNA, 19 nt, Homo sapiens
aguaacuccucauucaaga

SEQ ID NO: 219483 - RNA, 19 nt, Homo sapiens
ucaagggagcaguuuaaau

SEQ ID NO: 219484 - RNA, 19 nt, Homo sapiens
uauuggaggaaaugaagua

SEQ ID NO: 219485 - RNA, 19 nt, Homo sapiens
aagggagcaguuuaaauaa

SEQ ID NO: 219486 - RNA, 19 nt, Homo sapiens
ccuuuggccuugaaaauaa

SEQ ID NO: 219487 - RNA, 19 nt, Homo sapiens
ucacuuccuuuggccuuga

SEQ ID NO: 219488 - RNA, 19 nt, Homo sapiens
ccugugauuggaaugaaua

SEQ ID NO: 219489 - RNA, 19 nt, Homo sapiens
agucugcaaugaucgaaau

SEQ ID NO: 219490 - RNA, 19 nt, Homo sapiens
ucaauaucaccaucauaga

SEQ ID NO: 219491 - RNA, 19 nt, Homo sapiens
gaugaugugaaaccaggaa

SEQ ID NO: 219492 - RNA, 19 nt, Homo sapiens
gugacuauccuucaucuac

SEQ ID NO: 219493 - RNA, 19 nt, Homo sapiens
gugauuggaaugaauaugg

SEQ ID NO: 219494 - RNA, 19 nt, Homo sapiens
uauccuucaucuaccuaaa

SEQ ID NO: 219495 - RNA, 19 nt, Homo sapiens
caaaaggucccaggucauu

SEQ ID NO: 219496 - RNA, 19 nt, Homo sapiens
gacugcagcucacuguaac

SEQ ID NO: 219497 - RNA, 19 nt, Homo sapiens
cuacaugguccuacuuagu

SEQ ID NO: 219498 - RNA, 19 nt, Homo sapiens
ucaaagaaacaccucaacu

SEQ ID NO: 219499 - RNA, 19 nt, Homo sapiens
caauaucaccaucauagac

SEQ ID NO: 219500 - RNA, 19 nt, Homo sapiens
gaagagccaacaaaacaga

SEQ ID NO: 219501 - RNA, 19 nt, Homo sapiens
cacuguaacuugaacaaaa

SEQ ID NO: 219502 - RNA, 19 nt, Homo sapiens
gggacagcagccacaauga

SEQ ID NO: 219503 - RNA, 19 nt, Homo sapiens
ucuggaagcccuuuguugu

SEQ ID NO: 219504 - RNA, 19 nt, Homo sapiens
cagcagccacaaugaggaa

SEQ ID NO: 219505 - RNA, 19 nt, Homo sapiens
ucaacuggauaauuaugac

SEQ ID NO: 219506 - RNA, 19 nt, Homo sapiens
ugauuggaaugaauauggu

SEQ ID NO: 219507 - RNA, 19 nt, Homo sapiens
aauaaccguuuccuuucau

SEQ ID NO: 219508 - RNA, 19 nt, Homo sapiens
uuacuguggcuucuuaauc

SEQ ID NO: 219509 - RNA, 19 nt, Homo sapiens
ucgugggccuggugucuau

SEQ ID NO: 219510 - RNA, 19 nt, Homo sapiens
ucucucaguugucguuucu

SEQ ID NO: 219511 - RNA, 19 nt, Homo sapiens
ccugcuaauuccugaagau

SEQ ID NO: 219512 - RNA, 19 nt, Homo sapiens
uggaaugaauaugguuugu

SEQ ID NO: 219513 - RNA, 19 nt, Homo sapiens
ccuacuuagucuugacaga

SEQ ID NO: 219514 - RNA, 19 nt, Homo sapiens
ucugagagaagucaauauc

SEQ ID NO: 219515 - RNA, 19 nt, Homo sapiens
gugaaaccaggaaccaugu

SEQ ID NO: 219516 - RNA, 19 nt, Homo sapiens
ucuuggggcucacucaaua

SEQ ID NO: 219517 - RNA, 19 nt, Homo sapiens
ucacuguaacuugaacaaa

SEQ ID NO: 219518 - RNA, 19 nt, Homo sapiens
gccagcaacugaauaaaua

SEQ ID NO: 219519 - RNA, 19 nt, Homo sapiens
gccagcaacugaauaaaua

SEQ ID NO: 219520 - RNA, 19 nt, Homo sapiens
cuacauggcuuaucuuaug

SEQ ID NO: 219521 - RNA, 19 nt, Homo sapiens
ggagccaaguccagauuua

SEQ ID NO: 219522 - RNA, 19 nt, Homo sapiens
ggagccaaguccagauuua

SEQ ID NO: 219523 - RNA, 19 nt, Homo sapiens
gaaucugacuuacgccauu

SEQ ID NO: 219524 - RNA, 19 nt, Homo sapiens
gcaccaaagucucaagcuu

SEQ ID NO: 219525 - RNA, 19 nt, Homo sapiens
gagccgacccagcaguuua

SEQ ID NO: 219526 - RNA, 19 nt, Homo sapiens
caugaaacgcuacuaacua

SEQ ID NO: 219527 - RNA, 19 nt, Homo sapiens
gaauaaauaccucuuagcu

SEQ ID NO: 219528 - RNA, 19 nt, Homo sapiens
aaauaccucucccagugua

SEQ ID NO: 219529 - RNA, 19 nt, Homo sapiens
gaagaugacagugcaggaa

SEQ ID NO: 219530 - RNA, 19 nt, Homo sapiens
gcaacaaggcccaggugaa

SEQ ID NO: 219531 - RNA, 19 nt, Homo sapiens
ccacgagccugcaccaaag

SEQ ID NO: 219532 - RNA, 19 nt, Homo sapiens
ccuauaauccuaagaacuu

SEQ ID NO: 219533 - RNA, 19 nt, Homo sapiens
cauccagccuauaauccua

SEQ ID NO: 219534 - RNA, 19 nt, Homo sapiens
uggcuuaucuuaugaucug

SEQ ID NO: 219535 - RNA, 19 nt, Homo sapiens
gaucgaaagugcgaaucug

SEQ ID NO: 219536 - RNA, 19 nt, Homo sapiens
gaagaucgaaagugcgaau

SEQ ID NO: 219537 - RNA, 19 nt, Homo sapiens
caacaaggcccaggugaag

SEQ ID NO: 219538 - RNA, 19 nt, Homo sapiens
gagaggugccagcaacuga

SEQ ID NO: 219539 - RNA, 19 nt, Homo sapiens
gagaggugccagcaacuga

SEQ ID NO: 219540 - RNA, 19 nt, Homo sapiens
cgacaguaccauugaguug

SEQ ID NO: 219541 - RNA, 19 nt, Homo sapiens
aaucugacuuacgccauua

SEQ ID NO: 219542 - RNA, 19 nt, Homo sapiens
cugagaagaugcaaccaau

SEQ ID NO: 219543 - RNA, 19 nt, Homo sapiens
uuuguacacuggauaaaga

SEQ ID NO: 219544 - RNA, 19 nt, Homo sapiens
uacugcagcuggagagaaa

SEQ ID NO: 219545 - RNA, 19 nt, Homo sapiens
ggugccagcaacugaauaa

SEQ ID NO: 219546 - RNA, 19 nt, Homo sapiens
ggugccagcaacugaauaa

SEQ ID NO: 219547 - RNA, 19 nt, Homo sapiens
cuacaagaggugaagauga

SEQ ID NO: 219548 - RNA, 19 nt, Homo sapiens
gaaacgcuacuaacuacag

SEQ ID NO: 219549 - RNA, 19 nt, Homo sapiens
guaaugaaacaccuucucu

SEQ ID NO: 219550 - RNA, 19 nt, Homo sapiens
ugacuuacgccauuauuac

SEQ ID NO: 219551 - RNA, 19 nt, Homo sapiens
uacaagaggugaagaugac

SEQ ID NO: 219552 - RNA, 19 nt, Homo sapiens
cugaauaaauaccucuuag

SEQ ID NO: 219553 - RNA, 19 nt, Homo sapiens
ggaagcuccauaaauguca

SEQ ID NO: 219554 - RNA, 19 nt, Homo sapiens
ccagggcauugucuccuau

SEQ ID NO: 219555 - RNA, 19 nt, Homo sapiens
uacauggcuuaucuuauga

SEQ ID NO: 219556 - RNA, 19 nt, Homo sapiens
gcaguuuaucccugugaaa

SEQ ID NO: 219557 - RNA, 19 nt, Homo sapiens
ggcccacaauaucaaagaa

SEQ ID NO: 219558 - RNA, 19 nt, Homo sapiens
gagaagaugcaaccaaucc

SEQ ID NO: 219559 - RNA, 19 nt, Homo sapiens
acaguaccauugaguugug

SEQ ID NO: 219560 - RNA, 19 nt, Homo sapiens
gugcgguggcuuccugaua

SEQ ID NO: 219561 - RNA, 19 nt, Homo sapiens
cagccuauaauccuaagaa

SEQ ID NO: 219562 - RNA, 19 nt, Homo sapiens
uaaauaccucucccagugu

SEQ ID NO: 219563 - RNA, 19 nt, Homo sapiens
uggggaagcuccauaaaug

SEQ ID NO: 219564 - RNA, 19 nt, Homo sapiens
gggaagcuccauaaauguc

SEQ ID NO: 219565 - RNA, 19 nt, Homo sapiens
augaaacgcuacuaacuac

SEQ ID NO: 219566 - RNA, 19 nt, Homo sapiens
cccagggcauugucuccua

SEQ ID NO: 219567 - RNA, 19 nt, Homo sapiens
agaugacagugcaggaaga

SEQ ID NO: 219568 - RNA, 19 nt, Homo sapiens
cccacaauaucaaagaaca

SEQ ID NO: 219569 - RNA, 19 nt, Homo sapiens
cugacuuacgccauuauua

SEQ ID NO: 219570 - RNA, 19 nt, Homo sapiens
ggagccgacccagcaguuu

SEQ ID NO: 219571 - RNA, 19 nt, Homo sapiens
aaauaccucuuagcugagu

SEQ ID NO: 219572 - RNA, 19 nt, Homo sapiens
guggcuuccugauacaaga

SEQ ID NO: 219573 - RNA, 19 nt, Homo sapiens
guaaaucuggagccaaguc

SEQ ID NO: 219574 - RNA, 19 nt, Homo sapiens
aaccaugaaacgcuacuaa

SEQ ID NO: 219575 - RNA, 19 nt, Homo sapiens
gacaguaccauugaguugu

SEQ ID NO: 219576 - RNA, 19 nt, Homo sapiens
ggagaggugccagcaacug

SEQ ID NO: 219577 - RNA, 19 nt, Homo sapiens
ggagaggugccagcaacug

SEQ ID NO: 219578 - RNA, 19 nt, Homo sapiens
ccaugaaacgcuacuaacu

SEQ ID NO: 219579 - RNA, 19 nt, Homo sapiens
gggcccacaauaucaaaga

SEQ ID NO: 219580 - RNA, 19 nt, Homo sapiens
gcgguggcuuccugauaca

SEQ ID NO: 219581 - RNA, 19 nt, Homo sapiens
ggauaaagaaaaccaugaa

SEQ ID NO: 219582 - RNA, 19 nt, Homo sapiens
gggcauugucuccuaugga

SEQ ID NO: 219583 - RNA, 19 nt, Homo sapiens
ccugauacaagacgacuuc

SEQ ID NO: 219584 - RNA, 19 nt, Homo sapiens
cuaauaugcucgcagguua

SEQ ID NO: 219585 - RNA, 19 nt, Homo sapiens
caauaaacaugucaagaug

SEQ ID NO: 219586 - RNA, 19 nt, Homo sapiens
caucagauccucaaucaaa

SEQ ID NO: 219587 - RNA, 19 nt, Homo sapiens
caucugggcuucuuaaauc

SEQ ID NO: 219588 - RNA, 19 nt, Homo sapiens
ggaaauuauuggagggaaa

SEQ ID NO: 219589 - RNA, 19 nt, Homo sapiens
ccacaaagccuggaaucua

SEQ ID NO: 219590 - RNA, 19 nt, Homo sapiens
aaagaagugucaccucauu

SEQ ID NO: 219591 - RNA, 19 nt, Homo sapiens
gaaugaggccuccaaacaa

SEQ ID NO: 219592 - RNA, 19 nt, Homo sapiens
caauaucgguuuaccaaag

SEQ ID NO: 219593 - RNA, 19 nt, Homo sapiens
acucauguguguuucaaua

SEQ ID NO: 219594 - RNA, 19 nt, Homo sapiens
uggaugcacuugcuucuuu

SEQ ID NO: 219595 - RNA, 19 nt, Homo sapiens
ggucaugaaugugguguug

SEQ ID NO: 219596 - RNA, 19 nt, Homo sapiens
auaccauucucaagaguua

SEQ ID NO: 219597 - RNA, 19 nt, Homo sapiens
aaugaggccuccaaacaaa

SEQ ID NO: 219598 - RNA, 19 nt, Homo sapiens
agaguuggguguaaguaaa

SEQ ID NO: 219599 - RNA, 19 nt, Homo sapiens
cgauccagauucauuaaga

SEQ ID NO: 219600 - RNA, 19 nt, Homo sapiens
ucuuagaucuggaaccaaa

SEQ ID NO: 219601 - RNA, 19 nt, Homo sapiens
ucaagaugcuccacauaag

SEQ ID NO: 219602 - RNA, 19 nt, Homo sapiens
uacaucagauccucaauca

SEQ ID NO: 219603 - RNA, 19 nt, Homo sapiens
guggagguguucugauuga

SEQ ID NO: 219604 - RNA, 19 nt, Homo sapiens
gucaagaugcuccacauaa

SEQ ID NO: 219605 - RNA, 19 nt, Homo sapiens
cacacucucucucaaagaa

SEQ ID NO: 219606 - RNA, 19 nt, Homo sapiens
caagaugcuccacauaaga

SEQ ID NO: 219607 - RNA, 19 nt, Homo sapiens
ucucaagaguuacaucaga

SEQ ID NO: 219608 - RNA, 19 nt, Homo sapiens
cacaaagccuggaaucuac

SEQ ID NO: 219609 - RNA, 19 nt, Homo sapiens
ccaaaggccagaaggauuc

SEQ ID NO: 219610 - RNA, 19 nt, Homo sapiens
ccaccgauccagauucauu

SEQ ID NO: 219611 - RNA, 19 nt, Homo sapiens
ccagauucauuaagaccuu

SEQ ID NO: 219612 - RNA, 19 nt, Homo sapiens
guaaagcagagcacauaug

SEQ ID NO: 219613 - RNA, 19 nt, Homo sapiens
ggaaucuacacccuguuaa

SEQ ID NO: 219614 - RNA, 19 nt, Homo sapiens
gccaauaucgguuuaccaa

SEQ ID NO: 219615 - RNA, 19 nt, Homo sapiens
ccgcaaaacucaauaaaca

SEQ ID NO: 219616 - RNA, 19 nt, Homo sapiens
aacaaacacuggagaucaa

SEQ ID NO: 219617 - RNA, 19 nt, Homo sapiens
aaacaaacacuggagauca

SEQ ID NO: 219618 - RNA, 19 nt, Homo sapiens
agaaugaggccuccaaaca

SEQ ID NO: 219619 - RNA, 19 nt, Homo sapiens
gaaagaagugucaccucau

SEQ ID NO: 219620 - RNA, 19 nt, Homo sapiens
agaaauaccagacuuggau

SEQ ID NO: 219621 - RNA, 19 nt, Homo sapiens
caaagaaugaggccuccaa

SEQ ID NO: 219622 - RNA, 19 nt, Homo sapiens
ccucauuccaggccauuua

SEQ ID NO: 219623 - RNA, 19 nt, Homo sapiens
uaaagcagagcacauaugg

SEQ ID NO: 219624 - RNA, 19 nt, Homo sapiens
ucauguguguuucaauaug

SEQ ID NO: 219625 - RNA, 19 nt, Homo sapiens
gccaaaggccagaaggauu

SEQ ID NO: 219626 - RNA, 19 nt, Homo sapiens
gaucuggaaccaaaugcaa

SEQ ID NO: 219627 - RNA, 19 nt, Homo sapiens
gagaagucacuguuacugu

SEQ ID NO: 219628 - RNA, 19 nt, Homo sapiens
uggaaucuacacccuguua

SEQ ID NO: 219629 - RNA, 19 nt, Homo sapiens
caaaaccucucuuagaucu

SEQ ID NO: 219630 - RNA, 19 nt, Homo sapiens
gcgcacacucucucucaaa

SEQ ID NO: 219631 - RNA, 19 nt, Homo sapiens
gcacacucucucucaaaga

SEQ ID NO: 219632 - RNA, 19 nt, Homo sapiens
gaaauuauuggagggaaag

SEQ ID NO: 219633 - RNA, 19 nt, Homo sapiens
ccacugccaauaucgguuu

SEQ ID NO: 219634 - RNA, 19 nt, Homo sapiens
aaguaaagcagagcacaua

SEQ ID NO: 219635 - RNA, 19 nt, Homo sapiens
caccgauccagauucauua

SEQ ID NO: 219636 - RNA, 19 nt, Homo sapiens
ugacucauguguguuucaa

SEQ ID NO: 219637 - RNA, 19 nt, Homo sapiens
uggcggacaucacguuugu

SEQ ID NO: 219638 - RNA, 19 nt, Homo sapiens
gcaacagccaaaguuacua

SEQ ID NO: 219639 - RNA, 19 nt, Homo sapiens
auaccagacuuggaucaaa

SEQ ID NO: 219640 - RNA, 19 nt, Homo sapiens
cagccaaaguuacuacaac

SEQ ID NO: 219641 - RNA, 19 nt, Homo sapiens
ugacuaaguuuucuuccuu

SEQ ID NO: 219642 - RNA, 19 nt, Homo sapiens
gauccagauucauuaagac

SEQ ID NO: 219643 - RNA, 19 nt, Homo sapiens
gcaaaacucaauaaacaug

SEQ ID NO: 219644 - RNA, 19 nt, Homo sapiens
uuguggagguguucugauu

SEQ ID NO: 219645 - RNA, 19 nt, Homo sapiens
ucacguuuguggagguguu

SEQ ID NO: 219646 - RNA, 19 nt, Homo sapiens
uagaguuggguguaaguaa

SEQ ID NO: 219647 - RNA, 19 nt, Homo sapiens
aaccuugucccgccucaua

SEQ ID NO: 219648 - RNA, 19 nt, Homo sapiens
ucuacacccuguuaaccaa

SEQ ID NO: 219649 - RNA, 19 nt, Homo sapiens
uauagucucuggaggucau

SEQ ID NO: 219650 - RNA, 19 nt, Homo sapiens
ucauuaagaccuucugaca

SEQ ID NO: 219651 - RNA, 19 nt, Homo sapiens
cagauccucaaucaaauga

SEQ ID NO: 219652 - RNA, 19 nt, Homo sapiens
caaacaaacacuggagauc

SEQ ID NO: 219653 - RNA, 19 nt, Homo sapiens
cauguguguuucaauaugg

SEQ ID NO: 219654 - RNA, 19 nt, Homo sapiens
guuacuguccuaagucgaa

SEQ ID NO: 219655 - RNA, 19 nt, Homo sapiens
ccaaacaaacacuggagau

SEQ ID NO: 219656 - RNA, 19 nt, Homo sapiens
cugggcuucuuaaaucuaa

SEQ ID NO: 219657 - RNA, 19 nt, Homo sapiens
ggagguguucugauugauc

SEQ ID NO: 219658 - RNA, 19 nt, Homo sapiens
ucccgccucauacaaauua

SEQ ID NO: 219659 - RNA, 19 nt, Homo sapiens
gaaucuacacccuguuaac

SEQ ID NO: 219660 - RNA, 19 nt, Homo sapiens
caacagccaaaguuacuac

SEQ ID NO: 219661 - RNA, 19 nt, Homo sapiens
ggagccaccgauccagauu

SEQ ID NO: 219662 - RNA, 19 nt, Homo sapiens
cauggucugugcaggagau

SEQ ID NO: 219663 - RNA, 19 nt, Homo sapiens
aaagaaugaggccuccaaa

SEQ ID NO: 219664 - RNA, 19 nt, Homo sapiens
gaucuguaaaggugucuuc

SEQ ID NO: 219665 - RNA, 19 nt, Homo sapiens
cugcgagaagucacuguua

SEQ ID NO: 219666 - RNA, 19 nt, Homo sapiens
ucucuuagaucuggaacca

SEQ ID NO: 219667 - RNA, 19 nt, Homo sapiens
ccaauaucgguuuaccaaa

SEQ ID NO: 219668 - RNA, 19 nt, Homo sapiens
ccuaauaugcucgcagguu

SEQ ID NO: 219669 - RNA, 19 nt, Homo sapiens
ggaugcacuugcuucuuuu

SEQ ID NO: 219670 - RNA, 19 nt, Homo sapiens
ugucaagaugcuccacaua

SEQ ID NO: 219671 - RNA, 19 nt, Homo sapiens
auaaacaugucaagaugcu

SEQ ID NO: 219672 - RNA, 19 nt, Homo sapiens
ucagauccucaaucaaaug

SEQ ID NO: 219673 - RNA, 19 nt, Homo sapiens
gguuagaguuggguguaag

SEQ ID NO: 219674 - RNA, 19 nt, Homo sapiens
agacuuggaucaaaagcaa

SEQ ID NO: 219675 - RNA, 19 nt, Homo sapiens
accaagaaauaccagacuu

SEQ ID NO: 219676 - RNA, 19 nt, Homo sapiens
uccaaaaccucucuuagau

SEQ ID NO: 219677 - RNA, 19 nt, Homo sapiens
cacucucucucaaagaaug

SEQ ID NO: 219678 - RNA, 19 nt, Homo sapiens
caugcugguuuuauucuaa

SEQ ID NO: 219679 - RNA, 19 nt, Homo sapiens
uaccagacuuggaucaaaa

SEQ ID NO: 219680 - RNA, 19 nt, Homo sapiens
cucuggaggucaugaaugu

SEQ ID NO: 219681 - RNA, 19 nt, Homo sapiens
cucaagaguuacaucagau

SEQ ID NO: 219682 - RNA, 19 nt, Homo sapiens
cagguuagaguugggugua

SEQ ID NO: 219683 - RNA, 19 nt, Homo sapiens
guauggcggacaucacguu

SEQ ID NO: 219684 - RNA, 19 nt, Homo sapiens
ggacagggagggaccaaua

SEQ ID NO: 219685 - RNA, 19 nt, Homo sapiens
ggucugcacugacaucuuc

SEQ ID NO: 219686 - RNA, 19 nt, Homo sapiens
ggucucaccuuccacauca

SEQ ID NO: 219687 - RNA, 19 nt, Homo sapiens
ggaccaauaaaucauaaug

SEQ ID NO: 219688 - RNA, 19 nt, Homo sapiens
gagggaccaauaaaucaua

SEQ ID NO: 219689 - RNA, 19 nt, Homo sapiens
gacagggagggaccaauaa

SEQ ID NO: 219690 - RNA, 19 nt, Homo sapiens
gggagggaccaauaaauca

SEQ ID NO: 219691 - RNA, 19 nt, Homo sapiens
gcuccagggucugcacuga

SEQ ID NO: 219692 - RNA, 19 nt, Homo sapiens
cguuggcccugcccaguaa

SEQ ID NO: 219693 - RNA, 19 nt, Homo sapiens
uggccucacugcagagaaa

SEQ ID NO: 219694 - RNA, 19 nt, Homo sapiens
cagcuggacgggaaaguga

SEQ ID NO: 219695 - RNA, 19 nt, Homo sapiens
ggagggaccaauaaaucau

SEQ ID NO: 219696 - RNA, 19 nt, Homo sapiens
ucaguaggcagcuccuuug

SEQ ID NO: 219697 - RNA, 19 nt, Homo sapiens
ccagcacccucgcuacaag

SEQ ID NO: 219698 - RNA, 19 nt, Homo sapiens
agggaccaauaaaucauaa

SEQ ID NO: 219699 - RNA, 19 nt, Homo sapiens
gucaguaggcagcuccuuu

SEQ ID NO: 219700 - RNA, 19 nt, Homo sapiens
gcccguacauggccucacu

SEQ ID NO: 219701 - RNA, 19 nt, Homo sapiens
acagggagggaccaauaaa

SEQ ID NO: 219702 - RNA, 19 nt, Homo sapiens
cgccuuacguguccuggau

SEQ ID NO: 219703 - RNA, 19 nt, Homo sapiens
cagggagggaccaauaaau

SEQ ID NO: 219704 - RNA, 19 nt, Homo sapiens
gaacgaccucgcgcugcuu

SEQ ID NO: 219705 - RNA, 19 nt, Homo sapiens
ucagcaaauucucuuguua

SEQ ID NO: 219706 - RNA, 19 nt, Homo sapiens
gcaacaaccaaucuaauga

SEQ ID NO: 219707 - RNA, 19 nt, Homo sapiens
gcauguguguguuugugua

SEQ ID NO: 219708 - RNA, 19 nt, Homo sapiens
aagaagaagugacaaugaa

SEQ ID NO: 219709 - RNA, 19 nt, Homo sapiens
gccaguccauucagaagua

SEQ ID NO: 219710 - RNA, 19 nt, Homo sapiens
ucaagaaggccaagaagaa

SEQ ID NO: 219711 - RNA, 19 nt, Homo sapiens
caaauucucuuguuaaacc

SEQ ID NO: 219712 - RNA, 19 nt, Homo sapiens
caagaagaagugacaauga

SEQ ID NO: 219713 - RNA, 19 nt, Homo sapiens
gggauuugcuaaguaguuu

SEQ ID NO: 219714 - RNA, 19 nt, Homo sapiens
gacaggauuuggauucuuc

SEQ ID NO: 219715 - RNA, 19 nt, Homo sapiens
caaccaaucuaaugaugag

SEQ ID NO: 219716 - RNA, 19 nt, Homo sapiens
guucugacuuuauaagaga

SEQ ID NO: 219717 - RNA, 19 nt, Homo sapiens
ucaagaagaccaagaagga

SEQ ID NO: 219718 - RNA, 19 nt, Homo sapiens
cagcaaauucucuuguuaa

SEQ ID NO: 219719 - RNA, 19 nt, Homo sapiens
gagguuagcaggaauaucu

SEQ ID NO: 219720 - RNA, 19 nt, Homo sapiens
acaguugucuuucucuuau

SEQ ID NO: 219721 - RNA, 19 nt, Homo sapiens
gaagacacaaggcaguuug

SEQ ID NO: 219722 - RNA, 19 nt, Homo sapiens
cuucuguucugacuuuaua

SEQ ID NO: 219723 - RNA, 19 nt, Homo sapiens
gcaagaagaagugacaaug

SEQ ID NO: 219724 - RNA, 19 nt, Homo sapiens
ggaaaauuuugcugucuuu

SEQ ID NO: 219725 - RNA, 19 nt, Homo sapiens
ccaagaaggaaaucaagaa

SEQ ID NO: 219726 - RNA, 19 nt, Homo sapiens
agaaggaaaucaagaaggu

SEQ ID NO: 219727 - RNA, 19 nt, Homo sapiens
guacaguugucuuucucuu

SEQ ID NO: 219728 - RNA, 19 nt, Homo sapiens
cagaucaaguuguccauca

SEQ ID NO: 219729 - RNA, 19 nt, Homo sapiens
gaagaagugacaaugaagu

SEQ ID NO: 219730 - RNA, 19 nt, Homo sapiens
gccaaggccuccaagaagu

SEQ ID NO: 219731 - RNA, 19 nt, Homo sapiens
gaaggaaaucaagaaggua

SEQ ID NO: 219732 - RNA, 19 nt, Homo sapiens
gagagggaacccaggaauu

SEQ ID NO: 219733 - RNA, 19 nt, Homo sapiens
gaagugacaaugaagucuu

SEQ ID NO: 219734 - RNA, 19 nt, Homo sapiens
ggacagcaacaaccaaucu

SEQ ID NO: 219735 - RNA, 19 nt, Homo sapiens
gcuaguacuuaguuucaca

SEQ ID NO: 219736 - RNA, 19 nt, Homo sapiens
gauggauuguguccuagga

SEQ ID NO: 219737 - RNA, 19 nt, Homo sapiens
caacaaccaaucuaaugau

SEQ ID NO: 219738 - RNA, 19 nt, Homo sapiens
gaagguagccacgccaaag

SEQ ID NO: 219739 - RNA, 19 nt, Homo sapiens
gauuugggauuugcuaagu

SEQ ID NO: 219740 - RNA, 19 nt, Homo sapiens
guuagcaggaauaucuuua

SEQ ID NO: 219741 - RNA, 19 nt, Homo sapiens
ccaaucuaaugaugagaau

SEQ ID NO: 219742 - RNA, 19 nt, Homo sapiens
acaaugaagucuuuucuug

SEQ ID NO: 219743 - RNA, 19 nt, Homo sapiens
ccagucagcuaggauguag

SEQ ID NO: 219744 - RNA, 19 nt, Homo sapiens
ccacagaccaccccaagua

SEQ ID NO: 219745 - RNA, 19 nt, Homo sapiens
aagugacaaugaagucuuu

SEQ ID NO: 219746 - RNA, 19 nt, Homo sapiens
gcagucgauuugggauuug

SEQ ID NO: 219747 - RNA, 19 nt, Homo sapiens
gagaagacacaaggcaguu

SEQ ID NO: 219748 - RNA, 19 nt, Homo sapiens
gcaaggacagcaacaacca

SEQ ID NO: 219749 - RNA, 19 nt, Homo sapiens
gagacaggauuuggauucu

SEQ ID NO: 219750 - RNA, 19 nt, Homo sapiens
uaagagacaggauuuggau

SEQ ID NO: 219751 - RNA, 19 nt, Homo sapiens
caagaagaccaagaaggaa

SEQ ID NO: 219752 - RNA, 19 nt, Homo sapiens
gggcuaguacuuaguuuca

SEQ ID NO: 219753 - RNA, 19 nt, Homo sapiens
ccaguuuccuucucauuuu

SEQ ID NO: 219754 - RNA, 19 nt, Homo sapiens
gagaguuucagaaccuuug

SEQ ID NO: 219755 - RNA, 19 nt, Homo sapiens
gcaaaguccagugccaaga

SEQ ID NO: 219756 - RNA, 19 nt, Homo sapiens
cagugaaacccaaagcaaa

SEQ ID NO: 219757 - RNA, 19 nt, Homo sapiens
cccaggaauugugagguua

SEQ ID NO: 219758 - RNA, 19 nt, Homo sapiens
agagggaacccaggaauug

SEQ ID NO: 219759 - RNA, 19 nt, Homo sapiens
ccagugaaacccaaagcaa

SEQ ID NO: 219760 - RNA, 19 nt, Homo sapiens
ugcagucgauuugggauuu

SEQ ID NO: 219761 - RNA, 19 nt, Homo sapiens
gaggugucuuugcuugguu

SEQ ID NO: 219762 - RNA, 19 nt, Homo sapiens
gggcacccguugugagagu

SEQ ID NO: 219763 - RNA, 19 nt, Homo sapiens
gaauaucuuuagggugagu

SEQ ID NO: 219764 - RNA, 19 nt, Homo sapiens
gcgacgaacccaagaaguc

SEQ ID NO: 219765 - RNA, 19 nt, Homo sapiens
uacaguugucuuucucuua

SEQ ID NO: 219766 - RNA, 19 nt, Homo sapiens
gcaguuuguucuggcuaga

SEQ ID NO: 219767 - RNA, 19 nt, Homo sapiens
caagaaggccaagaagaag

SEQ ID NO: 219768 - RNA, 19 nt, Homo sapiens
caagaaggaaaucaagaag

SEQ ID NO: 219769 - RNA, 19 nt, Homo sapiens
aagaagaccaagaaggaaa

SEQ ID NO: 219770 - RNA, 19 nt, Homo sapiens
ugugcccuguugaaacuua

SEQ ID NO: 219771 - RNA, 19 nt, Homo sapiens
aacaaccaaucuaaugaug

SEQ ID NO: 219772 - RNA, 19 nt, Homo sapiens
cagcaacaaccaaucuaau

SEQ ID NO: 219773 - RNA, 19 nt, Homo sapiens
gacagcaacaaccaaucua

SEQ ID NO: 219774 - RNA, 19 nt, Homo sapiens
ucccuccugucuccuauuu

SEQ ID NO: 219775 - RNA, 19 nt, Homo sapiens
cgacgaacccaagaaguca

SEQ ID NO: 219776 - RNA, 19 nt, Homo sapiens
uguguguguuuguguauau

SEQ ID NO: 219777 - RNA, 19 nt, Homo sapiens
gugcauguguguguuugug

SEQ ID NO: 219778 - RNA, 19 nt, Homo sapiens
gggaacccaggaauuguga

SEQ ID NO: 219779 - RNA, 19 nt, Homo sapiens
gaugcucaccaccaccuuu

SEQ ID NO: 219780 - RNA, 19 nt, Homo sapiens
ccaccgguguccucaagca

SEQ ID NO: 219781 - RNA, 19 nt, Homo sapiens
ccaccaugaccgagaauuc

SEQ ID NO: 219782 - RNA, 19 nt, Homo sapiens
acagcaacaaccaaucuaa

SEQ ID NO: 219783 - RNA, 19 nt, Homo sapiens
agagacaggauuuggauuc

SEQ ID NO: 219784 - RNA, 19 nt, Homo sapiens
guguguguuuguguauaua

SEQ ID NO: 219785 - RNA, 19 nt, Homo sapiens
uagcaggaauaucuuuagg

SEQ ID NO: 219786 - RNA, 19 nt, Homo sapiens
caaguauucagacaugauc

SEQ ID NO: 219787 - RNA, 19 nt, Homo sapiens
agacaggauuuggauucuu

SEQ ID NO: 219788 - RNA, 19 nt, Homo sapiens
gaucaaguuguccaucaag

SEQ ID NO: 219789 - RNA, 19 nt, Homo sapiens
gagcgacgaacccaagaag

SEQ ID NO: 219790 - RNA, 19 nt, Homo sapiens
gcacccguugugagaguuu

SEQ ID NO: 219791 - RNA, 19 nt, Homo sapiens
gguuagcaggaauaucuuu

SEQ ID NO: 219792 - RNA, 19 nt, Homo sapiens
gaccaagaaggaaaucaag

SEQ ID NO: 219793 - RNA, 19 nt, Homo sapiens
gggaaaauuuugcugucuu

SEQ ID NO: 219794 - RNA, 19 nt, Homo sapiens
cuagaucugugugcaugug

SEQ ID NO: 219795 - RNA, 19 nt, Homo sapiens
cccaguuuccuucucauuu

SEQ ID NO: 219796 - RNA, 19 nt, Homo sapiens
agaucaaguuguccaucaa

SEQ ID NO: 219797 - RNA, 19 nt, Homo sapiens
gagggaacccaggaauugu

SEQ ID NO: 219798 - RNA, 19 nt, Homo sapiens
caaaguccagugccaagag

SEQ ID NO: 219799 - RNA, 19 nt, Homo sapiens
gucaagaaggccaagaaga

SEQ ID NO: 219800 - RNA, 19 nt, Homo sapiens
ccaaguauucagacaugau

SEQ ID NO: 219801 - RNA, 19 nt, Homo sapiens
ggcaguggauaguaagacu

SEQ ID NO: 219802 - RNA, 19 nt, Homo sapiens
ggauuguguccuaggaaga

SEQ ID NO: 219803 - RNA, 19 nt, Homo sapiens
ucagugugcccuguugaaa

SEQ ID NO: 219804 - RNA, 19 nt, Homo sapiens
gcaaauucucuuguuaaac

SEQ ID NO: 219805 - RNA, 19 nt, Homo sapiens
gaagaagagcgcuaagaaa

SEQ ID NO: 219806 - RNA, 19 nt, Homo sapiens
caacagccguaucaaacuu

SEQ ID NO: 219807 - RNA, 19 nt, Homo sapiens
caagaaagcugccaaaagu

SEQ ID NO: 219808 - RNA, 19 nt, Homo sapiens
ugucagagcucaucaccaa

SEQ ID NO: 219809 - RNA, 19 nt, Homo sapiens
gaagccaagcccaagguua

SEQ ID NO: 219810 - RNA, 19 nt, Homo sapiens
ccuuuaaacucaacaagaa

SEQ ID NO: 219811 - RNA, 19 nt, Homo sapiens
ccaagaaaguggcuaagag

SEQ ID NO: 219812 - RNA, 19 nt, Homo sapiens
cgaagaagagcgcuaagaa

SEQ ID NO: 219813 - RNA, 19 nt, Homo sapiens
aaacaacagccguaucaaa

SEQ ID NO: 219814 - RNA, 19 nt, Homo sapiens
gcgaacgccuacuucuaaa

SEQ ID NO: 219815 - RNA, 19 nt, Homo sapiens
ccaagguugucaagccuaa

SEQ ID NO: 219816 - RNA, 19 nt, Homo sapiens
ucaagagccuggugagcaa

SEQ ID NO: 219817 - RNA, 19 nt, Homo sapiens
uaaagagcguagcggaguu

SEQ ID NO: 219818 - RNA, 19 nt, Homo sapiens
uaaccaagaaaguggcuaa

SEQ ID NO: 219819 - RNA, 19 nt, Homo sapiens
aagccaagcccaagguuaa

SEQ ID NO: 219820 - RNA, 19 nt, Homo sapiens
gcgcaacuccgaagaagag

SEQ ID NO: 219821 - RNA, 19 nt, Homo sapiens
gcuucuggcuccuuuaaac

SEQ ID NO: 219822 - RNA, 19 nt, Homo sapiens
ccgcuaagcccaagguugu

SEQ ID NO: 219823 - RNA, 19 nt, Homo sapiens
guaucaaacuuggucucaa

SEQ ID NO: 219824 - RNA, 19 nt, Homo sapiens
cagccaagaagcccaagaa

SEQ ID NO: 219825 - RNA, 19 nt, Homo sapiens
ggaagccaagcccaagguu

SEQ ID NO: 219826 - RNA, 19 nt, Homo sapiens
gugcuucuggcuccuuuaa

SEQ ID NO: 219827 - RNA, 19 nt, Homo sapiens
cggcuaugauguggagaaa

SEQ ID NO: 219828 - RNA, 19 nt, Homo sapiens
aagaagagcgcuaagaaaa

SEQ ID NO: 219829 - RNA, 19 nt, Homo sapiens
gcccaaagaaggccaaggu

SEQ ID NO: 219830 - RNA, 19 nt, Homo sapiens
ccacuguaaccaagaaagu

SEQ ID NO: 219831 - RNA, 19 nt, Homo sapiens
gagcguagcggaguuucuc

SEQ ID NO: 219832 - RNA, 19 nt, Homo sapiens
aaaccuaagaagccaguug

SEQ ID NO: 219833 - RNA, 19 nt, Homo sapiens
cggccacuguaaccaagaa

SEQ ID NO: 219834 - RNA, 19 nt, Homo sapiens
gcggaaccaaaccuaagaa

SEQ ID NO: 219835 - RNA, 19 nt, Homo sapiens
ggcggaaccaaaccuaaga

SEQ ID NO: 219836 - RNA, 19 nt, Homo sapiens
gggcggaaccaaaccuaag

SEQ ID NO: 219837 - RNA, 19 nt, Homo sapiens
aaagagcguagcggaguuu

SEQ ID NO: 219838 - RNA, 19 nt, Homo sapiens
gcccaagaaagcugccaaa

SEQ ID NO: 219839 - RNA, 19 nt, Homo sapiens
gaaggcagcuccgaagaaa

SEQ ID NO: 219840 - RNA, 19 nt, Homo sapiens
uaucugagcuuaucaccaa

SEQ ID NO: 219841 - RNA, 19 nt, Homo sapiens
gaaaacaccucagccaaaa

SEQ ID NO: 219842 - RNA, 19 nt, Homo sapiens
caacagccguaucaagcuu

SEQ ID NO: 219843 - RNA, 19 nt, Homo sapiens
ccaagaagcccaagaaggu

SEQ ID NO: 219844 - RNA, 19 nt, Homo sapiens
ccaagaaaguggccaagag

SEQ ID NO: 219845 - RNA, 19 nt, Homo sapiens
ggaagccgaagguuacaaa

SEQ ID NO: 219846 - RNA, 19 nt, Homo sapiens
gaagaaggcaggcgcaacu

SEQ ID NO: 219847 - RNA, 19 nt, Homo sapiens
gacaguuugagauuacuua

SEQ ID NO: 219848 - RNA, 19 nt, Homo sapiens
ccuucaaacucaacaagaa

SEQ ID NO: 219849 - RNA, 19 nt, Homo sapiens
caagaaaguggccaagagu

SEQ ID NO: 219850 - RNA, 19 nt, Homo sapiens
guucugacaguuugagauu

SEQ ID NO: 219851 - RNA, 19 nt, Homo sapiens
guaucaagcuuggccucaa

SEQ ID NO: 219852 - RNA, 19 nt, Homo sapiens
uuaaacggcucuuuucaga

SEQ ID NO: 219853 - RNA, 19 nt, Homo sapiens
aaagacuccuaagaaggua

SEQ ID NO: 219854 - RNA, 19 nt, Homo sapiens
aaacaacagccguaucaag

SEQ ID NO: 219855 - RNA, 19 nt, Homo sapiens
cagccaagaagcccaagaa

SEQ ID NO: 219856 - RNA, 19 nt, Homo sapiens
aggcgcaacugcugggaaa

SEQ ID NO: 219857 - RNA, 19 nt, Homo sapiens
ggacguuccccuuugaaaa

SEQ ID NO: 219858 - RNA, 19 nt, Homo sapiens
agaaggcagcuccgaagaa

SEQ ID NO: 219859 - RNA, 19 nt, Homo sapiens
gaguccagcuaaggccaaa

SEQ ID NO: 219860 - RNA, 19 nt, Homo sapiens
cccaguaucugagcuuauc

SEQ ID NO: 219861 - RNA, 19 nt, Homo sapiens
ucugacaguuugagauuac

SEQ ID NO: 219862 - RNA, 19 nt, Homo sapiens
gcgcagccaagccuaggaa

SEQ ID NO: 219863 - RNA, 19 nt, Homo sapiens
gcuucuggcuccuucaaac

SEQ ID NO: 219864 - RNA, 19 nt, Homo sapiens
ccacuugcuccuaccauuc

SEQ ID NO: 219865 - RNA, 19 nt, Homo sapiens
ugaaaacaccucagccaaa

SEQ ID NO: 219866 - RNA, 19 nt, Homo sapiens
cuucaaacucaacaagaaa

SEQ ID NO: 219867 - RNA, 19 nt, Homo sapiens
caaagguaccggugcuucu

SEQ ID NO: 219868 - RNA, 19 nt, Homo sapiens
cuccuaagaagguaaagaa

SEQ ID NO: 219869 - RNA, 19 nt, Homo sapiens
gcaguggcagcuucuaagg

SEQ ID NO: 219870 - RNA, 19 nt, Homo sapiens
gcuaugacguggagaagaa

SEQ ID NO: 219871 - RNA, 19 nt, Homo sapiens
uguccgagcucauuacuaa

SEQ ID NO: 219872 - RNA, 19 nt, Homo sapiens
gaacaacagccgcaucaag

SEQ ID NO: 219873 - RNA, 19 nt, Homo sapiens
gaaggcggcagccaagaaa

SEQ ID NO: 219874 - RNA, 19 nt, Homo sapiens
ucaagagccuggugagcaa

SEQ ID NO: 219875 - RNA, 19 nt, Homo sapiens
cgagaagacucccgugaag

SEQ ID NO: 219876 - RNA, 19 nt, Homo sapiens
gcucauuacuaaagcuguu

SEQ ID NO: 219877 - RNA, 19 nt, Homo sapiens
ccaaggcggcuaaaccaaa

SEQ ID NO: 219878 - RNA, 19 nt, Homo sapiens
ccuucaaacucaacaagaa

SEQ ID NO: 219879 - RNA, 19 nt, Homo sapiens
caaggcggcuaaaccaaag

SEQ ID NO: 219880 - RNA, 19 nt, Homo sapiens
cgaaagcagccaagccaaa

SEQ ID NO: 219881 - RNA, 19 nt, Homo sapiens
gcaucaagcugggucucaa

SEQ ID NO: 219882 - RNA, 19 nt, Homo sapiens
gaaggccaaagcaguuaaa

SEQ ID NO: 219883 - RNA, 19 nt, Homo sapiens
gcgcagcggcguaucuuug

SEQ ID NO: 219884 - RNA, 19 nt, Homo sapiens
agaagacucccgugaagaa

SEQ ID NO: 219885 - RNA, 19 nt, Homo sapiens
gcgaaggccaaagcaguua

SEQ ID NO: 219886 - RNA, 19 nt, Homo sapiens
agacucccgugaagaagaa

SEQ ID NO: 219887 - RNA, 19 nt, Homo sapiens
gagaagacucccgugaaga

SEQ ID NO: 219888 - RNA, 19 nt, Homo sapiens
gaaagcagccaagccaaaa

SEQ ID NO: 219889 - RNA, 19 nt, Homo sapiens
acgcuugccuucaacaugu

SEQ ID NO: 219890 - RNA, 19 nt, Homo sapiens
cagcaggagcggcgaagaa

SEQ ID NO: 219891 - RNA, 19 nt, Homo sapiens
ccaaggcagccaagccaaa

SEQ ID NO: 219892 - RNA, 19 nt, Homo sapiens
cggcgaagaagcccaagaa

SEQ ID NO: 219893 - RNA, 19 nt, Homo sapiens
uuuggccgcucucaagaaa

SEQ ID NO: 219894 - RNA, 19 nt, Homo sapiens
ccgagaagacucccgugaa

SEQ ID NO: 219895 - RNA, 19 nt, Homo sapiens
cgaaggccaaagcaguuaa

SEQ ID NO: 219896 - RNA, 19 nt, Homo sapiens
agaaggcggcagccaagaa

SEQ ID NO: 219897 - RNA, 19 nt, Homo sapiens
aagaacaacagccgcauca

SEQ ID NO: 219898 - RNA, 19 nt, Homo sapiens
gagcgcagcggcguaucuu

SEQ ID NO: 219899 - RNA, 19 nt, Homo sapiens
gaagacucccgugaagaag

SEQ ID NO: 219900 - RNA, 19 nt, Homo sapiens
cuuagaagcccaacacaac

SEQ ID NO: 219901 - RNA, 19 nt, Homo sapiens
ucggguuccuucaaacuca

SEQ ID NO: 219902 - RNA, 19 nt, Homo sapiens
cgcgucggguuccuucaaa

SEQ ID NO: 219903 - RNA, 19 nt, Homo sapiens
guaggaagcuggcguguga

SEQ ID NO: 219904 - RNA, 19 nt, Homo sapiens
gaagaagacuccgaagaag

SEQ ID NO: 219905 - RNA, 19 nt, Homo sapiens
aagaauaacagccgcauua

SEQ ID NO: 219906 - RNA, 19 nt, Homo sapiens
ugaagaagacuccgaagaa

SEQ ID NO: 219907 - RNA, 19 nt, Homo sapiens
ccuuuaaacucaacaagaa

SEQ ID NO: 219908 - RNA, 19 nt, Homo sapiens
gcuacgacguggagaagaa

SEQ ID NO: 219909 - RNA, 19 nt, Homo sapiens
cuaagaagaaggcaacuaa

SEQ ID NO: 219910 - RNA, 19 nt, Homo sapiens
gaagaaggcaacuaagaag

SEQ ID NO: 219911 - RNA, 19 nt, Homo sapiens
gcauuaagcugggccucaa

SEQ ID NO: 219912 - RNA, 19 nt, Homo sapiens
caagaaggcggcugccaaa

SEQ ID NO: 219913 - RNA, 19 nt, Homo sapiens
caaagccgcuaagcccaaa

SEQ ID NO: 219914 - RNA, 19 nt, Homo sapiens
agaagaaggcaacuaagaa

SEQ ID NO: 219915 - RNA, 19 nt, Homo sapiens
gaauaacagccgcauuaag

SEQ ID NO: 219916 - RNA, 19 nt, Homo sapiens
gaagaauaacagccgcauu

SEQ ID NO: 219917 - RNA, 19 nt, Homo sapiens
aagaagaaggcaacuaaga

SEQ ID NO: 219918 - RNA, 19 nt, Homo sapiens
gcgcaauggccuuucuuug

SEQ ID NO: 219919 - RNA, 19 nt, Homo sapiens
gcuucuggcuccuuuaaac

SEQ ID NO: 219920 - RNA, 19 nt, Homo sapiens
ggagcgcaauggccuuucu

SEQ ID NO: 219921 - RNA, 19 nt, Homo sapiens
gugaagaagacuccgaaga

SEQ ID NO: 219922 - RNA, 19 nt, Homo sapiens
gcuaagaagaaggcaacua

SEQ ID NO: 219923 - RNA, 19 nt, Homo sapiens
agaauaacagccgcauuaa

SEQ ID NO: 219924 - RNA, 19 nt, Homo sapiens
gccaagcccaaggcaguua

SEQ ID NO: 219925 - RNA, 19 nt, Homo sapiens
gugcuucuggcuccuuuaa

SEQ ID NO: 219926 - RNA, 19 nt, Homo sapiens
aauaacagccgcauuaagc

SEQ ID NO: 219927 - RNA, 19 nt, Homo sapiens
uggcgaagagcccuaagaa

SEQ ID NO: 219928 - RNA, 19 nt, Homo sapiens
gaaggcggcaaagcccaaa

SEQ ID NO: 219929 - RNA, 19 nt, Homo sapiens
cgcaauggccuuucuuugg

SEQ ID NO: 219930 - RNA, 19 nt, Homo sapiens
cuuuagauuucgagcuuau

SEQ ID NO: 219931 - RNA, 19 nt, Homo sapiens
caaagcagcaaaaccuaaa

SEQ ID NO: 219932 - RNA, 19 nt, Homo sapiens
ccaagcccaaggcaguuaa

SEQ ID NO: 219933 - RNA, 19 nt, Homo sapiens
ggcuguggcugcuucuaag

SEQ ID NO: 219934 - RNA, 19 nt, Homo sapiens
caaagcccaaagccgcuaa

SEQ ID NO: 219935 - RNA, 19 nt, Homo sapiens
guaagaaggugauuccuaa

SEQ ID NO: 219936 - RNA, 19 nt, Homo sapiens
guuauuacaucuugcguuu

SEQ ID NO: 219937 - RNA, 19 nt, Homo sapiens
gaaaggccacaucuaagaa

SEQ ID NO: 219938 - RNA, 19 nt, Homo sapiens
gacccaacaucaugaaguu

SEQ ID NO: 219939 - RNA, 19 nt, Homo sapiens
gaauaacagccgcaucaaa

SEQ ID NO: 219940 - RNA, 19 nt, Homo sapiens
ggccacaucuaagaaguaa

SEQ ID NO: 219941 - RNA, 19 nt, Homo sapiens
ccaagaagcugguuuuauc

SEQ ID NO: 219942 - RNA, 19 nt, Homo sapiens
gcaucaaacugucccucaa

SEQ ID NO: 219943 - RNA, 19 nt, Homo sapiens
ggcaagggcuucgaaguca

SEQ ID NO: 219944 - RNA, 19 nt, Homo sapiens
ccaauaagagagccaagaa

SEQ ID NO: 219945 - RNA, 19 nt, Homo sapiens
gcguuucucuguuguuaug

SEQ ID NO: 219946 - RNA, 19 nt, Homo sapiens
gcaagggcuucgaagucaa

SEQ ID NO: 219947 - RNA, 19 nt, Homo sapiens
gagaaacuuccaaccaaga

SEQ ID NO: 219948 - RNA, 19 nt, Homo sapiens
agaaaggccacaucuaaga

SEQ ID NO: 219949 - RNA, 19 nt, Homo sapiens
gaaguuaauguuagaaagg

SEQ ID NO: 219950 - RNA, 19 nt, Homo sapiens
gauaagugcaagucgcaaa

SEQ ID NO: 219951 - RNA, 19 nt, Homo sapiens
caucuugcguuucucuguu

SEQ ID NO: 219952 - RNA, 19 nt, Homo sapiens
cuaaaggagccaaggguaa

SEQ ID NO: 219953 - RNA, 19 nt, Homo sapiens
ucuaagaaguaaagagcuu

SEQ ID NO: 219954 - RNA, 19 nt, Homo sapiens
cgagagcgacaacuccuaa

SEQ ID NO: 219955 - RNA, 19 nt, Homo sapiens
gaacgaguagguaugucuu

SEQ ID NO: 219956 - RNA, 19 nt, Homo sapiens
ccacaucuaagaaguaaag

SEQ ID NO: 219957 - RNA, 19 nt, Homo sapiens
ccaacaucaugaaguuaau

SEQ ID NO: 219958 - RNA, 19 nt, Homo sapiens
cagcagaagagcccaguga

SEQ ID NO: 219959 - RNA, 19 nt, Homo sapiens
gaguagguaugucuuuggu

SEQ ID NO: 219960 - RNA, 19 nt, Homo sapiens
gcagaagagcccagugaag

SEQ ID NO: 219961 - RNA, 19 nt, Homo sapiens
ucaagagcuuagugaacaa

SEQ ID NO: 219962 - RNA, 19 nt, Homo sapiens
cucaagagcuuagugaaca

SEQ ID NO: 219963 - RNA, 19 nt, Homo sapiens
aagaauaacagccgcauca

SEQ ID NO: 219964 - RNA, 19 nt, Homo sapiens
uauuacaucuugcguuucu

SEQ ID NO: 219965 - RNA, 19 nt, Homo sapiens
uugcguuucucuguuguua

SEQ ID NO: 219966 - RNA, 19 nt, Homo sapiens
caagggcuucgaagucaaa

SEQ ID NO: 219967 - RNA, 19 nt, Homo sapiens
ucacaggaacgaguaggua

SEQ ID NO: 219968 - RNA, 19 nt, Homo sapiens
ccggcuggcuugauaagug

SEQ ID NO: 219969 - RNA, 19 nt, Homo sapiens
guaagcaacagcagaagag

SEQ ID NO: 219970 - RNA, 19 nt, Homo sapiens
gguaagcaacagcagaaga

SEQ ID NO: 219971 - RNA, 19 nt, Homo sapiens
uccgguuccuuuaagcuua

SEQ ID NO: 219972 - RNA, 19 nt, Homo sapiens
ucucuguuguuaugucuga

SEQ ID NO: 219973 - RNA, 19 nt, Homo sapiens
cccaacaucaugaaguuaa

SEQ ID NO: 219974 - RNA, 19 nt, Homo sapiens
gagccaaggguaagcaaca

SEQ ID NO: 219975 - RNA, 19 nt, Homo sapiens
aaauugacccaacaucaug

SEQ ID NO: 219976 - RNA, 19 nt, Homo sapiens
ggaacgaguagguaugucu

SEQ ID NO: 219977 - RNA, 19 nt, Homo sapiens
ccaagaagcgagggaggaa

SEQ ID NO: 219978 - RNA, 19 nt, Homo sapiens
guuaggagcgggagaaagg

SEQ ID NO: 219979 - RNA, 19 nt, Homo sapiens
uaagaaggugauuccuaaa

SEQ ID NO: 219980 - RNA, 19 nt, Homo sapiens
uaacagccgcaucaaacug

SEQ ID NO: 219981 - RNA, 19 nt, Homo sapiens
gugcuuccgguuccuuuaa

SEQ ID NO: 219982 - RNA, 19 nt, Homo sapiens
aauaacagccgcaucaaac

SEQ ID NO: 219983 - RNA, 19 nt, Homo sapiens
caacaucaugaaguuaaug

SEQ ID NO: 219984 - RNA, 19 nt, Homo sapiens
uaaaggagccaaggguaag

SEQ ID NO: 219985 - RNA, 19 nt, Homo sapiens
ggagcgggagaaaggcuaa

SEQ ID NO: 219986 - RNA, 19 nt, Homo sapiens
cgacaacuccuaaaacugu

SEQ ID NO: 219987 - RNA, 19 nt, Homo sapiens
aguaagaaggugauuccua

SEQ ID NO: 219988 - RNA, 19 nt, Homo sapiens
caaaauugacccaacauca

SEQ ID NO: 219989 - RNA, 19 nt, Homo sapiens
gugccgaaccucucugugu

SEQ ID NO: 219990 - RNA, 19 nt, Homo sapiens
agaaacuuccaaccaagaa

SEQ ID NO: 219991 - RNA, 19 nt, Homo sapiens
gagagcgacaacuccuaaa

SEQ ID NO: 219992 - RNA, 19 nt, Homo sapiens
auuccuaaaucuaccagaa

SEQ ID NO: 219993 - RNA, 19 nt, Homo sapiens
aagaaggugauuccuaaau

SEQ ID NO: 219994 - RNA, 19 nt, Homo sapiens
caaagugccgaaccucucu

SEQ ID NO: 219995 - RNA, 19 nt, Homo sapiens
acgaguagguaugucuuug

SEQ ID NO: 219996 - RNA, 19 nt, Homo sapiens
ggugcuuccgguuccuuua

SEQ ID NO: 219997 - RNA, 19 nt, Homo sapiens
cuaaaucuaccagaagcaa

SEQ ID NO: 219998 - RNA, 19 nt, Homo sapiens
caagugaaaugauuacuag

SEQ ID NO: 219999 - RNA, 19 nt, Homo sapiens
gcaagugaaaugauuacua

SEQ ID NO: 220000 - RNA, 19 nt, Homo sapiens
ggucuucaguuuccaguug

SEQ ID NO: 220001 - RNA, 19 nt, Homo sapiens
ucuguaaagugcuggaaua

SEQ ID NO: 220002 - RNA, 19 nt, Homo sapiens
guaaagugcuggaauacac

SEQ ID NO: 220003 - RNA, 19 nt, Homo sapiens
gugaaaugauuacuaguca

SEQ ID NO: 220004 - RNA, 19 nt, Homo sapiens
caacauccaggccguauug

SEQ ID NO: 220005 - RNA, 19 nt, Homo sapiens
agacggagagccaccauaa

SEQ ID NO: 220006 - RNA, 19 nt, Homo sapiens
cacauacgaugccugaaau

SEQ ID NO: 220007 - RNA, 19 nt, Homo sapiens
acacauacgaugccugaaa

SEQ ID NO: 220008 - RNA, 19 nt, Homo sapiens
ccguauugcugccuaagaa

SEQ ID NO: 220009 - RNA, 19 nt, Homo sapiens
uaagaagacccgcaucauc

SEQ ID NO: 220010 - RNA, 19 nt, Homo sapiens
ccacccaccuuuucuguaa

SEQ ID NO: 220011 - RNA, 19 nt, Homo sapiens
gcaacgacgaggagcuaaa

SEQ ID NO: 220012 - RNA, 19 nt, Homo sapiens
aagggcaagugaaaugauu

SEQ ID NO: 220013 - RNA, 19 nt, Homo sapiens
guuaguucuucugcuguua

SEQ ID NO: 220014 - RNA, 19 nt, Homo sapiens
gccaagggcaagugaaaug

SEQ ID NO: 220015 - RNA, 19 nt, Homo sapiens
caacgacgaggagcuaaau

SEQ ID NO: 220016 - RNA, 19 nt, Homo sapiens
cggcaaagcucgggcaaaa

SEQ ID NO: 220017 - RNA, 19 nt, Homo sapiens
acgacgaggagcuaaauaa

SEQ ID NO: 220018 - RNA, 19 nt, Homo sapiens
gcuguuaggaagccacuau

SEQ ID NO: 220019 - RNA, 19 nt, Homo sapiens
ucugacggccgagaucuua

SEQ ID NO: 220020 - RNA, 19 nt, Homo sapiens
ccaagggcaagugaaauga

SEQ ID NO: 220021 - RNA, 19 nt, Homo sapiens
guauugcugccuaagaaga

SEQ ID NO: 220022 - RNA, 19 nt, Homo sapiens
cgacgaggagcuaaauaag

SEQ ID NO: 220023 - RNA, 19 nt, Homo sapiens
guucuucugcuguuaggaa

SEQ ID NO: 220024 - RNA, 19 nt, Homo sapiens
uucaguggauuguuaguuc

SEQ ID NO: 220025 - RNA, 19 nt, Homo sapiens
aauaagaagacccgcauca

SEQ ID NO: 220026 - RNA, 19 nt, Homo sapiens
gcgguguccugcccaacau

SEQ ID NO: 220027 - RNA, 19 nt, Homo sapiens
uuaggaagccacuaugucu

SEQ ID NO: 220028 - RNA, 19 nt, Homo sapiens
ggaaagcaaggcggcaaag

SEQ ID NO: 220029 - RNA, 19 nt, Homo sapiens
agucaaauccgucagugau

SEQ ID NO: 220030 - RNA, 19 nt, Homo sapiens
caagggcaagugaaaugau

SEQ ID NO: 220031 - RNA, 19 nt, Homo sapiens
uaaacaaguugcuggguaa

SEQ ID NO: 220032 - RNA, 19 nt, Homo sapiens
aacgagaacucuuauauug

SEQ ID NO: 220033 - RNA, 19 nt, Homo sapiens
gaagcagucuuaacaaagg

SEQ ID NO: 220034 - RNA, 19 nt, Homo sapiens
gaacucuuauauuggcuuu

SEQ ID NO: 220035 - RNA, 19 nt, Homo sapiens
acgaggagcuaaacaaguu

SEQ ID NO: 220036 - RNA, 19 nt, Homo sapiens
aggaagcagucuuaacaaa

SEQ ID NO: 220037 - RNA, 19 nt, Homo sapiens
caagaagacccgcaucauc

SEQ ID NO: 220038 - RNA, 19 nt, Homo sapiens
ggaagcagucuuaacaaag

SEQ ID NO: 220039 - RNA, 19 nt, Homo sapiens
gcaacgacgaggagcuaaa

SEQ ID NO: 220040 - RNA, 19 nt, Homo sapiens
ggaaaggcccgagcuaagg

SEQ ID NO: 220041 - RNA, 19 nt, Homo sapiens
gcggaaaggcccgagcuaa

SEQ ID NO: 220042 - RNA, 19 nt, Homo sapiens
acaaguugcuggguaaagu

SEQ ID NO: 220043 - RNA, 19 nt, Homo sapiens
caacauccaggcuguacug

SEQ ID NO: 220044 - RNA, 19 nt, Homo sapiens
caaggccaagggcaaguaa

SEQ ID NO: 220045 - RNA, 19 nt, Homo sapiens
guaccugaccgccgagauc

SEQ ID NO: 220046 - RNA, 19 nt, Homo sapiens
cgacgaggagcuaaacaag

SEQ ID NO: 220047 - RNA, 19 nt, Homo sapiens
gacgaggagcuaaacaagu

SEQ ID NO: 220048 - RNA, 19 nt, Homo sapiens
cggaaaggcccgagcuaag

SEQ ID NO: 220049 - RNA, 19 nt, Homo sapiens
guacugcuccccaagaaga

SEQ ID NO: 220050 - RNA, 19 nt, Homo sapiens
ccauuucccuuccagcaaa

SEQ ID NO: 220051 - RNA, 19 nt, Homo sapiens
gugcuuagcccaggacuuu

SEQ ID NO: 220052 - RNA, 19 nt, Homo sapiens
gacuagaaccuuaggcauu

SEQ ID NO: 220053 - RNA, 19 nt, Homo sapiens
ggacgaagcacuugguaac

SEQ ID NO: 220054 - RNA, 19 nt, Homo sapiens
gcuaacccuuccacgacua

SEQ ID NO: 220055 - RNA, 19 nt, Homo sapiens
gggcgucuguucuaguguu

SEQ ID NO: 220056 - RNA, 19 nt, Homo sapiens
acuagaaccuuaggcauug

SEQ ID NO: 220057 - RNA, 19 nt, Homo sapiens
caagaagacgcgaaucauc

SEQ ID NO: 220058 - RNA, 19 nt, Homo sapiens
cagcacaagucgguuaauc

SEQ ID NO: 220059 - RNA, 19 nt, Homo sapiens
ccaccgcccucauggaaag

SEQ ID NO: 220060 - RNA, 19 nt, Homo sapiens
cgucuguucuaguguuuga

SEQ ID NO: 220061 - RNA, 19 nt, Homo sapiens
cuucugaacuggaauucug

SEQ ID NO: 220062 - RNA, 19 nt, Homo sapiens
uggcggcagugcuggagua

SEQ ID NO: 220063 - RNA, 19 nt, Homo sapiens
cuucacggcuggcuaugug

SEQ ID NO: 220064 - RNA, 19 nt, Homo sapiens
cuagauaccagcacaaguc

SEQ ID NO: 220065 - RNA, 19 nt, Homo sapiens
cccuccaucuucauucaua

SEQ ID NO: 220066 - RNA, 19 nt, Homo sapiens
uuccacgacuagaaccuua

SEQ ID NO: 220067 - RNA, 19 nt, Homo sapiens
gcaauccaagcaccuagau

SEQ ID NO: 220068 - RNA, 19 nt, Homo sapiens
acccaggccuuucacauca

SEQ ID NO: 220069 - RNA, 19 nt, Homo sapiens
aaacucaacucggcaaucc

SEQ ID NO: 220070 - RNA, 19 nt, Homo sapiens
gggacgaagcacuugguaa

SEQ ID NO: 220071 - RNA, 19 nt, Homo sapiens
gacccaggccuuucacauc

SEQ ID NO: 220072 - RNA, 19 nt, Homo sapiens
uaccagcacaagucgguua

SEQ ID NO: 220073 - RNA, 19 nt, Homo sapiens
ggacccaggccuuucacau

SEQ ID NO: 220074 - RNA, 19 nt, Homo sapiens
ccucggcguucgugacuca

SEQ ID NO: 220075 - RNA, 19 nt, Homo sapiens
caauccaagcaccuagaua

SEQ ID NO: 220076 - RNA, 19 nt, Homo sapiens
caccaccgcccucauggaa

SEQ ID NO: 220077 - RNA, 19 nt, Homo sapiens
ggcgucuguucuaguguuu

SEQ ID NO: 220078 - RNA, 19 nt, Homo sapiens
caacucggcaauccaagca

SEQ ID NO: 220079 - RNA, 19 nt, Homo sapiens
guuggcuucugaacuggaa

SEQ ID NO: 220080 - RNA, 19 nt, Homo sapiens
gcaacgacgaggagcucaa

SEQ ID NO: 220081 - RNA, 19 nt, Homo sapiens
uccguuggcuucugaacug

SEQ ID NO: 220082 - RNA, 19 nt, Homo sapiens
gaggcguccugcccaacau

SEQ ID NO: 220083 - RNA, 19 nt, Homo sapiens
cgacgaggagcucaacaag

SEQ ID NO: 220084 - RNA, 19 nt, Homo sapiens
aacaagaagacgcgaauca

SEQ ID NO: 220085 - RNA, 19 nt, Homo sapiens
guggacagcaagagucguu

SEQ ID NO: 220086 - RNA, 19 nt, Homo sapiens
gcuuagcccaggacuuuca

SEQ ID NO: 220087 - RNA, 19 nt, Homo sapiens
ggucauaucccaaacuaaa

SEQ ID NO: 220088 - RNA, 19 nt, Homo sapiens
gaagaaaggacaacagaag

SEQ ID NO: 220089 - RNA, 19 nt, Homo sapiens
gcgcagccauccuggagua

SEQ ID NO: 220090 - RNA, 19 nt, Homo sapiens
caaccaaauuucugcauuc

SEQ ID NO: 220091 - RNA, 19 nt, Homo sapiens
cgaaauggcuggcgguaag

SEQ ID NO: 220092 - RNA, 19 nt, Homo sapiens
ggaaaggacuccggaaagg

SEQ ID NO: 220093 - RNA, 19 nt, Homo sapiens
guggauaaguucaauaaag

SEQ ID NO: 220094 - RNA, 19 nt, Homo sapiens
ucuaacagcuguccagugu

SEQ ID NO: 220095 - RNA, 19 nt, Homo sapiens
ccucgucacuugcaacuug

SEQ ID NO: 220096 - RNA, 19 nt, Homo sapiens
ccaaccaaauuucugcauu

SEQ ID NO: 220097 - RNA, 19 nt, Homo sapiens
uaucucaggacucuaaaua

SEQ ID NO: 220098 - RNA, 19 nt, Homo sapiens
uaauugugaugcagaaguu

SEQ ID NO: 220099 - RNA, 19 nt, Homo sapiens
ucuaaaggaugccuggauu

SEQ ID NO: 220100 - RNA, 19 nt, Homo sapiens
ggaagaaaggacaacagaa

SEQ ID NO: 220101 - RNA, 19 nt, Homo sapiens
ucguggagaugaagaauug

SEQ ID NO: 220102 - RNA, 19 nt, Homo sapiens
gggaagaaaggacaacaga

SEQ ID NO: 220103 - RNA, 19 nt, Homo sapiens
ccggaaaggccaagacaaa

SEQ ID NO: 220104 - RNA, 19 nt, Homo sapiens
aaggucauaucccaaacua

SEQ ID NO: 220105 - RNA, 19 nt, Homo sapiens
uuucugcauucgagucuua

SEQ ID NO: 220106 - RNA, 19 nt, Homo sapiens
ggacuguaucucugugaaa

SEQ ID NO: 220107 - RNA, 19 nt, Homo sapiens
caucaaggcuacaauugcu

SEQ ID NO: 220108 - RNA, 19 nt, Homo sapiens
uggauaaguucaauaaagg

SEQ ID NO: 220109 - RNA, 19 nt, Homo sapiens
augccuggauuccuuguua

SEQ ID NO: 220110 - RNA, 19 nt, Homo sapiens
ggagaugaagaauuggauu

SEQ ID NO: 220111 - RNA, 19 nt, Homo sapiens
gaugcagaaguuauaguaa

SEQ ID NO: 220112 - RNA, 19 nt, Homo sapiens
ggaaaggccaagacaaagg

SEQ ID NO: 220113 - RNA, 19 nt, Homo sapiens
ugaugcagaaguuauagua

SEQ ID NO: 220114 - RNA, 19 nt, Homo sapiens
gcggugcgacgaaggagua

SEQ ID NO: 220115 - RNA, 19 nt, Homo sapiens
auucgagucuuaaccauau

SEQ ID NO: 220116 - RNA, 19 nt, Homo sapiens
ucaggacucuaaauacucu

SEQ ID NO: 220117 - RNA, 19 nt, Homo sapiens
ucucaggacucuaaauacu

SEQ ID NO: 220118 - RNA, 19 nt, Homo sapiens
ggaaaugcaucaaaagacu

SEQ ID NO: 220119 - RNA, 19 nt, Homo sapiens
uacuugaacuggcaggaaa

SEQ ID NO: 220120 - RNA, 19 nt, Homo sapiens
ccagugggccguauucauc

SEQ ID NO: 220121 - RNA, 19 nt, Homo sapiens
gaacuggcaggaaaugcau

SEQ ID NO: 220122 - RNA, 19 nt, Homo sapiens
guguuacuguggcuucaaa

SEQ ID NO: 220123 - RNA, 19 nt, Homo sapiens
auaaaggucauaucccaaa

SEQ ID NO: 220124 - RNA, 19 nt, Homo sapiens
ggcaggaaaugcaucaaaa

SEQ ID NO: 220125 - RNA, 19 nt, Homo sapiens
ccgcagagguacuugaacu

SEQ ID NO: 220126 - RNA, 19 nt, Homo sapiens
gaaaggacaacagaagacu

SEQ ID NO: 220127 - RNA, 19 nt, Homo sapiens
cgagucuuaaccauauuua

SEQ ID NO: 220128 - RNA, 19 nt, Homo sapiens
gacucuaaauacucuaaca

SEQ ID NO: 220129 - RNA, 19 nt, Homo sapiens
acuuaaagguaaagcguau

SEQ ID NO: 220130 - RNA, 19 nt, Homo sapiens
uuacuguggcuucaaagaa

SEQ ID NO: 220131 - RNA, 19 nt, Homo sapiens
gcauucgagucuuaaccau

SEQ ID NO: 220132 - RNA, 19 nt, Homo sapiens
aagaaaggacaacagaaga

SEQ ID NO: 220133 - RNA, 19 nt, Homo sapiens
guacuugaacuggcaggaa

SEQ ID NO: 220134 - RNA, 19 nt, Homo sapiens
uggauuccuuguuaucuca

SEQ ID NO: 220135 - RNA, 19 nt, Homo sapiens
cauucgagucuuaaccaua

SEQ ID NO: 220136 - RNA, 19 nt, Homo sapiens
gagcuucagcggaauucga

SEQ ID NO: 220137 - RNA, 19 nt, Homo sapiens
gcgguaaggcuggaaagga

SEQ ID NO: 220138 - RNA, 19 nt, Homo sapiens
ccacacauccacaaaucuc

SEQ ID NO: 220139 - RNA, 19 nt, Homo sapiens
uaaaggucauaucccaaac

SEQ ID NO: 220140 - RNA, 19 nt, Homo sapiens
ugguggauaaguucaauaa

SEQ ID NO: 220141 - RNA, 19 nt, Homo sapiens
uguuaucucaggacucuaa

SEQ ID NO: 220142 - RNA, 19 nt, Homo sapiens
ucucaucaaggcuacaauu

SEQ ID NO: 220143 - RNA, 19 nt, Homo sapiens
gacuguaucucugugaaaa

SEQ ID NO: 220144 - RNA, 19 nt, Homo sapiens
ggauaaguucaauaaaggu

SEQ ID NO: 220145 - RNA, 19 nt, Homo sapiens
aaucuaggacgaccaguca

SEQ ID NO: 220146 - RNA, 19 nt, Homo sapiens
guauucaucgacaccuaaa

SEQ ID NO: 220147 - RNA, 19 nt, Homo sapiens
gguggauaaguucaauaaa

SEQ ID NO: 220148 - RNA, 19 nt, Homo sapiens
uggcaggaaaugcaucaaa

SEQ ID NO: 220149 - RNA, 19 nt, Homo sapiens
cguauucaucgacaccuaa

SEQ ID NO: 220150 - RNA, 19 nt, Homo sapiens
uuccacacauccacaaauc

SEQ ID NO: 220151 - RNA, 19 nt, Homo sapiens
ccguauucaucgacaccua

SEQ ID NO: 220152 - RNA, 19 nt, Homo sapiens
ggagagcuauucaguguau

SEQ ID NO: 220153 - RNA, 19 nt, Homo sapiens
guacaccaguuccaaguaa

SEQ ID NO: 220154 - RNA, 19 nt, Homo sapiens
ccaaggccgucaccaagua

SEQ ID NO: 220155 - RNA, 19 nt, Homo sapiens
ccaagaaggcggugacuaa

SEQ ID NO: 220156 - RNA, 19 nt, Homo sapiens
gcuauucaguguaugugua

SEQ ID NO: 220157 - RNA, 19 nt, Homo sapiens
ugacuaaggcucagaagaa

SEQ ID NO: 220158 - RNA, 19 nt, Homo sapiens
aaggagagcuauucagugu

SEQ ID NO: 220159 - RNA, 19 nt, Homo sapiens
gcaaggagagcuauucagu

SEQ ID NO: 220160 - RNA, 19 nt, Homo sapiens
ccacgcauguuuucaauaa

SEQ ID NO: 220161 - RNA, 19 nt, Homo sapiens
aacaagcgcucgaccauca

SEQ ID NO: 220162 - RNA, 19 nt, Homo sapiens
gcaccaaggccgucaccaa

SEQ ID NO: 220163 - RNA, 19 nt, Homo sapiens
gaagaaggacgggaagaag

SEQ ID NO: 220164 - RNA, 19 nt, Homo sapiens
uuaagagccacgcauguuu

SEQ ID NO: 220165 - RNA, 19 nt, Homo sapiens
gacuaaggcucagaagaag

SEQ ID NO: 220166 - RNA, 19 nt, Homo sapiens
uaagcaucuuuacaccuaa

SEQ ID NO: 220167 - RNA, 19 nt, Homo sapiens
caauggggaucaugaauuc

SEQ ID NO: 220168 - RNA, 19 nt, Homo sapiens
gcaauggggaucaugaauu

SEQ ID NO: 220169 - RNA, 19 nt, Homo sapiens
cuaaggcucagaagaagga

SEQ ID NO: 220170 - RNA, 19 nt, Homo sapiens
ccaaguacaccaguuccaa

SEQ ID NO: 220171 - RNA, 19 nt, Homo sapiens
agaagaaggacgggaagaa

SEQ ID NO: 220172 - RNA, 19 nt, Homo sapiens
cuuuacaccuaaucccaaa

SEQ ID NO: 220173 - RNA, 19 nt, Homo sapiens
ugccaaguaagcaucuuua

SEQ ID NO: 220174 - RNA, 19 nt, Homo sapiens
acaccggcaucucuuccaa

SEQ ID NO: 220175 - RNA, 19 nt, Homo sapiens
caagaaggcggugacuaag

SEQ ID NO: 220176 - RNA, 19 nt, Homo sapiens
ucaccaaguacaccaguuc

SEQ ID NO: 220177 - RNA, 19 nt, Homo sapiens
gccugaaccuaccaagucu

SEQ ID NO: 220178 - RNA, 19 nt, Homo sapiens
gcuacgaugccugaaccua

SEQ ID NO: 220179 - RNA, 19 nt, Homo sapiens
aagcaucuuuacaccuaau

SEQ ID NO: 220180 - RNA, 19 nt, Homo sapiens
gaggagaaaugaaugcaua

SEQ ID NO: 220181 - RNA, 19 nt, Homo sapiens
ggagagacaugaagacaga

SEQ ID NO: 220182 - RNA, 19 nt, Homo sapiens
ggaaggaacuaaagguguu

SEQ ID NO: 220183 - RNA, 19 nt, Homo sapiens
ggagagcuauucaguguau

SEQ ID NO: 220184 - RNA, 19 nt, Homo sapiens
guacaccaguuccaaguaa

SEQ ID NO: 220185 - RNA, 19 nt, Homo sapiens
ggacuaccuuugcuaagaa

SEQ ID NO: 220186 - RNA, 19 nt, Homo sapiens
ccaaggccgucaccaagua

SEQ ID NO: 220187 - RNA, 19 nt, Homo sapiens
ccaagaaggcggugacuaa

SEQ ID NO: 220188 - RNA, 19 nt, Homo sapiens
gaagacagaggagaaauga

SEQ ID NO: 220189 - RNA, 19 nt, Homo sapiens
gcuauucaguguaugugua

SEQ ID NO: 220190 - RNA, 19 nt, Homo sapiens
ugacuaaggcucagaagaa

SEQ ID NO: 220191 - RNA, 19 nt, Homo sapiens
aaggagagcuauucagugu

SEQ ID NO: 220192 - RNA, 19 nt, Homo sapiens
gcaaggagagcuauucagu

SEQ ID NO: 220193 - RNA, 19 nt, Homo sapiens
aacaagcgcucgaccauca

SEQ ID NO: 220194 - RNA, 19 nt, Homo sapiens
gcacacugguucaucaaaa

SEQ ID NO: 220195 - RNA, 19 nt, Homo sapiens
gcaccaaggccgucaccaa

SEQ ID NO: 220196 - RNA, 19 nt, Homo sapiens
ggagaaaugaaugcauaaa

SEQ ID NO: 220197 - RNA, 19 nt, Homo sapiens
agacagaggagaaaugaau

SEQ ID NO: 220198 - RNA, 19 nt, Homo sapiens
uaaagguguuugcacuuca

SEQ ID NO: 220199 - RNA, 19 nt, Homo sapiens
agaaaagucugaaugagaa

SEQ ID NO: 220200 - RNA, 19 nt, Homo sapiens
cuaaagguguuugcacuuc

SEQ ID NO: 220201 - RNA, 19 nt, Homo sapiens
gcugcacacugguucauca

SEQ ID NO: 220202 - RNA, 19 nt, Homo sapiens
gaagaaggacgggaagaag

SEQ ID NO: 220203 - RNA, 19 nt, Homo sapiens
gaaggaacuaaagguguuu

SEQ ID NO: 220204 - RNA, 19 nt, Homo sapiens
caagggagagacaugaaga

SEQ ID NO: 220205 - RNA, 19 nt, Homo sapiens
gauggcaggacgucugaaa

SEQ ID NO: 220206 - RNA, 19 nt, Homo sapiens
uggacuaccuuugcuaaga

SEQ ID NO: 220207 - RNA, 19 nt, Homo sapiens
gacuaaggcucagaagaag

SEQ ID NO: 220208 - RNA, 19 nt, Homo sapiens
uaaaaucugcggagaauug

SEQ ID NO: 220209 - RNA, 19 nt, Homo sapiens
gacuaccuuugcuaagaaa

SEQ ID NO: 220210 - RNA, 19 nt, Homo sapiens
guguuugcacuucauguua

SEQ ID NO: 220211 - RNA, 19 nt, Homo sapiens
aaucugcggagaauuguaa

SEQ ID NO: 220212 - RNA, 19 nt, Homo sapiens
caauggggaucaugaauuc

SEQ ID NO: 220213 - RNA, 19 nt, Homo sapiens
acugggaauucauuacuug

SEQ ID NO: 220214 - RNA, 19 nt, Homo sapiens
gcaauggggaucaugaauu

SEQ ID NO: 220215 - RNA, 19 nt, Homo sapiens
cauggacuaccuuugcuaa

SEQ ID NO: 220216 - RNA, 19 nt, Homo sapiens
ugaagacagaggagaaaug

SEQ ID NO: 220217 - RNA, 19 nt, Homo sapiens
gaagucucaucugccugaa

SEQ ID NO: 220218 - RNA, 19 nt, Homo sapiens
cuaaggcucagaagaagga

SEQ ID NO: 220219 - RNA, 19 nt, Homo sapiens
gguguuugcacuucauguu

SEQ ID NO: 220220 - RNA, 19 nt, Homo sapiens
ccaaguacaccaguuccaa

SEQ ID NO: 220221 - RNA, 19 nt, Homo sapiens
agaagaaggacgggaagaa

SEQ ID NO: 220222 - RNA, 19 nt, Homo sapiens
agaccuaguuacugggaau

SEQ ID NO: 220223 - RNA, 19 nt, Homo sapiens
gacagaggagaaaugaaug

SEQ ID NO: 220224 - RNA, 19 nt, Homo sapiens
caugaagacagaggagaaa

SEQ ID NO: 220225 - RNA, 19 nt, Homo sapiens
ccuaguuacugggaauuca

SEQ ID NO: 220226 - RNA, 19 nt, Homo sapiens
acaccggcaucucuuccaa

SEQ ID NO: 220227 - RNA, 19 nt, Homo sapiens
aauaaaaucugcggagaau

SEQ ID NO: 220228 - RNA, 19 nt, Homo sapiens
caagaaggcggugacuaag

SEQ ID NO: 220229 - RNA, 19 nt, Homo sapiens
aaagguguuugcacuucau

SEQ ID NO: 220230 - RNA, 19 nt, Homo sapiens
ccacccaaauccaacucau

SEQ ID NO: 220231 - RNA, 19 nt, Homo sapiens
cuaagaaaagucugaauga

SEQ ID NO: 220232 - RNA, 19 nt, Homo sapiens
auucauuacuugccaugga

SEQ ID NO: 220233 - RNA, 19 nt, Homo sapiens
gccugaaccuaccaagucu

SEQ ID NO: 220234 - RNA, 19 nt, Homo sapiens
gcuacgaugccugaaccua

SEQ ID NO: 220235 - RNA, 19 nt, Homo sapiens
ucaccaaguacaccaguuc

SEQ ID NO: 220236 - RNA, 19 nt, Homo sapiens
gccaagggagagacaugaa

SEQ ID NO: 220237 - RNA, 19 nt, Homo sapiens
gaagaaggaugguaagaag

SEQ ID NO: 220238 - RNA, 19 nt, Homo sapiens
ggagagcuauucuaucuau

SEQ ID NO: 220239 - RNA, 19 nt, Homo sapiens
gcaaggagagcuauucuau

SEQ ID NO: 220240 - RNA, 19 nt, Homo sapiens
gcuauucuaucuaugugua

SEQ ID NO: 220241 - RNA, 19 nt, Homo sapiens
cuaaggcaguuaccaagua

SEQ ID NO: 220242 - RNA, 19 nt, Homo sapiens
cuaagaaggcuaucacuaa

SEQ ID NO: 220243 - RNA, 19 nt, Homo sapiens
caaguacacuagcucuaaa

SEQ ID NO: 220244 - RNA, 19 nt, Homo sapiens
aauaagcgcucgaccauca

SEQ ID NO: 220245 - RNA, 19 nt, Homo sapiens
guacacuagcucuaaauaa

SEQ ID NO: 220246 - RNA, 19 nt, Homo sapiens
uaagaaggcuaucacuaag

SEQ ID NO: 220247 - RNA, 19 nt, Homo sapiens
ucacuaaggcgcagaagaa

SEQ ID NO: 220248 - RNA, 19 nt, Homo sapiens
gcacuaaggcaguuaccaa

SEQ ID NO: 220249 - RNA, 19 nt, Homo sapiens
gcaguuaccaaguacacua

SEQ ID NO: 220250 - RNA, 19 nt, Homo sapiens
aaggagagcuauucuaucu

SEQ ID NO: 220251 - RNA, 19 nt, Homo sapiens
ccaaguacacuagcucuaa

SEQ ID NO: 220252 - RNA, 19 nt, Homo sapiens
gagcuauucuaucuaugug

SEQ ID NO: 220253 - RNA, 19 nt, Homo sapiens
uacacuagcucuaaauaag

SEQ ID NO: 220254 - RNA, 19 nt, Homo sapiens
uguacaagguucugaagca

SEQ ID NO: 220255 - RNA, 19 nt, Homo sapiens
cuaaggcgcagaagaagga

SEQ ID NO: 220256 - RNA, 19 nt, Homo sapiens
ucgccuggcucacuacaau

SEQ ID NO: 220257 - RNA, 19 nt, Homo sapiens
agaagaaggaugguaagaa

SEQ ID NO: 220258 - RNA, 19 nt, Homo sapiens
uaaggcaguuaccaaguac

SEQ ID NO: 220259 - RNA, 19 nt, Homo sapiens
ucuaagaaggcuaucacua

SEQ ID NO: 220260 - RNA, 19 nt, Homo sapiens
cgagggcacuaaggcaguu

SEQ ID NO: 220261 - RNA, 19 nt, Homo sapiens
acaauaagcgcucgaccau

SEQ ID NO: 220262 - RNA, 19 nt, Homo sapiens
gagagcuauucuaucuaug

SEQ ID NO: 220263 - RNA, 19 nt, Homo sapiens
gccuggcucacuacaauaa

SEQ ID NO: 220264 - RNA, 19 nt, Homo sapiens
gcgcagaagaaggauggua

SEQ ID NO: 220265 - RNA, 19 nt, Homo sapiens
cgcagaagaaggaugguaa

SEQ ID NO: 220266 - RNA, 19 nt, Homo sapiens
gcagaagaaggaugguaag

SEQ ID NO: 220267 - RNA, 19 nt, Homo sapiens
cuucucgccuggcucacua

SEQ ID NO: 220268 - RNA, 19 nt, Homo sapiens
caaggagagcuauucuauc

SEQ ID NO: 220269 - RNA, 19 nt, Homo sapiens
acaccggcaucucauccaa

SEQ ID NO: 220270 - RNA, 19 nt, Homo sapiens
cagaagaaggaugguaaga

SEQ ID NO: 220271 - RNA, 19 nt, Homo sapiens
cuaucuauguguacaaggu

SEQ ID NO: 220272 - RNA, 19 nt, Homo sapiens
uauguaagcacuuccaaac

SEQ ID NO: 220273 - RNA, 19 nt, Homo sapiens
gcacuuccaaacccaaagg

SEQ ID NO: 220274 - RNA, 19 nt, Homo sapiens
acacuagcucuaaauaagu

SEQ ID NO: 220275 - RNA, 19 nt, Homo sapiens
aguacacuagcucuaaaua

SEQ ID NO: 220276 - RNA, 19 nt, Homo sapiens
ggacagaaaucagguauug

SEQ ID NO: 220277 - RNA, 19 nt, Homo sapiens
ggaagcaacuggcuacaaa

SEQ ID NO: 220278 - RNA, 19 nt, Homo sapiens
gaagaaaccucaucguuac

SEQ ID NO: 220279 - RNA, 19 nt, Homo sapiens
gcggagacguaaagcauua

SEQ ID NO: 220280 - RNA, 19 nt, Homo sapiens
ugaagaaaccucaucguua

SEQ ID NO: 220281 - RNA, 19 nt, Homo sapiens
gcaacuaaaugguguuugu

SEQ ID NO: 220282 - RNA, 19 nt, Homo sapiens
guaccuaaguauaugauug

SEQ ID NO: 220283 - RNA, 19 nt, Homo sapiens
ccuguaaguuugcuauuaa

SEQ ID NO: 220284 - RNA, 19 nt, Homo sapiens
uuucagcgguucaacuuua

SEQ ID NO: 220285 - RNA, 19 nt, Homo sapiens
gccaaacguguaacaauua

SEQ ID NO: 220286 - RNA, 19 nt, Homo sapiens
gcaaaucgaccggugguaa

SEQ ID NO: 220287 - RNA, 19 nt, Homo sapiens
gcgguucaacuuuauaaua

SEQ ID NO: 220288 - RNA, 19 nt, Homo sapiens
ccacugaacuucugauucg

SEQ ID NO: 220289 - RNA, 19 nt, Homo sapiens
ccaaacguguaacaauuau

SEQ ID NO: 220290 - RNA, 19 nt, Homo sapiens
uggagaacgugcuuaagaa

SEQ ID NO: 220291 - RNA, 19 nt, Homo sapiens
ugccaaacguguaacaauu

SEQ ID NO: 220292 - RNA, 19 nt, Homo sapiens
aaagguaccuaaguauaug

SEQ ID NO: 220293 - RNA, 19 nt, Homo sapiens
gcgcagcuaucggugcuuu

SEQ ID NO: 220294 - RNA, 19 nt, Homo sapiens
uaccauggcucguacaaag

SEQ ID NO: 220295 - RNA, 19 nt, Homo sapiens
aaucagguauuggcaguuu

SEQ ID NO: 220296 - RNA, 19 nt, Homo sapiens
caaaucgaccggugguaaa

SEQ ID NO: 220297 - RNA, 19 nt, Homo sapiens
aaacagaucugcgcuucca

SEQ ID NO: 220298 - RNA, 19 nt, Homo sapiens
gugaagaaaccucaucguu

SEQ ID NO: 220299 - RNA, 19 nt, Homo sapiens
caacuaaaugguguuugua

SEQ ID NO: 220300 - RNA, 19 nt, Homo sapiens
ggagaacgugcuuaagaau

SEQ ID NO: 220301 - RNA, 19 nt, Homo sapiens
guggagaacgugcuuaaga

SEQ ID NO: 220302 - RNA, 19 nt, Homo sapiens
caaaagguaccuaaguaua

SEQ ID NO: 220303 - RNA, 19 nt, Homo sapiens
gucaaaagguaccuaagua

SEQ ID NO: 220304 - RNA, 19 nt, Homo sapiens
ccagcuagcacgccgcaua

SEQ ID NO: 220305 - RNA, 19 nt, Homo sapiens
guguaacaauuaugccaaa

SEQ ID NO: 220306 - RNA, 19 nt, Homo sapiens
ucuuauugauggcaacuaa

SEQ ID NO: 220307 - RNA, 19 nt, Homo sapiens
uaaguaaggaggucucugu

SEQ ID NO: 220308 - RNA, 19 nt, Homo sapiens
cuucugugcuguuccugua

SEQ ID NO: 220309 - RNA, 19 nt, Homo sapiens
aauguugucugucuucugu

SEQ ID NO: 220310 - RNA, 19 nt, Homo sapiens
uccuguaaguuugcuauua

SEQ ID NO: 220311 - RNA, 19 nt, Homo sapiens
gugcuguuccuguaaguuu

SEQ ID NO: 220312 - RNA, 19 nt, Homo sapiens
aaauugcucaggacuuuaa

SEQ ID NO: 220313 - RNA, 19 nt, Homo sapiens
uacaguagauuccauccau

SEQ ID NO: 220314 - RNA, 19 nt, Homo sapiens
uaaaugcggagacguaaag

SEQ ID NO: 220315 - RNA, 19 nt, Homo sapiens
caaccugugugcuauccau

SEQ ID NO: 220316 - RNA, 19 nt, Homo sapiens
gaacuucugauucgcaaac

SEQ ID NO: 220317 - RNA, 19 nt, Homo sapiens
gagaacgugcuuaagaauc

SEQ ID NO: 220318 - RNA, 19 nt, Homo sapiens
uaaaugguguuuguagcau

SEQ ID NO: 220319 - RNA, 19 nt, Homo sapiens
guaaagcacccaggaagca

SEQ ID NO: 220320 - RNA, 19 nt, Homo sapiens
cagcgguucaacuuuauaa

SEQ ID NO: 220321 - RNA, 19 nt, Homo sapiens
acaguagauuccauccauu

SEQ ID NO: 220322 - RNA, 19 nt, Homo sapiens
ugaguuguccuacaugcaa

SEQ ID NO: 220323 - RNA, 19 nt, Homo sapiens
auauaaaugcggagacgua

SEQ ID NO: 220324 - RNA, 19 nt, Homo sapiens
cauccauucacuauacuuu

SEQ ID NO: 220325 - RNA, 19 nt, Homo sapiens
guggcgcuccgugaaauua

SEQ ID NO: 220326 - RNA, 19 nt, Homo sapiens
uauaaaugcggagacguaa

SEQ ID NO: 220327 - RNA, 19 nt, Homo sapiens
gcucaggacuuuaaaacag

SEQ ID NO: 220328 - RNA, 19 nt, Homo sapiens
uagauuccauccauucacu

SEQ ID NO: 220329 - RNA, 19 nt, Homo sapiens
agaacgugcuuaagaaucc

SEQ ID NO: 220330 - RNA, 19 nt, Homo sapiens
gauuccauccauucacuau

SEQ ID NO: 220331 - RNA, 19 nt, Homo sapiens
cuaaaugguguuuguagca

SEQ ID NO: 220332 - RNA, 19 nt, Homo sapiens
ggagacguaaagcauuaau

SEQ ID NO: 220333 - RNA, 19 nt, Homo sapiens
gagacguaaagcauuaaug

SEQ ID NO: 220334 - RNA, 19 nt, Homo sapiens
ggcgcuccgugaaauuaga

SEQ ID NO: 220335 - RNA, 19 nt, Homo sapiens
aaacguguaacaauuaugc

SEQ ID NO: 220336 - RNA, 19 nt, Homo sapiens
caguagauuccauccauuc

SEQ ID NO: 220337 - RNA, 19 nt, Homo sapiens
uuccauccauucacuauac

SEQ ID NO: 220338 - RNA, 19 nt, Homo sapiens
uauaugauugcgaguggaa

SEQ ID NO: 220339 - RNA, 19 nt, Homo sapiens
gcaaacagcuggccacgaa

SEQ ID NO: 220340 - RNA, 19 nt, Homo sapiens
guacuagaguugauaaaug

SEQ ID NO: 220341 - RNA, 19 nt, Homo sapiens
ggagagagagcuuaaguga

SEQ ID NO: 220342 - RNA, 19 nt, Homo sapiens
ccaguuggcucgccggaua

SEQ ID NO: 220343 - RNA, 19 nt, Homo sapiens
gcauguuucuguauguuaa

SEQ ID NO: 220344 - RNA, 19 nt, Homo sapiens
agagagagcuuaagugaag

SEQ ID NO: 220345 - RNA, 19 nt, Homo sapiens
gcucaggagugacaaguug

SEQ ID NO: 220346 - RNA, 19 nt, Homo sapiens
gaaccucugccaauuaaga

SEQ ID NO: 220347 - RNA, 19 nt, Homo sapiens
uuaagaugguguuggguua

SEQ ID NO: 220348 - RNA, 19 nt, Homo sapiens
gcuguuaagucugaccaua

SEQ ID NO: 220349 - RNA, 19 nt, Homo sapiens
gguuacaucugguuacugu

SEQ ID NO: 220350 - RNA, 19 nt, Homo sapiens
uaagguguguguaauuuag

SEQ ID NO: 220351 - RNA, 19 nt, Homo sapiens
gaauacacuaugugcauuu

SEQ ID NO: 220352 - RNA, 19 nt, Homo sapiens
cugaaccucugccaauuaa

SEQ ID NO: 220353 - RNA, 19 nt, Homo sapiens
caucuuaacuaacauucug

SEQ ID NO: 220354 - RNA, 19 nt, Homo sapiens
gcagaagggaugggugaua

SEQ ID NO: 220355 - RNA, 19 nt, Homo sapiens
gcuaagagagucaccauca

SEQ ID NO: 220356 - RNA, 19 nt, Homo sapiens
cuaacauucugaacuaguu

SEQ ID NO: 220357 - RNA, 19 nt, Homo sapiens
uuggguagcuauuaaggua

SEQ ID NO: 220358 - RNA, 19 nt, Homo sapiens
gugacaaguugcuaauaug

SEQ ID NO: 220359 - RNA, 19 nt, Homo sapiens
ccagcaucaucuuaacuaa

SEQ ID NO: 220360 - RNA, 19 nt, Homo sapiens
gcauaaguccucauucuac

SEQ ID NO: 220361 - RNA, 19 nt, Homo sapiens
guauguuaaugacuuguug

SEQ ID NO: 220362 - RNA, 19 nt, Homo sapiens
gagauucgucguuaucaga

SEQ ID NO: 220363 - RNA, 19 nt, Homo sapiens
ccacugaaccucugccaau

SEQ ID NO: 220364 - RNA, 19 nt, Homo sapiens
ucacaccagcaucaucuua

SEQ ID NO: 220365 - RNA, 19 nt, Homo sapiens
cuauuaagguacuagaguu

SEQ ID NO: 220366 - RNA, 19 nt, Homo sapiens
cuuaagucauuccaucuuu

SEQ ID NO: 220367 - RNA, 19 nt, Homo sapiens
gcccaaagacauccaguug

SEQ ID NO: 220368 - RNA, 19 nt, Homo sapiens
ucuuguggcauuuguauua

SEQ ID NO: 220369 - RNA, 19 nt, Homo sapiens
gacugcacuuguucucaua

SEQ ID NO: 220370 - RNA, 19 nt, Homo sapiens
aaguaaaccuggcagcuau

SEQ ID NO: 220371 - RNA, 19 nt, Homo sapiens
gcacuuguucucauaguag

SEQ ID NO: 220372 - RNA, 19 nt, Homo sapiens
aaaccuggcagcuauagaa

SEQ ID NO: 220373 - RNA, 19 nt, Homo sapiens
agugacaaguugcuaauau

SEQ ID NO: 220374 - RNA, 19 nt, Homo sapiens
ggagaucgcgcaggauuuc

SEQ ID NO: 220375 - RNA, 19 nt, Homo sapiens
cacgaaagccgccaggaaa

SEQ ID NO: 220376 - RNA, 19 nt, Homo sapiens
agagauggccuuccaagug

SEQ ID NO: 220377 - RNA, 19 nt, Homo sapiens
uaagagagucaccaucaug

SEQ ID NO: 220378 - RNA, 19 nt, Homo sapiens
gaugcauguuucuguaugu

SEQ ID NO: 220379 - RNA, 19 nt, Homo sapiens
ccacgaaagccgccaggaa

SEQ ID NO: 220380 - RNA, 19 nt, Homo sapiens
uuaacccucuagcugauaa

SEQ ID NO: 220381 - RNA, 19 nt, Homo sapiens
ugacugcacuuguucucau

SEQ ID NO: 220382 - RNA, 19 nt, Homo sapiens
agaauacacuaugugcauu

SEQ ID NO: 220383 - RNA, 19 nt, Homo sapiens
gaagggaugggugauacuu

SEQ ID NO: 220384 - RNA, 19 nt, Homo sapiens
gagagagagcuuaagugaa

SEQ ID NO: 220385 - RNA, 19 nt, Homo sapiens
aaaguaaaccuggcagcua

SEQ ID NO: 220386 - RNA, 19 nt, Homo sapiens
gugauagaaugugggcuuu

SEQ ID NO: 220387 - RNA, 19 nt, Homo sapiens
uaaaacugguuaugacuug

SEQ ID NO: 220388 - RNA, 19 nt, Homo sapiens
ggugauacuucuugcuucu

SEQ ID NO: 220389 - RNA, 19 nt, Homo sapiens
aaacaguaccgaaguucuu

SEQ ID NO: 220390 - RNA, 19 nt, Homo sapiens
ggaaacaguaccgaaguuc

SEQ ID NO: 220391 - RNA, 19 nt, Homo sapiens
gcugauaaugcaaacacua

SEQ ID NO: 220392 - RNA, 19 nt, Homo sapiens
agucuuaaccacaguguaa

SEQ ID NO: 220393 - RNA, 19 nt, Homo sapiens
cuuguuggguagcuauuaa

SEQ ID NO: 220394 - RNA, 19 nt, Homo sapiens
ggagugacaaguugcuaau

SEQ ID NO: 220395 - RNA, 19 nt, Homo sapiens
gugggucuguucgaagaua

SEQ ID NO: 220396 - RNA, 19 nt, Homo sapiens
gcagcuauagaauacacua

SEQ ID NO: 220397 - RNA, 19 nt, Homo sapiens
ccuggcagcuauagaauac

SEQ ID NO: 220398 - RNA, 19 nt, Homo sapiens
uucgagagauucgucguua

SEQ ID NO: 220399 - RNA, 19 nt, Homo sapiens
cagaagggaugggugauac

SEQ ID NO: 220400 - RNA, 19 nt, Homo sapiens
gucauuaagguguguguaa

SEQ ID NO: 220401 - RNA, 19 nt, Homo sapiens
gaaacaguaccgaaguucu

SEQ ID NO: 220402 - RNA, 19 nt, Homo sapiens
gaggaaacaguaccgaagu

SEQ ID NO: 220403 - RNA, 19 nt, Homo sapiens
ggagucuugucauuaaggu

SEQ ID NO: 220404 - RNA, 19 nt, Homo sapiens
uuaaccacaguguaacuua

SEQ ID NO: 220405 - RNA, 19 nt, Homo sapiens
uaagguacuagaguugaua

SEQ ID NO: 220406 - RNA, 19 nt, Homo sapiens
ucaccaucaugcccaaaga

SEQ ID NO: 220407 - RNA, 19 nt, Homo sapiens
agcaucaucuuaacuaaca

SEQ ID NO: 220408 - RNA, 19 nt, Homo sapiens
guaauuuagaguccaguug

SEQ ID NO: 220409 - RNA, 19 nt, Homo sapiens
ugauacuucuugcuucuca

SEQ ID NO: 220410 - RNA, 19 nt, Homo sapiens
aggaaacaguaccgaaguu

SEQ ID NO: 220411 - RNA, 19 nt, Homo sapiens
gguacuagaguugauaaau

SEQ ID NO: 220412 - RNA, 19 nt, Homo sapiens
gcuauuaagguacuagagu

SEQ ID NO: 220413 - RNA, 19 nt, Homo sapiens
ggaugggugauacuucuug

SEQ ID NO: 220414 - RNA, 19 nt, Homo sapiens
ggucggagaaguggccuaa

SEQ ID NO: 220415 - RNA, 19 nt, Homo sapiens
gguguuggguuagguuaca

SEQ ID NO: 220416 - RNA, 19 nt, Homo sapiens
cacugaaccucugccaauu

SEQ ID NO: 220417 - RNA, 19 nt, Homo sapiens
cugauaaugcaaacacuaa

SEQ ID NO: 220418 - RNA, 19 nt, Homo sapiens
uugcauaaguccucauucu

SEQ ID NO: 220419 - RNA, 19 nt, Homo sapiens
gagugacaaguugcuaaua

SEQ ID NO: 220420 - RNA, 19 nt, Homo sapiens
uuaagucauuccaucuuuc

SEQ ID NO: 220421 - RNA, 19 nt, Homo sapiens
gaucgcgcaggauuucaaa

SEQ ID NO: 220422 - RNA, 19 nt, Homo sapiens
acugaaccucugccaauua

SEQ ID NO: 220423 - RNA, 19 nt, Homo sapiens
uagaauacacuaugugcau

SEQ ID NO: 220424 - RNA, 19 nt, Homo sapiens
ugaugcauguuucuguaug

SEQ ID NO: 220425 - RNA, 19 nt, Homo sapiens
cgagagauucgucguuauc

SEQ ID NO: 220426 - RNA, 19 nt, Homo sapiens
cuaagagagucaccaucau

SEQ ID NO: 220427 - RNA, 19 nt, Homo sapiens
gggagaucgcgcaggauuu

SEQ ID NO: 220428 - RNA, 19 nt, Homo sapiens
ggucucauaacuagguuga

SEQ ID NO: 220429 - RNA, 19 nt, Homo sapiens
ccaguugguuuucuucuga

SEQ ID NO: 220430 - RNA, 19 nt, Homo sapiens
uguuaagucugaccauaca

SEQ ID NO: 220431 - RNA, 19 nt, Homo sapiens
caucaugcccaaagacauc

SEQ ID NO: 220432 - RNA, 19 nt, Homo sapiens
uuauagagauggccuucca

SEQ ID NO: 220433 - RNA, 19 nt, Homo sapiens
gugguuggucucauaacua

SEQ ID NO: 220434 - RNA, 19 nt, Homo sapiens
cacaccagcaucaucuuaa

SEQ ID NO: 220435 - RNA, 19 nt, Homo sapiens
uuuauaagggcucuagaaa

SEQ ID NO: 220436 - RNA, 19 nt, Homo sapiens
ugugugccauccacgcuaa

SEQ ID NO: 220437 - RNA, 19 nt, Homo sapiens
cucauucuaccacauguua

SEQ ID NO: 220438 - RNA, 19 nt, Homo sapiens
uaagucauuccaucuuuca

SEQ ID NO: 220439 - RNA, 19 nt, Homo sapiens
gcggaucucuggccucauu

SEQ ID NO: 220440 - RNA, 19 nt, Homo sapiens
ggaaaaggcuuaggcaaag

SEQ ID NO: 220441 - RNA, 19 nt, Homo sapiens
gcggugugcugaagguguu

SEQ ID NO: 220442 - RNA, 19 nt, Homo sapiens
ggaucucuggccucauuua

SEQ ID NO: 220443 - RNA, 19 nt, Homo sapiens
gcuccagcuuugcacguuu

SEQ ID NO: 220444 - RNA, 19 nt, Homo sapiens
ugaagguguuccuggagaa

SEQ ID NO: 220445 - RNA, 19 nt, Homo sapiens
ucucuggccucauuuacga

SEQ ID NO: 220446 - RNA, 19 nt, Homo sapiens
gaagguguuccuggagaau

SEQ ID NO: 220447 - RNA, 19 nt, Homo sapiens
ucaccaagccugccauucg

SEQ ID NO: 220448 - RNA, 19 nt, Homo sapiens
gagcacgccaagcgcaaga

SEQ ID NO: 220449 - RNA, 19 nt, Homo sapiens
gcagaggaaagggcggaaa

SEQ ID NO: 220450 - RNA, 19 nt, Homo sapiens
gcacguuucgaucccaaag

SEQ ID NO: 220451 - RNA, 19 nt, Homo sapiens
ccucaaagguggcuacaaa

SEQ ID NO: 220452 - RNA, 19 nt, Homo sapiens
gaaagcggcacccaagaaa

SEQ ID NO: 220453 - RNA, 19 nt, Homo sapiens
gaacaacagccgcauuaag

SEQ ID NO: 220454 - RNA, 19 nt, Homo sapiens
gcuacgacguggagaagaa

SEQ ID NO: 220455 - RNA, 19 nt, Homo sapiens
aagaacaacagccgcauua

SEQ ID NO: 220456 - RNA, 19 nt, Homo sapiens
uauuuggugugcuguguua

SEQ ID NO: 220457 - RNA, 19 nt, Homo sapiens
ccuucaagcucaacaagaa

SEQ ID NO: 220458 - RNA, 19 nt, Homo sapiens
gaagaacaacagccgcauu

SEQ ID NO: 220459 - RNA, 19 nt, Homo sapiens
ggcaacgggugcaucuaaa

SEQ ID NO: 220460 - RNA, 19 nt, Homo sapiens
uuaagagccugguaagcaa

SEQ ID NO: 220461 - RNA, 19 nt, Homo sapiens
gcaaagaaaccugcuaagg

SEQ ID NO: 220462 - RNA, 19 nt, Homo sapiens
gaaggcguccuccguggaa

SEQ ID NO: 220463 - RNA, 19 nt, Homo sapiens
ucagguuuauaccacuuua

SEQ ID NO: 220464 - RNA, 19 nt, Homo sapiens
guaaagcccaagaaaguag

SEQ ID NO: 220465 - RNA, 19 nt, Homo sapiens
gcagcagccuccaagaaaa

SEQ ID NO: 220466 - RNA, 19 nt, Homo sapiens
agaaagcggcacccaagaa

SEQ ID NO: 220467 - RNA, 19 nt, Homo sapiens
gcaagaaggcaaagaaacc

SEQ ID NO: 220468 - RNA, 19 nt, Homo sapiens
ggcauuaagagccugguaa

SEQ ID NO: 220469 - RNA, 19 nt, Homo sapiens
ggaaauccuccaagaaucc

SEQ ID NO: 220470 - RNA, 19 nt, Homo sapiens
cuaaagcuaaggcuguaaa

SEQ ID NO: 220471 - RNA, 19 nt, Homo sapiens
uaaaagcccugcuaaagcu

SEQ ID NO: 220472 - RNA, 19 nt, Homo sapiens
uguaaagcccaagaaagua

SEQ ID NO: 220473 - RNA, 19 nt, Homo sapiens
cgcauuaagcugggcauua

SEQ ID NO: 220474 - RNA, 19 nt, Homo sapiens
ccaagaaaguagcuaaaag

SEQ ID NO: 220475 - RNA, 19 nt, Homo sapiens
gcauuaagagccugguaag

SEQ ID NO: 220476 - RNA, 19 nt, Homo sapiens
uaacccaacggcucuuuua

SEQ ID NO: 220477 - RNA, 19 nt, Homo sapiens
cuguaaagcccaagaaagu

SEQ ID NO: 220478 - RNA, 19 nt, Homo sapiens
gcccaagaaaguagcuaaa

SEQ ID NO: 220479 - RNA, 19 nt, Homo sapiens
uuagucaccaugucugaaa

SEQ ID NO: 220480 - RNA, 19 nt, Homo sapiens
aggcaacgggugcaucuaa

SEQ ID NO: 220481 - RNA, 19 nt, Homo sapiens
ugcagcagccuccaagaaa

SEQ ID NO: 220482 - RNA, 19 nt, Homo sapiens
gaagccaaagacugccaaa

SEQ ID NO: 220483 - RNA, 19 nt, Homo sapiens
aggcaaagaaaccugcuaa

SEQ ID NO: 220484 - RNA, 19 nt, Homo sapiens
ccaaggcuagggugacgaa

SEQ ID NO: 220485 - RNA, 19 nt, Homo sapiens
ugcuaaagcuaaggcugua

SEQ ID NO: 220486 - RNA, 19 nt, Homo sapiens
gcuaaaagcccugcuaaag

SEQ ID NO: 220487 - RNA, 19 nt, Homo sapiens
aaacuguaaagcccaagaa

SEQ ID NO: 220488 - RNA, 19 nt, Homo sapiens
cgucagguuuauaccacuu

SEQ ID NO: 220489 - RNA, 19 nt, Homo sapiens
gagcgucaagacuccgaaa

SEQ ID NO: 220490 - RNA, 19 nt, Homo sapiens
gucguuggcagcucuuaaa

SEQ ID NO: 220491 - RNA, 19 nt, Homo sapiens
uggcaagaaggcaaagaaa

SEQ ID NO: 220492 - RNA, 19 nt, Homo sapiens
gagccucggguuccuucaa

SEQ ID NO: 220493 - RNA, 19 nt, Homo sapiens
gggcauuaagagccuggua

SEQ ID NO: 220494 - RNA, 19 nt, Homo sapiens
gaaaguggcuucuaaggua

SEQ ID NO: 220495 - RNA, 19 nt, Homo sapiens
gaaauuaggcgccuuguuu

SEQ ID NO: 220496 - RNA, 19 nt, Homo sapiens
gaaccaccaucacaucuuu

SEQ ID NO: 220497 - RNA, 19 nt, Homo sapiens
gaucaaagccaccaucaaa

SEQ ID NO: 220498 - RNA, 19 nt, Homo sapiens
gagaaucuauggaggcuuu

SEQ ID NO: 220499 - RNA, 19 nt, Homo sapiens
gaaauucugugaaauaggu

SEQ ID NO: 220500 - RNA, 19 nt, Homo sapiens
ccaaauacgugaagacugu

SEQ ID NO: 220501 - RNA, 19 nt, Homo sapiens
caaagccaaucucucauuu

SEQ ID NO: 220502 - RNA, 19 nt, Homo sapiens
gagaagauauucaaguaca

SEQ ID NO: 220503 - RNA, 19 nt, Homo sapiens
ggaauacugugaugucuca

SEQ ID NO: 220504 - RNA, 19 nt, Homo sapiens
gaccagcauuugcacaaua

SEQ ID NO: 220505 - RNA, 19 nt, Homo sapiens
ucagagaggaccacaaaua

SEQ ID NO: 220506 - RNA, 19 nt, Homo sapiens
uggagaagauauucaagua

SEQ ID NO: 220507 - RNA, 19 nt, Homo sapiens
gcaggagaauuacaacaug

SEQ ID NO: 220508 - RNA, 19 nt, Homo sapiens
cagcagggccuucuucuuu

SEQ ID NO: 220509 - RNA, 19 nt, Homo sapiens
gaaaaucaguguucacaga

SEQ ID NO: 220510 - RNA, 19 nt, Homo sapiens
gggaauaagugucagaaag

SEQ ID NO: 220511 - RNA, 19 nt, Homo sapiens
gaagagaacaccaguagca

SEQ ID NO: 220512 - RNA, 19 nt, Homo sapiens
gcagcugccuggcuccuuu

SEQ ID NO: 220513 - RNA, 19 nt, Homo sapiens
gaauaagugucagaaagug

SEQ ID NO: 220514 - RNA, 19 nt, Homo sapiens
gcaaagccaaucucucauu

SEQ ID NO: 220515 - RNA, 19 nt, Homo sapiens
gaacaccaguagcacacuu

SEQ ID NO: 220516 - RNA, 19 nt, Homo sapiens
gcacagggagcauuuaaca

SEQ ID NO: 220517 - RNA, 19 nt, Homo sapiens
gagcugcguuucacacuuc

SEQ ID NO: 220518 - RNA, 19 nt, Homo sapiens
gaaucaacacaacauagua

SEQ ID NO: 220519 - RNA, 19 nt, Homo sapiens
ugaaauagguucugaugac

SEQ ID NO: 220520 - RNA, 19 nt, Homo sapiens
gagaggaccacaaauacaa

SEQ ID NO: 220521 - RNA, 19 nt, Homo sapiens
gauauugcauugcucaagu

SEQ ID NO: 220522 - RNA, 19 nt, Homo sapiens
ucacacuucuuuagagcua

SEQ ID NO: 220523 - RNA, 19 nt, Homo sapiens
agaggaagaucaagagaau

SEQ ID NO: 220524 - RNA, 19 nt, Homo sapiens
ggaauaagugucagaaagu

SEQ ID NO: 220525 - RNA, 19 nt, Homo sapiens
ccugaugucuuuauuggaa

SEQ ID NO: 220526 - RNA, 19 nt, Homo sapiens
gaccacaaauacaacauuc

SEQ ID NO: 220527 - RNA, 19 nt, Homo sapiens
aaacacaaguccuuaaacu

SEQ ID NO: 220528 - RNA, 19 nt, Homo sapiens
gggaaauucugugaaauag

SEQ ID NO: 220529 - RNA, 19 nt, Homo sapiens
ucucagacccaugaaauua

SEQ ID NO: 220530 - RNA, 19 nt, Homo sapiens
agaccuggcuucuuucuuc

SEQ ID NO: 220531 - RNA, 19 nt, Homo sapiens
gcagagaggaagaucaaga

SEQ ID NO: 220532 - RNA, 19 nt, Homo sapiens
gaaaucaaagccaucugaa

SEQ ID NO: 220533 - RNA, 19 nt, Homo sapiens
ccacuacaaugaaagagau

SEQ ID NO: 220534 - RNA, 19 nt, Homo sapiens
guacagccacuacaaugaa

SEQ ID NO: 220535 - RNA, 19 nt, Homo sapiens
ggagaauuacaacauguuu

SEQ ID NO: 220536 - RNA, 19 nt, Homo sapiens
ucugaugacugcuauguug

SEQ ID NO: 220537 - RNA, 19 nt, Homo sapiens
gaaauagguucugaugacu

SEQ ID NO: 220538 - RNA, 19 nt, Homo sapiens
ccacaggacacgcuaagaa

SEQ ID NO: 220539 - RNA, 19 nt, Homo sapiens
acacccaaguuaccaaauu

SEQ ID NO: 220540 - RNA, 19 nt, Homo sapiens
uugcauugcucaaguuaaa

SEQ ID NO: 220541 - RNA, 19 nt, Homo sapiens
gaacucccaccuccucuug

SEQ ID NO: 220542 - RNA, 19 nt, Homo sapiens
guacuacacugaggaccaa

SEQ ID NO: 220543 - RNA, 19 nt, Homo sapiens
uaauggcucuggugggaaa

SEQ ID NO: 220544 - RNA, 19 nt, Homo sapiens
ccaauuguaccuucuagaa

SEQ ID NO: 220545 - RNA, 19 nt, Homo sapiens
gauuacagcuacgaggauu

SEQ ID NO: 220546 - RNA, 19 nt, Homo sapiens
agaaagcccugcaggaagu

SEQ ID NO: 220547 - RNA, 19 nt, Homo sapiens
gcaggaaugagaaagcaaa

SEQ ID NO: 220548 - RNA, 19 nt, Homo sapiens
uaucagagaggaccacaaa

SEQ ID NO: 220549 - RNA, 19 nt, Homo sapiens
ggaaucaacacaacauagu

SEQ ID NO: 220550 - RNA, 19 nt, Homo sapiens
cuaaaggcauagacaacaa

SEQ ID NO: 220551 - RNA, 19 nt, Homo sapiens
gaaaugggaauacugugau

SEQ ID NO: 220552 - RNA, 19 nt, Homo sapiens
gguucucccugaugucuuu

SEQ ID NO: 220553 - RNA, 19 nt, Homo sapiens
gcgagucccugacccuuuc

SEQ ID NO: 220554 - RNA, 19 nt, Homo sapiens
gccaaucucucauuuagac

SEQ ID NO: 220555 - RNA, 19 nt, Homo sapiens
ccacaugauugaugacagu

SEQ ID NO: 220556 - RNA, 19 nt, Homo sapiens
ccacugagccaucaaccaa

SEQ ID NO: 220557 - RNA, 19 nt, Homo sapiens
cgaaaucaaagccaucuga

SEQ ID NO: 220558 - RNA, 19 nt, Homo sapiens
ggaccacacaguagacuau

SEQ ID NO: 220559 - RNA, 19 nt, Homo sapiens
gagaggaagaucaagagaa

SEQ ID NO: 220560 - RNA, 19 nt, Homo sapiens
ccaaugacaaggugaaaug

SEQ ID NO: 220561 - RNA, 19 nt, Homo sapiens
aagccaaucucucauuuag

SEQ ID NO: 220562 - RNA, 19 nt, Homo sapiens
aaacauaccccaaguuaaa

SEQ ID NO: 220563 - RNA, 19 nt, Homo sapiens
ccaacucuaugaccacaug

SEQ ID NO: 220564 - RNA, 19 nt, Homo sapiens
ggaccacaaauacaacauu

SEQ ID NO: 220565 - RNA, 19 nt, Homo sapiens
aagugaaaguggcuucuaa

SEQ ID NO: 220566 - RNA, 19 nt, Homo sapiens
gcuccuuucucugggaaua

SEQ ID NO: 220567 - RNA, 19 nt, Homo sapiens
gaacuaauggcugugacuu

SEQ ID NO: 220568 - RNA, 19 nt, Homo sapiens
auuuagaccuggcuucuuu

SEQ ID NO: 220569 - RNA, 19 nt, Homo sapiens
aagcaaagccaaucucuca

SEQ ID NO: 220570 - RNA, 19 nt, Homo sapiens
gaaaacacaaguccuuaaa

SEQ ID NO: 220571 - RNA, 19 nt, Homo sapiens
caggaaaucuucagaaacc

SEQ ID NO: 220572 - RNA, 19 nt, Homo sapiens
ugcaggaaaucuucagaaa

SEQ ID NO: 220573 - RNA, 19 nt, Homo sapiens
gauggucacugugcucuag

SEQ ID NO: 220574 - RNA, 19 nt, Homo sapiens
gagaugagauuccccacaa

SEQ ID NO: 220575 - RNA, 19 nt, Homo sapiens
ggguuugacuccuguggaa

SEQ ID NO: 220576 - RNA, 19 nt, Homo sapiens
aagcggagauccaaguuca

SEQ ID NO: 220577 - RNA, 19 nt, Homo sapiens
ggcugugacuucagagaaa

SEQ ID NO: 220578 - RNA, 19 nt, Homo sapiens
uaauggcugugacuucaga

SEQ ID NO: 220579 - RNA, 19 nt, Homo sapiens
gaaagcaaagccaaucucu

SEQ ID NO: 220580 - RNA, 19 nt, Homo sapiens
gaagcacagggagcauuua

SEQ ID NO: 220581 - RNA, 19 nt, Homo sapiens
gcaaaugcagacuccagaa

SEQ ID NO: 220582 - RNA, 19 nt, Homo sapiens
caaugaaagagaugagauu

SEQ ID NO: 220583 - RNA, 19 nt, Homo sapiens
gcuaccugcucccggcaua

SEQ ID NO: 220584 - RNA, 19 nt, Homo sapiens
ccaagugguuccuguaugc

SEQ ID NO: 220585 - RNA, 19 nt, Homo sapiens
gggagcaccuucacaugca

SEQ ID NO: 220586 - RNA, 19 nt, Homo sapiens
agagcuagcugaccuuugg

SEQ ID NO: 220587 - RNA, 19 nt, Homo sapiens
gaugucugaucuccauguu

SEQ ID NO: 220588 - RNA, 19 nt, Homo sapiens
caauuguaccuucuagaaa

SEQ ID NO: 220589 - RNA, 19 nt, Homo sapiens
caugauugaugacaguaug

SEQ ID NO: 220590 - RNA, 19 nt, Homo sapiens
ugaaaugggaauacuguga

SEQ ID NO: 220591 - RNA, 19 nt, Homo sapiens
uaugaucugugcaggaaau

SEQ ID NO: 220592 - RNA, 19 nt, Homo sapiens
cuacuacgucuaugggaua

SEQ ID NO: 220593 - RNA, 19 nt, Homo sapiens
gcuuuaggguggagaagau

SEQ ID NO: 220594 - RNA, 19 nt, Homo sapiens
ggauguagcugucaacugu

SEQ ID NO: 220595 - RNA, 19 nt, Homo sapiens
gcaaacagcucuggcucua

SEQ ID NO: 220596 - RNA, 19 nt, Homo sapiens
uagcaagacguacaacuua

SEQ ID NO: 220597 - RNA, 19 nt, Homo sapiens
gaagggagaaggcagagaa

SEQ ID NO: 220598 - RNA, 19 nt, Homo sapiens
gcaagacguacaacuuaaa

SEQ ID NO: 220599 - RNA, 19 nt, Homo sapiens
ccaagaaguuaggaaacaa

SEQ ID NO: 220600 - RNA, 19 nt, Homo sapiens
gccaagaaguuaggaaaca

SEQ ID NO: 220601 - RNA, 19 nt, Homo sapiens
ggaucuggcucccauaggu

SEQ ID NO: 220602 - RNA, 19 nt, Homo sapiens
ugaccagccucccagagaa

SEQ ID NO: 220603 - RNA, 19 nt, Homo sapiens
ugagaaggaugugcaaaca

SEQ ID NO: 220604 - RNA, 19 nt, Homo sapiens
cagccgacgugaccucuga

SEQ ID NO: 220605 - RNA, 19 nt, Homo sapiens
gaucuggcucccauaggua

SEQ ID NO: 220606 - RNA, 19 nt, Homo sapiens
gcaugacacugcccauugc

SEQ ID NO: 220607 - RNA, 19 nt, Homo sapiens
ccugguggcuggugagaug

SEQ ID NO: 220608 - RNA, 19 nt, Homo sapiens
agacguacaacuuaaagaa

SEQ ID NO: 220609 - RNA, 19 nt, Homo sapiens
ggcccaagccaagaaguua

SEQ ID NO: 220610 - RNA, 19 nt, Homo sapiens
aagaagggccagacccaua

SEQ ID NO: 220611 - RNA, 19 nt, Homo sapiens
uggacaagcugcauacucu

SEQ ID NO: 220612 - RNA, 19 nt, Homo sapiens
gggagccucugcugugcuu

SEQ ID NO: 220613 - RNA, 19 nt, Homo sapiens
ccagcgaguucuugaugug

SEQ ID NO: 220614 - RNA, 19 nt, Homo sapiens
gcaucgcgguggcuagcaa

SEQ ID NO: 220615 - RNA, 19 nt, Homo sapiens
agcaagacguacaacuuaa

SEQ ID NO: 220616 - RNA, 19 nt, Homo sapiens
cgcccucugugccuaauaa

SEQ ID NO: 220617 - RNA, 19 nt, Homo sapiens
cgagaacccauuccucaau

SEQ ID NO: 220618 - RNA, 19 nt, Homo sapiens
ccagacccauaccuuggaa

SEQ ID NO: 220619 - RNA, 19 nt, Homo sapiens
gggaauagugggcaugaca

SEQ ID NO: 220620 - RNA, 19 nt, Homo sapiens
gaccagccucccagagaaa

SEQ ID NO: 220621 - RNA, 19 nt, Homo sapiens
gagaugggccagaaugaac

SEQ ID NO: 220622 - RNA, 19 nt, Homo sapiens
cgacgugaccucugagaag

SEQ ID NO: 220623 - RNA, 19 nt, Homo sapiens
gcgaguucuugaugugaau

SEQ ID NO: 220624 - RNA, 19 nt, Homo sapiens
ggaagcccaguagccauuu

SEQ ID NO: 220625 - RNA, 19 nt, Homo sapiens
uacaggccaucaucgagaa

SEQ ID NO: 220626 - RNA, 19 nt, Homo sapiens
ggugagaugggccagaaug

SEQ ID NO: 220627 - RNA, 19 nt, Homo sapiens
cuagcaagacguacaacuu

SEQ ID NO: 220628 - RNA, 19 nt, Homo sapiens
caagacguacaacuuaaag

SEQ ID NO: 220629 - RNA, 19 nt, Homo sapiens
ccucugugccuaauaaagu

SEQ ID NO: 220630 - RNA, 19 nt, Homo sapiens
caucaucgagaacccauuc

SEQ ID NO: 220631 - RNA, 19 nt, Homo sapiens
gcuccucugcccuuccuuu

SEQ ID NO: 220632 - RNA, 19 nt, Homo sapiens
ugagaugggccagaaugaa

SEQ ID NO: 220633 - RNA, 19 nt, Homo sapiens
augggcaccuucaauguga

SEQ ID NO: 220634 - RNA, 19 nt, Homo sapiens
gggaggcccaagccaagaa

SEQ ID NO: 220635 - RNA, 19 nt, Homo sapiens
gaagcccaguagccauuuu

SEQ ID NO: 220636 - RNA, 19 nt, Homo sapiens
gugagaugggccagaauga

SEQ ID NO: 220637 - RNA, 19 nt, Homo sapiens
ggguacuacucuccagcuu

SEQ ID NO: 220638 - RNA, 19 nt, Homo sapiens
gcccauugcucgggaucug

SEQ ID NO: 220639 - RNA, 19 nt, Homo sapiens
aagccaagaaguuaggaaa

SEQ ID NO: 220640 - RNA, 19 nt, Homo sapiens
ccagagaaagugugcaacu

SEQ ID NO: 220641 - RNA, 19 nt, Homo sapiens
auagguauccgggugauga

SEQ ID NO: 220642 - RNA, 19 nt, Homo sapiens
caugggcaccuucaaugug

SEQ ID NO: 220643 - RNA, 19 nt, Homo sapiens
gacguacaacuuaaagaag

SEQ ID NO: 220644 - RNA, 19 nt, Homo sapiens
caaggaggcugccauugug

SEQ ID NO: 220645 - RNA, 19 nt, Homo sapiens
cagaggaguuuaccuacaa

SEQ ID NO: 220646 - RNA, 19 nt, Homo sapiens
gcagaggaguuuaccuaca

SEQ ID NO: 220647 - RNA, 19 nt, Homo sapiens
acauguaccuggucauuga

SEQ ID NO: 220648 - RNA, 19 nt, Homo sapiens
caucaacaaccucaaguuu

SEQ ID NO: 220649 - RNA, 19 nt, Homo sapiens
gcccuuggcuuguguuauc

SEQ ID NO: 220650 - RNA, 19 nt, Homo sapiens
gagaaggaccaguucaaga

SEQ ID NO: 220651 - RNA, 19 nt, Homo sapiens
ggaccaugcuggcgggaau

SEQ ID NO: 220652 - RNA, 19 nt, Homo sapiens
gcagggagaaggaccaguu

SEQ ID NO: 220653 - RNA, 19 nt, Homo sapiens
ggacacaagagucuacugu

SEQ ID NO: 220654 - RNA, 19 nt, Homo sapiens
cuucaggacacauuuguua

SEQ ID NO: 220655 - RNA, 19 nt, Homo sapiens
acacagauuugcggaagaa

SEQ ID NO: 220656 - RNA, 19 nt, Homo sapiens
ucaacaaccucaaguuugc

SEQ ID NO: 220657 - RNA, 19 nt, Homo sapiens
ccaaggaggcugccauugu

SEQ ID NO: 220658 - RNA, 19 nt, Homo sapiens
gggaaauucagucuugauu

SEQ ID NO: 220659 - RNA, 19 nt, Homo sapiens
gaaggaccaguucaagaug

SEQ ID NO: 220660 - RNA, 19 nt, Homo sapiens
cagucuugauuuaaccuua

SEQ ID NO: 220661 - RNA, 19 nt, Homo sapiens
ggaaugagaaacuggucaa

SEQ ID NO: 220662 - RNA, 19 nt, Homo sapiens
ggacugcggaugagaugug

SEQ ID NO: 220663 - RNA, 19 nt, Homo sapiens
ucacucaccuguccacacu

SEQ ID NO: 220664 - RNA, 19 nt, Homo sapiens
gcgagcgcguugauugguu

SEQ ID NO: 220665 - RNA, 19 nt, Homo sapiens
caggacacauuuguuacuu

SEQ ID NO: 220666 - RNA, 19 nt, Homo sapiens
ggauuaggcucuuuuaggu

SEQ ID NO: 220667 - RNA, 19 nt, Homo sapiens
agaaggaccaguucaagau

SEQ ID NO: 220668 - RNA, 19 nt, Homo sapiens
gaccaaggaggcugccauu

SEQ ID NO: 220669 - RNA, 19 nt, Homo sapiens
ggagaaggaccaguucaag

SEQ ID NO: 220670 - RNA, 19 nt, Homo sapiens
gggagaaggaccaguucaa

SEQ ID NO: 220671 - RNA, 19 nt, Homo sapiens
uggcagaggaguuuaccua

SEQ ID NO: 220672 - RNA, 19 nt, Homo sapiens
ugaccgacaacuacaugua

SEQ ID NO: 220673 - RNA, 19 nt, Homo sapiens
gcgggaaauucagucuuga

SEQ ID NO: 220674 - RNA, 19 nt, Homo sapiens
ggacgagggcaccaugaag

SEQ ID NO: 220675 - RNA, 19 nt, Homo sapiens
ccacacuucaggacacauu

SEQ ID NO: 220676 - RNA, 19 nt, Homo sapiens
ggcccugacucacaagauc

SEQ ID NO: 220677 - RNA, 19 nt, Homo sapiens
ugcgggaaauucagucuug

SEQ ID NO: 220678 - RNA, 19 nt, Homo sapiens
ccaaggagaaguacagcau

SEQ ID NO: 220679 - RNA, 19 nt, Homo sapiens
cuacauguaccuggucauu

SEQ ID NO: 220680 - RNA, 19 nt, Homo sapiens
gcugcgggaaguucuauga

SEQ ID NO: 220681 - RNA, 19 nt, Homo sapiens
uguguuaucggacauucua

SEQ ID NO: 220682 - RNA, 19 nt, Homo sapiens
cggaugagauguguaaagc

SEQ ID NO: 220683 - RNA, 19 nt, Homo sapiens
gaagggacugcggaugaga

SEQ ID NO: 220684 - RNA, 19 nt, Homo sapiens
ggccacgaguacaccauca

SEQ ID NO: 220685 - RNA, 19 nt, Homo sapiens
cugcggaugagauguguaa

SEQ ID NO: 220686 - RNA, 19 nt, Homo sapiens
ugaagggacugcggaugag

SEQ ID NO: 220687 - RNA, 19 nt, Homo sapiens
ugacucacaagaucacuca

SEQ ID NO: 220688 - RNA, 19 nt, Homo sapiens
gaccgacaacuacauguac

SEQ ID NO: 220689 - RNA, 19 nt, Homo sapiens
uuagguaacuggcuuuccu

SEQ ID NO: 220690 - RNA, 19 nt, Homo sapiens
gcggaugagauguguaaag

SEQ ID NO: 220691 - RNA, 19 nt, Homo sapiens
cgagggcaccaugaaggua

SEQ ID NO: 220692 - RNA, 19 nt, Homo sapiens
gcgagguggacgcugauug

SEQ ID NO: 220693 - RNA, 19 nt, Homo sapiens
gaagaaagcucuaacauca

SEQ ID NO: 220694 - RNA, 19 nt, Homo sapiens
guaaagagcuacauucaga

SEQ ID NO: 220695 - RNA, 19 nt, Homo sapiens
ggaaggauuugaauucuga

SEQ ID NO: 220696 - RNA, 19 nt, Homo sapiens
ccaaaggacuagcugauaa

SEQ ID NO: 220697 - RNA, 19 nt, Homo sapiens
uaacacagcuaucacaaga

SEQ ID NO: 220698 - RNA, 19 nt, Homo sapiens
gcucuaacaucauuugaaa

SEQ ID NO: 220699 - RNA, 19 nt, Homo sapiens
aagaagaucucuccaaaga

SEQ ID NO: 220700 - RNA, 19 nt, Homo sapiens
ggauggaccuggcuucuau

SEQ ID NO: 220701 - RNA, 19 nt, Homo sapiens
ucucagaaguuaugaauga

SEQ ID NO: 220702 - RNA, 19 nt, Homo sapiens
ugaaagggauuccaucuuc

SEQ ID NO: 220703 - RNA, 19 nt, Homo sapiens
agaaagcucuaacaucauu

SEQ ID NO: 220704 - RNA, 19 nt, Homo sapiens
gacaauagaauaccuagaa

SEQ ID NO: 220705 - RNA, 19 nt, Homo sapiens
ugacugggcagcuugauua

SEQ ID NO: 220706 - RNA, 19 nt, Homo sapiens
gaaagggauuccaucuuca

SEQ ID NO: 220707 - RNA, 19 nt, Homo sapiens
gggcuaaagacuauacuua

SEQ ID NO: 220708 - RNA, 19 nt, Homo sapiens
gguuauauaugccgcaauu

SEQ ID NO: 220709 - RNA, 19 nt, Homo sapiens
agaguggugucuagauuua

SEQ ID NO: 220710 - RNA, 19 nt, Homo sapiens
guaaauacacugaguaaag

SEQ ID NO: 220711 - RNA, 19 nt, Homo sapiens
gccaaacacauaacaauaa

SEQ ID NO: 220712 - RNA, 19 nt, Homo sapiens
gcuaacagcccuaacaaga

SEQ ID NO: 220713 - RNA, 19 nt, Homo sapiens
gggagggccuuuccgcuuu

SEQ ID NO: 220714 - RNA, 19 nt, Homo sapiens
cgaaacauguggcggaaga

SEQ ID NO: 220715 - RNA, 19 nt, Homo sapiens
gcaagaagaauaaauuugg

SEQ ID NO: 220716 - RNA, 19 nt, Homo sapiens
auaagaagaucucuccaaa

SEQ ID NO: 220717 - RNA, 19 nt, Homo sapiens
gcacagagaauaguugaga

SEQ ID NO: 220718 - RNA, 19 nt, Homo sapiens
uaacagcccuaacaagaag

SEQ ID NO: 220719 - RNA, 19 nt, Homo sapiens
ggauuugaauucugacaug

SEQ ID NO: 220720 - RNA, 19 nt, Homo sapiens
gguaaagacuggaauugag

SEQ ID NO: 220721 - RNA, 19 nt, Homo sapiens
gaagcugccuccuaagucu

SEQ ID NO: 220722 - RNA, 19 nt, Homo sapiens
uagaauaccuagaagaagu

SEQ ID NO: 220723 - RNA, 19 nt, Homo sapiens
gugcugauaucaacauguu

SEQ ID NO: 220724 - RNA, 19 nt, Homo sapiens
uggguuugcucccugauua

SEQ ID NO: 220725 - RNA, 19 nt, Homo sapiens
gaagaagaaagcucuaaca

SEQ ID NO: 220726 - RNA, 19 nt, Homo sapiens
gacaagggauugguggaaa

SEQ ID NO: 220727 - RNA, 19 nt, Homo sapiens
uagaagaaguugcaauuac

SEQ ID NO: 220728 - RNA, 19 nt, Homo sapiens
ccagaacccauauuaacua

SEQ ID NO: 220729 - RNA, 19 nt, Homo sapiens
uggaccggcucaagaaaua

SEQ ID NO: 220730 - RNA, 19 nt, Homo sapiens
gaagaggaaggauuugaau

SEQ ID NO: 220731 - RNA, 19 nt, Homo sapiens
ggaaguagaagcggugauu

SEQ ID NO: 220732 - RNA, 19 nt, Homo sapiens
acaagaagcacagagaaua

SEQ ID NO: 220733 - RNA, 19 nt, Homo sapiens
ggacugggaugagagaaag

SEQ ID NO: 220734 - RNA, 19 nt, Homo sapiens
ggaugaaguugguguggau

SEQ ID NO: 220735 - RNA, 19 nt, Homo sapiens
caccagugcuucagcugua

SEQ ID NO: 220736 - RNA, 19 nt, Homo sapiens
gcccaagucuccguggaua

SEQ ID NO: 220737 - RNA, 19 nt, Homo sapiens
gacaugaugcugacuggua

SEQ ID NO: 220738 - RNA, 19 nt, Homo sapiens
gaaauaugaagcugccuau

SEQ ID NO: 220739 - RNA, 19 nt, Homo sapiens
caacuugacugggcagcuu

SEQ ID NO: 220740 - RNA, 19 nt, Homo sapiens
gauaagaagaucucuccaa

SEQ ID NO: 220741 - RNA, 19 nt, Homo sapiens
gacuugagguugccauuuc

SEQ ID NO: 220742 - RNA, 19 nt, Homo sapiens
aaagcaaucuggaagaaag

SEQ ID NO: 220743 - RNA, 19 nt, Homo sapiens
gagcaggcaucgcccaagu

SEQ ID NO: 220744 - RNA, 19 nt, Homo sapiens
gaaauuuggagagcuugua

SEQ ID NO: 220745 - RNA, 19 nt, Homo sapiens
acagaguggugucuagauu

SEQ ID NO: 220746 - RNA, 19 nt, Homo sapiens
gucugaagcugccuccuaa

SEQ ID NO: 220747 - RNA, 19 nt, Homo sapiens
gaggaaggauuugaauucu

SEQ ID NO: 220748 - RNA, 19 nt, Homo sapiens
ggcuaaagacuauacuuaa

SEQ ID NO: 220749 - RNA, 19 nt, Homo sapiens
ucagaaauuuggagagcuu

SEQ ID NO: 220750 - RNA, 19 nt, Homo sapiens
ugccaugacuauuccauuu

SEQ ID NO: 220751 - RNA, 19 nt, Homo sapiens
gggauuccaucuucagcaa

SEQ ID NO: 220752 - RNA, 19 nt, Homo sapiens
gaauugagcaagggaguga

SEQ ID NO: 220753 - RNA, 19 nt, Homo sapiens
gaagugccguccuuaucuc

SEQ ID NO: 220754 - RNA, 19 nt, Homo sapiens
gaguaaagagcuacauuca

SEQ ID NO: 220755 - RNA, 19 nt, Homo sapiens
cggaagaucugggcaaagu

SEQ ID NO: 220756 - RNA, 19 nt, Homo sapiens
gaccagaacccauauuaac

SEQ ID NO: 220757 - RNA, 19 nt, Homo sapiens
cagaacccauauuaacuau

SEQ ID NO: 220758 - RNA, 19 nt, Homo sapiens
ggagggccuuuccgcuuug

SEQ ID NO: 220759 - RNA, 19 nt, Homo sapiens
ugaaguugguguggaugua

SEQ ID NO: 220760 - RNA, 19 nt, Homo sapiens
gauugaagcuguguuugag

SEQ ID NO: 220761 - RNA, 19 nt, Homo sapiens
ucuuugcccuucugguuua

SEQ ID NO: 220762 - RNA, 19 nt, Homo sapiens
caaaggauugaaugacaaa

SEQ ID NO: 220763 - RNA, 19 nt, Homo sapiens
cugugaaucucagaaauuu

SEQ ID NO: 220764 - RNA, 19 nt, Homo sapiens
gccaaaggacuagcugaua

SEQ ID NO: 220765 - RNA, 19 nt, Homo sapiens
acacagcuaucacaagaag

SEQ ID NO: 220766 - RNA, 19 nt, Homo sapiens
aaucagaagugccguccuu

SEQ ID NO: 220767 - RNA, 19 nt, Homo sapiens
cuagaagaaguugcaauua

SEQ ID NO: 220768 - RNA, 19 nt, Homo sapiens
ggacuugagguugccauuu

SEQ ID NO: 220769 - RNA, 19 nt, Homo sapiens
gaagcacagagaauaguug

SEQ ID NO: 220770 - RNA, 19 nt, Homo sapiens
aaugaaaucugggcuagug

SEQ ID NO: 220771 - RNA, 19 nt, Homo sapiens
gggagggacugggaugaga

SEQ ID NO: 220772 - RNA, 19 nt, Homo sapiens
uuuaaacgccuccuucaaa

SEQ ID NO: 220773 - RNA, 19 nt, Homo sapiens
cagaacugcugacacagau

SEQ ID NO: 220774 - RNA, 19 nt, Homo sapiens
uuugaggaccuuagucuua

SEQ ID NO: 220775 - RNA, 19 nt, Homo sapiens
uuaagcaucuggcuauucu

SEQ ID NO: 220776 - RNA, 19 nt, Homo sapiens
agaagaaguugcaauuacu

SEQ ID NO: 220777 - RNA, 19 nt, Homo sapiens
aaagguaaauacacugagu

SEQ ID NO: 220778 - RNA, 19 nt, Homo sapiens
auaugaagcugccuaugga

SEQ ID NO: 220779 - RNA, 19 nt, Homo sapiens
gaagggcuuuuacaucuau

SEQ ID NO: 220780 - RNA, 19 nt, Homo sapiens
uaauugaugugguaaagac

SEQ ID NO: 220781 - RNA, 19 nt, Homo sapiens
ccuagaagaaguugcaauu

SEQ ID NO: 220782 - RNA, 19 nt, Homo sapiens
gaggaacggacaauagaau

SEQ ID NO: 220783 - RNA, 19 nt, Homo sapiens
caagaagcacagagaauag

SEQ ID NO: 220784 - RNA, 19 nt, Homo sapiens
ccaacagaguggugucuag

SEQ ID NO: 220785 - RNA, 19 nt, Homo sapiens
gaagaucugggcaaagucu

SEQ ID NO: 220786 - RNA, 19 nt, Homo sapiens
uugaggaccuuagucuuaa

SEQ ID NO: 220787 - RNA, 19 nt, Homo sapiens
uacagggucuucugcuuug

SEQ ID NO: 220788 - RNA, 19 nt, Homo sapiens
ggccacugcuguccucuuc

SEQ ID NO: 220789 - RNA, 19 nt, Homo sapiens
ccaugacuauuccauuugu

SEQ ID NO: 220790 - RNA, 19 nt, Homo sapiens
cagcguaugccaugacuau

SEQ ID NO: 220791 - RNA, 19 nt, Homo sapiens
cagaggaacggacaauaga

SEQ ID NO: 220792 - RNA, 19 nt, Homo sapiens
ugaccagaacccauauuaa

SEQ ID NO: 220793 - RNA, 19 nt, Homo sapiens
ggaaagaggucaacugaga

SEQ ID NO: 220794 - RNA, 19 nt, Homo sapiens
gaaugacuaucuugacuua

SEQ ID NO: 220795 - RNA, 19 nt, Homo sapiens
gagcagcgcuuacggguuu

SEQ ID NO: 220796 - RNA, 19 nt, Homo sapiens
aaaccaacgugccuaauua

SEQ ID NO: 220797 - RNA, 19 nt, Homo sapiens
gaagugaccugaaguuucu

SEQ ID NO: 220798 - RNA, 19 nt, Homo sapiens
ggaaguaguugauuauauc

SEQ ID NO: 220799 - RNA, 19 nt, Homo sapiens
cuaaggaaguaguugauua

SEQ ID NO: 220800 - RNA, 19 nt, Homo sapiens
gcagggccaugcuaugaua

SEQ ID NO: 220801 - RNA, 19 nt, Homo sapiens
cuaaagauguguucucuau

SEQ ID NO: 220802 - RNA, 19 nt, Homo sapiens
gaaagaaggaggccaguau

SEQ ID NO: 220803 - RNA, 19 nt, Homo sapiens
guucugagcuuuucaauaa

SEQ ID NO: 220804 - RNA, 19 nt, Homo sapiens
caacauaugcuacuccaaa

SEQ ID NO: 220805 - RNA, 19 nt, Homo sapiens
ggauugaccaugaaugaua

SEQ ID NO: 220806 - RNA, 19 nt, Homo sapiens
gcaaauucuucuuucuuga

SEQ ID NO: 220807 - RNA, 19 nt, Homo sapiens
guuauaagccgaaggcaua

SEQ ID NO: 220808 - RNA, 19 nt, Homo sapiens
gaagaagacguuagccaaa

SEQ ID NO: 220809 - RNA, 19 nt, Homo sapiens
gagcagauggccaaacuaa

SEQ ID NO: 220810 - RNA, 19 nt, Homo sapiens
guucuuaucuguguccuaa

SEQ ID NO: 220811 - RNA, 19 nt, Homo sapiens
ucaauaaggccaaaucuau

SEQ ID NO: 220812 - RNA, 19 nt, Homo sapiens
gaagaagugaccugaaguu

SEQ ID NO: 220813 - RNA, 19 nt, Homo sapiens
uuaaagccauggauucuga

SEQ ID NO: 220814 - RNA, 19 nt, Homo sapiens
ggagcuggcuucucugaca

SEQ ID NO: 220815 - RNA, 19 nt, Homo sapiens
ggaacaggaugaauaugca

SEQ ID NO: 220816 - RNA, 19 nt, Homo sapiens
gguguuggcuugauugcuu

SEQ ID NO: 220817 - RNA, 19 nt, Homo sapiens
gaccaugaaugauauugau

SEQ ID NO: 220818 - RNA, 19 nt, Homo sapiens
caagcaauguggcuagaga

SEQ ID NO: 220819 - RNA, 19 nt, Homo sapiens
uaaaugaggguuugcaguu

SEQ ID NO: 220820 - RNA, 19 nt, Homo sapiens
gauugaccaugaaugauau

SEQ ID NO: 220821 - RNA, 19 nt, Homo sapiens
ggucagcguuaauaaagug

SEQ ID NO: 220822 - RNA, 19 nt, Homo sapiens
ccaccagaaucucacauga

SEQ ID NO: 220823 - RNA, 19 nt, Homo sapiens
cagaagaagugaccugaag

SEQ ID NO: 220824 - RNA, 19 nt, Homo sapiens
gauaauggcauccguccuu

SEQ ID NO: 220825 - RNA, 19 nt, Homo sapiens
ccaacgugccuaauuaauu

SEQ ID NO: 220826 - RNA, 19 nt, Homo sapiens
caaaccaacgugccuaauu

SEQ ID NO: 220827 - RNA, 19 nt, Homo sapiens
caccauggcuuguaucucu

SEQ ID NO: 220828 - RNA, 19 nt, Homo sapiens
guacaguuauucaggaagu

SEQ ID NO: 220829 - RNA, 19 nt, Homo sapiens
ccaagaaggcacaggauga

SEQ ID NO: 220830 - RNA, 19 nt, Homo sapiens
ggccagcgacugucuuuaa

SEQ ID NO: 220831 - RNA, 19 nt, Homo sapiens
gauguccgaugucccuauu

SEQ ID NO: 220832 - RNA, 19 nt, Homo sapiens
gccaacagauuacggaaag

SEQ ID NO: 220833 - RNA, 19 nt, Homo sapiens
cauggauucugauugguuu

SEQ ID NO: 220834 - RNA, 19 nt, Homo sapiens
gcagauggccaaacuaaaa

SEQ ID NO: 220835 - RNA, 19 nt, Homo sapiens
gaccugaugccacaugauu

SEQ ID NO: 220836 - RNA, 19 nt, Homo sapiens
ugagaaaacugaugcuuga

SEQ ID NO: 220837 - RNA, 19 nt, Homo sapiens
uagagaggcugcccuugga

SEQ ID NO: 220838 - RNA, 19 nt, Homo sapiens
caucuuugguacaguuauu

SEQ ID NO: 220839 - RNA, 19 nt, Homo sapiens
uaucaucuuugguacaguu

SEQ ID NO: 220840 - RNA, 19 nt, Homo sapiens
ggaaagaaggaggccagua

SEQ ID NO: 220841 - RNA, 19 nt, Homo sapiens
gcacagugacagcugcaaa

SEQ ID NO: 220842 - RNA, 19 nt, Homo sapiens
ugugguacccuucaaagua

SEQ ID NO: 220843 - RNA, 19 nt, Homo sapiens
gcgacugucuuuaaucucu

SEQ ID NO: 220844 - RNA, 19 nt, Homo sapiens
caacagauuacggaaagaa

SEQ ID NO: 220845 - RNA, 19 nt, Homo sapiens
gaagcuuucucgggucaga

SEQ ID NO: 220846 - RNA, 19 nt, Homo sapiens
ugcaaauucuucuuucuug

SEQ ID NO: 220847 - RNA, 19 nt, Homo sapiens
uaagaccucugagcuguuc

SEQ ID NO: 220848 - RNA, 19 nt, Homo sapiens
caauaaggccaaaucuaug

SEQ ID NO: 220849 - RNA, 19 nt, Homo sapiens
gaaagaggucaacugagau

SEQ ID NO: 220850 - RNA, 19 nt, Homo sapiens
gggcagggccaugcuauga

SEQ ID NO: 220851 - RNA, 19 nt, Homo sapiens
cagcgacugucuuuaaucu

SEQ ID NO: 220852 - RNA, 19 nt, Homo sapiens
gagcuggcuucucugacaa

SEQ ID NO: 220853 - RNA, 19 nt, Homo sapiens
cagaaugacuaucuugacu

SEQ ID NO: 220854 - RNA, 19 nt, Homo sapiens
cuuguggccuucuauuaaa

SEQ ID NO: 220855 - RNA, 19 nt, Homo sapiens
gaaggcacaggaugaagga

SEQ ID NO: 220856 - RNA, 19 nt, Homo sapiens
caagaaggcacaggaugaa

SEQ ID NO: 220857 - RNA, 19 nt, Homo sapiens
caggauugaccaugaauga

SEQ ID NO: 220858 - RNA, 19 nt, Homo sapiens
ggcaggugguguugaguug

SEQ ID NO: 220859 - RNA, 19 nt, Homo sapiens
gaggucaacugagauuugg

SEQ ID NO: 220860 - RNA, 19 nt, Homo sapiens
gcuggaacaggaugaauau

SEQ ID NO: 220861 - RNA, 19 nt, Homo sapiens
gaucguggcaggugguguu

SEQ ID NO: 220862 - RNA, 19 nt, Homo sapiens
aggcauauuugagggauuu

SEQ ID NO: 220863 - RNA, 19 nt, Homo sapiens
gccagcgacugucuuuaau

SEQ ID NO: 220864 - RNA, 19 nt, Homo sapiens
gcccucagauuuuccauaa

SEQ ID NO: 220865 - RNA, 19 nt, Homo sapiens
aaaugaggguuugcaguug

SEQ ID NO: 220866 - RNA, 19 nt, Homo sapiens
caaaaugggcccucagauu

SEQ ID NO: 220867 - RNA, 19 nt, Homo sapiens
uaauagauccagaagaagu

SEQ ID NO: 220868 - RNA, 19 nt, Homo sapiens
cgacugucuuuaaucucua

SEQ ID NO: 220869 - RNA, 19 nt, Homo sapiens
gaaaacugaugcuugaucu

SEQ ID NO: 220870 - RNA, 19 nt, Homo sapiens
ugucuggcacuucauauaa

SEQ ID NO: 220871 - RNA, 19 nt, Homo sapiens
ggucaacugagauuuggaa

SEQ ID NO: 220872 - RNA, 19 nt, Homo sapiens
uguugucacuaaagacuaa

SEQ ID NO: 220873 - RNA, 19 nt, Homo sapiens
caucugcaauguuaaucau

SEQ ID NO: 220874 - RNA, 19 nt, Homo sapiens
cagcugcaaauucuucuuu

SEQ ID NO: 220875 - RNA, 19 nt, Homo sapiens
gacugucuuuaaucucuaa

SEQ ID NO: 220876 - RNA, 19 nt, Homo sapiens
gucuggcacuucauauaaa

SEQ ID NO: 220877 - RNA, 19 nt, Homo sapiens
aaagaggucaacugagauu

SEQ ID NO: 220878 - RNA, 19 nt, Homo sapiens
ccacagguguuggcuugau

SEQ ID NO: 220879 - RNA, 19 nt, Homo sapiens
gguggucagcguuaauaaa

SEQ ID NO: 220880 - RNA, 19 nt, Homo sapiens
gcucuggccauggguuaua

SEQ ID NO: 220881 - RNA, 19 nt, Homo sapiens
agugacagcugcaaauucu

SEQ ID NO: 220882 - RNA, 19 nt, Homo sapiens
ggcuggaacaggaugaaua

SEQ ID NO: 220883 - RNA, 19 nt, Homo sapiens
ggucucuguugucacuaaa

SEQ ID NO: 220884 - RNA, 19 nt, Homo sapiens
gacguuagccaaacccaau

SEQ ID NO: 220885 - RNA, 19 nt, Homo sapiens
uaucuugacuuaccccuuu

SEQ ID NO: 220886 - RNA, 19 nt, Homo sapiens
ucuuguggccuucuauuaa

SEQ ID NO: 220887 - RNA, 19 nt, Homo sapiens
ggaccaacauaugcuacuc

SEQ ID NO: 220888 - RNA, 19 nt, Homo sapiens
ccaaacccaauauaaggaa

SEQ ID NO: 220889 - RNA, 19 nt, Homo sapiens
aaacugaugcuugaucuca

SEQ ID NO: 220890 - RNA, 19 nt, Homo sapiens
caaacccaauauaaggaau

SEQ ID NO: 220891 - RNA, 19 nt, Homo sapiens
ucucuguugucacuaaaga

SEQ ID NO: 220892 - RNA, 19 nt, Homo sapiens
aaggcaggauugaccauga

SEQ ID NO: 220893 - RNA, 19 nt, Homo sapiens
ccacagaucugaaugauua

SEQ ID NO: 220894 - RNA, 19 nt, Homo sapiens
cauuugagcuucuagauua

SEQ ID NO: 220895 - RNA, 19 nt, Homo sapiens
gaaaguacuuccucugaga

SEQ ID NO: 220896 - RNA, 19 nt, Homo sapiens
caagaagacuggagaagga

SEQ ID NO: 220897 - RNA, 19 nt, Homo sapiens
gcaccuggaucuugccuuu

SEQ ID NO: 220898 - RNA, 19 nt, Homo sapiens
gacauucccucacacagua

SEQ ID NO: 220899 - RNA, 19 nt, Homo sapiens
ugacacugcuaugaaauua

SEQ ID NO: 220900 - RNA, 19 nt, Homo sapiens
ggaaugcucuuuggucaga

SEQ ID NO: 220901 - RNA, 19 nt, Homo sapiens
agaaaucacuguugcaaau

SEQ ID NO: 220902 - RNA, 19 nt, Homo sapiens
gcagagaacccauuacauc

SEQ ID NO: 220903 - RNA, 19 nt, Homo sapiens
gcaagcaagugguauaguc

SEQ ID NO: 220904 - RNA, 19 nt, Homo sapiens
ggacaaguuugcugcugaa

SEQ ID NO: 220905 - RNA, 19 nt, Homo sapiens
gaggaaagccuuaggaaag

SEQ ID NO: 220906 - RNA, 19 nt, Homo sapiens
ggucagacauucccucaca

SEQ ID NO: 220907 - RNA, 19 nt, Homo sapiens
ggacacuccuggguuuauu

SEQ ID NO: 220908 - RNA, 19 nt, Homo sapiens
ccaagaagauaaucgucaa

SEQ ID NO: 220909 - RNA, 19 nt, Homo sapiens
gcgaugaauuuguggagaa

SEQ ID NO: 220910 - RNA, 19 nt, Homo sapiens
caagugguauagucuguga

SEQ ID NO: 220911 - RNA, 19 nt, Homo sapiens
ggaaaguggcaaagaagaa

SEQ ID NO: 220912 - RNA, 19 nt, Homo sapiens
caaguuugcugcugaacau

SEQ ID NO: 220913 - RNA, 19 nt, Homo sapiens
ucaaaaggcuggacaaguu

SEQ ID NO: 220914 - RNA, 19 nt, Homo sapiens
gcaaagcccuaggaaagca

SEQ ID NO: 220915 - RNA, 19 nt, Homo sapiens
ggaauugaggaaagccuua

SEQ ID NO: 220916 - RNA, 19 nt, Homo sapiens
gaagacuggagaaggauuu

SEQ ID NO: 220917 - RNA, 19 nt, Homo sapiens
gaaauuaggagccgguuac

SEQ ID NO: 220918 - RNA, 19 nt, Homo sapiens
aagaagaaguuugcagaaa

SEQ ID NO: 220919 - RNA, 19 nt, Homo sapiens
uuaggaaaguggcaaagaa

SEQ ID NO: 220920 - RNA, 19 nt, Homo sapiens
cauugacacugcuaugaaa

SEQ ID NO: 220921 - RNA, 19 nt, Homo sapiens
ugaagaugcugcugcugaa

SEQ ID NO: 220922 - RNA, 19 nt, Homo sapiens
gaaaucacuguugcaaauu

SEQ ID NO: 220923 - RNA, 19 nt, Homo sapiens
cagcauaucucuguuugca

SEQ ID NO: 220924 - RNA, 19 nt, Homo sapiens
ggaugcagagaacccauua

SEQ ID NO: 220925 - RNA, 19 nt, Homo sapiens
gauuaugucggacuggaua

SEQ ID NO: 220926 - RNA, 19 nt, Homo sapiens
uggagaaucugaaggugaa

SEQ ID NO: 220927 - RNA, 19 nt, Homo sapiens
gagcagcaccuggaucuug

SEQ ID NO: 220928 - RNA, 19 nt, Homo sapiens
gugauuauuacaccaguua

SEQ ID NO: 220929 - RNA, 19 nt, Homo sapiens
uagcaaagcccuaggaaag

SEQ ID NO: 220930 - RNA, 19 nt, Homo sapiens
caagugaugugcagcuucu

SEQ ID NO: 220931 - RNA, 19 nt, Homo sapiens
gaagcaaucaggcuguaug

SEQ ID NO: 220932 - RNA, 19 nt, Homo sapiens
ccaaugaccagccagaaga

SEQ ID NO: 220933 - RNA, 19 nt, Homo sapiens
ggaaagccuuaggaaagug

SEQ ID NO: 220934 - RNA, 19 nt, Homo sapiens
aaaucacuguugcaaauug

SEQ ID NO: 220935 - RNA, 19 nt, Homo sapiens
gagaaaucacuguugcaaa

SEQ ID NO: 220936 - RNA, 19 nt, Homo sapiens
gcaaucaggcuguaugaac

SEQ ID NO: 220937 - RNA, 19 nt, Homo sapiens
cccagugccugucaugaaa

SEQ ID NO: 220938 - RNA, 19 nt, Homo sapiens
aaaacgagcucuucaaaag

SEQ ID NO: 220939 - RNA, 19 nt, Homo sapiens
cccagcccauccuuaaaua

SEQ ID NO: 220940 - RNA, 19 nt, Homo sapiens
caaagaagacauugacacu

SEQ ID NO: 220941 - RNA, 19 nt, Homo sapiens
gaaaguggcaaagaagaag

SEQ ID NO: 220942 - RNA, 19 nt, Homo sapiens
ggucagcauaucucuguuu

SEQ ID NO: 220943 - RNA, 19 nt, Homo sapiens
cagagaacccauuacauca

SEQ ID NO: 220944 - RNA, 19 nt, Homo sapiens
gaagacauugacacugcua

SEQ ID NO: 220945 - RNA, 19 nt, Homo sapiens
gacauuugaaucuuuggua

SEQ ID NO: 220946 - RNA, 19 nt, Homo sapiens
gccuauaaauugacucuac

SEQ ID NO: 220947 - RNA, 19 nt, Homo sapiens
gaacaccugagagcgcuuu

SEQ ID NO: 220948 - RNA, 19 nt, Homo sapiens
agaagaaguuugcagaaaa

SEQ ID NO: 220949 - RNA, 19 nt, Homo sapiens
ccagaagacauuugaaucu

SEQ ID NO: 220950 - RNA, 19 nt, Homo sapiens
cagcccagcccauccuuaa

SEQ ID NO: 220951 - RNA, 19 nt, Homo sapiens
gaggugacgcauccaaaga

SEQ ID NO: 220952 - RNA, 19 nt, Homo sapiens
gacauugacacugcuauga

SEQ ID NO: 220953 - RNA, 19 nt, Homo sapiens
uggaagccaucguggagaa

SEQ ID NO: 220954 - RNA, 19 nt, Homo sapiens
ugaggaaagccuuaggaaa

SEQ ID NO: 220955 - RNA, 19 nt, Homo sapiens
gcucuuuggucagacauuc

SEQ ID NO: 220956 - RNA, 19 nt, Homo sapiens
gucagcauaucucuguuug

SEQ ID NO: 220957 - RNA, 19 nt, Homo sapiens
acuccuggguuuauuguga

SEQ ID NO: 220958 - RNA, 19 nt, Homo sapiens
uuuacuaccugcagcuuug

SEQ ID NO: 220959 - RNA, 19 nt, Homo sapiens
aaagaagaaguuugcagaa

SEQ ID NO: 220960 - RNA, 19 nt, Homo sapiens
gcccagcccauccuuaaau

SEQ ID NO: 220961 - RNA, 19 nt, Homo sapiens
gacuggauacuacgaaguu

SEQ ID NO: 220962 - RNA, 19 nt, Homo sapiens
acacugcuaugaaauuagg

SEQ ID NO: 220963 - RNA, 19 nt, Homo sapiens
ccgauucgcuggccuccau

SEQ ID NO: 220964 - RNA, 19 nt, Homo sapiens
uguaaucuaucgaagugau

SEQ ID NO: 220965 - RNA, 19 nt, Homo sapiens
gaagacccugagcaccaua

SEQ ID NO: 220966 - RNA, 19 nt, Homo sapiens
ccauuugagcuucuagauu

SEQ ID NO: 220967 - RNA, 19 nt, Homo sapiens
ggaugcagccuccguuguc

SEQ ID NO: 220968 - RNA, 19 nt, Homo sapiens
ucgcuggccuccauuucuu

SEQ ID NO: 220969 - RNA, 19 nt, Homo sapiens
ggugacgcauccaaagaag

SEQ ID NO: 220970 - RNA, 19 nt, Homo sapiens
aaacuuguggaggucauua

SEQ ID NO: 220971 - RNA, 19 nt, Homo sapiens
agaagauaaucgucaagca

SEQ ID NO: 220972 - RNA, 19 nt, Homo sapiens
aggaaagccuuaggaaagu

SEQ ID NO: 220973 - RNA, 19 nt, Homo sapiens
ugaaauuaggagccgguua

SEQ ID NO: 220974 - RNA, 19 nt, Homo sapiens
uggaagcaaucaggcugua

SEQ ID NO: 220975 - RNA, 19 nt, Homo sapiens
gccagaagacauuugaauc

SEQ ID NO: 220976 - RNA, 19 nt, Homo sapiens
ugagaaaucacuguugcaa

SEQ ID NO: 220977 - RNA, 19 nt, Homo sapiens
ccuggaucuugccuuuaua

SEQ ID NO: 220978 - RNA, 19 nt, Homo sapiens
caucaacgggaaaguacuu

SEQ ID NO: 220979 - RNA, 19 nt, Homo sapiens
ugaccagccagaagacauu

SEQ ID NO: 220980 - RNA, 19 nt, Homo sapiens
ucauucaguuccacagauc

SEQ ID NO: 220981 - RNA, 19 nt, Homo sapiens
ucucaucaacgggaaagua

SEQ ID NO: 220982 - RNA, 19 nt, Homo sapiens
ucuguucauuucuguguau

SEQ ID NO: 220983 - RNA, 19 nt, Homo sapiens
auuguaaucuaucgaagug

SEQ ID NO: 220984 - RNA, 19 nt, Homo sapiens
ccagccagaagacauuuga

SEQ ID NO: 220985 - RNA, 19 nt, Homo sapiens
gucauucaguuccacagau

SEQ ID NO: 220986 - RNA, 19 nt, Homo sapiens
gaagaugcugcugcugaau

SEQ ID NO: 220987 - RNA, 19 nt, Homo sapiens
gcaguaauagauucuccau

SEQ ID NO: 220988 - RNA, 19 nt, Homo sapiens
cuaucgaagugauuauuac

SEQ ID NO: 220989 - RNA, 19 nt, Homo sapiens
aaucuuugguagacuuuag

SEQ ID NO: 220990 - RNA, 19 nt, Homo sapiens
gaaacuuguggaggucauu

SEQ ID NO: 220991 - RNA, 19 nt, Homo sapiens
ugcugaacauacaaucuuu

SEQ ID NO: 220992 - RNA, 19 nt, Homo sapiens
gaaugauuacugucugucu

SEQ ID NO: 220993 - RNA, 19 nt, Homo sapiens
ggucauagauagcaucaua

SEQ ID NO: 220994 - RNA, 19 nt, Homo sapiens
ggagagaccugagaacuuu

SEQ ID NO: 220995 - RNA, 19 nt, Homo sapiens
ggaaacagauugauagcaa

SEQ ID NO: 220996 - RNA, 19 nt, Homo sapiens
ggaaguagcugcuccauac

SEQ ID NO: 220997 - RNA, 19 nt, Homo sapiens
caaaggagauaaggaauga

SEQ ID NO: 220998 - RNA, 19 nt, Homo sapiens
gaacaucauuaccacagaa

SEQ ID NO: 220999 - RNA, 19 nt, Homo sapiens
gcagaagguuugggaagua

SEQ ID NO: 221000 - RNA, 19 nt, Homo sapiens
cagaaggaguuuaucuaua

SEQ ID NO: 221001 - RNA, 19 nt, Homo sapiens
guacuuaucacuacacgua

SEQ ID NO: 221002 - RNA, 19 nt, Homo sapiens
cagcagcccuuguuucuga

SEQ ID NO: 221003 - RNA, 19 nt, Homo sapiens
gaacuguaauuccuaucaa

SEQ ID NO: 221004 - RNA, 19 nt, Homo sapiens
uaaccaaccuccuuucugu

SEQ ID NO: 221005 - RNA, 19 nt, Homo sapiens
gcuagaagcccauggauug

SEQ ID NO: 221006 - RNA, 19 nt, Homo sapiens
gaaauuugccagaacugua

SEQ ID NO: 221007 - RNA, 19 nt, Homo sapiens
gaacagcgcaacagauaau

SEQ ID NO: 221008 - RNA, 19 nt, Homo sapiens
ucaauagggucuucagcua

SEQ ID NO: 221009 - RNA, 19 nt, Homo sapiens
gguagccacuccugcauaa

SEQ ID NO: 221010 - RNA, 19 nt, Homo sapiens
gauaaaagaucgcuucaug

SEQ ID NO: 221011 - RNA, 19 nt, Homo sapiens
ccaaagcccuagacuacuu

SEQ ID NO: 221012 - RNA, 19 nt, Homo sapiens
cagcaggucuggauggaaa

SEQ ID NO: 221013 - RNA, 19 nt, Homo sapiens
ggagauaaggaaugaauau

SEQ ID NO: 221014 - RNA, 19 nt, Homo sapiens
cuagguagaucaauccauu

SEQ ID NO: 221015 - RNA, 19 nt, Homo sapiens
caauagcauuugugaagaa

SEQ ID NO: 221016 - RNA, 19 nt, Homo sapiens
ccagggaggucauagauag

SEQ ID NO: 221017 - RNA, 19 nt, Homo sapiens
ggcgcuauaucaagaauaa

SEQ ID NO: 221018 - RNA, 19 nt, Homo sapiens
gcggagccaugcccagaua

SEQ ID NO: 221019 - RNA, 19 nt, Homo sapiens
gcagucaguuuagcacaaa

SEQ ID NO: 221020 - RNA, 19 nt, Homo sapiens
gcaguauuauaguugcuaa

SEQ ID NO: 221021 - RNA, 19 nt, Homo sapiens
ugagagggcagucaguuua

SEQ ID NO: 221022 - RNA, 19 nt, Homo sapiens
uuaaugggcuuugucauga

SEQ ID NO: 221023 - RNA, 19 nt, Homo sapiens
gaucaccacccaucagaaa

SEQ ID NO: 221024 - RNA, 19 nt, Homo sapiens
ggauugaaaccaguuauuu

SEQ ID NO: 221025 - RNA, 19 nt, Homo sapiens
agaaggaguuuaucuauac

SEQ ID NO: 221026 - RNA, 19 nt, Homo sapiens
gagaagagggugcagaaau

SEQ ID NO: 221027 - RNA, 19 nt, Homo sapiens
gaguuuaucuauacagcaa

SEQ ID NO: 221028 - RNA, 19 nt, Homo sapiens
gcacaagaaauccaccaaa

SEQ ID NO: 221029 - RNA, 19 nt, Homo sapiens
ccuauggucuuugccaaua

SEQ ID NO: 221030 - RNA, 19 nt, Homo sapiens
cggaggaucuggucaacuu

SEQ ID NO: 221031 - RNA, 19 nt, Homo sapiens
caaccuccuuucuguaaug

SEQ ID NO: 221032 - RNA, 19 nt, Homo sapiens
gcaaaggagauaaggaaug

SEQ ID NO: 221033 - RNA, 19 nt, Homo sapiens
ggucuucagcuauuaauug

SEQ ID NO: 221034 - RNA, 19 nt, Homo sapiens
gaagaauaaccacaauugu

SEQ ID NO: 221035 - RNA, 19 nt, Homo sapiens
aaacuuccauggugaauac

SEQ ID NO: 221036 - RNA, 19 nt, Homo sapiens
gugaggcgcuauaucaaga

SEQ ID NO: 221037 - RNA, 19 nt, Homo sapiens
gacuuucuuuggcuaauuu

SEQ ID NO: 221038 - RNA, 19 nt, Homo sapiens
gaaggaguuuaucuauaca

SEQ ID NO: 221039 - RNA, 19 nt, Homo sapiens
gcugauggcaguauuauag

SEQ ID NO: 221040 - RNA, 19 nt, Homo sapiens
agaagagggugcagaaauc

SEQ ID NO: 221041 - RNA, 19 nt, Homo sapiens
agaauaagcccgacaaugg

SEQ ID NO: 221042 - RNA, 19 nt, Homo sapiens
gagggaagagagagaaauu

SEQ ID NO: 221043 - RNA, 19 nt, Homo sapiens
caacaaggaguuucaugug

SEQ ID NO: 221044 - RNA, 19 nt, Homo sapiens
guucaagacccaccaggua

SEQ ID NO: 221045 - RNA, 19 nt, Homo sapiens
gaacuuuccuagguagauc

SEQ ID NO: 221046 - RNA, 19 nt, Homo sapiens
caaacaagucauagaaaug

SEQ ID NO: 221047 - RNA, 19 nt, Homo sapiens
auuguaaccuuccucauuu

SEQ ID NO: 221048 - RNA, 19 nt, Homo sapiens
ccugagaacuuuccuaggu

SEQ ID NO: 221049 - RNA, 19 nt, Homo sapiens
gaaacuuccauggugaaua

SEQ ID NO: 221050 - RNA, 19 nt, Homo sapiens
uguggugaaugauacaaua

SEQ ID NO: 221051 - RNA, 19 nt, Homo sapiens
ccagaacuguaauuccuau

SEQ ID NO: 221052 - RNA, 19 nt, Homo sapiens
guuguaaggcccuggauaa

SEQ ID NO: 221053 - RNA, 19 nt, Homo sapiens
ucaccacccaucagaaaua

SEQ ID NO: 221054 - RNA, 19 nt, Homo sapiens
uggcugggcugaugcuaaa

SEQ ID NO: 221055 - RNA, 19 nt, Homo sapiens
caaaggauacaguggcauu

SEQ ID NO: 221056 - RNA, 19 nt, Homo sapiens
cggaugcucuuggcuuuaa

SEQ ID NO: 221057 - RNA, 19 nt, Homo sapiens
uuaguacgcucacauucuu

SEQ ID NO: 221058 - RNA, 19 nt, Homo sapiens
agaagaauaaccacaauug

SEQ ID NO: 221059 - RNA, 19 nt, Homo sapiens
gagaagaauaaccacaauu

SEQ ID NO: 221060 - RNA, 19 nt, Homo sapiens
ccagaaggaguuuaucuau

SEQ ID NO: 221061 - RNA, 19 nt, Homo sapiens
ggauuaaccaaccuccuuu

SEQ ID NO: 221062 - RNA, 19 nt, Homo sapiens
uacaggagcuucaggucaa

SEQ ID NO: 221063 - RNA, 19 nt, Homo sapiens
ggaaagggacgcuacaaaa

SEQ ID NO: 221064 - RNA, 19 nt, Homo sapiens
gggaaagggacgcuacaaa

SEQ ID NO: 221065 - RNA, 19 nt, Homo sapiens
gugcaaaggagauaaggaa

SEQ ID NO: 221066 - RNA, 19 nt, Homo sapiens
gcaauacuaggcugaagga

SEQ ID NO: 221067 - RNA, 19 nt, Homo sapiens
cugaacagcgcaacagaua

SEQ ID NO: 221068 - RNA, 19 nt, Homo sapiens
gaucaaugucuuagccaaa

SEQ ID NO: 221069 - RNA, 19 nt, Homo sapiens
gaaauccagggaggucaua

SEQ ID NO: 221070 - RNA, 19 nt, Homo sapiens
uaaccuuccucauuucaca

SEQ ID NO: 221071 - RNA, 19 nt, Homo sapiens
gaguuugagguuaguauuu

SEQ ID NO: 221072 - RNA, 19 nt, Homo sapiens
uuggguggcucuuauuaaa

SEQ ID NO: 221073 - RNA, 19 nt, Homo sapiens
caaggaguuucaugugcaa

SEQ ID NO: 221074 - RNA, 19 nt, Homo sapiens
ugagaagaauaaccacaau

SEQ ID NO: 221075 - RNA, 19 nt, Homo sapiens
gaauaagcccgacaauggu

SEQ ID NO: 221076 - RNA, 19 nt, Homo sapiens
gcaaucagugagagaagaa

SEQ ID NO: 221077 - RNA, 19 nt, Homo sapiens
acaggccacucacucuuaa

SEQ ID NO: 221078 - RNA, 19 nt, Homo sapiens
caacagauaauccuauggu

SEQ ID NO: 221079 - RNA, 19 nt, Homo sapiens
agaagcccauggauugaaa

SEQ ID NO: 221080 - RNA, 19 nt, Homo sapiens
aacaagcucuccaccaguu

SEQ ID NO: 221081 - RNA, 19 nt, Homo sapiens
gaauaaccacaauuguaug

SEQ ID NO: 221082 - RNA, 19 nt, Homo sapiens
gcacuguguuccuguuguc

SEQ ID NO: 221083 - RNA, 19 nt, Homo sapiens
cugagaacuuuccuaggua

SEQ ID NO: 221084 - RNA, 19 nt, Homo sapiens
uggcagcccugacccuuga

SEQ ID NO: 221085 - RNA, 19 nt, Homo sapiens
ccuccuuucuguaauggua

SEQ ID NO: 221086 - RNA, 19 nt, Homo sapiens
cuucagcuauuaauuguag

SEQ ID NO: 221087 - RNA, 19 nt, Homo sapiens
ugccaucccucgucuguug

SEQ ID NO: 221088 - RNA, 19 nt, Homo sapiens
ccucaaacaagucauagaa

SEQ ID NO: 221089 - RNA, 19 nt, Homo sapiens
acaguuguuuacgguauua

SEQ ID NO: 221090 - RNA, 19 nt, Homo sapiens
caagacccaccagguauuu

SEQ ID NO: 221091 - RNA, 19 nt, Homo sapiens
cagauaauccuauggucuu

SEQ ID NO: 221092 - RNA, 19 nt, Homo sapiens
ugaaguugcuuuucgguuu

SEQ ID NO: 221093 - RNA, 19 nt, Homo sapiens
gaacagagccuuugauuuu

SEQ ID NO: 221094 - RNA, 19 nt, Homo sapiens
gacuaaagcuugucucaga

SEQ ID NO: 221095 - RNA, 19 nt, Homo sapiens
ugaaguugcucuuugagua

SEQ ID NO: 221096 - RNA, 19 nt, Homo sapiens
ugaauaaacugaccaacau

SEQ ID NO: 221097 - RNA, 19 nt, Homo sapiens
gaacaaacuaucagaggaa

SEQ ID NO: 221098 - RNA, 19 nt, Homo sapiens
gaacuaaaggaaacacuga

SEQ ID NO: 221099 - RNA, 19 nt, Homo sapiens
gagaagguguuugacguaa

SEQ ID NO: 221100 - RNA, 19 nt, Homo sapiens
acuccaagcuuaucuauga

SEQ ID NO: 221101 - RNA, 19 nt, Homo sapiens
gaagguguuugacguaauc

SEQ ID NO: 221102 - RNA, 19 nt, Homo sapiens
gaagaguggucagaacaga

SEQ ID NO: 221103 - RNA, 19 nt, Homo sapiens
aagacaaacugcauaugua

SEQ ID NO: 221104 - RNA, 19 nt, Homo sapiens
gaccugaaguugcucuuug

SEQ ID NO: 221105 - RNA, 19 nt, Homo sapiens
gcgaaacuccugaaacuga

SEQ ID NO: 221106 - RNA, 19 nt, Homo sapiens
gaugaaagcaaacagaaau

SEQ ID NO: 221107 - RNA, 19 nt, Homo sapiens
ccacauagcaaagguauau

SEQ ID NO: 221108 - RNA, 19 nt, Homo sapiens
gcagagugccugaagauca

SEQ ID NO: 221109 - RNA, 19 nt, Homo sapiens
aaacacugaugggaaagua

SEQ ID NO: 221110 - RNA, 19 nt, Homo sapiens
gugcagaagucauugauac

SEQ ID NO: 221111 - RNA, 19 nt, Homo sapiens
caagaagaacccaaagcua

SEQ ID NO: 221112 - RNA, 19 nt, Homo sapiens
gagcugcuguacaagaaga

SEQ ID NO: 221113 - RNA, 19 nt, Homo sapiens
aggcugagcugcuguacaa

SEQ ID NO: 221114 - RNA, 19 nt, Homo sapiens
guacuucaauugcuuugca

SEQ ID NO: 221115 - RNA, 19 nt, Homo sapiens
cugcauauguacuucaauu

SEQ ID NO: 221116 - RNA, 19 nt, Homo sapiens
uaagacaaacugcauaugu

SEQ ID NO: 221117 - RNA, 19 nt, Homo sapiens
cauuaaacgcuaccacaua

SEQ ID NO: 221118 - RNA, 19 nt, Homo sapiens
cgaaacuccugaaacugaa

SEQ ID NO: 221119 - RNA, 19 nt, Homo sapiens
gauccuaaacuaucccaaa

SEQ ID NO: 221120 - RNA, 19 nt, Homo sapiens
ggggaagacuccaagcuua

SEQ ID NO: 221121 - RNA, 19 nt, Homo sapiens
gaauaaacugaccaacauu

SEQ ID NO: 221122 - RNA, 19 nt, Homo sapiens
aggaaacacugaugggaaa

SEQ ID NO: 221123 - RNA, 19 nt, Homo sapiens
guaaucauccguugcuuca

SEQ ID NO: 221124 - RNA, 19 nt, Homo sapiens
cagaacagagccuuugauu

SEQ ID NO: 221125 - RNA, 19 nt, Homo sapiens
uggaggagcuggugaaacu

SEQ ID NO: 221126 - RNA, 19 nt, Homo sapiens
gaagaagcugcuagaggaa

SEQ ID NO: 221127 - RNA, 19 nt, Homo sapiens
cucgagggcuggauuacua

SEQ ID NO: 221128 - RNA, 19 nt, Homo sapiens
uugaguaccugacccuauu

SEQ ID NO: 221129 - RNA, 19 nt, Homo sapiens
gcacagcuggguccugaug

SEQ ID NO: 221130 - RNA, 19 nt, Homo sapiens
agagguggauguccgaaga

SEQ ID NO: 221131 - RNA, 19 nt, Homo sapiens
cauucuagaugggauguuu

SEQ ID NO: 221132 - RNA, 19 nt, Homo sapiens
acaccuguauuugaacuaa

SEQ ID NO: 221133 - RNA, 19 nt, Homo sapiens
gaugcagagugccugaaga

SEQ ID NO: 221134 - RNA, 19 nt, Homo sapiens
ggguaucccugguggaaca

SEQ ID NO: 221135 - RNA, 19 nt, Homo sapiens
cgagaagguguuugacgua

SEQ ID NO: 221136 - RNA, 19 nt, Homo sapiens
uggcgaaacuccugaaacu

SEQ ID NO: 221137 - RNA, 19 nt, Homo sapiens
cagagugccugaagaucau

SEQ ID NO: 221138 - RNA, 19 nt, Homo sapiens
gggaagacuccaagcuuau

SEQ ID NO: 221139 - RNA, 19 nt, Homo sapiens
ccacggugcagaagucauu

SEQ ID NO: 221140 - RNA, 19 nt, Homo sapiens
acaaggcccaggaggcuua

SEQ ID NO: 221141 - RNA, 19 nt, Homo sapiens
cugcugaacugaacaaacu

SEQ ID NO: 221142 - RNA, 19 nt, Homo sapiens
ugaguucacuucagauagg

SEQ ID NO: 221143 - RNA, 19 nt, Homo sapiens
ugccaaagguccaauaaaa

SEQ ID NO: 221144 - RNA, 19 nt, Homo sapiens
ggucagaacagagccuuug

SEQ ID NO: 221145 - RNA, 19 nt, Homo sapiens
gccgauaccgggaauucua

SEQ ID NO: 221146 - RNA, 19 nt, Homo sapiens
gauggcaguucgcgagaag

SEQ ID NO: 221147 - RNA, 19 nt, Homo sapiens
ggacccagccugagauggu

SEQ ID NO: 221148 - RNA, 19 nt, Homo sapiens
caaacugcauauguacuuc

SEQ ID NO: 221149 - RNA, 19 nt, Homo sapiens
gcagggaagagguggaugu

SEQ ID NO: 221150 - RNA, 19 nt, Homo sapiens
acacuggggugaucuauga

SEQ ID NO: 221151 - RNA, 19 nt, Homo sapiens
gaaguugcucuuugaguac

SEQ ID NO: 221152 - RNA, 19 nt, Homo sapiens
gcuuaucuaugaccugaag

SEQ ID NO: 221153 - RNA, 19 nt, Homo sapiens
auuaaacgcuaccacauag

SEQ ID NO: 221154 - RNA, 19 nt, Homo sapiens
uucaauugcuuugcacuuu

SEQ ID NO: 221155 - RNA, 19 nt, Homo sapiens
guuaagacaaacugcauau

SEQ ID NO: 221156 - RNA, 19 nt, Homo sapiens
aacagagacuagaggcuuu

SEQ ID NO: 221157 - RNA, 19 nt, Homo sapiens
gacccuauuuggcauugau

SEQ ID NO: 221158 - RNA, 19 nt, Homo sapiens
aaucauccguugcuucaag

SEQ ID NO: 221159 - RNA, 19 nt, Homo sapiens
agaacagagccuuugauuu

SEQ ID NO: 221160 - RNA, 19 nt, Homo sapiens
gguuaagacaaacugcaua

SEQ ID NO: 221161 - RNA, 19 nt, Homo sapiens
caagggcacaagagacuau

SEQ ID NO: 221162 - RNA, 19 nt, Homo sapiens
cugagcugcuguacaagaa

SEQ ID NO: 221163 - RNA, 19 nt, Homo sapiens
gcugagcugcuguacaaga

SEQ ID NO: 221164 - RNA, 19 nt, Homo sapiens
ggcgcaaggugccaugugu

SEQ ID NO: 221165 - RNA, 19 nt, Homo sapiens
aaacugaccaacauuaaac

SEQ ID NO: 221166 - RNA, 19 nt, Homo sapiens
gcucgguauuuggcaauga

SEQ ID NO: 221167 - RNA, 19 nt, Homo sapiens
acagcuggguccugaugaa

SEQ ID NO: 221168 - RNA, 19 nt, Homo sapiens
gcauauguacuucaauugc

SEQ ID NO: 221169 - RNA, 19 nt, Homo sapiens
gaagaacccaaagcuacug

SEQ ID NO: 221170 - RNA, 19 nt, Homo sapiens
acuaaagcuugucucagaa

SEQ ID NO: 221171 - RNA, 19 nt, Homo sapiens
gcugcuagaggaaagacua

SEQ ID NO: 221172 - RNA, 19 nt, Homo sapiens
uagaggcuuuggaggagaa

SEQ ID NO: 221173 - RNA, 19 nt, Homo sapiens
gaggagcuggugaaacuuc

SEQ ID NO: 221174 - RNA, 19 nt, Homo sapiens
ggaagacuccaagcuuauc

SEQ ID NO: 221175 - RNA, 19 nt, Homo sapiens
acaaggacccagccugaga

SEQ ID NO: 221176 - RNA, 19 nt, Homo sapiens
aagcuugucucagaacugu

SEQ ID NO: 221177 - RNA, 19 nt, Homo sapiens
aggaaagacuaaagcuugu

SEQ ID NO: 221178 - RNA, 19 nt, Homo sapiens
acaaacugcauauguacuu

SEQ ID NO: 221179 - RNA, 19 nt, Homo sapiens
gcuggaggacgcuaugaug

SEQ ID NO: 221180 - RNA, 19 nt, Homo sapiens
ugaccucacuguuccuuuu

SEQ ID NO: 221181 - RNA, 19 nt, Homo sapiens
ccaaagguccaauaaaaug

SEQ ID NO: 221182 - RNA, 19 nt, Homo sapiens
cauauguacuucaauugcu

SEQ ID NO: 221183 - RNA, 19 nt, Homo sapiens
ugaugaaagcaaacagaaa

SEQ ID NO: 221184 - RNA, 19 nt, Homo sapiens
acccaaagcuacugaacca

SEQ ID NO: 221185 - RNA, 19 nt, Homo sapiens
cgggauaacccagccauga

SEQ ID NO: 221186 - RNA, 19 nt, Homo sapiens
ggugcagaagucauugaua

SEQ ID NO: 221187 - RNA, 19 nt, Homo sapiens
aacaaacuaucagaggaaa

SEQ ID NO: 221188 - RNA, 19 nt, Homo sapiens
ccgaagagaagaccuugug

SEQ ID NO: 221189 - RNA, 19 nt, Homo sapiens
ucaucaagcuccguucagu

SEQ ID NO: 221190 - RNA, 19 nt, Homo sapiens
gaagacuccaagcuuaucu

SEQ ID NO: 221191 - RNA, 19 nt, Homo sapiens
gcuuugcacuuuuccguuu

SEQ ID NO: 221192 - RNA, 19 nt, Homo sapiens
agaagguguuugacguaau

SEQ ID NO: 221193 - RNA, 19 nt, Homo sapiens
ccagggaggguauuuauug

SEQ ID NO: 221194 - RNA, 19 nt, Homo sapiens
gagauucgguggacuacgu

SEQ ID NO: 221195 - RNA, 19 nt, Homo sapiens
gaucaggauguaauaaaga

SEQ ID NO: 221196 - RNA, 19 nt, Homo sapiens
ucaaggcgcucggagauuc

SEQ ID NO: 221197 - RNA, 19 nt, Homo sapiens
gaagcuggccgcuaacuac

SEQ ID NO: 221198 - RNA, 19 nt, Homo sapiens
gcuacuggguggccauguu

SEQ ID NO: 221199 - RNA, 19 nt, Homo sapiens
ucuccucguucuuauuuaa

SEQ ID NO: 221200 - RNA, 19 nt, Homo sapiens
ggaagcuggccgcuaacua

SEQ ID NO: 221201 - RNA, 19 nt, Homo sapiens
gauacuggguagccuucaa

SEQ ID NO: 221202 - RNA, 19 nt, Homo sapiens
cagacacgcugguccaagu

SEQ ID NO: 221203 - RNA, 19 nt, Homo sapiens
gugaucaggauguaauaaa

SEQ ID NO: 221204 - RNA, 19 nt, Homo sapiens
ccacugugcugcgucuguu

SEQ ID NO: 221205 - RNA, 19 nt, Homo sapiens
gagcuacuuccacugugua

SEQ ID NO: 221206 - RNA, 19 nt, Homo sapiens
gcaagcgcgaggucaugua

SEQ ID NO: 221207 - RNA, 19 nt, Homo sapiens
ugaucaggauguaauaaag

SEQ ID NO: 221208 - RNA, 19 nt, Homo sapiens
uaaucuccauuucuacugu

SEQ ID NO: 221209 - RNA, 19 nt, Homo sapiens
uggguuaugcuaccaagua

SEQ ID NO: 221210 - RNA, 19 nt, Homo sapiens
ccaaguuccuggcgcuagu

SEQ ID NO: 221211 - RNA, 19 nt, Homo sapiens
gguccucuaggccuauaua

SEQ ID NO: 221212 - RNA, 19 nt, Homo sapiens
ccuccugccugccaaguuc

SEQ ID NO: 221213 - RNA, 19 nt, Homo sapiens
auauaggaauaaccucuug

SEQ ID NO: 221214 - RNA, 19 nt, Homo sapiens
cagggaggguauuuauugg

SEQ ID NO: 221215 - RNA, 19 nt, Homo sapiens
ucagagcuacuuccacugu

SEQ ID NO: 221216 - RNA, 19 nt, Homo sapiens
gcgguccucuaggccuaua

SEQ ID NO: 221217 - RNA, 19 nt, Homo sapiens
cuccauuucuacuguguga

SEQ ID NO: 221218 - RNA, 19 nt, Homo sapiens
gggacgugcggauccuuaa

SEQ ID NO: 221219 - RNA, 19 nt, Homo sapiens
gcuuucuccucguucuuau

SEQ ID NO: 221220 - RNA, 19 nt, Homo sapiens
ggguuaugcuaccaaguac

SEQ ID NO: 221221 - RNA, 19 nt, Homo sapiens
agagcuacuuccacugugu

SEQ ID NO: 221222 - RNA, 19 nt, Homo sapiens
uuucuccucguucuuauuu

SEQ ID NO: 221223 - RNA, 19 nt, Homo sapiens
ggacuacgugcaggucugu

SEQ ID NO: 221224 - RNA, 19 nt, Homo sapiens
guccugcuuucuccucguu

SEQ ID NO: 221225 - RNA, 19 nt, Homo sapiens
cagccgaggccuaccacuu

SEQ ID NO: 221226 - RNA, 19 nt, Homo sapiens
cuggguagccuucaaugug

SEQ ID NO: 221227 - RNA, 19 nt, Homo sapiens
gaagaugaccuuuacauga

SEQ ID NO: 221228 - RNA, 19 nt, Homo sapiens
gauuaucacuggauucuuu

SEQ ID NO: 221229 - RNA, 19 nt, Homo sapiens
caaaugaaaugccaaagga

SEQ ID NO: 221230 - RNA, 19 nt, Homo sapiens
gggaugaauucuuuguuua

SEQ ID NO: 221231 - RNA, 19 nt, Homo sapiens
gagaauggcuguacaaugc

SEQ ID NO: 221232 - RNA, 19 nt, Homo sapiens
gaagaagggacaacaauau

SEQ ID NO: 221233 - RNA, 19 nt, Homo sapiens
aaucacagcugcuuauauu

SEQ ID NO: 221234 - RNA, 19 nt, Homo sapiens
uguaugaucuuccauguuu

SEQ ID NO: 221235 - RNA, 19 nt, Homo sapiens
ggaagaagggacaacaaua

SEQ ID NO: 221236 - RNA, 19 nt, Homo sapiens
gaaagggccugucagucuu

SEQ ID NO: 221237 - RNA, 19 nt, Homo sapiens
ggaaauguuugcaaucugu

SEQ ID NO: 221238 - RNA, 19 nt, Homo sapiens
gaagugcaacggaaacaua

SEQ ID NO: 221239 - RNA, 19 nt, Homo sapiens
gaauuagacugaagugcaa

SEQ ID NO: 221240 - RNA, 19 nt, Homo sapiens
gaaacuccuuguugcauga

SEQ ID NO: 221241 - RNA, 19 nt, Homo sapiens
ugaaacaccuauagaguau

SEQ ID NO: 221242 - RNA, 19 nt, Homo sapiens
guacagaaacuccuuguug

SEQ ID NO: 221243 - RNA, 19 nt, Homo sapiens
ugugagagguuucuaugua

SEQ ID NO: 221244 - RNA, 19 nt, Homo sapiens
ggaaaaccauuguuguuaa

SEQ ID NO: 221245 - RNA, 19 nt, Homo sapiens
caauguagcuuuggugaug

SEQ ID NO: 221246 - RNA, 19 nt, Homo sapiens
agaagaagaucccaugguu

SEQ ID NO: 221247 - RNA, 19 nt, Homo sapiens
ccacuuauaucuggaagaa

SEQ ID NO: 221248 - RNA, 19 nt, Homo sapiens
ggucauagaugggaacuca

SEQ ID NO: 221249 - RNA, 19 nt, Homo sapiens
ccaaacggauaauuacuau

SEQ ID NO: 221250 - RNA, 19 nt, Homo sapiens
gggaagaaucaaacauuua

SEQ ID NO: 221251 - RNA, 19 nt, Homo sapiens
aaacagacaguucuaauug

SEQ ID NO: 221252 - RNA, 19 nt, Homo sapiens
caagacgucuggaaagaau

SEQ ID NO: 221253 - RNA, 19 nt, Homo sapiens
gccaagauguuugcaauug

SEQ ID NO: 221254 - RNA, 19 nt, Homo sapiens
ugacugauguucaugauag

SEQ ID NO: 221255 - RNA, 19 nt, Homo sapiens
gauauuggauggcuuuuaa

SEQ ID NO: 221256 - RNA, 19 nt, Homo sapiens
cagaaagacugaagcacaa

SEQ ID NO: 221257 - RNA, 19 nt, Homo sapiens
gcuaguaggucucauaaaa

SEQ ID NO: 221258 - RNA, 19 nt, Homo sapiens
ucaagaagauccagacuac

SEQ ID NO: 221259 - RNA, 19 nt, Homo sapiens
gaugggaacucagaagaug

SEQ ID NO: 221260 - RNA, 19 nt, Homo sapiens
gaaauaucgucauggucuu

SEQ ID NO: 221261 - RNA, 19 nt, Homo sapiens
aagaacaacuuccacgaaa

SEQ ID NO: 221262 - RNA, 19 nt, Homo sapiens
gaagcuugguugacugaug

SEQ ID NO: 221263 - RNA, 19 nt, Homo sapiens
caagaagaaacucagauuu

SEQ ID NO: 221264 - RNA, 19 nt, Homo sapiens
caaacagacaguucuaauu

SEQ ID NO: 221265 - RNA, 19 nt, Homo sapiens
cuauguauccugagaauaa

SEQ ID NO: 221266 - RNA, 19 nt, Homo sapiens
guauguaguucucaucaau

SEQ ID NO: 221267 - RNA, 19 nt, Homo sapiens
gaggaaauaucgucauggu

SEQ ID NO: 221268 - RNA, 19 nt, Homo sapiens
gaacauucuccucuucuug

SEQ ID NO: 221269 - RNA, 19 nt, Homo sapiens
gacgaaguguggauuaugu

SEQ ID NO: 221270 - RNA, 19 nt, Homo sapiens
gaacucagaagaugaccuu

SEQ ID NO: 221271 - RNA, 19 nt, Homo sapiens
gauccagacuacuuaagga

SEQ ID NO: 221272 - RNA, 19 nt, Homo sapiens
ggaacauucuccucuucuu

SEQ ID NO: 221273 - RNA, 19 nt, Homo sapiens
gaagauccagacuacuuaa

SEQ ID NO: 221274 - RNA, 19 nt, Homo sapiens
ggacuugaacaaagacauu

SEQ ID NO: 221275 - RNA, 19 nt, Homo sapiens
ugggaugaauucuuuguuu

SEQ ID NO: 221276 - RNA, 19 nt, Homo sapiens
gcugggacuugaacaaaga

SEQ ID NO: 221277 - RNA, 19 nt, Homo sapiens
gauguaugaucuuccaugu

SEQ ID NO: 221278 - RNA, 19 nt, Homo sapiens
uguuauacaugucgaguuu

SEQ ID NO: 221279 - RNA, 19 nt, Homo sapiens
ucacuggauucuuuccuuu

SEQ ID NO: 221280 - RNA, 19 nt, Homo sapiens
agacagaugagucacauaa

SEQ ID NO: 221281 - RNA, 19 nt, Homo sapiens
caaaucagccacuuauauc

SEQ ID NO: 221282 - RNA, 19 nt, Homo sapiens
ccucagcaguguaagauau

SEQ ID NO: 221283 - RNA, 19 nt, Homo sapiens
aagaugaccuuuacaugau

SEQ ID NO: 221284 - RNA, 19 nt, Homo sapiens
ggauuaaaguugucauggu

SEQ ID NO: 221285 - RNA, 19 nt, Homo sapiens
accaagagcugaacaagau

SEQ ID NO: 221286 - RNA, 19 nt, Homo sapiens
caacggaaacauaaagaga

SEQ ID NO: 221287 - RNA, 19 nt, Homo sapiens
acagacaguucuaauuguu

SEQ ID NO: 221288 - RNA, 19 nt, Homo sapiens
uaaccuacccugggauuaa

SEQ ID NO: 221289 - RNA, 19 nt, Homo sapiens
gugagagguuucuauguau

SEQ ID NO: 221290 - RNA, 19 nt, Homo sapiens
aauaugacauggugcuuga

SEQ ID NO: 221291 - RNA, 19 nt, Homo sapiens
acaaaucagccacuuauau

SEQ ID NO: 221292 - RNA, 19 nt, Homo sapiens
gagacaaaucagccacuua

SEQ ID NO: 221293 - RNA, 19 nt, Homo sapiens
ggaaucacagcugcuuaua

SEQ ID NO: 221294 - RNA, 19 nt, Homo sapiens
cuucaugucucucuacuca

SEQ ID NO: 221295 - RNA, 19 nt, Homo sapiens
gaauggcuguacaaugcaa

SEQ ID NO: 221296 - RNA, 19 nt, Homo sapiens
cuuguuaacuguccagcua

SEQ ID NO: 221297 - RNA, 19 nt, Homo sapiens
uaagauauuggauggcuuu

SEQ ID NO: 221298 - RNA, 19 nt, Homo sapiens
ccagacuacuuaaggaaau

SEQ ID NO: 221299 - RNA, 19 nt, Homo sapiens
gaaucacagcugcuuauau

SEQ ID NO: 221300 - RNA, 19 nt, Homo sapiens
gagcugaacaagaugcauu

SEQ ID NO: 221301 - RNA, 19 nt, Homo sapiens
auaaaccuguucuuccuuu

SEQ ID NO: 221302 - RNA, 19 nt, Homo sapiens
gaaaugccaaaggaaguuu

SEQ ID NO: 221303 - RNA, 19 nt, Homo sapiens
uaacuuauggacuguuuga

SEQ ID NO: 221304 - RNA, 19 nt, Homo sapiens
uauacaaccuaacuuaugg

SEQ ID NO: 221305 - RNA, 19 nt, Homo sapiens
cauggugcuugauguauga

SEQ ID NO: 221306 - RNA, 19 nt, Homo sapiens
auacacagcucgaucuaag

SEQ ID NO: 221307 - RNA, 19 nt, Homo sapiens
agaaagcucgcaacacgua

SEQ ID NO: 221308 - RNA, 19 nt, Homo sapiens
agacaaaucagccacuuau

SEQ ID NO: 221309 - RNA, 19 nt, Homo sapiens
uagaggaaauaucgucaug

SEQ ID NO: 221310 - RNA, 19 nt, Homo sapiens
gggccugucagucuuauuu

SEQ ID NO: 221311 - RNA, 19 nt, Homo sapiens
ggggagauguccagauuuu

SEQ ID NO: 221312 - RNA, 19 nt, Homo sapiens
acagaugagucacauaaag

SEQ ID NO: 221313 - RNA, 19 nt, Homo sapiens
gcugugcuguauuugauau

SEQ ID NO: 221314 - RNA, 19 nt, Homo sapiens
uggauucuuuccuuucuuu

SEQ ID NO: 221315 - RNA, 19 nt, Homo sapiens
cugaaacaccuauagagua

SEQ ID NO: 221316 - RNA, 19 nt, Homo sapiens
agaagauccagacuacuua

SEQ ID NO: 221317 - RNA, 19 nt, Homo sapiens
gaucucuuauuaccucaau

SEQ ID NO: 221318 - RNA, 19 nt, Homo sapiens
ggccguggcugugcuguau

SEQ ID NO: 221319 - RNA, 19 nt, Homo sapiens
gucaagacgucuggaaaga

SEQ ID NO: 221320 - RNA, 19 nt, Homo sapiens
ccuaacuuauggacuguuu

SEQ ID NO: 221321 - RNA, 19 nt, Homo sapiens
caccaaaggagacauauca

SEQ ID NO: 221322 - RNA, 19 nt, Homo sapiens
ccauuuauaaggagucuaa

SEQ ID NO: 221323 - RNA, 19 nt, Homo sapiens
aaagagaagucauguacac

SEQ ID NO: 221324 - RNA, 19 nt, Homo sapiens
caucacaccucaucaucca

SEQ ID NO: 221325 - RNA, 19 nt, Homo sapiens
gaagaaacucagauuuaac

SEQ ID NO: 221326 - RNA, 19 nt, Homo sapiens
caacaagaagaaacucaga

SEQ ID NO: 221327 - RNA, 19 nt, Homo sapiens
ggaagaagccggagcagua

SEQ ID NO: 221328 - RNA, 19 nt, Homo sapiens
gaagagccuuuauacaauu

SEQ ID NO: 221329 - RNA, 19 nt, Homo sapiens
ggaagagccuuuauacaau

SEQ ID NO: 221330 - RNA, 19 nt, Homo sapiens
gaagauuaauguaggauga

SEQ ID NO: 221331 - RNA, 19 nt, Homo sapiens
guucuuagcuugucuguga

SEQ ID NO: 221332 - RNA, 19 nt, Homo sapiens
aaagaacggugauguagua

SEQ ID NO: 221333 - RNA, 19 nt, Homo sapiens
gaagugaagucuuggguau

SEQ ID NO: 221334 - RNA, 19 nt, Homo sapiens
ccacuucacuuucuucaaa

SEQ ID NO: 221335 - RNA, 19 nt, Homo sapiens
caacuuuccucaaaucaaa

SEQ ID NO: 221336 - RNA, 19 nt, Homo sapiens
gaacuucauuggccucauu

SEQ ID NO: 221337 - RNA, 19 nt, Homo sapiens
gggaagagccuuuauacaa

SEQ ID NO: 221338 - RNA, 19 nt, Homo sapiens
ggaggacccugacuacuug

SEQ ID NO: 221339 - RNA, 19 nt, Homo sapiens
gcacugaacugcuuuuaaa

SEQ ID NO: 221340 - RNA, 19 nt, Homo sapiens
gaacggugauguaguaugg

SEQ ID NO: 221341 - RNA, 19 nt, Homo sapiens
guagugggcucacaacguu

SEQ ID NO: 221342 - RNA, 19 nt, Homo sapiens
gccaagaucuuugccauug

SEQ ID NO: 221343 - RNA, 19 nt, Homo sapiens
gcacuguggucgucaacuu

SEQ ID NO: 221344 - RNA, 19 nt, Homo sapiens
uaaaggaggccauaagcua

SEQ ID NO: 221345 - RNA, 19 nt, Homo sapiens
ggaauggugcuuuauguga

SEQ ID NO: 221346 - RNA, 19 nt, Homo sapiens
ggacaaaucuaaaaugcaa

SEQ ID NO: 221347 - RNA, 19 nt, Homo sapiens
ucacacagaccucgaguuu

SEQ ID NO: 221348 - RNA, 19 nt, Homo sapiens
gcuaacaguugccacauca

SEQ ID NO: 221349 - RNA, 19 nt, Homo sapiens
ccaaauguccuuucucaga

SEQ ID NO: 221350 - RNA, 19 nt, Homo sapiens
acacagaccucgaguuucu

SEQ ID NO: 221351 - RNA, 19 nt, Homo sapiens
uaagauugcgccugagaua

SEQ ID NO: 221352 - RNA, 19 nt, Homo sapiens
gcauuugccugcuucuuuc

SEQ ID NO: 221353 - RNA, 19 nt, Homo sapiens
guccaggaauggugcuuua

SEQ ID NO: 221354 - RNA, 19 nt, Homo sapiens
gagcuagccuuccuugucu

SEQ ID NO: 221355 - RNA, 19 nt, Homo sapiens
caaacugggucuucagcuu

SEQ ID NO: 221356 - RNA, 19 nt, Homo sapiens
gggcaagccucuaguguac

SEQ ID NO: 221357 - RNA, 19 nt, Homo sapiens
gcaaagaacggugauguag

SEQ ID NO: 221358 - RNA, 19 nt, Homo sapiens
uaaagauucucacauaugc

SEQ ID NO: 221359 - RNA, 19 nt, Homo sapiens
cuacuguucuugacaauca

SEQ ID NO: 221360 - RNA, 19 nt, Homo sapiens
gcagggaguuagcacugaa

SEQ ID NO: 221361 - RNA, 19 nt, Homo sapiens
ccagaagccugaucuuugg

SEQ ID NO: 221362 - RNA, 19 nt, Homo sapiens
gaucugaggcuaagacaca

SEQ ID NO: 221363 - RNA, 19 nt, Homo sapiens
ggaggaggauccccaagua

SEQ ID NO: 221364 - RNA, 19 nt, Homo sapiens
aaaccaaacuaggagauga

SEQ ID NO: 221365 - RNA, 19 nt, Homo sapiens
auacugcacuuauuuguca

SEQ ID NO: 221366 - RNA, 19 nt, Homo sapiens
gaaauccggucagccaagu

SEQ ID NO: 221367 - RNA, 19 nt, Homo sapiens
caucagacccaacccauga

SEQ ID NO: 221368 - RNA, 19 nt, Homo sapiens
aaagugaacucucaaaucc

SEQ ID NO: 221369 - RNA, 19 nt, Homo sapiens
gggcaaacccuggugcuuu

SEQ ID NO: 221370 - RNA, 19 nt, Homo sapiens
caaagugaacucucaaauc

SEQ ID NO: 221371 - RNA, 19 nt, Homo sapiens
cuagauggguucuuagcuu

SEQ ID NO: 221372 - RNA, 19 nt, Homo sapiens
gaccucgaguuucugguaa

SEQ ID NO: 221373 - RNA, 19 nt, Homo sapiens
ggcaaacccuggugcuuuc

SEQ ID NO: 221374 - RNA, 19 nt, Homo sapiens
caggaauggugcuuuaugu

SEQ ID NO: 221375 - RNA, 19 nt, Homo sapiens
agucaucaaugcaauaaga

SEQ ID NO: 221376 - RNA, 19 nt, Homo sapiens
acucagaaguugugcuaaa

SEQ ID NO: 221377 - RNA, 19 nt, Homo sapiens
caaguacgacucauggauu

SEQ ID NO: 221378 - RNA, 19 nt, Homo sapiens
ggccgcaucuggaacauuc

SEQ ID NO: 221379 - RNA, 19 nt, Homo sapiens
caaacccgcuggagcaagu

SEQ ID NO: 221380 - RNA, 19 nt, Homo sapiens
gcgauucgguggacuacau

SEQ ID NO: 221381 - RNA, 19 nt, Homo sapiens
agugaagucuuggguauuu

SEQ ID NO: 221382 - RNA, 19 nt, Homo sapiens
aaccugggauccugacuaa

SEQ ID NO: 221383 - RNA, 19 nt, Homo sapiens
cagcacauaugggaacuau

SEQ ID NO: 221384 - RNA, 19 nt, Homo sapiens
ucacugcagucaccucuuc

SEQ ID NO: 221385 - RNA, 19 nt, Homo sapiens
uaaccuguauacucuugaa

SEQ ID NO: 221386 - RNA, 19 nt, Homo sapiens
agagguggcaggagaauuu

SEQ ID NO: 221387 - RNA, 19 nt, Homo sapiens
gucgucaacuuuccucaaa

SEQ ID NO: 221388 - RNA, 19 nt, Homo sapiens
guuccuacauccuaagguu

SEQ ID NO: 221389 - RNA, 19 nt, Homo sapiens
gagaugaaacugguuccua

SEQ ID NO: 221390 - RNA, 19 nt, Homo sapiens
ugacaaucaucuccaaugg

SEQ ID NO: 221391 - RNA, 19 nt, Homo sapiens
caaguuaagucccauucag

SEQ ID NO: 221392 - RNA, 19 nt, Homo sapiens
gauguaguauggccugaca

SEQ ID NO: 221393 - RNA, 19 nt, Homo sapiens
gcaagccucuaguguacca

SEQ ID NO: 221394 - RNA, 19 nt, Homo sapiens
ucuacucccuccucuauau

SEQ ID NO: 221395 - RNA, 19 nt, Homo sapiens
aaaccaaacugggucuuca

SEQ ID NO: 221396 - RNA, 19 nt, Homo sapiens
aaacaggcagguacaggua

SEQ ID NO: 221397 - RNA, 19 nt, Homo sapiens
cccacgaacucaaggguuu

SEQ ID NO: 221398 - RNA, 19 nt, Homo sapiens
gguaaagugcaauggguaa

SEQ ID NO: 221399 - RNA, 19 nt, Homo sapiens
aaguacgacucauggauuu

SEQ ID NO: 221400 - RNA, 19 nt, Homo sapiens
aaacugggucuucagcuuu

SEQ ID NO: 221401 - RNA, 19 nt, Homo sapiens
gaaggggaauggaagagaa

SEQ ID NO: 221402 - RNA, 19 nt, Homo sapiens
gguacuggauggccuucaa

SEQ ID NO: 221403 - RNA, 19 nt, Homo sapiens
gagaauucaaauccucuuu

SEQ ID NO: 221404 - RNA, 19 nt, Homo sapiens
uaagacugcugguugacau

SEQ ID NO: 221405 - RNA, 19 nt, Homo sapiens
accaagugcuuccuacaaa

SEQ ID NO: 221406 - RNA, 19 nt, Homo sapiens
aggagccucugaucaaauu

SEQ ID NO: 221407 - RNA, 19 nt, Homo sapiens
ccuguauacucuugaauuc

SEQ ID NO: 221408 - RNA, 19 nt, Homo sapiens
gaucuuugggcaucagaaa

SEQ ID NO: 221409 - RNA, 19 nt, Homo sapiens
aagcagagcggguaaagug

SEQ ID NO: 221410 - RNA, 19 nt, Homo sapiens
gaaggcagcaggcauuugc

SEQ ID NO: 221411 - RNA, 19 nt, Homo sapiens
gacgcaaggugugcucuga

SEQ ID NO: 221412 - RNA, 19 nt, Homo sapiens
ugaaacugguuccuacauc

SEQ ID NO: 221413 - RNA, 19 nt, Homo sapiens
gcucugaucugaggcuaag

SEQ ID NO: 221414 - RNA, 19 nt, Homo sapiens
guagucaucaaugcaauaa

SEQ ID NO: 221415 - RNA, 19 nt, Homo sapiens
uccagauccucaacaagua

SEQ ID NO: 221416 - RNA, 19 nt, Homo sapiens
cgucaacuuuccucaaauc

SEQ ID NO: 221417 - RNA, 19 nt, Homo sapiens
gaaaccaaacuaggagaug

SEQ ID NO: 221418 - RNA, 19 nt, Homo sapiens
ggacugguaccaucagaag

SEQ ID NO: 221419 - RNA, 19 nt, Homo sapiens
ucucacauaugccgguuau

SEQ ID NO: 221420 - RNA, 19 nt, Homo sapiens
cguuugaccucgacugguu

SEQ ID NO: 221421 - RNA, 19 nt, Homo sapiens
caagugcuuccuacaaaga

SEQ ID NO: 221422 - RNA, 19 nt, Homo sapiens
gauccugacuaagccuuug

SEQ ID NO: 221423 - RNA, 19 nt, Homo sapiens
caaacuaggagaugaaacu

SEQ ID NO: 221424 - RNA, 19 nt, Homo sapiens
ggagcugcuuggacggauu

SEQ ID NO: 221425 - RNA, 19 nt, Homo sapiens
gcccagaagccugaucuuu

SEQ ID NO: 221426 - RNA, 19 nt, Homo sapiens
ucaaggcccucggcgauuc

SEQ ID NO: 221427 - RNA, 19 nt, Homo sapiens
ggaggacccugacuacuug

SEQ ID NO: 221428 - RNA, 19 nt, Homo sapiens
ggaaagguauggcaguaga

SEQ ID NO: 221429 - RNA, 19 nt, Homo sapiens
guucacaugccacaaauaa

SEQ ID NO: 221430 - RNA, 19 nt, Homo sapiens
caagaacaauucaagaaac

SEQ ID NO: 221431 - RNA, 19 nt, Homo sapiens
gaacaauucaagaaacuag

SEQ ID NO: 221432 - RNA, 19 nt, Homo sapiens
ggucagagcuacggaagca

SEQ ID NO: 221433 - RNA, 19 nt, Homo sapiens
ggaggaggauccccaagua

SEQ ID NO: 221434 - RNA, 19 nt, Homo sapiens
gaggaaaaguccacaagaa

SEQ ID NO: 221435 - RNA, 19 nt, Homo sapiens
gcgauucgguggacuacau

SEQ ID NO: 221436 - RNA, 19 nt, Homo sapiens
caucucaccuucagucaag

SEQ ID NO: 221437 - RNA, 19 nt, Homo sapiens
acaaauaacaucucaccuu

SEQ ID NO: 221438 - RNA, 19 nt, Homo sapiens
ucacaugccacaaauaaca

SEQ ID NO: 221439 - RNA, 19 nt, Homo sapiens
cacaagaacaauucaagaa

SEQ ID NO: 221440 - RNA, 19 nt, Homo sapiens
ccacaagaacaauucaaga

SEQ ID NO: 221441 - RNA, 19 nt, Homo sapiens
aagaaacaaugggcagaaa

SEQ ID NO: 221442 - RNA, 19 nt, Homo sapiens
guauggcaguagaggauga

SEQ ID NO: 221443 - RNA, 19 nt, Homo sapiens
agaaagcugugggacgaaa

SEQ ID NO: 221444 - RNA, 19 nt, Homo sapiens
caauguaucccugaggaaa

SEQ ID NO: 221445 - RNA, 19 nt, Homo sapiens
ggaccugcaggccaaugua

SEQ ID NO: 221446 - RNA, 19 nt, Homo sapiens
ucaaggcccucggcgauuc

SEQ ID NO: 221447 - RNA, 19 nt, Homo sapiens
gcaagcgcgaggucaugua

SEQ ID NO: 221448 - RNA, 19 nt, Homo sapiens
gaaacaaugggcagaaagc

SEQ ID NO: 221449 - RNA, 19 nt, Homo sapiens
agagagcagugagcugauu

SEQ ID NO: 221450 - RNA, 19 nt, Homo sapiens
aauaacaucucaccuucag

SEQ ID NO: 221451 - RNA, 19 nt, Homo sapiens
gaaaaguccacaagaacaa

SEQ ID NO: 221452 - RNA, 19 nt, Homo sapiens
uaagaaacaaugggcagaa

SEQ ID NO: 221453 - RNA, 19 nt, Homo sapiens
agggaaagguauggcagua

SEQ ID NO: 221454 - RNA, 19 nt, Homo sapiens
caagaaacuaguaagaaac

SEQ ID NO: 221455 - RNA, 19 nt, Homo sapiens
gugagcugauucuccaaug

SEQ ID NO: 221456 - RNA, 19 nt, Homo sapiens
ccaggaggacgccuacaug

SEQ ID NO: 221457 - RNA, 19 nt, Homo sapiens
gugacgggcuaccaguuca

SEQ ID NO: 221458 - RNA, 19 nt, Homo sapiens
acaguucacaugccacaaa

SEQ ID NO: 221459 - RNA, 19 nt, Homo sapiens
ucucucaagggcaggauua

SEQ ID NO: 221460 - RNA, 19 nt, Homo sapiens
ccuacaugcuggacaucuu

SEQ ID NO: 221461 - RNA, 19 nt, Homo sapiens
gccugcaccugcucauuca

SEQ ID NO: 221462 - RNA, 19 nt, Homo sapiens
caguucacaugccacaaau

SEQ ID NO: 221463 - RNA, 19 nt, Homo sapiens
ggaaaaguccacaagaaca

SEQ ID NO: 221464 - RNA, 19 nt, Homo sapiens
gagcugauucuccaauggu

SEQ ID NO: 221465 - RNA, 19 nt, Homo sapiens
ggccugcaccugcucauuc

SEQ ID NO: 221466 - RNA, 19 nt, Homo sapiens
gcaggggacuacaugugaa

SEQ ID NO: 221467 - RNA, 19 nt, Homo sapiens
ugccacaaauaacaucuca

SEQ ID NO: 221468 - RNA, 19 nt, Homo sapiens
gaccugcaggccaauguau

SEQ ID NO: 221469 - RNA, 19 nt, Homo sapiens
cucaagggcaggauuauuc

SEQ ID NO: 221470 - RNA, 19 nt, Homo sapiens
aggaggacccugacuacuu

SEQ ID NO: 221471 - RNA, 19 nt, Homo sapiens
aaaguccacaagaacaauu

SEQ ID NO: 221472 - RNA, 19 nt, Homo sapiens
gagagcagugagcugauuc

SEQ ID NO: 221473 - RNA, 19 nt, Homo sapiens
gaaagguauggcaguagag

SEQ ID NO: 221474 - RNA, 19 nt, Homo sapiens
gugcugaccuccaaauacc

SEQ ID NO: 221475 - RNA, 19 nt, Homo sapiens
cccguggucuuugaauaaa

SEQ ID NO: 221476 - RNA, 19 nt, Homo sapiens
agagagaacccaccauggu

SEQ ID NO: 221477 - RNA, 19 nt, Homo sapiens
agaccuacuucccgcacuu

SEQ ID NO: 221478 - RNA, 19 nt, Homo sapiens
gaccuccaaauaccguuaa

SEQ ID NO: 221479 - RNA, 19 nt, Homo sapiens
ugaccuccaaauaccguua

SEQ ID NO: 221480 - RNA, 19 nt, Homo sapiens
guuaagggccacggcaaga

SEQ ID NO: 221481 - RNA, 19 nt, Homo sapiens
caacuucaagcuccuaagc

SEQ ID NO: 221482 - RNA, 19 nt, Homo sapiens
ggcccuuccuggucuuuga

SEQ ID NO: 221483 - RNA, 19 nt, Homo sapiens
gugcugaccuccaaauacc

SEQ ID NO: 221484 - RNA, 19 nt, Homo sapiens
agagagaacccaccauggu

SEQ ID NO: 221485 - RNA, 19 nt, Homo sapiens
cuuccuggucuuugaauaa

SEQ ID NO: 221486 - RNA, 19 nt, Homo sapiens
agaccuacuucccgcacuu

SEQ ID NO: 221487 - RNA, 19 nt, Homo sapiens
gaccuccaaauaccguuaa

SEQ ID NO: 221488 - RNA, 19 nt, Homo sapiens
uuccuggucuuugaauaaa

SEQ ID NO: 221489 - RNA, 19 nt, Homo sapiens
ugaccuccaaauaccguua

SEQ ID NO: 221490 - RNA, 19 nt, Homo sapiens
guuaagggccacggcaaga

SEQ ID NO: 221491 - RNA, 19 nt, Homo sapiens
caacuucaagcuccuaagc

SEQ ID NO: 221492 - RNA, 19 nt, Homo sapiens
gaggagaagucugccguua

SEQ ID NO: 221493 - RNA, 19 nt, Homo sapiens
gaacguggaugaaguuggu

SEQ ID NO: 221494 - RNA, 19 nt, Homo sapiens
gcaucuggauucugccuaa

SEQ ID NO: 221495 - RNA, 19 nt, Homo sapiens
gcaacgugcuggucugugu

SEQ ID NO: 221496 - RNA, 19 nt, Homo sapiens
ggagaagucugccguuacu

SEQ ID NO: 221497 - RNA, 19 nt, Homo sapiens
gcuguccaauuucuauuaa

SEQ ID NO: 221498 - RNA, 19 nt, Homo sapiens
gcacguggauccugagaac

SEQ ID NO: 221499 - RNA, 19 nt, Homo sapiens
gaaggcucauggcaagaaa

SEQ ID NO: 221500 - RNA, 19 nt, Homo sapiens
caacuguguucacuagcaa

SEQ ID NO: 221501 - RNA, 19 nt, Homo sapiens
ucuggauucugccuaauaa

SEQ ID NO: 221502 - RNA, 19 nt, Homo sapiens
ccacaaguaucacuaagcu

SEQ ID NO: 221503 - RNA, 19 nt, Homo sapiens
ggacccagagguucuuuga

SEQ ID NO: 221504 - RNA, 19 nt, Homo sapiens
gcaaggugaacguggauga

SEQ ID NO: 221505 - RNA, 19 nt, Homo sapiens
cuaaugcccuggcccacaa

SEQ ID NO: 221506 - RNA, 19 nt, Homo sapiens
gagguucuuugaguccuuu

SEQ ID NO: 221507 - RNA, 19 nt, Homo sapiens
cuuucuugcuguccaauuu

SEQ ID NO: 221508 - RNA, 19 nt, Homo sapiens
gggcaacccuaaggugaag

SEQ ID NO: 221509 - RNA, 19 nt, Homo sapiens
acccagagguucuuugagu

SEQ ID NO: 221510 - RNA, 19 nt, Homo sapiens
ggugaacguggaugaaguu

SEQ ID NO: 221511 - RNA, 19 nt, Homo sapiens
gaucuguccacuccugaug

SEQ ID NO: 221512 - RNA, 19 nt, Homo sapiens
acaacuguguucacuagca

SEQ ID NO: 221513 - RNA, 19 nt, Homo sapiens
ucccuaaguccaacuacua

SEQ ID NO: 221514 - RNA, 19 nt, Homo sapiens
ugaaggcucauggcaagaa

SEQ ID NO: 221515 - RNA, 19 nt, Homo sapiens
gccuugagcaucuggauuc

SEQ ID NO: 221516 - RNA, 19 nt, Homo sapiens
gcccacaaguaucacuaag

SEQ ID NO: 221517 - RNA, 19 nt, Homo sapiens
ugugcuggcccaucacuuu

SEQ ID NO: 221518 - RNA, 19 nt, Homo sapiens
ucugugugcuggcccauca

SEQ ID NO: 221519 - RNA, 19 nt, Homo sapiens
caaggugaacguggaugaa

SEQ ID NO: 221520 - RNA, 19 nt, Homo sapiens
ucacuagcaaccucaaaca

SEQ ID NO: 221521 - RNA, 19 nt, Homo sapiens
gcucggugccuuuagugau

SEQ ID NO: 221522 - RNA, 19 nt, Homo sapiens
acuagcaaccucaaacaga

SEQ ID NO: 221523 - RNA, 19 nt, Homo sapiens
ggcccacaaguaucacuaa

SEQ ID NO: 221524 - RNA, 19 nt, Homo sapiens
ggagaagacugcugucaau

SEQ ID NO: 221525 - RNA, 19 nt, Homo sapiens
gcaaugugcuggugugugu

SEQ ID NO: 221526 - RNA, 19 nt, Homo sapiens
ggguauggcuucugccuaa

SEQ ID NO: 221527 - RNA, 19 nt, Homo sapiens
gaacguggaugcaguuggu

SEQ ID NO: 221528 - RNA, 19 nt, Homo sapiens
uaaagaauguucagcucaa

SEQ ID NO: 221529 - RNA, 19 nt, Homo sapiens
ggaacacaaugccuacuuc

SEQ ID NO: 221530 - RNA, 19 nt, Homo sapiens
gcacguggauccugagaac

SEQ ID NO: 221531 - RNA, 19 nt, Homo sapiens
gaucuguccucuccugaug

SEQ ID NO: 221532 - RNA, 19 nt, Homo sapiens
gacccuauuucccuagauu

SEQ ID NO: 221533 - RNA, 19 nt, Homo sapiens
cuaggugccuuuagugaug

SEQ ID NO: 221534 - RNA, 19 nt, Homo sapiens
ccuggacuguuuccugaua

SEQ ID NO: 221535 - RNA, 19 nt, Homo sapiens
cuaaugcccuggcucacaa

SEQ ID NO: 221536 - RNA, 19 nt, Homo sapiens
ggacccagagguucuuuga

SEQ ID NO: 221537 - RNA, 19 nt, Homo sapiens
uauggcuucugccuaauaa

SEQ ID NO: 221538 - RNA, 19 nt, Homo sapiens
gaacacaaugccuacuuca

SEQ ID NO: 221539 - RNA, 19 nt, Homo sapiens
cauaagaagacccuauuuc

SEQ ID NO: 221540 - RNA, 19 nt, Homo sapiens
guauggcuucugccuaaua

SEQ ID NO: 221541 - RNA, 19 nt, Homo sapiens
gaacuugggaacacaaugc

SEQ ID NO: 221542 - RNA, 19 nt, Homo sapiens
ggugcuaggugccuuuagu

SEQ ID NO: 221543 - RNA, 19 nt, Homo sapiens
gagguucuuugaguccuuu

SEQ ID NO: 221544 - RNA, 19 nt, Homo sapiens
ggaauucaccccacaaaug

SEQ ID NO: 221545 - RNA, 19 nt, Homo sapiens
ccugauaaccauaagaaga

SEQ ID NO: 221546 - RNA, 19 nt, Homo sapiens
gaaggcucauggcaagaag

SEQ ID NO: 221547 - RNA, 19 nt, Homo sapiens
uugagauccuggacuguuu

SEQ ID NO: 221548 - RNA, 19 nt, Homo sapiens
ccgcaacuuuggcaaggaa

SEQ ID NO: 221549 - RNA, 19 nt, Homo sapiens
ccauaagaagacccuauuu

SEQ ID NO: 221550 - RNA, 19 nt, Homo sapiens
ucacaaguaccauugagau

SEQ ID NO: 221551 - RNA, 19 nt, Homo sapiens
acacaaugccuacuucaag

SEQ ID NO: 221552 - RNA, 19 nt, Homo sapiens
gggaacacaaugccuacuu

SEQ ID NO: 221553 - RNA, 19 nt, Homo sapiens
gggcaacccuaaggugaag

SEQ ID NO: 221554 - RNA, 19 nt, Homo sapiens
acccagagguucuuugagu

SEQ ID NO: 221555 - RNA, 19 nt, Homo sapiens
gcaacuuuggcaaggaauu

SEQ ID NO: 221556 - RNA, 19 nt, Homo sapiens
gagaagacugcugucaaug

SEQ ID NO: 221557 - RNA, 19 nt, Homo sapiens
caacuuuggcaaggaauuc

SEQ ID NO: 221558 - RNA, 19 nt, Homo sapiens
caaguaccauugagauccu

SEQ ID NO: 221559 - RNA, 19 nt, Homo sapiens
gaauguucagcucaacuuc

SEQ ID NO: 221560 - RNA, 19 nt, Homo sapiens
gaggagaagacugcuguca

SEQ ID NO: 221561 - RNA, 19 nt, Homo sapiens
gcuaaugcccuggcucaca

SEQ ID NO: 221562 - RNA, 19 nt, Homo sapiens
gcuaggugccuuuagugau

SEQ ID NO: 221563 - RNA, 19 nt, Homo sapiens
ugaaggcucauggcaagaa

SEQ ID NO: 221564 - RNA, 19 nt, Homo sapiens
cuggacuguuuccugauaa

SEQ ID NO: 221565 - RNA, 19 nt, Homo sapiens
ucacuagcaaccucaaaca

SEQ ID NO: 221566 - RNA, 19 nt, Homo sapiens
gggcaaagugaacguggau

SEQ ID NO: 221567 - RNA, 19 nt, Homo sapiens
acuagcaaccucaaacaga

SEQ ID NO: 221568 - RNA, 19 nt, Homo sapiens
ggaagaggcuggaggugaa

SEQ ID NO: 221569 - RNA, 19 nt, Homo sapiens
gcagacuccucguuguuua

SEQ ID NO: 221570 - RNA, 19 nt, Homo sapiens
gaaagccuucuguuuaaua

SEQ ID NO: 221571 - RNA, 19 nt, Homo sapiens
ggacugggcuuggccuuga

SEQ ID NO: 221572 - RNA, 19 nt, Homo sapiens
gaacuucggcaguaaagaa

SEQ ID NO: 221573 - RNA, 19 nt, Homo sapiens
ggacacaggucagccuuga

SEQ ID NO: 221574 - RNA, 19 nt, Homo sapiens
cagcacacauuaucacaaa

SEQ ID NO: 221575 - RNA, 19 nt, Homo sapiens
ggagaaggcugccgucacu

SEQ ID NO: 221576 - RNA, 19 nt, Homo sapiens
ggccagaacuucggcagua

SEQ ID NO: 221577 - RNA, 19 nt, Homo sapiens
cgacacagcugcaaucacu

SEQ ID NO: 221578 - RNA, 19 nt, Homo sapiens
ccauugcccuggcccauaa

SEQ ID NO: 221579 - RNA, 19 nt, Homo sapiens
ugaguucucuuccaguuug

SEQ ID NO: 221580 - RNA, 19 nt, Homo sapiens
guaacgugauggugauuau

SEQ ID NO: 221581 - RNA, 19 nt, Homo sapiens
gcaagaugaauguggaaga

SEQ ID NO: 221582 - RNA, 19 nt, Homo sapiens
ucucaggccuggcaucaug

SEQ ID NO: 221583 - RNA, 19 nt, Homo sapiens
cuuuggagaugcuauuaaa

SEQ ID NO: 221584 - RNA, 19 nt, Homo sapiens
caagaugaauguggaagag

SEQ ID NO: 221585 - RNA, 19 nt, Homo sapiens
cuucggcaguaaagaauaa

SEQ ID NO: 221586 - RNA, 19 nt, Homo sapiens
caggauccagcacacauua

SEQ ID NO: 221587 - RNA, 19 nt, Homo sapiens
gcauguggauccugagaac

SEQ ID NO: 221588 - RNA, 19 nt, Homo sapiens
gccagaacuucggcaguaa

SEQ ID NO: 221589 - RNA, 19 nt, Homo sapiens
ggcuuggccuugagagaaa

SEQ ID NO: 221590 - RNA, 19 nt, Homo sapiens
uauucuggcuacucacuuu

SEQ ID NO: 221591 - RNA, 19 nt, Homo sapiens
cagcugcaaucacuagcaa

SEQ ID NO: 221592 - RNA, 19 nt, Homo sapiens
ggugucugcugucgccauu

SEQ ID NO: 221593 - RNA, 19 nt, Homo sapiens
ggugcugacuuccuuugga

SEQ ID NO: 221594 - RNA, 19 nt, Homo sapiens
ucacuagccuguggagcaa

SEQ ID NO: 221595 - RNA, 19 nt, Homo sapiens
ucacaaacuuaguguccau

SEQ ID NO: 221596 - RNA, 19 nt, Homo sapiens
gguaacgugauggugauua

SEQ ID NO: 221597 - RNA, 19 nt, Homo sapiens
gcuccuggguaacgugaug

SEQ ID NO: 221598 - RNA, 19 nt, Homo sapiens
gggcagacuccucguuguu

SEQ ID NO: 221599 - RNA, 19 nt, Homo sapiens
cauaucugcuuccgacaca

SEQ ID NO: 221600 - RNA, 19 nt, Homo sapiens
gggcuuggccuugagagaa

SEQ ID NO: 221601 - RNA, 19 nt, Homo sapiens
ugauuauucuggcuacuca

SEQ ID NO: 221602 - RNA, 19 nt, Homo sapiens
acuucaagcuccuggguaa

SEQ ID NO: 221603 - RNA, 19 nt, Homo sapiens
uaaguaccauggagaacag

SEQ ID NO: 221604 - RNA, 19 nt, Homo sapiens
gcacacauuaucacaaacu

SEQ ID NO: 221605 - RNA, 19 nt, Homo sapiens
aaacauggacaaccucaag

SEQ ID NO: 221606 - RNA, 19 nt, Homo sapiens
gagaggcagcagcacauau

SEQ ID NO: 221607 - RNA, 19 nt, Homo sapiens
ggcagacuccucguuguuu

SEQ ID NO: 221608 - RNA, 19 nt, Homo sapiens
ccauaaguaccacugaguu

SEQ ID NO: 221609 - RNA, 19 nt, Homo sapiens
caaggcccauggcaagaag

SEQ ID NO: 221610 - RNA, 19 nt, Homo sapiens
gauccagcacacauuauca

SEQ ID NO: 221611 - RNA, 19 nt, Homo sapiens
ccagaacuucggcaguaaa

SEQ ID NO: 221612 - RNA, 19 nt, Homo sapiens
cacauuaucacaaacuuag

SEQ ID NO: 221613 - RNA, 19 nt, Homo sapiens
ggauccagcacacauuauc

SEQ ID NO: 221614 - RNA, 19 nt, Homo sapiens
cauaaguaccacugaguuc

SEQ ID NO: 221615 - RNA, 19 nt, Homo sapiens
gagcaagaugaauguggaa

SEQ ID NO: 221616 - RNA, 19 nt, Homo sapiens
gaauaaaaggccagacaga

SEQ ID NO: 221617 - RNA, 19 nt, Homo sapiens
ggcaagaaggugcugacuu

SEQ ID NO: 221618 - RNA, 19 nt, Homo sapiens
caaacuuaguguccaucca

SEQ ID NO: 221619 - RNA, 19 nt, Homo sapiens
cuacucacuuuggcaagga

SEQ ID NO: 221620 - RNA, 19 nt, Homo sapiens
aaacuuaguguccauccau

SEQ ID NO: 221621 - RNA, 19 nt, Homo sapiens
guaccacugaguucucuuc

SEQ ID NO: 221622 - RNA, 19 nt, Homo sapiens
ucaaggcccauggcaagaa

SEQ ID NO: 221623 - RNA, 19 nt, Homo sapiens
cacacauuaucacaaacuu

SEQ ID NO: 221624 - RNA, 19 nt, Homo sapiens
uaacgugauggugauuauu

SEQ ID NO: 221625 - RNA, 19 nt, Homo sapiens
ggacaaggcuacuaucaca

SEQ ID NO: 221626 - RNA, 19 nt, Homo sapiens
ggaagaugcuggaggagaa

SEQ ID NO: 221627 - RNA, 19 nt, Homo sapiens
gcaccuggaugaucucaag

SEQ ID NO: 221628 - RNA, 19 nt, Homo sapiens
gagguucuuugacagcuuu

SEQ ID NO: 221629 - RNA, 19 nt, Homo sapiens
gaaggcuccugguugucua

SEQ ID NO: 221630 - RNA, 19 nt, Homo sapiens
ggcaauccauuucggcaaa

SEQ ID NO: 221631 - RNA, 19 nt, Homo sapiens
auucagagcuuucaaggau

SEQ ID NO: 221632 - RNA, 19 nt, Homo sapiens
gaacgucugagguuaucaa

SEQ ID NO: 221633 - RNA, 19 nt, Homo sapiens
ggacccagagguucuuuga

SEQ ID NO: 221634 - RNA, 19 nt, Homo sapiens
ucaaggauaggcuuuauuc

SEQ ID NO: 221635 - RNA, 19 nt, Homo sapiens
caaggcacauggcaagaag

SEQ ID NO: 221636 - RNA, 19 nt, Homo sapiens
gauaggcuuuauucugcaa

SEQ ID NO: 221637 - RNA, 19 nt, Homo sapiens
gcauguggauccugagaac

SEQ ID NO: 221638 - RNA, 19 nt, Homo sapiens
caaggugaauguggaagau

SEQ ID NO: 221639 - RNA, 19 nt, Homo sapiens
gcaaggugaauguggaaga

SEQ ID NO: 221640 - RNA, 19 nt, Homo sapiens
ucagagcuuucaaggauag

SEQ ID NO: 221641 - RNA, 19 nt, Homo sapiens
aaucuauucugcugagaga

SEQ ID NO: 221642 - RNA, 19 nt, Homo sapiens
gaggacaaggcuacuauca

SEQ ID NO: 221643 - RNA, 19 nt, Homo sapiens
ucugcaagcaauacaaaua

SEQ ID NO: 221644 - RNA, 19 nt, Homo sapiens
ucuggaacgucugagguua

SEQ ID NO: 221645 - RNA, 19 nt, Homo sapiens
cugcaagcaauacaaauaa

SEQ ID NO: 221646 - RNA, 19 nt, Homo sapiens
gaagaugcuggaggagaaa

SEQ ID NO: 221647 - RNA, 19 nt, Homo sapiens
gcccaugauucagagcuuu

SEQ ID NO: 221648 - RNA, 19 nt, Homo sapiens
ugggaaggcuccugguugu

SEQ ID NO: 221649 - RNA, 19 nt, Homo sapiens
cgccaugggucauuucaca

SEQ ID NO: 221650 - RNA, 19 nt, Homo sapiens
acccagagguucuuugaca

SEQ ID NO: 221651 - RNA, 19 nt, Homo sapiens
cagacgccaugggucauuu

SEQ ID NO: 221652 - RNA, 19 nt, Homo sapiens
ggaaggcuccugguugucu

SEQ ID NO: 221653 - RNA, 19 nt, Homo sapiens
gcaauccauuucggcaaag

SEQ ID NO: 221654 - RNA, 19 nt, Homo sapiens
acuucaagcuccugggaaa

SEQ ID NO: 221655 - RNA, 19 nt, Homo sapiens
ccauuucggcaaagaauuc

SEQ ID NO: 221656 - RNA, 19 nt, Homo sapiens
ucaagcuccugggaaaugu

SEQ ID NO: 221657 - RNA, 19 nt, Homo sapiens
gaggaggacaaggcuacua

SEQ ID NO: 221658 - RNA, 19 nt, Homo sapiens
aaggauaggcuuuauucug

SEQ ID NO: 221659 - RNA, 19 nt, Homo sapiens
ucaaggcacauggcaagaa

SEQ ID NO: 221660 - RNA, 19 nt, Homo sapiens
uuucaaggauaggcuuuau

SEQ ID NO: 221661 - RNA, 19 nt, Homo sapiens
ggcaagaaggugcugacuu

SEQ ID NO: 221662 - RNA, 19 nt, Homo sapiens
caauccauuucggcaaaga

SEQ ID NO: 221663 - RNA, 19 nt, Homo sapiens
ccaugggucauuucacaga

SEQ ID NO: 221664 - RNA, 19 nt, Homo sapiens
uaaaucuauucugcugaga

SEQ ID NO: 221665 - RNA, 19 nt, Homo sapiens
gggcaaggugaauguggaa

SEQ ID NO: 221666 - RNA, 19 nt, Homo sapiens
ggacaaggcuacuaucaca

SEQ ID NO: 221667 - RNA, 19 nt, Homo sapiens
ggaagaugcuggaggagaa

SEQ ID NO: 221668 - RNA, 19 nt, Homo sapiens
gcagagcuuucaaggauag

SEQ ID NO: 221669 - RNA, 19 nt, Homo sapiens
gcaccuggaugaucucaag

SEQ ID NO: 221670 - RNA, 19 nt, Homo sapiens
gagguucuuugacagcuuu

SEQ ID NO: 221671 - RNA, 19 nt, Homo sapiens
gaaggcuccugguugucua

SEQ ID NO: 221672 - RNA, 19 nt, Homo sapiens
ggcaauccauuucggcaaa

SEQ ID NO: 221673 - RNA, 19 nt, Homo sapiens
gaacgucugagguuaucaa

SEQ ID NO: 221674 - RNA, 19 nt, Homo sapiens
ggacccagagguucuuuga

SEQ ID NO: 221675 - RNA, 19 nt, Homo sapiens
augcagagcuuucaaggau

SEQ ID NO: 221676 - RNA, 19 nt, Homo sapiens
ucaaggauaggcuuuauuc

SEQ ID NO: 221677 - RNA, 19 nt, Homo sapiens
caaggcacauggcaagaag

SEQ ID NO: 221678 - RNA, 19 nt, Homo sapiens
aaucuauucugcuaagaga

SEQ ID NO: 221679 - RNA, 19 nt, Homo sapiens
gauaggcuuuauucugcaa

SEQ ID NO: 221680 - RNA, 19 nt, Homo sapiens
gcauguggauccugagaac

SEQ ID NO: 221681 - RNA, 19 nt, Homo sapiens
caaggugaauguggaagau

SEQ ID NO: 221682 - RNA, 19 nt, Homo sapiens
gcaaggugaauguggaaga

SEQ ID NO: 221683 - RNA, 19 nt, Homo sapiens
gaggacaaggcuacuauca

SEQ ID NO: 221684 - RNA, 19 nt, Homo sapiens
ucuggaacgucugagguua

SEQ ID NO: 221685 - RNA, 19 nt, Homo sapiens
gaagaugcuggaggagaaa

SEQ ID NO: 221686 - RNA, 19 nt, Homo sapiens
ugggaaggcuccugguugu

SEQ ID NO: 221687 - RNA, 19 nt, Homo sapiens
ucugcaagcaaucaaauaa

SEQ ID NO: 221688 - RNA, 19 nt, Homo sapiens
acccagagguucuuugaca

SEQ ID NO: 221689 - RNA, 19 nt, Homo sapiens
cgccaugggucauuucaca

SEQ ID NO: 221690 - RNA, 19 nt, Homo sapiens
cagacgccaugggucauuu

SEQ ID NO: 221691 - RNA, 19 nt, Homo sapiens
ggaaggcuccugguugucu

SEQ ID NO: 221692 - RNA, 19 nt, Homo sapiens
gcaauccauuucggcaaag

SEQ ID NO: 221693 - RNA, 19 nt, Homo sapiens
acuucaagcuccugggaaa

SEQ ID NO: 221694 - RNA, 19 nt, Homo sapiens
gaggaggacaaggcuacua

SEQ ID NO: 221695 - RNA, 19 nt, Homo sapiens
ccauuucggcaaagaauuc

SEQ ID NO: 221696 - RNA, 19 nt, Homo sapiens
ucaagcuccugggaaaugu

SEQ ID NO: 221697 - RNA, 19 nt, Homo sapiens
ugcagagcuuucaaggaua

SEQ ID NO: 221698 - RNA, 19 nt, Homo sapiens
aaggauaggcuuuauucug

SEQ ID NO: 221699 - RNA, 19 nt, Homo sapiens
gaugcagagcuuucaagga

SEQ ID NO: 221700 - RNA, 19 nt, Homo sapiens
ucaaggcacauggcaagaa

SEQ ID NO: 221701 - RNA, 19 nt, Homo sapiens
uuucaaggauaggcuuuau

SEQ ID NO: 221702 - RNA, 19 nt, Homo sapiens
ggcaagaaggugcugacuu

SEQ ID NO: 221703 - RNA, 19 nt, Homo sapiens
caauccauuucggcaaaga

SEQ ID NO: 221704 - RNA, 19 nt, Homo sapiens
ccaugggucauuucacaga

SEQ ID NO: 221705 - RNA, 19 nt, Homo sapiens
gggcaaggugaauguggaa

SEQ ID NO: 221706 - RNA, 19 nt, Homo sapiens
aggcgucgcuggacaaguu

SEQ ID NO: 221707 - RNA, 19 nt, Homo sapiens
cgacagaggcccuggaaag

SEQ ID NO: 221708 - RNA, 19 nt, Homo sapiens
gcagcaacgucggcgucua

SEQ ID NO: 221709 - RNA, 19 nt, Homo sapiens
ggccacugccugcugguaa

SEQ ID NO: 221710 - RNA, 19 nt, Homo sapiens
cggcgcugguuuccgagua

SEQ ID NO: 221711 - RNA, 19 nt, Homo sapiens
gcacuaccccggagacuuc

SEQ ID NO: 221712 - RNA, 19 nt, Homo sapiens
gagaggaccaucauugugu

SEQ ID NO: 221713 - RNA, 19 nt, Homo sapiens
ccaauaaaccaaugaacga

SEQ ID NO: 221714 - RNA, 19 nt, Homo sapiens
gaagagcaucgacgacauc

SEQ ID NO: 221715 - RNA, 19 nt, Homo sapiens
guaaugcgccaauaaacca

SEQ ID NO: 221716 - RNA, 19 nt, Homo sapiens
caauaaaccaaugaacgaa

SEQ ID NO: 221717 - RNA, 19 nt, Homo sapiens
ccucuguccugaccgagaa

SEQ ID NO: 221718 - RNA, 19 nt, Homo sapiens
ugaagagcaucgacgacau

SEQ ID NO: 221719 - RNA, 19 nt, Homo sapiens
ccgcguaaugcgccaauaa

SEQ ID NO: 221720 - RNA, 19 nt, Homo sapiens
gcgacgcggugaagagcau

SEQ ID NO: 221721 - RNA, 19 nt, Homo sapiens
agaccuacuucccgcacuu

SEQ ID NO: 221722 - RNA, 19 nt, Homo sapiens
ugagaggaccaucauugug

SEQ ID NO: 221723 - RNA, 19 nt, Homo sapiens
acugagaggaccaucauug

SEQ ID NO: 221724 - RNA, 19 nt, Homo sapiens
gcagaccaagaccuacuuc

SEQ ID NO: 221725 - RNA, 19 nt, Homo sapiens
gaaccuagauccuucaaau

SEQ ID NO: 221726 - RNA, 19 nt, Homo sapiens
ggaaugcaauguuaaagaa

SEQ ID NO: 221727 - RNA, 19 nt, Homo sapiens
ggacagaaguuagauaugu

SEQ ID NO: 221728 - RNA, 19 nt, Homo sapiens
gaaguuagauaugugauug

SEQ ID NO: 221729 - RNA, 19 nt, Homo sapiens
gagagcagauucagagaaa

SEQ ID NO: 221730 - RNA, 19 nt, Homo sapiens
guaaagcacuguuucagau

SEQ ID NO: 221731 - RNA, 19 nt, Homo sapiens
gaaaggcuguccagugaau

SEQ ID NO: 221732 - RNA, 19 nt, Homo sapiens
guucuggaaugcaauguua

SEQ ID NO: 221733 - RNA, 19 nt, Homo sapiens
uggagcagguggaaauuua

SEQ ID NO: 221734 - RNA, 19 nt, Homo sapiens
ggaaggagauuuugaagug

SEQ ID NO: 221735 - RNA, 19 nt, Homo sapiens
caacaaggacuaccaguuc

SEQ ID NO: 221736 - RNA, 19 nt, Homo sapiens
gaucagccauuugcauugu

SEQ ID NO: 221737 - RNA, 19 nt, Homo sapiens
guucaggccucaaaugcuu

SEQ ID NO: 221738 - RNA, 19 nt, Homo sapiens
gucagaaggauauguauaa

SEQ ID NO: 221739 - RNA, 19 nt, Homo sapiens
gacagaaguuagauaugug

SEQ ID NO: 221740 - RNA, 19 nt, Homo sapiens
augaaaggcuguccaguga

SEQ ID NO: 221741 - RNA, 19 nt, Homo sapiens
agagaagagucauccauuc

SEQ ID NO: 221742 - RNA, 19 nt, Homo sapiens
ggaacgcgccuaugaguac

SEQ ID NO: 221743 - RNA, 19 nt, Homo sapiens
guggugaagucaacaagga

SEQ ID NO: 221744 - RNA, 19 nt, Homo sapiens
uacguggagugucccauua

SEQ ID NO: 221745 - RNA, 19 nt, Homo sapiens
gagcgauacauuaaacuau

SEQ ID NO: 221746 - RNA, 19 nt, Homo sapiens
gagcagguggaaauuuaaa

SEQ ID NO: 221747 - RNA, 19 nt, Homo sapiens
gguaugaguugccuuuuga

SEQ ID NO: 221748 - RNA, 19 nt, Homo sapiens
gaauaaggagaaccuagau

SEQ ID NO: 221749 - RNA, 19 nt, Homo sapiens
ggagcagguggaaauuuaa

SEQ ID NO: 221750 - RNA, 19 nt, Homo sapiens
cagagaagagucauccauu

SEQ ID NO: 221751 - RNA, 19 nt, Homo sapiens
gauccgguuuggagggaaa

SEQ ID NO: 221752 - RNA, 19 nt, Homo sapiens
ggauaucagucagaaggau

SEQ ID NO: 221753 - RNA, 19 nt, Homo sapiens
cagaucagccauuugcauu

SEQ ID NO: 221754 - RNA, 19 nt, Homo sapiens
gcaguucaggccucaaaug

SEQ ID NO: 221755 - RNA, 19 nt, Homo sapiens
gcaaaagaguauucaccaa

SEQ ID NO: 221756 - RNA, 19 nt, Homo sapiens
guacguggagugucccauu

SEQ ID NO: 221757 - RNA, 19 nt, Homo sapiens
ucagucagaaggauaugua

SEQ ID NO: 221758 - RNA, 19 nt, Homo sapiens
gcaguaugggacagaauga

SEQ ID NO: 221759 - RNA, 19 nt, Homo sapiens
uaggcacgauuggaucaua

SEQ ID NO: 221760 - RNA, 19 nt, Homo sapiens
uuucugagcgauacauuaa

SEQ ID NO: 221761 - RNA, 19 nt, Homo sapiens
ggcccaaccugugagaaga

SEQ ID NO: 221762 - RNA, 19 nt, Homo sapiens
gauaggcacgauuggauca

SEQ ID NO: 221763 - RNA, 19 nt, Homo sapiens
ucaccaagggcacgaauuc

SEQ ID NO: 221764 - RNA, 19 nt, Homo sapiens
gaaggaugaggauaucagu

SEQ ID NO: 221765 - RNA, 19 nt, Homo sapiens
gaaguggaaggaugaggau

SEQ ID NO: 221766 - RNA, 19 nt, Homo sapiens
ccauuugcauugucuacug

SEQ ID NO: 221767 - RNA, 19 nt, Homo sapiens
agaauaaggagaaccuaga

SEQ ID NO: 221768 - RNA, 19 nt, Homo sapiens
ucaacaaggacuaccaguu

SEQ ID NO: 221769 - RNA, 19 nt, Homo sapiens
gguggaaguggaaggauga

SEQ ID NO: 221770 - RNA, 19 nt, Homo sapiens
ugagcgauacauuaaacua

SEQ ID NO: 221771 - RNA, 19 nt, Homo sapiens
cguaaagcacuguuucaga

SEQ ID NO: 221772 - RNA, 19 nt, Homo sapiens
aggcacgauuggaucauaa

SEQ ID NO: 221773 - RNA, 19 nt, Homo sapiens
cguuggaccucguaaagca

SEQ ID NO: 221774 - RNA, 19 nt, Homo sapiens
ucaaacaccagcuccagau

SEQ ID NO: 221775 - RNA, 19 nt, Homo sapiens
caucuggcccaaccuguga

SEQ ID NO: 221776 - RNA, 19 nt, Homo sapiens
ggaaggaugaggauaucag

SEQ ID NO: 221777 - RNA, 19 nt, Homo sapiens
guggaaggaugaggauauc

SEQ ID NO: 221778 - RNA, 19 nt, Homo sapiens
uaaagaaaggguggaagug

SEQ ID NO: 221779 - RNA, 19 nt, Homo sapiens
cgagagcagauucagagaa

SEQ ID NO: 221780 - RNA, 19 nt, Homo sapiens
aaacaccagcuccagauca

SEQ ID NO: 221781 - RNA, 19 nt, Homo sapiens
uaaacuauuuuccccagaa

SEQ ID NO: 221782 - RNA, 19 nt, Homo sapiens
gaugaggauaucagucaga

SEQ ID NO: 221783 - RNA, 19 nt, Homo sapiens
uaaagcacuguuucagaug

SEQ ID NO: 221784 - RNA, 19 nt, Homo sapiens
aacaaggacuaccaguuca

SEQ ID NO: 221785 - RNA, 19 nt, Homo sapiens
uggaaugcaauguuaaaga

SEQ ID NO: 221786 - RNA, 19 nt, Homo sapiens
cccgaugcaugaagggaaa

SEQ ID NO: 221787 - RNA, 19 nt, Homo sapiens
ugcauugucuacugucaga

SEQ ID NO: 221788 - RNA, 19 nt, Homo sapiens
ggagaaccuagauccuuca

SEQ ID NO: 221789 - RNA, 19 nt, Homo sapiens
ucugagcgauacauuaaac

SEQ ID NO: 221790 - RNA, 19 nt, Homo sapiens
cgggacagaaguuagauau

SEQ ID NO: 221791 - RNA, 19 nt, Homo sapiens
auaacgagcaggcuuggaa

SEQ ID NO: 221792 - RNA, 19 nt, Homo sapiens
agucagaaggauauguaua

SEQ ID NO: 221793 - RNA, 19 nt, Homo sapiens
agaaaggguggaaguggaa

SEQ ID NO: 221794 - RNA, 19 nt, Homo sapiens
uuaaagaaaggguggaagu

SEQ ID NO: 221795 - RNA, 19 nt, Homo sapiens
ugccuuagauucacuuucg

SEQ ID NO: 221796 - RNA, 19 nt, Homo sapiens
gcgggacagaaguuagaua

SEQ ID NO: 221797 - RNA, 19 nt, Homo sapiens
gagaagagucauccauucc

SEQ ID NO: 221798 - RNA, 19 nt, Homo sapiens
gguucggguuggcgacuga

SEQ ID NO: 221799 - RNA, 19 nt, Homo sapiens
ggcaguaugggacagaaug

SEQ ID NO: 221800 - RNA, 19 nt, Homo sapiens
acagaaguuagauauguga

SEQ ID NO: 221801 - RNA, 19 nt, Homo sapiens
ggaaagcaaaagaguauuc

SEQ ID NO: 221802 - RNA, 19 nt, Homo sapiens
caggaacgcgccuaugagu

SEQ ID NO: 221803 - RNA, 19 nt, Homo sapiens
gcugcagaguguccuugug

SEQ ID NO: 221804 - RNA, 19 nt, Homo sapiens
cauuagaauucacaaucag

SEQ ID NO: 221805 - RNA, 19 nt, Homo sapiens
cauuugcauugucuacugu

SEQ ID NO: 221806 - RNA, 19 nt, Homo sapiens
ggagggcuuaggugcagaa

SEQ ID NO: 221807 - RNA, 19 nt, Homo sapiens
ugucuacugucagagaaga

SEQ ID NO: 221808 - RNA, 19 nt, Homo sapiens
uuauuaugaugguggugaa

SEQ ID NO: 221809 - RNA, 19 nt, Homo sapiens
ccagaucagccauuugcau

SEQ ID NO: 221810 - RNA, 19 nt, Homo sapiens
gaagccaccucaagacaua

SEQ ID NO: 221811 - RNA, 19 nt, Homo sapiens
ccagauagcugacuucuca

SEQ ID NO: 221812 - RNA, 19 nt, Homo sapiens
gagaagaacuacaaucuag

SEQ ID NO: 221813 - RNA, 19 nt, Homo sapiens
aaacagaacucgagaagug

SEQ ID NO: 221814 - RNA, 19 nt, Homo sapiens
gauccugggugaauaaauu

SEQ ID NO: 221815 - RNA, 19 nt, Homo sapiens
gaaaucacgaccauucaua

SEQ ID NO: 221816 - RNA, 19 nt, Homo sapiens
gaacaagugcacucgauuu

SEQ ID NO: 221817 - RNA, 19 nt, Homo sapiens
guacacaacuagcaccauu

SEQ ID NO: 221818 - RNA, 19 nt, Homo sapiens
gagaggagcuuagaaacga

SEQ ID NO: 221819 - RNA, 19 nt, Homo sapiens
ggaagaagccaccucaaga

SEQ ID NO: 221820 - RNA, 19 nt, Homo sapiens
gcuguaagcucauagaagu

SEQ ID NO: 221821 - RNA, 19 nt, Homo sapiens
gaagagaggcuuguuggaa

SEQ ID NO: 221822 - RNA, 19 nt, Homo sapiens
caaggaggguacacaacua

SEQ ID NO: 221823 - RNA, 19 nt, Homo sapiens
agaagucacuguaacugua

SEQ ID NO: 221824 - RNA, 19 nt, Homo sapiens
ggagaagaacuacaaucua

SEQ ID NO: 221825 - RNA, 19 nt, Homo sapiens
caacauggcaggcaucuca

SEQ ID NO: 221826 - RNA, 19 nt, Homo sapiens
gcucauagaagucacugua

SEQ ID NO: 221827 - RNA, 19 nt, Homo sapiens
cacaauagcccaugcugua

SEQ ID NO: 221828 - RNA, 19 nt, Homo sapiens
ggaucaggaugcuguuuga

SEQ ID NO: 221829 - RNA, 19 nt, Homo sapiens
aagaugcucuggagaauau

SEQ ID NO: 221830 - RNA, 19 nt, Homo sapiens
gcaggcaucucagaccaaa

SEQ ID NO: 221831 - RNA, 19 nt, Homo sapiens
ucaaugaccuuuauaucca

SEQ ID NO: 221832 - RNA, 19 nt, Homo sapiens
ggucaacacuuucgauaac

SEQ ID NO: 221833 - RNA, 19 nt, Homo sapiens
gggaacauccuccagcuuu

SEQ ID NO: 221834 - RNA, 19 nt, Homo sapiens
gaaaugaguggugugacua

SEQ ID NO: 221835 - RNA, 19 nt, Homo sapiens
uggagaagauauucaguga

SEQ ID NO: 221836 - RNA, 19 nt, Homo sapiens
aaucaauucugcacaauag

SEQ ID NO: 221837 - RNA, 19 nt, Homo sapiens
caagaugucugggaugaag

SEQ ID NO: 221838 - RNA, 19 nt, Homo sapiens
cauaaucucuuccguaagc

SEQ ID NO: 221839 - RNA, 19 nt, Homo sapiens
ugccaugucucccauacua

SEQ ID NO: 221840 - RNA, 19 nt, Homo sapiens
ugaguggugugacuaauuc

SEQ ID NO: 221841 - RNA, 19 nt, Homo sapiens
gaagggagagacccaugaa

SEQ ID NO: 221842 - RNA, 19 nt, Homo sapiens
caacuagcaccauucuuga

SEQ ID NO: 221843 - RNA, 19 nt, Homo sapiens
guaguuaagguuuccauga

SEQ ID NO: 221844 - RNA, 19 nt, Homo sapiens
caacugcaucuacuucaaa

SEQ ID NO: 221845 - RNA, 19 nt, Homo sapiens
gagaauauagacccugcua

SEQ ID NO: 221846 - RNA, 19 nt, Homo sapiens
ucacgaccauucauaaucu

SEQ ID NO: 221847 - RNA, 19 nt, Homo sapiens
uaaacgcacuucucauuuu

SEQ ID NO: 221848 - RNA, 19 nt, Homo sapiens
aauucaagcuggagaagaa

SEQ ID NO: 221849 - RNA, 19 nt, Homo sapiens
cacaagaugucugggauga

SEQ ID NO: 221850 - RNA, 19 nt, Homo sapiens
aaaggauccugggugaaua

SEQ ID NO: 221851 - RNA, 19 nt, Homo sapiens
caaaggauccugggugaau

SEQ ID NO: 221852 - RNA, 19 nt, Homo sapiens
uucauaaucucuuccguaa

SEQ ID NO: 221853 - RNA, 19 nt, Homo sapiens
gaacuuccucgcagcaaau

SEQ ID NO: 221854 - RNA, 19 nt, Homo sapiens
aagagaggcuuguuggaau

SEQ ID NO: 221855 - RNA, 19 nt, Homo sapiens
ucaggaugcuguuugacaa

SEQ ID NO: 221856 - RNA, 19 nt, Homo sapiens
acaacuagcaccauucuug

SEQ ID NO: 221857 - RNA, 19 nt, Homo sapiens
gagcagcgcguccuaagca

SEQ ID NO: 221858 - RNA, 19 nt, Homo sapiens
agaaacacacagagcuuua

SEQ ID NO: 221859 - RNA, 19 nt, Homo sapiens
agugggagcaguuaaauaa

SEQ ID NO: 221860 - RNA, 19 nt, Homo sapiens
gagagguaguuaagguuuc

SEQ ID NO: 221861 - RNA, 19 nt, Homo sapiens
agagagagguaguuaaggu

SEQ ID NO: 221862 - RNA, 19 nt, Homo sapiens
gacccugccuucauaucaa

SEQ ID NO: 221863 - RNA, 19 nt, Homo sapiens
uguagugugucugcuguua

SEQ ID NO: 221864 - RNA, 19 nt, Homo sapiens
gcuuagaaacgaccaagaa

SEQ ID NO: 221865 - RNA, 19 nt, Homo sapiens
ccaagggccucauaaaaga

SEQ ID NO: 221866 - RNA, 19 nt, Homo sapiens
gauccagcgucuuaacauc

SEQ ID NO: 221867 - RNA, 19 nt, Homo sapiens
uaugagaggagcuuagaaa

SEQ ID NO: 221868 - RNA, 19 nt, Homo sapiens
gaccauucauaaucucuuc

SEQ ID NO: 221869 - RNA, 19 nt, Homo sapiens
gaagaagccaccucaagac

SEQ ID NO: 221870 - RNA, 19 nt, Homo sapiens
uggcaucauuuacguaguu

SEQ ID NO: 221871 - RNA, 19 nt, Homo sapiens
ccaacaaccacaucaugaa

SEQ ID NO: 221872 - RNA, 19 nt, Homo sapiens
cucagacccugccuucaua

SEQ ID NO: 221873 - RNA, 19 nt, Homo sapiens
gggagagacccaugaacaa

SEQ ID NO: 221874 - RNA, 19 nt, Homo sapiens
uuaaacgcacuucucauuu

SEQ ID NO: 221875 - RNA, 19 nt, Homo sapiens
uggugugacuaauuccuua

SEQ ID NO: 221876 - RNA, 19 nt, Homo sapiens
gaauucgaggcccauauga

SEQ ID NO: 221877 - RNA, 19 nt, Homo sapiens
ccaucgaccuguucaagca

SEQ ID NO: 221878 - RNA, 19 nt, Homo sapiens
uaguuaagguuuccaugau

SEQ ID NO: 221879 - RNA, 19 nt, Homo sapiens
ucaacugcaucuacuucaa

SEQ ID NO: 221880 - RNA, 19 nt, Homo sapiens
uaugaaaucacgaccauuc

SEQ ID NO: 221881 - RNA, 19 nt, Homo sapiens
caacaacgagaacagagau

SEQ ID NO: 221882 - RNA, 19 nt, Homo sapiens
gaaacacacagagcuuuag

SEQ ID NO: 221883 - RNA, 19 nt, Homo sapiens
ucaccaagggccucauaaa

SEQ ID NO: 221884 - RNA, 19 nt, Homo sapiens
gggaagaagccaccucaag

SEQ ID NO: 221885 - RNA, 19 nt, Homo sapiens
gagagagguaguuaagguu

SEQ ID NO: 221886 - RNA, 19 nt, Homo sapiens
caacaaccacaucaugaag

SEQ ID NO: 221887 - RNA, 19 nt, Homo sapiens
aaaucacgaccauucauaa

SEQ ID NO: 221888 - RNA, 19 nt, Homo sapiens
ggagagacccaugaacaag

SEQ ID NO: 221889 - RNA, 19 nt, Homo sapiens
ggaacauccuccagcuuuu

SEQ ID NO: 221890 - RNA, 19 nt, Homo sapiens
agaaaugaguggugugacu

SEQ ID NO: 221891 - RNA, 19 nt, Homo sapiens
gaagucacuguaacuguag

SEQ ID NO: 221892 - RNA, 19 nt, Homo sapiens
caguggaaaugacacacaa

SEQ ID NO: 221893 - RNA, 19 nt, Homo sapiens
gcucaccaagggccucaua

SEQ ID NO: 221894 - RNA, 19 nt, Homo sapiens
cagaagcaguuuccaaucc

SEQ ID NO: 221895 - RNA, 19 nt, Homo sapiens
cauagcacccguuggcauu

SEQ ID NO: 221896 - RNA, 19 nt, Homo sapiens
caggucaacacuuucgaua

SEQ ID NO: 221897 - RNA, 19 nt, Homo sapiens
cuacccagaugaugauucu

SEQ ID NO: 221898 - RNA, 19 nt, Homo sapiens
gagagacccaugaacaagu

SEQ ID NO: 221899 - RNA, 19 nt, Homo sapiens
cgauggguaugauuuccuu

SEQ ID NO: 221900 - RNA, 19 nt, Homo sapiens
ugagagagagguaguuaag

SEQ ID NO: 221901 - RNA, 19 nt, Homo sapiens
uaaaagaugcucuggagaa

SEQ ID NO: 221902 - RNA, 19 nt, Homo sapiens
cagaaacacacagagcuuu

SEQ ID NO: 221903 - RNA, 19 nt, Homo sapiens
agagacccaugaacaagug

SEQ ID NO: 221904 - RNA, 19 nt, Homo sapiens
aaagaugcucuggagaaua

SEQ ID NO: 221905 - RNA, 19 nt, Homo sapiens
ugaagacgacgacuacauc

SEQ ID NO: 221906 - RNA, 19 nt, Homo sapiens
gccagcagcaaguaugaaa

SEQ ID NO: 221907 - RNA, 19 nt, Homo sapiens
ucauagaagucacuguaac

SEQ ID NO: 221908 - RNA, 19 nt, Homo sapiens
gggaucaggaugcuguuug

SEQ ID NO: 221909 - RNA, 19 nt, Homo sapiens
gaaauucaagcuggagaag

SEQ ID NO: 221910 - RNA, 19 nt, Homo sapiens
gaaaucugcuccaaagaaa

SEQ ID NO: 221911 - RNA, 19 nt, Homo sapiens
ggaagagacucaaagcaaa

SEQ ID NO: 221912 - RNA, 19 nt, Homo sapiens
acaggaagcuuacacauuu

SEQ ID NO: 221913 - RNA, 19 nt, Homo sapiens
gaaaugaaaucugcuccaa

SEQ ID NO: 221914 - RNA, 19 nt, Homo sapiens
gagaaggaguggaagugua

SEQ ID NO: 221915 - RNA, 19 nt, Homo sapiens
caagguaccugaaugacuu

SEQ ID NO: 221916 - RNA, 19 nt, Homo sapiens
gcaaugaccucuacgaacu

SEQ ID NO: 221917 - RNA, 19 nt, Homo sapiens
caacaugaguucaaaccaa

SEQ ID NO: 221918 - RNA, 19 nt, Homo sapiens
gcagugcucugauuuccaa

SEQ ID NO: 221919 - RNA, 19 nt, Homo sapiens
guaccugaaugacuuauau

SEQ ID NO: 221920 - RNA, 19 nt, Homo sapiens
ccucugguuuguuguauua

SEQ ID NO: 221921 - RNA, 19 nt, Homo sapiens
guucacacuuucauuguaa

SEQ ID NO: 221922 - RNA, 19 nt, Homo sapiens
ggaggcagcugcuucucuu

SEQ ID NO: 221923 - RNA, 19 nt, Homo sapiens
caaccaccaucggaaauaa

SEQ ID NO: 221924 - RNA, 19 nt, Homo sapiens
gaaccgagcagccaaucuu

SEQ ID NO: 221925 - RNA, 19 nt, Homo sapiens
agaacaacauuccaaggua

SEQ ID NO: 221926 - RNA, 19 nt, Homo sapiens
ggacagcucauuccucaug

SEQ ID NO: 221927 - RNA, 19 nt, Homo sapiens
ugacuuauauauccuggaa

SEQ ID NO: 221928 - RNA, 19 nt, Homo sapiens
gaaagcacauuuuaccauu

SEQ ID NO: 221929 - RNA, 19 nt, Homo sapiens
gcaccgucccugacuauaa

SEQ ID NO: 221930 - RNA, 19 nt, Homo sapiens
guacaccguucacuauugu

SEQ ID NO: 221931 - RNA, 19 nt, Homo sapiens
gagaguacaccguucacua

SEQ ID NO: 221932 - RNA, 19 nt, Homo sapiens
gcaccaagccagccaacaa

SEQ ID NO: 221933 - RNA, 19 nt, Homo sapiens
ggcaguagcccacagauga

SEQ ID NO: 221934 - RNA, 19 nt, Homo sapiens
gaacggugauuggcaguag

SEQ ID NO: 221935 - RNA, 19 nt, Homo sapiens
ggacucgccuccugguguu

SEQ ID NO: 221936 - RNA, 19 nt, Homo sapiens
agacgugccugccugguuu

SEQ ID NO: 221937 - RNA, 19 nt, Homo sapiens
ccacucaccugguccuguu

SEQ ID NO: 221938 - RNA, 19 nt, Homo sapiens
ccaaaccaguucagacuuc

SEQ ID NO: 221939 - RNA, 19 nt, Homo sapiens
cagcaagucagaaggauuu

SEQ ID NO: 221940 - RNA, 19 nt, Homo sapiens
uaaggccgauggucaguga

SEQ ID NO: 221941 - RNA, 19 nt, Homo sapiens
gccuauaaguuucguguug

SEQ ID NO: 221942 - RNA, 19 nt, Homo sapiens
guagaccaguuaucacuuc

SEQ ID NO: 221943 - RNA, 19 nt, Homo sapiens
gcaaccaccaucggaaaua

SEQ ID NO: 221944 - RNA, 19 nt, Homo sapiens
ugacccagguggugcuuaa

SEQ ID NO: 221945 - RNA, 19 nt, Homo sapiens
ugaaaucugcuccaaagaa

SEQ ID NO: 221946 - RNA, 19 nt, Homo sapiens
aaugaaaucugcuccaaag

SEQ ID NO: 221947 - RNA, 19 nt, Homo sapiens
gugcaguccuccagccuuu

SEQ ID NO: 221948 - RNA, 19 nt, Homo sapiens
ccggcaagauuaucgagua

SEQ ID NO: 221949 - RNA, 19 nt, Homo sapiens
cgaaguagaccaguuauca

SEQ ID NO: 221950 - RNA, 19 nt, Homo sapiens
cugagcagcccaagcauua

SEQ ID NO: 221951 - RNA, 19 nt, Homo sapiens
gcagcugcuucucuuguga

SEQ ID NO: 221952 - RNA, 19 nt, Homo sapiens
gccaacugcugcauuuguu

SEQ ID NO: 221953 - RNA, 19 nt, Homo sapiens
gcaagauuaucgaguacuc

SEQ ID NO: 221954 - RNA, 19 nt, Homo sapiens
ccaacacgcuggcuugucu

SEQ ID NO: 221955 - RNA, 19 nt, Homo sapiens
aguccaagcuggugaucua

SEQ ID NO: 221956 - RNA, 19 nt, Homo sapiens
ccaaagaacaacauuccaa

SEQ ID NO: 221957 - RNA, 19 nt, Homo sapiens
ccuauugauuuguuucuga

SEQ ID NO: 221958 - RNA, 19 nt, Homo sapiens
ggaggcagugcucugauuu

SEQ ID NO: 221959 - RNA, 19 nt, Homo sapiens
ccaauccggucccaucugu

SEQ ID NO: 221960 - RNA, 19 nt, Homo sapiens
gcaaggaccucugguaccu

SEQ ID NO: 221961 - RNA, 19 nt, Homo sapiens
caggagaggugugaaaucu

SEQ ID NO: 221962 - RNA, 19 nt, Homo sapiens
cauguccucuccagaaaug

SEQ ID NO: 221963 - RNA, 19 nt, Homo sapiens
ggugaugacuucaggaacu

SEQ ID NO: 221964 - RNA, 19 nt, Homo sapiens
gaguggaaguguaccaaca

SEQ ID NO: 221965 - RNA, 19 nt, Homo sapiens
gagggugacuguguagugu

SEQ ID NO: 221966 - RNA, 19 nt, Homo sapiens
gaagagacucaaagcaaag

SEQ ID NO: 221967 - RNA, 19 nt, Homo sapiens
caagucagaaggauuugaa

SEQ ID NO: 221968 - RNA, 19 nt, Homo sapiens
gaaaucucagccuuuaaga

SEQ ID NO: 221969 - RNA, 19 nt, Homo sapiens
gugacucaauauuaccaua

SEQ ID NO: 221970 - RNA, 19 nt, Homo sapiens
guucacuauuguagaguaa

SEQ ID NO: 221971 - RNA, 19 nt, Homo sapiens
uggaaaggguggagaaugg

SEQ ID NO: 221972 - RNA, 19 nt, Homo sapiens
gcgaggacccaaagaacaa

SEQ ID NO: 221973 - RNA, 19 nt, Homo sapiens
gcaaugagaagggcuaugg

SEQ ID NO: 221974 - RNA, 19 nt, Homo sapiens
agcgaaaucucagccuuua

SEQ ID NO: 221975 - RNA, 19 nt, Homo sapiens
gcacgaccaccaucaucaa

SEQ ID NO: 221976 - RNA, 19 nt, Homo sapiens
cagcuacccugaccgaagu

SEQ ID NO: 221977 - RNA, 19 nt, Homo sapiens
gcaccaccaugacugugau

SEQ ID NO: 221978 - RNA, 19 nt, Homo sapiens
cagggccucugguuuguug

SEQ ID NO: 221979 - RNA, 19 nt, Homo sapiens
uaagggcaccaauguaaug

SEQ ID NO: 221980 - RNA, 19 nt, Homo sapiens
ugaccgaaguggccaaugg

SEQ ID NO: 221981 - RNA, 19 nt, Homo sapiens
ccacguugguugugaaagg

SEQ ID NO: 221982 - RNA, 19 nt, Homo sapiens
gaaaaugucacguuuaguc

SEQ ID NO: 221983 - RNA, 19 nt, Homo sapiens
cgaaaucucagccuuuaag

SEQ ID NO: 221984 - RNA, 19 nt, Homo sapiens
ccaauguaauggugacaca

SEQ ID NO: 221985 - RNA, 19 nt, Homo sapiens
ggcaucaagucacccauca

SEQ ID NO: 221986 - RNA, 19 nt, Homo sapiens
ccagaaauaugacauuccu

SEQ ID NO: 221987 - RNA, 19 nt, Homo sapiens
gcccauguccucuccagaa

SEQ ID NO: 221988 - RNA, 19 nt, Homo sapiens
gcaggaaaccaguaaagac

SEQ ID NO: 221989 - RNA, 19 nt, Homo sapiens
ugagguggcugcaggaaac

SEQ ID NO: 221990 - RNA, 19 nt, Homo sapiens
guccgaaguagaccaguua

SEQ ID NO: 221991 - RNA, 19 nt, Homo sapiens
ccacggguccugugacuca

SEQ ID NO: 221992 - RNA, 19 nt, Homo sapiens
gacccacggugcugagugu

SEQ ID NO: 221993 - RNA, 19 nt, Homo sapiens
gaguacaccguucacuauu

SEQ ID NO: 221994 - RNA, 19 nt, Homo sapiens
ggcgaucacuccgcaucua

SEQ ID NO: 221995 - RNA, 19 nt, Homo sapiens
auaaccagcugaagaagca

SEQ ID NO: 221996 - RNA, 19 nt, Homo sapiens
gacuauaaccagcugaaga

SEQ ID NO: 221997 - RNA, 19 nt, Homo sapiens
guaauggugacacacuauu

SEQ ID NO: 221998 - RNA, 19 nt, Homo sapiens
ccaccacugucacuuccaa

SEQ ID NO: 221999 - RNA, 19 nt, Homo sapiens
gcuccaacccaccauguga

SEQ ID NO: 222000 - RNA, 19 nt, Homo sapiens
caccaacacugccacuaca

SEQ ID NO: 222001 - RNA, 19 nt, Homo sapiens
uaugggaaauacagcaaug

SEQ ID NO: 222002 - RNA, 19 nt, Homo sapiens
cagcaguccuggcaucaag

SEQ ID NO: 222003 - RNA, 19 nt, Homo sapiens
acacccgccuguacauuug

SEQ ID NO: 222004 - RNA, 19 nt, Homo sapiens
gaugguggaguaugggaaa

SEQ ID NO: 222005 - RNA, 19 nt, Homo sapiens
ggaaccaggcguccuugga

SEQ ID NO: 222006 - RNA, 19 nt, Homo sapiens
cacaggaagcuuacacauu

SEQ ID NO: 222007 - RNA, 19 nt, Homo sapiens
uggaagagacucaaagcaa

SEQ ID NO: 222008 - RNA, 19 nt, Homo sapiens
cugaaugacuuauauaucc

SEQ ID NO: 222009 - RNA, 19 nt, Homo sapiens
ccacacaguccgaaguaga

SEQ ID NO: 222010 - RNA, 19 nt, Homo sapiens
gagauaccgugaaacauua

SEQ ID NO: 222011 - RNA, 19 nt, Homo sapiens
gcagggagauaccgugaaa

SEQ ID NO: 222012 - RNA, 19 nt, Homo sapiens
ggagauaccgugaaacauu

SEQ ID NO: 222013 - RNA, 19 nt, Homo sapiens
gaggagcucuacaacauca

SEQ ID NO: 222014 - RNA, 19 nt, Homo sapiens
cugcaucccugguguguaa

SEQ ID NO: 222015 - RNA, 19 nt, Homo sapiens
ccagaagccuugggagaaa

SEQ ID NO: 222016 - RNA, 19 nt, Homo sapiens
gaagcuugcuggacuuucu

SEQ ID NO: 222017 - RNA, 19 nt, Homo sapiens
ugauggagaucgucaccua

SEQ ID NO: 222018 - RNA, 19 nt, Homo sapiens
uuacagcugugauuuggaa

SEQ ID NO: 222019 - RNA, 19 nt, Homo sapiens
ccaaggagcccaucuacau

SEQ ID NO: 222020 - RNA, 19 nt, Homo sapiens
gagcccaucuacaucauca

SEQ ID NO: 222021 - RNA, 19 nt, Homo sapiens
ugguugcccuguaugauua

SEQ ID NO: 222022 - RNA, 19 nt, Homo sapiens
ucgaauacauccagagugu

SEQ ID NO: 222023 - RNA, 19 nt, Homo sapiens
ugaaaacucugcagcauga

SEQ ID NO: 222024 - RNA, 19 nt, Homo sapiens
cgugaaacauuacaagauc

SEQ ID NO: 222025 - RNA, 19 nt, Homo sapiens
gaucccacauccaccauca

SEQ ID NO: 222026 - RNA, 19 nt, Homo sapiens
caucgugguugcccuguau

SEQ ID NO: 222027 - RNA, 19 nt, Homo sapiens
agauauaaaugccaaaguc

SEQ ID NO: 222028 - RNA, 19 nt, Homo sapiens
gucaaacccugaagugauc

SEQ ID NO: 222029 - RNA, 19 nt, Homo sapiens
gaaagaugccugggagauc

SEQ ID NO: 222030 - RNA, 19 nt, Homo sapiens
ggagacagaggagugguuu

SEQ ID NO: 222031 - RNA, 19 nt, Homo sapiens
guguaagauugcugacuuu

SEQ ID NO: 222032 - RNA, 19 nt, Homo sapiens
ccuccgagcugccaacauc

SEQ ID NO: 222033 - RNA, 19 nt, Homo sapiens
gcaacaugcugggcuccuu

SEQ ID NO: 222034 - RNA, 19 nt, Homo sapiens
uguguaagauugcugacuu

SEQ ID NO: 222035 - RNA, 19 nt, Homo sapiens
ggucggaggcaauacauuc

SEQ ID NO: 222036 - RNA, 19 nt, Homo sapiens
augcugggcuccuucauga

SEQ ID NO: 222037 - RNA, 19 nt, Homo sapiens
gcacaucagaggcuuagag

SEQ ID NO: 222038 - RNA, 19 nt, Homo sapiens
gacgucugguccuuuggua

SEQ ID NO: 222039 - RNA, 19 nt, Homo sapiens
ugacuucucagcccagauu

SEQ ID NO: 222040 - RNA, 19 nt, Homo sapiens
gaggcaauacauucucaaa

SEQ ID NO: 222041 - RNA, 19 nt, Homo sapiens
agagugugcuggaugacuu

SEQ ID NO: 222042 - RNA, 19 nt, Homo sapiens
ucauugaggacaacgagua

SEQ ID NO: 222043 - RNA, 19 nt, Homo sapiens
gggauagcgagaccacuaa

SEQ ID NO: 222044 - RNA, 19 nt, Homo sapiens
gauuuggaagggaaacuuu

SEQ ID NO: 222045 - RNA, 19 nt, Homo sapiens
ccacagagagccaguacca

SEQ ID NO: 222046 - RNA, 19 nt, Homo sapiens
gggaagggacucagacagu

SEQ ID NO: 222047 - RNA, 19 nt, Homo sapiens
gaugucaaacccugaagug

SEQ ID NO: 222048 - RNA, 19 nt, Homo sapiens
cccucaagcuggagaagaa

SEQ ID NO: 222049 - RNA, 19 nt, Homo sapiens
caacagcagccaugauagg

SEQ ID NO: 222050 - RNA, 19 nt, Homo sapiens
acuuggagcugggcaguuu

SEQ ID NO: 222051 - RNA, 19 nt, Homo sapiens
ggauagcgagaccacuaaa

SEQ ID NO: 222052 - RNA, 19 nt, Homo sapiens
gauauaaaugccaaagucu

SEQ ID NO: 222053 - RNA, 19 nt, Homo sapiens
accaacagcagccaugaua

SEQ ID NO: 222054 - RNA, 19 nt, Homo sapiens
gacaagcuggucaaacuuc

SEQ ID NO: 222055 - RNA, 19 nt, Homo sapiens
gcagaggccaacgugauga

SEQ ID NO: 222056 - RNA, 19 nt, Homo sapiens
cuacaucccaagcaacuau

SEQ ID NO: 222057 - RNA, 19 nt, Homo sapiens
gugguugcccuguaugauu

SEQ ID NO: 222058 - RNA, 19 nt, Homo sapiens
ggauggccaccuacaacaa

SEQ ID NO: 222059 - RNA, 19 nt, Homo sapiens
caaguggacagcuccugaa

SEQ ID NO: 222060 - RNA, 19 nt, Homo sapiens
ucaccaaggagcccaucua

SEQ ID NO: 222061 - RNA, 19 nt, Homo sapiens
ggagcacaucagaggcuua

SEQ ID NO: 222062 - RNA, 19 nt, Homo sapiens
agacagugcaggacgagaa

SEQ ID NO: 222063 - RNA, 19 nt, Homo sapiens
cgggauagcgagaccacua

SEQ ID NO: 222064 - RNA, 19 nt, Homo sapiens
gacagugcaggacgagaaa

SEQ ID NO: 222065 - RNA, 19 nt, Homo sapiens
ucccugguguguaagauug

SEQ ID NO: 222066 - RNA, 19 nt, Homo sapiens
caaggagcccaucuacauc

SEQ ID NO: 222067 - RNA, 19 nt, Homo sapiens
ugucaaacccugaagugau

SEQ ID NO: 222068 - RNA, 19 nt, Homo sapiens
cggaggcaauacauucuca

SEQ ID NO: 222069 - RNA, 19 nt, Homo sapiens
cagcaacacaccaggaauc

SEQ ID NO: 222070 - RNA, 19 nt, Homo sapiens
cagccacaguuuccucauc

SEQ ID NO: 222071 - RNA, 19 nt, Homo sapiens
cuaauagccacaacagcaa

SEQ ID NO: 222072 - RNA, 19 nt, Homo sapiens
caugaugcgcugcuggaaa

SEQ ID NO: 222073 - RNA, 19 nt, Homo sapiens
cugaagccaucaacuuugg

SEQ ID NO: 222074 - RNA, 19 nt, Homo sapiens
ggaguucauggccaaagga

SEQ ID NO: 222075 - RNA, 19 nt, Homo sapiens
acaagcuggucaaacuuca

SEQ ID NO: 222076 - RNA, 19 nt, Homo sapiens
ggcagaggccaacgugaug

SEQ ID NO: 222077 - RNA, 19 nt, Homo sapiens
acaacaagcacaccaaggu

SEQ ID NO: 222078 - RNA, 19 nt, Homo sapiens
gagcacaucagaggcuuag

SEQ ID NO: 222079 - RNA, 19 nt, Homo sapiens
guaccaacagcagccauga

SEQ ID NO: 222080 - RNA, 19 nt, Homo sapiens
ggagcucuacaacaucaug

SEQ ID NO: 222081 - RNA, 19 nt, Homo sapiens
ggcaggcucugaggacauc

SEQ ID NO: 222082 - RNA, 19 nt, Homo sapiens
caucaucacggaguucaug

SEQ ID NO: 222083 - RNA, 19 nt, Homo sapiens
cgaggccauucaccacgaa

SEQ ID NO: 222084 - RNA, 19 nt, Homo sapiens
gaugaaaacucugcagcau

SEQ ID NO: 222085 - RNA, 19 nt, Homo sapiens
gcugggcuccuucaugauc

SEQ ID NO: 222086 - RNA, 19 nt, Homo sapiens
gagcucuacaacaucauga

SEQ ID NO: 222087 - RNA, 19 nt, Homo sapiens
gugcaugaaguccaaguuc

SEQ ID NO: 222088 - RNA, 19 nt, Homo sapiens
guaagauugcugacuuugg

SEQ ID NO: 222089 - RNA, 19 nt, Homo sapiens
gauggccaccuacaacaag

SEQ ID NO: 222090 - RNA, 19 nt, Homo sapiens
uagcgagaccacuaaagga

SEQ ID NO: 222091 - RNA, 19 nt, Homo sapiens
uuaguuacagcugugauuu

SEQ ID NO: 222092 - RNA, 19 nt, Homo sapiens
uggguagguuggacuggaa

SEQ ID NO: 222093 - RNA, 19 nt, Homo sapiens
ccugaagccaucaacuuug

SEQ ID NO: 222094 - RNA, 19 nt, Homo sapiens
caauccacaaucugacauu

SEQ ID NO: 222095 - RNA, 19 nt, Homo sapiens
gcaauccacaaucugacau

SEQ ID NO: 222096 - RNA, 19 nt, Homo sapiens
ggccgaccuucgaauacau

SEQ ID NO: 222097 - RNA, 19 nt, Homo sapiens
cggccgaccuucgaauaca

SEQ ID NO: 222098 - RNA, 19 nt, Homo sapiens
guauccugcugauggagau

SEQ ID NO: 222099 - RNA, 19 nt, Homo sapiens
uccugaagccaucaacuuu

SEQ ID NO: 222100 - RNA, 19 nt, Homo sapiens
ggacacagauccugacuuu

SEQ ID NO: 222101 - RNA, 19 nt, Homo sapiens
gaaaguacgucuagauugu

SEQ ID NO: 222102 - RNA, 19 nt, Homo sapiens
gcaaaugucuaaccagaug

SEQ ID NO: 222103 - RNA, 19 nt, Homo sapiens
gugaugagcuuuccuuuga

SEQ ID NO: 222104 - RNA, 19 nt, Homo sapiens
gcagucggcuuugauuaua

SEQ ID NO: 222105 - RNA, 19 nt, Homo sapiens
gaaauaaagugagacuaug

SEQ ID NO: 222106 - RNA, 19 nt, Homo sapiens
caaagcagcucugggauau

SEQ ID NO: 222107 - RNA, 19 nt, Homo sapiens
gaccacagcuuauaagaag

SEQ ID NO: 222108 - RNA, 19 nt, Homo sapiens
gaaaggcugugacaaagag

SEQ ID NO: 222109 - RNA, 19 nt, Homo sapiens
caaauuaugucaagcuucu

SEQ ID NO: 222110 - RNA, 19 nt, Homo sapiens
ggacagggcagacaaguca

SEQ ID NO: 222111 - RNA, 19 nt, Homo sapiens
gcacagaacacaucaacau

SEQ ID NO: 222112 - RNA, 19 nt, Homo sapiens
ggaaaguacgucuagauug

SEQ ID NO: 222113 - RNA, 19 nt, Homo sapiens
caacugugauuucccaugu

SEQ ID NO: 222114 - RNA, 19 nt, Homo sapiens
gaucucagcuguggcucua

SEQ ID NO: 222115 - RNA, 19 nt, Homo sapiens
agaaauaucugugaaccuu

SEQ ID NO: 222116 - RNA, 19 nt, Homo sapiens
cgaaauaaagugagacuau

SEQ ID NO: 222117 - RNA, 19 nt, Homo sapiens
gacuaugguucaccuguaa

SEQ ID NO: 222118 - RNA, 19 nt, Homo sapiens
gaagacgacgcccauagaa

SEQ ID NO: 222119 - RNA, 19 nt, Homo sapiens
gcgaaaggcugugacaaag

SEQ ID NO: 222120 - RNA, 19 nt, Homo sapiens
gggcuucccaguuuguuua

SEQ ID NO: 222121 - RNA, 19 nt, Homo sapiens
caaagcaucccauggcuau

SEQ ID NO: 222122 - RNA, 19 nt, Homo sapiens
aagcagcucugggauauga

SEQ ID NO: 222123 - RNA, 19 nt, Homo sapiens
caagucagcagucggcuuu

SEQ ID NO: 222124 - RNA, 19 nt, Homo sapiens
acacagauccugacuuugu

SEQ ID NO: 222125 - RNA, 19 nt, Homo sapiens
gggaaaguacgucuagauu

SEQ ID NO: 222126 - RNA, 19 nt, Homo sapiens
gauccugacuuugugaaug

SEQ ID NO: 222127 - RNA, 19 nt, Homo sapiens
gaaugacuaugaggacguu

SEQ ID NO: 222128 - RNA, 19 nt, Homo sapiens
gaagaggaagcgagaggaa

SEQ ID NO: 222129 - RNA, 19 nt, Homo sapiens
gaagugaugagcuuuccuu

SEQ ID NO: 222130 - RNA, 19 nt, Homo sapiens
ucucagcuguggcucuaua

SEQ ID NO: 222131 - RNA, 19 nt, Homo sapiens
gaaacacgagucccagaga

SEQ ID NO: 222132 - RNA, 19 nt, Homo sapiens
ggaggucgguuuggaguag

SEQ ID NO: 222133 - RNA, 19 nt, Homo sapiens
gaagaaagagauggaguca

SEQ ID NO: 222134 - RNA, 19 nt, Homo sapiens
gaugagcuuuccuuugauc

SEQ ID NO: 222135 - RNA, 19 nt, Homo sapiens
gcucgagccugaagauucu

SEQ ID NO: 222136 - RNA, 19 nt, Homo sapiens
agacuaugguucaccugua

SEQ ID NO: 222137 - RNA, 19 nt, Homo sapiens
ggcaugagcaggaggauga

SEQ ID NO: 222138 - RNA, 19 nt, Homo sapiens
gggcuuugguggccaguau

SEQ ID NO: 222139 - RNA, 19 nt, Homo sapiens
gccaugaugugucuguuuc

SEQ ID NO: 222140 - RNA, 19 nt, Homo sapiens
agauuacucucguggcuuu

SEQ ID NO: 222141 - RNA, 19 nt, Homo sapiens
ucagacggaugcugccaaa

SEQ ID NO: 222142 - RNA, 19 nt, Homo sapiens
gugaaugacaucucugaaa

SEQ ID NO: 222143 - RNA, 19 nt, Homo sapiens
ucacugacauugagauggu

SEQ ID NO: 222144 - RNA, 19 nt, Homo sapiens
ugaaugacaucucugaaaa

SEQ ID NO: 222145 - RNA, 19 nt, Homo sapiens
acucuucccugcaaauuau

SEQ ID NO: 222146 - RNA, 19 nt, Homo sapiens
cguaaucacugacauugag

SEQ ID NO: 222147 - RNA, 19 nt, Homo sapiens
acaaagcagcucugggaua

SEQ ID NO: 222148 - RNA, 19 nt, Homo sapiens
aaagugagacuaugguuca

SEQ ID NO: 222149 - RNA, 19 nt, Homo sapiens
ggacuccuccaucaucaga

SEQ ID NO: 222150 - RNA, 19 nt, Homo sapiens
ggaggcaacaggagcgaaa

SEQ ID NO: 222151 - RNA, 19 nt, Homo sapiens
agaaggaccgaguggauaa

SEQ ID NO: 222152 - RNA, 19 nt, Homo sapiens
ucaugaacauuucucuugu

SEQ ID NO: 222153 - RNA, 19 nt, Homo sapiens
cuguggcucuauaugauua

SEQ ID NO: 222154 - RNA, 19 nt, Homo sapiens
ccaagaaaaucuccucaga

SEQ ID NO: 222155 - RNA, 19 nt, Homo sapiens
cagaaggaccgaguggaua

SEQ ID NO: 222156 - RNA, 19 nt, Homo sapiens
ggacucuucccugcaaauu

SEQ ID NO: 222157 - RNA, 19 nt, Homo sapiens
ggaggaagagccaguguac

SEQ ID NO: 222158 - RNA, 19 nt, Homo sapiens
gggcugaaggcgaaauuug

SEQ ID NO: 222159 - RNA, 19 nt, Homo sapiens
ggauaaaugggacaaagca

SEQ ID NO: 222160 - RNA, 19 nt, Homo sapiens
cagcagucggcuuugauua

SEQ ID NO: 222161 - RNA, 19 nt, Homo sapiens
guagaaagagaccgaaugg

SEQ ID NO: 222162 - RNA, 19 nt, Homo sapiens
cugaagaaauaucugugaa

SEQ ID NO: 222163 - RNA, 19 nt, Homo sapiens
ccugacuccuucccaauga

SEQ ID NO: 222164 - RNA, 19 nt, Homo sapiens
agagggaagugaugagcuu

SEQ ID NO: 222165 - RNA, 19 nt, Homo sapiens
ucuauaugauuaccaagga

SEQ ID NO: 222166 - RNA, 19 nt, Homo sapiens
cagcuguggcucuauauga

SEQ ID NO: 222167 - RNA, 19 nt, Homo sapiens
ccacagccagugauagcua

SEQ ID NO: 222168 - RNA, 19 nt, Homo sapiens
cgacguaaucacugacauu

SEQ ID NO: 222169 - RNA, 19 nt, Homo sapiens
cgaccacagcuuauaagaa

SEQ ID NO: 222170 - RNA, 19 nt, Homo sapiens
caugaacauuucucuugug

SEQ ID NO: 222171 - RNA, 19 nt, Homo sapiens
gacucuucccugcaaauua

SEQ ID NO: 222172 - RNA, 19 nt, Homo sapiens
cagaacacaucaacaucca

SEQ ID NO: 222173 - RNA, 19 nt, Homo sapiens
cgaaaggcugugacaaaga

SEQ ID NO: 222174 - RNA, 19 nt, Homo sapiens
aaggagaaguggagaagca

SEQ ID NO: 222175 - RNA, 19 nt, Homo sapiens
cagucggcuuugauuauaa

SEQ ID NO: 222176 - RNA, 19 nt, Homo sapiens
ucccucuccugcuucauua

SEQ ID NO: 222177 - RNA, 19 nt, Homo sapiens
uauggaagagccagcagua

SEQ ID NO: 222178 - RNA, 19 nt, Homo sapiens
cggacgacguaaucacuga

SEQ ID NO: 222179 - RNA, 19 nt, Homo sapiens
cagcugaggaacaaaguau

SEQ ID NO: 222180 - RNA, 19 nt, Homo sapiens
gauuucccauguccaaagu

SEQ ID NO: 222181 - RNA, 19 nt, Homo sapiens
gacguaaucacugacauug

SEQ ID NO: 222182 - RNA, 19 nt, Homo sapiens
gcugaggaacaaaguauca

SEQ ID NO: 222183 - RNA, 19 nt, Homo sapiens
ggcugaaggcgaaauuuga

SEQ ID NO: 222184 - RNA, 19 nt, Homo sapiens
ggguggagaaggauaaaug

SEQ ID NO: 222185 - RNA, 19 nt, Homo sapiens
aaagagaccgaauggacaa

SEQ ID NO: 222186 - RNA, 19 nt, Homo sapiens
aaauaucugugaaccuucu

SEQ ID NO: 222187 - RNA, 19 nt, Homo sapiens
agucggcuuugauuauaaa

SEQ ID NO: 222188 - RNA, 19 nt, Homo sapiens
cugugaaccuucuuucugu

SEQ ID NO: 222189 - RNA, 19 nt, Homo sapiens
ugugcuauuugcccacuuu

SEQ ID NO: 222190 - RNA, 19 nt, Homo sapiens
guccauggcugaggagaag

SEQ ID NO: 222191 - RNA, 19 nt, Homo sapiens
agaagacgacgcccauaga

SEQ ID NO: 222192 - RNA, 19 nt, Homo sapiens
ccagaaggaccgaguggau

SEQ ID NO: 222193 - RNA, 19 nt, Homo sapiens
gaaggauaaaugggacaaa

SEQ ID NO: 222194 - RNA, 19 nt, Homo sapiens
ggacgcacagaacacauca

SEQ ID NO: 222195 - RNA, 19 nt, Homo sapiens
cagaggagcaugauguucu

SEQ ID NO: 222196 - RNA, 19 nt, Homo sapiens
caaaguaucagaggagcau

SEQ ID NO: 222197 - RNA, 19 nt, Homo sapiens
agcaugauguucucaggaa

SEQ ID NO: 222198 - RNA, 19 nt, Homo sapiens
gguuuggaguagaaagaga

SEQ ID NO: 222199 - RNA, 19 nt, Homo sapiens
cuacugcaacugugauuuc

SEQ ID NO: 222200 - RNA, 19 nt, Homo sapiens
gaaccuuccuuccacaaag

SEQ ID NO: 222201 - RNA, 19 nt, Homo sapiens
ccucaagguuccuggcuuu

SEQ ID NO: 222202 - RNA, 19 nt, Homo sapiens
ccacagacaucuccuuucc

SEQ ID NO: 222203 - RNA, 19 nt, Homo sapiens
caccacagacaucuccuuu

SEQ ID NO: 222204 - RNA, 19 nt, Homo sapiens
gcucuugccgccucuacga

SEQ ID NO: 222205 - RNA, 19 nt, Homo sapiens
gcacacggcucuucucagu

SEQ ID NO: 222206 - RNA, 19 nt, Homo sapiens
gaaaggcuguggcuucagu

SEQ ID NO: 222207 - RNA, 19 nt, Homo sapiens
cacaguugcuucuuuauug

SEQ ID NO: 222208 - RNA, 19 nt, Homo sapiens
gaugaacgcugggcagaug

SEQ ID NO: 222209 - RNA, 19 nt, Homo sapiens
uaccacaguugcuucuuua

SEQ ID NO: 222210 - RNA, 19 nt, Homo sapiens
gaugaccucuaucccaaga

SEQ ID NO: 222211 - RNA, 19 nt, Homo sapiens
cuaccacaguugcuucuuu

SEQ ID NO: 222212 - RNA, 19 nt, Homo sapiens
ugaggacagucaccaacua

SEQ ID NO: 222213 - RNA, 19 nt, Homo sapiens
gcaaauuccgggagcaguu

SEQ ID NO: 222214 - RNA, 19 nt, Homo sapiens
cauggccuauuuccagaua

SEQ ID NO: 222215 - RNA, 19 nt, Homo sapiens
cccaagaucuaccacaguu

SEQ ID NO: 222216 - RNA, 19 nt, Homo sapiens
ggacagucaccaacuacuu

SEQ ID NO: 222217 - RNA, 19 nt, Homo sapiens
ggaggaagacagccaagau

SEQ ID NO: 222218 - RNA, 19 nt, Homo sapiens
ccacaguugcuucuuuauu

SEQ ID NO: 222219 - RNA, 19 nt, Homo sapiens
gaggaagacagccaagaug

SEQ ID NO: 222220 - RNA, 19 nt, Homo sapiens
ccaacuacuucauugucaa

SEQ ID NO: 222221 - RNA, 19 nt, Homo sapiens
acacggcucuucucagucu

SEQ ID NO: 222222 - RNA, 19 nt, Homo sapiens
ggaaagacagcuggaugug

SEQ ID NO: 222223 - RNA, 19 nt, Homo sapiens
caucugccacccacuauug

SEQ ID NO: 222224 - RNA, 19 nt, Homo sapiens
caaauuccgggagcaguuu

SEQ ID NO: 222225 - RNA, 19 nt, Homo sapiens
uggcuucaguccuggguuu

SEQ ID NO: 222226 - RNA, 19 nt, Homo sapiens
caaaaucucugagcaugug

SEQ ID NO: 222227 - RNA, 19 nt, Homo sapiens
agacuaugaagaugaguuu

SEQ ID NO: 222228 - RNA, 19 nt, Homo sapiens
uggccuauuuccagauauu

SEQ ID NO: 222229 - RNA, 19 nt, Homo sapiens
gucaccaacuacuucauug

SEQ ID NO: 222230 - RNA, 19 nt, Homo sapiens
gacagucaccaacuacuuc

SEQ ID NO: 222231 - RNA, 19 nt, Homo sapiens
ugaccucuaucccaagauc

SEQ ID NO: 222232 - RNA, 19 nt, Homo sapiens
gaguuucuccgcuaucugu

SEQ ID NO: 222233 - RNA, 19 nt, Homo sapiens
uggcugaagugaagcagau

SEQ ID NO: 222234 - RNA, 19 nt, Homo sapiens
acaguugcuucuuuauugu

SEQ ID NO: 222235 - RNA, 19 nt, Homo sapiens
cacccacuauuguucaaga

SEQ ID NO: 222236 - RNA, 19 nt, Homo sapiens
ccaucagcguccucaaugu

SEQ ID NO: 222237 - RNA, 19 nt, Homo sapiens
cugggcagaugaccucuau

SEQ ID NO: 222238 - RNA, 19 nt, Homo sapiens
acagcuggauguggugaaa

SEQ ID NO: 222239 - RNA, 19 nt, Homo sapiens
caacuuccucaguggcaaa

SEQ ID NO: 222240 - RNA, 19 nt, Homo sapiens
uggcggaaccaccacauga

SEQ ID NO: 222241 - RNA, 19 nt, Homo sapiens
ccucaucgcagccuaugug

SEQ ID NO: 222242 - RNA, 19 nt, Homo sapiens
ucaccagcgucaccacagu

SEQ ID NO: 222243 - RNA, 19 nt, Homo sapiens
cuuccucaguggcaaauuc

SEQ ID NO: 222244 - RNA, 19 nt, Homo sapiens
ggaagacagccaagaugcu

SEQ ID NO: 222245 - RNA, 19 nt, Homo sapiens
gcuucuuuauugucaccua

SEQ ID NO: 222246 - RNA, 19 nt, Homo sapiens
ccugugugacucuggauaa

SEQ ID NO: 222247 - RNA, 19 nt, Homo sapiens
gcccaucagcguccucaau

SEQ ID NO: 222248 - RNA, 19 nt, Homo sapiens
aggcugcagucauggaaug

SEQ ID NO: 222249 - RNA, 19 nt, Homo sapiens
gccaugcccucugcaaggu

SEQ ID NO: 222250 - RNA, 19 nt, Homo sapiens
ucccuccucucccucugua

SEQ ID NO: 222251 - RNA, 19 nt, Homo sapiens
caucuacaacuuccucagu

SEQ ID NO: 222252 - RNA, 19 nt, Homo sapiens
gcaaggucauccccuaucu

SEQ ID NO: 222253 - RNA, 19 nt, Homo sapiens
gagaggagcuugcagcauu

SEQ ID NO: 222254 - RNA, 19 nt, Homo sapiens
gcaaagugauuccuuaucu

SEQ ID NO: 222255 - RNA, 19 nt, Homo sapiens
gcaaauauuucgcaaacuc

SEQ ID NO: 222256 - RNA, 19 nt, Homo sapiens
cagcaacuuugauaacaua

SEQ ID NO: 222257 - RNA, 19 nt, Homo sapiens
ugacaaggauaccugagua

SEQ ID NO: 222258 - RNA, 19 nt, Homo sapiens
uggauugucuccugcauua

SEQ ID NO: 222259 - RNA, 19 nt, Homo sapiens
gagaguauuugggauguuu

SEQ ID NO: 222260 - RNA, 19 nt, Homo sapiens
caaagugauuccuuaucua

SEQ ID NO: 222261 - RNA, 19 nt, Homo sapiens
uggcuuaucugcaaauauu

SEQ ID NO: 222262 - RNA, 19 nt, Homo sapiens
ccaauuagcauccucaaug

SEQ ID NO: 222263 - RNA, 19 nt, Homo sapiens
gguguuggcuuaucugcaa

SEQ ID NO: 222264 - RNA, 19 nt, Homo sapiens
ggaaguccuugaccacuca

SEQ ID NO: 222265 - RNA, 19 nt, Homo sapiens
ccaacgaagucccggauga

SEQ ID NO: 222266 - RNA, 19 nt, Homo sapiens
gauugucuccugcauuaua

SEQ ID NO: 222267 - RNA, 19 nt, Homo sapiens
caacaucgccuguaaagac

SEQ ID NO: 222268 - RNA, 19 nt, Homo sapiens
ggugcaacaucgccuguaa

SEQ ID NO: 222269 - RNA, 19 nt, Homo sapiens
caauuagcauccucaaugu

SEQ ID NO: 222270 - RNA, 19 nt, Homo sapiens
uaacagcauugucaucauc

SEQ ID NO: 222271 - RNA, 19 nt, Homo sapiens
gguaaccaacuacuucaua

SEQ ID NO: 222272 - RNA, 19 nt, Homo sapiens
ccuaugaugugaagcuaaa

SEQ ID NO: 222273 - RNA, 19 nt, Homo sapiens
ugaaauuuaucccaagaug

SEQ ID NO: 222274 - RNA, 19 nt, Homo sapiens
guaaccaacuacuucauag

SEQ ID NO: 222275 - RNA, 19 nt, Homo sapiens
ggaacguccugguuugugu

SEQ ID NO: 222276 - RNA, 19 nt, Homo sapiens
acagaucccuggaacauca

SEQ ID NO: 222277 - RNA, 19 nt, Homo sapiens
ccacaucuguuucuuucug

SEQ ID NO: 222278 - RNA, 19 nt, Homo sapiens
cuucaaaacugguagaaua

SEQ ID NO: 222279 - RNA, 19 nt, Homo sapiens
cugcgaauccaauuauuua

SEQ ID NO: 222280 - RNA, 19 nt, Homo sapiens
ggugaaauuuaucccaaga

SEQ ID NO: 222281 - RNA, 19 nt, Homo sapiens
gauccgagccagaaggaaa

SEQ ID NO: 222282 - RNA, 19 nt, Homo sapiens
ugaggacgguaaccaacua

SEQ ID NO: 222283 - RNA, 19 nt, Homo sapiens
cagcaaagccaccgcagaa

SEQ ID NO: 222284 - RNA, 19 nt, Homo sapiens
caaagccaccgcagaaguu

SEQ ID NO: 222285 - RNA, 19 nt, Homo sapiens
ggcauuggcucaguaacuu

SEQ ID NO: 222286 - RNA, 19 nt, Homo sapiens
ggagcaggaccacuucaaa

SEQ ID NO: 222287 - RNA, 19 nt, Homo sapiens
uaccacaucuguuucuuuc

SEQ ID NO: 222288 - RNA, 19 nt, Homo sapiens
gaaauuuaucccaagaugu

SEQ ID NO: 222289 - RNA, 19 nt, Homo sapiens
gcaaagccaccgcagaagu

SEQ ID NO: 222290 - RNA, 19 nt, Homo sapiens
ccacucaaaucagcaacuu

SEQ ID NO: 222291 - RNA, 19 nt, Homo sapiens
ggaauuuaaagcugcguuu

SEQ ID NO: 222292 - RNA, 19 nt, Homo sapiens
ggaagaaccaccacaugag

SEQ ID NO: 222293 - RNA, 19 nt, Homo sapiens
ucaaugugcuaaagagagu

SEQ ID NO: 222294 - RNA, 19 nt, Homo sapiens
ugucacccuuugauguuua

SEQ ID NO: 222295 - RNA, 19 nt, Homo sapiens
ggagcugaaugaaacucaa

SEQ ID NO: 222296 - RNA, 19 nt, Homo sapiens
ggacgaacuagcacagaga

SEQ ID NO: 222297 - RNA, 19 nt, Homo sapiens
gcugcgaauccaauuauuu

SEQ ID NO: 222298 - RNA, 19 nt, Homo sapiens
ucacugggaacagaaauuu

SEQ ID NO: 222299 - RNA, 19 nt, Homo sapiens
gcacagagagccggaaguc

SEQ ID NO: 222300 - RNA, 19 nt, Homo sapiens
guaccacaucuguuucuuu

SEQ ID NO: 222301 - RNA, 19 nt, Homo sapiens
gcuuguauaugccaauagu

SEQ ID NO: 222302 - RNA, 19 nt, Homo sapiens
gacuguguaugccugguuu

SEQ ID NO: 222303 - RNA, 19 nt, Homo sapiens
cuucggagcugaaugaaac

SEQ ID NO: 222304 - RNA, 19 nt, Homo sapiens
uaaaaucacugggaacaga

SEQ ID NO: 222305 - RNA, 19 nt, Homo sapiens
gacaaggauaccugaguaa

SEQ ID NO: 222306 - RNA, 19 nt, Homo sapiens
gauguuugcccauacugaa

SEQ ID NO: 222307 - RNA, 19 nt, Homo sapiens
uuugcaaagugauuccuua

SEQ ID NO: 222308 - RNA, 19 nt, Homo sapiens
ggacgguaaccaacuacuu

SEQ ID NO: 222309 - RNA, 19 nt, Homo sapiens
uggaagaaccaccacauga

SEQ ID NO: 222310 - RNA, 19 nt, Homo sapiens
caauggagcaggaccacuu

SEQ ID NO: 222311 - RNA, 19 nt, Homo sapiens
cgacagaucccuggaacau

SEQ ID NO: 222312 - RNA, 19 nt, Homo sapiens
gcgcugggguggugaaauu

SEQ ID NO: 222313 - RNA, 19 nt, Homo sapiens
guaacagcauugucaucau

SEQ ID NO: 222314 - RNA, 19 nt, Homo sapiens
ggaggcauuggcucaguaa

SEQ ID NO: 222315 - RNA, 19 nt, Homo sapiens
ccuggaacaucaucuguag

SEQ ID NO: 222316 - RNA, 19 nt, Homo sapiens
gcaaaucaccagugcucau

SEQ ID NO: 222317 - RNA, 19 nt, Homo sapiens
gagcggaaccggacuugag

SEQ ID NO: 222318 - RNA, 19 nt, Homo sapiens
cacacuggcuuguauaugc

SEQ ID NO: 222319 - RNA, 19 nt, Homo sapiens
guuucuuucuggugacaua

SEQ ID NO: 222320 - RNA, 19 nt, Homo sapiens
caauaaaaccacccucuuu

SEQ ID NO: 222321 - RNA, 19 nt, Homo sapiens
gacgguaaccaacuacuuc

SEQ ID NO: 222322 - RNA, 19 nt, Homo sapiens
cggaggcauuggcucagua

SEQ ID NO: 222323 - RNA, 19 nt, Homo sapiens
uggaacaucaucuguaguu

SEQ ID NO: 222324 - RNA, 19 nt, Homo sapiens
cugcaaauauuucgcaaac

SEQ ID NO: 222325 - RNA, 19 nt, Homo sapiens
gucaucaucuggauugucu

SEQ ID NO: 222326 - RNA, 19 nt, Homo sapiens
gcauugucaucaucuggau

SEQ ID NO: 222327 - RNA, 19 nt, Homo sapiens
caaaucaccagugcucaug

SEQ ID NO: 222328 - RNA, 19 nt, Homo sapiens
ggaauaccugcacccgaaa

SEQ ID NO: 222329 - RNA, 19 nt, Homo sapiens
gauguccggcaccaaauug

SEQ ID NO: 222330 - RNA, 19 nt, Homo sapiens
agaagacuccggaggcauu

SEQ ID NO: 222331 - RNA, 19 nt, Homo sapiens
gcccguaacagcauuguca

SEQ ID NO: 222332 - RNA, 19 nt, Homo sapiens
cgacuaugacgacgaggaa

SEQ ID NO: 222333 - RNA, 19 nt, Homo sapiens
gcauuggcucaguaacuuu

SEQ ID NO: 222334 - RNA, 19 nt, Homo sapiens
gcuguugccuuggaguuca

SEQ ID NO: 222335 - RNA, 19 nt, Homo sapiens
cggcugaaauaaagcagau

SEQ ID NO: 222336 - RNA, 19 nt, Homo sapiens
ucagcaacuuugauaacau

SEQ ID NO: 222337 - RNA, 19 nt, Homo sapiens
ggauguuugcccauacuga

SEQ ID NO: 222338 - RNA, 19 nt, Homo sapiens
agaggagcuugcagcauug

SEQ ID NO: 222339 - RNA, 19 nt, Homo sapiens
gugauuccuuaucuacaga

SEQ ID NO: 222340 - RNA, 19 nt, Homo sapiens
ccggguacaucaucguguu

SEQ ID NO: 222341 - RNA, 19 nt, Homo sapiens
uguggcggcugaaauaaag

SEQ ID NO: 222342 - RNA, 19 nt, Homo sapiens
auacauggcaccacugugu

SEQ ID NO: 222343 - RNA, 19 nt, Homo sapiens
ugcaaucugucacccuuug

SEQ ID NO: 222344 - RNA, 19 nt, Homo sapiens
ggacuugagcccgugaugu

SEQ ID NO: 222345 - RNA, 19 nt, Homo sapiens
gagcaggaccacuucaaaa

SEQ ID NO: 222346 - RNA, 19 nt, Homo sapiens
gaagacuccggaggcauug

SEQ ID NO: 222347 - RNA, 19 nt, Homo sapiens
gugcugcgaauccaauuau

SEQ ID NO: 222348 - RNA, 19 nt, Homo sapiens
gaucggugguaugcaaucu

SEQ ID NO: 222349 - RNA, 19 nt, Homo sapiens
aagcagauccgagccagaa

SEQ ID NO: 222350 - RNA, 19 nt, Homo sapiens
guuggcuuaucugcaaaua

SEQ ID NO: 222351 - RNA, 19 nt, Homo sapiens
gcaaucugucacccuuuga

SEQ ID NO: 222352 - RNA, 19 nt, Homo sapiens
acaaggauaccugaguaaa

SEQ ID NO: 222353 - RNA, 19 nt, Homo sapiens
gaacugacguuacaucaua

SEQ ID NO: 222354 - RNA, 19 nt, Homo sapiens
gacgagagauguauauuua

SEQ ID NO: 222355 - RNA, 19 nt, Homo sapiens
ggaagcuacugaauuauaa

SEQ ID NO: 222356 - RNA, 19 nt, Homo sapiens
gaaagugucuacccaguug

SEQ ID NO: 222357 - RNA, 19 nt, Homo sapiens
ggaaguagauccaaacaca

SEQ ID NO: 222358 - RNA, 19 nt, Homo sapiens
gcaagcacccaucguauua

SEQ ID NO: 222359 - RNA, 19 nt, Homo sapiens
uaacguggcucauuguaaa

SEQ ID NO: 222360 - RNA, 19 nt, Homo sapiens
gggcagggcucauucauug

SEQ ID NO: 222361 - RNA, 19 nt, Homo sapiens
ggagaugcauggccucuaa

SEQ ID NO: 222362 - RNA, 19 nt, Homo sapiens
gaaauaacacugugaaugu

SEQ ID NO: 222363 - RNA, 19 nt, Homo sapiens
aagggaagcuacugaauua

SEQ ID NO: 222364 - RNA, 19 nt, Homo sapiens
ggaggaagcugagcauuau

SEQ ID NO: 222365 - RNA, 19 nt, Homo sapiens
gaacuaggcacacugcuaa

SEQ ID NO: 222366 - RNA, 19 nt, Homo sapiens
caaguugaaugaucuguuu

SEQ ID NO: 222367 - RNA, 19 nt, Homo sapiens
ccagaaagaaggacaaaua

SEQ ID NO: 222368 - RNA, 19 nt, Homo sapiens
gaggaagacuuuaucaugu

SEQ ID NO: 222369 - RNA, 19 nt, Homo sapiens
gaacuauccucuggacgua

SEQ ID NO: 222370 - RNA, 19 nt, Homo sapiens
caaagaaccgugcagauaa

SEQ ID NO: 222371 - RNA, 19 nt, Homo sapiens
gaaagaaccaggagaacaa

SEQ ID NO: 222372 - RNA, 19 nt, Homo sapiens
agaaggacauugugaaauu

SEQ ID NO: 222373 - RNA, 19 nt, Homo sapiens
gcugagauguggacuugua

SEQ ID NO: 222374 - RNA, 19 nt, Homo sapiens
uaacagacgucacuaugga

SEQ ID NO: 222375 - RNA, 19 nt, Homo sapiens
caagaaggacacaauauuu

SEQ ID NO: 222376 - RNA, 19 nt, Homo sapiens
gcuucuggcugcaaauuua

SEQ ID NO: 222377 - RNA, 19 nt, Homo sapiens
ggaaaacacugaaggauga

SEQ ID NO: 222378 - RNA, 19 nt, Homo sapiens
caagagacccgaagaauca

SEQ ID NO: 222379 - RNA, 19 nt, Homo sapiens
caacauagaguuugucuuc

SEQ ID NO: 222380 - RNA, 19 nt, Homo sapiens
guuugaaccucuuguuaua

SEQ ID NO: 222381 - RNA, 19 nt, Homo sapiens
caucaaaggugacauugga

SEQ ID NO: 222382 - RNA, 19 nt, Homo sapiens
cagcaguguugauaaauuu

SEQ ID NO: 222383 - RNA, 19 nt, Homo sapiens
acagauagcugacaucauc

SEQ ID NO: 222384 - RNA, 19 nt, Homo sapiens
agacaaaccucacgagugu

SEQ ID NO: 222385 - RNA, 19 nt, Homo sapiens
gaacgagugcucaauaaug

SEQ ID NO: 222386 - RNA, 19 nt, Homo sapiens
ugacagcaguguugauaaa

SEQ ID NO: 222387 - RNA, 19 nt, Homo sapiens
gcuacuaaaugugcucuua

SEQ ID NO: 222388 - RNA, 19 nt, Homo sapiens
uaaagaauuugccagaaga

SEQ ID NO: 222389 - RNA, 19 nt, Homo sapiens
gaagggaaacaaauaaaga

SEQ ID NO: 222390 - RNA, 19 nt, Homo sapiens
ucuaucaucuuccuucaua

SEQ ID NO: 222391 - RNA, 19 nt, Homo sapiens
gggaaggacugacgagaga

SEQ ID NO: 222392 - RNA, 19 nt, Homo sapiens
gguaauaucgggaaagauu

SEQ ID NO: 222393 - RNA, 19 nt, Homo sapiens
ggaggaagacuuuaucaug

SEQ ID NO: 222394 - RNA, 19 nt, Homo sapiens
caacaugugugcaguuaca

SEQ ID NO: 222395 - RNA, 19 nt, Homo sapiens
uaauuaggcuugucccaaa

SEQ ID NO: 222396 - RNA, 19 nt, Homo sapiens
caagaacgagugcucaaua

SEQ ID NO: 222397 - RNA, 19 nt, Homo sapiens
ggaaacccuugcagagauu

SEQ ID NO: 222398 - RNA, 19 nt, Homo sapiens
ggagugagguuaguucugu

SEQ ID NO: 222399 - RNA, 19 nt, Homo sapiens
gcaagagauucaagcaaug

SEQ ID NO: 222400 - RNA, 19 nt, Homo sapiens
gggaggaagcugagcauua

SEQ ID NO: 222401 - RNA, 19 nt, Homo sapiens
gaacaagccucugaaagcu

SEQ ID NO: 222402 - RNA, 19 nt, Homo sapiens
ccugcuagcuccaugcuua

SEQ ID NO: 222403 - RNA, 19 nt, Homo sapiens
ggacaaagacugguacguu

SEQ ID NO: 222404 - RNA, 19 nt, Homo sapiens
ucucagacaucuugaacua

SEQ ID NO: 222405 - RNA, 19 nt, Homo sapiens
gggaagcuacugaauuaua

SEQ ID NO: 222406 - RNA, 19 nt, Homo sapiens
gcaccuuccuccugagaaa

SEQ ID NO: 222407 - RNA, 19 nt, Homo sapiens
gcaauucagucucguugug

SEQ ID NO: 222408 - RNA, 19 nt, Homo sapiens
ggauucagaucagguguuu

SEQ ID NO: 222409 - RNA, 19 nt, Homo sapiens
ggaaguguguugaagagau

SEQ ID NO: 222410 - RNA, 19 nt, Homo sapiens
gcccaggucucacugcuuu

SEQ ID NO: 222411 - RNA, 19 nt, Homo sapiens
caagaaagaccgugugaau

SEQ ID NO: 222412 - RNA, 19 nt, Homo sapiens
ggagaaagaaccaggagaa

SEQ ID NO: 222413 - RNA, 19 nt, Homo sapiens
gaacuaaucacaucaacca

SEQ ID NO: 222414 - RNA, 19 nt, Homo sapiens
aaggaugagucuucuguua

SEQ ID NO: 222415 - RNA, 19 nt, Homo sapiens
guuccuggcuagauguuua

SEQ ID NO: 222416 - RNA, 19 nt, Homo sapiens
gugcagagcuggugaaucg

SEQ ID NO: 222417 - RNA, 19 nt, Homo sapiens
ucaacagaauccaggaaua

SEQ ID NO: 222418 - RNA, 19 nt, Homo sapiens
uggaagaacucaacagaau

SEQ ID NO: 222419 - RNA, 19 nt, Homo sapiens
gcagcaacauacuuucuau

SEQ ID NO: 222420 - RNA, 19 nt, Homo sapiens
ggaaucagaggcaaucauu

SEQ ID NO: 222421 - RNA, 19 nt, Homo sapiens
uaccugaaauccugcuuua

SEQ ID NO: 222422 - RNA, 19 nt, Homo sapiens
caacaaaguuaucaaagcu

SEQ ID NO: 222423 - RNA, 19 nt, Homo sapiens
ucaaagagagagaauauug

SEQ ID NO: 222424 - RNA, 19 nt, Homo sapiens
guacguucaucuugucaaa

SEQ ID NO: 222425 - RNA, 19 nt, Homo sapiens
ccacgaccucuuuguauua

SEQ ID NO: 222426 - RNA, 19 nt, Homo sapiens
ugaaggugauuaacauuug

SEQ ID NO: 222427 - RNA, 19 nt, Homo sapiens
guucugaaauuguguuaga

SEQ ID NO: 222428 - RNA, 19 nt, Homo sapiens
gagcggguaucuguucuuu

SEQ ID NO: 222429 - RNA, 19 nt, Homo sapiens
ggucagaucccuucuagug

SEQ ID NO: 222430 - RNA, 19 nt, Homo sapiens
gaaggacauugugaaauuc

SEQ ID NO: 222431 - RNA, 19 nt, Homo sapiens
gcacauugacucucaugaa

SEQ ID NO: 222432 - RNA, 19 nt, Homo sapiens
gauggcaacuguuuguguu

SEQ ID NO: 222433 - RNA, 19 nt, Homo sapiens
gcaccaagaccacaauguu

SEQ ID NO: 222434 - RNA, 19 nt, Homo sapiens
ggaaaugagugagcagcaa

SEQ ID NO: 222435 - RNA, 19 nt, Homo sapiens
guacacgacuacaacaugu

SEQ ID NO: 222436 - RNA, 19 nt, Homo sapiens
acaaagaaccgugcagaua

SEQ ID NO: 222437 - RNA, 19 nt, Homo sapiens
ucacgagugucacaaagaa

SEQ ID NO: 222438 - RNA, 19 nt, Homo sapiens
caccagagcacucacauuu

SEQ ID NO: 222439 - RNA, 19 nt, Homo sapiens
gcacaauaaccagaauaua

SEQ ID NO: 222440 - RNA, 19 nt, Homo sapiens
ggaagacuuuaucauguuc

SEQ ID NO: 222441 - RNA, 19 nt, Homo sapiens
ggaagucugugcccuugug

SEQ ID NO: 222442 - RNA, 19 nt, Homo sapiens
aaacuuggaaugugcaaua

SEQ ID NO: 222443 - RNA, 19 nt, Homo sapiens
ucccaaagcuguuuuauaa

SEQ ID NO: 222444 - RNA, 19 nt, Homo sapiens
gaccuuggcugcagcuguu

SEQ ID NO: 222445 - RNA, 19 nt, Homo sapiens
gaagggaggaagacuuuau

SEQ ID NO: 222446 - RNA, 19 nt, Homo sapiens
cagaggagccaagucauua

SEQ ID NO: 222447 - RNA, 19 nt, Homo sapiens
ccacagacuucuacagaca

SEQ ID NO: 222448 - RNA, 19 nt, Homo sapiens
gcacagcauucccugagau

SEQ ID NO: 222449 - RNA, 19 nt, Homo sapiens
gcacuuaacguggcucauu

SEQ ID NO: 222450 - RNA, 19 nt, Homo sapiens
gaugguggcugacgaaugc

SEQ ID NO: 222451 - RNA, 19 nt, Homo sapiens
gaacagcacggaaaaguuu

SEQ ID NO: 222452 - RNA, 19 nt, Homo sapiens
gaaggugauuaacauuugu

SEQ ID NO: 222453 - RNA, 19 nt, Homo sapiens
gcaagcagaugcagagauu

SEQ ID NO: 222454 - RNA, 19 nt, Homo sapiens
cuaaugagcuuccauacaa

SEQ ID NO: 222455 - RNA, 19 nt, Homo sapiens
ccacagcgaugacuacauu

SEQ ID NO: 222456 - RNA, 19 nt, Homo sapiens
ggacaaggccacccaauga

SEQ ID NO: 222457 - RNA, 19 nt, Homo sapiens
gaaagucuguuacuacuac

SEQ ID NO: 222458 - RNA, 19 nt, Homo sapiens
ggacaucgcugugaauugg

SEQ ID NO: 222459 - RNA, 19 nt, Homo sapiens
ggaggaaagucuguuacua

SEQ ID NO: 222460 - RNA, 19 nt, Homo sapiens
cagauaacaugucggagua

SEQ ID NO: 222461 - RNA, 19 nt, Homo sapiens
auacggagaucccuaauga

SEQ ID NO: 222462 - RNA, 19 nt, Homo sapiens
agaaagaagucaccgaaga

SEQ ID NO: 222463 - RNA, 19 nt, Homo sapiens
ggagaucccuaaugagcuu

SEQ ID NO: 222464 - RNA, 19 nt, Homo sapiens
ggucaugacuguguccuuu

SEQ ID NO: 222465 - RNA, 19 nt, Homo sapiens
cugaggagaugaccaagua

SEQ ID NO: 222466 - RNA, 19 nt, Homo sapiens
aaaguaacaucagccauuu

SEQ ID NO: 222467 - RNA, 19 nt, Homo sapiens
ccaagugccugcuuaguag

SEQ ID NO: 222468 - RNA, 19 nt, Homo sapiens
gaggaagaguucuccgauu

SEQ ID NO: 222469 - RNA, 19 nt, Homo sapiens
gaucugcuccucugacaaa

SEQ ID NO: 222470 - RNA, 19 nt, Homo sapiens
gaauuugucaagagcuuua

SEQ ID NO: 222471 - RNA, 19 nt, Homo sapiens
gcaaguauuaugcuguuaa

SEQ ID NO: 222472 - RNA, 19 nt, Homo sapiens
uaaaguaacaucagccauu

SEQ ID NO: 222473 - RNA, 19 nt, Homo sapiens
auaauuugcugcucaacua

SEQ ID NO: 222474 - RNA, 19 nt, Homo sapiens
caaucuaacuaucaaagga

SEQ ID NO: 222475 - RNA, 19 nt, Homo sapiens
ccaaaguaauggagauguu

SEQ ID NO: 222476 - RNA, 19 nt, Homo sapiens
aagacaaacuccugaaaug

SEQ ID NO: 222477 - RNA, 19 nt, Homo sapiens
gugagccucuuuguaauaa

SEQ ID NO: 222478 - RNA, 19 nt, Homo sapiens
caucaguccuuccaauaug

SEQ ID NO: 222479 - RNA, 19 nt, Homo sapiens
ccaaguguguggaauuugu

SEQ ID NO: 222480 - RNA, 19 nt, Homo sapiens
gccaagugccugcuuagua

SEQ ID NO: 222481 - RNA, 19 nt, Homo sapiens
ccacaucaguccuuccaau

SEQ ID NO: 222482 - RNA, 19 nt, Homo sapiens
ggagaagccagaagccaaa

SEQ ID NO: 222483 - RNA, 19 nt, Homo sapiens
gaacucuuccaacuucaaa

SEQ ID NO: 222484 - RNA, 19 nt, Homo sapiens
acaaacgaauugccuguga

SEQ ID NO: 222485 - RNA, 19 nt, Homo sapiens
ggucauguccaaaguaaug

SEQ ID NO: 222486 - RNA, 19 nt, Homo sapiens
gcucaacuauggucucuac

SEQ ID NO: 222487 - RNA, 19 nt, Homo sapiens
gaaagaagucaccgaagag

SEQ ID NO: 222488 - RNA, 19 nt, Homo sapiens
gaagaguucuccgauucug

SEQ ID NO: 222489 - RNA, 19 nt, Homo sapiens
agagggugcuguacauuga

SEQ ID NO: 222490 - RNA, 19 nt, Homo sapiens
cgaggcaucuggcuucugu

SEQ ID NO: 222491 - RNA, 19 nt, Homo sapiens
aguauucgauggccuguuu

SEQ ID NO: 222492 - RNA, 19 nt, Homo sapiens
guauuaugcuguuaacuac

SEQ ID NO: 222493 - RNA, 19 nt, Homo sapiens
gcgaugacuacauuaaauu

SEQ ID NO: 222494 - RNA, 19 nt, Homo sapiens
ggaaagucuguuacuacua

SEQ ID NO: 222495 - RNA, 19 nt, Homo sapiens
caaugaagccucaccgaau

SEQ ID NO: 222496 - RNA, 19 nt, Homo sapiens
ucaaggaggaggucaaguu

SEQ ID NO: 222497 - RNA, 19 nt, Homo sapiens
ugacuaaccagaacacgaa

SEQ ID NO: 222498 - RNA, 19 nt, Homo sapiens
gaggaaagucuguuacuac

SEQ ID NO: 222499 - RNA, 19 nt, Homo sapiens
ucuguuacgucaaugauau

SEQ ID NO: 222500 - RNA, 19 nt, Homo sapiens
agaaagacccagaggagaa

SEQ ID NO: 222501 - RNA, 19 nt, Homo sapiens
caauaugacuaaccagaac

SEQ ID NO: 222502 - RNA, 19 nt, Homo sapiens
ccggucauguccaaaguaa

SEQ ID NO: 222503 - RNA, 19 nt, Homo sapiens
gcaaaggcaaguauuaugc

SEQ ID NO: 222504 - RNA, 19 nt, Homo sapiens
uccuggaacugcuaaagua

SEQ ID NO: 222505 - RNA, 19 nt, Homo sapiens
agacggacaucgcugugaa

SEQ ID NO: 222506 - RNA, 19 nt, Homo sapiens
uuugugagccucuuuguaa

SEQ ID NO: 222507 - RNA, 19 nt, Homo sapiens
uaagacaaacuccugaaau

SEQ ID NO: 222508 - RNA, 19 nt, Homo sapiens
aggaagaguucuccgauuc

SEQ ID NO: 222509 - RNA, 19 nt, Homo sapiens
uccauacaaugacuacuuu

SEQ ID NO: 222510 - RNA, 19 nt, Homo sapiens
cgucaaugauaucgucuug

SEQ ID NO: 222511 - RNA, 19 nt, Homo sapiens
gauaacaugucggaguaca

SEQ ID NO: 222512 - RNA, 19 nt, Homo sapiens
caaggaggaggucaaguug

SEQ ID NO: 222513 - RNA, 19 nt, Homo sapiens
ucgauggccuguuugaguu

SEQ ID NO: 222514 - RNA, 19 nt, Homo sapiens
ccaauaugacuaaccagaa

SEQ ID NO: 222515 - RNA, 19 nt, Homo sapiens
gcccggugcuggacauaug

SEQ ID NO: 222516 - RNA, 19 nt, Homo sapiens
cgccaaguguguggaauuu

SEQ ID NO: 222517 - RNA, 19 nt, Homo sapiens
ucgguuagguugcuucaau

SEQ ID NO: 222518 - RNA, 19 nt, Homo sapiens
caacguuggugaggacugu

SEQ ID NO: 222519 - RNA, 19 nt, Homo sapiens
acuauggucucuaccgaaa

SEQ ID NO: 222520 - RNA, 19 nt, Homo sapiens
ccaaguaccacagcgauga

SEQ ID NO: 222521 - RNA, 19 nt, Homo sapiens
gguggagguugcuagucua

SEQ ID NO: 222522 - RNA, 19 nt, Homo sapiens
gacaaggccacccaaugaa

SEQ ID NO: 222523 - RNA, 19 nt, Homo sapiens
cgaaugaguaccuggagaa

SEQ ID NO: 222524 - RNA, 19 nt, Homo sapiens
ucaagccggucauguccaa

SEQ ID NO: 222525 - RNA, 19 nt, Homo sapiens
ggauugaugacgaguccua

SEQ ID NO: 222526 - RNA, 19 nt, Homo sapiens
gcuucaaucuaacuaucaa

SEQ ID NO: 222527 - RNA, 19 nt, Homo sapiens
ugacuguguccuuucauaa

SEQ ID NO: 222528 - RNA, 19 nt, Homo sapiens
uggaacugcuaaaguauca

SEQ ID NO: 222529 - RNA, 19 nt, Homo sapiens
aaugaagccucaccgaauc

SEQ ID NO: 222530 - RNA, 19 nt, Homo sapiens
cacaucaguccuuccaaua

SEQ ID NO: 222531 - RNA, 19 nt, Homo sapiens
ucaaaggacacgccaagug

SEQ ID NO: 222532 - RNA, 19 nt, Homo sapiens
ugaauacuuuggaccagau

SEQ ID NO: 222533 - RNA, 19 nt, Homo sapiens
ggcaaguauuaugcuguua

SEQ ID NO: 222534 - RNA, 19 nt, Homo sapiens
ugacauugauauucaccau

SEQ ID NO: 222535 - RNA, 19 nt, Homo sapiens
cagcgaugacuacauuaaa

SEQ ID NO: 222536 - RNA, 19 nt, Homo sapiens
ccccucagauuuuauauuu

SEQ ID NO: 222537 - RNA, 19 nt, Homo sapiens
gaaagacccagaggagaag

SEQ ID NO: 222538 - RNA, 19 nt, Homo sapiens
gagcuuccauacaaugacu

SEQ ID NO: 222539 - RNA, 19 nt, Homo sapiens
uaaugagcuuccauacaau

SEQ ID NO: 222540 - RNA, 19 nt, Homo sapiens
caaguauuaugcuguuaac

SEQ ID NO: 222541 - RNA, 19 nt, Homo sapiens
ggcaaaggcaaguauuaug

SEQ ID NO: 222542 - RNA, 19 nt, Homo sapiens
gagccucuuuguaauaaaa

SEQ ID NO: 222543 - RNA, 19 nt, Homo sapiens
augaguaccuggagaagau

SEQ ID NO: 222544 - RNA, 19 nt, Homo sapiens
cauacaaugacuacuuuga

SEQ ID NO: 222545 - RNA, 19 nt, Homo sapiens
uaaccugccuaugcugaug

SEQ ID NO: 222546 - RNA, 19 nt, Homo sapiens
cuagugcgguggucuuaca

SEQ ID NO: 222547 - RNA, 19 nt, Homo sapiens
gcaucuggcuucuguuacg

SEQ ID NO: 222548 - RNA, 19 nt, Homo sapiens
aaugccaagugccugcuua

SEQ ID NO: 222549 - RNA, 19 nt, Homo sapiens
gaguggcgaugaggacgaa

SEQ ID NO: 222550 - RNA, 19 nt, Homo sapiens
cuaaccagaacacgaauga

SEQ ID NO: 222551 - RNA, 19 nt, Homo sapiens
ugugagccucuuuguaaua

SEQ ID NO: 222552 - RNA, 19 nt, Homo sapiens
caaugacuacuuugaauac

SEQ ID NO: 222553 - RNA, 19 nt, Homo sapiens
ccaaugaguugccauauaa

SEQ ID NO: 222554 - RNA, 19 nt, Homo sapiens
gaagaaauguggcugauca

SEQ ID NO: 222555 - RNA, 19 nt, Homo sapiens
gcggauagcuugugaugaa

SEQ ID NO: 222556 - RNA, 19 nt, Homo sapiens
gcuguuaaauuauggcuua

SEQ ID NO: 222557 - RNA, 19 nt, Homo sapiens
gcaaagaaagcuagaauug

SEQ ID NO: 222558 - RNA, 19 nt, Homo sapiens
ccagaacacuccagaauau

SEQ ID NO: 222559 - RNA, 19 nt, Homo sapiens
cagagagucuuauauauug

SEQ ID NO: 222560 - RNA, 19 nt, Homo sapiens
gaaauguggcugaucauaa

SEQ ID NO: 222561 - RNA, 19 nt, Homo sapiens
aaacagacguuaaggaaga

SEQ ID NO: 222562 - RNA, 19 nt, Homo sapiens
gaugaagaauucucagauu

SEQ ID NO: 222563 - RNA, 19 nt, Homo sapiens
caaaggugauggagaugua

SEQ ID NO: 222564 - RNA, 19 nt, Homo sapiens
gauaacaugucugaguaua

SEQ ID NO: 222565 - RNA, 19 nt, Homo sapiens
gaaagaaacagaggacaaa

SEQ ID NO: 222566 - RNA, 19 nt, Homo sapiens
caucagagagucuuauaua

SEQ ID NO: 222567 - RNA, 19 nt, Homo sapiens
caaauacuaugcugucaau

SEQ ID NO: 222568 - RNA, 19 nt, Homo sapiens
gaugcaagcuauuccagaa

SEQ ID NO: 222569 - RNA, 19 nt, Homo sapiens
agacugauauggcuguuaa

SEQ ID NO: 222570 - RNA, 19 nt, Homo sapiens
ggcauggacuguauuuauu

SEQ ID NO: 222571 - RNA, 19 nt, Homo sapiens
uaaagccacugccgaagaa

SEQ ID NO: 222572 - RNA, 19 nt, Homo sapiens
uaagaaaggagcaaagaaa

SEQ ID NO: 222573 - RNA, 19 nt, Homo sapiens
ucaggauucuguuacguua

SEQ ID NO: 222574 - RNA, 19 nt, Homo sapiens
caaaggaaccaaaucagaa

SEQ ID NO: 222575 - RNA, 19 nt, Homo sapiens
gaugugaguuauuauguca

SEQ ID NO: 222576 - RNA, 19 nt, Homo sapiens
agaaggaggucgaagaaau

SEQ ID NO: 222577 - RNA, 19 nt, Homo sapiens
caaaggucaugcuaaaugu

SEQ ID NO: 222578 - RNA, 19 nt, Homo sapiens
uaacaugucugaguauagu

SEQ ID NO: 222579 - RNA, 19 nt, Homo sapiens
uaacuuaccauuacugaug

SEQ ID NO: 222580 - RNA, 19 nt, Homo sapiens
gaaggaggucgaagaaaug

SEQ ID NO: 222581 - RNA, 19 nt, Homo sapiens
agucaaaggucaugcuaaa

SEQ ID NO: 222582 - RNA, 19 nt, Homo sapiens
ccgaagaaaugacaaaaua

SEQ ID NO: 222583 - RNA, 19 nt, Homo sapiens
caaagaaagcuagaauuga

SEQ ID NO: 222584 - RNA, 19 nt, Homo sapiens
ggagaaggaggucgaagaa

SEQ ID NO: 222585 - RNA, 19 nt, Homo sapiens
agaagaugcuguucaugaa

SEQ ID NO: 222586 - RNA, 19 nt, Homo sapiens
ggagauguaucaaccuagu

SEQ ID NO: 222587 - RNA, 19 nt, Homo sapiens
acaggagacuugagggaua

SEQ ID NO: 222588 - RNA, 19 nt, Homo sapiens
cagaagaugcuguucauga

SEQ ID NO: 222589 - RNA, 19 nt, Homo sapiens
gcagauauuuaagccuauu

SEQ ID NO: 222590 - RNA, 19 nt, Homo sapiens
uaagaaauacgaagcauca

SEQ ID NO: 222591 - RNA, 19 nt, Homo sapiens
gcauggacuguauuuauuu

SEQ ID NO: 222592 - RNA, 19 nt, Homo sapiens
gaauccgcaugacccauaa

SEQ ID NO: 222593 - RNA, 19 nt, Homo sapiens
cccaaugaguugccauaua

SEQ ID NO: 222594 - RNA, 19 nt, Homo sapiens
gugauagacuggguuguuu

SEQ ID NO: 222595 - RNA, 19 nt, Homo sapiens
ugauauggcuguuaauugg

SEQ ID NO: 222596 - RNA, 19 nt, Homo sapiens
gcuggaggauuacaucaug

SEQ ID NO: 222597 - RNA, 19 nt, Homo sapiens
gaacacuccagaauauaug

SEQ ID NO: 222598 - RNA, 19 nt, Homo sapiens
gacuucaaacugcauauua

SEQ ID NO: 222599 - RNA, 19 nt, Homo sapiens
gagcaaagaaagcuagaau

SEQ ID NO: 222600 - RNA, 19 nt, Homo sapiens
gauagcuugugaugaagaa

SEQ ID NO: 222601 - RNA, 19 nt, Homo sapiens
ugaagacaguggagaugaa

SEQ ID NO: 222602 - RNA, 19 nt, Homo sapiens
acggugauauuggaaauua

SEQ ID NO: 222603 - RNA, 19 nt, Homo sapiens
ucaaaggucaugcuaaaug

SEQ ID NO: 222604 - RNA, 19 nt, Homo sapiens
gagaagauccagacaagag

SEQ ID NO: 222605 - RNA, 19 nt, Homo sapiens
cgguaucauuccauaaaua

SEQ ID NO: 222606 - RNA, 19 nt, Homo sapiens
gauuacaucaugcuaagaa

SEQ ID NO: 222607 - RNA, 19 nt, Homo sapiens
gcucucaacuggcgguuca

SEQ ID NO: 222608 - RNA, 19 nt, Homo sapiens
ccaaaggaaccaaaucaga

SEQ ID NO: 222609 - RNA, 19 nt, Homo sapiens
gauccagacaagagaauuu

SEQ ID NO: 222610 - RNA, 19 nt, Homo sapiens
uaaaguaucaucagagagu

SEQ ID NO: 222611 - RNA, 19 nt, Homo sapiens
cuacgacggugauauugga

SEQ ID NO: 222612 - RNA, 19 nt, Homo sapiens
aaauguggcugaucauaag

SEQ ID NO: 222613 - RNA, 19 nt, Homo sapiens
gaguugccauauaaugauu

SEQ ID NO: 222614 - RNA, 19 nt, Homo sapiens
ggagguggcuacacaaucc

SEQ ID NO: 222615 - RNA, 19 nt, Homo sapiens
gacgguaucauuccauaaa

SEQ ID NO: 222616 - RNA, 19 nt, Homo sapiens
gaaguuaaaccgacaacag

SEQ ID NO: 222617 - RNA, 19 nt, Homo sapiens
caguugcccuugauuguga

SEQ ID NO: 222618 - RNA, 19 nt, Homo sapiens
ugagucauaugggcagaua

SEQ ID NO: 222619 - RNA, 19 nt, Homo sapiens
uugacagucucaccaauuu

SEQ ID NO: 222620 - RNA, 19 nt, Homo sapiens
gaagauccagacaagagaa

SEQ ID NO: 222621 - RNA, 19 nt, Homo sapiens
agaugaagauggagaagau

SEQ ID NO: 222622 - RNA, 19 nt, Homo sapiens
gaggauuacaucaugcuaa

SEQ ID NO: 222623 - RNA, 19 nt, Homo sapiens
ugguauagaugaugaguca

SEQ ID NO: 222624 - RNA, 19 nt, Homo sapiens
gcaaauacuaugcugucaa

SEQ ID NO: 222625 - RNA, 19 nt, Homo sapiens
caacagaucguguaaugac

SEQ ID NO: 222626 - RNA, 19 nt, Homo sapiens
aagcuagaauugaagaaga

SEQ ID NO: 222627 - RNA, 19 nt, Homo sapiens
cuacuacgacggugauauu

SEQ ID NO: 222628 - RNA, 19 nt, Homo sapiens
aauaagaccagauaacaug

SEQ ID NO: 222629 - RNA, 19 nt, Homo sapiens
acuaaaguaucaucagaga

SEQ ID NO: 222630 - RNA, 19 nt, Homo sapiens
ugcuggagcugugaaguua

SEQ ID NO: 222631 - RNA, 19 nt, Homo sapiens
ccgcaugacccauaacuug

SEQ ID NO: 222632 - RNA, 19 nt, Homo sapiens
cuaaauguguagaaguugu

SEQ ID NO: 222633 - RNA, 19 nt, Homo sapiens
cgacggugauauuggaaau

SEQ ID NO: 222634 - RNA, 19 nt, Homo sapiens
ucaauaagaccagauaaca

SEQ ID NO: 222635 - RNA, 19 nt, Homo sapiens
gaaaggagcaaagaaagcu

SEQ ID NO: 222636 - RNA, 19 nt, Homo sapiens
caguggagaugaagaugga

SEQ ID NO: 222637 - RNA, 19 nt, Homo sapiens
agacugcaguugcccuuga

SEQ ID NO: 222638 - RNA, 19 nt, Homo sapiens
uauaguaagcagaugcaua

SEQ ID NO: 222639 - RNA, 19 nt, Homo sapiens
aagaugcuguucaugaaga

SEQ ID NO: 222640 - RNA, 19 nt, Homo sapiens
uagacuggguuguuucaau

SEQ ID NO: 222641 - RNA, 19 nt, Homo sapiens
gcaagcuauuccagaagau

SEQ ID NO: 222642 - RNA, 19 nt, Homo sapiens
agacuggguuguuucaauc

SEQ ID NO: 222643 - RNA, 19 nt, Homo sapiens
ggugauagacuggguuguu

SEQ ID NO: 222644 - RNA, 19 nt, Homo sapiens
ggauauuggugcuggaaaa

SEQ ID NO: 222645 - RNA, 19 nt, Homo sapiens
uggcauggacuguauuuau

SEQ ID NO: 222646 - RNA, 19 nt, Homo sapiens
ucaaauuucuacggucaau

SEQ ID NO: 222647 - RNA, 19 nt, Homo sapiens
auacgaagcaucaggauuc

SEQ ID NO: 222648 - RNA, 19 nt, Homo sapiens
agaauccgcaugacccaua

SEQ ID NO: 222649 - RNA, 19 nt, Homo sapiens
cauaagaaaggagcaaaga

SEQ ID NO: 222650 - RNA, 19 nt, Homo sapiens
gaagaugcuguucaugaag

SEQ ID NO: 222651 - RNA, 19 nt, Homo sapiens
uggaggagguggcuacaca

SEQ ID NO: 222652 - RNA, 19 nt, Homo sapiens
ugcuaaauguguagaaguu

SEQ ID NO: 222653 - RNA, 19 nt, Homo sapiens
ggagagagaugguggauua

SEQ ID NO: 222654 - RNA, 19 nt, Homo sapiens
guacugaaauggcuaaaua

SEQ ID NO: 222655 - RNA, 19 nt, Homo sapiens
guacagagcuggagaugaa

SEQ ID NO: 222656 - RNA, 19 nt, Homo sapiens
gaacgucccuucagucugu

SEQ ID NO: 222657 - RNA, 19 nt, Homo sapiens
cagcagaccuucaguguga

SEQ ID NO: 222658 - RNA, 19 nt, Homo sapiens
gaaacgacccuuccuuuga

SEQ ID NO: 222659 - RNA, 19 nt, Homo sapiens
ggaaaaggcugguuugauu

SEQ ID NO: 222660 - RNA, 19 nt, Homo sapiens
ccacaucgaugcugcuuau

SEQ ID NO: 222661 - RNA, 19 nt, Homo sapiens
gaugaguccugccuaaaug

SEQ ID NO: 222662 - RNA, 19 nt, Homo sapiens
acaauuguaugccaacuuu

SEQ ID NO: 222663 - RNA, 19 nt, Homo sapiens
aaacgacccuuccuuugaa

SEQ ID NO: 222664 - RNA, 19 nt, Homo sapiens
ccaggaagaucaucaagca

SEQ ID NO: 222665 - RNA, 19 nt, Homo sapiens
gcugaugaguccugccuaa

SEQ ID NO: 222666 - RNA, 19 nt, Homo sapiens
acaauaggauacaaacgaa

SEQ ID NO: 222667 - RNA, 19 nt, Homo sapiens
ccuccuuccuguucaguua

SEQ ID NO: 222668 - RNA, 19 nt, Homo sapiens
cagaaacgacccuuccuuu

SEQ ID NO: 222669 - RNA, 19 nt, Homo sapiens
ucuaaaggguccuaauugu

SEQ ID NO: 222670 - RNA, 19 nt, Homo sapiens
gagagaugguggauuacau

SEQ ID NO: 222671 - RNA, 19 nt, Homo sapiens
ugauggagccugaggagua

SEQ ID NO: 222672 - RNA, 19 nt, Homo sapiens
uaaaggaaauagcuaaagc

SEQ ID NO: 222673 - RNA, 19 nt, Homo sapiens
acaaguuaaucauccguuu

SEQ ID NO: 222674 - RNA, 19 nt, Homo sapiens
gguuugauuucccuuguga

SEQ ID NO: 222675 - RNA, 19 nt, Homo sapiens
gccgacuccuucaccuuua

SEQ ID NO: 222676 - RNA, 19 nt, Homo sapiens
cagaaaauguguuaaagga

SEQ ID NO: 222677 - RNA, 19 nt, Homo sapiens
ugauuucccuugugaagau

SEQ ID NO: 222678 - RNA, 19 nt, Homo sapiens
ggacauugaacgaaucauc

SEQ ID NO: 222679 - RNA, 19 nt, Homo sapiens
gcuugugacaugauauaua

SEQ ID NO: 222680 - RNA, 19 nt, Homo sapiens
uaaaggguccuaauugucu

SEQ ID NO: 222681 - RNA, 19 nt, Homo sapiens
aaccucaucucccaaauca

SEQ ID NO: 222682 - RNA, 19 nt, Homo sapiens
cuaauugucucacagaaaa

SEQ ID NO: 222683 - RNA, 19 nt, Homo sapiens
gacuccagcugcccuguug

SEQ ID NO: 222684 - RNA, 19 nt, Homo sapiens
cagaagacaugaugaugcu

SEQ ID NO: 222685 - RNA, 19 nt, Homo sapiens
agaaggccaucgaggaaga

SEQ ID NO: 222686 - RNA, 19 nt, Homo sapiens
uggauuacaucugccagua

SEQ ID NO: 222687 - RNA, 19 nt, Homo sapiens
cagcuugugacaugauaua

SEQ ID NO: 222688 - RNA, 19 nt, Homo sapiens
gaaccucaucucccaaauc

SEQ ID NO: 222689 - RNA, 19 nt, Homo sapiens
gaaaaggcugguuugauuu

SEQ ID NO: 222690 - RNA, 19 nt, Homo sapiens
gggcucaugacccacaaua

SEQ ID NO: 222691 - RNA, 19 nt, Homo sapiens
agaagccacugcccacaga

SEQ ID NO: 222692 - RNA, 19 nt, Homo sapiens
ccucaggcaugccaacuca

SEQ ID NO: 222693 - RNA, 19 nt, Homo sapiens
caucgaugcugcuuaugca

SEQ ID NO: 222694 - RNA, 19 nt, Homo sapiens
ucagaaggccaucgaggaa

SEQ ID NO: 222695 - RNA, 19 nt, Homo sapiens
gacaugaugaugcugaaga

SEQ ID NO: 222696 - RNA, 19 nt, Homo sapiens
cgacgguuucgcucuguua

SEQ ID NO: 222697 - RNA, 19 nt, Homo sapiens
gaacaaaauccuggaaaug

SEQ ID NO: 222698 - RNA, 19 nt, Homo sapiens
gacauugaacgaaucauca

SEQ ID NO: 222699 - RNA, 19 nt, Homo sapiens
cgucuaaaggguccuaauu

SEQ ID NO: 222700 - RNA, 19 nt, Homo sapiens
cacaauaggauacaaacga

SEQ ID NO: 222701 - RNA, 19 nt, Homo sapiens
acaugaugaugcugaagaa

SEQ ID NO: 222702 - RNA, 19 nt, Homo sapiens
ggaaccucaucucccaaau

SEQ ID NO: 222703 - RNA, 19 nt, Homo sapiens
gacccuuccuuugaaauuc

SEQ ID NO: 222704 - RNA, 19 nt, Homo sapiens
caacuuugugugcuuaugu

SEQ ID NO: 222705 - RNA, 19 nt, Homo sapiens
gauggagccugaggaguac

SEQ ID NO: 222706 - RNA, 19 nt, Homo sapiens
gcucacuccucuguggaaa

SEQ ID NO: 222707 - RNA, 19 nt, Homo sapiens
ugguucagcuugugacaug

SEQ ID NO: 222708 - RNA, 19 nt, Homo sapiens
gcucaugacccacaauagg

SEQ ID NO: 222709 - RNA, 19 nt, Homo sapiens
agagagagagggagagaga

SEQ ID NO: 222710 - RNA, 19 nt, Homo sapiens
caucccaguuuaccacuag

SEQ ID NO: 222711 - RNA, 19 nt, Homo sapiens
ccacuauccaggacaaguu

SEQ ID NO: 222712 - RNA, 19 nt, Homo sapiens
agaaacgacccuuccuuug

SEQ ID NO: 222713 - RNA, 19 nt, Homo sapiens
cagacaugguacugaaaug

SEQ ID NO: 222714 - RNA, 19 nt, Homo sapiens
uaaacucugguucgugauu

SEQ ID NO: 222715 - RNA, 19 nt, Homo sapiens
ccgacuccuucaccuuuaa

SEQ ID NO: 222716 - RNA, 19 nt, Homo sapiens
ggagacaugcuggcugaug

SEQ ID NO: 222717 - RNA, 19 nt, Homo sapiens
acccagcccucaccucuug

SEQ ID NO: 222718 - RNA, 19 nt, Homo sapiens
cgacccuuccuuugaaauu

SEQ ID NO: 222719 - RNA, 19 nt, Homo sapiens
gccuguggaugacaacuuc

SEQ ID NO: 222720 - RNA, 19 nt, Homo sapiens
ggggcgaguucauaauuuu

SEQ ID NO: 222721 - RNA, 19 nt, Homo sapiens
gucuaaaggguccuaauug

SEQ ID NO: 222722 - RNA, 19 nt, Homo sapiens
guacuggguucugggucaa

SEQ ID NO: 222723 - RNA, 19 nt, Homo sapiens
ggaugauggugcauuuuga

SEQ ID NO: 222724 - RNA, 19 nt, Homo sapiens
aguggaugauggugcauuu

SEQ ID NO: 222725 - RNA, 19 nt, Homo sapiens
cagcagacggucagugaau

SEQ ID NO: 222726 - RNA, 19 nt, Homo sapiens
acaaaauccuggaaaugaa

SEQ ID NO: 222727 - RNA, 19 nt, Homo sapiens
cagaaucuuuuccagguuu

SEQ ID NO: 222728 - RNA, 19 nt, Homo sapiens
acggugcgcucccucaguu

SEQ ID NO: 222729 - RNA, 19 nt, Homo sapiens
ccuaauugucucacagaaa

SEQ ID NO: 222730 - RNA, 19 nt, Homo sapiens
ugaugaguccugccuaaau

SEQ ID NO: 222731 - RNA, 19 nt, Homo sapiens
ugccaacuuugugugcuua

SEQ ID NO: 222732 - RNA, 19 nt, Homo sapiens
caaguuaaucauccguuuc

SEQ ID NO: 222733 - RNA, 19 nt, Homo sapiens
aaacucugguucgugauuc

SEQ ID NO: 222734 - RNA, 19 nt, Homo sapiens
ugaacgucauggacugguu

SEQ ID NO: 222735 - RNA, 19 nt, Homo sapiens
agaaagggccgaggguaga

SEQ ID NO: 222736 - RNA, 19 nt, Homo sapiens
ccugaggaguacagagaga

SEQ ID NO: 222737 - RNA, 19 nt, Homo sapiens
ggacuccagcugcccuguu

SEQ ID NO: 222738 - RNA, 19 nt, Homo sapiens
cacuauccaggacaaguua

SEQ ID NO: 222739 - RNA, 19 nt, Homo sapiens
caucaugccugggguggua

SEQ ID NO: 222740 - RNA, 19 nt, Homo sapiens
agcacaagcuguccuccuu

SEQ ID NO: 222741 - RNA, 19 nt, Homo sapiens
gcauccagcccugcgugua

SEQ ID NO: 222742 - RNA, 19 nt, Homo sapiens
gguucugggucaaggacaa

SEQ ID NO: 222743 - RNA, 19 nt, Homo sapiens
ccuuuaauccuuccaagug

SEQ ID NO: 222744 - RNA, 19 nt, Homo sapiens
gcagcagacggucagugaa

SEQ ID NO: 222745 - RNA, 19 nt, Homo sapiens
aauaggauacaaacgaaga

SEQ ID NO: 222746 - RNA, 19 nt, Homo sapiens
ucagaaacgacccuuccuu

SEQ ID NO: 222747 - RNA, 19 nt, Homo sapiens
gaaauuucugccuguggau

SEQ ID NO: 222748 - RNA, 19 nt, Homo sapiens
cuaaaggguccuaauuguc

SEQ ID NO: 222749 - RNA, 19 nt, Homo sapiens
gauggugcauuuugacugu

SEQ ID NO: 222750 - RNA, 19 nt, Homo sapiens
ccaacuuugugugcuuaug

SEQ ID NO: 222751 - RNA, 19 nt, Homo sapiens
agagagagggagagagaug

SEQ ID NO: 222752 - RNA, 19 nt, Homo sapiens
gaugacugcuuuucagaag

SEQ ID NO: 222753 - RNA, 19 nt, Homo sapiens
caccagaucugauuuguaa

SEQ ID NO: 222754 - RNA, 19 nt, Homo sapiens
caacaaauaccaagucuuu

SEQ ID NO: 222755 - RNA, 19 nt, Homo sapiens
ggaagaggcuaccaaggaa

SEQ ID NO: 222756 - RNA, 19 nt, Homo sapiens
gaacaacccuacugucaag

SEQ ID NO: 222757 - RNA, 19 nt, Homo sapiens
gaaaucaacagccaacaaa

SEQ ID NO: 222758 - RNA, 19 nt, Homo sapiens
ggacagagagaaauaagug

SEQ ID NO: 222759 - RNA, 19 nt, Homo sapiens
aagggaagcuggucauuga

SEQ ID NO: 222760 - RNA, 19 nt, Homo sapiens
gagaggacagagagaaaua

SEQ ID NO: 222761 - RNA, 19 nt, Homo sapiens
gagaacaacccuacuguca

SEQ ID NO: 222762 - RNA, 19 nt, Homo sapiens
gaaagugggacagcuugua

SEQ ID NO: 222763 - RNA, 19 nt, Homo sapiens
uaucccagcugccuagauu

SEQ ID NO: 222764 - RNA, 19 nt, Homo sapiens
aaucaacagccaacaaaua

SEQ ID NO: 222765 - RNA, 19 nt, Homo sapiens
ugucaaggcuuccggcuau

SEQ ID NO: 222766 - RNA, 19 nt, Homo sapiens
gcucaaggccagcuuauag

SEQ ID NO: 222767 - RNA, 19 nt, Homo sapiens
gagaaaggagcguugaaga

SEQ ID NO: 222768 - RNA, 19 nt, Homo sapiens
gaagggaagcuggucauug

SEQ ID NO: 222769 - RNA, 19 nt, Homo sapiens
ucuacagucucgucucuuu

SEQ ID NO: 222770 - RNA, 19 nt, Homo sapiens
ccaaggagaagaacgagaa

SEQ ID NO: 222771 - RNA, 19 nt, Homo sapiens
gaccugaaggguugacuuu

SEQ ID NO: 222772 - RNA, 19 nt, Homo sapiens
uuccauaaauccuugauga

SEQ ID NO: 222773 - RNA, 19 nt, Homo sapiens
agaggaggaugaagaggaa

SEQ ID NO: 222774 - RNA, 19 nt, Homo sapiens
gauguuccuuccaguguca

SEQ ID NO: 222775 - RNA, 19 nt, Homo sapiens
gcagaaggaguacaaaugc

SEQ ID NO: 222776 - RNA, 19 nt, Homo sapiens
ugugggagaucgagaacaa

SEQ ID NO: 222777 - RNA, 19 nt, Homo sapiens
gauccaaccggcagaagga

SEQ ID NO: 222778 - RNA, 19 nt, Homo sapiens
ggcagaaggaguacaaaug

SEQ ID NO: 222779 - RNA, 19 nt, Homo sapiens
gaugauuucaguucuagga

SEQ ID NO: 222780 - RNA, 19 nt, Homo sapiens
gaggagggagcaauugaau

SEQ ID NO: 222781 - RNA, 19 nt, Homo sapiens
gaguuguaguuaaucauca

SEQ ID NO: 222782 - RNA, 19 nt, Homo sapiens
ggagaagaacgagaaagga

SEQ ID NO: 222783 - RNA, 19 nt, Homo sapiens
ccaaccugcucuccucuuc

SEQ ID NO: 222784 - RNA, 19 nt, Homo sapiens
ggaagaagaagaggaggau

SEQ ID NO: 222785 - RNA, 19 nt, Homo sapiens
gaaaauaaaacccguugau

SEQ ID NO: 222786 - RNA, 19 nt, Homo sapiens
cugccuagauucagggaaa

SEQ ID NO: 222787 - RNA, 19 nt, Homo sapiens
aaccugcucuccucuucua

SEQ ID NO: 222788 - RNA, 19 nt, Homo sapiens
gcagaggagggagcaauug

SEQ ID NO: 222789 - RNA, 19 nt, Homo sapiens
uauaucacccagacauaaa

SEQ ID NO: 222790 - RNA, 19 nt, Homo sapiens
ccugaaggguugacuuuac

SEQ ID NO: 222791 - RNA, 19 nt, Homo sapiens
aagaagaggaggaugaaga

SEQ ID NO: 222792 - RNA, 19 nt, Homo sapiens
ggaauccaaggagaaguuu

SEQ ID NO: 222793 - RNA, 19 nt, Homo sapiens
ggaguuguaguuaaucauc

SEQ ID NO: 222794 - RNA, 19 nt, Homo sapiens
ugaaaucaacagccaacaa

SEQ ID NO: 222795 - RNA, 19 nt, Homo sapiens
uauauaucacccagacaua

SEQ ID NO: 222796 - RNA, 19 nt, Homo sapiens
guaguuaaucaucaagaga

SEQ ID NO: 222797 - RNA, 19 nt, Homo sapiens
aagaagaagaggaggauga

SEQ ID NO: 222798 - RNA, 19 nt, Homo sapiens
gggcuccuuuccauaaauc

SEQ ID NO: 222799 - RNA, 19 nt, Homo sapiens
gaguugaggccacuguguu

SEQ ID NO: 222800 - RNA, 19 nt, Homo sapiens
ggaagggaagcuggucauu

SEQ ID NO: 222801 - RNA, 19 nt, Homo sapiens
ccaaccggcagaaggagua

SEQ ID NO: 222802 - RNA, 19 nt, Homo sapiens
gaccugguguucgccaaga

SEQ ID NO: 222803 - RNA, 19 nt, Homo sapiens
caacagccaacaaauacca

SEQ ID NO: 222804 - RNA, 19 nt, Homo sapiens
ugauugacaacacccauuu

SEQ ID NO: 222805 - RNA, 19 nt, Homo sapiens
gccaacaaauaccaagucu

SEQ ID NO: 222806 - RNA, 19 nt, Homo sapiens
gcuaucaguccucccagaa

SEQ ID NO: 222807 - RNA, 19 nt, Homo sapiens
cagaggagggagcaauuga

SEQ ID NO: 222808 - RNA, 19 nt, Homo sapiens
aggaagaggcuaccaagga

SEQ ID NO: 222809 - RNA, 19 nt, Homo sapiens
gggaagcuggucauugaug

SEQ ID NO: 222810 - RNA, 19 nt, Homo sapiens
gggugacggugauaagaag

SEQ ID NO: 222811 - RNA, 19 nt, Homo sapiens
gcagagggugacggugaua

SEQ ID NO: 222812 - RNA, 19 nt, Homo sapiens
gcaagcccaacaagaggaa

SEQ ID NO: 222813 - RNA, 19 nt, Homo sapiens
gagagccuguagccaccaa

SEQ ID NO: 222814 - RNA, 19 nt, Homo sapiens
caaggagaagaacgagaaa

SEQ ID NO: 222815 - RNA, 19 nt, Homo sapiens
ucucugaagccacaaauag

SEQ ID NO: 222816 - RNA, 19 nt, Homo sapiens
ucaccagaucugauuugua

SEQ ID NO: 222817 - RNA, 19 nt, Homo sapiens
ugucauuucucauccacau

SEQ ID NO: 222818 - RNA, 19 nt, Homo sapiens
ccaagaggaagaagaagag

SEQ ID NO: 222819 - RNA, 19 nt, Homo sapiens
gagggugacggugauaaga

SEQ ID NO: 222820 - RNA, 19 nt, Homo sapiens
aaagagcuguguggaagag

SEQ ID NO: 222821 - RNA, 19 nt, Homo sapiens
guugucaccagaucugauu

SEQ ID NO: 222822 - RNA, 19 nt, Homo sapiens
caaggccagcuuauaguca

SEQ ID NO: 222823 - RNA, 19 nt, Homo sapiens
uuugggaguuguaguuaau

SEQ ID NO: 222824 - RNA, 19 nt, Homo sapiens
gaggggcuccuuuccauaa

SEQ ID NO: 222825 - RNA, 19 nt, Homo sapiens
ggaaagugggacagcuugu

SEQ ID NO: 222826 - RNA, 19 nt, Homo sapiens
ccuguagccaccaauguuu

SEQ ID NO: 222827 - RNA, 19 nt, Homo sapiens
cuauggagguggaaaagaa

SEQ ID NO: 222828 - RNA, 19 nt, Homo sapiens
uaucaguccucccagaaaa

SEQ ID NO: 222829 - RNA, 19 nt, Homo sapiens
gaggacagagagaaauaag

SEQ ID NO: 222830 - RNA, 19 nt, Homo sapiens
gguugacuuuacccauuug

SEQ ID NO: 222831 - RNA, 19 nt, Homo sapiens
agaacaacccuacugucaa

SEQ ID NO: 222832 - RNA, 19 nt, Homo sapiens
ggacccacgagacggcauu

SEQ ID NO: 222833 - RNA, 19 nt, Homo sapiens
agaagaagaggaggaugaa

SEQ ID NO: 222834 - RNA, 19 nt, Homo sapiens
ucacccagacauaaaggaa

SEQ ID NO: 222835 - RNA, 19 nt, Homo sapiens
auauaucacccagacauaa

SEQ ID NO: 222836 - RNA, 19 nt, Homo sapiens
ccauuugggugggaguguu

SEQ ID NO: 222837 - RNA, 19 nt, Homo sapiens
ugucuucucccuggaauga

SEQ ID NO: 222838 - RNA, 19 nt, Homo sapiens
gagaucaugagagccugua

SEQ ID NO: 222839 - RNA, 19 nt, Homo sapiens
ucaguguugucaccagauc

SEQ ID NO: 222840 - RNA, 19 nt, Homo sapiens
gccuguagccaccaauguu

SEQ ID NO: 222841 - RNA, 19 nt, Homo sapiens
agaaaggagcguugaagag

SEQ ID NO: 222842 - RNA, 19 nt, Homo sapiens
cccuugggcucugaugaaa

SEQ ID NO: 222843 - RNA, 19 nt, Homo sapiens
ugggaguuguaguuaauca

SEQ ID NO: 222844 - RNA, 19 nt, Homo sapiens
aaagugggacagcuuguag

SEQ ID NO: 222845 - RNA, 19 nt, Homo sapiens
cgagaaaggagcguugaag

SEQ ID NO: 222846 - RNA, 19 nt, Homo sapiens
gaagagcggugccaacaua

SEQ ID NO: 222847 - RNA, 19 nt, Homo sapiens
ggagauugcugaagaguau

SEQ ID NO: 222848 - RNA, 19 nt, Homo sapiens
gaaaggaggcgcaaacauu

SEQ ID NO: 222849 - RNA, 19 nt, Homo sapiens
ccaaggaucuaaucauuga

SEQ ID NO: 222850 - RNA, 19 nt, Homo sapiens
ggagagaggcuaaagauug

SEQ ID NO: 222851 - RNA, 19 nt, Homo sapiens
gagagaaacugcaagacuu

SEQ ID NO: 222852 - RNA, 19 nt, Homo sapiens
caaauaccaucccaagauu

SEQ ID NO: 222853 - RNA, 19 nt, Homo sapiens
caagaucacuggcaccaaa

SEQ ID NO: 222854 - RNA, 19 nt, Homo sapiens
gaagaaaucccaacacaag

SEQ ID NO: 222855 - RNA, 19 nt, Homo sapiens
ggugugagaucaaccauga

SEQ ID NO: 222856 - RNA, 19 nt, Homo sapiens
gcaagaugauggaugaguu

SEQ ID NO: 222857 - RNA, 19 nt, Homo sapiens
gagagaggcuaaagauugu

SEQ ID NO: 222858 - RNA, 19 nt, Homo sapiens
gacauucgcuucccacaga

SEQ ID NO: 222859 - RNA, 19 nt, Homo sapiens
caccugagcugcagucuga

SEQ ID NO: 222860 - RNA, 19 nt, Homo sapiens
aaacguccuugacuuuaua

SEQ ID NO: 222861 - RNA, 19 nt, Homo sapiens
caucaaggcuucugucauc

SEQ ID NO: 222862 - RNA, 19 nt, Homo sapiens
ugagaaggcuccugacaug

SEQ ID NO: 222863 - RNA, 19 nt, Homo sapiens
gugaggcgcugcagguaua

SEQ ID NO: 222864 - RNA, 19 nt, Homo sapiens
caccaucgcuuuguuauug

SEQ ID NO: 222865 - RNA, 19 nt, Homo sapiens
gucaugaccucaggaaaua

SEQ ID NO: 222866 - RNA, 19 nt, Homo sapiens
ggagcaggauucugucuau

SEQ ID NO: 222867 - RNA, 19 nt, Homo sapiens
ucccagaggucaucauuaa

SEQ ID NO: 222868 - RNA, 19 nt, Homo sapiens
gggccucgcugcaaauuug

SEQ ID NO: 222869 - RNA, 19 nt, Homo sapiens
caucaucucuggccggaaa

SEQ ID NO: 222870 - RNA, 19 nt, Homo sapiens
gcaggauucugucuauuca

SEQ ID NO: 222871 - RNA, 19 nt, Homo sapiens
aaaggaggcgcaaacauua

SEQ ID NO: 222872 - RNA, 19 nt, Homo sapiens
caacaucgaccacaaguuc

SEQ ID NO: 222873 - RNA, 19 nt, Homo sapiens
gaccuucaccguuacguua

SEQ ID NO: 222874 - RNA, 19 nt, Homo sapiens
agaaagaccuggccaacau

SEQ ID NO: 222875 - RNA, 19 nt, Homo sapiens
uaccaaggaucuaaucauu

SEQ ID NO: 222876 - RNA, 19 nt, Homo sapiens
caacacaaguaugucauug

SEQ ID NO: 222877 - RNA, 19 nt, Homo sapiens
aaagaagacuacaaccauu

SEQ ID NO: 222878 - RNA, 19 nt, Homo sapiens
gaaauaaacguccuugacu

SEQ ID NO: 222879 - RNA, 19 nt, Homo sapiens
gaacuugagcagaugguuu

SEQ ID NO: 222880 - RNA, 19 nt, Homo sapiens
gaaagaccuggccaacaua

SEQ ID NO: 222881 - RNA, 19 nt, Homo sapiens
gcuggaugcugucaugaaa

SEQ ID NO: 222882 - RNA, 19 nt, Homo sapiens
gagaacuggugcucacuug

SEQ ID NO: 222883 - RNA, 19 nt, Homo sapiens
gaagugggauccgcaagau

SEQ ID NO: 222884 - RNA, 19 nt, Homo sapiens
ccuuugaccuucaccguua

SEQ ID NO: 222885 - RNA, 19 nt, Homo sapiens
gaaggacauuguugcuaga

SEQ ID NO: 222886 - RNA, 19 nt, Homo sapiens
acaaggauaugaaccaguu

SEQ ID NO: 222887 - RNA, 19 nt, Homo sapiens
ucagaggaccuaagaauga

SEQ ID NO: 222888 - RNA, 19 nt, Homo sapiens
caaaauacaugcagaagau

SEQ ID NO: 222889 - RNA, 19 nt, Homo sapiens
uagaaggcauggucaaaga

SEQ ID NO: 222890 - RNA, 19 nt, Homo sapiens
gcaucaagaagauuuauga

SEQ ID NO: 222891 - RNA, 19 nt, Homo sapiens
ccaaauaccaucccaagau

SEQ ID NO: 222892 - RNA, 19 nt, Homo sapiens
caacauagccgagguagag

SEQ ID NO: 222893 - RNA, 19 nt, Homo sapiens
gcagauuacucgggauuuc

SEQ ID NO: 222894 - RNA, 19 nt, Homo sapiens
gugaagaaaucccaacaca

SEQ ID NO: 222895 - RNA, 19 nt, Homo sapiens
ucacucagguguuccaugu

SEQ ID NO: 222896 - RNA, 19 nt, Homo sapiens
gcacacagagcgacaaagu

SEQ ID NO: 222897 - RNA, 19 nt, Homo sapiens
gaagaaagcaacaccaaaa

SEQ ID NO: 222898 - RNA, 19 nt, Homo sapiens
ccaaagagggcaucgagaa

SEQ ID NO: 222899 - RNA, 19 nt, Homo sapiens
aaucaaaguugccacucua

SEQ ID NO: 222900 - RNA, 19 nt, Homo sapiens
aaauaaacguccuugacuu

SEQ ID NO: 222901 - RNA, 19 nt, Homo sapiens
gaugcuauacugagaauug

SEQ ID NO: 222902 - RNA, 19 nt, Homo sapiens
gaauaucauugggaaagga

SEQ ID NO: 222903 - RNA, 19 nt, Homo sapiens
gcgcaucccuccugacagu

SEQ ID NO: 222904 - RNA, 19 nt, Homo sapiens
gaaggcauggucaaagauu

SEQ ID NO: 222905 - RNA, 19 nt, Homo sapiens
gaccaaggccucuccauca

SEQ ID NO: 222906 - RNA, 19 nt, Homo sapiens
ucacgggccucgcugcaaa

SEQ ID NO: 222907 - RNA, 19 nt, Homo sapiens
ccaagaguuucacuguuga

SEQ ID NO: 222908 - RNA, 19 nt, Homo sapiens
ggaagcgacaccguuguua

SEQ ID NO: 222909 - RNA, 19 nt, Homo sapiens
gcaauucagagaccauuau

SEQ ID NO: 222910 - RNA, 19 nt, Homo sapiens
caaagagggcaucgagaaa

SEQ ID NO: 222911 - RNA, 19 nt, Homo sapiens
gaacuggugcucacuugga

SEQ ID NO: 222912 - RNA, 19 nt, Homo sapiens
gagagaaaauacaaggaua

SEQ ID NO: 222913 - RNA, 19 nt, Homo sapiens
caaaguugccacucuaaau

SEQ ID NO: 222914 - RNA, 19 nt, Homo sapiens
gaguuucacuguugacauc

SEQ ID NO: 222915 - RNA, 19 nt, Homo sapiens
cugcacaacucccucauug

SEQ ID NO: 222916 - RNA, 19 nt, Homo sapiens
gaucuaaucauugagcaaa

SEQ ID NO: 222917 - RNA, 19 nt, Homo sapiens
cuacagaggaugucaaugu

SEQ ID NO: 222918 - RNA, 19 nt, Homo sapiens
gaaaucccaacacaaguau

SEQ ID NO: 222919 - RNA, 19 nt, Homo sapiens
gaaccaguuuggagaaggu

SEQ ID NO: 222920 - RNA, 19 nt, Homo sapiens
ggaaauaaacguccuugac

SEQ ID NO: 222921 - RNA, 19 nt, Homo sapiens
gagcauucgagcuaagaua

SEQ ID NO: 222922 - RNA, 19 nt, Homo sapiens
gcaaaaucauggacgaauu

SEQ ID NO: 222923 - RNA, 19 nt, Homo sapiens
aaguagaggugcccuuuga

SEQ ID NO: 222924 - RNA, 19 nt, Homo sapiens
gaagauuuaugaggagaag

SEQ ID NO: 222925 - RNA, 19 nt, Homo sapiens
gggcaguaauuacccaaau

SEQ ID NO: 222926 - RNA, 19 nt, Homo sapiens
gaagcgacaccguuguuau

SEQ ID NO: 222927 - RNA, 19 nt, Homo sapiens
gagcaggauucugucuauu

SEQ ID NO: 222928 - RNA, 19 nt, Homo sapiens
gcucagaggaccuaagaau

SEQ ID NO: 222929 - RNA, 19 nt, Homo sapiens
ggaccugcuccacuguuua

SEQ ID NO: 222930 - RNA, 19 nt, Homo sapiens
ggaccaaauuaccaucaca

SEQ ID NO: 222931 - RNA, 19 nt, Homo sapiens
gcaggaggaccgggcuuua

SEQ ID NO: 222932 - RNA, 19 nt, Homo sapiens
caagaugauggaugaguuu

SEQ ID NO: 222933 - RNA, 19 nt, Homo sapiens
ggaagugggauccgcaaga

SEQ ID NO: 222934 - RNA, 19 nt, Homo sapiens
aaaguugccacucuaaauu

SEQ ID NO: 222935 - RNA, 19 nt, Homo sapiens
ucagagaccauuaucauca

SEQ ID NO: 222936 - RNA, 19 nt, Homo sapiens
gauagaaggcauggucaaa

SEQ ID NO: 222937 - RNA, 19 nt, Homo sapiens
agaaaucccaacacaagua

SEQ ID NO: 222938 - RNA, 19 nt, Homo sapiens
aaaccaaggucaugagcau

SEQ ID NO: 222939 - RNA, 19 nt, Homo sapiens
gaccugcuccacuguuuaa

SEQ ID NO: 222940 - RNA, 19 nt, Homo sapiens
gaacauccaguuuccugau

SEQ ID NO: 222941 - RNA, 19 nt, Homo sapiens
guuccgaucuucaaacagu

SEQ ID NO: 222942 - RNA, 19 nt, Homo sapiens
cggcaaagccauucgcaaa

SEQ ID NO: 222943 - RNA, 19 nt, Homo sapiens
aagcucaggugacauuaga

SEQ ID NO: 222944 - RNA, 19 nt, Homo sapiens
uggauaaugugguggaaga

SEQ ID NO: 222945 - RNA, 19 nt, Homo sapiens
ggagggcccuacagaggau

SEQ ID NO: 222946 - RNA, 19 nt, Homo sapiens
gaacaaagaaguauccaua

SEQ ID NO: 222947 - RNA, 19 nt, Homo sapiens
gagagaaggucauuaguga

SEQ ID NO: 222948 - RNA, 19 nt, Homo sapiens
gaacuuuggucauugcuaa

SEQ ID NO: 222949 - RNA, 19 nt, Homo sapiens
uaagaucgaugaagaauug

SEQ ID NO: 222950 - RNA, 19 nt, Homo sapiens
ggaguuagcucgcggcauu

SEQ ID NO: 222951 - RNA, 19 nt, Homo sapiens
ggauagaugucauagaauu

SEQ ID NO: 222952 - RNA, 19 nt, Homo sapiens
agaaagagcuguuguggaa

SEQ ID NO: 222953 - RNA, 19 nt, Homo sapiens
gaaaugggauuggguaaga

SEQ ID NO: 222954 - RNA, 19 nt, Homo sapiens
ggacacaggauuaagaaua

SEQ ID NO: 222955 - RNA, 19 nt, Homo sapiens
gaacagaauguauugcaua

SEQ ID NO: 222956 - RNA, 19 nt, Homo sapiens
gaauaucccuguagaaucu

SEQ ID NO: 222957 - RNA, 19 nt, Homo sapiens
caggauagaugucauagaa

SEQ ID NO: 222958 - RNA, 19 nt, Homo sapiens
caaagccaguuguuguuua

SEQ ID NO: 222959 - RNA, 19 nt, Homo sapiens
guaaucacgucauuugaaa

SEQ ID NO: 222960 - RNA, 19 nt, Homo sapiens
gagaaggucauuagugaua

SEQ ID NO: 222961 - RNA, 19 nt, Homo sapiens
gaacagaagaagaaagaaa

SEQ ID NO: 222962 - RNA, 19 nt, Homo sapiens
ugauaaagaucuagaguug

SEQ ID NO: 222963 - RNA, 19 nt, Homo sapiens
caaauacuaucgaucagaa

SEQ ID NO: 222964 - RNA, 19 nt, Homo sapiens
gaagagaagccaguuauga

SEQ ID NO: 222965 - RNA, 19 nt, Homo sapiens
gauagagagucgacagaaa

SEQ ID NO: 222966 - RNA, 19 nt, Homo sapiens
gcagauucauccuguggua

SEQ ID NO: 222967 - RNA, 19 nt, Homo sapiens
ugaaacugcugaagauauu

SEQ ID NO: 222968 - RNA, 19 nt, Homo sapiens
uaucagaacuuuggucauu

SEQ ID NO: 222969 - RNA, 19 nt, Homo sapiens
ggaagugaauaucccugua

SEQ ID NO: 222970 - RNA, 19 nt, Homo sapiens
gacacaggauuaagaauau

SEQ ID NO: 222971 - RNA, 19 nt, Homo sapiens
gaugaaggacacaggauua

SEQ ID NO: 222972 - RNA, 19 nt, Homo sapiens
gaaggucauuagugauaaa

SEQ ID NO: 222973 - RNA, 19 nt, Homo sapiens
agauaucccuacaauguua

SEQ ID NO: 222974 - RNA, 19 nt, Homo sapiens
gaaggacacaggauuaaga

SEQ ID NO: 222975 - RNA, 19 nt, Homo sapiens
ccagauaucccuacaaugu

SEQ ID NO: 222976 - RNA, 19 nt, Homo sapiens
uagaugauuucccuaauga

SEQ ID NO: 222977 - RNA, 19 nt, Homo sapiens
aauaugaagugccgucuaa

SEQ ID NO: 222978 - RNA, 19 nt, Homo sapiens
guguuuaucuucuuaguga

SEQ ID NO: 222979 - RNA, 19 nt, Homo sapiens
gaaagagaacagaauguau

SEQ ID NO: 222980 - RNA, 19 nt, Homo sapiens
ugaguaguauucuuggaua

SEQ ID NO: 222981 - RNA, 19 nt, Homo sapiens
gaaauucgguaccguagac

SEQ ID NO: 222982 - RNA, 19 nt, Homo sapiens
gcucgcaugucuugggaua

SEQ ID NO: 222983 - RNA, 19 nt, Homo sapiens
uuucagaggucaugucaaa

SEQ ID NO: 222984 - RNA, 19 nt, Homo sapiens
uaccaugcguacuuaaaua

SEQ ID NO: 222985 - RNA, 19 nt, Homo sapiens
gaaaacuccuccucuacua

SEQ ID NO: 222986 - RNA, 19 nt, Homo sapiens
gcugauaacaaacuucuuu

SEQ ID NO: 222987 - RNA, 19 nt, Homo sapiens
gaucuagaguuguuguuag

SEQ ID NO: 222988 - RNA, 19 nt, Homo sapiens
cuggauggcugaauucaaa

SEQ ID NO: 222989 - RNA, 19 nt, Homo sapiens
gaugaagaauugguaacaa

SEQ ID NO: 222990 - RNA, 19 nt, Homo sapiens
acaauugaguuaaguccua

SEQ ID NO: 222991 - RNA, 19 nt, Homo sapiens
cuuaaccacuuccagauuu

SEQ ID NO: 222992 - RNA, 19 nt, Homo sapiens
ggucauuagugauaaagau

SEQ ID NO: 222993 - RNA, 19 nt, Homo sapiens
caagagagaaggucauuag

SEQ ID NO: 222994 - RNA, 19 nt, Homo sapiens
uaaugaugcuacuucguaa

SEQ ID NO: 222995 - RNA, 19 nt, Homo sapiens
ugauuucccuaaugaauug

SEQ ID NO: 222996 - RNA, 19 nt, Homo sapiens
ggaaaaggcucgcaugucu

SEQ ID NO: 222997 - RNA, 19 nt, Homo sapiens
gaugcuacuucguaaaugu

SEQ ID NO: 222998 - RNA, 19 nt, Homo sapiens
ggauuaagaauaugaagug

SEQ ID NO: 222999 - RNA, 19 nt, Homo sapiens
caccagauaucccuacaau

SEQ ID NO: 223000 - RNA, 19 nt, Homo sapiens
cuaacuggauggcugaauu

SEQ ID NO: 223001 - RNA, 19 nt, Homo sapiens
ucugggaaguucuugauuu

SEQ ID NO: 223002 - RNA, 19 nt, Homo sapiens
gaaggcauggaauggcuua

SEQ ID NO: 223003 - RNA, 19 nt, Homo sapiens
gaggagugaugcgauggua

SEQ ID NO: 223004 - RNA, 19 nt, Homo sapiens
gaaacgguuaggcagaaua

SEQ ID NO: 223005 - RNA, 19 nt, Homo sapiens
gaugaaaacuccuccucua

SEQ ID NO: 223006 - RNA, 19 nt, Homo sapiens
uuaaccacuuccagauuua

SEQ ID NO: 223007 - RNA, 19 nt, Homo sapiens
gauguguacuuaaccacuu

SEQ ID NO: 223008 - RNA, 19 nt, Homo sapiens
aaguggagcucaagaauag

SEQ ID NO: 223009 - RNA, 19 nt, Homo sapiens
ugauguugcucuugaaguu

SEQ ID NO: 223010 - RNA, 19 nt, Homo sapiens
ugacaucacuagucuuucu

SEQ ID NO: 223011 - RNA, 19 nt, Homo sapiens
gguaaucacgucauuugaa

SEQ ID NO: 223012 - RNA, 19 nt, Homo sapiens
cagcaaauacuaucgauca

SEQ ID NO: 223013 - RNA, 19 nt, Homo sapiens
uauagacccuguuacacaa

SEQ ID NO: 223014 - RNA, 19 nt, Homo sapiens
gagaaguagucguuuaugc

SEQ ID NO: 223015 - RNA, 19 nt, Homo sapiens
cagaauguauugcauaugc

SEQ ID NO: 223016 - RNA, 19 nt, Homo sapiens
agagguguuuaucuucuua

SEQ ID NO: 223017 - RNA, 19 nt, Homo sapiens
uaagacaguucagugcauu

SEQ ID NO: 223018 - RNA, 19 nt, Homo sapiens
uaacaaauucugggaaguu

SEQ ID NO: 223019 - RNA, 19 nt, Homo sapiens
gaaacugcugaagauauua

SEQ ID NO: 223020 - RNA, 19 nt, Homo sapiens
ccaaguagaaggcauggaa

SEQ ID NO: 223021 - RNA, 19 nt, Homo sapiens
aaaguggagcucaagaaua

SEQ ID NO: 223022 - RNA, 19 nt, Homo sapiens
gcugguggccugggcauua

SEQ ID NO: 223023 - RNA, 19 nt, Homo sapiens
gaucgaugaagaauuggua

SEQ ID NO: 223024 - RNA, 19 nt, Homo sapiens
gaagucugauguugcucuu

SEQ ID NO: 223025 - RNA, 19 nt, Homo sapiens
agaaagagaacagaaugua

SEQ ID NO: 223026 - RNA, 19 nt, Homo sapiens
ccuacaauguuauaucaug

SEQ ID NO: 223027 - RNA, 19 nt, Homo sapiens
aauggaacagcaacaauua

SEQ ID NO: 223028 - RNA, 19 nt, Homo sapiens
ccuguagaaucugaaguua

SEQ ID NO: 223029 - RNA, 19 nt, Homo sapiens
gaugauuucccuaaugaau

SEQ ID NO: 223030 - RNA, 19 nt, Homo sapiens
guaagacaguucagugcau

SEQ ID NO: 223031 - RNA, 19 nt, Homo sapiens
ccuaaggaauuaauggaau

SEQ ID NO: 223032 - RNA, 19 nt, Homo sapiens
gcaaauacuaucgaucaga

SEQ ID NO: 223033 - RNA, 19 nt, Homo sapiens
gauugaauauccuauagac

SEQ ID NO: 223034 - RNA, 19 nt, Homo sapiens
cuucguaaauguuguaauc

SEQ ID NO: 223035 - RNA, 19 nt, Homo sapiens
ugaaguuccuccuaaacga

SEQ ID NO: 223036 - RNA, 19 nt, Homo sapiens
uagaggaacagaagaagaa

SEQ ID NO: 223037 - RNA, 19 nt, Homo sapiens
gguggucagucuggauuaa

SEQ ID NO: 223038 - RNA, 19 nt, Homo sapiens
aaagccaguuguuguuuau

SEQ ID NO: 223039 - RNA, 19 nt, Homo sapiens
gaagugaauaucccuguag

SEQ ID NO: 223040 - RNA, 19 nt, Homo sapiens
aaagagcuguuguggaagu

SEQ ID NO: 223041 - RNA, 19 nt, Homo sapiens
cuagugauuucccuguauu

SEQ ID NO: 223042 - RNA, 19 nt, Homo sapiens
gcucaagaauagcuuuuaa

SEQ ID NO: 223043 - RNA, 19 nt, Homo sapiens
caggaccaauuaaagagaa

SEQ ID NO: 223044 - RNA, 19 nt, Homo sapiens
auaaugaugcuacuucgua

SEQ ID NO: 223045 - RNA, 19 nt, Homo sapiens
gagcuguuguggaagugaa

SEQ ID NO: 223046 - RNA, 19 nt, Homo sapiens
caagaaauuucccaacaua

SEQ ID NO: 223047 - RNA, 19 nt, Homo sapiens
ggaggaaucugccauguug

SEQ ID NO: 223048 - RNA, 19 nt, Homo sapiens
gagcagaucuguggaagaa

SEQ ID NO: 223049 - RNA, 19 nt, Homo sapiens
ugaagaagcugacagaaga

SEQ ID NO: 223050 - RNA, 19 nt, Homo sapiens
gaaaggguauggcaagaga

SEQ ID NO: 223051 - RNA, 19 nt, Homo sapiens
ggaguaacguacaaguaua

SEQ ID NO: 223052 - RNA, 19 nt, Homo sapiens
gcgagcagcuucuaccuaa

SEQ ID NO: 223053 - RNA, 19 nt, Homo sapiens
ggaaccaucucucaaguau

SEQ ID NO: 223054 - RNA, 19 nt, Homo sapiens
ggacauacuuguucagauc

SEQ ID NO: 223055 - RNA, 19 nt, Homo sapiens
gagaagauguuugccauga

SEQ ID NO: 223056 - RNA, 19 nt, Homo sapiens
aaacucaccucaaggaauu

SEQ ID NO: 223057 - RNA, 19 nt, Homo sapiens
gaacuggcacugacaauga

SEQ ID NO: 223058 - RNA, 19 nt, Homo sapiens
ugaaggagcuggagacugu

SEQ ID NO: 223059 - RNA, 19 nt, Homo sapiens
ggaguuaccuggacuugau

SEQ ID NO: 223060 - RNA, 19 nt, Homo sapiens
aaacagcacgcaacauuua

SEQ ID NO: 223061 - RNA, 19 nt, Homo sapiens
gcaugaaguuccugaguga

SEQ ID NO: 223062 - RNA, 19 nt, Homo sapiens
ucaaagugauacagcaaua

SEQ ID NO: 223063 - RNA, 19 nt, Homo sapiens
gagcaaggaacauguaauu

SEQ ID NO: 223064 - RNA, 19 nt, Homo sapiens
cuucugaucugucuacuuu

SEQ ID NO: 223065 - RNA, 19 nt, Homo sapiens
caaacaaguugauaaugga

SEQ ID NO: 223066 - RNA, 19 nt, Homo sapiens
gagcauggaggacagcuua

SEQ ID NO: 223067 - RNA, 19 nt, Homo sapiens
gaagagcccuuuggaccuu

SEQ ID NO: 223068 - RNA, 19 nt, Homo sapiens
caugugaccucucagauug

SEQ ID NO: 223069 - RNA, 19 nt, Homo sapiens
gaaacagcacgcaacauuu

SEQ ID NO: 223070 - RNA, 19 nt, Homo sapiens
gcauugagaaggaugguua

SEQ ID NO: 223071 - RNA, 19 nt, Homo sapiens
gaagaucggcggauacuca

SEQ ID NO: 223072 - RNA, 19 nt, Homo sapiens
ccacugcacucaugagaug

SEQ ID NO: 223073 - RNA, 19 nt, Homo sapiens
caagagaguggcagacaua

SEQ ID NO: 223074 - RNA, 19 nt, Homo sapiens
gcagaucuguggaagaaca

SEQ ID NO: 223075 - RNA, 19 nt, Homo sapiens
ggaguucucugacaucucu

SEQ ID NO: 223076 - RNA, 19 nt, Homo sapiens
gaacuucucaacaccauug

SEQ ID NO: 223077 - RNA, 19 nt, Homo sapiens
cgaaacagcacgcaacauu

SEQ ID NO: 223078 - RNA, 19 nt, Homo sapiens
gaggacagcuuauggaaaa

SEQ ID NO: 223079 - RNA, 19 nt, Homo sapiens
acaagaacauugaaacuca

SEQ ID NO: 223080 - RNA, 19 nt, Homo sapiens
gcaaagccaagaacaagaa

SEQ ID NO: 223081 - RNA, 19 nt, Homo sapiens
gaagcucacuauccugaau

SEQ ID NO: 223082 - RNA, 19 nt, Homo sapiens
ucaccacacucuacacaaa

SEQ ID NO: 223083 - RNA, 19 nt, Homo sapiens
gauugaggcuggacugguu

SEQ ID NO: 223084 - RNA, 19 nt, Homo sapiens
caaagacaccugaggacua

SEQ ID NO: 223085 - RNA, 19 nt, Homo sapiens
gaagcugacagaagaguuu

SEQ ID NO: 223086 - RNA, 19 nt, Homo sapiens
uaccuggacuugauuguaa

SEQ ID NO: 223087 - RNA, 19 nt, Homo sapiens
aaccaucucucaaguauau

SEQ ID NO: 223088 - RNA, 19 nt, Homo sapiens
ggaaacuucugaucugucu

SEQ ID NO: 223089 - RNA, 19 nt, Homo sapiens
gauugaagaucggcggaua

SEQ ID NO: 223090 - RNA, 19 nt, Homo sapiens
gcagaugcuuccagaguca

SEQ ID NO: 223091 - RNA, 19 nt, Homo sapiens
gcaauugcguccuggagau

SEQ ID NO: 223092 - RNA, 19 nt, Homo sapiens
gcaugagaacccugacuua

SEQ ID NO: 223093 - RNA, 19 nt, Homo sapiens
ucagugacaucauucagaa

SEQ ID NO: 223094 - RNA, 19 nt, Homo sapiens
cagcauaaauuagcagaga

SEQ ID NO: 223095 - RNA, 19 nt, Homo sapiens
gaggaggaguccaucauca

SEQ ID NO: 223096 - RNA, 19 nt, Homo sapiens
caaggaacauguaauugca

SEQ ID NO: 223097 - RNA, 19 nt, Homo sapiens
gaaacucaccucaaggaau

SEQ ID NO: 223098 - RNA, 19 nt, Homo sapiens
gaaggaugguuacaacaac

SEQ ID NO: 223099 - RNA, 19 nt, Homo sapiens
aaucugccauguugcguua

SEQ ID NO: 223100 - RNA, 19 nt, Homo sapiens
aaagacaccugaggacuau

SEQ ID NO: 223101 - RNA, 19 nt, Homo sapiens
ggagagcaaggaacaugua

SEQ ID NO: 223102 - RNA, 19 nt, Homo sapiens
cagauacaauggccuguga

SEQ ID NO: 223103 - RNA, 19 nt, Homo sapiens
gaaauuucccaacauagau

SEQ ID NO: 223104 - RNA, 19 nt, Homo sapiens
uuagauuccucaccaacua

SEQ ID NO: 223105 - RNA, 19 nt, Homo sapiens
uggaagcuguggucacuuu

SEQ ID NO: 223106 - RNA, 19 nt, Homo sapiens
ggugugggcugugacauug

SEQ ID NO: 223107 - RNA, 19 nt, Homo sapiens
gguggaaacuucugaucug

SEQ ID NO: 223108 - RNA, 19 nt, Homo sapiens
gaacauguaauugcaaaca

SEQ ID NO: 223109 - RNA, 19 nt, Homo sapiens
gcaugugaccucucagauu

SEQ ID NO: 223110 - RNA, 19 nt, Homo sapiens
gcaagagaguggcagacau

SEQ ID NO: 223111 - RNA, 19 nt, Homo sapiens
gaggaccuguuuagcaguu

SEQ ID NO: 223112 - RNA, 19 nt, Homo sapiens
uggacuugauuguaacuua

SEQ ID NO: 223113 - RNA, 19 nt, Homo sapiens
gaaagcugauacuucaucu

SEQ ID NO: 223114 - RNA, 19 nt, Homo sapiens
uggcaggagucaaagcaua

SEQ ID NO: 223115 - RNA, 19 nt, Homo sapiens
cgaagacacaucaaaguga

SEQ ID NO: 223116 - RNA, 19 nt, Homo sapiens
guucucauccguauguaua

SEQ ID NO: 223117 - RNA, 19 nt, Homo sapiens
caacuacuaccagucauuu

SEQ ID NO: 223118 - RNA, 19 nt, Homo sapiens
ccaggagacugacaagcuu

SEQ ID NO: 223119 - RNA, 19 nt, Homo sapiens
cggaagaaccgcagcauug

SEQ ID NO: 223120 - RNA, 19 nt, Homo sapiens
gagaguggcagacauaaag

SEQ ID NO: 223121 - RNA, 19 nt, Homo sapiens
guaucugucuguggaagua

SEQ ID NO: 223122 - RNA, 19 nt, Homo sapiens
ccacugacccuucuuccuu

SEQ ID NO: 223123 - RNA, 19 nt, Homo sapiens
uuacuucugucacggauug

SEQ ID NO: 223124 - RNA, 19 nt, Homo sapiens
ugacaucauucagaacuug

SEQ ID NO: 223125 - RNA, 19 nt, Homo sapiens
gcgcagugcccaacuucua

SEQ ID NO: 223126 - RNA, 19 nt, Homo sapiens
aagccgagauaauuagauu

SEQ ID NO: 223127 - RNA, 19 nt, Homo sapiens
ucuccgaccuucaucacua

SEQ ID NO: 223128 - RNA, 19 nt, Homo sapiens
ccuaaacccuugccauagu

SEQ ID NO: 223129 - RNA, 19 nt, Homo sapiens
ggagucaaagcauacauug

SEQ ID NO: 223130 - RNA, 19 nt, Homo sapiens
cauacuaucuucccuucug

SEQ ID NO: 223131 - RNA, 19 nt, Homo sapiens
ccaaaucuaagccaccuuu

SEQ ID NO: 223132 - RNA, 19 nt, Homo sapiens
gaucggcggauacucauug

SEQ ID NO: 223133 - RNA, 19 nt, Homo sapiens
ggaggacagcuuauggaaa

SEQ ID NO: 223134 - RNA, 19 nt, Homo sapiens
gaaccaucucucaaguaua

SEQ ID NO: 223135 - RNA, 19 nt, Homo sapiens
uauaugaacuucucaacac

SEQ ID NO: 223136 - RNA, 19 nt, Homo sapiens
ggaauuucgggaucaugua

SEQ ID NO: 223137 - RNA, 19 nt, Homo sapiens
ucucgggccuuccaccuaa

SEQ ID NO: 223138 - RNA, 19 nt, Homo sapiens
ugagaaggaugguuacaac

SEQ ID NO: 223139 - RNA, 19 nt, Homo sapiens
cuaaagcgcaugaccauca

SEQ ID NO: 223140 - RNA, 19 nt, Homo sapiens
uggacaagcuacaccuaaa

SEQ ID NO: 223141 - RNA, 19 nt, Homo sapiens
ggaagaaccgcagcauugu

SEQ ID NO: 223142 - RNA, 19 nt, Homo sapiens
uagcagagaagcucacuau

SEQ ID NO: 223143 - RNA, 19 nt, Homo sapiens
uaaaggagagcaaggaaca

SEQ ID NO: 223144 - RNA, 19 nt, Homo sapiens
uacaauggccugugaguau

SEQ ID NO: 223145 - RNA, 19 nt, Homo sapiens
caucacuauucuuaggaua

SEQ ID NO: 223146 - RNA, 19 nt, Homo sapiens
ugaaggaggucauugaaua

SEQ ID NO: 223147 - RNA, 19 nt, Homo sapiens
ucacuucacuucugcauua

SEQ ID NO: 223148 - RNA, 19 nt, Homo sapiens
guaaccagcuuccuacuuu

SEQ ID NO: 223149 - RNA, 19 nt, Homo sapiens
ggcaggagguguuugauaa

SEQ ID NO: 223150 - RNA, 19 nt, Homo sapiens
aaacauggauuaccugugu

SEQ ID NO: 223151 - RNA, 19 nt, Homo sapiens
ggagguguuugauaauaaa

SEQ ID NO: 223152 - RNA, 19 nt, Homo sapiens
gaaaggcuguggagcaaca

SEQ ID NO: 223153 - RNA, 19 nt, Homo sapiens
gcacauucuuuaucaacaa

SEQ ID NO: 223154 - RNA, 19 nt, Homo sapiens
uggagucaguggagaauua

SEQ ID NO: 223155 - RNA, 19 nt, Homo sapiens
gcugagggcacauucuuua

SEQ ID NO: 223156 - RNA, 19 nt, Homo sapiens
caggagguguuugauaaua

SEQ ID NO: 223157 - RNA, 19 nt, Homo sapiens
ggauacaucucgccauuac

SEQ ID NO: 223158 - RNA, 19 nt, Homo sapiens
gagggcacauucuuuauca

SEQ ID NO: 223159 - RNA, 19 nt, Homo sapiens
uaaaugaugaccaguguuu

SEQ ID NO: 223160 - RNA, 19 nt, Homo sapiens
ggcauacacuggagaagaa

SEQ ID NO: 223161 - RNA, 19 nt, Homo sapiens
ccagacaccugcccuaauc

SEQ ID NO: 223162 - RNA, 19 nt, Homo sapiens
aaugaaaccuauagccuuu

SEQ ID NO: 223163 - RNA, 19 nt, Homo sapiens
ggagaagaauguguugguu

SEQ ID NO: 223164 - RNA, 19 nt, Homo sapiens
ggacaucgucucuucuuau

SEQ ID NO: 223165 - RNA, 19 nt, Homo sapiens
ucaagcagcuggaguccuu

SEQ ID NO: 223166 - RNA, 19 nt, Homo sapiens
gaggagaugagguugauuu

SEQ ID NO: 223167 - RNA, 19 nt, Homo sapiens
caugagcacauucuucuua

SEQ ID NO: 223168 - RNA, 19 nt, Homo sapiens
gagaauauguggacaacac

SEQ ID NO: 223169 - RNA, 19 nt, Homo sapiens
uuccagagcucaugagaaa

SEQ ID NO: 223170 - RNA, 19 nt, Homo sapiens
agacugagauugaggacuu

SEQ ID NO: 223171 - RNA, 19 nt, Homo sapiens
cauaugagagcuucacuuu

SEQ ID NO: 223172 - RNA, 19 nt, Homo sapiens
gagcaggaguuugaacaga

SEQ ID NO: 223173 - RNA, 19 nt, Homo sapiens
gaccagcgcuacguccuuu

SEQ ID NO: 223174 - RNA, 19 nt, Homo sapiens
gcuauucuccuuuggguuu

SEQ ID NO: 223175 - RNA, 19 nt, Homo sapiens
caacaagacugagauugag

SEQ ID NO: 223176 - RNA, 19 nt, Homo sapiens
gacaucgucucuucuuaug

SEQ ID NO: 223177 - RNA, 19 nt, Homo sapiens
cauaaaugaugaccagugu

SEQ ID NO: 223178 - RNA, 19 nt, Homo sapiens
uggauuaccuguguuuaaa

SEQ ID NO: 223179 - RNA, 19 nt, Homo sapiens
gagaugagguugauuucac

SEQ ID NO: 223180 - RNA, 19 nt, Homo sapiens
gugaauggcguuaggguaa

SEQ ID NO: 223181 - RNA, 19 nt, Homo sapiens
ccagagauccaggacuuua

SEQ ID NO: 223182 - RNA, 19 nt, Homo sapiens
caucugaccugacauuugc

SEQ ID NO: 223183 - RNA, 19 nt, Homo sapiens
gauccuuccuucccauaug

SEQ ID NO: 223184 - RNA, 19 nt, Homo sapiens
ggauguaaccagcuuccua

SEQ ID NO: 223185 - RNA, 19 nt, Homo sapiens
agaagaauguguugguugu

SEQ ID NO: 223186 - RNA, 19 nt, Homo sapiens
cuagagcuauucuccuuug

SEQ ID NO: 223187 - RNA, 19 nt, Homo sapiens
gaugucauggcguacaaua

SEQ ID NO: 223188 - RNA, 19 nt, Homo sapiens
guugagggcugggaaugaa

SEQ ID NO: 223189 - RNA, 19 nt, Homo sapiens
guugacaucugaccugaca

SEQ ID NO: 223190 - RNA, 19 nt, Homo sapiens
ccugguaccugaaccguau

SEQ ID NO: 223191 - RNA, 19 nt, Homo sapiens
gauuucaccugcuggaagu

SEQ ID NO: 223192 - RNA, 19 nt, Homo sapiens
uaugagagcuucacuuuuc

SEQ ID NO: 223193 - RNA, 19 nt, Homo sapiens
ugucauggcguacaauaaa

SEQ ID NO: 223194 - RNA, 19 nt, Homo sapiens
uuagccagcuuguuuggaa

SEQ ID NO: 223195 - RNA, 19 nt, Homo sapiens
gaauuauacccugaccaua

SEQ ID NO: 223196 - RNA, 19 nt, Homo sapiens
ggugcuggcuguaggugaa

SEQ ID NO: 223197 - RNA, 19 nt, Homo sapiens
caauaauaccuaugaguuc

SEQ ID NO: 223198 - RNA, 19 nt, Homo sapiens
cuucacuucugcauuauau

SEQ ID NO: 223199 - RNA, 19 nt, Homo sapiens
aggagguguuugauaauaa

SEQ ID NO: 223200 - RNA, 19 nt, Homo sapiens
cgcauucaauaaagaguaa

SEQ ID NO: 223201 - RNA, 19 nt, Homo sapiens
ccucagaacuuccaaaccu

SEQ ID NO: 223202 - RNA, 19 nt, Homo sapiens
agaaggcucuggugauugg

SEQ ID NO: 223203 - RNA, 19 nt, Homo sapiens
gaaggaggucauugaauac

SEQ ID NO: 223204 - RNA, 19 nt, Homo sapiens
uaaccagcuuccuacuuug

SEQ ID NO: 223205 - RNA, 19 nt, Homo sapiens
gaccugacauuugccuaug

SEQ ID NO: 223206 - RNA, 19 nt, Homo sapiens
ccgaaaggcuguggagcaa

SEQ ID NO: 223207 - RNA, 19 nt, Homo sapiens
ugaaaccuauagccuuugu

SEQ ID NO: 223208 - RNA, 19 nt, Homo sapiens
gcgcucgcauucaauaaag

SEQ ID NO: 223209 - RNA, 19 nt, Homo sapiens
ugacaucugaccugacauu

SEQ ID NO: 223210 - RNA, 19 nt, Homo sapiens
ggcccugacuggaaggauu

SEQ ID NO: 223211 - RNA, 19 nt, Homo sapiens
gguugucucuguagucaca

SEQ ID NO: 223212 - RNA, 19 nt, Homo sapiens
uggacaucgucucuucuua

SEQ ID NO: 223213 - RNA, 19 nt, Homo sapiens
gggcugggaaugaaaccua

SEQ ID NO: 223214 - RNA, 19 nt, Homo sapiens
guaaagauucagccagaca

SEQ ID NO: 223215 - RNA, 19 nt, Homo sapiens
gcaggagguguuugauaau

SEQ ID NO: 223216 - RNA, 19 nt, Homo sapiens
ccgaacaacuuucaauucc

SEQ ID NO: 223217 - RNA, 19 nt, Homo sapiens
ugagcccucuggcaccuuu

SEQ ID NO: 223218 - RNA, 19 nt, Homo sapiens
uuggauacaucucgccauu

SEQ ID NO: 223219 - RNA, 19 nt, Homo sapiens
ucugugagcaggaguuuga

SEQ ID NO: 223220 - RNA, 19 nt, Homo sapiens
ccugacauuugccuaugaa

SEQ ID NO: 223221 - RNA, 19 nt, Homo sapiens
gggagaauauguggacaac

SEQ ID NO: 223222 - RNA, 19 nt, Homo sapiens
acccagagauccaggacuu

SEQ ID NO: 223223 - RNA, 19 nt, Homo sapiens
gaaguccaacccagagauc

SEQ ID NO: 223224 - RNA, 19 nt, Homo sapiens
cccuagagcuauucuccuu

SEQ ID NO: 223225 - RNA, 19 nt, Homo sapiens
ucagccagacacaaucaua

SEQ ID NO: 223226 - RNA, 19 nt, Homo sapiens
gagauccaggacuuuauga

SEQ ID NO: 223227 - RNA, 19 nt, Homo sapiens
ggagaugagguugauuuca

SEQ ID NO: 223228 - RNA, 19 nt, Homo sapiens
gcccuggccucagaacuuc

SEQ ID NO: 223229 - RNA, 19 nt, Homo sapiens
cgaacaacuuucaauucca

SEQ ID NO: 223230 - RNA, 19 nt, Homo sapiens
ggaaguccaacccagagau

SEQ ID NO: 223231 - RNA, 19 nt, Homo sapiens
gucauggcguacaauaaau

SEQ ID NO: 223232 - RNA, 19 nt, Homo sapiens
uguguugguugucucugua

SEQ ID NO: 223233 - RNA, 19 nt, Homo sapiens
ggcacauucuuuaucaaca

SEQ ID NO: 223234 - RNA, 19 nt, Homo sapiens
guagucacaccuggaugua

SEQ ID NO: 223235 - RNA, 19 nt, Homo sapiens
ccugaggucuuuuaaguug

SEQ ID NO: 223236 - RNA, 19 nt, Homo sapiens
uggcaggagguguuugaua

SEQ ID NO: 223237 - RNA, 19 nt, Homo sapiens
acacuuccgcugugaguug

SEQ ID NO: 223238 - RNA, 19 nt, Homo sapiens
ccugaaccguauauccuau

SEQ ID NO: 223239 - RNA, 19 nt, Homo sapiens
cagcuggaguccuucuaca

SEQ ID NO: 223240 - RNA, 19 nt, Homo sapiens
ugagcacauucuucuuaga

SEQ ID NO: 223241 - RNA, 19 nt, Homo sapiens
gcgcuaucgugaccugcuu

SEQ ID NO: 223242 - RNA, 19 nt, Homo sapiens
ccuaugaacguuugucaca

SEQ ID NO: 223243 - RNA, 19 nt, Homo sapiens
gcccugacuggaaggauuu

SEQ ID NO: 223244 - RNA, 19 nt, Homo sapiens
ggagucaguggagaauuau

SEQ ID NO: 223245 - RNA, 19 nt, Homo sapiens
gcuggaguccuucuacauc

SEQ ID NO: 223246 - RNA, 19 nt, Homo sapiens
gagaugaaguggaauuuaa

SEQ ID NO: 223247 - RNA, 19 nt, Homo sapiens
uaaccucacuccaagauua

SEQ ID NO: 223248 - RNA, 19 nt, Homo sapiens
gauugaauaugccagauua

SEQ ID NO: 223249 - RNA, 19 nt, Homo sapiens
gacauuaucugccaguuaa

SEQ ID NO: 223250 - RNA, 19 nt, Homo sapiens
gcaucuggcuucccuguaa

SEQ ID NO: 223251 - RNA, 19 nt, Homo sapiens
ccagaucaauucauucauu

SEQ ID NO: 223252 - RNA, 19 nt, Homo sapiens
gggaggagaugaaguggaa

SEQ ID NO: 223253 - RNA, 19 nt, Homo sapiens
ccaaagaugucagagauau

SEQ ID NO: 223254 - RNA, 19 nt, Homo sapiens
ggacaagauuggaggaaau

SEQ ID NO: 223255 - RNA, 19 nt, Homo sapiens
acauacagcuuccuuacua

SEQ ID NO: 223256 - RNA, 19 nt, Homo sapiens
gaacuuucaccaucaauga

SEQ ID NO: 223257 - RNA, 19 nt, Homo sapiens
gcacaauaguugaaguaug

SEQ ID NO: 223258 - RNA, 19 nt, Homo sapiens
ccaguuaguuuaucaagau

SEQ ID NO: 223259 - RNA, 19 nt, Homo sapiens
gaggaaauacuauaaagug

SEQ ID NO: 223260 - RNA, 19 nt, Homo sapiens
ucaugaaccugcugaauuc

SEQ ID NO: 223261 - RNA, 19 nt, Homo sapiens
ggauauuauugcaaccaua

SEQ ID NO: 223262 - RNA, 19 nt, Homo sapiens
ggagaugaaguggaauuua

SEQ ID NO: 223263 - RNA, 19 nt, Homo sapiens
cagaugagucuuauacuuu

SEQ ID NO: 223264 - RNA, 19 nt, Homo sapiens
uggagaagcuugucuaugg

SEQ ID NO: 223265 - RNA, 19 nt, Homo sapiens
gcaacuaaccucacuccaa

SEQ ID NO: 223266 - RNA, 19 nt, Homo sapiens
cacaauaguugaaguaugg

SEQ ID NO: 223267 - RNA, 19 nt, Homo sapiens
ucagaugagucuuauacuu

SEQ ID NO: 223268 - RNA, 19 nt, Homo sapiens
ugaccagucuuucccauau

SEQ ID NO: 223269 - RNA, 19 nt, Homo sapiens
ggaagcguuucgacgauau

SEQ ID NO: 223270 - RNA, 19 nt, Homo sapiens
gauuagcuauggacaagau

SEQ ID NO: 223271 - RNA, 19 nt, Homo sapiens
uauaaacccuacucugaau

SEQ ID NO: 223272 - RNA, 19 nt, Homo sapiens
ggaugacgccuaugacaga

SEQ ID NO: 223273 - RNA, 19 nt, Homo sapiens
gauggucgaacguggaaua

SEQ ID NO: 223274 - RNA, 19 nt, Homo sapiens
ccuauaaacccuacucuga

SEQ ID NO: 223275 - RNA, 19 nt, Homo sapiens
guacuuagauuugauuagc

SEQ ID NO: 223276 - RNA, 19 nt, Homo sapiens
guucuucacuggcacauag

SEQ ID NO: 223277 - RNA, 19 nt, Homo sapiens
gaggaagcguuucgacgau

SEQ ID NO: 223278 - RNA, 19 nt, Homo sapiens
gacaagauuggaggaaaua

SEQ ID NO: 223279 - RNA, 19 nt, Homo sapiens
gaagcuauucuuugucuca

SEQ ID NO: 223280 - RNA, 19 nt, Homo sapiens
caaucacccuucagucaga

SEQ ID NO: 223281 - RNA, 19 nt, Homo sapiens
agaaauuagugagguguuu

SEQ ID NO: 223282 - RNA, 19 nt, Homo sapiens
gcuauucuuugucucaugu

SEQ ID NO: 223283 - RNA, 19 nt, Homo sapiens
cauaucagagcaucacuuu

SEQ ID NO: 223284 - RNA, 19 nt, Homo sapiens
gcacagauuuuaagaaacu

SEQ ID NO: 223285 - RNA, 19 nt, Homo sapiens
cagcuuccuuacuacauuu

SEQ ID NO: 223286 - RNA, 19 nt, Homo sapiens
caaaugauguccguauggu

SEQ ID NO: 223287 - RNA, 19 nt, Homo sapiens
gaguuaagcaauaaaggaa

SEQ ID NO: 223288 - RNA, 19 nt, Homo sapiens
gggcacaauaguugaagua

SEQ ID NO: 223289 - RNA, 19 nt, Homo sapiens
gauauuguaaccaugagaa

SEQ ID NO: 223290 - RNA, 19 nt, Homo sapiens
uggaauagcugcacaaccu

SEQ ID NO: 223291 - RNA, 19 nt, Homo sapiens
gauuggaggaaauacuaua

SEQ ID NO: 223292 - RNA, 19 nt, Homo sapiens
aaaacaaguuggacucuuu

SEQ ID NO: 223293 - RNA, 19 nt, Homo sapiens
gaaccaguggcuguccuua

SEQ ID NO: 223294 - RNA, 19 nt, Homo sapiens
agauauggaugacgccuau

SEQ ID NO: 223295 - RNA, 19 nt, Homo sapiens
caagauuucaugaggcaaa

SEQ ID NO: 223296 - RNA, 19 nt, Homo sapiens
gaggagaugaaguggaauu

SEQ ID NO: 223297 - RNA, 19 nt, Homo sapiens
ggucgaacguggaauagcu

SEQ ID NO: 223298 - RNA, 19 nt, Homo sapiens
ggaggaaauacuauaaagu

SEQ ID NO: 223299 - RNA, 19 nt, Homo sapiens
caacauacagcuuccuuac

SEQ ID NO: 223300 - RNA, 19 nt, Homo sapiens
agacauuaucugccaguua

SEQ ID NO: 223301 - RNA, 19 nt, Homo sapiens
agagaccuuuagccaguua

SEQ ID NO: 223302 - RNA, 19 nt, Homo sapiens
ggaaagacagcgcauaucc

SEQ ID NO: 223303 - RNA, 19 nt, Homo sapiens
guugaaguauggaaagaca

SEQ ID NO: 223304 - RNA, 19 nt, Homo sapiens
gcuccuugguacuuagauu

SEQ ID NO: 223305 - RNA, 19 nt, Homo sapiens
caacuucuugucucaauca

SEQ ID NO: 223306 - RNA, 19 nt, Homo sapiens
gaucaauucauucauuugg

SEQ ID NO: 223307 - RNA, 19 nt, Homo sapiens
auugauacauccagacauu

SEQ ID NO: 223308 - RNA, 19 nt, Homo sapiens
gcauuacgagguuuagaga

SEQ ID NO: 223309 - RNA, 19 nt, Homo sapiens
cagaaacagaaacaacuuu

SEQ ID NO: 223310 - RNA, 19 nt, Homo sapiens
guuuccagaucaauucauu

SEQ ID NO: 223311 - RNA, 19 nt, Homo sapiens
gccaguuaguuuaucaaga

SEQ ID NO: 223312 - RNA, 19 nt, Homo sapiens
cuauaaacccuacucugaa

SEQ ID NO: 223313 - RNA, 19 nt, Homo sapiens
aaguggaaccucuugauuu

SEQ ID NO: 223314 - RNA, 19 nt, Homo sapiens
aaaguggaaccucuugauu

SEQ ID NO: 223315 - RNA, 19 nt, Homo sapiens
uggaggaaauacuauaaag

SEQ ID NO: 223316 - RNA, 19 nt, Homo sapiens
acagcuuccuuacuacauu

SEQ ID NO: 223317 - RNA, 19 nt, Homo sapiens
cugcugaauuccaggcuaa

SEQ ID NO: 223318 - RNA, 19 nt, Homo sapiens
uuuccugaguuaagcaaua

SEQ ID NO: 223319 - RNA, 19 nt, Homo sapiens
uauugauucuccaagguuu

SEQ ID NO: 223320 - RNA, 19 nt, Homo sapiens
gcaacuucuugucucaauc

SEQ ID NO: 223321 - RNA, 19 nt, Homo sapiens
ggaugcaacuaaccucacu

SEQ ID NO: 223322 - RNA, 19 nt, Homo sapiens
guacucagaaacagaaaca

SEQ ID NO: 223323 - RNA, 19 nt, Homo sapiens
uggcuucccuguaauccuu

SEQ ID NO: 223324 - RNA, 19 nt, Homo sapiens
guauggugauugaauaugc

SEQ ID NO: 223325 - RNA, 19 nt, Homo sapiens
ggaacuuucaccaucaaug

SEQ ID NO: 223326 - RNA, 19 nt, Homo sapiens
gaauauguggaugcaacua

SEQ ID NO: 223327 - RNA, 19 nt, Homo sapiens
gggagaauauguggaugca

SEQ ID NO: 223328 - RNA, 19 nt, Homo sapiens
ucagcaacuucuugucuca

SEQ ID NO: 223329 - RNA, 19 nt, Homo sapiens
aagauuggaggaaauacua

SEQ ID NO: 223330 - RNA, 19 nt, Homo sapiens
uggcacagauuuuaagaaa

SEQ ID NO: 223331 - RNA, 19 nt, Homo sapiens
uaugccagauuacgaggaa

SEQ ID NO: 223332 - RNA, 19 nt, Homo sapiens
cauaguugaugaccagucu

SEQ ID NO: 223333 - RNA, 19 nt, Homo sapiens
uuccaaagaugucagagau

SEQ ID NO: 223334 - RNA, 19 nt, Homo sapiens
uaaaguggaaccucuugau

SEQ ID NO: 223335 - RNA, 19 nt, Homo sapiens
cauaaacaagggauccauu

SEQ ID NO: 223336 - RNA, 19 nt, Homo sapiens
uccguauggugauugaaua

SEQ ID NO: 223337 - RNA, 19 nt, Homo sapiens
gggagcauuacgagguuua

SEQ ID NO: 223338 - RNA, 19 nt, Homo sapiens
uagcugcacaaccucuuua

SEQ ID NO: 223339 - RNA, 19 nt, Homo sapiens
guuuauacaccaaaugaug

SEQ ID NO: 223340 - RNA, 19 nt, Homo sapiens
ugaguuaagcaauaaagga

SEQ ID NO: 223341 - RNA, 19 nt, Homo sapiens
ugauacauccagacauuau

SEQ ID NO: 223342 - RNA, 19 nt, Homo sapiens
ucgacgauaucauggcuau

SEQ ID NO: 223343 - RNA, 19 nt, Homo sapiens
cugacuccauguuacagua

SEQ ID NO: 223344 - RNA, 19 nt, Homo sapiens
aggaagcguuucgacgaua

SEQ ID NO: 223345 - RNA, 19 nt, Homo sapiens
ucagaaacagaaacaacuu

SEQ ID NO: 223346 - RNA, 19 nt, Homo sapiens
gaaauuacaugcaaagaug

SEQ ID NO: 223347 - RNA, 19 nt, Homo sapiens
gaacagaguuagcugguaa

SEQ ID NO: 223348 - RNA, 19 nt, Homo sapiens
gaggaaauguguuugaaua

SEQ ID NO: 223349 - RNA, 19 nt, Homo sapiens
gaagugauguguuuaaaug

SEQ ID NO: 223350 - RNA, 19 nt, Homo sapiens
gaagugaacugcucaaugg

SEQ ID NO: 223351 - RNA, 19 nt, Homo sapiens
gagaauggguugcucuuaa

SEQ ID NO: 223352 - RNA, 19 nt, Homo sapiens
ggauauagaucucuuggaa

SEQ ID NO: 223353 - RNA, 19 nt, Homo sapiens
gagaagaaguuacguacaa

SEQ ID NO: 223354 - RNA, 19 nt, Homo sapiens
gagaguaccuguggagaua

SEQ ID NO: 223355 - RNA, 19 nt, Homo sapiens
gugaagugguggaauauua

SEQ ID NO: 223356 - RNA, 19 nt, Homo sapiens
gagaagaaauuacaugcaa

SEQ ID NO: 223357 - RNA, 19 nt, Homo sapiens
gcugguaaauguccucuua

SEQ ID NO: 223358 - RNA, 19 nt, Homo sapiens
gagaacaggugaaucaguu

SEQ ID NO: 223359 - RNA, 19 nt, Homo sapiens
cgaauaacauguagaaaug

SEQ ID NO: 223360 - RNA, 19 nt, Homo sapiens
gagaguacguuaucaaugu

SEQ ID NO: 223361 - RNA, 19 nt, Homo sapiens
cgagacagaugaguaaaua

SEQ ID NO: 223362 - RNA, 19 nt, Homo sapiens
ugaaggagaugaagaaaug

SEQ ID NO: 223363 - RNA, 19 nt, Homo sapiens
gaaguuacguacaaauguu

SEQ ID NO: 223364 - RNA, 19 nt, Homo sapiens
gcaagaaagaccaguauaa

SEQ ID NO: 223365 - RNA, 19 nt, Homo sapiens
gggacuaaauugaguuaua

SEQ ID NO: 223366 - RNA, 19 nt, Homo sapiens
gaacacggaaccauuaauu

SEQ ID NO: 223367 - RNA, 19 nt, Homo sapiens
gaaaucacguaccagugua

SEQ ID NO: 223368 - RNA, 19 nt, Homo sapiens
acacagaacuggagaugaa

SEQ ID NO: 223369 - RNA, 19 nt, Homo sapiens
agaguuagcugguaaaugu

SEQ ID NO: 223370 - RNA, 19 nt, Homo sapiens
ggacacagaucaauuacgu

SEQ ID NO: 223371 - RNA, 19 nt, Homo sapiens
gaagaagugauguguuuaa

SEQ ID NO: 223372 - RNA, 19 nt, Homo sapiens
gaagggaccuaauaaaauu

SEQ ID NO: 223373 - RNA, 19 nt, Homo sapiens
gaaauguguuugaauaugg

SEQ ID NO: 223374 - RNA, 19 nt, Homo sapiens
ggaaauguguuugaauaug

SEQ ID NO: 223375 - RNA, 19 nt, Homo sapiens
gaaaguuuguacaggguaa

SEQ ID NO: 223376 - RNA, 19 nt, Homo sapiens
uaaggagaaugaacgauuu

SEQ ID NO: 223377 - RNA, 19 nt, Homo sapiens
gcaguacgguuuguaugua

SEQ ID NO: 223378 - RNA, 19 nt, Homo sapiens
gcacccaggcuaucuauaa

SEQ ID NO: 223379 - RNA, 19 nt, Homo sapiens
gcacaugggacuaaauuga

SEQ ID NO: 223380 - RNA, 19 nt, Homo sapiens
gaagaaggauguguauaag

SEQ ID NO: 223381 - RNA, 19 nt, Homo sapiens
gaaacaucaggaucaauua

SEQ ID NO: 223382 - RNA, 19 nt, Homo sapiens
caaaguguguggaaauuuc

SEQ ID NO: 223383 - RNA, 19 nt, Homo sapiens
gaggagaacuggacguugu

SEQ ID NO: 223384 - RNA, 19 nt, Homo sapiens
ucaauuacguguauucaug

SEQ ID NO: 223385 - RNA, 19 nt, Homo sapiens
gaaagagaaugcgaacuuc

SEQ ID NO: 223386 - RNA, 19 nt, Homo sapiens
agaaggaauucgaucauaa

SEQ ID NO: 223387 - RNA, 19 nt, Homo sapiens
gaaagaccaguauaaaguu

SEQ ID NO: 223388 - RNA, 19 nt, Homo sapiens
ccacgugcauuaaaucuug

SEQ ID NO: 223389 - RNA, 19 nt, Homo sapiens
guauagauauugagaaugg

SEQ ID NO: 223390 - RNA, 19 nt, Homo sapiens
acagugaagugguggaaua

SEQ ID NO: 223391 - RNA, 19 nt, Homo sapiens
caagaaagaccaguauaaa

SEQ ID NO: 223392 - RNA, 19 nt, Homo sapiens
gcucaacccacgugcauua

SEQ ID NO: 223393 - RNA, 19 nt, Homo sapiens
gaccaaugauauuccuaua

SEQ ID NO: 223394 - RNA, 19 nt, Homo sapiens
ggauggagccaguaaugua

SEQ ID NO: 223395 - RNA, 19 nt, Homo sapiens
ugacaaccacacugaauua

SEQ ID NO: 223396 - RNA, 19 nt, Homo sapiens
agaagaaggauguguauaa

SEQ ID NO: 223397 - RNA, 19 nt, Homo sapiens
ggacuaaauugaguuauac

SEQ ID NO: 223398 - RNA, 19 nt, Homo sapiens
agauauaccugaacuugaa

SEQ ID NO: 223399 - RNA, 19 nt, Homo sapiens
uguaauaucccgagaaauu

SEQ ID NO: 223400 - RNA, 19 nt, Homo sapiens
guuaugggcuauuugugua

SEQ ID NO: 223401 - RNA, 19 nt, Homo sapiens
aaaccaggauuuacaauag

SEQ ID NO: 223402 - RNA, 19 nt, Homo sapiens
caaaccaggauuuacaaua

SEQ ID NO: 223403 - RNA, 19 nt, Homo sapiens
ggagagguguugaaauucu

SEQ ID NO: 223404 - RNA, 19 nt, Homo sapiens
gcaguaccaugccucagaa

SEQ ID NO: 223405 - RNA, 19 nt, Homo sapiens
gaguaccuguggagauaua

SEQ ID NO: 223406 - RNA, 19 nt, Homo sapiens
ggguaaaucuauagacguu

SEQ ID NO: 223407 - RNA, 19 nt, Homo sapiens
gcuccgagauguaccuuga

SEQ ID NO: 223408 - RNA, 19 nt, Homo sapiens
gcgaauaacauguagaaau

SEQ ID NO: 223409 - RNA, 19 nt, Homo sapiens
gaggguaacaagcgaauaa

SEQ ID NO: 223410 - RNA, 19 nt, Homo sapiens
uaggagcccuuaugaaaug

SEQ ID NO: 223411 - RNA, 19 nt, Homo sapiens
gagagaagaaggaugugua

SEQ ID NO: 223412 - RNA, 19 nt, Homo sapiens
gauggaagauggcagucaa

SEQ ID NO: 223413 - RNA, 19 nt, Homo sapiens
ggaaggagaagaaauuaca

SEQ ID NO: 223414 - RNA, 19 nt, Homo sapiens
guaaagagcaaguacaauc

SEQ ID NO: 223415 - RNA, 19 nt, Homo sapiens
gaaauucuccugcaaacca

SEQ ID NO: 223416 - RNA, 19 nt, Homo sapiens
caacccacgugcauuaaau

SEQ ID NO: 223417 - RNA, 19 nt, Homo sapiens
cuugaaaccuugugauuau

SEQ ID NO: 223418 - RNA, 19 nt, Homo sapiens
gagaugaaaucacguacca

SEQ ID NO: 223419 - RNA, 19 nt, Homo sapiens
uaacucaggcuacaagauu

SEQ ID NO: 223420 - RNA, 19 nt, Homo sapiens
aaagaaggauggauacaca

SEQ ID NO: 223421 - RNA, 19 nt, Homo sapiens
ggcaauagauaaacuuaag

SEQ ID NO: 223422 - RNA, 19 nt, Homo sapiens
ggagauauaccugaacuug

SEQ ID NO: 223423 - RNA, 19 nt, Homo sapiens
ccaaacagaagcuuuauuc

SEQ ID NO: 223424 - RNA, 19 nt, Homo sapiens
gaaggaauucgaucauaau

SEQ ID NO: 223425 - RNA, 19 nt, Homo sapiens
cuaaugaagggaccuaaua

SEQ ID NO: 223426 - RNA, 19 nt, Homo sapiens
uuggagagguguugaaauu

SEQ ID NO: 223427 - RNA, 19 nt, Homo sapiens
ucacaugguuuaagcugaa

SEQ ID NO: 223428 - RNA, 19 nt, Homo sapiens
ggaggucuauaucaugaga

SEQ ID NO: 223429 - RNA, 19 nt, Homo sapiens
aaauggaucuccuauaucu

SEQ ID NO: 223430 - RNA, 19 nt, Homo sapiens
gugaaguugugaaguguuu

SEQ ID NO: 223431 - RNA, 19 nt, Homo sapiens
gagauuaauuaccgugaau

SEQ ID NO: 223432 - RNA, 19 nt, Homo sapiens
gcaaaaugcuuaggagaaa

SEQ ID NO: 223433 - RNA, 19 nt, Homo sapiens
gagggugguuucaggauau

SEQ ID NO: 223434 - RNA, 19 nt, Homo sapiens
caagaaaguuaugcacaug

SEQ ID NO: 223435 - RNA, 19 nt, Homo sapiens
caaccacacugaauuaucg

SEQ ID NO: 223436 - RNA, 19 nt, Homo sapiens
caaaacauguuccaaauca

SEQ ID NO: 223437 - RNA, 19 nt, Homo sapiens
gugauuauccagacauuaa

SEQ ID NO: 223438 - RNA, 19 nt, Homo sapiens
gugaaucaguugaauuugu

SEQ ID NO: 223439 - RNA, 19 nt, Homo sapiens
ccaccucaaugcaaagauu

SEQ ID NO: 223440 - RNA, 19 nt, Homo sapiens
gauagaacacggaaccauu

SEQ ID NO: 223441 - RNA, 19 nt, Homo sapiens
acagaucaauuacguguau

SEQ ID NO: 223442 - RNA, 19 nt, Homo sapiens
ugaaacaucaggaucaauu

SEQ ID NO: 223443 - RNA, 19 nt, Homo sapiens
ugaaagaggagaugcugua

SEQ ID NO: 223444 - RNA, 19 nt, Homo sapiens
guaaagagaaaccaaagug

SEQ ID NO: 223445 - RNA, 19 nt, Homo sapiens
augaagaagugauguguuu

SEQ ID NO: 223446 - RNA, 19 nt, Homo sapiens
gcacuuggcugcauaaaug

SEQ ID NO: 223447 - RNA, 19 nt, Homo sapiens
ugaaguggcugaaggauaa

SEQ ID NO: 223448 - RNA, 19 nt, Homo sapiens
ggagagaguugaaccuaaa

SEQ ID NO: 223449 - RNA, 19 nt, Homo sapiens
gaucacauguucacuguug

SEQ ID NO: 223450 - RNA, 19 nt, Homo sapiens
gaaauugccugacgaacuc

SEQ ID NO: 223451 - RNA, 19 nt, Homo sapiens
ccaaggaguucgaaccuaa

SEQ ID NO: 223452 - RNA, 19 nt, Homo sapiens
gaaggugucauacagauuu

SEQ ID NO: 223453 - RNA, 19 nt, Homo sapiens
gauggcauguguuuacuuu

SEQ ID NO: 223454 - RNA, 19 nt, Homo sapiens
gcaugcacuucuuacaaua

SEQ ID NO: 223455 - RNA, 19 nt, Homo sapiens
guucgaaccuaaagacgua

SEQ ID NO: 223456 - RNA, 19 nt, Homo sapiens
caugugaccucuucaguga

SEQ ID NO: 223457 - RNA, 19 nt, Homo sapiens
guugacuucuggacuauua

SEQ ID NO: 223458 - RNA, 19 nt, Homo sapiens
ggaggcaaauaucuugaaa

SEQ ID NO: 223459 - RNA, 19 nt, Homo sapiens
gucauaaccuuaccagauu

SEQ ID NO: 223460 - RNA, 19 nt, Homo sapiens
gauuuacgcucauuguaga

SEQ ID NO: 223461 - RNA, 19 nt, Homo sapiens
gcagguaggaggcaaauau

SEQ ID NO: 223462 - RNA, 19 nt, Homo sapiens
ccauuuagguuucugaguu

SEQ ID NO: 223463 - RNA, 19 nt, Homo sapiens
caaaagaagcggagauuua

SEQ ID NO: 223464 - RNA, 19 nt, Homo sapiens
gauaucucaucucuucuuu

SEQ ID NO: 223465 - RNA, 19 nt, Homo sapiens
acacauguaucuaugcauu

SEQ ID NO: 223466 - RNA, 19 nt, Homo sapiens
ggacguggcuagucauaac

SEQ ID NO: 223467 - RNA, 19 nt, Homo sapiens
ucuagaggcuuccuucauu

SEQ ID NO: 223468 - RNA, 19 nt, Homo sapiens
gcugugaaaugcaagaaga

SEQ ID NO: 223469 - RNA, 19 nt, Homo sapiens
acaccuaugucauuucauu

SEQ ID NO: 223470 - RNA, 19 nt, Homo sapiens
caaagagggagugcauuua

SEQ ID NO: 223471 - RNA, 19 nt, Homo sapiens
gcaccuacuuacaugcauu

SEQ ID NO: 223472 - RNA, 19 nt, Homo sapiens
ggaacugucucucaugaac

SEQ ID NO: 223473 - RNA, 19 nt, Homo sapiens
ucaaagagggagugcauuu

SEQ ID NO: 223474 - RNA, 19 nt, Homo sapiens
cuacuuacaugcauuacug

SEQ ID NO: 223475 - RNA, 19 nt, Homo sapiens
cugacgaacuccuugauuu

SEQ ID NO: 223476 - RNA, 19 nt, Homo sapiens
cuagaggcuuccuucauuu

SEQ ID NO: 223477 - RNA, 19 nt, Homo sapiens
ggagagagagaacuaaagu

SEQ ID NO: 223478 - RNA, 19 nt, Homo sapiens
cauguucacuguugacuuc

SEQ ID NO: 223479 - RNA, 19 nt, Homo sapiens
auauacagcucagaaguuu

SEQ ID NO: 223480 - RNA, 19 nt, Homo sapiens
uggcauguguuuacuuuau

SEQ ID NO: 223481 - RNA, 19 nt, Homo sapiens
gaagaggcaggguucaaga

SEQ ID NO: 223482 - RNA, 19 nt, Homo sapiens
gggaucacauguucacugu

SEQ ID NO: 223483 - RNA, 19 nt, Homo sapiens
gcacuucuuacaauaauuc

SEQ ID NO: 223484 - RNA, 19 nt, Homo sapiens
gaaagggugggaucacaug

SEQ ID NO: 223485 - RNA, 19 nt, Homo sapiens
cccaguaacucaucuguca

SEQ ID NO: 223486 - RNA, 19 nt, Homo sapiens
gaguugaaccuaaacauag

SEQ ID NO: 223487 - RNA, 19 nt, Homo sapiens
gggcaggugcuucaggaua

SEQ ID NO: 223488 - RNA, 19 nt, Homo sapiens
uuccagaccugaagaauca

SEQ ID NO: 223489 - RNA, 19 nt, Homo sapiens
gcaggaccaccuugaauuc

SEQ ID NO: 223490 - RNA, 19 nt, Homo sapiens
gcauguguuuacuuuaugu

SEQ ID NO: 223491 - RNA, 19 nt, Homo sapiens
gaccugaagaaucacaaua

SEQ ID NO: 223492 - RNA, 19 nt, Homo sapiens
ugaauccucucucuguguu

SEQ ID NO: 223493 - RNA, 19 nt, Homo sapiens
gcacuacgucuuagcugaa

SEQ ID NO: 223494 - RNA, 19 nt, Homo sapiens
gucgucaucuuguucauug

SEQ ID NO: 223495 - RNA, 19 nt, Homo sapiens
ggagucaucaguggaauug

SEQ ID NO: 223496 - RNA, 19 nt, Homo sapiens
gggaagagcagagauauac

SEQ ID NO: 223497 - RNA, 19 nt, Homo sapiens
ggucuuuccuuguuugaag

SEQ ID NO: 223498 - RNA, 19 nt, Homo sapiens
guaggaggcaaauaucuug

SEQ ID NO: 223499 - RNA, 19 nt, Homo sapiens
ggacuauuauggaaaauca

SEQ ID NO: 223500 - RNA, 19 nt, Homo sapiens
ccugaagaaucacaauaau

SEQ ID NO: 223501 - RNA, 19 nt, Homo sapiens
cauacagauuugcaaaguu

SEQ ID NO: 223502 - RNA, 19 nt, Homo sapiens
ucauaaccuuaccagauuu

SEQ ID NO: 223503 - RNA, 19 nt, Homo sapiens
agaguugaaccuaaacaua

SEQ ID NO: 223504 - RNA, 19 nt, Homo sapiens
agaggcaccugucccagaa

SEQ ID NO: 223505 - RNA, 19 nt, Homo sapiens
aaagagggagugcauuuau

SEQ ID NO: 223506 - RNA, 19 nt, Homo sapiens
acuugucuauuaccuguua

SEQ ID NO: 223507 - RNA, 19 nt, Homo sapiens
ccucagagacauacaccua

SEQ ID NO: 223508 - RNA, 19 nt, Homo sapiens
caacaagugccuccuuugg

SEQ ID NO: 223509 - RNA, 19 nt, Homo sapiens
cauauacagcucagaaguu

SEQ ID NO: 223510 - RNA, 19 nt, Homo sapiens
uaccuggucucuccuuguu

SEQ ID NO: 223511 - RNA, 19 nt, Homo sapiens
ucauacagauuugcaaagu

SEQ ID NO: 223512 - RNA, 19 nt, Homo sapiens
aggcaaauaucuugaaagg

SEQ ID NO: 223513 - RNA, 19 nt, Homo sapiens
ggcaggaccaccuugaauu

SEQ ID NO: 223514 - RNA, 19 nt, Homo sapiens
gguaggaggcaaauaucuu

SEQ ID NO: 223515 - RNA, 19 nt, Homo sapiens
gccaaggaguucgaaccua

SEQ ID NO: 223516 - RNA, 19 nt, Homo sapiens
cccagaacaucaccaugaa

SEQ ID NO: 223517 - RNA, 19 nt, Homo sapiens
cugcauaaaugugguacaa

SEQ ID NO: 223518 - RNA, 19 nt, Homo sapiens
ccagauggcauguguuuac

SEQ ID NO: 223519 - RNA, 19 nt, Homo sapiens
cauuugggaugcuacucua

SEQ ID NO: 223520 - RNA, 19 nt, Homo sapiens
gguaguaugauggguguuu

SEQ ID NO: 223521 - RNA, 19 nt, Homo sapiens
auacaccuaugucauuuca

SEQ ID NO: 223522 - RNA, 19 nt, Homo sapiens
agacaaaacuagagacuca

SEQ ID NO: 223523 - RNA, 19 nt, Homo sapiens
gaagagcagagauauacgu

SEQ ID NO: 223524 - RNA, 19 nt, Homo sapiens
caauggaugccaaggaguu

SEQ ID NO: 223525 - RNA, 19 nt, Homo sapiens
guaccgagggcuacuggaa

SEQ ID NO: 223526 - RNA, 19 nt, Homo sapiens
ggcauguguuuacuuuaug

SEQ ID NO: 223527 - RNA, 19 nt, Homo sapiens
aggagagaguugaaccuaa

SEQ ID NO: 223528 - RNA, 19 nt, Homo sapiens
gaucagccccucauuguga

SEQ ID NO: 223529 - RNA, 19 nt, Homo sapiens
ccauggguuuccaguagaa

SEQ ID NO: 223530 - RNA, 19 nt, Homo sapiens
ggcaggugcuucaggauac

SEQ ID NO: 223531 - RNA, 19 nt, Homo sapiens
cuggaacugucucucauga

SEQ ID NO: 223532 - RNA, 19 nt, Homo sapiens
agagggagugcauuuauga

SEQ ID NO: 223533 - RNA, 19 nt, Homo sapiens
aagagggagugcauuuaug

SEQ ID NO: 223534 - RNA, 19 nt, Homo sapiens
cuucuggacuauuauggaa

SEQ ID NO: 223535 - RNA, 19 nt, Homo sapiens
acuguugacuucuggacua

SEQ ID NO: 223536 - RNA, 19 nt, Homo sapiens
ugcaugcacuucuuacaau

SEQ ID NO: 223537 - RNA, 19 nt, Homo sapiens
gggauucuuccaucugauu

SEQ ID NO: 223538 - RNA, 19 nt, Homo sapiens
cauuuagguuucugaguuc

SEQ ID NO: 223539 - RNA, 19 nt, Homo sapiens
ggaagaggcaggguucaag

SEQ ID NO: 223540 - RNA, 19 nt, Homo sapiens
gggcaggaccaccuugaau

SEQ ID NO: 223541 - RNA, 19 nt, Homo sapiens
uggaucaccuaguguuuca

SEQ ID NO: 223542 - RNA, 19 nt, Homo sapiens
uuacugcaugcacuucuua

SEQ ID NO: 223543 - RNA, 19 nt, Homo sapiens
cgacucuucugagcaccua

SEQ ID NO: 223544 - RNA, 19 nt, Homo sapiens
aaaagaagcggagauuuaa

SEQ ID NO: 223545 - RNA, 19 nt, Homo sapiens
agucauaaccuuaccagau

SEQ ID NO: 223546 - RNA, 19 nt, Homo sapiens
gaucacauguucacuguug

SEQ ID NO: 223547 - RNA, 19 nt, Homo sapiens
guugacuucuggacuauua

SEQ ID NO: 223548 - RNA, 19 nt, Homo sapiens
gauuuacgcucauuguaga

SEQ ID NO: 223549 - RNA, 19 nt, Homo sapiens
gauaucucaucucuucuuu

SEQ ID NO: 223550 - RNA, 19 nt, Homo sapiens
gcugugaaaugcaagaaga

SEQ ID NO: 223551 - RNA, 19 nt, Homo sapiens
cauguucacuguugacuuc

SEQ ID NO: 223552 - RNA, 19 nt, Homo sapiens
auauacagcucagaaguuu

SEQ ID NO: 223553 - RNA, 19 nt, Homo sapiens
gggaucacauguucacugu

SEQ ID NO: 223554 - RNA, 19 nt, Homo sapiens
gaaagggugggaucacaug

SEQ ID NO: 223555 - RNA, 19 nt, Homo sapiens
gggcaggugcuucaggaua

SEQ ID NO: 223556 - RNA, 19 nt, Homo sapiens
ggucuuuccuuguuugaag

SEQ ID NO: 223557 - RNA, 19 nt, Homo sapiens
ggacuauuauggaaaauca

SEQ ID NO: 223558 - RNA, 19 nt, Homo sapiens
acuugucuauuaccuguua

SEQ ID NO: 223559 - RNA, 19 nt, Homo sapiens
cauauacagcucagaaguu

SEQ ID NO: 223560 - RNA, 19 nt, Homo sapiens
guaccgagggcuacuggaa

SEQ ID NO: 223561 - RNA, 19 nt, Homo sapiens
ccauggguuuccaguagaa

SEQ ID NO: 223562 - RNA, 19 nt, Homo sapiens
ggcaggugcuucaggauac

SEQ ID NO: 223563 - RNA, 19 nt, Homo sapiens
cuucuggacuauuauggaa

SEQ ID NO: 223564 - RNA, 19 nt, Homo sapiens
acuguugacuucuggacua

SEQ ID NO: 223565 - RNA, 19 nt, Homo sapiens
gugauuuacgcucauugua

SEQ ID NO: 223566 - RNA, 19 nt, Homo sapiens
gaauuucaagccagaugug

SEQ ID NO: 223567 - RNA, 19 nt, Homo sapiens
cauccugggcugugaaaug

SEQ ID NO: 223568 - RNA, 19 nt, Homo sapiens
ccuguuaguauuauuguug

SEQ ID NO: 223569 - RNA, 19 nt, Homo sapiens
cuccauggguuuccaguag

SEQ ID NO: 223570 - RNA, 19 nt, Homo sapiens
guucacacucucugcacua

SEQ ID NO: 223571 - RNA, 19 nt, Homo sapiens
gaaaugcaagaagacaaca

SEQ ID NO: 223572 - RNA, 19 nt, Homo sapiens
ugauuuacgcucauuguag

SEQ ID NO: 223573 - RNA, 19 nt, Homo sapiens
uaccauauacagcucagaa

SEQ ID NO: 223574 - RNA, 19 nt, Homo sapiens
ucucugcacuaccucuuca

SEQ ID NO: 223575 - RNA, 19 nt, Homo sapiens
gcuucaggauaccauauac

SEQ ID NO: 223576 - RNA, 19 nt, Homo sapiens
agggugggaucacauguuc

SEQ ID NO: 223577 - RNA, 19 nt, Homo sapiens
gaccagcuguucguguucu

SEQ ID NO: 223578 - RNA, 19 nt, Homo sapiens
ccauauacagcucagaagu

SEQ ID NO: 223579 - RNA, 19 nt, Homo sapiens
ccugggcugugaaaugcaa

SEQ ID NO: 223580 - RNA, 19 nt, Homo sapiens
gugaaaugcaagaagacaa

SEQ ID NO: 223581 - RNA, 19 nt, Homo sapiens
ugaaguggcugaaggauaa

SEQ ID NO: 223582 - RNA, 19 nt, Homo sapiens
gaucacauguucacuguug

SEQ ID NO: 223583 - RNA, 19 nt, Homo sapiens
ccaaggaguucgaaccuaa

SEQ ID NO: 223584 - RNA, 19 nt, Homo sapiens
guucgaaccuaaagacgua

SEQ ID NO: 223585 - RNA, 19 nt, Homo sapiens
guugacuucuggacuauua

SEQ ID NO: 223586 - RNA, 19 nt, Homo sapiens
cauguucacuguugacuuc

SEQ ID NO: 223587 - RNA, 19 nt, Homo sapiens
gaagaggcaggguucaaga

SEQ ID NO: 223588 - RNA, 19 nt, Homo sapiens
gggaucacauguucacugu

SEQ ID NO: 223589 - RNA, 19 nt, Homo sapiens
gaaagggugggaucacaug

SEQ ID NO: 223590 - RNA, 19 nt, Homo sapiens
gcacuacgucuuagcugaa

SEQ ID NO: 223591 - RNA, 19 nt, Homo sapiens
gucgucaucuuguucauug

SEQ ID NO: 223592 - RNA, 19 nt, Homo sapiens
ggagucaucaguggaauug

SEQ ID NO: 223593 - RNA, 19 nt, Homo sapiens
gggaagagcagagauauac

SEQ ID NO: 223594 - RNA, 19 nt, Homo sapiens
ggucuuuccuuguuugaag

SEQ ID NO: 223595 - RNA, 19 nt, Homo sapiens
ggacuauuauggaaaauca

SEQ ID NO: 223596 - RNA, 19 nt, Homo sapiens
gccaaggaguucgaaccua

SEQ ID NO: 223597 - RNA, 19 nt, Homo sapiens
cccagaacaucaccaugaa

SEQ ID NO: 223598 - RNA, 19 nt, Homo sapiens
gaagagcagagauauacgu

SEQ ID NO: 223599 - RNA, 19 nt, Homo sapiens
caauggaugccaaggaguu

SEQ ID NO: 223600 - RNA, 19 nt, Homo sapiens
gaucagccccucauuguga

SEQ ID NO: 223601 - RNA, 19 nt, Homo sapiens
ccauggguuuccaguagaa

SEQ ID NO: 223602 - RNA, 19 nt, Homo sapiens
cuucuggacuauuauggaa

SEQ ID NO: 223603 - RNA, 19 nt, Homo sapiens
acuguugacuucuggacua

SEQ ID NO: 223604 - RNA, 19 nt, Homo sapiens
ggaagaggcaggguucaag

SEQ ID NO: 223605 - RNA, 19 nt, Homo sapiens
caaggaguucgaaccuaaa

SEQ ID NO: 223606 - RNA, 19 nt, Homo sapiens
cagaacaucaccaugaagu

SEQ ID NO: 223607 - RNA, 19 nt, Homo sapiens
gaauuucaagccagaugug

SEQ ID NO: 223608 - RNA, 19 nt, Homo sapiens
ggugucgggccuugaacua

SEQ ID NO: 223609 - RNA, 19 nt, Homo sapiens
acagcaaggugaccacucu

SEQ ID NO: 223610 - RNA, 19 nt, Homo sapiens
uggauaaccuuggcuguac

SEQ ID NO: 223611 - RNA, 19 nt, Homo sapiens
cuccauggguuuccaguag

SEQ ID NO: 223612 - RNA, 19 nt, Homo sapiens
ggaguucgaaccuaaagac

SEQ ID NO: 223613 - RNA, 19 nt, Homo sapiens
guucacacucucugcacua

SEQ ID NO: 223614 - RNA, 19 nt, Homo sapiens
uagcugaacgugagugaca

SEQ ID NO: 223615 - RNA, 19 nt, Homo sapiens
ucucugcacuaccucuuca

SEQ ID NO: 223616 - RNA, 19 nt, Homo sapiens
ggauaagcagccaauggau

SEQ ID NO: 223617 - RNA, 19 nt, Homo sapiens
ugaaggauaagcagccaau

SEQ ID NO: 223618 - RNA, 19 nt, Homo sapiens
caucuuguucauuggaauu

SEQ ID NO: 223619 - RNA, 19 nt, Homo sapiens
ucaguggaauugcuguuuu

SEQ ID NO: 223620 - RNA, 19 nt, Homo sapiens
agggugggaucacauguuc

SEQ ID NO: 223621 - RNA, 19 nt, Homo sapiens
gaccagcuguucguguucu

SEQ ID NO: 223622 - RNA, 19 nt, Homo sapiens
ccuagucauuggagucauc

SEQ ID NO: 223623 - RNA, 19 nt, Homo sapiens
gucgggccuugaacuacua

SEQ ID NO: 223624 - RNA, 19 nt, Homo sapiens
aggauaagcagccaaugga

SEQ ID NO: 223625 - RNA, 19 nt, Homo sapiens
ugaaguggcugaaggauaa

SEQ ID NO: 223626 - RNA, 19 nt, Homo sapiens
ggagagaguugaaccuaaa

SEQ ID NO: 223627 - RNA, 19 nt, Homo sapiens
gaucacauguucacuguug

SEQ ID NO: 223628 - RNA, 19 nt, Homo sapiens
gaaauugccugacgaacuc

SEQ ID NO: 223629 - RNA, 19 nt, Homo sapiens
ccaaggaguucgaaccuaa

SEQ ID NO: 223630 - RNA, 19 nt, Homo sapiens
gaaggugucauacagauuu

SEQ ID NO: 223631 - RNA, 19 nt, Homo sapiens
gcaugcacuucuuacaaua

SEQ ID NO: 223632 - RNA, 19 nt, Homo sapiens
guucgaaccuaaagacgua

SEQ ID NO: 223633 - RNA, 19 nt, Homo sapiens
caugugaccucuucaguga

SEQ ID NO: 223634 - RNA, 19 nt, Homo sapiens
guugacuucuggacuauua

SEQ ID NO: 223635 - RNA, 19 nt, Homo sapiens
ggaggcaaauaucuugaaa

SEQ ID NO: 223636 - RNA, 19 nt, Homo sapiens
gucauaaccuuaccagauu

SEQ ID NO: 223637 - RNA, 19 nt, Homo sapiens
gcagguaggaggcaaauau

SEQ ID NO: 223638 - RNA, 19 nt, Homo sapiens
ccauuuagguuucugaguu

SEQ ID NO: 223639 - RNA, 19 nt, Homo sapiens
caaaagaagcggagauuua

SEQ ID NO: 223640 - RNA, 19 nt, Homo sapiens
acacauguaucuaugcauu

SEQ ID NO: 223641 - RNA, 19 nt, Homo sapiens
ggacguggcuagucauaac

SEQ ID NO: 223642 - RNA, 19 nt, Homo sapiens
ucuagaggcuuccuucauu

SEQ ID NO: 223643 - RNA, 19 nt, Homo sapiens
acaccuaugucauuucauu

SEQ ID NO: 223644 - RNA, 19 nt, Homo sapiens
caaagagggagugcauuua

SEQ ID NO: 223645 - RNA, 19 nt, Homo sapiens
gcaccuacuuacaugcauu

SEQ ID NO: 223646 - RNA, 19 nt, Homo sapiens
ggaacugucucucaugaac

SEQ ID NO: 223647 - RNA, 19 nt, Homo sapiens
ucaaagagggagugcauuu

SEQ ID NO: 223648 - RNA, 19 nt, Homo sapiens
cuacuuacaugcauuacug

SEQ ID NO: 223649 - RNA, 19 nt, Homo sapiens
cugacgaacuccuugauuu

SEQ ID NO: 223650 - RNA, 19 nt, Homo sapiens
cuagaggcuuccuucauuu

SEQ ID NO: 223651 - RNA, 19 nt, Homo sapiens
cauguucacuguugacuuc

SEQ ID NO: 223652 - RNA, 19 nt, Homo sapiens
gaagaggcaggguucaaga

SEQ ID NO: 223653 - RNA, 19 nt, Homo sapiens
gggaucacauguucacugu

SEQ ID NO: 223654 - RNA, 19 nt, Homo sapiens
gcacuucuuacaauaauuc

SEQ ID NO: 223655 - RNA, 19 nt, Homo sapiens
gaaagggugggaucacaug

SEQ ID NO: 223656 - RNA, 19 nt, Homo sapiens
cccaguaacucaucuguca

SEQ ID NO: 223657 - RNA, 19 nt, Homo sapiens
gaguugaaccuaaacauag

SEQ ID NO: 223658 - RNA, 19 nt, Homo sapiens
uuccagaccugaagaauca

SEQ ID NO: 223659 - RNA, 19 nt, Homo sapiens
gaccugaagaaucacaaua

SEQ ID NO: 223660 - RNA, 19 nt, Homo sapiens
ugaauccucucucuguguu

SEQ ID NO: 223661 - RNA, 19 nt, Homo sapiens
gcacuacgucuuagcugaa

SEQ ID NO: 223662 - RNA, 19 nt, Homo sapiens
gucgucaucuuguucauug

SEQ ID NO: 223663 - RNA, 19 nt, Homo sapiens
ggagucaucaguggaauug

SEQ ID NO: 223664 - RNA, 19 nt, Homo sapiens
gggaagagcagagauauac

SEQ ID NO: 223665 - RNA, 19 nt, Homo sapiens
ggucuuuccuuguuugaag

SEQ ID NO: 223666 - RNA, 19 nt, Homo sapiens
guaggaggcaaauaucuug

SEQ ID NO: 223667 - RNA, 19 nt, Homo sapiens
ggacuauuauggaaaauca

SEQ ID NO: 223668 - RNA, 19 nt, Homo sapiens
ccugaagaaucacaauaau

SEQ ID NO: 223669 - RNA, 19 nt, Homo sapiens
cauacagauuugcaaaguu

SEQ ID NO: 223670 - RNA, 19 nt, Homo sapiens
ucauaaccuuaccagauuu

SEQ ID NO: 223671 - RNA, 19 nt, Homo sapiens
agaguugaaccuaaacaua

SEQ ID NO: 223672 - RNA, 19 nt, Homo sapiens
agaggcaccugucccagaa

SEQ ID NO: 223673 - RNA, 19 nt, Homo sapiens
aaagagggagugcauuuau

SEQ ID NO: 223674 - RNA, 19 nt, Homo sapiens
ccucagagacauacaccua

SEQ ID NO: 223675 - RNA, 19 nt, Homo sapiens
uaccuggucucuccuuguu

SEQ ID NO: 223676 - RNA, 19 nt, Homo sapiens
ucauacagauuugcaaagu

SEQ ID NO: 223677 - RNA, 19 nt, Homo sapiens
aggcaaauaucuugaaagg

SEQ ID NO: 223678 - RNA, 19 nt, Homo sapiens
gguaggaggcaaauaucuu

SEQ ID NO: 223679 - RNA, 19 nt, Homo sapiens
gccaaggaguucgaaccua

SEQ ID NO: 223680 - RNA, 19 nt, Homo sapiens
cccagaacaucaccaugaa

SEQ ID NO: 223681 - RNA, 19 nt, Homo sapiens
cauuugggaugcuacucua

SEQ ID NO: 223682 - RNA, 19 nt, Homo sapiens
gguaguaugauggguguuu

SEQ ID NO: 223683 - RNA, 19 nt, Homo sapiens
auacaccuaugucauuuca

SEQ ID NO: 223684 - RNA, 19 nt, Homo sapiens
agacaaaacuagagacuca

SEQ ID NO: 223685 - RNA, 19 nt, Homo sapiens
gaagagcagagauauacgu

SEQ ID NO: 223686 - RNA, 19 nt, Homo sapiens
caauggaugccaaggaguu

SEQ ID NO: 223687 - RNA, 19 nt, Homo sapiens
aggagagaguugaaccuaa

SEQ ID NO: 223688 - RNA, 19 nt, Homo sapiens
gaucagccccucauuguga

SEQ ID NO: 223689 - RNA, 19 nt, Homo sapiens
ccauggguuuccaguagaa

SEQ ID NO: 223690 - RNA, 19 nt, Homo sapiens
cuggaacugucucucauga

SEQ ID NO: 223691 - RNA, 19 nt, Homo sapiens
agagggagugcauuuauga

SEQ ID NO: 223692 - RNA, 19 nt, Homo sapiens
aagagggagugcauuuaug

SEQ ID NO: 223693 - RNA, 19 nt, Homo sapiens
cuucuggacuauuauggaa

SEQ ID NO: 223694 - RNA, 19 nt, Homo sapiens
acuguugacuucuggacua

SEQ ID NO: 223695 - RNA, 19 nt, Homo sapiens
ugcaugcacuucuuacaau

SEQ ID NO: 223696 - RNA, 19 nt, Homo sapiens
gggauucuuccaucugauu

SEQ ID NO: 223697 - RNA, 19 nt, Homo sapiens
cauuuagguuucugaguuc

SEQ ID NO: 223698 - RNA, 19 nt, Homo sapiens
ggaagaggcaggguucaag

SEQ ID NO: 223699 - RNA, 19 nt, Homo sapiens
uuacugcaugcacuucuua

SEQ ID NO: 223700 - RNA, 19 nt, Homo sapiens
cgacucuucugagcaccua

SEQ ID NO: 223701 - RNA, 19 nt, Homo sapiens
aaaagaagcggagauuuaa

SEQ ID NO: 223702 - RNA, 19 nt, Homo sapiens
agucauaaccuuaccagau

SEQ ID NO: 223703 - RNA, 19 nt, Homo sapiens
gaaccucaagcugcaucua

SEQ ID NO: 223704 - RNA, 19 nt, Homo sapiens
caaggaguucgaaccuaaa

SEQ ID NO: 223705 - RNA, 19 nt, Homo sapiens
uggugaaggugacacauca

SEQ ID NO: 223706 - RNA, 19 nt, Homo sapiens
ccugggacguggcuaguca

SEQ ID NO: 223707 - RNA, 19 nt, Homo sapiens
cagaacaucaccaugaagu

SEQ ID NO: 223708 - RNA, 19 nt, Homo sapiens
gaauuucaagccagaugug

SEQ ID NO: 223709 - RNA, 19 nt, Homo sapiens
caugcacuucuuacaauaa

SEQ ID NO: 223710 - RNA, 19 nt, Homo sapiens
caccuacuuacaugcauua

SEQ ID NO: 223711 - RNA, 19 nt, Homo sapiens
ggugucgggccuugaacua

SEQ ID NO: 223712 - RNA, 19 nt, Homo sapiens
cugagcaccuacuuacaug

SEQ ID NO: 223713 - RNA, 19 nt, Homo sapiens
gaauccucucucuguguua

SEQ ID NO: 223714 - RNA, 19 nt, Homo sapiens
cuccugagccuaggcaaua

SEQ ID NO: 223715 - RNA, 19 nt, Homo sapiens
agccuucucuguucauuuc

SEQ ID NO: 223716 - RNA, 19 nt, Homo sapiens
gacgaacuccuugauuuua

SEQ ID NO: 223717 - RNA, 19 nt, Homo sapiens
caggagagaguugaaccua

SEQ ID NO: 223718 - RNA, 19 nt, Homo sapiens
ggaaggagacaaaacuaga

SEQ ID NO: 223719 - RNA, 19 nt, Homo sapiens
uggauaaccuuggcuguac

SEQ ID NO: 223720 - RNA, 19 nt, Homo sapiens
cuccauggguuuccaguag

SEQ ID NO: 223721 - RNA, 19 nt, Homo sapiens
aguugaaccuaaacauaga

SEQ ID NO: 223722 - RNA, 19 nt, Homo sapiens
gugcauuuaugagcucuuc

SEQ ID NO: 223723 - RNA, 19 nt, Homo sapiens
ggaguucgaaccuaaagac

SEQ ID NO: 223724 - RNA, 19 nt, Homo sapiens
guucacacucucugcacua

SEQ ID NO: 223725 - RNA, 19 nt, Homo sapiens
gcacuuggcugcauaaaug

SEQ ID NO: 223726 - RNA, 19 nt, Homo sapiens
ugaaguggcugaaggauaa

SEQ ID NO: 223727 - RNA, 19 nt, Homo sapiens
gaucacauguucacuguug

SEQ ID NO: 223728 - RNA, 19 nt, Homo sapiens
ccaaggaguucgaaccuaa

SEQ ID NO: 223729 - RNA, 19 nt, Homo sapiens
gauggcauguguuuacuuu

SEQ ID NO: 223730 - RNA, 19 nt, Homo sapiens
guucgaaccuaaagacgua

SEQ ID NO: 223731 - RNA, 19 nt, Homo sapiens
caugugaccucuucaguga

SEQ ID NO: 223732 - RNA, 19 nt, Homo sapiens
guugacuucuggacuauua

SEQ ID NO: 223733 - RNA, 19 nt, Homo sapiens
caaaagaagcggagauuua

SEQ ID NO: 223734 - RNA, 19 nt, Homo sapiens
gcugugaaaugcaagaaga

SEQ ID NO: 223735 - RNA, 19 nt, Homo sapiens
ccaaagugcugagauuaca

SEQ ID NO: 223736 - RNA, 19 nt, Homo sapiens
cauguucacuguugacuuc

SEQ ID NO: 223737 - RNA, 19 nt, Homo sapiens
auauacagcucagaaguuu

SEQ ID NO: 223738 - RNA, 19 nt, Homo sapiens
uggcauguguuuacuuuau

SEQ ID NO: 223739 - RNA, 19 nt, Homo sapiens
gggaucacauguucacugu

SEQ ID NO: 223740 - RNA, 19 nt, Homo sapiens
gaaagggugggaucacaug

SEQ ID NO: 223741 - RNA, 19 nt, Homo sapiens
gggcaggugcuucaggaua

SEQ ID NO: 223742 - RNA, 19 nt, Homo sapiens
gcaggaccaccuugaauuc

SEQ ID NO: 223743 - RNA, 19 nt, Homo sapiens
gcauguguuuacuuuaugu

SEQ ID NO: 223744 - RNA, 19 nt, Homo sapiens
ggucuuuccuuguuugaag

SEQ ID NO: 223745 - RNA, 19 nt, Homo sapiens
ggacuauuauggaaaauca

SEQ ID NO: 223746 - RNA, 19 nt, Homo sapiens
caacaagugccuccuuugg

SEQ ID NO: 223747 - RNA, 19 nt, Homo sapiens
cauauacagcucagaaguu

SEQ ID NO: 223748 - RNA, 19 nt, Homo sapiens
ggcaggaccaccuugaauu

SEQ ID NO: 223749 - RNA, 19 nt, Homo sapiens
gccaaggaguucgaaccua

SEQ ID NO: 223750 - RNA, 19 nt, Homo sapiens
cccagaacaucaccaugaa

SEQ ID NO: 223751 - RNA, 19 nt, Homo sapiens
cugcauaaaugugguacaa

SEQ ID NO: 223752 - RNA, 19 nt, Homo sapiens
ccagauggcauguguuuac

SEQ ID NO: 223753 - RNA, 19 nt, Homo sapiens
caauggaugccaaggaguu

SEQ ID NO: 223754 - RNA, 19 nt, Homo sapiens
guaccgagggcuacuggaa

SEQ ID NO: 223755 - RNA, 19 nt, Homo sapiens
ggcauguguuuacuuuaug

SEQ ID NO: 223756 - RNA, 19 nt, Homo sapiens
ccauggguuuccaguagaa

SEQ ID NO: 223757 - RNA, 19 nt, Homo sapiens
ggcaggugcuucaggauac

SEQ ID NO: 223758 - RNA, 19 nt, Homo sapiens
cuucuggacuauuauggaa

SEQ ID NO: 223759 - RNA, 19 nt, Homo sapiens
acuguugacuucuggacua

SEQ ID NO: 223760 - RNA, 19 nt, Homo sapiens
gggcaggaccaccuugaau

SEQ ID NO: 223761 - RNA, 19 nt, Homo sapiens
aaaagaagcggagauuuaa

SEQ ID NO: 223762 - RNA, 19 nt, Homo sapiens
caaggaguucgaaccuaaa

SEQ ID NO: 223763 - RNA, 19 nt, Homo sapiens
uggugaaggugacacauca

SEQ ID NO: 223764 - RNA, 19 nt, Homo sapiens
gggaaaggcacaagauucg

SEQ ID NO: 223765 - RNA, 19 nt, Homo sapiens
cagaacaucaccaugaagu

SEQ ID NO: 223766 - RNA, 19 nt, Homo sapiens
accaacaagugccuccuuu

SEQ ID NO: 223767 - RNA, 19 nt, Homo sapiens
gaauuucaagccagaugug

SEQ ID NO: 223768 - RNA, 19 nt, Homo sapiens
ggugucgggccuugaacua

SEQ ID NO: 223769 - RNA, 19 nt, Homo sapiens
cauccugggcugugaaaug

SEQ ID NO: 223770 - RNA, 19 nt, Homo sapiens
uggauaaccuuggcuguac

SEQ ID NO: 223771 - RNA, 19 nt, Homo sapiens
cuccugagccuaggcaaua

SEQ ID NO: 223772 - RNA, 19 nt, Homo sapiens
cuccauggguuuccaguag

SEQ ID NO: 223773 - RNA, 19 nt, Homo sapiens
ggaguucgaaccuaaagac

SEQ ID NO: 223774 - RNA, 19 nt, Homo sapiens
ccaacaagugccuccuuug

SEQ ID NO: 223775 - RNA, 19 nt, Homo sapiens
guucacacucucugcacua

SEQ ID NO: 223776 - RNA, 19 nt, Homo sapiens
gaaaugcaagaagacaaca

SEQ ID NO: 223777 - RNA, 19 nt, Homo sapiens
uaccauauacagcucagaa

SEQ ID NO: 223778 - RNA, 19 nt, Homo sapiens
gcccugacacacuggauug

SEQ ID NO: 223779 - RNA, 19 nt, Homo sapiens
ggauaagcagccaauggau

SEQ ID NO: 223780 - RNA, 19 nt, Homo sapiens
ugaaggauaagcagccaau

SEQ ID NO: 223781 - RNA, 19 nt, Homo sapiens
ucucugcacuaccucuuca

SEQ ID NO: 223782 - RNA, 19 nt, Homo sapiens
gcuucaggauaccauauac

SEQ ID NO: 223783 - RNA, 19 nt, Homo sapiens
gugggaaaggcacaagauu

SEQ ID NO: 223784 - RNA, 19 nt, Homo sapiens
ggauuggagagcagcagaa

SEQ ID NO: 223785 - RNA, 19 nt, Homo sapiens
agggugggaucacauguuc

SEQ ID NO: 223786 - RNA, 19 nt, Homo sapiens
gaccagcuguucguguucu

SEQ ID NO: 223787 - RNA, 19 nt, Homo sapiens
ccauauacagcucagaagu

SEQ ID NO: 223788 - RNA, 19 nt, Homo sapiens
gucgggccuugaacuacua

SEQ ID NO: 223789 - RNA, 19 nt, Homo sapiens
gugaaggugacacaucaug

SEQ ID NO: 223790 - RNA, 19 nt, Homo sapiens
gaccaacaagugccuccuu

SEQ ID NO: 223791 - RNA, 19 nt, Homo sapiens
ugaauucugcccugacaca

SEQ ID NO: 223792 - RNA, 19 nt, Homo sapiens
aggauaagcagccaaugga

SEQ ID NO: 223793 - RNA, 19 nt, Homo sapiens
ugggaaaggcacaagauuc

SEQ ID NO: 223794 - RNA, 19 nt, Homo sapiens
ccugggcugugaaaugcaa

SEQ ID NO: 223795 - RNA, 19 nt, Homo sapiens
gcugagauuacagguguga

SEQ ID NO: 223796 - RNA, 19 nt, Homo sapiens
gugaaaugcaagaagacaa

SEQ ID NO: 223797 - RNA, 19 nt, Homo sapiens
ugaaguggcugaaggauaa

SEQ ID NO: 223798 - RNA, 19 nt, Homo sapiens
gaucacauguucacuguug

SEQ ID NO: 223799 - RNA, 19 nt, Homo sapiens
ccaaggaguucgaaccuaa

SEQ ID NO: 223800 - RNA, 19 nt, Homo sapiens
guucgaaccuaaagacgua

SEQ ID NO: 223801 - RNA, 19 nt, Homo sapiens
guugacuucuggacuauua

SEQ ID NO: 223802 - RNA, 19 nt, Homo sapiens
gcugugaaaugcaagaaga

SEQ ID NO: 223803 - RNA, 19 nt, Homo sapiens
cauguucacuguugacuuc

SEQ ID NO: 223804 - RNA, 19 nt, Homo sapiens
gaagaggcaggguucaaga

SEQ ID NO: 223805 - RNA, 19 nt, Homo sapiens
gggaucacauguucacugu

SEQ ID NO: 223806 - RNA, 19 nt, Homo sapiens
gaaagggugggaucacaug

SEQ ID NO: 223807 - RNA, 19 nt, Homo sapiens
gcaggaccaccuugaauuc

SEQ ID NO: 223808 - RNA, 19 nt, Homo sapiens
gcacuacgucuuagcugaa

SEQ ID NO: 223809 - RNA, 19 nt, Homo sapiens
gucgucaucuuguucauug

SEQ ID NO: 223810 - RNA, 19 nt, Homo sapiens
ggagucaucaguggaauug

SEQ ID NO: 223811 - RNA, 19 nt, Homo sapiens
gggaagagcagagauauac

SEQ ID NO: 223812 - RNA, 19 nt, Homo sapiens
ggucuuuccuuguuugaag

SEQ ID NO: 223813 - RNA, 19 nt, Homo sapiens
ggacuauuauggaaaauca

SEQ ID NO: 223814 - RNA, 19 nt, Homo sapiens
ggcaggaccaccuugaauu

SEQ ID NO: 223815 - RNA, 19 nt, Homo sapiens
gccaaggaguucgaaccua

SEQ ID NO: 223816 - RNA, 19 nt, Homo sapiens
cccagaacaucaccaugaa

SEQ ID NO: 223817 - RNA, 19 nt, Homo sapiens
gaagagcagagauauacgu

SEQ ID NO: 223818 - RNA, 19 nt, Homo sapiens
caauggaugccaaggaguu

SEQ ID NO: 223819 - RNA, 19 nt, Homo sapiens
guaccgagggcuacuggaa

SEQ ID NO: 223820 - RNA, 19 nt, Homo sapiens
gaucagccccucauuguga

SEQ ID NO: 223821 - RNA, 19 nt, Homo sapiens
ccauggguuuccaguagaa

SEQ ID NO: 223822 - RNA, 19 nt, Homo sapiens
cuucuggacuauuauggaa

SEQ ID NO: 223823 - RNA, 19 nt, Homo sapiens
acuguugacuucuggacua

SEQ ID NO: 223824 - RNA, 19 nt, Homo sapiens
ggaagaggcaggguucaag

SEQ ID NO: 223825 - RNA, 19 nt, Homo sapiens
gggcaggaccaccuugaau

SEQ ID NO: 223826 - RNA, 19 nt, Homo sapiens
caaggaguucgaaccuaaa

SEQ ID NO: 223827 - RNA, 19 nt, Homo sapiens
gggaaaggcacaagauucg

SEQ ID NO: 223828 - RNA, 19 nt, Homo sapiens
cagaacaucaccaugaagu

SEQ ID NO: 223829 - RNA, 19 nt, Homo sapiens
gaauuucaagccagaugug

SEQ ID NO: 223830 - RNA, 19 nt, Homo sapiens
ggugucgggccuugaacua

SEQ ID NO: 223831 - RNA, 19 nt, Homo sapiens
cauccugggcugugaaaug

SEQ ID NO: 223832 - RNA, 19 nt, Homo sapiens
uggauaaccuuggcuguac

SEQ ID NO: 223833 - RNA, 19 nt, Homo sapiens
cuccauggguuuccaguag

SEQ ID NO: 223834 - RNA, 19 nt, Homo sapiens
ggaguucgaaccuaaagac

SEQ ID NO: 223835 - RNA, 19 nt, Homo sapiens
guucacacucucugcacua

SEQ ID NO: 223836 - RNA, 19 nt, Homo sapiens
gaaaugcaagaagacaaca

SEQ ID NO: 223837 - RNA, 19 nt, Homo sapiens
uagcugaacgugagugaca

SEQ ID NO: 223838 - RNA, 19 nt, Homo sapiens
gcccugacacacuggauug

SEQ ID NO: 223839 - RNA, 19 nt, Homo sapiens
ucucugcacuaccucuuca

SEQ ID NO: 223840 - RNA, 19 nt, Homo sapiens
ggauaagcagccaauggau

SEQ ID NO: 223841 - RNA, 19 nt, Homo sapiens
ugaaggauaagcagccaau

SEQ ID NO: 223842 - RNA, 19 nt, Homo sapiens
caucuuguucauuggaauu

SEQ ID NO: 223843 - RNA, 19 nt, Homo sapiens
ucaguggaauugcuguuuu

SEQ ID NO: 223844 - RNA, 19 nt, Homo sapiens
gaccagcuguucguguucu

SEQ ID NO: 223845 - RNA, 19 nt, Homo sapiens
gugggaaaggcacaagauu

SEQ ID NO: 223846 - RNA, 19 nt, Homo sapiens
ggauuggagagcagcagaa

SEQ ID NO: 223847 - RNA, 19 nt, Homo sapiens
agggugggaucacauguuc

SEQ ID NO: 223848 - RNA, 19 nt, Homo sapiens
ccuagucauuggagucauc

SEQ ID NO: 223849 - RNA, 19 nt, Homo sapiens
gucgggccuugaacuacua

SEQ ID NO: 223850 - RNA, 19 nt, Homo sapiens
ugaauucugcccugacaca

SEQ ID NO: 223851 - RNA, 19 nt, Homo sapiens
aggauaagcagccaaugga

SEQ ID NO: 223852 - RNA, 19 nt, Homo sapiens
ugggaaaggcacaagauuc

SEQ ID NO: 223853 - RNA, 19 nt, Homo sapiens
ccugggcugugaaaugcaa

SEQ ID NO: 223854 - RNA, 19 nt, Homo sapiens
gugaaaugcaagaagacaa

SEQ ID NO: 223855 - RNA, 19 nt, Homo sapiens
ugaaguggcugaaggauaa

SEQ ID NO: 223856 - RNA, 19 nt, Homo sapiens
ggagagaguugaaccuaaa

SEQ ID NO: 223857 - RNA, 19 nt, Homo sapiens
gaaauugccugacgaacuc

SEQ ID NO: 223858 - RNA, 19 nt, Homo sapiens
ccaaggaguucgaaccuaa

SEQ ID NO: 223859 - RNA, 19 nt, Homo sapiens
guucgaaccuaaagacgua

SEQ ID NO: 223860 - RNA, 19 nt, Homo sapiens
caugugaccucuucaguga

SEQ ID NO: 223861 - RNA, 19 nt, Homo sapiens
caaaagaagcggagauuua

SEQ ID NO: 223862 - RNA, 19 nt, Homo sapiens
gcugugaaaugcaagaaga

SEQ ID NO: 223863 - RNA, 19 nt, Homo sapiens
caaagagggagugcauuua

SEQ ID NO: 223864 - RNA, 19 nt, Homo sapiens
ucaaagagggagugcauuu

SEQ ID NO: 223865 - RNA, 19 nt, Homo sapiens
cugacgaacuccuugauuu

SEQ ID NO: 223866 - RNA, 19 nt, Homo sapiens
gaagaggcaggguucaaga

SEQ ID NO: 223867 - RNA, 19 nt, Homo sapiens
gaguugaaccuaaacauag

SEQ ID NO: 223868 - RNA, 19 nt, Homo sapiens
gcaggaccaccuugaauuc

SEQ ID NO: 223869 - RNA, 19 nt, Homo sapiens
gcacuacgucuuagcugaa

SEQ ID NO: 223870 - RNA, 19 nt, Homo sapiens
gucgucaucuuguucauug

SEQ ID NO: 223871 - RNA, 19 nt, Homo sapiens
ggagucaucaguggaauug

SEQ ID NO: 223872 - RNA, 19 nt, Homo sapiens
gggaagagcagagauauac

SEQ ID NO: 223873 - RNA, 19 nt, Homo sapiens
agaguugaaccuaaacaua

SEQ ID NO: 223874 - RNA, 19 nt, Homo sapiens
aaagagggagugcauuuau

SEQ ID NO: 223875 - RNA, 19 nt, Homo sapiens
caacaagugccuccuuugg

SEQ ID NO: 223876 - RNA, 19 nt, Homo sapiens
ggcaggaccaccuugaauu

SEQ ID NO: 223877 - RNA, 19 nt, Homo sapiens
gccaaggaguucgaaccua

SEQ ID NO: 223878 - RNA, 19 nt, Homo sapiens
cccagaacaucaccaugaa

SEQ ID NO: 223879 - RNA, 19 nt, Homo sapiens
agacaaaacuagagacuca

SEQ ID NO: 223880 - RNA, 19 nt, Homo sapiens
gaagagcagagauauacgu

SEQ ID NO: 223881 - RNA, 19 nt, Homo sapiens
caauggaugccaaggaguu

SEQ ID NO: 223882 - RNA, 19 nt, Homo sapiens
guaccgagggcuacuggaa

SEQ ID NO: 223883 - RNA, 19 nt, Homo sapiens
aggagagaguugaaccuaa

SEQ ID NO: 223884 - RNA, 19 nt, Homo sapiens
gaucagccccucauuguga

SEQ ID NO: 223885 - RNA, 19 nt, Homo sapiens
agagggagugcauuuauga

SEQ ID NO: 223886 - RNA, 19 nt, Homo sapiens
aagagggagugcauuuaug

SEQ ID NO: 223887 - RNA, 19 nt, Homo sapiens
ggaagaggcaggguucaag

SEQ ID NO: 223888 - RNA, 19 nt, Homo sapiens
gggcaggaccaccuugaau

SEQ ID NO: 223889 - RNA, 19 nt, Homo sapiens
aaaagaagcggagauuuaa

SEQ ID NO: 223890 - RNA, 19 nt, Homo sapiens
caaggaguucgaaccuaaa

SEQ ID NO: 223891 - RNA, 19 nt, Homo sapiens
uggugaaggugacacauca

SEQ ID NO: 223892 - RNA, 19 nt, Homo sapiens
gggaaaggcacaagauucg

SEQ ID NO: 223893 - RNA, 19 nt, Homo sapiens
cagaacaucaccaugaagu

SEQ ID NO: 223894 - RNA, 19 nt, Homo sapiens
accaacaagugccuccuuu

SEQ ID NO: 223895 - RNA, 19 nt, Homo sapiens
ggugucgggccuugaacua

SEQ ID NO: 223896 - RNA, 19 nt, Homo sapiens
cauccugggcugugaaaug

SEQ ID NO: 223897 - RNA, 19 nt, Homo sapiens
gacgaacuccuugauuuua

SEQ ID NO: 223898 - RNA, 19 nt, Homo sapiens
caggagagaguugaaccua

SEQ ID NO: 223899 - RNA, 19 nt, Homo sapiens
ggaaggagacaaaacuaga

SEQ ID NO: 223900 - RNA, 19 nt, Homo sapiens
cuccugagccuaggcaaua

SEQ ID NO: 223901 - RNA, 19 nt, Homo sapiens
uggauaaccuuggcuguac

SEQ ID NO: 223902 - RNA, 19 nt, Homo sapiens
aguugaaccuaaacauaga

SEQ ID NO: 223903 - RNA, 19 nt, Homo sapiens
gugcauuuaugagcucuuc

SEQ ID NO: 223904 - RNA, 19 nt, Homo sapiens
ggaguucgaaccuaaagac

SEQ ID NO: 223905 - RNA, 19 nt, Homo sapiens
ccaacaagugccuccuuug

SEQ ID NO: 223906 - RNA, 19 nt, Homo sapiens
gaaaugcaagaagacaaca

SEQ ID NO: 223907 - RNA, 19 nt, Homo sapiens
gagaguugaaccuaaacau

SEQ ID NO: 223908 - RNA, 19 nt, Homo sapiens
uagcugaacgugagugaca

SEQ ID NO: 223909 - RNA, 19 nt, Homo sapiens
gcccugacacacuggauug

SEQ ID NO: 223910 - RNA, 19 nt, Homo sapiens
agaaauugccugacgaacu

SEQ ID NO: 223911 - RNA, 19 nt, Homo sapiens
ggauaagcagccaauggau

SEQ ID NO: 223912 - RNA, 19 nt, Homo sapiens
ugaaggauaagcagccaau

SEQ ID NO: 223913 - RNA, 19 nt, Homo sapiens
caucuuguucauuggaauu

SEQ ID NO: 223914 - RNA, 19 nt, Homo sapiens
ucaguggaauugcuguuuu

SEQ ID NO: 223915 - RNA, 19 nt, Homo sapiens
gugggaaaggcacaagauu

SEQ ID NO: 223916 - RNA, 19 nt, Homo sapiens
ggauuggagagcagcagaa

SEQ ID NO: 223917 - RNA, 19 nt, Homo sapiens
ccuagucauuggagucauc

SEQ ID NO: 223918 - RNA, 19 nt, Homo sapiens
gucgggccuugaacuacua

SEQ ID NO: 223919 - RNA, 19 nt, Homo sapiens
gugaaggugacacaucaug

SEQ ID NO: 223920 - RNA, 19 nt, Homo sapiens
gaccaacaagugccuccuu

SEQ ID NO: 223921 - RNA, 19 nt, Homo sapiens
ugaauucugcccugacaca

SEQ ID NO: 223922 - RNA, 19 nt, Homo sapiens
aggauaagcagccaaugga

SEQ ID NO: 223923 - RNA, 19 nt, Homo sapiens
ccugggcugugaaaugcaa

SEQ ID NO: 223924 - RNA, 19 nt, Homo sapiens
ugggaaaggcacaagauuc

SEQ ID NO: 223925 - RNA, 19 nt, Homo sapiens
gugaaaugcaagaagacaa

SEQ ID NO: 223926 - RNA, 19 nt, Homo sapiens
ugaaguggcugaaggauaa

SEQ ID NO: 223927 - RNA, 19 nt, Homo sapiens
ccaaggaguucgaaccuaa

SEQ ID NO: 223928 - RNA, 19 nt, Homo sapiens
guucgaaccuaaagacgua

SEQ ID NO: 223929 - RNA, 19 nt, Homo sapiens
gcugugaaaugcaagaaga

SEQ ID NO: 223930 - RNA, 19 nt, Homo sapiens
gaagaggcaggguucaaga

SEQ ID NO: 223931 - RNA, 19 nt, Homo sapiens
gcaggaccaccuugaauuc

SEQ ID NO: 223932 - RNA, 19 nt, Homo sapiens
gcacuacgucuuagcugaa

SEQ ID NO: 223933 - RNA, 19 nt, Homo sapiens
gucgucaucuuguucauug

SEQ ID NO: 223934 - RNA, 19 nt, Homo sapiens
ggagucaucaguggaauug

SEQ ID NO: 223935 - RNA, 19 nt, Homo sapiens
gggaagagcagagauauac

SEQ ID NO: 223936 - RNA, 19 nt, Homo sapiens
ggcaggaccaccuugaauu

SEQ ID NO: 223937 - RNA, 19 nt, Homo sapiens
gccaaggaguucgaaccua

SEQ ID NO: 223938 - RNA, 19 nt, Homo sapiens
cccagaacaucaccaugaa

SEQ ID NO: 223939 - RNA, 19 nt, Homo sapiens
gaagagcagagauauacgu

SEQ ID NO: 223940 - RNA, 19 nt, Homo sapiens
caauggaugccaaggaguu

SEQ ID NO: 223941 - RNA, 19 nt, Homo sapiens
guaccgagggcuacuggaa

SEQ ID NO: 223942 - RNA, 19 nt, Homo sapiens
gaucagccccucauuguga

SEQ ID NO: 223943 - RNA, 19 nt, Homo sapiens
ggaagaggcaggguucaag

SEQ ID NO: 223944 - RNA, 19 nt, Homo sapiens
gggcaggaccaccuugaau

SEQ ID NO: 223945 - RNA, 19 nt, Homo sapiens
caaggaguucgaaccuaaa

SEQ ID NO: 223946 - RNA, 19 nt, Homo sapiens
gggaaaggcacaagauucg

SEQ ID NO: 223947 - RNA, 19 nt, Homo sapiens
cagaacaucaccaugaagu

SEQ ID NO: 223948 - RNA, 19 nt, Homo sapiens
cauccugggcugugaaaug

SEQ ID NO: 223949 - RNA, 19 nt, Homo sapiens
ggugucgggccuugaacua

SEQ ID NO: 223950 - RNA, 19 nt, Homo sapiens
uggauaaccuuggcuguac

SEQ ID NO: 223951 - RNA, 19 nt, Homo sapiens
ggaguucgaaccuaaagac

SEQ ID NO: 223952 - RNA, 19 nt, Homo sapiens
gaaaugcaagaagacaaca

SEQ ID NO: 223953 - RNA, 19 nt, Homo sapiens
uagcugaacgugagugaca

SEQ ID NO: 223954 - RNA, 19 nt, Homo sapiens
gcccugacacacuggauug

SEQ ID NO: 223955 - RNA, 19 nt, Homo sapiens
ggauaagcagccaauggau

SEQ ID NO: 223956 - RNA, 19 nt, Homo sapiens
ugaaggauaagcagccaau

SEQ ID NO: 223957 - RNA, 19 nt, Homo sapiens
caucuuguucauuggaauu

SEQ ID NO: 223958 - RNA, 19 nt, Homo sapiens
ucaguggaauugcuguuuu

SEQ ID NO: 223959 - RNA, 19 nt, Homo sapiens
gugggaaaggcacaagauu

SEQ ID NO: 223960 - RNA, 19 nt, Homo sapiens
ggauuggagagcagcagaa

SEQ ID NO: 223961 - RNA, 19 nt, Homo sapiens
ccuagucauuggagucauc

SEQ ID NO: 223962 - RNA, 19 nt, Homo sapiens
gucgggccuugaacuacua

SEQ ID NO: 223963 - RNA, 19 nt, Homo sapiens
ugaauucugcccugacaca

SEQ ID NO: 223964 - RNA, 19 nt, Homo sapiens
ccugggcugugaaaugcaa

SEQ ID NO: 223965 - RNA, 19 nt, Homo sapiens
aggauaagcagccaaugga

SEQ ID NO: 223966 - RNA, 19 nt, Homo sapiens
ugggaaaggcacaagauuc

SEQ ID NO: 223967 - RNA, 19 nt, Homo sapiens
gugaaaugcaagaagacaa

SEQ ID NO: 223968 - RNA, 19 nt, Homo sapiens
ugaaguggcugaaggauaa

SEQ ID NO: 223969 - RNA, 19 nt, Homo sapiens
ggagagaguugaaccuaaa

SEQ ID NO: 223970 - RNA, 19 nt, Homo sapiens
gaucacauguucacuguug

SEQ ID NO: 223971 - RNA, 19 nt, Homo sapiens
gaaauugccugacgaacuc

SEQ ID NO: 223972 - RNA, 19 nt, Homo sapiens
ccaaggaguucgaaccuaa

SEQ ID NO: 223973 - RNA, 19 nt, Homo sapiens
guucgaaccuaaagacgua

SEQ ID NO: 223974 - RNA, 19 nt, Homo sapiens
caugugaccucuucaguga

SEQ ID NO: 223975 - RNA, 19 nt, Homo sapiens
guugacuucuggacuauua

SEQ ID NO: 223976 - RNA, 19 nt, Homo sapiens
caaaagaagcggagauuua

SEQ ID NO: 223977 - RNA, 19 nt, Homo sapiens
gcugugaaaugcaagaaga

SEQ ID NO: 223978 - RNA, 19 nt, Homo sapiens
caaagagggagugcauuua

SEQ ID NO: 223979 - RNA, 19 nt, Homo sapiens
ucaaagagggagugcauuu

SEQ ID NO: 223980 - RNA, 19 nt, Homo sapiens
cugacgaacuccuugauuu

SEQ ID NO: 223981 - RNA, 19 nt, Homo sapiens
cauguucacuguugacuuc

SEQ ID NO: 223982 - RNA, 19 nt, Homo sapiens
gaagaggcaggguucaaga

SEQ ID NO: 223983 - RNA, 19 nt, Homo sapiens
gggaucacauguucacugu

SEQ ID NO: 223984 - RNA, 19 nt, Homo sapiens
gaaagggugggaucacaug

SEQ ID NO: 223985 - RNA, 19 nt, Homo sapiens
gaguugaaccuaaacauag

SEQ ID NO: 223986 - RNA, 19 nt, Homo sapiens
gcaggaccaccuugaauuc

SEQ ID NO: 223987 - RNA, 19 nt, Homo sapiens
gcacuacgucuuagcugaa

SEQ ID NO: 223988 - RNA, 19 nt, Homo sapiens
gucgucaucuuguucauug

SEQ ID NO: 223989 - RNA, 19 nt, Homo sapiens
ggagucaucaguggaauug

SEQ ID NO: 223990 - RNA, 19 nt, Homo sapiens
gggaagagcagagauauac

SEQ ID NO: 223991 - RNA, 19 nt, Homo sapiens
ggacuauuauggaaaauca

SEQ ID NO: 223992 - RNA, 19 nt, Homo sapiens
agaguugaaccuaaacaua

SEQ ID NO: 223993 - RNA, 19 nt, Homo sapiens
aaagagggagugcauuuau

SEQ ID NO: 223994 - RNA, 19 nt, Homo sapiens
caacaagugccuccuuugg

SEQ ID NO: 223995 - RNA, 19 nt, Homo sapiens
ggcaggaccaccuugaauu

SEQ ID NO: 223996 - RNA, 19 nt, Homo sapiens
gccaaggaguucgaaccua

SEQ ID NO: 223997 - RNA, 19 nt, Homo sapiens
cccagaacaucaccaugaa

SEQ ID NO: 223998 - RNA, 19 nt, Homo sapiens
agacaaaacuagagacuca

SEQ ID NO: 223999 - RNA, 19 nt, Homo sapiens
gaagagcagagauauacgu

SEQ ID NO: 224000 - RNA, 19 nt, Homo sapiens
caauggaugccaaggaguu

SEQ ID NO: 224001 - RNA, 19 nt, Homo sapiens
guaccgagggcuacuggaa

SEQ ID NO: 224002 - RNA, 19 nt, Homo sapiens
aggagagaguugaaccuaa

SEQ ID NO: 224003 - RNA, 19 nt, Homo sapiens
gaucagccccucauuguga

SEQ ID NO: 224004 - RNA, 19 nt, Homo sapiens
ccauggguuuccaguagaa

SEQ ID NO: 224005 - RNA, 19 nt, Homo sapiens
agagggagugcauuuauga

SEQ ID NO: 224006 - RNA, 19 nt, Homo sapiens
aagagggagugcauuuaug

SEQ ID NO: 224007 - RNA, 19 nt, Homo sapiens
cuucuggacuauuauggaa

SEQ ID NO: 224008 - RNA, 19 nt, Homo sapiens
acuguugacuucuggacua

SEQ ID NO: 224009 - RNA, 19 nt, Homo sapiens
ggaagaggcaggguucaag

SEQ ID NO: 224010 - RNA, 19 nt, Homo sapiens
gggcaggaccaccuugaau

SEQ ID NO: 224011 - RNA, 19 nt, Homo sapiens
aaaagaagcggagauuuaa

SEQ ID NO: 224012 - RNA, 19 nt, Homo sapiens
caaggaguucgaaccuaaa

SEQ ID NO: 224013 - RNA, 19 nt, Homo sapiens
uggugaaggugacacauca

SEQ ID NO: 224014 - RNA, 19 nt, Homo sapiens
gggaaaggcacaagauucg

SEQ ID NO: 224015 - RNA, 19 nt, Homo sapiens
cagaacaucaccaugaagu

SEQ ID NO: 224016 - RNA, 19 nt, Homo sapiens
accaacaagugccuccuuu

SEQ ID NO: 224017 - RNA, 19 nt, Homo sapiens
gaauuucaagccagaugug

SEQ ID NO: 224018 - RNA, 19 nt, Homo sapiens
ggugucgggccuugaacua

SEQ ID NO: 224019 - RNA, 19 nt, Homo sapiens
cauccugggcugugaaaug

SEQ ID NO: 224020 - RNA, 19 nt, Homo sapiens
gacgaacuccuugauuuua

SEQ ID NO: 224021 - RNA, 19 nt, Homo sapiens
cuccugagccuaggcaaua

SEQ ID NO: 224022 - RNA, 19 nt, Homo sapiens
caggagagaguugaaccua

SEQ ID NO: 224023 - RNA, 19 nt, Homo sapiens
ggaaggagacaaaacuaga

SEQ ID NO: 224024 - RNA, 19 nt, Homo sapiens
uggauaaccuuggcuguac

SEQ ID NO: 224025 - RNA, 19 nt, Homo sapiens
cuccauggguuuccaguag

SEQ ID NO: 224026 - RNA, 19 nt, Homo sapiens
aguugaaccuaaacauaga

SEQ ID NO: 224027 - RNA, 19 nt, Homo sapiens
gugcauuuaugagcucuuc

SEQ ID NO: 224028 - RNA, 19 nt, Homo sapiens
ggaguucgaaccuaaagac

SEQ ID NO: 224029 - RNA, 19 nt, Homo sapiens
ccaacaagugccuccuuug

SEQ ID NO: 224030 - RNA, 19 nt, Homo sapiens
gaaaugcaagaagacaaca

SEQ ID NO: 224031 - RNA, 19 nt, Homo sapiens
gagaguugaaccuaaacau

SEQ ID NO: 224032 - RNA, 19 nt, Homo sapiens
uagcugaacgugagugaca

SEQ ID NO: 224033 - RNA, 19 nt, Homo sapiens
gcccugacacacuggauug

SEQ ID NO: 224034 - RNA, 19 nt, Homo sapiens
agaaauugccugacgaacu

SEQ ID NO: 224035 - RNA, 19 nt, Homo sapiens
ggauaagcagccaauggau

SEQ ID NO: 224036 - RNA, 19 nt, Homo sapiens
ugaaggauaagcagccaau

SEQ ID NO: 224037 - RNA, 19 nt, Homo sapiens
caucuuguucauuggaauu

SEQ ID NO: 224038 - RNA, 19 nt, Homo sapiens
ucaguggaauugcuguuuu

SEQ ID NO: 224039 - RNA, 19 nt, Homo sapiens
gaccagcuguucguguucu

SEQ ID NO: 224040 - RNA, 19 nt, Homo sapiens
gugggaaaggcacaagauu

SEQ ID NO: 224041 - RNA, 19 nt, Homo sapiens
ggauuggagagcagcagaa

SEQ ID NO: 224042 - RNA, 19 nt, Homo sapiens
agggugggaucacauguuc

SEQ ID NO: 224043 - RNA, 19 nt, Homo sapiens
ccuagucauuggagucauc

SEQ ID NO: 224044 - RNA, 19 nt, Homo sapiens
gucgggccuugaacuacua

SEQ ID NO: 224045 - RNA, 19 nt, Homo sapiens
gugaaggugacacaucaug

SEQ ID NO: 224046 - RNA, 19 nt, Homo sapiens
gaccaacaagugccuccuu

SEQ ID NO: 224047 - RNA, 19 nt, Homo sapiens
ugaauucugcccugacaca

SEQ ID NO: 224048 - RNA, 19 nt, Homo sapiens
aggauaagcagccaaugga

SEQ ID NO: 224049 - RNA, 19 nt, Homo sapiens
ugggaaaggcacaagauuc

SEQ ID NO: 224050 - RNA, 19 nt, Homo sapiens
ccugggcugugaaaugcaa

SEQ ID NO: 224051 - RNA, 19 nt, Homo sapiens
gugaaaugcaagaagacaa

SEQ ID NO: 224052 - RNA, 19 nt, Homo sapiens
ugaaguggcugaaggauaa

SEQ ID NO: 224053 - RNA, 19 nt, Homo sapiens
ggagagaguugaaccuaaa

SEQ ID NO: 224054 - RNA, 19 nt, Homo sapiens
gaaauugccugacgaacuc

SEQ ID NO: 224055 - RNA, 19 nt, Homo sapiens
ccaaggaguucgaaccuaa

SEQ ID NO: 224056 - RNA, 19 nt, Homo sapiens
guucgaaccuaaagacgua

SEQ ID NO: 224057 - RNA, 19 nt, Homo sapiens
caugugaccucuucaguga

SEQ ID NO: 224058 - RNA, 19 nt, Homo sapiens
caaaagaagcggagauuua

SEQ ID NO: 224059 - RNA, 19 nt, Homo sapiens
caaagagggagugcauuua

SEQ ID NO: 224060 - RNA, 19 nt, Homo sapiens
ucaaagagggagugcauuu

SEQ ID NO: 224061 - RNA, 19 nt, Homo sapiens
cugacgaacuccuugauuu

SEQ ID NO: 224062 - RNA, 19 nt, Homo sapiens
gaagaggcaggguucaaga

SEQ ID NO: 224063 - RNA, 19 nt, Homo sapiens
gaguugaaccuaaacauag

SEQ ID NO: 224064 - RNA, 19 nt, Homo sapiens
gcacuacgucuuagcugaa

SEQ ID NO: 224065 - RNA, 19 nt, Homo sapiens
gucgucaucuuguucauug

SEQ ID NO: 224066 - RNA, 19 nt, Homo sapiens
ggagucaucaguggaauug

SEQ ID NO: 224067 - RNA, 19 nt, Homo sapiens
gggaagagcagagauauac

SEQ ID NO: 224068 - RNA, 19 nt, Homo sapiens
agaguugaaccuaaacaua

SEQ ID NO: 224069 - RNA, 19 nt, Homo sapiens
aaagagggagugcauuuau

SEQ ID NO: 224070 - RNA, 19 nt, Homo sapiens
gccaaggaguucgaaccua

SEQ ID NO: 224071 - RNA, 19 nt, Homo sapiens
cccagaacaucaccaugaa

SEQ ID NO: 224072 - RNA, 19 nt, Homo sapiens
agacaaaacuagagacuca

SEQ ID NO: 224073 - RNA, 19 nt, Homo sapiens
gaagagcagagauauacgu

SEQ ID NO: 224074 - RNA, 19 nt, Homo sapiens
caauggaugccaaggaguu

SEQ ID NO: 224075 - RNA, 19 nt, Homo sapiens
aggagagaguugaaccuaa

SEQ ID NO: 224076 - RNA, 19 nt, Homo sapiens
gaucagccccucauuguga

SEQ ID NO: 224077 - RNA, 19 nt, Homo sapiens
agagggagugcauuuauga

SEQ ID NO: 224078 - RNA, 19 nt, Homo sapiens
aagagggagugcauuuaug

SEQ ID NO: 224079 - RNA, 19 nt, Homo sapiens
gcuugcugcugccuccuuu

SEQ ID NO: 224080 - RNA, 19 nt, Homo sapiens
ggaagaggcaggguucaag

SEQ ID NO: 224081 - RNA, 19 nt, Homo sapiens
aaaagaagcggagauuuaa

SEQ ID NO: 224082 - RNA, 19 nt, Homo sapiens
caaggaguucgaaccuaaa

SEQ ID NO: 224083 - RNA, 19 nt, Homo sapiens
uggugaaggugacacauca

SEQ ID NO: 224084 - RNA, 19 nt, Homo sapiens
cagaacaucaccaugaagu

SEQ ID NO: 224085 - RNA, 19 nt, Homo sapiens
ggugucgggccuugaacua

SEQ ID NO: 224086 - RNA, 19 nt, Homo sapiens
gacgaacuccuugauuuua

SEQ ID NO: 224087 - RNA, 19 nt, Homo sapiens
caggagagaguugaaccua

SEQ ID NO: 224088 - RNA, 19 nt, Homo sapiens
cuccugagccuaggcaaua

SEQ ID NO: 224089 - RNA, 19 nt, Homo sapiens
ggaaggagacaaaacuaga

SEQ ID NO: 224090 - RNA, 19 nt, Homo sapiens
uggauaaccuuggcuguac

SEQ ID NO: 224091 - RNA, 19 nt, Homo sapiens
aguugaaccuaaacauaga

SEQ ID NO: 224092 - RNA, 19 nt, Homo sapiens
gugcauuuaugagcucuuc

SEQ ID NO: 224093 - RNA, 19 nt, Homo sapiens
ggaguucgaaccuaaagac

SEQ ID NO: 224094 - RNA, 19 nt, Homo sapiens
gagaguugaaccuaaacau

SEQ ID NO: 224095 - RNA, 19 nt, Homo sapiens
uagcugaacgugagugaca

SEQ ID NO: 224096 - RNA, 19 nt, Homo sapiens
agaaauugccugacgaacu

SEQ ID NO: 224097 - RNA, 19 nt, Homo sapiens
ggauaagcagccaauggau

SEQ ID NO: 224098 - RNA, 19 nt, Homo sapiens
ugaaggauaagcagccaau

SEQ ID NO: 224099 - RNA, 19 nt, Homo sapiens
caucuuguucauuggaauu

SEQ ID NO: 224100 - RNA, 19 nt, Homo sapiens
ucaguggaauugcuguuuu

SEQ ID NO: 224101 - RNA, 19 nt, Homo sapiens
ccuagucauuggagucauc

SEQ ID NO: 224102 - RNA, 19 nt, Homo sapiens
gucgggccuugaacuacua

SEQ ID NO: 224103 - RNA, 19 nt, Homo sapiens
gugaaggugacacaucaug

SEQ ID NO: 224104 - RNA, 19 nt, Homo sapiens
aggauaagcagccaaugga

SEQ ID NO: 224105 - RNA, 19 nt, Homo sapiens
ggagagaguugaaccuaaa

SEQ ID NO: 224106 - RNA, 19 nt, Homo sapiens
gaaauugccugacgaacuc

SEQ ID NO: 224107 - RNA, 19 nt, Homo sapiens
caaaagaagcggagauuua

SEQ ID NO: 224108 - RNA, 19 nt, Homo sapiens
caaagagggagugcauuua

SEQ ID NO: 224109 - RNA, 19 nt, Homo sapiens
ucaaagagggagugcauuu

SEQ ID NO: 224110 - RNA, 19 nt, Homo sapiens
cugacgaacuccuugauuu

SEQ ID NO: 224111 - RNA, 19 nt, Homo sapiens
gaagaggcaggguucaaga

SEQ ID NO: 224112 - RNA, 19 nt, Homo sapiens
gaguugaaccuaaacauag

SEQ ID NO: 224113 - RNA, 19 nt, Homo sapiens
gcacuacgucuuagcugaa

SEQ ID NO: 224114 - RNA, 19 nt, Homo sapiens
gucgucaucuuguucauug

SEQ ID NO: 224115 - RNA, 19 nt, Homo sapiens
ggagucaucaguggaauug

SEQ ID NO: 224116 - RNA, 19 nt, Homo sapiens
agaguugaaccuaaacaua

SEQ ID NO: 224117 - RNA, 19 nt, Homo sapiens
aaagagggagugcauuuau

SEQ ID NO: 224118 - RNA, 19 nt, Homo sapiens
agacaaaacuagagacuca

SEQ ID NO: 224119 - RNA, 19 nt, Homo sapiens
aggagagaguugaaccuaa

SEQ ID NO: 224120 - RNA, 19 nt, Homo sapiens
agagggagugcauuuauga

SEQ ID NO: 224121 - RNA, 19 nt, Homo sapiens
aagagggagugcauuuaug

SEQ ID NO: 224122 - RNA, 19 nt, Homo sapiens
ggaagaggcaggguucaag

SEQ ID NO: 224123 - RNA, 19 nt, Homo sapiens
aaaagaagcggagauuuaa

SEQ ID NO: 224124 - RNA, 19 nt, Homo sapiens
gacgaacuccuugauuuua

SEQ ID NO: 224125 - RNA, 19 nt, Homo sapiens
caggagagaguugaaccua

SEQ ID NO: 224126 - RNA, 19 nt, Homo sapiens
ggaaggagacaaaacuaga

SEQ ID NO: 224127 - RNA, 19 nt, Homo sapiens
cuccugagccuaggcaaua

SEQ ID NO: 224128 - RNA, 19 nt, Homo sapiens
aguugaaccuaaacauaga

SEQ ID NO: 224129 - RNA, 19 nt, Homo sapiens
gugcauuuaugagcucuuc

SEQ ID NO: 224130 - RNA, 19 nt, Homo sapiens
gagaguugaaccuaaacau

SEQ ID NO: 224131 - RNA, 19 nt, Homo sapiens
uagcugaacgugagugaca

SEQ ID NO: 224132 - RNA, 19 nt, Homo sapiens
agaaauugccugacgaacu

SEQ ID NO: 224133 - RNA, 19 nt, Homo sapiens
caucuuguucauuggaauu

SEQ ID NO: 224134 - RNA, 19 nt, Homo sapiens
ucaguggaauugcuguuuu

SEQ ID NO: 224135 - RNA, 19 nt, Homo sapiens
ccuagucauuggagucauc

SEQ ID NO: 224136 - RNA, 19 nt, Homo sapiens
gaagugauguguuuaaaug

SEQ ID NO: 224137 - RNA, 19 nt, Homo sapiens
gaaagcagauucaaagcaa

SEQ ID NO: 224138 - RNA, 19 nt, Homo sapiens
cgaauaacauguagaaaug

SEQ ID NO: 224139 - RNA, 19 nt, Homo sapiens
gagaguacguuaucaaugu

SEQ ID NO: 224140 - RNA, 19 nt, Homo sapiens
cgagacagaugaguaaaua

SEQ ID NO: 224141 - RNA, 19 nt, Homo sapiens
ccaaacagaagcuuuauuu

SEQ ID NO: 224142 - RNA, 19 nt, Homo sapiens
gaagaagugauguguuuaa

SEQ ID NO: 224143 - RNA, 19 nt, Homo sapiens
ugaaucagcugaauuugug

SEQ ID NO: 224144 - RNA, 19 nt, Homo sapiens
cagcugaauuuguguguaa

SEQ ID NO: 224145 - RNA, 19 nt, Homo sapiens
caccaccacugaaguauuu

SEQ ID NO: 224146 - RNA, 19 nt, Homo sapiens
ucacggauauccucuguug

SEQ ID NO: 224147 - RNA, 19 nt, Homo sapiens
ggugauacugugcaaauua

SEQ ID NO: 224148 - RNA, 19 nt, Homo sapiens
uguaauaucccgagaaauu

SEQ ID NO: 224149 - RNA, 19 nt, Homo sapiens
gcgaauaacauguagaaau

SEQ ID NO: 224150 - RNA, 19 nt, Homo sapiens
gaggguaacaagcgaauaa

SEQ ID NO: 224151 - RNA, 19 nt, Homo sapiens
uaggagcccuuaugaaaug

SEQ ID NO: 224152 - RNA, 19 nt, Homo sapiens
gaagcaacauuuugugauu

SEQ ID NO: 224153 - RNA, 19 nt, Homo sapiens
ccaccucaaugcaaagauu

SEQ ID NO: 224154 - RNA, 19 nt, Homo sapiens
augaagaagugauguguuu

SEQ ID NO: 224155 - RNA, 19 nt, Homo sapiens
caggggaaguuuucuauua

SEQ ID NO: 224156 - RNA, 19 nt, Homo sapiens
gugauacugugcaaauuau

SEQ ID NO: 224157 - RNA, 19 nt, Homo sapiens
uguaggagcccuuaugaaa

SEQ ID NO: 224158 - RNA, 19 nt, Homo sapiens
ggaaggugauacugugcaa

SEQ ID NO: 224159 - RNA, 19 nt, Homo sapiens
cagccaaacagaagcuuua

SEQ ID NO: 224160 - RNA, 19 nt, Homo sapiens
guaacaagcgaauaacaug

SEQ ID NO: 224161 - RNA, 19 nt, Homo sapiens
caacacaggauacagacuu

SEQ ID NO: 224162 - RNA, 19 nt, Homo sapiens
accgguggcucucuucuua

SEQ ID NO: 224163 - RNA, 19 nt, Homo sapiens
gagcccuuaugaaauguuu

SEQ ID NO: 224164 - RNA, 19 nt, Homo sapiens
auucuaaucucacggauau

SEQ ID NO: 224165 - RNA, 19 nt, Homo sapiens
uguguaauaucccgagaaa

SEQ ID NO: 224166 - RNA, 19 nt, Homo sapiens
ggaauucuauaugaugaag

SEQ ID NO: 224167 - RNA, 19 nt, Homo sapiens
cagaagcuuuauuugagaa

SEQ ID NO: 224168 - RNA, 19 nt, Homo sapiens
aacagaagcuuuauuugag

SEQ ID NO: 224169 - RNA, 19 nt, Homo sapiens
acagaagcuuuauuugaga

SEQ ID NO: 224170 - RNA, 19 nt, Homo sapiens
agaguacguuaucaaugua

SEQ ID NO: 224171 - RNA, 19 nt, Homo sapiens
gcaacaccaccaccacuga

SEQ ID NO: 224172 - RNA, 19 nt, Homo sapiens
gagagaguacguuaucaau

SEQ ID NO: 224173 - RNA, 19 nt, Homo sapiens
gggauaucgucuuucauca

SEQ ID NO: 224174 - RNA, 19 nt, Homo sapiens
guaggagcccuuaugaaau

SEQ ID NO: 224175 - RNA, 19 nt, Homo sapiens
ucucacacauugcgaacaa

SEQ ID NO: 224176 - RNA, 19 nt, Homo sapiens
gaaauggacaauggucaga

SEQ ID NO: 224177 - RNA, 19 nt, Homo sapiens
ccaaaugcagguccacuga

SEQ ID NO: 224178 - RNA, 19 nt, Homo sapiens
gauacagacuucaaaacaa

SEQ ID NO: 224179 - RNA, 19 nt, Homo sapiens
gugauguguuuaaauggaa

SEQ ID NO: 224180 - RNA, 19 nt, Homo sapiens
gcuccagcuucaucaguug

SEQ ID NO: 224181 - RNA, 19 nt, Homo sapiens
gcagguccacugacacuuc

SEQ ID NO: 224182 - RNA, 19 nt, Homo sapiens
cauaacaugcacagaagaa

SEQ ID NO: 224183 - RNA, 19 nt, Homo sapiens
accauggaauucuauauga

SEQ ID NO: 224184 - RNA, 19 nt, Homo sapiens
cgguggcucucuucuuaaa

SEQ ID NO: 224185 - RNA, 19 nt, Homo sapiens
gguaacaagcgaauaacau

SEQ ID NO: 224186 - RNA, 19 nt, Homo sapiens
caguguaauucuaaucuca

SEQ ID NO: 224187 - RNA, 19 nt, Homo sapiens
ggugagagaguacguuauc

SEQ ID NO: 224188 - RNA, 19 nt, Homo sapiens
gacuguguuucuuuccuuu

SEQ ID NO: 224189 - RNA, 19 nt, Homo sapiens
ccauggaauucuauaugau

SEQ ID NO: 224190 - RNA, 19 nt, Homo sapiens
uaucgucuuucaucacguu

SEQ ID NO: 224191 - RNA, 19 nt, Homo sapiens
aaacggggauaucgucuuu

SEQ ID NO: 224192 - RNA, 19 nt, Homo sapiens
gaagcuuuauuugagaaca

SEQ ID NO: 224193 - RNA, 19 nt, Homo sapiens
ugccagaacuuguaucaac

SEQ ID NO: 224194 - RNA, 19 nt, Homo sapiens
caauguaggagcccuuaug

SEQ ID NO: 224195 - RNA, 19 nt, Homo sapiens
ccuggucaguguaauucua

SEQ ID NO: 224196 - RNA, 19 nt, Homo sapiens
cagaacuuguaucaacuug

SEQ ID NO: 224197 - RNA, 19 nt, Homo sapiens
caacaccaccaccacugaa

SEQ ID NO: 224198 - RNA, 19 nt, Homo sapiens
guaccaaugccagaacuug

SEQ ID NO: 224199 - RNA, 19 nt, Homo sapiens
ugaagaagugauguguuua

SEQ ID NO: 224200 - RNA, 19 nt, Homo sapiens
aaauauccaucuggugaga

SEQ ID NO: 224201 - RNA, 19 nt, Homo sapiens
agacagaugaguaaauauc

SEQ ID NO: 224202 - RNA, 19 nt, Homo sapiens
aaaugcagguccacugaca

SEQ ID NO: 224203 - RNA, 19 nt, Homo sapiens
gugaaucagcugaauuugu

SEQ ID NO: 224204 - RNA, 19 nt, Homo sapiens
uaacaagcgaauaacaugu

SEQ ID NO: 224205 - RNA, 19 nt, Homo sapiens
gaugaagaagugauguguu

SEQ ID NO: 224206 - RNA, 19 nt, Homo sapiens
gggaugggaaacuggagua

SEQ ID NO: 224207 - RNA, 19 nt, Homo sapiens
ucucagacuguguuucuuu

SEQ ID NO: 224208 - RNA, 19 nt, Homo sapiens
aagcgaauaacauguagaa

SEQ ID NO: 224209 - RNA, 19 nt, Homo sapiens
aacaagcgaauaacaugua

SEQ ID NO: 224210 - RNA, 19 nt, Homo sapiens
caccaccaccacugaagua

SEQ ID NO: 224211 - RNA, 19 nt, Homo sapiens
ggaugaagaagugaugugu

SEQ ID NO: 224212 - RNA, 19 nt, Homo sapiens
ugagagaguacguuaucaa

SEQ ID NO: 224213 - RNA, 19 nt, Homo sapiens
acaaacacaucuggaaggu

SEQ ID NO: 224214 - RNA, 19 nt, Homo sapiens
agacuguguuucuuuccuu

SEQ ID NO: 224215 - RNA, 19 nt, Homo sapiens
cauggaauucuauaugaug

SEQ ID NO: 224216 - RNA, 19 nt, Homo sapiens
ggucagaaccaccaaaaug

SEQ ID NO: 224217 - RNA, 19 nt, Homo sapiens
gccagaacuuguaucaacu

SEQ ID NO: 224218 - RNA, 19 nt, Homo sapiens
aguauaugcuccagcuuca

SEQ ID NO: 224219 - RNA, 19 nt, Homo sapiens
agugauguguuuaaaugga

SEQ ID NO: 224220 - RNA, 19 nt, Homo sapiens
ucagcugaauuugugugua

SEQ ID NO: 224221 - RNA, 19 nt, Homo sapiens
uaagguggacagccaaaca

SEQ ID NO: 224222 - RNA, 19 nt, Homo sapiens
ucauucccguugucaguau

SEQ ID NO: 224223 - RNA, 19 nt, Homo sapiens
guauccaacuugugcaaaa

SEQ ID NO: 224224 - RNA, 19 nt, Homo sapiens
acaagcgaauaacauguag

SEQ ID NO: 224225 - RNA, 19 nt, Homo sapiens
gcuccuggucaguguaauu

SEQ ID NO: 224226 - RNA, 19 nt, Homo sapiens
ccaccaccacugaaguauu

SEQ ID NO: 224227 - RNA, 19 nt, Homo sapiens
gugagagaguacguuauca

SEQ ID NO: 224228 - RNA, 19 nt, Homo sapiens
acacauugcgaacaacaug

SEQ ID NO: 224229 - RNA, 19 nt, Homo sapiens
caucacguucucacacauu

SEQ ID NO: 224230 - RNA, 19 nt, Homo sapiens
aggugaaucagcugaauuu

SEQ ID NO: 224231 - RNA, 19 nt, Homo sapiens
gaauaacauguagaaaugg

SEQ ID NO: 224232 - RNA, 19 nt, Homo sapiens
ccagaacuuguaucaacuu

SEQ ID NO: 224233 - RNA, 19 nt, Homo sapiens
ccaaugccagaacuuguau

SEQ ID NO: 224234 - RNA, 19 nt, Homo sapiens
ucucacggauauccucugu

SEQ ID NO: 224235 - RNA, 19 nt, Homo sapiens
ggauacagacuucaaaaca

SEQ ID NO: 224236 - RNA, 19 nt, Homo sapiens
gaagcaauguucugugauu

SEQ ID NO: 224237 - RNA, 19 nt, Homo sapiens
caccaccacugaaguauuu

SEQ ID NO: 224238 - RNA, 19 nt, Homo sapiens
ggugauacuguacaaauua

SEQ ID NO: 224239 - RNA, 19 nt, Homo sapiens
ucacggauauccucuguug

SEQ ID NO: 224240 - RNA, 19 nt, Homo sapiens
gaggguaacaaucaaauaa

SEQ ID NO: 224241 - RNA, 19 nt, Homo sapiens
caaauaacauguagaaacg

SEQ ID NO: 224242 - RNA, 19 nt, Homo sapiens
gaacaggugacauaguuga

SEQ ID NO: 224243 - RNA, 19 nt, Homo sapiens
aagaacaggugacauaguu

SEQ ID NO: 224244 - RNA, 19 nt, Homo sapiens
ggaaggugauacuguacaa

SEQ ID NO: 224245 - RNA, 19 nt, Homo sapiens
caggggaaguuuucuauua

SEQ ID NO: 224246 - RNA, 19 nt, Homo sapiens
caggugacauaguugaauu

SEQ ID NO: 224247 - RNA, 19 nt, Homo sapiens
ggguaacaaucaaauaaca

SEQ ID NO: 224248 - RNA, 19 nt, Homo sapiens
caacacaggauacagacuu

SEQ ID NO: 224249 - RNA, 19 nt, Homo sapiens
ucuggaaggugauacugua

SEQ ID NO: 224250 - RNA, 19 nt, Homo sapiens
cgagcaaugugucagaaug

SEQ ID NO: 224251 - RNA, 19 nt, Homo sapiens
gcuccagguucaucaguug

SEQ ID NO: 224252 - RNA, 19 nt, Homo sapiens
auucuaaucucacggauau

SEQ ID NO: 224253 - RNA, 19 nt, Homo sapiens
ggcacgagauucaaagcaa

SEQ ID NO: 224254 - RNA, 19 nt, Homo sapiens
ggaauucuauaugaugaag

SEQ ID NO: 224255 - RNA, 19 nt, Homo sapiens
gcaacaccaccaccacuga

SEQ ID NO: 224256 - RNA, 19 nt, Homo sapiens
augcuuagauccaugugua

SEQ ID NO: 224257 - RNA, 19 nt, Homo sapiens
gauacagacuucaaaacaa

SEQ ID NO: 224258 - RNA, 19 nt, Homo sapiens
ccaaaugcagguccacuau

SEQ ID NO: 224259 - RNA, 19 nt, Homo sapiens
auggagacauuacuucauu

SEQ ID NO: 224260 - RNA, 19 nt, Homo sapiens
caaaugcagguccacuauu

SEQ ID NO: 224261 - RNA, 19 nt, Homo sapiens
guucaucaguugaguacca

SEQ ID NO: 224262 - RNA, 19 nt, Homo sapiens
accauggaauucuauauga

SEQ ID NO: 224263 - RNA, 19 nt, Homo sapiens
gacuguguuucuuuccuuu

SEQ ID NO: 224264 - RNA, 19 nt, Homo sapiens
ccauggaauucuauaugau

SEQ ID NO: 224265 - RNA, 19 nt, Homo sapiens
aagcaauguucugugauuu

SEQ ID NO: 224266 - RNA, 19 nt, Homo sapiens
caguguaauucuaaucuca

SEQ ID NO: 224267 - RNA, 19 nt, Homo sapiens
ugccagaacuuguaucaac

SEQ ID NO: 224268 - RNA, 19 nt, Homo sapiens
ccuggucaguguaauucua

SEQ ID NO: 224269 - RNA, 19 nt, Homo sapiens
uaaaguggacaaaccaaca

SEQ ID NO: 224270 - RNA, 19 nt, Homo sapiens
cagaacuuguaucaacuug

SEQ ID NO: 224271 - RNA, 19 nt, Homo sapiens
gguccacuccucccaaaug

SEQ ID NO: 224272 - RNA, 19 nt, Homo sapiens
caacaccaccaccacugaa

SEQ ID NO: 224273 - RNA, 19 nt, Homo sapiens
gaaugggaaacugguauau

SEQ ID NO: 224274 - RNA, 19 nt, Homo sapiens
uucaagaacaggugacaua

SEQ ID NO: 224275 - RNA, 19 nt, Homo sapiens
caacuugaggguaacaauc

SEQ ID NO: 224276 - RNA, 19 nt, Homo sapiens
gaaggugauacuguacaaa

SEQ ID NO: 224277 - RNA, 19 nt, Homo sapiens
ugaggguaacaaucaaaua

SEQ ID NO: 224278 - RNA, 19 nt, Homo sapiens
ucucagacuguguuucuuu

SEQ ID NO: 224279 - RNA, 19 nt, Homo sapiens
cauaacgugcgcagaagaa

SEQ ID NO: 224280 - RNA, 19 nt, Homo sapiens
gcauaacgugcgcagaaga

SEQ ID NO: 224281 - RNA, 19 nt, Homo sapiens
gcaauguucugugauuuuc

SEQ ID NO: 224282 - RNA, 19 nt, Homo sapiens
agaaugggaaacugguaua

SEQ ID NO: 224283 - RNA, 19 nt, Homo sapiens
cuuagauccauguguaaua

SEQ ID NO: 224284 - RNA, 19 nt, Homo sapiens
ucauuccuguugucaguau

SEQ ID NO: 224285 - RNA, 19 nt, Homo sapiens
caccaccaccacugaagua

SEQ ID NO: 224286 - RNA, 19 nt, Homo sapiens
acaaacacaucuggaaggu

SEQ ID NO: 224287 - RNA, 19 nt, Homo sapiens
agacuguguuucuuuccuu

SEQ ID NO: 224288 - RNA, 19 nt, Homo sapiens
caagaacaggugacauagu

SEQ ID NO: 224289 - RNA, 19 nt, Homo sapiens
agauccauguguaauauca

SEQ ID NO: 224290 - RNA, 19 nt, Homo sapiens
cauggaauucuauaugaug

SEQ ID NO: 224291 - RNA, 19 nt, Homo sapiens
ggucagaaccaccaaaaug

SEQ ID NO: 224292 - RNA, 19 nt, Homo sapiens
gaaacggacaauggucaga

SEQ ID NO: 224293 - RNA, 19 nt, Homo sapiens
gccagaacuuguaucaacu

SEQ ID NO: 224294 - RNA, 19 nt, Homo sapiens
aguauaugcuccagguuca

SEQ ID NO: 224295 - RNA, 19 nt, Homo sapiens
gagcaaugugucagaaugg

SEQ ID NO: 224296 - RNA, 19 nt, Homo sapiens
ucucauucauuucgagcaa

SEQ ID NO: 224297 - RNA, 19 nt, Homo sapiens
cuucauuccuguugucagu

SEQ ID NO: 224298 - RNA, 19 nt, Homo sapiens
aggugauacuguacaaauu

SEQ ID NO: 224299 - RNA, 19 nt, Homo sapiens
ccaccaccacugaaguauu

SEQ ID NO: 224300 - RNA, 19 nt, Homo sapiens
aaauuaaaguggacaaacc

SEQ ID NO: 224301 - RNA, 19 nt, Homo sapiens
gcuccuggucaguguaauu

SEQ ID NO: 224302 - RNA, 19 nt, Homo sapiens
cagaaugggaaacugguau

SEQ ID NO: 224303 - RNA, 19 nt, Homo sapiens
gugacauaguugaauuugu

SEQ ID NO: 224304 - RNA, 19 nt, Homo sapiens
ucucacggauauccucugu

SEQ ID NO: 224305 - RNA, 19 nt, Homo sapiens
ccagaacuuguaucaacuu

SEQ ID NO: 224306 - RNA, 19 nt, Homo sapiens
ggauacagacuucaaaaca

SEQ ID NO: 224307 - RNA, 19 nt, Homo sapiens
ggugacauaguugaauuug

SEQ ID NO: 224308 - RNA, 19 nt, Homo sapiens
ucagaaugggaaacuggua

SEQ ID NO: 224309 - RNA, 19 nt, Homo sapiens
caaaccaacaaaagcuuua

SEQ ID NO: 224310 - RNA, 19 nt, Homo sapiens
aaacggacaauggucagaa

SEQ ID NO: 224311 - RNA, 19 nt, Homo sapiens
aaaguggacaaaccaacaa

SEQ ID NO: 224312 - RNA, 19 nt, Homo sapiens
ccaccaaaaugcuuagauc

SEQ ID NO: 224313 - RNA, 19 nt, Homo sapiens
gauaucauccaacaaaauc

SEQ ID NO: 224314 - RNA, 19 nt, Homo sapiens
guuuguaaaucuggauauc

SEQ ID NO: 224315 - RNA, 19 nt, Homo sapiens
guaccagugccagaacuug

SEQ ID NO: 224316 - RNA, 19 nt, Homo sapiens
uuacuucauuccuguuguc

SEQ ID NO: 224317 - RNA, 19 nt, Homo sapiens
aaggugauacuguacaaau

SEQ ID NO: 224318 - RNA, 19 nt, Homo sapiens
ugguauaucccaguuguga

SEQ ID NO: 224319 - RNA, 19 nt, Homo sapiens
acacaucuggaaggugaua

SEQ ID NO: 224320 - RNA, 19 nt, Homo sapiens
aaccauggaauucuauaug

SEQ ID NO: 224321 - RNA, 19 nt, Homo sapiens
gaacauugcuaccauaauu

SEQ ID NO: 224322 - RNA, 19 nt, Homo sapiens
aagagaagcuggcuguaua

SEQ ID NO: 224323 - RNA, 19 nt, Homo sapiens
gaaacgcauuugcaaaguu

SEQ ID NO: 224324 - RNA, 19 nt, Homo sapiens
gaagcuggcuguauaggau

SEQ ID NO: 224325 - RNA, 19 nt, Homo sapiens
guuacacggucauuaauaa

SEQ ID NO: 224326 - RNA, 19 nt, Homo sapiens
gacauaaagucuaacaaug

SEQ ID NO: 224327 - RNA, 19 nt, Homo sapiens
gaaccggaauauccaaaga

SEQ ID NO: 224328 - RNA, 19 nt, Homo sapiens
guaugaggaucgccaagua

SEQ ID NO: 224329 - RNA, 19 nt, Homo sapiens
guguggagcuggagacaua

SEQ ID NO: 224330 - RNA, 19 nt, Homo sapiens
gaugagaacuaccacaagu

SEQ ID NO: 224331 - RNA, 19 nt, Homo sapiens
gaaaauggcugaguuaaag

SEQ ID NO: 224332 - RNA, 19 nt, Homo sapiens
aguacaaccugaagaauuu

SEQ ID NO: 224333 - RNA, 19 nt, Homo sapiens
ggucuaugguguccacuuu

SEQ ID NO: 224334 - RNA, 19 nt, Homo sapiens
ccacggagcaccaauaaga

SEQ ID NO: 224335 - RNA, 19 nt, Homo sapiens
gauccucgcugcccagguu

SEQ ID NO: 224336 - RNA, 19 nt, Homo sapiens
cagcagaaccuaauugaga

SEQ ID NO: 224337 - RNA, 19 nt, Homo sapiens
cagcauagaugucuuugag

SEQ ID NO: 224338 - RNA, 19 nt, Homo sapiens
ggaauuauacacccuacaa

SEQ ID NO: 224339 - RNA, 19 nt, Homo sapiens
ggaaugaguguucuucaga

SEQ ID NO: 224340 - RNA, 19 nt, Homo sapiens
gaguggccauugcugauuu

SEQ ID NO: 224341 - RNA, 19 nt, Homo sapiens
ugaguuaccugaccuugga

SEQ ID NO: 224342 - RNA, 19 nt, Homo sapiens
caccauggcauuuauguuu

SEQ ID NO: 224343 - RNA, 19 nt, Homo sapiens
gaugcugacugcuuugaga

SEQ ID NO: 224344 - RNA, 19 nt, Homo sapiens
caauaaacuugcugguguu

SEQ ID NO: 224345 - RNA, 19 nt, Homo sapiens
ggaaacgcauuugcaaagu

SEQ ID NO: 224346 - RNA, 19 nt, Homo sapiens
gaguagauuugugaagauu

SEQ ID NO: 224347 - RNA, 19 nt, Homo sapiens
gaacagaugcuuuuacaau

SEQ ID NO: 224348 - RNA, 19 nt, Homo sapiens
gaaggagaaagaagcauug

SEQ ID NO: 224349 - RNA, 19 nt, Homo sapiens
gaacccagcagaaccuaau

SEQ ID NO: 224350 - RNA, 19 nt, Homo sapiens
aaacgcauuugcaaaguuc

SEQ ID NO: 224351 - RNA, 19 nt, Homo sapiens
aagaguagauuugugaaga

SEQ ID NO: 224352 - RNA, 19 nt, Homo sapiens
gauucuaccuucaguuucu

SEQ ID NO: 224353 - RNA, 19 nt, Homo sapiens
gcugucaccuuaauuacuc

SEQ ID NO: 224354 - RNA, 19 nt, Homo sapiens
gguuacacggucauuaaua

SEQ ID NO: 224355 - RNA, 19 nt, Homo sapiens
gagaacagaugcuuuuaca

SEQ ID NO: 224356 - RNA, 19 nt, Homo sapiens
uaaacuugcugguguucug

SEQ ID NO: 224357 - RNA, 19 nt, Homo sapiens
guagauuugugaagauucu

SEQ ID NO: 224358 - RNA, 19 nt, Homo sapiens
gagagaaaauggcugaguu

SEQ ID NO: 224359 - RNA, 19 nt, Homo sapiens
gaagucaccacacauagag

SEQ ID NO: 224360 - RNA, 19 nt, Homo sapiens
ccauggcauuuauguuuga

SEQ ID NO: 224361 - RNA, 19 nt, Homo sapiens
ugaguggccugcauaccuu

SEQ ID NO: 224362 - RNA, 19 nt, Homo sapiens
uucuauggcugucaccuua

SEQ ID NO: 224363 - RNA, 19 nt, Homo sapiens
ccuucaggccuccuuauua

SEQ ID NO: 224364 - RNA, 19 nt, Homo sapiens
gugguuacacggucauuaa

SEQ ID NO: 224365 - RNA, 19 nt, Homo sapiens
ucuaugguguccacuuuga

SEQ ID NO: 224366 - RNA, 19 nt, Homo sapiens
gauggggacuucuugauug

SEQ ID NO: 224367 - RNA, 19 nt, Homo sapiens
acaaugggcuugcuaucca

SEQ ID NO: 224368 - RNA, 19 nt, Homo sapiens
uaauugagacuggaacauu

SEQ ID NO: 224369 - RNA, 19 nt, Homo sapiens
ccagguguuuggaugagaa

SEQ ID NO: 224370 - RNA, 19 nt, Homo sapiens
uaagagaagcuggcuguau

SEQ ID NO: 224371 - RNA, 19 nt, Homo sapiens
caggaucggcuuucacuug

SEQ ID NO: 224372 - RNA, 19 nt, Homo sapiens
aauugagacuggaacauug

SEQ ID NO: 224373 - RNA, 19 nt, Homo sapiens
guauaggauucuaccuuca

SEQ ID NO: 224374 - RNA, 19 nt, Homo sapiens
ccugaagucaccacacaua

SEQ ID NO: 224375 - RNA, 19 nt, Homo sapiens
acaaguacaaccugaagaa

SEQ ID NO: 224376 - RNA, 19 nt, Homo sapiens
ccaaaagcaucucagaaga

SEQ ID NO: 224377 - RNA, 19 nt, Homo sapiens
ccagaaggacagaauaauc

SEQ ID NO: 224378 - RNA, 19 nt, Homo sapiens
gaguuaaaguacauuucug

SEQ ID NO: 224379 - RNA, 19 nt, Homo sapiens
gaauauccaaagagugguu

SEQ ID NO: 224380 - RNA, 19 nt, Homo sapiens
gggaaugaguguucuucag

SEQ ID NO: 224381 - RNA, 19 nt, Homo sapiens
gcuggcaccugagaggauu

SEQ ID NO: 224382 - RNA, 19 nt, Homo sapiens
ugaaggagaaagaagcauu

SEQ ID NO: 224383 - RNA, 19 nt, Homo sapiens
gcagugggaaccggaauau

SEQ ID NO: 224384 - RNA, 19 nt, Homo sapiens
gcuaccauaauuaagagua

SEQ ID NO: 224385 - RNA, 19 nt, Homo sapiens
cauccgaggucacuaugag

SEQ ID NO: 224386 - RNA, 19 nt, Homo sapiens
cuucaggccuccuuauuac

SEQ ID NO: 224387 - RNA, 19 nt, Homo sapiens
ggaguggccauugcugauu

SEQ ID NO: 224388 - RNA, 19 nt, Homo sapiens
uaaccagcuuagauggaaa

SEQ ID NO: 224389 - RNA, 19 nt, Homo sapiens
acaauucuuucagcuaguu

SEQ ID NO: 224390 - RNA, 19 nt, Homo sapiens
acucagaacuuuuauggaa

SEQ ID NO: 224391 - RNA, 19 nt, Homo sapiens
ugaagucaccacacauaga

SEQ ID NO: 224392 - RNA, 19 nt, Homo sapiens
aaaagcaucucagaagaaa

SEQ ID NO: 224393 - RNA, 19 nt, Homo sapiens
caugcagacccauccauuu

SEQ ID NO: 224394 - RNA, 19 nt, Homo sapiens
gggccuggguuuccugaag

SEQ ID NO: 224395 - RNA, 19 nt, Homo sapiens
ugaguguucuucagaggau

SEQ ID NO: 224396 - RNA, 19 nt, Homo sapiens
acacauagaggagagagaa

SEQ ID NO: 224397 - RNA, 19 nt, Homo sapiens
caugcuuucugguaguauu

SEQ ID NO: 224398 - RNA, 19 nt, Homo sapiens
cuggaacauugcuaccaua

SEQ ID NO: 224399 - RNA, 19 nt, Homo sapiens
gaccugaugcugacugcuu

SEQ ID NO: 224400 - RNA, 19 nt, Homo sapiens
auuauacacccuacaagua

SEQ ID NO: 224401 - RNA, 19 nt, Homo sapiens
guucagcauagaugucuuu

SEQ ID NO: 224402 - RNA, 19 nt, Homo sapiens
aaucucaugcuuucuggua

SEQ ID NO: 224403 - RNA, 19 nt, Homo sapiens
agaguagauuugugaagau

SEQ ID NO: 224404 - RNA, 19 nt, Homo sapiens
ggaacauugcuaccauaau

SEQ ID NO: 224405 - RNA, 19 nt, Homo sapiens
aaauggcugaguuaaagua

SEQ ID NO: 224406 - RNA, 19 nt, Homo sapiens
gcaccauggcauuuauguu

SEQ ID NO: 224407 - RNA, 19 nt, Homo sapiens
uggaaaccauuugagauuc

SEQ ID NO: 224408 - RNA, 19 nt, Homo sapiens
uucagaaucucaugcuuuc

SEQ ID NO: 224409 - RNA, 19 nt, Homo sapiens
cuucagaaucucaugcuuu

SEQ ID NO: 224410 - RNA, 19 nt, Homo sapiens
aaguacaaccugaagaauu

SEQ ID NO: 224411 - RNA, 19 nt, Homo sapiens
agagugguuugaaggagaa

SEQ ID NO: 224412 - RNA, 19 nt, Homo sapiens
acauaaagucuaacaaugg

SEQ ID NO: 224413 - RNA, 19 nt, Homo sapiens
gaaaccauuugagauucca

SEQ ID NO: 224414 - RNA, 19 nt, Homo sapiens
caagcccuuugaauccauu

SEQ ID NO: 224415 - RNA, 19 nt, Homo sapiens
ucacaagcccuuugaaucc

SEQ ID NO: 224416 - RNA, 19 nt, Homo sapiens
uggcauuuauguuugaauc

SEQ ID NO: 224417 - RNA, 19 nt, Homo sapiens
uaccauaggaacugcauga

SEQ ID NO: 224418 - RNA, 19 nt, Homo sapiens
gcagacccauccauuuuca

SEQ ID NO: 224419 - RNA, 19 nt, Homo sapiens
ggaaccuucucauuuacac

SEQ ID NO: 224420 - RNA, 19 nt, Homo sapiens
gggcuugcuauccacauuu

SEQ ID NO: 224421 - RNA, 19 nt, Homo sapiens
caacuaugauggccuauua

SEQ ID NO: 224422 - RNA, 19 nt, Homo sapiens
gcaaacagguucucaaugu

SEQ ID NO: 224423 - RNA, 19 nt, Homo sapiens
caaguaagcugaaugagaa

SEQ ID NO: 224424 - RNA, 19 nt, Homo sapiens
gaagauacuugaauggauu

SEQ ID NO: 224425 - RNA, 19 nt, Homo sapiens
gcuaauagauguacuagga

SEQ ID NO: 224426 - RNA, 19 nt, Homo sapiens
gacaagggcuuugaugaua

SEQ ID NO: 224427 - RNA, 19 nt, Homo sapiens
gaaugagucugaaauaugu

SEQ ID NO: 224428 - RNA, 19 nt, Homo sapiens
gcacaucucuauauaaugg

SEQ ID NO: 224429 - RNA, 19 nt, Homo sapiens
gaaacugcaucauugguaa

SEQ ID NO: 224430 - RNA, 19 nt, Homo sapiens
caaacaagaucuggacuaa

SEQ ID NO: 224431 - RNA, 19 nt, Homo sapiens
cagagaauguggaauuuaa

SEQ ID NO: 224432 - RNA, 19 nt, Homo sapiens
ggaguacugugcaauuaaa

SEQ ID NO: 224433 - RNA, 19 nt, Homo sapiens
cguaauaucuugugccaaa

SEQ ID NO: 224434 - RNA, 19 nt, Homo sapiens
caacuuaucccaaacaaga

SEQ ID NO: 224435 - RNA, 19 nt, Homo sapiens
gcagaccaaugugcuaaua

SEQ ID NO: 224436 - RNA, 19 nt, Homo sapiens
ggaacaguaucuaucacua

SEQ ID NO: 224437 - RNA, 19 nt, Homo sapiens
gagaauuacugccgaaauc

SEQ ID NO: 224438 - RNA, 19 nt, Homo sapiens
gaacaguaucuaucacuaa

SEQ ID NO: 224439 - RNA, 19 nt, Homo sapiens
gaacaaacauaggauggau

SEQ ID NO: 224440 - RNA, 19 nt, Homo sapiens
gaauuugaccucuaugaaa

SEQ ID NO: 224441 - RNA, 19 nt, Homo sapiens
uaggauggaugguuaguuu

SEQ ID NO: 224442 - RNA, 19 nt, Homo sapiens
gcaaguaagcugaaugaga

SEQ ID NO: 224443 - RNA, 19 nt, Homo sapiens
agucauagcugaaguaagu

SEQ ID NO: 224444 - RNA, 19 nt, Homo sapiens
gaucuggacuaacauguuc

SEQ ID NO: 224445 - RNA, 19 nt, Homo sapiens
ggagagucauguuuguuga

SEQ ID NO: 224446 - RNA, 19 nt, Homo sapiens
ggaaggugacucugaauga

SEQ ID NO: 224447 - RNA, 19 nt, Homo sapiens
gagggaaggugacucugaa

SEQ ID NO: 224448 - RNA, 19 nt, Homo sapiens
gaacauggaagacuuacau

SEQ ID NO: 224449 - RNA, 19 nt, Homo sapiens
guaaagaccuacaggaaaa

SEQ ID NO: 224450 - RNA, 19 nt, Homo sapiens
gaaaauuacugccgaaauc

SEQ ID NO: 224451 - RNA, 19 nt, Homo sapiens
gggcuuugaugauaauuau

SEQ ID NO: 224452 - RNA, 19 nt, Homo sapiens
gaagaggagaugagaaaug

SEQ ID NO: 224453 - RNA, 19 nt, Homo sapiens
gcaaagacuacccuaauca

SEQ ID NO: 224454 - RNA, 19 nt, Homo sapiens
ugaaagauaucccgacaag

SEQ ID NO: 224455 - RNA, 19 nt, Homo sapiens
aaacauaucugcggaggau

SEQ ID NO: 224456 - RNA, 19 nt, Homo sapiens
guaagcugaaugagaauua

SEQ ID NO: 224457 - RNA, 19 nt, Homo sapiens
caagaacauggaagacuua

SEQ ID NO: 224458 - RNA, 19 nt, Homo sapiens
caauuaaucugucuaagcu

SEQ ID NO: 224459 - RNA, 19 nt, Homo sapiens
gguaaagaccuacaggaaa

SEQ ID NO: 224460 - RNA, 19 nt, Homo sapiens
ccaaugugcuaauagaugu

SEQ ID NO: 224461 - RNA, 19 nt, Homo sapiens
aaggagaguuggguucuua

SEQ ID NO: 224462 - RNA, 19 nt, Homo sapiens
aacauaggauggaugguua

SEQ ID NO: 224463 - RNA, 19 nt, Homo sapiens
aacaagaucuggacuaaca

SEQ ID NO: 224464 - RNA, 19 nt, Homo sapiens
cauccaaggucaaggagaa

SEQ ID NO: 224465 - RNA, 19 nt, Homo sapiens
cacaaauucuugccugaaa

SEQ ID NO: 224466 - RNA, 19 nt, Homo sapiens
ggacuuccauucacuugca

SEQ ID NO: 224467 - RNA, 19 nt, Homo sapiens
ucucauggaucauacagaa

SEQ ID NO: 224468 - RNA, 19 nt, Homo sapiens
cacaagcaauccagaggua

SEQ ID NO: 224469 - RNA, 19 nt, Homo sapiens
uggcacaucucuauauaau

SEQ ID NO: 224470 - RNA, 19 nt, Homo sapiens
gggcuacacuggauugauc

SEQ ID NO: 224471 - RNA, 19 nt, Homo sapiens
ucucgagacuugaaagauu

SEQ ID NO: 224472 - RNA, 19 nt, Homo sapiens
caccuacaauagucaauuu

SEQ ID NO: 224473 - RNA, 19 nt, Homo sapiens
acaagggcuuugaugauaa

SEQ ID NO: 224474 - RNA, 19 nt, Homo sapiens
ggaaccagaugcaaguaag

SEQ ID NO: 224475 - RNA, 19 nt, Homo sapiens
acaagaacauggaagacuu

SEQ ID NO: 224476 - RNA, 19 nt, Homo sapiens
caaauuccaaacugugaua

SEQ ID NO: 224477 - RNA, 19 nt, Homo sapiens
gaaggugacucugaaugag

SEQ ID NO: 224478 - RNA, 19 nt, Homo sapiens
agacuuacaucgucauauc

SEQ ID NO: 224479 - RNA, 19 nt, Homo sapiens
gaagacuuacaucgucaua

SEQ ID NO: 224480 - RNA, 19 nt, Homo sapiens
gauccaaacauccgaguug

SEQ ID NO: 224481 - RNA, 19 nt, Homo sapiens
gaaaacuacugucgaaauc

SEQ ID NO: 224482 - RNA, 19 nt, Homo sapiens
auuagaaacugcaucauug

SEQ ID NO: 224483 - RNA, 19 nt, Homo sapiens
acacuggauugaucaacua

SEQ ID NO: 224484 - RNA, 19 nt, Homo sapiens
acacugauguuccuuugga

SEQ ID NO: 224485 - RNA, 19 nt, Homo sapiens
uuuagaccaucccguaaua

SEQ ID NO: 224486 - RNA, 19 nt, Homo sapiens
agaccaaugugcuaauaga

SEQ ID NO: 224487 - RNA, 19 nt, Homo sapiens
ugggaguacugugcaauua

SEQ ID NO: 224488 - RNA, 19 nt, Homo sapiens
gauccagcacugaagauaa

SEQ ID NO: 224489 - RNA, 19 nt, Homo sapiens
ucacuuacaacaauccuaa

SEQ ID NO: 224490 - RNA, 19 nt, Homo sapiens
ugaaugagucugaaauaug

SEQ ID NO: 224491 - RNA, 19 nt, Homo sapiens
cucgagacuugaaagauua

SEQ ID NO: 224492 - RNA, 19 nt, Homo sapiens
caagggcuuugaugauaau

SEQ ID NO: 224493 - RNA, 19 nt, Homo sapiens
gcgcugggaucaucagaca

SEQ ID NO: 224494 - RNA, 19 nt, Homo sapiens
ccaugaauuugaccucuau

SEQ ID NO: 224495 - RNA, 19 nt, Homo sapiens
caugucaaguggagugaaa

SEQ ID NO: 224496 - RNA, 19 nt, Homo sapiens
uaccuugugucccuaaauu

SEQ ID NO: 224497 - RNA, 19 nt, Homo sapiens
aaacacacagguauauuug

SEQ ID NO: 224498 - RNA, 19 nt, Homo sapiens
ugaagauacuugaauggau

SEQ ID NO: 224499 - RNA, 19 nt, Homo sapiens
gacaacuacuggagaguca

SEQ ID NO: 224500 - RNA, 19 nt, Homo sapiens
uuacaacaauccuaagaca

SEQ ID NO: 224501 - RNA, 19 nt, Homo sapiens
gaaguaagugugucugaag

SEQ ID NO: 224502 - RNA, 19 nt, Homo sapiens
gcguugggauucucaguau

SEQ ID NO: 224503 - RNA, 19 nt, Homo sapiens
ugacacugauguuccuuug

SEQ ID NO: 224504 - RNA, 19 nt, Homo sapiens
gaagugaauuaagguacau

SEQ ID NO: 224505 - RNA, 19 nt, Homo sapiens
gcugguauauggcccugaa

SEQ ID NO: 224506 - RNA, 19 nt, Homo sapiens
ggauggaugguuaguuuga

SEQ ID NO: 224507 - RNA, 19 nt, Homo sapiens
cagcaaagacuacccuaau

SEQ ID NO: 224508 - RNA, 19 nt, Homo sapiens
ugacaugacuccugaaaau

SEQ ID NO: 224509 - RNA, 19 nt, Homo sapiens
uaaaggacuuccauucacu

SEQ ID NO: 224510 - RNA, 19 nt, Homo sapiens
ugaaguaagugugucugaa

SEQ ID NO: 224511 - RNA, 19 nt, Homo sapiens
gaauacugcagaccaaugu

SEQ ID NO: 224512 - RNA, 19 nt, Homo sapiens
gcaaggaccuacgagaaaa

SEQ ID NO: 224513 - RNA, 19 nt, Homo sapiens
cuacgaagucugugacauu

SEQ ID NO: 224514 - RNA, 19 nt, Homo sapiens
gcaaguguaauaacauauc

SEQ ID NO: 224515 - RNA, 19 nt, Homo sapiens
gaagcacccaccaauacaa

SEQ ID NO: 224516 - RNA, 19 nt, Homo sapiens
cuggauugaucaacuauga

SEQ ID NO: 224517 - RNA, 19 nt, Homo sapiens
cggaagaggagaugagaaa

SEQ ID NO: 224518 - RNA, 19 nt, Homo sapiens
cacgggaaauccacucauu

SEQ ID NO: 224519 - RNA, 19 nt, Homo sapiens
caaagacuacccuaaucaa

SEQ ID NO: 224520 - RNA, 19 nt, Homo sapiens
gcacaaauucuugccugaa

SEQ ID NO: 224521 - RNA, 19 nt, Homo sapiens
ggacacaagugccagauug

SEQ ID NO: 224522 - RNA, 19 nt, Homo sapiens
gcaguucccucgagcagua

SEQ ID NO: 224523 - RNA, 19 nt, Homo sapiens
gagaaaugcuuugaugaga

SEQ ID NO: 224524 - RNA, 19 nt, Homo sapiens
acagagaaaugcuuugaug

SEQ ID NO: 224525 - RNA, 19 nt, Homo sapiens
gcgaaucccucaccagagu

SEQ ID NO: 224526 - RNA, 19 nt, Homo sapiens
gcacagagaaaugcuuuga

SEQ ID NO: 224527 - RNA, 19 nt, Homo sapiens
gagcagcccuugccugaac

SEQ ID NO: 224528 - RNA, 19 nt, Homo sapiens
ggacugcggcacagagaaa

SEQ ID NO: 224529 - RNA, 19 nt, Homo sapiens
gaacuccgaucugcucuac

SEQ ID NO: 224530 - RNA, 19 nt, Homo sapiens
ccaacuauguggacuggau

SEQ ID NO: 224531 - RNA, 19 nt, Homo sapiens
ugaccucugugaccucuga

SEQ ID NO: 224532 - RNA, 19 nt, Homo sapiens
agaagaacggcguggcuua

SEQ ID NO: 224533 - RNA, 19 nt, Homo sapiens
ccacaacucacaacuacga

SEQ ID NO: 224534 - RNA, 19 nt, Homo sapiens
ggugcuacguggugaagga

SEQ ID NO: 224535 - RNA, 19 nt, Homo sapiens
gaaggcacccgacauacag

SEQ ID NO: 224536 - RNA, 19 nt, Homo sapiens
cggcguggcuuaccucuac

SEQ ID NO: 224537 - RNA, 19 nt, Homo sapiens
gcaggaggcacaagaagag

SEQ ID NO: 224538 - RNA, 19 nt, Homo sapiens
ugauccggcugaagaagaa

SEQ ID NO: 224539 - RNA, 19 nt, Homo sapiens
cugccuugcugacaauaaa

SEQ ID NO: 224540 - RNA, 19 nt, Homo sapiens
ucagcugccuggccuggaa

SEQ ID NO: 224541 - RNA, 19 nt, Homo sapiens
cagagaaaugcuuugauga

SEQ ID NO: 224542 - RNA, 19 nt, Homo sapiens
gcucugugccggcuacuuc

SEQ ID NO: 224543 - RNA, 19 nt, Homo sapiens
gcagcagcccugaggucua

SEQ ID NO: 224544 - RNA, 19 nt, Homo sapiens
cgaaggcacccgacauaca

SEQ ID NO: 224545 - RNA, 19 nt, Homo sapiens
gaagaacggcguggcuuac

SEQ ID NO: 224546 - RNA, 19 nt, Homo sapiens
cagcagcccugaggucuac

SEQ ID NO: 224547 - RNA, 19 nt, Homo sapiens
caccagaguccaacuguca

SEQ ID NO: 224548 - RNA, 19 nt, Homo sapiens
ugccacaacucacaacuac

SEQ ID NO: 224549 - RNA, 19 nt, Homo sapiens
guccugauccggcugaaga

SEQ ID NO: 224550 - RNA, 19 nt, Homo sapiens
ggcaggaggcacaagaaga

SEQ ID NO: 224551 - RNA, 19 nt, Homo sapiens
ggaacuccgaucugcucua

SEQ ID NO: 224552 - RNA, 19 nt, Homo sapiens
gcagugcacacaggaagug

SEQ ID NO: 224553 - RNA, 19 nt, Homo sapiens
cggcacagagaaaugcuuu

SEQ ID NO: 224554 - RNA, 19 nt, Homo sapiens
acacccgcguggccaacua

SEQ ID NO: 224555 - RNA, 19 nt, Homo sapiens
ugcgaaggcacccgacaua

SEQ ID NO: 224556 - RNA, 19 nt, Homo sapiens
gugccacaacucacaacua

SEQ ID NO: 224557 - RNA, 19 nt, Homo sapiens
agagaaaugcuuugaugag

SEQ ID NO: 224558 - RNA, 19 nt, Homo sapiens
gcaaggacugcggcacaga

SEQ ID NO: 224559 - RNA, 19 nt, Homo sapiens
gcagagggaccccaaagug

SEQ ID NO: 224560 - RNA, 19 nt, Homo sapiens
gcaagaagauuauuuacug

SEQ ID NO: 224561 - RNA, 19 nt, Homo sapiens
gcaaauacuucuucaucua

SEQ ID NO: 224562 - RNA, 19 nt, Homo sapiens
gagcauaugugucuucaga

SEQ ID NO: 224563 - RNA, 19 nt, Homo sapiens
ggaaugaauugaaucgaaa

SEQ ID NO: 224564 - RNA, 19 nt, Homo sapiens
gcaaagugaucagcaaauu

SEQ ID NO: 224565 - RNA, 19 nt, Homo sapiens
gaguauaugugcaaaguga

SEQ ID NO: 224566 - RNA, 19 nt, Homo sapiens
gaaaagaaauccugugugu

SEQ ID NO: 224567 - RNA, 19 nt, Homo sapiens
gggaaugaauugaaucgaa

SEQ ID NO: 224568 - RNA, 19 nt, Homo sapiens
gugaucaccugccaaauga

SEQ ID NO: 224569 - RNA, 19 nt, Homo sapiens
gaacuucgcauuaacaaag

SEQ ID NO: 224570 - RNA, 19 nt, Homo sapiens
gaauaucaguauccacaga

SEQ ID NO: 224571 - RNA, 19 nt, Homo sapiens
gaaugggaaugaauugaau

SEQ ID NO: 224572 - RNA, 19 nt, Homo sapiens
gaaaagaugugcagauauc

SEQ ID NO: 224573 - RNA, 19 nt, Homo sapiens
caaagugaucagcaaauua

SEQ ID NO: 224574 - RNA, 19 nt, Homo sapiens
cagaagggcaagaagauua

SEQ ID NO: 224575 - RNA, 19 nt, Homo sapiens
gacagugccucugccaaua

SEQ ID NO: 224576 - RNA, 19 nt, Homo sapiens
caugauugauuguugcuuu

SEQ ID NO: 224577 - RNA, 19 nt, Homo sapiens
gagcaaauacuucuucauc

SEQ ID NO: 224578 - RNA, 19 nt, Homo sapiens
gagaguauaugugcaaagu

SEQ ID NO: 224579 - RNA, 19 nt, Homo sapiens
agucagaacuucgcauuaa

SEQ ID NO: 224580 - RNA, 19 nt, Homo sapiens
gauucuaugucucaugauu

SEQ ID NO: 224581 - RNA, 19 nt, Homo sapiens
caaagaaggcagaggcaaa

SEQ ID NO: 224582 - RNA, 19 nt, Homo sapiens
gcauaugugucuucagagu

SEQ ID NO: 224583 - RNA, 19 nt, Homo sapiens
cgucaucacuccucuguca

SEQ ID NO: 224584 - RNA, 19 nt, Homo sapiens
gaauaagacaacaaagaga

SEQ ID NO: 224585 - RNA, 19 nt, Homo sapiens
cagaaaagaugugcagaua

SEQ ID NO: 224586 - RNA, 19 nt, Homo sapiens
gaauacuccucucucagau

SEQ ID NO: 224587 - RNA, 19 nt, Homo sapiens
guaagauaauguugcuuuc

SEQ ID NO: 224588 - RNA, 19 nt, Homo sapiens
gugugucgcuuaugucuau

SEQ ID NO: 224589 - RNA, 19 nt, Homo sapiens
gcaaagggaagggcaagaa

SEQ ID NO: 224590 - RNA, 19 nt, Homo sapiens
ucaagugguucaagaaugg

SEQ ID NO: 224591 - RNA, 19 nt, Homo sapiens
ugaaaccaguucugaauac

SEQ ID NO: 224592 - RNA, 19 nt, Homo sapiens
caaugugugugagguguuu

SEQ ID NO: 224593 - RNA, 19 nt, Homo sapiens
ucaagaaugggaaugaauu

SEQ ID NO: 224594 - RNA, 19 nt, Homo sapiens
uauaacuccuuguuucaga

SEQ ID NO: 224595 - RNA, 19 nt, Homo sapiens
gaucagcaaauuaggaaau

SEQ ID NO: 224596 - RNA, 19 nt, Homo sapiens
gugaaaccaguucugaaua

SEQ ID NO: 224597 - RNA, 19 nt, Homo sapiens
ugaauacuccucucucaga

SEQ ID NO: 224598 - RNA, 19 nt, Homo sapiens
caaauuaggaaaugacagu

SEQ ID NO: 224599 - RNA, 19 nt, Homo sapiens
gcagaagggcaagaagauu

SEQ ID NO: 224600 - RNA, 19 nt, Homo sapiens
caacugaaggagcauaugu

SEQ ID NO: 224601 - RNA, 19 nt, Homo sapiens
caagaaugggaaugaauug

SEQ ID NO: 224602 - RNA, 19 nt, Homo sapiens
gucuauaacuccuuguuuc

SEQ ID NO: 224603 - RNA, 19 nt, Homo sapiens
ugaaggagcauaugugucu

SEQ ID NO: 224604 - RNA, 19 nt, Homo sapiens
gggauugugcuuacuguug

SEQ ID NO: 224605 - RNA, 19 nt, Homo sapiens
ccaaaugaauaagacaaca

SEQ ID NO: 224606 - RNA, 19 nt, Homo sapiens
guugcaucauguugaauaa

SEQ ID NO: 224607 - RNA, 19 nt, Homo sapiens
aaagugaucagcaaauuag

SEQ ID NO: 224608 - RNA, 19 nt, Homo sapiens
gaaaccaguucugaauacu

SEQ ID NO: 224609 - RNA, 19 nt, Homo sapiens
ggaagggcaagaagaagga

SEQ ID NO: 224610 - RNA, 19 nt, Homo sapiens
ggcugcagguuccaaacua

SEQ ID NO: 224611 - RNA, 19 nt, Homo sapiens
ucacuccucugucauaugc

SEQ ID NO: 224612 - RNA, 19 nt, Homo sapiens
gaaucaaacgagaucauca

SEQ ID NO: 224613 - RNA, 19 nt, Homo sapiens
caauaucaccaucguggaa

SEQ ID NO: 224614 - RNA, 19 nt, Homo sapiens
gaucaccugccaaaugaau

SEQ ID NO: 224615 - RNA, 19 nt, Homo sapiens
ccagugaucaccugccaaa

SEQ ID NO: 224616 - RNA, 19 nt, Homo sapiens
ugaauaagacaacaaagag

SEQ ID NO: 224617 - RNA, 19 nt, Homo sapiens
ucaccugccaaaugaauaa

SEQ ID NO: 224618 - RNA, 19 nt, Homo sapiens
gcuuacuguugcauaacua

SEQ ID NO: 224619 - RNA, 19 nt, Homo sapiens
uaauguugcuuucuuaucc

SEQ ID NO: 224620 - RNA, 19 nt, Homo sapiens
gccauguuauuuauagugu

SEQ ID NO: 224621 - RNA, 19 nt, Homo sapiens
cagagucucccauuagaau

SEQ ID NO: 224622 - RNA, 19 nt, Homo sapiens
ucaccaucguggaaucaaa

SEQ ID NO: 224623 - RNA, 19 nt, Homo sapiens
ugcaucauguugaauaaug

SEQ ID NO: 224624 - RNA, 19 nt, Homo sapiens
ggacaaacuuuucccaaac

SEQ ID NO: 224625 - RNA, 19 nt, Homo sapiens
gaaggagcauaugugucuu

SEQ ID NO: 224626 - RNA, 19 nt, Homo sapiens
auacuccucucucagauuc

SEQ ID NO: 224627 - RNA, 19 nt, Homo sapiens
caucacuccucugucauau

SEQ ID NO: 224628 - RNA, 19 nt, Homo sapiens
caaauacuucuucaucuac

SEQ ID NO: 224629 - RNA, 19 nt, Homo sapiens
gcuguaagauaauguugcu

SEQ ID NO: 224630 - RNA, 19 nt, Homo sapiens
ggaaucaaacgagaucauc

SEQ ID NO: 224631 - RNA, 19 nt, Homo sapiens
caacaaagagaagcagaag

SEQ ID NO: 224632 - RNA, 19 nt, Homo sapiens
ucaucacuccucugucaua

SEQ ID NO: 224633 - RNA, 19 nt, Homo sapiens
cagaugauucuaugucuca

SEQ ID NO: 224634 - RNA, 19 nt, Homo sapiens
ccacagaaggagcaaauac

SEQ ID NO: 224635 - RNA, 19 nt, Homo sapiens
ugacagugccucugccaau

SEQ ID NO: 224636 - RNA, 19 nt, Homo sapiens
agaaugggaaugaauugaa

SEQ ID NO: 224637 - RNA, 19 nt, Homo sapiens
ugugcuuacuguugcauaa

SEQ ID NO: 224638 - RNA, 19 nt, Homo sapiens
ucugaauacuccucucuca

SEQ ID NO: 224639 - RNA, 19 nt, Homo sapiens
agauucaagugguucaaga

SEQ ID NO: 224640 - RNA, 19 nt, Homo sapiens
acacuugggauugugcuua

SEQ ID NO: 224641 - RNA, 19 nt, Homo sapiens
gaagggcaagaagauuauu

SEQ ID NO: 224642 - RNA, 19 nt, Homo sapiens
cccauuagaauaucaguau

SEQ ID NO: 224643 - RNA, 19 nt, Homo sapiens
gagucucccauuagaauau

SEQ ID NO: 224644 - RNA, 19 nt, Homo sapiens
ucagcaaauuaggaaauga

SEQ ID NO: 224645 - RNA, 19 nt, Homo sapiens
gugaucagcaaauuaggaa

SEQ ID NO: 224646 - RNA, 19 nt, Homo sapiens
agggcaagaagauuauuua

SEQ ID NO: 224647 - RNA, 19 nt, Homo sapiens
cauguugaauaaugcuguu

SEQ ID NO: 224648 - RNA, 19 nt, Homo sapiens
ggugugaaaccaguucuga

SEQ ID NO: 224649 - RNA, 19 nt, Homo sapiens
acagaaggagcaaauacuu

SEQ ID NO: 224650 - RNA, 19 nt, Homo sapiens
ucuucagagucucccauua

SEQ ID NO: 224651 - RNA, 19 nt, Homo sapiens
aacgagaucaucacuggua

SEQ ID NO: 224652 - RNA, 19 nt, Homo sapiens
gauguccgagcgcaaagaa

SEQ ID NO: 224653 - RNA, 19 nt, Homo sapiens
gcugcagguuccaaacuag

SEQ ID NO: 224654 - RNA, 19 nt, Homo sapiens
gauucaagugguucaagaa

SEQ ID NO: 224655 - RNA, 19 nt, Homo sapiens
cgagauguccgagcgcaaa

SEQ ID NO: 224656 - RNA, 19 nt, Homo sapiens
uuucuugguugguuauuca

SEQ ID NO: 224657 - RNA, 19 nt, Homo sapiens
aaagggaagggcaagaaga

SEQ ID NO: 224658 - RNA, 19 nt, Homo sapiens
uucuaugucucaugauuga

SEQ ID NO: 224659 - RNA, 19 nt, Homo sapiens
gugcaaagugaucagcaaa

SEQ ID NO: 224660 - RNA, 19 nt, Homo sapiens
gcaaauacuucuucaucua

SEQ ID NO: 224661 - RNA, 19 nt, Homo sapiens
gagcauaugugucuucaga

SEQ ID NO: 224662 - RNA, 19 nt, Homo sapiens
ggaaugaauugaaucgaaa

SEQ ID NO: 224663 - RNA, 19 nt, Homo sapiens
acacauagauucaccugua

SEQ ID NO: 224664 - RNA, 19 nt, Homo sapiens
gcaaagugaucagcaaauu

SEQ ID NO: 224665 - RNA, 19 nt, Homo sapiens
gaacgaaacaauaugauga

SEQ ID NO: 224666 - RNA, 19 nt, Homo sapiens
ccaagagccuguuaagaaa

SEQ ID NO: 224667 - RNA, 19 nt, Homo sapiens
gaguauaugugcaaaguga

SEQ ID NO: 224668 - RNA, 19 nt, Homo sapiens
ccacauugcuaacagauug

SEQ ID NO: 224669 - RNA, 19 nt, Homo sapiens
uuaagaaacucgccaauag

SEQ ID NO: 224670 - RNA, 19 nt, Homo sapiens
gggaaugaauugaaucgaa

SEQ ID NO: 224671 - RNA, 19 nt, Homo sapiens
gaacuucgcauuaacaaag

SEQ ID NO: 224672 - RNA, 19 nt, Homo sapiens
gaauaucaguauccacaga

SEQ ID NO: 224673 - RNA, 19 nt, Homo sapiens
gaaugggaaugaauugaau

SEQ ID NO: 224674 - RNA, 19 nt, Homo sapiens
caaagugaucagcaaauua

SEQ ID NO: 224675 - RNA, 19 nt, Homo sapiens
cggaggagcuguaccagaa

SEQ ID NO: 224676 - RNA, 19 nt, Homo sapiens
aacagaagaugaaagagua

SEQ ID NO: 224677 - RNA, 19 nt, Homo sapiens
gacagugccucugccaaua

SEQ ID NO: 224678 - RNA, 19 nt, Homo sapiens
ccaagacccuauugcugua

SEQ ID NO: 224679 - RNA, 19 nt, Homo sapiens
gaaagaguaggugaagaua

SEQ ID NO: 224680 - RNA, 19 nt, Homo sapiens
gcuggugaaucaauacgua

SEQ ID NO: 224681 - RNA, 19 nt, Homo sapiens
gaagagagugcugaccaua

SEQ ID NO: 224682 - RNA, 19 nt, Homo sapiens
gagcaaauacuucuucauc

SEQ ID NO: 224683 - RNA, 19 nt, Homo sapiens
gagaguauaugugcaaagu

SEQ ID NO: 224684 - RNA, 19 nt, Homo sapiens
agucagaacuucgcauuaa

SEQ ID NO: 224685 - RNA, 19 nt, Homo sapiens
agaagaaguuugaccauca

SEQ ID NO: 224686 - RNA, 19 nt, Homo sapiens
gcucguaugucaccuguag

SEQ ID NO: 224687 - RNA, 19 nt, Homo sapiens
caaagaaggcagaggcaaa

SEQ ID NO: 224688 - RNA, 19 nt, Homo sapiens
gccaggcugucuaguguaa

SEQ ID NO: 224689 - RNA, 19 nt, Homo sapiens
ugaaacagaagaugaaaga

SEQ ID NO: 224690 - RNA, 19 nt, Homo sapiens
cccaagagccuguuaagaa

SEQ ID NO: 224691 - RNA, 19 nt, Homo sapiens
gaaagccacucuguaaucg

SEQ ID NO: 224692 - RNA, 19 nt, Homo sapiens
ccagugagcauauuguuga

SEQ ID NO: 224693 - RNA, 19 nt, Homo sapiens
gcauaugugucuucagagu

SEQ ID NO: 224694 - RNA, 19 nt, Homo sapiens
guaugucaccuguagauuu

SEQ ID NO: 224695 - RNA, 19 nt, Homo sapiens
gcaagugcccaaaugaguu

SEQ ID NO: 224696 - RNA, 19 nt, Homo sapiens
ggucugaacgaaacaauau

SEQ ID NO: 224697 - RNA, 19 nt, Homo sapiens
gaauacuccucucucagau

SEQ ID NO: 224698 - RNA, 19 nt, Homo sapiens
guuaagaaacucgccaaua

SEQ ID NO: 224699 - RNA, 19 nt, Homo sapiens
gcaaagggaagggcaagaa

SEQ ID NO: 224700 - RNA, 19 nt, Homo sapiens
gcccaucacuccacuacug

SEQ ID NO: 224701 - RNA, 19 nt, Homo sapiens
gaggagcuguaccagaaga

SEQ ID NO: 224702 - RNA, 19 nt, Homo sapiens
ucaagugguucaagaaugg

SEQ ID NO: 224703 - RNA, 19 nt, Homo sapiens
ugaaaccaguucugaauac

SEQ ID NO: 224704 - RNA, 19 nt, Homo sapiens
gaaguggacagcaacacaa

SEQ ID NO: 224705 - RNA, 19 nt, Homo sapiens
cacauagauucaccuguaa

SEQ ID NO: 224706 - RNA, 19 nt, Homo sapiens
gauuggaaguggacagcaa

SEQ ID NO: 224707 - RNA, 19 nt, Homo sapiens
uaugucaccuguagauuuc

SEQ ID NO: 224708 - RNA, 19 nt, Homo sapiens
ucaagaaugggaaugaauu

SEQ ID NO: 224709 - RNA, 19 nt, Homo sapiens
gugaaaccaguucugaaua

SEQ ID NO: 224710 - RNA, 19 nt, Homo sapiens
gaucagcaaauuaggaaau

SEQ ID NO: 224711 - RNA, 19 nt, Homo sapiens
caucuugggauugaauuua

SEQ ID NO: 224712 - RNA, 19 nt, Homo sapiens
caagugcccaaaugaguuu

SEQ ID NO: 224713 - RNA, 19 nt, Homo sapiens
ugaauacuccucucucaga

SEQ ID NO: 224714 - RNA, 19 nt, Homo sapiens
caggcugucuaguguaauu

SEQ ID NO: 224715 - RNA, 19 nt, Homo sapiens
cgaaagccacucuguaauc

SEQ ID NO: 224716 - RNA, 19 nt, Homo sapiens
caaauuaggaaaugacagu

SEQ ID NO: 224717 - RNA, 19 nt, Homo sapiens
caacugaaggagcauaugu

SEQ ID NO: 224718 - RNA, 19 nt, Homo sapiens
caagaaugggaaugaauug

SEQ ID NO: 224719 - RNA, 19 nt, Homo sapiens
gagugaaacagaagaugaa

SEQ ID NO: 224720 - RNA, 19 nt, Homo sapiens
gaagaaguuugaccaucac

SEQ ID NO: 224721 - RNA, 19 nt, Homo sapiens
caccaaggcugcgggagaa

SEQ ID NO: 224722 - RNA, 19 nt, Homo sapiens
gcauauuguugagagagaa

SEQ ID NO: 224723 - RNA, 19 nt, Homo sapiens
ugaaggagcauaugugucu

SEQ ID NO: 224724 - RNA, 19 nt, Homo sapiens
ggcugcagguuccaaacua

SEQ ID NO: 224725 - RNA, 19 nt, Homo sapiens
ugaaagaguaggugaagau

SEQ ID NO: 224726 - RNA, 19 nt, Homo sapiens
ccucaggcaugccagagaa

SEQ ID NO: 224727 - RNA, 19 nt, Homo sapiens
gagcaacggacacacugaa

SEQ ID NO: 224728 - RNA, 19 nt, Homo sapiens
ggaagggcaagaagaagga

SEQ ID NO: 224729 - RNA, 19 nt, Homo sapiens
aaagugaucagcaaauuag

SEQ ID NO: 224730 - RNA, 19 nt, Homo sapiens
gaaaccaguucugaauacu

SEQ ID NO: 224731 - RNA, 19 nt, Homo sapiens
gcaaauagaaaacaggaaa

SEQ ID NO: 224732 - RNA, 19 nt, Homo sapiens
aaacagaagaugaaagagu

SEQ ID NO: 224733 - RNA, 19 nt, Homo sapiens
ggaaguggacagcaacaca

SEQ ID NO: 224734 - RNA, 19 nt, Homo sapiens
gaaucaaacgagaucauca

SEQ ID NO: 224735 - RNA, 19 nt, Homo sapiens
caauaucaccaucguggaa

SEQ ID NO: 224736 - RNA, 19 nt, Homo sapiens
ugucuaguguaauugcuaa

SEQ ID NO: 224737 - RNA, 19 nt, Homo sapiens
gugaaucaauacguaucua

SEQ ID NO: 224738 - RNA, 19 nt, Homo sapiens
ugaggauaguggaggauga

SEQ ID NO: 224739 - RNA, 19 nt, Homo sapiens
cagagucucccauuagaau

SEQ ID NO: 224740 - RNA, 19 nt, Homo sapiens
ucaccaucguggaaucaaa

SEQ ID NO: 224741 - RNA, 19 nt, Homo sapiens
auacuccucucucagauuc

SEQ ID NO: 224742 - RNA, 19 nt, Homo sapiens
uccgaaagccacucuguaa

SEQ ID NO: 224743 - RNA, 19 nt, Homo sapiens
gaaggagcauaugugucuu

SEQ ID NO: 224744 - RNA, 19 nt, Homo sapiens
aguaacagccucccugcua

SEQ ID NO: 224745 - RNA, 19 nt, Homo sapiens
ccacccguguccagcauga

SEQ ID NO: 224746 - RNA, 19 nt, Homo sapiens
gagaaaccccugauuccua

SEQ ID NO: 224747 - RNA, 19 nt, Homo sapiens
caaauacuucuucaucuac

SEQ ID NO: 224748 - RNA, 19 nt, Homo sapiens
gaugaggaguaugaaacga

SEQ ID NO: 224749 - RNA, 19 nt, Homo sapiens
gaggaugaggaguaugaaa

SEQ ID NO: 224750 - RNA, 19 nt, Homo sapiens
gagaagcagagacauccuu

SEQ ID NO: 224751 - RNA, 19 nt, Homo sapiens
ggaaucaaacgagaucauc

SEQ ID NO: 224752 - RNA, 19 nt, Homo sapiens
agagagugcugaccauaac

SEQ ID NO: 224753 - RNA, 19 nt, Homo sapiens
ccacagaaggagcaaauac

SEQ ID NO: 224754 - RNA, 19 nt, Homo sapiens
agaaugggaaugaauugaa

SEQ ID NO: 224755 - RNA, 19 nt, Homo sapiens
ugacagugccucugccaau

SEQ ID NO: 224756 - RNA, 19 nt, Homo sapiens
agauucaagugguucaaga

SEQ ID NO: 224757 - RNA, 19 nt, Homo sapiens
gaugaaagaguaggugaag

SEQ ID NO: 224758 - RNA, 19 nt, Homo sapiens
ugagagagaagcagagaca

SEQ ID NO: 224759 - RNA, 19 nt, Homo sapiens
ucugaauacuccucucuca

SEQ ID NO: 224760 - RNA, 19 nt, Homo sapiens
gcaaauacuucuucaucua

SEQ ID NO: 224761 - RNA, 19 nt, Homo sapiens
gagcauaugugucuucaga

SEQ ID NO: 224762 - RNA, 19 nt, Homo sapiens
ggaaugaauugaaucgaaa

SEQ ID NO: 224763 - RNA, 19 nt, Homo sapiens
acacauagauucaccugua

SEQ ID NO: 224764 - RNA, 19 nt, Homo sapiens
gcaaagugaucagcaaauu

SEQ ID NO: 224765 - RNA, 19 nt, Homo sapiens
gaacgaaacaauaugauga

SEQ ID NO: 224766 - RNA, 19 nt, Homo sapiens
ccaagagccuguuaagaaa

SEQ ID NO: 224767 - RNA, 19 nt, Homo sapiens
gaguauaugugcaaaguga

SEQ ID NO: 224768 - RNA, 19 nt, Homo sapiens
ccacauugcuaacagauug

SEQ ID NO: 224769 - RNA, 19 nt, Homo sapiens
uuaagaaacucgccaauag

SEQ ID NO: 224770 - RNA, 19 nt, Homo sapiens
gggaaugaauugaaucgaa

SEQ ID NO: 224771 - RNA, 19 nt, Homo sapiens
gaacuucgcauuaacaaag

SEQ ID NO: 224772 - RNA, 19 nt, Homo sapiens
gaauaucaguauccacaga

SEQ ID NO: 224773 - RNA, 19 nt, Homo sapiens
gaaugggaaugaauugaau

SEQ ID NO: 224774 - RNA, 19 nt, Homo sapiens
caaagugaucagcaaauua

SEQ ID NO: 224775 - RNA, 19 nt, Homo sapiens
cggaggagcuguaccagaa

SEQ ID NO: 224776 - RNA, 19 nt, Homo sapiens
aacagaagaugaaagagua

SEQ ID NO: 224777 - RNA, 19 nt, Homo sapiens
gacagugccucugccaaua

SEQ ID NO: 224778 - RNA, 19 nt, Homo sapiens
ccaagacccuauugcugua

SEQ ID NO: 224779 - RNA, 19 nt, Homo sapiens
gaaagaguaggugaagaua

SEQ ID NO: 224780 - RNA, 19 nt, Homo sapiens
gcuggugaaucaauacgua

SEQ ID NO: 224781 - RNA, 19 nt, Homo sapiens
gaagagagugcugaccaua

SEQ ID NO: 224782 - RNA, 19 nt, Homo sapiens
gagcaaauacuucuucauc

SEQ ID NO: 224783 - RNA, 19 nt, Homo sapiens
gagaguauaugugcaaagu

SEQ ID NO: 224784 - RNA, 19 nt, Homo sapiens
agucagaacuucgcauuaa

SEQ ID NO: 224785 - RNA, 19 nt, Homo sapiens
agaagaaguuugaccauca

SEQ ID NO: 224786 - RNA, 19 nt, Homo sapiens
gcucguaugucaccuguag

SEQ ID NO: 224787 - RNA, 19 nt, Homo sapiens
caaagaaggcagaggcaaa

SEQ ID NO: 224788 - RNA, 19 nt, Homo sapiens
gccaggcugucuaguguaa

SEQ ID NO: 224789 - RNA, 19 nt, Homo sapiens
ugaaacagaagaugaaaga

SEQ ID NO: 224790 - RNA, 19 nt, Homo sapiens
cccaagagccuguuaagaa

SEQ ID NO: 224791 - RNA, 19 nt, Homo sapiens
gaaagccacucuguaaucg

SEQ ID NO: 224792 - RNA, 19 nt, Homo sapiens
ccagugagcauauuguuga

SEQ ID NO: 224793 - RNA, 19 nt, Homo sapiens
gcauaugugucuucagagu

SEQ ID NO: 224794 - RNA, 19 nt, Homo sapiens
guaugucaccuguagauuu

SEQ ID NO: 224795 - RNA, 19 nt, Homo sapiens
gcaagugcccaaaugaguu

SEQ ID NO: 224796 - RNA, 19 nt, Homo sapiens
ggucugaacgaaacaauau

SEQ ID NO: 224797 - RNA, 19 nt, Homo sapiens
gaauacuccucucucagau

SEQ ID NO: 224798 - RNA, 19 nt, Homo sapiens
guuaagaaacucgccaaua

SEQ ID NO: 224799 - RNA, 19 nt, Homo sapiens
gcaaagggaagggcaagaa

SEQ ID NO: 224800 - RNA, 19 nt, Homo sapiens
gcccaucacuccacuacug

SEQ ID NO: 224801 - RNA, 19 nt, Homo sapiens
gaggagcuguaccagaaga

SEQ ID NO: 224802 - RNA, 19 nt, Homo sapiens
ucaagugguucaagaaugg

SEQ ID NO: 224803 - RNA, 19 nt, Homo sapiens
ugaaaccaguucugaauac

SEQ ID NO: 224804 - RNA, 19 nt, Homo sapiens
gaaguggacagcaacacaa

SEQ ID NO: 224805 - RNA, 19 nt, Homo sapiens
cacauagauucaccuguaa

SEQ ID NO: 224806 - RNA, 19 nt, Homo sapiens
gauuggaaguggacagcaa

SEQ ID NO: 224807 - RNA, 19 nt, Homo sapiens
uaugucaccuguagauuuc

SEQ ID NO: 224808 - RNA, 19 nt, Homo sapiens
ucaagaaugggaaugaauu

SEQ ID NO: 224809 - RNA, 19 nt, Homo sapiens
gaucagcaaauuaggaaau

SEQ ID NO: 224810 - RNA, 19 nt, Homo sapiens
gugaaaccaguucugaaua

SEQ ID NO: 224811 - RNA, 19 nt, Homo sapiens
caagugcccaaaugaguuu

SEQ ID NO: 224812 - RNA, 19 nt, Homo sapiens
ugaauacuccucucucaga

SEQ ID NO: 224813 - RNA, 19 nt, Homo sapiens
caggcugucuaguguaauu

SEQ ID NO: 224814 - RNA, 19 nt, Homo sapiens
cgaaagccacucuguaauc

SEQ ID NO: 224815 - RNA, 19 nt, Homo sapiens
caaauuaggaaaugacagu

SEQ ID NO: 224816 - RNA, 19 nt, Homo sapiens
caacugaaggagcauaugu

SEQ ID NO: 224817 - RNA, 19 nt, Homo sapiens
caagaaugggaaugaauug

SEQ ID NO: 224818 - RNA, 19 nt, Homo sapiens
gagugaaacagaagaugaa

SEQ ID NO: 224819 - RNA, 19 nt, Homo sapiens
gaagaaguuugaccaucac

SEQ ID NO: 224820 - RNA, 19 nt, Homo sapiens
caccaaggcugcgggagaa

SEQ ID NO: 224821 - RNA, 19 nt, Homo sapiens
gcauauuguugagagagaa

SEQ ID NO: 224822 - RNA, 19 nt, Homo sapiens
ugaaggagcauaugugucu

SEQ ID NO: 224823 - RNA, 19 nt, Homo sapiens
ugaaagaguaggugaagau

SEQ ID NO: 224824 - RNA, 19 nt, Homo sapiens
ccucaggcaugccagagaa

SEQ ID NO: 224825 - RNA, 19 nt, Homo sapiens
gagcaacggacacacugaa

SEQ ID NO: 224826 - RNA, 19 nt, Homo sapiens
ggaagggcaagaagaagga

SEQ ID NO: 224827 - RNA, 19 nt, Homo sapiens
ggcugcagguuccaaacua

SEQ ID NO: 224828 - RNA, 19 nt, Homo sapiens
aaagugaucagcaaauuag

SEQ ID NO: 224829 - RNA, 19 nt, Homo sapiens
gaaaccaguucugaauacu

SEQ ID NO: 224830 - RNA, 19 nt, Homo sapiens
aaacagaagaugaaagagu

SEQ ID NO: 224831 - RNA, 19 nt, Homo sapiens
ggaaguggacagcaacaca

SEQ ID NO: 224832 - RNA, 19 nt, Homo sapiens
gaaucaaacgagaucauca

SEQ ID NO: 224833 - RNA, 19 nt, Homo sapiens
caauaucaccaucguggaa

SEQ ID NO: 224834 - RNA, 19 nt, Homo sapiens
ugucuaguguaauugcuaa

SEQ ID NO: 224835 - RNA, 19 nt, Homo sapiens
gugaaucaauacguaucua

SEQ ID NO: 224836 - RNA, 19 nt, Homo sapiens
ugaggauaguggaggauga

SEQ ID NO: 224837 - RNA, 19 nt, Homo sapiens
cagagucucccauuagaau

SEQ ID NO: 224838 - RNA, 19 nt, Homo sapiens
ucaccaucguggaaucaaa

SEQ ID NO: 224839 - RNA, 19 nt, Homo sapiens
auacuccucucucagauuc

SEQ ID NO: 224840 - RNA, 19 nt, Homo sapiens
uccgaaagccacucuguaa

SEQ ID NO: 224841 - RNA, 19 nt, Homo sapiens
ggacaaacuuuucccaaac

SEQ ID NO: 224842 - RNA, 19 nt, Homo sapiens
gaaggagcauaugugucuu

SEQ ID NO: 224843 - RNA, 19 nt, Homo sapiens
aguaacagccucccugcua

SEQ ID NO: 224844 - RNA, 19 nt, Homo sapiens
ccacccguguccagcauga

SEQ ID NO: 224845 - RNA, 19 nt, Homo sapiens
gagaaaccccugauuccua

SEQ ID NO: 224846 - RNA, 19 nt, Homo sapiens
caaauacuucuucaucuac

SEQ ID NO: 224847 - RNA, 19 nt, Homo sapiens
gaugaggaguaugaaacga

SEQ ID NO: 224848 - RNA, 19 nt, Homo sapiens
gaggaugaggaguaugaaa

SEQ ID NO: 224849 - RNA, 19 nt, Homo sapiens
gagaagcagagacauccuu

SEQ ID NO: 224850 - RNA, 19 nt, Homo sapiens
ggaaucaaacgagaucauc

SEQ ID NO: 224851 - RNA, 19 nt, Homo sapiens
agagagugcugaccauaac

SEQ ID NO: 224852 - RNA, 19 nt, Homo sapiens
ccacagaaggagcaaauac

SEQ ID NO: 224853 - RNA, 19 nt, Homo sapiens
ugacagugccucugccaau

SEQ ID NO: 224854 - RNA, 19 nt, Homo sapiens
agaaugggaaugaauugaa

SEQ ID NO: 224855 - RNA, 19 nt, Homo sapiens
gaugaaagaguaggugaag

SEQ ID NO: 224856 - RNA, 19 nt, Homo sapiens
ugagagagaagcagagaca

SEQ ID NO: 224857 - RNA, 19 nt, Homo sapiens
agauucaagugguucaaga

SEQ ID NO: 224858 - RNA, 19 nt, Homo sapiens
ucugaauacuccucucuca

SEQ ID NO: 224859 - RNA, 19 nt, Homo sapiens
gcaacggacacacugaaag

SEQ ID NO: 224860 - RNA, 19 nt, Homo sapiens
gcaaauacuucuucaucua

SEQ ID NO: 224861 - RNA, 19 nt, Homo sapiens
gagcauaugugucuucaga

SEQ ID NO: 224862 - RNA, 19 nt, Homo sapiens
ggaaugaauugaaucgaaa

SEQ ID NO: 224863 - RNA, 19 nt, Homo sapiens
gaacaguccaucuucuuua

SEQ ID NO: 224864 - RNA, 19 nt, Homo sapiens
gcaaagugaucagcaaauu

SEQ ID NO: 224865 - RNA, 19 nt, Homo sapiens
gaguauaugugcaaaguga

SEQ ID NO: 224866 - RNA, 19 nt, Homo sapiens
gauaugcacuugaaaugau

SEQ ID NO: 224867 - RNA, 19 nt, Homo sapiens
gggaaugaauugaaucgaa

SEQ ID NO: 224868 - RNA, 19 nt, Homo sapiens
gaacuucgcauuaacaaag

SEQ ID NO: 224869 - RNA, 19 nt, Homo sapiens
gaauaucaguauccacaga

SEQ ID NO: 224870 - RNA, 19 nt, Homo sapiens
gaaugggaaugaauugaau

SEQ ID NO: 224871 - RNA, 19 nt, Homo sapiens
caaagugaucagcaaauua

SEQ ID NO: 224872 - RNA, 19 nt, Homo sapiens
uaaccgauaugcacuugaa

SEQ ID NO: 224873 - RNA, 19 nt, Homo sapiens
cagaauguguuauuuguca

SEQ ID NO: 224874 - RNA, 19 nt, Homo sapiens
gacagugccucugccaaua

SEQ ID NO: 224875 - RNA, 19 nt, Homo sapiens
gagcaaauacuucuucauc

SEQ ID NO: 224876 - RNA, 19 nt, Homo sapiens
gagaguauaugugcaaagu

SEQ ID NO: 224877 - RNA, 19 nt, Homo sapiens
agucagaacuucgcauuaa

SEQ ID NO: 224878 - RNA, 19 nt, Homo sapiens
gcacuugaaaugaugguaa

SEQ ID NO: 224879 - RNA, 19 nt, Homo sapiens
gcuaagcuguaaccgauau

SEQ ID NO: 224880 - RNA, 19 nt, Homo sapiens
ugucuuaccagaucuaaua

SEQ ID NO: 224881 - RNA, 19 nt, Homo sapiens
caaagaaggcagaggcaaa

SEQ ID NO: 224882 - RNA, 19 nt, Homo sapiens
gcauaugugucuucagagu

SEQ ID NO: 224883 - RNA, 19 nt, Homo sapiens
gcaagugcccaaaugaguu

SEQ ID NO: 224884 - RNA, 19 nt, Homo sapiens
gaauacuccucucucagau

SEQ ID NO: 224885 - RNA, 19 nt, Homo sapiens
gcaaagggaagggcaagaa

SEQ ID NO: 224886 - RNA, 19 nt, Homo sapiens
ucaagugguucaagaaugg

SEQ ID NO: 224887 - RNA, 19 nt, Homo sapiens
ugaaaccaguucugaauac

SEQ ID NO: 224888 - RNA, 19 nt, Homo sapiens
gcucugagauacuaauagg

SEQ ID NO: 224889 - RNA, 19 nt, Homo sapiens
cuuaccagaucuaauauug

SEQ ID NO: 224890 - RNA, 19 nt, Homo sapiens
ggauguuucuggaauugau

SEQ ID NO: 224891 - RNA, 19 nt, Homo sapiens
ucaagaaugggaaugaauu

SEQ ID NO: 224892 - RNA, 19 nt, Homo sapiens
gaucagcaaauuaggaaau

SEQ ID NO: 224893 - RNA, 19 nt, Homo sapiens
gugaaaccaguucugaaua

SEQ ID NO: 224894 - RNA, 19 nt, Homo sapiens
uaaaggcauuucaaagucu

SEQ ID NO: 224895 - RNA, 19 nt, Homo sapiens
caagugcccaaaugaguuu

SEQ ID NO: 224896 - RNA, 19 nt, Homo sapiens
ugaauacuccucucucaga

SEQ ID NO: 224897 - RNA, 19 nt, Homo sapiens
caaauuaggaaaugacagu

SEQ ID NO: 224898 - RNA, 19 nt, Homo sapiens
uaaaaggaguucagauguu

SEQ ID NO: 224899 - RNA, 19 nt, Homo sapiens
caacugaaggagcauaugu

SEQ ID NO: 224900 - RNA, 19 nt, Homo sapiens
caagaaugggaaugaauug

SEQ ID NO: 224901 - RNA, 19 nt, Homo sapiens
auaaaggcauuucaaaguc

SEQ ID NO: 224902 - RNA, 19 nt, Homo sapiens
ugaaggagcauaugugucu

SEQ ID NO: 224903 - RNA, 19 nt, Homo sapiens
aaagugaucagcaaauuag

SEQ ID NO: 224904 - RNA, 19 nt, Homo sapiens
ggaagggcaagaagaagga

SEQ ID NO: 224905 - RNA, 19 nt, Homo sapiens
gaaaccaguucugaauacu

SEQ ID NO: 224906 - RNA, 19 nt, Homo sapiens
ggcugcagguuccaaacua

SEQ ID NO: 224907 - RNA, 19 nt, Homo sapiens
ugaacaguccaucuucuuu

SEQ ID NO: 224908 - RNA, 19 nt, Homo sapiens
gcaugagaacauuaacaaa

SEQ ID NO: 224909 - RNA, 19 nt, Homo sapiens
gaaucaaacgagaucauca

SEQ ID NO: 224910 - RNA, 19 nt, Homo sapiens
caauaucaccaucguggaa

SEQ ID NO: 224911 - RNA, 19 nt, Homo sapiens
aaaaggaguucagauguuu

SEQ ID NO: 224912 - RNA, 19 nt, Homo sapiens
gauacuaauagguguguga

SEQ ID NO: 224913 - RNA, 19 nt, Homo sapiens
uguauuacuuccucuguuc

SEQ ID NO: 224914 - RNA, 19 nt, Homo sapiens
cagagucucccauuagaau

SEQ ID NO: 224915 - RNA, 19 nt, Homo sapiens
ucaccaucguggaaucaaa

SEQ ID NO: 224916 - RNA, 19 nt, Homo sapiens
ggacaaacuuuucccaaac

SEQ ID NO: 224917 - RNA, 19 nt, Homo sapiens
gaaggagcauaugugucuu

SEQ ID NO: 224918 - RNA, 19 nt, Homo sapiens
auacuccucucucagauuc

SEQ ID NO: 224919 - RNA, 19 nt, Homo sapiens
aucaagcagugaaauauga

SEQ ID NO: 224920 - RNA, 19 nt, Homo sapiens
caaauacuucuucaucuac

SEQ ID NO: 224921 - RNA, 19 nt, Homo sapiens
aacaguccaucuucuuuau

SEQ ID NO: 224922 - RNA, 19 nt, Homo sapiens
caagcagugaaauaugaua

SEQ ID NO: 224923 - RNA, 19 nt, Homo sapiens
ggaaucaaacgagaucauc

SEQ ID NO: 224924 - RNA, 19 nt, Homo sapiens
cgauaugcacuugaaauga

SEQ ID NO: 224925 - RNA, 19 nt, Homo sapiens
ggguguugcuaagcuguaa

SEQ ID NO: 224926 - RNA, 19 nt, Homo sapiens
acaaugaccacauccugaa

SEQ ID NO: 224927 - RNA, 19 nt, Homo sapiens
cuaguuggcucugagauac

SEQ ID NO: 224928 - RNA, 19 nt, Homo sapiens
uaccagaucuaauauugac

SEQ ID NO: 224929 - RNA, 19 nt, Homo sapiens
ccacagaaggagcaaauac

SEQ ID NO: 224930 - RNA, 19 nt, Homo sapiens
ugacagugccucugccaau

SEQ ID NO: 224931 - RNA, 19 nt, Homo sapiens
agaaugggaaugaauugaa

SEQ ID NO: 224932 - RNA, 19 nt, Homo sapiens
agaugugucuuaccagauc

SEQ ID NO: 224933 - RNA, 19 nt, Homo sapiens
ucugaauacuccucucuca

SEQ ID NO: 224934 - RNA, 19 nt, Homo sapiens
agauucaagugguucaaga

SEQ ID NO: 224935 - RNA, 19 nt, Homo sapiens
caguccaucuucuuuauac

SEQ ID NO: 224936 - RNA, 19 nt, Homo sapiens
gauguuucuggaauugaua

SEQ ID NO: 224937 - RNA, 19 nt, Homo sapiens
cagauuccaccuagagcua

SEQ ID NO: 224938 - RNA, 19 nt, Homo sapiens
cccauuagaauaucaguau

SEQ ID NO: 224939 - RNA, 19 nt, Homo sapiens
gagucucccauuagaauau

SEQ ID NO: 224940 - RNA, 19 nt, Homo sapiens
ucagcaaauuaggaaauga

SEQ ID NO: 224941 - RNA, 19 nt, Homo sapiens
gugaucagcaaauuaggaa

SEQ ID NO: 224942 - RNA, 19 nt, Homo sapiens
ggugugaaaccaguucuga

SEQ ID NO: 224943 - RNA, 19 nt, Homo sapiens
acagaaggagcaaauacuu

SEQ ID NO: 224944 - RNA, 19 nt, Homo sapiens
ucuucagagucucccauua

SEQ ID NO: 224945 - RNA, 19 nt, Homo sapiens
aacgagaucaucacuggua

SEQ ID NO: 224946 - RNA, 19 nt, Homo sapiens
cgagauguccgagcgcaaa

SEQ ID NO: 224947 - RNA, 19 nt, Homo sapiens
gcugcagguuccaaacuag

SEQ ID NO: 224948 - RNA, 19 nt, Homo sapiens
gauucaagugguucaagaa

SEQ ID NO: 224949 - RNA, 19 nt, Homo sapiens
gauguccgagcgcaaagaa

SEQ ID NO: 224950 - RNA, 19 nt, Homo sapiens
uaucaagcagugaaauaug

SEQ ID NO: 224951 - RNA, 19 nt, Homo sapiens
ccggauguuucuggaauug

SEQ ID NO: 224952 - RNA, 19 nt, Homo sapiens
guaauggccagcuucuaca

SEQ ID NO: 224953 - RNA, 19 nt, Homo sapiens
ccgauaugcacuugaaaug

SEQ ID NO: 224954 - RNA, 19 nt, Homo sapiens
caaugaccacauccugaaa

SEQ ID NO: 224955 - RNA, 19 nt, Homo sapiens
aaagggaagggcaagaaga

SEQ ID NO: 224956 - RNA, 19 nt, Homo sapiens
auggccagcuucuacagua

SEQ ID NO: 224957 - RNA, 19 nt, Homo sapiens
ggugaucgcugccaaaacu

SEQ ID NO: 224958 - RNA, 19 nt, Homo sapiens
gugcaaagugaucagcaaa

SEQ ID NO: 224959 - RNA, 19 nt, Homo sapiens
ggcugauucuggagaguau

SEQ ID NO: 224960 - RNA, 19 nt, Homo sapiens
guaagaugcuguaucauuu

SEQ ID NO: 224961 - RNA, 19 nt, Homo sapiens
gaaagugagguucaaguua

SEQ ID NO: 224962 - RNA, 19 nt, Homo sapiens
gaacaguccaucuucuuua

SEQ ID NO: 224963 - RNA, 19 nt, Homo sapiens
gacaagaucuuugaauaug

SEQ ID NO: 224964 - RNA, 19 nt, Homo sapiens
gauaugcacuugaaaugau

SEQ ID NO: 224965 - RNA, 19 nt, Homo sapiens
gaauaugacucuccuacuc

SEQ ID NO: 224966 - RNA, 19 nt, Homo sapiens
ggacaagaucuuugaauau

SEQ ID NO: 224967 - RNA, 19 nt, Homo sapiens
uggacaagaucuuugaaua

SEQ ID NO: 224968 - RNA, 19 nt, Homo sapiens
ccaaacugcuccuaaacuu

SEQ ID NO: 224969 - RNA, 19 nt, Homo sapiens
gugagccgauggagauuua

SEQ ID NO: 224970 - RNA, 19 nt, Homo sapiens
ucugaacucuucuugauuu

SEQ ID NO: 224971 - RNA, 19 nt, Homo sapiens
gcuacugguuuacuuaauu

SEQ ID NO: 224972 - RNA, 19 nt, Homo sapiens
uaaccgauaugcacuugaa

SEQ ID NO: 224973 - RNA, 19 nt, Homo sapiens
cagaauguguuauuuguca

SEQ ID NO: 224974 - RNA, 19 nt, Homo sapiens
ggccaggacccuauuauuu

SEQ ID NO: 224975 - RNA, 19 nt, Homo sapiens
aacagcagcuuaaagaauu

SEQ ID NO: 224976 - RNA, 19 nt, Homo sapiens
gcacuugaaaugaugguaa

SEQ ID NO: 224977 - RNA, 19 nt, Homo sapiens
gcuaagcuguaaccgauau

SEQ ID NO: 224978 - RNA, 19 nt, Homo sapiens
ccuguaagaugcuguauca

SEQ ID NO: 224979 - RNA, 19 nt, Homo sapiens
ugucuuaccagaucuaaua

SEQ ID NO: 224980 - RNA, 19 nt, Homo sapiens
agaaacagcagcuuaaaga

SEQ ID NO: 224981 - RNA, 19 nt, Homo sapiens
gaaacagcagcuuaaagaa

SEQ ID NO: 224982 - RNA, 19 nt, Homo sapiens
gcaagugcccaaaugaguu

SEQ ID NO: 224983 - RNA, 19 nt, Homo sapiens
aaagugagguucaaguuac

SEQ ID NO: 224984 - RNA, 19 nt, Homo sapiens
gaaacuaaucuccaaacug

SEQ ID NO: 224985 - RNA, 19 nt, Homo sapiens
ccuaaacuuucuacaucua

SEQ ID NO: 224986 - RNA, 19 nt, Homo sapiens
gaugcuguaucauuugguu

SEQ ID NO: 224987 - RNA, 19 nt, Homo sapiens
ggaguagcauuuaaaagaa

SEQ ID NO: 224988 - RNA, 19 nt, Homo sapiens
gcagcuccgucgaucuauu

SEQ ID NO: 224989 - RNA, 19 nt, Homo sapiens
gcucugagauacuaauagg

SEQ ID NO: 224990 - RNA, 19 nt, Homo sapiens
cuuaccagaucuaauauug

SEQ ID NO: 224991 - RNA, 19 nt, Homo sapiens
ccacaaacaacagaaacua

SEQ ID NO: 224992 - RNA, 19 nt, Homo sapiens
gaggugagccgauggagau

SEQ ID NO: 224993 - RNA, 19 nt, Homo sapiens
ggauguuucuggaauugau

SEQ ID NO: 224994 - RNA, 19 nt, Homo sapiens
gcccagaaacagcagcuua

SEQ ID NO: 224995 - RNA, 19 nt, Homo sapiens
uaaaggcauuucaaagucu

SEQ ID NO: 224996 - RNA, 19 nt, Homo sapiens
caagugcccaaaugaguuu

SEQ ID NO: 224997 - RNA, 19 nt, Homo sapiens
caaacugcuccuaaacuuu

SEQ ID NO: 224998 - RNA, 19 nt, Homo sapiens
ucuccaaacugcuccuaaa

SEQ ID NO: 224999 - RNA, 19 nt, Homo sapiens
gcugagcgccugagagguu

SEQ ID NO: 225000 - RNA, 19 nt, Homo sapiens
uguaagaugcuguaucauu

SEQ ID NO: 225001 - RNA, 19 nt, Homo sapiens
gcaucuuucugaacucuuc

SEQ ID NO: 225002 - RNA, 19 nt, Homo sapiens
acagcagcuuaaagaauua

SEQ ID NO: 225003 - RNA, 19 nt, Homo sapiens
aaacagcagcuuaaagaau

SEQ ID NO: 225004 - RNA, 19 nt, Homo sapiens
gccaggacccuauuauuuc

SEQ ID NO: 225005 - RNA, 19 nt, Homo sapiens
gguuuggaguagcauuuaa

SEQ ID NO: 225006 - RNA, 19 nt, Homo sapiens
auaaaggcauuucaaaguc

SEQ ID NO: 225007 - RNA, 19 nt, Homo sapiens
aaacugcuccuaaacuuuc

SEQ ID NO: 225008 - RNA, 19 nt, Homo sapiens
gcaacucagccacaaacaa

SEQ ID NO: 225009 - RNA, 19 nt, Homo sapiens
gcagacaccagcuucagau

SEQ ID NO: 225010 - RNA, 19 nt, Homo sapiens
ugaacaguccaucuucuuu

SEQ ID NO: 225011 - RNA, 19 nt, Homo sapiens
gcaugagaacauuaacaaa

SEQ ID NO: 225012 - RNA, 19 nt, Homo sapiens
ggugagaacgcccaaguca

SEQ ID NO: 225013 - RNA, 19 nt, Homo sapiens
gcauacacuucaccugucu

SEQ ID NO: 225014 - RNA, 19 nt, Homo sapiens
caagaucuuugaauaugac

SEQ ID NO: 225015 - RNA, 19 nt, Homo sapiens
gugcagacccaucucuuga

SEQ ID NO: 225016 - RNA, 19 nt, Homo sapiens
gcaccgacaccgaagaauc

SEQ ID NO: 225017 - RNA, 19 nt, Homo sapiens
gcuguugucuccuuugaac

SEQ ID NO: 225018 - RNA, 19 nt, Homo sapiens
ccaggacccuauuauuucu

SEQ ID NO: 225019 - RNA, 19 nt, Homo sapiens
uuucugaacucuucuugau

SEQ ID NO: 225020 - RNA, 19 nt, Homo sapiens
gauacuaauagguguguga

SEQ ID NO: 225021 - RNA, 19 nt, Homo sapiens
uguauuacuuccucuguuc

SEQ ID NO: 225022 - RNA, 19 nt, Homo sapiens
cacaaacaacagaaacuaa

SEQ ID NO: 225023 - RNA, 19 nt, Homo sapiens
caacucagccacaaacaac

SEQ ID NO: 225024 - RNA, 19 nt, Homo sapiens
aauaauggccuuggacuug

SEQ ID NO: 225025 - RNA, 19 nt, Homo sapiens
cuccuaaacuuucuacauc

SEQ ID NO: 225026 - RNA, 19 nt, Homo sapiens
aguuugggcuacugguuua

SEQ ID NO: 225027 - RNA, 19 nt, Homo sapiens
aacagaaacuaaucuccaa

SEQ ID NO: 225028 - RNA, 19 nt, Homo sapiens
gggcuacugguuuacuuaa

SEQ ID NO: 225029 - RNA, 19 nt, Homo sapiens
cagcuccgucgaucuauuu

SEQ ID NO: 225030 - RNA, 19 nt, Homo sapiens
uaagaugcuguaucauuug

SEQ ID NO: 225031 - RNA, 19 nt, Homo sapiens
aucaagcagugaaauauga

SEQ ID NO: 225032 - RNA, 19 nt, Homo sapiens
caaacaacagaaacuaauc

SEQ ID NO: 225033 - RNA, 19 nt, Homo sapiens
uuucgucccuguccucuug

SEQ ID NO: 225034 - RNA, 19 nt, Homo sapiens
aacaguccaucuucuuuau

SEQ ID NO: 225035 - RNA, 19 nt, Homo sapiens
caagcagugaaauaugaua

SEQ ID NO: 225036 - RNA, 19 nt, Homo sapiens
ccuuggacuuggacgauuu

SEQ ID NO: 225037 - RNA, 19 nt, Homo sapiens
ccagaaacagcagcuuaaa

SEQ ID NO: 225038 - RNA, 19 nt, Homo sapiens
cgauaugcacuugaaauga

SEQ ID NO: 225039 - RNA, 19 nt, Homo sapiens
ggguguugcuaagcuguaa

SEQ ID NO: 225040 - RNA, 19 nt, Homo sapiens
acaaugaccacauccugaa

SEQ ID NO: 225041 - RNA, 19 nt, Homo sapiens
cuaguuggcucugagauac

SEQ ID NO: 225042 - RNA, 19 nt, Homo sapiens
uaccagaucuaauauugac

SEQ ID NO: 225043 - RNA, 19 nt, Homo sapiens
gggcucaaucugaaaguga

SEQ ID NO: 225044 - RNA, 19 nt, Homo sapiens
gaaaaguggcccagaaaca

SEQ ID NO: 225045 - RNA, 19 nt, Homo sapiens
gggaugguuuggaguagca

SEQ ID NO: 225046 - RNA, 19 nt, Homo sapiens
agaugugucuuaccagauc

SEQ ID NO: 225047 - RNA, 19 nt, Homo sapiens
gacaccagcuucagaugcu

SEQ ID NO: 225048 - RNA, 19 nt, Homo sapiens
cgacaccgaagaaucguau

SEQ ID NO: 225049 - RNA, 19 nt, Homo sapiens
acacuucaccugucucuag

SEQ ID NO: 225050 - RNA, 19 nt, Homo sapiens
ggccucaaguggguauuug

SEQ ID NO: 225051 - RNA, 19 nt, Homo sapiens
cggcagcuccgucgaucua

SEQ ID NO: 225052 - RNA, 19 nt, Homo sapiens
gagccgauggagauuuauu

SEQ ID NO: 225053 - RNA, 19 nt, Homo sapiens
caguccaucuucuuuauac

SEQ ID NO: 225054 - RNA, 19 nt, Homo sapiens
gauguuucuggaauugaua

SEQ ID NO: 225055 - RNA, 19 nt, Homo sapiens
cagauuccaccuagagcua

SEQ ID NO: 225056 - RNA, 19 nt, Homo sapiens
acaccgaagaaucguauuu

SEQ ID NO: 225057 - RNA, 19 nt, Homo sapiens
gcuccuaaacuuucuacau

SEQ ID NO: 225058 - RNA, 19 nt, Homo sapiens
ucucuagggcucaaucuga

SEQ ID NO: 225059 - RNA, 19 nt, Homo sapiens
uaucaagcagugaaauaug

SEQ ID NO: 225060 - RNA, 19 nt, Homo sapiens
gcaaauacuucuucaucua

SEQ ID NO: 225061 - RNA, 19 nt, Homo sapiens
gagcauaugugucuucaga

SEQ ID NO: 225062 - RNA, 19 nt, Homo sapiens
ggaaugaauugaaucgaaa

SEQ ID NO: 225063 - RNA, 19 nt, Homo sapiens
gcaaagugaucagcaaauu

SEQ ID NO: 225064 - RNA, 19 nt, Homo sapiens
gaacgaaacaauaugauga

SEQ ID NO: 225065 - RNA, 19 nt, Homo sapiens
gaguauaugugcaaaguga

SEQ ID NO: 225066 - RNA, 19 nt, Homo sapiens
gcacacagauccaaaugca

SEQ ID NO: 225067 - RNA, 19 nt, Homo sapiens
ggagcaagauguacugaga

SEQ ID NO: 225068 - RNA, 19 nt, Homo sapiens
gggaaugaauugaaucgaa

SEQ ID NO: 225069 - RNA, 19 nt, Homo sapiens
gaacuucgcauuaacaaag

SEQ ID NO: 225070 - RNA, 19 nt, Homo sapiens
gaauaucaguauccacaga

SEQ ID NO: 225071 - RNA, 19 nt, Homo sapiens
gaaugggaaugaauugaau

SEQ ID NO: 225072 - RNA, 19 nt, Homo sapiens
caaagugaucagcaaauua

SEQ ID NO: 225073 - RNA, 19 nt, Homo sapiens
cggaggagcuguaccagaa

SEQ ID NO: 225074 - RNA, 19 nt, Homo sapiens
gacagugccucugccaaua

SEQ ID NO: 225075 - RNA, 19 nt, Homo sapiens
gcuggugaaucaauacgua

SEQ ID NO: 225076 - RNA, 19 nt, Homo sapiens
gaagagagugcugaccaua

SEQ ID NO: 225077 - RNA, 19 nt, Homo sapiens
gagcaaauacuucuucauc

SEQ ID NO: 225078 - RNA, 19 nt, Homo sapiens
gagaguauaugugcaaagu

SEQ ID NO: 225079 - RNA, 19 nt, Homo sapiens
agucagaacuucgcauuaa

SEQ ID NO: 225080 - RNA, 19 nt, Homo sapiens
agaagaaguuugaccauca

SEQ ID NO: 225081 - RNA, 19 nt, Homo sapiens
gcucguaugucaccuguag

SEQ ID NO: 225082 - RNA, 19 nt, Homo sapiens
caaagaaggcagaggcaaa

SEQ ID NO: 225083 - RNA, 19 nt, Homo sapiens
gaaagccacucuguaaucg

SEQ ID NO: 225084 - RNA, 19 nt, Homo sapiens
ccagugagcauauuguuga

SEQ ID NO: 225085 - RNA, 19 nt, Homo sapiens
caagauguacugagaaugu

SEQ ID NO: 225086 - RNA, 19 nt, Homo sapiens
gcauaugugucuucagagu

SEQ ID NO: 225087 - RNA, 19 nt, Homo sapiens
guaugucaccuguagauuu

SEQ ID NO: 225088 - RNA, 19 nt, Homo sapiens
gaaacaaggcacacagauc

SEQ ID NO: 225089 - RNA, 19 nt, Homo sapiens
ggucugaacgaaacaauau

SEQ ID NO: 225090 - RNA, 19 nt, Homo sapiens
ucuuagaucuucuuccauu

SEQ ID NO: 225091 - RNA, 19 nt, Homo sapiens
gaauacuccucucucagau

SEQ ID NO: 225092 - RNA, 19 nt, Homo sapiens
gcaaagggaagggcaagaa

SEQ ID NO: 225093 - RNA, 19 nt, Homo sapiens
gcccaucacuccacuacug

SEQ ID NO: 225094 - RNA, 19 nt, Homo sapiens
gaggagcuguaccagaaga

SEQ ID NO: 225095 - RNA, 19 nt, Homo sapiens
ucaagugguucaagaaugg

SEQ ID NO: 225096 - RNA, 19 nt, Homo sapiens
ugaaaccaguucugaauac

SEQ ID NO: 225097 - RNA, 19 nt, Homo sapiens
uaugucaccuguagauuuc

SEQ ID NO: 225098 - RNA, 19 nt, Homo sapiens
ucaagaaugggaaugaauu

SEQ ID NO: 225099 - RNA, 19 nt, Homo sapiens
gaucagcaaauuaggaaau

SEQ ID NO: 225100 - RNA, 19 nt, Homo sapiens
gugaaaccaguucugaaua

SEQ ID NO: 225101 - RNA, 19 nt, Homo sapiens
gcaugcagauccagcuauc

SEQ ID NO: 225102 - RNA, 19 nt, Homo sapiens
ugaauacuccucucucaga

SEQ ID NO: 225103 - RNA, 19 nt, Homo sapiens
cgaaagccacucuguaauc

SEQ ID NO: 225104 - RNA, 19 nt, Homo sapiens
caaauuaggaaaugacagu

SEQ ID NO: 225105 - RNA, 19 nt, Homo sapiens
gagaaacaaggcacacaga

SEQ ID NO: 225106 - RNA, 19 nt, Homo sapiens
uggauucacuggagcaaga

SEQ ID NO: 225107 - RNA, 19 nt, Homo sapiens
caacugaaggagcauaugu

SEQ ID NO: 225108 - RNA, 19 nt, Homo sapiens
caagaaugggaaugaauug

SEQ ID NO: 225109 - RNA, 19 nt, Homo sapiens
gaagaaguuugaccaucac

SEQ ID NO: 225110 - RNA, 19 nt, Homo sapiens
caccaaggcugcgggagaa

SEQ ID NO: 225111 - RNA, 19 nt, Homo sapiens
ccaaaugcaugcagaucca

SEQ ID NO: 225112 - RNA, 19 nt, Homo sapiens
agugaaagacauaaccuua

SEQ ID NO: 225113 - RNA, 19 nt, Homo sapiens
ccucauagugaaagacaua

SEQ ID NO: 225114 - RNA, 19 nt, Homo sapiens
gcauauuguugagagagaa

SEQ ID NO: 225115 - RNA, 19 nt, Homo sapiens
ugaaggagcauaugugucu

SEQ ID NO: 225116 - RNA, 19 nt, Homo sapiens
ccucaggcaugccagagaa

SEQ ID NO: 225117 - RNA, 19 nt, Homo sapiens
gagcaacggacacacugaa

SEQ ID NO: 225118 - RNA, 19 nt, Homo sapiens
ggaagggcaagaagaagga

SEQ ID NO: 225119 - RNA, 19 nt, Homo sapiens
gcaagugccaaccuggauu

SEQ ID NO: 225120 - RNA, 19 nt, Homo sapiens
gaaaccaguucugaauacu

SEQ ID NO: 225121 - RNA, 19 nt, Homo sapiens
aaagugaucagcaaauuag

SEQ ID NO: 225122 - RNA, 19 nt, Homo sapiens
ggcugcagguuccaaacua

SEQ ID NO: 225123 - RNA, 19 nt, Homo sapiens
gagaaugugcccaugaaag

SEQ ID NO: 225124 - RNA, 19 nt, Homo sapiens
gaaucaaacgagaucauca

SEQ ID NO: 225125 - RNA, 19 nt, Homo sapiens
caauaucaccaucguggaa

SEQ ID NO: 225126 - RNA, 19 nt, Homo sapiens
cauuugggcuucauucucu

SEQ ID NO: 225127 - RNA, 19 nt, Homo sapiens
gugaaucaauacguaucua

SEQ ID NO: 225128 - RNA, 19 nt, Homo sapiens
cugagaaugugcccaugaa

SEQ ID NO: 225129 - RNA, 19 nt, Homo sapiens
gagcaagauguacugagaa

SEQ ID NO: 225130 - RNA, 19 nt, Homo sapiens
cagagucucccauuagaau

SEQ ID NO: 225131 - RNA, 19 nt, Homo sapiens
ucaccaucguggaaucaaa

SEQ ID NO: 225132 - RNA, 19 nt, Homo sapiens
ggacaaacuuuucccaaac

SEQ ID NO: 225133 - RNA, 19 nt, Homo sapiens
uccgaaagccacucuguaa

SEQ ID NO: 225134 - RNA, 19 nt, Homo sapiens
gaaggagcauaugugucuu

SEQ ID NO: 225135 - RNA, 19 nt, Homo sapiens
auacuccucucucagauuc

SEQ ID NO: 225136 - RNA, 19 nt, Homo sapiens
ccacccguguccagcauga

SEQ ID NO: 225137 - RNA, 19 nt, Homo sapiens
gagaaaccccugauuccua

SEQ ID NO: 225138 - RNA, 19 nt, Homo sapiens
caaauacuucuucaucuac

SEQ ID NO: 225139 - RNA, 19 nt, Homo sapiens
gagaagcagagacauccuu

SEQ ID NO: 225140 - RNA, 19 nt, Homo sapiens
ggaaucaaacgagaucauc

SEQ ID NO: 225141 - RNA, 19 nt, Homo sapiens
agagagugcugaccauaac

SEQ ID NO: 225142 - RNA, 19 nt, Homo sapiens
ccacagaaggagcaaauac

SEQ ID NO: 225143 - RNA, 19 nt, Homo sapiens
agaaugggaaugaauugaa

SEQ ID NO: 225144 - RNA, 19 nt, Homo sapiens
ugacagugccucugccaau

SEQ ID NO: 225145 - RNA, 19 nt, Homo sapiens
agauucaagugguucaaga

SEQ ID NO: 225146 - RNA, 19 nt, Homo sapiens
ugagagagaagcagagaca

SEQ ID NO: 225147 - RNA, 19 nt, Homo sapiens
ucugaauacuccucucuca

SEQ ID NO: 225148 - RNA, 19 nt, Homo sapiens
uaagaccccuuggccuuua

SEQ ID NO: 225149 - RNA, 19 nt, Homo sapiens
gcaacggacacacugaaag

SEQ ID NO: 225150 - RNA, 19 nt, Homo sapiens
aagagagugcugaccauaa

SEQ ID NO: 225151 - RNA, 19 nt, Homo sapiens
agaaugugcccaugaaagu

SEQ ID NO: 225152 - RNA, 19 nt, Homo sapiens
gugccaaccuggauucacu

SEQ ID NO: 225153 - RNA, 19 nt, Homo sapiens
cccauuagaauaucaguau

SEQ ID NO: 225154 - RNA, 19 nt, Homo sapiens
gagucucccauuagaauau

SEQ ID NO: 225155 - RNA, 19 nt, Homo sapiens
ucagcaaauuaggaaauga

SEQ ID NO: 225156 - RNA, 19 nt, Homo sapiens
gugaucagcaaauuaggaa

SEQ ID NO: 225157 - RNA, 19 nt, Homo sapiens
ggagaagaaguuugaccau

SEQ ID NO: 225158 - RNA, 19 nt, Homo sapiens
ggugugaaaccaguucuga

SEQ ID NO: 225159 - RNA, 19 nt, Homo sapiens
gcuaucagcaacucaucuu

SEQ ID NO: 225160 - RNA, 19 nt, Homo sapiens
gcaaauacuucuucaucua

SEQ ID NO: 225161 - RNA, 19 nt, Homo sapiens
gagcauaugugucuucaga

SEQ ID NO: 225162 - RNA, 19 nt, Homo sapiens
ggaaugaauugaaucgaaa

SEQ ID NO: 225163 - RNA, 19 nt, Homo sapiens
gcaaagugaucagcaaauu

SEQ ID NO: 225164 - RNA, 19 nt, Homo sapiens
gaguauaugugcaaaguga

SEQ ID NO: 225165 - RNA, 19 nt, Homo sapiens
gggaaugaauugaaucgaa

SEQ ID NO: 225166 - RNA, 19 nt, Homo sapiens
gaacuucgcauuaacaaag

SEQ ID NO: 225167 - RNA, 19 nt, Homo sapiens
gaauaucaguauccacaga

SEQ ID NO: 225168 - RNA, 19 nt, Homo sapiens
gaaugggaaugaauugaau

SEQ ID NO: 225169 - RNA, 19 nt, Homo sapiens
caaagugaucagcaaauua

SEQ ID NO: 225170 - RNA, 19 nt, Homo sapiens
gacagugccucugccaaua

SEQ ID NO: 225171 - RNA, 19 nt, Homo sapiens
gagcaaauacuucuucauc

SEQ ID NO: 225172 - RNA, 19 nt, Homo sapiens
gagaguauaugugcaaagu

SEQ ID NO: 225173 - RNA, 19 nt, Homo sapiens
agucagaacuucgcauuaa

SEQ ID NO: 225174 - RNA, 19 nt, Homo sapiens
caaagaaggcagaggcaaa

SEQ ID NO: 225175 - RNA, 19 nt, Homo sapiens
gcauaugugucuucagagu

SEQ ID NO: 225176 - RNA, 19 nt, Homo sapiens
gcaagugcccaaaugaguu

SEQ ID NO: 225177 - RNA, 19 nt, Homo sapiens
gaauacuccucucucagau

SEQ ID NO: 225178 - RNA, 19 nt, Homo sapiens
gcaaagggaagggcaagaa

SEQ ID NO: 225179 - RNA, 19 nt, Homo sapiens
ucaagugguucaagaaugg

SEQ ID NO: 225180 - RNA, 19 nt, Homo sapiens
ugaaaccaguucugaauac

SEQ ID NO: 225181 - RNA, 19 nt, Homo sapiens
ucaagaaugggaaugaauu

SEQ ID NO: 225182 - RNA, 19 nt, Homo sapiens
gaucagcaaauuaggaaau

SEQ ID NO: 225183 - RNA, 19 nt, Homo sapiens
gugaaaccaguucugaaua

SEQ ID NO: 225184 - RNA, 19 nt, Homo sapiens
caagugcccaaaugaguuu

SEQ ID NO: 225185 - RNA, 19 nt, Homo sapiens
ugaauacuccucucucaga

SEQ ID NO: 225186 - RNA, 19 nt, Homo sapiens
caaauuaggaaaugacagu

SEQ ID NO: 225187 - RNA, 19 nt, Homo sapiens
caacugaaggagcauaugu

SEQ ID NO: 225188 - RNA, 19 nt, Homo sapiens
caagaaugggaaugaauug

SEQ ID NO: 225189 - RNA, 19 nt, Homo sapiens
ugaaggagcauaugugucu

SEQ ID NO: 225190 - RNA, 19 nt, Homo sapiens
aaagugaucagcaaauuag

SEQ ID NO: 225191 - RNA, 19 nt, Homo sapiens
ggaagggcaagaagaagga

SEQ ID NO: 225192 - RNA, 19 nt, Homo sapiens
gaaaccaguucugaauacu

SEQ ID NO: 225193 - RNA, 19 nt, Homo sapiens
ggcugcagguuccaaacua

SEQ ID NO: 225194 - RNA, 19 nt, Homo sapiens
gaaucaaacgagaucauca

SEQ ID NO: 225195 - RNA, 19 nt, Homo sapiens
caauaucaccaucguggaa

SEQ ID NO: 225196 - RNA, 19 nt, Homo sapiens
cagagucucccauuagaau

SEQ ID NO: 225197 - RNA, 19 nt, Homo sapiens
ucaccaucguggaaucaaa

SEQ ID NO: 225198 - RNA, 19 nt, Homo sapiens
gaaggagcauaugugucuu

SEQ ID NO: 225199 - RNA, 19 nt, Homo sapiens
ggacaaacuuuucccaaac

SEQ ID NO: 225200 - RNA, 19 nt, Homo sapiens
auacuccucucucagauuc

SEQ ID NO: 225201 - RNA, 19 nt, Homo sapiens
caaauacuucuucaucuac

SEQ ID NO: 225202 - RNA, 19 nt, Homo sapiens
ggaaucaaacgagaucauc

SEQ ID NO: 225203 - RNA, 19 nt, Homo sapiens
ccacagaaggagcaaauac

SEQ ID NO: 225204 - RNA, 19 nt, Homo sapiens
ugacagugccucugccaau

SEQ ID NO: 225205 - RNA, 19 nt, Homo sapiens
agaaugggaaugaauugaa

SEQ ID NO: 225206 - RNA, 19 nt, Homo sapiens
agauucaagugguucaaga

SEQ ID NO: 225207 - RNA, 19 nt, Homo sapiens
ucugaauacuccucucuca

SEQ ID NO: 225208 - RNA, 19 nt, Homo sapiens
cagauuccaccuagagcua

SEQ ID NO: 225209 - RNA, 19 nt, Homo sapiens
cccauuagaauaucaguau

SEQ ID NO: 225210 - RNA, 19 nt, Homo sapiens
gagucucccauuagaauau

SEQ ID NO: 225211 - RNA, 19 nt, Homo sapiens
ucagcaaauuaggaaauga

SEQ ID NO: 225212 - RNA, 19 nt, Homo sapiens
gugaucagcaaauuaggaa

SEQ ID NO: 225213 - RNA, 19 nt, Homo sapiens
acagaaggagcaaauacuu

SEQ ID NO: 225214 - RNA, 19 nt, Homo sapiens
ucuucagagucucccauua

SEQ ID NO: 225215 - RNA, 19 nt, Homo sapiens
aacgagaucaucacuggua

SEQ ID NO: 225216 - RNA, 19 nt, Homo sapiens
ggugugaaaccaguucuga

SEQ ID NO: 225217 - RNA, 19 nt, Homo sapiens
cgagauguccgagcgcaaa

SEQ ID NO: 225218 - RNA, 19 nt, Homo sapiens
gcugcagguuccaaacuag

SEQ ID NO: 225219 - RNA, 19 nt, Homo sapiens
gauguccgagcgcaaagaa

SEQ ID NO: 225220 - RNA, 19 nt, Homo sapiens
gauucaagugguucaagaa

SEQ ID NO: 225221 - RNA, 19 nt, Homo sapiens
guaauggccagcuucuaca

SEQ ID NO: 225222 - RNA, 19 nt, Homo sapiens
auggccagcuucuacagua

SEQ ID NO: 225223 - RNA, 19 nt, Homo sapiens
ggugaucgcugccaaaacu

SEQ ID NO: 225224 - RNA, 19 nt, Homo sapiens
aaagggaagggcaagaaga

SEQ ID NO: 225225 - RNA, 19 nt, Homo sapiens
gugcaaagugaucagcaaa

SEQ ID NO: 225226 - RNA, 19 nt, Homo sapiens
ggcugauucuggagaguau

SEQ ID NO: 225227 - RNA, 19 nt, Homo sapiens
gcucaguuggugcugcuuu

SEQ ID NO: 225228 - RNA, 19 nt, Homo sapiens
ugugaaaccaguucugaau

SEQ ID NO: 225229 - RNA, 19 nt, Homo sapiens
guacguccacucccuuucu

SEQ ID NO: 225230 - RNA, 19 nt, Homo sapiens
ucagaacuucgcauuaaca

SEQ ID NO: 225231 - RNA, 19 nt, Homo sapiens
cguaauggccagcuucuac

SEQ ID NO: 225232 - RNA, 19 nt, Homo sapiens
uucagagucucccauuaga

SEQ ID NO: 225233 - RNA, 19 nt, Homo sapiens
caaagggaagggcaagaag

SEQ ID NO: 225234 - RNA, 19 nt, Homo sapiens
aagggaagggcaagaagaa

SEQ ID NO: 225235 - RNA, 19 nt, Homo sapiens
uucugucucugccugaaua

SEQ ID NO: 225236 - RNA, 19 nt, Homo sapiens
ccauuagaauaucaguauc

SEQ ID NO: 225237 - RNA, 19 nt, Homo sapiens
ccaucgagggacaaacuuu

SEQ ID NO: 225238 - RNA, 19 nt, Homo sapiens
aguuggugcugcuuucuug

SEQ ID NO: 225239 - RNA, 19 nt, Homo sapiens
ccacucccuuucugucucu

SEQ ID NO: 225240 - RNA, 19 nt, Homo sapiens
cuucagagucucccauuag

SEQ ID NO: 225241 - RNA, 19 nt, Homo sapiens
cagaacuucgcauuaacaa

SEQ ID NO: 225242 - RNA, 19 nt, Homo sapiens
uucaagugguucaagaaug

SEQ ID NO: 225243 - RNA, 19 nt, Homo sapiens
uuucaaaccccucgagaua

SEQ ID NO: 225244 - RNA, 19 nt, Homo sapiens
uaaaaugugcggagaagga

SEQ ID NO: 225245 - RNA, 19 nt, Homo sapiens
gagaucaucacugguaugc

SEQ ID NO: 225246 - RNA, 19 nt, Homo sapiens
ugugcaaagugaucagcaa

SEQ ID NO: 225247 - RNA, 19 nt, Homo sapiens
guauaugugcaaagugauc

SEQ ID NO: 225248 - RNA, 19 nt, Homo sapiens
gugagcaggacggugauaa

SEQ ID NO: 225249 - RNA, 19 nt, Homo sapiens
ggaaugaauugaaucgaaa

SEQ ID NO: 225250 - RNA, 19 nt, Homo sapiens
gaacaguccaucuucuuua

SEQ ID NO: 225251 - RNA, 19 nt, Homo sapiens
gcaaagugaucagcaaauu

SEQ ID NO: 225252 - RNA, 19 nt, Homo sapiens
gaguauaugugcaaaguga

SEQ ID NO: 225253 - RNA, 19 nt, Homo sapiens
gauaugcacuugaaaugau

SEQ ID NO: 225254 - RNA, 19 nt, Homo sapiens
gggaaugaauugaaucgaa

SEQ ID NO: 225255 - RNA, 19 nt, Homo sapiens
gaacuucgcauuaacaaag

SEQ ID NO: 225256 - RNA, 19 nt, Homo sapiens
gaaugggaaugaauugaau

SEQ ID NO: 225257 - RNA, 19 nt, Homo sapiens
caaagugaucagcaaauua

SEQ ID NO: 225258 - RNA, 19 nt, Homo sapiens
uaaccgauaugcacuugaa

SEQ ID NO: 225259 - RNA, 19 nt, Homo sapiens
cagaauguguuauuuguca

SEQ ID NO: 225260 - RNA, 19 nt, Homo sapiens
gacagugccucugccaaua

SEQ ID NO: 225261 - RNA, 19 nt, Homo sapiens
gagaguauaugugcaaagu

SEQ ID NO: 225262 - RNA, 19 nt, Homo sapiens
agucagaacuucgcauuaa

SEQ ID NO: 225263 - RNA, 19 nt, Homo sapiens
gcagguacaucuucuucau

SEQ ID NO: 225264 - RNA, 19 nt, Homo sapiens
gcacuugaaaugaugguaa

SEQ ID NO: 225265 - RNA, 19 nt, Homo sapiens
gcuaagcuguaaccgauau

SEQ ID NO: 225266 - RNA, 19 nt, Homo sapiens
ugucuuaccagaucuaaua

SEQ ID NO: 225267 - RNA, 19 nt, Homo sapiens
gaaucaaacgcuacaucua

SEQ ID NO: 225268 - RNA, 19 nt, Homo sapiens
gcaagugcccaaaugaguu

SEQ ID NO: 225269 - RNA, 19 nt, Homo sapiens
gaauacuccucucucagau

SEQ ID NO: 225270 - RNA, 19 nt, Homo sapiens
gccggaaccucaagaagga

SEQ ID NO: 225271 - RNA, 19 nt, Homo sapiens
ucaagugguucaagaaugg

SEQ ID NO: 225272 - RNA, 19 nt, Homo sapiens
ugaaaccaguucugaauac

SEQ ID NO: 225273 - RNA, 19 nt, Homo sapiens
ggacagcagguacaucuuc

SEQ ID NO: 225274 - RNA, 19 nt, Homo sapiens
gcucugagauacuaauagg

SEQ ID NO: 225275 - RNA, 19 nt, Homo sapiens
cuuaccagaucuaauauug

SEQ ID NO: 225276 - RNA, 19 nt, Homo sapiens
ggauguuucuggaauugau

SEQ ID NO: 225277 - RNA, 19 nt, Homo sapiens
ucaagaaugggaaugaauu

SEQ ID NO: 225278 - RNA, 19 nt, Homo sapiens
gaucagcaaauuaggaaau

SEQ ID NO: 225279 - RNA, 19 nt, Homo sapiens
gugaaaccaguucugaaua

SEQ ID NO: 225280 - RNA, 19 nt, Homo sapiens
uaaaggcauuucaaagucu

SEQ ID NO: 225281 - RNA, 19 nt, Homo sapiens
caagugcccaaaugaguuu

SEQ ID NO: 225282 - RNA, 19 nt, Homo sapiens
ugaauacuccucucucaga

SEQ ID NO: 225283 - RNA, 19 nt, Homo sapiens
caaauuaggaaaugacagu

SEQ ID NO: 225284 - RNA, 19 nt, Homo sapiens
ggaaucaaacgcuacaucu

SEQ ID NO: 225285 - RNA, 19 nt, Homo sapiens
caagaaugggaaugaauug

SEQ ID NO: 225286 - RNA, 19 nt, Homo sapiens
auaaaggcauuucaaaguc

SEQ ID NO: 225287 - RNA, 19 nt, Homo sapiens
aaagugaucagcaaauuag

SEQ ID NO: 225288 - RNA, 19 nt, Homo sapiens
gaaaccaguucugaauacu

SEQ ID NO: 225289 - RNA, 19 nt, Homo sapiens
ggcugcagguuccaaacua

SEQ ID NO: 225290 - RNA, 19 nt, Homo sapiens
ugaacaguccaucuucuuu

SEQ ID NO: 225291 - RNA, 19 nt, Homo sapiens
gcaugagaacauuaacaaa

SEQ ID NO: 225292 - RNA, 19 nt, Homo sapiens
caauaucaccaucguggaa

SEQ ID NO: 225293 - RNA, 19 nt, Homo sapiens
gauacuaauagguguguga

SEQ ID NO: 225294 - RNA, 19 nt, Homo sapiens
uguauuacuuccucuguuc

SEQ ID NO: 225295 - RNA, 19 nt, Homo sapiens
gaggacagcagguacaucu

SEQ ID NO: 225296 - RNA, 19 nt, Homo sapiens
gcaccucgcaccaugagau

SEQ ID NO: 225297 - RNA, 19 nt, Homo sapiens
ucaccaucguggaaucaaa

SEQ ID NO: 225298 - RNA, 19 nt, Homo sapiens
auacuccucucucagauuc

SEQ ID NO: 225299 - RNA, 19 nt, Homo sapiens
aucaagcagugaaauauga

SEQ ID NO: 225300 - RNA, 19 nt, Homo sapiens
aacaguccaucuucuuuau

SEQ ID NO: 225301 - RNA, 19 nt, Homo sapiens
caagcagugaaauaugaua

SEQ ID NO: 225302 - RNA, 19 nt, Homo sapiens
ucaaggaggacagcaggua

SEQ ID NO: 225303 - RNA, 19 nt, Homo sapiens
cgauaugcacuugaaauga

SEQ ID NO: 225304 - RNA, 19 nt, Homo sapiens
ggguguugcuaagcuguaa

SEQ ID NO: 225305 - RNA, 19 nt, Homo sapiens
acaaugaccacauccugaa

SEQ ID NO: 225306 - RNA, 19 nt, Homo sapiens
cuaguuggcucugagauac

SEQ ID NO: 225307 - RNA, 19 nt, Homo sapiens
uaccagaucuaauauugac

SEQ ID NO: 225308 - RNA, 19 nt, Homo sapiens
ugacagugccucugccaau

SEQ ID NO: 225309 - RNA, 19 nt, Homo sapiens
agaaugggaaugaauugaa

SEQ ID NO: 225310 - RNA, 19 nt, Homo sapiens
agaugugucuuaccagauc

SEQ ID NO: 225311 - RNA, 19 nt, Homo sapiens
agauucaagugguucaaga

SEQ ID NO: 225312 - RNA, 19 nt, Homo sapiens
ucugaauacuccucucuca

SEQ ID NO: 225313 - RNA, 19 nt, Homo sapiens
caguccaucuucuuuauac

SEQ ID NO: 225314 - RNA, 19 nt, Homo sapiens
gacagcagguacaucuucu

SEQ ID NO: 225315 - RNA, 19 nt, Homo sapiens
gauguuucuggaauugaua

SEQ ID NO: 225316 - RNA, 19 nt, Homo sapiens
cagauuccaccuagagcua

SEQ ID NO: 225317 - RNA, 19 nt, Homo sapiens
ucagcaaauuaggaaauga

SEQ ID NO: 225318 - RNA, 19 nt, Homo sapiens
gugaucagcaaauuaggaa

SEQ ID NO: 225319 - RNA, 19 nt, Homo sapiens
ggugugaaaccaguucuga

SEQ ID NO: 225320 - RNA, 19 nt, Homo sapiens
ccaauugaaagagaugaaa

SEQ ID NO: 225321 - RNA, 19 nt, Homo sapiens
gauucaagugguucaagaa

SEQ ID NO: 225322 - RNA, 19 nt, Homo sapiens
gcugcagguuccaaacuag

SEQ ID NO: 225323 - RNA, 19 nt, Homo sapiens
uaucaagcagugaaauaug

SEQ ID NO: 225324 - RNA, 19 nt, Homo sapiens
ccggauguuucuggaauug

SEQ ID NO: 225325 - RNA, 19 nt, Homo sapiens
guaauggccagcuucuaca

SEQ ID NO: 225326 - RNA, 19 nt, Homo sapiens
aaucaaacgcuacaucuac

SEQ ID NO: 225327 - RNA, 19 nt, Homo sapiens
ccgauaugcacuugaaaug

SEQ ID NO: 225328 - RNA, 19 nt, Homo sapiens
caaugaccacauccugaaa

SEQ ID NO: 225329 - RNA, 19 nt, Homo sapiens
auggccagcuucuacagua

SEQ ID NO: 225330 - RNA, 19 nt, Homo sapiens
ggugaucgcugccaaaacu

SEQ ID NO: 225331 - RNA, 19 nt, Homo sapiens
gugcaaagugaucagcaaa

SEQ ID NO: 225332 - RNA, 19 nt, Homo sapiens
ggcugauucuggagaguau

SEQ ID NO: 225333 - RNA, 19 nt, Homo sapiens
gcucaguuggugcugcuuu

SEQ ID NO: 225334 - RNA, 19 nt, Homo sapiens
ugugaaaccaguucugaau

SEQ ID NO: 225335 - RNA, 19 nt, Homo sapiens
cagcagguacaucuucuuc

SEQ ID NO: 225336 - RNA, 19 nt, Homo sapiens
ucaauaucaagcagugaaa

SEQ ID NO: 225337 - RNA, 19 nt, Homo sapiens
cgcaugagaacauuaacaa

SEQ ID NO: 225338 - RNA, 19 nt, Homo sapiens
gccucugccugucgcauga

SEQ ID NO: 225339 - RNA, 19 nt, Homo sapiens
guacguccacucccuuucu

SEQ ID NO: 225340 - RNA, 19 nt, Homo sapiens
ucagaacuucgcauuaaca

SEQ ID NO: 225341 - RNA, 19 nt, Homo sapiens
uguaaccgauaugcacuug

SEQ ID NO: 225342 - RNA, 19 nt, Homo sapiens
cguaauggccagcuucuac

SEQ ID NO: 225343 - RNA, 19 nt, Homo sapiens
cgcccuaucuggugaaggu

SEQ ID NO: 225344 - RNA, 19 nt, Homo sapiens
gucaauaucaagcagugaa

SEQ ID NO: 225345 - RNA, 19 nt, Homo sapiens
gugugaggcuccggauguu

SEQ ID NO: 225346 - RNA, 19 nt, Homo sapiens
acuaguuggcucugagaua

SEQ ID NO: 225347 - RNA, 19 nt, Homo sapiens
uucugucucugccugaaua

SEQ ID NO: 225348 - RNA, 19 nt, Homo sapiens
ugaaaaggguguugcuaag

SEQ ID NO: 225349 - RNA, 19 nt, Homo sapiens
gcaaauacuucuucaucua

SEQ ID NO: 225350 - RNA, 19 nt, Homo sapiens
gagcauaugugucuucaga

SEQ ID NO: 225351 - RNA, 19 nt, Homo sapiens
ggaaugaauugaaucgaaa

SEQ ID NO: 225352 - RNA, 19 nt, Homo sapiens
acacauagauucaccugua

SEQ ID NO: 225353 - RNA, 19 nt, Homo sapiens
gcaaagugaucagcaaauu

SEQ ID NO: 225354 - RNA, 19 nt, Homo sapiens
gaacgaaacaauaugauga

SEQ ID NO: 225355 - RNA, 19 nt, Homo sapiens
ccaagagccuguuaagaaa

SEQ ID NO: 225356 - RNA, 19 nt, Homo sapiens
gaguauaugugcaaaguga

SEQ ID NO: 225357 - RNA, 19 nt, Homo sapiens
ggagcaagauguacugaga

SEQ ID NO: 225358 - RNA, 19 nt, Homo sapiens
ccacauugcuaacagauug

SEQ ID NO: 225359 - RNA, 19 nt, Homo sapiens
uuaagaaacucgccaauag

SEQ ID NO: 225360 - RNA, 19 nt, Homo sapiens
gggaaugaauugaaucgaa

SEQ ID NO: 225361 - RNA, 19 nt, Homo sapiens
gaacuucgcauuaacaaag

SEQ ID NO: 225362 - RNA, 19 nt, Homo sapiens
gaauaucaguauccacaga

SEQ ID NO: 225363 - RNA, 19 nt, Homo sapiens
gaaugggaaugaauugaau

SEQ ID NO: 225364 - RNA, 19 nt, Homo sapiens
caaagugaucagcaaauua

SEQ ID NO: 225365 - RNA, 19 nt, Homo sapiens
cggaggagcuguaccagaa

SEQ ID NO: 225366 - RNA, 19 nt, Homo sapiens
aacagaagaugaaagagua

SEQ ID NO: 225367 - RNA, 19 nt, Homo sapiens
gacagugccucugccaaua

SEQ ID NO: 225368 - RNA, 19 nt, Homo sapiens
ccaagacccuauugcugua

SEQ ID NO: 225369 - RNA, 19 nt, Homo sapiens
gaaagaguaggugaagaua

SEQ ID NO: 225370 - RNA, 19 nt, Homo sapiens
gcuggugaaucaauacgua

SEQ ID NO: 225371 - RNA, 19 nt, Homo sapiens
gaagagagugcugaccaua

SEQ ID NO: 225372 - RNA, 19 nt, Homo sapiens
gagcaaauacuucuucauc

SEQ ID NO: 225373 - RNA, 19 nt, Homo sapiens
gagaguauaugugcaaagu

SEQ ID NO: 225374 - RNA, 19 nt, Homo sapiens
agucagaacuucgcauuaa

SEQ ID NO: 225375 - RNA, 19 nt, Homo sapiens
agaagaaguuugaccauca

SEQ ID NO: 225376 - RNA, 19 nt, Homo sapiens
gcucguaugucaccuguag

SEQ ID NO: 225377 - RNA, 19 nt, Homo sapiens
caaagaaggcagaggcaaa

SEQ ID NO: 225378 - RNA, 19 nt, Homo sapiens
gccaggcugucuaguguaa

SEQ ID NO: 225379 - RNA, 19 nt, Homo sapiens
ugaaacagaagaugaaaga

SEQ ID NO: 225380 - RNA, 19 nt, Homo sapiens
cccaagagccuguuaagaa

SEQ ID NO: 225381 - RNA, 19 nt, Homo sapiens
gaaagccacucuguaaucg

SEQ ID NO: 225382 - RNA, 19 nt, Homo sapiens
ccagugagcauauuguuga

SEQ ID NO: 225383 - RNA, 19 nt, Homo sapiens
caagauguacugagaaugu

SEQ ID NO: 225384 - RNA, 19 nt, Homo sapiens
gcauaugugucuucagagu

SEQ ID NO: 225385 - RNA, 19 nt, Homo sapiens
guaugucaccuguagauuu

SEQ ID NO: 225386 - RNA, 19 nt, Homo sapiens
ggucugaacgaaacaauau

SEQ ID NO: 225387 - RNA, 19 nt, Homo sapiens
gaauacuccucucucagau

SEQ ID NO: 225388 - RNA, 19 nt, Homo sapiens
guuaagaaacucgccaaua

SEQ ID NO: 225389 - RNA, 19 nt, Homo sapiens
gcaaagggaagggcaagaa

SEQ ID NO: 225390 - RNA, 19 nt, Homo sapiens
gcccaucacuccacuacug

SEQ ID NO: 225391 - RNA, 19 nt, Homo sapiens
gaggagcuguaccagaaga

SEQ ID NO: 225392 - RNA, 19 nt, Homo sapiens
ucaagugguucaagaaugg

SEQ ID NO: 225393 - RNA, 19 nt, Homo sapiens
ugaaaccaguucugaauac

SEQ ID NO: 225394 - RNA, 19 nt, Homo sapiens
gaaguggacagcaacacaa

SEQ ID NO: 225395 - RNA, 19 nt, Homo sapiens
cacauagauucaccuguaa

SEQ ID NO: 225396 - RNA, 19 nt, Homo sapiens
gauuggaaguggacagcaa

SEQ ID NO: 225397 - RNA, 19 nt, Homo sapiens
uaugucaccuguagauuuc

SEQ ID NO: 225398 - RNA, 19 nt, Homo sapiens
ucaagaaugggaaugaauu

SEQ ID NO: 225399 - RNA, 19 nt, Homo sapiens
gaucagcaaauuaggaaau

SEQ ID NO: 225400 - RNA, 19 nt, Homo sapiens
gugaaaccaguucugaaua

SEQ ID NO: 225401 - RNA, 19 nt, Homo sapiens
ugaauacuccucucucaga

SEQ ID NO: 225402 - RNA, 19 nt, Homo sapiens
caggcugucuaguguaauu

SEQ ID NO: 225403 - RNA, 19 nt, Homo sapiens
cgaaagccacucuguaauc

SEQ ID NO: 225404 - RNA, 19 nt, Homo sapiens
caaauuaggaaaugacagu

SEQ ID NO: 225405 - RNA, 19 nt, Homo sapiens
uggauucacuggagcaaga

SEQ ID NO: 225406 - RNA, 19 nt, Homo sapiens
caacugaaggagcauaugu

SEQ ID NO: 225407 - RNA, 19 nt, Homo sapiens
caagaaugggaaugaauug

SEQ ID NO: 225408 - RNA, 19 nt, Homo sapiens
gagugaaacagaagaugaa

SEQ ID NO: 225409 - RNA, 19 nt, Homo sapiens
gaagaaguuugaccaucac

SEQ ID NO: 225410 - RNA, 19 nt, Homo sapiens
caccaaggcugcgggagaa

SEQ ID NO: 225411 - RNA, 19 nt, Homo sapiens
gcauauuguugagagagaa

SEQ ID NO: 225412 - RNA, 19 nt, Homo sapiens
ugaaggagcauaugugucu

SEQ ID NO: 225413 - RNA, 19 nt, Homo sapiens
ggaagggcaagaagaagga

SEQ ID NO: 225414 - RNA, 19 nt, Homo sapiens
ugaaagaguaggugaagau

SEQ ID NO: 225415 - RNA, 19 nt, Homo sapiens
ccucaggcaugccagagaa

SEQ ID NO: 225416 - RNA, 19 nt, Homo sapiens
ggcugcagguuccaaacua

SEQ ID NO: 225417 - RNA, 19 nt, Homo sapiens
gagcaacggacacacugaa

SEQ ID NO: 225418 - RNA, 19 nt, Homo sapiens
gaaaccaguucugaauacu

SEQ ID NO: 225419 - RNA, 19 nt, Homo sapiens
gcaagugccaaccuggauu

SEQ ID NO: 225420 - RNA, 19 nt, Homo sapiens
aaagugaucagcaaauuag

SEQ ID NO: 225421 - RNA, 19 nt, Homo sapiens
gcaaauagaaaacaggaaa

SEQ ID NO: 225422 - RNA, 19 nt, Homo sapiens
aaacagaagaugaaagagu

SEQ ID NO: 225423 - RNA, 19 nt, Homo sapiens
ggaaguggacagcaacaca

SEQ ID NO: 225424 - RNA, 19 nt, Homo sapiens
gagaaugugcccaugaaag

SEQ ID NO: 225425 - RNA, 19 nt, Homo sapiens
gaaucaaacgagaucauca

SEQ ID NO: 225426 - RNA, 19 nt, Homo sapiens
caauaucaccaucguggaa

SEQ ID NO: 225427 - RNA, 19 nt, Homo sapiens
ugucuaguguaauugcuaa

SEQ ID NO: 225428 - RNA, 19 nt, Homo sapiens
gugaaucaauacguaucua

SEQ ID NO: 225429 - RNA, 19 nt, Homo sapiens
ugaggauaguggaggauga

SEQ ID NO: 225430 - RNA, 19 nt, Homo sapiens
cugagaaugugcccaugaa

SEQ ID NO: 225431 - RNA, 19 nt, Homo sapiens
gagcaagauguacugagaa

SEQ ID NO: 225432 - RNA, 19 nt, Homo sapiens
cagagucucccauuagaau

SEQ ID NO: 225433 - RNA, 19 nt, Homo sapiens
ucaccaucguggaaucaaa

SEQ ID NO: 225434 - RNA, 19 nt, Homo sapiens
ggacaaacuuuucccaaac

SEQ ID NO: 225435 - RNA, 19 nt, Homo sapiens
auacuccucucucagauuc

SEQ ID NO: 225436 - RNA, 19 nt, Homo sapiens
uccgaaagccacucuguaa

SEQ ID NO: 225437 - RNA, 19 nt, Homo sapiens
gaaggagcauaugugucuu

SEQ ID NO: 225438 - RNA, 19 nt, Homo sapiens
aguaacagccucccugcua

SEQ ID NO: 225439 - RNA, 19 nt, Homo sapiens
ccacccguguccagcauga

SEQ ID NO: 225440 - RNA, 19 nt, Homo sapiens
gagaaaccccugauuccua

SEQ ID NO: 225441 - RNA, 19 nt, Homo sapiens
caaauacuucuucaucuac

SEQ ID NO: 225442 - RNA, 19 nt, Homo sapiens
gaugaggaguaugaaacga

SEQ ID NO: 225443 - RNA, 19 nt, Homo sapiens
gaggaugaggaguaugaaa

SEQ ID NO: 225444 - RNA, 19 nt, Homo sapiens
gagaagcagagacauccuu

SEQ ID NO: 225445 - RNA, 19 nt, Homo sapiens
ggaaucaaacgagaucauc

SEQ ID NO: 225446 - RNA, 19 nt, Homo sapiens
agaaugggaaugaauugaa

SEQ ID NO: 225447 - RNA, 19 nt, Homo sapiens
agagagugcugaccauaac

SEQ ID NO: 225448 - RNA, 19 nt, Homo sapiens
ccacagaaggagcaaauac

SEQ ID NO: 225449 - RNA, 19 nt, Homo sapiens
gauaguaccucccaauuca

SEQ ID NO: 225450 - RNA, 19 nt, Homo sapiens
guaaguagauuguagauac

SEQ ID NO: 225451 - RNA, 19 nt, Homo sapiens
gaacuggaaggcuauauaa

SEQ ID NO: 225452 - RNA, 19 nt, Homo sapiens
aaacugaccugacuaaagu

SEQ ID NO: 225453 - RNA, 19 nt, Homo sapiens
ucagagauaugguugauga

SEQ ID NO: 225454 - RNA, 19 nt, Homo sapiens
ggagaacccucaaagcaau

SEQ ID NO: 225455 - RNA, 19 nt, Homo sapiens
gaagucacagguuaauuaa

SEQ ID NO: 225456 - RNA, 19 nt, Homo sapiens
agaagucacagguuaauua

SEQ ID NO: 225457 - RNA, 19 nt, Homo sapiens
gagauaugguugaugagaa

SEQ ID NO: 225458 - RNA, 19 nt, Homo sapiens
ucagagauguguguucuuu

SEQ ID NO: 225459 - RNA, 19 nt, Homo sapiens
gcauuggcauguucagaaa

SEQ ID NO: 225460 - RNA, 19 nt, Homo sapiens
uaaaguuaaucgcagauga

SEQ ID NO: 225461 - RNA, 19 nt, Homo sapiens
ggaagcgucuggccaagau

SEQ ID NO: 225462 - RNA, 19 nt, Homo sapiens
ccaucgagcuggagaagaa

SEQ ID NO: 225463 - RNA, 19 nt, Homo sapiens
ucagagcucuugucucaga

SEQ ID NO: 225464 - RNA, 19 nt, Homo sapiens
gaaacugaccugacuaaag

SEQ ID NO: 225465 - RNA, 19 nt, Homo sapiens
uuucagagcucuugucuca

SEQ ID NO: 225466 - RNA, 19 nt, Homo sapiens
guacugcucuuagguuguu

SEQ ID NO: 225467 - RNA, 19 nt, Homo sapiens
guuaaucgcagaugaacua

SEQ ID NO: 225468 - RNA, 19 nt, Homo sapiens
gagaaacugaccugacuaa

SEQ ID NO: 225469 - RNA, 19 nt, Homo sapiens
aggaagaccuugaaucaga

SEQ ID NO: 225470 - RNA, 19 nt, Homo sapiens
gcacugcucaauuaacaaa

SEQ ID NO: 225471 - RNA, 19 nt, Homo sapiens
ggaaggcuauauaagaaag

SEQ ID NO: 225472 - RNA, 19 nt, Homo sapiens
uuggugcacugcucaauua

SEQ ID NO: 225473 - RNA, 19 nt, Homo sapiens
gaacuagaagucacagguu

SEQ ID NO: 225474 - RNA, 19 nt, Homo sapiens
aaucgcagaugaacuagaa

SEQ ID NO: 225475 - RNA, 19 nt, Homo sapiens
ggacauugagggcgauaaa

SEQ ID NO: 225476 - RNA, 19 nt, Homo sapiens
uuggauagcucucaauguu

SEQ ID NO: 225477 - RNA, 19 nt, Homo sapiens
ccaggaagaccuugaauca

SEQ ID NO: 225478 - RNA, 19 nt, Homo sapiens
ucaauucucugguauucug

SEQ ID NO: 225479 - RNA, 19 nt, Homo sapiens
cuggaaggcuauauaagaa

SEQ ID NO: 225480 - RNA, 19 nt, Homo sapiens
gugcacugcucaauuaaca

SEQ ID NO: 225481 - RNA, 19 nt, Homo sapiens
cagagaaacugaccugacu

SEQ ID NO: 225482 - RNA, 19 nt, Homo sapiens
auccagagcugccuacauu

SEQ ID NO: 225483 - RNA, 19 nt, Homo sapiens
aacuagaagucacagguua

SEQ ID NO: 225484 - RNA, 19 nt, Homo sapiens
ggauaguaccucccaauuc

SEQ ID NO: 225485 - RNA, 19 nt, Homo sapiens
aaaccuacauggagaccuu

SEQ ID NO: 225486 - RNA, 19 nt, Homo sapiens
gcuaaauggaggagacuaa

SEQ ID NO: 225487 - RNA, 19 nt, Homo sapiens
gaaauucgagacgcagaaa

SEQ ID NO: 225488 - RNA, 19 nt, Homo sapiens
gaacgacuuuucuguaauc

SEQ ID NO: 225489 - RNA, 19 nt, Homo sapiens
ggaauaauguuuugcuaca

SEQ ID NO: 225490 - RNA, 19 nt, Homo sapiens
ugaccugacuaaaguuaau

SEQ ID NO: 225491 - RNA, 19 nt, Homo sapiens
ucacuuaguaccuguuuga

SEQ ID NO: 225492 - RNA, 19 nt, Homo sapiens
cuguuuaucucccacuuaa

SEQ ID NO: 225493 - RNA, 19 nt, Homo sapiens
cuacauggagaccuuaauu

SEQ ID NO: 225494 - RNA, 19 nt, Homo sapiens
gaugaugaccacuggcauu

SEQ ID NO: 225495 - RNA, 19 nt, Homo sapiens
ucagagauuucagaggauu

SEQ ID NO: 225496 - RNA, 19 nt, Homo sapiens
aaucaauucucugguauuc

SEQ ID NO: 225497 - RNA, 19 nt, Homo sapiens
gaagaacuggaaggcuaua

SEQ ID NO: 225498 - RNA, 19 nt, Homo sapiens
gagaacccucaaagcaaua

SEQ ID NO: 225499 - RNA, 19 nt, Homo sapiens
gcagaugaacuagaaguca

SEQ ID NO: 225500 - RNA, 19 nt, Homo sapiens
gugaucagaggcaagauuu

SEQ ID NO: 225501 - RNA, 19 nt, Homo sapiens
agauaugguugaugagaau

SEQ ID NO: 225502 - RNA, 19 nt, Homo sapiens
ccacuggcauuggcauguu

SEQ ID NO: 225503 - RNA, 19 nt, Homo sapiens
agaggauucugaucaggaa

SEQ ID NO: 225504 - RNA, 19 nt, Homo sapiens
uuaauaggaccuucuugaa

SEQ ID NO: 225505 - RNA, 19 nt, Homo sapiens
gcucuuagguuguuuugau

SEQ ID NO: 225506 - RNA, 19 nt, Homo sapiens
caggagaacccucaaagca

SEQ ID NO: 225507 - RNA, 19 nt, Homo sapiens
guuuaucucccacuuaaug

SEQ ID NO: 225508 - RNA, 19 nt, Homo sapiens
agaacuggaaggcuauaua

SEQ ID NO: 225509 - RNA, 19 nt, Homo sapiens
ggcauuggcauguucagaa

SEQ ID NO: 225510 - RNA, 19 nt, Homo sapiens
gaaucgacgcgcuaaaugg

SEQ ID NO: 225511 - RNA, 19 nt, Homo sapiens
gaucaggaaguggacauug

SEQ ID NO: 225512 - RNA, 19 nt, Homo sapiens
gaacagaauaaaggugcuu

SEQ ID NO: 225513 - RNA, 19 nt, Homo sapiens
aaaguuaaucgcagaugaa

SEQ ID NO: 225514 - RNA, 19 nt, Homo sapiens
aauucgagacgcagaaaua

SEQ ID NO: 225515 - RNA, 19 nt, Homo sapiens
ccagugaacagaauaaagg

SEQ ID NO: 225516 - RNA, 19 nt, Homo sapiens
ccagagcugccuacauuuc

SEQ ID NO: 225517 - RNA, 19 nt, Homo sapiens
ggaccuucuugaacgacuu

SEQ ID NO: 225518 - RNA, 19 nt, Homo sapiens
uggaaaguuuggacaguuc

SEQ ID NO: 225519 - RNA, 19 nt, Homo sapiens
ucuguaaucuguuuaucuc

SEQ ID NO: 225520 - RNA, 19 nt, Homo sapiens
cagaaucgacgcgcuaaau

SEQ ID NO: 225521 - RNA, 19 nt, Homo sapiens
uuauacugcugucucaaau

SEQ ID NO: 225522 - RNA, 19 nt, Homo sapiens
aaacaggagaacccucaaa

SEQ ID NO: 225523 - RNA, 19 nt, Homo sapiens
ugaugagaaucuuaaaugc

SEQ ID NO: 225524 - RNA, 19 nt, Homo sapiens
acuggaaggcuauauaaga

SEQ ID NO: 225525 - RNA, 19 nt, Homo sapiens
ugucagagauaugguugau

SEQ ID NO: 225526 - RNA, 19 nt, Homo sapiens
aaacauuucagagcucuug

SEQ ID NO: 225527 - RNA, 19 nt, Homo sapiens
uuuaauaggaccuucuuga

SEQ ID NO: 225528 - RNA, 19 nt, Homo sapiens
uacauggagaccuuaauuu

SEQ ID NO: 225529 - RNA, 19 nt, Homo sapiens
ucagaaaacuggauuuagg

SEQ ID NO: 225530 - RNA, 19 nt, Homo sapiens
cgacuuuucuguaaucugu

SEQ ID NO: 225531 - RNA, 19 nt, Homo sapiens
uaauaggaccuucuugaac

SEQ ID NO: 225532 - RNA, 19 nt, Homo sapiens
gucacagguuaauuaaaug

SEQ ID NO: 225533 - RNA, 19 nt, Homo sapiens
cuaaauggaggagacuaaa

SEQ ID NO: 225534 - RNA, 19 nt, Homo sapiens
caauuaacaaaccuacaug

SEQ ID NO: 225535 - RNA, 19 nt, Homo sapiens
gaagaccuugaaucagaga

SEQ ID NO: 225536 - RNA, 19 nt, Homo sapiens
gaugagaaucuuaaaugcu

SEQ ID NO: 225537 - RNA, 19 nt, Homo sapiens
cuggaaaguuuggacaguu

SEQ ID NO: 225538 - RNA, 19 nt, Homo sapiens
ggauucugaucaggaagug

SEQ ID NO: 225539 - RNA, 19 nt, Homo sapiens
cugguauucuggaaaccua

SEQ ID NO: 225540 - RNA, 19 nt, Homo sapiens
cgcggacggugaacgacua

SEQ ID NO: 225541 - RNA, 19 nt, Homo sapiens
aucaggaaguggacauuga

SEQ ID NO: 225542 - RNA, 19 nt, Homo sapiens
cagagcugccuacauuuca

SEQ ID NO: 225543 - RNA, 19 nt, Homo sapiens
agaaucgacgcgcuaaaug

SEQ ID NO: 225544 - RNA, 19 nt, Homo sapiens
guagauuguagauacuguu

SEQ ID NO: 225545 - RNA, 19 nt, Homo sapiens
uugaacgacuuuucuguaa

SEQ ID NO: 225546 - RNA, 19 nt, Homo sapiens
gguauucuggaaaccuaaa

SEQ ID NO: 225547 - RNA, 19 nt, Homo sapiens
gagaaucuuaaaugcuugu

SEQ ID NO: 225548 - RNA, 19 nt, Homo sapiens
cuuauacugcugucucaaa

SEQ ID NO: 225549 - RNA, 19 nt, Homo sapiens
gugcuggacuucaucuaca

SEQ ID NO: 225550 - RNA, 19 nt, Homo sapiens
agacgaugcuggacacgau

SEQ ID NO: 225551 - RNA, 19 nt, Homo sapiens
ggccuagucuccucuaucg

SEQ ID NO: 225552 - RNA, 19 nt, Homo sapiens
cagcagcgccuaccucaag

SEQ ID NO: 225553 - RNA, 19 nt, Homo sapiens
gaccaucgaccguuucucu

SEQ ID NO: 225554 - RNA, 19 nt, Homo sapiens
gcgacaagagcuacaagga

SEQ ID NO: 225555 - RNA, 19 nt, Homo sapiens
cagcaacgcaaccucauca

SEQ ID NO: 225556 - RNA, 19 nt, Homo sapiens
ucuacccgcuggccaaguu

SEQ ID NO: 225557 - RNA, 19 nt, Homo sapiens
gcaagggcaagcucgacuu

SEQ ID NO: 225558 - RNA, 19 nt, Homo sapiens
ccgagcagcugagccugaa

SEQ ID NO: 225559 - RNA, 19 nt, Homo sapiens
cgacggcgacgacuacaag

SEQ ID NO: 225560 - RNA, 19 nt, Homo sapiens
caagggcaagcucgacuuc

SEQ ID NO: 225561 - RNA, 19 nt, Homo sapiens
caaccuguacgugugcauu

SEQ ID NO: 225562 - RNA, 19 nt, Homo sapiens
ucguggcgcugugcaagaa

SEQ ID NO: 225563 - RNA, 19 nt, Homo sapiens
gaaggaaccugaugcuuua

SEQ ID NO: 225564 - RNA, 19 nt, Homo sapiens
ggacacagauuuagacuug

SEQ ID NO: 225565 - RNA, 19 nt, Homo sapiens
gaagguauguggcauuuau

SEQ ID NO: 225566 - RNA, 19 nt, Homo sapiens
gaaaugagagaaaugcuua

SEQ ID NO: 225567 - RNA, 19 nt, Homo sapiens
gcaguaaccuuucaucaug

SEQ ID NO: 225568 - RNA, 19 nt, Homo sapiens
gaacaaauacaugggauua

SEQ ID NO: 225569 - RNA, 19 nt, Homo sapiens
gcauauaucuagaagguau

SEQ ID NO: 225570 - RNA, 19 nt, Homo sapiens
gauguuagcucccuauauc

SEQ ID NO: 225571 - RNA, 19 nt, Homo sapiens
ucaagcaacugucauauau

SEQ ID NO: 225572 - RNA, 19 nt, Homo sapiens
gauaaggccucugugauga

SEQ ID NO: 225573 - RNA, 19 nt, Homo sapiens
gagacacaaucauaucuuu

SEQ ID NO: 225574 - RNA, 19 nt, Homo sapiens
cuacaucacuuucuuggaa

SEQ ID NO: 225575 - RNA, 19 nt, Homo sapiens
gauacuagcuuugcagaau

SEQ ID NO: 225576 - RNA, 19 nt, Homo sapiens
ggauaugucuggguugaaa

SEQ ID NO: 225577 - RNA, 19 nt, Homo sapiens
gaacauaaagucugcaaca

SEQ ID NO: 225578 - RNA, 19 nt, Homo sapiens
gaggaaguaccauuauaua

SEQ ID NO: 225579 - RNA, 19 nt, Homo sapiens
agaaugaaguguacccuaa

SEQ ID NO: 225580 - RNA, 19 nt, Homo sapiens
gaaaaugacucagcuauuc

SEQ ID NO: 225581 - RNA, 19 nt, Homo sapiens
gaucacagacagcucauuu

SEQ ID NO: 225582 - RNA, 19 nt, Homo sapiens
gauggaagcacuagacaaa

SEQ ID NO: 225583 - RNA, 19 nt, Homo sapiens
gaucuaacacuaacuguau

SEQ ID NO: 225584 - RNA, 19 nt, Homo sapiens
ggacacugguggcucacua

SEQ ID NO: 225585 - RNA, 19 nt, Homo sapiens
caaguagccucuuugacaa

SEQ ID NO: 225586 - RNA, 19 nt, Homo sapiens
caaacagaauguguccuua

SEQ ID NO: 225587 - RNA, 19 nt, Homo sapiens
ugccaccacugaugaauua

SEQ ID NO: 225588 - RNA, 19 nt, Homo sapiens
cgacacagccuggauauga

SEQ ID NO: 225589 - RNA, 19 nt, Homo sapiens
auaaacaucuucuguggaa

SEQ ID NO: 225590 - RNA, 19 nt, Homo sapiens
caccaaaguugaaucagaa

SEQ ID NO: 225591 - RNA, 19 nt, Homo sapiens
uauaagaaaccaccuauga

SEQ ID NO: 225592 - RNA, 19 nt, Homo sapiens
gaacuaaauccaaagauac

SEQ ID NO: 225593 - RNA, 19 nt, Homo sapiens
ccacauacauaaagaaacu

SEQ ID NO: 225594 - RNA, 19 nt, Homo sapiens
caaucaagaaguugcauua

SEQ ID NO: 225595 - RNA, 19 nt, Homo sapiens
caaccacagugcauuguau

SEQ ID NO: 225596 - RNA, 19 nt, Homo sapiens
cuuaaaugcuguaugguuu

SEQ ID NO: 225597 - RNA, 19 nt, Homo sapiens
gcaaaucuagugaacagaa

SEQ ID NO: 225598 - RNA, 19 nt, Homo sapiens
guaaaaggaugcaaaucua

SEQ ID NO: 225599 - RNA, 19 nt, Homo sapiens
aguaggaauuggaacauua

SEQ ID NO: 225600 - RNA, 19 nt, Homo sapiens
ugaaagcacagaugaauug

SEQ ID NO: 225601 - RNA, 19 nt, Homo sapiens
gaugaugacuuccaguuac

SEQ ID NO: 225602 - RNA, 19 nt, Homo sapiens
ggaugaugacuuccaguua

SEQ ID NO: 225603 - RNA, 19 nt, Homo sapiens
ggacuugccuuuccuucuc

SEQ ID NO: 225604 - RNA, 19 nt, Homo sapiens
ugaaagccuuggaugguuu

SEQ ID NO: 225605 - RNA, 19 nt, Homo sapiens
gcucaucaguugccacuuc

SEQ ID NO: 225606 - RNA, 19 nt, Homo sapiens
gaagaacuaaauccaaaga

SEQ ID NO: 225607 - RNA, 19 nt, Homo sapiens
ucaaagcacaguuacagua

SEQ ID NO: 225608 - RNA, 19 nt, Homo sapiens
auagugauauggucaauga

SEQ ID NO: 225609 - RNA, 19 nt, Homo sapiens
gaaauuccuuuagauagca

SEQ ID NO: 225610 - RNA, 19 nt, Homo sapiens
ugagagaaaugcuuacaca

SEQ ID NO: 225611 - RNA, 19 nt, Homo sapiens
ugaaguuaaugcuccuaua

SEQ ID NO: 225612 - RNA, 19 nt, Homo sapiens
gaucaguugucaccauuag

SEQ ID NO: 225613 - RNA, 19 nt, Homo sapiens
ucaccaaaguugaaucaga

SEQ ID NO: 225614 - RNA, 19 nt, Homo sapiens
ugacucagcuauucaccaa

SEQ ID NO: 225615 - RNA, 19 nt, Homo sapiens
gcagaaugcucagagaaag

SEQ ID NO: 225616 - RNA, 19 nt, Homo sapiens
gaaaaggagucauagaaca

SEQ ID NO: 225617 - RNA, 19 nt, Homo sapiens
agaaggaaccugaugcuuu

SEQ ID NO: 225618 - RNA, 19 nt, Homo sapiens
aggaagaacuaaauccaaa

SEQ ID NO: 225619 - RNA, 19 nt, Homo sapiens
gugauauggucaaugaauu

SEQ ID NO: 225620 - RNA, 19 nt, Homo sapiens
gcacugcacaggccacauu

SEQ ID NO: 225621 - RNA, 19 nt, Homo sapiens
uacaagaaccuacugcuaa

SEQ ID NO: 225622 - RNA, 19 nt, Homo sapiens
ucaaugaauucaaguugga

SEQ ID NO: 225623 - RNA, 19 nt, Homo sapiens
gaucagacaccuaguccuu

SEQ ID NO: 225624 - RNA, 19 nt, Homo sapiens
ugaguucgcaucuugauaa

SEQ ID NO: 225625 - RNA, 19 nt, Homo sapiens
gcuaauauuguguaacuga

SEQ ID NO: 225626 - RNA, 19 nt, Homo sapiens
uagaagguauguggcauuu

SEQ ID NO: 225627 - RNA, 19 nt, Homo sapiens
gcauugcaguagcaucauu

SEQ ID NO: 225628 - RNA, 19 nt, Homo sapiens
ccagcagacucaaauacaa

SEQ ID NO: 225629 - RNA, 19 nt, Homo sapiens
gacacagccuggauaugaa

SEQ ID NO: 225630 - RNA, 19 nt, Homo sapiens
ccucacccaucaaauauug

SEQ ID NO: 225631 - RNA, 19 nt, Homo sapiens
ggaugaaaguggauuacca

SEQ ID NO: 225632 - RNA, 19 nt, Homo sapiens
gcuacuacaucacuuucuu

SEQ ID NO: 225633 - RNA, 19 nt, Homo sapiens
cguguuaucugucgcuuug

SEQ ID NO: 225634 - RNA, 19 nt, Homo sapiens
uuaaaccgguugaaucuuc

SEQ ID NO: 225635 - RNA, 19 nt, Homo sapiens
gcaacugucauauauaaca

SEQ ID NO: 225636 - RNA, 19 nt, Homo sapiens
gaugaaagaauuaccgaau

SEQ ID NO: 225637 - RNA, 19 nt, Homo sapiens
uagcaagacuuuccucagu

SEQ ID NO: 225638 - RNA, 19 nt, Homo sapiens
gcuuggugcugauuuguga

SEQ ID NO: 225639 - RNA, 19 nt, Homo sapiens
gugguuggaucuaacacua

SEQ ID NO: 225640 - RNA, 19 nt, Homo sapiens
ggaauuggaacauuauuac

SEQ ID NO: 225641 - RNA, 19 nt, Homo sapiens
cagagucacuggaacuuuc

SEQ ID NO: 225642 - RNA, 19 nt, Homo sapiens
gcaacgacacagaaacuga

SEQ ID NO: 225643 - RNA, 19 nt, Homo sapiens
caaaagagguggauauguc

SEQ ID NO: 225644 - RNA, 19 nt, Homo sapiens
gaugggauaugagccagaa

SEQ ID NO: 225645 - RNA, 19 nt, Homo sapiens
caaccucaguguggguaua

SEQ ID NO: 225646 - RNA, 19 nt, Homo sapiens
ggaaaugagagaaaugcuu

SEQ ID NO: 225647 - RNA, 19 nt, Homo sapiens
acugcagggugaagaauua

SEQ ID NO: 225648 - RNA, 19 nt, Homo sapiens
caagaagcccuaacguguu

SEQ ID NO: 225649 - RNA, 19 nt, Homo sapiens
acaagaaccuacugcuaau

SEQ ID NO: 225650 - RNA, 19 nt, Homo sapiens
acaaguagccucuuugaca

SEQ ID NO: 225651 - RNA, 19 nt, Homo sapiens
aaacagaauguguccuuaa

SEQ ID NO: 225652 - RNA, 19 nt, Homo sapiens
gaaaugcuuacacacagaa

SEQ ID NO: 225653 - RNA, 19 nt, Homo sapiens
aacaauacccuauguaguu

SEQ ID NO: 225654 - RNA, 19 nt, Homo sapiens
gcaguagcaucauuuuaaa

SEQ ID NO: 225655 - RNA, 19 nt, Homo sapiens
gaaagcgcaaguccucaaa

SEQ ID NO: 225656 - RNA, 19 nt, Homo sapiens
ccaguuacguuccuucgau

SEQ ID NO: 225657 - RNA, 19 nt, Homo sapiens
aacagaauguguccuuaaa

SEQ ID NO: 225658 - RNA, 19 nt, Homo sapiens
gccgcucaauuuaugaaua

SEQ ID NO: 225659 - RNA, 19 nt, Homo sapiens
gagcagacuguaaacaaga

SEQ ID NO: 225660 - RNA, 19 nt, Homo sapiens
gaagaauuacucagagcuu

SEQ ID NO: 225661 - RNA, 19 nt, Homo sapiens
gaaguuaaugcuccuauac

SEQ ID NO: 225662 - RNA, 19 nt, Homo sapiens
caaaucuagugaacagaau

SEQ ID NO: 225663 - RNA, 19 nt, Homo sapiens
ggaaguagcugucagaugu

SEQ ID NO: 225664 - RNA, 19 nt, Homo sapiens
gggaagaucuuaugccuuu

SEQ ID NO: 225665 - RNA, 19 nt, Homo sapiens
ggaaguggcuguaaaggaa

SEQ ID NO: 225666 - RNA, 19 nt, Homo sapiens
gcagugaucccuucaauuu

SEQ ID NO: 225667 - RNA, 19 nt, Homo sapiens
ggaaugaacuguccgugaa

SEQ ID NO: 225668 - RNA, 19 nt, Homo sapiens
ccaaggugcuggacuguua

SEQ ID NO: 225669 - RNA, 19 nt, Homo sapiens
acucauauguucccaauua

SEQ ID NO: 225670 - RNA, 19 nt, Homo sapiens
aaacgggaaucacaucuua

SEQ ID NO: 225671 - RNA, 19 nt, Homo sapiens
gaauggagcuggugagauc

SEQ ID NO: 225672 - RNA, 19 nt, Homo sapiens
ggacgaggcuggagaaagu

SEQ ID NO: 225673 - RNA, 19 nt, Homo sapiens
gaagagcuauuuaaugaca

SEQ ID NO: 225674 - RNA, 19 nt, Homo sapiens
gaaugcugcuuucugcuua

SEQ ID NO: 225675 - RNA, 19 nt, Homo sapiens
gagcugagaucacgccauu

SEQ ID NO: 225676 - RNA, 19 nt, Homo sapiens
gaacucaaccucuuccaaa

SEQ ID NO: 225677 - RNA, 19 nt, Homo sapiens
gaagaugaagagcuauuua

SEQ ID NO: 225678 - RNA, 19 nt, Homo sapiens
ggaaguaucagcacuagaa

SEQ ID NO: 225679 - RNA, 19 nt, Homo sapiens
gaaccaagauggaguacca

SEQ ID NO: 225680 - RNA, 19 nt, Homo sapiens
agaaagcacuuaaacagaa

SEQ ID NO: 225681 - RNA, 19 nt, Homo sapiens
gagcuaaggugggagaauu

SEQ ID NO: 225682 - RNA, 19 nt, Homo sapiens
ugaaugauccugucucuaa

SEQ ID NO: 225683 - RNA, 19 nt, Homo sapiens
gcaugacacuucccaaaga

SEQ ID NO: 225684 - RNA, 19 nt, Homo sapiens
guaaaugggucaugacaag

SEQ ID NO: 225685 - RNA, 19 nt, Homo sapiens
gggaagaacccuauacuug

SEQ ID NO: 225686 - RNA, 19 nt, Homo sapiens
ggacuucuccauuccauaa

SEQ ID NO: 225687 - RNA, 19 nt, Homo sapiens
gaagaucguuccacuuucu

SEQ ID NO: 225688 - RNA, 19 nt, Homo sapiens
ggcaaacagucuaguguaa

SEQ ID NO: 225689 - RNA, 19 nt, Homo sapiens
uaagugaccuucugaucuu

SEQ ID NO: 225690 - RNA, 19 nt, Homo sapiens
gcagccaccuuuaugacua

SEQ ID NO: 225691 - RNA, 19 nt, Homo sapiens
caaacagucuaguguaaug

SEQ ID NO: 225692 - RNA, 19 nt, Homo sapiens
gagaaggaccacuuaauug

SEQ ID NO: 225693 - RNA, 19 nt, Homo sapiens
ccugagaccucuagagaaa

SEQ ID NO: 225694 - RNA, 19 nt, Homo sapiens
ugacacaccuuggauuaaa

SEQ ID NO: 225695 - RNA, 19 nt, Homo sapiens
gaaugauccugucucuaaa

SEQ ID NO: 225696 - RNA, 19 nt, Homo sapiens
gaagaacccuauacuuggu

SEQ ID NO: 225697 - RNA, 19 nt, Homo sapiens
gcaaaucacagaucgaaga

SEQ ID NO: 225698 - RNA, 19 nt, Homo sapiens
ggaaagcucaagccaauga

SEQ ID NO: 225699 - RNA, 19 nt, Homo sapiens
ggucaggaguucaagacua

SEQ ID NO: 225700 - RNA, 19 nt, Homo sapiens
gcaacaaaaucauggcuua

SEQ ID NO: 225701 - RNA, 19 nt, Homo sapiens
gagcguaaaugggucauga

SEQ ID NO: 225702 - RNA, 19 nt, Homo sapiens
aaaugaagaugaagagcua

SEQ ID NO: 225703 - RNA, 19 nt, Homo sapiens
gaauagagccaaaccaaca

SEQ ID NO: 225704 - RNA, 19 nt, Homo sapiens
cuaaggaccuccagagaga

SEQ ID NO: 225705 - RNA, 19 nt, Homo sapiens
gcaggacacucagcucaaa

SEQ ID NO: 225706 - RNA, 19 nt, Homo sapiens
ggaaacuucugcccaguca

SEQ ID NO: 225707 - RNA, 19 nt, Homo sapiens
cugcaagccuucuaaauga

SEQ ID NO: 225708 - RNA, 19 nt, Homo sapiens
gcaacagccuacaaagaga

SEQ ID NO: 225709 - RNA, 19 nt, Homo sapiens
gccaagaacucucgaugga

SEQ ID NO: 225710 - RNA, 19 nt, Homo sapiens
ugaagaaccuccucucauc

SEQ ID NO: 225711 - RNA, 19 nt, Homo sapiens
ggaaagggaagaucuuaug

SEQ ID NO: 225712 - RNA, 19 nt, Homo sapiens
gguguguucucaugaaauu

SEQ ID NO: 225713 - RNA, 19 nt, Homo sapiens
ggauuuccacugcuucuua

SEQ ID NO: 225714 - RNA, 19 nt, Homo sapiens
gaaauugggcagucuuaau

SEQ ID NO: 225715 - RNA, 19 nt, Homo sapiens
gaucaaacgccaagagaug

SEQ ID NO: 225716 - RNA, 19 nt, Homo sapiens
gcaugacgcugacacagau

SEQ ID NO: 225717 - RNA, 19 nt, Homo sapiens
cuaauucagugucacauga

SEQ ID NO: 225718 - RNA, 19 nt, Homo sapiens
uagaggagcugcuuguugu

SEQ ID NO: 225719 - RNA, 19 nt, Homo sapiens
guaagacagugcccugaga

SEQ ID NO: 225720 - RNA, 19 nt, Homo sapiens
ggaaucacaucuuaaagcu

SEQ ID NO: 225721 - RNA, 19 nt, Homo sapiens
gaaaugaauugagugacau

SEQ ID NO: 225722 - RNA, 19 nt, Homo sapiens
ugacaaacccggaagauca

SEQ ID NO: 225723 - RNA, 19 nt, Homo sapiens
gaagagggaagccuugaga

SEQ ID NO: 225724 - RNA, 19 nt, Homo sapiens
gaugaagagcuauuuaaug

SEQ ID NO: 225725 - RNA, 19 nt, Homo sapiens
gugcaugccuguagucuca

SEQ ID NO: 225726 - RNA, 19 nt, Homo sapiens
ugagaaggaccacuuaauu

SEQ ID NO: 225727 - RNA, 19 nt, Homo sapiens
gaaagcacuuaaacagaag

SEQ ID NO: 225728 - RNA, 19 nt, Homo sapiens
uaacucauauguucccaau

SEQ ID NO: 225729 - RNA, 19 nt, Homo sapiens
aaggaaagcucaagccaau

SEQ ID NO: 225730 - RNA, 19 nt, Homo sapiens
cagcagaauuuauuugaca

SEQ ID NO: 225731 - RNA, 19 nt, Homo sapiens
gaaccugcaagccuucuaa

SEQ ID NO: 225732 - RNA, 19 nt, Homo sapiens
agugacagcuuuccucaaa

SEQ ID NO: 225733 - RNA, 19 nt, Homo sapiens
ccugagaucugcacaguca

SEQ ID NO: 225734 - RNA, 19 nt, Homo sapiens
caauggguauccuuaauag

SEQ ID NO: 225735 - RNA, 19 nt, Homo sapiens
caacaauggguauccuuaa

SEQ ID NO: 225736 - RNA, 19 nt, Homo sapiens
cccaaagacucccuccaua

SEQ ID NO: 225737 - RNA, 19 nt, Homo sapiens
gacaagcccagguagauuu

SEQ ID NO: 225738 - RNA, 19 nt, Homo sapiens
gagccugucugagauagaa

SEQ ID NO: 225739 - RNA, 19 nt, Homo sapiens
ccagcaaccugcaguacuu

SEQ ID NO: 225740 - RNA, 19 nt, Homo sapiens
ggagaagacaacagaaaga

SEQ ID NO: 225741 - RNA, 19 nt, Homo sapiens
aggcggagcugcugaguga

SEQ ID NO: 225742 - RNA, 19 nt, Homo sapiens
gagcaagccuagguacgaa

SEQ ID NO: 225743 - RNA, 19 nt, Homo sapiens
ucaauaaggccauuaauac

SEQ ID NO: 225744 - RNA, 19 nt, Homo sapiens
caguggagauguuugacua

SEQ ID NO: 225745 - RNA, 19 nt, Homo sapiens
caucagccuucaagaauca

SEQ ID NO: 225746 - RNA, 19 nt, Homo sapiens
caacagagaggaccaacau

SEQ ID NO: 225747 - RNA, 19 nt, Homo sapiens
gaaguucugccauguguuc

SEQ ID NO: 225748 - RNA, 19 nt, Homo sapiens
gcauuuaagugaccuucug

SEQ ID NO: 225749 - RNA, 19 nt, Homo sapiens
agaaaugaauugagugaca

SEQ ID NO: 225750 - RNA, 19 nt, Homo sapiens
gcacagccaugaggaacug

SEQ ID NO: 225751 - RNA, 19 nt, Homo sapiens
gagcgacuauacagagaga

SEQ ID NO: 225752 - RNA, 19 nt, Homo sapiens
aaacagaagcagaggcuaa

SEQ ID NO: 225753 - RNA, 19 nt, Homo sapiens
gaccucaucucuacuaaaa

SEQ ID NO: 225754 - RNA, 19 nt, Homo sapiens
gcaaaacuccgucucaaaa

SEQ ID NO: 225755 - RNA, 19 nt, Homo sapiens
gcgacacccuuucuguuug

SEQ ID NO: 225756 - RNA, 19 nt, Homo sapiens
ggaacugccugagcaagau

SEQ ID NO: 225757 - RNA, 19 nt, Homo sapiens
acagagagaucaguggauu

SEQ ID NO: 225758 - RNA, 19 nt, Homo sapiens
ggacugcagccaccuuuau

SEQ ID NO: 225759 - RNA, 19 nt, Homo sapiens
caagaccucaucucuacua

SEQ ID NO: 225760 - RNA, 19 nt, Homo sapiens
ggaguguccuggcugugaa

SEQ ID NO: 225761 - RNA, 19 nt, Homo sapiens
gaagaaccuccucucauca

SEQ ID NO: 225762 - RNA, 19 nt, Homo sapiens
ccacuuaauugagcgacua

SEQ ID NO: 225763 - RNA, 19 nt, Homo sapiens
gaagaaacaugcuacuuua

SEQ ID NO: 225764 - RNA, 19 nt, Homo sapiens
gcaggcaguucuauauaua

SEQ ID NO: 225765 - RNA, 19 nt, Homo sapiens
gcaaaucaguacaaacaaa

SEQ ID NO: 225766 - RNA, 19 nt, Homo sapiens
ccagaaacauacccauuua

SEQ ID NO: 225767 - RNA, 19 nt, Homo sapiens
auagagagcugcugauaua

SEQ ID NO: 225768 - RNA, 19 nt, Homo sapiens
ggaagaaacaugcuacuuu

SEQ ID NO: 225769 - RNA, 19 nt, Homo sapiens
acacacagcuaauauucua

SEQ ID NO: 225770 - RNA, 19 nt, Homo sapiens
gaaacaugcuacuuuagug

SEQ ID NO: 225771 - RNA, 19 nt, Homo sapiens
gagauugcuuuauuggaua

SEQ ID NO: 225772 - RNA, 19 nt, Homo sapiens
ugauaggaaugcaguaaua

SEQ ID NO: 225773 - RNA, 19 nt, Homo sapiens
ggaauagaaguguguuaua

SEQ ID NO: 225774 - RNA, 19 nt, Homo sapiens
ggaggaagauaccaacuag

SEQ ID NO: 225775 - RNA, 19 nt, Homo sapiens
guacuugacuucuuaggau

SEQ ID NO: 225776 - RNA, 19 nt, Homo sapiens
gauaccaacuagagauaaa

SEQ ID NO: 225777 - RNA, 19 nt, Homo sapiens
guaaggcuguauauugaaa

SEQ ID NO: 225778 - RNA, 19 nt, Homo sapiens
gcuuguacuugacuucuua

SEQ ID NO: 225779 - RNA, 19 nt, Homo sapiens
aaaguaaggcuguauauug

SEQ ID NO: 225780 - RNA, 19 nt, Homo sapiens
gcacauaggaauagaagug

SEQ ID NO: 225781 - RNA, 19 nt, Homo sapiens
agaguuugcuucaggauuu

SEQ ID NO: 225782 - RNA, 19 nt, Homo sapiens
ggucguagguuuggaaugu

SEQ ID NO: 225783 - RNA, 19 nt, Homo sapiens
gaauuaaaguaaggcugua

SEQ ID NO: 225784 - RNA, 19 nt, Homo sapiens
aaguaaggcuguauauuga

SEQ ID NO: 225785 - RNA, 19 nt, Homo sapiens
aaucauaacgucagcauaa

SEQ ID NO: 225786 - RNA, 19 nt, Homo sapiens
aaacagacagcucgacuuu

SEQ ID NO: 225787 - RNA, 19 nt, Homo sapiens
gaagauaccaacuagagau

SEQ ID NO: 225788 - RNA, 19 nt, Homo sapiens
cagcauaacuucauuugac

SEQ ID NO: 225789 - RNA, 19 nt, Homo sapiens
aaugaaagaacccaacuua

SEQ ID NO: 225790 - RNA, 19 nt, Homo sapiens
gaaacauacccauuuaauc

SEQ ID NO: 225791 - RNA, 19 nt, Homo sapiens
caagaucacacacuaaugu

SEQ ID NO: 225792 - RNA, 19 nt, Homo sapiens
gcauagagagcugcugaua

SEQ ID NO: 225793 - RNA, 19 nt, Homo sapiens
ucaaggaggugcugaagag

SEQ ID NO: 225794 - RNA, 19 nt, Homo sapiens
gaagguugaaguggauuua

SEQ ID NO: 225795 - RNA, 19 nt, Homo sapiens
ugaagauggugaccuauuc

SEQ ID NO: 225796 - RNA, 19 nt, Homo sapiens
ugaaagaacccaacuuagu

SEQ ID NO: 225797 - RNA, 19 nt, Homo sapiens
caucacagcuaccuuaacu

SEQ ID NO: 225798 - RNA, 19 nt, Homo sapiens
ugaaagcuguguugguguu

SEQ ID NO: 225799 - RNA, 19 nt, Homo sapiens
ucagugaauuugacaccua

SEQ ID NO: 225800 - RNA, 19 nt, Homo sapiens
gagagcugcugauauaguc

SEQ ID NO: 225801 - RNA, 19 nt, Homo sapiens
gcacgguauuauugucauu

SEQ ID NO: 225802 - RNA, 19 nt, Homo sapiens
gaauuaagaggagaaauag

SEQ ID NO: 225803 - RNA, 19 nt, Homo sapiens
agagauugcuuuauuggau

SEQ ID NO: 225804 - RNA, 19 nt, Homo sapiens
ggaaugucuugucccaguu

SEQ ID NO: 225805 - RNA, 19 nt, Homo sapiens
ugaauuuacuugcaugcuu

SEQ ID NO: 225806 - RNA, 19 nt, Homo sapiens
acagacagcucgacuuugg

SEQ ID NO: 225807 - RNA, 19 nt, Homo sapiens
cuaauuaaacgucugugua

SEQ ID NO: 225808 - RNA, 19 nt, Homo sapiens
cagcuaauauucuaauggu

SEQ ID NO: 225809 - RNA, 19 nt, Homo sapiens
gaaucaagcgggaguucaa

SEQ ID NO: 225810 - RNA, 19 nt, Homo sapiens
uagcaaaucaguacaaaca

SEQ ID NO: 225811 - RNA, 19 nt, Homo sapiens
guuuggauauccugaaaga

SEQ ID NO: 225812 - RNA, 19 nt, Homo sapiens
ccucugugccugugaauuu

SEQ ID NO: 225813 - RNA, 19 nt, Homo sapiens
gcggagacauggccaacau

SEQ ID NO: 225814 - RNA, 19 nt, Homo sapiens
uguagagacugcaacagaa

SEQ ID NO: 225815 - RNA, 19 nt, Homo sapiens
caaacaaaaucccgaaaug

SEQ ID NO: 225816 - RNA, 19 nt, Homo sapiens
aacuuuaccuucucuugua

SEQ ID NO: 225817 - RNA, 19 nt, Homo sapiens
ugucagggccauucaaauu

SEQ ID NO: 225818 - RNA, 19 nt, Homo sapiens
ccaagacuagcaagaguuu

SEQ ID NO: 225819 - RNA, 19 nt, Homo sapiens
ggaagauaccaacuagaga

SEQ ID NO: 225820 - RNA, 19 nt, Homo sapiens
aauugaagauggugaccua

SEQ ID NO: 225821 - RNA, 19 nt, Homo sapiens
ucccugcucuguaaauaaa

SEQ ID NO: 225822 - RNA, 19 nt, Homo sapiens
uuaggauucugcauagauu

SEQ ID NO: 225823 - RNA, 19 nt, Homo sapiens
uaccuucucuuguacauag

SEQ ID NO: 225824 - RNA, 19 nt, Homo sapiens
ucagaugcacauaggaaua

SEQ ID NO: 225825 - RNA, 19 nt, Homo sapiens
gaagauggugaccuauuca

SEQ ID NO: 225826 - RNA, 19 nt, Homo sapiens
ccuaagguccgguuuauca

SEQ ID NO: 225827 - RNA, 19 nt, Homo sapiens
gauccucugugccugugaa

SEQ ID NO: 225828 - RNA, 19 nt, Homo sapiens
uuacauuauucccagguuu

SEQ ID NO: 225829 - RNA, 19 nt, Homo sapiens
caugcuacuuuaguguuua

SEQ ID NO: 225830 - RNA, 19 nt, Homo sapiens
aaacauacccauuuaaucc

SEQ ID NO: 225831 - RNA, 19 nt, Homo sapiens
uagucaagcuugccucuuc

SEQ ID NO: 225832 - RNA, 19 nt, Homo sapiens
ggcuguauauugaaaguca

SEQ ID NO: 225833 - RNA, 19 nt, Homo sapiens
ucagggccauucaaauugu

SEQ ID NO: 225834 - RNA, 19 nt, Homo sapiens
gcaagaucacacacuaaug

SEQ ID NO: 225835 - RNA, 19 nt, Homo sapiens
guauguaucccuugcuuca

SEQ ID NO: 225836 - RNA, 19 nt, Homo sapiens
gcugaaggacaguauguau

SEQ ID NO: 225837 - RNA, 19 nt, Homo sapiens
cagaaacauacccauuuaa

SEQ ID NO: 225838 - RNA, 19 nt, Homo sapiens
ugacuucucaauaaucuug

SEQ ID NO: 225839 - RNA, 19 nt, Homo sapiens
gugaauuugacaccuauuu

SEQ ID NO: 225840 - RNA, 19 nt, Homo sapiens
guaaauuucucuguaucag

SEQ ID NO: 225841 - RNA, 19 nt, Homo sapiens
agacacaccauaugaagga

SEQ ID NO: 225842 - RNA, 19 nt, Homo sapiens
ucaaugggcagcugcaaug

SEQ ID NO: 225843 - RNA, 19 nt, Homo sapiens
gaaucauaacgucagcaua

SEQ ID NO: 225844 - RNA, 19 nt, Homo sapiens
uacauuauucccagguuua

SEQ ID NO: 225845 - RNA, 19 nt, Homo sapiens
ggaggaggcggguacgaau

SEQ ID NO: 225846 - RNA, 19 nt, Homo sapiens
gaggagcaccaacaucugu

SEQ ID NO: 225847 - RNA, 19 nt, Homo sapiens
uaacuucauuugacuucuc

SEQ ID NO: 225848 - RNA, 19 nt, Homo sapiens
ugcaggcaguucuauauau

SEQ ID NO: 225849 - RNA, 19 nt, Homo sapiens
ucaaauuguugguguugca

SEQ ID NO: 225850 - RNA, 19 nt, Homo sapiens
uaauauuaguuccgucaca

SEQ ID NO: 225851 - RNA, 19 nt, Homo sapiens
guuuagcaguguaccaaga

SEQ ID NO: 225852 - RNA, 19 nt, Homo sapiens
acaugcuacuuuaguguuu

SEQ ID NO: 225853 - RNA, 19 nt, Homo sapiens
aaucccugcucuguaaaua

SEQ ID NO: 225854 - RNA, 19 nt, Homo sapiens
gauguuaucuaggcaccau

SEQ ID NO: 225855 - RNA, 19 nt, Homo sapiens
uaugaagguugaaguggau

SEQ ID NO: 225856 - RNA, 19 nt, Homo sapiens
agucagcuguuugcaguuu

SEQ ID NO: 225857 - RNA, 19 nt, Homo sapiens
uggauauccugaaagauca

SEQ ID NO: 225858 - RNA, 19 nt, Homo sapiens
gguaaauuucucuguauca

SEQ ID NO: 225859 - RNA, 19 nt, Homo sapiens
uuugagaacuggcaaggau

SEQ ID NO: 225860 - RNA, 19 nt, Homo sapiens
agacugaauuaaaguaagg

SEQ ID NO: 225861 - RNA, 19 nt, Homo sapiens
ucacaggggcuauuuguuu

SEQ ID NO: 225862 - RNA, 19 nt, Homo sapiens
gccuaaugauguuaucuag

SEQ ID NO: 225863 - RNA, 19 nt, Homo sapiens
gaaaugugcugcugaucug

SEQ ID NO: 225864 - RNA, 19 nt, Homo sapiens
gcauuggccuccugguuaa

SEQ ID NO: 225865 - RNA, 19 nt, Homo sapiens
ggcagaagaugaugaugaa

SEQ ID NO: 225866 - RNA, 19 nt, Homo sapiens
caagaaaugugcugcugau

SEQ ID NO: 225867 - RNA, 19 nt, Homo sapiens
ggagagauucaagaaauaa

SEQ ID NO: 225868 - RNA, 19 nt, Homo sapiens
gcaauuuccaguauguuaa

SEQ ID NO: 225869 - RNA, 19 nt, Homo sapiens
uggagagauucaagaaaua

SEQ ID NO: 225870 - RNA, 19 nt, Homo sapiens
cgagauggcagaugagauu

SEQ ID NO: 225871 - RNA, 19 nt, Homo sapiens
gaucauccgcaaggaaaua

SEQ ID NO: 225872 - RNA, 19 nt, Homo sapiens
gaagaucauccgcaaggaa

SEQ ID NO: 225873 - RNA, 19 nt, Homo sapiens
ggcaauuuccaguauguua

SEQ ID NO: 225874 - RNA, 19 nt, Homo sapiens
guuaggcaauuuccaguau

SEQ ID NO: 225875 - RNA, 19 nt, Homo sapiens
gaucugggccugaauaagg

SEQ ID NO: 225876 - RNA, 19 nt, Homo sapiens
gaugaccggugccuugcuu

SEQ ID NO: 225877 - RNA, 19 nt, Homo sapiens
gaugaugaaagucuucuug

SEQ ID NO: 225878 - RNA, 19 nt, Homo sapiens
agaagaugaugaugaaagu

SEQ ID NO: 225879 - RNA, 19 nt, Homo sapiens
ggaaauaccagccaaaauc

SEQ ID NO: 225880 - RNA, 19 nt, Homo sapiens
cuuggacacuuaaugauug

SEQ ID NO: 225881 - RNA, 19 nt, Homo sapiens
ggaagaucauccgcaagga

SEQ ID NO: 225882 - RNA, 19 nt, Homo sapiens
ggacacuuaaugauuguug

SEQ ID NO: 225883 - RNA, 19 nt, Homo sapiens
ugaugaaagucuucuugga

SEQ ID NO: 225884 - RNA, 19 nt, Homo sapiens
ggaggucggcaaaugcauu

SEQ ID NO: 225885 - RNA, 19 nt, Homo sapiens
gcugaucugggccugaaua

SEQ ID NO: 225886 - RNA, 19 nt, Homo sapiens
agaaacauauaucccagau

SEQ ID NO: 225887 - RNA, 19 nt, Homo sapiens
ucacguucaucuccauguu

SEQ ID NO: 225888 - RNA, 19 nt, Homo sapiens
auggagagauucaagaaau

SEQ ID NO: 225889 - RNA, 19 nt, Homo sapiens
gugauacccaagaaacaua

SEQ ID NO: 225890 - RNA, 19 nt, Homo sapiens
guauggagagauucaagaa

SEQ ID NO: 225891 - RNA, 19 nt, Homo sapiens
ugcauuggccuccugguua

SEQ ID NO: 225892 - RNA, 19 nt, Homo sapiens
aaugauuguuggcaagaaa

SEQ ID NO: 225893 - RNA, 19 nt, Homo sapiens
aggccgagauggcagauga

SEQ ID NO: 225894 - RNA, 19 nt, Homo sapiens
gcggguuccucccuucuuc

SEQ ID NO: 225895 - RNA, 19 nt, Homo sapiens
gaaacauauaucccagauu

SEQ ID NO: 225896 - RNA, 19 nt, Homo sapiens
caaggaaauaccagccaaa

SEQ ID NO: 225897 - RNA, 19 nt, Homo sapiens
gaaauaccagccaaaauca

SEQ ID NO: 225898 - RNA, 19 nt, Homo sapiens
ccucaagcaccaacacauu

SEQ ID NO: 225899 - RNA, 19 nt, Homo sapiens
ccgcauacauaauaaaaga

SEQ ID NO: 225900 - RNA, 19 nt, Homo sapiens
cagaagaugaugaugaaag

SEQ ID NO: 225901 - RNA, 19 nt, Homo sapiens
uggcagaagaugaugauga

SEQ ID NO: 225902 - RNA, 19 nt, Homo sapiens
gccuguguauggagagauu

SEQ ID NO: 225903 - RNA, 19 nt, Homo sapiens
uaggcaauuuccaguaugu

SEQ ID NO: 225904 - RNA, 19 nt, Homo sapiens
aagaucauccgcaaggaaa

SEQ ID NO: 225905 - RNA, 19 nt, Homo sapiens
gaggucggcaaaugcauug

SEQ ID NO: 225906 - RNA, 19 nt, Homo sapiens
guuaucgaaugguggugaa

SEQ ID NO: 225907 - RNA, 19 nt, Homo sapiens
uaaugauuguuggcaagaa

SEQ ID NO: 225908 - RNA, 19 nt, Homo sapiens
gauacccaagaaacauaua

SEQ ID NO: 225909 - RNA, 19 nt, Homo sapiens
guucaucuccauguucuug

SEQ ID NO: 225910 - RNA, 19 nt, Homo sapiens
cuucuuggacacuuaauga

SEQ ID NO: 225911 - RNA, 19 nt, Homo sapiens
gggauaauuuucucuucuu

SEQ ID NO: 225912 - RNA, 19 nt, Homo sapiens
gcagaagaugaugaugaaa

SEQ ID NO: 225913 - RNA, 19 nt, Homo sapiens
agaaaugugcugcugaucu

SEQ ID NO: 225914 - RNA, 19 nt, Homo sapiens
cucaagcaccaacacauuu

SEQ ID NO: 225915 - RNA, 19 nt, Homo sapiens
ggugauacccaagaaacau

SEQ ID NO: 225916 - RNA, 19 nt, Homo sapiens
gauuaaguuaggcaauuuc

SEQ ID NO: 225917 - RNA, 19 nt, Homo sapiens
guucuuggaggucggcaaa

SEQ ID NO: 225918 - RNA, 19 nt, Homo sapiens
cugcugaucugggccugaa

SEQ ID NO: 225919 - RNA, 19 nt, Homo sapiens
caacacauuuucuggugau

SEQ ID NO: 225920 - RNA, 19 nt, Homo sapiens
cuucuuuaggcaaugauua

SEQ ID NO: 225921 - RNA, 19 nt, Homo sapiens
ucuuggaggucggcaaaug

SEQ ID NO: 225922 - RNA, 19 nt, Homo sapiens
gaaagucuucuuggacacu

SEQ ID NO: 225923 - RNA, 19 nt, Homo sapiens
gaugaugaugaaagucuuc

SEQ ID NO: 225924 - RNA, 19 nt, Homo sapiens
uuaggcaauuuccaguaug

SEQ ID NO: 225925 - RNA, 19 nt, Homo sapiens
ggacagcccucaagacuua

SEQ ID NO: 225926 - RNA, 19 nt, Homo sapiens
ggacagaucugcagaauca

SEQ ID NO: 225927 - RNA, 19 nt, Homo sapiens
uaagaaaccuagcauguua

SEQ ID NO: 225928 - RNA, 19 nt, Homo sapiens
gacauaaacucaugacuaa

SEQ ID NO: 225929 - RNA, 19 nt, Homo sapiens
gaacagaagcagcaaauaa

SEQ ID NO: 225930 - RNA, 19 nt, Homo sapiens
gcacauggauuaauugaug

SEQ ID NO: 225931 - RNA, 19 nt, Homo sapiens
gaagaugccucgaacuaaa

SEQ ID NO: 225932 - RNA, 19 nt, Homo sapiens
gcaaauaguuuagacauug

SEQ ID NO: 225933 - RNA, 19 nt, Homo sapiens
gagcggauaucgaagcuua

SEQ ID NO: 225934 - RNA, 19 nt, Homo sapiens
gcagucagcuucucauuug

SEQ ID NO: 225935 - RNA, 19 nt, Homo sapiens
guaaugaggcuguuaauuu

SEQ ID NO: 225936 - RNA, 19 nt, Homo sapiens
aaagaugccucugaaauua

SEQ ID NO: 225937 - RNA, 19 nt, Homo sapiens
aaacagagauucaguuaug

SEQ ID NO: 225938 - RNA, 19 nt, Homo sapiens
caacaccacuuacugaauu

SEQ ID NO: 225939 - RNA, 19 nt, Homo sapiens
gaacaagacucuggaagga

SEQ ID NO: 225940 - RNA, 19 nt, Homo sapiens
gaaauccucuucaggcaaa

SEQ ID NO: 225941 - RNA, 19 nt, Homo sapiens
caggaaagcuccagaaaga

SEQ ID NO: 225942 - RNA, 19 nt, Homo sapiens
gcaaauggauucugcuuca

SEQ ID NO: 225943 - RNA, 19 nt, Homo sapiens
agaaacaccuggaauaauu

SEQ ID NO: 225944 - RNA, 19 nt, Homo sapiens
gagcaaaugugcaaucuuc

SEQ ID NO: 225945 - RNA, 19 nt, Homo sapiens
gaaggcacauucugaaguu

SEQ ID NO: 225946 - RNA, 19 nt, Homo sapiens
gcacaaggcccacauauag

SEQ ID NO: 225947 - RNA, 19 nt, Homo sapiens
gcaagacucucacguagga

SEQ ID NO: 225948 - RNA, 19 nt, Homo sapiens
ggaauugguugcugaauca

SEQ ID NO: 225949 - RNA, 19 nt, Homo sapiens
guaguugaauucagcaaua

SEQ ID NO: 225950 - RNA, 19 nt, Homo sapiens
gaagugaccagcagcauaa

SEQ ID NO: 225951 - RNA, 19 nt, Homo sapiens
ggacaauguuugaguguga

SEQ ID NO: 225952 - RNA, 19 nt, Homo sapiens
gaggacaccuuauaauaug

SEQ ID NO: 225953 - RNA, 19 nt, Homo sapiens
uaucgaagcuuaucucaga

SEQ ID NO: 225954 - RNA, 19 nt, Homo sapiens
gaaguucuauggcaggaaa

SEQ ID NO: 225955 - RNA, 19 nt, Homo sapiens
caacagacgugagaccuuu

SEQ ID NO: 225956 - RNA, 19 nt, Homo sapiens
gaaggaauuucuaugugaa

SEQ ID NO: 225957 - RNA, 19 nt, Homo sapiens
uaaugaggcuguuaauuug

SEQ ID NO: 225958 - RNA, 19 nt, Homo sapiens
ggaagucagucauuugaug

SEQ ID NO: 225959 - RNA, 19 nt, Homo sapiens
gucaaaugcugaaacuuua

SEQ ID NO: 225960 - RNA, 19 nt, Homo sapiens
caauaaagaugccucugaa

SEQ ID NO: 225961 - RNA, 19 nt, Homo sapiens
gaaguacggauucugguua

SEQ ID NO: 225962 - RNA, 19 nt, Homo sapiens
gcuuugaguucgagaguua

SEQ ID NO: 225963 - RNA, 19 nt, Homo sapiens
gaggagaacuucaggaaag

SEQ ID NO: 225964 - RNA, 19 nt, Homo sapiens
gcaugugccucucuuagaa

SEQ ID NO: 225965 - RNA, 19 nt, Homo sapiens
ggagaaacaccuggaauaa

SEQ ID NO: 225966 - RNA, 19 nt, Homo sapiens
gcaaacccuucaucacaaa

SEQ ID NO: 225967 - RNA, 19 nt, Homo sapiens
ggauauaagucaaaugaag

SEQ ID NO: 225968 - RNA, 19 nt, Homo sapiens
gaaagagccuccccaguuu

SEQ ID NO: 225969 - RNA, 19 nt, Homo sapiens
ucacuugacuguuuaccua

SEQ ID NO: 225970 - RNA, 19 nt, Homo sapiens
caaacugggucuugucuug

SEQ ID NO: 225971 - RNA, 19 nt, Homo sapiens
gcagugacaucaucuguag

SEQ ID NO: 225972 - RNA, 19 nt, Homo sapiens
caucagaacagauuaauug

SEQ ID NO: 225973 - RNA, 19 nt, Homo sapiens
gauagaacauuccucaaca

SEQ ID NO: 225974 - RNA, 19 nt, Homo sapiens
gcgaggagguuauguuugu

SEQ ID NO: 225975 - RNA, 19 nt, Homo sapiens
acagggagcuccagaaaug

SEQ ID NO: 225976 - RNA, 19 nt, Homo sapiens
ucacuucucuuucauuguu

SEQ ID NO: 225977 - RNA, 19 nt, Homo sapiens
caagucauccacaucauua

SEQ ID NO: 225978 - RNA, 19 nt, Homo sapiens
ccauggagcugcagaaugu

SEQ ID NO: 225979 - RNA, 19 nt, Homo sapiens
uaaagaugccucugaaauu

SEQ ID NO: 225980 - RNA, 19 nt, Homo sapiens
gaagucaggugcagaaggu

SEQ ID NO: 225981 - RNA, 19 nt, Homo sapiens
gaaucacagucuucuugua

SEQ ID NO: 225982 - RNA, 19 nt, Homo sapiens
gggcucaccuugugcaauu

SEQ ID NO: 225983 - RNA, 19 nt, Homo sapiens
gaggauauaagucaaauga

SEQ ID NO: 225984 - RNA, 19 nt, Homo sapiens
gaaaaucacuauacuguca

SEQ ID NO: 225985 - RNA, 19 nt, Homo sapiens
uggaauacguuguaagaaa

SEQ ID NO: 225986 - RNA, 19 nt, Homo sapiens
ucagaauccuugcccauaa

SEQ ID NO: 225987 - RNA, 19 nt, Homo sapiens
ccaaagcacuuaguauuca

SEQ ID NO: 225988 - RNA, 19 nt, Homo sapiens
gcaauaaagaugccucuga

SEQ ID NO: 225989 - RNA, 19 nt, Homo sapiens
ucacaucccugccacaaau

SEQ ID NO: 225990 - RNA, 19 nt, Homo sapiens
caaugaagcuuugguagau

SEQ ID NO: 225991 - RNA, 19 nt, Homo sapiens
gcgcugauccugccaaauu

SEQ ID NO: 225992 - RNA, 19 nt, Homo sapiens
caacauuaccaaccaaauu

SEQ ID NO: 225993 - RNA, 19 nt, Homo sapiens
gcacagggagcuccagaaa

SEQ ID NO: 225994 - RNA, 19 nt, Homo sapiens
ccucugaaauuaacaguga

SEQ ID NO: 225995 - RNA, 19 nt, Homo sapiens
uacaugguguuaucucuua

SEQ ID NO: 225996 - RNA, 19 nt, Homo sapiens
gaaaugaggcguacugcau

SEQ ID NO: 225997 - RNA, 19 nt, Homo sapiens
ucaaugccaugaucaagaa

SEQ ID NO: 225998 - RNA, 19 nt, Homo sapiens
uaaagaggaugucaaaugc

SEQ ID NO: 225999 - RNA, 19 nt, Homo sapiens
cauguugccucuguuguua

SEQ ID NO: 226000 - RNA, 19 nt, Homo sapiens
ugacaaaucugcaaaauca

SEQ ID NO: 226001 - RNA, 19 nt, Homo sapiens
guuccacuguugaauauaa

SEQ ID NO: 226002 - RNA, 19 nt, Homo sapiens
ugacauaaacucaugacua

SEQ ID NO: 226003 - RNA, 19 nt, Homo sapiens
gagcaggcccaacucauuu

SEQ ID NO: 226004 - RNA, 19 nt, Homo sapiens
uccaguagaucucagguua

SEQ ID NO: 226005 - RNA, 19 nt, Homo sapiens
ggaauacguuguaagaaac

SEQ ID NO: 226006 - RNA, 19 nt, Homo sapiens
gaaagucauguucuuggua

SEQ ID NO: 226007 - RNA, 19 nt, Homo sapiens
gagacaagcagccauagaa

SEQ ID NO: 226008 - RNA, 19 nt, Homo sapiens
gcgaaugcaucucuucuca

SEQ ID NO: 226009 - RNA, 19 nt, Homo sapiens
gaacuucggaaucccuuaa

SEQ ID NO: 226010 - RNA, 19 nt, Homo sapiens
aaaccuagcauguuaaaga

SEQ ID NO: 226011 - RNA, 19 nt, Homo sapiens
gcucuaaauuugucguuau

SEQ ID NO: 226012 - RNA, 19 nt, Homo sapiens
aaacagaagaagccuauuu

SEQ ID NO: 226013 - RNA, 19 nt, Homo sapiens
cccaagaucugcccaauca

SEQ ID NO: 226014 - RNA, 19 nt, Homo sapiens
gaacagacgccccagauaa

SEQ ID NO: 226015 - RNA, 19 nt, Homo sapiens
uaccuucacuugacuguuu

SEQ ID NO: 226016 - RNA, 19 nt, Homo sapiens
uacuguaacuucuccuuua

SEQ ID NO: 226017 - RNA, 19 nt, Homo sapiens
gaauguggaauacguugua

SEQ ID NO: 226018 - RNA, 19 nt, Homo sapiens
gcacuugcucuccuuaauu

SEQ ID NO: 226019 - RNA, 19 nt, Homo sapiens
gaacuggaaucucugucau

SEQ ID NO: 226020 - RNA, 19 nt, Homo sapiens
caucauggaacaacagaua

SEQ ID NO: 226021 - RNA, 19 nt, Homo sapiens
ggagcuuuauguuuagaaa

SEQ ID NO: 226022 - RNA, 19 nt, Homo sapiens
ggauuuaggcaucucagua

SEQ ID NO: 226023 - RNA, 19 nt, Homo sapiens
aaacacauacgaacccaua

SEQ ID NO: 226024 - RNA, 19 nt, Homo sapiens
guacagacaauaaccaaga

SEQ ID NO: 226025 - RNA, 19 nt, Homo sapiens
gaaagaaaccugcugagua

SEQ ID NO: 226026 - RNA, 19 nt, Homo sapiens
gaagauacaugaccacaau

SEQ ID NO: 226027 - RNA, 19 nt, Homo sapiens
ggacacagcucuaggacaa

SEQ ID NO: 226028 - RNA, 19 nt, Homo sapiens
gaagagagaugucccaaag

SEQ ID NO: 226029 - RNA, 19 nt, Homo sapiens
gaaaggagauauucaugga

SEQ ID NO: 226030 - RNA, 19 nt, Homo sapiens
gagaggaagucacucauuu

SEQ ID NO: 226031 - RNA, 19 nt, Homo sapiens
gcaaagauccuucaucaga

SEQ ID NO: 226032 - RNA, 19 nt, Homo sapiens
gaaaguacauuugugaaga

SEQ ID NO: 226033 - RNA, 19 nt, Homo sapiens
gaagaaaccaguaagcuuu

SEQ ID NO: 226034 - RNA, 19 nt, Homo sapiens
ggaagucacucauuugaug

SEQ ID NO: 226035 - RNA, 19 nt, Homo sapiens
caaccaacauccuauauga

SEQ ID NO: 226036 - RNA, 19 nt, Homo sapiens
gaggagaguucuuuauuug

SEQ ID NO: 226037 - RNA, 19 nt, Homo sapiens
aaugaaagcucucaguaua

SEQ ID NO: 226038 - RNA, 19 nt, Homo sapiens
aaagaaaccugcugaguau

SEQ ID NO: 226039 - RNA, 19 nt, Homo sapiens
cgaagcauaugaaaucuaa

SEQ ID NO: 226040 - RNA, 19 nt, Homo sapiens
caucauggcuuccgauuau

SEQ ID NO: 226041 - RNA, 19 nt, Homo sapiens
gaggaugucuguuguaugu

SEQ ID NO: 226042 - RNA, 19 nt, Homo sapiens
ccaagaaggugcuuaugaa

SEQ ID NO: 226043 - RNA, 19 nt, Homo sapiens
aaaggaagcugcauugaga

SEQ ID NO: 226044 - RNA, 19 nt, Homo sapiens
gagcagaccuacccauguu

SEQ ID NO: 226045 - RNA, 19 nt, Homo sapiens
ggaugucuguuguauguaa

SEQ ID NO: 226046 - RNA, 19 nt, Homo sapiens
agaagaggcucacaagaaa

SEQ ID NO: 226047 - RNA, 19 nt, Homo sapiens
uaacuuaagugcugauugu

SEQ ID NO: 226048 - RNA, 19 nt, Homo sapiens
ucacggacauggcagauuu

SEQ ID NO: 226049 - RNA, 19 nt, Homo sapiens
gggauaggauucaacauug

SEQ ID NO: 226050 - RNA, 19 nt, Homo sapiens
gcacuaagacugucagaga

SEQ ID NO: 226051 - RNA, 19 nt, Homo sapiens
ggagucaccuucagccauu

SEQ ID NO: 226052 - RNA, 19 nt, Homo sapiens
gugcaucacugguacaauu

SEQ ID NO: 226053 - RNA, 19 nt, Homo sapiens
caaagauccuucaucagaa

SEQ ID NO: 226054 - RNA, 19 nt, Homo sapiens
cgagauaauucaccaaaga

SEQ ID NO: 226055 - RNA, 19 nt, Homo sapiens
ggaaucagauggugaggau

SEQ ID NO: 226056 - RNA, 19 nt, Homo sapiens
gugaacauguugaucuaua

SEQ ID NO: 226057 - RNA, 19 nt, Homo sapiens
ggaaaauacugucggcuua

SEQ ID NO: 226058 - RNA, 19 nt, Homo sapiens
ugaggagaguucuuuauuu

SEQ ID NO: 226059 - RNA, 19 nt, Homo sapiens
gcacuuaugcauuaguuaa

SEQ ID NO: 226060 - RNA, 19 nt, Homo sapiens
gcacaaagcagcagagaag

SEQ ID NO: 226061 - RNA, 19 nt, Homo sapiens
gcagcaaacuagaaaggaa

SEQ ID NO: 226062 - RNA, 19 nt, Homo sapiens
ggaaguccaucucuugugu

SEQ ID NO: 226063 - RNA, 19 nt, Homo sapiens
ugaaagcucucaguauauu

SEQ ID NO: 226064 - RNA, 19 nt, Homo sapiens
ggauuccucucccuaauga

SEQ ID NO: 226065 - RNA, 19 nt, Homo sapiens
gaauuuguguaucugcuuu

SEQ ID NO: 226066 - RNA, 19 nt, Homo sapiens
gcaugccuguccuaaguua

SEQ ID NO: 226067 - RNA, 19 nt, Homo sapiens
ggauggagaugauaaugau

SEQ ID NO: 226068 - RNA, 19 nt, Homo sapiens
uaacgaagcauaugaaauc

SEQ ID NO: 226069 - RNA, 19 nt, Homo sapiens
gaaccuucuuccaaaguuu

SEQ ID NO: 226070 - RNA, 19 nt, Homo sapiens
gaagacaagcggcauuuga

SEQ ID NO: 226071 - RNA, 19 nt, Homo sapiens
caaauaagcccucccaaca

SEQ ID NO: 226072 - RNA, 19 nt, Homo sapiens
ccacagaguucuucauuac

SEQ ID NO: 226073 - RNA, 19 nt, Homo sapiens
gaaggaagcccagagcaaa

SEQ ID NO: 226074 - RNA, 19 nt, Homo sapiens
caacacaaaugcaaagucu

SEQ ID NO: 226075 - RNA, 19 nt, Homo sapiens
gcuaccaaauccaucuuua

SEQ ID NO: 226076 - RNA, 19 nt, Homo sapiens
aagcaaagauccuucauca

SEQ ID NO: 226077 - RNA, 19 nt, Homo sapiens
aaacacauccguacccaua

SEQ ID NO: 226078 - RNA, 19 nt, Homo sapiens
acacaaaugcaaagucuua

SEQ ID NO: 226079 - RNA, 19 nt, Homo sapiens
ggaagcaguuuacucagau

SEQ ID NO: 226080 - RNA, 19 nt, Homo sapiens
caaagucgaugagaauaug

SEQ ID NO: 226081 - RNA, 19 nt, Homo sapiens
gaagaggacacgcccauga

SEQ ID NO: 226082 - RNA, 19 nt, Homo sapiens
gggcuuagcaaucuccuua

SEQ ID NO: 226083 - RNA, 19 nt, Homo sapiens
gcaagcagagccaauugua

SEQ ID NO: 226084 - RNA, 19 nt, Homo sapiens
gaauagcccugccauuguc

SEQ ID NO: 226085 - RNA, 19 nt, Homo sapiens
ucacugagccgacccaauu

SEQ ID NO: 226086 - RNA, 19 nt, Homo sapiens
cagcucugauucuguaaua

SEQ ID NO: 226087 - RNA, 19 nt, Homo sapiens
cauagcauguccagcauuu

SEQ ID NO: 226088 - RNA, 19 nt, Homo sapiens
caucagggcuacacccaaa

SEQ ID NO: 226089 - RNA, 19 nt, Homo sapiens
gauaguaccguaaagcauu

SEQ ID NO: 226090 - RNA, 19 nt, Homo sapiens
aaaggaaacuagugggaaa

SEQ ID NO: 226091 - RNA, 19 nt, Homo sapiens
gcaguuuacucagaugaaa

SEQ ID NO: 226092 - RNA, 19 nt, Homo sapiens
guuggugcuucuugaauua

SEQ ID NO: 226093 - RNA, 19 nt, Homo sapiens
agagucagcuguaucuaaa

SEQ ID NO: 226094 - RNA, 19 nt, Homo sapiens
cagaagaggcucacaagaa

SEQ ID NO: 226095 - RNA, 19 nt, Homo sapiens
acaaucagcuguuauuaag

SEQ ID NO: 226096 - RNA, 19 nt, Homo sapiens
cagaagggcuuuauaccau

SEQ ID NO: 226097 - RNA, 19 nt, Homo sapiens
ggacauucuucguugauca

SEQ ID NO: 226098 - RNA, 19 nt, Homo sapiens
gagaugauaaugaugauga

SEQ ID NO: 226099 - RNA, 19 nt, Homo sapiens
cuuaagaccuuguguaaca

SEQ ID NO: 226100 - RNA, 19 nt, Homo sapiens
gcacuuaagaccuugugua

SEQ ID NO: 226101 - RNA, 19 nt, Homo sapiens
caacugaaacgcccucuga

SEQ ID NO: 226102 - RNA, 19 nt, Homo sapiens
gaacagccacacuuauuuc

SEQ ID NO: 226103 - RNA, 19 nt, Homo sapiens
cagguuagaugucaagaug

SEQ ID NO: 226104 - RNA, 19 nt, Homo sapiens
gcacacagucaaacagaaa

SEQ ID NO: 226105 - RNA, 19 nt, Homo sapiens
ggacagcggcaaccacaaa

SEQ ID NO: 226106 - RNA, 19 nt, Homo sapiens
ggacucagaaccagacaaa

SEQ ID NO: 226107 - RNA, 19 nt, Homo sapiens
gaaagagaagaaaccagua

SEQ ID NO: 226108 - RNA, 19 nt, Homo sapiens
uaacuauuccuccuucuuu

SEQ ID NO: 226109 - RNA, 19 nt, Homo sapiens
gaaccauuaccucacguua

SEQ ID NO: 226110 - RNA, 19 nt, Homo sapiens
caaaugcaaagucuuauga

SEQ ID NO: 226111 - RNA, 19 nt, Homo sapiens
aaacagaaacuugcacuaa

SEQ ID NO: 226112 - RNA, 19 nt, Homo sapiens
gacacuagguugccacaga

SEQ ID NO: 226113 - RNA, 19 nt, Homo sapiens
ggaucuaaaugauguaaag

SEQ ID NO: 226114 - RNA, 19 nt, Homo sapiens
uaugaugcauggagacuuu

SEQ ID NO: 226115 - RNA, 19 nt, Homo sapiens
aaagauccuucaucagaaa

SEQ ID NO: 226116 - RNA, 19 nt, Homo sapiens
gcaaggaauuaucuucaag

SEQ ID NO: 226117 - RNA, 19 nt, Homo sapiens
ggaaacuagugggaaauau

SEQ ID NO: 226118 - RNA, 19 nt, Homo sapiens
cacaagcauuucucagaua

SEQ ID NO: 226119 - RNA, 19 nt, Homo sapiens
cagaaugccuuguuucagu

SEQ ID NO: 226120 - RNA, 19 nt, Homo sapiens
caacuaaucuaacuauucc

SEQ ID NO: 226121 - RNA, 19 nt, Homo sapiens
gcaacuaaucuaacuauuc

SEQ ID NO: 226122 - RNA, 19 nt, Homo sapiens
gcaacucagugccaacuuc

SEQ ID NO: 226123 - RNA, 19 nt, Homo sapiens
gguuagaugucaagauguu

SEQ ID NO: 226124 - RNA, 19 nt, Homo sapiens
gcagaaauacauucagaug

SEQ ID NO: 226125 - RNA, 19 nt, Homo sapiens
gggaagagcuguuugauca

SEQ ID NO: 226126 - RNA, 19 nt, Homo sapiens
ggaaggagaugaagaaugg

SEQ ID NO: 226127 - RNA, 19 nt, Homo sapiens
gcaagugaaucaugagaaa

SEQ ID NO: 226128 - RNA, 19 nt, Homo sapiens
ucacggagcugaaggauga

SEQ ID NO: 226129 - RNA, 19 nt, Homo sapiens
gggaggauguguaucaaua

SEQ ID NO: 226130 - RNA, 19 nt, Homo sapiens
ggaaaugugucuugucuuc

SEQ ID NO: 226131 - RNA, 19 nt, Homo sapiens
gaaguuaccugugggauuc

SEQ ID NO: 226132 - RNA, 19 nt, Homo sapiens
gcacaacaaugccgugguu

SEQ ID NO: 226133 - RNA, 19 nt, Homo sapiens
ugaaggaacugucaccaaa

SEQ ID NO: 226134 - RNA, 19 nt, Homo sapiens
caacagaguuauuuauugg

SEQ ID NO: 226135 - RNA, 19 nt, Homo sapiens
ccaacagaguuauuuauug

SEQ ID NO: 226136 - RNA, 19 nt, Homo sapiens
cgacggaucucuuuacaag

SEQ ID NO: 226137 - RNA, 19 nt, Homo sapiens
uggagacgauggaucauua

SEQ ID NO: 226138 - RNA, 19 nt, Homo sapiens
gagcagauguggucaaacu

SEQ ID NO: 226139 - RNA, 19 nt, Homo sapiens
gaauagagcgugugcuguu

SEQ ID NO: 226140 - RNA, 19 nt, Homo sapiens
gagaagaugaucaguggua

SEQ ID NO: 226141 - RNA, 19 nt, Homo sapiens
gaucaaggacaagaaguua

SEQ ID NO: 226142 - RNA, 19 nt, Homo sapiens
aaacaaagguaugagaaga

SEQ ID NO: 226143 - RNA, 19 nt, Homo sapiens
gcacauugaucugguggaa

SEQ ID NO: 226144 - RNA, 19 nt, Homo sapiens
gaacugaggcacauugauc

SEQ ID NO: 226145 - RNA, 19 nt, Homo sapiens
aaaggaagaucaaggacaa

SEQ ID NO: 226146 - RNA, 19 nt, Homo sapiens
gaagagcuguuugaucaca

SEQ ID NO: 226147 - RNA, 19 nt, Homo sapiens
ggaaacaaagguaugagaa

SEQ ID NO: 226148 - RNA, 19 nt, Homo sapiens
guaguggcauccauuucua

SEQ ID NO: 226149 - RNA, 19 nt, Homo sapiens
ggaagcagacgcacaacaa

SEQ ID NO: 226150 - RNA, 19 nt, Homo sapiens
gaagacauccggacagagu

SEQ ID NO: 226151 - RNA, 19 nt, Homo sapiens
caucguagcuguggugaau

SEQ ID NO: 226152 - RNA, 19 nt, Homo sapiens
ggacaaagcgauuuaaagc

SEQ ID NO: 226153 - RNA, 19 nt, Homo sapiens
ggacuggaccgucugaaug

SEQ ID NO: 226154 - RNA, 19 nt, Homo sapiens
gagcgugugcuguugauaa

SEQ ID NO: 226155 - RNA, 19 nt, Homo sapiens
cguaugaccuaguaaacuu

SEQ ID NO: 226156 - RNA, 19 nt, Homo sapiens
gaaccaaccaacaaacaau

SEQ ID NO: 226157 - RNA, 19 nt, Homo sapiens
gaugaucagugguauguac

SEQ ID NO: 226158 - RNA, 19 nt, Homo sapiens
gaucuacgccauuccuauu

SEQ ID NO: 226159 - RNA, 19 nt, Homo sapiens
gcacagaggcaagcagcua

SEQ ID NO: 226160 - RNA, 19 nt, Homo sapiens
cugcaucucugacuucuug

SEQ ID NO: 226161 - RNA, 19 nt, Homo sapiens
gaguggagccguccgauga

SEQ ID NO: 226162 - RNA, 19 nt, Homo sapiens
gacgauggaucauuagaag

SEQ ID NO: 226163 - RNA, 19 nt, Homo sapiens
gaaggcgagugugggcaua

SEQ ID NO: 226164 - RNA, 19 nt, Homo sapiens
gaaacucucauagauauca

SEQ ID NO: 226165 - RNA, 19 nt, Homo sapiens
caccaaugcuugcuacaug

SEQ ID NO: 226166 - RNA, 19 nt, Homo sapiens
gcggaaaugugucuugucu

SEQ ID NO: 226167 - RNA, 19 nt, Homo sapiens
ucacuugcccugccacuuu

SEQ ID NO: 226168 - RNA, 19 nt, Homo sapiens
uggcugcgguuguggauaa

SEQ ID NO: 226169 - RNA, 19 nt, Homo sapiens
gaaaauccguagugggaaa

SEQ ID NO: 226170 - RNA, 19 nt, Homo sapiens
gagguuggacucauuguug

SEQ ID NO: 226171 - RNA, 19 nt, Homo sapiens
gggcuucacguucucauuu

SEQ ID NO: 226172 - RNA, 19 nt, Homo sapiens
gauaagauccgcgagaaca

SEQ ID NO: 226173 - RNA, 19 nt, Homo sapiens
gaaaucguccgcaacaucu

SEQ ID NO: 226174 - RNA, 19 nt, Homo sapiens
gaggagacccuggcucauu

SEQ ID NO: 226175 - RNA, 19 nt, Homo sapiens
gagcagcaccggcagauag

SEQ ID NO: 226176 - RNA, 19 nt, Homo sapiens
ccaaguuucucucucagau

SEQ ID NO: 226177 - RNA, 19 nt, Homo sapiens
guauguaccugggugaaau

SEQ ID NO: 226178 - RNA, 19 nt, Homo sapiens
gaaacaaagguaugagaag

SEQ ID NO: 226179 - RNA, 19 nt, Homo sapiens
gaccgagaauggugacuuc

SEQ ID NO: 226180 - RNA, 19 nt, Homo sapiens
ggucaaacugcuuaacaaa

SEQ ID NO: 226181 - RNA, 19 nt, Homo sapiens
cuaguaaacuuuguaccaa

SEQ ID NO: 226182 - RNA, 19 nt, Homo sapiens
gagugugggcauagcauua

SEQ ID NO: 226183 - RNA, 19 nt, Homo sapiens
ccaugcggcucuccgauga

SEQ ID NO: 226184 - RNA, 19 nt, Homo sapiens
ccggaucccuccucacuug

SEQ ID NO: 226185 - RNA, 19 nt, Homo sapiens
caacaagaucuacgccauu

SEQ ID NO: 226186 - RNA, 19 nt, Homo sapiens
gauguggucaaacugcuua

SEQ ID NO: 226187 - RNA, 19 nt, Homo sapiens
ggaaccaaccaacaaacaa

SEQ ID NO: 226188 - RNA, 19 nt, Homo sapiens
uuaaucgacuucaccaaga

SEQ ID NO: 226189 - RNA, 19 nt, Homo sapiens
gaaaugcacaacaagaucu

SEQ ID NO: 226190 - RNA, 19 nt, Homo sapiens
ggaaaugcacaacaagauc

SEQ ID NO: 226191 - RNA, 19 nt, Homo sapiens
aggagacccuggcucauuu

SEQ ID NO: 226192 - RNA, 19 nt, Homo sapiens
ggagagcugguucgacuga

SEQ ID NO: 226193 - RNA, 19 nt, Homo sapiens
cgugugcuguugauaauau

SEQ ID NO: 226194 - RNA, 19 nt, Homo sapiens
agaccaaguuucucucuca

SEQ ID NO: 226195 - RNA, 19 nt, Homo sapiens
ccacaaugccaaagaaauc

SEQ ID NO: 226196 - RNA, 19 nt, Homo sapiens
uaaggaaggccuccacaau

SEQ ID NO: 226197 - RNA, 19 nt, Homo sapiens
gaagaucaaggacaagaag

SEQ ID NO: 226198 - RNA, 19 nt, Homo sapiens
gaaagcaaaauccaacuaa

SEQ ID NO: 226199 - RNA, 19 nt, Homo sapiens
cagcagcuaggucugaaua

SEQ ID NO: 226200 - RNA, 19 nt, Homo sapiens
uagaagacauccggacaga

SEQ ID NO: 226201 - RNA, 19 nt, Homo sapiens
uaaucgacuucaccaagaa

SEQ ID NO: 226202 - RNA, 19 nt, Homo sapiens
acaaagguaugagaagaug

SEQ ID NO: 226203 - RNA, 19 nt, Homo sapiens
ccuaaaugcugggaaacaa

SEQ ID NO: 226204 - RNA, 19 nt, Homo sapiens
acaagacgcacccacagua

SEQ ID NO: 226205 - RNA, 19 nt, Homo sapiens
gggugcaagugaaucauga

SEQ ID NO: 226206 - RNA, 19 nt, Homo sapiens
ugugagccgugucguauga

SEQ ID NO: 226207 - RNA, 19 nt, Homo sapiens
gaaguguaguggcauccau

SEQ ID NO: 226208 - RNA, 19 nt, Homo sapiens
ugaagaacguggagauggu

SEQ ID NO: 226209 - RNA, 19 nt, Homo sapiens
acaaugccgugguuaagau

SEQ ID NO: 226210 - RNA, 19 nt, Homo sapiens
ucaggaaggagaugaagaa

SEQ ID NO: 226211 - RNA, 19 nt, Homo sapiens
ggaaguuuaacaccaguga

SEQ ID NO: 226212 - RNA, 19 nt, Homo sapiens
gcuccuggccuauuacuuc

SEQ ID NO: 226213 - RNA, 19 nt, Homo sapiens
cauccaacagaguuauuua

SEQ ID NO: 226214 - RNA, 19 nt, Homo sapiens
gaagcagacgcacaacaau

SEQ ID NO: 226215 - RNA, 19 nt, Homo sapiens
caucggcacuggcaccaau

SEQ ID NO: 226216 - RNA, 19 nt, Homo sapiens
cgcagcuccuggccuauua

SEQ ID NO: 226217 - RNA, 19 nt, Homo sapiens
ggaagaucaaggacaagaa

SEQ ID NO: 226218 - RNA, 19 nt, Homo sapiens
gacaguauccucgucaaga

SEQ ID NO: 226219 - RNA, 19 nt, Homo sapiens
aaagagaacgguggaaaug

SEQ ID NO: 226220 - RNA, 19 nt, Homo sapiens
gauggucaguggcauguac

SEQ ID NO: 226221 - RNA, 19 nt, Homo sapiens
aaaggaaccaaccaacaaa

SEQ ID NO: 226222 - RNA, 19 nt, Homo sapiens
ucucugacuucuuggacua

SEQ ID NO: 226223 - RNA, 19 nt, Homo sapiens
uuaagaugcugcccuccuu

SEQ ID NO: 226224 - RNA, 19 nt, Homo sapiens
cagcacguuugcaccauug

SEQ ID NO: 226225 - RNA, 19 nt, Homo sapiens
gggaagagcuguuugauca

SEQ ID NO: 226226 - RNA, 19 nt, Homo sapiens
ggaaggagaugaagaaugg

SEQ ID NO: 226227 - RNA, 19 nt, Homo sapiens
gcaagugaaucaugagaaa

SEQ ID NO: 226228 - RNA, 19 nt, Homo sapiens
gggaggauguguaucaaua

SEQ ID NO: 226229 - RNA, 19 nt, Homo sapiens
ggaaaugugucuugucuuc

SEQ ID NO: 226230 - RNA, 19 nt, Homo sapiens
gaaguuaccugugggauuc

SEQ ID NO: 226231 - RNA, 19 nt, Homo sapiens
gcacaacaaugccgugguu

SEQ ID NO: 226232 - RNA, 19 nt, Homo sapiens
ugaaggaacugucaccaaa

SEQ ID NO: 226233 - RNA, 19 nt, Homo sapiens
caacagaguuauuuauugg

SEQ ID NO: 226234 - RNA, 19 nt, Homo sapiens
ccaacagaguuauuuauug

SEQ ID NO: 226235 - RNA, 19 nt, Homo sapiens
cgacggaucucuuuacaag

SEQ ID NO: 226236 - RNA, 19 nt, Homo sapiens
uggagacgauggaucauua

SEQ ID NO: 226237 - RNA, 19 nt, Homo sapiens
gagcagauguggucaaacu

SEQ ID NO: 226238 - RNA, 19 nt, Homo sapiens
gaauagagcgugugcuguu

SEQ ID NO: 226239 - RNA, 19 nt, Homo sapiens
gagaagaugaucaguggua

SEQ ID NO: 226240 - RNA, 19 nt, Homo sapiens
gaucaaggacaagaaguua

SEQ ID NO: 226241 - RNA, 19 nt, Homo sapiens
aaacaaagguaugagaaga

SEQ ID NO: 226242 - RNA, 19 nt, Homo sapiens
gcacauugaucugguggaa

SEQ ID NO: 226243 - RNA, 19 nt, Homo sapiens
gaacugaggcacauugauc

SEQ ID NO: 226244 - RNA, 19 nt, Homo sapiens
aaaggaagaucaaggacaa

SEQ ID NO: 226245 - RNA, 19 nt, Homo sapiens
gaagagcuguuugaucaca

SEQ ID NO: 226246 - RNA, 19 nt, Homo sapiens
ggaaacaaagguaugagaa

SEQ ID NO: 226247 - RNA, 19 nt, Homo sapiens
guaguggcauccauuucua

SEQ ID NO: 226248 - RNA, 19 nt, Homo sapiens
ggaagcagacgcacaacaa

SEQ ID NO: 226249 - RNA, 19 nt, Homo sapiens
gaagacauccggacagagu

SEQ ID NO: 226250 - RNA, 19 nt, Homo sapiens
caucguagcuguggugaau

SEQ ID NO: 226251 - RNA, 19 nt, Homo sapiens
ggacaaagcgauuuaaagc

SEQ ID NO: 226252 - RNA, 19 nt, Homo sapiens
ggacuggaccgucugaaug

SEQ ID NO: 226253 - RNA, 19 nt, Homo sapiens
agauugggauugacaagua

SEQ ID NO: 226254 - RNA, 19 nt, Homo sapiens
gagcgugugcuguugauaa

SEQ ID NO: 226255 - RNA, 19 nt, Homo sapiens
cguaugaccuaguaaacuu

SEQ ID NO: 226256 - RNA, 19 nt, Homo sapiens
gaaccaaccaacaaacaau

SEQ ID NO: 226257 - RNA, 19 nt, Homo sapiens
gaugaucagugguauguac

SEQ ID NO: 226258 - RNA, 19 nt, Homo sapiens
gaucuacgccauuccuauu

SEQ ID NO: 226259 - RNA, 19 nt, Homo sapiens
gcacagaggcaagcagcua

SEQ ID NO: 226260 - RNA, 19 nt, Homo sapiens
cugcaucucugacuucuug

SEQ ID NO: 226261 - RNA, 19 nt, Homo sapiens
gaguggagccguccgauga

SEQ ID NO: 226262 - RNA, 19 nt, Homo sapiens
gacgauggaucauuagaag

SEQ ID NO: 226263 - RNA, 19 nt, Homo sapiens
gaaggcgagugugggcaua

SEQ ID NO: 226264 - RNA, 19 nt, Homo sapiens
caccaaugcuugcuacaug

SEQ ID NO: 226265 - RNA, 19 nt, Homo sapiens
gaaacucucauagauauca

SEQ ID NO: 226266 - RNA, 19 nt, Homo sapiens
gcggaaaugugucuugucu

SEQ ID NO: 226267 - RNA, 19 nt, Homo sapiens
ucacuugcccugccacuuu

SEQ ID NO: 226268 - RNA, 19 nt, Homo sapiens
uggcugcgguuguggauaa

SEQ ID NO: 226269 - RNA, 19 nt, Homo sapiens
gaaaauccguagugggaaa

SEQ ID NO: 226270 - RNA, 19 nt, Homo sapiens
gagguuggacucauuguug

SEQ ID NO: 226271 - RNA, 19 nt, Homo sapiens
gggcuucacguucucauuu

SEQ ID NO: 226272 - RNA, 19 nt, Homo sapiens
gauaagauccgcgagaaca

SEQ ID NO: 226273 - RNA, 19 nt, Homo sapiens
gaaaucguccgcaacaucu

SEQ ID NO: 226274 - RNA, 19 nt, Homo sapiens
gaggagacccuggcucauu

SEQ ID NO: 226275 - RNA, 19 nt, Homo sapiens
gagcagcaccggcagauag

SEQ ID NO: 226276 - RNA, 19 nt, Homo sapiens
gcucaaaacucuaccacaa

SEQ ID NO: 226277 - RNA, 19 nt, Homo sapiens
ccaaguuucucucucagau

SEQ ID NO: 226278 - RNA, 19 nt, Homo sapiens
guauguaccugggugaaau

SEQ ID NO: 226279 - RNA, 19 nt, Homo sapiens
gaaacaaagguaugagaag

SEQ ID NO: 226280 - RNA, 19 nt, Homo sapiens
gaccgagaauggugacuuc

SEQ ID NO: 226281 - RNA, 19 nt, Homo sapiens
gcugaggccugggagauug

SEQ ID NO: 226282 - RNA, 19 nt, Homo sapiens
ggucaaacugcuuaacaaa

SEQ ID NO: 226283 - RNA, 19 nt, Homo sapiens
cuaguaaacuuuguaccaa

SEQ ID NO: 226284 - RNA, 19 nt, Homo sapiens
gagugugggcauagcauua

SEQ ID NO: 226285 - RNA, 19 nt, Homo sapiens
ccggaucccuccucacuug

SEQ ID NO: 226286 - RNA, 19 nt, Homo sapiens
gagcacagccugaguuugc

SEQ ID NO: 226287 - RNA, 19 nt, Homo sapiens
caacaagaucuacgccauu

SEQ ID NO: 226288 - RNA, 19 nt, Homo sapiens
ccaugcggcucuccgauga

SEQ ID NO: 226289 - RNA, 19 nt, Homo sapiens
gauguggucaaacugcuua

SEQ ID NO: 226290 - RNA, 19 nt, Homo sapiens
ggaaccaaccaacaaacaa

SEQ ID NO: 226291 - RNA, 19 nt, Homo sapiens
uuaaucgacuucaccaaga

SEQ ID NO: 226292 - RNA, 19 nt, Homo sapiens
gaaaugcacaacaagaucu

SEQ ID NO: 226293 - RNA, 19 nt, Homo sapiens
ggaaaugcacaacaagauc

SEQ ID NO: 226294 - RNA, 19 nt, Homo sapiens
aggagacccuggcucauuu

SEQ ID NO: 226295 - RNA, 19 nt, Homo sapiens
ggagagcugguucgacuga

SEQ ID NO: 226296 - RNA, 19 nt, Homo sapiens
cgugugcuguugauaauau

SEQ ID NO: 226297 - RNA, 19 nt, Homo sapiens
agaccaaguuucucucuca

SEQ ID NO: 226298 - RNA, 19 nt, Homo sapiens
ccacaaugccaaagaaauc

SEQ ID NO: 226299 - RNA, 19 nt, Homo sapiens
uaaggaaggccuccacaau

SEQ ID NO: 226300 - RNA, 19 nt, Homo sapiens
gaagaucaaggacaagaag

SEQ ID NO: 226301 - RNA, 19 nt, Homo sapiens
gaaagcaaaauccaacuaa

SEQ ID NO: 226302 - RNA, 19 nt, Homo sapiens
cagcagcuaggucugaaua

SEQ ID NO: 226303 - RNA, 19 nt, Homo sapiens
uagaagacauccggacaga

SEQ ID NO: 226304 - RNA, 19 nt, Homo sapiens
uaaucgacuucaccaagaa

SEQ ID NO: 226305 - RNA, 19 nt, Homo sapiens
gauugggauugacaaguau

SEQ ID NO: 226306 - RNA, 19 nt, Homo sapiens
acaaagguaugagaagaug

SEQ ID NO: 226307 - RNA, 19 nt, Homo sapiens
ccuaaaugcugggaaacaa

SEQ ID NO: 226308 - RNA, 19 nt, Homo sapiens
acaagacgcacccacagua

SEQ ID NO: 226309 - RNA, 19 nt, Homo sapiens
gggugcaagugaaucauga

SEQ ID NO: 226310 - RNA, 19 nt, Homo sapiens
ugugagccgugucguauga

SEQ ID NO: 226311 - RNA, 19 nt, Homo sapiens
gaaguguaguggcauccau

SEQ ID NO: 226312 - RNA, 19 nt, Homo sapiens
ucaggaaggagaugaagaa

SEQ ID NO: 226313 - RNA, 19 nt, Homo sapiens
agaggagucuggguguaua

SEQ ID NO: 226314 - RNA, 19 nt, Homo sapiens
ugaagaacguggagauggu

SEQ ID NO: 226315 - RNA, 19 nt, Homo sapiens
acaaugccgugguuaagau

SEQ ID NO: 226316 - RNA, 19 nt, Homo sapiens
ggaaguuuaacaccaguga

SEQ ID NO: 226317 - RNA, 19 nt, Homo sapiens
cauccaacagaguuauuua

SEQ ID NO: 226318 - RNA, 19 nt, Homo sapiens
gaagcagacgcacaacaau

SEQ ID NO: 226319 - RNA, 19 nt, Homo sapiens
caucggcacuggcaccaau

SEQ ID NO: 226320 - RNA, 19 nt, Homo sapiens
aaagaggagucugggugua

SEQ ID NO: 226321 - RNA, 19 nt, Homo sapiens
ggaagaucaaggacaagaa

SEQ ID NO: 226322 - RNA, 19 nt, Homo sapiens
gacaguauccucgucaaga

SEQ ID NO: 226323 - RNA, 19 nt, Homo sapiens
aaagagaacgguggaaaug

SEQ ID NO: 226324 - RNA, 19 nt, Homo sapiens
gauggucaguggcauguac

SEQ ID NO: 226325 - RNA, 19 nt, Homo sapiens
gggaagagcuguuugauca

SEQ ID NO: 226326 - RNA, 19 nt, Homo sapiens
aaagugagauugacaagua

SEQ ID NO: 226327 - RNA, 19 nt, Homo sapiens
ggaaggagaugaagaaugg

SEQ ID NO: 226328 - RNA, 19 nt, Homo sapiens
gcaagugaaucaugagaaa

SEQ ID NO: 226329 - RNA, 19 nt, Homo sapiens
gggaggauguguaucaaua

SEQ ID NO: 226330 - RNA, 19 nt, Homo sapiens
ggaaaugugucuugucuuc

SEQ ID NO: 226331 - RNA, 19 nt, Homo sapiens
caacaaggacuucaacuaa

SEQ ID NO: 226332 - RNA, 19 nt, Homo sapiens
gaaguuaccugugggauuc

SEQ ID NO: 226333 - RNA, 19 nt, Homo sapiens
gcacaacaaugccgugguu

SEQ ID NO: 226334 - RNA, 19 nt, Homo sapiens
ugaaggaacugucaccaaa

SEQ ID NO: 226335 - RNA, 19 nt, Homo sapiens
caacagaguuauuuauugg

SEQ ID NO: 226336 - RNA, 19 nt, Homo sapiens
ccaacagaguuauuuauug

SEQ ID NO: 226337 - RNA, 19 nt, Homo sapiens
cgacggaucucuuuacaag

SEQ ID NO: 226338 - RNA, 19 nt, Homo sapiens
uggagacgauggaucauua

SEQ ID NO: 226339 - RNA, 19 nt, Homo sapiens
gagcagauguggucaaacu

SEQ ID NO: 226340 - RNA, 19 nt, Homo sapiens
gaauagagcgugugcuguu

SEQ ID NO: 226341 - RNA, 19 nt, Homo sapiens
gagaagaugaucaguggua

SEQ ID NO: 226342 - RNA, 19 nt, Homo sapiens
gaucaaggacaagaaguua

SEQ ID NO: 226343 - RNA, 19 nt, Homo sapiens
gcaacaaggacuucaacua

SEQ ID NO: 226344 - RNA, 19 nt, Homo sapiens
aaacaaagguaugagaaga

SEQ ID NO: 226345 - RNA, 19 nt, Homo sapiens
gcacauugaucugguggaa

SEQ ID NO: 226346 - RNA, 19 nt, Homo sapiens
caacuaaccaacuaaagaa

SEQ ID NO: 226347 - RNA, 19 nt, Homo sapiens
gaacugaggcacauugauc

SEQ ID NO: 226348 - RNA, 19 nt, Homo sapiens
aaaggaagaucaaggacaa

SEQ ID NO: 226349 - RNA, 19 nt, Homo sapiens
gaagagcuguuugaucaca

SEQ ID NO: 226350 - RNA, 19 nt, Homo sapiens
ggaaacaaagguaugagaa

SEQ ID NO: 226351 - RNA, 19 nt, Homo sapiens
guaguggcauccauuucua

SEQ ID NO: 226352 - RNA, 19 nt, Homo sapiens
ggaagcagacgcacaacaa

SEQ ID NO: 226353 - RNA, 19 nt, Homo sapiens
gaagacauccggacagagu

SEQ ID NO: 226354 - RNA, 19 nt, Homo sapiens
caucguagcuguggugaau

SEQ ID NO: 226355 - RNA, 19 nt, Homo sapiens
ggacaaagcgauuuaaagc

SEQ ID NO: 226356 - RNA, 19 nt, Homo sapiens
ggacuggaccgucugaaug

SEQ ID NO: 226357 - RNA, 19 nt, Homo sapiens
ugaaacaucuugggcaaug

SEQ ID NO: 226358 - RNA, 19 nt, Homo sapiens
gagcgugugcuguugauaa

SEQ ID NO: 226359 - RNA, 19 nt, Homo sapiens
cguaugaccuaguaaacuu

SEQ ID NO: 226360 - RNA, 19 nt, Homo sapiens
gaaccaaccaacaaacaau

SEQ ID NO: 226361 - RNA, 19 nt, Homo sapiens
gaugaucagugguauguac

SEQ ID NO: 226362 - RNA, 19 nt, Homo sapiens
gaucuacgccauuccuauu

SEQ ID NO: 226363 - RNA, 19 nt, Homo sapiens
gcacagaggcaagcagcua

SEQ ID NO: 226364 - RNA, 19 nt, Homo sapiens
cugcaucucugacuucuug

SEQ ID NO: 226365 - RNA, 19 nt, Homo sapiens
gaguggagccguccgauga

SEQ ID NO: 226366 - RNA, 19 nt, Homo sapiens
gacgauggaucauuagaag

SEQ ID NO: 226367 - RNA, 19 nt, Homo sapiens
gaaggcgagugugggcaua

SEQ ID NO: 226368 - RNA, 19 nt, Homo sapiens
caccaaugcuugcuacaug

SEQ ID NO: 226369 - RNA, 19 nt, Homo sapiens
gaaacucucauagauauca

SEQ ID NO: 226370 - RNA, 19 nt, Homo sapiens
gcggaaaugugucuugucu

SEQ ID NO: 226371 - RNA, 19 nt, Homo sapiens
ucacuugcccugccacuuu

SEQ ID NO: 226372 - RNA, 19 nt, Homo sapiens
uggcugcgguuguggauaa

SEQ ID NO: 226373 - RNA, 19 nt, Homo sapiens
gaaaauccguagugggaaa

SEQ ID NO: 226374 - RNA, 19 nt, Homo sapiens
gagguuggacucauuguug

SEQ ID NO: 226375 - RNA, 19 nt, Homo sapiens
gggcuucacguucucauuu

SEQ ID NO: 226376 - RNA, 19 nt, Homo sapiens
gacuucaacuaaccaacua

SEQ ID NO: 226377 - RNA, 19 nt, Homo sapiens
gauaagauccgcgagaaca

SEQ ID NO: 226378 - RNA, 19 nt, Homo sapiens
gaaaucguccgcaacaucu

SEQ ID NO: 226379 - RNA, 19 nt, Homo sapiens
gaggagacccuggcucauu

SEQ ID NO: 226380 - RNA, 19 nt, Homo sapiens
gagcagcaccggcagauag

SEQ ID NO: 226381 - RNA, 19 nt, Homo sapiens
ccaaguuucucucucagau

SEQ ID NO: 226382 - RNA, 19 nt, Homo sapiens
guauguaccugggugaaau

SEQ ID NO: 226383 - RNA, 19 nt, Homo sapiens
gaaacaaagguaugagaag

SEQ ID NO: 226384 - RNA, 19 nt, Homo sapiens
gaccgagaauggugacuuc

SEQ ID NO: 226385 - RNA, 19 nt, Homo sapiens
ggucaaacugcuuaacaaa

SEQ ID NO: 226386 - RNA, 19 nt, Homo sapiens
cuaguaaacuuuguaccaa

SEQ ID NO: 226387 - RNA, 19 nt, Homo sapiens
gagugugggcauagcauua

SEQ ID NO: 226388 - RNA, 19 nt, Homo sapiens
ccggaucccuccucacuug

SEQ ID NO: 226389 - RNA, 19 nt, Homo sapiens
ucaacuaaccaacuaaaga

SEQ ID NO: 226390 - RNA, 19 nt, Homo sapiens
caacaagaucuacgccauu

SEQ ID NO: 226391 - RNA, 19 nt, Homo sapiens
gauguggucaaacugcuua

SEQ ID NO: 226392 - RNA, 19 nt, Homo sapiens
ccaugcggcucuccgauga

SEQ ID NO: 226393 - RNA, 19 nt, Homo sapiens
gagcauuguuccugagaag

SEQ ID NO: 226394 - RNA, 19 nt, Homo sapiens
ggaaccaaccaacaaacaa

SEQ ID NO: 226395 - RNA, 19 nt, Homo sapiens
uuaaucgacuucaccaaga

SEQ ID NO: 226396 - RNA, 19 nt, Homo sapiens
gaaaugcacaacaagaucu

SEQ ID NO: 226397 - RNA, 19 nt, Homo sapiens
ggaaaugcacaacaagauc

SEQ ID NO: 226398 - RNA, 19 nt, Homo sapiens
aggagacccuggcucauuu

SEQ ID NO: 226399 - RNA, 19 nt, Homo sapiens
ggagagcugguucgacuga

SEQ ID NO: 226400 - RNA, 19 nt, Homo sapiens
cgugugcuguugauaauau

SEQ ID NO: 226401 - RNA, 19 nt, Homo sapiens
agaccaaguuucucucuca

SEQ ID NO: 226402 - RNA, 19 nt, Homo sapiens
ccacaaugccaaagaaauc

SEQ ID NO: 226403 - RNA, 19 nt, Homo sapiens
uaaggaaggccuccacaau

SEQ ID NO: 226404 - RNA, 19 nt, Homo sapiens
gaagaucaaggacaagaag

SEQ ID NO: 226405 - RNA, 19 nt, Homo sapiens
gaaagcaaaauccaacuaa

SEQ ID NO: 226406 - RNA, 19 nt, Homo sapiens
cagcagcuaggucugaaua

SEQ ID NO: 226407 - RNA, 19 nt, Homo sapiens
uagaagacauccggacaga

SEQ ID NO: 226408 - RNA, 19 nt, Homo sapiens
gcaauggaggguuaacuuc

SEQ ID NO: 226409 - RNA, 19 nt, Homo sapiens
caucuaucuugcuguguuu

SEQ ID NO: 226410 - RNA, 19 nt, Homo sapiens
gcaaggacagugcguucaa

SEQ ID NO: 226411 - RNA, 19 nt, Homo sapiens
uaaucgacuucaccaagaa

SEQ ID NO: 226412 - RNA, 19 nt, Homo sapiens
acaaagguaugagaagaug

SEQ ID NO: 226413 - RNA, 19 nt, Homo sapiens
ccuaaaugcugggaaacaa

SEQ ID NO: 226414 - RNA, 19 nt, Homo sapiens
acaagacgcacccacagua

SEQ ID NO: 226415 - RNA, 19 nt, Homo sapiens
gggugcaagugaaucauga

SEQ ID NO: 226416 - RNA, 19 nt, Homo sapiens
ugugagccgugucguauga

SEQ ID NO: 226417 - RNA, 19 nt, Homo sapiens
gaaguguaguggcauccau

SEQ ID NO: 226418 - RNA, 19 nt, Homo sapiens
ugaagaacguggagauggu

SEQ ID NO: 226419 - RNA, 19 nt, Homo sapiens
acaaugccgugguuaagau

SEQ ID NO: 226420 - RNA, 19 nt, Homo sapiens
ggaaguuuaacaccaguga

SEQ ID NO: 226421 - RNA, 19 nt, Homo sapiens
ucaggaaggagaugaagaa

SEQ ID NO: 226422 - RNA, 19 nt, Homo sapiens
cauccaacagaguuauuua

SEQ ID NO: 226423 - RNA, 19 nt, Homo sapiens
gaagcagacgcacaacaau

SEQ ID NO: 226424 - RNA, 19 nt, Homo sapiens
caucggcacuggcaccaau

SEQ ID NO: 226425 - RNA, 19 nt, Homo sapiens
gggaagagcuguuugauca

SEQ ID NO: 226426 - RNA, 19 nt, Homo sapiens
aaagugagauugacaagua

SEQ ID NO: 226427 - RNA, 19 nt, Homo sapiens
ggaaggagaugaagaaugg

SEQ ID NO: 226428 - RNA, 19 nt, Homo sapiens
gcaagugaaucaugagaaa

SEQ ID NO: 226429 - RNA, 19 nt, Homo sapiens
gggaggauguguaucaaua

SEQ ID NO: 226430 - RNA, 19 nt, Homo sapiens
ggaaaugugucuugucuuc

SEQ ID NO: 226431 - RNA, 19 nt, Homo sapiens
caacaaggacuucaacuaa

SEQ ID NO: 226432 - RNA, 19 nt, Homo sapiens
gaaguuaccugugggauuc

SEQ ID NO: 226433 - RNA, 19 nt, Homo sapiens
gcacaacaaugccgugguu

SEQ ID NO: 226434 - RNA, 19 nt, Homo sapiens
ugaaggaacugucaccaaa

SEQ ID NO: 226435 - RNA, 19 nt, Homo sapiens
caacagaguuauuuauugg

SEQ ID NO: 226436 - RNA, 19 nt, Homo sapiens
ccaacagaguuauuuauug

SEQ ID NO: 226437 - RNA, 19 nt, Homo sapiens
cgacggaucucuuuacaag

SEQ ID NO: 226438 - RNA, 19 nt, Homo sapiens
uggagacgauggaucauua

SEQ ID NO: 226439 - RNA, 19 nt, Homo sapiens
gagcagauguggucaaacu

SEQ ID NO: 226440 - RNA, 19 nt, Homo sapiens
gaauagagcgugugcuguu

SEQ ID NO: 226441 - RNA, 19 nt, Homo sapiens
gagaagaugaucaguggua

SEQ ID NO: 226442 - RNA, 19 nt, Homo sapiens
gaucaaggacaagaaguua

SEQ ID NO: 226443 - RNA, 19 nt, Homo sapiens
gcaacaaggacuucaacua

SEQ ID NO: 226444 - RNA, 19 nt, Homo sapiens
aaacaaagguaugagaaga

SEQ ID NO: 226445 - RNA, 19 nt, Homo sapiens
gcacauugaucugguggaa

SEQ ID NO: 226446 - RNA, 19 nt, Homo sapiens
caacuaaccaacuaaagaa

SEQ ID NO: 226447 - RNA, 19 nt, Homo sapiens
gaacugaggcacauugauc

SEQ ID NO: 226448 - RNA, 19 nt, Homo sapiens
aaaggaagaucaaggacaa

SEQ ID NO: 226449 - RNA, 19 nt, Homo sapiens
gcaaggacaguguauguug

SEQ ID NO: 226450 - RNA, 19 nt, Homo sapiens
gaagagcuguuugaucaca

SEQ ID NO: 226451 - RNA, 19 nt, Homo sapiens
ggaaacaaagguaugagaa

SEQ ID NO: 226452 - RNA, 19 nt, Homo sapiens
guaguggcauccauuucua

SEQ ID NO: 226453 - RNA, 19 nt, Homo sapiens
ggaagcagacgcacaacaa

SEQ ID NO: 226454 - RNA, 19 nt, Homo sapiens
gaagacauccggacagagu

SEQ ID NO: 226455 - RNA, 19 nt, Homo sapiens
caucguagcuguggugaau

SEQ ID NO: 226456 - RNA, 19 nt, Homo sapiens
ggacaaagcgauuuaaagc

SEQ ID NO: 226457 - RNA, 19 nt, Homo sapiens
ggacuggaccgucugaaug

SEQ ID NO: 226458 - RNA, 19 nt, Homo sapiens
ugaaacaucuugggcaaug

SEQ ID NO: 226459 - RNA, 19 nt, Homo sapiens
gagcgugugcuguugauaa

SEQ ID NO: 226460 - RNA, 19 nt, Homo sapiens
cguaugaccuaguaaacuu

SEQ ID NO: 226461 - RNA, 19 nt, Homo sapiens
gaaccaaccaacaaacaau

SEQ ID NO: 226462 - RNA, 19 nt, Homo sapiens
gaugaucagugguauguac

SEQ ID NO: 226463 - RNA, 19 nt, Homo sapiens
gaucuacgccauuccuauu

SEQ ID NO: 226464 - RNA, 19 nt, Homo sapiens
gagcccaaaugaagaacaa

SEQ ID NO: 226465 - RNA, 19 nt, Homo sapiens
gcacagaggcaagcagcua

SEQ ID NO: 226466 - RNA, 19 nt, Homo sapiens
cugcaucucugacuucuug

SEQ ID NO: 226467 - RNA, 19 nt, Homo sapiens
gaguggagccguccgauga

SEQ ID NO: 226468 - RNA, 19 nt, Homo sapiens
gacgauggaucauuagaag

SEQ ID NO: 226469 - RNA, 19 nt, Homo sapiens
gaaggcgagugugggcaua

SEQ ID NO: 226470 - RNA, 19 nt, Homo sapiens
caccaaugcuugcuacaug

SEQ ID NO: 226471 - RNA, 19 nt, Homo sapiens
gaaacucucauagauauca

SEQ ID NO: 226472 - RNA, 19 nt, Homo sapiens
gcggaaaugugucuugucu

SEQ ID NO: 226473 - RNA, 19 nt, Homo sapiens
ucacuugcccugccacuuu

SEQ ID NO: 226474 - RNA, 19 nt, Homo sapiens
uggcugcgguuguggauaa

SEQ ID NO: 226475 - RNA, 19 nt, Homo sapiens
gaaaauccguagugggaaa

SEQ ID NO: 226476 - RNA, 19 nt, Homo sapiens
gagguuggacucauuguug

SEQ ID NO: 226477 - RNA, 19 nt, Homo sapiens
gggcuucacguucucauuu

SEQ ID NO: 226478 - RNA, 19 nt, Homo sapiens
gacuucaacuaaccaacua

SEQ ID NO: 226479 - RNA, 19 nt, Homo sapiens
gauaagauccgcgagaaca

SEQ ID NO: 226480 - RNA, 19 nt, Homo sapiens
gaaaucguccgcaacaucu

SEQ ID NO: 226481 - RNA, 19 nt, Homo sapiens
gaggagacccuggcucauu

SEQ ID NO: 226482 - RNA, 19 nt, Homo sapiens
gagcagcaccggcagauag

SEQ ID NO: 226483 - RNA, 19 nt, Homo sapiens
caaggacaguguauguugu

SEQ ID NO: 226484 - RNA, 19 nt, Homo sapiens
ccaaguuucucucucagau

SEQ ID NO: 226485 - RNA, 19 nt, Homo sapiens
guauguaccugggugaaau

SEQ ID NO: 226486 - RNA, 19 nt, Homo sapiens
gaaacaaagguaugagaag

SEQ ID NO: 226487 - RNA, 19 nt, Homo sapiens
gaccgagaauggugacuuc

SEQ ID NO: 226488 - RNA, 19 nt, Homo sapiens
ggucaaacugcuuaacaaa

SEQ ID NO: 226489 - RNA, 19 nt, Homo sapiens
cuaguaaacuuuguaccaa

SEQ ID NO: 226490 - RNA, 19 nt, Homo sapiens
gagugugggcauagcauua

SEQ ID NO: 226491 - RNA, 19 nt, Homo sapiens
ccggaucccuccucacuug

SEQ ID NO: 226492 - RNA, 19 nt, Homo sapiens
caacaagaucuacgccauu

SEQ ID NO: 226493 - RNA, 19 nt, Homo sapiens
ucaacuaaccaacuaaaga

SEQ ID NO: 226494 - RNA, 19 nt, Homo sapiens
gauguggucaaacugcuua

SEQ ID NO: 226495 - RNA, 19 nt, Homo sapiens
ccaugcggcucuccgauga

SEQ ID NO: 226496 - RNA, 19 nt, Homo sapiens
gagcauuguuccugagaag

SEQ ID NO: 226497 - RNA, 19 nt, Homo sapiens
ggaaccaaccaacaaacaa

SEQ ID NO: 226498 - RNA, 19 nt, Homo sapiens
uuaaucgacuucaccaaga

SEQ ID NO: 226499 - RNA, 19 nt, Homo sapiens
gaaaugcacaacaagaucu

SEQ ID NO: 226500 - RNA, 19 nt, Homo sapiens
ggaaaugcacaacaagauc

SEQ ID NO: 226501 - RNA, 19 nt, Homo sapiens
aggagacccuggcucauuu

SEQ ID NO: 226502 - RNA, 19 nt, Homo sapiens
ggagagcugguucgacuga

SEQ ID NO: 226503 - RNA, 19 nt, Homo sapiens
caaaugaagaacaagcaaa

SEQ ID NO: 226504 - RNA, 19 nt, Homo sapiens
cgugugcuguugauaauau

SEQ ID NO: 226505 - RNA, 19 nt, Homo sapiens
agaccaaguuucucucuca

SEQ ID NO: 226506 - RNA, 19 nt, Homo sapiens
ccacaaugccaaagaaauc

SEQ ID NO: 226507 - RNA, 19 nt, Homo sapiens
uaaggaaggccuccacaau

SEQ ID NO: 226508 - RNA, 19 nt, Homo sapiens
gaagaucaaggacaagaag

SEQ ID NO: 226509 - RNA, 19 nt, Homo sapiens
gaaagcaaaauccaacuaa

SEQ ID NO: 226510 - RNA, 19 nt, Homo sapiens
cagcagcuaggucugaaua

SEQ ID NO: 226511 - RNA, 19 nt, Homo sapiens
uagaagacauccggacaga

SEQ ID NO: 226512 - RNA, 19 nt, Homo sapiens
gcaauggaggguuaacuuc

SEQ ID NO: 226513 - RNA, 19 nt, Homo sapiens
caucuaucuugcuguguuu

SEQ ID NO: 226514 - RNA, 19 nt, Homo sapiens
uaaucgacuucaccaagaa

SEQ ID NO: 226515 - RNA, 19 nt, Homo sapiens
acaaagguaugagaagaug

SEQ ID NO: 226516 - RNA, 19 nt, Homo sapiens
ccuaaaugcugggaaacaa

SEQ ID NO: 226517 - RNA, 19 nt, Homo sapiens
acaagacgcacccacagua

SEQ ID NO: 226518 - RNA, 19 nt, Homo sapiens
gggugcaagugaaucauga

SEQ ID NO: 226519 - RNA, 19 nt, Homo sapiens
ugugagccgugucguauga

SEQ ID NO: 226520 - RNA, 19 nt, Homo sapiens
gaaguguaguggcauccau

SEQ ID NO: 226521 - RNA, 19 nt, Homo sapiens
ugaagaacguggagauggu

SEQ ID NO: 226522 - RNA, 19 nt, Homo sapiens
acaaugccgugguuaagau

SEQ ID NO: 226523 - RNA, 19 nt, Homo sapiens
ggaaguuuaacaccaguga

SEQ ID NO: 226524 - RNA, 19 nt, Homo sapiens
ucaggaaggagaugaagaa

SEQ ID NO: 226525 - RNA, 19 nt, Homo sapiens
gggaagagcuguuugauca

SEQ ID NO: 226526 - RNA, 19 nt, Homo sapiens
ggaaggagaugaagaaugg

SEQ ID NO: 226527 - RNA, 19 nt, Homo sapiens
gcaagugaaucaugagaaa

SEQ ID NO: 226528 - RNA, 19 nt, Homo sapiens
gggaggauguguaucaaua

SEQ ID NO: 226529 - RNA, 19 nt, Homo sapiens
ggaaaugugucuugucuuc

SEQ ID NO: 226530 - RNA, 19 nt, Homo sapiens
caacaaggacuucaacuaa

SEQ ID NO: 226531 - RNA, 19 nt, Homo sapiens
gaaguuaccugugggauuc

SEQ ID NO: 226532 - RNA, 19 nt, Homo sapiens
gcacaacaaugccgugguu

SEQ ID NO: 226533 - RNA, 19 nt, Homo sapiens
ugaaggaacugucaccaaa

SEQ ID NO: 226534 - RNA, 19 nt, Homo sapiens
caacagaguuauuuauugg

SEQ ID NO: 226535 - RNA, 19 nt, Homo sapiens
ccaacagaguuauuuauug

SEQ ID NO: 226536 - RNA, 19 nt, Homo sapiens
cgacggaucucuuuacaag

SEQ ID NO: 226537 - RNA, 19 nt, Homo sapiens
uggagacgauggaucauua

SEQ ID NO: 226538 - RNA, 19 nt, Homo sapiens
gagcagauguggucaaacu

SEQ ID NO: 226539 - RNA, 19 nt, Homo sapiens
gaauagagcgugugcuguu

SEQ ID NO: 226540 - RNA, 19 nt, Homo sapiens
gagaagaugaucaguggua

SEQ ID NO: 226541 - RNA, 19 nt, Homo sapiens
gaucaaggacaagaaguua

SEQ ID NO: 226542 - RNA, 19 nt, Homo sapiens
gcaacaaggacuucaacua

SEQ ID NO: 226543 - RNA, 19 nt, Homo sapiens
aaacaaagguaugagaaga

SEQ ID NO: 226544 - RNA, 19 nt, Homo sapiens
gcacauugaucugguggaa

SEQ ID NO: 226545 - RNA, 19 nt, Homo sapiens
caacuaaccaacuaaagaa

SEQ ID NO: 226546 - RNA, 19 nt, Homo sapiens
gaacugaggcacauugauc

SEQ ID NO: 226547 - RNA, 19 nt, Homo sapiens
aaaggaagaucaaggacaa

SEQ ID NO: 226548 - RNA, 19 nt, Homo sapiens
aaagagcccugcgugauuu

SEQ ID NO: 226549 - RNA, 19 nt, Homo sapiens
gcaaggacaguguauguug

SEQ ID NO: 226550 - RNA, 19 nt, Homo sapiens
gaagagcuguuugaucaca

SEQ ID NO: 226551 - RNA, 19 nt, Homo sapiens
ggaaacaaagguaugagaa

SEQ ID NO: 226552 - RNA, 19 nt, Homo sapiens
guaguggcauccauuucua

SEQ ID NO: 226553 - RNA, 19 nt, Homo sapiens
ggaagcagacgcacaacaa

SEQ ID NO: 226554 - RNA, 19 nt, Homo sapiens
gaagacauccggacagagu

SEQ ID NO: 226555 - RNA, 19 nt, Homo sapiens
caucguagcuguggugaau

SEQ ID NO: 226556 - RNA, 19 nt, Homo sapiens
ggacaaagcgauuuaaagc

SEQ ID NO: 226557 - RNA, 19 nt, Homo sapiens
ggacuggaccgucugaaug

SEQ ID NO: 226558 - RNA, 19 nt, Homo sapiens
ugaaacaucuugggcaaug

SEQ ID NO: 226559 - RNA, 19 nt, Homo sapiens
gagcgugugcuguugauaa

SEQ ID NO: 226560 - RNA, 19 nt, Homo sapiens
cguaugaccuaguaaacuu

SEQ ID NO: 226561 - RNA, 19 nt, Homo sapiens
gaaccaaccaacaaacaau

SEQ ID NO: 226562 - RNA, 19 nt, Homo sapiens
gaugaucagugguauguac

SEQ ID NO: 226563 - RNA, 19 nt, Homo sapiens
gaucuacgccauuccuauu

SEQ ID NO: 226564 - RNA, 19 nt, Homo sapiens
gagcccaaaugaagaacaa

SEQ ID NO: 226565 - RNA, 19 nt, Homo sapiens
gcacagaggcaagcagcua

SEQ ID NO: 226566 - RNA, 19 nt, Homo sapiens
cugcaucucugacuucuug

SEQ ID NO: 226567 - RNA, 19 nt, Homo sapiens
gaguggagccguccgauga

SEQ ID NO: 226568 - RNA, 19 nt, Homo sapiens
gacgauggaucauuagaag

SEQ ID NO: 226569 - RNA, 19 nt, Homo sapiens
gaaggcgagugugggcaua

SEQ ID NO: 226570 - RNA, 19 nt, Homo sapiens
caccaaugcuugcuacaug

SEQ ID NO: 226571 - RNA, 19 nt, Homo sapiens
gaaacucucauagauauca

SEQ ID NO: 226572 - RNA, 19 nt, Homo sapiens
gcggaaaugugucuugucu

SEQ ID NO: 226573 - RNA, 19 nt, Homo sapiens
ucacuugcccugccacuuu

SEQ ID NO: 226574 - RNA, 19 nt, Homo sapiens
uggcugcgguuguggauaa

SEQ ID NO: 226575 - RNA, 19 nt, Homo sapiens
gaaaauccguagugggaaa

SEQ ID NO: 226576 - RNA, 19 nt, Homo sapiens
gagguuggacucauuguug

SEQ ID NO: 226577 - RNA, 19 nt, Homo sapiens
gggcuucacguucucauuu

SEQ ID NO: 226578 - RNA, 19 nt, Homo sapiens
gacuucaacuaaccaacua

SEQ ID NO: 226579 - RNA, 19 nt, Homo sapiens
gauaagauccgcgagaaca

SEQ ID NO: 226580 - RNA, 19 nt, Homo sapiens
gaaaucguccgcaacaucu

SEQ ID NO: 226581 - RNA, 19 nt, Homo sapiens
gaggagacccuggcucauu

SEQ ID NO: 226582 - RNA, 19 nt, Homo sapiens
gagcagcaccggcagauag

SEQ ID NO: 226583 - RNA, 19 nt, Homo sapiens
caaggacaguguauguugu

SEQ ID NO: 226584 - RNA, 19 nt, Homo sapiens
ccaaguuucucucucagau

SEQ ID NO: 226585 - RNA, 19 nt, Homo sapiens
guauguaccugggugaaau

SEQ ID NO: 226586 - RNA, 19 nt, Homo sapiens
gaaacaaagguaugagaag

SEQ ID NO: 226587 - RNA, 19 nt, Homo sapiens
gaccgagaauggugacuuc

SEQ ID NO: 226588 - RNA, 19 nt, Homo sapiens
ggucaaacugcuuaacaaa

SEQ ID NO: 226589 - RNA, 19 nt, Homo sapiens
cuaguaaacuuuguaccaa

SEQ ID NO: 226590 - RNA, 19 nt, Homo sapiens
gagugugggcauagcauua

SEQ ID NO: 226591 - RNA, 19 nt, Homo sapiens
ccggaucccuccucacuug

SEQ ID NO: 226592 - RNA, 19 nt, Homo sapiens
caacaagaucuacgccauu

SEQ ID NO: 226593 - RNA, 19 nt, Homo sapiens
ucaacuaaccaacuaaaga

SEQ ID NO: 226594 - RNA, 19 nt, Homo sapiens
gauguggucaaacugcuua

SEQ ID NO: 226595 - RNA, 19 nt, Homo sapiens
ccaugcggcucuccgauga

SEQ ID NO: 226596 - RNA, 19 nt, Homo sapiens
gagcauuguuccugagaag

SEQ ID NO: 226597 - RNA, 19 nt, Homo sapiens
ggaaccaaccaacaaacaa

SEQ ID NO: 226598 - RNA, 19 nt, Homo sapiens
uuaaucgacuucaccaaga

SEQ ID NO: 226599 - RNA, 19 nt, Homo sapiens
gaaaugcacaacaagaucu

SEQ ID NO: 226600 - RNA, 19 nt, Homo sapiens
ggaaaugcacaacaagauc

SEQ ID NO: 226601 - RNA, 19 nt, Homo sapiens
aggagacccuggcucauuu

SEQ ID NO: 226602 - RNA, 19 nt, Homo sapiens
ggagagcugguucgacuga

SEQ ID NO: 226603 - RNA, 19 nt, Homo sapiens
caaaugaagaacaagcaaa

SEQ ID NO: 226604 - RNA, 19 nt, Homo sapiens
cgugugcuguugauaauau

SEQ ID NO: 226605 - RNA, 19 nt, Homo sapiens
agaccaaguuucucucuca

SEQ ID NO: 226606 - RNA, 19 nt, Homo sapiens
ccacaaugccaaagaaauc

SEQ ID NO: 226607 - RNA, 19 nt, Homo sapiens
uaaggaaggccuccacaau

SEQ ID NO: 226608 - RNA, 19 nt, Homo sapiens
gaagaucaaggacaagaag

SEQ ID NO: 226609 - RNA, 19 nt, Homo sapiens
gaaagugagcauuguugau

SEQ ID NO: 226610 - RNA, 19 nt, Homo sapiens
gaaagcaaaauccaacuaa

SEQ ID NO: 226611 - RNA, 19 nt, Homo sapiens
cagcagcuaggucugaaua

SEQ ID NO: 226612 - RNA, 19 nt, Homo sapiens
gcaauggaggguuaacuuc

SEQ ID NO: 226613 - RNA, 19 nt, Homo sapiens
uagaagacauccggacaga

SEQ ID NO: 226614 - RNA, 19 nt, Homo sapiens
caucuaucuugcuguguuu

SEQ ID NO: 226615 - RNA, 19 nt, Homo sapiens
uaaucgacuucaccaagaa

SEQ ID NO: 226616 - RNA, 19 nt, Homo sapiens
acaaagguaugagaagaug

SEQ ID NO: 226617 - RNA, 19 nt, Homo sapiens
ccuaaaugcugggaaacaa

SEQ ID NO: 226618 - RNA, 19 nt, Homo sapiens
acaagacgcacccacagua

SEQ ID NO: 226619 - RNA, 19 nt, Homo sapiens
gggugcaagugaaucauga

SEQ ID NO: 226620 - RNA, 19 nt, Homo sapiens
ugugagccgugucguauga

SEQ ID NO: 226621 - RNA, 19 nt, Homo sapiens
gaaguguaguggcauccau

SEQ ID NO: 226622 - RNA, 19 nt, Homo sapiens
ugaagaacguggagauggu

SEQ ID NO: 226623 - RNA, 19 nt, Homo sapiens
acaaugccgugguuaagau

SEQ ID NO: 226624 - RNA, 19 nt, Homo sapiens
ggaaguuuaacaccaguga

SEQ ID NO: 226625 - RNA, 19 nt, Homo sapiens
gaaagcaacuguuugagaa

SEQ ID NO: 226626 - RNA, 19 nt, Homo sapiens
gcacugauguuguuacuga

SEQ ID NO: 226627 - RNA, 19 nt, Homo sapiens
ucacggagcucaaccauga

SEQ ID NO: 226628 - RNA, 19 nt, Homo sapiens
gggcggauguguaucaaua

SEQ ID NO: 226629 - RNA, 19 nt, Homo sapiens
gaaguuggccucauuguug

SEQ ID NO: 226630 - RNA, 19 nt, Homo sapiens
gcaaggagauggagaaagg

SEQ ID NO: 226631 - RNA, 19 nt, Homo sapiens
gaacaugacauuucuaagu

SEQ ID NO: 226632 - RNA, 19 nt, Homo sapiens
gcagaagguugaccaguau

SEQ ID NO: 226633 - RNA, 19 nt, Homo sapiens
caagcuacauccucacuuu

SEQ ID NO: 226634 - RNA, 19 nt, Homo sapiens
caaauuccaugucccugua

SEQ ID NO: 226635 - RNA, 19 nt, Homo sapiens
guaacauucucaucgauuu

SEQ ID NO: 226636 - RNA, 19 nt, Homo sapiens
gacgacagcaucauuguua

SEQ ID NO: 226637 - RNA, 19 nt, Homo sapiens
ggacuuugauaucgacauu

SEQ ID NO: 226638 - RNA, 19 nt, Homo sapiens
gaacugaggcgccuucuag

SEQ ID NO: 226639 - RNA, 19 nt, Homo sapiens
gagcuuggcccuauuaaga

SEQ ID NO: 226640 - RNA, 19 nt, Homo sapiens
gacaauggaugccuagaug

SEQ ID NO: 226641 - RNA, 19 nt, Homo sapiens
gaguagaucugcuucuuca

SEQ ID NO: 226642 - RNA, 19 nt, Homo sapiens
cggcugcgcucuacuauug

SEQ ID NO: 226643 - RNA, 19 nt, Homo sapiens
ggaccuggcuccgaaaugu

SEQ ID NO: 226644 - RNA, 19 nt, Homo sapiens
ggaaagcaacuguuugaga

SEQ ID NO: 226645 - RNA, 19 nt, Homo sapiens
gaguggagaugcacaacaa

SEQ ID NO: 226646 - RNA, 19 nt, Homo sapiens
aaagacaucucagacauug

SEQ ID NO: 226647 - RNA, 19 nt, Homo sapiens
ccaaagacaucucagacau

SEQ ID NO: 226648 - RNA, 19 nt, Homo sapiens
gcuggacgcucucaaagug

SEQ ID NO: 226649 - RNA, 19 nt, Homo sapiens
ggaugaagguagaaaugga

SEQ ID NO: 226650 - RNA, 19 nt, Homo sapiens
ccaugucccuguauaauuc

SEQ ID NO: 226651 - RNA, 19 nt, Homo sapiens
gaauguaccugggugagau

SEQ ID NO: 226652 - RNA, 19 nt, Homo sapiens
ucaagaugcugcccaccua

SEQ ID NO: 226653 - RNA, 19 nt, Homo sapiens
gcucaaccaugaccaagug

SEQ ID NO: 226654 - RNA, 19 nt, Homo sapiens
gaggaugugagccugauua

SEQ ID NO: 226655 - RNA, 19 nt, Homo sapiens
gcuuggcccuauuaagaua

SEQ ID NO: 226656 - RNA, 19 nt, Homo sapiens
gagauuguccguaacauuc

SEQ ID NO: 226657 - RNA, 19 nt, Homo sapiens
gcgcacauguuauccacaa

SEQ ID NO: 226658 - RNA, 19 nt, Homo sapiens
cgaaaugugaugugucuuu

SEQ ID NO: 226659 - RNA, 19 nt, Homo sapiens
ggacagaacacggagaguu

SEQ ID NO: 226660 - RNA, 19 nt, Homo sapiens
guauauagaugugcaaguc

SEQ ID NO: 226661 - RNA, 19 nt, Homo sapiens
ggauguguaucaauaugga

SEQ ID NO: 226662 - RNA, 19 nt, Homo sapiens
ccgaaugccuggcuaacuu

SEQ ID NO: 226663 - RNA, 19 nt, Homo sapiens
uguaaugaauggucaguug

SEQ ID NO: 226664 - RNA, 19 nt, Homo sapiens
caucauaaccauucccauu

SEQ ID NO: 226665 - RNA, 19 nt, Homo sapiens
uggcuaacuucauggauaa

SEQ ID NO: 226666 - RNA, 19 nt, Homo sapiens
gcaagcagagguucgagaa

SEQ ID NO: 226667 - RNA, 19 nt, Homo sapiens
gaugaccuguggcuuugaa

SEQ ID NO: 226668 - RNA, 19 nt, Homo sapiens
gcccagagcuucucaacac

SEQ ID NO: 226669 - RNA, 19 nt, Homo sapiens
ugcagaagguugaccagua

SEQ ID NO: 226670 - RNA, 19 nt, Homo sapiens
ugggugagauuguccguaa

SEQ ID NO: 226671 - RNA, 19 nt, Homo sapiens
acaaugggcuccagaaggu

SEQ ID NO: 226672 - RNA, 19 nt, Homo sapiens
ucauagaaauaccucauuc

SEQ ID NO: 226673 - RNA, 19 nt, Homo sapiens
gaccuuggaggaacaaauu

SEQ ID NO: 226674 - RNA, 19 nt, Homo sapiens
caaagacaucucagacauu

SEQ ID NO: 226675 - RNA, 19 nt, Homo sapiens
caacaccggucgcuuugag

SEQ ID NO: 226676 - RNA, 19 nt, Homo sapiens
gauggagaaucagaucuau

SEQ ID NO: 226677 - RNA, 19 nt, Homo sapiens
gaagaugcugcccaccuuu

SEQ ID NO: 226678 - RNA, 19 nt, Homo sapiens
ugaagaugcugcccaccuu

SEQ ID NO: 226679 - RNA, 19 nt, Homo sapiens
ucacaugcaucauaaccau

SEQ ID NO: 226680 - RNA, 19 nt, Homo sapiens
gggaagauacugacuaguc

SEQ ID NO: 226681 - RNA, 19 nt, Homo sapiens
gaugugagccugauuaucc

SEQ ID NO: 226682 - RNA, 19 nt, Homo sapiens
gcggauguguaucaauaug

SEQ ID NO: 226683 - RNA, 19 nt, Homo sapiens
cacaagcaauggaccuuug

SEQ ID NO: 226684 - RNA, 19 nt, Homo sapiens
gcugagcuuggcccuauua

SEQ ID NO: 226685 - RNA, 19 nt, Homo sapiens
ggacaauggaugccuagau

SEQ ID NO: 226686 - RNA, 19 nt, Homo sapiens
cuggcuaacuucauggaua

SEQ ID NO: 226687 - RNA, 19 nt, Homo sapiens
gaucugcuucuucaucuug

SEQ ID NO: 226688 - RNA, 19 nt, Homo sapiens
ucuuuaaccucaucuacaa

SEQ ID NO: 226689 - RNA, 19 nt, Homo sapiens
gaggaugaagguagaaaug

SEQ ID NO: 226690 - RNA, 19 nt, Homo sapiens
ucaacgacauucgcacuga

SEQ ID NO: 226691 - RNA, 19 nt, Homo sapiens
gaugaccugugguuaugau

SEQ ID NO: 226692 - RNA, 19 nt, Homo sapiens
gaaaccaaagccaggaguu

SEQ ID NO: 226693 - RNA, 19 nt, Homo sapiens
gcauuugcccuguggauuc

SEQ ID NO: 226694 - RNA, 19 nt, Homo sapiens
aacaugacauuucuaagug

SEQ ID NO: 226695 - RNA, 19 nt, Homo sapiens
auaaggauuuguucacaug

SEQ ID NO: 226696 - RNA, 19 nt, Homo sapiens
ugacuuccgcacagaauuu

SEQ ID NO: 226697 - RNA, 19 nt, Homo sapiens
gaauuggccucaguguagu

SEQ ID NO: 226698 - RNA, 19 nt, Homo sapiens
agaauuggccucaguguag

SEQ ID NO: 226699 - RNA, 19 nt, Homo sapiens
uaaugaauggucaguugua

SEQ ID NO: 226700 - RNA, 19 nt, Homo sapiens
ggccagcugucgcaucuca

SEQ ID NO: 226701 - RNA, 19 nt, Homo sapiens
uaugaugaccuguggcuuu

SEQ ID NO: 226702 - RNA, 19 nt, Homo sapiens
gcaacuguuugagaagaug

SEQ ID NO: 226703 - RNA, 19 nt, Homo sapiens
uuaaggaggugugcacugu

SEQ ID NO: 226704 - RNA, 19 nt, Homo sapiens
gagccauccugcaacacuu

SEQ ID NO: 226705 - RNA, 19 nt, Homo sapiens
gagagcauccuccucaagu

SEQ ID NO: 226706 - RNA, 19 nt, Homo sapiens
agacaucucagacauugaa

SEQ ID NO: 226707 - RNA, 19 nt, Homo sapiens
aauggucaguuguacguaa

SEQ ID NO: 226708 - RNA, 19 nt, Homo sapiens
gacacagucggaacuauga

SEQ ID NO: 226709 - RNA, 19 nt, Homo sapiens
gccaagcgucuacauaaga

SEQ ID NO: 226710 - RNA, 19 nt, Homo sapiens
caucuugacauguaaugaa

SEQ ID NO: 226711 - RNA, 19 nt, Homo sapiens
gagccugauuauccuauag

SEQ ID NO: 226712 - RNA, 19 nt, Homo sapiens
uggcugagcuuggcccuau

SEQ ID NO: 226713 - RNA, 19 nt, Homo sapiens
agaggaggaugaagguaga

SEQ ID NO: 226714 - RNA, 19 nt, Homo sapiens
guagaucugcuucuucauc

SEQ ID NO: 226715 - RNA, 19 nt, Homo sapiens
ucgcggacuuccucgagua

SEQ ID NO: 226716 - RNA, 19 nt, Homo sapiens
ggauggcaguggcaaaggu

SEQ ID NO: 226717 - RNA, 19 nt, Homo sapiens
gaugaucagugggauguac

SEQ ID NO: 226718 - RNA, 19 nt, Homo sapiens
cgggaaagcaacuguuuga

SEQ ID NO: 226719 - RNA, 19 nt, Homo sapiens
caugaugaccugugguuau

SEQ ID NO: 226720 - RNA, 19 nt, Homo sapiens
caacuuccgugugcuuugg

SEQ ID NO: 226721 - RNA, 19 nt, Homo sapiens
cagaauuggccucagugua

SEQ ID NO: 226722 - RNA, 19 nt, Homo sapiens
uagcaguugugacgccaaa

SEQ ID NO: 226723 - RNA, 19 nt, Homo sapiens
ccuuggagccugaacauga

SEQ ID NO: 226724 - RNA, 19 nt, Homo sapiens
gcuccgaaaugugaugugu

SEQ ID NO: 226725 - RNA, 19 nt, Homo sapiens
ggaaugcgaugucuccuua

SEQ ID NO: 226726 - RNA, 19 nt, Homo sapiens
gcaguugacucgugucuga

SEQ ID NO: 226727 - RNA, 19 nt, Homo sapiens
gcacucagguuagcaauau

SEQ ID NO: 226728 - RNA, 19 nt, Homo sapiens
agaaguagcacucagguua

SEQ ID NO: 226729 - RNA, 19 nt, Homo sapiens
gacaggagcacccucauuu

SEQ ID NO: 226730 - RNA, 19 nt, Homo sapiens
gugacuagcuucucugugu

SEQ ID NO: 226731 - RNA, 19 nt, Homo sapiens
ccacauccuuuuacauuua

SEQ ID NO: 226732 - RNA, 19 nt, Homo sapiens
gggaagaaacccugaguug

SEQ ID NO: 226733 - RNA, 19 nt, Homo sapiens
gggcacagcuacagcagau

SEQ ID NO: 226734 - RNA, 19 nt, Homo sapiens
gaagaaacccugaguugcu

SEQ ID NO: 226735 - RNA, 19 nt, Homo sapiens
gcaacaaacacuccagguu

SEQ ID NO: 226736 - RNA, 19 nt, Homo sapiens
gaccagugcugaccaccuu

SEQ ID NO: 226737 - RNA, 19 nt, Homo sapiens
gccagcagcucuuugacuu

SEQ ID NO: 226738 - RNA, 19 nt, Homo sapiens
agaccaaguuccucucuga

SEQ ID NO: 226739 - RNA, 19 nt, Homo sapiens
cagcagcucuuugacuuug

SEQ ID NO: 226740 - RNA, 19 nt, Homo sapiens
ggacaggagcacccucauu

SEQ ID NO: 226741 - RNA, 19 nt, Homo sapiens
gaccaugagucccugaauc

SEQ ID NO: 226742 - RNA, 19 nt, Homo sapiens
cagcuucucuuucccuugu

SEQ ID NO: 226743 - RNA, 19 nt, Homo sapiens
ucacguuccugcagucaga

SEQ ID NO: 226744 - RNA, 19 nt, Homo sapiens
gccaagaugucgugagucu

SEQ ID NO: 226745 - RNA, 19 nt, Homo sapiens
gggccaagaugucgugagu

SEQ ID NO: 226746 - RNA, 19 nt, Homo sapiens
caagaugucgugagucugu

SEQ ID NO: 226747 - RNA, 19 nt, Homo sapiens
gaaguagcacucagguuag

SEQ ID NO: 226748 - RNA, 19 nt, Homo sapiens
uggcagugcuggacgaaga

SEQ ID NO: 226749 - RNA, 19 nt, Homo sapiens
cgagauaggccucauuguc

SEQ ID NO: 226750 - RNA, 19 nt, Homo sapiens
gacaggcaguggagcugaa

SEQ ID NO: 226751 - RNA, 19 nt, Homo sapiens
caaacagggucugcagcuu

SEQ ID NO: 226752 - RNA, 19 nt, Homo sapiens
gcacugagcaaggagacuu

SEQ ID NO: 226753 - RNA, 19 nt, Homo sapiens
gcagcauccuccuggaaca

SEQ ID NO: 226754 - RNA, 19 nt, Homo sapiens
gaggauggguccggcaaag

SEQ ID NO: 226755 - RNA, 19 nt, Homo sapiens
gaacuggaccaaggguuuc

SEQ ID NO: 226756 - RNA, 19 nt, Homo sapiens
ccagcgagaucuacuccau

SEQ ID NO: 226757 - RNA, 19 nt, Homo sapiens
ggagaucguccgccacauc

SEQ ID NO: 226758 - RNA, 19 nt, Homo sapiens
gcucagcacccgcuuugau

SEQ ID NO: 226759 - RNA, 19 nt, Homo sapiens
ugaacuggaccaaggguuu

SEQ ID NO: 226760 - RNA, 19 nt, Homo sapiens
ggucaggccgugugagguu

SEQ ID NO: 226761 - RNA, 19 nt, Homo sapiens
uccggaugcugccuacaua

SEQ ID NO: 226762 - RNA, 19 nt, Homo sapiens
gcagagguuugaaaagaug

SEQ ID NO: 226763 - RNA, 19 nt, Homo sapiens
caugauguccuguggcuau

SEQ ID NO: 226764 - RNA, 19 nt, Homo sapiens
gcccagaagccaggaguuu

SEQ ID NO: 226765 - RNA, 19 nt, Homo sapiens
ggauggaacgcucuacaag

SEQ ID NO: 226766 - RNA, 19 nt, Homo sapiens
uagcugccgugguggagaa

SEQ ID NO: 226767 - RNA, 19 nt, Homo sapiens
gcagcucuuugaccacauc

SEQ ID NO: 226768 - RNA, 19 nt, Homo sapiens
caccaacgcguguuacaug

SEQ ID NO: 226769 - RNA, 19 nt, Homo sapiens
ugaggagagugacuagcuu

SEQ ID NO: 226770 - RNA, 19 nt, Homo sapiens
gcaagcagagguuugaaaa

SEQ ID NO: 226771 - RNA, 19 nt, Homo sapiens
ccagaagccaggaguuugu

SEQ ID NO: 226772 - RNA, 19 nt, Homo sapiens
accauacccuggaccauga

SEQ ID NO: 226773 - RNA, 19 nt, Homo sapiens
gcagguccgagccauccua

SEQ ID NO: 226774 - RNA, 19 nt, Homo sapiens
ggcaagcagagguuugaaa

SEQ ID NO: 226775 - RNA, 19 nt, Homo sapiens
caccaaugccugcuacaug

SEQ ID NO: 226776 - RNA, 19 nt, Homo sapiens
gaccugaggagagugacua

SEQ ID NO: 226777 - RNA, 19 nt, Homo sapiens
gaucguccgccacauccuu

SEQ ID NO: 226778 - RNA, 19 nt, Homo sapiens
gaugaucagcggcauguac

SEQ ID NO: 226779 - RNA, 19 nt, Homo sapiens
aagcagagguuugaaaaga

SEQ ID NO: 226780 - RNA, 19 nt, Homo sapiens
ggccgcaugugcaucaaca

SEQ ID NO: 226781 - RNA, 19 nt, Homo sapiens
gcacagccgggagcaacaa

SEQ ID NO: 226782 - RNA, 19 nt, Homo sapiens
ucagagguuugagaagaug

SEQ ID NO: 226783 - RNA, 19 nt, Homo sapiens
uaggugcagugguguggaa

SEQ ID NO: 226784 - RNA, 19 nt, Homo sapiens
gagaaguagcacucagguu

SEQ ID NO: 226785 - RNA, 19 nt, Homo sapiens
ggaacacguggcugagaug

SEQ ID NO: 226786 - RNA, 19 nt, Homo sapiens
gacucuaacuggcauugag

SEQ ID NO: 226787 - RNA, 19 nt, Homo sapiens
ggacuccauugggucuuca

SEQ ID NO: 226788 - RNA, 19 nt, Homo sapiens
cuucggauguugagcuugu

SEQ ID NO: 226789 - RNA, 19 nt, Homo sapiens
ugacucgugucugaggaaa

SEQ ID NO: 226790 - RNA, 19 nt, Homo sapiens
ggauggguccggcaaaggu

SEQ ID NO: 226791 - RNA, 19 nt, Homo sapiens
gaccagggacaucuucaag

SEQ ID NO: 226792 - RNA, 19 nt, Homo sapiens
agcgagaucuacuccauuc

SEQ ID NO: 226793 - RNA, 19 nt, Homo sapiens
aaugcgaugucuccuuaau

SEQ ID NO: 226794 - RNA, 19 nt, Homo sapiens
uggaacacguggcugagau

SEQ ID NO: 226795 - RNA, 19 nt, Homo sapiens
gaugaucggaggccuguac

SEQ ID NO: 226796 - RNA, 19 nt, Homo sapiens
gguccgagccauccuagag

SEQ ID NO: 226797 - RNA, 19 nt, Homo sapiens
gaagccaggaguuugugau

SEQ ID NO: 226798 - RNA, 19 nt, Homo sapiens
gaaugcgaugucuccuuaa

SEQ ID NO: 226799 - RNA, 19 nt, Homo sapiens
cuacaacaucgacgugguu

SEQ ID NO: 226800 - RNA, 19 nt, Homo sapiens
gcaccaaugccugcuacau

SEQ ID NO: 226801 - RNA, 19 nt, Homo sapiens
ggugacaagggcacagcua

SEQ ID NO: 226802 - RNA, 19 nt, Homo sapiens
ccacaggcgugcagaucac

SEQ ID NO: 226803 - RNA, 19 nt, Homo sapiens
gcaccaacgcguguuacau

SEQ ID NO: 226804 - RNA, 19 nt, Homo sapiens
gauguccuguggcuaugag

SEQ ID NO: 226805 - RNA, 19 nt, Homo sapiens
ggacugcaucguggacuuc

SEQ ID NO: 226806 - RNA, 19 nt, Homo sapiens
ccagcagcucuuugacuuu

SEQ ID NO: 226807 - RNA, 19 nt, Homo sapiens
gagguugggcuaguuguag

SEQ ID NO: 226808 - RNA, 19 nt, Homo sapiens
cccacugccugucugaguu

SEQ ID NO: 226809 - RNA, 19 nt, Homo sapiens
uaaccagccuuggcguucu

SEQ ID NO: 226810 - RNA, 19 nt, Homo sapiens
cugaccaccuucgaccaua

SEQ ID NO: 226811 - RNA, 19 nt, Homo sapiens
gccacauccuuuuacauuu

SEQ ID NO: 226812 - RNA, 19 nt, Homo sapiens
ugagguugggcuaguugua

SEQ ID NO: 226813 - RNA, 19 nt, Homo sapiens
cacucagguuagcaauaua

SEQ ID NO: 226814 - RNA, 19 nt, Homo sapiens
acauggcacugagcaagga

SEQ ID NO: 226815 - RNA, 19 nt, Homo sapiens
gaacagcgcuucacugaga

SEQ ID NO: 226816 - RNA, 19 nt, Homo sapiens
gaguguggcuacaaguuua

SEQ ID NO: 226817 - RNA, 19 nt, Homo sapiens
ggagaaacccuuugagugu

SEQ ID NO: 226818 - RNA, 19 nt, Homo sapiens
ccaaaugugggaaguguua

SEQ ID NO: 226819 - RNA, 19 nt, Homo sapiens
caauaaaccguguggcuuu

SEQ ID NO: 226820 - RNA, 19 nt, Homo sapiens
ggagaugcccuacaagugu

SEQ ID NO: 226821 - RNA, 19 nt, Homo sapiens
ggaccugccugggagcuuu

SEQ ID NO: 226822 - RNA, 19 nt, Homo sapiens
gagaugcccuacaaguguu

SEQ ID NO: 226823 - RNA, 19 nt, Homo sapiens
aggaggaagucaaauguaa

SEQ ID NO: 226824 - RNA, 19 nt, Homo sapiens
ggauggcgauuacaugucu

SEQ ID NO: 226825 - RNA, 19 nt, Homo sapiens
uggcuucgcugagaucuuu

SEQ ID NO: 226826 - RNA, 19 nt, Homo sapiens
ugagaucuuuggccucuug

SEQ ID NO: 226827 - RNA, 19 nt, Homo sapiens
gaucuuuggccucuuguug

SEQ ID NO: 226828 - RNA, 19 nt, Homo sapiens
gagcaugaagcccggaauu

SEQ ID NO: 226829 - RNA, 19 nt, Homo sapiens
gggaaguggugguucaagu

SEQ ID NO: 226830 - RNA, 19 nt, Homo sapiens
gagcccagaggcagucaua

SEQ ID NO: 226831 - RNA, 19 nt, Homo sapiens
ggaagaagaggaaguuucg

SEQ ID NO: 226832 - RNA, 19 nt, Homo sapiens
guccacaacaggaaacaua

SEQ ID NO: 226833 - RNA, 19 nt, Homo sapiens
agucaaauguaauccgaaa

SEQ ID NO: 226834 - RNA, 19 nt, Homo sapiens
gaaugagaggccacacgua

SEQ ID NO: 226835 - RNA, 19 nt, Homo sapiens
ggagcuuucucuugcauac

SEQ ID NO: 226836 - RNA, 19 nt, Homo sapiens
gcacacacacgggugagaa

SEQ ID NO: 226837 - RNA, 19 nt, Homo sapiens
ggugagaagcuguuugugu

SEQ ID NO: 226838 - RNA, 19 nt, Homo sapiens
ggaaguggugguucaagug

SEQ ID NO: 226839 - RNA, 19 nt, Homo sapiens
ugcaggagcucaacaagca

SEQ ID NO: 226840 - RNA, 19 nt, Homo sapiens
cgaguguggcuacaaguuu

SEQ ID NO: 226841 - RNA, 19 nt, Homo sapiens
gaggaagucaaauguaauc

SEQ ID NO: 226842 - RNA, 19 nt, Homo sapiens
ggaggaagucaaauguaau

SEQ ID NO: 226843 - RNA, 19 nt, Homo sapiens
gaaacccgaggacugcaaa

SEQ ID NO: 226844 - RNA, 19 nt, Homo sapiens
gaucaucgaggacgagaag

SEQ ID NO: 226845 - RNA, 19 nt, Homo sapiens
aaaaguuccucagcaaaua

SEQ ID NO: 226846 - RNA, 19 nt, Homo sapiens
gcccuucaguugcgaguuc

SEQ ID NO: 226847 - RNA, 19 nt, Homo sapiens
aaaggccaaucucaacaug

SEQ ID NO: 226848 - RNA, 19 nt, Homo sapiens
gggagaugcccuacaagug

SEQ ID NO: 226849 - RNA, 19 nt, Homo sapiens
ucaaagccguggagcaacu

SEQ ID NO: 226850 - RNA, 19 nt, Homo sapiens
gcagagccacaugaucaaa

SEQ ID NO: 226851 - RNA, 19 nt, Homo sapiens
gaaacauacuggggagaaa

SEQ ID NO: 226852 - RNA, 19 nt, Homo sapiens
gcaugaaccgcucggaaca

SEQ ID NO: 226853 - RNA, 19 nt, Homo sapiens
ugagaggccacacguaugu

SEQ ID NO: 226854 - RNA, 19 nt, Homo sapiens
gccaagcacaggaaugaga

SEQ ID NO: 226855 - RNA, 19 nt, Homo sapiens
agaagcuguuuguguguga

SEQ ID NO: 226856 - RNA, 19 nt, Homo sapiens
caggaggaagucaaaugua

SEQ ID NO: 226857 - RNA, 19 nt, Homo sapiens
ccaggaggaagucaaaugu

SEQ ID NO: 226858 - RNA, 19 nt, Homo sapiens
cggcaggcuuggaagaaga

SEQ ID NO: 226859 - RNA, 19 nt, Homo sapiens
uaaaccguguggcuuugga

SEQ ID NO: 226860 - RNA, 19 nt, Homo sapiens
aauaaaccguguggcuuug

SEQ ID NO: 226861 - RNA, 19 nt, Homo sapiens
aaugagaggccacacguau

SEQ ID NO: 226862 - RNA, 19 nt, Homo sapiens
ccucagcaaauauuaucua

SEQ ID NO: 226863 - RNA, 19 nt, Homo sapiens
gcugagaacagaaaaggua

SEQ ID NO: 226864 - RNA, 19 nt, Homo sapiens
gggagaagggccaguacug

SEQ ID NO: 226865 - RNA, 19 nt, Homo sapiens
uugcagagccacaugauca

SEQ ID NO: 226866 - RNA, 19 nt, Homo sapiens
ggacuugcagagccacaug

SEQ ID NO: 226867 - RNA, 19 nt, Homo sapiens
gggugcacauggugucuca

SEQ ID NO: 226868 - RNA, 19 nt, Homo sapiens
gaagcccggaauugcauga

SEQ ID NO: 226869 - RNA, 19 nt, Homo sapiens
gcaugaagcccggaauugc

SEQ ID NO: 226870 - RNA, 19 nt, Homo sapiens
cagcaguucaugcagaaga

SEQ ID NO: 226871 - RNA, 19 nt, Homo sapiens
cccagcaguucaugcagaa

SEQ ID NO: 226872 - RNA, 19 nt, Homo sapiens
gagacauuccgccgaagga

SEQ ID NO: 226873 - RNA, 19 nt, Homo sapiens
gccacaugaucaaacuuca

SEQ ID NO: 226874 - RNA, 19 nt, Homo sapiens
ucaacaagcagcgggagaa

SEQ ID NO: 226875 - RNA, 19 nt, Homo sapiens
gcaccgaguguggcuacaa

SEQ ID NO: 226876 - RNA, 19 nt, Homo sapiens
gcccagaggcagucauagu

SEQ ID NO: 226877 - RNA, 19 nt, Homo sapiens
cuucaaagccguggagcaa

SEQ ID NO: 226878 - RNA, 19 nt, Homo sapiens
aaaguuccucagcaaauau

SEQ ID NO: 226879 - RNA, 19 nt, Homo sapiens
cgaggacucugggucuagu

SEQ ID NO: 226880 - RNA, 19 nt, Homo sapiens
gcucggcggaggucauugu

SEQ ID NO: 226881 - RNA, 19 nt, Homo sapiens
ucaguugcgaguucuguga

SEQ ID NO: 226882 - RNA, 19 nt, Homo sapiens
aggccaaucucaacaugca

SEQ ID NO: 226883 - RNA, 19 nt, Homo sapiens
guggugagaagcuguuugu

SEQ ID NO: 226884 - RNA, 19 nt, Homo sapiens
gaaugccccacaugucaua

SEQ ID NO: 226885 - RNA, 19 nt, Homo sapiens
ugguucaaguggaggauga

SEQ ID NO: 226886 - RNA, 19 nt, Homo sapiens
gcaguaaugagugggaagu

SEQ ID NO: 226887 - RNA, 19 nt, Homo sapiens
caccgaguguggcuacaag

SEQ ID NO: 226888 - RNA, 19 nt, Homo sapiens
ugaacagccacgucaagga

SEQ ID NO: 226889 - RNA, 19 nt, Homo sapiens
caugaagcccggaauugca

SEQ ID NO: 226890 - RNA, 19 nt, Homo sapiens
ccucacagcuuguaaagug

SEQ ID NO: 226891 - RNA, 19 nt, Homo sapiens
caucauugcuggccugguu

SEQ ID NO: 226892 - RNA, 19 nt, Homo sapiens
gagauacaccugccaugug

SEQ ID NO: 226893 - RNA, 19 nt, Homo sapiens
gaacccuccuccugcuacu

SEQ ID NO: 226894 - RNA, 19 nt, Homo sapiens
gugaggagguggagagaca

SEQ ID NO: 226895 - RNA, 19 nt, Homo sapiens
ggaacacacagaucuacaa

SEQ ID NO: 226896 - RNA, 19 nt, Homo sapiens
gaacacacagaucuacaag

SEQ ID NO: 226897 - RNA, 19 nt, Homo sapiens
ccagggcucugaugugucu

SEQ ID NO: 226898 - RNA, 19 nt, Homo sapiens
gcugggcccuggguuucua

SEQ ID NO: 226899 - RNA, 19 nt, Homo sapiens
ccuacgacggcaaggauua

SEQ ID NO: 226900 - RNA, 19 nt, Homo sapiens
aggauuacaucgcccugaa

SEQ ID NO: 226901 - RNA, 19 nt, Homo sapiens
gaccggaacacacagaucu

SEQ ID NO: 226902 - RNA, 19 nt, Homo sapiens
uggccuggcuguccuagca

SEQ ID NO: 226903 - RNA, 19 nt, Homo sapiens
ugagaugggagccgucuuc

SEQ ID NO: 226904 - RNA, 19 nt, Homo sapiens
cccacuccaugagguauuu

SEQ ID NO: 226905 - RNA, 19 nt, Homo sapiens
uccaugagguauuucuaca

SEQ ID NO: 226906 - RNA, 19 nt, Homo sapiens
gcucccacuccaugaggua

SEQ ID NO: 226907 - RNA, 19 nt, Homo sapiens
ggacugagaugcaggauuu

SEQ ID NO: 226908 - RNA, 19 nt, Homo sapiens
gcaaauaaagaccugagaa

SEQ ID NO: 226909 - RNA, 19 nt, Homo sapiens
ccgaucaucuuuccuguuc

SEQ ID NO: 226910 - RNA, 19 nt, Homo sapiens
aggaagagcucagguggaa

SEQ ID NO: 226911 - RNA, 19 nt, Homo sapiens
auaaagaccugagaaccuu

SEQ ID NO: 226912 - RNA, 19 nt, Homo sapiens
gaccugagaaccuuccaaa

SEQ ID NO: 226913 - RNA, 19 nt, Homo sapiens
gaucaucuuuccuguucca

SEQ ID NO: 226914 - RNA, 19 nt, Homo sapiens
ccagggcucugaugagucu

SEQ ID NO: 226915 - RNA, 19 nt, Homo sapiens
gaagagcucagguggaaaa

SEQ ID NO: 226916 - RNA, 19 nt, Homo sapiens
gagcucagguggaaaagga

SEQ ID NO: 226917 - RNA, 19 nt, Homo sapiens
ugagguauuucuccacauc

SEQ ID NO: 226918 - RNA, 19 nt, Homo sapiens
caaauaaagaccugagaac

SEQ ID NO: 226919 - RNA, 19 nt, Homo sapiens
gagccucuggcaucucuuu

SEQ ID NO: 226920 - RNA, 19 nt, Homo sapiens
ccuacgacggcaaggauua

SEQ ID NO: 226921 - RNA, 19 nt, Homo sapiens
ugagagagcaaauaaagac

SEQ ID NO: 226922 - RNA, 19 nt, Homo sapiens
aggauuacaucgcccugaa

SEQ ID NO: 226923 - RNA, 19 nt, Homo sapiens
ugagaugcaggauuucuuc

SEQ ID NO: 226924 - RNA, 19 nt, Homo sapiens
cccacuccaugagguauuu

SEQ ID NO: 226925 - RNA, 19 nt, Homo sapiens
gaccaggccagcaggagau

SEQ ID NO: 226926 - RNA, 19 nt, Homo sapiens
gcucccacuccaugaggua

SEQ ID NO: 226927 - RNA, 19 nt, Homo sapiens
ccaaggagcugcgcugcua

SEQ ID NO: 226928 - RNA, 19 nt, Homo sapiens
cuacagauguuaccacuuc

SEQ ID NO: 226929 - RNA, 19 nt, Homo sapiens
ccucagaucugcuggagaa

SEQ ID NO: 226930 - RNA, 19 nt, Homo sapiens
gagcugcgcugcuacagau

SEQ ID NO: 226931 - RNA, 19 nt, Homo sapiens
ggaacgcacugcccucaga

SEQ ID NO: 226932 - RNA, 19 nt, Homo sapiens
gcauuguucucaucaucua

SEQ ID NO: 226933 - RNA, 19 nt, Homo sapiens
cagaucugcuggagaaugu

SEQ ID NO: 226934 - RNA, 19 nt, Homo sapiens
cagaguggccugccuauca

SEQ ID NO: 226935 - RNA, 19 nt, Homo sapiens
aaacagaggaugcucagau

SEQ ID NO: 226936 - RNA, 19 nt, Homo sapiens
gcaaauagggccaaaacuu

SEQ ID NO: 226937 - RNA, 19 nt, Homo sapiens
gggcauuguucucaucauc

SEQ ID NO: 226938 - RNA, 19 nt, Homo sapiens
gcaagaagguaugggucau

SEQ ID NO: 226939 - RNA, 19 nt, Homo sapiens
ugucucagcugucgaugga

SEQ ID NO: 226940 - RNA, 19 nt, Homo sapiens
aacagaggaugcucagauu

SEQ ID NO: 226941 - RNA, 19 nt, Homo sapiens
acacauuccugcacacagu

SEQ ID NO: 226942 - RNA, 19 nt, Homo sapiens
aagaagguaugggucauga

SEQ ID NO: 226943 - RNA, 19 nt, Homo sapiens
gaagguaugggucaugaac

SEQ ID NO: 226944 - RNA, 19 nt, Homo sapiens
cagaggaugcucagauuuc

SEQ ID NO: 226945 - RNA, 19 nt, Homo sapiens
cuacacagcaauugccuau

SEQ ID NO: 226946 - RNA, 19 nt, Homo sapiens
gagaugcuccugccauuuu

SEQ ID NO: 226947 - RNA, 19 nt, Homo sapiens
ggguguguguguagauuuc

SEQ ID NO: 226948 - RNA, 19 nt, Homo sapiens
ggacaucccuggggugugu

SEQ ID NO: 226949 - RNA, 19 nt, Homo sapiens
cgaaauugaccgcuacaca

SEQ ID NO: 226950 - RNA, 19 nt, Homo sapiens
caaauagggccaaaacuug

SEQ ID NO: 226951 - RNA, 19 nt, Homo sapiens
ugacugggcucaggaacag

SEQ ID NO: 226952 - RNA, 19 nt, Homo sapiens
ugaacuggcagcaucauuc

SEQ ID NO: 226953 - RNA, 19 nt, Homo sapiens
uccuaucgcugaaguguuc

SEQ ID NO: 226954 - RNA, 19 nt, Homo sapiens
gacauuuucuccugcauug

SEQ ID NO: 226955 - RNA, 19 nt, Homo sapiens
guaugggucaugaacagaa

SEQ ID NO: 226956 - RNA, 19 nt, Homo sapiens
ggaaggauuugggccuacu

SEQ ID NO: 226957 - RNA, 19 nt, Homo sapiens
ccacccaugcugacaguga

SEQ ID NO: 226958 - RNA, 19 nt, Homo sapiens
ccacaaggcaauaaaucuc

SEQ ID NO: 226959 - RNA, 19 nt, Homo sapiens
ugaagcuccuacuccaaug

SEQ ID NO: 226960 - RNA, 19 nt, Homo sapiens
gaacgcacugcccucagau

SEQ ID NO: 226961 - RNA, 19 nt, Homo sapiens
gaagcuccuacuccaaugu

SEQ ID NO: 226962 - RNA, 19 nt, Homo sapiens
caucaucgugggcauuguu

SEQ ID NO: 226963 - RNA, 19 nt, Homo sapiens
ccaggccuuuucuuacuua

SEQ ID NO: 226964 - RNA, 19 nt, Homo sapiens
ggagcugcgcugcuacaga

SEQ ID NO: 226965 - RNA, 19 nt, Homo sapiens
gccaaaacuugaugggaaa

SEQ ID NO: 226966 - RNA, 19 nt, Homo sapiens
cuucggccauccaaacaga

SEQ ID NO: 226967 - RNA, 19 nt, Homo sapiens
gcuggagaaugugcugugu

SEQ ID NO: 226968 - RNA, 19 nt, Homo sapiens
cacccaugcugacagugaa

SEQ ID NO: 226969 - RNA, 19 nt, Homo sapiens
caaggcaauaaaucucauu

SEQ ID NO: 226970 - RNA, 19 nt, Homo sapiens
acagaggaugcucagauuu

SEQ ID NO: 226971 - RNA, 19 nt, Homo sapiens
gaacuggcagcaucauucc

SEQ ID NO: 226972 - RNA, 19 nt, Homo sapiens
caagaagguaugggucaug

SEQ ID NO: 226973 - RNA, 19 nt, Homo sapiens
gaaggauuugggccuacuu

SEQ ID NO: 226974 - RNA, 19 nt, Homo sapiens
ggaccagcuuuucuucuuc

SEQ ID NO: 226975 - RNA, 19 nt, Homo sapiens
acuccaauguggccagaug

SEQ ID NO: 226976 - RNA, 19 nt, Homo sapiens
cagaugaccugcaaaacca

SEQ ID NO: 226977 - RNA, 19 nt, Homo sapiens
cacaaggcaauaaaucuca

SEQ ID NO: 226978 - RNA, 19 nt, Homo sapiens
guggccagaugaccugcaa

SEQ ID NO: 226979 - RNA, 19 nt, Homo sapiens
ucuccugcauugugacuca

SEQ ID NO: 226980 - RNA, 19 nt, Homo sapiens
ggaaggaacagauuuaaua

SEQ ID NO: 226981 - RNA, 19 nt, Homo sapiens
ggacuaugcuguaaccaaa

SEQ ID NO: 226982 - RNA, 19 nt, Homo sapiens
gcaccugucuguuggauga

SEQ ID NO: 226983 - RNA, 19 nt, Homo sapiens
ggaaagcaccugucuguug

SEQ ID NO: 226984 - RNA, 19 nt, Homo sapiens
ucagaaggauggcacauuu

SEQ ID NO: 226985 - RNA, 19 nt, Homo sapiens
gacauuaucuuggauccua

SEQ ID NO: 226986 - RNA, 19 nt, Homo sapiens
agaaggagauucaaacuca

SEQ ID NO: 226987 - RNA, 19 nt, Homo sapiens
gagcuggccacucuaguua

SEQ ID NO: 226988 - RNA, 19 nt, Homo sapiens
caaaggauuucacauacug

SEQ ID NO: 226989 - RNA, 19 nt, Homo sapiens
gacagcaacuggugauugu

SEQ ID NO: 226990 - RNA, 19 nt, Homo sapiens
gaaggagauucaaacucaa

SEQ ID NO: 226991 - RNA, 19 nt, Homo sapiens
uaucuuggauccuaugguu

SEQ ID NO: 226992 - RNA, 19 nt, Homo sapiens
gagcagagcaugaucacau

SEQ ID NO: 226993 - RNA, 19 nt, Homo sapiens
gcuggaaggaacagauuua

SEQ ID NO: 226994 - RNA, 19 nt, Homo sapiens
cugaauagcuuggcgaaug

SEQ ID NO: 226995 - RNA, 19 nt, Homo sapiens
ggacagcaacuggugauug

SEQ ID NO: 226996 - RNA, 19 nt, Homo sapiens
ucacagcaccucaaccaaa

SEQ ID NO: 226997 - RNA, 19 nt, Homo sapiens
gaacgggaagcuugucaug

SEQ ID NO: 226998 - RNA, 19 nt, Homo sapiens
ucagagaaauaaacuuugg

SEQ ID NO: 226999 - RNA, 19 nt, Homo sapiens
caagugagaaggagauuca

SEQ ID NO: 227000 - RNA, 19 nt, Homo sapiens
ggacacggccaccaucugu

SEQ ID NO: 227001 - RNA, 19 nt, Homo sapiens
ccucucccauuuagccuua

SEQ ID NO: 227002 - RNA, 19 nt, Homo sapiens
ugaauagcuuggcgaaugu

SEQ ID NO: 227003 - RNA, 19 nt, Homo sapiens
ggcagaauccuacaacuuc

SEQ ID NO: 227004 - RNA, 19 nt, Homo sapiens
gccaccaucugugcaagua

SEQ ID NO: 227005 - RNA, 19 nt, Homo sapiens
cagcaacuggugauuguuu

SEQ ID NO: 227006 - RNA, 19 nt, Homo sapiens
gauggcacauuuccuagag

SEQ ID NO: 227007 - RNA, 19 nt, Homo sapiens
ggagauucaaacucaauga

SEQ ID NO: 227008 - RNA, 19 nt, Homo sapiens
ggaagaacgggaagcuugu

SEQ ID NO: 227009 - RNA, 19 nt, Homo sapiens
ccaaaggauuucacauacu

SEQ ID NO: 227010 - RNA, 19 nt, Homo sapiens
gagcuggaaggaacagauu

SEQ ID NO: 227011 - RNA, 19 nt, Homo sapiens
gauggccccuugcgaauuu

SEQ ID NO: 227012 - RNA, 19 nt, Homo sapiens
ugaacucccggcaucuuua

SEQ ID NO: 227013 - RNA, 19 nt, Homo sapiens
cuccaaaggauuucacaua

SEQ ID NO: 227014 - RNA, 19 nt, Homo sapiens
ggacucccgugagcuggaa

SEQ ID NO: 227015 - RNA, 19 nt, Homo sapiens
ugggaugaauauaaucuga

SEQ ID NO: 227016 - RNA, 19 nt, Homo sapiens
cucaucaucuucucucuug

SEQ ID NO: 227017 - RNA, 19 nt, Homo sapiens
ccagacccucucccauuua

SEQ ID NO: 227018 - RNA, 19 nt, Homo sapiens
guggaaagcaccugucugu

SEQ ID NO: 227019 - RNA, 19 nt, Homo sapiens
uaccaugccucuccaacau

SEQ ID NO: 227020 - RNA, 19 nt, Homo sapiens
acuaugcuguaaccaaauu

SEQ ID NO: 227021 - RNA, 19 nt, Homo sapiens
accagacccucucccauuu

SEQ ID NO: 227022 - RNA, 19 nt, Homo sapiens
uaccagacccucucccauu

SEQ ID NO: 227023 - RNA, 19 nt, Homo sapiens
guccaauuauucagaagga

SEQ ID NO: 227024 - RNA, 19 nt, Homo sapiens
gggauccagaggagaauaa

SEQ ID NO: 227025 - RNA, 19 nt, Homo sapiens
cuuccuggguccaauuauu

SEQ ID NO: 227026 - RNA, 19 nt, Homo sapiens
gcuggccacucuaguuaca

SEQ ID NO: 227027 - RNA, 19 nt, Homo sapiens
uccaaaggauuucacauac

SEQ ID NO: 227028 - RNA, 19 nt, Homo sapiens
ugaggaagggaguuaaaga

SEQ ID NO: 227029 - RNA, 19 nt, Homo sapiens
gcuguaaccaaauuauugu

SEQ ID NO: 227030 - RNA, 19 nt, Homo sapiens
gaauuuggggugcugaaua

SEQ ID NO: 227031 - RNA, 19 nt, Homo sapiens
cgcaaugggcuucagaauu

SEQ ID NO: 227032 - RNA, 19 nt, Homo sapiens
cauacugcaucuccuucaa

SEQ ID NO: 227033 - RNA, 19 nt, Homo sapiens
gagauucaaacucaaugau

SEQ ID NO: 227034 - RNA, 19 nt, Homo sapiens
augcagacccugaagguuu

SEQ ID NO: 227035 - RNA, 19 nt, Homo sapiens
ccaauggagacuggacaua

SEQ ID NO: 227036 - RNA, 19 nt, Homo sapiens
gaugcuggccugcuaugug

SEQ ID NO: 227037 - RNA, 19 nt, Homo sapiens
gagaaggagauucaaacuc

SEQ ID NO: 227038 - RNA, 19 nt, Homo sapiens
ggauggcacauuuccuaga

SEQ ID NO: 227039 - RNA, 19 nt, Homo sapiens
cagacccucucccauuuag

SEQ ID NO: 227040 - RNA, 19 nt, Homo sapiens
uggcgaauguccucucaca

SEQ ID NO: 227041 - RNA, 19 nt, Homo sapiens
gaacucccggcaucuuuac

SEQ ID NO: 227042 - RNA, 19 nt, Homo sapiens
gggacuaugcuguaaccaa

SEQ ID NO: 227043 - RNA, 19 nt, Homo sapiens
aaucugaggaagggaguua

SEQ ID NO: 227044 - RNA, 19 nt, Homo sapiens
ucacauacugcaucuccuu

SEQ ID NO: 227045 - RNA, 19 nt, Homo sapiens
gauuucacauacugcaucu

SEQ ID NO: 227046 - RNA, 19 nt, Homo sapiens
auaguauucugcucagugu

SEQ ID NO: 227047 - RNA, 19 nt, Homo sapiens
ccugaagguuucugugucu

SEQ ID NO: 227048 - RNA, 19 nt, Homo sapiens
uuacagagcagagcaugau

SEQ ID NO: 227049 - RNA, 19 nt, Homo sapiens
acuaucacguggaggaaga

SEQ ID NO: 227050 - RNA, 19 nt, Homo sapiens
gcaacuggugauuguuuca

SEQ ID NO: 227051 - RNA, 19 nt, Homo sapiens
gaggaagggaguuaaagac

SEQ ID NO: 227052 - RNA, 19 nt, Homo sapiens
gcagagcaugaucacauuc

SEQ ID NO: 227053 - RNA, 19 nt, Homo sapiens
ccaugccucuccaacaucu

SEQ ID NO: 227054 - RNA, 19 nt, Homo sapiens
gaggcagaauccuacaacu

SEQ ID NO: 227055 - RNA, 19 nt, Homo sapiens
cgagggagccugugaugcu

SEQ ID NO: 227056 - RNA, 19 nt, Homo sapiens
gcugggacuccaaaggauu

SEQ ID NO: 227057 - RNA, 19 nt, Homo sapiens
gcgcaaugggcuucagaau

SEQ ID NO: 227058 - RNA, 19 nt, Homo sapiens
cacagcaccucaaccaaaa

SEQ ID NO: 227059 - RNA, 19 nt, Homo sapiens
gauccagaggagaauaaga

SEQ ID NO: 227060 - RNA, 19 nt, Homo sapiens
agcagagcaugaucacauu

SEQ ID NO: 227061 - RNA, 19 nt, Homo sapiens
gaggacagcaacuggugau

SEQ ID NO: 227062 - RNA, 19 nt, Homo sapiens
gcucucagugugccauaga

SEQ ID NO: 227063 - RNA, 19 nt, Homo sapiens
ccuacaacuuccacuccaa

SEQ ID NO: 227064 - RNA, 19 nt, Homo sapiens
cuucguggcccauguggaa

SEQ ID NO: 227065 - RNA, 19 nt, Homo sapiens
gccugggccucaucaucuu

SEQ ID NO: 227066 - RNA, 19 nt, Homo sapiens
ugcagacccugaagguuuc

SEQ ID NO: 227067 - RNA, 19 nt, Homo sapiens
caauggagacuggacauac

SEQ ID NO: 227068 - RNA, 19 nt, Homo sapiens
ccucauuccugggacuaug

SEQ ID NO: 227069 - RNA, 19 nt, Homo sapiens
uggguccaauuauucagaa

SEQ ID NO: 227070 - RNA, 19 nt, Homo sapiens
gaagaacgggaagcuuguc

SEQ ID NO: 227071 - RNA, 19 nt, Homo sapiens
gaaauggaaacgcagcaaa

SEQ ID NO: 227072 - RNA, 19 nt, Homo sapiens
gagcaccaguucaaguuca

SEQ ID NO: 227073 - RNA, 19 nt, Homo sapiens
agacccaggugaagauuug

SEQ ID NO: 227074 - RNA, 19 nt, Homo sapiens
gcaugauccugccuaagau

SEQ ID NO: 227075 - RNA, 19 nt, Homo sapiens
ggacgacgaggaccauuuc

SEQ ID NO: 227076 - RNA, 19 nt, Homo sapiens
aguucaaguucaacaagua

SEQ ID NO: 227077 - RNA, 19 nt, Homo sapiens
uaagaugcccgacuucaac

SEQ ID NO: 227078 - RNA, 19 nt, Homo sapiens
ugccuaagaugcccgacuu

SEQ ID NO: 227079 - RNA, 19 nt, Homo sapiens
gcaggaagcggagaaacag

SEQ ID NO: 227080 - RNA, 19 nt, Homo sapiens
gagacccaggugaagauuu

SEQ ID NO: 227081 - RNA, 19 nt, Homo sapiens
cuaagaugcccgacuucaa

SEQ ID NO: 227082 - RNA, 19 nt, Homo sapiens
caguucaaguucaacaagu

SEQ ID NO: 227083 - RNA, 19 nt, Homo sapiens
ggagcaccaguucaaguuc

SEQ ID NO: 227084 - RNA, 19 nt, Homo sapiens
ggaagcggagaaacagaag

SEQ ID NO: 227085 - RNA, 19 nt, Homo sapiens
uggagcaccaguucaaguu

SEQ ID NO: 227086 - RNA, 19 nt, Homo sapiens
ggacugagacugauuugau

SEQ ID NO: 227087 - RNA, 19 nt, Homo sapiens
caccaaggcugaccacaug

SEQ ID NO: 227088 - RNA, 19 nt, Homo sapiens
gacugagacugauuugauu

SEQ ID NO: 227089 - RNA, 19 nt, Homo sapiens
gauuaaagcaccagagugu

SEQ ID NO: 227090 - RNA, 19 nt, Homo sapiens
uagcuucccuucccauuca

SEQ ID NO: 227091 - RNA, 19 nt, Homo sapiens
uuaaagcaccagaguguaa

SEQ ID NO: 227092 - RNA, 19 nt, Homo sapiens
uaaaugcuuuggugguguu

SEQ ID NO: 227093 - RNA, 19 nt, Homo sapiens
gcucagugcccuuuaagug

SEQ ID NO: 227094 - RNA, 19 nt, Homo sapiens
gagacugauuugauuaaag

SEQ ID NO: 227095 - RNA, 19 nt, Homo sapiens
ccacacggacugagacuga

SEQ ID NO: 227096 - RNA, 19 nt, Homo sapiens
ccaugaauuugaugaggaa

SEQ ID NO: 227097 - RNA, 19 nt, Homo sapiens
uaaugauccuucugagaga

SEQ ID NO: 227098 - RNA, 19 nt, Homo sapiens
gggaucaacaucuguccua

SEQ ID NO: 227099 - RNA, 19 nt, Homo sapiens
gcccagaccagcuucuauu

SEQ ID NO: 227100 - RNA, 19 nt, Homo sapiens
gcaccguccucaucaucau

SEQ ID NO: 227101 - RNA, 19 nt, Homo sapiens
gguaaugauccuucugaga

SEQ ID NO: 227102 - RNA, 19 nt, Homo sapiens
gaccauuuguuccgcaagu

SEQ ID NO: 227103 - RNA, 19 nt, Homo sapiens
ugagugggaucaacaucug

SEQ ID NO: 227104 - RNA, 19 nt, Homo sapiens
agacugauuugauuaaagc

SEQ ID NO: 227105 - RNA, 19 nt, Homo sapiens
cagccgaggacgucuauga

SEQ ID NO: 227106 - RNA, 19 nt, Homo sapiens
caacacacacacacauucu

SEQ ID NO: 227107 - RNA, 19 nt, Homo sapiens
acacacacacacauucuug

SEQ ID NO: 227108 - RNA, 19 nt, Homo sapiens
cagguaaugauccuucuga

SEQ ID NO: 227109 - RNA, 19 nt, Homo sapiens
cauucuugcucuacccaaa

SEQ ID NO: 227110 - RNA, 19 nt, Homo sapiens
cgugcucagugcccuuuaa

SEQ ID NO: 227111 - RNA, 19 nt, Homo sapiens
caaagcccaucuggacauc

SEQ ID NO: 227112 - RNA, 19 nt, Homo sapiens
gccugaguuuggugacuuu

SEQ ID NO: 227113 - RNA, 19 nt, Homo sapiens
ccaacauccucaucugcau

SEQ ID NO: 227114 - RNA, 19 nt, Homo sapiens
cuacggacccgccuucuac

SEQ ID NO: 227115 - RNA, 19 nt, Homo sapiens
ugcagauccucauggguuu

SEQ ID NO: 227116 - RNA, 19 nt, Homo sapiens
gcgccacuccucaggcauu

SEQ ID NO: 227117 - RNA, 19 nt, Homo sapiens
caucguggacaacaucuuc

SEQ ID NO: 227118 - RNA, 19 nt, Homo sapiens
ucaacacacacacacauuc

SEQ ID NO: 227119 - RNA, 19 nt, Homo sapiens
caucaucaugggcacauau

SEQ ID NO: 227120 - RNA, 19 nt, Homo sapiens
gagcuccaggugccuauuc

SEQ ID NO: 227121 - RNA, 19 nt, Homo sapiens
ccgcugugcugacuuugag

SEQ ID NO: 227122 - RNA, 19 nt, Homo sapiens
gauccucauggguuuguga

SEQ ID NO: 227123 - RNA, 19 nt, Homo sapiens
gagacacccugcagauccu

SEQ ID NO: 227124 - RNA, 19 nt, Homo sapiens
ccaccaaggcugaccacau

SEQ ID NO: 227125 - RNA, 19 nt, Homo sapiens
ucaaagcccaucuggacau

SEQ ID NO: 227126 - RNA, 19 nt, Homo sapiens
acugagacugauuugauua

SEQ ID NO: 227127 - RNA, 19 nt, Homo sapiens
uaaagcaccagaguguaau

SEQ ID NO: 227128 - RNA, 19 nt, Homo sapiens
cugagacugauuugauuaa

SEQ ID NO: 227129 - RNA, 19 nt, Homo sapiens
ugaauuugaugaggaacag

SEQ ID NO: 227130 - RNA, 19 nt, Homo sapiens
gaagacaaaugcucaggua

SEQ ID NO: 227131 - RNA, 19 nt, Homo sapiens
gguagucacuguuuccuuu

SEQ ID NO: 227132 - RNA, 19 nt, Homo sapiens
agaaaugacuccugaacuu

SEQ ID NO: 227133 - RNA, 19 nt, Homo sapiens
gcuaagggcucagaaagga

SEQ ID NO: 227134 - RNA, 19 nt, Homo sapiens
gcacagacucuccagaaga

SEQ ID NO: 227135 - RNA, 19 nt, Homo sapiens
gaaaugacuccugaacuug

SEQ ID NO: 227136 - RNA, 19 nt, Homo sapiens
aggcaaaggcugacuguua

SEQ ID NO: 227137 - RNA, 19 nt, Homo sapiens
ggaggaguauguacguuuc

SEQ ID NO: 227138 - RNA, 19 nt, Homo sapiens
ggaggagcccgaacugauu

SEQ ID NO: 227139 - RNA, 19 nt, Homo sapiens
ggucaauguucugggaaua

SEQ ID NO: 227140 - RNA, 19 nt, Homo sapiens
gcucagaaaggauauguga

SEQ ID NO: 227141 - RNA, 19 nt, Homo sapiens
caagggcauuguccagaaa

SEQ ID NO: 227142 - RNA, 19 nt, Homo sapiens
ccaagggcauuguccagaa

SEQ ID NO: 227143 - RNA, 19 nt, Homo sapiens
ugaagaggcugacgauuuu

SEQ ID NO: 227144 - RNA, 19 nt, Homo sapiens
gaauggagacuggaccuuu

SEQ ID NO: 227145 - RNA, 19 nt, Homo sapiens
aaccagaggugacagugua

SEQ ID NO: 227146 - RNA, 19 nt, Homo sapiens
ggaaucgucauccagcuaa

SEQ ID NO: 227147 - RNA, 19 nt, Homo sapiens
ggagcucuguguucugaga

SEQ ID NO: 227148 - RNA, 19 nt, Homo sapiens
ggcaaaggcugacuguuac

SEQ ID NO: 227149 - RNA, 19 nt, Homo sapiens
gucaugaucuccaaagcuu

SEQ ID NO: 227150 - RNA, 19 nt, Homo sapiens
guccagcccuacuccuaua

SEQ ID NO: 227151 - RNA, 19 nt, Homo sapiens
cugaagaggcugacgauuu

SEQ ID NO: 227152 - RNA, 19 nt, Homo sapiens
ggagagagcuggggucaug

SEQ ID NO: 227153 - RNA, 19 nt, Homo sapiens
gcucagguagucacuguuu

SEQ ID NO: 227154 - RNA, 19 nt, Homo sapiens
gacaaaugcucagguaguc

SEQ ID NO: 227155 - RNA, 19 nt, Homo sapiens
uaagggcucagaaaggaua

SEQ ID NO: 227156 - RNA, 19 nt, Homo sapiens
ucaagugguuccugaaugg

SEQ ID NO: 227157 - RNA, 19 nt, Homo sapiens
guauguacguuucgacagu

SEQ ID NO: 227158 - RNA, 19 nt, Homo sapiens
cuccaaagcuuucugucuu

SEQ ID NO: 227159 - RNA, 19 nt, Homo sapiens
ccacuggcccuaucaggaa

SEQ ID NO: 227160 - RNA, 19 nt, Homo sapiens
ggugguggcucugcuagug

SEQ ID NO: 227161 - RNA, 19 nt, Homo sapiens
cagaaaaggugcaguuugu

SEQ ID NO: 227162 - RNA, 19 nt, Homo sapiens
augcuaagguccucacuga

SEQ ID NO: 227163 - RNA, 19 nt, Homo sapiens
gaucaagugguuccugaau

SEQ ID NO: 227164 - RNA, 19 nt, Homo sapiens
uaacuuggaggaguaugua

SEQ ID NO: 227165 - RNA, 19 nt, Homo sapiens
gcuaagguccucacugaag

SEQ ID NO: 227166 - RNA, 19 nt, Homo sapiens
acaccugccuugucgauca

SEQ ID NO: 227167 - RNA, 19 nt, Homo sapiens
cugcugcacugcucuguga

SEQ ID NO: 227168 - RNA, 19 nt, Homo sapiens
gaaguagugaugaguaguc

SEQ ID NO: 227169 - RNA, 19 nt, Homo sapiens
uauaagucaugaucuccaa

SEQ ID NO: 227170 - RNA, 19 nt, Homo sapiens
cacugaagcuucucucucu

SEQ ID NO: 227171 - RNA, 19 nt, Homo sapiens
gcucugcuagugaaucuga

SEQ ID NO: 227172 - RNA, 19 nt, Homo sapiens
gcccuacuccuauaaguca

SEQ ID NO: 227173 - RNA, 19 nt, Homo sapiens
agacuguggugaugcuaga

SEQ ID NO: 227174 - RNA, 19 nt, Homo sapiens
gggaaucgucauccagcua

SEQ ID NO: 227175 - RNA, 19 nt, Homo sapiens
gaacuuggacaugucuaca

SEQ ID NO: 227176 - RNA, 19 nt, Homo sapiens
gagcagacaggccguggau

SEQ ID NO: 227177 - RNA, 19 nt, Homo sapiens
aaagcuuucugucuuccaa

SEQ ID NO: 227178 - RNA, 19 nt, Homo sapiens
gguccucacugaagcuucu

SEQ ID NO: 227179 - RNA, 19 nt, Homo sapiens
auaucaagaucaagugguu

SEQ ID NO: 227180 - RNA, 19 nt, Homo sapiens
ucuggagccugaaguagug

SEQ ID NO: 227181 - RNA, 19 nt, Homo sapiens
ggacagaaaaggugcaguu

SEQ ID NO: 227182 - RNA, 19 nt, Homo sapiens
ucuuuaacuuggaggagua

SEQ ID NO: 227183 - RNA, 19 nt, Homo sapiens
cuggagcucuguguucuga

SEQ ID NO: 227184 - RNA, 19 nt, Homo sapiens
gaggagcccgaacugauuc

SEQ ID NO: 227185 - RNA, 19 nt, Homo sapiens
auaacucucuucccugauc

SEQ ID NO: 227186 - RNA, 19 nt, Homo sapiens
cgauuuuacugucucauuu

SEQ ID NO: 227187 - RNA, 19 nt, Homo sapiens
aauggagacuggaccuuuc

SEQ ID NO: 227188 - RNA, 19 nt, Homo sapiens
agacaaaugcucagguagu

SEQ ID NO: 227189 - RNA, 19 nt, Homo sapiens
ggcacagacucuccagaag

SEQ ID NO: 227190 - RNA, 19 nt, Homo sapiens
guggugaugcuagaaauga

SEQ ID NO: 227191 - RNA, 19 nt, Homo sapiens
ggagacuggaccuuucaga

SEQ ID NO: 227192 - RNA, 19 nt, Homo sapiens
ccacccaucugcccuucuc

SEQ ID NO: 227193 - RNA, 19 nt, Homo sapiens
gguccagcccuacuccuau

SEQ ID NO: 227194 - RNA, 19 nt, Homo sapiens
aaacuccccugagaccuua

SEQ ID NO: 227195 - RNA, 19 nt, Homo sapiens
gcucuguguucugagauca

SEQ ID NO: 227196 - RNA, 19 nt, Homo sapiens
cuacuccuauaagucauga

SEQ ID NO: 227197 - RNA, 19 nt, Homo sapiens
ccugaaguagugaugagua

SEQ ID NO: 227198 - RNA, 19 nt, Homo sapiens
cagcuaagggcucagaaag

SEQ ID NO: 227199 - RNA, 19 nt, Homo sapiens
ccagcuaagggcucagaaa

SEQ ID NO: 227200 - RNA, 19 nt, Homo sapiens
caugaucuccaaagcuuuc

SEQ ID NO: 227201 - RNA, 19 nt, Homo sapiens
gucaauguucugggaauaa

SEQ ID NO: 227202 - RNA, 19 nt, Homo sapiens
gcaguuuguggucagauuc

SEQ ID NO: 227203 - RNA, 19 nt, Homo sapiens
caaaggcugacuguuacuu

SEQ ID NO: 227204 - RNA, 19 nt, Homo sapiens
uccaaagcuuucugucuuc

SEQ ID NO: 227205 - RNA, 19 nt, Homo sapiens
gaucuccaaagcuuucugu

SEQ ID NO: 227206 - RNA, 19 nt, Homo sapiens
cugaaguagugaugaguag

SEQ ID NO: 227207 - RNA, 19 nt, Homo sapiens
uggaggaguauguacguuu

SEQ ID NO: 227208 - RNA, 19 nt, Homo sapiens
ucaauguucugggaauaac

SEQ ID NO: 227209 - RNA, 19 nt, Homo sapiens
guacguuucgacagugaug

SEQ ID NO: 227210 - RNA, 19 nt, Homo sapiens
gaaucgucauccagcuaag

SEQ ID NO: 227211 - RNA, 19 nt, Homo sapiens
ccacuccugcaccagcaua

SEQ ID NO: 227212 - RNA, 19 nt, Homo sapiens
cagcccuacuccuauaagu

SEQ ID NO: 227213 - RNA, 19 nt, Homo sapiens
gaaacuccccugagaccuu

SEQ ID NO: 227214 - RNA, 19 nt, Homo sapiens
aaggcugacuguuacuuca

SEQ ID NO: 227215 - RNA, 19 nt, Homo sapiens
gauaugugaggacgcagau

SEQ ID NO: 227216 - RNA, 19 nt, Homo sapiens
cuccugaacuuggacaugu

SEQ ID NO: 227217 - RNA, 19 nt, Homo sapiens
aggcacagacucuccagaa

SEQ ID NO: 227218 - RNA, 19 nt, Homo sapiens
caaccagaggugacagugu

SEQ ID NO: 227219 - RNA, 19 nt, Homo sapiens
cuacguguacaucauuaau

SEQ ID NO: 227220 - RNA, 19 nt, Homo sapiens
uggcauugcagccuuccua

SEQ ID NO: 227221 - RNA, 19 nt, Homo sapiens
gugacaguguacccagaga

SEQ ID NO: 227222 - RNA, 19 nt, Homo sapiens
gagauuauccuuucauuga

SEQ ID NO: 227223 - RNA, 19 nt, Homo sapiens
gaagaggacuuaggagaga

SEQ ID NO: 227224 - RNA, 19 nt, Homo sapiens
gaagacagaauguuccaua

SEQ ID NO: 227225 - RNA, 19 nt, Homo sapiens
gacagaauguuccauauca

SEQ ID NO: 227226 - RNA, 19 nt, Homo sapiens
gcaccguccucaucauaaa

SEQ ID NO: 227227 - RNA, 19 nt, Homo sapiens
gauuacagcuuccacaagu

SEQ ID NO: 227228 - RNA, 19 nt, Homo sapiens
aagaugagauguucuaugu

SEQ ID NO: 227229 - RNA, 19 nt, Homo sapiens
gaccaugugucaacuuaug

SEQ ID NO: 227230 - RNA, 19 nt, Homo sapiens
ucacagucaucaauuauag

SEQ ID NO: 227231 - RNA, 19 nt, Homo sapiens
uggcuaacauugcuauauu

SEQ ID NO: 227232 - RNA, 19 nt, Homo sapiens
caacuugaauaccuugauc

SEQ ID NO: 227233 - RNA, 19 nt, Homo sapiens
aagcagucauuccuuagua

SEQ ID NO: 227234 - RNA, 19 nt, Homo sapiens
gaacagaagaggacuuagg

SEQ ID NO: 227235 - RNA, 19 nt, Homo sapiens
cggaccaugugucaacuua

SEQ ID NO: 227236 - RNA, 19 nt, Homo sapiens
gaagaugagauguucuaug

SEQ ID NO: 227237 - RNA, 19 nt, Homo sapiens
ggagauuauccuuucauug

SEQ ID NO: 227238 - RNA, 19 nt, Homo sapiens
ccuucaagcucuguccuua

SEQ ID NO: 227239 - RNA, 19 nt, Homo sapiens
gggcaccguccucaucaua

SEQ ID NO: 227240 - RNA, 19 nt, Homo sapiens
ggcuaacauugcuauauug

SEQ ID NO: 227241 - RNA, 19 nt, Homo sapiens
ugaugaagaugagauguuc

SEQ ID NO: 227242 - RNA, 19 nt, Homo sapiens
gcagucauuccuuaguaaa

SEQ ID NO: 227243 - RNA, 19 nt, Homo sapiens
uccauuaccugaccuuugu

SEQ ID NO: 227244 - RNA, 19 nt, Homo sapiens
gcuaacauugcuauauuga

SEQ ID NO: 227245 - RNA, 19 nt, Homo sapiens
cuguaaaggugacaaaaua

SEQ ID NO: 227246 - RNA, 19 nt, Homo sapiens
ugaauuugaugaagaugag

SEQ ID NO: 227247 - RNA, 19 nt, Homo sapiens
acaacaacuugaauaccuu

SEQ ID NO: 227248 - RNA, 19 nt, Homo sapiens
aagacagaauguuccauau

SEQ ID NO: 227249 - RNA, 19 nt, Homo sapiens
cauaaagucucugcguucu

SEQ ID NO: 227250 - RNA, 19 nt, Homo sapiens
caugcgcccugaagacaga

SEQ ID NO: 227251 - RNA, 19 nt, Homo sapiens
caucaaggcggaccaugug

SEQ ID NO: 227252 - RNA, 19 nt, Homo sapiens
cagaauguuccauaucaga

SEQ ID NO: 227253 - RNA, 19 nt, Homo sapiens
ccugugaaauacuguaaag

SEQ ID NO: 227254 - RNA, 19 nt, Homo sapiens
ucagagcugugaucuugag

SEQ ID NO: 227255 - RNA, 19 nt, Homo sapiens
ucuggcaucuggaggaguu

SEQ ID NO: 227256 - RNA, 19 nt, Homo sapiens
caacaugcgcccugaagac

SEQ ID NO: 227257 - RNA, 19 nt, Homo sapiens
acccucaucugccacauug

SEQ ID NO: 227258 - RNA, 19 nt, Homo sapiens
gaacuccagcugcccuaca

SEQ ID NO: 227259 - RNA, 19 nt, Homo sapiens
cugaacagaagaggacuua

SEQ ID NO: 227260 - RNA, 19 nt, Homo sapiens
caaggcggaccauguguca

SEQ ID NO: 227261 - RNA, 19 nt, Homo sapiens
gucauuccuuaguaaaguu

SEQ ID NO: 227262 - RNA, 19 nt, Homo sapiens
gauguucuauguggaucug

SEQ ID NO: 227263 - RNA, 19 nt, Homo sapiens
gaacagauuacagcuucca

SEQ ID NO: 227264 - RNA, 19 nt, Homo sapiens
gaacaacaacuugaauacc

SEQ ID NO: 227265 - RNA, 19 nt, Homo sapiens
agcagucauuccuuaguaa

SEQ ID NO: 227266 - RNA, 19 nt, Homo sapiens
ggcaccguccucaucauaa

SEQ ID NO: 227267 - RNA, 19 nt, Homo sapiens
ccaagagccaauccagaug

SEQ ID NO: 227268 - RNA, 19 nt, Homo sapiens
cagauuacagcuuccacaa

SEQ ID NO: 227269 - RNA, 19 nt, Homo sapiens
ugaacaacaacuugaauac

SEQ ID NO: 227270 - RNA, 19 nt, Homo sapiens
aacaacaacuugaauaccu

SEQ ID NO: 227271 - RNA, 19 nt, Homo sapiens
uucaagcucuguccuuauc

SEQ ID NO: 227272 - RNA, 19 nt, Homo sapiens
cccaagagccaauccagau

SEQ ID NO: 227273 - RNA, 19 nt, Homo sapiens
gcuuccacaaguuccauua

SEQ ID NO: 227274 - RNA, 19 nt, Homo sapiens
ccagaacagauuacagcuu

SEQ ID NO: 227275 - RNA, 19 nt, Homo sapiens
agucauuccuuaguaaagu

SEQ ID NO: 227276 - RNA, 19 nt, Homo sapiens
gaauugcugacccuucaag

SEQ ID NO: 227277 - RNA, 19 nt, Homo sapiens
agacagaauguuccauauc

SEQ ID NO: 227278 - RNA, 19 nt, Homo sapiens
ugugaaauacuguaaaggu

SEQ ID NO: 227279 - RNA, 19 nt, Homo sapiens
uuacagcuuccacaaguuc

SEQ ID NO: 227280 - RNA, 19 nt, Homo sapiens
ggaccaugugucaacuuau

SEQ ID NO: 227281 - RNA, 19 nt, Homo sapiens
ggaaagaagagaaccauga

SEQ ID NO: 227282 - RNA, 19 nt, Homo sapiens
ccaccaaccugauccguaa

SEQ ID NO: 227283 - RNA, 19 nt, Homo sapiens
ccacuauucuuaacuauuc

SEQ ID NO: 227284 - RNA, 19 nt, Homo sapiens
caacgaggaucugcauaaa

SEQ ID NO: 227285 - RNA, 19 nt, Homo sapiens
gaaagaagagaaccaugaa

SEQ ID NO: 227286 - RNA, 19 nt, Homo sapiens
gaaguuaaaugaacaucag

SEQ ID NO: 227287 - RNA, 19 nt, Homo sapiens
ucucagaccacuauucuua

SEQ ID NO: 227288 - RNA, 19 nt, Homo sapiens
ccacagcacuaauucaaca

SEQ ID NO: 227289 - RNA, 19 nt, Homo sapiens
gcaggaaugcuacgcguuu

SEQ ID NO: 227290 - RNA, 19 nt, Homo sapiens
uuagugcccucauccauuu

SEQ ID NO: 227291 - RNA, 19 nt, Homo sapiens
gacaguaggaguuaauaaa

SEQ ID NO: 227292 - RNA, 19 nt, Homo sapiens
ccaagaaguugcucugaag

SEQ ID NO: 227293 - RNA, 19 nt, Homo sapiens
gccaagaaguugcucugaa

SEQ ID NO: 227294 - RNA, 19 nt, Homo sapiens
cugcaaaucugccugauag

SEQ ID NO: 227295 - RNA, 19 nt, Homo sapiens
agaccacuauucuuaacua

SEQ ID NO: 227296 - RNA, 19 nt, Homo sapiens
ggggauauguuaacuauug

SEQ ID NO: 227297 - RNA, 19 nt, Homo sapiens
caguaggaguuaauaaaga

SEQ ID NO: 227298 - RNA, 19 nt, Homo sapiens
gggccacuccagagaauua

SEQ ID NO: 227299 - RNA, 19 nt, Homo sapiens
ggaaggcacagucugauuc

SEQ ID NO: 227300 - RNA, 19 nt, Homo sapiens
gcacuaauucaacauauac

SEQ ID NO: 227301 - RNA, 19 nt, Homo sapiens
gcaaaucugccugauagga

SEQ ID NO: 227302 - RNA, 19 nt, Homo sapiens
acgaggaucugcauaaaca

SEQ ID NO: 227303 - RNA, 19 nt, Homo sapiens
ucaacgaggaucugcauaa

SEQ ID NO: 227304 - RNA, 19 nt, Homo sapiens
caggaaugcuacgcguuua

SEQ ID NO: 227305 - RNA, 19 nt, Homo sapiens
gagagcauguuuuaucauu

SEQ ID NO: 227306 - RNA, 19 nt, Homo sapiens
ggauacugcugccaagaag

SEQ ID NO: 227307 - RNA, 19 nt, Homo sapiens
gcacaggaggagcaagaaa

SEQ ID NO: 227308 - RNA, 19 nt, Homo sapiens
acacaugacacucuucuga

SEQ ID NO: 227309 - RNA, 19 nt, Homo sapiens
gaaaauggggauauguuaa

SEQ ID NO: 227310 - RNA, 19 nt, Homo sapiens
cagcacuaauucaacauau

SEQ ID NO: 227311 - RNA, 19 nt, Homo sapiens
gaccacuauucuuaacuau

SEQ ID NO: 227312 - RNA, 19 nt, Homo sapiens
gaagagaaccaugaaaaug

SEQ ID NO: 227313 - RNA, 19 nt, Homo sapiens
agaaguugcucugaaguca

SEQ ID NO: 227314 - RNA, 19 nt, Homo sapiens
gcauucaaguccgaugguu

SEQ ID NO: 227315 - RNA, 19 nt, Homo sapiens
acaugacacucuucugaau

SEQ ID NO: 227316 - RNA, 19 nt, Homo sapiens
gcucugacggcguuacuga

SEQ ID NO: 227317 - RNA, 19 nt, Homo sapiens
ccaaccauguucccuucuu

SEQ ID NO: 227318 - RNA, 19 nt, Homo sapiens
gagcaagaaaguucaacga

SEQ ID NO: 227319 - RNA, 19 nt, Homo sapiens
caaguuuagugcccucauc

SEQ ID NO: 227320 - RNA, 19 nt, Homo sapiens
cuucugaauugacuguauu

SEQ ID NO: 227321 - RNA, 19 nt, Homo sapiens
gcagggccacuccagagaa

SEQ ID NO: 227322 - RNA, 19 nt, Homo sapiens
gggauauguuaacuauugu

SEQ ID NO: 227323 - RNA, 19 nt, Homo sapiens
aaacauaggaaagaagaga

SEQ ID NO: 227324 - RNA, 19 nt, Homo sapiens
ggaaugcuacgcguuuaau

SEQ ID NO: 227325 - RNA, 19 nt, Homo sapiens
ccugauaggacccauauuc

SEQ ID NO: 227326 - RNA, 19 nt, Homo sapiens
augacacucuucugaauug

SEQ ID NO: 227327 - RNA, 19 nt, Homo sapiens
cugcagcucuuuucauuuu

SEQ ID NO: 227328 - RNA, 19 nt, Homo sapiens
guagacaguaggaguuaau

SEQ ID NO: 227329 - RNA, 19 nt, Homo sapiens
uuacugagagcauguuuua

SEQ ID NO: 227330 - RNA, 19 nt, Homo sapiens
cauauucccacagcacuaa

SEQ ID NO: 227331 - RNA, 19 nt, Homo sapiens
gacugcagcucuuuucauu

SEQ ID NO: 227332 - RNA, 19 nt, Homo sapiens
gaaugcuacgcguuuaaug

SEQ ID NO: 227333 - RNA, 19 nt, Homo sapiens
caugaugguucugcagguu

SEQ ID NO: 227334 - RNA, 19 nt, Homo sapiens
agacaguaggaguuaauaa

SEQ ID NO: 227335 - RNA, 19 nt, Homo sapiens
gaaggcacagucugauucu

SEQ ID NO: 227336 - RNA, 19 nt, Homo sapiens
caugacacucuucugaauu

SEQ ID NO: 227337 - RNA, 19 nt, Homo sapiens
ugaaaauggggauauguua

SEQ ID NO: 227338 - RNA, 19 nt, Homo sapiens
gguuuaaacauaggaaaga

SEQ ID NO: 227339 - RNA, 19 nt, Homo sapiens
caaagcacuguuucucuca

SEQ ID NO: 227340 - RNA, 19 nt, Homo sapiens
gaaaguucaacgaggaucu

SEQ ID NO: 227341 - RNA, 19 nt, Homo sapiens
cagggccacuccagagaau

SEQ ID NO: 227342 - RNA, 19 nt, Homo sapiens
aaagaagagaaccaugaaa

SEQ ID NO: 227343 - RNA, 19 nt, Homo sapiens
gagcauguuuuaucauuac

SEQ ID NO: 227344 - RNA, 19 nt, Homo sapiens
ucagaccacuauucuuaac

SEQ ID NO: 227345 - RNA, 19 nt, Homo sapiens
uaguagacaguaggaguua

SEQ ID NO: 227346 - RNA, 19 nt, Homo sapiens
gaauggacaggaggaaaca

SEQ ID NO: 227347 - RNA, 19 nt, Homo sapiens
ucacugggccuccaaccau

SEQ ID NO: 227348 - RNA, 19 nt, Homo sapiens
ggaggagcaagaaaguuca

SEQ ID NO: 227349 - RNA, 19 nt, Homo sapiens
guccgaugguuccugaaug

SEQ ID NO: 227350 - RNA, 19 nt, Homo sapiens
ugacacucuucugaauuga

SEQ ID NO: 227351 - RNA, 19 nt, Homo sapiens
cacaugacacucuucugaa

SEQ ID NO: 227352 - RNA, 19 nt, Homo sapiens
ugaugguucugcagguuuc

SEQ ID NO: 227353 - RNA, 19 nt, Homo sapiens
acagcacuaauucaacaua

SEQ ID NO: 227354 - RNA, 19 nt, Homo sapiens
acaguaggaguuaauaaag

SEQ ID NO: 227355 - RNA, 19 nt, Homo sapiens
auacugcugccaagaaguu

SEQ ID NO: 227356 - RNA, 19 nt, Homo sapiens
ggaguuaauaaagaaguuc

SEQ ID NO: 227357 - RNA, 19 nt, Homo sapiens
caagaaguugcucugaagu

SEQ ID NO: 227358 - RNA, 19 nt, Homo sapiens
ccauauucccacagcacua

SEQ ID NO: 227359 - RNA, 19 nt, Homo sapiens
uagacaguaggaguuaaua

SEQ ID NO: 227360 - RNA, 19 nt, Homo sapiens
gaggagcaagaaaguucaa

SEQ ID NO: 227361 - RNA, 19 nt, Homo sapiens
caaccugauccguaaugga

SEQ ID NO: 227362 - RNA, 19 nt, Homo sapiens
gaauggacuugcuaaauga

SEQ ID NO: 227363 - RNA, 19 nt, Homo sapiens
aaacacaacuugaacauca

SEQ ID NO: 227364 - RNA, 19 nt, Homo sapiens
gaaggugcaucgccaucua

SEQ ID NO: 227365 - RNA, 19 nt, Homo sapiens
agaauggacuugcuaaaug

SEQ ID NO: 227366 - RNA, 19 nt, Homo sapiens
ccaguacacccaugaauuu

SEQ ID NO: 227367 - RNA, 19 nt, Homo sapiens
gaagaauggacuugcuaaa

SEQ ID NO: 227368 - RNA, 19 nt, Homo sapiens
guacacccaugaauuugau

SEQ ID NO: 227369 - RNA, 19 nt, Homo sapiens
caacuugaacaucaugauu

SEQ ID NO: 227370 - RNA, 19 nt, Homo sapiens
ccaaggaagcaauaaauuc

SEQ ID NO: 227371 - RNA, 19 nt, Homo sapiens
gcagaagaauggacuugcu

SEQ ID NO: 227372 - RNA, 19 nt, Homo sapiens
gccaguacacccaugaauu

SEQ ID NO: 227373 - RNA, 19 nt, Homo sapiens
auuaaacgcuacaacucua

SEQ ID NO: 227374 - RNA, 19 nt, Homo sapiens
gauuaaacgcuacaacucu

SEQ ID NO: 227375 - RNA, 19 nt, Homo sapiens
cagaagaauggacuugcua

SEQ ID NO: 227376 - RNA, 19 nt, Homo sapiens
ugaauuugauggagaugag

SEQ ID NO: 227377 - RNA, 19 nt, Homo sapiens
gagcagaagaauggacuug

SEQ ID NO: 227378 - RNA, 19 nt, Homo sapiens
gagugaucauuccuucuuc

SEQ ID NO: 227379 - RNA, 19 nt, Homo sapiens
ggacuugcuaaaugaccua

SEQ ID NO: 227380 - RNA, 19 nt, Homo sapiens
agaagaauggacuugcuaa

SEQ ID NO: 227381 - RNA, 19 nt, Homo sapiens
aagaauggacuugcuaaau

SEQ ID NO: 227382 - RNA, 19 nt, Homo sapiens
uacaggagcagaagaaugg

SEQ ID NO: 227383 - RNA, 19 nt, Homo sapiens
caaggccugcguucaguug

SEQ ID NO: 227384 - RNA, 19 nt, Homo sapiens
acacugggagccugagauu

SEQ ID NO: 227385 - RNA, 19 nt, Homo sapiens
agagugaucauuccuucuu

SEQ ID NO: 227386 - RNA, 19 nt, Homo sapiens
cuacaggagcagaagaaug

SEQ ID NO: 227387 - RNA, 19 nt, Homo sapiens
ccaagagugaucauuccuu

SEQ ID NO: 227388 - RNA, 19 nt, Homo sapiens
uccaaggaagcaauaaauu

SEQ ID NO: 227389 - RNA, 19 nt, Homo sapiens
uuccugaggucacaguguu

SEQ ID NO: 227390 - RNA, 19 nt, Homo sapiens
ccaguacacccaugaauuu

SEQ ID NO: 227391 - RNA, 19 nt, Homo sapiens
gaaauauggcugugggaaa

SEQ ID NO: 227392 - RNA, 19 nt, Homo sapiens
aaacacaccuuggaauuca

SEQ ID NO: 227393 - RNA, 19 nt, Homo sapiens
cagagugcacugagaaaua

SEQ ID NO: 227394 - RNA, 19 nt, Homo sapiens
guacacccaugaauuugau

SEQ ID NO: 227395 - RNA, 19 nt, Homo sapiens
gaaaacacaccuuggaauu

SEQ ID NO: 227396 - RNA, 19 nt, Homo sapiens
agagugcacugagaaauau

SEQ ID NO: 227397 - RNA, 19 nt, Homo sapiens
cauuguggcugaccauguu

SEQ ID NO: 227398 - RNA, 19 nt, Homo sapiens
ggugggcacugucuucauc

SEQ ID NO: 227399 - RNA, 19 nt, Homo sapiens
ccaacacccucaucugucu

SEQ ID NO: 227400 - RNA, 19 nt, Homo sapiens
gccuauguuuagcaaauuu

SEQ ID NO: 227401 - RNA, 19 nt, Homo sapiens
gccaguacacccaugaauu

SEQ ID NO: 227402 - RNA, 19 nt, Homo sapiens
ucaccuggcugagcaaugg

SEQ ID NO: 227403 - RNA, 19 nt, Homo sapiens
gagugaucauuccuucuuc

SEQ ID NO: 227404 - RNA, 19 nt, Homo sapiens
cuguggaggugaagacauu

SEQ ID NO: 227405 - RNA, 19 nt, Homo sapiens
gcccaacacccucaucugu

SEQ ID NO: 227406 - RNA, 19 nt, Homo sapiens
gcagagugcacugagaaau

SEQ ID NO: 227407 - RNA, 19 nt, Homo sapiens
gaugagacaguccaacucu

SEQ ID NO: 227408 - RNA, 19 nt, Homo sapiens
aaauauggcugugggaaaa

SEQ ID NO: 227409 - RNA, 19 nt, Homo sapiens
ucaguuaccucaccuuccu

SEQ ID NO: 227410 - RNA, 19 nt, Homo sapiens
gcacucagucacagaaggu

SEQ ID NO: 227411 - RNA, 19 nt, Homo sapiens
caaggccugcguucaguug

SEQ ID NO: 227412 - RNA, 19 nt, Homo sapiens
gcacugucuucaucaucca

SEQ ID NO: 227413 - RNA, 19 nt, Homo sapiens
acacugggagccugagauu

SEQ ID NO: 227414 - RNA, 19 nt, Homo sapiens
gcauuguggugggcacugu

SEQ ID NO: 227415 - RNA, 19 nt, Homo sapiens
agagugaucauuccuucuu

SEQ ID NO: 227416 - RNA, 19 nt, Homo sapiens
gcaguugccuauguuuagc

SEQ ID NO: 227417 - RNA, 19 nt, Homo sapiens
ggaaaacacaccuuggaau

SEQ ID NO: 227418 - RNA, 19 nt, Homo sapiens
ccaagagugaucauuccuu

SEQ ID NO: 227419 - RNA, 19 nt, Homo sapiens
cuaccgcugccaccaauga

SEQ ID NO: 227420 - RNA, 19 nt, Homo sapiens
ccgcagagugcacugagaa

SEQ ID NO: 227421 - RNA, 19 nt, Homo sapiens
acguggaccuggagacgaa

SEQ ID NO: 227422 - RNA, 19 nt, Homo sapiens
uuccugaggucacaguguu

SEQ ID NO: 227423 - RNA, 19 nt, Homo sapiens
gaccuggagacgaaagaga

SEQ ID NO: 227424 - RNA, 19 nt, Homo sapiens
ugagacaguccaacucuac

SEQ ID NO: 227425 - RNA, 19 nt, Homo sapiens
caccuuggaauucaugaug

SEQ ID NO: 227426 - RNA, 19 nt, Homo sapiens
gauuucguguaccaguuua

SEQ ID NO: 227427 - RNA, 19 nt, Homo sapiens
caggucaucuccuuucauc

SEQ ID NO: 227428 - RNA, 19 nt, Homo sapiens
ggauuucguguaccaguuu

SEQ ID NO: 227429 - RNA, 19 nt, Homo sapiens
uuaccugacuuuagagcuu

SEQ ID NO: 227430 - RNA, 19 nt, Homo sapiens
aagcaucuauaaccgagaa

SEQ ID NO: 227431 - RNA, 19 nt, Homo sapiens
ucagacugcucaagagaag

SEQ ID NO: 227432 - RNA, 19 nt, Homo sapiens
gcuugucccugcccagaau

SEQ ID NO: 227433 - RNA, 19 nt, Homo sapiens
gugagcagaagcaucuaua

SEQ ID NO: 227434 - RNA, 19 nt, Homo sapiens
ucaagagaagcacaugaaa

SEQ ID NO: 227435 - RNA, 19 nt, Homo sapiens
gagcagaagcaucuauaac

SEQ ID NO: 227436 - RNA, 19 nt, Homo sapiens
gguccgagcuguguugacu

SEQ ID NO: 227437 - RNA, 19 nt, Homo sapiens
acagagcgcgugcgucuug

SEQ ID NO: 227438 - RNA, 19 nt, Homo sapiens
gcucaagagaagcacauga

SEQ ID NO: 227439 - RNA, 19 nt, Homo sapiens
gagcgcgugcgucuuguga

SEQ ID NO: 227440 - RNA, 19 nt, Homo sapiens
ugagcagaagcaucuauaa

SEQ ID NO: 227441 - RNA, 19 nt, Homo sapiens
uaccugacuuuagagcuuu

SEQ ID NO: 227442 - RNA, 19 nt, Homo sapiens
gccaccaggucaucuccuu

SEQ ID NO: 227443 - RNA, 19 nt, Homo sapiens
caagagaagcacaugaaaa

SEQ ID NO: 227444 - RNA, 19 nt, Homo sapiens
uuaaacaugauccugaguu

SEQ ID NO: 227445 - RNA, 19 nt, Homo sapiens
gaacagccagaaggacauc

SEQ ID NO: 227446 - RNA, 19 nt, Homo sapiens
ggaacagccagaaggacau

SEQ ID NO: 227447 - RNA, 19 nt, Homo sapiens
agaauucccagcugucugu

SEQ ID NO: 227448 - RNA, 19 nt, Homo sapiens
caucagguccgagcugugu

SEQ ID NO: 227449 - RNA, 19 nt, Homo sapiens
ggauggcugugacccuacu

SEQ ID NO: 227450 - RNA, 19 nt, Homo sapiens
ccaccaggucaucuccuuu

SEQ ID NO: 227451 - RNA, 19 nt, Homo sapiens
ccgaggauuucguguacca

SEQ ID NO: 227452 - RNA, 19 nt, Homo sapiens
cgagcuguguugacuacca

SEQ ID NO: 227453 - RNA, 19 nt, Homo sapiens
caacauagcuguggacaaa

SEQ ID NO: 227454 - RNA, 19 nt, Homo sapiens
uuacaaagcuggcaauauu

SEQ ID NO: 227455 - RNA, 19 nt, Homo sapiens
acaaagcgcuccaacuaua

SEQ ID NO: 227456 - RNA, 19 nt, Homo sapiens
ggacaaagccaaccuggaa

SEQ ID NO: 227457 - RNA, 19 nt, Homo sapiens
ugaagaauuuggacgauuu

SEQ ID NO: 227458 - RNA, 19 nt, Homo sapiens
ugacaaagcgcuccaacua

SEQ ID NO: 227459 - RNA, 19 nt, Homo sapiens
ccaacguccucaucuguuu

SEQ ID NO: 227460 - RNA, 19 nt, Homo sapiens
caaagaagaacaugugauc

SEQ ID NO: 227461 - RNA, 19 nt, Homo sapiens
ggaaucaugggcuaucaaa

SEQ ID NO: 227462 - RNA, 19 nt, Homo sapiens
gggaccaucuucaucauca

SEQ ID NO: 227463 - RNA, 19 nt, Homo sapiens
ugcaaugccucuggaauaa

SEQ ID NO: 227464 - RNA, 19 nt, Homo sapiens
caacugaggacguuuacga

SEQ ID NO: 227465 - RNA, 19 nt, Homo sapiens
ucacguggcuucgaaaugg

SEQ ID NO: 227466 - RNA, 19 nt, Homo sapiens
uguuuaagguuuccucaaa

SEQ ID NO: 227467 - RNA, 19 nt, Homo sapiens
gaguuuauguuugacuuug

SEQ ID NO: 227468 - RNA, 19 nt, Homo sapiens
caggcgaguuuauguuuga

SEQ ID NO: 227469 - RNA, 19 nt, Homo sapiens
ggucuggugggcaucauua

SEQ ID NO: 227470 - RNA, 19 nt, Homo sapiens
caaaagcaaugcagcagaa

SEQ ID NO: 227471 - RNA, 19 nt, Homo sapiens
ugaccaaucaggcgaguuu

SEQ ID NO: 227472 - RNA, 19 nt, Homo sapiens
aaucaugggcuaucaaaga

SEQ ID NO: 227473 - RNA, 19 nt, Homo sapiens
gacaaagcgcuccaacuau

SEQ ID NO: 227474 - RNA, 19 nt, Homo sapiens
gaagaauuuggacgauuug

SEQ ID NO: 227475 - RNA, 19 nt, Homo sapiens
caugggcuaucaaagaaga

SEQ ID NO: 227476 - RNA, 19 nt, Homo sapiens
gcaauauuacaauccuuga

SEQ ID NO: 227477 - RNA, 19 nt, Homo sapiens
uacaaagcuggcaauauua

SEQ ID NO: 227478 - RNA, 19 nt, Homo sapiens
gcgaguuuauguuugacuu

SEQ ID NO: 227479 - RNA, 19 nt, Homo sapiens
uaucaaagaagaacaugug

SEQ ID NO: 227480 - RNA, 19 nt, Homo sapiens
ucuggcggcuugaagaauu

SEQ ID NO: 227481 - RNA, 19 nt, Homo sapiens
gcaaugccucuggaauaaa

SEQ ID NO: 227482 - RNA, 19 nt, Homo sapiens
ucugaauccugaccaauca

SEQ ID NO: 227483 - RNA, 19 nt, Homo sapiens
agaagaacaugugaucauc

SEQ ID NO: 227484 - RNA, 19 nt, Homo sapiens
auacuccgaucaccaaugu

SEQ ID NO: 227485 - RNA, 19 nt, Homo sapiens
caaugccucuggaauaaaa

SEQ ID NO: 227486 - RNA, 19 nt, Homo sapiens
ggaccaucuucaucaucaa

SEQ ID NO: 227487 - RNA, 19 nt, Homo sapiens
gaucauccaggccgaguuc

SEQ ID NO: 227488 - RNA, 19 nt, Homo sapiens
gugaugagauuuuccaugu

SEQ ID NO: 227489 - RNA, 19 nt, Homo sapiens
ucaggcgaguuuauguuug

SEQ ID NO: 227490 - RNA, 19 nt, Homo sapiens
gacaaagccaaccuggaaa

SEQ ID NO: 227491 - RNA, 19 nt, Homo sapiens
uaaggcacauggaggugau

SEQ ID NO: 227492 - RNA, 19 nt, Homo sapiens
ugacuuugauggugaugag

SEQ ID NO: 227493 - RNA, 19 nt, Homo sapiens
uugaugaucuuggguggaa

SEQ ID NO: 227494 - RNA, 19 nt, Homo sapiens
augcaaugccucuggaaua

SEQ ID NO: 227495 - RNA, 19 nt, Homo sapiens
caaggugcauuggccaaca

SEQ ID NO: 227496 - RNA, 19 nt, Homo sapiens
ccaaucaggcgaguuuaug

SEQ ID NO: 227497 - RNA, 19 nt, Homo sapiens
ucccagagacuacagagaa

SEQ ID NO: 227498 - RNA, 19 nt, Homo sapiens
aagccaaccuggaaaucau

SEQ ID NO: 227499 - RNA, 19 nt, Homo sapiens
uggacgauuugccagcuuu

SEQ ID NO: 227500 - RNA, 19 nt, Homo sapiens
ggucuggcggcuugaagaa

SEQ ID NO: 227501 - RNA, 19 nt, Homo sapiens
aucaugggcuaucaaagaa

SEQ ID NO: 227502 - RNA, 19 nt, Homo sapiens
gucugucucugcuauggaa

SEQ ID NO: 227503 - RNA, 19 nt, Homo sapiens
aaugucacguggcuucgaa

SEQ ID NO: 227504 - RNA, 19 nt, Homo sapiens
caggaaucaugggcuauca

SEQ ID NO: 227505 - RNA, 19 nt, Homo sapiens
aagaacaugugaucaucca

SEQ ID NO: 227506 - RNA, 19 nt, Homo sapiens
gaagaaaauggccauaagu

SEQ ID NO: 227507 - RNA, 19 nt, Homo sapiens
caaucaggcgaguuuaugu

SEQ ID NO: 227508 - RNA, 19 nt, Homo sapiens
aagaagaacaugugaucau

SEQ ID NO: 227509 - RNA, 19 nt, Homo sapiens
gccgaguucuaucugaauc

SEQ ID NO: 227510 - RNA, 19 nt, Homo sapiens
gagucugucucugcuaugg

SEQ ID NO: 227511 - RNA, 19 nt, Homo sapiens
uuuccucuauuuccuauca

SEQ ID NO: 227512 - RNA, 19 nt, Homo sapiens
uggcuuucccugucuauug

SEQ ID NO: 227513 - RNA, 19 nt, Homo sapiens
aaagcuggcaauauuacaa

SEQ ID NO: 227514 - RNA, 19 nt, Homo sapiens
cuggugggcaucauuauug

SEQ ID NO: 227515 - RNA, 19 nt, Homo sapiens
gcacugggaguuugaugcu

SEQ ID NO: 227516 - RNA, 19 nt, Homo sapiens
uugaagaauuuggacgauu

SEQ ID NO: 227517 - RNA, 19 nt, Homo sapiens
uggagucccugugcuagga

SEQ ID NO: 227518 - RNA, 19 nt, Homo sapiens
cauccaggccgaguucuau

SEQ ID NO: 227519 - RNA, 19 nt, Homo sapiens
gaccaaucaggcgaguuua

SEQ ID NO: 227520 - RNA, 19 nt, Homo sapiens
gcccaacguccucaucugu

SEQ ID NO: 227521 - RNA, 19 nt, Homo sapiens
guaacugugcucacgaaca

SEQ ID NO: 227522 - RNA, 19 nt, Homo sapiens
caggccgaguucuaucuga

SEQ ID NO: 227523 - RNA, 19 nt, Homo sapiens
aggagucugucucugcuau

SEQ ID NO: 227524 - RNA, 19 nt, Homo sapiens
ucuauugccuuuuccugua

SEQ ID NO: 227525 - RNA, 19 nt, Homo sapiens
caaagcgcuccaacuauac

SEQ ID NO: 227526 - RNA, 19 nt, Homo sapiens
acaaagccaaccuggaaau

SEQ ID NO: 227527 - RNA, 19 nt, Homo sapiens
cgaguuuauguuugacuuu

SEQ ID NO: 227528 - RNA, 19 nt, Homo sapiens
ucaaagaagaacaugugau

SEQ ID NO: 227529 - RNA, 19 nt, Homo sapiens
uacaauccuugaccucagu

SEQ ID NO: 227530 - RNA, 19 nt, Homo sapiens
gagucccugugcuaggauu

SEQ ID NO: 227531 - RNA, 19 nt, Homo sapiens
ccucuauuuccuaucauuu

SEQ ID NO: 227532 - RNA, 19 nt, Homo sapiens
uaacaucuagcuggcuuuc

SEQ ID NO: 227533 - RNA, 19 nt, Homo sapiens
accuggaaaucaugacaaa

SEQ ID NO: 227534 - RNA, 19 nt, Homo sapiens
caaccuggaaaucaugaca

SEQ ID NO: 227535 - RNA, 19 nt, Homo sapiens
caaagccaaccuggaaauc

SEQ ID NO: 227536 - RNA, 19 nt, Homo sapiens
ggacgauuugccagcuuug

SEQ ID NO: 227537 - RNA, 19 nt, Homo sapiens
gcauugaagucaggugguu

SEQ ID NO: 227538 - RNA, 19 nt, Homo sapiens
gaaaauguccucccuugug

SEQ ID NO: 227539 - RNA, 19 nt, Homo sapiens
gaugaccacauucaaggaa

SEQ ID NO: 227540 - RNA, 19 nt, Homo sapiens
ucccagcuuugcagaauga

SEQ ID NO: 227541 - RNA, 19 nt, Homo sapiens
ugaccacauucaaggaaga

SEQ ID NO: 227542 - RNA, 19 nt, Homo sapiens
cgggugcgguugcuggaaa

SEQ ID NO: 227543 - RNA, 19 nt, Homo sapiens
aaccuucugucccagcuuu

SEQ ID NO: 227544 - RNA, 19 nt, Homo sapiens
cuccuggucugcucuguga

SEQ ID NO: 227545 - RNA, 19 nt, Homo sapiens
ugucccagcuuugcagaau

SEQ ID NO: 227546 - RNA, 19 nt, Homo sapiens
gcauugaagucaggugguu

SEQ ID NO: 227547 - RNA, 19 nt, Homo sapiens
ugagugucauuucuucaau

SEQ ID NO: 227548 - RNA, 19 nt, Homo sapiens
ggacacccgaccacguuuc

SEQ ID NO: 227549 - RNA, 19 nt, Homo sapiens
cacccgaccacguuucuug

SEQ ID NO: 227550 - RNA, 19 nt, Homo sapiens
uguggaaccugaucagaua

SEQ ID NO: 227551 - RNA, 19 nt, Homo sapiens
gccacacauugcauuauua

SEQ ID NO: 227552 - RNA, 19 nt, Homo sapiens
ggacggagcgaguguggaa

SEQ ID NO: 227553 - RNA, 19 nt, Homo sapiens
ccacacauugcauuauuaa

SEQ ID NO: 227554 - RNA, 19 nt, Homo sapiens
ccacuggucuuguccucuu

SEQ ID NO: 227555 - RNA, 19 nt, Homo sapiens
gcauugaagucaggugguu

SEQ ID NO: 227556 - RNA, 19 nt, Homo sapiens
gaaaauguccucccuugug

SEQ ID NO: 227557 - RNA, 19 nt, Homo sapiens
ugccacacauugcauuauu

SEQ ID NO: 227558 - RNA, 19 nt, Homo sapiens
gcgcugacagugacauuga

SEQ ID NO: 227559 - RNA, 19 nt, Homo sapiens
gaugaccacauucaaggaa

SEQ ID NO: 227560 - RNA, 19 nt, Homo sapiens
ggacaccuacugcagauac

SEQ ID NO: 227561 - RNA, 19 nt, Homo sapiens
ugaccacauucaaggaaga

SEQ ID NO: 227562 - RNA, 19 nt, Homo sapiens
ggagugcacggucugaauc

SEQ ID NO: 227563 - RNA, 19 nt, Homo sapiens
ucuauaaccaagaggagua

SEQ ID NO: 227564 - RNA, 19 nt, Homo sapiens
ggucugcucugugaauggu

SEQ ID NO: 227565 - RNA, 19 nt, Homo sapiens
cuccuggucugcucuguga

SEQ ID NO: 227566 - RNA, 19 nt, Homo sapiens
guggacaccuacugcagau

SEQ ID NO: 227567 - RNA, 19 nt, Homo sapiens
auacaucuauaaccaagag

SEQ ID NO: 227568 - RNA, 19 nt, Homo sapiens
ggacacccaaccacguuuc

SEQ ID NO: 227569 - RNA, 19 nt, Homo sapiens
gaaccugaucagauacauc

SEQ ID NO: 227570 - RNA, 19 nt, Homo sapiens
ggaaccugaucagauacau

SEQ ID NO: 227571 - RNA, 19 nt, Homo sapiens
uggagcaggcuaaguguga

SEQ ID NO: 227572 - RNA, 19 nt, Homo sapiens
gguuuacaccugccaagug

SEQ ID NO: 227573 - RNA, 19 nt, Homo sapiens
uaagugugagugucauuuc

SEQ ID NO: 227574 - RNA, 19 nt, Homo sapiens
ucugcucugugaaugguuu

SEQ ID NO: 227575 - RNA, 19 nt, Homo sapiens
cagcggcgaguccaaccua

SEQ ID NO: 227576 - RNA, 19 nt, Homo sapiens
cacccaaccacguuucuug

SEQ ID NO: 227577 - RNA, 19 nt, Homo sapiens
cuaagugugagugucauuu

SEQ ID NO: 227578 - RNA, 19 nt, Homo sapiens
gacaccuacugcagauaca

SEQ ID NO: 227579 - RNA, 19 nt, Homo sapiens
gcuaagugugagugucauu

SEQ ID NO: 227580 - RNA, 19 nt, Homo sapiens
ccaccuggcuccaaagaca

SEQ ID NO: 227581 - RNA, 19 nt, Homo sapiens
gaaagggcacucuggacuu

SEQ ID NO: 227582 - RNA, 19 nt, Homo sapiens
gcauugaagucaggugguu

SEQ ID NO: 227583 - RNA, 19 nt, Homo sapiens
ggccugaagucccagcauu

SEQ ID NO: 227584 - RNA, 19 nt, Homo sapiens
gagcugaagugcagaugac

SEQ ID NO: 227585 - RNA, 19 nt, Homo sapiens
gcagaugaccacauucaag

SEQ ID NO: 227586 - RNA, 19 nt, Homo sapiens
cugcuuggcucuuauucuu

SEQ ID NO: 227587 - RNA, 19 nt, Homo sapiens
cagcaacucugcagaaaau

SEQ ID NO: 227588 - RNA, 19 nt, Homo sapiens
aaagggcacucuggacuuc

SEQ ID NO: 227589 - RNA, 19 nt, Homo sapiens
ucaucuacuucaagaauca

SEQ ID NO: 227590 - RNA, 19 nt, Homo sapiens
gaaaauguccauccuugug

SEQ ID NO: 227591 - RNA, 19 nt, Homo sapiens
aagugcagaugaccacauu

SEQ ID NO: 227592 - RNA, 19 nt, Homo sapiens
ugaagucccagcauugaug

SEQ ID NO: 227593 - RNA, 19 nt, Homo sapiens
guucagcaacucugcagaa

SEQ ID NO: 227594 - RNA, 19 nt, Homo sapiens
ggccucccaugcaucugua

SEQ ID NO: 227595 - RNA, 19 nt, Homo sapiens
gugcagaugaccacauuca

SEQ ID NO: 227596 - RNA, 19 nt, Homo sapiens
ggucugcucugugaauggu

SEQ ID NO: 227597 - RNA, 19 nt, Homo sapiens
cuccuggucugcucuguga

SEQ ID NO: 227598 - RNA, 19 nt, Homo sapiens
gcucuuauucuuccacaag

SEQ ID NO: 227599 - RNA, 19 nt, Homo sapiens
ggacucgugagcugaagug

SEQ ID NO: 227600 - RNA, 19 nt, Homo sapiens
gaagugcagaugaccacau

SEQ ID NO: 227601 - RNA, 19 nt, Homo sapiens
cuacuucaagaaucagaaa

SEQ ID NO: 227602 - RNA, 19 nt, Homo sapiens
guuccuacauggcaaagcu

SEQ ID NO: 227603 - RNA, 19 nt, Homo sapiens
cccuggagguuccuacaug

SEQ ID NO: 227604 - RNA, 19 nt, Homo sapiens
ucugcucugugaaugguuu

SEQ ID NO: 227605 - RNA, 19 nt, Homo sapiens
ccugaagucccagcauuga

SEQ ID NO: 227606 - RNA, 19 nt, Homo sapiens
gaacguaugugcucuuaua

SEQ ID NO: 227607 - RNA, 19 nt, Homo sapiens
ggaaggagcugggcaaaug

SEQ ID NO: 227608 - RNA, 19 nt, Homo sapiens
caagaaagcucgcaaaguc

SEQ ID NO: 227609 - RNA, 19 nt, Homo sapiens
cagaguaucuaauccuuua

SEQ ID NO: 227610 - RNA, 19 nt, Homo sapiens
ggagcuuucuuguuucuua

SEQ ID NO: 227611 - RNA, 19 nt, Homo sapiens
gcacuggucucucuuggaa

SEQ ID NO: 227612 - RNA, 19 nt, Homo sapiens
uggaauagauggacaguuu

SEQ ID NO: 227613 - RNA, 19 nt, Homo sapiens
gcaaagaggcgaauuguag

SEQ ID NO: 227614 - RNA, 19 nt, Homo sapiens
ccauaucccucuugacauu

SEQ ID NO: 227615 - RNA, 19 nt, Homo sapiens
uaaguuaccaugcuaauga

SEQ ID NO: 227616 - RNA, 19 nt, Homo sapiens
cagcagaucuugcccuuuc

SEQ ID NO: 227617 - RNA, 19 nt, Homo sapiens
aaaagaagcuggaugauga

SEQ ID NO: 227618 - RNA, 19 nt, Homo sapiens
gagcauggccagacuauuc

SEQ ID NO: 227619 - RNA, 19 nt, Homo sapiens
cuaaugaggugcacacaau

SEQ ID NO: 227620 - RNA, 19 nt, Homo sapiens
ggagaauuguggaaggauu

SEQ ID NO: 227621 - RNA, 19 nt, Homo sapiens
gaaaugggaggucuaagga

SEQ ID NO: 227622 - RNA, 19 nt, Homo sapiens
gcaugcugccugaguauua

SEQ ID NO: 227623 - RNA, 19 nt, Homo sapiens
ccgcagcucuaguccuuua

SEQ ID NO: 227624 - RNA, 19 nt, Homo sapiens
aaagaaaggugccaugucu

SEQ ID NO: 227625 - RNA, 19 nt, Homo sapiens
ggauuagccuuugacauug

SEQ ID NO: 227626 - RNA, 19 nt, Homo sapiens
gaagcuggaugaugagagu

SEQ ID NO: 227627 - RNA, 19 nt, Homo sapiens
gaaaagcucagcaacauuu

SEQ ID NO: 227628 - RNA, 19 nt, Homo sapiens
ucagaaagaagucaguuaa

SEQ ID NO: 227629 - RNA, 19 nt, Homo sapiens
cugaugaccugaaggauga

SEQ ID NO: 227630 - RNA, 19 nt, Homo sapiens
ggugcuauguguuugguuu

SEQ ID NO: 227631 - RNA, 19 nt, Homo sapiens
guacagagaagaagugcuu

SEQ ID NO: 227632 - RNA, 19 nt, Homo sapiens
gauuagccuuugacauuga

SEQ ID NO: 227633 - RNA, 19 nt, Homo sapiens
guggaaggauuguaacaug

SEQ ID NO: 227634 - RNA, 19 nt, Homo sapiens
ugacgaauccugcucuaaa

SEQ ID NO: 227635 - RNA, 19 nt, Homo sapiens
cuuauucucuguuugcuuu

SEQ ID NO: 227636 - RNA, 19 nt, Homo sapiens
uggauuagccuuugacauu

SEQ ID NO: 227637 - RNA, 19 nt, Homo sapiens
gcacuacuccgcagcucua

SEQ ID NO: 227638 - RNA, 19 nt, Homo sapiens
ggacguagaguuggccuuu

SEQ ID NO: 227639 - RNA, 19 nt, Homo sapiens
gcuauguguuugguuuaua

SEQ ID NO: 227640 - RNA, 19 nt, Homo sapiens
gcacuuuaccagaggcaua

SEQ ID NO: 227641 - RNA, 19 nt, Homo sapiens
gcaaggcgcagaaagaaca

SEQ ID NO: 227642 - RNA, 19 nt, Homo sapiens
agacacagguggacguaga

SEQ ID NO: 227643 - RNA, 19 nt, Homo sapiens
uaugugcucuuauaaagug

SEQ ID NO: 227644 - RNA, 19 nt, Homo sapiens
aaaccaaccuuucugacau

SEQ ID NO: 227645 - RNA, 19 nt, Homo sapiens
cagcucuaguccuuuauaa

SEQ ID NO: 227646 - RNA, 19 nt, Homo sapiens
aaagggcccugguaaaaua

SEQ ID NO: 227647 - RNA, 19 nt, Homo sapiens
gagcuuaccuacucuucca

SEQ ID NO: 227648 - RNA, 19 nt, Homo sapiens
guagauaacagcaagagau

SEQ ID NO: 227649 - RNA, 19 nt, Homo sapiens
gaaagaagucaguuaacgu

SEQ ID NO: 227650 - RNA, 19 nt, Homo sapiens
gcaaacgcaaguucucuga

SEQ ID NO: 227651 - RNA, 19 nt, Homo sapiens
acaaaacccuucccuauga

SEQ ID NO: 227652 - RNA, 19 nt, Homo sapiens
ugauaucggugcuaugugu

SEQ ID NO: 227653 - RNA, 19 nt, Homo sapiens
gaugacgaauccugcucua

SEQ ID NO: 227654 - RNA, 19 nt, Homo sapiens
cguaugugcucuuauaaag

SEQ ID NO: 227655 - RNA, 19 nt, Homo sapiens
guaaaguaaugcauuugag

SEQ ID NO: 227656 - RNA, 19 nt, Homo sapiens
gucuguaccuaaagcaaua

SEQ ID NO: 227657 - RNA, 19 nt, Homo sapiens
ggugauaaucgucuucaaa

SEQ ID NO: 227658 - RNA, 19 nt, Homo sapiens
gggcaaaugcaagaacaua

SEQ ID NO: 227659 - RNA, 19 nt, Homo sapiens
ggacaaaacccuucccuau

SEQ ID NO: 227660 - RNA, 19 nt, Homo sapiens
aaacugugguuaauccaau

SEQ ID NO: 227661 - RNA, 19 nt, Homo sapiens
ggaaaugggaggucuaagg

SEQ ID NO: 227662 - RNA, 19 nt, Homo sapiens
gcucuaguccuuuauaagu

SEQ ID NO: 227663 - RNA, 19 nt, Homo sapiens
cacaauaacuuagcacuac

SEQ ID NO: 227664 - RNA, 19 nt, Homo sapiens
aaaagcaucugccacaaaa

SEQ ID NO: 227665 - RNA, 19 nt, Homo sapiens
gagcuuucuuguuucuuau

SEQ ID NO: 227666 - RNA, 19 nt, Homo sapiens
ccaaaaggagagauuauua

SEQ ID NO: 227667 - RNA, 19 nt, Homo sapiens
gcagcucuaguccuuuaua

SEQ ID NO: 227668 - RNA, 19 nt, Homo sapiens
gcaggcuggcuuuggaaua

SEQ ID NO: 227669 - RNA, 19 nt, Homo sapiens
gaucaagaaagcucgcaaa

SEQ ID NO: 227670 - RNA, 19 nt, Homo sapiens
ccacagcccaugaucaaga

SEQ ID NO: 227671 - RNA, 19 nt, Homo sapiens
gcaaaccgcaauacaccaa

SEQ ID NO: 227672 - RNA, 19 nt, Homo sapiens
ccacgaagacgcauuuagu

SEQ ID NO: 227673 - RNA, 19 nt, Homo sapiens
caaagaggcgaauuguaga

SEQ ID NO: 227674 - RNA, 19 nt, Homo sapiens
gaauagauggacaguuugu

SEQ ID NO: 227675 - RNA, 19 nt, Homo sapiens
cggagauacuuuccaguug

SEQ ID NO: 227676 - RNA, 19 nt, Homo sapiens
gucuuuaaguggagaauug

SEQ ID NO: 227677 - RNA, 19 nt, Homo sapiens
ucaaugggauuuucuaguu

SEQ ID NO: 227678 - RNA, 19 nt, Homo sapiens
uuacugcuaucuacuaagu

SEQ ID NO: 227679 - RNA, 19 nt, Homo sapiens
acauggaccuggaggaguu

SEQ ID NO: 227680 - RNA, 19 nt, Homo sapiens
ggaaggauuguaacaugga

SEQ ID NO: 227681 - RNA, 19 nt, Homo sapiens
ccaaauuuauggccguauc

SEQ ID NO: 227682 - RNA, 19 nt, Homo sapiens
aaaacugcgucuuggauua

SEQ ID NO: 227683 - RNA, 19 nt, Homo sapiens
gccagacuauucccuagga

SEQ ID NO: 227684 - RNA, 19 nt, Homo sapiens
ccuaagaauuucacugucu

SEQ ID NO: 227685 - RNA, 19 nt, Homo sapiens
agagcaugcugccugagua

SEQ ID NO: 227686 - RNA, 19 nt, Homo sapiens
gugauaaucgucuucaaau

SEQ ID NO: 227687 - RNA, 19 nt, Homo sapiens
caaaccaaccuuucugaca

SEQ ID NO: 227688 - RNA, 19 nt, Homo sapiens
gagcugggcaaaugcaaga

SEQ ID NO: 227689 - RNA, 19 nt, Homo sapiens
gggcaaggcgcagaaagaa

SEQ ID NO: 227690 - RNA, 19 nt, Homo sapiens
gagaauuguggaaggauug

SEQ ID NO: 227691 - RNA, 19 nt, Homo sapiens
ugucacaagcuguagauaa

SEQ ID NO: 227692 - RNA, 19 nt, Homo sapiens
cacgaagacgcauuuagua

SEQ ID NO: 227693 - RNA, 19 nt, Homo sapiens
caaggaagcagagggaaau

SEQ ID NO: 227694 - RNA, 19 nt, Homo sapiens
acugcuaucuacuaaguuu

SEQ ID NO: 227695 - RNA, 19 nt, Homo sapiens
gaucccauauuuacuuacu

SEQ ID NO: 227696 - RNA, 19 nt, Homo sapiens
uaggauauuucuacaaggu

SEQ ID NO: 227697 - RNA, 19 nt, Homo sapiens
ggaaacccaaccaguagga

SEQ ID NO: 227698 - RNA, 19 nt, Homo sapiens
gaaaagcaucugccacaaa

SEQ ID NO: 227699 - RNA, 19 nt, Homo sapiens
ucaguuaacgucacccaaa

SEQ ID NO: 227700 - RNA, 19 nt, Homo sapiens
uauuaggccucagaaagaa

SEQ ID NO: 227701 - RNA, 19 nt, Homo sapiens
gacaauguauuuuggaaga

SEQ ID NO: 227702 - RNA, 19 nt, Homo sapiens
ggcgguuguuucuuucuuu

SEQ ID NO: 227703 - RNA, 19 nt, Homo sapiens
acacaacugacucccauuu

SEQ ID NO: 227704 - RNA, 19 nt, Homo sapiens
caaugcuucucucauagug

SEQ ID NO: 227705 - RNA, 19 nt, Homo sapiens
gaugagggguuaauuuauc

SEQ ID NO: 227706 - RNA, 19 nt, Homo sapiens
ggagggagcuacucuaagg

SEQ ID NO: 227707 - RNA, 19 nt, Homo sapiens
aagaagagcucaggacauu

SEQ ID NO: 227708 - RNA, 19 nt, Homo sapiens
caucauugcuggccugguu

SEQ ID NO: 227709 - RNA, 19 nt, Homo sapiens
gcacagauuuuccgaguga

SEQ ID NO: 227710 - RNA, 19 nt, Homo sapiens
gcugugauauggaggaaga

SEQ ID NO: 227711 - RNA, 19 nt, Homo sapiens
gagcaaaagucaaaugaug

SEQ ID NO: 227712 - RNA, 19 nt, Homo sapiens
guagauggaacccuccuuu

SEQ ID NO: 227713 - RNA, 19 nt, Homo sapiens
ugugguugcugcugugaua

SEQ ID NO: 227714 - RNA, 19 nt, Homo sapiens
gaagagcucaggacauuuu

SEQ ID NO: 227715 - RNA, 19 nt, Homo sapiens
caaagacacacgugacuca

SEQ ID NO: 227716 - RNA, 19 nt, Homo sapiens
gaagaagagcucaggacau

SEQ ID NO: 227717 - RNA, 19 nt, Homo sapiens
aggauuaucucacccugaa

SEQ ID NO: 227718 - RNA, 19 nt, Homo sapiens
gauuaucucacccugaaug

SEQ ID NO: 227719 - RNA, 19 nt, Homo sapiens
gagauacacgugccaugug

SEQ ID NO: 227720 - RNA, 19 nt, Homo sapiens
ccuacgacggcaaggauua

SEQ ID NO: 227721 - RNA, 19 nt, Homo sapiens
cccacuccuugaaguauuu

SEQ ID NO: 227722 - RNA, 19 nt, Homo sapiens
ccacaaauaccuggagaag

SEQ ID NO: 227723 - RNA, 19 nt, Homo sapiens
cagggacaccgcacagauu

SEQ ID NO: 227724 - RNA, 19 nt, Homo sapiens
aaggagggagcuacucuaa

SEQ ID NO: 227725 - RNA, 19 nt, Homo sapiens
gcucccacuccuugaagua

SEQ ID NO: 227726 - RNA, 19 nt, Homo sapiens
agucaaaugaugccucuga

SEQ ID NO: 227727 - RNA, 19 nt, Homo sapiens
agauggaacccuccuuuua

SEQ ID NO: 227728 - RNA, 19 nt, Homo sapiens
aaaggagggagcuacucua

SEQ ID NO: 227729 - RNA, 19 nt, Homo sapiens
ucccacuccuugaaguauu

SEQ ID NO: 227730 - RNA, 19 nt, Homo sapiens
ccagggacaccgcacagau

SEQ ID NO: 227731 - RNA, 19 nt, Homo sapiens
gaagcaagauaucaaugua

SEQ ID NO: 227732 - RNA, 19 nt, Homo sapiens
aagaagagcucagauagaa

SEQ ID NO: 227733 - RNA, 19 nt, Homo sapiens
gcagauacuuggagaaugg

SEQ ID NO: 227734 - RNA, 19 nt, Homo sapiens
ggacugagaagcaagauau

SEQ ID NO: 227735 - RNA, 19 nt, Homo sapiens
ugagacagcuuccuugugu

SEQ ID NO: 227736 - RNA, 19 nt, Homo sapiens
gagcucagauagaaacaga

SEQ ID NO: 227737 - RNA, 19 nt, Homo sapiens
gaagaagagcucagauaga

SEQ ID NO: 227738 - RNA, 19 nt, Homo sapiens
ggaagaagagcucagauag

SEQ ID NO: 227739 - RNA, 19 nt, Homo sapiens
ucucacagcuaauaaagug

SEQ ID NO: 227740 - RNA, 19 nt, Homo sapiens
gcugugauguggaggaaga

SEQ ID NO: 227741 - RNA, 19 nt, Homo sapiens
gggugucucucacagcuaa

SEQ ID NO: 227742 - RNA, 19 nt, Homo sapiens
caucguugcuggccuuguu

SEQ ID NO: 227743 - RNA, 19 nt, Homo sapiens
gaagagcucagauagaaac

SEQ ID NO: 227744 - RNA, 19 nt, Homo sapiens
uagcagaauugcacuugug

SEQ ID NO: 227745 - RNA, 19 nt, Homo sapiens
agauaucaauguagcagaa

SEQ ID NO: 227746 - RNA, 19 nt, Homo sapiens
gcgcgcagauccuccaaag

SEQ ID NO: 227747 - RNA, 19 nt, Homo sapiens
cagaggaguucaggaccua

SEQ ID NO: 227748 - RNA, 19 nt, Homo sapiens
ucacccagcgcuucuauga

SEQ ID NO: 227749 - RNA, 19 nt, Homo sapiens
gcuaauaaagugugagaca

SEQ ID NO: 227750 - RNA, 19 nt, Homo sapiens
ucuaugaggcagaggaaua

SEQ ID NO: 227751 - RNA, 19 nt, Homo sapiens
gagaagcaagauaucaaug

SEQ ID NO: 227752 - RNA, 19 nt, Homo sapiens
ggaggaagaagagcucaga

SEQ ID NO: 227753 - RNA, 19 nt, Homo sapiens
uguggucgcugcugugaug

SEQ ID NO: 227754 - RNA, 19 nt, Homo sapiens
ggaauaugcagaggaguuc

SEQ ID NO: 227755 - RNA, 19 nt, Homo sapiens
guagcagaauugcacuugu

SEQ ID NO: 227756 - RNA, 19 nt, Homo sapiens
aggaagaagagcucagaua

SEQ ID NO: 227757 - RNA, 19 nt, Homo sapiens
ggagaggaacagagauaca

SEQ ID NO: 227758 - RNA, 19 nt, Homo sapiens
gaucacccagcgcuucuau

SEQ ID NO: 227759 - RNA, 19 nt, Homo sapiens
aggauuacaucucccugaa

SEQ ID NO: 227760 - RNA, 19 nt, Homo sapiens
cguacgacggcaaggauua

SEQ ID NO: 227761 - RNA, 19 nt, Homo sapiens
gcgagugccuggaguugcu

SEQ ID NO: 227762 - RNA, 19 nt, Homo sapiens
agaagcaagauaucaaugu

SEQ ID NO: 227763 - RNA, 19 nt, Homo sapiens
ugagaagcaagauaucaau

SEQ ID NO: 227764 - RNA, 19 nt, Homo sapiens
ggacaccguggcucagauc

SEQ ID NO: 227765 - RNA, 19 nt, Homo sapiens
cagcuaauaaagugugaga

SEQ ID NO: 227766 - RNA, 19 nt, Homo sapiens
cuggagaggaacagagaua

SEQ ID NO: 227767 - RNA, 19 nt, Homo sapiens
ggaacagacccaggacaca

SEQ ID NO: 227768 - RNA, 19 nt, Homo sapiens
cuacaucgccguggaguac

SEQ ID NO: 227769 - RNA, 19 nt, Homo sapiens
gggacugagaagcaagaua

SEQ ID NO: 227770 - RNA, 19 nt, Homo sapiens
gcucccacuccuugaggua

SEQ ID NO: 227771 - RNA, 19 nt, Homo sapiens
gaagauuccugaaauuuga

SEQ ID NO: 227772 - RNA, 19 nt, Homo sapiens
ggagaagauuccugaaauu

SEQ ID NO: 227773 - RNA, 19 nt, Homo sapiens
ccaaucaccuuuccuguuc

SEQ ID NO: 227774 - RNA, 19 nt, Homo sapiens
gagaagauuccugaaauuu

SEQ ID NO: 227775 - RNA, 19 nt, Homo sapiens
gagauugauggguuaauua

SEQ ID NO: 227776 - RNA, 19 nt, Homo sapiens
aagaagagcucagauugaa

SEQ ID NO: 227777 - RNA, 19 nt, Homo sapiens
ccacugagcuauaacuuac

SEQ ID NO: 227778 - RNA, 19 nt, Homo sapiens
gugaugggcuguuuaaagu

SEQ ID NO: 227779 - RNA, 19 nt, Homo sapiens
gcuauaacuuacuucugua

SEQ ID NO: 227780 - RNA, 19 nt, Homo sapiens
gcacagacugacagaauga

SEQ ID NO: 227781 - RNA, 19 nt, Homo sapiens
caauguggcugaacaaagg

SEQ ID NO: 227782 - RNA, 19 nt, Homo sapiens
ucucacggcuuguaaaugu

SEQ ID NO: 227783 - RNA, 19 nt, Homo sapiens
gaugggcuguuuaaagugu

SEQ ID NO: 227784 - RNA, 19 nt, Homo sapiens
gcuaugagguuucuuugac

SEQ ID NO: 227785 - RNA, 19 nt, Homo sapiens
aagagagauugauggguua

SEQ ID NO: 227786 - RNA, 19 nt, Homo sapiens
agagauugauggguuaauu

SEQ ID NO: 227787 - RNA, 19 nt, Homo sapiens
gaagagcucagauugaaaa

SEQ ID NO: 227788 - RNA, 19 nt, Homo sapiens
gagcucagauugaaaagga

SEQ ID NO: 227789 - RNA, 19 nt, Homo sapiens
uaucguugcuggccugguu

SEQ ID NO: 227790 - RNA, 19 nt, Homo sapiens
caucuccuguggucucuga

SEQ ID NO: 227791 - RNA, 19 nt, Homo sapiens
gaagaggagacacggaaca

SEQ ID NO: 227792 - RNA, 19 nt, Homo sapiens
agaagauuccugaaauuug

SEQ ID NO: 227793 - RNA, 19 nt, Homo sapiens
caugugaugggcuguuuaa

SEQ ID NO: 227794 - RNA, 19 nt, Homo sapiens
guucuacucuaggcaguga

SEQ ID NO: 227795 - RNA, 19 nt, Homo sapiens
aggauuaccucgcccugaa

SEQ ID NO: 227796 - RNA, 19 nt, Homo sapiens
caccuuuccuguuccagaa

SEQ ID NO: 227797 - RNA, 19 nt, Homo sapiens
gagauacacgugccaugug

SEQ ID NO: 227798 - RNA, 19 nt, Homo sapiens
ccuacgauggcaaggauua

SEQ ID NO: 227799 - RNA, 19 nt, Homo sapiens
gcaugugaugggcuguuua

SEQ ID NO: 227800 - RNA, 19 nt, Homo sapiens
ccagggcucuaaugugucu

SEQ ID NO: 227801 - RNA, 19 nt, Homo sapiens
ggacacugcggcucagauc

SEQ ID NO: 227802 - RNA, 19 nt, Homo sapiens
agcuauaacuuacuucugu

SEQ ID NO: 227803 - RNA, 19 nt, Homo sapiens
ccgucucugucucaaauuu

SEQ ID NO: 227804 - RNA, 19 nt, Homo sapiens
uaugagguuucuuugacuu

SEQ ID NO: 227805 - RNA, 19 nt, Homo sapiens
ugaacaguaugccuacgau

SEQ ID NO: 227806 - RNA, 19 nt, Homo sapiens
ccgcgguccugguucuaaa

SEQ ID NO: 227807 - RNA, 19 nt, Homo sapiens
ucacccacccggacucauu

SEQ ID NO: 227808 - RNA, 19 nt, Homo sapiens
cacugugacugauaugaau

SEQ ID NO: 227809 - RNA, 19 nt, Homo sapiens
acucucaggcugcaaguaa

SEQ ID NO: 227810 - RNA, 19 nt, Homo sapiens
ucuccaagcgcaaguguga

SEQ ID NO: 227811 - RNA, 19 nt, Homo sapiens
gguuguccuugcagcugua

SEQ ID NO: 227812 - RNA, 19 nt, Homo sapiens
caucauggguaucguugcu

SEQ ID NO: 227813 - RNA, 19 nt, Homo sapiens
cgcacagacugacagaaug

SEQ ID NO: 227814 - RNA, 19 nt, Homo sapiens
ccugaaauuugagagacaa

SEQ ID NO: 227815 - RNA, 19 nt, Homo sapiens
uggguuaauuaaaggagaa

SEQ ID NO: 227816 - RNA, 19 nt, Homo sapiens
cuccgucucugucucaaau

SEQ ID NO: 227817 - RNA, 19 nt, Homo sapiens
ugagguuucuuugacuuca

SEQ ID NO: 227818 - RNA, 19 nt, Homo sapiens
ugauguguguggguuguug

SEQ ID NO: 227819 - RNA, 19 nt, Homo sapiens
ccaauguggcugaacaaag

SEQ ID NO: 227820 - RNA, 19 nt, Homo sapiens
acugagcuauaacuuacuu

SEQ ID NO: 227821 - RNA, 19 nt, Homo sapiens
cccacuccaugagguauuu

SEQ ID NO: 227822 - RNA, 19 nt, Homo sapiens
gagcuauaacuuacuucug

SEQ ID NO: 227823 - RNA, 19 nt, Homo sapiens
uccacugagcuauaacuua

SEQ ID NO: 227824 - RNA, 19 nt, Homo sapiens
cccaaucaccuuuccuguu

SEQ ID NO: 227825 - RNA, 19 nt, Homo sapiens
gcucccacuccaugaggua

SEQ ID NO: 227826 - RNA, 19 nt, Homo sapiens
ugugaugggcuguuuaaag

SEQ ID NO: 227827 - RNA, 19 nt, Homo sapiens
ggaagaaauuguccaagaa

SEQ ID NO: 227828 - RNA, 19 nt, Homo sapiens
gaaacuaucccucuuguga

SEQ ID NO: 227829 - RNA, 19 nt, Homo sapiens
gaaagacacccuacaaaga

SEQ ID NO: 227830 - RNA, 19 nt, Homo sapiens
gggaagaaauuguccaaga

SEQ ID NO: 227831 - RNA, 19 nt, Homo sapiens
gcacugcgguguccacaug

SEQ ID NO: 227832 - RNA, 19 nt, Homo sapiens
gaagaaauuguccaagaaa

SEQ ID NO: 227833 - RNA, 19 nt, Homo sapiens
cagaguaaaucgcaaagaa

SEQ ID NO: 227834 - RNA, 19 nt, Homo sapiens
gaacugaagcgccuacaga

SEQ ID NO: 227835 - RNA, 19 nt, Homo sapiens
agaauuggcuggaagaaga

SEQ ID NO: 227836 - RNA, 19 nt, Homo sapiens
caacauacaugagaguaau

SEQ ID NO: 227837 - RNA, 19 nt, Homo sapiens
ccacaggauuucugcagua

SEQ ID NO: 227838 - RNA, 19 nt, Homo sapiens
uaaagagauuccuggagua

SEQ ID NO: 227839 - RNA, 19 nt, Homo sapiens
ccaagaaauugauuaugga

SEQ ID NO: 227840 - RNA, 19 nt, Homo sapiens
ggaaagacacccuacaaag

SEQ ID NO: 227841 - RNA, 19 nt, Homo sapiens
ccuguuaccucucaucauu

SEQ ID NO: 227842 - RNA, 19 nt, Homo sapiens
ugacgacacccacaacaua

SEQ ID NO: 227843 - RNA, 19 nt, Homo sapiens
aaagacacccuacaaagaa

SEQ ID NO: 227844 - RNA, 19 nt, Homo sapiens
uuacagcucucuucugcaa

SEQ ID NO: 227845 - RNA, 19 nt, Homo sapiens
ccucagagcagcaaccuuu

SEQ ID NO: 227846 - RNA, 19 nt, Homo sapiens
uguauugccuggcuaaaga

SEQ ID NO: 227847 - RNA, 19 nt, Homo sapiens
gggaaagacacccuacaaa

SEQ ID NO: 227848 - RNA, 19 nt, Homo sapiens
cagaaacuaucccucuugu

SEQ ID NO: 227849 - RNA, 19 nt, Homo sapiens
gaaauugauuauggagaca

SEQ ID NO: 227850 - RNA, 19 nt, Homo sapiens
gaauguauugccuggcuaa

SEQ ID NO: 227851 - RNA, 19 nt, Homo sapiens
ggagccaucuaccuuccaa

SEQ ID NO: 227852 - RNA, 19 nt, Homo sapiens
uccaagaaauugauuaugg

SEQ ID NO: 227853 - RNA, 19 nt, Homo sapiens
guaaaucgcaaagaaacuu

SEQ ID NO: 227854 - RNA, 19 nt, Homo sapiens
acugauggcguuccuguua

SEQ ID NO: 227855 - RNA, 19 nt, Homo sapiens
cauaugacgggcaggauuu

SEQ ID NO: 227856 - RNA, 19 nt, Homo sapiens
gcauaugacgggcaggauu

SEQ ID NO: 227857 - RNA, 19 nt, Homo sapiens
gauggaagcaccacaggau

SEQ ID NO: 227858 - RNA, 19 nt, Homo sapiens
gcuggaagaagaauguauu

SEQ ID NO: 227859 - RNA, 19 nt, Homo sapiens
caacagaggagccacaaaa

SEQ ID NO: 227860 - RNA, 19 nt, Homo sapiens
ccagaaauuuacaugacau

SEQ ID NO: 227861 - RNA, 19 nt, Homo sapiens
agagauuccuggaguaugg

SEQ ID NO: 227862 - RNA, 19 nt, Homo sapiens
ggcagcagauguucaaggu

SEQ ID NO: 227863 - RNA, 19 nt, Homo sapiens
acucagggucucacacuua

SEQ ID NO: 227864 - RNA, 19 nt, Homo sapiens
ggucagaguaaaucgcaaa

SEQ ID NO: 227865 - RNA, 19 nt, Homo sapiens
agagaaugauuggcuguga

SEQ ID NO: 227866 - RNA, 19 nt, Homo sapiens
ccauuguccuugucauugu

SEQ ID NO: 227867 - RNA, 19 nt, Homo sapiens
uuccugaucuucaauaaag

SEQ ID NO: 227868 - RNA, 19 nt, Homo sapiens
ggaagcaccacaggauuuc

SEQ ID NO: 227869 - RNA, 19 nt, Homo sapiens
cuacagaggcacuacaauc

SEQ ID NO: 227870 - RNA, 19 nt, Homo sapiens
ggcuggaguugguguucua

SEQ ID NO: 227871 - RNA, 19 nt, Homo sapiens
gaauuggcuggaagaagaa

SEQ ID NO: 227872 - RNA, 19 nt, Homo sapiens
caggauuucugcaguaugc

SEQ ID NO: 227873 - RNA, 19 nt, Homo sapiens
ccaguucuccuuccucuag

SEQ ID NO: 227874 - RNA, 19 nt, Homo sapiens
gaguaaaucgcaaagaaac

SEQ ID NO: 227875 - RNA, 19 nt, Homo sapiens
uggaagcaccacaggauuu

SEQ ID NO: 227876 - RNA, 19 nt, Homo sapiens
agaguaaaucgcaaagaaa

SEQ ID NO: 227877 - RNA, 19 nt, Homo sapiens
aacaccagaucgaugauug

SEQ ID NO: 227878 - RNA, 19 nt, Homo sapiens
ucagaaacuaucccucuug

SEQ ID NO: 227879 - RNA, 19 nt, Homo sapiens
gauugcagaucccucuuuu

SEQ ID NO: 227880 - RNA, 19 nt, Homo sapiens
gauuuccugaucuucaaua

SEQ ID NO: 227881 - RNA, 19 nt, Homo sapiens
gauggacuguuuuaucaga

SEQ ID NO: 227882 - RNA, 19 nt, Homo sapiens
ccaggaaucagaaacuauc

SEQ ID NO: 227883 - RNA, 19 nt, Homo sapiens
caacaccagaucgaugauu

SEQ ID NO: 227884 - RNA, 19 nt, Homo sapiens
gauuauggagacauucuuc

SEQ ID NO: 227885 - RNA, 19 nt, Homo sapiens
uugccuggcuaaagagauu

SEQ ID NO: 227886 - RNA, 19 nt, Homo sapiens
ucuccuggcuggcuguaga

SEQ ID NO: 227887 - RNA, 19 nt, Homo sapiens
cacaggauuucugcaguau

SEQ ID NO: 227888 - RNA, 19 nt, Homo sapiens
uacagaggcacuacaauca

SEQ ID NO: 227889 - RNA, 19 nt, Homo sapiens
gcaacagaggagccacaaa

SEQ ID NO: 227890 - RNA, 19 nt, Homo sapiens
aaagagauuccuggaguau

SEQ ID NO: 227891 - RNA, 19 nt, Homo sapiens
cagaggcacuacaaucacu

SEQ ID NO: 227892 - RNA, 19 nt, Homo sapiens
caugaguugcuguaucaaa

SEQ ID NO: 227893 - RNA, 19 nt, Homo sapiens
acaacauacaugagaguaa

SEQ ID NO: 227894 - RNA, 19 nt, Homo sapiens
aacuaucccucuugugaug

SEQ ID NO: 227895 - RNA, 19 nt, Homo sapiens
cccagaaauuuacaugaca

SEQ ID NO: 227896 - RNA, 19 nt, Homo sapiens
gggaggccaaucagcauga

SEQ ID NO: 227897 - RNA, 19 nt, Homo sapiens
gagccauguuauccucugu

SEQ ID NO: 227898 - RNA, 19 nt, Homo sapiens
acagcucucuucugcaaag

SEQ ID NO: 227899 - RNA, 19 nt, Homo sapiens
aaccuuuacuccugucaug

SEQ ID NO: 227900 - RNA, 19 nt, Homo sapiens
ggaguugguguucuagucu

SEQ ID NO: 227901 - RNA, 19 nt, Homo sapiens
uguuaccucucaucauugu

SEQ ID NO: 227902 - RNA, 19 nt, Homo sapiens
ccacuggucagaguaaauc

SEQ ID NO: 227903 - RNA, 19 nt, Homo sapiens
cuggcuggcuguagauaau

SEQ ID NO: 227904 - RNA, 19 nt, Homo sapiens
uaucaggcgugggcaucaa

SEQ ID NO: 227905 - RNA, 19 nt, Homo sapiens
cgcacccuaucaccacaua

SEQ ID NO: 227906 - RNA, 19 nt, Homo sapiens
acaugagaguaaugggauu

SEQ ID NO: 227907 - RNA, 19 nt, Homo sapiens
uggaguugguguucuaguc

SEQ ID NO: 227908 - RNA, 19 nt, Homo sapiens
cuaucccucuugugaugaa

SEQ ID NO: 227909 - RNA, 19 nt, Homo sapiens
gcguuccuguuaccucuca

SEQ ID NO: 227910 - RNA, 19 nt, Homo sapiens
ugggaaagacacccuacaa

SEQ ID NO: 227911 - RNA, 19 nt, Homo sapiens
cagaggagccacaaaaugu

SEQ ID NO: 227912 - RNA, 19 nt, Homo sapiens
ccacaacauacaugagagu

SEQ ID NO: 227913 - RNA, 19 nt, Homo sapiens
gacgacacccacaacauac

SEQ ID NO: 227914 - RNA, 19 nt, Homo sapiens
uccaacaccagaucgauga

SEQ ID NO: 227915 - RNA, 19 nt, Homo sapiens
aaacuaucccucuugugau

SEQ ID NO: 227916 - RNA, 19 nt, Homo sapiens
gcagauguucaagguggaa

SEQ ID NO: 227917 - RNA, 19 nt, Homo sapiens
ccucucaucauuguguuaa

SEQ ID NO: 227918 - RNA, 19 nt, Homo sapiens
ucaaaagaauuggcuggaa

SEQ ID NO: 227919 - RNA, 19 nt, Homo sapiens
gaaaugggcuuaauaguga

SEQ ID NO: 227920 - RNA, 19 nt, Homo sapiens
gaacaugcuuggacacuua

SEQ ID NO: 227921 - RNA, 19 nt, Homo sapiens
gaaacaaguuccugccuua

SEQ ID NO: 227922 - RNA, 19 nt, Homo sapiens
gaacaugggagaauccuua

SEQ ID NO: 227923 - RNA, 19 nt, Homo sapiens
ggaaaugaggcuucaauua

SEQ ID NO: 227924 - RNA, 19 nt, Homo sapiens
ggaaaucaguucauuacuu

SEQ ID NO: 227925 - RNA, 19 nt, Homo sapiens
cuaaaugccuguagagaua

SEQ ID NO: 227926 - RNA, 19 nt, Homo sapiens
ggacuuacguuuauuguca

SEQ ID NO: 227927 - RNA, 19 nt, Homo sapiens
gauaucaacuuacgaguga

SEQ ID NO: 227928 - RNA, 19 nt, Homo sapiens
gauagaugguuaagaagua

SEQ ID NO: 227929 - RNA, 19 nt, Homo sapiens
acaaagaucucgaggcuaa

SEQ ID NO: 227930 - RNA, 19 nt, Homo sapiens
gaaaugaggcuucaauuag

SEQ ID NO: 227931 - RNA, 19 nt, Homo sapiens
guacugaacuguaagaaca

SEQ ID NO: 227932 - RNA, 19 nt, Homo sapiens
gaacaagugggcccuauuu

SEQ ID NO: 227933 - RNA, 19 nt, Homo sapiens
gaaaucagggauccucuua

SEQ ID NO: 227934 - RNA, 19 nt, Homo sapiens
caagagcuuuaguuacuua

SEQ ID NO: 227935 - RNA, 19 nt, Homo sapiens
caaaaucccuucauuguaa

SEQ ID NO: 227936 - RNA, 19 nt, Homo sapiens
gagcugccaucaucacuuu

SEQ ID NO: 227937 - RNA, 19 nt, Homo sapiens
cuacaagccucaugaaaga

SEQ ID NO: 227938 - RNA, 19 nt, Homo sapiens
ucaaggagcuuuaaagucu

SEQ ID NO: 227939 - RNA, 19 nt, Homo sapiens
gagggcaucugcagaauau

SEQ ID NO: 227940 - RNA, 19 nt, Homo sapiens
agaauuagcugaauaaagg

SEQ ID NO: 227941 - RNA, 19 nt, Homo sapiens
ggaaaugggcuuaauagug

SEQ ID NO: 227942 - RNA, 19 nt, Homo sapiens
uaagccaguuucagauuua

SEQ ID NO: 227943 - RNA, 19 nt, Homo sapiens
gaagagacaggaucaaguu

SEQ ID NO: 227944 - RNA, 19 nt, Homo sapiens
gguacaaagugagaauuua

SEQ ID NO: 227945 - RNA, 19 nt, Homo sapiens
gcacaggacagcccuauga

SEQ ID NO: 227946 - RNA, 19 nt, Homo sapiens
gcucugggauagaugguua

SEQ ID NO: 227947 - RNA, 19 nt, Homo sapiens
ccagaucuguuugcucuua

SEQ ID NO: 227948 - RNA, 19 nt, Homo sapiens
gcccaagccuucuuucaaa

SEQ ID NO: 227949 - RNA, 19 nt, Homo sapiens
gaacagcaccauugaguca

SEQ ID NO: 227950 - RNA, 19 nt, Homo sapiens
gaaaugcacuuagauuguc

SEQ ID NO: 227951 - RNA, 19 nt, Homo sapiens
ucaaagaguuucaggacaa

SEQ ID NO: 227952 - RNA, 19 nt, Homo sapiens
gaaauaaccccaucuugua

SEQ ID NO: 227953 - RNA, 19 nt, Homo sapiens
aaacggaaaugcacuuaga

SEQ ID NO: 227954 - RNA, 19 nt, Homo sapiens
caaaggcuauggagauguu

SEQ ID NO: 227955 - RNA, 19 nt, Homo sapiens
gaaaugaagccuuuugaua

SEQ ID NO: 227956 - RNA, 19 nt, Homo sapiens
gggagguacugaacuguaa

SEQ ID NO: 227957 - RNA, 19 nt, Homo sapiens
uauagucugucuaccuuua

SEQ ID NO: 227958 - RNA, 19 nt, Homo sapiens
acucagaagucauaaguuu

SEQ ID NO: 227959 - RNA, 19 nt, Homo sapiens
uggagaaacugaucaaaga

SEQ ID NO: 227960 - RNA, 19 nt, Homo sapiens
ccagcucucucuuagauuu

SEQ ID NO: 227961 - RNA, 19 nt, Homo sapiens
gauacgaaguccuuagaga

SEQ ID NO: 227962 - RNA, 19 nt, Homo sapiens
ccgaagaccuguaccagaa

SEQ ID NO: 227963 - RNA, 19 nt, Homo sapiens
ggacagaggaucccguuug

SEQ ID NO: 227964 - RNA, 19 nt, Homo sapiens
ugaaggaaguuaaggauca

SEQ ID NO: 227965 - RNA, 19 nt, Homo sapiens
ugggauagaugguuaagaa

SEQ ID NO: 227966 - RNA, 19 nt, Homo sapiens
gcaggaaaugggcuuaaua

SEQ ID NO: 227967 - RNA, 19 nt, Homo sapiens
aaaugaggcuucaauuaga

SEQ ID NO: 227968 - RNA, 19 nt, Homo sapiens
ggaaagaaaguuugaugga

SEQ ID NO: 227969 - RNA, 19 nt, Homo sapiens
cuuauuggcuguggauuua

SEQ ID NO: 227970 - RNA, 19 nt, Homo sapiens
ggaaaugcacuuagauugu

SEQ ID NO: 227971 - RNA, 19 nt, Homo sapiens
gaaauuaguggaaagaaag

SEQ ID NO: 227972 - RNA, 19 nt, Homo sapiens
ucaacgaccucaucacaga

SEQ ID NO: 227973 - RNA, 19 nt, Homo sapiens
ggacauugacaguuauauu

SEQ ID NO: 227974 - RNA, 19 nt, Homo sapiens
guguggacauugacaguua

SEQ ID NO: 227975 - RNA, 19 nt, Homo sapiens
guaagccucugcaauuuua

SEQ ID NO: 227976 - RNA, 19 nt, Homo sapiens
gaacagccaguccauugaa

SEQ ID NO: 227977 - RNA, 19 nt, Homo sapiens
gaacugaagcccuuaagag

SEQ ID NO: 227978 - RNA, 19 nt, Homo sapiens
gcguaagccucugcaauuu

SEQ ID NO: 227979 - RNA, 19 nt, Homo sapiens
ucucagagcugccaucauc

SEQ ID NO: 227980 - RNA, 19 nt, Homo sapiens
uagaagacauggcauuuua

SEQ ID NO: 227981 - RNA, 19 nt, Homo sapiens
gaaguggcccaacgauauu

SEQ ID NO: 227982 - RNA, 19 nt, Homo sapiens
ugagguccauucccaagua

SEQ ID NO: 227983 - RNA, 19 nt, Homo sapiens
gaacauuucaacuuagaga

SEQ ID NO: 227984 - RNA, 19 nt, Homo sapiens
ggaggacagugcucucaga

SEQ ID NO: 227985 - RNA, 19 nt, Homo sapiens
caaaggaugucucugaaaa

SEQ ID NO: 227986 - RNA, 19 nt, Homo sapiens
gaccuucccuacgauuaua

SEQ ID NO: 227987 - RNA, 19 nt, Homo sapiens
gagaucauccucuucagaa

SEQ ID NO: 227988 - RNA, 19 nt, Homo sapiens
gaaguguggccuugucaaa

SEQ ID NO: 227989 - RNA, 19 nt, Homo sapiens
gguaugcuaucacuguuug

SEQ ID NO: 227990 - RNA, 19 nt, Homo sapiens
ccaggccaguggugaguua

SEQ ID NO: 227991 - RNA, 19 nt, Homo sapiens
gaagaacccaaacaaagga

SEQ ID NO: 227992 - RNA, 19 nt, Homo sapiens
ggacuccacucugaaggaa

SEQ ID NO: 227993 - RNA, 19 nt, Homo sapiens
gucaagagcuuuaguuacu

SEQ ID NO: 227994 - RNA, 19 nt, Homo sapiens
agacagacuuccaagaguu

SEQ ID NO: 227995 - RNA, 19 nt, Homo sapiens
ccaugcaucuggaaaucua

SEQ ID NO: 227996 - RNA, 19 nt, Homo sapiens
acagugaccucaugaagau

SEQ ID NO: 227997 - RNA, 19 nt, Homo sapiens
gaugugcucuuucuacucu

SEQ ID NO: 227998 - RNA, 19 nt, Homo sapiens
caucagaacauuucaacuu

SEQ ID NO: 227999 - RNA, 19 nt, Homo sapiens
ggccagcucucucuuagau

SEQ ID NO: 228000 - RNA, 19 nt, Homo sapiens
ggaccacgcuccuagaaaa

SEQ ID NO: 228001 - RNA, 19 nt, Homo sapiens
ggccaccugugcuaguuua

SEQ ID NO: 228002 - RNA, 19 nt, Homo sapiens
aaaccacucuucuccaaau

SEQ ID NO: 228003 - RNA, 19 nt, Homo sapiens
caaagaguuucaggacaaa

SEQ ID NO: 228004 - RNA, 19 nt, Homo sapiens
cagaacauuucaacuuaga

SEQ ID NO: 228005 - RNA, 19 nt, Homo sapiens
ccaguggguuguugagauu

SEQ ID NO: 228006 - RNA, 19 nt, Homo sapiens
ugaaguggcccaacgauau

SEQ ID NO: 228007 - RNA, 19 nt, Homo sapiens
gacagaggaucccguuugu

SEQ ID NO: 228008 - RNA, 19 nt, Homo sapiens
ccucagcugugacaugaaa

SEQ ID NO: 228009 - RNA, 19 nt, Homo sapiens
gacguugccugaugugaga

SEQ ID NO: 228010 - RNA, 19 nt, Homo sapiens
gaacaaaaucccuucauug

SEQ ID NO: 228011 - RNA, 19 nt, Homo sapiens
agagcuagcuggugugguu

SEQ ID NO: 228012 - RNA, 19 nt, Homo sapiens
aaucagggauccucuuaug

SEQ ID NO: 228013 - RNA, 19 nt, Homo sapiens
gagucaaccucacgggaaa

SEQ ID NO: 228014 - RNA, 19 nt, Homo sapiens
gaagugcaaauuuaaagug

SEQ ID NO: 228015 - RNA, 19 nt, Homo sapiens
ucugcuggcugcuauuaua

SEQ ID NO: 228016 - RNA, 19 nt, Homo sapiens
acugauagcuguucguguu

SEQ ID NO: 228017 - RNA, 19 nt, Homo sapiens
ucucgaggcuaacgaugua

SEQ ID NO: 228018 - RNA, 19 nt, Homo sapiens
ccucauuuaccucguauua

SEQ ID NO: 228019 - RNA, 19 nt, Homo sapiens
gaaauucaguucagcauca

SEQ ID NO: 228020 - RNA, 19 nt, Homo sapiens
cagcaaagaccucaaauuu

SEQ ID NO: 228021 - RNA, 19 nt, Homo sapiens
gguuugagauucagaagua

SEQ ID NO: 228022 - RNA, 19 nt, Homo sapiens
gagccuaccucccgacauu

SEQ ID NO: 228023 - RNA, 19 nt, Homo sapiens
gcgcuuggcugcuuauaga

SEQ ID NO: 228024 - RNA, 19 nt, Homo sapiens
uaacgaggcuucugcaauc

SEQ ID NO: 228025 - RNA, 19 nt, Homo sapiens
gcacuuaggacgccuuaaa

SEQ ID NO: 228026 - RNA, 19 nt, Homo sapiens
gaucucacuucccugcuaa

SEQ ID NO: 228027 - RNA, 19 nt, Homo sapiens
ggacuauuauuguuguugu

SEQ ID NO: 228028 - RNA, 19 nt, Homo sapiens
caaggaggcuggcgagaag

SEQ ID NO: 228029 - RNA, 19 nt, Homo sapiens
ggcaauaguuucagcuuca

SEQ ID NO: 228030 - RNA, 19 nt, Homo sapiens
gcaccaaacaacaguuauu

SEQ ID NO: 228031 - RNA, 19 nt, Homo sapiens
ggaaaggccuggagaaaag

SEQ ID NO: 228032 - RNA, 19 nt, Homo sapiens
gcaacacgcugagagaucu

SEQ ID NO: 228033 - RNA, 19 nt, Homo sapiens
ucuuagggcuuagcuauuu

SEQ ID NO: 228034 - RNA, 19 nt, Homo sapiens
caccaaacaacaguuauua

SEQ ID NO: 228035 - RNA, 19 nt, Homo sapiens
gaggaaaggccuggagaaa

SEQ ID NO: 228036 - RNA, 19 nt, Homo sapiens
gagaaaagguuugagauuc

SEQ ID NO: 228037 - RNA, 19 nt, Homo sapiens
cagcaucaguuccaagaca

SEQ ID NO: 228038 - RNA, 19 nt, Homo sapiens
uaacggacuauuauuguug

SEQ ID NO: 228039 - RNA, 19 nt, Homo sapiens
ccaaacaacaguuauuaag

SEQ ID NO: 228040 - RNA, 19 nt, Homo sapiens
ugaccaagccggaccgaaa

SEQ ID NO: 228041 - RNA, 19 nt, Homo sapiens
cuaacggacuauuauuguu

SEQ ID NO: 228042 - RNA, 19 nt, Homo sapiens
uuaggacgccuuaaauuug

SEQ ID NO: 228043 - RNA, 19 nt, Homo sapiens
cuuaggacgccuuaaauuu

SEQ ID NO: 228044 - RNA, 19 nt, Homo sapiens
acugugagguguuugacua

SEQ ID NO: 228045 - RNA, 19 nt, Homo sapiens
uaggacgccuuaaauuugu

SEQ ID NO: 228046 - RNA, 19 nt, Homo sapiens
gcucuuagggcuuagcuau

SEQ ID NO: 228047 - RNA, 19 nt, Homo sapiens
guucgacugugagguguuu

SEQ ID NO: 228048 - RNA, 19 nt, Homo sapiens
ccuaacuaacggacuauua

SEQ ID NO: 228049 - RNA, 19 nt, Homo sapiens
uaaacucgaacccaagaaa

SEQ ID NO: 228050 - RNA, 19 nt, Homo sapiens
ggaauugaccgcauuuuau

SEQ ID NO: 228051 - RNA, 19 nt, Homo sapiens
cuaacuaacggacuauuau

SEQ ID NO: 228052 - RNA, 19 nt, Homo sapiens
ucuccaaccugcagaggaa

SEQ ID NO: 228053 - RNA, 19 nt, Homo sapiens
gcaauccugagucccuuaa

SEQ ID NO: 228054 - RNA, 19 nt, Homo sapiens
gaacccaagaaauucaguu

SEQ ID NO: 228055 - RNA, 19 nt, Homo sapiens
caaacaacaguuauuaagg

SEQ ID NO: 228056 - RNA, 19 nt, Homo sapiens
ggagaaaagguuugagauu

SEQ ID NO: 228057 - RNA, 19 nt, Homo sapiens
ccuaugcugugcucacgaa

SEQ ID NO: 228058 - RNA, 19 nt, Homo sapiens
ccagcaaagaccucaaauu

SEQ ID NO: 228059 - RNA, 19 nt, Homo sapiens
ggacgccuuaaauuuguaa

SEQ ID NO: 228060 - RNA, 19 nt, Homo sapiens
gagucucaguguccugcua

SEQ ID NO: 228061 - RNA, 19 nt, Homo sapiens
guauguuggcgacuuggua

SEQ ID NO: 228062 - RNA, 19 nt, Homo sapiens
caggcugguucgacuguga

SEQ ID NO: 228063 - RNA, 19 nt, Homo sapiens
agaucucacuucccugcua

SEQ ID NO: 228064 - RNA, 19 nt, Homo sapiens
agaaaagguuugagauuca

SEQ ID NO: 228065 - RNA, 19 nt, Homo sapiens
ccagaggucguggcucaaa

SEQ ID NO: 228066 - RNA, 19 nt, Homo sapiens
gcaauaguuucagcuucag

SEQ ID NO: 228067 - RNA, 19 nt, Homo sapiens
acaccaugccgcagacgua

SEQ ID NO: 228068 - RNA, 19 nt, Homo sapiens
auuuagcucuuagggcuua

SEQ ID NO: 228069 - RNA, 19 nt, Homo sapiens
cccaagaaauucaguucag

SEQ ID NO: 228070 - RNA, 19 nt, Homo sapiens
cuucuacgccuccaacuuc

SEQ ID NO: 228071 - RNA, 19 nt, Homo sapiens
gggcuggguuuugugcuua

SEQ ID NO: 228072 - RNA, 19 nt, Homo sapiens
cugcaccaaacaacaguua

SEQ ID NO: 228073 - RNA, 19 nt, Homo sapiens
acaaggaggcuggcgagaa

SEQ ID NO: 228074 - RNA, 19 nt, Homo sapiens
gaccaagccggaccgaaag

SEQ ID NO: 228075 - RNA, 19 nt, Homo sapiens
aaacucgaacccaagaaau

SEQ ID NO: 228076 - RNA, 19 nt, Homo sapiens
aaagaccucaaauuuggaa

SEQ ID NO: 228077 - RNA, 19 nt, Homo sapiens
ugugagguguuugacuaaa

SEQ ID NO: 228078 - RNA, 19 nt, Homo sapiens
ucaguuccaagacacguuu

SEQ ID NO: 228079 - RNA, 19 nt, Homo sapiens
gaauugaccgcauuuuauc

SEQ ID NO: 228080 - RNA, 19 nt, Homo sapiens
cuagccagccgaacacuuc

SEQ ID NO: 228081 - RNA, 19 nt, Homo sapiens
cagcagcgccagcagucuu

SEQ ID NO: 228082 - RNA, 19 nt, Homo sapiens
uuaacgaggcuucugcaau

SEQ ID NO: 228083 - RNA, 19 nt, Homo sapiens
augcugugcucacgaagga

SEQ ID NO: 228084 - RNA, 19 nt, Homo sapiens
caacagccuuugaauguaa

SEQ ID NO: 228085 - RNA, 19 nt, Homo sapiens
gcaacagccuuugaaugua

SEQ ID NO: 228086 - RNA, 19 nt, Homo sapiens
gaaaacagcccaaagauga

SEQ ID NO: 228087 - RNA, 19 nt, Homo sapiens
ggaggagucuggagucuag

SEQ ID NO: 228088 - RNA, 19 nt, Homo sapiens
gaacaugcccuggagaaga

SEQ ID NO: 228089 - RNA, 19 nt, Homo sapiens
caucacugcucguaacauu

SEQ ID NO: 228090 - RNA, 19 nt, Homo sapiens
ugaaggaccugcccacugu

SEQ ID NO: 228091 - RNA, 19 nt, Homo sapiens
uagaaacccugccagagaa

SEQ ID NO: 228092 - RNA, 19 nt, Homo sapiens
ucagauagcauacaagaga

SEQ ID NO: 228093 - RNA, 19 nt, Homo sapiens
ucaugaugcuguugucuuu

SEQ ID NO: 228094 - RNA, 19 nt, Homo sapiens
caucuggaguucaggagua

SEQ ID NO: 228095 - RNA, 19 nt, Homo sapiens
gcggagccaugucugguaa

SEQ ID NO: 228096 - RNA, 19 nt, Homo sapiens
guaaccaauccuacuaaua

SEQ ID NO: 228097 - RNA, 19 nt, Homo sapiens
ggaguucagugccaucauc

SEQ ID NO: 228098 - RNA, 19 nt, Homo sapiens
gaagaaaacagcccaaaga

SEQ ID NO: 228099 - RNA, 19 nt, Homo sapiens
gauguugcacggcagcuua

SEQ ID NO: 228100 - RNA, 19 nt, Homo sapiens
gcucagauagcauacaaga

SEQ ID NO: 228101 - RNA, 19 nt, Homo sapiens
gcaucagccuggccaacuu

SEQ ID NO: 228102 - RNA, 19 nt, Homo sapiens
gaaguggaccugguuguuc

SEQ ID NO: 228103 - RNA, 19 nt, Homo sapiens
cuagaaacccugccagaga

SEQ ID NO: 228104 - RNA, 19 nt, Homo sapiens
auacugcacucucuaagau

SEQ ID NO: 228105 - RNA, 19 nt, Homo sapiens
caacauugaaagccucgua

SEQ ID NO: 228106 - RNA, 19 nt, Homo sapiens
gcauacagacggacagugu

SEQ ID NO: 228107 - RNA, 19 nt, Homo sapiens
gaaugaaguggaccugguu

SEQ ID NO: 228108 - RNA, 19 nt, Homo sapiens
ggagagaaaagccuguuua

SEQ ID NO: 228109 - RNA, 19 nt, Homo sapiens
uaacgaugcccauuaacug

SEQ ID NO: 228110 - RNA, 19 nt, Homo sapiens
ccaguuggcugcccagaac

SEQ ID NO: 228111 - RNA, 19 nt, Homo sapiens
gauacugcacucucuaaga

SEQ ID NO: 228112 - RNA, 19 nt, Homo sapiens
agagaaaguucccgcaucu

SEQ ID NO: 228113 - RNA, 19 nt, Homo sapiens
aacaugcccuggagaagaa

SEQ ID NO: 228114 - RNA, 19 nt, Homo sapiens
ccaagcaacagccuuugaa

SEQ ID NO: 228115 - RNA, 19 nt, Homo sapiens
gcccaaagaugagagugau

SEQ ID NO: 228116 - RNA, 19 nt, Homo sapiens
gcggagaccaggagucaga

SEQ ID NO: 228117 - RNA, 19 nt, Homo sapiens
ccaaggaccaggacaucuu

SEQ ID NO: 228118 - RNA, 19 nt, Homo sapiens
gagaaaagccuguuuacca

SEQ ID NO: 228119 - RNA, 19 nt, Homo sapiens
acagugugguggcaacauu

SEQ ID NO: 228120 - RNA, 19 nt, Homo sapiens
cggcucagauagcauacaa

SEQ ID NO: 228121 - RNA, 19 nt, Homo sapiens
agacggcucagauagcaua

SEQ ID NO: 228122 - RNA, 19 nt, Homo sapiens
ugaaggaugggcaacugua

SEQ ID NO: 228123 - RNA, 19 nt, Homo sapiens
ccaaagaugagagugauuc

SEQ ID NO: 228124 - RNA, 19 nt, Homo sapiens
ggaaaacccucaugaugcu

SEQ ID NO: 228125 - RNA, 19 nt, Homo sapiens
ggccugcaguuugaaauca

SEQ ID NO: 228126 - RNA, 19 nt, Homo sapiens
gaauguaaccaauccuacu

SEQ ID NO: 228127 - RNA, 19 nt, Homo sapiens
ugccuugccuccucaguau

SEQ ID NO: 228128 - RNA, 19 nt, Homo sapiens
agaaaagccuguuuaccaa

SEQ ID NO: 228129 - RNA, 19 nt, Homo sapiens
ccugaggaaugcauguaug

SEQ ID NO: 228130 - RNA, 19 nt, Homo sapiens
agcaacagccuuugaaugu

SEQ ID NO: 228131 - RNA, 19 nt, Homo sapiens
ggaugacccacaguuggua

SEQ ID NO: 228132 - RNA, 19 nt, Homo sapiens
aagauggcccugaggauga

SEQ ID NO: 228133 - RNA, 19 nt, Homo sapiens
cuagacggcucagauagca

SEQ ID NO: 228134 - RNA, 19 nt, Homo sapiens
acacacagccuacuuucca

SEQ ID NO: 228135 - RNA, 19 nt, Homo sapiens
guaggcaucacugcucgua

SEQ ID NO: 228136 - RNA, 19 nt, Homo sapiens
caagcaacagccuuugaau

SEQ ID NO: 228137 - RNA, 19 nt, Homo sapiens
cgaugcccauuaacugguu

SEQ ID NO: 228138 - RNA, 19 nt, Homo sapiens
gaaggaugggcaacuguac

SEQ ID NO: 228139 - RNA, 19 nt, Homo sapiens
ggaccaggacaucuuggau

SEQ ID NO: 228140 - RNA, 19 nt, Homo sapiens
aaguggaccugguuguuca

SEQ ID NO: 228141 - RNA, 19 nt, Homo sapiens
acugcacucucuaagauug

SEQ ID NO: 228142 - RNA, 19 nt, Homo sapiens
uguaaccaauccuacuaau

SEQ ID NO: 228143 - RNA, 19 nt, Homo sapiens
aauguaaccaauccuacua

SEQ ID NO: 228144 - RNA, 19 nt, Homo sapiens
uaugaaggaugggcaacug

SEQ ID NO: 228145 - RNA, 19 nt, Homo sapiens
ccacacacagccuacuuuc

SEQ ID NO: 228146 - RNA, 19 nt, Homo sapiens
ggaccugcccacugugcuu

SEQ ID NO: 228147 - RNA, 19 nt, Homo sapiens
acccuggccugcaguuuga

SEQ ID NO: 228148 - RNA, 19 nt, Homo sapiens
agucuagacggcucagaua

SEQ ID NO: 228149 - RNA, 19 nt, Homo sapiens
aagcaacagccuuugaaug

SEQ ID NO: 228150 - RNA, 19 nt, Homo sapiens
uagagaaguccaagcaaca

SEQ ID NO: 228151 - RNA, 19 nt, Homo sapiens
gccaguagccgugcauaca

SEQ ID NO: 228152 - RNA, 19 nt, Homo sapiens
gaugcccauuaacugguuu

SEQ ID NO: 228153 - RNA, 19 nt, Homo sapiens
gaaacccugccagagaaga

SEQ ID NO: 228154 - RNA, 19 nt, Homo sapiens
ugaaguggaccugguuguu

SEQ ID NO: 228155 - RNA, 19 nt, Homo sapiens
gcugagcaaaggagccaaa

SEQ ID NO: 228156 - RNA, 19 nt, Homo sapiens
ugaggaugacccacaguug

SEQ ID NO: 228157 - RNA, 19 nt, Homo sapiens
ccaugucccugcccagcau

SEQ ID NO: 228158 - RNA, 19 nt, Homo sapiens
ccagcuugcucgcauacag

SEQ ID NO: 228159 - RNA, 19 nt, Homo sapiens
ccugcaguuugaaaucauu

SEQ ID NO: 228160 - RNA, 19 nt, Homo sapiens
guugggaagacccuagaaa

SEQ ID NO: 228161 - RNA, 19 nt, Homo sapiens
gcuguccagugccuacauc

SEQ ID NO: 228162 - RNA, 19 nt, Homo sapiens
aaacagcccaaagaugaga

SEQ ID NO: 228163 - RNA, 19 nt, Homo sapiens
gccuuugaauguaaccaau

SEQ ID NO: 228164 - RNA, 19 nt, Homo sapiens
ggacgagcagcaggaguuc

SEQ ID NO: 228165 - RNA, 19 nt, Homo sapiens
cacacagccuacuuuccaa

SEQ ID NO: 228166 - RNA, 19 nt, Homo sapiens
gagucuagacggcucagau

SEQ ID NO: 228167 - RNA, 19 nt, Homo sapiens
guacacaacucacuccuuu

SEQ ID NO: 228168 - RNA, 19 nt, Homo sapiens
ccacuaaccuugccuggua

SEQ ID NO: 228169 - RNA, 19 nt, Homo sapiens
gcacagcacaaauuaguua

SEQ ID NO: 228170 - RNA, 19 nt, Homo sapiens
ggagagauguggaauaaca

SEQ ID NO: 228171 - RNA, 19 nt, Homo sapiens
ggaggaagaugaagaagau

SEQ ID NO: 228172 - RNA, 19 nt, Homo sapiens
guaaggcuguguaagauuu

SEQ ID NO: 228173 - RNA, 19 nt, Homo sapiens
ugaagaagaugaagaugaa

SEQ ID NO: 228174 - RNA, 19 nt, Homo sapiens
ggacaaggcccguuaugaa

SEQ ID NO: 228175 - RNA, 19 nt, Homo sapiens
ccgaaugugucuuuagaua

SEQ ID NO: 228176 - RNA, 19 nt, Homo sapiens
ggaggaagaugaggaagau

SEQ ID NO: 228177 - RNA, 19 nt, Homo sapiens
ucugaaugcuucuaaguaa

SEQ ID NO: 228178 - RNA, 19 nt, Homo sapiens
gggaggagcauaagaagaa

SEQ ID NO: 228179 - RNA, 19 nt, Homo sapiens
cgaaauaauuguuguucug

SEQ ID NO: 228180 - RNA, 19 nt, Homo sapiens
gaaauguaaggcuguguaa

SEQ ID NO: 228181 - RNA, 19 nt, Homo sapiens
agaagaagaugaugaugau

SEQ ID NO: 228182 - RNA, 19 nt, Homo sapiens
agaugaagaugaagaagaa

SEQ ID NO: 228183 - RNA, 19 nt, Homo sapiens
gaccaugucugcuaaagag

SEQ ID NO: 228184 - RNA, 19 nt, Homo sapiens
ugggagagauguggaauaa

SEQ ID NO: 228185 - RNA, 19 nt, Homo sapiens
ugaugcagcuuauacgaaa

SEQ ID NO: 228186 - RNA, 19 nt, Homo sapiens
gacaaggcccguuaugaaa

SEQ ID NO: 228187 - RNA, 19 nt, Homo sapiens
gaaugugucuuuagauagc

SEQ ID NO: 228188 - RNA, 19 nt, Homo sapiens
ugaggaagaugaagaggau

SEQ ID NO: 228189 - RNA, 19 nt, Homo sapiens
gaagaaacugggagagaug

SEQ ID NO: 228190 - RNA, 19 nt, Homo sapiens
cgaagaaacugggagagau

SEQ ID NO: 228191 - RNA, 19 nt, Homo sapiens
caaggcccguuaugaaaga

SEQ ID NO: 228192 - RNA, 19 nt, Homo sapiens
ucuaagaagugcucagaga

SEQ ID NO: 228193 - RNA, 19 nt, Homo sapiens
ggaggaggaagaugaagaa

SEQ ID NO: 228194 - RNA, 19 nt, Homo sapiens
aaaaggauauugcugcaua

SEQ ID NO: 228195 - RNA, 19 nt, Homo sapiens
gacaagcagccuuaugaaa

SEQ ID NO: 228196 - RNA, 19 nt, Homo sapiens
agaagaugaugaugaugaa

SEQ ID NO: 228197 - RNA, 19 nt, Homo sapiens
gcauaucgagcuaaaggaa

SEQ ID NO: 228198 - RNA, 19 nt, Homo sapiens
gaugaugaauaaguugguu

SEQ ID NO: 228199 - RNA, 19 nt, Homo sapiens
ggaagaugaagaagaugaa

SEQ ID NO: 228200 - RNA, 19 nt, Homo sapiens
cagaugacaagcagccuua

SEQ ID NO: 228201 - RNA, 19 nt, Homo sapiens
aaccuugccugguacagua

SEQ ID NO: 228202 - RNA, 19 nt, Homo sapiens
uaccgaaugugucuuuaga

SEQ ID NO: 228203 - RNA, 19 nt, Homo sapiens
gaaggaagaggaggaagau

SEQ ID NO: 228204 - RNA, 19 nt, Homo sapiens
ucagucaacuucucagagu

SEQ ID NO: 228205 - RNA, 19 nt, Homo sapiens
ggaagaugaggaagaugaa

SEQ ID NO: 228206 - RNA, 19 nt, Homo sapiens
guucaaggaucccaaugca

SEQ ID NO: 228207 - RNA, 19 nt, Homo sapiens
guuguaaauuggcauggaa

SEQ ID NO: 228208 - RNA, 19 nt, Homo sapiens
ggaggaggaggaagaugaa

SEQ ID NO: 228209 - RNA, 19 nt, Homo sapiens
gaaagccugaugcagcaaa

SEQ ID NO: 228210 - RNA, 19 nt, Homo sapiens
aagaagaugaugaugauga

SEQ ID NO: 228211 - RNA, 19 nt, Homo sapiens
aagaagaagaugaugauga

SEQ ID NO: 228212 - RNA, 19 nt, Homo sapiens
guuguucuguuaacugaau

SEQ ID NO: 228213 - RNA, 19 nt, Homo sapiens
ugaaauguaaggcugugua

SEQ ID NO: 228214 - RNA, 19 nt, Homo sapiens
caugucugcuaaagagaaa

SEQ ID NO: 228215 - RNA, 19 nt, Homo sapiens
uuaacacacuaccgaaugu

SEQ ID NO: 228216 - RNA, 19 nt, Homo sapiens
aauguaaggcuguguaaga

SEQ ID NO: 228217 - RNA, 19 nt, Homo sapiens
ugaagaagaagaugaugau

SEQ ID NO: 228218 - RNA, 19 nt, Homo sapiens
cauccuggccuguccauug

SEQ ID NO: 228219 - RNA, 19 nt, Homo sapiens
gaaguucaaggaucccaau

SEQ ID NO: 228220 - RNA, 19 nt, Homo sapiens
gcgaagaaacugggagaga

SEQ ID NO: 228221 - RNA, 19 nt, Homo sapiens
ggcaaaaugucaucauaug

SEQ ID NO: 228222 - RNA, 19 nt, Homo sapiens
cugaaugcuucuaaguaaa

SEQ ID NO: 228223 - RNA, 19 nt, Homo sapiens
gcccuguccuggugguauu

SEQ ID NO: 228224 - RNA, 19 nt, Homo sapiens
guuaacacacuaccgaaug

SEQ ID NO: 228225 - RNA, 19 nt, Homo sapiens
gaagaagaagaugaugaug

SEQ ID NO: 228226 - RNA, 19 nt, Homo sapiens
gaagaugaagaagaagaug

SEQ ID NO: 228227 - RNA, 19 nt, Homo sapiens
cugcgaagcugaaggaaaa

SEQ ID NO: 228228 - RNA, 19 nt, Homo sapiens
acacaacucacuccuuuua

SEQ ID NO: 228229 - RNA, 19 nt, Homo sapiens
ggaagaggaggaagaugag

SEQ ID NO: 228230 - RNA, 19 nt, Homo sapiens
ugacaagcagccuuaugaa

SEQ ID NO: 228231 - RNA, 19 nt, Homo sapiens
uuaaagcagguucuuguug

SEQ ID NO: 228232 - RNA, 19 nt, Homo sapiens
uaacuaaacaugggcaaag

SEQ ID NO: 228233 - RNA, 19 nt, Homo sapiens
aaacaugggcaaaggagau

SEQ ID NO: 228234 - RNA, 19 nt, Homo sapiens
aggaagaggaggaagauga

SEQ ID NO: 228235 - RNA, 19 nt, Homo sapiens
gcuaaaggaaagccugaug

SEQ ID NO: 228236 - RNA, 19 nt, Homo sapiens
uuggugauguugcgaagaa

SEQ ID NO: 228237 - RNA, 19 nt, Homo sapiens
gaugaugaugaauaaguug

SEQ ID NO: 228238 - RNA, 19 nt, Homo sapiens
gaugacaagcagccuuaug

SEQ ID NO: 228239 - RNA, 19 nt, Homo sapiens
gaaauuuaaagcagguucu

SEQ ID NO: 228240 - RNA, 19 nt, Homo sapiens
acaacucacuccuuuuaaa

SEQ ID NO: 228241 - RNA, 19 nt, Homo sapiens
ggaguugucaaggcugaaa

SEQ ID NO: 228242 - RNA, 19 nt, Homo sapiens
ggaggagcauaagaagaag

SEQ ID NO: 228243 - RNA, 19 nt, Homo sapiens
gguuguaaauuggcaugga

SEQ ID NO: 228244 - RNA, 19 nt, Homo sapiens
cgaaugugucuuuagauag

SEQ ID NO: 228245 - RNA, 19 nt, Homo sapiens
agaagaugaagaugaagaa

SEQ ID NO: 228246 - RNA, 19 nt, Homo sapiens
uaaaggaaagccugaugca

SEQ ID NO: 228247 - RNA, 19 nt, Homo sapiens
acaagcagccuuaugaaaa

SEQ ID NO: 228248 - RNA, 19 nt, Homo sapiens
gaugcagcuuauacgaaau

SEQ ID NO: 228249 - RNA, 19 nt, Homo sapiens
aggaagaugaggaagauga

SEQ ID NO: 228250 - RNA, 19 nt, Homo sapiens
agaaggaagaggaggaaga

SEQ ID NO: 228251 - RNA, 19 nt, Homo sapiens
caagcagccuuaugaaaag

SEQ ID NO: 228252 - RNA, 19 nt, Homo sapiens
gaagaagaugaugaugaug

SEQ ID NO: 228253 - RNA, 19 nt, Homo sapiens
aagaugaagaugaagaaga

SEQ ID NO: 228254 - RNA, 19 nt, Homo sapiens
augaauaaguugguucuag

SEQ ID NO: 228255 - RNA, 19 nt, Homo sapiens
gaagaugaugaugaugaau

SEQ ID NO: 228256 - RNA, 19 nt, Homo sapiens
gaagaugaagaugaagaag

SEQ ID NO: 228257 - RNA, 19 nt, Homo sapiens
gaagaugaagaagaugaag

SEQ ID NO: 228258 - RNA, 19 nt, Homo sapiens
cauaucgagcuaaaggaaa

SEQ ID NO: 228259 - RNA, 19 nt, Homo sapiens
gcugcgaagcugaaggaaa

SEQ ID NO: 228260 - RNA, 19 nt, Homo sapiens
ccaugucugcuaaagagaa

SEQ ID NO: 228261 - RNA, 19 nt, Homo sapiens
ugaagaugaagaagaagau

SEQ ID NO: 228262 - RNA, 19 nt, Homo sapiens
aagaagaugaagaugaaga

SEQ ID NO: 228263 - RNA, 19 nt, Homo sapiens
uaagaagaagcacccagau

SEQ ID NO: 228264 - RNA, 19 nt, Homo sapiens
augacaagcagccuuauga

SEQ ID NO: 228265 - RNA, 19 nt, Homo sapiens
ggcccguuaugaaagagaa

SEQ ID NO: 228266 - RNA, 19 nt, Homo sapiens
cggacaaggcccguuauga

SEQ ID NO: 228267 - RNA, 19 nt, Homo sapiens
ggaugaagaugaagaauaa

SEQ ID NO: 228268 - RNA, 19 nt, Homo sapiens
gcaaagaaauugggugaaa

SEQ ID NO: 228269 - RNA, 19 nt, Homo sapiens
gaacaucgcccaaagauca

SEQ ID NO: 228270 - RNA, 19 nt, Homo sapiens
ggaagaggaugaagaugaa

SEQ ID NO: 228271 - RNA, 19 nt, Homo sapiens
gggaagagcacaagaagaa

SEQ ID NO: 228272 - RNA, 19 nt, Homo sapiens
gaauaaauggcuauccuuu

SEQ ID NO: 228273 - RNA, 19 nt, Homo sapiens
cagcaaacuuguaggaauu

SEQ ID NO: 228274 - RNA, 19 nt, Homo sapiens
ccaacaggcucaaagaaga

SEQ ID NO: 228275 - RNA, 19 nt, Homo sapiens
ggaagaagaagaugaagau

SEQ ID NO: 228276 - RNA, 19 nt, Homo sapiens
gaagaagaacgaaccagaa

SEQ ID NO: 228277 - RNA, 19 nt, Homo sapiens
caaaggagaagucgaaguu

SEQ ID NO: 228278 - RNA, 19 nt, Homo sapiens
gcagucagccaaagauaaa

SEQ ID NO: 228279 - RNA, 19 nt, Homo sapiens
ugacaaagcucgcuaugac

SEQ ID NO: 228280 - RNA, 19 nt, Homo sapiens
gauguugaauguuccuaaa

SEQ ID NO: 228281 - RNA, 19 nt, Homo sapiens
gaggauugcguuagagaua

SEQ ID NO: 228282 - RNA, 19 nt, Homo sapiens
gaagaacgaaccagaagau

SEQ ID NO: 228283 - RNA, 19 nt, Homo sapiens
ggaggaagaagaagaugaa

SEQ ID NO: 228284 - RNA, 19 nt, Homo sapiens
ccaaagauaaacaaccaua

SEQ ID NO: 228285 - RNA, 19 nt, Homo sapiens
caaagaaauugggugaaau

SEQ ID NO: 228286 - RNA, 19 nt, Homo sapiens
aaaugcagguuguagcuuu

SEQ ID NO: 228287 - RNA, 19 nt, Homo sapiens
gaacgaaccagaagaugag

SEQ ID NO: 228288 - RNA, 19 nt, Homo sapiens
ggagaacucugcaaaacaa

SEQ ID NO: 228289 - RNA, 19 nt, Homo sapiens
ggauugcguuagagauaaa

SEQ ID NO: 228290 - RNA, 19 nt, Homo sapiens
uggccuagcucgucaaguu

SEQ ID NO: 228291 - RNA, 19 nt, Homo sapiens
gcacagcaaacuuguagga

SEQ ID NO: 228292 - RNA, 19 nt, Homo sapiens
gaauucaagugcagcucaa

SEQ ID NO: 228293 - RNA, 19 nt, Homo sapiens
ggaggaagaggaugaagau

SEQ ID NO: 228294 - RNA, 19 nt, Homo sapiens
agaagaagaugaagaugag

SEQ ID NO: 228295 - RNA, 19 nt, Homo sapiens
aaaaggauauugcugcaua

SEQ ID NO: 228296 - RNA, 19 nt, Homo sapiens
gcccaaagaucaaaaguga

SEQ ID NO: 228297 - RNA, 19 nt, Homo sapiens
caagaaguguucggagaga

SEQ ID NO: 228298 - RNA, 19 nt, Homo sapiens
caagugcagcucaauacua

SEQ ID NO: 228299 - RNA, 19 nt, Homo sapiens
ggagaaauaugaaaaggau

SEQ ID NO: 228300 - RNA, 19 nt, Homo sapiens
cugauaagauucucuguag

SEQ ID NO: 228301 - RNA, 19 nt, Homo sapiens
ggaggaggaggaagaagaa

SEQ ID NO: 228302 - RNA, 19 nt, Homo sapiens
gcucaaagaagaagaacga

SEQ ID NO: 228303 - RNA, 19 nt, Homo sapiens
acaaccauaugaacagaaa

SEQ ID NO: 228304 - RNA, 19 nt, Homo sapiens
aaauggcuauccuuuaaug

SEQ ID NO: 228305 - RNA, 19 nt, Homo sapiens
gaagaugaagaauaaaugg

SEQ ID NO: 228306 - RNA, 19 nt, Homo sapiens
gagcagucagccaaagaua

SEQ ID NO: 228307 - RNA, 19 nt, Homo sapiens
agucgaaguuugaagauau

SEQ ID NO: 228308 - RNA, 19 nt, Homo sapiens
aaggagaagucgaaguuug

SEQ ID NO: 228309 - RNA, 19 nt, Homo sapiens
gcugauaagauucucugua

SEQ ID NO: 228310 - RNA, 19 nt, Homo sapiens
aaacaaccauaugaacaga

SEQ ID NO: 228311 - RNA, 19 nt, Homo sapiens
caacaggcucaaagaagaa

SEQ ID NO: 228312 - RNA, 19 nt, Homo sapiens
cuucugauguugaauguuc

SEQ ID NO: 228313 - RNA, 19 nt, Homo sapiens
acgcggaucugucaacaug

SEQ ID NO: 228314 - RNA, 19 nt, Homo sapiens
gcucaauacuagcuucagu

SEQ ID NO: 228315 - RNA, 19 nt, Homo sapiens
cguuagagauaaaccaguu

SEQ ID NO: 228316 - RNA, 19 nt, Homo sapiens
acagcaaacuuguaggaau

SEQ ID NO: 228317 - RNA, 19 nt, Homo sapiens
gcuaaaggagaaauaugaa

SEQ ID NO: 228318 - RNA, 19 nt, Homo sapiens
ggacgcggaucugucaaca

SEQ ID NO: 228319 - RNA, 19 nt, Homo sapiens
gauaaacaaccauaugaac

SEQ ID NO: 228320 - RNA, 19 nt, Homo sapiens
gggauacugcaaagaaauu

SEQ ID NO: 228321 - RNA, 19 nt, Homo sapiens
ucccaaaggugauaagaag

SEQ ID NO: 228322 - RNA, 19 nt, Homo sapiens
gaagaaacacccggacucu

SEQ ID NO: 228323 - RNA, 19 nt, Homo sapiens
aagaagaagaugaagauga

SEQ ID NO: 228324 - RNA, 19 nt, Homo sapiens
ggaggaggaagaagaagau

SEQ ID NO: 228325 - RNA, 19 nt, Homo sapiens
aaagaaauugggugaaaug

SEQ ID NO: 228326 - RNA, 19 nt, Homo sapiens
aaauuacguuccucccaaa

SEQ ID NO: 228327 - RNA, 19 nt, Homo sapiens
ggacucuuccgucaauuuc

SEQ ID NO: 228328 - RNA, 19 nt, Homo sapiens
agaaacacccggacucuuc

SEQ ID NO: 228329 - RNA, 19 nt, Homo sapiens
gcgcggagaacucugcaaa

SEQ ID NO: 228330 - RNA, 19 nt, Homo sapiens
gaacagaaagcagcuaagc

SEQ ID NO: 228331 - RNA, 19 nt, Homo sapiens
aacaagaggcugaggauug

SEQ ID NO: 228332 - RNA, 19 nt, Homo sapiens
gccaccaucugccuucuuc

SEQ ID NO: 228333 - RNA, 19 nt, Homo sapiens
gaagagcacaagaagaaac

SEQ ID NO: 228334 - RNA, 19 nt, Homo sapiens
ggaagagcacaagaagaaa

SEQ ID NO: 228335 - RNA, 19 nt, Homo sapiens
uggcuauccuuuaaugaug

SEQ ID NO: 228336 - RNA, 19 nt, Homo sapiens
agaacgaaccagaagauga

SEQ ID NO: 228337 - RNA, 19 nt, Homo sapiens
gcuaugacagggagaugaa

SEQ ID NO: 228338 - RNA, 19 nt, Homo sapiens
gaagucgaaguuugaagau

SEQ ID NO: 228339 - RNA, 19 nt, Homo sapiens
gcaaacuuguaggaauuag

SEQ ID NO: 228340 - RNA, 19 nt, Homo sapiens
aagugcagcucaauacuag

SEQ ID NO: 228341 - RNA, 19 nt, Homo sapiens
aggaagaggaugaagauga

SEQ ID NO: 228342 - RNA, 19 nt, Homo sapiens
gauaagaaggggaagaaaa

SEQ ID NO: 228343 - RNA, 19 nt, Homo sapiens
agaugaagaugaggaggaa

SEQ ID NO: 228344 - RNA, 19 nt, Homo sapiens
gaagaagaagaugaagaug

SEQ ID NO: 228345 - RNA, 19 nt, Homo sapiens
ggagaagucgaaguuugaa

SEQ ID NO: 228346 - RNA, 19 nt, Homo sapiens
ugauaagauucucuguaga

SEQ ID NO: 228347 - RNA, 19 nt, Homo sapiens
aggaugaagaugaagaaua

SEQ ID NO: 228348 - RNA, 19 nt, Homo sapiens
gaucugucaacauggguaa

SEQ ID NO: 228349 - RNA, 19 nt, Homo sapiens
ggaggaggaggaggaagaa

SEQ ID NO: 228350 - RNA, 19 nt, Homo sapiens
uaaacaaccauaugaacag

SEQ ID NO: 228351 - RNA, 19 nt, Homo sapiens
cuacucauacaguuagauu

SEQ ID NO: 228352 - RNA, 19 nt, Homo sapiens
aggauugcguuagagauaa

SEQ ID NO: 228353 - RNA, 19 nt, Homo sapiens
ggcugaggauugcguuaga

SEQ ID NO: 228354 - RNA, 19 nt, Homo sapiens
agaagucgaaguuugaaga

SEQ ID NO: 228355 - RNA, 19 nt, Homo sapiens
gcaaaggagaagucgaagu

SEQ ID NO: 228356 - RNA, 19 nt, Homo sapiens
gcucugaacaucgcccaaa

SEQ ID NO: 228357 - RNA, 19 nt, Homo sapiens
caucugccuucuuccuguu

SEQ ID NO: 228358 - RNA, 19 nt, Homo sapiens
uagcacagcaaacuuguag

SEQ ID NO: 228359 - RNA, 19 nt, Homo sapiens
acaagaggcugaggauugc

SEQ ID NO: 228360 - RNA, 19 nt, Homo sapiens
gccaacaggcucaaagaag

SEQ ID NO: 228361 - RNA, 19 nt, Homo sapiens
ggccaacaggcucaaagaa

SEQ ID NO: 228362 - RNA, 19 nt, Homo sapiens
cacccuggccuauccauug

SEQ ID NO: 228363 - RNA, 19 nt, Homo sapiens
gucgaaguuugaagauaug

SEQ ID NO: 228364 - RNA, 19 nt, Homo sapiens
gguggacgcggaucuguca

SEQ ID NO: 228365 - RNA, 19 nt, Homo sapiens
aagaauaaauggcuauccu

SEQ ID NO: 228366 - RNA, 19 nt, Homo sapiens
aagucgaaguuugaagaua

SEQ ID NO: 228367 - RNA, 19 nt, Homo sapiens
gaacucuucucuacuauaa

SEQ ID NO: 228368 - RNA, 19 nt, Homo sapiens
ucaaagugcucuagaaauu

SEQ ID NO: 228369 - RNA, 19 nt, Homo sapiens
ugacacaucucuuauuuga

SEQ ID NO: 228370 - RNA, 19 nt, Homo sapiens
ggaggaggaugaauaaaga

SEQ ID NO: 228371 - RNA, 19 nt, Homo sapiens
ggugagauguggaauaauu

SEQ ID NO: 228372 - RNA, 19 nt, Homo sapiens
ggaaagagaaauccaaauu

SEQ ID NO: 228373 - RNA, 19 nt, Homo sapiens
gagaagaacauaagaagaa

SEQ ID NO: 228374 - RNA, 19 nt, Homo sapiens
guaauugacacaucucuua

SEQ ID NO: 228375 - RNA, 19 nt, Homo sapiens
gcauucugcugccaucuua

SEQ ID NO: 228376 - RNA, 19 nt, Homo sapiens
cggcaaagcugaaggagaa

SEQ ID NO: 228377 - RNA, 19 nt, Homo sapiens
ucaagaaccuccuguacuu

SEQ ID NO: 228378 - RNA, 19 nt, Homo sapiens
caucuuagcuguggacaaa

SEQ ID NO: 228379 - RNA, 19 nt, Homo sapiens
gagacuggccucccuauaa

SEQ ID NO: 228380 - RNA, 19 nt, Homo sapiens
gacaaggcauuuaaagaug

SEQ ID NO: 228381 - RNA, 19 nt, Homo sapiens
ggagcacccugaaacugua

SEQ ID NO: 228382 - RNA, 19 nt, Homo sapiens
ggaggaggaggaugaauaa

SEQ ID NO: 228383 - RNA, 19 nt, Homo sapiens
gaaggauguugcugacuau

SEQ ID NO: 228384 - RNA, 19 nt, Homo sapiens
gaagaaggauccuaaugcu

SEQ ID NO: 228385 - RNA, 19 nt, Homo sapiens
guaagguggugguaacuau

SEQ ID NO: 228386 - RNA, 19 nt, Homo sapiens
ggaagaggaagaugaagaa

SEQ ID NO: 228387 - RNA, 19 nt, Homo sapiens
cuauagaacucuucauugu

SEQ ID NO: 228388 - RNA, 19 nt, Homo sapiens
ccauuuagcuucagguugu

SEQ ID NO: 228389 - RNA, 19 nt, Homo sapiens
agacuggccucccuauaaa

SEQ ID NO: 228390 - RNA, 19 nt, Homo sapiens
agaaggauguugcugacua

SEQ ID NO: 228391 - RNA, 19 nt, Homo sapiens
gcaaagagucacugcauca

SEQ ID NO: 228392 - RNA, 19 nt, Homo sapiens
ggcuagaaauccugaguuu

SEQ ID NO: 228393 - RNA, 19 nt, Homo sapiens
cagauaaagugcgcuauga

SEQ ID NO: 228394 - RNA, 19 nt, Homo sapiens
gcagagaagaacauaagaa

SEQ ID NO: 228395 - RNA, 19 nt, Homo sapiens
uaaagauguuucuggcauu

SEQ ID NO: 228396 - RNA, 19 nt, Homo sapiens
ugacaaggcauuuaaagau

SEQ ID NO: 228397 - RNA, 19 nt, Homo sapiens
gggcauccauuuagcuuca

SEQ ID NO: 228398 - RNA, 19 nt, Homo sapiens
ggauguugcugacuauaag

SEQ ID NO: 228399 - RNA, 19 nt, Homo sapiens
caaaggguccugcuaaagu

SEQ ID NO: 228400 - RNA, 19 nt, Homo sapiens
ggaaaugaaggauuaugga

SEQ ID NO: 228401 - RNA, 19 nt, Homo sapiens
auagaacucuucauuguca

SEQ ID NO: 228402 - RNA, 19 nt, Homo sapiens
aaaggguccugcuaaaguu

SEQ ID NO: 228403 - RNA, 19 nt, Homo sapiens
gaaaggaaaguuugauggu

SEQ ID NO: 228404 - RNA, 19 nt, Homo sapiens
ugggugagauguggaauaa

SEQ ID NO: 228405 - RNA, 19 nt, Homo sapiens
ucgcaacguucuguuauuu

SEQ ID NO: 228406 - RNA, 19 nt, Homo sapiens
aaagauguuucuggcauuu

SEQ ID NO: 228407 - RNA, 19 nt, Homo sapiens
ggagaaguaugagaaggau

SEQ ID NO: 228408 - RNA, 19 nt, Homo sapiens
gcuaugaucgggaaaugaa

SEQ ID NO: 228409 - RNA, 19 nt, Homo sapiens
gcagacaugcagagaagaa

SEQ ID NO: 228410 - RNA, 19 nt, Homo sapiens
caagaaccuccuguacuua

SEQ ID NO: 228411 - RNA, 19 nt, Homo sapiens
cagguugucuuguuucugu

SEQ ID NO: 228412 - RNA, 19 nt, Homo sapiens
aaagugcucuagaaauugu

SEQ ID NO: 228413 - RNA, 19 nt, Homo sapiens
agaagaagaaggauccuaa

SEQ ID NO: 228414 - RNA, 19 nt, Homo sapiens
aagagucacugcaucaaug

SEQ ID NO: 228415 - RNA, 19 nt, Homo sapiens
gaggaugaauaaagaaacu

SEQ ID NO: 228416 - RNA, 19 nt, Homo sapiens
gugcaaaggguccugcuaa

SEQ ID NO: 228417 - RNA, 19 nt, Homo sapiens
ugaaggagaaguaugagaa

SEQ ID NO: 228418 - RNA, 19 nt, Homo sapiens
gaagaagaaggauccuaau

SEQ ID NO: 228419 - RNA, 19 nt, Homo sapiens
gcagauaaagugcgcuaug

SEQ ID NO: 228420 - RNA, 19 nt, Homo sapiens
gaaauggcaaaggcagaua

SEQ ID NO: 228421 - RNA, 19 nt, Homo sapiens
gauaaagugcgcuaugauc

SEQ ID NO: 228422 - RNA, 19 nt, Homo sapiens
caaggcauuuaaagauguu

SEQ ID NO: 228423 - RNA, 19 nt, Homo sapiens
cagaggucccugucaauuu

SEQ ID NO: 228424 - RNA, 19 nt, Homo sapiens
aaacacgauucgcaacguu

SEQ ID NO: 228425 - RNA, 19 nt, Homo sapiens
ggugugacaaggcauuuaa

SEQ ID NO: 228426 - RNA, 19 nt, Homo sapiens
gaaauugucagugguuuac

SEQ ID NO: 228427 - RNA, 19 nt, Homo sapiens
caaagcugaaggagaagua

SEQ ID NO: 228428 - RNA, 19 nt, Homo sapiens
ggcaaaggcagauaaagug

SEQ ID NO: 228429 - RNA, 19 nt, Homo sapiens
ugucagugguuuacaugaa

SEQ ID NO: 228430 - RNA, 19 nt, Homo sapiens
gauucgcaacguucuguua

SEQ ID NO: 228431 - RNA, 19 nt, Homo sapiens
gcuucagguugucuuguuu

SEQ ID NO: 228432 - RNA, 19 nt, Homo sapiens
caaagugcucuagaaauug

SEQ ID NO: 228433 - RNA, 19 nt, Homo sapiens
gcuaagggaggcaagaaga

SEQ ID NO: 228434 - RNA, 19 nt, Homo sapiens
ccacuccguuguauuugga

SEQ ID NO: 228435 - RNA, 19 nt, Homo sapiens
cagcuggcaugagaauauu

SEQ ID NO: 228436 - RNA, 19 nt, Homo sapiens
acaaggcauuuaaagaugu

SEQ ID NO: 228437 - RNA, 19 nt, Homo sapiens
agaggaagaugaagaacag

SEQ ID NO: 228438 - RNA, 19 nt, Homo sapiens
uccaagaagugcucugaga

SEQ ID NO: 228439 - RNA, 19 nt, Homo sapiens
gaaaagcagccuuacauca

SEQ ID NO: 228440 - RNA, 19 nt, Homo sapiens
ggcaagacguccgcuuaug

SEQ ID NO: 228441 - RNA, 19 nt, Homo sapiens
gcaaaggguccugcuaaag

SEQ ID NO: 228442 - RNA, 19 nt, Homo sapiens
gcgcuaugaucgggaaaug

SEQ ID NO: 228443 - RNA, 19 nt, Homo sapiens
ugcaaaggguccugcuaaa

SEQ ID NO: 228444 - RNA, 19 nt, Homo sapiens
uagaaauugucagugguuu

SEQ ID NO: 228445 - RNA, 19 nt, Homo sapiens
ccagaggucccugucaauu

SEQ ID NO: 228446 - RNA, 19 nt, Homo sapiens
gguggaagaggaagaugaa

SEQ ID NO: 228447 - RNA, 19 nt, Homo sapiens
gaaggagaaguaugagaag

SEQ ID NO: 228448 - RNA, 19 nt, Homo sapiens
gaagacgguguccgggaaa

SEQ ID NO: 228449 - RNA, 19 nt, Homo sapiens
aagaaccuccuguacuuaa

SEQ ID NO: 228450 - RNA, 19 nt, Homo sapiens
gcaagacguccgcuuaugc

SEQ ID NO: 228451 - RNA, 19 nt, Homo sapiens
agaaauugucagugguuua

SEQ ID NO: 228452 - RNA, 19 nt, Homo sapiens
aucgggaaaugaaggauua

SEQ ID NO: 228453 - RNA, 19 nt, Homo sapiens
gaucgggaaaugaaggauu

SEQ ID NO: 228454 - RNA, 19 nt, Homo sapiens
ucagcuggcaugagaauau

SEQ ID NO: 228455 - RNA, 19 nt, Homo sapiens
gaacaaaacaaccgagaca

SEQ ID NO: 228456 - RNA, 19 nt, Homo sapiens
gugacaaggcauuuaaaga

SEQ ID NO: 228457 - RNA, 19 nt, Homo sapiens
ucucaaagugcucuagaaa

SEQ ID NO: 228458 - RNA, 19 nt, Homo sapiens
cauauuguagucucucaaa

SEQ ID NO: 228459 - RNA, 19 nt, Homo sapiens
gauucuuccuguucuguuc

SEQ ID NO: 228460 - RNA, 19 nt, Homo sapiens
gaggcaagaagaagaagga

SEQ ID NO: 228461 - RNA, 19 nt, Homo sapiens
gggcaagacguccgcuuau

SEQ ID NO: 228462 - RNA, 19 nt, Homo sapiens
agaaccuccuguacuuaaa

SEQ ID NO: 228463 - RNA, 19 nt, Homo sapiens
acucuucucuacuauaaca

SEQ ID NO: 228464 - RNA, 19 nt, Homo sapiens
cagagaagaacauaagaag

SEQ ID NO: 228465 - RNA, 19 nt, Homo sapiens
aggaggaggaggaugaaua

SEQ ID NO: 228466 - RNA, 19 nt, Homo sapiens
uaagucgaaaggaaaguuu

SEQ ID NO: 228467 - RNA, 19 nt, Homo sapiens
ggauaaaucuucagacaaa

SEQ ID NO: 228468 - RNA, 19 nt, Homo sapiens
cgaaguggcuaaccaagaa

SEQ ID NO: 228469 - RNA, 19 nt, Homo sapiens
gaaaaccacucuuugauca

SEQ ID NO: 228470 - RNA, 19 nt, Homo sapiens
agccaagucugauuaauaa

SEQ ID NO: 228471 - RNA, 19 nt, Homo sapiens
cauauaccaugucuuauca

SEQ ID NO: 228472 - RNA, 19 nt, Homo sapiens
uuuaguagcucuagaaaca

SEQ ID NO: 228473 - RNA, 19 nt, Homo sapiens
ccaagaaacuaaagaagac

SEQ ID NO: 228474 - RNA, 19 nt, Homo sapiens
guacugauccucaaccaau

SEQ ID NO: 228475 - RNA, 19 nt, Homo sapiens
ugaagauacugguacuuga

SEQ ID NO: 228476 - RNA, 19 nt, Homo sapiens
gauuacagauuugaacaug

SEQ ID NO: 228477 - RNA, 19 nt, Homo sapiens
agugugggauauugaauua

SEQ ID NO: 228478 - RNA, 19 nt, Homo sapiens
aaccauauaccaugucuua

SEQ ID NO: 228479 - RNA, 19 nt, Homo sapiens
guagaauuguuuccuaaag

SEQ ID NO: 228480 - RNA, 19 nt, Homo sapiens
agaaagaagccaagucuga

SEQ ID NO: 228481 - RNA, 19 nt, Homo sapiens
gaaagaagccaagucugau

SEQ ID NO: 228482 - RNA, 19 nt, Homo sapiens
gaacuggugggccguaugu

SEQ ID NO: 228483 - RNA, 19 nt, Homo sapiens
gauuugaacauguagugua

SEQ ID NO: 228484 - RNA, 19 nt, Homo sapiens
cagcuaaaccuccugcaaa

SEQ ID NO: 228485 - RNA, 19 nt, Homo sapiens
gaagauacugguacuugau

SEQ ID NO: 228486 - RNA, 19 nt, Homo sapiens
gaagccaagucugauuaau

SEQ ID NO: 228487 - RNA, 19 nt, Homo sapiens
acugugcugugaaagauua

SEQ ID NO: 228488 - RNA, 19 nt, Homo sapiens
gugaaagauuacagauuug

SEQ ID NO: 228489 - RNA, 19 nt, Homo sapiens
aagccaagucugauuaaua

SEQ ID NO: 228490 - RNA, 19 nt, Homo sapiens
gaauuucguuacguauguu

SEQ ID NO: 228491 - RNA, 19 nt, Homo sapiens
ugucucgggugucagcuua

SEQ ID NO: 228492 - RNA, 19 nt, Homo sapiens
uaguagcucuagaaacauu

SEQ ID NO: 228493 - RNA, 19 nt, Homo sapiens
aaaccacucuuugaucaug

SEQ ID NO: 228494 - RNA, 19 nt, Homo sapiens
aaggauaaaucuucagaca

SEQ ID NO: 228495 - RNA, 19 nt, Homo sapiens
agaauuucguuacguaugu

SEQ ID NO: 228496 - RNA, 19 nt, Homo sapiens
cagcuuaacauuccacaga

SEQ ID NO: 228497 - RNA, 19 nt, Homo sapiens
aagaagccaagucugauua

SEQ ID NO: 228498 - RNA, 19 nt, Homo sapiens
ugaugaagcaggagagaaa

SEQ ID NO: 228499 - RNA, 19 nt, Homo sapiens
uguaacagcugaccaacgu

SEQ ID NO: 228500 - RNA, 19 nt, Homo sapiens
cggcaaggcagcccaguuu

SEQ ID NO: 228501 - RNA, 19 nt, Homo sapiens
caacgugaagauacuggua

SEQ ID NO: 228502 - RNA, 19 nt, Homo sapiens
ugugggauauugaauuaug

SEQ ID NO: 228503 - RNA, 19 nt, Homo sapiens
guacaauccagaggaauau

SEQ ID NO: 228504 - RNA, 19 nt, Homo sapiens
ccacgaugcccaagaggaa

SEQ ID NO: 228505 - RNA, 19 nt, Homo sapiens
gaagagcccaagaggagau

SEQ ID NO: 228506 - RNA, 19 nt, Homo sapiens
ggugucagcuuaacauucc

SEQ ID NO: 228507 - RNA, 19 nt, Homo sapiens
aucauuugcugguuguuua

SEQ ID NO: 228508 - RNA, 19 nt, Homo sapiens
gugaagauacugguacuug

SEQ ID NO: 228509 - RNA, 19 nt, Homo sapiens
gcuuaacauuccacagaug

SEQ ID NO: 228510 - RNA, 19 nt, Homo sapiens
ccauauaccaugucuuauc

SEQ ID NO: 228511 - RNA, 19 nt, Homo sapiens
caagucugauuaauaacca

SEQ ID NO: 228512 - RNA, 19 nt, Homo sapiens
uguacaauccagaggaaua

SEQ ID NO: 228513 - RNA, 19 nt, Homo sapiens
aaagaagccaagucugauu

SEQ ID NO: 228514 - RNA, 19 nt, Homo sapiens
uguaacaucuuugguugug

SEQ ID NO: 228515 - RNA, 19 nt, Homo sapiens
uuacugugcugugaaagau

SEQ ID NO: 228516 - RNA, 19 nt, Homo sapiens
aaucccaccucaucccauu

SEQ ID NO: 228517 - RNA, 19 nt, Homo sapiens
cagcagcgaaggauaaauc

SEQ ID NO: 228518 - RNA, 19 nt, Homo sapiens
gucccugucucccuucuug

SEQ ID NO: 228519 - RNA, 19 nt, Homo sapiens
uggcuaaccaagaaacuaa

SEQ ID NO: 228520 - RNA, 19 nt, Homo sapiens
gaaguggcuaaccaagaaa

SEQ ID NO: 228521 - RNA, 19 nt, Homo sapiens
uacugauccucaaccaaua

SEQ ID NO: 228522 - RNA, 19 nt, Homo sapiens
cguuacguauguuaagauu

SEQ ID NO: 228523 - RNA, 19 nt, Homo sapiens
acaauccagaggaauauuu

SEQ ID NO: 228524 - RNA, 19 nt, Homo sapiens
aagauacugguacuugaua

SEQ ID NO: 228525 - RNA, 19 nt, Homo sapiens
ugaccaacgugaagauacu

SEQ ID NO: 228526 - RNA, 19 nt, Homo sapiens
guauguaacagcugaccaa

SEQ ID NO: 228527 - RNA, 19 nt, Homo sapiens
gaguccagccucugaugaa

SEQ ID NO: 228528 - RNA, 19 nt, Homo sapiens
caucuuugguugugguagu

SEQ ID NO: 228529 - RNA, 19 nt, Homo sapiens
uauaccaugucuuaucagu

SEQ ID NO: 228530 - RNA, 19 nt, Homo sapiens
gcugaccaacgugaagaua

SEQ ID NO: 228531 - RNA, 19 nt, Homo sapiens
gagagaaagaagccaaguc

SEQ ID NO: 228532 - RNA, 19 nt, Homo sapiens
ugaagcaggagagaaagaa

SEQ ID NO: 228533 - RNA, 19 nt, Homo sapiens
uaugggaggcucugacugu

SEQ ID NO: 228534 - RNA, 19 nt, Homo sapiens
aggcagcagcgaaggauaa

SEQ ID NO: 228535 - RNA, 19 nt, Homo sapiens
agaagccaagucugauuaa

SEQ ID NO: 228536 - RNA, 19 nt, Homo sapiens
gaagacuuaccugcggaaa

SEQ ID NO: 228537 - RNA, 19 nt, Homo sapiens
agagaaagaagccaagucu

SEQ ID NO: 228538 - RNA, 19 nt, Homo sapiens
gcaaggcagcccaguuucg

SEQ ID NO: 228539 - RNA, 19 nt, Homo sapiens
cagaaaauagugugggaua

SEQ ID NO: 228540 - RNA, 19 nt, Homo sapiens
accaagaaacuaaagaaga

SEQ ID NO: 228541 - RNA, 19 nt, Homo sapiens
guuacugugcugugaaaga

SEQ ID NO: 228542 - RNA, 19 nt, Homo sapiens
cuuguacaauccagaggaa

SEQ ID NO: 228543 - RNA, 19 nt, Homo sapiens
gaagcaggagagaaagaag

SEQ ID NO: 228544 - RNA, 19 nt, Homo sapiens
ccaaggaagagcccaagag

SEQ ID NO: 228545 - RNA, 19 nt, Homo sapiens
ccgaaguggcuaaccaaga

SEQ ID NO: 228546 - RNA, 19 nt, Homo sapiens
gcagcgaaggauaaaucuu

SEQ ID NO: 228547 - RNA, 19 nt, Homo sapiens
uagaauuucguuacguaug

SEQ ID NO: 228548 - RNA, 19 nt, Homo sapiens
cagauuugaacauguagug

SEQ ID NO: 228549 - RNA, 19 nt, Homo sapiens
gaaaacggggaaacgaaga

SEQ ID NO: 228550 - RNA, 19 nt, Homo sapiens
ggagagaaagaagccaagu

SEQ ID NO: 228551 - RNA, 19 nt, Homo sapiens
gaaacuaaagaagacuuac

SEQ ID NO: 228552 - RNA, 19 nt, Homo sapiens
gaagggaguuugaaaguug

SEQ ID NO: 228553 - RNA, 19 nt, Homo sapiens
uauaguggcuuucugauuu

SEQ ID NO: 228554 - RNA, 19 nt, Homo sapiens
gggcauaugucacuaauag

SEQ ID NO: 228555 - RNA, 19 nt, Homo sapiens
uaauaaagcuggauacagu

SEQ ID NO: 228556 - RNA, 19 nt, Homo sapiens
gaaaguuguuguauacugu

SEQ ID NO: 228557 - RNA, 19 nt, Homo sapiens
gcacacagaacacuucauu

SEQ ID NO: 228558 - RNA, 19 nt, Homo sapiens
gaagguacccaaagggaaa

SEQ ID NO: 228559 - RNA, 19 nt, Homo sapiens
gcauaugucacuaauagaa

SEQ ID NO: 228560 - RNA, 19 nt, Homo sapiens
gaauaacccugcagaaaau

SEQ ID NO: 228561 - RNA, 19 nt, Homo sapiens
gagagaagguacccaaagg

SEQ ID NO: 228562 - RNA, 19 nt, Homo sapiens
gggaauaacccugcagaaa

SEQ ID NO: 228563 - RNA, 19 nt, Homo sapiens
cuaauagaaugucuccaaa

SEQ ID NO: 228564 - RNA, 19 nt, Homo sapiens
caagugaagugugugcauu

SEQ ID NO: 228565 - RNA, 19 nt, Homo sapiens
aaagagcagugguuccauu

SEQ ID NO: 228566 - RNA, 19 nt, Homo sapiens
gaagaagggaguuugaaag

SEQ ID NO: 228567 - RNA, 19 nt, Homo sapiens
aaacagaccaggcacagaa

SEQ ID NO: 228568 - RNA, 19 nt, Homo sapiens
ggaauaacccugcagaaaa

SEQ ID NO: 228569 - RNA, 19 nt, Homo sapiens
uguauacuguuaacgauug

SEQ ID NO: 228570 - RNA, 19 nt, Homo sapiens
ugaaaguuguuguauacug

SEQ ID NO: 228571 - RNA, 19 nt, Homo sapiens
ugacacacauggccaccuu

SEQ ID NO: 228572 - RNA, 19 nt, Homo sapiens
acacagaacacuucauugu

SEQ ID NO: 228573 - RNA, 19 nt, Homo sapiens
ugaagaagggaguuugaaa

SEQ ID NO: 228574 - RNA, 19 nt, Homo sapiens
gaagaagaggcgagaacga

SEQ ID NO: 228575 - RNA, 19 nt, Homo sapiens
uauguccucuucucccuuu

SEQ ID NO: 228576 - RNA, 19 nt, Homo sapiens
agaagggaguuugaaaguu

SEQ ID NO: 228577 - RNA, 19 nt, Homo sapiens
ggagaugccaagugaagug

SEQ ID NO: 228578 - RNA, 19 nt, Homo sapiens
ggagagaagguacccaaag

SEQ ID NO: 228579 - RNA, 19 nt, Homo sapiens
aaacaccuuucccuucuag

SEQ ID NO: 228580 - RNA, 19 nt, Homo sapiens
ccgcgagguugucugcuaa

SEQ ID NO: 228581 - RNA, 19 nt, Homo sapiens
gaugccaagugaagugugu

SEQ ID NO: 228582 - RNA, 19 nt, Homo sapiens
ccaccaugcccaagagaaa

SEQ ID NO: 228583 - RNA, 19 nt, Homo sapiens
caugcuaaaugugaaaugu

SEQ ID NO: 228584 - RNA, 19 nt, Homo sapiens
agccagagcccaagccuaa

SEQ ID NO: 228585 - RNA, 19 nt, Homo sapiens
caaagaagggagagaaggu

SEQ ID NO: 228586 - RNA, 19 nt, Homo sapiens
uuugauaacuguguacuuc

SEQ ID NO: 228587 - RNA, 19 nt, Homo sapiens
uaaaccugcuccuccaaag

SEQ ID NO: 228588 - RNA, 19 nt, Homo sapiens
gaguuugaaaguuguugua

SEQ ID NO: 228589 - RNA, 19 nt, Homo sapiens
caugauuguuuauggaaag

SEQ ID NO: 228590 - RNA, 19 nt, Homo sapiens
guuguauacuguuaacgau

SEQ ID NO: 228591 - RNA, 19 nt, Homo sapiens
caccuuucccuucuaguuu

SEQ ID NO: 228592 - RNA, 19 nt, Homo sapiens
aauagaaugucuccaaagc

SEQ ID NO: 228593 - RNA, 19 nt, Homo sapiens
aaagaagggagagaaggua

SEQ ID NO: 228594 - RNA, 19 nt, Homo sapiens
gucaggcaaucuggacuuu

SEQ ID NO: 228595 - RNA, 19 nt, Homo sapiens
ugauaacuguguacuucug

SEQ ID NO: 228596 - RNA, 19 nt, Homo sapiens
ugcuaaaugugaaauguca

SEQ ID NO: 228597 - RNA, 19 nt, Homo sapiens
ucuaaacuuucccuguuca

SEQ ID NO: 228598 - RNA, 19 nt, Homo sapiens
gaaaauggagaugccaaaa

SEQ ID NO: 228599 - RNA, 19 nt, Homo sapiens
cuuuccaucuuucagcaua

SEQ ID NO: 228600 - RNA, 19 nt, Homo sapiens
acuaauagaaugucuccaa

SEQ ID NO: 228601 - RNA, 19 nt, Homo sapiens
ugcuggagaugccaaguga

SEQ ID NO: 228602 - RNA, 19 nt, Homo sapiens
gaagauccgcgagguuguc

SEQ ID NO: 228603 - RNA, 19 nt, Homo sapiens
aaauggagaugccaaaaca

SEQ ID NO: 228604 - RNA, 19 nt, Homo sapiens
aaagcuggauacaguuugg

SEQ ID NO: 228605 - RNA, 19 nt, Homo sapiens
auaaagcuggauacaguuu

SEQ ID NO: 228606 - RNA, 19 nt, Homo sapiens
aagaagggaguuugaaagu

SEQ ID NO: 228607 - RNA, 19 nt, Homo sapiens
caaaagccuugugguauag

SEQ ID NO: 228608 - RNA, 19 nt, Homo sapiens
ggauugauguggagaaaac

SEQ ID NO: 228609 - RNA, 19 nt, Homo sapiens
cuaaaccugcuccuccaaa

SEQ ID NO: 228610 - RNA, 19 nt, Homo sapiens
cuucucccuuuccaucuuu

SEQ ID NO: 228611 - RNA, 19 nt, Homo sapiens
aaagccuugugguauagaa

SEQ ID NO: 228612 - RNA, 19 nt, Homo sapiens
gggagagaagguacccaaa

SEQ ID NO: 228613 - RNA, 19 nt, Homo sapiens
guauacuguuaacgauugu

SEQ ID NO: 228614 - RNA, 19 nt, Homo sapiens
cauagacuuaacucccuua

SEQ ID NO: 228615 - RNA, 19 nt, Homo sapiens
uaaagcuggauacaguuug

SEQ ID NO: 228616 - RNA, 19 nt, Homo sapiens
aagagcagugguuccauuu

SEQ ID NO: 228617 - RNA, 19 nt, Homo sapiens
acaccuuucccuucuaguu

SEQ ID NO: 228618 - RNA, 19 nt, Homo sapiens
uuauaguggcuuucugauu

SEQ ID NO: 228619 - RNA, 19 nt, Homo sapiens
uaaacuuucccuguucaga

SEQ ID NO: 228620 - RNA, 19 nt, Homo sapiens
caggcaaucuggacuuucc

SEQ ID NO: 228621 - RNA, 19 nt, Homo sapiens
cuggauugauguggagaaa

SEQ ID NO: 228622 - RNA, 19 nt, Homo sapiens
ccaaagcuggauugaugug

SEQ ID NO: 228623 - RNA, 19 nt, Homo sapiens
uaauagaaugucuccaaag

SEQ ID NO: 228624 - RNA, 19 nt, Homo sapiens
uccgcgagguugucugcua

SEQ ID NO: 228625 - RNA, 19 nt, Homo sapiens
aaaaggccccugcaaagaa

SEQ ID NO: 228626 - RNA, 19 nt, Homo sapiens
gaagcaggacucucuguua

SEQ ID NO: 228627 - RNA, 19 nt, Homo sapiens
ucuggaagcuggaaacuuu

SEQ ID NO: 228628 - RNA, 19 nt, Homo sapiens
ccucagagcucuucaccaa

SEQ ID NO: 228629 - RNA, 19 nt, Homo sapiens
gcucuuggcugcccuuaug

SEQ ID NO: 228630 - RNA, 19 nt, Homo sapiens
ccaagaagaacaucaauug

SEQ ID NO: 228631 - RNA, 19 nt, Homo sapiens
uagcugaggucaccaagaa

SEQ ID NO: 228632 - RNA, 19 nt, Homo sapiens
gaagggcauucagaaguuu

SEQ ID NO: 228633 - RNA, 19 nt, Homo sapiens
gcugaagucucccuuuguu

SEQ ID NO: 228634 - RNA, 19 nt, Homo sapiens
gcaggacucucuguuauag

SEQ ID NO: 228635 - RNA, 19 nt, Homo sapiens
ugauagacaugcuuucuga

SEQ ID NO: 228636 - RNA, 19 nt, Homo sapiens
ggacauggaaaugagaaua

SEQ ID NO: 228637 - RNA, 19 nt, Homo sapiens
gucaagcccugaacagaaa

SEQ ID NO: 228638 - RNA, 19 nt, Homo sapiens
gggcugaagucucccuuug

SEQ ID NO: 228639 - RNA, 19 nt, Homo sapiens
gcccagaccugaggaguga

SEQ ID NO: 228640 - RNA, 19 nt, Homo sapiens
ggaaaugagaauagguuaa

SEQ ID NO: 228641 - RNA, 19 nt, Homo sapiens
caaggaaguagucaucuuu

SEQ ID NO: 228642 - RNA, 19 nt, Homo sapiens
ugaccacacugaagucuug

SEQ ID NO: 228643 - RNA, 19 nt, Homo sapiens
gaaguuuccuggcaucaac

SEQ ID NO: 228644 - RNA, 19 nt, Homo sapiens
gcagaggccauuuguggaa

SEQ ID NO: 228645 - RNA, 19 nt, Homo sapiens
gagauggacuacaaaauga

SEQ ID NO: 228646 - RNA, 19 nt, Homo sapiens
ccaaggaaguagucaucuu

SEQ ID NO: 228647 - RNA, 19 nt, Homo sapiens
aagcaggacucucuguuau

SEQ ID NO: 228648 - RNA, 19 nt, Homo sapiens
ccacugccaugacaccuau

SEQ ID NO: 228649 - RNA, 19 nt, Homo sapiens
gcagcgcagucagccaaua

SEQ ID NO: 228650 - RNA, 19 nt, Homo sapiens
guaauuaaagguugaaugg

SEQ ID NO: 228651 - RNA, 19 nt, Homo sapiens
ggaaguagucaucuuugga

SEQ ID NO: 228652 - RNA, 19 nt, Homo sapiens
gaaaccaccagcuuugugu

SEQ ID NO: 228653 - RNA, 19 nt, Homo sapiens
gaaacuuggccacagaaga

SEQ ID NO: 228654 - RNA, 19 nt, Homo sapiens
gggaugauguggaaauagg

SEQ ID NO: 228655 - RNA, 19 nt, Homo sapiens
cagcuuauguaauuaaagg

SEQ ID NO: 228656 - RNA, 19 nt, Homo sapiens
cuagagggcuugggcauuc

SEQ ID NO: 228657 - RNA, 19 nt, Homo sapiens
caggaaacuuggccacaga

SEQ ID NO: 228658 - RNA, 19 nt, Homo sapiens
ccucaucuaugggcacuuu

SEQ ID NO: 228659 - RNA, 19 nt, Homo sapiens
gcagucagccaauauuucu

SEQ ID NO: 228660 - RNA, 19 nt, Homo sapiens
uauagaaaccaccagcuuu

SEQ ID NO: 228661 - RNA, 19 nt, Homo sapiens
gaagaucuccccagcuaaa

SEQ ID NO: 228662 - RNA, 19 nt, Homo sapiens
gcgcagucagccaauauuu

SEQ ID NO: 228663 - RNA, 19 nt, Homo sapiens
caagaagaacaucaauugu

SEQ ID NO: 228664 - RNA, 19 nt, Homo sapiens
ccagaugggugaccacacu

SEQ ID NO: 228665 - RNA, 19 nt, Homo sapiens
aggacucucuguuauagaa

SEQ ID NO: 228666 - RNA, 19 nt, Homo sapiens
caucaauuguuccauagag

SEQ ID NO: 228667 - RNA, 19 nt, Homo sapiens
gucagcaccucaucuaugg

SEQ ID NO: 228668 - RNA, 19 nt, Homo sapiens
cguaucuacuccagugaaa

SEQ ID NO: 228669 - RNA, 19 nt, Homo sapiens
auagccagcucuacacaga

SEQ ID NO: 228670 - RNA, 19 nt, Homo sapiens
guacgucuccugugcucuu

SEQ ID NO: 228671 - RNA, 19 nt, Homo sapiens
ccagcuuugugucuccuaa

SEQ ID NO: 228672 - RNA, 19 nt, Homo sapiens
cagaggccauuuguggaaa

SEQ ID NO: 228673 - RNA, 19 nt, Homo sapiens
cuggaaacuuuaucuguca

SEQ ID NO: 228674 - RNA, 19 nt, Homo sapiens
ccagggaucaugaaagaca

SEQ ID NO: 228675 - RNA, 19 nt, Homo sapiens
ucagagguuugacgcaauc

SEQ ID NO: 228676 - RNA, 19 nt, Homo sapiens
caaagcgggugaaaauugu

SEQ ID NO: 228677 - RNA, 19 nt, Homo sapiens
gacauggaaaugagaauag

SEQ ID NO: 228678 - RNA, 19 nt, Homo sapiens
ugucaagcccugaacagaa

SEQ ID NO: 228679 - RNA, 19 nt, Homo sapiens
gaagcuggaaacuuuaucu

SEQ ID NO: 228680 - RNA, 19 nt, Homo sapiens
ggaaauaggggcacacaca

SEQ ID NO: 228681 - RNA, 19 nt, Homo sapiens
aagaauaucguaucuacuc

SEQ ID NO: 228682 - RNA, 19 nt, Homo sapiens
ccucauagccagcucuaca

SEQ ID NO: 228683 - RNA, 19 nt, Homo sapiens
gggcacacacagaugauuc

SEQ ID NO: 228684 - RNA, 19 nt, Homo sapiens
ucaccaagaagaacaucaa

SEQ ID NO: 228685 - RNA, 19 nt, Homo sapiens
ccaaagcgggugaaaauug

SEQ ID NO: 228686 - RNA, 19 nt, Homo sapiens
ggcccuugcucucugacuu

SEQ ID NO: 228687 - RNA, 19 nt, Homo sapiens
auagaaaccaccagcuuug

SEQ ID NO: 228688 - RNA, 19 nt, Homo sapiens
aagguugaauggcacauca

SEQ ID NO: 228689 - RNA, 19 nt, Homo sapiens
ugaagucucccuuuguuac

SEQ ID NO: 228690 - RNA, 19 nt, Homo sapiens
ggucucuccuggcagaaag

SEQ ID NO: 228691 - RNA, 19 nt, Homo sapiens
uggaaaugagaauagguua

SEQ ID NO: 228692 - RNA, 19 nt, Homo sapiens
gugugaaucuccagaagcu

SEQ ID NO: 228693 - RNA, 19 nt, Homo sapiens
ggacucucuguuauagaaa

SEQ ID NO: 228694 - RNA, 19 nt, Homo sapiens
gauagacaugcuuucugaa

SEQ ID NO: 228695 - RNA, 19 nt, Homo sapiens
aaacuuggccacagaagac

SEQ ID NO: 228696 - RNA, 19 nt, Homo sapiens
cgagauggacuacaaaaug

SEQ ID NO: 228697 - RNA, 19 nt, Homo sapiens
ucuccacgcugaaugugau

SEQ ID NO: 228698 - RNA, 19 nt, Homo sapiens
gaaaaucuccacgcugaau

SEQ ID NO: 228699 - RNA, 19 nt, Homo sapiens
ugucagcaccucaucuaug

SEQ ID NO: 228700 - RNA, 19 nt, Homo sapiens
gcuagagggcuugggcauu

SEQ ID NO: 228701 - RNA, 19 nt, Homo sapiens
gcugaggucaccaagaagu

SEQ ID NO: 228702 - RNA, 19 nt, Homo sapiens
cagcgcagucagccaauau

SEQ ID NO: 228703 - RNA, 19 nt, Homo sapiens
ugaagcaggacucucuguu

SEQ ID NO: 228704 - RNA, 19 nt, Homo sapiens
ucuccucucuggauggaau

SEQ ID NO: 228705 - RNA, 19 nt, Homo sapiens
cugaagucucccuuuguua

SEQ ID NO: 228706 - RNA, 19 nt, Homo sapiens
gggugugaaucuccagaag

SEQ ID NO: 228707 - RNA, 19 nt, Homo sapiens
ggugaaaauuguggaaguu

SEQ ID NO: 228708 - RNA, 19 nt, Homo sapiens
ggaaguugguccccgagau

SEQ ID NO: 228709 - RNA, 19 nt, Homo sapiens
gaugggugaccacacugaa

SEQ ID NO: 228710 - RNA, 19 nt, Homo sapiens
ggcuaccuguaaacucuga

SEQ ID NO: 228711 - RNA, 19 nt, Homo sapiens
gcccugaccaacaccuuga

SEQ ID NO: 228712 - RNA, 19 nt, Homo sapiens
gaucuccccagcuaaagua

SEQ ID NO: 228713 - RNA, 19 nt, Homo sapiens
ucuaugggcacuuuaccaa

SEQ ID NO: 228714 - RNA, 19 nt, Homo sapiens
caagaaaccugcugcuaua

SEQ ID NO: 228715 - RNA, 19 nt, Homo sapiens
gaagagauuucaacaagaa

SEQ ID NO: 228716 - RNA, 19 nt, Homo sapiens
gaaauuaugugcugcuuug

SEQ ID NO: 228717 - RNA, 19 nt, Homo sapiens
gcagaguuauugaaucuua

SEQ ID NO: 228718 - RNA, 19 nt, Homo sapiens
gaaauaaccagaaauguga

SEQ ID NO: 228719 - RNA, 19 nt, Homo sapiens
gaaugaagcuuugcccuuu

SEQ ID NO: 228720 - RNA, 19 nt, Homo sapiens
gaacacaguuuagugcuuu

SEQ ID NO: 228721 - RNA, 19 nt, Homo sapiens
uaucagagcucuuaauguu

SEQ ID NO: 228722 - RNA, 19 nt, Homo sapiens
uaacaugucuuucagcauu

SEQ ID NO: 228723 - RNA, 19 nt, Homo sapiens
ugaagaaugucuacagaua

SEQ ID NO: 228724 - RNA, 19 nt, Homo sapiens
gcagauacuucuaagguuu

SEQ ID NO: 228725 - RNA, 19 nt, Homo sapiens
gauugugucugcauuguua

SEQ ID NO: 228726 - RNA, 19 nt, Homo sapiens
ccagaaaugugauucagua

SEQ ID NO: 228727 - RNA, 19 nt, Homo sapiens
aaacagagcuacauuugug

SEQ ID NO: 228728 - RNA, 19 nt, Homo sapiens
caaggagcaugcaaagaua

SEQ ID NO: 228729 - RNA, 19 nt, Homo sapiens
gaaaccugcugcuauaaau

SEQ ID NO: 228730 - RNA, 19 nt, Homo sapiens
gaaaaucuguuguuuguga

SEQ ID NO: 228731 - RNA, 19 nt, Homo sapiens
ugacagcacuagcagauuu

SEQ ID NO: 228732 - RNA, 19 nt, Homo sapiens
ggucagaaauaaccagaaa

SEQ ID NO: 228733 - RNA, 19 nt, Homo sapiens
gcauagccauccuguauau

SEQ ID NO: 228734 - RNA, 19 nt, Homo sapiens
gugagaauguuauuggaua

SEQ ID NO: 228735 - RNA, 19 nt, Homo sapiens
gaaaugugauucaguagag

SEQ ID NO: 228736 - RNA, 19 nt, Homo sapiens
gaagaucaauuuacaagac

SEQ ID NO: 228737 - RNA, 19 nt, Homo sapiens
ccacagaggcuaugauuga

SEQ ID NO: 228738 - RNA, 19 nt, Homo sapiens
gaauuuacgucaacuugga

SEQ ID NO: 228739 - RNA, 19 nt, Homo sapiens
caacuuguguacugauaaa

SEQ ID NO: 228740 - RNA, 19 nt, Homo sapiens
gagcuaaguucuaaguuca

SEQ ID NO: 228741 - RNA, 19 nt, Homo sapiens
ggucgaagaucaauuuaca

SEQ ID NO: 228742 - RNA, 19 nt, Homo sapiens
gacaauaacacgaugcaua

SEQ ID NO: 228743 - RNA, 19 nt, Homo sapiens
gcagugacauuauaauucu

SEQ ID NO: 228744 - RNA, 19 nt, Homo sapiens
gcaaauauaagcugggaaa

SEQ ID NO: 228745 - RNA, 19 nt, Homo sapiens
caagaagacagccugaaua

SEQ ID NO: 228746 - RNA, 19 nt, Homo sapiens
gaacaaguuauuacccuaa

SEQ ID NO: 228747 - RNA, 19 nt, Homo sapiens
gaaucuacacucucauuaa

SEQ ID NO: 228748 - RNA, 19 nt, Homo sapiens
gacagaaucuacacucuca

SEQ ID NO: 228749 - RNA, 19 nt, Homo sapiens
gaaaauguguccaagagaa

SEQ ID NO: 228750 - RNA, 19 nt, Homo sapiens
cacgaacgcucuuagcuuu

SEQ ID NO: 228751 - RNA, 19 nt, Homo sapiens
gcucaccucugaaagcaaa

SEQ ID NO: 228752 - RNA, 19 nt, Homo sapiens
gaugcuagguguucaagga

SEQ ID NO: 228753 - RNA, 19 nt, Homo sapiens
gacaguuacuuuccaagaa

SEQ ID NO: 228754 - RNA, 19 nt, Homo sapiens
guacgucagcuugaaauua

SEQ ID NO: 228755 - RNA, 19 nt, Homo sapiens
aguaagagcuaaguucuaa

SEQ ID NO: 228756 - RNA, 19 nt, Homo sapiens
gaacaaacagagacagaau

SEQ ID NO: 228757 - RNA, 19 nt, Homo sapiens
gaaagucccagacaauugu

SEQ ID NO: 228758 - RNA, 19 nt, Homo sapiens
uaucacaucuccuguagug

SEQ ID NO: 228759 - RNA, 19 nt, Homo sapiens
caagagaauugaaccaagu

SEQ ID NO: 228760 - RNA, 19 nt, Homo sapiens
guacagcagauacuucuaa

SEQ ID NO: 228761 - RNA, 19 nt, Homo sapiens
uagccauccuguauauuua

SEQ ID NO: 228762 - RNA, 19 nt, Homo sapiens
uggaaguguucaagaaaua

SEQ ID NO: 228763 - RNA, 19 nt, Homo sapiens
gcauuaggcuuuuaagaaa

SEQ ID NO: 228764 - RNA, 19 nt, Homo sapiens
gcauggauauugaacaagu

SEQ ID NO: 228765 - RNA, 19 nt, Homo sapiens
cagcauggauauugaacaa

SEQ ID NO: 228766 - RNA, 19 nt, Homo sapiens
ggauaaaccgagaaagaaa

SEQ ID NO: 228767 - RNA, 19 nt, Homo sapiens
gagcagugacauuauaauu

SEQ ID NO: 228768 - RNA, 19 nt, Homo sapiens
gaaagcugaugaugucucu

SEQ ID NO: 228769 - RNA, 19 nt, Homo sapiens
guucuaaguucauguuugu

SEQ ID NO: 228770 - RNA, 19 nt, Homo sapiens
ggauguagaacuucaagaa

SEQ ID NO: 228771 - RNA, 19 nt, Homo sapiens
caacucacaggaugaagua

SEQ ID NO: 228772 - RNA, 19 nt, Homo sapiens
aagcaagacugggaccuua

SEQ ID NO: 228773 - RNA, 19 nt, Homo sapiens
gcaagcacauuagcaaagu

SEQ ID NO: 228774 - RNA, 19 nt, Homo sapiens
gauaucagagcucuuaaug

SEQ ID NO: 228775 - RNA, 19 nt, Homo sapiens
cuacauuugugguugguaa

SEQ ID NO: 228776 - RNA, 19 nt, Homo sapiens
aaauauugcucguggaaug

SEQ ID NO: 228777 - RNA, 19 nt, Homo sapiens
guacaguugucauucacuu

SEQ ID NO: 228778 - RNA, 19 nt, Homo sapiens
cagcagaguuauugaaucu

SEQ ID NO: 228779 - RNA, 19 nt, Homo sapiens
ccaaaucuguauauguugu

SEQ ID NO: 228780 - RNA, 19 nt, Homo sapiens
uaagaucugugguuggaau

SEQ ID NO: 228781 - RNA, 19 nt, Homo sapiens
ggcauuggguucuaaagga

SEQ ID NO: 228782 - RNA, 19 nt, Homo sapiens
cagccaagguugucagaga

SEQ ID NO: 228783 - RNA, 19 nt, Homo sapiens
cuacagaaacuucauacaa

SEQ ID NO: 228784 - RNA, 19 nt, Homo sapiens
ucgaaugcauggccucuuu

SEQ ID NO: 228785 - RNA, 19 nt, Homo sapiens
gaucugugguuggaauuau

SEQ ID NO: 228786 - RNA, 19 nt, Homo sapiens
cacaacaggucgaagauca

SEQ ID NO: 228787 - RNA, 19 nt, Homo sapiens
uacgucagcuugaaauuau

SEQ ID NO: 228788 - RNA, 19 nt, Homo sapiens
gaccuuagaaaucauugua

SEQ ID NO: 228789 - RNA, 19 nt, Homo sapiens
gggauaaaccgagaaagaa

SEQ ID NO: 228790 - RNA, 19 nt, Homo sapiens
gcugauccuucuccucaaa

SEQ ID NO: 228791 - RNA, 19 nt, Homo sapiens
ccaggagguuggugacuga

SEQ ID NO: 228792 - RNA, 19 nt, Homo sapiens
gaaguaagagcuaaguucu

SEQ ID NO: 228793 - RNA, 19 nt, Homo sapiens
ccucugaaagcaaauauaa

SEQ ID NO: 228794 - RNA, 19 nt, Homo sapiens
ucaaggagcaugcaaagau

SEQ ID NO: 228795 - RNA, 19 nt, Homo sapiens
uacagaaacuucauacaag

SEQ ID NO: 228796 - RNA, 19 nt, Homo sapiens
guacaucuucuuugaacaa

SEQ ID NO: 228797 - RNA, 19 nt, Homo sapiens
gcauuguuauuguggaaga

SEQ ID NO: 228798 - RNA, 19 nt, Homo sapiens
guuggugacugaaacauuc

SEQ ID NO: 228799 - RNA, 19 nt, Homo sapiens
ggaaguguucaagaaauaa

SEQ ID NO: 228800 - RNA, 19 nt, Homo sapiens
gcacagaauguugguaguu

SEQ ID NO: 228801 - RNA, 19 nt, Homo sapiens
uagcagauuugcacgucua

SEQ ID NO: 228802 - RNA, 19 nt, Homo sapiens
aauaagaucugugguugga

SEQ ID NO: 228803 - RNA, 19 nt, Homo sapiens
uauuggaaguguucaagaa

SEQ ID NO: 228804 - RNA, 19 nt, Homo sapiens
ugagacagccacuugguuu

SEQ ID NO: 228805 - RNA, 19 nt, Homo sapiens
ggacuaacauaaaaucugu

SEQ ID NO: 228806 - RNA, 19 nt, Homo sapiens
ggucaacauuaacaagaau

SEQ ID NO: 228807 - RNA, 19 nt, Homo sapiens
aauagaggcugcagagcaa

SEQ ID NO: 228808 - RNA, 19 nt, Homo sapiens
gaaccuaugcuggucagaa

SEQ ID NO: 228809 - RNA, 19 nt, Homo sapiens
gaauugacaggcuugaaug

SEQ ID NO: 228810 - RNA, 19 nt, Homo sapiens
aaagucacaugauucacaa

SEQ ID NO: 228811 - RNA, 19 nt, Homo sapiens
ucacgaguauuucccugaa

SEQ ID NO: 228812 - RNA, 19 nt, Homo sapiens
gaaccucggccuaaugaag

SEQ ID NO: 228813 - RNA, 19 nt, Homo sapiens
ucagaaauaaccagaaaug

SEQ ID NO: 228814 - RNA, 19 nt, Homo sapiens
gaagacaccuacuuugaua

SEQ ID NO: 228815 - RNA, 19 nt, Homo sapiens
gaagagaauuggaguguuu

SEQ ID NO: 228816 - RNA, 19 nt, Homo sapiens
guacacaucuucaguauau

SEQ ID NO: 228817 - RNA, 19 nt, Homo sapiens
guacucaccucagcaauua

SEQ ID NO: 228818 - RNA, 19 nt, Homo sapiens
gcaaguuuaugugaucuua

SEQ ID NO: 228819 - RNA, 19 nt, Homo sapiens
gaauacagauauagaagga

SEQ ID NO: 228820 - RNA, 19 nt, Homo sapiens
gccaaaugcuccuuuaauu

SEQ ID NO: 228821 - RNA, 19 nt, Homo sapiens
gauauuaacucucuuugca

SEQ ID NO: 228822 - RNA, 19 nt, Homo sapiens
ggaacgugguacuuaguua

SEQ ID NO: 228823 - RNA, 19 nt, Homo sapiens
ugaaugacuuccuuaauga

SEQ ID NO: 228824 - RNA, 19 nt, Homo sapiens
caggagauauugcuguaua

SEQ ID NO: 228825 - RNA, 19 nt, Homo sapiens
gaaggaacgugguacuuag

SEQ ID NO: 228826 - RNA, 19 nt, Homo sapiens
gaaggaaucgacacaacua

SEQ ID NO: 228827 - RNA, 19 nt, Homo sapiens
uuacaagccugauaugcua

SEQ ID NO: 228828 - RNA, 19 nt, Homo sapiens
gaacagagacaaucaucga

SEQ ID NO: 228829 - RNA, 19 nt, Homo sapiens
gagaggacacccaucauuu

SEQ ID NO: 228830 - RNA, 19 nt, Homo sapiens
gaaagagggaaaugauaaa

SEQ ID NO: 228831 - RNA, 19 nt, Homo sapiens
gaauuggaguguuuucuua

SEQ ID NO: 228832 - RNA, 19 nt, Homo sapiens
gaguaggacuugugcauuc

SEQ ID NO: 228833 - RNA, 19 nt, Homo sapiens
gggaaacucuccauacagu

SEQ ID NO: 228834 - RNA, 19 nt, Homo sapiens
aagcagcugucauuaguaa

SEQ ID NO: 228835 - RNA, 19 nt, Homo sapiens
ugaagcagcugucauuagu

SEQ ID NO: 228836 - RNA, 19 nt, Homo sapiens
gcacagauagagaagauau

SEQ ID NO: 228837 - RNA, 19 nt, Homo sapiens
ccagaugucuucgcugaaa

SEQ ID NO: 228838 - RNA, 19 nt, Homo sapiens
gcaauuagcagggaagaga

SEQ ID NO: 228839 - RNA, 19 nt, Homo sapiens
gcucggauguugcugaaug

SEQ ID NO: 228840 - RNA, 19 nt, Homo sapiens
guaaacugguucagaaauc

SEQ ID NO: 228841 - RNA, 19 nt, Homo sapiens
gcuguuaacuggauugagu

SEQ ID NO: 228842 - RNA, 19 nt, Homo sapiens
cugaaugacuuccuuaaug

SEQ ID NO: 228843 - RNA, 19 nt, Homo sapiens
ggauguugcugaaugacuu

SEQ ID NO: 228844 - RNA, 19 nt, Homo sapiens
ugaaggaacgugguacuua

SEQ ID NO: 228845 - RNA, 19 nt, Homo sapiens
ggagaaggcauuuaugaag

SEQ ID NO: 228846 - RNA, 19 nt, Homo sapiens
agaaagagggaaaugauaa

SEQ ID NO: 228847 - RNA, 19 nt, Homo sapiens
uaacagcaaguuuauguga

SEQ ID NO: 228848 - RNA, 19 nt, Homo sapiens
gcagaaagagggaaaugau

SEQ ID NO: 228849 - RNA, 19 nt, Homo sapiens
ugaugcagcuguuugaaga

SEQ ID NO: 228850 - RNA, 19 nt, Homo sapiens
cauagcaacugagcauauu

SEQ ID NO: 228851 - RNA, 19 nt, Homo sapiens
gcaugacugugguucagaa

SEQ ID NO: 228852 - RNA, 19 nt, Homo sapiens
ggaagagaauuggaguguu

SEQ ID NO: 228853 - RNA, 19 nt, Homo sapiens
ggaaucgacacaacuaaug

SEQ ID NO: 228854 - RNA, 19 nt, Homo sapiens
gcugggaaguauaccauug

SEQ ID NO: 228855 - RNA, 19 nt, Homo sapiens
acauuaagauacucuguga

SEQ ID NO: 228856 - RNA, 19 nt, Homo sapiens
uagaagacaccuacuuuga

SEQ ID NO: 228857 - RNA, 19 nt, Homo sapiens
agagggaaaugauaaagau

SEQ ID NO: 228858 - RNA, 19 nt, Homo sapiens
cagaaagagggaaaugaua

SEQ ID NO: 228859 - RNA, 19 nt, Homo sapiens
gcuauucugucuacugcaa

SEQ ID NO: 228860 - RNA, 19 nt, Homo sapiens
ucaauagauucacucuuug

SEQ ID NO: 228861 - RNA, 19 nt, Homo sapiens
gccacucuguacucucuua

SEQ ID NO: 228862 - RNA, 19 nt, Homo sapiens
uaugaaggcuagcucugaa

SEQ ID NO: 228863 - RNA, 19 nt, Homo sapiens
gaagcagcugucauuagua

SEQ ID NO: 228864 - RNA, 19 nt, Homo sapiens
gaaaagcacagaagaacuu

SEQ ID NO: 228865 - RNA, 19 nt, Homo sapiens
ucaaugcuguuaacuggau

SEQ ID NO: 228866 - RNA, 19 nt, Homo sapiens
caccaugccuggaucacuu

SEQ ID NO: 228867 - RNA, 19 nt, Homo sapiens
gaacauuaagauacucugu

SEQ ID NO: 228868 - RNA, 19 nt, Homo sapiens
uccaagcccugccaagaaa

SEQ ID NO: 228869 - RNA, 19 nt, Homo sapiens
gaacgugguacuuaguuag

SEQ ID NO: 228870 - RNA, 19 nt, Homo sapiens
ugaccagaauagagauaaa

SEQ ID NO: 228871 - RNA, 19 nt, Homo sapiens
gcauuagaccgcugcuauu

SEQ ID NO: 228872 - RNA, 19 nt, Homo sapiens
agacaaucaucgacaaauc

SEQ ID NO: 228873 - RNA, 19 nt, Homo sapiens
ggacuugugcauucaaaca

SEQ ID NO: 228874 - RNA, 19 nt, Homo sapiens
cagagacaaucaucgacaa

SEQ ID NO: 228875 - RNA, 19 nt, Homo sapiens
ugacugugguucagaaucu

SEQ ID NO: 228876 - RNA, 19 nt, Homo sapiens
caauagauucacucuuuga

SEQ ID NO: 228877 - RNA, 19 nt, Homo sapiens
ggucugcucuugauaaaau

SEQ ID NO: 228878 - RNA, 19 nt, Homo sapiens
guggagaaggcauuuauga

SEQ ID NO: 228879 - RNA, 19 nt, Homo sapiens
gacaaucaucgacaaauca

SEQ ID NO: 228880 - RNA, 19 nt, Homo sapiens
cacuuuggaugaaggagua

SEQ ID NO: 228881 - RNA, 19 nt, Homo sapiens
ggcuagcucugaacucuuc

SEQ ID NO: 228882 - RNA, 19 nt, Homo sapiens
acaccuacuuugauagaga

SEQ ID NO: 228883 - RNA, 19 nt, Homo sapiens
uuaaugaccagaauagaga

SEQ ID NO: 228884 - RNA, 19 nt, Homo sapiens
ucacucaccauauuguaaa

SEQ ID NO: 228885 - RNA, 19 nt, Homo sapiens
gguaguugcaggagauauu

SEQ ID NO: 228886 - RNA, 19 nt, Homo sapiens
cuggaucacuuccuuugaa

SEQ ID NO: 228887 - RNA, 19 nt, Homo sapiens
cuaauuugaugcagcuguu

SEQ ID NO: 228888 - RNA, 19 nt, Homo sapiens
ugugaagacuaauuugaug

SEQ ID NO: 228889 - RNA, 19 nt, Homo sapiens
ccaagaaaguaccaagacu

SEQ ID NO: 228890 - RNA, 19 nt, Homo sapiens
aaacauagcaacugagcau

SEQ ID NO: 228891 - RNA, 19 nt, Homo sapiens
caaaagauguugggauugu

SEQ ID NO: 228892 - RNA, 19 nt, Homo sapiens
cugaauauccuauaguaga

SEQ ID NO: 228893 - RNA, 19 nt, Homo sapiens
ggccaaaugcuccuuuaau

SEQ ID NO: 228894 - RNA, 19 nt, Homo sapiens
ugaagagucugggaauaca

SEQ ID NO: 228895 - RNA, 19 nt, Homo sapiens
auucaaacauagcaacuga

SEQ ID NO: 228896 - RNA, 19 nt, Homo sapiens
ggaguaggacuugugcauu

SEQ ID NO: 228897 - RNA, 19 nt, Homo sapiens
guacuuaguuaggguggau

SEQ ID NO: 228898 - RNA, 19 nt, Homo sapiens
gaucuuucacucaccauau

SEQ ID NO: 228899 - RNA, 19 nt, Homo sapiens
gcaacaugccuaugauuuu

SEQ ID NO: 228900 - RNA, 19 nt, Homo sapiens
ggaugaaggaguaggacuu

SEQ ID NO: 228901 - RNA, 19 nt, Homo sapiens
guagaugcugggaaguaua

SEQ ID NO: 228902 - RNA, 19 nt, Homo sapiens
ugauagagauguggagaag

SEQ ID NO: 228903 - RNA, 19 nt, Homo sapiens
auuguaaacugguucagaa

SEQ ID NO: 228904 - RNA, 19 nt, Homo sapiens
gggcuucgugggacacaua

SEQ ID NO: 228905 - RNA, 19 nt, Homo sapiens
ugcaggagauauugcugua

SEQ ID NO: 228906 - RNA, 19 nt, Homo sapiens
agaaucuuauggagagaaa

SEQ ID NO: 228907 - RNA, 19 nt, Homo sapiens
gaugaaggaguaggacuug

SEQ ID NO: 228908 - RNA, 19 nt, Homo sapiens
ucagagaggacacccauca

SEQ ID NO: 228909 - RNA, 19 nt, Homo sapiens
guauaugguucccuugcau

SEQ ID NO: 228910 - RNA, 19 nt, Homo sapiens
uaaacugguucagaaaucu

SEQ ID NO: 228911 - RNA, 19 nt, Homo sapiens
gaucaagcagaguuggaaa

SEQ ID NO: 228912 - RNA, 19 nt, Homo sapiens
uauaguagaugggaaacuc

SEQ ID NO: 228913 - RNA, 19 nt, Homo sapiens
ucugugaggugcaagacuu

SEQ ID NO: 228914 - RNA, 19 nt, Homo sapiens
aaacugaccuggagaagua

SEQ ID NO: 228915 - RNA, 19 nt, Homo sapiens
gcacugagaccaucauuga

SEQ ID NO: 228916 - RNA, 19 nt, Homo sapiens
acucuuagcugguaaauga

SEQ ID NO: 228917 - RNA, 19 nt, Homo sapiens
gaacccauauggagaaugu

SEQ ID NO: 228918 - RNA, 19 nt, Homo sapiens
cagauaaacuuuccuguca

SEQ ID NO: 228919 - RNA, 19 nt, Homo sapiens
gagagcaauucuaccauaa

SEQ ID NO: 228920 - RNA, 19 nt, Homo sapiens
gaagacaccuacaccaaca

SEQ ID NO: 228921 - RNA, 19 nt, Homo sapiens
caucagcccuguagaguga

SEQ ID NO: 228922 - RNA, 19 nt, Homo sapiens
acacaaaccagcuuauaua

SEQ ID NO: 228923 - RNA, 19 nt, Homo sapiens
gauaaacuuuccugucaug

SEQ ID NO: 228924 - RNA, 19 nt, Homo sapiens
ggauaaagcacuucuaaag

SEQ ID NO: 228925 - RNA, 19 nt, Homo sapiens
gcagauccauggaaagcuu

SEQ ID NO: 228926 - RNA, 19 nt, Homo sapiens
gaucagcuguugccuucaa

SEQ ID NO: 228927 - RNA, 19 nt, Homo sapiens
gaaaugugcaugcagauca

SEQ ID NO: 228928 - RNA, 19 nt, Homo sapiens
ggacauguucgacaagaaa

SEQ ID NO: 228929 - RNA, 19 nt, Homo sapiens
agagagcaauucuaccaua

SEQ ID NO: 228930 - RNA, 19 nt, Homo sapiens
gggcauagauaccaccaau

SEQ ID NO: 228931 - RNA, 19 nt, Homo sapiens
ggagaaguauaacaaugug

SEQ ID NO: 228932 - RNA, 19 nt, Homo sapiens
gaauuugaaucgacauagu

SEQ ID NO: 228933 - RNA, 19 nt, Homo sapiens
ggaguucacagaaauaaug

SEQ ID NO: 228934 - RNA, 19 nt, Homo sapiens
ggauuggugccuucucuua

SEQ ID NO: 228935 - RNA, 19 nt, Homo sapiens
ccaccacucugcccaagaa

SEQ ID NO: 228936 - RNA, 19 nt, Homo sapiens
gcaagaugguccagaaguc

SEQ ID NO: 228937 - RNA, 19 nt, Homo sapiens
caacaaggaccuggauaaa

SEQ ID NO: 228938 - RNA, 19 nt, Homo sapiens
gaauguguaugacuucuac

SEQ ID NO: 228939 - RNA, 19 nt, Homo sapiens
gauauugagggcauagaua

SEQ ID NO: 228940 - RNA, 19 nt, Homo sapiens
aaacuuuccugucaugugu

SEQ ID NO: 228941 - RNA, 19 nt, Homo sapiens
ggaccuggauaaagcacuu

SEQ ID NO: 228942 - RNA, 19 nt, Homo sapiens
caaauuuggccucggagua

SEQ ID NO: 228943 - RNA, 19 nt, Homo sapiens
guaccuuguucuaagcuaa

SEQ ID NO: 228944 - RNA, 19 nt, Homo sapiens
gcaugcagaucagcuguug

SEQ ID NO: 228945 - RNA, 19 nt, Homo sapiens
gaucuuucauacacccuuu

SEQ ID NO: 228946 - RNA, 19 nt, Homo sapiens
gagcaauucuaccauaagg

SEQ ID NO: 228947 - RNA, 19 nt, Homo sapiens
uuucugaacugcuggguuu

SEQ ID NO: 228948 - RNA, 19 nt, Homo sapiens
ucacagaaauaaugaacca

SEQ ID NO: 228949 - RNA, 19 nt, Homo sapiens
ccaacaaggaccuggauaa

SEQ ID NO: 228950 - RNA, 19 nt, Homo sapiens
aaacagugcucauggaacu

SEQ ID NO: 228951 - RNA, 19 nt, Homo sapiens
gcaggaaaccucccucaca

SEQ ID NO: 228952 - RNA, 19 nt, Homo sapiens
gaaauaaugaaccaaagag

SEQ ID NO: 228953 - RNA, 19 nt, Homo sapiens
caagagcggugcaggaaac

SEQ ID NO: 228954 - RNA, 19 nt, Homo sapiens
caagauccagauaaacuuu

SEQ ID NO: 228955 - RNA, 19 nt, Homo sapiens
ccaaagagagcaauucuac

SEQ ID NO: 228956 - RNA, 19 nt, Homo sapiens
gcacaucagaccugccaaa

SEQ ID NO: 228957 - RNA, 19 nt, Homo sapiens
ugucauguguuagaacuuu

SEQ ID NO: 228958 - RNA, 19 nt, Homo sapiens
acaaggaccuggauaaagc

SEQ ID NO: 228959 - RNA, 19 nt, Homo sapiens
cuaaagguguucugcagau

SEQ ID NO: 228960 - RNA, 19 nt, Homo sapiens
gaaccaaagagagcaauuc

SEQ ID NO: 228961 - RNA, 19 nt, Homo sapiens
gauaaagcacuucuaaagg

SEQ ID NO: 228962 - RNA, 19 nt, Homo sapiens
cacaaaccagcuuauauaa

SEQ ID NO: 228963 - RNA, 19 nt, Homo sapiens
ggagaugcagcgucuguug

SEQ ID NO: 228964 - RNA, 19 nt, Homo sapiens
cagcaucgccgaaaguaug

SEQ ID NO: 228965 - RNA, 19 nt, Homo sapiens
ccugaggaguucacagaaa

SEQ ID NO: 228966 - RNA, 19 nt, Homo sapiens
agagcaagauggagcaaug

SEQ ID NO: 228967 - RNA, 19 nt, Homo sapiens
gaggaguucacagaaauaa

SEQ ID NO: 228968 - RNA, 19 nt, Homo sapiens
gacaagagcggugcaggaa

SEQ ID NO: 228969 - RNA, 19 nt, Homo sapiens
aaacagauacuuggccaaa

SEQ ID NO: 228970 - RNA, 19 nt, Homo sapiens
cuucacccuugacgauuua

SEQ ID NO: 228971 - RNA, 19 nt, Homo sapiens
ccuucaagauccagauaaa

SEQ ID NO: 228972 - RNA, 19 nt, Homo sapiens
cagaaauaaugaaccaaag

SEQ ID NO: 228973 - RNA, 19 nt, Homo sapiens
guccaaagcugucaaaaca

SEQ ID NO: 228974 - RNA, 19 nt, Homo sapiens
gagaugcagcgucuguuga

SEQ ID NO: 228975 - RNA, 19 nt, Homo sapiens
acacacaaaccagcuuaua

SEQ ID NO: 228976 - RNA, 19 nt, Homo sapiens
ugacacacaaaccagcuua

SEQ ID NO: 228977 - RNA, 19 nt, Homo sapiens
uggagaauguguaugacuu

SEQ ID NO: 228978 - RNA, 19 nt, Homo sapiens
gguacugccucccucuuca

SEQ ID NO: 228979 - RNA, 19 nt, Homo sapiens
gaaguauaacaauguggaa

SEQ ID NO: 228980 - RNA, 19 nt, Homo sapiens
ccugugaaucuccaaauuu

SEQ ID NO: 228981 - RNA, 19 nt, Homo sapiens
cuacuucccagcccaauau

SEQ ID NO: 228982 - RNA, 19 nt, Homo sapiens
gucauguguuagaacuuua

SEQ ID NO: 228983 - RNA, 19 nt, Homo sapiens
cugaggaguucacagaaau

SEQ ID NO: 228984 - RNA, 19 nt, Homo sapiens
ggagaauguguaugacuuc

SEQ ID NO: 228985 - RNA, 19 nt, Homo sapiens
acagauacuuggccaaagg

SEQ ID NO: 228986 - RNA, 19 nt, Homo sapiens
aaagagagcaauucuacca

SEQ ID NO: 228987 - RNA, 19 nt, Homo sapiens
ccuucacccuugacgauuu

SEQ ID NO: 228988 - RNA, 19 nt, Homo sapiens
guauaacaauguggaagca

SEQ ID NO: 228989 - RNA, 19 nt, Homo sapiens
caggacauguucgacaaga

SEQ ID NO: 228990 - RNA, 19 nt, Homo sapiens
cacacaaaccagcuuauau

SEQ ID NO: 228991 - RNA, 19 nt, Homo sapiens
cuggagaaguauaacaaug

SEQ ID NO: 228992 - RNA, 19 nt, Homo sapiens
ugaggaguucacagaaaua

SEQ ID NO: 228993 - RNA, 19 nt, Homo sapiens
ggccuuggaucgauguuac

SEQ ID NO: 228994 - RNA, 19 nt, Homo sapiens
gagcagcaucgccgaaagu

SEQ ID NO: 228995 - RNA, 19 nt, Homo sapiens
gauuggugccuucucuuau

SEQ ID NO: 228996 - RNA, 19 nt, Homo sapiens
uguggaagcaggaaaguau

SEQ ID NO: 228997 - RNA, 19 nt, Homo sapiens
ucacuguccugggcuuaug

SEQ ID NO: 228998 - RNA, 19 nt, Homo sapiens
cgacauaguagccccauaa

SEQ ID NO: 228999 - RNA, 19 nt, Homo sapiens
cuggauaaagcacuucuaa

SEQ ID NO: 229000 - RNA, 19 nt, Homo sapiens
gaguucacagaaauaauga

SEQ ID NO: 229001 - RNA, 19 nt, Homo sapiens
cccaauauguggaccaaac

SEQ ID NO: 229002 - RNA, 19 nt, Homo sapiens
ucaagauccagauaaacuu

SEQ ID NO: 229003 - RNA, 19 nt, Homo sapiens
caggauuggugccuucucu

SEQ ID NO: 229004 - RNA, 19 nt, Homo sapiens
auauggagaauguguauga

SEQ ID NO: 229005 - RNA, 19 nt, Homo sapiens
gaagcgcauucugcaacug

SEQ ID NO: 229006 - RNA, 19 nt, Homo sapiens
caaguccaaagcugucaaa

SEQ ID NO: 229007 - RNA, 19 nt, Homo sapiens
guggaagcaggaaaguaua

SEQ ID NO: 229008 - RNA, 19 nt, Homo sapiens
uuaaacuucugugcuguuc

SEQ ID NO: 229009 - RNA, 19 nt, Homo sapiens
acuuuccugucauguguua

SEQ ID NO: 229010 - RNA, 19 nt, Homo sapiens
gggcuuauggugccuaugg

SEQ ID NO: 229011 - RNA, 19 nt, Homo sapiens
uaaagguguucugcagauc

SEQ ID NO: 229012 - RNA, 19 nt, Homo sapiens
cccuuuaccucuccacuca

SEQ ID NO: 229013 - RNA, 19 nt, Homo sapiens
aaaggccucucaggacaug

SEQ ID NO: 229014 - RNA, 19 nt, Homo sapiens
gagaugcagucacuuauug

SEQ ID NO: 229015 - RNA, 19 nt, Homo sapiens
gugcugcgcuccucuaauu

SEQ ID NO: 229016 - RNA, 19 nt, Homo sapiens
caagaaggcauccgcauuu

SEQ ID NO: 229017 - RNA, 19 nt, Homo sapiens
gcaagcagccuccgaagga

SEQ ID NO: 229018 - RNA, 19 nt, Homo sapiens
gagaagggaagaugaguga

SEQ ID NO: 229019 - RNA, 19 nt, Homo sapiens
ccaagguucugguuccauu

SEQ ID NO: 229020 - RNA, 19 nt, Homo sapiens
ccugggaucugaguacaua

SEQ ID NO: 229021 - RNA, 19 nt, Homo sapiens
ggagaugcagucacuuauu

SEQ ID NO: 229022 - RNA, 19 nt, Homo sapiens
caaacuaccucuggacagu

SEQ ID NO: 229023 - RNA, 19 nt, Homo sapiens
gaagugccaacaccuaaga

SEQ ID NO: 229024 - RNA, 19 nt, Homo sapiens
ccucucugguuuccuauuu

SEQ ID NO: 229025 - RNA, 19 nt, Homo sapiens
gcgaagugccaacaccuaa

SEQ ID NO: 229026 - RNA, 19 nt, Homo sapiens
gaaggagcccagcgaagug

SEQ ID NO: 229027 - RNA, 19 nt, Homo sapiens
ccaagaaggcauccgcauu

SEQ ID NO: 229028 - RNA, 19 nt, Homo sapiens
gaagggaagaugagugagu

SEQ ID NO: 229029 - RNA, 19 nt, Homo sapiens
gaucugaguacauauugug

SEQ ID NO: 229030 - RNA, 19 nt, Homo sapiens
cagcagguguggccaaugg

SEQ ID NO: 229031 - RNA, 19 nt, Homo sapiens
gguuuccuauuugcaguua

SEQ ID NO: 229032 - RNA, 19 nt, Homo sapiens
gaguacauauuguggugau

SEQ ID NO: 229033 - RNA, 19 nt, Homo sapiens
gaaaaggacggcacugaga

SEQ ID NO: 229034 - RNA, 19 nt, Homo sapiens
ggaucugaguacauauugu

SEQ ID NO: 229035 - RNA, 19 nt, Homo sapiens
aaggcuaacaucccacuua

SEQ ID NO: 229036 - RNA, 19 nt, Homo sapiens
cacaugcccuccuggacaa

SEQ ID NO: 229037 - RNA, 19 nt, Homo sapiens
gaaggcauccgcauuugcu

SEQ ID NO: 229038 - RNA, 19 nt, Homo sapiens
cgaaggagcccagcgaagu

SEQ ID NO: 229039 - RNA, 19 nt, Homo sapiens
aagaaggcauccgcauuug

SEQ ID NO: 229040 - RNA, 19 nt, Homo sapiens
ccuacucccucuucacugu

SEQ ID NO: 229041 - RNA, 19 nt, Homo sapiens
caggcugggugaccgacua

SEQ ID NO: 229042 - RNA, 19 nt, Homo sapiens
gcuaccagcgccaaauguu

SEQ ID NO: 229043 - RNA, 19 nt, Homo sapiens
ugauggagaugcagucacu

SEQ ID NO: 229044 - RNA, 19 nt, Homo sapiens
ccacaacuccaggaaggaa

SEQ ID NO: 229045 - RNA, 19 nt, Homo sapiens
cuggacaguuguguuguuu

SEQ ID NO: 229046 - RNA, 19 nt, Homo sapiens
gggaucugaguacauauug

SEQ ID NO: 229047 - RNA, 19 nt, Homo sapiens
acauugcucucugggcuuu

SEQ ID NO: 229048 - RNA, 19 nt, Homo sapiens
ccuauuugcaguuacuuga

SEQ ID NO: 229049 - RNA, 19 nt, Homo sapiens
ucuggacaguuguguuguu

SEQ ID NO: 229050 - RNA, 19 nt, Homo sapiens
ccucuggacaguuguguug

SEQ ID NO: 229051 - RNA, 19 nt, Homo sapiens
caagguucugguuccauuu

SEQ ID NO: 229052 - RNA, 19 nt, Homo sapiens
ccucuggcuucccauagug

SEQ ID NO: 229053 - RNA, 19 nt, Homo sapiens
auggagaugcagucacuua

SEQ ID NO: 229054 - RNA, 19 nt, Homo sapiens
ucagauggggcaccaauaa

SEQ ID NO: 229055 - RNA, 19 nt, Homo sapiens
ucucugggcuuuugguuug

SEQ ID NO: 229056 - RNA, 19 nt, Homo sapiens
gcccgaaucgaccauaaag

SEQ ID NO: 229057 - RNA, 19 nt, Homo sapiens
uaccagcgccaaauguuca

SEQ ID NO: 229058 - RNA, 19 nt, Homo sapiens
gagaugcagucacuuauug

SEQ ID NO: 229059 - RNA, 19 nt, Homo sapiens
gugcugcgcuccucuaauu

SEQ ID NO: 229060 - RNA, 19 nt, Homo sapiens
caagaaggcauccgcauuu

SEQ ID NO: 229061 - RNA, 19 nt, Homo sapiens
gagaagggaagaugaguga

SEQ ID NO: 229062 - RNA, 19 nt, Homo sapiens
ccaagguucugguuccauu

SEQ ID NO: 229063 - RNA, 19 nt, Homo sapiens
ccugggaucugaguacaua

SEQ ID NO: 229064 - RNA, 19 nt, Homo sapiens
ggagaugcagucacuuauu

SEQ ID NO: 229065 - RNA, 19 nt, Homo sapiens
caaacuaccucuggacagu

SEQ ID NO: 229066 - RNA, 19 nt, Homo sapiens
gaagugccaacaccuaaga

SEQ ID NO: 229067 - RNA, 19 nt, Homo sapiens
ccucucugguuuccuauuu

SEQ ID NO: 229068 - RNA, 19 nt, Homo sapiens
gcgaagugccaacaccuaa

SEQ ID NO: 229069 - RNA, 19 nt, Homo sapiens
gaaggagcccagcgaagug

SEQ ID NO: 229070 - RNA, 19 nt, Homo sapiens
ccaagaaggcauccgcauu

SEQ ID NO: 229071 - RNA, 19 nt, Homo sapiens
gaagggaagaugagugagu

SEQ ID NO: 229072 - RNA, 19 nt, Homo sapiens
gaucugaguacauauugug

SEQ ID NO: 229073 - RNA, 19 nt, Homo sapiens
cagcagguguggccaaugg

SEQ ID NO: 229074 - RNA, 19 nt, Homo sapiens
gguuuccuauuugcaguua

SEQ ID NO: 229075 - RNA, 19 nt, Homo sapiens
gaguacauauuguggugau

SEQ ID NO: 229076 - RNA, 19 nt, Homo sapiens
gaaaaggacggcacugaga

SEQ ID NO: 229077 - RNA, 19 nt, Homo sapiens
ggaucugaguacauauugu

SEQ ID NO: 229078 - RNA, 19 nt, Homo sapiens
aaggcuaacaucccacuua

SEQ ID NO: 229079 - RNA, 19 nt, Homo sapiens
cacaugcccuccuggacaa

SEQ ID NO: 229080 - RNA, 19 nt, Homo sapiens
gaaggcauccgcauuugcu

SEQ ID NO: 229081 - RNA, 19 nt, Homo sapiens
aagaaggcauccgcauuug

SEQ ID NO: 229082 - RNA, 19 nt, Homo sapiens
ccuacucccucuucacugu

SEQ ID NO: 229083 - RNA, 19 nt, Homo sapiens
caggcugggugaccgacua

SEQ ID NO: 229084 - RNA, 19 nt, Homo sapiens
gcuaccagcgccaaauguu

SEQ ID NO: 229085 - RNA, 19 nt, Homo sapiens
ugauggagaugcagucacu

SEQ ID NO: 229086 - RNA, 19 nt, Homo sapiens
ccacaacuccaggaaggaa

SEQ ID NO: 229087 - RNA, 19 nt, Homo sapiens
cuggacaguuguguuguuu

SEQ ID NO: 229088 - RNA, 19 nt, Homo sapiens
gggaucugaguacauauug

SEQ ID NO: 229089 - RNA, 19 nt, Homo sapiens
acauugcucucugggcuuu

SEQ ID NO: 229090 - RNA, 19 nt, Homo sapiens
ccuauuugcaguuacuuga

SEQ ID NO: 229091 - RNA, 19 nt, Homo sapiens
ucuggacaguuguguuguu

SEQ ID NO: 229092 - RNA, 19 nt, Homo sapiens
ccucuggacaguuguguug

SEQ ID NO: 229093 - RNA, 19 nt, Homo sapiens
caagguucugguuccauuu

SEQ ID NO: 229094 - RNA, 19 nt, Homo sapiens
agaaggagcccagcgaagu

SEQ ID NO: 229095 - RNA, 19 nt, Homo sapiens
caagcagccuccggugagu

SEQ ID NO: 229096 - RNA, 19 nt, Homo sapiens
ccucuggcuucccauagug

SEQ ID NO: 229097 - RNA, 19 nt, Homo sapiens
auggagaugcagucacuua

SEQ ID NO: 229098 - RNA, 19 nt, Homo sapiens
ucagauggggcaccaauaa

SEQ ID NO: 229099 - RNA, 19 nt, Homo sapiens
ucucugggcuuuugguuug

SEQ ID NO: 229100 - RNA, 19 nt, Homo sapiens
gcccgaaucgaccauaaag

SEQ ID NO: 229101 - RNA, 19 nt, Homo sapiens
uaccagcgccaaauguuca

SEQ ID NO: 229102 - RNA, 19 nt, Homo sapiens
gagaugcagucacuuauug

SEQ ID NO: 229103 - RNA, 19 nt, Homo sapiens
gugcugcgcuccucuaauu

SEQ ID NO: 229104 - RNA, 19 nt, Homo sapiens
caagaaggcauccgcauuu

SEQ ID NO: 229105 - RNA, 19 nt, Homo sapiens
gagaagggaagaugaguga

SEQ ID NO: 229106 - RNA, 19 nt, Homo sapiens
ccaagguucugguuccauu

SEQ ID NO: 229107 - RNA, 19 nt, Homo sapiens
ccugggaucugaguacaua

SEQ ID NO: 229108 - RNA, 19 nt, Homo sapiens
ggagaugcagucacuuauu

SEQ ID NO: 229109 - RNA, 19 nt, Homo sapiens
caaacuaccucuggacagu

SEQ ID NO: 229110 - RNA, 19 nt, Homo sapiens
gaagugccaacaccuaaga

SEQ ID NO: 229111 - RNA, 19 nt, Homo sapiens
ccucucugguuuccuauuu

SEQ ID NO: 229112 - RNA, 19 nt, Homo sapiens
gcgaagugccaacaccuaa

SEQ ID NO: 229113 - RNA, 19 nt, Homo sapiens
gaaggagcccagcgaagug

SEQ ID NO: 229114 - RNA, 19 nt, Homo sapiens
ccaagaaggcauccgcauu

SEQ ID NO: 229115 - RNA, 19 nt, Homo sapiens
gaagggaagaugagugagu

SEQ ID NO: 229116 - RNA, 19 nt, Homo sapiens
gaucugaguacauauugug

SEQ ID NO: 229117 - RNA, 19 nt, Homo sapiens
cagcagguguggccaaugg

SEQ ID NO: 229118 - RNA, 19 nt, Homo sapiens
gguuuccuauuugcaguua

SEQ ID NO: 229119 - RNA, 19 nt, Homo sapiens
gaguacauauuguggugau

SEQ ID NO: 229120 - RNA, 19 nt, Homo sapiens
ggaucugaguacauauugu

SEQ ID NO: 229121 - RNA, 19 nt, Homo sapiens
aaggcuaacaucccacuua

SEQ ID NO: 229122 - RNA, 19 nt, Homo sapiens
cacaugcccuccuggacaa

SEQ ID NO: 229123 - RNA, 19 nt, Homo sapiens
gaaggcauccgcauuugcu

SEQ ID NO: 229124 - RNA, 19 nt, Homo sapiens
aagaaggcauccgcauuug

SEQ ID NO: 229125 - RNA, 19 nt, Homo sapiens
ccuacucccucuucacugu

SEQ ID NO: 229126 - RNA, 19 nt, Homo sapiens
caggcugggugaccgacua

SEQ ID NO: 229127 - RNA, 19 nt, Homo sapiens
gcuaccagcgccaaauguu

SEQ ID NO: 229128 - RNA, 19 nt, Homo sapiens
ugauggagaugcagucacu

SEQ ID NO: 229129 - RNA, 19 nt, Homo sapiens
ccacaacuccaggaaggaa

SEQ ID NO: 229130 - RNA, 19 nt, Homo sapiens
cuggacaguuguguuguuu

SEQ ID NO: 229131 - RNA, 19 nt, Homo sapiens
gggaucugaguacauauug

SEQ ID NO: 229132 - RNA, 19 nt, Homo sapiens
acauugcucucugggcuuu

SEQ ID NO: 229133 - RNA, 19 nt, Homo sapiens
ccuauuugcaguuacuuga

SEQ ID NO: 229134 - RNA, 19 nt, Homo sapiens
ucuggacaguuguguuguu

SEQ ID NO: 229135 - RNA, 19 nt, Homo sapiens
ccucuggacaguuguguug

SEQ ID NO: 229136 - RNA, 19 nt, Homo sapiens
gcccuuggccucugagaag

SEQ ID NO: 229137 - RNA, 19 nt, Homo sapiens
caagcagccuccggugagu

SEQ ID NO: 229138 - RNA, 19 nt, Homo sapiens
caagguucugguuccauuu

SEQ ID NO: 229139 - RNA, 19 nt, Homo sapiens
agaaggagcccagcgaagu

SEQ ID NO: 229140 - RNA, 19 nt, Homo sapiens
ccucuggcuucccauagug

SEQ ID NO: 229141 - RNA, 19 nt, Homo sapiens
auggagaugcagucacuua

SEQ ID NO: 229142 - RNA, 19 nt, Homo sapiens
ucagauggggcaccaauaa

SEQ ID NO: 229143 - RNA, 19 nt, Homo sapiens
ucucugggcuuuugguuug

SEQ ID NO: 229144 - RNA, 19 nt, Homo sapiens
gcccgaaucgaccauaaag

SEQ ID NO: 229145 - RNA, 19 nt, Homo sapiens
uaccagcgccaaauguuca

SEQ ID NO: 229146 - RNA, 19 nt, Homo sapiens
gagaugcagucacuuauug

SEQ ID NO: 229147 - RNA, 19 nt, Homo sapiens
gagaagggaagaugaguga

SEQ ID NO: 229148 - RNA, 19 nt, Homo sapiens
ccaagguucugguuccauu

SEQ ID NO: 229149 - RNA, 19 nt, Homo sapiens
ccugggaucugaguacaua

SEQ ID NO: 229150 - RNA, 19 nt, Homo sapiens
ggagaugcagucacuuauu

SEQ ID NO: 229151 - RNA, 19 nt, Homo sapiens
caaacuaccucuggacagu

SEQ ID NO: 229152 - RNA, 19 nt, Homo sapiens
gaagugccaacaccuaaga

SEQ ID NO: 229153 - RNA, 19 nt, Homo sapiens
ccucucugguuuccuauuu

SEQ ID NO: 229154 - RNA, 19 nt, Homo sapiens
gcgaagugccaacaccuaa

SEQ ID NO: 229155 - RNA, 19 nt, Homo sapiens
gaaggagcccagcgaagug

SEQ ID NO: 229156 - RNA, 19 nt, Homo sapiens
gaagggaagaugagugagu

SEQ ID NO: 229157 - RNA, 19 nt, Homo sapiens
gaucugaguacauauugug

SEQ ID NO: 229158 - RNA, 19 nt, Homo sapiens
cagcagguguggccaaugg

SEQ ID NO: 229159 - RNA, 19 nt, Homo sapiens
gguuuccuauuugcaguua

SEQ ID NO: 229160 - RNA, 19 nt, Homo sapiens
gaguacauauuguggugau

SEQ ID NO: 229161 - RNA, 19 nt, Homo sapiens
gaaaaggacggcacugaga

SEQ ID NO: 229162 - RNA, 19 nt, Homo sapiens
ggaucugaguacauauugu

SEQ ID NO: 229163 - RNA, 19 nt, Homo sapiens
aaggcuaacaucccacuua

SEQ ID NO: 229164 - RNA, 19 nt, Homo sapiens
cacaugcccuccuggacaa

SEQ ID NO: 229165 - RNA, 19 nt, Homo sapiens
ccuacucccucuucacugu

SEQ ID NO: 229166 - RNA, 19 nt, Homo sapiens
caggcugggugaccgacua

SEQ ID NO: 229167 - RNA, 19 nt, Homo sapiens
gcuaccagcgccaaauguu

SEQ ID NO: 229168 - RNA, 19 nt, Homo sapiens
ugauggagaugcagucacu

SEQ ID NO: 229169 - RNA, 19 nt, Homo sapiens
ccacaacuccaggaaggaa

SEQ ID NO: 229170 - RNA, 19 nt, Homo sapiens
cuggacaguuguguuguuu

SEQ ID NO: 229171 - RNA, 19 nt, Homo sapiens
gggaucugaguacauauug

SEQ ID NO: 229172 - RNA, 19 nt, Homo sapiens
acauugcucucugggcuuu

SEQ ID NO: 229173 - RNA, 19 nt, Homo sapiens
ccuauuugcaguuacuuga

SEQ ID NO: 229174 - RNA, 19 nt, Homo sapiens
ucuggacaguuguguuguu

SEQ ID NO: 229175 - RNA, 19 nt, Homo sapiens
ccucuggacaguuguguug

SEQ ID NO: 229176 - RNA, 19 nt, Homo sapiens
caagguucugguuccauuu

SEQ ID NO: 229177 - RNA, 19 nt, Homo sapiens
agaaggagcccagcgaagu

SEQ ID NO: 229178 - RNA, 19 nt, Homo sapiens
caagcagccuccggugagu

SEQ ID NO: 229179 - RNA, 19 nt, Homo sapiens
ccucuggcuucccauagug

SEQ ID NO: 229180 - RNA, 19 nt, Homo sapiens
auggagaugcagucacuua

SEQ ID NO: 229181 - RNA, 19 nt, Homo sapiens
ucagauggggcaccaauaa

SEQ ID NO: 229182 - RNA, 19 nt, Homo sapiens
ucucugggcuuuugguuug

SEQ ID NO: 229183 - RNA, 19 nt, Homo sapiens
gcccgaaucgaccauaaag

SEQ ID NO: 229184 - RNA, 19 nt, Homo sapiens
uaccagcgccaaauguuca

SEQ ID NO: 229185 - RNA, 19 nt, Homo sapiens
gagaugcagucacuuauug

SEQ ID NO: 229186 - RNA, 19 nt, Homo sapiens
gcaagcagccuccgaagga

SEQ ID NO: 229187 - RNA, 19 nt, Homo sapiens
gagaagggaagaugaguga

SEQ ID NO: 229188 - RNA, 19 nt, Homo sapiens
ccaagguucugguuccauu

SEQ ID NO: 229189 - RNA, 19 nt, Homo sapiens
ccugggaucugaguacaua

SEQ ID NO: 229190 - RNA, 19 nt, Homo sapiens
ggagaugcagucacuuauu

SEQ ID NO: 229191 - RNA, 19 nt, Homo sapiens
caaacuaccucuggacagu

SEQ ID NO: 229192 - RNA, 19 nt, Homo sapiens
gaagugccaacaccuaaga

SEQ ID NO: 229193 - RNA, 19 nt, Homo sapiens
ccucucugguuuccuauuu

SEQ ID NO: 229194 - RNA, 19 nt, Homo sapiens
gcgaagugccaacaccuaa

SEQ ID NO: 229195 - RNA, 19 nt, Homo sapiens
gaaggagcccagcgaagug

SEQ ID NO: 229196 - RNA, 19 nt, Homo sapiens
gaagggaagaugagugagu

SEQ ID NO: 229197 - RNA, 19 nt, Homo sapiens
gaucugaguacauauugug

SEQ ID NO: 229198 - RNA, 19 nt, Homo sapiens
cagcagguguggccaaugg

SEQ ID NO: 229199 - RNA, 19 nt, Homo sapiens
gguuuccuauuugcaguua

SEQ ID NO: 229200 - RNA, 19 nt, Homo sapiens
gaguacauauuguggugau

SEQ ID NO: 229201 - RNA, 19 nt, Homo sapiens
gaaaaggacggcacugaga

SEQ ID NO: 229202 - RNA, 19 nt, Homo sapiens
ggaucugaguacauauugu

SEQ ID NO: 229203 - RNA, 19 nt, Homo sapiens
aaggcuaacaucccacuua

SEQ ID NO: 229204 - RNA, 19 nt, Homo sapiens
cacaugcccuccuggacaa

SEQ ID NO: 229205 - RNA, 19 nt, Homo sapiens
cgaaggagcccagcgaagu

SEQ ID NO: 229206 - RNA, 19 nt, Homo sapiens
ccuacucccucuucacugu

SEQ ID NO: 229207 - RNA, 19 nt, Homo sapiens
caggcugggugaccgacua

SEQ ID NO: 229208 - RNA, 19 nt, Homo sapiens
gcuaccagcgccaaauguu

SEQ ID NO: 229209 - RNA, 19 nt, Homo sapiens
ugauggagaugcagucacu

SEQ ID NO: 229210 - RNA, 19 nt, Homo sapiens
ccacaacuccaggaaggaa

SEQ ID NO: 229211 - RNA, 19 nt, Homo sapiens
cuggacaguuguguuguuu

SEQ ID NO: 229212 - RNA, 19 nt, Homo sapiens
gggaucugaguacauauug

SEQ ID NO: 229213 - RNA, 19 nt, Homo sapiens
acauugcucucugggcuuu

SEQ ID NO: 229214 - RNA, 19 nt, Homo sapiens
ccuauuugcaguuacuuga

SEQ ID NO: 229215 - RNA, 19 nt, Homo sapiens
ucuggacaguuguguuguu

SEQ ID NO: 229216 - RNA, 19 nt, Homo sapiens
ccucuggacaguuguguug

SEQ ID NO: 229217 - RNA, 19 nt, Homo sapiens
caagguucugguuccauuu

SEQ ID NO: 229218 - RNA, 19 nt, Homo sapiens
ccucuggcuucccauagug

SEQ ID NO: 229219 - RNA, 19 nt, Homo sapiens
auggagaugcagucacuua

SEQ ID NO: 229220 - RNA, 19 nt, Homo sapiens
ucagauggggcaccaauaa

SEQ ID NO: 229221 - RNA, 19 nt, Homo sapiens
ucucugggcuuuugguuug

SEQ ID NO: 229222 - RNA, 19 nt, Homo sapiens
gcccgaaucgaccauaaag

SEQ ID NO: 229223 - RNA, 19 nt, Homo sapiens
uaccagcgccaaauguuca

SEQ ID NO: 229224 - RNA, 19 nt, Homo sapiens
gagaugcagucacuuauug

SEQ ID NO: 229225 - RNA, 19 nt, Homo sapiens
gugcugcgcuccucuaauu

SEQ ID NO: 229226 - RNA, 19 nt, Homo sapiens
gcaagcagccuccgaagga

SEQ ID NO: 229227 - RNA, 19 nt, Homo sapiens
gagaagggaagaugaguga

SEQ ID NO: 229228 - RNA, 19 nt, Homo sapiens
ccaagguucugguuccauu

SEQ ID NO: 229229 - RNA, 19 nt, Homo sapiens
ccugggaucugaguacaua

SEQ ID NO: 229230 - RNA, 19 nt, Homo sapiens
ggagaugcagucacuuauu

SEQ ID NO: 229231 - RNA, 19 nt, Homo sapiens
caaacuaccucuggacagu

SEQ ID NO: 229232 - RNA, 19 nt, Homo sapiens
gaagugccaacaccuaaga

SEQ ID NO: 229233 - RNA, 19 nt, Homo sapiens
ccucucugguuuccuauuu

SEQ ID NO: 229234 - RNA, 19 nt, Homo sapiens
gcgaagugccaacaccuaa

SEQ ID NO: 229235 - RNA, 19 nt, Homo sapiens
gaaggagcccagcgaagug

SEQ ID NO: 229236 - RNA, 19 nt, Homo sapiens
gaagggaagaugagugagu

SEQ ID NO: 229237 - RNA, 19 nt, Homo sapiens
gaucugaguacauauugug

SEQ ID NO: 229238 - RNA, 19 nt, Homo sapiens
cagcagguguggccaaugg

SEQ ID NO: 229239 - RNA, 19 nt, Homo sapiens
gguuuccuauuugcaguua

SEQ ID NO: 229240 - RNA, 19 nt, Homo sapiens
gaguacauauuguggugau

SEQ ID NO: 229241 - RNA, 19 nt, Homo sapiens
gaaaaggacggcacugaga

SEQ ID NO: 229242 - RNA, 19 nt, Homo sapiens
ggaucugaguacauauugu

SEQ ID NO: 229243 - RNA, 19 nt, Homo sapiens
aaggcuaacaucccacuua

SEQ ID NO: 229244 - RNA, 19 nt, Homo sapiens
cacaugcccuccuggacaa

SEQ ID NO: 229245 - RNA, 19 nt, Homo sapiens
cgaaggagcccagcgaagu

SEQ ID NO: 229246 - RNA, 19 nt, Homo sapiens
ccuacucccucuucacugu

SEQ ID NO: 229247 - RNA, 19 nt, Homo sapiens
caggcugggugaccgacua

SEQ ID NO: 229248 - RNA, 19 nt, Homo sapiens
gcuaccagcgccaaauguu

SEQ ID NO: 229249 - RNA, 19 nt, Homo sapiens
ugauggagaugcagucacu

SEQ ID NO: 229250 - RNA, 19 nt, Homo sapiens
ccacaacuccaggaaggaa

SEQ ID NO: 229251 - RNA, 19 nt, Homo sapiens
cuggacaguuguguuguuu

SEQ ID NO: 229252 - RNA, 19 nt, Homo sapiens
gggaucugaguacauauug

SEQ ID NO: 229253 - RNA, 19 nt, Homo sapiens
acauugcucucugggcuuu

SEQ ID NO: 229254 - RNA, 19 nt, Homo sapiens
ccuauuugcaguuacuuga

SEQ ID NO: 229255 - RNA, 19 nt, Homo sapiens
ucuggacaguuguguuguu

SEQ ID NO: 229256 - RNA, 19 nt, Homo sapiens
ccucuggacaguuguguug

SEQ ID NO: 229257 - RNA, 19 nt, Homo sapiens
caagguucugguuccauuu

SEQ ID NO: 229258 - RNA, 19 nt, Homo sapiens
ccucuggcuucccauagug

SEQ ID NO: 229259 - RNA, 19 nt, Homo sapiens
auggagaugcagucacuua

SEQ ID NO: 229260 - RNA, 19 nt, Homo sapiens
ucagauggggcaccaauaa

SEQ ID NO: 229261 - RNA, 19 nt, Homo sapiens
ucucugggcuuuugguuug

SEQ ID NO: 229262 - RNA, 19 nt, Homo sapiens
gcccgaaucgaccauaaag

SEQ ID NO: 229263 - RNA, 19 nt, Homo sapiens
uaccagcgccaaauguuca

SEQ ID NO: 229264 - RNA, 19 nt, Homo sapiens
gagaugcagucacuuauug

SEQ ID NO: 229265 - RNA, 19 nt, Homo sapiens
gagaagggaagaugaguga

SEQ ID NO: 229266 - RNA, 19 nt, Homo sapiens
ccaagguucugguuccauu

SEQ ID NO: 229267 - RNA, 19 nt, Homo sapiens
ccugggaucugaguacaua

SEQ ID NO: 229268 - RNA, 19 nt, Homo sapiens
ggagaugcagucacuuauu

SEQ ID NO: 229269 - RNA, 19 nt, Homo sapiens
caaacuaccucuggacagu

SEQ ID NO: 229270 - RNA, 19 nt, Homo sapiens
gaagugccaacaccuaaga

SEQ ID NO: 229271 - RNA, 19 nt, Homo sapiens
ccaaagugcugggauuaca

SEQ ID NO: 229272 - RNA, 19 nt, Homo sapiens
ccucucugguuuccuauuu

SEQ ID NO: 229273 - RNA, 19 nt, Homo sapiens
gcgaagugccaacaccuaa

SEQ ID NO: 229274 - RNA, 19 nt, Homo sapiens
gaaggagcccagcgaagug

SEQ ID NO: 229275 - RNA, 19 nt, Homo sapiens
gaagggaagaugagugagu

SEQ ID NO: 229276 - RNA, 19 nt, Homo sapiens
gaucugaguacauauugug

SEQ ID NO: 229277 - RNA, 19 nt, Homo sapiens
cagcagguguggccaaugg

SEQ ID NO: 229278 - RNA, 19 nt, Homo sapiens
gguuuccuauuugcaguua

SEQ ID NO: 229279 - RNA, 19 nt, Homo sapiens
gaguacauauuguggugau

SEQ ID NO: 229280 - RNA, 19 nt, Homo sapiens
gaaaaggacggcacugaga

SEQ ID NO: 229281 - RNA, 19 nt, Homo sapiens
ggaucugaguacauauugu

SEQ ID NO: 229282 - RNA, 19 nt, Homo sapiens
aaggcuaacaucccacuua

SEQ ID NO: 229283 - RNA, 19 nt, Homo sapiens
cacaugcccuccuggacaa

SEQ ID NO: 229284 - RNA, 19 nt, Homo sapiens
ccuacucccucuucacugu

SEQ ID NO: 229285 - RNA, 19 nt, Homo sapiens
caggcugggugaccgacua

SEQ ID NO: 229286 - RNA, 19 nt, Homo sapiens
gcuaccagcgccaaauguu

SEQ ID NO: 229287 - RNA, 19 nt, Homo sapiens
ugauggagaugcagucacu

SEQ ID NO: 229288 - RNA, 19 nt, Homo sapiens
gaacuccugaccucaagca

SEQ ID NO: 229289 - RNA, 19 nt, Homo sapiens
ccacaacuccaggaaggaa

SEQ ID NO: 229290 - RNA, 19 nt, Homo sapiens
cuggacaguuguguuguuu

SEQ ID NO: 229291 - RNA, 19 nt, Homo sapiens
gggaucugaguacauauug

SEQ ID NO: 229292 - RNA, 19 nt, Homo sapiens
acauugcucucugggcuuu

SEQ ID NO: 229293 - RNA, 19 nt, Homo sapiens
ccuauuugcaguuacuuga

SEQ ID NO: 229294 - RNA, 19 nt, Homo sapiens
ucuggacaguuguguuguu

SEQ ID NO: 229295 - RNA, 19 nt, Homo sapiens
ccucuggacaguuguguug

SEQ ID NO: 229296 - RNA, 19 nt, Homo sapiens
caagguucugguuccauuu

SEQ ID NO: 229297 - RNA, 19 nt, Homo sapiens
agaaggagcccagcgaagu

SEQ ID NO: 229298 - RNA, 19 nt, Homo sapiens
caagcagccuccggugagu

SEQ ID NO: 229299 - RNA, 19 nt, Homo sapiens
ccucuggcuucccauagug

SEQ ID NO: 229300 - RNA, 19 nt, Homo sapiens
auggagaugcagucacuua

SEQ ID NO: 229301 - RNA, 19 nt, Homo sapiens
ucagauggggcaccaauaa

SEQ ID NO: 229302 - RNA, 19 nt, Homo sapiens
ucucugggcuuuugguuug

SEQ ID NO: 229303 - RNA, 19 nt, Homo sapiens
gcccgaaucgaccauaaag

SEQ ID NO: 229304 - RNA, 19 nt, Homo sapiens
uaccagcgccaaauguuca

SEQ ID NO: 229305 - RNA, 19 nt, Homo sapiens
gagaugcagucacuuauug

SEQ ID NO: 229306 - RNA, 19 nt, Homo sapiens
gcaagcagccuccgaagga

SEQ ID NO: 229307 - RNA, 19 nt, Homo sapiens
gagaagggaagaugaguga

SEQ ID NO: 229308 - RNA, 19 nt, Homo sapiens
ccaagguucugguuccauu

SEQ ID NO: 229309 - RNA, 19 nt, Homo sapiens
ccugggaucugaguacaua

SEQ ID NO: 229310 - RNA, 19 nt, Homo sapiens
ggagaugcagucacuuauu

SEQ ID NO: 229311 - RNA, 19 nt, Homo sapiens
ccaggcagaccuuauauga

SEQ ID NO: 229312 - RNA, 19 nt, Homo sapiens
caaacuaccucuggacagu

SEQ ID NO: 229313 - RNA, 19 nt, Homo sapiens
gaagugccaacaccuaaga

SEQ ID NO: 229314 - RNA, 19 nt, Homo sapiens
ccucucugguuuccuauuu

SEQ ID NO: 229315 - RNA, 19 nt, Homo sapiens
gcgaagugccaacaccuaa

SEQ ID NO: 229316 - RNA, 19 nt, Homo sapiens
gaaggagcccagcgaagug

SEQ ID NO: 229317 - RNA, 19 nt, Homo sapiens
gaagggaagaugagugagu

SEQ ID NO: 229318 - RNA, 19 nt, Homo sapiens
gaucugaguacauauugug

SEQ ID NO: 229319 - RNA, 19 nt, Homo sapiens
cagcagguguggccaaugg

SEQ ID NO: 229320 - RNA, 19 nt, Homo sapiens
gguuuccuauuugcaguua

SEQ ID NO: 229321 - RNA, 19 nt, Homo sapiens
gaguacauauuguggugau

SEQ ID NO: 229322 - RNA, 19 nt, Homo sapiens
gaaaaggacggcacugaga

SEQ ID NO: 229323 - RNA, 19 nt, Homo sapiens
ggaucugaguacauauugu

SEQ ID NO: 229324 - RNA, 19 nt, Homo sapiens
aaggcuaacaucccacuua

SEQ ID NO: 229325 - RNA, 19 nt, Homo sapiens
cacaugcccuccuggacaa

SEQ ID NO: 229326 - RNA, 19 nt, Homo sapiens
ggacuggcuucgcccaacu

SEQ ID NO: 229327 - RNA, 19 nt, Homo sapiens
cgaaggagcccagcgaagu

SEQ ID NO: 229328 - RNA, 19 nt, Homo sapiens
ccuacucccucuucacugu

SEQ ID NO: 229329 - RNA, 19 nt, Homo sapiens
caggcugggugaccgacua

SEQ ID NO: 229330 - RNA, 19 nt, Homo sapiens
gcuaccagcgccaaauguu

SEQ ID NO: 229331 - RNA, 19 nt, Homo sapiens
ugauggagaugcagucacu

SEQ ID NO: 229332 - RNA, 19 nt, Homo sapiens
ccacaacuccaggaaggaa

SEQ ID NO: 229333 - RNA, 19 nt, Homo sapiens
cuggacaguuguguuguuu

SEQ ID NO: 229334 - RNA, 19 nt, Homo sapiens
gggaucugaguacauauug

SEQ ID NO: 229335 - RNA, 19 nt, Homo sapiens
acauugcucucugggcuuu

SEQ ID NO: 229336 - RNA, 19 nt, Homo sapiens
uggcuucgcccaacuggaa

SEQ ID NO: 229337 - RNA, 19 nt, Homo sapiens
gagcaucccagccaucacu

SEQ ID NO: 229338 - RNA, 19 nt, Homo sapiens
ccuauuugcaguuacuuga

SEQ ID NO: 229339 - RNA, 19 nt, Homo sapiens
ucuggacaguuguguuguu

SEQ ID NO: 229340 - RNA, 19 nt, Homo sapiens
ccucuggacaguuguguug

SEQ ID NO: 229341 - RNA, 19 nt, Homo sapiens
caagguucugguuccauuu

SEQ ID NO: 229342 - RNA, 19 nt, Homo sapiens
ccucuggcuucccauagug

SEQ ID NO: 229343 - RNA, 19 nt, Homo sapiens
auggagaugcagucacuua

SEQ ID NO: 229344 - RNA, 19 nt, Homo sapiens
ucagauggggcaccaauaa

SEQ ID NO: 229345 - RNA, 19 nt, Homo sapiens
ccagaugguaugagagcuu

SEQ ID NO: 229346 - RNA, 19 nt, Homo sapiens
ucucugggcuuuugguuug

SEQ ID NO: 229347 - RNA, 19 nt, Homo sapiens
gcccgaaucgaccauaaag

SEQ ID NO: 229348 - RNA, 19 nt, Homo sapiens
uaccagcgccaaauguuca

SEQ ID NO: 229349 - RNA, 19 nt, Homo sapiens
gcaaauaccuccucccuaa

SEQ ID NO: 229350 - RNA, 19 nt, Homo sapiens
ggacaagccuaacuucaua

SEQ ID NO: 229351 - RNA, 19 nt, Homo sapiens
gaaauaaggacaagccuaa

SEQ ID NO: 229352 - RNA, 19 nt, Homo sapiens
ggaugagcuugauaaauua

SEQ ID NO: 229353 - RNA, 19 nt, Homo sapiens
uggaugagcuugauaaauu

SEQ ID NO: 229354 - RNA, 19 nt, Homo sapiens
gcaacaagagaaagaauua

SEQ ID NO: 229355 - RNA, 19 nt, Homo sapiens
gaaguaaacaucugagaaa

SEQ ID NO: 229356 - RNA, 19 nt, Homo sapiens
gagcucaaaucaagaauau

SEQ ID NO: 229357 - RNA, 19 nt, Homo sapiens
gaaugcaucucaucaacuu

SEQ ID NO: 229358 - RNA, 19 nt, Homo sapiens
aaacaucucucucugcaaa

SEQ ID NO: 229359 - RNA, 19 nt, Homo sapiens
agaaaccuguugaagauua

SEQ ID NO: 229360 - RNA, 19 nt, Homo sapiens
gaauaaaguucuagguauc

SEQ ID NO: 229361 - RNA, 19 nt, Homo sapiens
ugaaagcuauaaagcguua

SEQ ID NO: 229362 - RNA, 19 nt, Homo sapiens
gaccaggacuaaugaacua

SEQ ID NO: 229363 - RNA, 19 nt, Homo sapiens
ugagaaaccuguugaagau

SEQ ID NO: 229364 - RNA, 19 nt, Homo sapiens
gcaaagccuugaagauguu

SEQ ID NO: 229365 - RNA, 19 nt, Homo sapiens
gaggaagaauuaaagcaaa

SEQ ID NO: 229366 - RNA, 19 nt, Homo sapiens
cuucagaguuugucauaua

SEQ ID NO: 229367 - RNA, 19 nt, Homo sapiens
caagaggaauugaauaaag

SEQ ID NO: 229368 - RNA, 19 nt, Homo sapiens
gaacucaucauuacaggaa

SEQ ID NO: 229369 - RNA, 19 nt, Homo sapiens
cgaagagucucaagggaaa

SEQ ID NO: 229370 - RNA, 19 nt, Homo sapiens
gaauagagaacacaacgaa

SEQ ID NO: 229371 - RNA, 19 nt, Homo sapiens
guuauugccucuacuuuga

SEQ ID NO: 229372 - RNA, 19 nt, Homo sapiens
ggaaaugguuaaagagaag

SEQ ID NO: 229373 - RNA, 19 nt, Homo sapiens
ugaaagagaagaaugauga

SEQ ID NO: 229374 - RNA, 19 nt, Homo sapiens
gauacuaccuugccugcuu

SEQ ID NO: 229375 - RNA, 19 nt, Homo sapiens
cugagaaacucuacaugua

SEQ ID NO: 229376 - RNA, 19 nt, Homo sapiens
ggaauacaucgaagaaauu

SEQ ID NO: 229377 - RNA, 19 nt, Homo sapiens
gaaaauagccaacucaaau

SEQ ID NO: 229378 - RNA, 19 nt, Homo sapiens
aucuagagcugaagaauua

SEQ ID NO: 229379 - RNA, 19 nt, Homo sapiens
gaauugaccaggacuaaug

SEQ ID NO: 229380 - RNA, 19 nt, Homo sapiens
ggaccaguauccuuucaga

SEQ ID NO: 229381 - RNA, 19 nt, Homo sapiens
caagaaucauggaaguaaa

SEQ ID NO: 229382 - RNA, 19 nt, Homo sapiens
ucaagcauguugugaaguu

SEQ ID NO: 229383 - RNA, 19 nt, Homo sapiens
guuaacagccagugagaua

SEQ ID NO: 229384 - RNA, 19 nt, Homo sapiens
aagccuaacuucauagaaa

SEQ ID NO: 229385 - RNA, 19 nt, Homo sapiens
cuacucagcauuugauuaa

SEQ ID NO: 229386 - RNA, 19 nt, Homo sapiens
ggaaguaaacaucugagaa

SEQ ID NO: 229387 - RNA, 19 nt, Homo sapiens
caacucaaaucggaaguau

SEQ ID NO: 229388 - RNA, 19 nt, Homo sapiens
aagaggaaaugguuaaaga

SEQ ID NO: 229389 - RNA, 19 nt, Homo sapiens
gcuagauauugcccaguua

SEQ ID NO: 229390 - RNA, 19 nt, Homo sapiens
gcuaaaugcugcacuaagg

SEQ ID NO: 229391 - RNA, 19 nt, Homo sapiens
gaaaccuguugaagauuau

SEQ ID NO: 229392 - RNA, 19 nt, Homo sapiens
gcucaggaacagcuaaaua

SEQ ID NO: 229393 - RNA, 19 nt, Homo sapiens
gcacuaaaggaaacagaaa

SEQ ID NO: 229394 - RNA, 19 nt, Homo sapiens
gaaauuaguugugcuucag

SEQ ID NO: 229395 - RNA, 19 nt, Homo sapiens
caaguggcgucuccucuau

SEQ ID NO: 229396 - RNA, 19 nt, Homo sapiens
gcaacaggaggaagacuuu

SEQ ID NO: 229397 - RNA, 19 nt, Homo sapiens
gcucaaaucaagaauaugu

SEQ ID NO: 229398 - RNA, 19 nt, Homo sapiens
ugagaaacucuacauguaa

SEQ ID NO: 229399 - RNA, 19 nt, Homo sapiens
cugaagaaauuaacaagug

SEQ ID NO: 229400 - RNA, 19 nt, Homo sapiens
gaacacaacgaaaaucuaa

SEQ ID NO: 229401 - RNA, 19 nt, Homo sapiens
gaagaaauuaguugugcuu

SEQ ID NO: 229402 - RNA, 19 nt, Homo sapiens
uggaauacaucgaagaaau

SEQ ID NO: 229403 - RNA, 19 nt, Homo sapiens
ccuauuauccuucuacuug

SEQ ID NO: 229404 - RNA, 19 nt, Homo sapiens
gcuggagaacucaucauua

SEQ ID NO: 229405 - RNA, 19 nt, Homo sapiens
gagaaacucuacauguaac

SEQ ID NO: 229406 - RNA, 19 nt, Homo sapiens
cagcagaauuaacugaaga

SEQ ID NO: 229407 - RNA, 19 nt, Homo sapiens
caagucagcacuaaaggaa

SEQ ID NO: 229408 - RNA, 19 nt, Homo sapiens
agauguuacugcucaauuu

SEQ ID NO: 229409 - RNA, 19 nt, Homo sapiens
gaccaugucaacaggaaua

SEQ ID NO: 229410 - RNA, 19 nt, Homo sapiens
ggacuaaugaacuacuaaa

SEQ ID NO: 229411 - RNA, 19 nt, Homo sapiens
aaaguuaagucuucggaau

SEQ ID NO: 229412 - RNA, 19 nt, Homo sapiens
ucaagaaucauggaaguaa

SEQ ID NO: 229413 - RNA, 19 nt, Homo sapiens
uaaggaugcuucuagaucu

SEQ ID NO: 229414 - RNA, 19 nt, Homo sapiens
gaggaaaugguuaaagaga

SEQ ID NO: 229415 - RNA, 19 nt, Homo sapiens
gaaagagaagaaugaugaa

SEQ ID NO: 229416 - RNA, 19 nt, Homo sapiens
ccaaaggagucucgaagag

SEQ ID NO: 229417 - RNA, 19 nt, Homo sapiens
gcaugucuacucagcauuu

SEQ ID NO: 229418 - RNA, 19 nt, Homo sapiens
guaacuauuucuucagagu

SEQ ID NO: 229419 - RNA, 19 nt, Homo sapiens
gguccuaccuauuauccuu

SEQ ID NO: 229420 - RNA, 19 nt, Homo sapiens
guugugaaguugaaagaug

SEQ ID NO: 229421 - RNA, 19 nt, Homo sapiens
caacauguccuuuccuaag

SEQ ID NO: 229422 - RNA, 19 nt, Homo sapiens
caagaaggcauggagauga

SEQ ID NO: 229423 - RNA, 19 nt, Homo sapiens
uaacugauuugcagaacca

SEQ ID NO: 229424 - RNA, 19 nt, Homo sapiens
aaauaaugcuacacuggaa

SEQ ID NO: 229425 - RNA, 19 nt, Homo sapiens
caacagcagaauuaacuga

SEQ ID NO: 229426 - RNA, 19 nt, Homo sapiens
ggaaaaguaugacaguaug

SEQ ID NO: 229427 - RNA, 19 nt, Homo sapiens
uaugauggcuaagcaagaa

SEQ ID NO: 229428 - RNA, 19 nt, Homo sapiens
guaaggaugcuucuagauc

SEQ ID NO: 229429 - RNA, 19 nt, Homo sapiens
caaugacccuucugguugu

SEQ ID NO: 229430 - RNA, 19 nt, Homo sapiens
gugcaaagccuugaagaug

SEQ ID NO: 229431 - RNA, 19 nt, Homo sapiens
gucaacauguccuuuccua

SEQ ID NO: 229432 - RNA, 19 nt, Homo sapiens
ggaggaagacuuuagaaaa

SEQ ID NO: 229433 - RNA, 19 nt, Homo sapiens
gaauuaucuucgagucuuc

SEQ ID NO: 229434 - RNA, 19 nt, Homo sapiens
gaaacucuacauguaacua

SEQ ID NO: 229435 - RNA, 19 nt, Homo sapiens
guaaacaucugagaaaccu

SEQ ID NO: 229436 - RNA, 19 nt, Homo sapiens
agaauuaucuucgagucuu

SEQ ID NO: 229437 - RNA, 19 nt, Homo sapiens
ggagcuggccgucaacaug

SEQ ID NO: 229438 - RNA, 19 nt, Homo sapiens
ucaaaucggaaguaucaaa

SEQ ID NO: 229439 - RNA, 19 nt, Homo sapiens
cugaaaggcuggucaagca

SEQ ID NO: 229440 - RNA, 19 nt, Homo sapiens
gagaaagagauucguguuc

SEQ ID NO: 229441 - RNA, 19 nt, Homo sapiens
ugaaaugucagcugcuuga

SEQ ID NO: 229442 - RNA, 19 nt, Homo sapiens
aagaaggcauggagaugaa

SEQ ID NO: 229443 - RNA, 19 nt, Homo sapiens
gcaagaaggcauggagaug

SEQ ID NO: 229444 - RNA, 19 nt, Homo sapiens
cacuugguccuaccuauua

SEQ ID NO: 229445 - RNA, 19 nt, Homo sapiens
acaaauugauucacuucug

SEQ ID NO: 229446 - RNA, 19 nt, Homo sapiens
ucaaaggaaucucaaaaga

SEQ ID NO: 229447 - RNA, 19 nt, Homo sapiens
uauggagugucaagaauca

SEQ ID NO: 229448 - RNA, 19 nt, Homo sapiens
ccaggugcuuaugauguua

SEQ ID NO: 229449 - RNA, 19 nt, Homo sapiens
gcaaauaccuccucccuaa

SEQ ID NO: 229450 - RNA, 19 nt, Homo sapiens
ggacaagccuaacuucaua

SEQ ID NO: 229451 - RNA, 19 nt, Homo sapiens
gaaauaaggacaagccuaa

SEQ ID NO: 229452 - RNA, 19 nt, Homo sapiens
ggaugagcuugauaaauua

SEQ ID NO: 229453 - RNA, 19 nt, Homo sapiens
uggaugagcuugauaaauu

SEQ ID NO: 229454 - RNA, 19 nt, Homo sapiens
gcaacaagagaaagaauua

SEQ ID NO: 229455 - RNA, 19 nt, Homo sapiens
gaaguaaacaucugagaaa

SEQ ID NO: 229456 - RNA, 19 nt, Homo sapiens
gagcucaaaucaagaauau

SEQ ID NO: 229457 - RNA, 19 nt, Homo sapiens
gaaugcaucucaucaacuu

SEQ ID NO: 229458 - RNA, 19 nt, Homo sapiens
aaacaucucucucugcaaa

SEQ ID NO: 229459 - RNA, 19 nt, Homo sapiens
agaaaccuguugaagauua

SEQ ID NO: 229460 - RNA, 19 nt, Homo sapiens
gaauaaaguucuagguauc

SEQ ID NO: 229461 - RNA, 19 nt, Homo sapiens
ugaaagcuauaaagcguua

SEQ ID NO: 229462 - RNA, 19 nt, Homo sapiens
gaccaggacuaaugaacua

SEQ ID NO: 229463 - RNA, 19 nt, Homo sapiens
ugagaaaccuguugaagau

SEQ ID NO: 229464 - RNA, 19 nt, Homo sapiens
gcaaagccuugaagauguu

SEQ ID NO: 229465 - RNA, 19 nt, Homo sapiens
gaggaagaauuaaagcaaa

SEQ ID NO: 229466 - RNA, 19 nt, Homo sapiens
cuucagaguuugucauaua

SEQ ID NO: 229467 - RNA, 19 nt, Homo sapiens
caagaggaauugaauaaag

SEQ ID NO: 229468 - RNA, 19 nt, Homo sapiens
gaacucaucauuacaggaa

SEQ ID NO: 229469 - RNA, 19 nt, Homo sapiens
cgaagagucucaagggaaa

SEQ ID NO: 229470 - RNA, 19 nt, Homo sapiens
gaauagagaacacaacgaa

SEQ ID NO: 229471 - RNA, 19 nt, Homo sapiens
guuauugccucuacuuuga

SEQ ID NO: 229472 - RNA, 19 nt, Homo sapiens
ggaaaugguuaaagagaag

SEQ ID NO: 229473 - RNA, 19 nt, Homo sapiens
ugaaagagaagaaugauga

SEQ ID NO: 229474 - RNA, 19 nt, Homo sapiens
gauacuaccuugccugcuu

SEQ ID NO: 229475 - RNA, 19 nt, Homo sapiens
cugagaaacucuacaugua

SEQ ID NO: 229476 - RNA, 19 nt, Homo sapiens
ggaauacaucgaagaaauu

SEQ ID NO: 229477 - RNA, 19 nt, Homo sapiens
gaaaauagccaacucaaau

SEQ ID NO: 229478 - RNA, 19 nt, Homo sapiens
aucuagagcugaagaauua

SEQ ID NO: 229479 - RNA, 19 nt, Homo sapiens
gaauugaccaggacuaaug

SEQ ID NO: 229480 - RNA, 19 nt, Homo sapiens
ggaccaguauccuuucaga

SEQ ID NO: 229481 - RNA, 19 nt, Homo sapiens
caagaaucauggaaguaaa

SEQ ID NO: 229482 - RNA, 19 nt, Homo sapiens
ucaagcauguugugaaguu

SEQ ID NO: 229483 - RNA, 19 nt, Homo sapiens
guuaacagccagugagaua

SEQ ID NO: 229484 - RNA, 19 nt, Homo sapiens
aagccuaacuucauagaaa

SEQ ID NO: 229485 - RNA, 19 nt, Homo sapiens
cuacucagcauuugauuaa

SEQ ID NO: 229486 - RNA, 19 nt, Homo sapiens
ggaaguaaacaucugagaa

SEQ ID NO: 229487 - RNA, 19 nt, Homo sapiens
caacucaaaucggaaguau

SEQ ID NO: 229488 - RNA, 19 nt, Homo sapiens
aagaggaaaugguuaaaga

SEQ ID NO: 229489 - RNA, 19 nt, Homo sapiens
gcuagauauugcccaguua

SEQ ID NO: 229490 - RNA, 19 nt, Homo sapiens
gcuaaaugcugcacuaagg

SEQ ID NO: 229491 - RNA, 19 nt, Homo sapiens
gaaaccuguugaagauuau

SEQ ID NO: 229492 - RNA, 19 nt, Homo sapiens
gcucaggaacagcuaaaua

SEQ ID NO: 229493 - RNA, 19 nt, Homo sapiens
gcacuaaaggaaacagaaa

SEQ ID NO: 229494 - RNA, 19 nt, Homo sapiens
gaaauuaguugugcuucag

SEQ ID NO: 229495 - RNA, 19 nt, Homo sapiens
caaguggcgucuccucuau

SEQ ID NO: 229496 - RNA, 19 nt, Homo sapiens
gcaacaggaggaagacuuu

SEQ ID NO: 229497 - RNA, 19 nt, Homo sapiens
gcucaaaucaagaauaugu

SEQ ID NO: 229498 - RNA, 19 nt, Homo sapiens
ugagaaacucuacauguaa

SEQ ID NO: 229499 - RNA, 19 nt, Homo sapiens
cugaagaaauuaacaagug

SEQ ID NO: 229500 - RNA, 19 nt, Homo sapiens
gaacacaacgaaaaucuaa

SEQ ID NO: 229501 - RNA, 19 nt, Homo sapiens
gaagaaauuaguugugcuu

SEQ ID NO: 229502 - RNA, 19 nt, Homo sapiens
uggaauacaucgaagaaau

SEQ ID NO: 229503 - RNA, 19 nt, Homo sapiens
ccuauuauccuucuacuug

SEQ ID NO: 229504 - RNA, 19 nt, Homo sapiens
gcuggagaacucaucauua

SEQ ID NO: 229505 - RNA, 19 nt, Homo sapiens
gagaaacucuacauguaac

SEQ ID NO: 229506 - RNA, 19 nt, Homo sapiens
cagcagaauuaacugaaga

SEQ ID NO: 229507 - RNA, 19 nt, Homo sapiens
caagucagcacuaaaggaa

SEQ ID NO: 229508 - RNA, 19 nt, Homo sapiens
agauguuacugcucaauuu

SEQ ID NO: 229509 - RNA, 19 nt, Homo sapiens
gaccaugucaacaggaaua

SEQ ID NO: 229510 - RNA, 19 nt, Homo sapiens
ggacuaaugaacuacuaaa

SEQ ID NO: 229511 - RNA, 19 nt, Homo sapiens
aaaguuaagucuucggaau

SEQ ID NO: 229512 - RNA, 19 nt, Homo sapiens
ucaagaaucauggaaguaa

SEQ ID NO: 229513 - RNA, 19 nt, Homo sapiens
uaaggaugcuucuagaucu

SEQ ID NO: 229514 - RNA, 19 nt, Homo sapiens
gaggaaaugguuaaagaga

SEQ ID NO: 229515 - RNA, 19 nt, Homo sapiens
gaaagagaagaaugaugaa

SEQ ID NO: 229516 - RNA, 19 nt, Homo sapiens
ccaaaggagucucgaagag

SEQ ID NO: 229517 - RNA, 19 nt, Homo sapiens
gcaugucuacucagcauuu

SEQ ID NO: 229518 - RNA, 19 nt, Homo sapiens
guaacuauuucuucagagu

SEQ ID NO: 229519 - RNA, 19 nt, Homo sapiens
gguccuaccuauuauccuu

SEQ ID NO: 229520 - RNA, 19 nt, Homo sapiens
guugugaaguugaaagaug

SEQ ID NO: 229521 - RNA, 19 nt, Homo sapiens
caacauguccuuuccuaag

SEQ ID NO: 229522 - RNA, 19 nt, Homo sapiens
caagaaggcauggagauga

SEQ ID NO: 229523 - RNA, 19 nt, Homo sapiens
uaacugauuugcagaacca

SEQ ID NO: 229524 - RNA, 19 nt, Homo sapiens
aaauaaugcuacacuggaa

SEQ ID NO: 229525 - RNA, 19 nt, Homo sapiens
caacagcagaauuaacuga

SEQ ID NO: 229526 - RNA, 19 nt, Homo sapiens
ggaaaaguaugacaguaug

SEQ ID NO: 229527 - RNA, 19 nt, Homo sapiens
uaugauggcuaagcaagaa

SEQ ID NO: 229528 - RNA, 19 nt, Homo sapiens
guaaggaugcuucuagauc

SEQ ID NO: 229529 - RNA, 19 nt, Homo sapiens
caaugacccuucugguugu

SEQ ID NO: 229530 - RNA, 19 nt, Homo sapiens
gugcaaagccuugaagaug

SEQ ID NO: 229531 - RNA, 19 nt, Homo sapiens
gucaacauguccuuuccua

SEQ ID NO: 229532 - RNA, 19 nt, Homo sapiens
ggaggaagacuuuagaaaa

SEQ ID NO: 229533 - RNA, 19 nt, Homo sapiens
gaauuaucuucgagucuuc

SEQ ID NO: 229534 - RNA, 19 nt, Homo sapiens
gaaacucuacauguaacua

SEQ ID NO: 229535 - RNA, 19 nt, Homo sapiens
guaaacaucugagaaaccu

SEQ ID NO: 229536 - RNA, 19 nt, Homo sapiens
agaauuaucuucgagucuu

SEQ ID NO: 229537 - RNA, 19 nt, Homo sapiens
ggagcuggccgucaacaug

SEQ ID NO: 229538 - RNA, 19 nt, Homo sapiens
ucaaaucggaaguaucaaa

SEQ ID NO: 229539 - RNA, 19 nt, Homo sapiens
cugaaaggcuggucaagca

SEQ ID NO: 229540 - RNA, 19 nt, Homo sapiens
ugaaaugucagcugcuuga

SEQ ID NO: 229541 - RNA, 19 nt, Homo sapiens
aagaaggcauggagaugaa

SEQ ID NO: 229542 - RNA, 19 nt, Homo sapiens
gcaagaaggcauggagaug

SEQ ID NO: 229543 - RNA, 19 nt, Homo sapiens
cacuugguccuaccuauua

SEQ ID NO: 229544 - RNA, 19 nt, Homo sapiens
acaaauugauucacuucug

SEQ ID NO: 229545 - RNA, 19 nt, Homo sapiens
uauggagugucaagaauca

SEQ ID NO: 229546 - RNA, 19 nt, Homo sapiens
ccaggugcuuaugauguua

SEQ ID NO: 229547 - RNA, 19 nt, Homo sapiens
gaaaggcuggucaagcaau

SEQ ID NO: 229548 - RNA, 19 nt, Homo sapiens
uaaagcaaacacuggauga

SEQ ID NO: 229549 - RNA, 19 nt, Homo sapiens
gcaacaaagugcaagauuc

SEQ ID NO: 229550 - RNA, 19 nt, Homo sapiens
gauguugugucuuguguuu

SEQ ID NO: 229551 - RNA, 19 nt, Homo sapiens
acacggccaugaccacuuu

SEQ ID NO: 229552 - RNA, 19 nt, Homo sapiens
ggcagagggugauagaaga

SEQ ID NO: 229553 - RNA, 19 nt, Homo sapiens
acacaaaccugaaaagaug

SEQ ID NO: 229554 - RNA, 19 nt, Homo sapiens
gcaauggccuaaacuucag

SEQ ID NO: 229555 - RNA, 19 nt, Homo sapiens
caacaaagugcaagauucu

SEQ ID NO: 229556 - RNA, 19 nt, Homo sapiens
ggcaauggccuaaacuuca

SEQ ID NO: 229557 - RNA, 19 nt, Homo sapiens
ugaaggaggccaccaagga

SEQ ID NO: 229558 - RNA, 19 nt, Homo sapiens
gaaggagccuauggcaucu

SEQ ID NO: 229559 - RNA, 19 nt, Homo sapiens
cgugggcacugaaggcuuu

SEQ ID NO: 229560 - RNA, 19 nt, Homo sapiens
ucucuuggcuggcuuccuu

SEQ ID NO: 229561 - RNA, 19 nt, Homo sapiens
ccagggccaugaacuuugu

SEQ ID NO: 229562 - RNA, 19 nt, Homo sapiens
gcacuguggccuuggucua

SEQ ID NO: 229563 - RNA, 19 nt, Homo sapiens
agagaaugcugaguucaug

SEQ ID NO: 229564 - RNA, 19 nt, Homo sapiens
ggcagagaaugcugaguuc

SEQ ID NO: 229565 - RNA, 19 nt, Homo sapiens
gcccugaguuucaaguauc

SEQ ID NO: 229566 - RNA, 19 nt, Homo sapiens
cagcagagccuggaagaca

SEQ ID NO: 229567 - RNA, 19 nt, Homo sapiens
caaaagcccugaguuucaa

SEQ ID NO: 229568 - RNA, 19 nt, Homo sapiens
ggugauggccucccuguac

SEQ ID NO: 229569 - RNA, 19 nt, Homo sapiens
gauagaagaggccaagacu

SEQ ID NO: 229570 - RNA, 19 nt, Homo sapiens
gagaaugcugaguucauga

SEQ ID NO: 229571 - RNA, 19 nt, Homo sapiens
gcacacccaggcagagaau

SEQ ID NO: 229572 - RNA, 19 nt, Homo sapiens
gcucaacauccagcucuuu

SEQ ID NO: 229573 - RNA, 19 nt, Homo sapiens
caaggagagcccagucuuc

SEQ ID NO: 229574 - RNA, 19 nt, Homo sapiens
uaauguggcagcugucuca

SEQ ID NO: 229575 - RNA, 19 nt, Homo sapiens
agauugagcgcaacaagga

SEQ ID NO: 229576 - RNA, 19 nt, Homo sapiens
augcugaguucaugaggaa

SEQ ID NO: 229577 - RNA, 19 nt, Homo sapiens
caacauccagcucuuugag

SEQ ID NO: 229578 - RNA, 19 nt, Homo sapiens
ggagauugagcgcaacaag

SEQ ID NO: 229579 - RNA, 19 nt, Homo sapiens
cuucuccgauggguccuua

SEQ ID NO: 229580 - RNA, 19 nt, Homo sapiens
agacugcguuccugcucaa

SEQ ID NO: 229581 - RNA, 19 nt, Homo sapiens
cgauggguccuuacacuca

SEQ ID NO: 229582 - RNA, 19 nt, Homo sapiens
cuaccugggugaccugucu

SEQ ID NO: 229583 - RNA, 19 nt, Homo sapiens
gccaugcagcgcuauguga

SEQ ID NO: 229584 - RNA, 19 nt, Homo sapiens
aggagcugcugacccauga

SEQ ID NO: 229585 - RNA, 19 nt, Homo sapiens
aggcagagaaugcugaguu

SEQ ID NO: 229586 - RNA, 19 nt, Homo sapiens
ccaaaagcccugaguuuca

SEQ ID NO: 229587 - RNA, 19 nt, Homo sapiens
uguggcagcugucucaaac

SEQ ID NO: 229588 - RNA, 19 nt, Homo sapiens
uggaagacacccuaaugug

SEQ ID NO: 229589 - RNA, 19 nt, Homo sapiens
ccuggaagacacccuaaug

SEQ ID NO: 229590 - RNA, 19 nt, Homo sapiens
gcagagaaugcugaguuca

SEQ ID NO: 229591 - RNA, 19 nt, Homo sapiens
cagagaaugcugaguucau

SEQ ID NO: 229592 - RNA, 19 nt, Homo sapiens
gacccgagacggcuucaag

SEQ ID NO: 229593 - RNA, 19 nt, Homo sapiens
ccaugcagcgcuaugugaa

SEQ ID NO: 229594 - RNA, 19 nt, Homo sapiens
aaaggaggaaggagccuau

SEQ ID NO: 229595 - RNA, 19 nt, Homo sapiens
caguugcuguagggcuuua

SEQ ID NO: 229596 - RNA, 19 nt, Homo sapiens
gguccuuacacucagcuuu

SEQ ID NO: 229597 - RNA, 19 nt, Homo sapiens
gcagagggugauagaagag

SEQ ID NO: 229598 - RNA, 19 nt, Homo sapiens
uuuguuguguucuguuguu

SEQ ID NO: 229599 - RNA, 19 nt, Homo sapiens
caugaggaacuuucagaag

SEQ ID NO: 229600 - RNA, 19 nt, Homo sapiens
ucaggcagagggugauaga

SEQ ID NO: 229601 - RNA, 19 nt, Homo sapiens
ccaaggacauggaguauuu

SEQ ID NO: 229602 - RNA, 19 nt, Homo sapiens
ggacauggaguauuucuuu

SEQ ID NO: 229603 - RNA, 19 nt, Homo sapiens
uaagaaaggcaaccaauaa

SEQ ID NO: 229604 - RNA, 19 nt, Homo sapiens
ggaggugaguggccuguaa

SEQ ID NO: 229605 - RNA, 19 nt, Homo sapiens
caacaaggcuuuugaguau

SEQ ID NO: 229606 - RNA, 19 nt, Homo sapiens
ggaaaggagacaugcguaa

SEQ ID NO: 229607 - RNA, 19 nt, Homo sapiens
gaaaggagacaugcguaaa

SEQ ID NO: 229608 - RNA, 19 nt, Homo sapiens
guacaugggugacuaucuc

SEQ ID NO: 229609 - RNA, 19 nt, Homo sapiens
gaguauaacaugcagauau

SEQ ID NO: 229610 - RNA, 19 nt, Homo sapiens
ggaaggaggcgcugaccaa

SEQ ID NO: 229611 - RNA, 19 nt, Homo sapiens
gcacuuuacuucacauacu

SEQ ID NO: 229612 - RNA, 19 nt, Homo sapiens
gaggauggguucccuguac

SEQ ID NO: 229613 - RNA, 19 nt, Homo sapiens
ggacccaguucuaccuguu

SEQ ID NO: 229614 - RNA, 19 nt, Homo sapiens
gaaggaagggaccaaggaa

SEQ ID NO: 229615 - RNA, 19 nt, Homo sapiens
ggaugcugcuguacaacuu

SEQ ID NO: 229616 - RNA, 19 nt, Homo sapiens
gcuggaugcugcuguacaa

SEQ ID NO: 229617 - RNA, 19 nt, Homo sapiens
gcuagagccucgucugaca

SEQ ID NO: 229618 - RNA, 19 nt, Homo sapiens
ggacaaugcccagcaguuc

SEQ ID NO: 229619 - RNA, 19 nt, Homo sapiens
gggaagggacccaguucua

SEQ ID NO: 229620 - RNA, 19 nt, Homo sapiens
ccaaggcugcccagaagua

SEQ ID NO: 229621 - RNA, 19 nt, Homo sapiens
ggaaauggagcgcaacaag

SEQ ID NO: 229622 - RNA, 19 nt, Homo sapiens
uuaagaaaggcaaccaaua

SEQ ID NO: 229623 - RNA, 19 nt, Homo sapiens
acaugcagauauucaauga

SEQ ID NO: 229624 - RNA, 19 nt, Homo sapiens
gagcggauccacuacauag

SEQ ID NO: 229625 - RNA, 19 nt, Homo sapiens
gacauggaguauuucuuug

SEQ ID NO: 229626 - RNA, 19 nt, Homo sapiens
gcuccacacuggccagaga

SEQ ID NO: 229627 - RNA, 19 nt, Homo sapiens
gaaaggcaacauuaagaag

SEQ ID NO: 229628 - RNA, 19 nt, Homo sapiens
ugaaaggcaacauuaagaa

SEQ ID NO: 229629 - RNA, 19 nt, Homo sapiens
gcacacgaccgggcagaaa

SEQ ID NO: 229630 - RNA, 19 nt, Homo sapiens
uuucuacgcugcugaacaa

SEQ ID NO: 229631 - RNA, 19 nt, Homo sapiens
gaacaugaagaccaaagag

SEQ ID NO: 229632 - RNA, 19 nt, Homo sapiens
ugaccaaggacauggagua

SEQ ID NO: 229633 - RNA, 19 nt, Homo sapiens
ggagcgagacgagcaagaa

SEQ ID NO: 229634 - RNA, 19 nt, Homo sapiens
ggagcggauccacuacaua

SEQ ID NO: 229635 - RNA, 19 nt, Homo sapiens
gaaaaggagaaccaaauga

SEQ ID NO: 229636 - RNA, 19 nt, Homo sapiens
aagaaaggcaaccaauaaa

SEQ ID NO: 229637 - RNA, 19 nt, Homo sapiens
guacccuccucccgacuga

SEQ ID NO: 229638 - RNA, 19 nt, Homo sapiens
aaggagacaugcguaaaug

SEQ ID NO: 229639 - RNA, 19 nt, Homo sapiens
ugaacgcccuggaccugaa

SEQ ID NO: 229640 - RNA, 19 nt, Homo sapiens
gacagcauccucucuaugg

SEQ ID NO: 229641 - RNA, 19 nt, Homo sapiens
ccuagcugcuggacucuug

SEQ ID NO: 229642 - RNA, 19 nt, Homo sapiens
gcccuggaccugaacauga

SEQ ID NO: 229643 - RNA, 19 nt, Homo sapiens
aggaggcgcugaccaagga

SEQ ID NO: 229644 - RNA, 19 nt, Homo sapiens
aaauggagcgcaacaagga

SEQ ID NO: 229645 - RNA, 19 nt, Homo sapiens
cuccagcacucaauaaagu

SEQ ID NO: 229646 - RNA, 19 nt, Homo sapiens
gaaccacacccagcagcaa

SEQ ID NO: 229647 - RNA, 19 nt, Homo sapiens
gccaggugcugaagaaggu

SEQ ID NO: 229648 - RNA, 19 nt, Homo sapiens
ucacccagaaucccucuaa

SEQ ID NO: 229649 - RNA, 19 nt, Homo sapiens
aaaggagacaugcguaaau

SEQ ID NO: 229650 - RNA, 19 nt, Homo sapiens
acacccaguuugucaagga

SEQ ID NO: 229651 - RNA, 19 nt, Homo sapiens
gcagaacgagccggagcua

SEQ ID NO: 229652 - RNA, 19 nt, Homo sapiens
acaaggcuuuugaguauaa

SEQ ID NO: 229653 - RNA, 19 nt, Homo sapiens
ggaagggacccaguucuac

SEQ ID NO: 229654 - RNA, 19 nt, Homo sapiens
gaacgagccggagcuacug

SEQ ID NO: 229655 - RNA, 19 nt, Homo sapiens
ccacggcacuuuacuucac

SEQ ID NO: 229656 - RNA, 19 nt, Homo sapiens
gaaaggcaaccaauaaaag

SEQ ID NO: 229657 - RNA, 19 nt, Homo sapiens
aaggagaaccaaaugagaa

SEQ ID NO: 229658 - RNA, 19 nt, Homo sapiens
aaggcaacauuaagaagga

SEQ ID NO: 229659 - RNA, 19 nt, Homo sapiens
gagaaccaaaugagaaugg

SEQ ID NO: 229660 - RNA, 19 nt, Homo sapiens
ggaggauggguucccugua

SEQ ID NO: 229661 - RNA, 19 nt, Homo sapiens
aaaggagaaccaaaugaga

SEQ ID NO: 229662 - RNA, 19 nt, Homo sapiens
gcaguacaugggugacuau

SEQ ID NO: 229663 - RNA, 19 nt, Homo sapiens
ugaaggaagggaccaagga

SEQ ID NO: 229664 - RNA, 19 nt, Homo sapiens
ccaacaaggcuuuugagua

SEQ ID NO: 229665 - RNA, 19 nt, Homo sapiens
gacaaugcccagcaguuca

SEQ ID NO: 229666 - RNA, 19 nt, Homo sapiens
ggccugguacuacauguga

SEQ ID NO: 229667 - RNA, 19 nt, Homo sapiens
cccuggaccugaacaugaa

SEQ ID NO: 229668 - RNA, 19 nt, Homo sapiens
gaccaaggacauggaguau

SEQ ID NO: 229669 - RNA, 19 nt, Homo sapiens
gugacuaucuccccuguug

SEQ ID NO: 229670 - RNA, 19 nt, Homo sapiens
cauggaguauuucuuuggu

SEQ ID NO: 229671 - RNA, 19 nt, Homo sapiens
gacccaguucuaccuguuu

SEQ ID NO: 229672 - RNA, 19 nt, Homo sapiens
uugaaaggcaacauuaaga

SEQ ID NO: 229673 - RNA, 19 nt, Homo sapiens
acuccaggcuuccacacuu

SEQ ID NO: 229674 - RNA, 19 nt, Homo sapiens
ggaagcccagccuccaguu

SEQ ID NO: 229675 - RNA, 19 nt, Homo sapiens
cuauggcugugcugaggaa

SEQ ID NO: 229676 - RNA, 19 nt, Homo sapiens
ggaagggaccaaggaagca

SEQ ID NO: 229677 - RNA, 19 nt, Homo sapiens
gcguaaaugcccuuucuac

SEQ ID NO: 229678 - RNA, 19 nt, Homo sapiens
gaagcccagccuccaguuc

SEQ ID NO: 229679 - RNA, 19 nt, Homo sapiens
cuacgcugcugaacaagac

SEQ ID NO: 229680 - RNA, 19 nt, Homo sapiens
uugagaauguggacaaugc

SEQ ID NO: 229681 - RNA, 19 nt, Homo sapiens
caccacggcacuuuacuuc

SEQ ID NO: 229682 - RNA, 19 nt, Homo sapiens
gaggaaauggagcgcaaca

SEQ ID NO: 229683 - RNA, 19 nt, Homo sapiens
ggaguauuucuuuggugaa

SEQ ID NO: 229684 - RNA, 19 nt, Homo sapiens
ugacagcauccucucuaug

SEQ ID NO: 229685 - RNA, 19 nt, Homo sapiens
ggagaaccaaaugagaaug

SEQ ID NO: 229686 - RNA, 19 nt, Homo sapiens
ccaccacggcacuuuacuu

SEQ ID NO: 229687 - RNA, 19 nt, Homo sapiens
ugcaguacaugggugacua

SEQ ID NO: 229688 - RNA, 19 nt, Homo sapiens
auuaagaaggagcuguuua

SEQ ID NO: 229689 - RNA, 19 nt, Homo sapiens
acacccagcagcaauguca

SEQ ID NO: 229690 - RNA, 19 nt, Homo sapiens
uggguucccuguacacgau

SEQ ID NO: 229691 - RNA, 19 nt, Homo sapiens
ugaacaugaagaccaaaga

SEQ ID NO: 229692 - RNA, 19 nt, Homo sapiens
gcuccagcacucaauaaag

SEQ ID NO: 229693 - RNA, 19 nt, Homo sapiens
ucaucccucucacccagaa

SEQ ID NO: 229694 - RNA, 19 nt, Homo sapiens
caacuucugggccucucuu

SEQ ID NO: 229695 - RNA, 19 nt, Homo sapiens
cugacagcauccucucuau

SEQ ID NO: 229696 - RNA, 19 nt, Homo sapiens
ucugacagcauccucucua

SEQ ID NO: 229697 - RNA, 19 nt, Homo sapiens
aaugcuggguuuaagaaag

SEQ ID NO: 229698 - RNA, 19 nt, Homo sapiens
cuccagcccugacuaaacu

SEQ ID NO: 229699 - RNA, 19 nt, Homo sapiens
uaagaaggagcuguuuaag

SEQ ID NO: 229700 - RNA, 19 nt, Homo sapiens
gaaggaaguuguccgaaca

SEQ ID NO: 229701 - RNA, 19 nt, Homo sapiens
cuagauagaugcccuguau

SEQ ID NO: 229702 - RNA, 19 nt, Homo sapiens
guaaauacaggaagaaaga

SEQ ID NO: 229703 - RNA, 19 nt, Homo sapiens
ggcuugagcugcagaauga

SEQ ID NO: 229704 - RNA, 19 nt, Homo sapiens
gcacaugcgcacucucaua

SEQ ID NO: 229705 - RNA, 19 nt, Homo sapiens
gaagaucccuggcuuugcu

SEQ ID NO: 229706 - RNA, 19 nt, Homo sapiens
gaagaagacaaaugacaga

SEQ ID NO: 229707 - RNA, 19 nt, Homo sapiens
gcccagugcugcuguaaau

SEQ ID NO: 229708 - RNA, 19 nt, Homo sapiens
uacauaaacugucacucua

SEQ ID NO: 229709 - RNA, 19 nt, Homo sapiens
gaaggccgcugugcugugu

SEQ ID NO: 229710 - RNA, 19 nt, Homo sapiens
aaauagacauguaguugga

SEQ ID NO: 229711 - RNA, 19 nt, Homo sapiens
caaggucccugcacagcuu

SEQ ID NO: 229712 - RNA, 19 nt, Homo sapiens
gagaagaucccuggcuuug

SEQ ID NO: 229713 - RNA, 19 nt, Homo sapiens
guacauaaacugucacucu

SEQ ID NO: 229714 - RNA, 19 nt, Homo sapiens
gcaagugggcggagaagau

SEQ ID NO: 229715 - RNA, 19 nt, Homo sapiens
cgaaaccgcugccaguucu

SEQ ID NO: 229716 - RNA, 19 nt, Homo sapiens
ggacugcccuguggacaag

SEQ ID NO: 229717 - RNA, 19 nt, Homo sapiens
caggagaguuugacaccuu

SEQ ID NO: 229718 - RNA, 19 nt, Homo sapiens
cuaggaagaagacaaauga

SEQ ID NO: 229719 - RNA, 19 nt, Homo sapiens
gcucaggccuggugcuaca

SEQ ID NO: 229720 - RNA, 19 nt, Homo sapiens
ggagaagaucccuggcuuu

SEQ ID NO: 229721 - RNA, 19 nt, Homo sapiens
gcccagcacugccaaacug

SEQ ID NO: 229722 - RNA, 19 nt, Homo sapiens
ggagugcacagaagaacuu

SEQ ID NO: 229723 - RNA, 19 nt, Homo sapiens
gaaugacuccaccuucuca

SEQ ID NO: 229724 - RNA, 19 nt, Homo sapiens
ggaagaugcuggggaugua

SEQ ID NO: 229725 - RNA, 19 nt, Homo sapiens
caguggcucugacuacuau

SEQ ID NO: 229726 - RNA, 19 nt, Homo sapiens
gggaacacgugugcacaug

SEQ ID NO: 229727 - RNA, 19 nt, Homo sapiens
ggugcaagccacauuguug

SEQ ID NO: 229728 - RNA, 19 nt, Homo sapiens
cagagcagcugcccaaagc

SEQ ID NO: 229729 - RNA, 19 nt, Homo sapiens
ccacauguacauaaacugu

SEQ ID NO: 229730 - RNA, 19 nt, Homo sapiens
uaaacugucacucuaggaa

SEQ ID NO: 229731 - RNA, 19 nt, Homo sapiens
gcgccgugcuguaaauaag

SEQ ID NO: 229732 - RNA, 19 nt, Homo sapiens
cuacggccuucccagguuu

SEQ ID NO: 229733 - RNA, 19 nt, Homo sapiens
ccacuucuccacaccuuga

SEQ ID NO: 229734 - RNA, 19 nt, Homo sapiens
cugccaaucuccucacuuc

SEQ ID NO: 229735 - RNA, 19 nt, Homo sapiens
gcacugccaaacuggacua

SEQ ID NO: 229736 - RNA, 19 nt, Homo sapiens
acauguacauaaacuguca

SEQ ID NO: 229737 - RNA, 19 nt, Homo sapiens
gcgaaaccgcugccaguuc

SEQ ID NO: 229738 - RNA, 19 nt, Homo sapiens
ucgaggacuuccaggugua

SEQ ID NO: 229739 - RNA, 19 nt, Homo sapiens
auagacauguaguuggaaa

SEQ ID NO: 229740 - RNA, 19 nt, Homo sapiens
ggacacgcugcccuucuga

SEQ ID NO: 229741 - RNA, 19 nt, Homo sapiens
acauagcgccgugcuguaa

SEQ ID NO: 229742 - RNA, 19 nt, Homo sapiens
cacaugcgcacucucauau

SEQ ID NO: 229743 - RNA, 19 nt, Homo sapiens
cggcuacacaggagaguuu

SEQ ID NO: 229744 - RNA, 19 nt, Homo sapiens
agaagacaaaugacagauu

SEQ ID NO: 229745 - RNA, 19 nt, Homo sapiens
uaagcccagugcugcugua

SEQ ID NO: 229746 - RNA, 19 nt, Homo sapiens
acagcuugcuugucgaugu

SEQ ID NO: 229747 - RNA, 19 nt, Homo sapiens
gcacagcuugcuugucgau

SEQ ID NO: 229748 - RNA, 19 nt, Homo sapiens
ccuacggccuucccagguu

SEQ ID NO: 229749 - RNA, 19 nt, Homo sapiens
uugacaagaucuucaugga

SEQ ID NO: 229750 - RNA, 19 nt, Homo sapiens
gggcuugagcugcagaaug

SEQ ID NO: 229751 - RNA, 19 nt, Homo sapiens
gggauguacagcaguucua

SEQ ID NO: 229752 - RNA, 19 nt, Homo sapiens
ccaguggcucugacuacua

SEQ ID NO: 229753 - RNA, 19 nt, Homo sapiens
ggauuuauaguaugugacu

SEQ ID NO: 229754 - RNA, 19 nt, Homo sapiens
caugcgcacucucauaugc

SEQ ID NO: 229755 - RNA, 19 nt, Homo sapiens
acaucugccuggcuaacaa

SEQ ID NO: 229756 - RNA, 19 nt, Homo sapiens
ccagugcugcuguaaauac

SEQ ID NO: 229757 - RNA, 19 nt, Homo sapiens
gcacaugugagggcugcaa

SEQ ID NO: 229758 - RNA, 19 nt, Homo sapiens
gaacaggugcaagccacau

SEQ ID NO: 229759 - RNA, 19 nt, Homo sapiens
ggcggaggcuacgaaacuu

SEQ ID NO: 229760 - RNA, 19 nt, Homo sapiens
ucaucaagcccaccaugga

SEQ ID NO: 229761 - RNA, 19 nt, Homo sapiens
cuggauuuauaguauguga

SEQ ID NO: 229762 - RNA, 19 nt, Homo sapiens
ccuuccacauguacauaaa

SEQ ID NO: 229763 - RNA, 19 nt, Homo sapiens
caagugggcggagaagauc

SEQ ID NO: 229764 - RNA, 19 nt, Homo sapiens
uggcuuugcugagcuguca

SEQ ID NO: 229765 - RNA, 19 nt, Homo sapiens
cugccaaacuggacuacuc

SEQ ID NO: 229766 - RNA, 19 nt, Homo sapiens
auagaugcccuguauccaa

SEQ ID NO: 229767 - RNA, 19 nt, Homo sapiens
aacugucacucuaggaaga

SEQ ID NO: 229768 - RNA, 19 nt, Homo sapiens
uacccuccuuccacaugua

SEQ ID NO: 229769 - RNA, 19 nt, Homo sapiens
acaggaagaaagagcuuga

SEQ ID NO: 229770 - RNA, 19 nt, Homo sapiens
gcgcaucuucuaccucaag

SEQ ID NO: 229771 - RNA, 19 nt, Homo sapiens
cagcuugcuugucgauguc

SEQ ID NO: 229772 - RNA, 19 nt, Homo sapiens
ugaggcuuguucagcagaa

SEQ ID NO: 229773 - RNA, 19 nt, Homo sapiens
agggcaagcucaucuucug

SEQ ID NO: 229774 - RNA, 19 nt, Homo sapiens
gaaggaaguuguccgaaca

SEQ ID NO: 229775 - RNA, 19 nt, Homo sapiens
guaaauacaggaagaaaga

SEQ ID NO: 229776 - RNA, 19 nt, Homo sapiens
ggcuugagcugcagaauga

SEQ ID NO: 229777 - RNA, 19 nt, Homo sapiens
gcacaugcgcacucucaua

SEQ ID NO: 229778 - RNA, 19 nt, Homo sapiens
gaagaucccuggcuuugcu

SEQ ID NO: 229779 - RNA, 19 nt, Homo sapiens
gaagaagacaaaugacaga

SEQ ID NO: 229780 - RNA, 19 nt, Homo sapiens
gcccagugcugcuguaaau

SEQ ID NO: 229781 - RNA, 19 nt, Homo sapiens
uacauaaacugucacucua

SEQ ID NO: 229782 - RNA, 19 nt, Homo sapiens
ggccggagaugcccuguau

SEQ ID NO: 229783 - RNA, 19 nt, Homo sapiens
gaaggccgcugugcugugu

SEQ ID NO: 229784 - RNA, 19 nt, Homo sapiens
aaauagacauguaguugga

SEQ ID NO: 229785 - RNA, 19 nt, Homo sapiens
caaggucccugcacagcuu

SEQ ID NO: 229786 - RNA, 19 nt, Homo sapiens
gagaagaucccuggcuuug

SEQ ID NO: 229787 - RNA, 19 nt, Homo sapiens
ggagaugcccuguauccaa

SEQ ID NO: 229788 - RNA, 19 nt, Homo sapiens
guacauaaacugucacucu

SEQ ID NO: 229789 - RNA, 19 nt, Homo sapiens
gcaagugggcggagaagau

SEQ ID NO: 229790 - RNA, 19 nt, Homo sapiens
cgaaaccgcugccaguucu

SEQ ID NO: 229791 - RNA, 19 nt, Homo sapiens
ggacugcccuguggacaag

SEQ ID NO: 229792 - RNA, 19 nt, Homo sapiens
caggagaguuugacaccuu

SEQ ID NO: 229793 - RNA, 19 nt, Homo sapiens
cuaggaagaagacaaauga

SEQ ID NO: 229794 - RNA, 19 nt, Homo sapiens
gcucaggccuggugcuaca

SEQ ID NO: 229795 - RNA, 19 nt, Homo sapiens
ggagaagaucccuggcuuu

SEQ ID NO: 229796 - RNA, 19 nt, Homo sapiens
gcccagcacugccaaacug

SEQ ID NO: 229797 - RNA, 19 nt, Homo sapiens
ggagugcacagaagaacuu

SEQ ID NO: 229798 - RNA, 19 nt, Homo sapiens
gaaugacuccaccuucuca

SEQ ID NO: 229799 - RNA, 19 nt, Homo sapiens
ggaagaugcuggggaugua

SEQ ID NO: 229800 - RNA, 19 nt, Homo sapiens
caguggcucugacuacuau

SEQ ID NO: 229801 - RNA, 19 nt, Homo sapiens
gggaacacgugugcacaug

SEQ ID NO: 229802 - RNA, 19 nt, Homo sapiens
cagagcagcugcccaaagc

SEQ ID NO: 229803 - RNA, 19 nt, Homo sapiens
ccacauguacauaaacugu

SEQ ID NO: 229804 - RNA, 19 nt, Homo sapiens
uaaacugucacucuaggaa

SEQ ID NO: 229805 - RNA, 19 nt, Homo sapiens
gcgccgugcuguaaauaag

SEQ ID NO: 229806 - RNA, 19 nt, Homo sapiens
cuacggccuucccagguuu

SEQ ID NO: 229807 - RNA, 19 nt, Homo sapiens
ccacuucuccacaccuuga

SEQ ID NO: 229808 - RNA, 19 nt, Homo sapiens
cugccaaucuccucacuuc

SEQ ID NO: 229809 - RNA, 19 nt, Homo sapiens
gcacugccaaacuggacua

SEQ ID NO: 229810 - RNA, 19 nt, Homo sapiens
acauguacauaaacuguca

SEQ ID NO: 229811 - RNA, 19 nt, Homo sapiens
gcgaaaccgcugccaguuc

SEQ ID NO: 229812 - RNA, 19 nt, Homo sapiens
ucgaggacuuccaggugua

SEQ ID NO: 229813 - RNA, 19 nt, Homo sapiens
auagacauguaguuggaaa

SEQ ID NO: 229814 - RNA, 19 nt, Homo sapiens
ggacacgcugcccuucuga

SEQ ID NO: 229815 - RNA, 19 nt, Homo sapiens
acauagcgccgugcuguaa

SEQ ID NO: 229816 - RNA, 19 nt, Homo sapiens
cacaugcgcacucucauau

SEQ ID NO: 229817 - RNA, 19 nt, Homo sapiens
cggcuacacaggagaguuu

SEQ ID NO: 229818 - RNA, 19 nt, Homo sapiens
agaagacaaaugacagauu

SEQ ID NO: 229819 - RNA, 19 nt, Homo sapiens
uaagcccagugcugcugua

SEQ ID NO: 229820 - RNA, 19 nt, Homo sapiens
acagcuugcuugucgaugu

SEQ ID NO: 229821 - RNA, 19 nt, Homo sapiens
gcacagcuugcuugucgau

SEQ ID NO: 229822 - RNA, 19 nt, Homo sapiens
ccuacggccuucccagguu

SEQ ID NO: 229823 - RNA, 19 nt, Homo sapiens
uugacaagaucuucaugga

SEQ ID NO: 229824 - RNA, 19 nt, Homo sapiens
gggcuugagcugcagaaug

SEQ ID NO: 229825 - RNA, 19 nt, Homo sapiens
gggauguacagcaguucua

SEQ ID NO: 229826 - RNA, 19 nt, Homo sapiens
ccaguggcucugacuacua

SEQ ID NO: 229827 - RNA, 19 nt, Homo sapiens
ggauuuauaguaugugacu

SEQ ID NO: 229828 - RNA, 19 nt, Homo sapiens
caugcgcacucucauaugc

SEQ ID NO: 229829 - RNA, 19 nt, Homo sapiens
acaucugccuggcuaacaa

SEQ ID NO: 229830 - RNA, 19 nt, Homo sapiens
ccagugcugcuguaaauac

SEQ ID NO: 229831 - RNA, 19 nt, Homo sapiens
gcacaugugagggcugcaa

SEQ ID NO: 229832 - RNA, 19 nt, Homo sapiens
ggcggaggcuacgaaacuu

SEQ ID NO: 229833 - RNA, 19 nt, Homo sapiens
ucaucaagcccaccaugga

SEQ ID NO: 229834 - RNA, 19 nt, Homo sapiens
cuggauuuauaguauguga

SEQ ID NO: 229835 - RNA, 19 nt, Homo sapiens
ccuuccacauguacauaaa

SEQ ID NO: 229836 - RNA, 19 nt, Homo sapiens
caagugggcggagaagauc

SEQ ID NO: 229837 - RNA, 19 nt, Homo sapiens
uggcuuugcugagcuguca

SEQ ID NO: 229838 - RNA, 19 nt, Homo sapiens
cugccaaacuggacuacuc

SEQ ID NO: 229839 - RNA, 19 nt, Homo sapiens
aacugucacucuaggaaga

SEQ ID NO: 229840 - RNA, 19 nt, Homo sapiens
uacccuccuuccacaugua

SEQ ID NO: 229841 - RNA, 19 nt, Homo sapiens
acaggaagaaagagcuuga

SEQ ID NO: 229842 - RNA, 19 nt, Homo sapiens
gcgcaucuucuaccucaag

SEQ ID NO: 229843 - RNA, 19 nt, Homo sapiens
cagcuugcuugucgauguc

SEQ ID NO: 229844 - RNA, 19 nt, Homo sapiens
agggcaagcucaucuucug

SEQ ID NO: 229845 - RNA, 19 nt, Homo sapiens
gcuggaagcuuucauuugc

SEQ ID NO: 229846 - RNA, 19 nt, Homo sapiens
cagcgauggugccugcuua

SEQ ID NO: 229847 - RNA, 19 nt, Homo sapiens
gaaggccgcugugcugugu

SEQ ID NO: 229848 - RNA, 19 nt, Homo sapiens
aagcugagaugcccuguau

SEQ ID NO: 229849 - RNA, 19 nt, Homo sapiens
gauggugccugcuuagcuu

SEQ ID NO: 229850 - RNA, 19 nt, Homo sapiens
ggagaaggcagguggacaa

SEQ ID NO: 229851 - RNA, 19 nt, Homo sapiens
gcaagggcuucuucaaggu

SEQ ID NO: 229852 - RNA, 19 nt, Homo sapiens
caggagaguuugacaccuu

SEQ ID NO: 229853 - RNA, 19 nt, Homo sapiens
gaacagagagcgcuuuugu

SEQ ID NO: 229854 - RNA, 19 nt, Homo sapiens
ggacaagggcccaugaaaa

SEQ ID NO: 229855 - RNA, 19 nt, Homo sapiens
gcgguugucugggaccuuu

SEQ ID NO: 229856 - RNA, 19 nt, Homo sapiens
caguggcucugacuacuau

SEQ ID NO: 229857 - RNA, 19 nt, Homo sapiens
gcggaggguuugguucuug

SEQ ID NO: 229858 - RNA, 19 nt, Homo sapiens
cagagcagcugcccaaagc

SEQ ID NO: 229859 - RNA, 19 nt, Homo sapiens
gggcuggaagcuuucauuu

SEQ ID NO: 229860 - RNA, 19 nt, Homo sapiens
caagggcuucuucaaggua

SEQ ID NO: 229861 - RNA, 19 nt, Homo sapiens
aaauacaggugucuagacu

SEQ ID NO: 229862 - RNA, 19 nt, Homo sapiens
cuacggccuucccagguuu

SEQ ID NO: 229863 - RNA, 19 nt, Homo sapiens
ccacuucuccacaccuuga

SEQ ID NO: 229864 - RNA, 19 nt, Homo sapiens
ugagaugcccuguauccaa

SEQ ID NO: 229865 - RNA, 19 nt, Homo sapiens
gaagcugagaugcccugua

SEQ ID NO: 229866 - RNA, 19 nt, Homo sapiens
ucgaggacuuccaggugua

SEQ ID NO: 229867 - RNA, 19 nt, Homo sapiens
cggcuacacaggagaguuu

SEQ ID NO: 229868 - RNA, 19 nt, Homo sapiens
ccuacggccuucccagguu

SEQ ID NO: 229869 - RNA, 19 nt, Homo sapiens
ccacccaaauguuagaaaa

SEQ ID NO: 229870 - RNA, 19 nt, Homo sapiens
ggguucuccuccuagcuaa

SEQ ID NO: 229871 - RNA, 19 nt, Homo sapiens
ucauguuccuggcgugaga

SEQ ID NO: 229872 - RNA, 19 nt, Homo sapiens
cggaggguuugguucuuga

SEQ ID NO: 229873 - RNA, 19 nt, Homo sapiens
ccaguggcucugacuacua

SEQ ID NO: 229874 - RNA, 19 nt, Homo sapiens
ccuugccacccaaauguua

SEQ ID NO: 229875 - RNA, 19 nt, Homo sapiens
gcacaugugagggcugcaa

SEQ ID NO: 229876 - RNA, 19 nt, Homo sapiens
ccuguccucucccaacuca

SEQ ID NO: 229877 - RNA, 19 nt, Homo sapiens
ucaucaagcccaccaugga

SEQ ID NO: 229878 - RNA, 19 nt, Homo sapiens
guuccuggcgugagaugaa

SEQ ID NO: 229879 - RNA, 19 nt, Homo sapiens
ggcuggaagcuuucauuug

SEQ ID NO: 229880 - RNA, 19 nt, Homo sapiens
gagcgccucuagaauguaa

SEQ ID NO: 229881 - RNA, 19 nt, Homo sapiens
gggagcgccucuagaaugu

SEQ ID NO: 229882 - RNA, 19 nt, Homo sapiens
ucaccgagacgcagguuaa

SEQ ID NO: 229883 - RNA, 19 nt, Homo sapiens
agacgcagguuaagaucug

SEQ ID NO: 229884 - RNA, 19 nt, Homo sapiens
cuacuuauuugcguaugga

SEQ ID NO: 229885 - RNA, 19 nt, Homo sapiens
caacacuaaacgucccuuu

SEQ ID NO: 229886 - RNA, 19 nt, Homo sapiens
gcccagcgcaacaaaggaa

SEQ ID NO: 229887 - RNA, 19 nt, Homo sapiens
cuacgaaccggcuguccaa

SEQ ID NO: 229888 - RNA, 19 nt, Homo sapiens
ccggugcucuaccacgaaa

SEQ ID NO: 229889 - RNA, 19 nt, Homo sapiens
ccuccuuccucaucgagaa

SEQ ID NO: 229890 - RNA, 19 nt, Homo sapiens
caacaaaggaaaacuacga

SEQ ID NO: 229891 - RNA, 19 nt, Homo sapiens
ccgagacgcagguuaagau

SEQ ID NO: 229892 - RNA, 19 nt, Homo sapiens
ccaagcccagcgcaacaaa

SEQ ID NO: 229893 - RNA, 19 nt, Homo sapiens
gcaauacucuuaaccauaa

SEQ ID NO: 229894 - RNA, 19 nt, Homo sapiens
gcagaugucuuuaaaugaa

SEQ ID NO: 229895 - RNA, 19 nt, Homo sapiens
gcagauagcagaugucuuu

SEQ ID NO: 229896 - RNA, 19 nt, Homo sapiens
gaacucugcuucuugcuuu

SEQ ID NO: 229897 - RNA, 19 nt, Homo sapiens
gaauugaaauggugaagaa

SEQ ID NO: 229898 - RNA, 19 nt, Homo sapiens
gauagcagaugucuuuaaa

SEQ ID NO: 229899 - RNA, 19 nt, Homo sapiens
agacaauacugcuguuaua

SEQ ID NO: 229900 - RNA, 19 nt, Homo sapiens
aaaggaagauggucaaguu

SEQ ID NO: 229901 - RNA, 19 nt, Homo sapiens
cagacggguuucauuauua

SEQ ID NO: 229902 - RNA, 19 nt, Homo sapiens
uagcagaugucuuuaaaug

SEQ ID NO: 229903 - RNA, 19 nt, Homo sapiens
cagcugaaauugcuuuaaa

SEQ ID NO: 229904 - RNA, 19 nt, Homo sapiens
gguaauagauaggugauau

SEQ ID NO: 229905 - RNA, 19 nt, Homo sapiens
gaaagacaauacugcuguu

SEQ ID NO: 229906 - RNA, 19 nt, Homo sapiens
gccauuugcuucucaguuu

SEQ ID NO: 229907 - RNA, 19 nt, Homo sapiens
ggaagauggucaaguuugu

SEQ ID NO: 229908 - RNA, 19 nt, Homo sapiens
gaaauucuccuccuuccuu

SEQ ID NO: 229909 - RNA, 19 nt, Homo sapiens
guagacauccuccguauau

SEQ ID NO: 229910 - RNA, 19 nt, Homo sapiens
caauacugcuguuauauag

SEQ ID NO: 229911 - RNA, 19 nt, Homo sapiens
ccagacggguuucauuauu

SEQ ID NO: 229912 - RNA, 19 nt, Homo sapiens
gaggucacauaacacauaa

SEQ ID NO: 229913 - RNA, 19 nt, Homo sapiens
ccacaaguguauauaugaa

SEQ ID NO: 229914 - RNA, 19 nt, Homo sapiens
gacauccuccguauauuua

SEQ ID NO: 229915 - RNA, 19 nt, Homo sapiens
gaaguuuaaugauccacaa

SEQ ID NO: 229916 - RNA, 19 nt, Homo sapiens
ggacaugguguuaguauag

SEQ ID NO: 229917 - RNA, 19 nt, Homo sapiens
gaauugcccucaagaacuc

SEQ ID NO: 229918 - RNA, 19 nt, Homo sapiens
gcaagacauaaacagauua

SEQ ID NO: 229919 - RNA, 19 nt, Homo sapiens
ggacuuaauuaugcacaug

SEQ ID NO: 229920 - RNA, 19 nt, Homo sapiens
gaaacaaguauacacuaga

SEQ ID NO: 229921 - RNA, 19 nt, Homo sapiens
ccauuugcuucucaguuua

SEQ ID NO: 229922 - RNA, 19 nt, Homo sapiens
gaagauggucaaguuugua

SEQ ID NO: 229923 - RNA, 19 nt, Homo sapiens
guuaggaacugugaagaug

SEQ ID NO: 229924 - RNA, 19 nt, Homo sapiens
gaagaaacaaguauacacu

SEQ ID NO: 229925 - RNA, 19 nt, Homo sapiens
auagggagcuggauuucaa

SEQ ID NO: 229926 - RNA, 19 nt, Homo sapiens
ggcaauacucuuaaccaua

SEQ ID NO: 229927 - RNA, 19 nt, Homo sapiens
agacauccuccguauauuu

SEQ ID NO: 229928 - RNA, 19 nt, Homo sapiens
aaacaaguauacacuagag

SEQ ID NO: 229929 - RNA, 19 nt, Homo sapiens
gaacaggcacugcaauacu

SEQ ID NO: 229930 - RNA, 19 nt, Homo sapiens
ccucggagcagcagcauaa

SEQ ID NO: 229931 - RNA, 19 nt, Homo sapiens
ugaggucacauaacacaua

SEQ ID NO: 229932 - RNA, 19 nt, Homo sapiens
agaaacaaguauacacuag

SEQ ID NO: 229933 - RNA, 19 nt, Homo sapiens
cgagaacggcugcuacuug

SEQ ID NO: 229934 - RNA, 19 nt, Homo sapiens
guuaugcacuuuccacagu

SEQ ID NO: 229935 - RNA, 19 nt, Homo sapiens
caggguggcuccaggaugu

SEQ ID NO: 229936 - RNA, 19 nt, Homo sapiens
gaagauggaagggcaugaa

SEQ ID NO: 229937 - RNA, 19 nt, Homo sapiens
ugaacuccaugaacaccua

SEQ ID NO: 229938 - RNA, 19 nt, Homo sapiens
ucucuuugcuuucucaaug

SEQ ID NO: 229939 - RNA, 19 nt, Homo sapiens
agacggguuucauuauuau

SEQ ID NO: 229940 - RNA, 19 nt, Homo sapiens
aagaguugcuugaccgaaa

SEQ ID NO: 229941 - RNA, 19 nt, Homo sapiens
ggacuucaaggcauacgaa

SEQ ID NO: 229942 - RNA, 19 nt, Homo sapiens
ggaauugcccucaagaacu

SEQ ID NO: 229943 - RNA, 19 nt, Homo sapiens
gcugguagcaagagagaaa

SEQ ID NO: 229944 - RNA, 19 nt, Homo sapiens
gcuguuauauagcaagaca

SEQ ID NO: 229945 - RNA, 19 nt, Homo sapiens
uuaaugauccacaagugua

SEQ ID NO: 229946 - RNA, 19 nt, Homo sapiens
gcugaaauugcuuuaaaug

SEQ ID NO: 229947 - RNA, 19 nt, Homo sapiens
gauccacaaguguauauau

SEQ ID NO: 229948 - RNA, 19 nt, Homo sapiens
uguauggacuuaauuaugc

SEQ ID NO: 229949 - RNA, 19 nt, Homo sapiens
acauguauauuguguaugg

SEQ ID NO: 229950 - RNA, 19 nt, Homo sapiens
agcauaagcuggacuucaa

SEQ ID NO: 229951 - RNA, 19 nt, Homo sapiens
ucuaguuuguggaggguua

SEQ ID NO: 229952 - RNA, 19 nt, Homo sapiens
gccacucgcuguccuucaa

SEQ ID NO: 229953 - RNA, 19 nt, Homo sapiens
guuauagggagcuggauuu

SEQ ID NO: 229954 - RNA, 19 nt, Homo sapiens
gaguguauaccauuuaaag

SEQ ID NO: 229955 - RNA, 19 nt, Homo sapiens
cuaugaguguauaccauuu

SEQ ID NO: 229956 - RNA, 19 nt, Homo sapiens
guguagacauccuccguau

SEQ ID NO: 229957 - RNA, 19 nt, Homo sapiens
agcaagacauaaacagauu

SEQ ID NO: 229958 - RNA, 19 nt, Homo sapiens
cuccagacauucuaguuug

SEQ ID NO: 229959 - RNA, 19 nt, Homo sapiens
guacuaccaagguguguau

SEQ ID NO: 229960 - RNA, 19 nt, Homo sapiens
cuuguuucauccaguguua

SEQ ID NO: 229961 - RNA, 19 nt, Homo sapiens
auucugaggucacauaaca

SEQ ID NO: 229962 - RNA, 19 nt, Homo sapiens
caguuuacauuucugauac

SEQ ID NO: 229963 - RNA, 19 nt, Homo sapiens
gacaauacugcuguuauau

SEQ ID NO: 229964 - RNA, 19 nt, Homo sapiens
gaaauggugaagaaacaag

SEQ ID NO: 229965 - RNA, 19 nt, Homo sapiens
uaggaacugugaagaugga

SEQ ID NO: 229966 - RNA, 19 nt, Homo sapiens
ccaaaccgucaacagcaua

SEQ ID NO: 229967 - RNA, 19 nt, Homo sapiens
gaucauuugcaguuaagga

SEQ ID NO: 229968 - RNA, 19 nt, Homo sapiens
ggccugggcuccaugaacu

SEQ ID NO: 229969 - RNA, 19 nt, Homo sapiens
caauguuggaggagagaua

SEQ ID NO: 229970 - RNA, 19 nt, Homo sapiens
guuuguggaggguuauuua

SEQ ID NO: 229971 - RNA, 19 nt, Homo sapiens
guuuaaugauccacaagug

SEQ ID NO: 229972 - RNA, 19 nt, Homo sapiens
ggacuccggcaacauguuc

SEQ ID NO: 229973 - RNA, 19 nt, Homo sapiens
cuugaucauuugcaguuaa

SEQ ID NO: 229974 - RNA, 19 nt, Homo sapiens
uggacaugguguuaguaua

SEQ ID NO: 229975 - RNA, 19 nt, Homo sapiens
caaaccgucaacagcauaa

SEQ ID NO: 229976 - RNA, 19 nt, Homo sapiens
aaacgugguccaagauuca

SEQ ID NO: 229977 - RNA, 19 nt, Homo sapiens
ggaauauuacaauguugga

SEQ ID NO: 229978 - RNA, 19 nt, Homo sapiens
aaagacaauacugcuguua

SEQ ID NO: 229979 - RNA, 19 nt, Homo sapiens
uugaaauggugaagaaaca

SEQ ID NO: 229980 - RNA, 19 nt, Homo sapiens
auaaacaucagagccauuu

SEQ ID NO: 229981 - RNA, 19 nt, Homo sapiens
ucguacaucucgcucauca

SEQ ID NO: 229982 - RNA, 19 nt, Homo sapiens
agccagacggguuucauua

SEQ ID NO: 229983 - RNA, 19 nt, Homo sapiens
ccucaggaauugcccucaa

SEQ ID NO: 229984 - RNA, 19 nt, Homo sapiens
guguauggacuuaauuaug

SEQ ID NO: 229985 - RNA, 19 nt, Homo sapiens
gcuucucaguuuacauuuc

SEQ ID NO: 229986 - RNA, 19 nt, Homo sapiens
acgaacaggcacugcaaua

SEQ ID NO: 229987 - RNA, 19 nt, Homo sapiens
guugcuugaccgaaaguua

SEQ ID NO: 229988 - RNA, 19 nt, Homo sapiens
uagcaagacauaaacagau

SEQ ID NO: 229989 - RNA, 19 nt, Homo sapiens
aagauggucaaguuuguaa

SEQ ID NO: 229990 - RNA, 19 nt, Homo sapiens
ggaagaccggccagcuaga

SEQ ID NO: 229991 - RNA, 19 nt, Homo sapiens
ggaaaauguucuugaucau

SEQ ID NO: 229992 - RNA, 19 nt, Homo sapiens
acaguuggacaugguguua

SEQ ID NO: 229993 - RNA, 19 nt, Homo sapiens
guaagggucuguuguaaau

SEQ ID NO: 229994 - RNA, 19 nt, Homo sapiens
ccagaggguuguacuauug

SEQ ID NO: 229995 - RNA, 19 nt, Homo sapiens
gcacucggcuuccaguaug

SEQ ID NO: 229996 - RNA, 19 nt, Homo sapiens
gagaagaaauccauaacac

SEQ ID NO: 229997 - RNA, 19 nt, Homo sapiens
uguuguggcuguuaaauuu

SEQ ID NO: 229998 - RNA, 19 nt, Homo sapiens
ggugauugcuggucguuug

SEQ ID NO: 229999 - RNA, 19 nt, Homo sapiens
ggccagaguuccacaaauc

SEQ ID NO: 230000 - RNA, 19 nt, Homo sapiens
caacgacuguuuccugaag

SEQ ID NO: 230001 - RNA, 19 nt, Homo sapiens
gaacaccacuacgccuuca

SEQ ID NO: 230002 - RNA, 19 nt, Homo sapiens
ugaacggcaugaacacgua

SEQ ID NO: 230003 - RNA, 19 nt, Homo sapiens
aaacagagggccacacaga

SEQ ID NO: 230004 - RNA, 19 nt, Homo sapiens
gugcuuuauuuauggcuua

SEQ ID NO: 230005 - RNA, 19 nt, Homo sapiens
acagagggccacacagaua

SEQ ID NO: 230006 - RNA, 19 nt, Homo sapiens
ucaagcaccugcagauucu

SEQ ID NO: 230007 - RNA, 19 nt, Homo sapiens
ggagaagaaauccauaaca

SEQ ID NO: 230008 - RNA, 19 nt, Homo sapiens
uaugaacuccucuuaagaa

SEQ ID NO: 230009 - RNA, 19 nt, Homo sapiens
ggguuguacuauuguuuaa

SEQ ID NO: 230010 - RNA, 19 nt, Homo sapiens
acgaacaggugaugcacua

SEQ ID NO: 230011 - RNA, 19 nt, Homo sapiens
aagggucuguuguaaauga

SEQ ID NO: 230012 - RNA, 19 nt, Homo sapiens
cgggaaagaauauaaaguu

SEQ ID NO: 230013 - RNA, 19 nt, Homo sapiens
ccgcagauaccuccuacua

SEQ ID NO: 230014 - RNA, 19 nt, Homo sapiens
ccgauuaauuuaugguuuc

SEQ ID NO: 230015 - RNA, 19 nt, Homo sapiens
guagacuccugcuucuuca

SEQ ID NO: 230016 - RNA, 19 nt, Homo sapiens
gccacucgcucuccuucaa

SEQ ID NO: 230017 - RNA, 19 nt, Homo sapiens
guuucugcgugcuuuauuu

SEQ ID NO: 230018 - RNA, 19 nt, Homo sapiens
uguuguaaaugaccaagaa

SEQ ID NO: 230019 - RNA, 19 nt, Homo sapiens
gcagcuacacgcacgcaaa

SEQ ID NO: 230020 - RNA, 19 nt, Homo sapiens
gauugcuggucguuuguug

SEQ ID NO: 230021 - RNA, 19 nt, Homo sapiens
ccauuaugaacuccucuua

SEQ ID NO: 230022 - RNA, 19 nt, Homo sapiens
gggccagaguuccacaaau

SEQ ID NO: 230023 - RNA, 19 nt, Homo sapiens
ggaaaacgggaaagaauau

SEQ ID NO: 230024 - RNA, 19 nt, Homo sapiens
gggaugaacggcaugaaca

SEQ ID NO: 230025 - RNA, 19 nt, Homo sapiens
aaaguguuauacccgguuu

SEQ ID NO: 230026 - RNA, 19 nt, Homo sapiens
aauguaagggucuguugua

SEQ ID NO: 230027 - RNA, 19 nt, Homo sapiens
caagggagaagaaauccau

SEQ ID NO: 230028 - RNA, 19 nt, Homo sapiens
gcagagacgcaagggagaa

SEQ ID NO: 230029 - RNA, 19 nt, Homo sapiens
auuaugaacuccucuuaag

SEQ ID NO: 230030 - RNA, 19 nt, Homo sapiens
cauuaugaacuccucuuaa

SEQ ID NO: 230031 - RNA, 19 nt, Homo sapiens
ccagaguuccacaaaucua

SEQ ID NO: 230032 - RNA, 19 nt, Homo sapiens
gaggguuguacuauuguuu

SEQ ID NO: 230033 - RNA, 19 nt, Homo sapiens
ccaaacagagggccacaca

SEQ ID NO: 230034 - RNA, 19 nt, Homo sapiens
ggaucgaggacaagugaga

SEQ ID NO: 230035 - RNA, 19 nt, Homo sapiens
cggguccgauuaauuuaug

SEQ ID NO: 230036 - RNA, 19 nt, Homo sapiens
ucguacaucucgcucauca

SEQ ID NO: 230037 - RNA, 19 nt, Homo sapiens
cagcagagccccaacaaga

SEQ ID NO: 230038 - RNA, 19 nt, Homo sapiens
gaaaacgggaaagaauaua

SEQ ID NO: 230039 - RNA, 19 nt, Homo sapiens
ggaccucaaggccuacgaa

SEQ ID NO: 230040 - RNA, 19 nt, Homo sapiens
ccauguaguuuuaacagaa

SEQ ID NO: 230041 - RNA, 19 nt, Homo sapiens
ugggagcggugaagaugga

SEQ ID NO: 230042 - RNA, 19 nt, Homo sapiens
gagacgcaagggagaagaa

SEQ ID NO: 230043 - RNA, 19 nt, Homo sapiens
cgggcaacauguucgagaa

SEQ ID NO: 230044 - RNA, 19 nt, Homo sapiens
cgacuggagcagcuacuau

SEQ ID NO: 230045 - RNA, 19 nt, Homo sapiens
cagaguuccacaaaucuau

SEQ ID NO: 230046 - RNA, 19 nt, Homo sapiens
ucugcgugcuuuauuuaug

SEQ ID NO: 230047 - RNA, 19 nt, Homo sapiens
uaugguuucugcgugcuuu

SEQ ID NO: 230048 - RNA, 19 nt, Homo sapiens
uguaagggucuguuguaaa

SEQ ID NO: 230049 - RNA, 19 nt, Homo sapiens
accagaggguuguacuauu

SEQ ID NO: 230050 - RNA, 19 nt, Homo sapiens
agaguuccacaaaucuaua

SEQ ID NO: 230051 - RNA, 19 nt, Homo sapiens
uuucugcgugcuuuauuua

SEQ ID NO: 230052 - RNA, 19 nt, Homo sapiens
gcugggagcggugaagaug

SEQ ID NO: 230053 - RNA, 19 nt, Homo sapiens
gacuggagcagcuacuaug

SEQ ID NO: 230054 - RNA, 19 nt, Homo sapiens
gaguuccacaaaucuauau

SEQ ID NO: 230055 - RNA, 19 nt, Homo sapiens
aggguuguacuauuguuua

SEQ ID NO: 230056 - RNA, 19 nt, Homo sapiens
gaggaaaacgggaaagaau

SEQ ID NO: 230057 - RNA, 19 nt, Homo sapiens
ccucaaggccuacgaacag

SEQ ID NO: 230058 - RNA, 19 nt, Homo sapiens
uguagacuccugcuucuuc

SEQ ID NO: 230059 - RNA, 19 nt, Homo sapiens
ccggaucgaggacaaguga

SEQ ID NO: 230060 - RNA, 19 nt, Homo sapiens
ccaccaaccccacaaaaug

SEQ ID NO: 230061 - RNA, 19 nt, Homo sapiens
aaagcauucccaaucuuga

SEQ ID NO: 230062 - RNA, 19 nt, Homo sapiens
guaagggucuguuguaaau

SEQ ID NO: 230063 - RNA, 19 nt, Homo sapiens
ccagaggguuguacuauug

SEQ ID NO: 230064 - RNA, 19 nt, Homo sapiens
gagaagaaauccauaacac

SEQ ID NO: 230065 - RNA, 19 nt, Homo sapiens
ggccagaguuccacaaauc

SEQ ID NO: 230066 - RNA, 19 nt, Homo sapiens
caacgacuguuuccugaag

SEQ ID NO: 230067 - RNA, 19 nt, Homo sapiens
gaacaccacuacgccuuca

SEQ ID NO: 230068 - RNA, 19 nt, Homo sapiens
ugaacggcaugaacacgua

SEQ ID NO: 230069 - RNA, 19 nt, Homo sapiens
aaacagagggccacacaga

SEQ ID NO: 230070 - RNA, 19 nt, Homo sapiens
gugcuuuauuuauggcuua

SEQ ID NO: 230071 - RNA, 19 nt, Homo sapiens
acagagggccacacagaua

SEQ ID NO: 230072 - RNA, 19 nt, Homo sapiens
ucaagcaccugcagauucu

SEQ ID NO: 230073 - RNA, 19 nt, Homo sapiens
ggagaagaaauccauaaca

SEQ ID NO: 230074 - RNA, 19 nt, Homo sapiens
uaugaacuccucuuaagaa

SEQ ID NO: 230075 - RNA, 19 nt, Homo sapiens
ggguuguacuauuguuuaa

SEQ ID NO: 230076 - RNA, 19 nt, Homo sapiens
acgaacaggugaugcacua

SEQ ID NO: 230077 - RNA, 19 nt, Homo sapiens
aagggucuguuguaaauga

SEQ ID NO: 230078 - RNA, 19 nt, Homo sapiens
cgggaaagaauauaaaguu

SEQ ID NO: 230079 - RNA, 19 nt, Homo sapiens
ccgcagauaccuccuacua

SEQ ID NO: 230080 - RNA, 19 nt, Homo sapiens
ccgauuaauuuaugguuuc

SEQ ID NO: 230081 - RNA, 19 nt, Homo sapiens
guagacuccugcuucuuca

SEQ ID NO: 230082 - RNA, 19 nt, Homo sapiens
gccacucgcucuccuucaa

SEQ ID NO: 230083 - RNA, 19 nt, Homo sapiens
guuucugcgugcuuuauuu

SEQ ID NO: 230084 - RNA, 19 nt, Homo sapiens
uguuguaaaugaccaagaa

SEQ ID NO: 230085 - RNA, 19 nt, Homo sapiens
gcagcuacacgcacgcaaa

SEQ ID NO: 230086 - RNA, 19 nt, Homo sapiens
ccauuaugaacuccucuua

SEQ ID NO: 230087 - RNA, 19 nt, Homo sapiens
gggccagaguuccacaaau

SEQ ID NO: 230088 - RNA, 19 nt, Homo sapiens
ggaaaacgggaaagaauau

SEQ ID NO: 230089 - RNA, 19 nt, Homo sapiens
gggaugaacggcaugaaca

SEQ ID NO: 230090 - RNA, 19 nt, Homo sapiens
uuccgggucugaacuguaa

SEQ ID NO: 230091 - RNA, 19 nt, Homo sapiens
aaaguguuauacccgguuu

SEQ ID NO: 230092 - RNA, 19 nt, Homo sapiens
aauguaagggucuguugua

SEQ ID NO: 230093 - RNA, 19 nt, Homo sapiens
caagggagaagaaauccau

SEQ ID NO: 230094 - RNA, 19 nt, Homo sapiens
gcagagacgcaagggagaa

SEQ ID NO: 230095 - RNA, 19 nt, Homo sapiens
auuaugaacuccucuuaag

SEQ ID NO: 230096 - RNA, 19 nt, Homo sapiens
cauuaugaacuccucuuaa

SEQ ID NO: 230097 - RNA, 19 nt, Homo sapiens
ccagaguuccacaaaucua

SEQ ID NO: 230098 - RNA, 19 nt, Homo sapiens
gaggguuguacuauuguuu

SEQ ID NO: 230099 - RNA, 19 nt, Homo sapiens
ccaaacagagggccacaca

SEQ ID NO: 230100 - RNA, 19 nt, Homo sapiens
ggaucgaggacaagugaga

SEQ ID NO: 230101 - RNA, 19 nt, Homo sapiens
cggguccgauuaauuuaug

SEQ ID NO: 230102 - RNA, 19 nt, Homo sapiens
ucguacaucucgcucauca

SEQ ID NO: 230103 - RNA, 19 nt, Homo sapiens
cagcagagccccaacaaga

SEQ ID NO: 230104 - RNA, 19 nt, Homo sapiens
gaaaacgggaaagaauaua

SEQ ID NO: 230105 - RNA, 19 nt, Homo sapiens
ggaccucaaggccuacgaa

SEQ ID NO: 230106 - RNA, 19 nt, Homo sapiens
ccauguaguuuuaacagaa

SEQ ID NO: 230107 - RNA, 19 nt, Homo sapiens
gagacgcaagggagaagaa

SEQ ID NO: 230108 - RNA, 19 nt, Homo sapiens
ugggagcggugaagaugga

SEQ ID NO: 230109 - RNA, 19 nt, Homo sapiens
cgggcaacauguucgagaa

SEQ ID NO: 230110 - RNA, 19 nt, Homo sapiens
cgacuggagcagcuacuau

SEQ ID NO: 230111 - RNA, 19 nt, Homo sapiens
cagaguuccacaaaucuau

SEQ ID NO: 230112 - RNA, 19 nt, Homo sapiens
ucugcgugcuuuauuuaug

SEQ ID NO: 230113 - RNA, 19 nt, Homo sapiens
uaugguuucugcgugcuuu

SEQ ID NO: 230114 - RNA, 19 nt, Homo sapiens
uguaagggucuguuguaaa

SEQ ID NO: 230115 - RNA, 19 nt, Homo sapiens
accagaggguuguacuauu

SEQ ID NO: 230116 - RNA, 19 nt, Homo sapiens
agaguuccacaaaucuaua

SEQ ID NO: 230117 - RNA, 19 nt, Homo sapiens
uuucugcgugcuuuauuua

SEQ ID NO: 230118 - RNA, 19 nt, Homo sapiens
gacuggagcagcuacuaug

SEQ ID NO: 230119 - RNA, 19 nt, Homo sapiens
gcugggagcggugaagaug

SEQ ID NO: 230120 - RNA, 19 nt, Homo sapiens
gaguuccacaaaucuauau

SEQ ID NO: 230121 - RNA, 19 nt, Homo sapiens
aggguuguacuauuguuua

SEQ ID NO: 230122 - RNA, 19 nt, Homo sapiens
gaggaaaacgggaaagaau

SEQ ID NO: 230123 - RNA, 19 nt, Homo sapiens
ccucaaggccuacgaacag

SEQ ID NO: 230124 - RNA, 19 nt, Homo sapiens
uguagacuccugcuucuuc

SEQ ID NO: 230125 - RNA, 19 nt, Homo sapiens
ccggaucgaggacaaguga

SEQ ID NO: 230126 - RNA, 19 nt, Homo sapiens
ccaccaaccccacaaaaug

SEQ ID NO: 230127 - RNA, 19 nt, Homo sapiens
aaagcauucccaaucuuga

SEQ ID NO: 230128 - RNA, 19 nt, Homo sapiens
ucauggaccucuucccuua

SEQ ID NO: 230129 - RNA, 19 nt, Homo sapiens
ggugauagcauuucaguga

SEQ ID NO: 230130 - RNA, 19 nt, Homo sapiens
ucacuugucccauugguua

SEQ ID NO: 230131 - RNA, 19 nt, Homo sapiens
ugagaauacuccuugguuu

SEQ ID NO: 230132 - RNA, 19 nt, Homo sapiens
cacaguaggugccaaguug

SEQ ID NO: 230133 - RNA, 19 nt, Homo sapiens
uaaccaccauggauacauu

SEQ ID NO: 230134 - RNA, 19 nt, Homo sapiens
acacuucacuugucccauu

SEQ ID NO: 230135 - RNA, 19 nt, Homo sapiens
ucaacaaccuaaugucaga

SEQ ID NO: 230136 - RNA, 19 nt, Homo sapiens
gcauuucagugacaucuuc

SEQ ID NO: 230137 - RNA, 19 nt, Homo sapiens
cuaauccacugcaugguuu

SEQ ID NO: 230138 - RNA, 19 nt, Homo sapiens
ggaacauggugguggguau

SEQ ID NO: 230139 - RNA, 19 nt, Homo sapiens
cagggaacauguuugagaa

SEQ ID NO: 230140 - RNA, 19 nt, Homo sapiens
ccucuaagcucucccuauc

SEQ ID NO: 230141 - RNA, 19 nt, Homo sapiens
gggaacauguuugagaaug

SEQ ID NO: 230142 - RNA, 19 nt, Homo sapiens
gaggacugcuacauugaug

SEQ ID NO: 230143 - RNA, 19 nt, Homo sapiens
ugugaggacugcuacauug

SEQ ID NO: 230144 - RNA, 19 nt, Homo sapiens
gugauaaccaccauggaua

SEQ ID NO: 230145 - RNA, 19 nt, Homo sapiens
caucugggugggucuauua

SEQ ID NO: 230146 - RNA, 19 nt, Homo sapiens
ggaacauguuugagaaugg

SEQ ID NO: 230147 - RNA, 19 nt, Homo sapiens
gcucagggaacauguuuga

SEQ ID NO: 230148 - RNA, 19 nt, Homo sapiens
gguacuggcuguguuuaau

SEQ ID NO: 230149 - RNA, 19 nt, Homo sapiens
gggaauuucuacugaaguc

SEQ ID NO: 230150 - RNA, 19 nt, Homo sapiens
gauggauguuauuggcuaa

SEQ ID NO: 230151 - RNA, 19 nt, Homo sapiens
augcugaccuugagugaaa

SEQ ID NO: 230152 - RNA, 19 nt, Homo sapiens
ucagugacaucuucuuugg

SEQ ID NO: 230153 - RNA, 19 nt, Homo sapiens
gaccuugagugaaaucuac

SEQ ID NO: 230154 - RNA, 19 nt, Homo sapiens
gccacucgcugucuuucaa

SEQ ID NO: 230155 - RNA, 19 nt, Homo sapiens
gcuaauccacugcaugguu

SEQ ID NO: 230156 - RNA, 19 nt, Homo sapiens
uauucccgcucuuugcuua

SEQ ID NO: 230157 - RNA, 19 nt, Homo sapiens
gugcugugcccacuucuuu

SEQ ID NO: 230158 - RNA, 19 nt, Homo sapiens
ugugaugacugcugucuca

SEQ ID NO: 230159 - RNA, 19 nt, Homo sapiens
gaaaucuaccaguggauca

SEQ ID NO: 230160 - RNA, 19 nt, Homo sapiens
caucaacaaccuaauguca

SEQ ID NO: 230161 - RNA, 19 nt, Homo sapiens
cuacugaagucugauucuu

SEQ ID NO: 230162 - RNA, 19 nt, Homo sapiens
ccaagccaccguauuccua

SEQ ID NO: 230163 - RNA, 19 nt, Homo sapiens
ggauggaggugagaauacu

SEQ ID NO: 230164 - RNA, 19 nt, Homo sapiens
caacuucaaccacccuuuc

SEQ ID NO: 230165 - RNA, 19 nt, Homo sapiens
ucagggaacauguuugaga

SEQ ID NO: 230166 - RNA, 19 nt, Homo sapiens
guaccguguccgccucuua

SEQ ID NO: 230167 - RNA, 19 nt, Homo sapiens
uccuauaucucacucauca

SEQ ID NO: 230168 - RNA, 19 nt, Homo sapiens
gugagaauacuccuugguu

SEQ ID NO: 230169 - RNA, 19 nt, Homo sapiens
ggacugcuacauugaugga

SEQ ID NO: 230170 - RNA, 19 nt, Homo sapiens
ggucuauuacuuacuguga

SEQ ID NO: 230171 - RNA, 19 nt, Homo sapiens
gaacauggugguggguaug

SEQ ID NO: 230172 - RNA, 19 nt, Homo sapiens
acugaagucugauucuuuc

SEQ ID NO: 230173 - RNA, 19 nt, Homo sapiens
uggccaccauucuguguaa

SEQ ID NO: 230174 - RNA, 19 nt, Homo sapiens
gagaauacuccuugguuuu

SEQ ID NO: 230175 - RNA, 19 nt, Homo sapiens
guacugugauaaccaccau

SEQ ID NO: 230176 - RNA, 19 nt, Homo sapiens
ucuauuacuuacugugaug

SEQ ID NO: 230177 - RNA, 19 nt, Homo sapiens
ugggugggucuauuacuua

SEQ ID NO: 230178 - RNA, 19 nt, Homo sapiens
cagcucagggaacauguuu

SEQ ID NO: 230179 - RNA, 19 nt, Homo sapiens
caaguuggccaccauucug

SEQ ID NO: 230180 - RNA, 19 nt, Homo sapiens
caucucgguuggcccuuug

SEQ ID NO: 230181 - RNA, 19 nt, Homo sapiens
gugggucuauuacuuacug

SEQ ID NO: 230182 - RNA, 19 nt, Homo sapiens
ggccaugucgucaccauuc

SEQ ID NO: 230183 - RNA, 19 nt, Homo sapiens
ugauagcauuucagugaca

SEQ ID NO: 230184 - RNA, 19 nt, Homo sapiens
gacaccagcaccucccaaa

SEQ ID NO: 230185 - RNA, 19 nt, Homo sapiens
gauagcauuucagugacau

SEQ ID NO: 230186 - RNA, 19 nt, Homo sapiens
caagccaccguauuccuau

SEQ ID NO: 230187 - RNA, 19 nt, Homo sapiens
cugggugggucuauuacuu

SEQ ID NO: 230188 - RNA, 19 nt, Homo sapiens
guacuggcuguguuuaauc

SEQ ID NO: 230189 - RNA, 19 nt, Homo sapiens
ucucugaagcccacccuuu

SEQ ID NO: 230190 - RNA, 19 nt, Homo sapiens
cgggcaagaugcugaccuu

SEQ ID NO: 230191 - RNA, 19 nt, Homo sapiens
aagccaccguauuccuaua

SEQ ID NO: 230192 - RNA, 19 nt, Homo sapiens
aaccuaaugucagaacaga

SEQ ID NO: 230193 - RNA, 19 nt, Homo sapiens
uaccguguccgccucuuaa

SEQ ID NO: 230194 - RNA, 19 nt, Homo sapiens
gggaugcugggcucaguga

SEQ ID NO: 230195 - RNA, 19 nt, Homo sapiens
uaggugcugugcccacuuc

SEQ ID NO: 230196 - RNA, 19 nt, Homo sapiens
ggguacuggcuguguuuaa

SEQ ID NO: 230197 - RNA, 19 nt, Homo sapiens
uacugaagucugauucuuu

SEQ ID NO: 230198 - RNA, 19 nt, Homo sapiens
gugugauggugauagcauu

SEQ ID NO: 230199 - RNA, 19 nt, Homo sapiens
ccaucucgguuggcccuuu

SEQ ID NO: 230200 - RNA, 19 nt, Homo sapiens
gugaggacugcuacauuga

SEQ ID NO: 230201 - RNA, 19 nt, Homo sapiens
uacuggcuguguuuaauca

SEQ ID NO: 230202 - RNA, 19 nt, Homo sapiens
ccaccguauuccuauaucu

SEQ ID NO: 230203 - RNA, 19 nt, Homo sapiens
ugauggugauagcauuuca

SEQ ID NO: 230204 - RNA, 19 nt, Homo sapiens
cuggcuguguuuaaucauu

SEQ ID NO: 230205 - RNA, 19 nt, Homo sapiens
aauuucuacugaagucuga

SEQ ID NO: 230206 - RNA, 19 nt, Homo sapiens
gauaaccaccauggauaca

SEQ ID NO: 230207 - RNA, 19 nt, Homo sapiens
uaacaucugggugggucua

SEQ ID NO: 230208 - RNA, 19 nt, Homo sapiens
gacccugaauccucuaagc

SEQ ID NO: 230209 - RNA, 19 nt, Homo sapiens
ggaccucuucccuuacuac

SEQ ID NO: 230210 - RNA, 19 nt, Homo sapiens
ggagaugacuugagccuua

SEQ ID NO: 230211 - RNA, 19 nt, Homo sapiens
cgacaucacuggagcauau

SEQ ID NO: 230212 - RNA, 19 nt, Homo sapiens
gaaggaagccguccagaau

SEQ ID NO: 230213 - RNA, 19 nt, Homo sapiens
ccaaguacaucccagcuuu

SEQ ID NO: 230214 - RNA, 19 nt, Homo sapiens
ggacauggccgacuacagu

SEQ ID NO: 230215 - RNA, 19 nt, Homo sapiens
gcagaucgaugacaaugag

SEQ ID NO: 230216 - RNA, 19 nt, Homo sapiens
gaugggcaaugauuuguug

SEQ ID NO: 230217 - RNA, 19 nt, Homo sapiens
gcaggaaguuaucuagcaa

SEQ ID NO: 230218 - RNA, 19 nt, Homo sapiens
gagcagauccaguucauca

SEQ ID NO: 230219 - RNA, 19 nt, Homo sapiens
aaacccagcucccuucuuc

SEQ ID NO: 230220 - RNA, 19 nt, Homo sapiens
cgaagaagauugccagcau

SEQ ID NO: 230221 - RNA, 19 nt, Homo sapiens
gacuugagccuuacuuaaa

SEQ ID NO: 230222 - RNA, 19 nt, Homo sapiens
ucaaagccaucaucuucuu

SEQ ID NO: 230223 - RNA, 19 nt, Homo sapiens
gcucugauaacaagacuuu

SEQ ID NO: 230224 - RNA, 19 nt, Homo sapiens
gcucagccaucccgucuuc

SEQ ID NO: 230225 - RNA, 19 nt, Homo sapiens
gcaggaaugggaaggauga

SEQ ID NO: 230226 - RNA, 19 nt, Homo sapiens
acaccacccuggaauuuga

SEQ ID NO: 230227 - RNA, 19 nt, Homo sapiens
ggaagaaccacauguacuc

SEQ ID NO: 230228 - RNA, 19 nt, Homo sapiens
gcaacggacagauguguga

SEQ ID NO: 230229 - RNA, 19 nt, Homo sapiens
gauccaugguguucaagga

SEQ ID NO: 230230 - RNA, 19 nt, Homo sapiens
gggcuggcaugaagaagga

SEQ ID NO: 230231 - RNA, 19 nt, Homo sapiens
ccucaaagccaucaucuuc

SEQ ID NO: 230232 - RNA, 19 nt, Homo sapiens
ggaggagcgugcggaagaa

SEQ ID NO: 230233 - RNA, 19 nt, Homo sapiens
cauguacuccugcagauuu

SEQ ID NO: 230234 - RNA, 19 nt, Homo sapiens
gcaccuugcuccuccuucu

SEQ ID NO: 230235 - RNA, 19 nt, Homo sapiens
ucaacgaccgccaguauga

SEQ ID NO: 230236 - RNA, 19 nt, Homo sapiens
caucaacgaccgccaguau

SEQ ID NO: 230237 - RNA, 19 nt, Homo sapiens
aggaagccguccagaauga

SEQ ID NO: 230238 - RNA, 19 nt, Homo sapiens
ugacuugagccuuacuuaa

SEQ ID NO: 230239 - RNA, 19 nt, Homo sapiens
gauaacaagacuuugacuu

SEQ ID NO: 230240 - RNA, 19 nt, Homo sapiens
gagcaggaaugggaaggau

SEQ ID NO: 230241 - RNA, 19 nt, Homo sapiens
ggucugagcccuauaagcu

SEQ ID NO: 230242 - RNA, 19 nt, Homo sapiens
ccaacacaaugcccacuca

SEQ ID NO: 230243 - RNA, 19 nt, Homo sapiens
gaguaugccuaccucaaag

SEQ ID NO: 230244 - RNA, 19 nt, Homo sapiens
caagagauccaugguguuc

SEQ ID NO: 230245 - RNA, 19 nt, Homo sapiens
gcccugcucugauaacaag

SEQ ID NO: 230246 - RNA, 19 nt, Homo sapiens
ucaccaagcaggaaguuau

SEQ ID NO: 230247 - RNA, 19 nt, Homo sapiens
cuacaccacccuggaauuu

SEQ ID NO: 230248 - RNA, 19 nt, Homo sapiens
gaggcuggguccaauugug

SEQ ID NO: 230249 - RNA, 19 nt, Homo sapiens
cugacgcccugcucugaua

SEQ ID NO: 230250 - RNA, 19 nt, Homo sapiens
agagauccaugguguucaa

SEQ ID NO: 230251 - RNA, 19 nt, Homo sapiens
gaucgaugacaaugaguau

SEQ ID NO: 230252 - RNA, 19 nt, Homo sapiens
gacgaugggcaaugauuug

SEQ ID NO: 230253 - RNA, 19 nt, Homo sapiens
ugacucgcguggccgcuuu

SEQ ID NO: 230254 - RNA, 19 nt, Homo sapiens
gcagggagaaugcgacucu

SEQ ID NO: 230255 - RNA, 19 nt, Homo sapiens
ggugagggaagacgccuuu

SEQ ID NO: 230256 - RNA, 19 nt, Homo sapiens
cuacugccuuggacaacuu

SEQ ID NO: 230257 - RNA, 19 nt, Homo sapiens
ugacgaugggcaaugauuu

SEQ ID NO: 230258 - RNA, 19 nt, Homo sapiens
uuggacaacuuucucaugu

SEQ ID NO: 230259 - RNA, 19 nt, Homo sapiens
gcagauccaguucaucaag

SEQ ID NO: 230260 - RNA, 19 nt, Homo sapiens
ccaagcaggaaguuaucua

SEQ ID NO: 230261 - RNA, 19 nt, Homo sapiens
gagcuuggaggacuacauc

SEQ ID NO: 230262 - RNA, 19 nt, Homo sapiens
acugcaggcucaagaaaug

SEQ ID NO: 230263 - RNA, 19 nt, Homo sapiens
ccgagaacauggccuaagg

SEQ ID NO: 230264 - RNA, 19 nt, Homo sapiens
uccaggagcugcagaucga

SEQ ID NO: 230265 - RNA, 19 nt, Homo sapiens
agaaggaagccguccagaa

SEQ ID NO: 230266 - RNA, 19 nt, Homo sapiens
gagaugacuugagccuuac

SEQ ID NO: 230267 - RNA, 19 nt, Homo sapiens
gccacugccuucaccuuca

SEQ ID NO: 230268 - RNA, 19 nt, Homo sapiens
ucugauaacaagacuuuga

SEQ ID NO: 230269 - RNA, 19 nt, Homo sapiens
ggcaaaggaagacgugaug

SEQ ID NO: 230270 - RNA, 19 nt, Homo sapiens
ggcagugcgugguggacaa

SEQ ID NO: 230271 - RNA, 19 nt, Homo sapiens
gacagccgccuggagauga

SEQ ID NO: 230272 - RNA, 19 nt, Homo sapiens
uggacaacuuucucauguu

SEQ ID NO: 230273 - RNA, 19 nt, Homo sapiens
gagaaugugcagguguuga

SEQ ID NO: 230274 - RNA, 19 nt, Homo sapiens
caagcaggaaguuaucuag

SEQ ID NO: 230275 - RNA, 19 nt, Homo sapiens
ggcagaugaucgagcagau

SEQ ID NO: 230276 - RNA, 19 nt, Homo sapiens
gagggaagacgccuuucuc

SEQ ID NO: 230277 - RNA, 19 nt, Homo sapiens
caucccgucuucuccaaca

SEQ ID NO: 230278 - RNA, 19 nt, Homo sapiens
uugagaaugugcagguguu

SEQ ID NO: 230279 - RNA, 19 nt, Homo sapiens
ccaacaccaccucuacaga

SEQ ID NO: 230280 - RNA, 19 nt, Homo sapiens
gccuucaccuucaccuuca

SEQ ID NO: 230281 - RNA, 19 nt, Homo sapiens
ccaaaacccucgucgacau

SEQ ID NO: 230282 - RNA, 19 nt, Homo sapiens
gaccaucaccaagcaggaa

SEQ ID NO: 230283 - RNA, 19 nt, Homo sapiens
ucacguggcagaugaucga

SEQ ID NO: 230284 - RNA, 19 nt, Homo sapiens
gaugagccggguguccaua

SEQ ID NO: 230285 - RNA, 19 nt, Homo sapiens
cuacugcaggcucaagaaa

SEQ ID NO: 230286 - RNA, 19 nt, Homo sapiens
cacauguacuccugcagau

SEQ ID NO: 230287 - RNA, 19 nt, Homo sapiens
gcaccaggcagggucuaga

SEQ ID NO: 230288 - RNA, 19 nt, Homo sapiens
aagccaucaucuucuuuga

SEQ ID NO: 230289 - RNA, 19 nt, Homo sapiens
gcagugcgugguggacaaa

SEQ ID NO: 230290 - RNA, 19 nt, Homo sapiens
gugaggcuggguccaauug

SEQ ID NO: 230291 - RNA, 19 nt, Homo sapiens
ccugcacccucaccugaug

SEQ ID NO: 230292 - RNA, 19 nt, Homo sapiens
ucgagcagauccaguucau

SEQ ID NO: 230293 - RNA, 19 nt, Homo sapiens
uguugacgaugggcaauga

SEQ ID NO: 230294 - RNA, 19 nt, Homo sapiens
auguacuccugcagauuua

SEQ ID NO: 230295 - RNA, 19 nt, Homo sapiens
gccaucccgucuucuccaa

SEQ ID NO: 230296 - RNA, 19 nt, Homo sapiens
ccucagcaacggacagaug

SEQ ID NO: 230297 - RNA, 19 nt, Homo sapiens
gaaugcgacucuccaaaac

SEQ ID NO: 230298 - RNA, 19 nt, Homo sapiens
ccaagagauccaugguguu

SEQ ID NO: 230299 - RNA, 19 nt, Homo sapiens
caaguacaucccagcuuuc

SEQ ID NO: 230300 - RNA, 19 nt, Homo sapiens
gcggaagaaccacauguac

SEQ ID NO: 230301 - RNA, 19 nt, Homo sapiens
gggccacgggcaaacacua

SEQ ID NO: 230302 - RNA, 19 nt, Homo sapiens
agcaggaaguuaucuagca

SEQ ID NO: 230303 - RNA, 19 nt, Homo sapiens
gcuccuaggcaaugacuac

SEQ ID NO: 230304 - RNA, 19 nt, Homo sapiens
agccugcccuccaucaaug

SEQ ID NO: 230305 - RNA, 19 nt, Homo sapiens
gcuacugcaggcucaagaa

SEQ ID NO: 230306 - RNA, 19 nt, Homo sapiens
ggaaugggcuaaauauauu

SEQ ID NO: 230307 - RNA, 19 nt, Homo sapiens
gaacggcacuacauaaaug

SEQ ID NO: 230308 - RNA, 19 nt, Homo sapiens
gcaaaugauugagcaaaua

SEQ ID NO: 230309 - RNA, 19 nt, Homo sapiens
gcacugacauaaacguuaa

SEQ ID NO: 230310 - RNA, 19 nt, Homo sapiens
cagcaucucuccaaacaaa

SEQ ID NO: 230311 - RNA, 19 nt, Homo sapiens
acaaagagauccaugaugu

SEQ ID NO: 230312 - RNA, 19 nt, Homo sapiens
caaaauagcugcaaaccaa

SEQ ID NO: 230313 - RNA, 19 nt, Homo sapiens
caaugaguaugcuuguuua

SEQ ID NO: 230314 - RNA, 19 nt, Homo sapiens
agagauccaugauguauaa

SEQ ID NO: 230315 - RNA, 19 nt, Homo sapiens
aaaugaacgugacagaaua

SEQ ID NO: 230316 - RNA, 19 nt, Homo sapiens
gaaagcagccagucugaga

SEQ ID NO: 230317 - RNA, 19 nt, Homo sapiens
cuacucuucucuacaaaua

SEQ ID NO: 230318 - RNA, 19 nt, Homo sapiens
gauccaugauguauaaaga

SEQ ID NO: 230319 - RNA, 19 nt, Homo sapiens
ccagagacaaguaugaaua

SEQ ID NO: 230320 - RNA, 19 nt, Homo sapiens
ucaaugaucggcaguauga

SEQ ID NO: 230321 - RNA, 19 nt, Homo sapiens
gugcaaggguuucuucaga

SEQ ID NO: 230322 - RNA, 19 nt, Homo sapiens
gauauugacacuacagaaa

SEQ ID NO: 230323 - RNA, 19 nt, Homo sapiens
agaauaagcaccagaagaa

SEQ ID NO: 230324 - RNA, 19 nt, Homo sapiens
guaagagucacauuuauuc

SEQ ID NO: 230325 - RNA, 19 nt, Homo sapiens
gggcuaagcgauccaguaa

SEQ ID NO: 230326 - RNA, 19 nt, Homo sapiens
ccaaucguguucuagauga

SEQ ID NO: 230327 - RNA, 19 nt, Homo sapiens
gaacgugacagaauaagca

SEQ ID NO: 230328 - RNA, 19 nt, Homo sapiens
gcaagaacaguacaaaaua

SEQ ID NO: 230329 - RNA, 19 nt, Homo sapiens
gcuaagcgauccaguaaaa

SEQ ID NO: 230330 - RNA, 19 nt, Homo sapiens
gcuuggagcuacaaagaga

SEQ ID NO: 230331 - RNA, 19 nt, Homo sapiens
ggugaugucugugaaucua

SEQ ID NO: 230332 - RNA, 19 nt, Homo sapiens
gaaaaguuguugaucuuga

SEQ ID NO: 230333 - RNA, 19 nt, Homo sapiens
aaaccaagcaucagucauu

SEQ ID NO: 230334 - RNA, 19 nt, Homo sapiens
cuucauuggugcuguuaua

SEQ ID NO: 230335 - RNA, 19 nt, Homo sapiens
ugaguaugcuuguuuaaag

SEQ ID NO: 230336 - RNA, 19 nt, Homo sapiens
gcugugaaguugagauuag

SEQ ID NO: 230337 - RNA, 19 nt, Homo sapiens
caaagagauccaugaugua

SEQ ID NO: 230338 - RNA, 19 nt, Homo sapiens
ugaaggauguuuauauagg

SEQ ID NO: 230339 - RNA, 19 nt, Homo sapiens
caauguauaucugaguuug

SEQ ID NO: 230340 - RNA, 19 nt, Homo sapiens
agaagaagcacauuugaug

SEQ ID NO: 230341 - RNA, 19 nt, Homo sapiens
agagucacauuuauucuug

SEQ ID NO: 230342 - RNA, 19 nt, Homo sapiens
ggcaaaugauugagcaaau

SEQ ID NO: 230343 - RNA, 19 nt, Homo sapiens
cauuggugcuguuauaaga

SEQ ID NO: 230344 - RNA, 19 nt, Homo sapiens
gguuagaccauuucaagaa

SEQ ID NO: 230345 - RNA, 19 nt, Homo sapiens
ggacagagcaacaggaaaa

SEQ ID NO: 230346 - RNA, 19 nt, Homo sapiens
gacaaucuacuucaggaaa

SEQ ID NO: 230347 - RNA, 19 nt, Homo sapiens
uggaaugggcuaaauauau

SEQ ID NO: 230348 - RNA, 19 nt, Homo sapiens
ucagaacggcacuacauaa

SEQ ID NO: 230349 - RNA, 19 nt, Homo sapiens
gaucucaacuccugaaacc

SEQ ID NO: 230350 - RNA, 19 nt, Homo sapiens
cagccagucugagauauug

SEQ ID NO: 230351 - RNA, 19 nt, Homo sapiens
gaauuaccauuggaugauc

SEQ ID NO: 230352 - RNA, 19 nt, Homo sapiens
cagaacggcacuacauaaa

SEQ ID NO: 230353 - RNA, 19 nt, Homo sapiens
caaaaggaaucaauguaga

SEQ ID NO: 230354 - RNA, 19 nt, Homo sapiens
acaaggcucugggcaagaa

SEQ ID NO: 230355 - RNA, 19 nt, Homo sapiens
cagcuuacuccuuguauug

SEQ ID NO: 230356 - RNA, 19 nt, Homo sapiens
gcucugggcaagaacagua

SEQ ID NO: 230357 - RNA, 19 nt, Homo sapiens
gaaaauguguuuacuucag

SEQ ID NO: 230358 - RNA, 19 nt, Homo sapiens
gagcaucacguggcaaaug

SEQ ID NO: 230359 - RNA, 19 nt, Homo sapiens
agacgcagcauucguaaga

SEQ ID NO: 230360 - RNA, 19 nt, Homo sapiens
gcaaaccaagcaucaguca

SEQ ID NO: 230361 - RNA, 19 nt, Homo sapiens
ucacguggcaaaugauuga

SEQ ID NO: 230362 - RNA, 19 nt, Homo sapiens
aaagagauccaugauguau

SEQ ID NO: 230363 - RNA, 19 nt, Homo sapiens
cguaagagucacauuuauu

SEQ ID NO: 230364 - RNA, 19 nt, Homo sapiens
uaccacagccuuauaguuc

SEQ ID NO: 230365 - RNA, 19 nt, Homo sapiens
ccaagcaucagucauuuca

SEQ ID NO: 230366 - RNA, 19 nt, Homo sapiens
gaucagguggcacuguuga

SEQ ID NO: 230367 - RNA, 19 nt, Homo sapiens
gguggaaugggcuaaauau

SEQ ID NO: 230368 - RNA, 19 nt, Homo sapiens
gcaaccaauguauaucuga

SEQ ID NO: 230369 - RNA, 19 nt, Homo sapiens
gugaaaauguguuuacuuc

SEQ ID NO: 230370 - RNA, 19 nt, Homo sapiens
aagcaucagucauuucaca

SEQ ID NO: 230371 - RNA, 19 nt, Homo sapiens
cccauuaacuggacaaacu

SEQ ID NO: 230372 - RNA, 19 nt, Homo sapiens
ccagaagaagcacauuuga

SEQ ID NO: 230373 - RNA, 19 nt, Homo sapiens
cagaauaagcaccagaaga

SEQ ID NO: 230374 - RNA, 19 nt, Homo sapiens
gcagccagucugagauauu

SEQ ID NO: 230375 - RNA, 19 nt, Homo sapiens
gaguaugcuuguuuaaagg

SEQ ID NO: 230376 - RNA, 19 nt, Homo sapiens
acaaucuacuucaggaaau

SEQ ID NO: 230377 - RNA, 19 nt, Homo sapiens
ucugagauauugacacuac

SEQ ID NO: 230378 - RNA, 19 nt, Homo sapiens
gacagaauaagcaccagaa

SEQ ID NO: 230379 - RNA, 19 nt, Homo sapiens
ugaguuugaaggauguuua

SEQ ID NO: 230380 - RNA, 19 nt, Homo sapiens
gcgaaagcagccagucuga

SEQ ID NO: 230381 - RNA, 19 nt, Homo sapiens
uguuauugcuacuauguga

SEQ ID NO: 230382 - RNA, 19 nt, Homo sapiens
aaccaagcaucagucauuu

SEQ ID NO: 230383 - RNA, 19 nt, Homo sapiens
caagaacaguacaaaauag

SEQ ID NO: 230384 - RNA, 19 nt, Homo sapiens
gcuacaaagagauccauga

SEQ ID NO: 230385 - RNA, 19 nt, Homo sapiens
ucaacugucugugugcuau

SEQ ID NO: 230386 - RNA, 19 nt, Homo sapiens
caaucuacuucaggaaaug

SEQ ID NO: 230387 - RNA, 19 nt, Homo sapiens
ggccaaucguguucuagau

SEQ ID NO: 230388 - RNA, 19 nt, Homo sapiens
gaaacagcagcucuuaguc

SEQ ID NO: 230389 - RNA, 19 nt, Homo sapiens
acaccagcaucucuccaaa

SEQ ID NO: 230390 - RNA, 19 nt, Homo sapiens
gugaauuaccauuggauga

SEQ ID NO: 230391 - RNA, 19 nt, Homo sapiens
guggaaugggcuaaauaua

SEQ ID NO: 230392 - RNA, 19 nt, Homo sapiens
ugacagcuuacuccuugua

SEQ ID NO: 230393 - RNA, 19 nt, Homo sapiens
caaaugauugagcaaauac

SEQ ID NO: 230394 - RNA, 19 nt, Homo sapiens
ugauugagcaaauacaguu

SEQ ID NO: 230395 - RNA, 19 nt, Homo sapiens
aacagcagcucuuagucuu

SEQ ID NO: 230396 - RNA, 19 nt, Homo sapiens
caccagaagaagcacauuu

SEQ ID NO: 230397 - RNA, 19 nt, Homo sapiens
ucguaagagucacauuuau

SEQ ID NO: 230398 - RNA, 19 nt, Homo sapiens
gugaaaaguuguugaucuu

SEQ ID NO: 230399 - RNA, 19 nt, Homo sapiens
aagcagccagucugagaua

SEQ ID NO: 230400 - RNA, 19 nt, Homo sapiens
gcucuuagucuugguggaa

SEQ ID NO: 230401 - RNA, 19 nt, Homo sapiens
aaacagcagcucuuagucu

SEQ ID NO: 230402 - RNA, 19 nt, Homo sapiens
ccacagccuuauaguucug

SEQ ID NO: 230403 - RNA, 19 nt, Homo sapiens
ggacaaaaggaaucaaugu

SEQ ID NO: 230404 - RNA, 19 nt, Homo sapiens
augcuacucuucucuacaa

SEQ ID NO: 230405 - RNA, 19 nt, Homo sapiens
ccgcaacagcugugaaguu

SEQ ID NO: 230406 - RNA, 19 nt, Homo sapiens
gauagcagguuuauacuua

SEQ ID NO: 230407 - RNA, 19 nt, Homo sapiens
caaagaaaccaaagacuua

SEQ ID NO: 230408 - RNA, 19 nt, Homo sapiens
caacucaucuucuucauca

SEQ ID NO: 230409 - RNA, 19 nt, Homo sapiens
gggcuggccuccaugaaua

SEQ ID NO: 230410 - RNA, 19 nt, Homo sapiens
gaagguguauggugucuca

SEQ ID NO: 230411 - RNA, 19 nt, Homo sapiens
ggaagaaccacaaacuaaa

SEQ ID NO: 230412 - RNA, 19 nt, Homo sapiens
caagauagcagguuuauac

SEQ ID NO: 230413 - RNA, 19 nt, Homo sapiens
ggaggagucuggacaagug

SEQ ID NO: 230414 - RNA, 19 nt, Homo sapiens
uagcucaccugcauucuga

SEQ ID NO: 230415 - RNA, 19 nt, Homo sapiens
gaagagaucaauaccaaag

SEQ ID NO: 230416 - RNA, 19 nt, Homo sapiens
uggaagagaucaauaccaa

SEQ ID NO: 230417 - RNA, 19 nt, Homo sapiens
gcagguuuauacuuagaaa

SEQ ID NO: 230418 - RNA, 19 nt, Homo sapiens
agacuuagcucaccugcau

SEQ ID NO: 230419 - RNA, 19 nt, Homo sapiens
ucaccugcauucugacuuu

SEQ ID NO: 230420 - RNA, 19 nt, Homo sapiens
ccauugagcggacaucuuu

SEQ ID NO: 230421 - RNA, 19 nt, Homo sapiens
ccaaagaaaccaaagacuu

SEQ ID NO: 230422 - RNA, 19 nt, Homo sapiens
gucagcaacuucuucauga

SEQ ID NO: 230423 - RNA, 19 nt, Homo sapiens
gaacucuacaugcaauauu

SEQ ID NO: 230424 - RNA, 19 nt, Homo sapiens
gguguauggugucucagua

SEQ ID NO: 230425 - RNA, 19 nt, Homo sapiens
ggucagcaauggaaguaau

SEQ ID NO: 230426 - RNA, 19 nt, Homo sapiens
gaaggaagaaccacaaacu

SEQ ID NO: 230427 - RNA, 19 nt, Homo sapiens
gaucgaacuuucucaucug

SEQ ID NO: 230428 - RNA, 19 nt, Homo sapiens
aaauaagcguccauccaaa

SEQ ID NO: 230429 - RNA, 19 nt, Homo sapiens
caugcaauauucaaggaaa

SEQ ID NO: 230430 - RNA, 19 nt, Homo sapiens
ucaggcaacucaucuucuu

SEQ ID NO: 230431 - RNA, 19 nt, Homo sapiens
gacaaaugaugagcaggaa

SEQ ID NO: 230432 - RNA, 19 nt, Homo sapiens
gaccaggaccucaagauag

SEQ ID NO: 230433 - RNA, 19 nt, Homo sapiens
aggaagaaccacaaacuaa

SEQ ID NO: 230434 - RNA, 19 nt, Homo sapiens
gaaggaggagucuggacaa

SEQ ID NO: 230435 - RNA, 19 nt, Homo sapiens
gagggcagcuccaauucag

SEQ ID NO: 230436 - RNA, 19 nt, Homo sapiens
gacgagggcagcuccaauu

SEQ ID NO: 230437 - RNA, 19 nt, Homo sapiens
uccaaagaauugcaaauca

SEQ ID NO: 230438 - RNA, 19 nt, Homo sapiens
ccagguuggucuucacaga

SEQ ID NO: 230439 - RNA, 19 nt, Homo sapiens
gaagaaccacaaacuaaaa

SEQ ID NO: 230440 - RNA, 19 nt, Homo sapiens
gguuggagcugagcacugu

SEQ ID NO: 230441 - RNA, 19 nt, Homo sapiens
caagaacaugggaaggaua

SEQ ID NO: 230442 - RNA, 19 nt, Homo sapiens
agaccaggaccucaagaua

SEQ ID NO: 230443 - RNA, 19 nt, Homo sapiens
ccaaagaauugcaaaucac

SEQ ID NO: 230444 - RNA, 19 nt, Homo sapiens
ggaagagaucaauaccaaa

SEQ ID NO: 230445 - RNA, 19 nt, Homo sapiens
gcgcaggucagcaauggaa

SEQ ID NO: 230446 - RNA, 19 nt, Homo sapiens
ucagcaacuucuucaugaa

SEQ ID NO: 230447 - RNA, 19 nt, Homo sapiens
ccgcuuagcagcaugcaaa

SEQ ID NO: 230448 - RNA, 19 nt, Homo sapiens
uagcagguuuauacuuaga

SEQ ID NO: 230449 - RNA, 19 nt, Homo sapiens
ucucacaccuucaauccau

SEQ ID NO: 230450 - RNA, 19 nt, Homo sapiens
gcuuggcuguuuagugguu

SEQ ID NO: 230451 - RNA, 19 nt, Homo sapiens
ucgcugugcuuggcuguuu

SEQ ID NO: 230452 - RNA, 19 nt, Homo sapiens
gaacaugggaaggauagag

SEQ ID NO: 230453 - RNA, 19 nt, Homo sapiens
ggacgagggcagcuccaau

SEQ ID NO: 230454 - RNA, 19 nt, Homo sapiens
aagcguccauccaaagaau

SEQ ID NO: 230455 - RNA, 19 nt, Homo sapiens
acaagaacaugggaaggau

SEQ ID NO: 230456 - RNA, 19 nt, Homo sapiens
cagauggaagagaucaaua

SEQ ID NO: 230457 - RNA, 19 nt, Homo sapiens
gaccauggccugcgagacu

SEQ ID NO: 230458 - RNA, 19 nt, Homo sapiens
guuuggagcauagugauuu

SEQ ID NO: 230459 - RNA, 19 nt, Homo sapiens
acgcgcagcugaccaugga

SEQ ID NO: 230460 - RNA, 19 nt, Homo sapiens
aaggaagaaccacaaacua

SEQ ID NO: 230461 - RNA, 19 nt, Homo sapiens
caaaaggaaagaacaagaa

SEQ ID NO: 230462 - RNA, 19 nt, Homo sapiens
cauguccgcgcuccgcuua

SEQ ID NO: 230463 - RNA, 19 nt, Homo sapiens
caaaugaugagcaggaaaa

SEQ ID NO: 230464 - RNA, 19 nt, Homo sapiens
gaggaaggaaggcaacagu

SEQ ID NO: 230465 - RNA, 19 nt, Homo sapiens
ccucaagauagcagguuua

SEQ ID NO: 230466 - RNA, 19 nt, Homo sapiens
gcaacucaucuucuucauc

SEQ ID NO: 230467 - RNA, 19 nt, Homo sapiens
gaaaauaagcguccaucca

SEQ ID NO: 230468 - RNA, 19 nt, Homo sapiens
uacaugcaauauucaagga

SEQ ID NO: 230469 - RNA, 19 nt, Homo sapiens
agagaucaauaccaaagag

SEQ ID NO: 230470 - RNA, 19 nt, Homo sapiens
gcgucgaacucuacaugca

SEQ ID NO: 230471 - RNA, 19 nt, Homo sapiens
accaaagcaugaaggaaga

SEQ ID NO: 230472 - RNA, 19 nt, Homo sapiens
ccacagucucggacaaguu

SEQ ID NO: 230473 - RNA, 19 nt, Homo sapiens
gcaaaaggaaagaacaaga

SEQ ID NO: 230474 - RNA, 19 nt, Homo sapiens
gucgaacucuacaugcaau

SEQ ID NO: 230475 - RNA, 19 nt, Homo sapiens
gccagcagccgaugugaag

SEQ ID NO: 230476 - RNA, 19 nt, Homo sapiens
guauggugucucaguacua

SEQ ID NO: 230477 - RNA, 19 nt, Homo sapiens
caugaaggaagaaccacaa

SEQ ID NO: 230478 - RNA, 19 nt, Homo sapiens
gcacugucagcaacuucuu

SEQ ID NO: 230479 - RNA, 19 nt, Homo sapiens
cuccaugaauaaccucuau

SEQ ID NO: 230480 - RNA, 19 nt, Homo sapiens
aaaauaagcguccauccaa

SEQ ID NO: 230481 - RNA, 19 nt, Homo sapiens
cagcgucgaacucuacaug

SEQ ID NO: 230482 - RNA, 19 nt, Homo sapiens
cccaaacccuggagcaaac

SEQ ID NO: 230483 - RNA, 19 nt, Homo sapiens
uaagaucgaacuuucucau

SEQ ID NO: 230484 - RNA, 19 nt, Homo sapiens
uuuagugguuuggagcaua

SEQ ID NO: 230485 - RNA, 19 nt, Homo sapiens
gaucucacaccuucaaucc

SEQ ID NO: 230486 - RNA, 19 nt, Homo sapiens
ugucagcaacuucuucaug

SEQ ID NO: 230487 - RNA, 19 nt, Homo sapiens
caggucagcaauggaagua

SEQ ID NO: 230488 - RNA, 19 nt, Homo sapiens
acagauguccagcgucgaa

SEQ ID NO: 230489 - RNA, 19 nt, Homo sapiens
gaaggauagaggcaacaca

SEQ ID NO: 230490 - RNA, 19 nt, Homo sapiens
gcgcuccgcuuagcagcau

SEQ ID NO: 230491 - RNA, 19 nt, Homo sapiens
uuucucaucuguucuacca

SEQ ID NO: 230492 - RNA, 19 nt, Homo sapiens
ccaauucaggcaacucauc

SEQ ID NO: 230493 - RNA, 19 nt, Homo sapiens
ccaugaauaaccucuauac

SEQ ID NO: 230494 - RNA, 19 nt, Homo sapiens
aaggaaagaacaagaacau

SEQ ID NO: 230495 - RNA, 19 nt, Homo sapiens
uauggugucucaguacuac

SEQ ID NO: 230496 - RNA, 19 nt, Homo sapiens
uuagugguuuggagcauag

SEQ ID NO: 230497 - RNA, 19 nt, Homo sapiens
ccugcauucugacuuuguu

SEQ ID NO: 230498 - RNA, 19 nt, Homo sapiens
ccucccaucuccacagucu

SEQ ID NO: 230499 - RNA, 19 nt, Homo sapiens
gcaggucagcaauggaagu

SEQ ID NO: 230500 - RNA, 19 nt, Homo sapiens
guaccaaagcaugaaggaa

SEQ ID NO: 230501 - RNA, 19 nt, Homo sapiens
cgagggcagcuccaauuca

SEQ ID NO: 230502 - RNA, 19 nt, Homo sapiens
ucacaccuucaauccauga

SEQ ID NO: 230503 - RNA, 19 nt, Homo sapiens
gcguccauccaaagaauug

SEQ ID NO: 230504 - RNA, 19 nt, Homo sapiens
uaagcguccauccaaagaa

SEQ ID NO: 230505 - RNA, 19 nt, Homo sapiens
aacucuacaugcaauauuc

SEQ ID NO: 230506 - RNA, 19 nt, Homo sapiens
ggauauaucugacugcuuu

SEQ ID NO: 230507 - RNA, 19 nt, Homo sapiens
guaagcaccuuuagaauau

SEQ ID NO: 230508 - RNA, 19 nt, Homo sapiens
gagcagagcuugggaaaga

SEQ ID NO: 230509 - RNA, 19 nt, Homo sapiens
gauaugagauguagcaaau

SEQ ID NO: 230510 - RNA, 19 nt, Homo sapiens
gcaaagucccguucaaaua

SEQ ID NO: 230511 - RNA, 19 nt, Homo sapiens
caaauucucuccaaaguuc

SEQ ID NO: 230512 - RNA, 19 nt, Homo sapiens
gccaagugcugaacaaauu

SEQ ID NO: 230513 - RNA, 19 nt, Homo sapiens
caacucgaaucacucauuu

SEQ ID NO: 230514 - RNA, 19 nt, Homo sapiens
ucgaaucacucauuuguuu

SEQ ID NO: 230515 - RNA, 19 nt, Homo sapiens
gaugaccucugccaguaua

SEQ ID NO: 230516 - RNA, 19 nt, Homo sapiens
auaaagcacuguuuggaua

SEQ ID NO: 230517 - RNA, 19 nt, Homo sapiens
gcuaagaugcucauuauug

SEQ ID NO: 230518 - RNA, 19 nt, Homo sapiens
acugaaaccugcaacuuua

SEQ ID NO: 230519 - RNA, 19 nt, Homo sapiens
caacauaacauaagcuaga

SEQ ID NO: 230520 - RNA, 19 nt, Homo sapiens
cugaacaaauugccaaaua

SEQ ID NO: 230521 - RNA, 19 nt, Homo sapiens
gcauaacuaucaaucacaa

SEQ ID NO: 230522 - RNA, 19 nt, Homo sapiens
gaacaacucgaaucacuca

SEQ ID NO: 230523 - RNA, 19 nt, Homo sapiens
caaagucccguucaaauau

SEQ ID NO: 230524 - RNA, 19 nt, Homo sapiens
gacaucaucugaauaccaa

SEQ ID NO: 230525 - RNA, 19 nt, Homo sapiens
gaacaaauugccaaauaca

SEQ ID NO: 230526 - RNA, 19 nt, Homo sapiens
ucacucauuuguuuccaua

SEQ ID NO: 230527 - RNA, 19 nt, Homo sapiens
gagccugaauuuagugcua

SEQ ID NO: 230528 - RNA, 19 nt, Homo sapiens
cuaagaugcucauuauugu

SEQ ID NO: 230529 - RNA, 19 nt, Homo sapiens
cagaugaccucacucagau

SEQ ID NO: 230530 - RNA, 19 nt, Homo sapiens
gccaguauaucacaucaga

SEQ ID NO: 230531 - RNA, 19 nt, Homo sapiens
aaaaggagcuucaaaagug

SEQ ID NO: 230532 - RNA, 19 nt, Homo sapiens
gaaguaugcacuaaucaau

SEQ ID NO: 230533 - RNA, 19 nt, Homo sapiens
guaagaguaagcaccuuua

SEQ ID NO: 230534 - RNA, 19 nt, Homo sapiens
ccaaaguucaggcucaaua

SEQ ID NO: 230535 - RNA, 19 nt, Homo sapiens
uaugagauguagcaaauuc

SEQ ID NO: 230536 - RNA, 19 nt, Homo sapiens
ggaaucauaugggauacug

SEQ ID NO: 230537 - RNA, 19 nt, Homo sapiens
ucauagugauugaggcaua

SEQ ID NO: 230538 - RNA, 19 nt, Homo sapiens
aaaguagaauguuggagaa

SEQ ID NO: 230539 - RNA, 19 nt, Homo sapiens
ggagacaucaucugaauac

SEQ ID NO: 230540 - RNA, 19 nt, Homo sapiens
caaccuagggcuuaaguau

SEQ ID NO: 230541 - RNA, 19 nt, Homo sapiens
ucacucagaugcuggacaa

SEQ ID NO: 230542 - RNA, 19 nt, Homo sapiens
cagcuacccugaaauucuu

SEQ ID NO: 230543 - RNA, 19 nt, Homo sapiens
aguaagcaccuuuagaaua

SEQ ID NO: 230544 - RNA, 19 nt, Homo sapiens
ucacaaacucauccauuaa

SEQ ID NO: 230545 - RNA, 19 nt, Homo sapiens
gacugaaaccugcaacuuu

SEQ ID NO: 230546 - RNA, 19 nt, Homo sapiens
agaguaagcaccuuuagaa

SEQ ID NO: 230547 - RNA, 19 nt, Homo sapiens
uacaagagccugaauuuag

SEQ ID NO: 230548 - RNA, 19 nt, Homo sapiens
caucccagcuacccugaaa

SEQ ID NO: 230549 - RNA, 19 nt, Homo sapiens
guagauaaagcacuguuug

SEQ ID NO: 230550 - RNA, 19 nt, Homo sapiens
acaagagccugaauuuagu

SEQ ID NO: 230551 - RNA, 19 nt, Homo sapiens
cuacaagagccugaauuua

SEQ ID NO: 230552 - RNA, 19 nt, Homo sapiens
cagccuuuguggcauguua

SEQ ID NO: 230553 - RNA, 19 nt, Homo sapiens
aucacaaacucauccauua

SEQ ID NO: 230554 - RNA, 19 nt, Homo sapiens
gagaccugcuuugggauuu

SEQ ID NO: 230555 - RNA, 19 nt, Homo sapiens
cgggaaauauguugaaucu

SEQ ID NO: 230556 - RNA, 19 nt, Homo sapiens
cuauugugcuuucuaucua

SEQ ID NO: 230557 - RNA, 19 nt, Homo sapiens
aaagucccguucaaauauu

SEQ ID NO: 230558 - RNA, 19 nt, Homo sapiens
aaccaaauauggcaucuuc

SEQ ID NO: 230559 - RNA, 19 nt, Homo sapiens
gauaaagcacuguuuggau

SEQ ID NO: 230560 - RNA, 19 nt, Homo sapiens
gauugaggcauaacuauca

SEQ ID NO: 230561 - RNA, 19 nt, Homo sapiens
guuaaaguaucagugcaaa

SEQ ID NO: 230562 - RNA, 19 nt, Homo sapiens
caaaacaagcuuagcauuu

SEQ ID NO: 230563 - RNA, 19 nt, Homo sapiens
gcucauuauuguuguguca

SEQ ID NO: 230564 - RNA, 19 nt, Homo sapiens
aaggagacaucaucugaau

SEQ ID NO: 230565 - RNA, 19 nt, Homo sapiens
ugaacaaauugccaaauac

SEQ ID NO: 230566 - RNA, 19 nt, Homo sapiens
acaaacucauccauuaaug

SEQ ID NO: 230567 - RNA, 19 nt, Homo sapiens
augcuaagaugcucauuau

SEQ ID NO: 230568 - RNA, 19 nt, Homo sapiens
cauagugauugaggcauaa

SEQ ID NO: 230569 - RNA, 19 nt, Homo sapiens
ugggaaagaucuacaagag

SEQ ID NO: 230570 - RNA, 19 nt, Homo sapiens
gaauaccaaaguagaaugu

SEQ ID NO: 230571 - RNA, 19 nt, Homo sapiens
aagccuguguuacugauuu

SEQ ID NO: 230572 - RNA, 19 nt, Homo sapiens
accuagggcuuaaguauga

SEQ ID NO: 230573 - RNA, 19 nt, Homo sapiens
ucagaugaccucacucaga

SEQ ID NO: 230574 - RNA, 19 nt, Homo sapiens
acccugaaauucuuccaua

SEQ ID NO: 230575 - RNA, 19 nt, Homo sapiens
guucuucuauugugcuuuc

SEQ ID NO: 230576 - RNA, 19 nt, Homo sapiens
guagcaaauuccaauacau

SEQ ID NO: 230577 - RNA, 19 nt, Homo sapiens
gauguagcaaauuccaaua

SEQ ID NO: 230578 - RNA, 19 nt, Homo sapiens
gaaaccugcaacuuuaaug

SEQ ID NO: 230579 - RNA, 19 nt, Homo sapiens
uaaaguaucagugcaaagu

SEQ ID NO: 230580 - RNA, 19 nt, Homo sapiens
caaagccuguguuacugau

SEQ ID NO: 230581 - RNA, 19 nt, Homo sapiens
ggauaugagauguagcaaa

SEQ ID NO: 230582 - RNA, 19 nt, Homo sapiens
aggaugaccucugccagua

SEQ ID NO: 230583 - RNA, 19 nt, Homo sapiens
gcucaauacccaggaguuu

SEQ ID NO: 230584 - RNA, 19 nt, Homo sapiens
agagggaacugggaagaga

SEQ ID NO: 230585 - RNA, 19 nt, Homo sapiens
ggagaccugcuuugggauu

SEQ ID NO: 230586 - RNA, 19 nt, Homo sapiens
gaaaauggagaccugcuuu

SEQ ID NO: 230587 - RNA, 19 nt, Homo sapiens
caaacucauccauuaaugu

SEQ ID NO: 230588 - RNA, 19 nt, Homo sapiens
ucuacaagagccugaauuu

SEQ ID NO: 230589 - RNA, 19 nt, Homo sapiens
auaccaaaguagaauguug

SEQ ID NO: 230590 - RNA, 19 nt, Homo sapiens
auaucugacugcuuuauug

SEQ ID NO: 230591 - RNA, 19 nt, Homo sapiens
auucuuccauagucucuua

SEQ ID NO: 230592 - RNA, 19 nt, Homo sapiens
ucaucugaauaccaaagua

SEQ ID NO: 230593 - RNA, 19 nt, Homo sapiens
guaaaguuugcuuggcaua

SEQ ID NO: 230594 - RNA, 19 nt, Homo sapiens
gaaccucgagaacguaaag

SEQ ID NO: 230595 - RNA, 19 nt, Homo sapiens
acucauccauuaauguaga

SEQ ID NO: 230596 - RNA, 19 nt, Homo sapiens
uaugagugcuaugaccuuu

SEQ ID NO: 230597 - RNA, 19 nt, Homo sapiens
auaaggagacaucaucuga

SEQ ID NO: 230598 - RNA, 19 nt, Homo sapiens
caaauugccaaauacaaag

SEQ ID NO: 230599 - RNA, 19 nt, Homo sapiens
ggcauaauaggaaggauug

SEQ ID NO: 230600 - RNA, 19 nt, Homo sapiens
ugaguuucauagugauuga

SEQ ID NO: 230601 - RNA, 19 nt, Homo sapiens
ucugacugcuuuauugaug

SEQ ID NO: 230602 - RNA, 19 nt, Homo sapiens
uaaaguuugcuuggcauaa

SEQ ID NO: 230603 - RNA, 19 nt, Homo sapiens
ccucgagaacguaaaguuu

SEQ ID NO: 230604 - RNA, 19 nt, Homo sapiens
gaguaagcaccuuuagaau

SEQ ID NO: 230605 - RNA, 19 nt, Homo sapiens
uuuguacguucuucuauug

SEQ ID NO: 230606 - RNA, 19 nt, Homo sapiens
gcuacuaccuggccaauaa

SEQ ID NO: 230607 - RNA, 19 nt, Homo sapiens
gacggagccugaccucuua

SEQ ID NO: 230608 - RNA, 19 nt, Homo sapiens
gaggaugccuucaacuuca

SEQ ID NO: 230609 - RNA, 19 nt, Homo sapiens
ggacggagccugaccucuu

SEQ ID NO: 230610 - RNA, 19 nt, Homo sapiens
ucauguccaucguguguua

SEQ ID NO: 230611 - RNA, 19 nt, Homo sapiens
gaaaucaccaccggucauu

SEQ ID NO: 230612 - RNA, 19 nt, Homo sapiens
ucaaggcgcugcucugaag

SEQ ID NO: 230613 - RNA, 19 nt, Homo sapiens
gggccuggcugggaucuuu

SEQ ID NO: 230614 - RNA, 19 nt, Homo sapiens
agaaggagccggaaucaga

SEQ ID NO: 230615 - RNA, 19 nt, Homo sapiens
gccuucaacuucaacaauu

SEQ ID NO: 230616 - RNA, 19 nt, Homo sapiens
gaaguuugcccgcuacuac

SEQ ID NO: 230617 - RNA, 19 nt, Homo sapiens
ggacccuucuucuccauca

SEQ ID NO: 230618 - RNA, 19 nt, Homo sapiens
ggaaguggagucaguucuu

SEQ ID NO: 230619 - RNA, 19 nt, Homo sapiens
gcaccaugcccuccaccua

SEQ ID NO: 230620 - RNA, 19 nt, Homo sapiens
gagccugccucaccugaag

SEQ ID NO: 230621 - RNA, 19 nt, Homo sapiens
gcucugacccuggaucuug

SEQ ID NO: 230622 - RNA, 19 nt, Homo sapiens
gagccugaccucuuacuuc

SEQ ID NO: 230623 - RNA, 19 nt, Homo sapiens
ggagaaggagccggaauca

SEQ ID NO: 230624 - RNA, 19 nt, Homo sapiens
cucaggagcuggagaccaa

SEQ ID NO: 230625 - RNA, 19 nt, Homo sapiens
gcucuuugccguuucuaau

SEQ ID NO: 230626 - RNA, 19 nt, Homo sapiens
guguuggucuucacaguca

SEQ ID NO: 230627 - RNA, 19 nt, Homo sapiens
cuaccuggccaauaaauca

SEQ ID NO: 230628 - RNA, 19 nt, Homo sapiens
cgaggaugccuucaacuuc

SEQ ID NO: 230629 - RNA, 19 nt, Homo sapiens
ggaaucagagccagaugag

SEQ ID NO: 230630 - RNA, 19 nt, Homo sapiens
ucaccgccaucccguacuu

SEQ ID NO: 230631 - RNA, 19 nt, Homo sapiens
cccuggaacuucuucauca

SEQ ID NO: 230632 - RNA, 19 nt, Homo sapiens
ccuucaacuucaacaauug

SEQ ID NO: 230633 - RNA, 19 nt, Homo sapiens
aggaaaaccuucagucuuc

SEQ ID NO: 230634 - RNA, 19 nt, Homo sapiens
gagcuccuccagucugaug

SEQ ID NO: 230635 - RNA, 19 nt, Homo sapiens
ucaccaccggucauucuaa

SEQ ID NO: 230636 - RNA, 19 nt, Homo sapiens
ccgaggaugccuucaacuu

SEQ ID NO: 230637 - RNA, 19 nt, Homo sapiens
ccucaacuccuuccuguac

SEQ ID NO: 230638 - RNA, 19 nt, Homo sapiens
gcugcuuccuccucuucaa

SEQ ID NO: 230639 - RNA, 19 nt, Homo sapiens
ccugggaaguggagucagu

SEQ ID NO: 230640 - RNA, 19 nt, Homo sapiens
ccauacugcugcucuuugc

SEQ ID NO: 230641 - RNA, 19 nt, Homo sapiens
cggaaucagagccagauga

SEQ ID NO: 230642 - RNA, 19 nt, Homo sapiens
ccucauguccaucgugugu

SEQ ID NO: 230643 - RNA, 19 nt, Homo sapiens
gcucuucacccuccucaac

SEQ ID NO: 230644 - RNA, 19 nt, Homo sapiens
cccacaggaugccuacuuc

SEQ ID NO: 230645 - RNA, 19 nt, Homo sapiens
ggaaaaccuucagucuuca

SEQ ID NO: 230646 - RNA, 19 nt, Homo sapiens
gccauacugcugcucuuug

SEQ ID NO: 230647 - RNA, 19 nt, Homo sapiens
ggccauacugcugcucuuu

SEQ ID NO: 230648 - RNA, 19 nt, Homo sapiens
gagccucccucuccuuccu

SEQ ID NO: 230649 - RNA, 19 nt, Homo sapiens
uaugugggcauccucaugu

SEQ ID NO: 230650 - RNA, 19 nt, Homo sapiens
gaacaucaccuaagagauu

SEQ ID NO: 230651 - RNA, 19 nt, Homo sapiens
gaagaagcaucguuaaagu

SEQ ID NO: 230652 - RNA, 19 nt, Homo sapiens
gaauaaugguaccagauaa

SEQ ID NO: 230653 - RNA, 19 nt, Homo sapiens
gaaugaagcuuguguaucc

SEQ ID NO: 230654 - RNA, 19 nt, Homo sapiens
gguggaagcuacaaugauu

SEQ ID NO: 230655 - RNA, 19 nt, Homo sapiens
ugaagaacaucaccuaaga

SEQ ID NO: 230656 - RNA, 19 nt, Homo sapiens
gaagguaggcuggcagaua

SEQ ID NO: 230657 - RNA, 19 nt, Homo sapiens
ggacuguauuugugacuaa

SEQ ID NO: 230658 - RNA, 19 nt, Homo sapiens
cuacaaagaagacauguuu

SEQ ID NO: 230659 - RNA, 19 nt, Homo sapiens
gcacauccuaugcaauaua

SEQ ID NO: 230660 - RNA, 19 nt, Homo sapiens
gaccaugacuccguggaua

SEQ ID NO: 230661 - RNA, 19 nt, Homo sapiens
uaaagaagacacugaagaa

SEQ ID NO: 230662 - RNA, 19 nt, Homo sapiens
ggauggcuauaauggauuu

SEQ ID NO: 230663 - RNA, 19 nt, Homo sapiens
gaaaagcccugucaaagca

SEQ ID NO: 230664 - RNA, 19 nt, Homo sapiens
ggagguggaugcagcuaug

SEQ ID NO: 230665 - RNA, 19 nt, Homo sapiens
ugaauaaugguaccagaua

SEQ ID NO: 230666 - RNA, 19 nt, Homo sapiens
aaugugcuguguaaaguua

SEQ ID NO: 230667 - RNA, 19 nt, Homo sapiens
guaaagcauuccaacaaag

SEQ ID NO: 230668 - RNA, 19 nt, Homo sapiens
uguaaagcauuccaacaaa

SEQ ID NO: 230669 - RNA, 19 nt, Homo sapiens
agacaaauacucaugugua

SEQ ID NO: 230670 - RNA, 19 nt, Homo sapiens
gcaaugauggaagcaauuu

SEQ ID NO: 230671 - RNA, 19 nt, Homo sapiens
gauauuuguugguggcauu

SEQ ID NO: 230672 - RNA, 19 nt, Homo sapiens
ggguugagcuuugaaacaa

SEQ ID NO: 230673 - RNA, 19 nt, Homo sapiens
gaagcuuguguauccauua

SEQ ID NO: 230674 - RNA, 19 nt, Homo sapiens
gaagacauguuuuagacaa

SEQ ID NO: 230675 - RNA, 19 nt, Homo sapiens
uggcacauccuaugcaaua

SEQ ID NO: 230676 - RNA, 19 nt, Homo sapiens
uauaauggauuuggcaaug

SEQ ID NO: 230677 - RNA, 19 nt, Homo sapiens
ccaacagugugaaguuaga

SEQ ID NO: 230678 - RNA, 19 nt, Homo sapiens
agaagacacugaagaacau

SEQ ID NO: 230679 - RNA, 19 nt, Homo sapiens
gcuuguguauccauuauca

SEQ ID NO: 230680 - RNA, 19 nt, Homo sapiens
guaaugagagauccaaaca

SEQ ID NO: 230681 - RNA, 19 nt, Homo sapiens
gcucacggacuguguggua

SEQ ID NO: 230682 - RNA, 19 nt, Homo sapiens
gcuguugauugcuaaaugu

SEQ ID NO: 230683 - RNA, 19 nt, Homo sapiens
agagauggcuagugcuuca

SEQ ID NO: 230684 - RNA, 19 nt, Homo sapiens
cacauccuaugcaauauau

SEQ ID NO: 230685 - RNA, 19 nt, Homo sapiens
aaaccuugguguaguugaa

SEQ ID NO: 230686 - RNA, 19 nt, Homo sapiens
acagggaagcuacagguua

SEQ ID NO: 230687 - RNA, 19 nt, Homo sapiens
gcaaaaucauggaaugguu

SEQ ID NO: 230688 - RNA, 19 nt, Homo sapiens
cggaaaccuugguguaguu

SEQ ID NO: 230689 - RNA, 19 nt, Homo sapiens
cgaagaagcaucguuaaag

SEQ ID NO: 230690 - RNA, 19 nt, Homo sapiens
gaacucagccaagcacagu

SEQ ID NO: 230691 - RNA, 19 nt, Homo sapiens
aacaucaccuaagagauua

SEQ ID NO: 230692 - RNA, 19 nt, Homo sapiens
gggaaugaagcuuguguau

SEQ ID NO: 230693 - RNA, 19 nt, Homo sapiens
guguaaagcauuccaacaa

SEQ ID NO: 230694 - RNA, 19 nt, Homo sapiens
caagagauggcuagugcuu

SEQ ID NO: 230695 - RNA, 19 nt, Homo sapiens
cagauacguucgucagcuu

SEQ ID NO: 230696 - RNA, 19 nt, Homo sapiens
gaagcuacagguuacaaca

SEQ ID NO: 230697 - RNA, 19 nt, Homo sapiens
ccgaggcaguggcaagaaa

SEQ ID NO: 230698 - RNA, 19 nt, Homo sapiens
gcauuaaagaagacacuga

SEQ ID NO: 230699 - RNA, 19 nt, Homo sapiens
cagggaagcuacagguuac

SEQ ID NO: 230700 - RNA, 19 nt, Homo sapiens
uaauggauuuggcaaugau

SEQ ID NO: 230701 - RNA, 19 nt, Homo sapiens
uuaaagaagacacugaaga

SEQ ID NO: 230702 - RNA, 19 nt, Homo sapiens
ugagagauccaaacaccaa

SEQ ID NO: 230703 - RNA, 19 nt, Homo sapiens
ggaaugaagcuuguguauc

SEQ ID NO: 230704 - RNA, 19 nt, Homo sapiens
ggcagaagauuuuaauuag

SEQ ID NO: 230705 - RNA, 19 nt, Homo sapiens
uaagucagagucuccuaaa

SEQ ID NO: 230706 - RNA, 19 nt, Homo sapiens
ccgaagaagcaucguuaaa

SEQ ID NO: 230707 - RNA, 19 nt, Homo sapiens
uggaaaguguaaagcauuc

SEQ ID NO: 230708 - RNA, 19 nt, Homo sapiens
aagcuuguguauccauuau

SEQ ID NO: 230709 - RNA, 19 nt, Homo sapiens
cgccgaagaagcaucguua

SEQ ID NO: 230710 - RNA, 19 nt, Homo sapiens
agucagagucuccuaaaga

SEQ ID NO: 230711 - RNA, 19 nt, Homo sapiens
gaagaacaucaccuaagag

SEQ ID NO: 230712 - RNA, 19 nt, Homo sapiens
ugaagcuuguguauccauu

SEQ ID NO: 230713 - RNA, 19 nt, Homo sapiens
caaaaucauggaaugguua

SEQ ID NO: 230714 - RNA, 19 nt, Homo sapiens
gguggaggccaauacuuug

SEQ ID NO: 230715 - RNA, 19 nt, Homo sapiens
uuacaacaaucagucuuca

SEQ ID NO: 230716 - RNA, 19 nt, Homo sapiens
gucagagucuccuaaagag

SEQ ID NO: 230717 - RNA, 19 nt, Homo sapiens
ggacugugugguaaugaga

SEQ ID NO: 230718 - RNA, 19 nt, Homo sapiens
aagguaggcuggcagauac

SEQ ID NO: 230719 - RNA, 19 nt, Homo sapiens
caagcaaaaucauggaaug

SEQ ID NO: 230720 - RNA, 19 nt, Homo sapiens
cccaugcuguugauugcua

SEQ ID NO: 230721 - RNA, 19 nt, Homo sapiens
auaauggauuuggcaauga

SEQ ID NO: 230722 - RNA, 19 nt, Homo sapiens
guguauccauuaucaugug

SEQ ID NO: 230723 - RNA, 19 nt, Homo sapiens
guggaaaguguaaagcauu

SEQ ID NO: 230724 - RNA, 19 nt, Homo sapiens
aagaacaucaccuaagaga

SEQ ID NO: 230725 - RNA, 19 nt, Homo sapiens
ggaggguugagcuuugaaa

SEQ ID NO: 230726 - RNA, 19 nt, Homo sapiens
aagccaucuugguaaauuu

SEQ ID NO: 230727 - RNA, 19 nt, Homo sapiens
uuagacaaauacucaugug

SEQ ID NO: 230728 - RNA, 19 nt, Homo sapiens
gcuuugaaacaacugauga

SEQ ID NO: 230729 - RNA, 19 nt, Homo sapiens
aagaagacacugaagaaca

SEQ ID NO: 230730 - RNA, 19 nt, Homo sapiens
cauuaaagaagacacugaa

SEQ ID NO: 230731 - RNA, 19 nt, Homo sapiens
aaacucgaggacuguauuu

SEQ ID NO: 230732 - RNA, 19 nt, Homo sapiens
gaauuacaacaaucagucu

SEQ ID NO: 230733 - RNA, 19 nt, Homo sapiens
uggcaaugauggaagcaau

SEQ ID NO: 230734 - RNA, 19 nt, Homo sapiens
uucgucagcuugcuccuuu

SEQ ID NO: 230735 - RNA, 19 nt, Homo sapiens
gaacgcucacggacugugu

SEQ ID NO: 230736 - RNA, 19 nt, Homo sapiens
guuggcacauccuaugcaa

SEQ ID NO: 230737 - RNA, 19 nt, Homo sapiens
cuaagucagagucuccuaa

SEQ ID NO: 230738 - RNA, 19 nt, Homo sapiens
uaguuucuguucuguggaa

SEQ ID NO: 230739 - RNA, 19 nt, Homo sapiens
ccaugcuguugauugcuaa

SEQ ID NO: 230740 - RNA, 19 nt, Homo sapiens
cuguauuugugacuaauug

SEQ ID NO: 230741 - RNA, 19 nt, Homo sapiens
acccugccgucaugucuaa

SEQ ID NO: 230742 - RNA, 19 nt, Homo sapiens
ggaaaccuugguguaguug

SEQ ID NO: 230743 - RNA, 19 nt, Homo sapiens
gaggagccauuuugagcaa

SEQ ID NO: 230744 - RNA, 19 nt, Homo sapiens
gaaaguguaaagcauucca

SEQ ID NO: 230745 - RNA, 19 nt, Homo sapiens
gugacuaauuguauaacag

SEQ ID NO: 230746 - RNA, 19 nt, Homo sapiens
cuauggcaguggcagaaga

SEQ ID NO: 230747 - RNA, 19 nt, Homo sapiens
ggauuuggcaaugauggaa

SEQ ID NO: 230748 - RNA, 19 nt, Homo sapiens
aagcaucguuaaagucucu

SEQ ID NO: 230749 - RNA, 19 nt, Homo sapiens
gaaccaaagagagcugucu

SEQ ID NO: 230750 - RNA, 19 nt, Homo sapiens
gaacaucaccuaagagauu

SEQ ID NO: 230751 - RNA, 19 nt, Homo sapiens
gaagaagcaucguuaaagu

SEQ ID NO: 230752 - RNA, 19 nt, Homo sapiens
gaauaaugguaccagauaa

SEQ ID NO: 230753 - RNA, 19 nt, Homo sapiens
gaaugaagcuuguguaucc

SEQ ID NO: 230754 - RNA, 19 nt, Homo sapiens
gguggaagcuacaaugauu

SEQ ID NO: 230755 - RNA, 19 nt, Homo sapiens
ugaagaacaucaccuaaga

SEQ ID NO: 230756 - RNA, 19 nt, Homo sapiens
gaagguaggcuggcagaua

SEQ ID NO: 230757 - RNA, 19 nt, Homo sapiens
ggacuguauuugugacuaa

SEQ ID NO: 230758 - RNA, 19 nt, Homo sapiens
cuacaaagaagacauguuu

SEQ ID NO: 230759 - RNA, 19 nt, Homo sapiens
gcacauccuaugcaauaua

SEQ ID NO: 230760 - RNA, 19 nt, Homo sapiens
gaccaugacuccguggaua

SEQ ID NO: 230761 - RNA, 19 nt, Homo sapiens
uaaagaagacacugaagaa

SEQ ID NO: 230762 - RNA, 19 nt, Homo sapiens
ggauggcuauaauggauuu

SEQ ID NO: 230763 - RNA, 19 nt, Homo sapiens
gaaaagcccugucaaagca

SEQ ID NO: 230764 - RNA, 19 nt, Homo sapiens
ggagguggaugcagcuaug

SEQ ID NO: 230765 - RNA, 19 nt, Homo sapiens
ugaauaaugguaccagaua

SEQ ID NO: 230766 - RNA, 19 nt, Homo sapiens
aaugugcuguguaaaguua

SEQ ID NO: 230767 - RNA, 19 nt, Homo sapiens
guaaagcauuccaacaaag

SEQ ID NO: 230768 - RNA, 19 nt, Homo sapiens
uguaaagcauuccaacaaa

SEQ ID NO: 230769 - RNA, 19 nt, Homo sapiens
agacaaauacucaugugua

SEQ ID NO: 230770 - RNA, 19 nt, Homo sapiens
gauauuuguugguggcauu

SEQ ID NO: 230771 - RNA, 19 nt, Homo sapiens
ggguugagcuuugaaacaa

SEQ ID NO: 230772 - RNA, 19 nt, Homo sapiens
gaagcuuguguauccauua

SEQ ID NO: 230773 - RNA, 19 nt, Homo sapiens
gaagacauguuuuagacaa

SEQ ID NO: 230774 - RNA, 19 nt, Homo sapiens
uggcacauccuaugcaaua

SEQ ID NO: 230775 - RNA, 19 nt, Homo sapiens
ggaagcagaggcuauggaa

SEQ ID NO: 230776 - RNA, 19 nt, Homo sapiens
uauaauggauuuggcaaug

SEQ ID NO: 230777 - RNA, 19 nt, Homo sapiens
ccaacagugugaaguuaga

SEQ ID NO: 230778 - RNA, 19 nt, Homo sapiens
gaagugguggacaggguua

SEQ ID NO: 230779 - RNA, 19 nt, Homo sapiens
agaagacacugaagaacau

SEQ ID NO: 230780 - RNA, 19 nt, Homo sapiens
gcuuguguauccauuauca

SEQ ID NO: 230781 - RNA, 19 nt, Homo sapiens
guaaugagagauccaaaca

SEQ ID NO: 230782 - RNA, 19 nt, Homo sapiens
gcucacggacuguguggua

SEQ ID NO: 230783 - RNA, 19 nt, Homo sapiens
gcuguugauugcuaaaugu

SEQ ID NO: 230784 - RNA, 19 nt, Homo sapiens
agagauggcuagugcuuca

SEQ ID NO: 230785 - RNA, 19 nt, Homo sapiens
cacauccuaugcaauauau

SEQ ID NO: 230786 - RNA, 19 nt, Homo sapiens
aaaccuugguguaguugaa

SEQ ID NO: 230787 - RNA, 19 nt, Homo sapiens
acagggaagcuacagguua

SEQ ID NO: 230788 - RNA, 19 nt, Homo sapiens
gcaaaaucauggaaugguu

SEQ ID NO: 230789 - RNA, 19 nt, Homo sapiens
cggaaaccuugguguaguu

SEQ ID NO: 230790 - RNA, 19 nt, Homo sapiens
cgaagaagcaucguuaaag

SEQ ID NO: 230791 - RNA, 19 nt, Homo sapiens
gaacucagccaagcacagu

SEQ ID NO: 230792 - RNA, 19 nt, Homo sapiens
aacaucaccuaagagauua

SEQ ID NO: 230793 - RNA, 19 nt, Homo sapiens
gcuaugacagcuauaacaa

SEQ ID NO: 230794 - RNA, 19 nt, Homo sapiens
gggaaugaagcuuguguau

SEQ ID NO: 230795 - RNA, 19 nt, Homo sapiens
guguaaagcauuccaacaa

SEQ ID NO: 230796 - RNA, 19 nt, Homo sapiens
caaugauggugguuaugga

SEQ ID NO: 230797 - RNA, 19 nt, Homo sapiens
caagagauggcuagugcuu

SEQ ID NO: 230798 - RNA, 19 nt, Homo sapiens
cagauacguucgucagcuu

SEQ ID NO: 230799 - RNA, 19 nt, Homo sapiens
gaagcuacagguuacaaca

SEQ ID NO: 230800 - RNA, 19 nt, Homo sapiens
ccgaggcaguggcaagaaa

SEQ ID NO: 230801 - RNA, 19 nt, Homo sapiens
gcauuaaagaagacacuga

SEQ ID NO: 230802 - RNA, 19 nt, Homo sapiens
cagggaagcuacagguuac

SEQ ID NO: 230803 - RNA, 19 nt, Homo sapiens
ggaggaagcagaggcuaug

SEQ ID NO: 230804 - RNA, 19 nt, Homo sapiens
uaauggauuuggcaaugau

SEQ ID NO: 230805 - RNA, 19 nt, Homo sapiens
uuaaagaagacacugaaga

SEQ ID NO: 230806 - RNA, 19 nt, Homo sapiens
ugagagauccaaacaccaa

SEQ ID NO: 230807 - RNA, 19 nt, Homo sapiens
ggaaugaagcuuguguauc

SEQ ID NO: 230808 - RNA, 19 nt, Homo sapiens
uaagucagagucuccuaaa

SEQ ID NO: 230809 - RNA, 19 nt, Homo sapiens
ggcagaagauuuuaauuag

SEQ ID NO: 230810 - RNA, 19 nt, Homo sapiens
gcaaugauggugguuaugg

SEQ ID NO: 230811 - RNA, 19 nt, Homo sapiens
ccgaagaagcaucguuaaa

SEQ ID NO: 230812 - RNA, 19 nt, Homo sapiens
uggaaaguguaaagcauuc

SEQ ID NO: 230813 - RNA, 19 nt, Homo sapiens
uggcaaugauggugguuau

SEQ ID NO: 230814 - RNA, 19 nt, Homo sapiens
aagcuuguguauccauuau

SEQ ID NO: 230815 - RNA, 19 nt, Homo sapiens
cgccgaagaagcaucguua

SEQ ID NO: 230816 - RNA, 19 nt, Homo sapiens
ggugguaguggaagcaauu

SEQ ID NO: 230817 - RNA, 19 nt, Homo sapiens
agucagagucuccuaaaga

SEQ ID NO: 230818 - RNA, 19 nt, Homo sapiens
gaagaacaucaccuaagag

SEQ ID NO: 230819 - RNA, 19 nt, Homo sapiens
ugaagcuuguguauccauu

SEQ ID NO: 230820 - RNA, 19 nt, Homo sapiens
caaaaucauggaaugguua

SEQ ID NO: 230821 - RNA, 19 nt, Homo sapiens
gguggaggccaauacuuug

SEQ ID NO: 230822 - RNA, 19 nt, Homo sapiens
uuacaacaaucagucuuca

SEQ ID NO: 230823 - RNA, 19 nt, Homo sapiens
gucagagucuccuaaagag

SEQ ID NO: 230824 - RNA, 19 nt, Homo sapiens
ggacugugugguaaugaga

SEQ ID NO: 230825 - RNA, 19 nt, Homo sapiens
aagguaggcuggcagauac

SEQ ID NO: 230826 - RNA, 19 nt, Homo sapiens
caagcaaaaucauggaaug

SEQ ID NO: 230827 - RNA, 19 nt, Homo sapiens
cccaugcuguugauugcua

SEQ ID NO: 230828 - RNA, 19 nt, Homo sapiens
auaauggauuuggcaauga

SEQ ID NO: 230829 - RNA, 19 nt, Homo sapiens
guguauccauuaucaugug

SEQ ID NO: 230830 - RNA, 19 nt, Homo sapiens
guggaaaguguaaagcauu

SEQ ID NO: 230831 - RNA, 19 nt, Homo sapiens
gggaguggcagcuaugaca

SEQ ID NO: 230832 - RNA, 19 nt, Homo sapiens
aagcagaggcuauggaagu

SEQ ID NO: 230833 - RNA, 19 nt, Homo sapiens
aagaacaucaccuaagaga

SEQ ID NO: 230834 - RNA, 19 nt, Homo sapiens
ggaggguugagcuuugaaa

SEQ ID NO: 230835 - RNA, 19 nt, Homo sapiens
aagccaucuugguaaauuu

SEQ ID NO: 230836 - RNA, 19 nt, Homo sapiens
uuagacaaauacucaugug

SEQ ID NO: 230837 - RNA, 19 nt, Homo sapiens
gcuuugaaacaacugauga

SEQ ID NO: 230838 - RNA, 19 nt, Homo sapiens
aagaagacacugaagaaca

SEQ ID NO: 230839 - RNA, 19 nt, Homo sapiens
cauuaaagaagacacugaa

SEQ ID NO: 230840 - RNA, 19 nt, Homo sapiens
aaacucgaggacuguauuu

SEQ ID NO: 230841 - RNA, 19 nt, Homo sapiens
gaauuacaacaaucagucu

SEQ ID NO: 230842 - RNA, 19 nt, Homo sapiens
gaacgcucacggacugugu

SEQ ID NO: 230843 - RNA, 19 nt, Homo sapiens
uucgucagcuugcuccuuu

SEQ ID NO: 230844 - RNA, 19 nt, Homo sapiens
guuggcacauccuaugcaa

SEQ ID NO: 230845 - RNA, 19 nt, Homo sapiens
uaguuucuguucuguggaa

SEQ ID NO: 230846 - RNA, 19 nt, Homo sapiens
cuaagucagagucuccuaa

SEQ ID NO: 230847 - RNA, 19 nt, Homo sapiens
ccaugcuguugauugcuaa

SEQ ID NO: 230848 - RNA, 19 nt, Homo sapiens
cuguauuugugacuaauug

SEQ ID NO: 230849 - RNA, 19 nt, Homo sapiens
ggaaaccuugguguaguug

SEQ ID NO: 230850 - RNA, 19 nt, Homo sapiens
gggcuucacuguauaaaua

SEQ ID NO: 230851 - RNA, 19 nt, Homo sapiens
gaacaucaccuuagagauu

SEQ ID NO: 230852 - RNA, 19 nt, Homo sapiens
gagauuacuuugaggaaua

SEQ ID NO: 230853 - RNA, 19 nt, Homo sapiens
uaaagaagauacugaggaa

SEQ ID NO: 230854 - RNA, 19 nt, Homo sapiens
gcagugauauggcagaaga

SEQ ID NO: 230855 - RNA, 19 nt, Homo sapiens
gaaauaccauaccaucaau

SEQ ID NO: 230856 - RNA, 19 nt, Homo sapiens
cagaacagcuucagguuau

SEQ ID NO: 230857 - RNA, 19 nt, Homo sapiens
aagcauuccuucuuugaua

SEQ ID NO: 230858 - RNA, 19 nt, Homo sapiens
gaaguggaaauuacaauga

SEQ ID NO: 230859 - RNA, 19 nt, Homo sapiens
auacugagcuucuuccuau

SEQ ID NO: 230860 - RNA, 19 nt, Homo sapiens
ccauugagauaauuacuga

SEQ ID NO: 230861 - RNA, 19 nt, Homo sapiens
ggugacaugugaaaccuuu

SEQ ID NO: 230862 - RNA, 19 nt, Homo sapiens
gaugagagcccagagguaa

SEQ ID NO: 230863 - RNA, 19 nt, Homo sapiens
gccaugggcuucacuguau

SEQ ID NO: 230864 - RNA, 19 nt, Homo sapiens
ccaggaucaugguguaaua

SEQ ID NO: 230865 - RNA, 19 nt, Homo sapiens
gacaagaaaugcaggaagu

SEQ ID NO: 230866 - RNA, 19 nt, Homo sapiens
ugcaagaccucauucaauu

SEQ ID NO: 230867 - RNA, 19 nt, Homo sapiens
ggagaguaguugagccaaa

SEQ ID NO: 230868 - RNA, 19 nt, Homo sapiens
gaacuacuacgaacaaugg

SEQ ID NO: 230869 - RNA, 19 nt, Homo sapiens
ucucagucaugcauaaaua

SEQ ID NO: 230870 - RNA, 19 nt, Homo sapiens
uaacuacgguccaaugaag

SEQ ID NO: 230871 - RNA, 19 nt, Homo sapiens
ggaggcaacuuuggcuuug

SEQ ID NO: 230872 - RNA, 19 nt, Homo sapiens
guaagaguguagaagcauu

SEQ ID NO: 230873 - RNA, 19 nt, Homo sapiens
gagacaguuucuuagcuuu

SEQ ID NO: 230874 - RNA, 19 nt, Homo sapiens
aaugaagaguggaaacuuu

SEQ ID NO: 230875 - RNA, 19 nt, Homo sapiens
gauaggcagucuggaaaga

SEQ ID NO: 230876 - RNA, 19 nt, Homo sapiens
ugaggaacaucaccuuaga

SEQ ID NO: 230877 - RNA, 19 nt, Homo sapiens
ggaucaugguguaauaaga

SEQ ID NO: 230878 - RNA, 19 nt, Homo sapiens
aacaucaccuuagagauua

SEQ ID NO: 230879 - RNA, 19 nt, Homo sapiens
gcucuuuauugguggcuua

SEQ ID NO: 230880 - RNA, 19 nt, Homo sapiens
aggaggaucugauggauau

SEQ ID NO: 230881 - RNA, 19 nt, Homo sapiens
gugaagaagcuguuuguug

SEQ ID NO: 230882 - RNA, 19 nt, Homo sapiens
gcagagagccauuuuguga

SEQ ID NO: 230883 - RNA, 19 nt, Homo sapiens
ggaagaggaggcaacuuug

SEQ ID NO: 230884 - RNA, 19 nt, Homo sapiens
caagaccucauucaauuga

SEQ ID NO: 230885 - RNA, 19 nt, Homo sapiens
gagggauccugcaagcaaa

SEQ ID NO: 230886 - RNA, 19 nt, Homo sapiens
gcccagagguaacagaaca

SEQ ID NO: 230887 - RNA, 19 nt, Homo sapiens
ccagcaaccuucuaacuac

SEQ ID NO: 230888 - RNA, 19 nt, Homo sapiens
caagagaggaaucuggaaa

SEQ ID NO: 230889 - RNA, 19 nt, Homo sapiens
gcaagaccucauucaauug

SEQ ID NO: 230890 - RNA, 19 nt, Homo sapiens
ugagacaguuucuuagcuu

SEQ ID NO: 230891 - RNA, 19 nt, Homo sapiens
ggaaguggaaauuacaaug

SEQ ID NO: 230892 - RNA, 19 nt, Homo sapiens
gaaauuauggaaguggaaa

SEQ ID NO: 230893 - RNA, 19 nt, Homo sapiens
ggaccaggaccaggaagua

SEQ ID NO: 230894 - RNA, 19 nt, Homo sapiens
gaacaauggggaaagcuua

SEQ ID NO: 230895 - RNA, 19 nt, Homo sapiens
gaaguucagaguucuagga

SEQ ID NO: 230896 - RNA, 19 nt, Homo sapiens
caaaagaucaagaggauuu

SEQ ID NO: 230897 - RNA, 19 nt, Homo sapiens
agaaauaccauaccaucaa

SEQ ID NO: 230898 - RNA, 19 nt, Homo sapiens
gaagacaccagagcagaug

SEQ ID NO: 230899 - RNA, 19 nt, Homo sapiens
acagaacagcuucagguua

SEQ ID NO: 230900 - RNA, 19 nt, Homo sapiens
gcuuuggcuuuguuacuuu

SEQ ID NO: 230901 - RNA, 19 nt, Homo sapiens
gaucaagaggauuugguuu

SEQ ID NO: 230902 - RNA, 19 nt, Homo sapiens
gaggaacuacuacgaacaa

SEQ ID NO: 230903 - RNA, 19 nt, Homo sapiens
gcuucagguuaucgaaaua

SEQ ID NO: 230904 - RNA, 19 nt, Homo sapiens
gaggaggaucugauggaua

SEQ ID NO: 230905 - RNA, 19 nt, Homo sapiens
cagaagaaaguuugaggaa

SEQ ID NO: 230906 - RNA, 19 nt, Homo sapiens
ggaggaaauuauggaagug

SEQ ID NO: 230907 - RNA, 19 nt, Homo sapiens
ggauggcuauaauggguau

SEQ ID NO: 230908 - RNA, 19 nt, Homo sapiens
uggaagaggaggcaacuuu

SEQ ID NO: 230909 - RNA, 19 nt, Homo sapiens
uagccaggaucauggugua

SEQ ID NO: 230910 - RNA, 19 nt, Homo sapiens
caucaauggucauaaugca

SEQ ID NO: 230911 - RNA, 19 nt, Homo sapiens
uaggcagucuggaaagaaa

SEQ ID NO: 230912 - RNA, 19 nt, Homo sapiens
ggucauaaugcagaaguaa

SEQ ID NO: 230913 - RNA, 19 nt, Homo sapiens
ccuuugagacaguuucuua

SEQ ID NO: 230914 - RNA, 19 nt, Homo sapiens
aggaaacucuuaucucagu

SEQ ID NO: 230915 - RNA, 19 nt, Homo sapiens
gcaggaaguucagaguucu

SEQ ID NO: 230916 - RNA, 19 nt, Homo sapiens
ggaugagagcccagaggua

SEQ ID NO: 230917 - RNA, 19 nt, Homo sapiens
ccaugggcuucacuguaua

SEQ ID NO: 230918 - RNA, 19 nt, Homo sapiens
gauacugagcuucuuccua

SEQ ID NO: 230919 - RNA, 19 nt, Homo sapiens
gaagaggaggcaacuuugg

SEQ ID NO: 230920 - RNA, 19 nt, Homo sapiens
gcuguuuguuggcggaauu

SEQ ID NO: 230921 - RNA, 19 nt, Homo sapiens
aguggaaacuuugguggua

SEQ ID NO: 230922 - RNA, 19 nt, Homo sapiens
ggaaauuauggaaguggaa

SEQ ID NO: 230923 - RNA, 19 nt, Homo sapiens
ggaggaggaaauuauggaa

SEQ ID NO: 230924 - RNA, 19 nt, Homo sapiens
gaccaggaccaggaaguaa

SEQ ID NO: 230925 - RNA, 19 nt, Homo sapiens
gaaacucuuaucucaguca

SEQ ID NO: 230926 - RNA, 19 nt, Homo sapiens
cuacggaggugguuaugac

SEQ ID NO: 230927 - RNA, 19 nt, Homo sapiens
ggaggaagaggaggauaug

SEQ ID NO: 230928 - RNA, 19 nt, Homo sapiens
gggcucauguaacugugaa

SEQ ID NO: 230929 - RNA, 19 nt, Homo sapiens
gagaguaguugagccaaaa

SEQ ID NO: 230930 - RNA, 19 nt, Homo sapiens
ggaacuacuacgaacaaug

SEQ ID NO: 230931 - RNA, 19 nt, Homo sapiens
caugguguaauaagacaua

SEQ ID NO: 230932 - RNA, 19 nt, Homo sapiens
uccguaagcucuuuauugg

SEQ ID NO: 230933 - RNA, 19 nt, Homo sapiens
ccuuagagauuacuuugag

SEQ ID NO: 230934 - RNA, 19 nt, Homo sapiens
guaaugagggauccugcaa

SEQ ID NO: 230935 - RNA, 19 nt, Homo sapiens
ucauaaugcagaaguaaga

SEQ ID NO: 230936 - RNA, 19 nt, Homo sapiens
gcaagagaggaaucuggaa

SEQ ID NO: 230937 - RNA, 19 nt, Homo sapiens
guaaguuucaggugacaug

SEQ ID NO: 230938 - RNA, 19 nt, Homo sapiens
caagaaaugcaggaaguuc

SEQ ID NO: 230939 - RNA, 19 nt, Homo sapiens
ucauguaacugugaagaag

SEQ ID NO: 230940 - RNA, 19 nt, Homo sapiens
ugagggauccugcaagcaa

SEQ ID NO: 230941 - RNA, 19 nt, Homo sapiens
ggcuuuggcuuuguuacuu

SEQ ID NO: 230942 - RNA, 19 nt, Homo sapiens
ugaaaccacagaagaaagu

SEQ ID NO: 230943 - RNA, 19 nt, Homo sapiens
caacuauggaggaggaaau

SEQ ID NO: 230944 - RNA, 19 nt, Homo sapiens
gaaaugcaggaaguucaga

SEQ ID NO: 230945 - RNA, 19 nt, Homo sapiens
ugagauaauuacugauagg

SEQ ID NO: 230946 - RNA, 19 nt, Homo sapiens
ggaauuaaagaagauacug

SEQ ID NO: 230947 - RNA, 19 nt, Homo sapiens
gaucaugguguaauaagac

SEQ ID NO: 230948 - RNA, 19 nt, Homo sapiens
gcagaugcagagagccauu

SEQ ID NO: 230949 - RNA, 19 nt, Homo sapiens
gcuccucgcagaguuguuu

SEQ ID NO: 230950 - RNA, 19 nt, Homo sapiens
gggcuucacuguauaaaua

SEQ ID NO: 230951 - RNA, 19 nt, Homo sapiens
gaacaucaccuuagagauu

SEQ ID NO: 230952 - RNA, 19 nt, Homo sapiens
gagauuacuuugaggaaua

SEQ ID NO: 230953 - RNA, 19 nt, Homo sapiens
uaaagaagauacugaggaa

SEQ ID NO: 230954 - RNA, 19 nt, Homo sapiens
gcagugauauggcagaaga

SEQ ID NO: 230955 - RNA, 19 nt, Homo sapiens
gaaauaccauaccaucaau

SEQ ID NO: 230956 - RNA, 19 nt, Homo sapiens
cagaacagcuucagguuau

SEQ ID NO: 230957 - RNA, 19 nt, Homo sapiens
aagcauuccuucuuugaua

SEQ ID NO: 230958 - RNA, 19 nt, Homo sapiens
gaaguggaaauuacaauga

SEQ ID NO: 230959 - RNA, 19 nt, Homo sapiens
auacugagcuucuuccuau

SEQ ID NO: 230960 - RNA, 19 nt, Homo sapiens
ccauugagauaauuacuga

SEQ ID NO: 230961 - RNA, 19 nt, Homo sapiens
ggugacaugugaaaccuuu

SEQ ID NO: 230962 - RNA, 19 nt, Homo sapiens
gaugagagcccagagguaa

SEQ ID NO: 230963 - RNA, 19 nt, Homo sapiens
gccaugggcuucacuguau

SEQ ID NO: 230964 - RNA, 19 nt, Homo sapiens
ccaggaucaugguguaaua

SEQ ID NO: 230965 - RNA, 19 nt, Homo sapiens
gacaagaaaugcaggaagu

SEQ ID NO: 230966 - RNA, 19 nt, Homo sapiens
ugcaagaccucauucaauu

SEQ ID NO: 230967 - RNA, 19 nt, Homo sapiens
ggagaguaguugagccaaa

SEQ ID NO: 230968 - RNA, 19 nt, Homo sapiens
gaacuacuacgaacaaugg

SEQ ID NO: 230969 - RNA, 19 nt, Homo sapiens
ucucagucaugcauaaaua

SEQ ID NO: 230970 - RNA, 19 nt, Homo sapiens
uaacuacgguccaaugaag

SEQ ID NO: 230971 - RNA, 19 nt, Homo sapiens
ggagaaaacuuuagaaacu

SEQ ID NO: 230972 - RNA, 19 nt, Homo sapiens
ggaggcaacuuuggcuuug

SEQ ID NO: 230973 - RNA, 19 nt, Homo sapiens
guaagaguguagaagcauu

SEQ ID NO: 230974 - RNA, 19 nt, Homo sapiens
gagacaguuucuuagcuuu

SEQ ID NO: 230975 - RNA, 19 nt, Homo sapiens
aaugaagaguggaaacuuu

SEQ ID NO: 230976 - RNA, 19 nt, Homo sapiens
gauaggcagucuggaaaga

SEQ ID NO: 230977 - RNA, 19 nt, Homo sapiens
ugaggaacaucaccuuaga

SEQ ID NO: 230978 - RNA, 19 nt, Homo sapiens
ggaucaugguguaauaaga

SEQ ID NO: 230979 - RNA, 19 nt, Homo sapiens
aacaucaccuuagagauua

SEQ ID NO: 230980 - RNA, 19 nt, Homo sapiens
gcucuuuauugguggcuua

SEQ ID NO: 230981 - RNA, 19 nt, Homo sapiens
aggaggaucugauggauau

SEQ ID NO: 230982 - RNA, 19 nt, Homo sapiens
gugaagaagcuguuuguug

SEQ ID NO: 230983 - RNA, 19 nt, Homo sapiens
gcagagagccauuuuguga

SEQ ID NO: 230984 - RNA, 19 nt, Homo sapiens
ggaagaggaggcaacuuug

SEQ ID NO: 230985 - RNA, 19 nt, Homo sapiens
caagaccucauucaauuga

SEQ ID NO: 230986 - RNA, 19 nt, Homo sapiens
gagggauccugcaagcaaa

SEQ ID NO: 230987 - RNA, 19 nt, Homo sapiens
uuuagaaacuguuccuuug

SEQ ID NO: 230988 - RNA, 19 nt, Homo sapiens
gcccagagguaacagaaca

SEQ ID NO: 230989 - RNA, 19 nt, Homo sapiens
ccagcaaccuucuaacuac

SEQ ID NO: 230990 - RNA, 19 nt, Homo sapiens
caagagaggaaucuggaaa

SEQ ID NO: 230991 - RNA, 19 nt, Homo sapiens
gcaagaccucauucaauug

SEQ ID NO: 230992 - RNA, 19 nt, Homo sapiens
ugagacaguuucuuagcuu

SEQ ID NO: 230993 - RNA, 19 nt, Homo sapiens
ggaaguggaaauuacaaug

SEQ ID NO: 230994 - RNA, 19 nt, Homo sapiens
gaaauuauggaaguggaaa

SEQ ID NO: 230995 - RNA, 19 nt, Homo sapiens
ggaccaggaccaggaagua

SEQ ID NO: 230996 - RNA, 19 nt, Homo sapiens
gaacaauggggaaagcuua

SEQ ID NO: 230997 - RNA, 19 nt, Homo sapiens
gaaguucagaguucuagga

SEQ ID NO: 230998 - RNA, 19 nt, Homo sapiens
caaaagaucaagaggauuu

SEQ ID NO: 230999 - RNA, 19 nt, Homo sapiens
uagaaacuguuccuuugga

SEQ ID NO: 231000 - RNA, 19 nt, Homo sapiens
agaaauaccauaccaucaa

SEQ ID NO: 231001 - RNA, 19 nt, Homo sapiens
gaagacaccagagcagaug

SEQ ID NO: 231002 - RNA, 19 nt, Homo sapiens
acagaacagcuucagguua

SEQ ID NO: 231003 - RNA, 19 nt, Homo sapiens
gcuuuggcuuuguuacuuu

SEQ ID NO: 231004 - RNA, 19 nt, Homo sapiens
gaucaagaggauuugguuu

SEQ ID NO: 231005 - RNA, 19 nt, Homo sapiens
gaggaacuacuacgaacaa

SEQ ID NO: 231006 - RNA, 19 nt, Homo sapiens
gcuucagguuaucgaaaua

SEQ ID NO: 231007 - RNA, 19 nt, Homo sapiens
gaggaggaucugauggaua

SEQ ID NO: 231008 - RNA, 19 nt, Homo sapiens
cagaagaaaguuugaggaa

SEQ ID NO: 231009 - RNA, 19 nt, Homo sapiens
ggaggaaauuauggaagug

SEQ ID NO: 231010 - RNA, 19 nt, Homo sapiens
ggauggcuauaauggguau

SEQ ID NO: 231011 - RNA, 19 nt, Homo sapiens
uggaagaggaggcaacuuu

SEQ ID NO: 231012 - RNA, 19 nt, Homo sapiens
uagccaggaucauggugua

SEQ ID NO: 231013 - RNA, 19 nt, Homo sapiens
caucaauggucauaaugca

SEQ ID NO: 231014 - RNA, 19 nt, Homo sapiens
uaggcagucuggaaagaaa

SEQ ID NO: 231015 - RNA, 19 nt, Homo sapiens
ggucauaaugcagaaguaa

SEQ ID NO: 231016 - RNA, 19 nt, Homo sapiens
ccuuugagacaguuucuua

SEQ ID NO: 231017 - RNA, 19 nt, Homo sapiens
aggaaacucuuaucucagu

SEQ ID NO: 231018 - RNA, 19 nt, Homo sapiens
gcaggaaguucagaguucu

SEQ ID NO: 231019 - RNA, 19 nt, Homo sapiens
ggaugagagcccagaggua

SEQ ID NO: 231020 - RNA, 19 nt, Homo sapiens
ccaugggcuucacuguaua

SEQ ID NO: 231021 - RNA, 19 nt, Homo sapiens
gauacugagcuucuuccua

SEQ ID NO: 231022 - RNA, 19 nt, Homo sapiens
gaagaggaggcaacuuugg

SEQ ID NO: 231023 - RNA, 19 nt, Homo sapiens
gcuguuuguuggcggaauu

SEQ ID NO: 231024 - RNA, 19 nt, Homo sapiens
aguggaaacuuugguggua

SEQ ID NO: 231025 - RNA, 19 nt, Homo sapiens
ggaaauuauggaaguggaa

SEQ ID NO: 231026 - RNA, 19 nt, Homo sapiens
ggaggaggaaauuauggaa

SEQ ID NO: 231027 - RNA, 19 nt, Homo sapiens
gaccaggaccaggaaguaa

SEQ ID NO: 231028 - RNA, 19 nt, Homo sapiens
gaaacucuuaucucaguca

SEQ ID NO: 231029 - RNA, 19 nt, Homo sapiens
cuacggaggugguuaugac

SEQ ID NO: 231030 - RNA, 19 nt, Homo sapiens
ggaggaagaggaggauaug

SEQ ID NO: 231031 - RNA, 19 nt, Homo sapiens
gggcucauguaacugugaa

SEQ ID NO: 231032 - RNA, 19 nt, Homo sapiens
gagaguaguugagccaaaa

SEQ ID NO: 231033 - RNA, 19 nt, Homo sapiens
ggaacuacuacgaacaaug

SEQ ID NO: 231034 - RNA, 19 nt, Homo sapiens
caugguguaauaagacaua

SEQ ID NO: 231035 - RNA, 19 nt, Homo sapiens
uccguaagcucuuuauugg

SEQ ID NO: 231036 - RNA, 19 nt, Homo sapiens
ccuuagagauuacuuugag

SEQ ID NO: 231037 - RNA, 19 nt, Homo sapiens
guaaugagggauccugcaa

SEQ ID NO: 231038 - RNA, 19 nt, Homo sapiens
ucauaaugcagaaguaaga

SEQ ID NO: 231039 - RNA, 19 nt, Homo sapiens
gcaagagaggaaucuggaa

SEQ ID NO: 231040 - RNA, 19 nt, Homo sapiens
guaaguuucaggugacaug

SEQ ID NO: 231041 - RNA, 19 nt, Homo sapiens
caagaaaugcaggaaguuc

SEQ ID NO: 231042 - RNA, 19 nt, Homo sapiens
ucauguaacugugaagaag

SEQ ID NO: 231043 - RNA, 19 nt, Homo sapiens
ugagggauccugcaagcaa

SEQ ID NO: 231044 - RNA, 19 nt, Homo sapiens
ggcuuuggcuuuguuacuu

SEQ ID NO: 231045 - RNA, 19 nt, Homo sapiens
caacuauggaggaggaaau

SEQ ID NO: 231046 - RNA, 19 nt, Homo sapiens
gaaaugcaggaaguucaga

SEQ ID NO: 231047 - RNA, 19 nt, Homo sapiens
ugagauaauuacugauagg

SEQ ID NO: 231048 - RNA, 19 nt, Homo sapiens
ggaauuaaagaagauacug

SEQ ID NO: 231049 - RNA, 19 nt, Homo sapiens
ugaaaccacagaagaaagu

SEQ ID NO: 231050 - RNA, 19 nt, Homo sapiens
ggaaaucacucuccuguug

SEQ ID NO: 231051 - RNA, 19 nt, Homo sapiens
ggacggagcuuggcuguug

SEQ ID NO: 231052 - RNA, 19 nt, Homo sapiens
ggaaaccagugucaccuuu

SEQ ID NO: 231053 - RNA, 19 nt, Homo sapiens
gccaauggauccaaaguug

SEQ ID NO: 231054 - RNA, 19 nt, Homo sapiens
ggaguacuuuggcgaguuu

SEQ ID NO: 231055 - RNA, 19 nt, Homo sapiens
ggagugaacacaauuaugu

SEQ ID NO: 231056 - RNA, 19 nt, Homo sapiens
ucaagaggguuuggguuua

SEQ ID NO: 231057 - RNA, 19 nt, Homo sapiens
gauauggagugaacacaau

SEQ ID NO: 231058 - RNA, 19 nt, Homo sapiens
ggccugagcugggauacua

SEQ ID NO: 231059 - RNA, 19 nt, Homo sapiens
gucguugacuguacaauaa

SEQ ID NO: 231060 - RNA, 19 nt, Homo sapiens
gagcugggauacuagcaaa

SEQ ID NO: 231061 - RNA, 19 nt, Homo sapiens
ccagagcucuagguguuua

SEQ ID NO: 231062 - RNA, 19 nt, Homo sapiens
ccaugugcaucuuauuuaa

SEQ ID NO: 231063 - RNA, 19 nt, Homo sapiens
gaacacaauuauguaccaa

SEQ ID NO: 231064 - RNA, 19 nt, Homo sapiens
ggaagcaagugugagauca

SEQ ID NO: 231065 - RNA, 19 nt, Homo sapiens
gaaaucacucuccuguuga

SEQ ID NO: 231066 - RNA, 19 nt, Homo sapiens
ucgcacacaugcuuuguuu

SEQ ID NO: 231067 - RNA, 19 nt, Homo sapiens
caagaggguuuggguuuau

SEQ ID NO: 231068 - RNA, 19 nt, Homo sapiens
aagaagaacccgugaagaa

SEQ ID NO: 231069 - RNA, 19 nt, Homo sapiens
gggaaucuaauguauugua

SEQ ID NO: 231070 - RNA, 19 nt, Homo sapiens
uaacuuggcaaacuuucua

SEQ ID NO: 231071 - RNA, 19 nt, Homo sapiens
caagggagcgaccaacuga

SEQ ID NO: 231072 - RNA, 19 nt, Homo sapiens
ggucguugacuguacaaua

SEQ ID NO: 231073 - RNA, 19 nt, Homo sapiens
gcacacaugcuuuguuugg

SEQ ID NO: 231074 - RNA, 19 nt, Homo sapiens
gauugaggccauugaauug

SEQ ID NO: 231075 - RNA, 19 nt, Homo sapiens
gaaagucccacugaggaaa

SEQ ID NO: 231076 - RNA, 19 nt, Homo sapiens
gaagaagaacccgugaaga

SEQ ID NO: 231077 - RNA, 19 nt, Homo sapiens
gauccaaaguugaacaaaa

SEQ ID NO: 231078 - RNA, 19 nt, Homo sapiens
gguuuauccuguucaaaga

SEQ ID NO: 231079 - RNA, 19 nt, Homo sapiens
uugggaaucuaauguauug

SEQ ID NO: 231080 - RNA, 19 nt, Homo sapiens
ucacucuccuguugacuau

SEQ ID NO: 231081 - RNA, 19 nt, Homo sapiens
cacaugcuuuguuuggaua

SEQ ID NO: 231082 - RNA, 19 nt, Homo sapiens
uaacuacaagccauacuga

SEQ ID NO: 231083 - RNA, 19 nt, Homo sapiens
caauggauccaaaguugaa

SEQ ID NO: 231084 - RNA, 19 nt, Homo sapiens
gagugaacacaauuaugua

SEQ ID NO: 231085 - RNA, 19 nt, Homo sapiens
ggagaggucguugacugua

SEQ ID NO: 231086 - RNA, 19 nt, Homo sapiens
uuccagagcucuagguguu

SEQ ID NO: 231087 - RNA, 19 nt, Homo sapiens
ggagauugaggccauugaa

SEQ ID NO: 231088 - RNA, 19 nt, Homo sapiens
acucuccuguugacuauuu

SEQ ID NO: 231089 - RNA, 19 nt, Homo sapiens
ggauauggagugaacacaa

SEQ ID NO: 231090 - RNA, 19 nt, Homo sapiens
gaucaacgccagcaagaac

SEQ ID NO: 231091 - RNA, 19 nt, Homo sapiens
gaagcaagugugagaucaa

SEQ ID NO: 231092 - RNA, 19 nt, Homo sapiens
ucuauugccugucccaugu

SEQ ID NO: 231093 - RNA, 19 nt, Homo sapiens
ccauggcuaugaagaagga

SEQ ID NO: 231094 - RNA, 19 nt, Homo sapiens
gucaagaggguuuggguuu

SEQ ID NO: 231095 - RNA, 19 nt, Homo sapiens
acacaugcuuuguuuggau

SEQ ID NO: 231096 - RNA, 19 nt, Homo sapiens
cccaugugcaucuuauuua

SEQ ID NO: 231097 - RNA, 19 nt, Homo sapiens
gugguggccaucagaauaa

SEQ ID NO: 231098 - RNA, 19 nt, Homo sapiens
agauugaggccauugaauu

SEQ ID NO: 231099 - RNA, 19 nt, Homo sapiens
gggaguacuuuggcgaguu

SEQ ID NO: 231100 - RNA, 19 nt, Homo sapiens
ggaggaggagacacaguug

SEQ ID NO: 231101 - RNA, 19 nt, Homo sapiens
gagaggucguugacuguac

SEQ ID NO: 231102 - RNA, 19 nt, Homo sapiens
agaauaacuacaagccaua

SEQ ID NO: 231103 - RNA, 19 nt, Homo sapiens
ggacccugguuguaaagag

SEQ ID NO: 231104 - RNA, 19 nt, Homo sapiens
cgugguggccaucagaaua

SEQ ID NO: 231105 - RNA, 19 nt, Homo sapiens
caagguggcccagcccaaa

SEQ ID NO: 231106 - RNA, 19 nt, Homo sapiens
ucaaagaugcagccagugu

SEQ ID NO: 231107 - RNA, 19 nt, Homo sapiens
uguggacccugguuguaaa

SEQ ID NO: 231108 - RNA, 19 nt, Homo sapiens
ucuaucagcagcagcagua

SEQ ID NO: 231109 - RNA, 19 nt, Homo sapiens
ggccauggcuaugaagaag

SEQ ID NO: 231110 - RNA, 19 nt, Homo sapiens
ugaacacaauuauguacca

SEQ ID NO: 231111 - RNA, 19 nt, Homo sapiens
ggaggucaggguaguacaa

SEQ ID NO: 231112 - RNA, 19 nt, Homo sapiens
gcaagugugagaucaaggu

SEQ ID NO: 231113 - RNA, 19 nt, Homo sapiens
gagauugaggccauugaau

SEQ ID NO: 231114 - RNA, 19 nt, Homo sapiens
ccaaggaggaggagacaca

SEQ ID NO: 231115 - RNA, 19 nt, Homo sapiens
ggcagcguguggugucuga

SEQ ID NO: 231116 - RNA, 19 nt, Homo sapiens
uauggagugaacacaauua

SEQ ID NO: 231117 - RNA, 19 nt, Homo sapiens
ccaauggauccaaaguuga

SEQ ID NO: 231118 - RNA, 19 nt, Homo sapiens
gacccugguuguaaagagu

SEQ ID NO: 231119 - RNA, 19 nt, Homo sapiens
gguuuggguuuauccuguu

SEQ ID NO: 231120 - RNA, 19 nt, Homo sapiens
aagacgagguuuuguguuu

SEQ ID NO: 231121 - RNA, 19 nt, Homo sapiens
gguuguaaagaguaaauug

SEQ ID NO: 231122 - RNA, 19 nt, Homo sapiens
ggguuuauccuguucaaag

SEQ ID NO: 231123 - RNA, 19 nt, Homo sapiens
gccaucagaauaacuacaa

SEQ ID NO: 231124 - RNA, 19 nt, Homo sapiens
cagaucaacgccagcaaga

SEQ ID NO: 231125 - RNA, 19 nt, Homo sapiens
gaggucaggguaguacaaa

SEQ ID NO: 231126 - RNA, 19 nt, Homo sapiens
ugaaagucccacugaggaa

SEQ ID NO: 231127 - RNA, 19 nt, Homo sapiens
ucccaugugcaucuuauuu

SEQ ID NO: 231128 - RNA, 19 nt, Homo sapiens
ccaccgagaacggacauga

SEQ ID NO: 231129 - RNA, 19 nt, Homo sapiens
uuacacguguccugauuuu

SEQ ID NO: 231130 - RNA, 19 nt, Homo sapiens
agaagaagaacccgugaag

SEQ ID NO: 231131 - RNA, 19 nt, Homo sapiens
aaaaggccauggcuaugaa

SEQ ID NO: 231132 - RNA, 19 nt, Homo sapiens
uaucuuaggaaaccagugu

SEQ ID NO: 231133 - RNA, 19 nt, Homo sapiens
gcuggauggccgugucauu

SEQ ID NO: 231134 - RNA, 19 nt, Homo sapiens
gaauaacuacaagccauac

SEQ ID NO: 231135 - RNA, 19 nt, Homo sapiens
ucaguggaagcaaguguga

SEQ ID NO: 231136 - RNA, 19 nt, Homo sapiens
agacgagguuuuguguuua

SEQ ID NO: 231137 - RNA, 19 nt, Homo sapiens
aggaaaagaucagggagua

SEQ ID NO: 231138 - RNA, 19 nt, Homo sapiens
gaaaccagugucaccuuuu

SEQ ID NO: 231139 - RNA, 19 nt, Homo sapiens
ccaagggagcgaccaacug

SEQ ID NO: 231140 - RNA, 19 nt, Homo sapiens
cgacgugguggccaucaga

SEQ ID NO: 231141 - RNA, 19 nt, Homo sapiens
aagaacccgugaagaaggu

SEQ ID NO: 231142 - RNA, 19 nt, Homo sapiens
gggucugaauccugaaagu

SEQ ID NO: 231143 - RNA, 19 nt, Homo sapiens
agaagaacccgugaagaag

SEQ ID NO: 231144 - RNA, 19 nt, Homo sapiens
cagccaguguggagaaggu

SEQ ID NO: 231145 - RNA, 19 nt, Homo sapiens
ugucccaugugcaucuuau

SEQ ID NO: 231146 - RNA, 19 nt, Homo sapiens
guuuggauauggagugaac

SEQ ID NO: 231147 - RNA, 19 nt, Homo sapiens
guggccaucagaauaacua

SEQ ID NO: 231148 - RNA, 19 nt, Homo sapiens
ggucaggguaguacaaacu

SEQ ID NO: 231149 - RNA, 19 nt, Homo sapiens
aagcaagugugagaucaag

SEQ ID NO: 231150 - RNA, 19 nt, Homo sapiens
ggaaaucacucuccuguug

SEQ ID NO: 231151 - RNA, 19 nt, Homo sapiens
ggacggagcuuggcuguug

SEQ ID NO: 231152 - RNA, 19 nt, Homo sapiens
ggaaaccagugucaccuuu

SEQ ID NO: 231153 - RNA, 19 nt, Homo sapiens
gccaauggauccaaaguug

SEQ ID NO: 231154 - RNA, 19 nt, Homo sapiens
ggaguacuuuggcgaguuu

SEQ ID NO: 231155 - RNA, 19 nt, Homo sapiens
ggagugaacacaauuaugu

SEQ ID NO: 231156 - RNA, 19 nt, Homo sapiens
ucaagaggguuuggguuua

SEQ ID NO: 231157 - RNA, 19 nt, Homo sapiens
gauauggagugaacacaau

SEQ ID NO: 231158 - RNA, 19 nt, Homo sapiens
ggccugagcugggauacua

SEQ ID NO: 231159 - RNA, 19 nt, Homo sapiens
gucguugacuguacaauaa

SEQ ID NO: 231160 - RNA, 19 nt, Homo sapiens
gagcugggauacuagcaaa

SEQ ID NO: 231161 - RNA, 19 nt, Homo sapiens
ccagagcucuagguguuua

SEQ ID NO: 231162 - RNA, 19 nt, Homo sapiens
ccaugugcaucuuauuuaa

SEQ ID NO: 231163 - RNA, 19 nt, Homo sapiens
gaacacaauuauguaccaa

SEQ ID NO: 231164 - RNA, 19 nt, Homo sapiens
ggaagcaagugugagauca

SEQ ID NO: 231165 - RNA, 19 nt, Homo sapiens
gaaaucacucuccuguuga

SEQ ID NO: 231166 - RNA, 19 nt, Homo sapiens
ucgcacacaugcuuuguuu

SEQ ID NO: 231167 - RNA, 19 nt, Homo sapiens
caagaggguuuggguuuau

SEQ ID NO: 231168 - RNA, 19 nt, Homo sapiens
aagaagaacccgugaagaa

SEQ ID NO: 231169 - RNA, 19 nt, Homo sapiens
gggaaucuaauguauugua

SEQ ID NO: 231170 - RNA, 19 nt, Homo sapiens
uaacuuggcaaacuuucua

SEQ ID NO: 231171 - RNA, 19 nt, Homo sapiens
caagggagcgaccaacuga

SEQ ID NO: 231172 - RNA, 19 nt, Homo sapiens
ggucguugacuguacaaua

SEQ ID NO: 231173 - RNA, 19 nt, Homo sapiens
gcacacaugcuuuguuugg

SEQ ID NO: 231174 - RNA, 19 nt, Homo sapiens
gauugaggccauugaauug

SEQ ID NO: 231175 - RNA, 19 nt, Homo sapiens
gaaagucccacugaggaaa

SEQ ID NO: 231176 - RNA, 19 nt, Homo sapiens
gaagaagaacccgugaaga

SEQ ID NO: 231177 - RNA, 19 nt, Homo sapiens
gauccaaaguugaacaaaa

SEQ ID NO: 231178 - RNA, 19 nt, Homo sapiens
gguuuauccuguucaaaga

SEQ ID NO: 231179 - RNA, 19 nt, Homo sapiens
uugggaaucuaauguauug

SEQ ID NO: 231180 - RNA, 19 nt, Homo sapiens
ucacucuccuguugacuau

SEQ ID NO: 231181 - RNA, 19 nt, Homo sapiens
cacaugcuuuguuuggaua

SEQ ID NO: 231182 - RNA, 19 nt, Homo sapiens
uaacuacaagccauacuga

SEQ ID NO: 231183 - RNA, 19 nt, Homo sapiens
caauggauccaaaguugaa

SEQ ID NO: 231184 - RNA, 19 nt, Homo sapiens
gagugaacacaauuaugua

SEQ ID NO: 231185 - RNA, 19 nt, Homo sapiens
ggagaggucguugacugua

SEQ ID NO: 231186 - RNA, 19 nt, Homo sapiens
uuccagagcucuagguguu

SEQ ID NO: 231187 - RNA, 19 nt, Homo sapiens
ggagauugaggccauugaa

SEQ ID NO: 231188 - RNA, 19 nt, Homo sapiens
acucuccuguugacuauuu

SEQ ID NO: 231189 - RNA, 19 nt, Homo sapiens
ggauauggagugaacacaa

SEQ ID NO: 231190 - RNA, 19 nt, Homo sapiens
gaucaacgccagcaagaac

SEQ ID NO: 231191 - RNA, 19 nt, Homo sapiens
gaagcaagugugagaucaa

SEQ ID NO: 231192 - RNA, 19 nt, Homo sapiens
ucuauugccugucccaugu

SEQ ID NO: 231193 - RNA, 19 nt, Homo sapiens
gaggucagagucagaguug

SEQ ID NO: 231194 - RNA, 19 nt, Homo sapiens
ccauggcuaugaagaagga

SEQ ID NO: 231195 - RNA, 19 nt, Homo sapiens
gucaagaggguuuggguuu

SEQ ID NO: 231196 - RNA, 19 nt, Homo sapiens
acacaugcuuuguuuggau

SEQ ID NO: 231197 - RNA, 19 nt, Homo sapiens
cccaugugcaucuuauuua

SEQ ID NO: 231198 - RNA, 19 nt, Homo sapiens
gugguggccaucagaauaa

SEQ ID NO: 231199 - RNA, 19 nt, Homo sapiens
agauugaggccauugaauu

SEQ ID NO: 231200 - RNA, 19 nt, Homo sapiens
gggaguacuuuggcgaguu

SEQ ID NO: 231201 - RNA, 19 nt, Homo sapiens
ggaggaggagacacaguug

SEQ ID NO: 231202 - RNA, 19 nt, Homo sapiens
gagaggucguugacuguac

SEQ ID NO: 231203 - RNA, 19 nt, Homo sapiens
agaauaacuacaagccaua

SEQ ID NO: 231204 - RNA, 19 nt, Homo sapiens
ggacccugguuguaaagag

SEQ ID NO: 231205 - RNA, 19 nt, Homo sapiens
cgugguggccaucagaaua

SEQ ID NO: 231206 - RNA, 19 nt, Homo sapiens
caagguggcccagcccaaa

SEQ ID NO: 231207 - RNA, 19 nt, Homo sapiens
ucaaagaugcagccagugu

SEQ ID NO: 231208 - RNA, 19 nt, Homo sapiens
uguggacccugguuguaaa

SEQ ID NO: 231209 - RNA, 19 nt, Homo sapiens
ucuaucagcagcagcagua

SEQ ID NO: 231210 - RNA, 19 nt, Homo sapiens
ggccauggcuaugaagaag

SEQ ID NO: 231211 - RNA, 19 nt, Homo sapiens
ugaacacaauuauguacca

SEQ ID NO: 231212 - RNA, 19 nt, Homo sapiens
ggucagagucagaguugga

SEQ ID NO: 231213 - RNA, 19 nt, Homo sapiens
gcaagugugagaucaaggu

SEQ ID NO: 231214 - RNA, 19 nt, Homo sapiens
gagauugaggccauugaau

SEQ ID NO: 231215 - RNA, 19 nt, Homo sapiens
ccaaggaggaggagacaca

SEQ ID NO: 231216 - RNA, 19 nt, Homo sapiens
ggcagcguguggugucuga

SEQ ID NO: 231217 - RNA, 19 nt, Homo sapiens
uauggagugaacacaauua

SEQ ID NO: 231218 - RNA, 19 nt, Homo sapiens
ggaggucagagucagaguu

SEQ ID NO: 231219 - RNA, 19 nt, Homo sapiens
ccaauggauccaaaguuga

SEQ ID NO: 231220 - RNA, 19 nt, Homo sapiens
gacccugguuguaaagagu

SEQ ID NO: 231221 - RNA, 19 nt, Homo sapiens
gguuuggguuuauccuguu

SEQ ID NO: 231222 - RNA, 19 nt, Homo sapiens
aagacgagguuuuguguuu

SEQ ID NO: 231223 - RNA, 19 nt, Homo sapiens
gguuguaaagaguaaauug

SEQ ID NO: 231224 - RNA, 19 nt, Homo sapiens
ggguuuauccuguucaaag

SEQ ID NO: 231225 - RNA, 19 nt, Homo sapiens
gccaucagaauaacuacaa

SEQ ID NO: 231226 - RNA, 19 nt, Homo sapiens
cagaucaacgccagcaaga

SEQ ID NO: 231227 - RNA, 19 nt, Homo sapiens
ugaaagucccacugaggaa

SEQ ID NO: 231228 - RNA, 19 nt, Homo sapiens
ucccaugugcaucuuauuu

SEQ ID NO: 231229 - RNA, 19 nt, Homo sapiens
ccaccgagaacggacauga

SEQ ID NO: 231230 - RNA, 19 nt, Homo sapiens
uuacacguguccugauuuu

SEQ ID NO: 231231 - RNA, 19 nt, Homo sapiens
gcuauggcggcuacgacua

SEQ ID NO: 231232 - RNA, 19 nt, Homo sapiens
agaagaagaacccgugaag

SEQ ID NO: 231233 - RNA, 19 nt, Homo sapiens
aaaaggccauggcuaugaa

SEQ ID NO: 231234 - RNA, 19 nt, Homo sapiens
uaucuuaggaaaccagugu

SEQ ID NO: 231235 - RNA, 19 nt, Homo sapiens
gcuggauggccgugucauu

SEQ ID NO: 231236 - RNA, 19 nt, Homo sapiens
gaauaacuacaagccauac

SEQ ID NO: 231237 - RNA, 19 nt, Homo sapiens
ucaguggaagcaaguguga

SEQ ID NO: 231238 - RNA, 19 nt, Homo sapiens
agacgagguuuuguguuua

SEQ ID NO: 231239 - RNA, 19 nt, Homo sapiens
aggaaaagaucagggagua

SEQ ID NO: 231240 - RNA, 19 nt, Homo sapiens
gaaaccagugucaccuuuu

SEQ ID NO: 231241 - RNA, 19 nt, Homo sapiens
ccaagggagcgaccaacug

SEQ ID NO: 231242 - RNA, 19 nt, Homo sapiens
gggucugaauccugaaagu

SEQ ID NO: 231243 - RNA, 19 nt, Homo sapiens
cgacgugguggccaucaga

SEQ ID NO: 231244 - RNA, 19 nt, Homo sapiens
cuacucgcccuauggcuau

SEQ ID NO: 231245 - RNA, 19 nt, Homo sapiens
aagaacccgugaagaaggu

SEQ ID NO: 231246 - RNA, 19 nt, Homo sapiens
agaagaacccgugaagaag

SEQ ID NO: 231247 - RNA, 19 nt, Homo sapiens
cagccaguguggagaaggu

SEQ ID NO: 231248 - RNA, 19 nt, Homo sapiens
ugucccaugugcaucuuau

SEQ ID NO: 231249 - RNA, 19 nt, Homo sapiens
guuuggauauggagugaac

SEQ ID NO: 231250 - RNA, 19 nt, Homo sapiens
caacgggacuauuaugaua

SEQ ID NO: 231251 - RNA, 19 nt, Homo sapiens
gaagaaagaugagacuaau

SEQ ID NO: 231252 - RNA, 19 nt, Homo sapiens
gcaaaggcaaucucauuua

SEQ ID NO: 231253 - RNA, 19 nt, Homo sapiens
gaacucccguguauucauu

SEQ ID NO: 231254 - RNA, 19 nt, Homo sapiens
caguagagaugaagaauga

SEQ ID NO: 231255 - RNA, 19 nt, Homo sapiens
ucaaaugcauccucuagaa

SEQ ID NO: 231256 - RNA, 19 nt, Homo sapiens
gaugaagaaugauaaguca

SEQ ID NO: 231257 - RNA, 19 nt, Homo sapiens
ugagaaaccuuaccaucaa

SEQ ID NO: 231258 - RNA, 19 nt, Homo sapiens
caaaggcaaucucauuuag

SEQ ID NO: 231259 - RNA, 19 nt, Homo sapiens
caauggaggaugacucuua

SEQ ID NO: 231260 - RNA, 19 nt, Homo sapiens
gagaaaccuuaccaucaaa

SEQ ID NO: 231261 - RNA, 19 nt, Homo sapiens
ccuaggcgcuugucuaaga

SEQ ID NO: 231262 - RNA, 19 nt, Homo sapiens
gaagaaugauaagucagaa

SEQ ID NO: 231263 - RNA, 19 nt, Homo sapiens
ggaaggagaggaugacaga

SEQ ID NO: 231264 - RNA, 19 nt, Homo sapiens
agaaggagcugacccagau

SEQ ID NO: 231265 - RNA, 19 nt, Homo sapiens
gaggauggcagaaugauug

SEQ ID NO: 231266 - RNA, 19 nt, Homo sapiens
ggaugaugaugauaaugaa

SEQ ID NO: 231267 - RNA, 19 nt, Homo sapiens
caaacaagcaguagagaug

SEQ ID NO: 231268 - RNA, 19 nt, Homo sapiens
gugaagagacgaagacuga

SEQ ID NO: 231269 - RNA, 19 nt, Homo sapiens
guagagaugaagaaugaua

SEQ ID NO: 231270 - RNA, 19 nt, Homo sapiens
ugacuuggacuaugacuuu

SEQ ID NO: 231271 - RNA, 19 nt, Homo sapiens
guuagaaguauguguguua

SEQ ID NO: 231272 - RNA, 19 nt, Homo sapiens
gcagcuccgugaagaaaga

SEQ ID NO: 231273 - RNA, 19 nt, Homo sapiens
aaaguggcuucaauucuaa

SEQ ID NO: 231274 - RNA, 19 nt, Homo sapiens
augauaggauguacaguua

SEQ ID NO: 231275 - RNA, 19 nt, Homo sapiens
ugaagaaagaugagacuaa

SEQ ID NO: 231276 - RNA, 19 nt, Homo sapiens
caaacacgauggccagcaa

SEQ ID NO: 231277 - RNA, 19 nt, Homo sapiens
gauaccucuuuaugacuua

SEQ ID NO: 231278 - RNA, 19 nt, Homo sapiens
agacuaaugugaagaugga

SEQ ID NO: 231279 - RNA, 19 nt, Homo sapiens
aaaaguggcuucaauucua

SEQ ID NO: 231280 - RNA, 19 nt, Homo sapiens
aaggcaaucucauuuaguu

SEQ ID NO: 231281 - RNA, 19 nt, Homo sapiens
gcaguucaacacaaaugua

SEQ ID NO: 231282 - RNA, 19 nt, Homo sapiens
gcgcuugucuaagaucaaa

SEQ ID NO: 231283 - RNA, 19 nt, Homo sapiens
ggaugacucuuaagcacau

SEQ ID NO: 231284 - RNA, 19 nt, Homo sapiens
gggcugcucuguucauaag

SEQ ID NO: 231285 - RNA, 19 nt, Homo sapiens
caaaugcauccucuagaaa

SEQ ID NO: 231286 - RNA, 19 nt, Homo sapiens
gauccucgcuccaugaacu

SEQ ID NO: 231287 - RNA, 19 nt, Homo sapiens
ccagcaacguuaccaacaa

SEQ ID NO: 231288 - RNA, 19 nt, Homo sapiens
gcagaacccgggaguagga

SEQ ID NO: 231289 - RNA, 19 nt, Homo sapiens
aauggaggaugacucuuaa

SEQ ID NO: 231290 - RNA, 19 nt, Homo sapiens
ggagaggauggcagaauga

SEQ ID NO: 231291 - RNA, 19 nt, Homo sapiens
gugagaaaccuuaccauca

SEQ ID NO: 231292 - RNA, 19 nt, Homo sapiens
aaugagaguuggcauguca

SEQ ID NO: 231293 - RNA, 19 nt, Homo sapiens
agaaagaugagacuaaugu

SEQ ID NO: 231294 - RNA, 19 nt, Homo sapiens
uccaugaacucccguguau

SEQ ID NO: 231295 - RNA, 19 nt, Homo sapiens
guacaguucuuuucauuca

SEQ ID NO: 231296 - RNA, 19 nt, Homo sapiens
gcagggaguacaguucuuu

SEQ ID NO: 231297 - RNA, 19 nt, Homo sapiens
caugaacucccguguauuc

SEQ ID NO: 231298 - RNA, 19 nt, Homo sapiens
gcaaacaagcaguagagau

SEQ ID NO: 231299 - RNA, 19 nt, Homo sapiens
ugauaccucuuuaugacuu

SEQ ID NO: 231300 - RNA, 19 nt, Homo sapiens
guccuucccauguucauua

SEQ ID NO: 231301 - RNA, 19 nt, Homo sapiens
cccauuauuucuuuaccua

SEQ ID NO: 231302 - RNA, 19 nt, Homo sapiens
ggcaaucucauuuaguuga

SEQ ID NO: 231303 - RNA, 19 nt, Homo sapiens
uacauaaguucaguaguug

SEQ ID NO: 231304 - RNA, 19 nt, Homo sapiens
ugaagaaugauaagucaga

SEQ ID NO: 231305 - RNA, 19 nt, Homo sapiens
gagcaaacaagcaguagag

SEQ ID NO: 231306 - RNA, 19 nt, Homo sapiens
aaugauugcuggccagguu

SEQ ID NO: 231307 - RNA, 19 nt, Homo sapiens
gggaaucucaacacucuug

SEQ ID NO: 231308 - RNA, 19 nt, Homo sapiens
gggaugaccagcuggaguu

SEQ ID NO: 231309 - RNA, 19 nt, Homo sapiens
aaagaugagacuaauguga

SEQ ID NO: 231310 - RNA, 19 nt, Homo sapiens
ucaacacucuuguggucaa

SEQ ID NO: 231311 - RNA, 19 nt, Homo sapiens
uggaguugaucaaggauga

SEQ ID NO: 231312 - RNA, 19 nt, Homo sapiens
gaaggagcugacccagaua

SEQ ID NO: 231313 - RNA, 19 nt, Homo sapiens
uaugauaggauguacaguu

SEQ ID NO: 231314 - RNA, 19 nt, Homo sapiens
cuucccauguucauuaauu

SEQ ID NO: 231315 - RNA, 19 nt, Homo sapiens
cagcgccaauggaggauga

SEQ ID NO: 231316 - RNA, 19 nt, Homo sapiens
gaaagaugagacuaaugug

SEQ ID NO: 231317 - RNA, 19 nt, Homo sapiens
gcaguagagaugaagaaug

SEQ ID NO: 231318 - RNA, 19 nt, Homo sapiens
gaaaguugaaaggagauga

SEQ ID NO: 231319 - RNA, 19 nt, Homo sapiens
ucaggaaacacuucacgaa

SEQ ID NO: 231320 - RNA, 19 nt, Homo sapiens
gggaccuacuggaugauga

SEQ ID NO: 231321 - RNA, 19 nt, Homo sapiens
gggcaaaaguggcuucaau

SEQ ID NO: 231322 - RNA, 19 nt, Homo sapiens
agaguuggcaugucaaaug

SEQ ID NO: 231323 - RNA, 19 nt, Homo sapiens
gaguacaguucuuuucauu

SEQ ID NO: 231324 - RNA, 19 nt, Homo sapiens
uaccuaggcgcuugucuaa

SEQ ID NO: 231325 - RNA, 19 nt, Homo sapiens
uggaugaugaugauaauga

SEQ ID NO: 231326 - RNA, 19 nt, Homo sapiens
aagaugagacuaaugugaa

SEQ ID NO: 231327 - RNA, 19 nt, Homo sapiens
cagcagcuccgugaagaaa

SEQ ID NO: 231328 - RNA, 19 nt, Homo sapiens
guaggagacucagaaucga

SEQ ID NO: 231329 - RNA, 19 nt, Homo sapiens
aaucugauguggaggcaau

SEQ ID NO: 231330 - RNA, 19 nt, Homo sapiens
agaaugauaagucagaaga

SEQ ID NO: 231331 - RNA, 19 nt, Homo sapiens
gaaacgucagcguguauca

SEQ ID NO: 231332 - RNA, 19 nt, Homo sapiens
cagcaacguuaccaacaag

SEQ ID NO: 231333 - RNA, 19 nt, Homo sapiens
caguucaacacaaauguaa

SEQ ID NO: 231334 - RNA, 19 nt, Homo sapiens
gcuuugaguuagaaguaug

SEQ ID NO: 231335 - RNA, 19 nt, Homo sapiens
cugcaaaggcaaucucauu

SEQ ID NO: 231336 - RNA, 19 nt, Homo sapiens
ugacagagacagcgccaau

SEQ ID NO: 231337 - RNA, 19 nt, Homo sapiens
ggccagguuuuagauauua

SEQ ID NO: 231338 - RNA, 19 nt, Homo sapiens
gaaugagaguuggcauguc

SEQ ID NO: 231339 - RNA, 19 nt, Homo sapiens
ggaggaugacucuuaagca

SEQ ID NO: 231340 - RNA, 19 nt, Homo sapiens
gaaaccuuaccaucaaaca

SEQ ID NO: 231341 - RNA, 19 nt, Homo sapiens
aaacaagcaguagagauga

SEQ ID NO: 231342 - RNA, 19 nt, Homo sapiens
gugggcugcucuguucaua

SEQ ID NO: 231343 - RNA, 19 nt, Homo sapiens
gaccuucaggccauuaaga

SEQ ID NO: 231344 - RNA, 19 nt, Homo sapiens
gcaaaaguggcuucaauuc

SEQ ID NO: 231345 - RNA, 19 nt, Homo sapiens
gauaggauguacaguuacc

SEQ ID NO: 231346 - RNA, 19 nt, Homo sapiens
aggagaggauggcagaaug

SEQ ID NO: 231347 - RNA, 19 nt, Homo sapiens
guucaacacaaauguaaca

SEQ ID NO: 231348 - RNA, 19 nt, Homo sapiens
ugcaaaggcaaucucauuu

SEQ ID NO: 231349 - RNA, 19 nt, Homo sapiens
cagcguguaucaggaaaca

SEQ ID NO: 231350 - RNA, 19 nt, Homo sapiens
caacgggacuauuaugaua

SEQ ID NO: 231351 - RNA, 19 nt, Homo sapiens
gaagaaagaugagacuaau

SEQ ID NO: 231352 - RNA, 19 nt, Homo sapiens
gcaaaggcaaucucauuua

SEQ ID NO: 231353 - RNA, 19 nt, Homo sapiens
gaacucccguguauucauu

SEQ ID NO: 231354 - RNA, 19 nt, Homo sapiens
caguagagaugaagaauga

SEQ ID NO: 231355 - RNA, 19 nt, Homo sapiens
ucaaaugcauccucuagaa

SEQ ID NO: 231356 - RNA, 19 nt, Homo sapiens
gaugaagaaugauaaguca

SEQ ID NO: 231357 - RNA, 19 nt, Homo sapiens
ugagaaaccuuaccaucaa

SEQ ID NO: 231358 - RNA, 19 nt, Homo sapiens
caaaggcaaucucauuuag

SEQ ID NO: 231359 - RNA, 19 nt, Homo sapiens
caauggaggaugacucuua

SEQ ID NO: 231360 - RNA, 19 nt, Homo sapiens
gagaaaccuuaccaucaaa

SEQ ID NO: 231361 - RNA, 19 nt, Homo sapiens
ccuaggcgcuugucuaaga

SEQ ID NO: 231362 - RNA, 19 nt, Homo sapiens
gaagaaugauaagucagaa

SEQ ID NO: 231363 - RNA, 19 nt, Homo sapiens
ggaaggagaggaugacaga

SEQ ID NO: 231364 - RNA, 19 nt, Homo sapiens
agaaggagcugacccagau

SEQ ID NO: 231365 - RNA, 19 nt, Homo sapiens
gaggauggcagaaugauug

SEQ ID NO: 231366 - RNA, 19 nt, Homo sapiens
ggaugaugaugauaaugaa

SEQ ID NO: 231367 - RNA, 19 nt, Homo sapiens
caaacaagcaguagagaug

SEQ ID NO: 231368 - RNA, 19 nt, Homo sapiens
gugaagagacgaagacuga

SEQ ID NO: 231369 - RNA, 19 nt, Homo sapiens
guagagaugaagaaugaua

SEQ ID NO: 231370 - RNA, 19 nt, Homo sapiens
ugacuuggacuaugacuuu

SEQ ID NO: 231371 - RNA, 19 nt, Homo sapiens
guuagaaguauguguguua

SEQ ID NO: 231372 - RNA, 19 nt, Homo sapiens
gcagcuccgugaagaaaga

SEQ ID NO: 231373 - RNA, 19 nt, Homo sapiens
aaaguggcuucaauucuaa

SEQ ID NO: 231374 - RNA, 19 nt, Homo sapiens
augauaggauguacaguua

SEQ ID NO: 231375 - RNA, 19 nt, Homo sapiens
ugaagaaagaugagacuaa

SEQ ID NO: 231376 - RNA, 19 nt, Homo sapiens
caaacacgauggccagcaa

SEQ ID NO: 231377 - RNA, 19 nt, Homo sapiens
gauaccucuuuaugacuua

SEQ ID NO: 231378 - RNA, 19 nt, Homo sapiens
agacuaaugugaagaugga

SEQ ID NO: 231379 - RNA, 19 nt, Homo sapiens
aaaaguggcuucaauucua

SEQ ID NO: 231380 - RNA, 19 nt, Homo sapiens
aaggcaaucucauuuaguu

SEQ ID NO: 231381 - RNA, 19 nt, Homo sapiens
gcaguucaacacaaaugua

SEQ ID NO: 231382 - RNA, 19 nt, Homo sapiens
gcgcuugucuaagaucaaa

SEQ ID NO: 231383 - RNA, 19 nt, Homo sapiens
ggaugacucuuaagcacau

SEQ ID NO: 231384 - RNA, 19 nt, Homo sapiens
gggcugcucuguucauaag

SEQ ID NO: 231385 - RNA, 19 nt, Homo sapiens
caaaugcauccucuagaaa

SEQ ID NO: 231386 - RNA, 19 nt, Homo sapiens
gauccucgcuccaugaacu

SEQ ID NO: 231387 - RNA, 19 nt, Homo sapiens
ccagcaacguuaccaacaa

SEQ ID NO: 231388 - RNA, 19 nt, Homo sapiens
aauggaggaugacucuuaa

SEQ ID NO: 231389 - RNA, 19 nt, Homo sapiens
gagauguacgggucaguaa

SEQ ID NO: 231390 - RNA, 19 nt, Homo sapiens
ggagauguacgggucagua

SEQ ID NO: 231391 - RNA, 19 nt, Homo sapiens
ggagaggauggcagaauga

SEQ ID NO: 231392 - RNA, 19 nt, Homo sapiens
gugagaaaccuuaccauca

SEQ ID NO: 231393 - RNA, 19 nt, Homo sapiens
aaugagaguuggcauguca

SEQ ID NO: 231394 - RNA, 19 nt, Homo sapiens
agaaagaugagacuaaugu

SEQ ID NO: 231395 - RNA, 19 nt, Homo sapiens
uccaugaacucccguguau

SEQ ID NO: 231396 - RNA, 19 nt, Homo sapiens
guacaguucuuuucauuca

SEQ ID NO: 231397 - RNA, 19 nt, Homo sapiens
gcagggaguacaguucuuu

SEQ ID NO: 231398 - RNA, 19 nt, Homo sapiens
guacgggucaguaacagaa

SEQ ID NO: 231399 - RNA, 19 nt, Homo sapiens
caugaacucccguguauuc

SEQ ID NO: 231400 - RNA, 19 nt, Homo sapiens
gcaaacaagcaguagagau

SEQ ID NO: 231401 - RNA, 19 nt, Homo sapiens
ugauaccucuuuaugacuu

SEQ ID NO: 231402 - RNA, 19 nt, Homo sapiens
guccuucccauguucauua

SEQ ID NO: 231403 - RNA, 19 nt, Homo sapiens
cccauuauuucuuuaccua

SEQ ID NO: 231404 - RNA, 19 nt, Homo sapiens
ggcaaucucauuuaguuga

SEQ ID NO: 231405 - RNA, 19 nt, Homo sapiens
uacauaaguucaguaguug

SEQ ID NO: 231406 - RNA, 19 nt, Homo sapiens
ugaagaaugauaagucaga

SEQ ID NO: 231407 - RNA, 19 nt, Homo sapiens
gagcaaacaagcaguagag

SEQ ID NO: 231408 - RNA, 19 nt, Homo sapiens
cuacucagcuccucuuuug

SEQ ID NO: 231409 - RNA, 19 nt, Homo sapiens
aaugauugcuggccagguu

SEQ ID NO: 231410 - RNA, 19 nt, Homo sapiens
gggaaucucaacacucuug

SEQ ID NO: 231411 - RNA, 19 nt, Homo sapiens
gggaugaccagcuggaguu

SEQ ID NO: 231412 - RNA, 19 nt, Homo sapiens
aaagaugagacuaauguga

SEQ ID NO: 231413 - RNA, 19 nt, Homo sapiens
ucaacacucuuguggucaa

SEQ ID NO: 231414 - RNA, 19 nt, Homo sapiens
uggaguugaucaaggauga

SEQ ID NO: 231415 - RNA, 19 nt, Homo sapiens
gaaggagcugacccagaua

SEQ ID NO: 231416 - RNA, 19 nt, Homo sapiens
uaugauaggauguacaguu

SEQ ID NO: 231417 - RNA, 19 nt, Homo sapiens
cuucccauguucauuaauu

SEQ ID NO: 231418 - RNA, 19 nt, Homo sapiens
cagcgccaauggaggauga

SEQ ID NO: 231419 - RNA, 19 nt, Homo sapiens
gaaagaugagacuaaugug

SEQ ID NO: 231420 - RNA, 19 nt, Homo sapiens
gcaguagagaugaagaaug

SEQ ID NO: 231421 - RNA, 19 nt, Homo sapiens
gaaaguugaaaggagauga

SEQ ID NO: 231422 - RNA, 19 nt, Homo sapiens
ucaggaaacacuucacgaa

SEQ ID NO: 231423 - RNA, 19 nt, Homo sapiens
gggaccuacuggaugauga

SEQ ID NO: 231424 - RNA, 19 nt, Homo sapiens
gggcaaaaguggcuucaau

SEQ ID NO: 231425 - RNA, 19 nt, Homo sapiens
agaguuggcaugucaaaug

SEQ ID NO: 231426 - RNA, 19 nt, Homo sapiens
gaguacaguucuuuucauu

SEQ ID NO: 231427 - RNA, 19 nt, Homo sapiens
uaccuaggcgcuugucuaa

SEQ ID NO: 231428 - RNA, 19 nt, Homo sapiens
uggaugaugaugauaauga

SEQ ID NO: 231429 - RNA, 19 nt, Homo sapiens
aagaugagacuaaugugaa

SEQ ID NO: 231430 - RNA, 19 nt, Homo sapiens
guaggagacucagaaucga

SEQ ID NO: 231431 - RNA, 19 nt, Homo sapiens
cagcagcuccgugaagaaa

SEQ ID NO: 231432 - RNA, 19 nt, Homo sapiens
aaucugauguggaggcaau

SEQ ID NO: 231433 - RNA, 19 nt, Homo sapiens
agaaugauaagucagaaga

SEQ ID NO: 231434 - RNA, 19 nt, Homo sapiens
gaaacgucagcguguauca

SEQ ID NO: 231435 - RNA, 19 nt, Homo sapiens
caguucaacacaaauguaa

SEQ ID NO: 231436 - RNA, 19 nt, Homo sapiens
gcuuugaguuagaaguaug

SEQ ID NO: 231437 - RNA, 19 nt, Homo sapiens
cugcaaaggcaaucucauu

SEQ ID NO: 231438 - RNA, 19 nt, Homo sapiens
cagcaacguuaccaacaag

SEQ ID NO: 231439 - RNA, 19 nt, Homo sapiens
ugacagagacagcgccaau

SEQ ID NO: 231440 - RNA, 19 nt, Homo sapiens
ggccagguuuuagauauua

SEQ ID NO: 231441 - RNA, 19 nt, Homo sapiens
gaaugagaguuggcauguc

SEQ ID NO: 231442 - RNA, 19 nt, Homo sapiens
ggaggaugacucuuaagca

SEQ ID NO: 231443 - RNA, 19 nt, Homo sapiens
gauguacgggucaguaaca

SEQ ID NO: 231444 - RNA, 19 nt, Homo sapiens
cagaaacccgggaguagga

SEQ ID NO: 231445 - RNA, 19 nt, Homo sapiens
aaacaagcaguagagauga

SEQ ID NO: 231446 - RNA, 19 nt, Homo sapiens
gugggcugcucuguucaua

SEQ ID NO: 231447 - RNA, 19 nt, Homo sapiens
gaaaccuuaccaucaaaca

SEQ ID NO: 231448 - RNA, 19 nt, Homo sapiens
gaccuucaggccauuaaga

SEQ ID NO: 231449 - RNA, 19 nt, Homo sapiens
gcaaaaguggcuucaauuc

SEQ ID NO: 231450 - RNA, 19 nt, Homo sapiens
gaacaaaucuggauaaaug

SEQ ID NO: 231451 - RNA, 19 nt, Homo sapiens
gaaguuagauccuaucaca

SEQ ID NO: 231452 - RNA, 19 nt, Homo sapiens
gcacagauaguuaauguuu

SEQ ID NO: 231453 - RNA, 19 nt, Homo sapiens
agaaagaucugaaggacua

SEQ ID NO: 231454 - RNA, 19 nt, Homo sapiens
caaauuuggugaaguugua

SEQ ID NO: 231455 - RNA, 19 nt, Homo sapiens
ggaaggugauugauccuaa

SEQ ID NO: 231456 - RNA, 19 nt, Homo sapiens
gaaauugaggacaugauua

SEQ ID NO: 231457 - RNA, 19 nt, Homo sapiens
gcagugaaguuugaaaugu

SEQ ID NO: 231458 - RNA, 19 nt, Homo sapiens
gaaguuuaauucugaguuc

SEQ ID NO: 231459 - RNA, 19 nt, Homo sapiens
gaaggugauugauccuaaa

SEQ ID NO: 231460 - RNA, 19 nt, Homo sapiens
ggauaaaugugcaaaagua

SEQ ID NO: 231461 - RNA, 19 nt, Homo sapiens
agacugcacucugaaguua

SEQ ID NO: 231462 - RNA, 19 nt, Homo sapiens
gaaaagaaauaccacaaug

SEQ ID NO: 231463 - RNA, 19 nt, Homo sapiens
gagggaggauuaaagaaau

SEQ ID NO: 231464 - RNA, 19 nt, Homo sapiens
uagauaaggucauggauca

SEQ ID NO: 231465 - RNA, 19 nt, Homo sapiens
cguggguucugcuuuauua

SEQ ID NO: 231466 - RNA, 19 nt, Homo sapiens
aggaagagcucguggaaga

SEQ ID NO: 231467 - RNA, 19 nt, Homo sapiens
ggacuacuuuuccaaauuu

SEQ ID NO: 231468 - RNA, 19 nt, Homo sapiens
agauacaccugaagagaaa

SEQ ID NO: 231469 - RNA, 19 nt, Homo sapiens
ggccuuagcugggacacua

SEQ ID NO: 231470 - RNA, 19 nt, Homo sapiens
uagaugaauucaaguguug

SEQ ID NO: 231471 - RNA, 19 nt, Homo sapiens
gaaaugcggcuaguucaga

SEQ ID NO: 231472 - RNA, 19 nt, Homo sapiens
gaagaaccagugaagaaga

SEQ ID NO: 231473 - RNA, 19 nt, Homo sapiens
agacaggcuugccgaaauu

SEQ ID NO: 231474 - RNA, 19 nt, Homo sapiens
caaaauagcuacaaaccau

SEQ ID NO: 231475 - RNA, 19 nt, Homo sapiens
gaagacaggcuugccgaaa

SEQ ID NO: 231476 - RNA, 19 nt, Homo sapiens
ugucauggauucaaguuau

SEQ ID NO: 231477 - RNA, 19 nt, Homo sapiens
gaaggaacaauaucagcaa

SEQ ID NO: 231478 - RNA, 19 nt, Homo sapiens
guuguagacugcacucuga

SEQ ID NO: 231479 - RNA, 19 nt, Homo sapiens
caaagaaagaucugaagga

SEQ ID NO: 231480 - RNA, 19 nt, Homo sapiens
caauguuggucuuaguaaa

SEQ ID NO: 231481 - RNA, 19 nt, Homo sapiens
ggaagaagaaccagugaag

SEQ ID NO: 231482 - RNA, 19 nt, Homo sapiens
gaaccagugaagaagauaa

SEQ ID NO: 231483 - RNA, 19 nt, Homo sapiens
gauaaggucauggaucaaa

SEQ ID NO: 231484 - RNA, 19 nt, Homo sapiens
gcaggaagagcucguggaa

SEQ ID NO: 231485 - RNA, 19 nt, Homo sapiens
gaagaagaaccagugaaga

SEQ ID NO: 231486 - RNA, 19 nt, Homo sapiens
guaagaacgaggaggauga

SEQ ID NO: 231487 - RNA, 19 nt, Homo sapiens
aaauugcagugaaguuuga

SEQ ID NO: 231488 - RNA, 19 nt, Homo sapiens
uaauugcuaugcuucagaa

SEQ ID NO: 231489 - RNA, 19 nt, Homo sapiens
aggcguggguucugcuuua

SEQ ID NO: 231490 - RNA, 19 nt, Homo sapiens
gaaaauaagggaguacuuu

SEQ ID NO: 231491 - RNA, 19 nt, Homo sapiens
gggaguacuuuggugguuu

SEQ ID NO: 231492 - RNA, 19 nt, Homo sapiens
ccaaagccaugaaaacaaa

SEQ ID NO: 231493 - RNA, 19 nt, Homo sapiens
uaaagaaucggagagugua

SEQ ID NO: 231494 - RNA, 19 nt, Homo sapiens
cagugaaguuugaaauguu

SEQ ID NO: 231495 - RNA, 19 nt, Homo sapiens
cgaaauugaggacaugauu

SEQ ID NO: 231496 - RNA, 19 nt, Homo sapiens
acagugucaugauguagua

SEQ ID NO: 231497 - RNA, 19 nt, Homo sapiens
gaagcaguauuuuccaauu

SEQ ID NO: 231498 - RNA, 19 nt, Homo sapiens
gcuacaaaccauacuaaau

SEQ ID NO: 231499 - RNA, 19 nt, Homo sapiens
aagaagaaccagugaagaa

SEQ ID NO: 231500 - RNA, 19 nt, Homo sapiens
ugagggaggauuaaagaaa

SEQ ID NO: 231501 - RNA, 19 nt, Homo sapiens
gugguggacuucauagaug

SEQ ID NO: 231502 - RNA, 19 nt, Homo sapiens
uuacuuugcugcuaguuuc

SEQ ID NO: 231503 - RNA, 19 nt, Homo sapiens
aaucggagaguguagauaa

SEQ ID NO: 231504 - RNA, 19 nt, Homo sapiens
uguccucccuguccaaauu

SEQ ID NO: 231505 - RNA, 19 nt, Homo sapiens
ccacaauguuggucuuagu

SEQ ID NO: 231506 - RNA, 19 nt, Homo sapiens
gacaacaagaccaauaaga

SEQ ID NO: 231507 - RNA, 19 nt, Homo sapiens
ggaacaauaucagcaacag

SEQ ID NO: 231508 - RNA, 19 nt, Homo sapiens
gcugggacacuacaaagaa

SEQ ID NO: 231509 - RNA, 19 nt, Homo sapiens
cagaaucaauuuguguguu

SEQ ID NO: 231510 - RNA, 19 nt, Homo sapiens
gugaagaagauaauggaaa

SEQ ID NO: 231511 - RNA, 19 nt, Homo sapiens
cagauacaccugaagagaa

SEQ ID NO: 231512 - RNA, 19 nt, Homo sapiens
ggucuuaguaaaugugaaa

SEQ ID NO: 231513 - RNA, 19 nt, Homo sapiens
gaguguagauaaggucaug

SEQ ID NO: 231514 - RNA, 19 nt, Homo sapiens
ccucugaaguuuaauucug

SEQ ID NO: 231515 - RNA, 19 nt, Homo sapiens
gacguugggucccucugaa

SEQ ID NO: 231516 - RNA, 19 nt, Homo sapiens
gaagauugacgccaguaag

SEQ ID NO: 231517 - RNA, 19 nt, Homo sapiens
gguggccuuucuccagaua

SEQ ID NO: 231518 - RNA, 19 nt, Homo sapiens
ugaaugggaaggugauuga

SEQ ID NO: 231519 - RNA, 19 nt, Homo sapiens
uugcacagauaguuaaugu

SEQ ID NO: 231520 - RNA, 19 nt, Homo sapiens
aagacaggcuugccgaaau

SEQ ID NO: 231521 - RNA, 19 nt, Homo sapiens
uugcuaugcuucagaauca

SEQ ID NO: 231522 - RNA, 19 nt, Homo sapiens
gggucccucugaaguuuaa

SEQ ID NO: 231523 - RNA, 19 nt, Homo sapiens
ccaugucgaaggaacaaua

SEQ ID NO: 231524 - RNA, 19 nt, Homo sapiens
guucugcuuuauuaccuuu

SEQ ID NO: 231525 - RNA, 19 nt, Homo sapiens
gagcugugguggacuucau

SEQ ID NO: 231526 - RNA, 19 nt, Homo sapiens
ggagacacuagcacuaugu

SEQ ID NO: 231527 - RNA, 19 nt, Homo sapiens
caaauugggaaugacuuaa

SEQ ID NO: 231528 - RNA, 19 nt, Homo sapiens
gucauggauucaaguuauu

SEQ ID NO: 231529 - RNA, 19 nt, Homo sapiens
cuacaaagaaagaucugaa

SEQ ID NO: 231530 - RNA, 19 nt, Homo sapiens
caauuuguuuguugguugu

SEQ ID NO: 231531 - RNA, 19 nt, Homo sapiens
ggaagaauggaaaauguuu

SEQ ID NO: 231532 - RNA, 19 nt, Homo sapiens
uguauuggcucuuuuauca

SEQ ID NO: 231533 - RNA, 19 nt, Homo sapiens
guugagggaggauuaaaga

SEQ ID NO: 231534 - RNA, 19 nt, Homo sapiens
uagcuacaaaccauacuaa

SEQ ID NO: 231535 - RNA, 19 nt, Homo sapiens
caggcgagguggucaucaa

SEQ ID NO: 231536 - RNA, 19 nt, Homo sapiens
ggacaacaagaccaauaag

SEQ ID NO: 231537 - RNA, 19 nt, Homo sapiens
ccagauacaccugaagaga

SEQ ID NO: 231538 - RNA, 19 nt, Homo sapiens
aagaaccagugaagaagau

SEQ ID NO: 231539 - RNA, 19 nt, Homo sapiens
ggaguacuuuggugguuuu

SEQ ID NO: 231540 - RNA, 19 nt, Homo sapiens
uaauagaaaugcggcuagu

SEQ ID NO: 231541 - RNA, 19 nt, Homo sapiens
ccgcuggugcuuauucuuu

SEQ ID NO: 231542 - RNA, 19 nt, Homo sapiens
uuccuuauguagccauuaa

SEQ ID NO: 231543 - RNA, 19 nt, Homo sapiens
uuagagcugugguggacuu

SEQ ID NO: 231544 - RNA, 19 nt, Homo sapiens
aacagguggugaagcagua

SEQ ID NO: 231545 - RNA, 19 nt, Homo sapiens
cccaacagguggugaagca

SEQ ID NO: 231546 - RNA, 19 nt, Homo sapiens
agaggaggauuugcaggaa

SEQ ID NO: 231547 - RNA, 19 nt, Homo sapiens
cacaauguuggucuuagua

SEQ ID NO: 231548 - RNA, 19 nt, Homo sapiens
uuaaagaaucggagagugu

SEQ ID NO: 231549 - RNA, 19 nt, Homo sapiens
acucugaaguuagauccua

SEQ ID NO: 231550 - RNA, 19 nt, Homo sapiens
gaacaaaucuggauaaaug

SEQ ID NO: 231551 - RNA, 19 nt, Homo sapiens
gaaguuagauccuaucaca

SEQ ID NO: 231552 - RNA, 19 nt, Homo sapiens
gcacagauaguuaauguuu

SEQ ID NO: 231553 - RNA, 19 nt, Homo sapiens
agaaagaucugaaggacua

SEQ ID NO: 231554 - RNA, 19 nt, Homo sapiens
caaauuuggugaaguugua

SEQ ID NO: 231555 - RNA, 19 nt, Homo sapiens
ggaaggugauugauccuaa

SEQ ID NO: 231556 - RNA, 19 nt, Homo sapiens
gaaauugaggacaugauua

SEQ ID NO: 231557 - RNA, 19 nt, Homo sapiens
gcagugaaguuugaaaugu

SEQ ID NO: 231558 - RNA, 19 nt, Homo sapiens
gaaguuuaauucugaguuc

SEQ ID NO: 231559 - RNA, 19 nt, Homo sapiens
gaaggugauugauccuaaa

SEQ ID NO: 231560 - RNA, 19 nt, Homo sapiens
ggauaaaugugcaaaagua

SEQ ID NO: 231561 - RNA, 19 nt, Homo sapiens
agacugcacucugaaguua

SEQ ID NO: 231562 - RNA, 19 nt, Homo sapiens
gaaaagaaauaccacaaug

SEQ ID NO: 231563 - RNA, 19 nt, Homo sapiens
caacaacuacuauggauau

SEQ ID NO: 231564 - RNA, 19 nt, Homo sapiens
ggauaugacuacacugguu

SEQ ID NO: 231565 - RNA, 19 nt, Homo sapiens
gagggaggauuaaagaaau

SEQ ID NO: 231566 - RNA, 19 nt, Homo sapiens
uagauaaggucauggauca

SEQ ID NO: 231567 - RNA, 19 nt, Homo sapiens
cguggguucugcuuuauua

SEQ ID NO: 231568 - RNA, 19 nt, Homo sapiens
aggaagagcucguggaaga

SEQ ID NO: 231569 - RNA, 19 nt, Homo sapiens
ggacuacuuuuccaaauuu

SEQ ID NO: 231570 - RNA, 19 nt, Homo sapiens
gauaugacuacacugguua

SEQ ID NO: 231571 - RNA, 19 nt, Homo sapiens
ggauauaacagccaagguu

SEQ ID NO: 231572 - RNA, 19 nt, Homo sapiens
agauacaccugaagagaaa

SEQ ID NO: 231573 - RNA, 19 nt, Homo sapiens
ggccuuagcugggacacua

SEQ ID NO: 231574 - RNA, 19 nt, Homo sapiens
uagaugaauucaaguguug

SEQ ID NO: 231575 - RNA, 19 nt, Homo sapiens
gaaaugcggcuaguucaga

SEQ ID NO: 231576 - RNA, 19 nt, Homo sapiens
gaagaaccagugaagaaga

SEQ ID NO: 231577 - RNA, 19 nt, Homo sapiens
ucaaggcuauggcaacuau

SEQ ID NO: 231578 - RNA, 19 nt, Homo sapiens
cgaggaggaugaagggaaa

SEQ ID NO: 231579 - RNA, 19 nt, Homo sapiens
agacaggcuugccgaaauu

SEQ ID NO: 231580 - RNA, 19 nt, Homo sapiens
caaaauagcuacaaaccau

SEQ ID NO: 231581 - RNA, 19 nt, Homo sapiens
gaagacaggcuugccgaaa

SEQ ID NO: 231582 - RNA, 19 nt, Homo sapiens
ugucauggauucaaguuau

SEQ ID NO: 231583 - RNA, 19 nt, Homo sapiens
caacuacuauggauauggu

SEQ ID NO: 231584 - RNA, 19 nt, Homo sapiens
gaaggaacaauaucagcaa

SEQ ID NO: 231585 - RNA, 19 nt, Homo sapiens
guuguagacugcacucuga

SEQ ID NO: 231586 - RNA, 19 nt, Homo sapiens
caaagaaagaucugaagga

SEQ ID NO: 231587 - RNA, 19 nt, Homo sapiens
caauguuggucuuaguaaa

SEQ ID NO: 231588 - RNA, 19 nt, Homo sapiens
ggaagaagaaccagugaag

SEQ ID NO: 231589 - RNA, 19 nt, Homo sapiens
gaaccagugaagaagauaa

SEQ ID NO: 231590 - RNA, 19 nt, Homo sapiens
gauaaggucauggaucaaa

SEQ ID NO: 231591 - RNA, 19 nt, Homo sapiens
guaagaacgaggaggauga

SEQ ID NO: 231592 - RNA, 19 nt, Homo sapiens
ggaaccagggauauaguaa

SEQ ID NO: 231593 - RNA, 19 nt, Homo sapiens
gcaggaagagcucguggaa

SEQ ID NO: 231594 - RNA, 19 nt, Homo sapiens
gaagaagaaccagugaaga

SEQ ID NO: 231595 - RNA, 19 nt, Homo sapiens
aaauugcagugaaguuuga

SEQ ID NO: 231596 - RNA, 19 nt, Homo sapiens
uaauugcuaugcuucagaa

SEQ ID NO: 231597 - RNA, 19 nt, Homo sapiens
cuauggauauggugauuau

SEQ ID NO: 231598 - RNA, 19 nt, Homo sapiens
aggcguggguucugcuuua

SEQ ID NO: 231599 - RNA, 19 nt, Homo sapiens
gaaaauaagggaguacuuu

SEQ ID NO: 231600 - RNA, 19 nt, Homo sapiens
gggaguacuuuggugguuu

SEQ ID NO: 231601 - RNA, 19 nt, Homo sapiens
ccaaagccaugaaaacaaa

SEQ ID NO: 231602 - RNA, 19 nt, Homo sapiens
uaaagaaucggagagugua

SEQ ID NO: 231603 - RNA, 19 nt, Homo sapiens
cagugaaguuugaaauguu

SEQ ID NO: 231604 - RNA, 19 nt, Homo sapiens
cgaaauugaggacaugauu

SEQ ID NO: 231605 - RNA, 19 nt, Homo sapiens
acagugucaugauguagua

SEQ ID NO: 231606 - RNA, 19 nt, Homo sapiens
gaagcaguauuuuccaauu

SEQ ID NO: 231607 - RNA, 19 nt, Homo sapiens
gcuacaaaccauacuaaau

SEQ ID NO: 231608 - RNA, 19 nt, Homo sapiens
ugacuacacugguuacaac

SEQ ID NO: 231609 - RNA, 19 nt, Homo sapiens
aagaagaaccagugaagaa

SEQ ID NO: 231610 - RNA, 19 nt, Homo sapiens
ugagggaggauuaaagaaa

SEQ ID NO: 231611 - RNA, 19 nt, Homo sapiens
gugguggacuucauagaug

SEQ ID NO: 231612 - RNA, 19 nt, Homo sapiens
uuacuuugcugcuaguuuc

SEQ ID NO: 231613 - RNA, 19 nt, Homo sapiens
aaucggagaguguagauaa

SEQ ID NO: 231614 - RNA, 19 nt, Homo sapiens
uguccucccuguccaaauu

SEQ ID NO: 231615 - RNA, 19 nt, Homo sapiens
ccacaauguuggucuuagu

SEQ ID NO: 231616 - RNA, 19 nt, Homo sapiens
gacaacaagaccaauaaga

SEQ ID NO: 231617 - RNA, 19 nt, Homo sapiens
uauggcaacuauggauaua

SEQ ID NO: 231618 - RNA, 19 nt, Homo sapiens
ggaacaauaucagcaacag

SEQ ID NO: 231619 - RNA, 19 nt, Homo sapiens
gcugggacacuacaaagaa

SEQ ID NO: 231620 - RNA, 19 nt, Homo sapiens
cagaaucaauuuguguguu

SEQ ID NO: 231621 - RNA, 19 nt, Homo sapiens
gugaagaagauaauggaaa

SEQ ID NO: 231622 - RNA, 19 nt, Homo sapiens
cagauacaccugaagagaa

SEQ ID NO: 231623 - RNA, 19 nt, Homo sapiens
ggucuuaguaaaugugaaa

SEQ ID NO: 231624 - RNA, 19 nt, Homo sapiens
gaguguagauaaggucaug

SEQ ID NO: 231625 - RNA, 19 nt, Homo sapiens
ccucugaaguuuaauucug

SEQ ID NO: 231626 - RNA, 19 nt, Homo sapiens
gacguugggucccucugaa

SEQ ID NO: 231627 - RNA, 19 nt, Homo sapiens
gaagauugacgccaguaag

SEQ ID NO: 231628 - RNA, 19 nt, Homo sapiens
gguggccuuucuccagaua

SEQ ID NO: 231629 - RNA, 19 nt, Homo sapiens
ugaaugggaaggugauuga

SEQ ID NO: 231630 - RNA, 19 nt, Homo sapiens
uugcacagauaguuaaugu

SEQ ID NO: 231631 - RNA, 19 nt, Homo sapiens
aagacaggcuugccgaaau

SEQ ID NO: 231632 - RNA, 19 nt, Homo sapiens
uugcuaugcuucagaauca

SEQ ID NO: 231633 - RNA, 19 nt, Homo sapiens
gggucccucugaaguuuaa

SEQ ID NO: 231634 - RNA, 19 nt, Homo sapiens
gcuauggcaacuauggaua

SEQ ID NO: 231635 - RNA, 19 nt, Homo sapiens
ccaugucgaaggaacaaua

SEQ ID NO: 231636 - RNA, 19 nt, Homo sapiens
guucugcuuuauuaccuuu

SEQ ID NO: 231637 - RNA, 19 nt, Homo sapiens
gagcugugguggacuucau

SEQ ID NO: 231638 - RNA, 19 nt, Homo sapiens
caaauugggaaugacuuaa

SEQ ID NO: 231639 - RNA, 19 nt, Homo sapiens
gucauggauucaaguuauu

SEQ ID NO: 231640 - RNA, 19 nt, Homo sapiens
uacaacaacuacuauggau

SEQ ID NO: 231641 - RNA, 19 nt, Homo sapiens
ggagacacuagcacuaugu

SEQ ID NO: 231642 - RNA, 19 nt, Homo sapiens
cuacaaagaaagaucugaa

SEQ ID NO: 231643 - RNA, 19 nt, Homo sapiens
caauuuguuuguugguugu

SEQ ID NO: 231644 - RNA, 19 nt, Homo sapiens
gauauggugauuauagcaa

SEQ ID NO: 231645 - RNA, 19 nt, Homo sapiens
uguauuggcucuuuuauca

SEQ ID NO: 231646 - RNA, 19 nt, Homo sapiens
gaagggaaaauguuuauag

SEQ ID NO: 231647 - RNA, 19 nt, Homo sapiens
guugagggaggauuaaaga

SEQ ID NO: 231648 - RNA, 19 nt, Homo sapiens
uagcuacaaaccauacuaa

SEQ ID NO: 231649 - RNA, 19 nt, Homo sapiens
caggcgagguggucaucaa

SEQ ID NO: 231650 - RNA, 19 nt, Homo sapiens
gaacaaaucuggauaaaug

SEQ ID NO: 231651 - RNA, 19 nt, Homo sapiens
gaaguuagauccuaucaca

SEQ ID NO: 231652 - RNA, 19 nt, Homo sapiens
gcacagauaguuaauguuu

SEQ ID NO: 231653 - RNA, 19 nt, Homo sapiens
agaaagaucugaaggacua

SEQ ID NO: 231654 - RNA, 19 nt, Homo sapiens
caaauuuggugaaguugua

SEQ ID NO: 231655 - RNA, 19 nt, Homo sapiens
ggaaggugauugauccuaa

SEQ ID NO: 231656 - RNA, 19 nt, Homo sapiens
gaaauugaggacaugauua

SEQ ID NO: 231657 - RNA, 19 nt, Homo sapiens
gcagugaaguuugaaaugu

SEQ ID NO: 231658 - RNA, 19 nt, Homo sapiens
gaaguuuaauucugaguuc

SEQ ID NO: 231659 - RNA, 19 nt, Homo sapiens
gaaggugauugauccuaaa

SEQ ID NO: 231660 - RNA, 19 nt, Homo sapiens
ggauaaaugugcaaaagua

SEQ ID NO: 231661 - RNA, 19 nt, Homo sapiens
agacugcacucugaaguua

SEQ ID NO: 231662 - RNA, 19 nt, Homo sapiens
gaaaagaaauaccacaaug

SEQ ID NO: 231663 - RNA, 19 nt, Homo sapiens
caacaacuacuauggauau

SEQ ID NO: 231664 - RNA, 19 nt, Homo sapiens
ggauaugacuacacugguu

SEQ ID NO: 231665 - RNA, 19 nt, Homo sapiens
gagggaggauuaaagaaau

SEQ ID NO: 231666 - RNA, 19 nt, Homo sapiens
uagauaaggucauggauca

SEQ ID NO: 231667 - RNA, 19 nt, Homo sapiens
cguggguucugcuuuauua

SEQ ID NO: 231668 - RNA, 19 nt, Homo sapiens
aggaagagcucguggaaga

SEQ ID NO: 231669 - RNA, 19 nt, Homo sapiens
ggacuacuuuuccaaauuu

SEQ ID NO: 231670 - RNA, 19 nt, Homo sapiens
gauaugacuacacugguua

SEQ ID NO: 231671 - RNA, 19 nt, Homo sapiens
ggauauaacagccaagguu

SEQ ID NO: 231672 - RNA, 19 nt, Homo sapiens
agauacaccugaagagaaa

SEQ ID NO: 231673 - RNA, 19 nt, Homo sapiens
ggccuuagcugggacacua

SEQ ID NO: 231674 - RNA, 19 nt, Homo sapiens
uagaugaauucaaguguug

SEQ ID NO: 231675 - RNA, 19 nt, Homo sapiens
gaaaugcggcuaguucaga

SEQ ID NO: 231676 - RNA, 19 nt, Homo sapiens
gaagaaccagugaagaaga

SEQ ID NO: 231677 - RNA, 19 nt, Homo sapiens
ucaaggcuauggcaacuau

SEQ ID NO: 231678 - RNA, 19 nt, Homo sapiens
agacaggcuugccgaaauu

SEQ ID NO: 231679 - RNA, 19 nt, Homo sapiens
caaaauagcuacaaaccau

SEQ ID NO: 231680 - RNA, 19 nt, Homo sapiens
gaagacaggcuugccgaaa

SEQ ID NO: 231681 - RNA, 19 nt, Homo sapiens
ugucauggauucaaguuau

SEQ ID NO: 231682 - RNA, 19 nt, Homo sapiens
caacuacuauggauauggu

SEQ ID NO: 231683 - RNA, 19 nt, Homo sapiens
gaaggaacaauaucagcaa

SEQ ID NO: 231684 - RNA, 19 nt, Homo sapiens
guuguagacugcacucuga

SEQ ID NO: 231685 - RNA, 19 nt, Homo sapiens
caaagaaagaucugaagga

SEQ ID NO: 231686 - RNA, 19 nt, Homo sapiens
caauguuggucuuaguaaa

SEQ ID NO: 231687 - RNA, 19 nt, Homo sapiens
ggaagaagaaccagugaag

SEQ ID NO: 231688 - RNA, 19 nt, Homo sapiens
gaaccagugaagaagauaa

SEQ ID NO: 231689 - RNA, 19 nt, Homo sapiens
gauaaggucauggaucaaa

SEQ ID NO: 231690 - RNA, 19 nt, Homo sapiens
ggaaccagggauauaguaa

SEQ ID NO: 231691 - RNA, 19 nt, Homo sapiens
gcaggaagagcucguggaa

SEQ ID NO: 231692 - RNA, 19 nt, Homo sapiens
guaagaacgaggaggauga

SEQ ID NO: 231693 - RNA, 19 nt, Homo sapiens
gaagaagaaccagugaaga

SEQ ID NO: 231694 - RNA, 19 nt, Homo sapiens
aaauugcagugaaguuuga

SEQ ID NO: 231695 - RNA, 19 nt, Homo sapiens
uaauugcuaugcuucagaa

SEQ ID NO: 231696 - RNA, 19 nt, Homo sapiens
cuauggauauggugauuau

SEQ ID NO: 231697 - RNA, 19 nt, Homo sapiens
aggcguggguucugcuuua

SEQ ID NO: 231698 - RNA, 19 nt, Homo sapiens
gaaaauaagggaguacuuu

SEQ ID NO: 231699 - RNA, 19 nt, Homo sapiens
gggaguacuuuggugguuu

SEQ ID NO: 231700 - RNA, 19 nt, Homo sapiens
ccaaagccaugaaaacaaa

SEQ ID NO: 231701 - RNA, 19 nt, Homo sapiens
uaaagaaucggagagugua

SEQ ID NO: 231702 - RNA, 19 nt, Homo sapiens
cagugaaguuugaaauguu

SEQ ID NO: 231703 - RNA, 19 nt, Homo sapiens
cgaaauugaggacaugauu

SEQ ID NO: 231704 - RNA, 19 nt, Homo sapiens
acagugucaugauguagua

SEQ ID NO: 231705 - RNA, 19 nt, Homo sapiens
gaagcaguauuuuccaauu

SEQ ID NO: 231706 - RNA, 19 nt, Homo sapiens
gcuacaaaccauacuaaau

SEQ ID NO: 231707 - RNA, 19 nt, Homo sapiens
ugacuacacugguuacaac

SEQ ID NO: 231708 - RNA, 19 nt, Homo sapiens
aagaagaaccagugaagaa

SEQ ID NO: 231709 - RNA, 19 nt, Homo sapiens
ugagggaggauuaaagaaa

SEQ ID NO: 231710 - RNA, 19 nt, Homo sapiens
gugguggacuucauagaug

SEQ ID NO: 231711 - RNA, 19 nt, Homo sapiens
uuacuuugcugcuaguuuc

SEQ ID NO: 231712 - RNA, 19 nt, Homo sapiens
aaucggagaguguagauaa

SEQ ID NO: 231713 - RNA, 19 nt, Homo sapiens
uguccucccuguccaaauu

SEQ ID NO: 231714 - RNA, 19 nt, Homo sapiens
ccacaauguuggucuuagu

SEQ ID NO: 231715 - RNA, 19 nt, Homo sapiens
gacaacaagaccaauaaga

SEQ ID NO: 231716 - RNA, 19 nt, Homo sapiens
uauggcaacuauggauaua

SEQ ID NO: 231717 - RNA, 19 nt, Homo sapiens
ggaacaauaucagcaacag

SEQ ID NO: 231718 - RNA, 19 nt, Homo sapiens
gcugggacacuacaaagaa

SEQ ID NO: 231719 - RNA, 19 nt, Homo sapiens
cagaaucaauuuguguguu

SEQ ID NO: 231720 - RNA, 19 nt, Homo sapiens
gugaagaagauaauggaaa

SEQ ID NO: 231721 - RNA, 19 nt, Homo sapiens
cagauacaccugaagagaa

SEQ ID NO: 231722 - RNA, 19 nt, Homo sapiens
ggucuuaguaaaugugaaa

SEQ ID NO: 231723 - RNA, 19 nt, Homo sapiens
gaguguagauaaggucaug

SEQ ID NO: 231724 - RNA, 19 nt, Homo sapiens
ccucugaaguuuaauucug

SEQ ID NO: 231725 - RNA, 19 nt, Homo sapiens
gacguugggucccucugaa

SEQ ID NO: 231726 - RNA, 19 nt, Homo sapiens
gaagauugacgccaguaag

SEQ ID NO: 231727 - RNA, 19 nt, Homo sapiens
gguggccuuucuccagaua

SEQ ID NO: 231728 - RNA, 19 nt, Homo sapiens
ugaaugggaaggugauuga

SEQ ID NO: 231729 - RNA, 19 nt, Homo sapiens
uugcacagauaguuaaugu

SEQ ID NO: 231730 - RNA, 19 nt, Homo sapiens
aagacaggcuugccgaaau

SEQ ID NO: 231731 - RNA, 19 nt, Homo sapiens
uugcuaugcuucagaauca

SEQ ID NO: 231732 - RNA, 19 nt, Homo sapiens
gggucccucugaaguuuaa

SEQ ID NO: 231733 - RNA, 19 nt, Homo sapiens
gcuauggcaacuauggaua

SEQ ID NO: 231734 - RNA, 19 nt, Homo sapiens
ccaugucgaaggaacaaua

SEQ ID NO: 231735 - RNA, 19 nt, Homo sapiens
guucugcuuuauuaccuuu

SEQ ID NO: 231736 - RNA, 19 nt, Homo sapiens
gagcugugguggacuucau

SEQ ID NO: 231737 - RNA, 19 nt, Homo sapiens
caaauugggaaugacuuaa

SEQ ID NO: 231738 - RNA, 19 nt, Homo sapiens
gucauggauucaaguuauu

SEQ ID NO: 231739 - RNA, 19 nt, Homo sapiens
uacaacaacuacuauggau

SEQ ID NO: 231740 - RNA, 19 nt, Homo sapiens
ggagacacuagcacuaugu

SEQ ID NO: 231741 - RNA, 19 nt, Homo sapiens
cuacaaagaaagaucugaa

SEQ ID NO: 231742 - RNA, 19 nt, Homo sapiens
caauuuguuuguugguugu

SEQ ID NO: 231743 - RNA, 19 nt, Homo sapiens
ggaagaauggaaaauguuu

SEQ ID NO: 231744 - RNA, 19 nt, Homo sapiens
gauauggugauuauagcaa

SEQ ID NO: 231745 - RNA, 19 nt, Homo sapiens
uguauuggcucuuuuauca

SEQ ID NO: 231746 - RNA, 19 nt, Homo sapiens
guugagggaggauuaaaga

SEQ ID NO: 231747 - RNA, 19 nt, Homo sapiens
uagcuacaaaccauacuaa

SEQ ID NO: 231748 - RNA, 19 nt, Homo sapiens
caggcgagguggucaucaa

SEQ ID NO: 231749 - RNA, 19 nt, Homo sapiens
ggacaacaagaccaauaag

SEQ ID NO: 231750 - RNA, 19 nt, Homo sapiens
gcaauuaagagcaguuaua

SEQ ID NO: 231751 - RNA, 19 nt, Homo sapiens
ggaagaaauuguucaguuc

SEQ ID NO: 231752 - RNA, 19 nt, Homo sapiens
ugaagcagauguugaguuu

SEQ ID NO: 231753 - RNA, 19 nt, Homo sapiens
gaacuuggaucagaagaug

SEQ ID NO: 231754 - RNA, 19 nt, Homo sapiens
gaacgacauuuacaacuuc

SEQ ID NO: 231755 - RNA, 19 nt, Homo sapiens
guugauagcuggagaacuu

SEQ ID NO: 231756 - RNA, 19 nt, Homo sapiens
gcacagauauauagaacuc

SEQ ID NO: 231757 - RNA, 19 nt, Homo sapiens
ucuaugaucucccuuauau

SEQ ID NO: 231758 - RNA, 19 nt, Homo sapiens
ggugaggccuugacuuaaa

SEQ ID NO: 231759 - RNA, 19 nt, Homo sapiens
ugagaaggcucuagggaaa

SEQ ID NO: 231760 - RNA, 19 nt, Homo sapiens
ggagucacaucuguugaua

SEQ ID NO: 231761 - RNA, 19 nt, Homo sapiens
ucagagugauguuaucuaa

SEQ ID NO: 231762 - RNA, 19 nt, Homo sapiens
guuaggaacauuugaguua

SEQ ID NO: 231763 - RNA, 19 nt, Homo sapiens
gaucucccuuauauucuua

SEQ ID NO: 231764 - RNA, 19 nt, Homo sapiens
guaguauacuucagaguga

SEQ ID NO: 231765 - RNA, 19 nt, Homo sapiens
ggagagaccucagcuacug

SEQ ID NO: 231766 - RNA, 19 nt, Homo sapiens
ugagggaggugaaggcuuu

SEQ ID NO: 231767 - RNA, 19 nt, Homo sapiens
gagaguccauauugagauu

SEQ ID NO: 231768 - RNA, 19 nt, Homo sapiens
cgaccgagaacgacauuua

SEQ ID NO: 231769 - RNA, 19 nt, Homo sapiens
gcacaguggucccaacagu

SEQ ID NO: 231770 - RNA, 19 nt, Homo sapiens
ggugcuagcucccugauuc

SEQ ID NO: 231771 - RNA, 19 nt, Homo sapiens
gcacagauuacucagcaaa

SEQ ID NO: 231772 - RNA, 19 nt, Homo sapiens
ccaauaugcagcacagaua

SEQ ID NO: 231773 - RNA, 19 nt, Homo sapiens
ccaaagacagggccaauau

SEQ ID NO: 231774 - RNA, 19 nt, Homo sapiens
ggauguaugaccacagaua

SEQ ID NO: 231775 - RNA, 19 nt, Homo sapiens
gggaagcguucgugcaguu

SEQ ID NO: 231776 - RNA, 19 nt, Homo sapiens
cgagauggauuggguguug

SEQ ID NO: 231777 - RNA, 19 nt, Homo sapiens
gcacuguuguaaaccauuc

SEQ ID NO: 231778 - RNA, 19 nt, Homo sapiens
aggaagaaauuguucaguu

SEQ ID NO: 231779 - RNA, 19 nt, Homo sapiens
agaacgacauuuacaacuu

SEQ ID NO: 231780 - RNA, 19 nt, Homo sapiens
agagugauguuaucuaagu

SEQ ID NO: 231781 - RNA, 19 nt, Homo sapiens
aaaauuaccucuucagugu

SEQ ID NO: 231782 - RNA, 19 nt, Homo sapiens
gaacauuugaguuacuuca

SEQ ID NO: 231783 - RNA, 19 nt, Homo sapiens
ggguggcuaugacuaguuu

SEQ ID NO: 231784 - RNA, 19 nt, Homo sapiens
gagcuucgguggaauuucg

SEQ ID NO: 231785 - RNA, 19 nt, Homo sapiens
ggaguacaguggccucagu

SEQ ID NO: 231786 - RNA, 19 nt, Homo sapiens
uaugaucucccuuauauuc

SEQ ID NO: 231787 - RNA, 19 nt, Homo sapiens
caaugacuggcacagauua

SEQ ID NO: 231788 - RNA, 19 nt, Homo sapiens
aauuaccucuucaguguuu

SEQ ID NO: 231789 - RNA, 19 nt, Homo sapiens
uggcagcuauguccaaaga

SEQ ID NO: 231790 - RNA, 19 nt, Homo sapiens
gagauuggcccagauggaa

SEQ ID NO: 231791 - RNA, 19 nt, Homo sapiens
gaccucagcuacugucucu

SEQ ID NO: 231792 - RNA, 19 nt, Homo sapiens
cacaaugacuggcacagau

SEQ ID NO: 231793 - RNA, 19 nt, Homo sapiens
gaacagcauggguggcuau

SEQ ID NO: 231794 - RNA, 19 nt, Homo sapiens
gaaggcauccgugguuguu

SEQ ID NO: 231795 - RNA, 19 nt, Homo sapiens
caaguacuacauugugaaa

SEQ ID NO: 231796 - RNA, 19 nt, Homo sapiens
ggccuugacuuaaaacuuu

SEQ ID NO: 231797 - RNA, 19 nt, Homo sapiens
ccagccaccugcaacuuau

SEQ ID NO: 231798 - RNA, 19 nt, Homo sapiens
caaaacgggugguugaaga

SEQ ID NO: 231799 - RNA, 19 nt, Homo sapiens
gcagccaacaagcaauuaa

SEQ ID NO: 231800 - RNA, 19 nt, Homo sapiens
cagcacagauauauagaac

SEQ ID NO: 231801 - RNA, 19 nt, Homo sapiens
gaaacacaaggagaggaua

SEQ ID NO: 231802 - RNA, 19 nt, Homo sapiens
ggccgcagguguccauuuc

SEQ ID NO: 231803 - RNA, 19 nt, Homo sapiens
cuuaugaugaggcuaaaua

SEQ ID NO: 231804 - RNA, 19 nt, Homo sapiens
gcaccaugaguuugugaaa

SEQ ID NO: 231805 - RNA, 19 nt, Homo sapiens
guacaaagcgaccgagaac

SEQ ID NO: 231806 - RNA, 19 nt, Homo sapiens
aggaggaaguuaggucaua

SEQ ID NO: 231807 - RNA, 19 nt, Homo sapiens
acagguacauugagguguu

SEQ ID NO: 231808 - RNA, 19 nt, Homo sapiens
ggaaacacaaggagaggau

SEQ ID NO: 231809 - RNA, 19 nt, Homo sapiens
gugacuagcagcacacauu

SEQ ID NO: 231810 - RNA, 19 nt, Homo sapiens
gcucccugauucaaagaaa

SEQ ID NO: 231811 - RNA, 19 nt, Homo sapiens
acauugagguguuuaagag

SEQ ID NO: 231812 - RNA, 19 nt, Homo sapiens
guacugugauuuccuuuug

SEQ ID NO: 231813 - RNA, 19 nt, Homo sapiens
uagcaugugauaaugagua

SEQ ID NO: 231814 - RNA, 19 nt, Homo sapiens
ccacagauacggcgacagu

SEQ ID NO: 231815 - RNA, 19 nt, Homo sapiens
ggaggaaguuaggucauac

SEQ ID NO: 231816 - RNA, 19 nt, Homo sapiens
gagauggauuggguguuga

SEQ ID NO: 231817 - RNA, 19 nt, Homo sapiens
ccacagaaccgagauggau

SEQ ID NO: 231818 - RNA, 19 nt, Homo sapiens
gacacaauacuaauacugu

SEQ ID NO: 231819 - RNA, 19 nt, Homo sapiens
gcagcacagauauauagaa

SEQ ID NO: 231820 - RNA, 19 nt, Homo sapiens
gccggcagguugagaacaa

SEQ ID NO: 231821 - RNA, 19 nt, Homo sapiens
ucucaggguuggaaauugu

SEQ ID NO: 231822 - RNA, 19 nt, Homo sapiens
uaugugcacuguuguaaac

SEQ ID NO: 231823 - RNA, 19 nt, Homo sapiens
aagcagauguugaguuugc

SEQ ID NO: 231824 - RNA, 19 nt, Homo sapiens
caaaggaagaaauuguuca

SEQ ID NO: 231825 - RNA, 19 nt, Homo sapiens
uuggugaggccuugacuua

SEQ ID NO: 231826 - RNA, 19 nt, Homo sapiens
gagugauguuaucuaaguu

SEQ ID NO: 231827 - RNA, 19 nt, Homo sapiens
caaagacagggccaauaug

SEQ ID NO: 231828 - RNA, 19 nt, Homo sapiens
cgggauguaugaccacaga

SEQ ID NO: 231829 - RNA, 19 nt, Homo sapiens
guacuacauugugaaagca

SEQ ID NO: 231830 - RNA, 19 nt, Homo sapiens
aaucuaugaucucccuuau

SEQ ID NO: 231831 - RNA, 19 nt, Homo sapiens
ccugugagaguccauauug

SEQ ID NO: 231832 - RNA, 19 nt, Homo sapiens
ucauuaccauccagaagug

SEQ ID NO: 231833 - RNA, 19 nt, Homo sapiens
cacccaagaucaccugaca

SEQ ID NO: 231834 - RNA, 19 nt, Homo sapiens
ggaaguuaggucauacuca

SEQ ID NO: 231835 - RNA, 19 nt, Homo sapiens
ugaucucccuuauauucuu

SEQ ID NO: 231836 - RNA, 19 nt, Homo sapiens
cagcauggguggcuaugac

SEQ ID NO: 231837 - RNA, 19 nt, Homo sapiens
gcagguguccauuucaucu

SEQ ID NO: 231838 - RNA, 19 nt, Homo sapiens
gcuggagucacaucuguug

SEQ ID NO: 231839 - RNA, 19 nt, Homo sapiens
aaaucuaugaucucccuua

SEQ ID NO: 231840 - RNA, 19 nt, Homo sapiens
caauacuaauacuguagga

SEQ ID NO: 231841 - RNA, 19 nt, Homo sapiens
gcagauguugaguuugcua

SEQ ID NO: 231842 - RNA, 19 nt, Homo sapiens
acaaagcgaccgagaacga

SEQ ID NO: 231843 - RNA, 19 nt, Homo sapiens
ggagguacauuggcaucgu

SEQ ID NO: 231844 - RNA, 19 nt, Homo sapiens
uggauuggguguugaagca

SEQ ID NO: 231845 - RNA, 19 nt, Homo sapiens
acagauacggcgacaguga

SEQ ID NO: 231846 - RNA, 19 nt, Homo sapiens
cagguacauugagguguuu

SEQ ID NO: 231847 - RNA, 19 nt, Homo sapiens
gaaauuguucaguucuucu

SEQ ID NO: 231848 - RNA, 19 nt, Homo sapiens
aaacgggugguugaagaua

SEQ ID NO: 231849 - RNA, 19 nt, Homo sapiens
gagacacaauacuaauacu

SEQ ID NO: 231850 - RNA, 19 nt, Homo sapiens
gaagagaccucaauuacug

SEQ ID NO: 231851 - RNA, 19 nt, Homo sapiens
acacagauauguugaagua

SEQ ID NO: 231852 - RNA, 19 nt, Homo sapiens
ggagcugugucuacuauua

SEQ ID NO: 231853 - RNA, 19 nt, Homo sapiens
gaagcugaguaaacuauaa

SEQ ID NO: 231854 - RNA, 19 nt, Homo sapiens
gaacucuucuugaauucua

SEQ ID NO: 231855 - RNA, 19 nt, Homo sapiens
gaacucuucuugaauucua

SEQ ID NO: 231856 - RNA, 19 nt, Homo sapiens
ggaagaaauuguucaguuc

SEQ ID NO: 231857 - RNA, 19 nt, Homo sapiens
ggacuucccuuuggaugua

SEQ ID NO: 231858 - RNA, 19 nt, Homo sapiens
ggauuguuaugaagacuua

SEQ ID NO: 231859 - RNA, 19 nt, Homo sapiens
gaagucgcgugucuaguuu

SEQ ID NO: 231860 - RNA, 19 nt, Homo sapiens
gcacagguauauugaaauc

SEQ ID NO: 231861 - RNA, 19 nt, Homo sapiens
gguaaaagcaguugaauua

SEQ ID NO: 231862 - RNA, 19 nt, Homo sapiens
gcaguuugcuucacaggaa

SEQ ID NO: 231863 - RNA, 19 nt, Homo sapiens
gaacuugaaucagaagaug

SEQ ID NO: 231864 - RNA, 19 nt, Homo sapiens
gggcacagguauauugaaa

SEQ ID NO: 231865 - RNA, 19 nt, Homo sapiens
caguagagcugaaguuaga

SEQ ID NO: 231866 - RNA, 19 nt, Homo sapiens
uuacagagcuacugagaau

SEQ ID NO: 231867 - RNA, 19 nt, Homo sapiens
gaaacacaaggaaagaaua

SEQ ID NO: 231868 - RNA, 19 nt, Homo sapiens
caaacaacguugaaaugga

SEQ ID NO: 231869 - RNA, 19 nt, Homo sapiens
gagaguacacauugaaauu

SEQ ID NO: 231870 - RNA, 19 nt, Homo sapiens
ugaaaaggcucuaaagaaa

SEQ ID NO: 231871 - RNA, 19 nt, Homo sapiens
caaguuaguuauaggaugu

SEQ ID NO: 231872 - RNA, 19 nt, Homo sapiens
ugaaauggauuggguguug

SEQ ID NO: 231873 - RNA, 19 nt, Homo sapiens
gaacacagauauguagaac

SEQ ID NO: 231874 - RNA, 19 nt, Homo sapiens
caaauaugcaacacagaua

SEQ ID NO: 231875 - RNA, 19 nt, Homo sapiens
gaaauggauuggguguuga

SEQ ID NO: 231876 - RNA, 19 nt, Homo sapiens
gcaguaagcguauuuaggu

SEQ ID NO: 231877 - RNA, 19 nt, Homo sapiens
cagaguaacuggugaagca

SEQ ID NO: 231878 - RNA, 19 nt, Homo sapiens
gaauagggcacagguauau

SEQ ID NO: 231879 - RNA, 19 nt, Homo sapiens
gaagcauacugguccaaau

SEQ ID NO: 231880 - RNA, 19 nt, Homo sapiens
gaacagcagcuacuacagu

SEQ ID NO: 231881 - RNA, 19 nt, Homo sapiens
ugaagcagaugucgaguuc

SEQ ID NO: 231882 - RNA, 19 nt, Homo sapiens
aaacaacguugaaauggau

SEQ ID NO: 231883 - RNA, 19 nt, Homo sapiens
gauuggguguugaagcaua

SEQ ID NO: 231884 - RNA, 19 nt, Homo sapiens
ggacacagauauguugaag

SEQ ID NO: 231885 - RNA, 19 nt, Homo sapiens
gcaaauaugcaacacagau

SEQ ID NO: 231886 - RNA, 19 nt, Homo sapiens
uacaauggcuauaaugaug

SEQ ID NO: 231887 - RNA, 19 nt, Homo sapiens
gacuuaaggcccaguauuu

SEQ ID NO: 231888 - RNA, 19 nt, Homo sapiens
gacgcaauaccaauacuua

SEQ ID NO: 231889 - RNA, 19 nt, Homo sapiens
uaacagugaagcugaguaa

SEQ ID NO: 231890 - RNA, 19 nt, Homo sapiens
gaugaggcguggugcuuau

SEQ ID NO: 231891 - RNA, 19 nt, Homo sapiens
acacagauauguagaacuc

SEQ ID NO: 231892 - RNA, 19 nt, Homo sapiens
acacagauauguagaacuc

SEQ ID NO: 231893 - RNA, 19 nt, Homo sapiens
cagaggagcuggcuuugag

SEQ ID NO: 231894 - RNA, 19 nt, Homo sapiens
guucgcaacucaugaagau

SEQ ID NO: 231895 - RNA, 19 nt, Homo sapiens
aggaagaaauuguucaguu

SEQ ID NO: 231896 - RNA, 19 nt, Homo sapiens
gcaauaccaauacuuagga

SEQ ID NO: 231897 - RNA, 19 nt, Homo sapiens
aaucaaacauugcauaggu

SEQ ID NO: 231898 - RNA, 19 nt, Homo sapiens
ucagauagauuuggaagag

SEQ ID NO: 231899 - RNA, 19 nt, Homo sapiens
gauccaccacgaaagcuua

SEQ ID NO: 231900 - RNA, 19 nt, Homo sapiens
gagcugugucuacuauuaa

SEQ ID NO: 231901 - RNA, 19 nt, Homo sapiens
guuauaggauguacuuaag

SEQ ID NO: 231902 - RNA, 19 nt, Homo sapiens
auacaauacucaucuagga

SEQ ID NO: 231903 - RNA, 19 nt, Homo sapiens
uaaagaaacacaaggaaag

SEQ ID NO: 231904 - RNA, 19 nt, Homo sapiens
cagauauguugaaguauuc

SEQ ID NO: 231905 - RNA, 19 nt, Homo sapiens
cguaagagacgaugauguu

SEQ ID NO: 231906 - RNA, 19 nt, Homo sapiens
ucuagcauguccaguauga

SEQ ID NO: 231907 - RNA, 19 nt, Homo sapiens
ucgcgugucuaguuuguuu

SEQ ID NO: 231908 - RNA, 19 nt, Homo sapiens
gaagaugaagucaaauugg

SEQ ID NO: 231909 - RNA, 19 nt, Homo sapiens
gcauguuuguuaauucuag

SEQ ID NO: 231910 - RNA, 19 nt, Homo sapiens
ggaaugggaggguugucua

SEQ ID NO: 231911 - RNA, 19 nt, Homo sapiens
gaguacacauugaaauugg

SEQ ID NO: 231912 - RNA, 19 nt, Homo sapiens
ggauuugggucagauagau

SEQ ID NO: 231913 - RNA, 19 nt, Homo sapiens
uaacauugccgguggacuu

SEQ ID NO: 231914 - RNA, 19 nt, Homo sapiens
cagaagaugaagucaaauu

SEQ ID NO: 231915 - RNA, 19 nt, Homo sapiens
caggaaaacuccagugauu

SEQ ID NO: 231916 - RNA, 19 nt, Homo sapiens
gcagaagucgcgugucuag

SEQ ID NO: 231917 - RNA, 19 nt, Homo sapiens
caacacagauauguagaac

SEQ ID NO: 231918 - RNA, 19 nt, Homo sapiens
gcaacacagauauguagaa

SEQ ID NO: 231919 - RNA, 19 nt, Homo sapiens
agacaaagcaaauaugcaa

SEQ ID NO: 231920 - RNA, 19 nt, Homo sapiens
ggaagagaccucaauuacu

SEQ ID NO: 231921 - RNA, 19 nt, Homo sapiens
uaggagcugugucuacuau

SEQ ID NO: 231922 - RNA, 19 nt, Homo sapiens
ccgaugaagugcagagguu

SEQ ID NO: 231923 - RNA, 19 nt, Homo sapiens
ggaggguugucuagcaugu

SEQ ID NO: 231924 - RNA, 19 nt, Homo sapiens
gaaacuaugggacacagau

SEQ ID NO: 231925 - RNA, 19 nt, Homo sapiens
gaugguggcucuacuuucc

SEQ ID NO: 231926 - RNA, 19 nt, Homo sapiens
ggaugaggcguggugcuua

SEQ ID NO: 231927 - RNA, 19 nt, Homo sapiens
uaagagcaguagagcugaa

SEQ ID NO: 231928 - RNA, 19 nt, Homo sapiens
cuaaagaaacacaaggaaa

SEQ ID NO: 231929 - RNA, 19 nt, Homo sapiens
aagcauacugguccaaaua

SEQ ID NO: 231930 - RNA, 19 nt, Homo sapiens
gguauucguuucaucuaca

SEQ ID NO: 231931 - RNA, 19 nt, Homo sapiens
ggucuugguguuuguauga

SEQ ID NO: 231932 - RNA, 19 nt, Homo sapiens
caguaagcguauuuaggua

SEQ ID NO: 231933 - RNA, 19 nt, Homo sapiens
gagagggauucguggugaa

SEQ ID NO: 231934 - RNA, 19 nt, Homo sapiens
gaaagcuuauggccaugca

SEQ ID NO: 231935 - RNA, 19 nt, Homo sapiens
agaagucgcgugucuaguu

SEQ ID NO: 231936 - RNA, 19 nt, Homo sapiens
uugcauagguaaccaagga

SEQ ID NO: 231937 - RNA, 19 nt, Homo sapiens
acagagcuacugagaauga

SEQ ID NO: 231938 - RNA, 19 nt, Homo sapiens
ggauuaccuuacagagcua

SEQ ID NO: 231939 - RNA, 19 nt, Homo sapiens
aaugauggcuauggauuug

SEQ ID NO: 231940 - RNA, 19 nt, Homo sapiens
gcaaggaagaaauuguuca

SEQ ID NO: 231941 - RNA, 19 nt, Homo sapiens
ggauguagcaaggaagaaa

SEQ ID NO: 231942 - RNA, 19 nt, Homo sapiens
gcuuagaggacuucccuuu

SEQ ID NO: 231943 - RNA, 19 nt, Homo sapiens
uauaggauguacuuaagca

SEQ ID NO: 231944 - RNA, 19 nt, Homo sapiens
gaagacuuaaggcccagua

SEQ ID NO: 231945 - RNA, 19 nt, Homo sapiens
gaguggauacgaccaaguu

SEQ ID NO: 231946 - RNA, 19 nt, Homo sapiens
gccagguccuuaugacaga

SEQ ID NO: 231947 - RNA, 19 nt, Homo sapiens
gcauacugguccaaauagu

SEQ ID NO: 231948 - RNA, 19 nt, Homo sapiens
uaaugauggcuauggauuu

SEQ ID NO: 231949 - RNA, 19 nt, Homo sapiens
uauggaggcuaugaugauu

SEQ ID NO: 231950 - RNA, 19 nt, Homo sapiens
gaagagaccucaauuacug

SEQ ID NO: 231951 - RNA, 19 nt, Homo sapiens
ggagggauguuuaguauau

SEQ ID NO: 231952 - RNA, 19 nt, Homo sapiens
gaaauuggcuuugaagaag

SEQ ID NO: 231953 - RNA, 19 nt, Homo sapiens
gaagugaaauuggcuuuga

SEQ ID NO: 231954 - RNA, 19 nt, Homo sapiens
aaacaugccuuucuguaaa

SEQ ID NO: 231955 - RNA, 19 nt, Homo sapiens
ccacugagaaugauauuua

SEQ ID NO: 231956 - RNA, 19 nt, Homo sapiens
ugaggcagauguugaauuu

SEQ ID NO: 231957 - RNA, 19 nt, Homo sapiens
agacaaagcuaauaugcaa

SEQ ID NO: 231958 - RNA, 19 nt, Homo sapiens
guggagcucuucuuaaauu

SEQ ID NO: 231959 - RNA, 19 nt, Homo sapiens
cuaaauagcuacuccagau

SEQ ID NO: 231960 - RNA, 19 nt, Homo sapiens
gaaguuuggucgugucguu

SEQ ID NO: 231961 - RNA, 19 nt, Homo sapiens
gaaacacaaggaaagaaua

SEQ ID NO: 231962 - RNA, 19 nt, Homo sapiens
gaucauagauacggagaug

SEQ ID NO: 231963 - RNA, 19 nt, Homo sapiens
guaagcguauuuagguuaa

SEQ ID NO: 231964 - RNA, 19 nt, Homo sapiens
gagaaggccuuaaagaaac

SEQ ID NO: 231965 - RNA, 19 nt, Homo sapiens
ggaagagauuguucaguuc

SEQ ID NO: 231966 - RNA, 19 nt, Homo sapiens
acacagauacguugaagua

SEQ ID NO: 231967 - RNA, 19 nt, Homo sapiens
ugagaaggccuuaaagaaa

SEQ ID NO: 231968 - RNA, 19 nt, Homo sapiens
gagccaaacuugccaccaa

SEQ ID NO: 231969 - RNA, 19 nt, Homo sapiens
gaguggauaugaccaaguu

SEQ ID NO: 231970 - RNA, 19 nt, Homo sapiens
ucacagcuauguagaacuu

SEQ ID NO: 231971 - RNA, 19 nt, Homo sapiens
gagcucuucuuaaauucua

SEQ ID NO: 231972 - RNA, 19 nt, Homo sapiens
ugaaauggauuggguguug

SEQ ID NO: 231973 - RNA, 19 nt, Homo sapiens
gcacaucagguauucguuu

SEQ ID NO: 231974 - RNA, 19 nt, Homo sapiens
gaaauggauuggguguuga

SEQ ID NO: 231975 - RNA, 19 nt, Homo sapiens
gcaguaagcguauuuaggu

SEQ ID NO: 231976 - RNA, 19 nt, Homo sapiens
gaaugucugaucauagaua

SEQ ID NO: 231977 - RNA, 19 nt, Homo sapiens
cagaggagcuggguuugaa

SEQ ID NO: 231978 - RNA, 19 nt, Homo sapiens
gggcacagguacauugaga

SEQ ID NO: 231979 - RNA, 19 nt, Homo sapiens
aggaagagauuguucaguu

SEQ ID NO: 231980 - RNA, 19 nt, Homo sapiens
gaguguaccuaagcaguaa

SEQ ID NO: 231981 - RNA, 19 nt, Homo sapiens
gauuggguguugaagcaua

SEQ ID NO: 231982 - RNA, 19 nt, Homo sapiens
aaucugaggcuuugguuua

SEQ ID NO: 231983 - RNA, 19 nt, Homo sapiens
guuaaugcaguuucacuua

SEQ ID NO: 231984 - RNA, 19 nt, Homo sapiens
ugaauuugcuacucaugaa

SEQ ID NO: 231985 - RNA, 19 nt, Homo sapiens
cagcuucucuuucuuuauc

SEQ ID NO: 231986 - RNA, 19 nt, Homo sapiens
ugucuacgauucaaaguga

SEQ ID NO: 231987 - RNA, 19 nt, Homo sapiens
ggaguguaccuaagcagua

SEQ ID NO: 231988 - RNA, 19 nt, Homo sapiens
agagaaggagcacuaaaua

SEQ ID NO: 231989 - RNA, 19 nt, Homo sapiens
ggacacagauacguugaag

SEQ ID NO: 231990 - RNA, 19 nt, Homo sapiens
uaaaguggaaguugagauu

SEQ ID NO: 231991 - RNA, 19 nt, Homo sapiens
caaccagucuaguuaugga

SEQ ID NO: 231992 - RNA, 19 nt, Homo sapiens
uauccaaccagucuaguua

SEQ ID NO: 231993 - RNA, 19 nt, Homo sapiens
ggucgugucguuuguauga

SEQ ID NO: 231994 - RNA, 19 nt, Homo sapiens
ggacauaauaacaaaguuc

SEQ ID NO: 231995 - RNA, 19 nt, Homo sapiens
gaucacagcuauguagaac

SEQ ID NO: 231996 - RNA, 19 nt, Homo sapiens
gagcuggguuugaaaggau

SEQ ID NO: 231997 - RNA, 19 nt, Homo sapiens
ggaagccuuugugcaguuu

SEQ ID NO: 231998 - RNA, 19 nt, Homo sapiens
ugaaauuggcuuugaagaa

SEQ ID NO: 231999 - RNA, 19 nt, Homo sapiens
ggagcugugucuacgauuc

SEQ ID NO: 232000 - RNA, 19 nt, Homo sapiens
gaguacauauugaaauugg

SEQ ID NO: 232001 - RNA, 19 nt, Homo sapiens
aggaaugucugaucauaga

SEQ ID NO: 232002 - RNA, 19 nt, Homo sapiens
gcuggcagaggguauaaua

SEQ ID NO: 232003 - RNA, 19 nt, Homo sapiens
ggucagcuucucuuucuuu

SEQ ID NO: 232004 - RNA, 19 nt, Homo sapiens
uaaagaaacacaaggaaag

SEQ ID NO: 232005 - RNA, 19 nt, Homo sapiens
gggaagccuuugugcaguu

SEQ ID NO: 232006 - RNA, 19 nt, Homo sapiens
gcaguuucacuuauguuaa

SEQ ID NO: 232007 - RNA, 19 nt, Homo sapiens
caaguuaguuauguuguag

SEQ ID NO: 232008 - RNA, 19 nt, Homo sapiens
gcaaggaagagauuguuca

SEQ ID NO: 232009 - RNA, 19 nt, Homo sapiens
ggacucccauuuggcugua

SEQ ID NO: 232010 - RNA, 19 nt, Homo sapiens
ugaagcauuuguugaacuu

SEQ ID NO: 232011 - RNA, 19 nt, Homo sapiens
caaaauggcacaucaggua

SEQ ID NO: 232012 - RNA, 19 nt, Homo sapiens
ggcuuugguuuaaaucuuu

SEQ ID NO: 232013 - RNA, 19 nt, Homo sapiens
gcauguuuguuaauucuag

SEQ ID NO: 232014 - RNA, 19 nt, Homo sapiens
uaaugcaguuucacuuaug

SEQ ID NO: 232015 - RNA, 19 nt, Homo sapiens
aauagcuacuccagauaua

SEQ ID NO: 232016 - RNA, 19 nt, Homo sapiens
uaugguggcuauaaugaug

SEQ ID NO: 232017 - RNA, 19 nt, Homo sapiens
ugacuaugguggcuauaau

SEQ ID NO: 232018 - RNA, 19 nt, Homo sapiens
gcuuagaggacucccauuu

SEQ ID NO: 232019 - RNA, 19 nt, Homo sapiens
uaaggauacgggacaauuu

SEQ ID NO: 232020 - RNA, 19 nt, Homo sapiens
gcucuuauaccacaaauac

SEQ ID NO: 232021 - RNA, 19 nt, Homo sapiens
uauccaguaugauugguaa

SEQ ID NO: 232022 - RNA, 19 nt, Homo sapiens
ugggagggauguuuaguau

SEQ ID NO: 232023 - RNA, 19 nt, Homo sapiens
guacauuugugggaguuga

SEQ ID NO: 232024 - RNA, 19 nt, Homo sapiens
uaaauagcuacuccagaua

SEQ ID NO: 232025 - RNA, 19 nt, Homo sapiens
gagaaggagcacuaaauag

SEQ ID NO: 232026 - RNA, 19 nt, Homo sapiens
gcagcugaguggugguuau

SEQ ID NO: 232027 - RNA, 19 nt, Homo sapiens
uuacagagccacugagaau

SEQ ID NO: 232028 - RNA, 19 nt, Homo sapiens
ggaagagaccucaauuacu

SEQ ID NO: 232029 - RNA, 19 nt, Homo sapiens
gauauggcuuugggucuga

SEQ ID NO: 232030 - RNA, 19 nt, Homo sapiens
ggagcuggguuugaaagga

SEQ ID NO: 232031 - RNA, 19 nt, Homo sapiens
cacaggagauagcugagaa

SEQ ID NO: 232032 - RNA, 19 nt, Homo sapiens
agaaugggagggauguuua

SEQ ID NO: 232033 - RNA, 19 nt, Homo sapiens
gaaguucgaacccacuaug

SEQ ID NO: 232034 - RNA, 19 nt, Homo sapiens
gaagaggaagugaaauugg

SEQ ID NO: 232035 - RNA, 19 nt, Homo sapiens
cauuuggcauguuuguuaa

SEQ ID NO: 232036 - RNA, 19 nt, Homo sapiens
gucagcuucucuuucuuua

SEQ ID NO: 232037 - RNA, 19 nt, Homo sapiens
aaggagcacuaaauagcua

SEQ ID NO: 232038 - RNA, 19 nt, Homo sapiens
gagaugguggguccaguuu

SEQ ID NO: 232039 - RNA, 19 nt, Homo sapiens
gguauucguuucaucuaca

SEQ ID NO: 232040 - RNA, 19 nt, Homo sapiens
cucgaaagcucauggcuau

SEQ ID NO: 232041 - RNA, 19 nt, Homo sapiens
aagcauacagguccgaaua

SEQ ID NO: 232042 - RNA, 19 nt, Homo sapiens
ggcuugugauucaugcuua

SEQ ID NO: 232043 - RNA, 19 nt, Homo sapiens
ccaguaugauugguaaaug

SEQ ID NO: 232044 - RNA, 19 nt, Homo sapiens
uagccgagcugaaguucga

SEQ ID NO: 232045 - RNA, 19 nt, Homo sapiens
acagguacauugagaucuu

SEQ ID NO: 232046 - RNA, 19 nt, Homo sapiens
gcacagguacauugagauc

SEQ ID NO: 232047 - RNA, 19 nt, Homo sapiens
gcugagaaggccuuaaaga

SEQ ID NO: 232048 - RNA, 19 nt, Homo sapiens
aaacuucggaugcauguug

SEQ ID NO: 232049 - RNA, 19 nt, Homo sapiens
acagauauguggagcucuu

SEQ ID NO: 232050 - RNA, 19 nt, Homo sapiens
gaauagagcuugacaaaua

SEQ ID NO: 232051 - RNA, 19 nt, Homo sapiens
ggacaacacuguaaauaua

SEQ ID NO: 232052 - RNA, 19 nt, Homo sapiens
ggaaauaguucaguucuuu

SEQ ID NO: 232053 - RNA, 19 nt, Homo sapiens
gaaguagugugguguaauu

SEQ ID NO: 232054 - RNA, 19 nt, Homo sapiens
ccacugauguugauacuuu

SEQ ID NO: 232055 - RNA, 19 nt, Homo sapiens
gcauagcucugaaacauug

SEQ ID NO: 232056 - RNA, 19 nt, Homo sapiens
gaacucuucuugaauucua

SEQ ID NO: 232057 - RNA, 19 nt, Homo sapiens
caaauuggcuaauggauca

SEQ ID NO: 232058 - RNA, 19 nt, Homo sapiens
gcaacaaguccaugucaua

SEQ ID NO: 232059 - RNA, 19 nt, Homo sapiens
gagauggaauggauaauca

SEQ ID NO: 232060 - RNA, 19 nt, Homo sapiens
gaagagauggaauggauaa

SEQ ID NO: 232061 - RNA, 19 nt, Homo sapiens
gauuuggguugauguauuu

SEQ ID NO: 232062 - RNA, 19 nt, Homo sapiens
agaagcagauguagaguuu

SEQ ID NO: 232063 - RNA, 19 nt, Homo sapiens
gaucuaagagguauugauu

SEQ ID NO: 232064 - RNA, 19 nt, Homo sapiens
gaaacacaaggaaagaaua

SEQ ID NO: 232065 - RNA, 19 nt, Homo sapiens
gaaggaauguguuuucaaa

SEQ ID NO: 232066 - RNA, 19 nt, Homo sapiens
uauaaugacugaaggaaug

SEQ ID NO: 232067 - RNA, 19 nt, Homo sapiens
gcacagguauauugagauc

SEQ ID NO: 232068 - RNA, 19 nt, Homo sapiens
guuggaagcugaauucuag

SEQ ID NO: 232069 - RNA, 19 nt, Homo sapiens
ugacauugcuaauuucuuc

SEQ ID NO: 232070 - RNA, 19 nt, Homo sapiens
ggaaguauguaugacagaa

SEQ ID NO: 232071 - RNA, 19 nt, Homo sapiens
caacaucgauauauugaac

SEQ ID NO: 232072 - RNA, 19 nt, Homo sapiens
gaugugaauucaguuauug

SEQ ID NO: 232073 - RNA, 19 nt, Homo sapiens
ggguuaagguucucaguga

SEQ ID NO: 232074 - RNA, 19 nt, Homo sapiens
gaaacauaaugguccaaau

SEQ ID NO: 232075 - RNA, 19 nt, Homo sapiens
aagaugugcugccuucaua

SEQ ID NO: 232076 - RNA, 19 nt, Homo sapiens
gggcacagguauauugaga

SEQ ID NO: 232077 - RNA, 19 nt, Homo sapiens
uagcaggagugaaaucaaa

SEQ ID NO: 232078 - RNA, 19 nt, Homo sapiens
ugacaggcauuuaaaucaa

SEQ ID NO: 232079 - RNA, 19 nt, Homo sapiens
gaauagggcacagguauau

SEQ ID NO: 232080 - RNA, 19 nt, Homo sapiens
gacaggcauuuaaaucaaa

SEQ ID NO: 232081 - RNA, 19 nt, Homo sapiens
gcaaagaggaaauaguuca

SEQ ID NO: 232082 - RNA, 19 nt, Homo sapiens
cagcaaagaggaaauaguu

SEQ ID NO: 232083 - RNA, 19 nt, Homo sapiens
ggaguauaauucucacaau

SEQ ID NO: 232084 - RNA, 19 nt, Homo sapiens
ucuaagagguauugauuuc

SEQ ID NO: 232085 - RNA, 19 nt, Homo sapiens
gggauguacugaaagcaaa

SEQ ID NO: 232086 - RNA, 19 nt, Homo sapiens
caaaggagauagcagaaaa

SEQ ID NO: 232087 - RNA, 19 nt, Homo sapiens
cgacuucucccuucuuuga

SEQ ID NO: 232088 - RNA, 19 nt, Homo sapiens
caauuacaguggaggauau

SEQ ID NO: 232089 - RNA, 19 nt, Homo sapiens
cggaagagauggaauggau

SEQ ID NO: 232090 - RNA, 19 nt, Homo sapiens
gagauggauuggguuauga

SEQ ID NO: 232091 - RNA, 19 nt, Homo sapiens
gcugccaugucuaaagaua

SEQ ID NO: 232092 - RNA, 19 nt, Homo sapiens
agaaguagcaggagugaaa

SEQ ID NO: 232093 - RNA, 19 nt, Homo sapiens
caugggagguucuggaaug

SEQ ID NO: 232094 - RNA, 19 nt, Homo sapiens
aaugaaaccuguugaugug

SEQ ID NO: 232095 - RNA, 19 nt, Homo sapiens
guaaagcaacagauuguga

SEQ ID NO: 232096 - RNA, 19 nt, Homo sapiens
ggaaacacaaggaaagaau

SEQ ID NO: 232097 - RNA, 19 nt, Homo sapiens
uaacauugacgauggacua

SEQ ID NO: 232098 - RNA, 19 nt, Homo sapiens
uaagagguauugauuucug

SEQ ID NO: 232099 - RNA, 19 nt, Homo sapiens
caugcaacaucgauauauu

SEQ ID NO: 232100 - RNA, 19 nt, Homo sapiens
guagugugguguaauuuua

SEQ ID NO: 232101 - RNA, 19 nt, Homo sapiens
caaacgguauugagaugga

SEQ ID NO: 232102 - RNA, 19 nt, Homo sapiens
gggaggcuauggaucaguu

SEQ ID NO: 232103 - RNA, 19 nt, Homo sapiens
cgaccgggaccauaugaua

SEQ ID NO: 232104 - RNA, 19 nt, Homo sapiens
gaaaccuguugaugugaau

SEQ ID NO: 232105 - RNA, 19 nt, Homo sapiens
gcuaauggaucaaaaugaa

SEQ ID NO: 232106 - RNA, 19 nt, Homo sapiens
ggaagagauggaauggaua

SEQ ID NO: 232107 - RNA, 19 nt, Homo sapiens
uaacaugcaacaucgauau

SEQ ID NO: 232108 - RNA, 19 nt, Homo sapiens
uagcugccaugucuaaaga

SEQ ID NO: 232109 - RNA, 19 nt, Homo sapiens
ggauaacauugacgaugga

SEQ ID NO: 232110 - RNA, 19 nt, Homo sapiens
ccaaaugacgcuagugaug

SEQ ID NO: 232111 - RNA, 19 nt, Homo sapiens
gcacuugaccgaaauacca

SEQ ID NO: 232112 - RNA, 19 nt, Homo sapiens
aaacauaaugguccaaaug

SEQ ID NO: 232113 - RNA, 19 nt, Homo sapiens
gacaacagcaucuggucua

SEQ ID NO: 232114 - RNA, 19 nt, Homo sapiens
ggcgugggauguacugaaa

SEQ ID NO: 232115 - RNA, 19 nt, Homo sapiens
ugaaaccuguugaugugaa

SEQ ID NO: 232116 - RNA, 19 nt, Homo sapiens
cuucagcacuugaccgaaa

SEQ ID NO: 232117 - RNA, 19 nt, Homo sapiens
cauaagauuuggguugaug

SEQ ID NO: 232118 - RNA, 19 nt, Homo sapiens
aacagcaucuggucuacua

SEQ ID NO: 232119 - RNA, 19 nt, Homo sapiens
ugacuaugguggcuauaau

SEQ ID NO: 232120 - RNA, 19 nt, Homo sapiens
acgaggaggugauggauau

SEQ ID NO: 232121 - RNA, 19 nt, Homo sapiens
ugagauggauuggguuaug

SEQ ID NO: 232122 - RNA, 19 nt, Homo sapiens
acagguauauugagaucuu

SEQ ID NO: 232123 - RNA, 19 nt, Homo sapiens
cuacuagacuuucuuacag

SEQ ID NO: 232124 - RNA, 19 nt, Homo sapiens
ugccaugucuaaagauaaa

SEQ ID NO: 232125 - RNA, 19 nt, Homo sapiens
gcagauguagaguuuguga

SEQ ID NO: 232126 - RNA, 19 nt, Homo sapiens
gaugacagaaugagagaug

SEQ ID NO: 232127 - RNA, 19 nt, Homo sapiens
uggaauagagcuugacaaa

SEQ ID NO: 232128 - RNA, 19 nt, Homo sapiens
gcguaaacugcaagucuua

SEQ ID NO: 232129 - RNA, 19 nt, Homo sapiens
caagaaguaguguggugua

SEQ ID NO: 232130 - RNA, 19 nt, Homo sapiens
uggauuggguuaugaaaca

SEQ ID NO: 232131 - RNA, 19 nt, Homo sapiens
gagaagcagauguagaguu

SEQ ID NO: 232132 - RNA, 19 nt, Homo sapiens
gcccaauagaguuuaaaua

SEQ ID NO: 232133 - RNA, 19 nt, Homo sapiens
aagcagauguagaguuugu

SEQ ID NO: 232134 - RNA, 19 nt, Homo sapiens
gacuaugguggcuauaaua

SEQ ID NO: 232135 - RNA, 19 nt, Homo sapiens
agauuuggguugauguauu

SEQ ID NO: 232136 - RNA, 19 nt, Homo sapiens
gugcugccuucauaagauu

SEQ ID NO: 232137 - RNA, 19 nt, Homo sapiens
aagaggaaauaguucaguu

SEQ ID NO: 232138 - RNA, 19 nt, Homo sapiens
gguggucauuucguacaua

SEQ ID NO: 232139 - RNA, 19 nt, Homo sapiens
ucaugguggucauuucgua

SEQ ID NO: 232140 - RNA, 19 nt, Homo sapiens
aaaugaaaccuguugaugu

SEQ ID NO: 232141 - RNA, 19 nt, Homo sapiens
aggcauagcucugaaacau

SEQ ID NO: 232142 - RNA, 19 nt, Homo sapiens
ugacugaaggaauguguuu

SEQ ID NO: 232143 - RNA, 19 nt, Homo sapiens
caacaaguccaugucauag

SEQ ID NO: 232144 - RNA, 19 nt, Homo sapiens
gacacaagaauucaguauu

SEQ ID NO: 232145 - RNA, 19 nt, Homo sapiens
ggaguauaaauucagcuaa

SEQ ID NO: 232146 - RNA, 19 nt, Homo sapiens
ggaauagagcuugacaaau

SEQ ID NO: 232147 - RNA, 19 nt, Homo sapiens
caucuggaauagagcuuga

SEQ ID NO: 232148 - RNA, 19 nt, Homo sapiens
gggaggacauggcuauggu

SEQ ID NO: 232149 - RNA, 19 nt, Homo sapiens
gcaguuggguuuuguaucu

SEQ ID NO: 232150 - RNA, 19 nt, Homo sapiens
gaauagagcuugacaaaua

SEQ ID NO: 232151 - RNA, 19 nt, Homo sapiens
ggacaacacuguaaauaua

SEQ ID NO: 232152 - RNA, 19 nt, Homo sapiens
ggaaauaguucaguucuuu

SEQ ID NO: 232153 - RNA, 19 nt, Homo sapiens
gaaguagugugguguaauu

SEQ ID NO: 232154 - RNA, 19 nt, Homo sapiens
ccacugauguugauacuuu

SEQ ID NO: 232155 - RNA, 19 nt, Homo sapiens
gcauagcucugaaacauug

SEQ ID NO: 232156 - RNA, 19 nt, Homo sapiens
gaacucuucuugaauucua

SEQ ID NO: 232157 - RNA, 19 nt, Homo sapiens
caaauuggcuaauggauca

SEQ ID NO: 232158 - RNA, 19 nt, Homo sapiens
gcaacaaguccaugucaua

SEQ ID NO: 232159 - RNA, 19 nt, Homo sapiens
gagauggaauggauaauca

SEQ ID NO: 232160 - RNA, 19 nt, Homo sapiens
gaagagauggaauggauaa

SEQ ID NO: 232161 - RNA, 19 nt, Homo sapiens
gauuuggguugauguauuu

SEQ ID NO: 232162 - RNA, 19 nt, Homo sapiens
agaagcagauguagaguuu

SEQ ID NO: 232163 - RNA, 19 nt, Homo sapiens
gaucuaagagguauugauu

SEQ ID NO: 232164 - RNA, 19 nt, Homo sapiens
gaaacacaaggaaagaaua

SEQ ID NO: 232165 - RNA, 19 nt, Homo sapiens
gaaggaauguguuuucaaa

SEQ ID NO: 232166 - RNA, 19 nt, Homo sapiens
uauaaugacugaaggaaug

SEQ ID NO: 232167 - RNA, 19 nt, Homo sapiens
ggaaugauggcuuugauga

SEQ ID NO: 232168 - RNA, 19 nt, Homo sapiens
gcacagguauauugagauc

SEQ ID NO: 232169 - RNA, 19 nt, Homo sapiens
guuggaagcugaauucuag

SEQ ID NO: 232170 - RNA, 19 nt, Homo sapiens
ugacauugcuaauuucuuc

SEQ ID NO: 232171 - RNA, 19 nt, Homo sapiens
caacaucgauauauugaac

SEQ ID NO: 232172 - RNA, 19 nt, Homo sapiens
gaugugaauucaguuauug

SEQ ID NO: 232173 - RNA, 19 nt, Homo sapiens
ggguuaagguucucaguga

SEQ ID NO: 232174 - RNA, 19 nt, Homo sapiens
gaaacauaaugguccaaau

SEQ ID NO: 232175 - RNA, 19 nt, Homo sapiens
aagaugugcugccuucaua

SEQ ID NO: 232176 - RNA, 19 nt, Homo sapiens
gggcacagguauauugaga

SEQ ID NO: 232177 - RNA, 19 nt, Homo sapiens
uagcaggagugaaaucaaa

SEQ ID NO: 232178 - RNA, 19 nt, Homo sapiens
ugacaggcauuuaaaucaa

SEQ ID NO: 232179 - RNA, 19 nt, Homo sapiens
gaauagggcacagguauau

SEQ ID NO: 232180 - RNA, 19 nt, Homo sapiens
gagcugggcguggaaguua

SEQ ID NO: 232181 - RNA, 19 nt, Homo sapiens
gacaggcauuuaaaucaaa

SEQ ID NO: 232182 - RNA, 19 nt, Homo sapiens
gcaaagaggaaauaguuca

SEQ ID NO: 232183 - RNA, 19 nt, Homo sapiens
cagcaaagaggaaauaguu

SEQ ID NO: 232184 - RNA, 19 nt, Homo sapiens
ggaguauaauucucacaau

SEQ ID NO: 232185 - RNA, 19 nt, Homo sapiens
ucuaagagguauugauuuc

SEQ ID NO: 232186 - RNA, 19 nt, Homo sapiens
gggauguacugaaagcaaa

SEQ ID NO: 232187 - RNA, 19 nt, Homo sapiens
caaaggagauagcagaaaa

SEQ ID NO: 232188 - RNA, 19 nt, Homo sapiens
cgacuucucccuucuuuga

SEQ ID NO: 232189 - RNA, 19 nt, Homo sapiens
caauuacaguggaggauau

SEQ ID NO: 232190 - RNA, 19 nt, Homo sapiens
gagauggauuggguuauga

SEQ ID NO: 232191 - RNA, 19 nt, Homo sapiens
cggaagagauggaauggau

SEQ ID NO: 232192 - RNA, 19 nt, Homo sapiens
gcugccaugucuaaagaua

SEQ ID NO: 232193 - RNA, 19 nt, Homo sapiens
agaaguagcaggagugaaa

SEQ ID NO: 232194 - RNA, 19 nt, Homo sapiens
caugggagguucuggaaug

SEQ ID NO: 232195 - RNA, 19 nt, Homo sapiens
aaugaaaccuguugaugug

SEQ ID NO: 232196 - RNA, 19 nt, Homo sapiens
guaaagcaacagauuguga

SEQ ID NO: 232197 - RNA, 19 nt, Homo sapiens
ggaaacacaaggaaagaau

SEQ ID NO: 232198 - RNA, 19 nt, Homo sapiens
uaacauugacgauggacua

SEQ ID NO: 232199 - RNA, 19 nt, Homo sapiens
uaagagguauugauuucug

SEQ ID NO: 232200 - RNA, 19 nt, Homo sapiens
caugcaacaucgauauauu

SEQ ID NO: 232201 - RNA, 19 nt, Homo sapiens
guagugugguguaauuuua

SEQ ID NO: 232202 - RNA, 19 nt, Homo sapiens
caaacgguauugagaugga

SEQ ID NO: 232203 - RNA, 19 nt, Homo sapiens
gggaggcuauggaucaguu

SEQ ID NO: 232204 - RNA, 19 nt, Homo sapiens
cgaccgggaccauaugaua

SEQ ID NO: 232205 - RNA, 19 nt, Homo sapiens
gaaaccuguugaugugaau

SEQ ID NO: 232206 - RNA, 19 nt, Homo sapiens
gcuaauggaucaaaaugaa

SEQ ID NO: 232207 - RNA, 19 nt, Homo sapiens
ggaagagauggaauggaua

SEQ ID NO: 232208 - RNA, 19 nt, Homo sapiens
uaacaugcaacaucgauau

SEQ ID NO: 232209 - RNA, 19 nt, Homo sapiens
uagcugccaugucuaaaga

SEQ ID NO: 232210 - RNA, 19 nt, Homo sapiens
ggauaacauugacgaugga

SEQ ID NO: 232211 - RNA, 19 nt, Homo sapiens
ccaaaugacgcuagugaug

SEQ ID NO: 232212 - RNA, 19 nt, Homo sapiens
gcacuugaccgaaauacca

SEQ ID NO: 232213 - RNA, 19 nt, Homo sapiens
gacaacagcaucuggucua

SEQ ID NO: 232214 - RNA, 19 nt, Homo sapiens
ggcgugggauguacugaaa

SEQ ID NO: 232215 - RNA, 19 nt, Homo sapiens
aaacauaaugguccaaaug

SEQ ID NO: 232216 - RNA, 19 nt, Homo sapiens
ugaaaccuguugaugugaa

SEQ ID NO: 232217 - RNA, 19 nt, Homo sapiens
cuucagcacuugaccgaaa

SEQ ID NO: 232218 - RNA, 19 nt, Homo sapiens
cauaagauuuggguugaug

SEQ ID NO: 232219 - RNA, 19 nt, Homo sapiens
aacagcaucuggucuacua

SEQ ID NO: 232220 - RNA, 19 nt, Homo sapiens
ugacuaugguggcuauaau

SEQ ID NO: 232221 - RNA, 19 nt, Homo sapiens
ugagauggauuggguuaug

SEQ ID NO: 232222 - RNA, 19 nt, Homo sapiens
acagguauauugagaucuu

SEQ ID NO: 232223 - RNA, 19 nt, Homo sapiens
cuacuagacuuucuuacag

SEQ ID NO: 232224 - RNA, 19 nt, Homo sapiens
ugccaugucuaaagauaaa

SEQ ID NO: 232225 - RNA, 19 nt, Homo sapiens
gcagauguagaguuuguga

SEQ ID NO: 232226 - RNA, 19 nt, Homo sapiens
gaugacagaaugagagaug

SEQ ID NO: 232227 - RNA, 19 nt, Homo sapiens
uggaauagagcuugacaaa

SEQ ID NO: 232228 - RNA, 19 nt, Homo sapiens
gcguaaacugcaagucuua

SEQ ID NO: 232229 - RNA, 19 nt, Homo sapiens
caagaaguaguguggugua

SEQ ID NO: 232230 - RNA, 19 nt, Homo sapiens
gagaagcagauguagaguu

SEQ ID NO: 232231 - RNA, 19 nt, Homo sapiens
uggauuggguuaugaaaca

SEQ ID NO: 232232 - RNA, 19 nt, Homo sapiens
gcccaauagaguuuaaaua

SEQ ID NO: 232233 - RNA, 19 nt, Homo sapiens
aagcagauguagaguuugu

SEQ ID NO: 232234 - RNA, 19 nt, Homo sapiens
gacuaugguggcuauaaua

SEQ ID NO: 232235 - RNA, 19 nt, Homo sapiens
agauuuggguugauguauu

SEQ ID NO: 232236 - RNA, 19 nt, Homo sapiens
gugcugccuucauaagauu

SEQ ID NO: 232237 - RNA, 19 nt, Homo sapiens
aagaggaaauaguucaguu

SEQ ID NO: 232238 - RNA, 19 nt, Homo sapiens
gguggucauuucguacaua

SEQ ID NO: 232239 - RNA, 19 nt, Homo sapiens
ucaugguggucauuucgua

SEQ ID NO: 232240 - RNA, 19 nt, Homo sapiens
aaaugaaaccuguugaugu

SEQ ID NO: 232241 - RNA, 19 nt, Homo sapiens
aggcauagcucugaaacau

SEQ ID NO: 232242 - RNA, 19 nt, Homo sapiens
ugacugaaggaauguguuu

SEQ ID NO: 232243 - RNA, 19 nt, Homo sapiens
caacaaguccaugucauag

SEQ ID NO: 232244 - RNA, 19 nt, Homo sapiens
gacacaagaauucaguauu

SEQ ID NO: 232245 - RNA, 19 nt, Homo sapiens
ggaguauaaauucagcuaa

SEQ ID NO: 232246 - RNA, 19 nt, Homo sapiens
ggaauagagcuugacaaau

SEQ ID NO: 232247 - RNA, 19 nt, Homo sapiens
caucuggaauagagcuuga

SEQ ID NO: 232248 - RNA, 19 nt, Homo sapiens
gggaggacauggcuauggu

SEQ ID NO: 232249 - RNA, 19 nt, Homo sapiens
gcaguuggguuuuguaucu

SEQ ID NO: 232250 - RNA, 19 nt, Homo sapiens
gcauaaagaucauccuuga

SEQ ID NO: 232251 - RNA, 19 nt, Homo sapiens
gcaguauucuggaaaguuu

SEQ ID NO: 232252 - RNA, 19 nt, Homo sapiens
ugacagaguuguucuuauu

SEQ ID NO: 232253 - RNA, 19 nt, Homo sapiens
gauaauuucucaccuauag

SEQ ID NO: 232254 - RNA, 19 nt, Homo sapiens
gcagcaaguuuauuaauca

SEQ ID NO: 232255 - RNA, 19 nt, Homo sapiens
gcagauggcuuaugaacca

SEQ ID NO: 232256 - RNA, 19 nt, Homo sapiens
gacuuaaacugucaauuug

SEQ ID NO: 232257 - RNA, 19 nt, Homo sapiens
ggaagugacuaaugcugaa

SEQ ID NO: 232258 - RNA, 19 nt, Homo sapiens
gagcgcauauugaguauca

SEQ ID NO: 232259 - RNA, 19 nt, Homo sapiens
ggucaaaggugcuaaaauu

SEQ ID NO: 232260 - RNA, 19 nt, Homo sapiens
ggaagaggaacaagcauuu

SEQ ID NO: 232261 - RNA, 19 nt, Homo sapiens
gaaggauucuaaugcaaga

SEQ ID NO: 232262 - RNA, 19 nt, Homo sapiens
gaucuugguggaccuauua

SEQ ID NO: 232263 - RNA, 19 nt, Homo sapiens
gaugaaaccuaugauuaug

SEQ ID NO: 232264 - RNA, 19 nt, Homo sapiens
ggugauuucuugaugguuu

SEQ ID NO: 232265 - RNA, 19 nt, Homo sapiens
gaagaggaacaagcauuua

SEQ ID NO: 232266 - RNA, 19 nt, Homo sapiens
acaaguaacuauucccaaa

SEQ ID NO: 232267 - RNA, 19 nt, Homo sapiens
cagaauggcagauggcuua

SEQ ID NO: 232268 - RNA, 19 nt, Homo sapiens
aaaggaggcaagaauauua

SEQ ID NO: 232269 - RNA, 19 nt, Homo sapiens
uagaaacacugaugagaug

SEQ ID NO: 232270 - RNA, 19 nt, Homo sapiens
guucugcucugcaaggaua

SEQ ID NO: 232271 - RNA, 19 nt, Homo sapiens
gaagcaguaugcagauguu

SEQ ID NO: 232272 - RNA, 19 nt, Homo sapiens
uuaaagaacuucgagagaa

SEQ ID NO: 232273 - RNA, 19 nt, Homo sapiens
gagcaguacuacaaguuga

SEQ ID NO: 232274 - RNA, 19 nt, Homo sapiens
gaagaaauuccaucauaca

SEQ ID NO: 232275 - RNA, 19 nt, Homo sapiens
gagguguagugaaaucuuu

SEQ ID NO: 232276 - RNA, 19 nt, Homo sapiens
cauuugagguguagugaaa

SEQ ID NO: 232277 - RNA, 19 nt, Homo sapiens
gaacacaggaccagauaca

SEQ ID NO: 232278 - RNA, 19 nt, Homo sapiens
gcaccgaccucgacgucuu

SEQ ID NO: 232279 - RNA, 19 nt, Homo sapiens
ccauuucucuguuguaugu

SEQ ID NO: 232280 - RNA, 19 nt, Homo sapiens
ucauagguguucugcauuu

SEQ ID NO: 232281 - RNA, 19 nt, Homo sapiens
cugaugagaugguugaauu

SEQ ID NO: 232282 - RNA, 19 nt, Homo sapiens
ugaaacagcagcagaguga

SEQ ID NO: 232283 - RNA, 19 nt, Homo sapiens
aaacaaauccgucaugagu

SEQ ID NO: 232284 - RNA, 19 nt, Homo sapiens
ucuguuguauguuggauua

SEQ ID NO: 232285 - RNA, 19 nt, Homo sapiens
guaugcagauguugaagga

SEQ ID NO: 232286 - RNA, 19 nt, Homo sapiens
uagcagagcucggaaucuu

SEQ ID NO: 232287 - RNA, 19 nt, Homo sapiens
uuucucaccuauagacuua

SEQ ID NO: 232288 - RNA, 19 nt, Homo sapiens
gaagcaguauucuggaaag

SEQ ID NO: 232289 - RNA, 19 nt, Homo sapiens
uaaacgcccugcagaagau

SEQ ID NO: 232290 - RNA, 19 nt, Homo sapiens
uaucuuggcauuuguauug

SEQ ID NO: 232291 - RNA, 19 nt, Homo sapiens
gauguaccauuucucuguu

SEQ ID NO: 232292 - RNA, 19 nt, Homo sapiens
ggucagcggauuaaacaaa

SEQ ID NO: 232293 - RNA, 19 nt, Homo sapiens
gcucugcaaggauauauaa

SEQ ID NO: 232294 - RNA, 19 nt, Homo sapiens
ucaauuugcucuagugucu

SEQ ID NO: 232295 - RNA, 19 nt, Homo sapiens
caaaauugaugagccuuua

SEQ ID NO: 232296 - RNA, 19 nt, Homo sapiens
aauggcagauggcuuauga

SEQ ID NO: 232297 - RNA, 19 nt, Homo sapiens
cgaugaaaccuaugauuau

SEQ ID NO: 232298 - RNA, 19 nt, Homo sapiens
ggaaaaggaggcaagaaua

SEQ ID NO: 232299 - RNA, 19 nt, Homo sapiens
uguaguaucuuggcauuug

SEQ ID NO: 232300 - RNA, 19 nt, Homo sapiens
uauguuggauuauguagga

SEQ ID NO: 232301 - RNA, 19 nt, Homo sapiens
aauuugcucuagugucuua

SEQ ID NO: 232302 - RNA, 19 nt, Homo sapiens
uuaaacaaauccgucauga

SEQ ID NO: 232303 - RNA, 19 nt, Homo sapiens
acgaugaaaccuaugauua

SEQ ID NO: 232304 - RNA, 19 nt, Homo sapiens
ggaacaagcauuuaaaaga

SEQ ID NO: 232305 - RNA, 19 nt, Homo sapiens
gcucuagugucuuauuagu

SEQ ID NO: 232306 - RNA, 19 nt, Homo sapiens
ggcagcaaguuuauuaauc

SEQ ID NO: 232307 - RNA, 19 nt, Homo sapiens
aaacugaacagccagaaga

SEQ ID NO: 232308 - RNA, 19 nt, Homo sapiens
ugauuggugugcccguuua

SEQ ID NO: 232309 - RNA, 19 nt, Homo sapiens
uaccaacacuauaaaggaa

SEQ ID NO: 232310 - RNA, 19 nt, Homo sapiens
guaaacgcccugcagaaga

SEQ ID NO: 232311 - RNA, 19 nt, Homo sapiens
agaacagugugaagcagua

SEQ ID NO: 232312 - RNA, 19 nt, Homo sapiens
guaacuauucccaaagauu

SEQ ID NO: 232313 - RNA, 19 nt, Homo sapiens
guuguagagugcauaaaga

SEQ ID NO: 232314 - RNA, 19 nt, Homo sapiens
caaaccaccaucaagcuuu

SEQ ID NO: 232315 - RNA, 19 nt, Homo sapiens
uaaagaacuucgagagaac

SEQ ID NO: 232316 - RNA, 19 nt, Homo sapiens
gaucuagaaacacugauga

SEQ ID NO: 232317 - RNA, 19 nt, Homo sapiens
caccagauguaauguuuua

SEQ ID NO: 232318 - RNA, 19 nt, Homo sapiens
gcaguaugcagauguugaa

SEQ ID NO: 232319 - RNA, 19 nt, Homo sapiens
aaucaucccuaccuuggaa

SEQ ID NO: 232320 - RNA, 19 nt, Homo sapiens
caaguugaguaaugguaug

SEQ ID NO: 232321 - RNA, 19 nt, Homo sapiens
caaaauaacuuggcaaacu

SEQ ID NO: 232322 - RNA, 19 nt, Homo sapiens
auaagugcaucucuuguug

SEQ ID NO: 232323 - RNA, 19 nt, Homo sapiens
uaacaauaguccacauguc

SEQ ID NO: 232324 - RNA, 19 nt, Homo sapiens
cuugguggaccuauuauua

SEQ ID NO: 232325 - RNA, 19 nt, Homo sapiens
guagagugcauaaagauca

SEQ ID NO: 232326 - RNA, 19 nt, Homo sapiens
ggaagagggccugcaguug

SEQ ID NO: 232327 - RNA, 19 nt, Homo sapiens
gaaaaggaggcaagaauau

SEQ ID NO: 232328 - RNA, 19 nt, Homo sapiens
gugaagcaguauucuggaa

SEQ ID NO: 232329 - RNA, 19 nt, Homo sapiens
gucgggagcuucgaucaaa

SEQ ID NO: 232330 - RNA, 19 nt, Homo sapiens
caaagguggucagcggauu

SEQ ID NO: 232331 - RNA, 19 nt, Homo sapiens
ggauaugauuauuccuaug

SEQ ID NO: 232332 - RNA, 19 nt, Homo sapiens
cgaaucugaugcuguggaa

SEQ ID NO: 232333 - RNA, 19 nt, Homo sapiens
gaguaaugguaugaguaua

SEQ ID NO: 232334 - RNA, 19 nt, Homo sapiens
ggauucuaaugcaagauau

SEQ ID NO: 232335 - RNA, 19 nt, Homo sapiens
gauuuggcuggaucuauua

SEQ ID NO: 232336 - RNA, 19 nt, Homo sapiens
gaguugaggcuguugauuc

SEQ ID NO: 232337 - RNA, 19 nt, Homo sapiens
cauauaagugcaucucuug

SEQ ID NO: 232338 - RNA, 19 nt, Homo sapiens
caacauuccucugcuucau

SEQ ID NO: 232339 - RNA, 19 nt, Homo sapiens
guugaaggauucuaaugca

SEQ ID NO: 232340 - RNA, 19 nt, Homo sapiens
ggagcaguacuacaaguug

SEQ ID NO: 232341 - RNA, 19 nt, Homo sapiens
cacaguauuugcugcagaa

SEQ ID NO: 232342 - RNA, 19 nt, Homo sapiens
cggauaugauuauuccuau

SEQ ID NO: 232343 - RNA, 19 nt, Homo sapiens
uccuugaucuuauaucuga

SEQ ID NO: 232344 - RNA, 19 nt, Homo sapiens
gagucuagcaggaggaauu

SEQ ID NO: 232345 - RNA, 19 nt, Homo sapiens
cagcagagugaguggauuu

SEQ ID NO: 232346 - RNA, 19 nt, Homo sapiens
guucugcauuugaggugua

SEQ ID NO: 232347 - RNA, 19 nt, Homo sapiens
cuucauagguguucugcau

SEQ ID NO: 232348 - RNA, 19 nt, Homo sapiens
uuuauagugugaagcagua

SEQ ID NO: 232349 - RNA, 19 nt, Homo sapiens
gaccuauuauuacuacaca

SEQ ID NO: 232350 - RNA, 19 nt, Homo sapiens
gcauaaagaucauccuuga

SEQ ID NO: 232351 - RNA, 19 nt, Homo sapiens
gcaguauucuggaaaguuu

SEQ ID NO: 232352 - RNA, 19 nt, Homo sapiens
ugacagaguuguucuuauu

SEQ ID NO: 232353 - RNA, 19 nt, Homo sapiens
gauaauuucucaccuauag

SEQ ID NO: 232354 - RNA, 19 nt, Homo sapiens
gcagcaaguuuauuaauca

SEQ ID NO: 232355 - RNA, 19 nt, Homo sapiens
gcagauggcuuaugaacca

SEQ ID NO: 232356 - RNA, 19 nt, Homo sapiens
gacuuaaacugucaauuug

SEQ ID NO: 232357 - RNA, 19 nt, Homo sapiens
ggaagugacuaaugcugaa

SEQ ID NO: 232358 - RNA, 19 nt, Homo sapiens
gagcgcauauugaguauca

SEQ ID NO: 232359 - RNA, 19 nt, Homo sapiens
ggucaaaggugcuaaaauu

SEQ ID NO: 232360 - RNA, 19 nt, Homo sapiens
ggaagaggaacaagcauuu

SEQ ID NO: 232361 - RNA, 19 nt, Homo sapiens
gaucuugguggaccuauua

SEQ ID NO: 232362 - RNA, 19 nt, Homo sapiens
gaugaaaccuaugauuaug

SEQ ID NO: 232363 - RNA, 19 nt, Homo sapiens
ggugauuucuugaugguuu

SEQ ID NO: 232364 - RNA, 19 nt, Homo sapiens
gaagaggaacaagcauuua

SEQ ID NO: 232365 - RNA, 19 nt, Homo sapiens
acaaguaacuauucccaaa

SEQ ID NO: 232366 - RNA, 19 nt, Homo sapiens
cagaauggcagauggcuua

SEQ ID NO: 232367 - RNA, 19 nt, Homo sapiens
aaaggaggcaagaauauua

SEQ ID NO: 232368 - RNA, 19 nt, Homo sapiens
uagaaacacugaugagaug

SEQ ID NO: 232369 - RNA, 19 nt, Homo sapiens
guucugcucugcaaggaua

SEQ ID NO: 232370 - RNA, 19 nt, Homo sapiens
uuaaagaacuucgagagaa

SEQ ID NO: 232371 - RNA, 19 nt, Homo sapiens
gagcaguacuacaaguuga

SEQ ID NO: 232372 - RNA, 19 nt, Homo sapiens
gaagaaauuccaucauaca

SEQ ID NO: 232373 - RNA, 19 nt, Homo sapiens
gagguguagugaaaucuuu

SEQ ID NO: 232374 - RNA, 19 nt, Homo sapiens
cauuugagguguagugaaa

SEQ ID NO: 232375 - RNA, 19 nt, Homo sapiens
gaacacaggaccagauaca

SEQ ID NO: 232376 - RNA, 19 nt, Homo sapiens
gcaccgaccucgacgucuu

SEQ ID NO: 232377 - RNA, 19 nt, Homo sapiens
ccauuucucuguuguaugu

SEQ ID NO: 232378 - RNA, 19 nt, Homo sapiens
ucauagguguucugcauuu

SEQ ID NO: 232379 - RNA, 19 nt, Homo sapiens
cugaugagaugguugaauu

SEQ ID NO: 232380 - RNA, 19 nt, Homo sapiens
ugaaacagcagcagaguga

SEQ ID NO: 232381 - RNA, 19 nt, Homo sapiens
aaacaaauccgucaugagu

SEQ ID NO: 232382 - RNA, 19 nt, Homo sapiens
ucuguuguauguuggauua

SEQ ID NO: 232383 - RNA, 19 nt, Homo sapiens
uagcagagcucggaaucuu

SEQ ID NO: 232384 - RNA, 19 nt, Homo sapiens
uuucucaccuauagacuua

SEQ ID NO: 232385 - RNA, 19 nt, Homo sapiens
gaagcaguauucuggaaag

SEQ ID NO: 232386 - RNA, 19 nt, Homo sapiens
uaaacgcccugcagaagau

SEQ ID NO: 232387 - RNA, 19 nt, Homo sapiens
uaucuuggcauuuguauug

SEQ ID NO: 232388 - RNA, 19 nt, Homo sapiens
gauguaccauuucucuguu

SEQ ID NO: 232389 - RNA, 19 nt, Homo sapiens
ggucagcggauuaaacaaa

SEQ ID NO: 232390 - RNA, 19 nt, Homo sapiens
gcucugcaaggauauauaa

SEQ ID NO: 232391 - RNA, 19 nt, Homo sapiens
ucaauuugcucuagugucu

SEQ ID NO: 232392 - RNA, 19 nt, Homo sapiens
caaaauugaugagccuuua

SEQ ID NO: 232393 - RNA, 19 nt, Homo sapiens
aauggcagauggcuuauga

SEQ ID NO: 232394 - RNA, 19 nt, Homo sapiens
cgaugaaaccuaugauuau

SEQ ID NO: 232395 - RNA, 19 nt, Homo sapiens
ggaaaaggaggcaagaaua

SEQ ID NO: 232396 - RNA, 19 nt, Homo sapiens
uguaguaucuuggcauuug

SEQ ID NO: 232397 - RNA, 19 nt, Homo sapiens
uauguuggauuauguagga

SEQ ID NO: 232398 - RNA, 19 nt, Homo sapiens
aauuugcucuagugucuua

SEQ ID NO: 232399 - RNA, 19 nt, Homo sapiens
uuaaacaaauccgucauga

SEQ ID NO: 232400 - RNA, 19 nt, Homo sapiens
acgaugaaaccuaugauua

SEQ ID NO: 232401 - RNA, 19 nt, Homo sapiens
ggaacaagcauuuaaaaga

SEQ ID NO: 232402 - RNA, 19 nt, Homo sapiens
gcucuagugucuuauuagu

SEQ ID NO: 232403 - RNA, 19 nt, Homo sapiens
aaacugaacagccagaaga

SEQ ID NO: 232404 - RNA, 19 nt, Homo sapiens
ggcagcaaguuuauuaauc

SEQ ID NO: 232405 - RNA, 19 nt, Homo sapiens
ugauuggugugcccguuua

SEQ ID NO: 232406 - RNA, 19 nt, Homo sapiens
uaccaacacuauaaaggaa

SEQ ID NO: 232407 - RNA, 19 nt, Homo sapiens
guaaacgcccugcagaaga

SEQ ID NO: 232408 - RNA, 19 nt, Homo sapiens
agaacagugugaagcagua

SEQ ID NO: 232409 - RNA, 19 nt, Homo sapiens
guaacuauucccaaagauu

SEQ ID NO: 232410 - RNA, 19 nt, Homo sapiens
guuguagagugcauaaaga

SEQ ID NO: 232411 - RNA, 19 nt, Homo sapiens
caaaccaccaucaagcuuu

SEQ ID NO: 232412 - RNA, 19 nt, Homo sapiens
uaaagaacuucgagagaac

SEQ ID NO: 232413 - RNA, 19 nt, Homo sapiens
gaucuagaaacacugauga

SEQ ID NO: 232414 - RNA, 19 nt, Homo sapiens
caccagauguaauguuuua

SEQ ID NO: 232415 - RNA, 19 nt, Homo sapiens
aaucaucccuaccuuggaa

SEQ ID NO: 232416 - RNA, 19 nt, Homo sapiens
caaguugaguaaugguaug

SEQ ID NO: 232417 - RNA, 19 nt, Homo sapiens
caaaauaacuuggcaaacu

SEQ ID NO: 232418 - RNA, 19 nt, Homo sapiens
auaagugcaucucuuguug

SEQ ID NO: 232419 - RNA, 19 nt, Homo sapiens
uaacaauaguccacauguc

SEQ ID NO: 232420 - RNA, 19 nt, Homo sapiens
cuugguggaccuauuauua

SEQ ID NO: 232421 - RNA, 19 nt, Homo sapiens
guagagugcauaaagauca

SEQ ID NO: 232422 - RNA, 19 nt, Homo sapiens
ggaagagggccugcaguug

SEQ ID NO: 232423 - RNA, 19 nt, Homo sapiens
gaaaaggaggcaagaauau

SEQ ID NO: 232424 - RNA, 19 nt, Homo sapiens
gugaagcaguauucuggaa

SEQ ID NO: 232425 - RNA, 19 nt, Homo sapiens
gucgggagcuucgaucaaa

SEQ ID NO: 232426 - RNA, 19 nt, Homo sapiens
caaagguggucagcggauu

SEQ ID NO: 232427 - RNA, 19 nt, Homo sapiens
ggauaugauuauuccuaug

SEQ ID NO: 232428 - RNA, 19 nt, Homo sapiens
cgaaucugaugcuguggaa

SEQ ID NO: 232429 - RNA, 19 nt, Homo sapiens
gaguaaugguaugaguaua

SEQ ID NO: 232430 - RNA, 19 nt, Homo sapiens
gauuuggcuggaucuauua

SEQ ID NO: 232431 - RNA, 19 nt, Homo sapiens
gaguugaggcuguugauuc

SEQ ID NO: 232432 - RNA, 19 nt, Homo sapiens
cauauaagugcaucucuug

SEQ ID NO: 232433 - RNA, 19 nt, Homo sapiens
caacauuccucugcuucau

SEQ ID NO: 232434 - RNA, 19 nt, Homo sapiens
ggagcaguacuacaaguug

SEQ ID NO: 232435 - RNA, 19 nt, Homo sapiens
cacaguauuugcugcagaa

SEQ ID NO: 232436 - RNA, 19 nt, Homo sapiens
cggauaugauuauuccuau

SEQ ID NO: 232437 - RNA, 19 nt, Homo sapiens
uccuugaucuuauaucuga

SEQ ID NO: 232438 - RNA, 19 nt, Homo sapiens
gagucuagcaggaggaauu

SEQ ID NO: 232439 - RNA, 19 nt, Homo sapiens
cagcagagugaguggauuu

SEQ ID NO: 232440 - RNA, 19 nt, Homo sapiens
guucugcauuugaggugua

SEQ ID NO: 232441 - RNA, 19 nt, Homo sapiens
cuucauagguguucugcau

SEQ ID NO: 232442 - RNA, 19 nt, Homo sapiens
gaccuauuauuacuacaca

SEQ ID NO: 232443 - RNA, 19 nt, Homo sapiens
guaggaauguuuguguaca

SEQ ID NO: 232444 - RNA, 19 nt, Homo sapiens
cugauuggcagcaaguuua

SEQ ID NO: 232445 - RNA, 19 nt, Homo sapiens
auaauaagcuggggauuuu

SEQ ID NO: 232446 - RNA, 19 nt, Homo sapiens
aaguaacuauucccaaaga

SEQ ID NO: 232447 - RNA, 19 nt, Homo sapiens
ugaaaccuaugauuauggu

SEQ ID NO: 232448 - RNA, 19 nt, Homo sapiens
agacuacaaugccaguguu

SEQ ID NO: 232449 - RNA, 19 nt, Homo sapiens
aagaggaacaagcauuuaa

SEQ ID NO: 232450 - RNA, 19 nt, Homo sapiens
gcauaaagaucauccuuga

SEQ ID NO: 232451 - RNA, 19 nt, Homo sapiens
gcaguauucuggaaaguuu

SEQ ID NO: 232452 - RNA, 19 nt, Homo sapiens
ugacagaguuguucuuauu

SEQ ID NO: 232453 - RNA, 19 nt, Homo sapiens
gauaauuucucaccuauag

SEQ ID NO: 232454 - RNA, 19 nt, Homo sapiens
gcagcaaguuuauuaauca

SEQ ID NO: 232455 - RNA, 19 nt, Homo sapiens
gcagauggcuuaugaacca

SEQ ID NO: 232456 - RNA, 19 nt, Homo sapiens
ucaaagaacuucgagagaa

SEQ ID NO: 232457 - RNA, 19 nt, Homo sapiens
gacuuaaacugucaauuug

SEQ ID NO: 232458 - RNA, 19 nt, Homo sapiens
ggaagugacuaaugcugaa

SEQ ID NO: 232459 - RNA, 19 nt, Homo sapiens
gagcgcauauugaguauca

SEQ ID NO: 232460 - RNA, 19 nt, Homo sapiens
ggaagaggaacaagcauuu

SEQ ID NO: 232461 - RNA, 19 nt, Homo sapiens
gaaggauucuaaugcaaga

SEQ ID NO: 232462 - RNA, 19 nt, Homo sapiens
gaucuugguggaccuauua

SEQ ID NO: 232463 - RNA, 19 nt, Homo sapiens
gaugaaaccuaugauuaug

SEQ ID NO: 232464 - RNA, 19 nt, Homo sapiens
ggugauuucuugaugguuu

SEQ ID NO: 232465 - RNA, 19 nt, Homo sapiens
gaagaggaacaagcauuua

SEQ ID NO: 232466 - RNA, 19 nt, Homo sapiens
acaaguaacuauucccaaa

SEQ ID NO: 232467 - RNA, 19 nt, Homo sapiens
cagaauggcagauggcuua

SEQ ID NO: 232468 - RNA, 19 nt, Homo sapiens
guucugcucugcaaggaua

SEQ ID NO: 232469 - RNA, 19 nt, Homo sapiens
aaaggaggcaagaauauua

SEQ ID NO: 232470 - RNA, 19 nt, Homo sapiens
uagaaacacugaugagaug

SEQ ID NO: 232471 - RNA, 19 nt, Homo sapiens
gaagcaguaugcagauguu

SEQ ID NO: 232472 - RNA, 19 nt, Homo sapiens
gagcaguacuacaaguuga

SEQ ID NO: 232473 - RNA, 19 nt, Homo sapiens
gaagaaauuccaucauaca

SEQ ID NO: 232474 - RNA, 19 nt, Homo sapiens
gagguguagugaaaucuuu

SEQ ID NO: 232475 - RNA, 19 nt, Homo sapiens
cauuugagguguagugaaa

SEQ ID NO: 232476 - RNA, 19 nt, Homo sapiens
gaacacaggaccagauaca

SEQ ID NO: 232477 - RNA, 19 nt, Homo sapiens
ccauuucucuguuguaugu

SEQ ID NO: 232478 - RNA, 19 nt, Homo sapiens
ucauagguguucugcauuu

SEQ ID NO: 232479 - RNA, 19 nt, Homo sapiens
cugaugagaugguugaauu

SEQ ID NO: 232480 - RNA, 19 nt, Homo sapiens
ugaaacagcagcagaguga

SEQ ID NO: 232481 - RNA, 19 nt, Homo sapiens
aaacaaauccgucaugagu

SEQ ID NO: 232482 - RNA, 19 nt, Homo sapiens
ucuguuguauguuggauua

SEQ ID NO: 232483 - RNA, 19 nt, Homo sapiens
guaugcagauguugaagga

SEQ ID NO: 232484 - RNA, 19 nt, Homo sapiens
uagcagagcucggaaucuu

SEQ ID NO: 232485 - RNA, 19 nt, Homo sapiens
uuucucaccuauagacuua

SEQ ID NO: 232486 - RNA, 19 nt, Homo sapiens
gaagcaguauucuggaaag

SEQ ID NO: 232487 - RNA, 19 nt, Homo sapiens
uaaacgcccugcagaagau

SEQ ID NO: 232488 - RNA, 19 nt, Homo sapiens
uaucuuggcauuuguauug

SEQ ID NO: 232489 - RNA, 19 nt, Homo sapiens
gauguaccauuucucuguu

SEQ ID NO: 232490 - RNA, 19 nt, Homo sapiens
gcucugcaaggauauauaa

SEQ ID NO: 232491 - RNA, 19 nt, Homo sapiens
ggucagcggauuaaacaaa

SEQ ID NO: 232492 - RNA, 19 nt, Homo sapiens
ggucaaaggugcuaaaauc

SEQ ID NO: 232493 - RNA, 19 nt, Homo sapiens
ucaauuugcucuagugucu

SEQ ID NO: 232494 - RNA, 19 nt, Homo sapiens
caaaauugaugagccuuua

SEQ ID NO: 232495 - RNA, 19 nt, Homo sapiens
aauggcagauggcuuauga

SEQ ID NO: 232496 - RNA, 19 nt, Homo sapiens
cgaugaaaccuaugauuau

SEQ ID NO: 232497 - RNA, 19 nt, Homo sapiens
caaagaacuucgagagaac

SEQ ID NO: 232498 - RNA, 19 nt, Homo sapiens
ggaaaaggaggcaagaaua

SEQ ID NO: 232499 - RNA, 19 nt, Homo sapiens
uguaguaucuuggcauuug

SEQ ID NO: 232500 - RNA, 19 nt, Homo sapiens
uauguuggauuauguagga

SEQ ID NO: 232501 - RNA, 19 nt, Homo sapiens
aauuugcucuagugucuua

SEQ ID NO: 232502 - RNA, 19 nt, Homo sapiens
uuaaacaaauccgucauga

SEQ ID NO: 232503 - RNA, 19 nt, Homo sapiens
acgaugaaaccuaugauua

SEQ ID NO: 232504 - RNA, 19 nt, Homo sapiens
ggaacaagcauuuaaaaga

SEQ ID NO: 232505 - RNA, 19 nt, Homo sapiens
aaacugaacagccagaaga

SEQ ID NO: 232506 - RNA, 19 nt, Homo sapiens
gcucuagugucuuauuagu

SEQ ID NO: 232507 - RNA, 19 nt, Homo sapiens
guaaacgcccugcagaaga

SEQ ID NO: 232508 - RNA, 19 nt, Homo sapiens
ggcagcaaguuuauuaauc

SEQ ID NO: 232509 - RNA, 19 nt, Homo sapiens
ugauuggugugcccguuua

SEQ ID NO: 232510 - RNA, 19 nt, Homo sapiens
caaaggugcuaaaaucaaa

SEQ ID NO: 232511 - RNA, 19 nt, Homo sapiens
uaccaacacuauaaaggaa

SEQ ID NO: 232512 - RNA, 19 nt, Homo sapiens
agaacagugugaagcagua

SEQ ID NO: 232513 - RNA, 19 nt, Homo sapiens
guaacuauucccaaagauu

SEQ ID NO: 232514 - RNA, 19 nt, Homo sapiens
guuguagagugcauaaaga

SEQ ID NO: 232515 - RNA, 19 nt, Homo sapiens
caaaccaccaucaagcuuu

SEQ ID NO: 232516 - RNA, 19 nt, Homo sapiens
gaucuagaaacacugauga

SEQ ID NO: 232517 - RNA, 19 nt, Homo sapiens
caccagauguaauguuuua

SEQ ID NO: 232518 - RNA, 19 nt, Homo sapiens
gcaguaugcagauguugaa

SEQ ID NO: 232519 - RNA, 19 nt, Homo sapiens
aaucaucccuaccuuggaa

SEQ ID NO: 232520 - RNA, 19 nt, Homo sapiens
caaguugaguaaugguaug

SEQ ID NO: 232521 - RNA, 19 nt, Homo sapiens
caaaauaacuuggcaaacu

SEQ ID NO: 232522 - RNA, 19 nt, Homo sapiens
auaagugcaucucuuguug

SEQ ID NO: 232523 - RNA, 19 nt, Homo sapiens
uaacaauaguccacauguc

SEQ ID NO: 232524 - RNA, 19 nt, Homo sapiens
ggacagggaggaaaaguaa

SEQ ID NO: 232525 - RNA, 19 nt, Homo sapiens
cuugguggaccuauuauua

SEQ ID NO: 232526 - RNA, 19 nt, Homo sapiens
guagagugcauaaagauca

SEQ ID NO: 232527 - RNA, 19 nt, Homo sapiens
ggaagagggccugcaguug

SEQ ID NO: 232528 - RNA, 19 nt, Homo sapiens
gaaaaggaggcaagaauau

SEQ ID NO: 232529 - RNA, 19 nt, Homo sapiens
gugaagcaguauucuggaa

SEQ ID NO: 232530 - RNA, 19 nt, Homo sapiens
gucgggagcuucgaucaaa

SEQ ID NO: 232531 - RNA, 19 nt, Homo sapiens
caaagguggucagcggauu

SEQ ID NO: 232532 - RNA, 19 nt, Homo sapiens
ggauaugauuauuccuaug

SEQ ID NO: 232533 - RNA, 19 nt, Homo sapiens
cgaaucugaugcuguggaa

SEQ ID NO: 232534 - RNA, 19 nt, Homo sapiens
gaguaaugguaugaguaua

SEQ ID NO: 232535 - RNA, 19 nt, Homo sapiens
ggauucuaaugcaagauau

SEQ ID NO: 232536 - RNA, 19 nt, Homo sapiens
gauuuggcuggaucuauua

SEQ ID NO: 232537 - RNA, 19 nt, Homo sapiens
gaguugaggcuguugauuc

SEQ ID NO: 232538 - RNA, 19 nt, Homo sapiens
cauauaagugcaucucuug

SEQ ID NO: 232539 - RNA, 19 nt, Homo sapiens
caacauuccucugcuucau

SEQ ID NO: 232540 - RNA, 19 nt, Homo sapiens
guugaaggauucuaaugca

SEQ ID NO: 232541 - RNA, 19 nt, Homo sapiens
ggagcaguacuacaaguug

SEQ ID NO: 232542 - RNA, 19 nt, Homo sapiens
cacaguauuugcugcagaa

SEQ ID NO: 232543 - RNA, 19 nt, Homo sapiens
cggauaugauuauuccuau

SEQ ID NO: 232544 - RNA, 19 nt, Homo sapiens
uccuugaucuuauaucuga

SEQ ID NO: 232545 - RNA, 19 nt, Homo sapiens
gagucuagcaggaggaauu

SEQ ID NO: 232546 - RNA, 19 nt, Homo sapiens
cagcagagugaguggauuu

SEQ ID NO: 232547 - RNA, 19 nt, Homo sapiens
guucugcauuugaggugua

SEQ ID NO: 232548 - RNA, 19 nt, Homo sapiens
cuucauagguguucugcau

SEQ ID NO: 232549 - RNA, 19 nt, Homo sapiens
uuuauagugugaagcagua

SEQ ID NO: 232550 - RNA, 19 nt, Homo sapiens
gaacuguuaucucccaaga

SEQ ID NO: 232551 - RNA, 19 nt, Homo sapiens
gaaaguauucucaggcaaa

SEQ ID NO: 232552 - RNA, 19 nt, Homo sapiens
gacaagcacugguggaguu

SEQ ID NO: 232553 - RNA, 19 nt, Homo sapiens
agacauuucucuuuccuuu

SEQ ID NO: 232554 - RNA, 19 nt, Homo sapiens
gaacagugugcuucucuuu

SEQ ID NO: 232555 - RNA, 19 nt, Homo sapiens
ucagcacgccuccuaauua

SEQ ID NO: 232556 - RNA, 19 nt, Homo sapiens
caucaugccuggucaguca

SEQ ID NO: 232557 - RNA, 19 nt, Homo sapiens
cuaagcggcucaagacuga

SEQ ID NO: 232558 - RNA, 19 nt, Homo sapiens
gcgaugagcugggagugaa

SEQ ID NO: 232559 - RNA, 19 nt, Homo sapiens
gccaaggccucucucaaug

SEQ ID NO: 232560 - RNA, 19 nt, Homo sapiens
caagauuaaccuucacuuu

SEQ ID NO: 232561 - RNA, 19 nt, Homo sapiens
caucuucugugaaaguauu

SEQ ID NO: 232562 - RNA, 19 nt, Homo sapiens
ccacagccauuaccaugau

SEQ ID NO: 232563 - RNA, 19 nt, Homo sapiens
gaagaucgaauacgcaaag

SEQ ID NO: 232564 - RNA, 19 nt, Homo sapiens
caucagcuaugugguggua

SEQ ID NO: 232565 - RNA, 19 nt, Homo sapiens
gcggccaucuucugugaaa

SEQ ID NO: 232566 - RNA, 19 nt, Homo sapiens
gaccgagucuucaaugucu

SEQ ID NO: 232567 - RNA, 19 nt, Homo sapiens
gcacucugaagaucgaaua

SEQ ID NO: 232568 - RNA, 19 nt, Homo sapiens
agaaugaucaggauacuug

SEQ ID NO: 232569 - RNA, 19 nt, Homo sapiens
gguggaauuugacucaguu

SEQ ID NO: 232570 - RNA, 19 nt, Homo sapiens
cagcacgccuccuaauuag

SEQ ID NO: 232571 - RNA, 19 nt, Homo sapiens
gaacuacgcagccgacaac

SEQ ID NO: 232572 - RNA, 19 nt, Homo sapiens
cauuugugcugcccaugua

SEQ ID NO: 232573 - RNA, 19 nt, Homo sapiens
guuuguagaggcuuacuua

SEQ ID NO: 232574 - RNA, 19 nt, Homo sapiens
guucaagaaugaucaggau

SEQ ID NO: 232575 - RNA, 19 nt, Homo sapiens
cggauguucuuuacacuau

SEQ ID NO: 232576 - RNA, 19 nt, Homo sapiens
uggaaacgcuggaaaucug

SEQ ID NO: 232577 - RNA, 19 nt, Homo sapiens
gcgaugcccuggagacucu

SEQ ID NO: 232578 - RNA, 19 nt, Homo sapiens
uuacccaccucaacaacaa

SEQ ID NO: 232579 - RNA, 19 nt, Homo sapiens
gcccugugcucauggucua

SEQ ID NO: 232580 - RNA, 19 nt, Homo sapiens
caauggggcugauaucuau

SEQ ID NO: 232581 - RNA, 19 nt, Homo sapiens
ccacggauguucuuuacac

SEQ ID NO: 232582 - RNA, 19 nt, Homo sapiens
ggaguuugaagauguguug

SEQ ID NO: 232583 - RNA, 19 nt, Homo sapiens
cgacaaccaaauauacauu

SEQ ID NO: 232584 - RNA, 19 nt, Homo sapiens
ggagugaagcggccaucuu

SEQ ID NO: 232585 - RNA, 19 nt, Homo sapiens
ucaccacggauguucuuua

SEQ ID NO: 232586 - RNA, 19 nt, Homo sapiens
caaaagaucuuguauuccu

SEQ ID NO: 232587 - RNA, 19 nt, Homo sapiens
ucaaugucuucugcuuaua

SEQ ID NO: 232588 - RNA, 19 nt, Homo sapiens
ccugaaccauuaccagaug

SEQ ID NO: 232589 - RNA, 19 nt, Homo sapiens
gccaucuucugugaaagua

SEQ ID NO: 232590 - RNA, 19 nt, Homo sapiens
aagcggccaucuucuguga

SEQ ID NO: 232591 - RNA, 19 nt, Homo sapiens
gacauuucucuuuccuuua

SEQ ID NO: 232592 - RNA, 19 nt, Homo sapiens
cgggagcgauggugaagau

SEQ ID NO: 232593 - RNA, 19 nt, Homo sapiens
gaaccauuaccagaugaaa

SEQ ID NO: 232594 - RNA, 19 nt, Homo sapiens
gggcagaagcugaaugucu

SEQ ID NO: 232595 - RNA, 19 nt, Homo sapiens
gagaucaccccgcagaaua

SEQ ID NO: 232596 - RNA, 19 nt, Homo sapiens
gauguucuuuacacuaucu

SEQ ID NO: 232597 - RNA, 19 nt, Homo sapiens
gacaaccaaauauacauug

SEQ ID NO: 232598 - RNA, 19 nt, Homo sapiens
cagccgacaaccaaauaua

SEQ ID NO: 232599 - RNA, 19 nt, Homo sapiens
gauugacggugugguggaa

SEQ ID NO: 232600 - RNA, 19 nt, Homo sapiens
cuagguuuguagaggcuua

SEQ ID NO: 232601 - RNA, 19 nt, Homo sapiens
ugggcuuccugaaccauua

SEQ ID NO: 232602 - RNA, 19 nt, Homo sapiens
caaugucuucugcuuauau

SEQ ID NO: 232603 - RNA, 19 nt, Homo sapiens
gaugguggaauuugacuca

SEQ ID NO: 232604 - RNA, 19 nt, Homo sapiens
guccagagaauugucauuu

SEQ ID NO: 232605 - RNA, 19 nt, Homo sapiens
gaucaccacggauguucuu

SEQ ID NO: 232606 - RNA, 19 nt, Homo sapiens
aagcacugguggaguuuga

SEQ ID NO: 232607 - RNA, 19 nt, Homo sapiens
acagugugcuucucuuuac

SEQ ID NO: 232608 - RNA, 19 nt, Homo sapiens
cuuggcacauuucaauaaa

SEQ ID NO: 232609 - RNA, 19 nt, Homo sapiens
gcaauguggagaaggugaa

SEQ ID NO: 232610 - RNA, 19 nt, Homo sapiens
uucaaugucuucugcuuau

SEQ ID NO: 232611 - RNA, 19 nt, Homo sapiens
gguggaagcagaccuugug

SEQ ID NO: 232612 - RNA, 19 nt, Homo sapiens
cuacgcagccgacaaccaa

SEQ ID NO: 232613 - RNA, 19 nt, Homo sapiens
uaaaugcuagguuuguaga

SEQ ID NO: 232614 - RNA, 19 nt, Homo sapiens
ugcaaaagaucuuguauuc

SEQ ID NO: 232615 - RNA, 19 nt, Homo sapiens
cugcuuauauggcaaugug

SEQ ID NO: 232616 - RNA, 19 nt, Homo sapiens
caagaaugaucaggauacu

SEQ ID NO: 232617 - RNA, 19 nt, Homo sapiens
ucagcuauguggugguaau

SEQ ID NO: 232618 - RNA, 19 nt, Homo sapiens
uaauggaaacgcuggaaau

SEQ ID NO: 232619 - RNA, 19 nt, Homo sapiens
ccagagaauugucauuuuc

SEQ ID NO: 232620 - RNA, 19 nt, Homo sapiens
caccacggauguucuuuac

SEQ ID NO: 232621 - RNA, 19 nt, Homo sapiens
guccauacccuuacacucu

SEQ ID NO: 232622 - RNA, 19 nt, Homo sapiens
ucuuugagaucugcgauga

SEQ ID NO: 232623 - RNA, 19 nt, Homo sapiens
aggcgaugguggaauuuga

SEQ ID NO: 232624 - RNA, 19 nt, Homo sapiens
gaauugucauuuucaggaa

SEQ ID NO: 232625 - RNA, 19 nt, Homo sapiens
gguggaguuugaagaugug

SEQ ID NO: 232626 - RNA, 19 nt, Homo sapiens
uguagaggcuuacuuaacc

SEQ ID NO: 232627 - RNA, 19 nt, Homo sapiens
gcucagcacgccuccuaau

SEQ ID NO: 232628 - RNA, 19 nt, Homo sapiens
acucugaaguuguguuucu

SEQ ID NO: 232629 - RNA, 19 nt, Homo sapiens
guuacaaagacuucaguga

SEQ ID NO: 232630 - RNA, 19 nt, Homo sapiens
cuucaaugucuucugcuua

SEQ ID NO: 232631 - RNA, 19 nt, Homo sapiens
cauggucuauggcuuggau

SEQ ID NO: 232632 - RNA, 19 nt, Homo sapiens
ugaacagugugcuucucuu

SEQ ID NO: 232633 - RNA, 19 nt, Homo sapiens
cagagcaggcagccaagaa

SEQ ID NO: 232634 - RNA, 19 nt, Homo sapiens
gucuauggcuuggaucaau

SEQ ID NO: 232635 - RNA, 19 nt, Homo sapiens
ucaagaaugaucaggauac

SEQ ID NO: 232636 - RNA, 19 nt, Homo sapiens
aacagugugcuucucuuua

SEQ ID NO: 232637 - RNA, 19 nt, Homo sapiens
uggcuuggaucaaucuaag

SEQ ID NO: 232638 - RNA, 19 nt, Homo sapiens
caaucucaguggacaaggu

SEQ ID NO: 232639 - RNA, 19 nt, Homo sapiens
auacuugggacuacacaaa

SEQ ID NO: 232640 - RNA, 19 nt, Homo sapiens
ucuuggcacauuucaauaa

SEQ ID NO: 232641 - RNA, 19 nt, Homo sapiens
ccauacccuuacacucuga

SEQ ID NO: 232642 - RNA, 19 nt, Homo sapiens
gcagccgacaaccaaauau

SEQ ID NO: 232643 - RNA, 19 nt, Homo sapiens
gugaccgagucuucaaugu

SEQ ID NO: 232644 - RNA, 19 nt, Homo sapiens
uucaggcgaugguggaauu

SEQ ID NO: 232645 - RNA, 19 nt, Homo sapiens
cuuacacucugaaguugug

SEQ ID NO: 232646 - RNA, 19 nt, Homo sapiens
gccauuacccaccucaaca

SEQ ID NO: 232647 - RNA, 19 nt, Homo sapiens
ggauguucuuuacacuauc

SEQ ID NO: 232648 - RNA, 19 nt, Homo sapiens
caagcagccagccaucaug

SEQ ID NO: 232649 - RNA, 19 nt, Homo sapiens
ccaagcagccagccaucau

SEQ ID NO: 232650 - RNA, 19 nt, Homo sapiens
gaagaaagauugugaaguu

SEQ ID NO: 232651 - RNA, 19 nt, Homo sapiens
gaacuaagauagagaagau

SEQ ID NO: 232652 - RNA, 19 nt, Homo sapiens
ggaaagaccuaccagaaca

SEQ ID NO: 232653 - RNA, 19 nt, Homo sapiens
guagaacucucguaugcua

SEQ ID NO: 232654 - RNA, 19 nt, Homo sapiens
gaagaaagcagaaguagag

SEQ ID NO: 232655 - RNA, 19 nt, Homo sapiens
gaacagaaaggcggagaua

SEQ ID NO: 232656 - RNA, 19 nt, Homo sapiens
gaugaagacuauaagcaaa

SEQ ID NO: 232657 - RNA, 19 nt, Homo sapiens
cguauuggcuggucacuaa

SEQ ID NO: 232658 - RNA, 19 nt, Homo sapiens
gcaaagaacacagaagaaa

SEQ ID NO: 232659 - RNA, 19 nt, Homo sapiens
cacaagaagucgacuguuu

SEQ ID NO: 232660 - RNA, 19 nt, Homo sapiens
gcgaaaagcuguuguaguu

SEQ ID NO: 232661 - RNA, 19 nt, Homo sapiens
ugaaagugaugaaguagaa

SEQ ID NO: 232662 - RNA, 19 nt, Homo sapiens
gacaauaacugggaagguu

SEQ ID NO: 232663 - RNA, 19 nt, Homo sapiens
uaagagaaccucagcauug

SEQ ID NO: 232664 - RNA, 19 nt, Homo sapiens
gaaauaaccuauguugaac

SEQ ID NO: 232665 - RNA, 19 nt, Homo sapiens
uagagaagauggaguguau

SEQ ID NO: 232666 - RNA, 19 nt, Homo sapiens
gaaagauugugaaguugug

SEQ ID NO: 232667 - RNA, 19 nt, Homo sapiens
gaacacuggcucaaagaaa

SEQ ID NO: 232668 - RNA, 19 nt, Homo sapiens
ugagugcuuugaugaaaua

SEQ ID NO: 232669 - RNA, 19 nt, Homo sapiens
gaaaagcuguuguaguuug

SEQ ID NO: 232670 - RNA, 19 nt, Homo sapiens
ccaguaaggcauuuauaua

SEQ ID NO: 232671 - RNA, 19 nt, Homo sapiens
gaagauggaguguauguag

SEQ ID NO: 232672 - RNA, 19 nt, Homo sapiens
gaagucgacuguuuucuuu

SEQ ID NO: 232673 - RNA, 19 nt, Homo sapiens
gaucauggccguggauauu

SEQ ID NO: 232674 - RNA, 19 nt, Homo sapiens
gaaguaaaauguugcuuug

SEQ ID NO: 232675 - RNA, 19 nt, Homo sapiens
gagaaugugucaguauuuc

SEQ ID NO: 232676 - RNA, 19 nt, Homo sapiens
aaacaaucguggcuacaaa

SEQ ID NO: 232677 - RNA, 19 nt, Homo sapiens
gaagagaacaaguauagca

SEQ ID NO: 232678 - RNA, 19 nt, Homo sapiens
gaugaaauaaccuauguug

SEQ ID NO: 232679 - RNA, 19 nt, Homo sapiens
ggaaauuuauugagauugc

SEQ ID NO: 232680 - RNA, 19 nt, Homo sapiens
gacugaagauuauggagaa

SEQ ID NO: 232681 - RNA, 19 nt, Homo sapiens
agagguagcugagugcuuu

SEQ ID NO: 232682 - RNA, 19 nt, Homo sapiens
ugaaagaggagcucaagaa

SEQ ID NO: 232683 - RNA, 19 nt, Homo sapiens
gcugagugcuuugaugaaa

SEQ ID NO: 232684 - RNA, 19 nt, Homo sapiens
cgaaagaagcgaaauuuua

SEQ ID NO: 232685 - RNA, 19 nt, Homo sapiens
ugguuugucuugauacuua

SEQ ID NO: 232686 - RNA, 19 nt, Homo sapiens
gcuaaaucauaguuucuga

SEQ ID NO: 232687 - RNA, 19 nt, Homo sapiens
gcaaccagauucauguaag

SEQ ID NO: 232688 - RNA, 19 nt, Homo sapiens
gauaagagaaugugucagu

SEQ ID NO: 232689 - RNA, 19 nt, Homo sapiens
gaaguugugaugaugauug

SEQ ID NO: 232690 - RNA, 19 nt, Homo sapiens
aaucguggcggauauaaua

SEQ ID NO: 232691 - RNA, 19 nt, Homo sapiens
gaaaauccagggaaauaua

SEQ ID NO: 232692 - RNA, 19 nt, Homo sapiens
gaauaacagucgggaguca

SEQ ID NO: 232693 - RNA, 19 nt, Homo sapiens
ccagggaaauauaacauuc

SEQ ID NO: 232694 - RNA, 19 nt, Homo sapiens
uaagugguccucaugaauu

SEQ ID NO: 232695 - RNA, 19 nt, Homo sapiens
caauaugcgugguggaaau

SEQ ID NO: 232696 - RNA, 19 nt, Homo sapiens
ggagaaaaguuugaugaaa

SEQ ID NO: 232697 - RNA, 19 nt, Homo sapiens
gaauguuacuuggugaaga

SEQ ID NO: 232698 - RNA, 19 nt, Homo sapiens
gaugaacacuucgaugaca

SEQ ID NO: 232699 - RNA, 19 nt, Homo sapiens
caccaaggauauuauugaa

SEQ ID NO: 232700 - RNA, 19 nt, Homo sapiens
gaaacaaucguggcuacaa

SEQ ID NO: 232701 - RNA, 19 nt, Homo sapiens
ggagcaauauaaggaagaa

SEQ ID NO: 232702 - RNA, 19 nt, Homo sapiens
acagaaaggcggagauaaa

SEQ ID NO: 232703 - RNA, 19 nt, Homo sapiens
ucaaacuugugaagguuaa

SEQ ID NO: 232704 - RNA, 19 nt, Homo sapiens
gcucaaacuugugaagguu

SEQ ID NO: 232705 - RNA, 19 nt, Homo sapiens
aagagaaugugucaguauu

SEQ ID NO: 232706 - RNA, 19 nt, Homo sapiens
gaaagaggagcucaagaag

SEQ ID NO: 232707 - RNA, 19 nt, Homo sapiens
agaugaagguuacagagaa

SEQ ID NO: 232708 - RNA, 19 nt, Homo sapiens
gcaagaaccaguuuaacag

SEQ ID NO: 232709 - RNA, 19 nt, Homo sapiens
gcauuaagacucuguacug

SEQ ID NO: 232710 - RNA, 19 nt, Homo sapiens
gaacuacaaccagaacuuc

SEQ ID NO: 232711 - RNA, 19 nt, Homo sapiens
uaacauucuuggcacaaau

SEQ ID NO: 232712 - RNA, 19 nt, Homo sapiens
ugacauacaugaaguucgu

SEQ ID NO: 232713 - RNA, 19 nt, Homo sapiens
acagugguuugucuugaua

SEQ ID NO: 232714 - RNA, 19 nt, Homo sapiens
ucagccaccuguugaagaa

SEQ ID NO: 232715 - RNA, 19 nt, Homo sapiens
gagaagauggaguguaugu

SEQ ID NO: 232716 - RNA, 19 nt, Homo sapiens
gaacugauacauauuucuc

SEQ ID NO: 232717 - RNA, 19 nt, Homo sapiens
gaaguagaacucucguaug

SEQ ID NO: 232718 - RNA, 19 nt, Homo sapiens
cagagaagaucccaguaag

SEQ ID NO: 232719 - RNA, 19 nt, Homo sapiens
gagaugaagguuacagaga

SEQ ID NO: 232720 - RNA, 19 nt, Homo sapiens
uggcuuugcccauuucuua

SEQ ID NO: 232721 - RNA, 19 nt, Homo sapiens
acugugagacugaagauua

SEQ ID NO: 232722 - RNA, 19 nt, Homo sapiens
guauguagaagggcuguua

SEQ ID NO: 232723 - RNA, 19 nt, Homo sapiens
ugaauugcauuaagacucu

SEQ ID NO: 232724 - RNA, 19 nt, Homo sapiens
cuuuguaccuggugucuuu

SEQ ID NO: 232725 - RNA, 19 nt, Homo sapiens
ucaccaaggauauuauuga

SEQ ID NO: 232726 - RNA, 19 nt, Homo sapiens
aacuacaaguggaauguua

SEQ ID NO: 232727 - RNA, 19 nt, Homo sapiens
gaaggugucggagcugaaa

SEQ ID NO: 232728 - RNA, 19 nt, Homo sapiens
ggaacuacaaccagaacuu

SEQ ID NO: 232729 - RNA, 19 nt, Homo sapiens
cgaacucggugaaaggaau

SEQ ID NO: 232730 - RNA, 19 nt, Homo sapiens
cuaccuggguuacuaaaca

SEQ ID NO: 232731 - RNA, 19 nt, Homo sapiens
guaagagaaccucagcauu

SEQ ID NO: 232732 - RNA, 19 nt, Homo sapiens
caagaaccaguuuaacaga

SEQ ID NO: 232733 - RNA, 19 nt, Homo sapiens
ggcaagaaccaguuuaaca

SEQ ID NO: 232734 - RNA, 19 nt, Homo sapiens
acagaacacuggcucaaag

SEQ ID NO: 232735 - RNA, 19 nt, Homo sapiens
ugagauugcugcccgaaag

SEQ ID NO: 232736 - RNA, 19 nt, Homo sapiens
gaugaagguuacagagaag

SEQ ID NO: 232737 - RNA, 19 nt, Homo sapiens
gguauaauugggauugaaa

SEQ ID NO: 232738 - RNA, 19 nt, Homo sapiens
uaagagaaugugucaguau

SEQ ID NO: 232739 - RNA, 19 nt, Homo sapiens
gaacucucguaugcuaaga

SEQ ID NO: 232740 - RNA, 19 nt, Homo sapiens
ugaaguagaacucucguau

SEQ ID NO: 232741 - RNA, 19 nt, Homo sapiens
ucuuauggguauucucuaa

SEQ ID NO: 232742 - RNA, 19 nt, Homo sapiens
gauauugacauacaugaag

SEQ ID NO: 232743 - RNA, 19 nt, Homo sapiens
aaagagggguguuaaaaga

SEQ ID NO: 232744 - RNA, 19 nt, Homo sapiens
guagcugagugcuuugaug

SEQ ID NO: 232745 - RNA, 19 nt, Homo sapiens
guuacuuggugaagaagaa

SEQ ID NO: 232746 - RNA, 19 nt, Homo sapiens
aauguuacuuggugaagaa

SEQ ID NO: 232747 - RNA, 19 nt, Homo sapiens
acagagaagaucccaguaa

SEQ ID NO: 232748 - RNA, 19 nt, Homo sapiens
ugugaagguuaauaccaua

SEQ ID NO: 232749 - RNA, 19 nt, Homo sapiens
ccucaugaauugcauuaag

SEQ ID NO: 232750 - RNA, 19 nt, Homo sapiens
gaagaaagauugugaaguu

SEQ ID NO: 232751 - RNA, 19 nt, Homo sapiens
gaacuaagauagagaagau

SEQ ID NO: 232752 - RNA, 19 nt, Homo sapiens
ggaaagaccuaccagaaca

SEQ ID NO: 232753 - RNA, 19 nt, Homo sapiens
guagaacucucguaugcua

SEQ ID NO: 232754 - RNA, 19 nt, Homo sapiens
gaagaaagcagaaguagag

SEQ ID NO: 232755 - RNA, 19 nt, Homo sapiens
gaacagaaaggcggagaua

SEQ ID NO: 232756 - RNA, 19 nt, Homo sapiens
gaugaagacuauaagcaaa

SEQ ID NO: 232757 - RNA, 19 nt, Homo sapiens
cguauuggcuggucacuaa

SEQ ID NO: 232758 - RNA, 19 nt, Homo sapiens
gcaaagaacacagaagaaa

SEQ ID NO: 232759 - RNA, 19 nt, Homo sapiens
cacaagaagucgacuguuu

SEQ ID NO: 232760 - RNA, 19 nt, Homo sapiens
gcgaaaagcuguuguaguu

SEQ ID NO: 232761 - RNA, 19 nt, Homo sapiens
ugaaagugaugaaguagaa

SEQ ID NO: 232762 - RNA, 19 nt, Homo sapiens
gacaauaacugggaagguu

SEQ ID NO: 232763 - RNA, 19 nt, Homo sapiens
uaagagaaccucagcauug

SEQ ID NO: 232764 - RNA, 19 nt, Homo sapiens
gaaauaaccuauguugaac

SEQ ID NO: 232765 - RNA, 19 nt, Homo sapiens
uagagaagauggaguguau

SEQ ID NO: 232766 - RNA, 19 nt, Homo sapiens
gaaagauugugaaguugug

SEQ ID NO: 232767 - RNA, 19 nt, Homo sapiens
gaacacuggcucaaagaaa

SEQ ID NO: 232768 - RNA, 19 nt, Homo sapiens
ugagugcuuugaugaaaua

SEQ ID NO: 232769 - RNA, 19 nt, Homo sapiens
gaaaagcuguuguaguuug

SEQ ID NO: 232770 - RNA, 19 nt, Homo sapiens
ccaguaaggcauuuauaua

SEQ ID NO: 232771 - RNA, 19 nt, Homo sapiens
gaagauggaguguauguag

SEQ ID NO: 232772 - RNA, 19 nt, Homo sapiens
gaagucgacuguuuucuuu

SEQ ID NO: 232773 - RNA, 19 nt, Homo sapiens
gaucauggccguggauauu

SEQ ID NO: 232774 - RNA, 19 nt, Homo sapiens
gaaguaaaauguugcuuug

SEQ ID NO: 232775 - RNA, 19 nt, Homo sapiens
uuucaggguucuacauuua

SEQ ID NO: 232776 - RNA, 19 nt, Homo sapiens
gagaaugugucaguauuuc

SEQ ID NO: 232777 - RNA, 19 nt, Homo sapiens
aaacaaucguggcuacaaa

SEQ ID NO: 232778 - RNA, 19 nt, Homo sapiens
gaagagaacaaguauagca

SEQ ID NO: 232779 - RNA, 19 nt, Homo sapiens
gaugaaauaaccuauguug

SEQ ID NO: 232780 - RNA, 19 nt, Homo sapiens
ggaaauuuauugagauugc

SEQ ID NO: 232781 - RNA, 19 nt, Homo sapiens
gacugaagauuauggagaa

SEQ ID NO: 232782 - RNA, 19 nt, Homo sapiens
agagguagcugagugcuuu

SEQ ID NO: 232783 - RNA, 19 nt, Homo sapiens
ugaaagaggagcucaagaa

SEQ ID NO: 232784 - RNA, 19 nt, Homo sapiens
gcugagugcuuugaugaaa

SEQ ID NO: 232785 - RNA, 19 nt, Homo sapiens
cgaaagaagcgaaauuuua

SEQ ID NO: 232786 - RNA, 19 nt, Homo sapiens
ugguuugucuugauacuua

SEQ ID NO: 232787 - RNA, 19 nt, Homo sapiens
gcuaaaucauaguuucuga

SEQ ID NO: 232788 - RNA, 19 nt, Homo sapiens
gcaaccagauucauguaag

SEQ ID NO: 232789 - RNA, 19 nt, Homo sapiens
gauaagagaaugugucagu

SEQ ID NO: 232790 - RNA, 19 nt, Homo sapiens
gaaguugugaugaugauug

SEQ ID NO: 232791 - RNA, 19 nt, Homo sapiens
aaucguggcggauauaaua

SEQ ID NO: 232792 - RNA, 19 nt, Homo sapiens
gaaaauccagggaaauaua

SEQ ID NO: 232793 - RNA, 19 nt, Homo sapiens
gaauaacagucgggaguca

SEQ ID NO: 232794 - RNA, 19 nt, Homo sapiens
ccagggaaauauaacauuc

SEQ ID NO: 232795 - RNA, 19 nt, Homo sapiens
uaagugguccucaugaauu

SEQ ID NO: 232796 - RNA, 19 nt, Homo sapiens
caauaugcgugguggaaau

SEQ ID NO: 232797 - RNA, 19 nt, Homo sapiens
ggagaaaaguuugaugaaa

SEQ ID NO: 232798 - RNA, 19 nt, Homo sapiens
gaauguuacuuggugaaga

SEQ ID NO: 232799 - RNA, 19 nt, Homo sapiens
gaugaacacuucgaugaca

SEQ ID NO: 232800 - RNA, 19 nt, Homo sapiens
caccaaggauauuauugaa

SEQ ID NO: 232801 - RNA, 19 nt, Homo sapiens
gaaacaaucguggcuacaa

SEQ ID NO: 232802 - RNA, 19 nt, Homo sapiens
ggagcaauauaaggaagaa

SEQ ID NO: 232803 - RNA, 19 nt, Homo sapiens
acagaaaggcggagauaaa

SEQ ID NO: 232804 - RNA, 19 nt, Homo sapiens
ucaaacuugugaagguuaa

SEQ ID NO: 232805 - RNA, 19 nt, Homo sapiens
gcucaaacuugugaagguu

SEQ ID NO: 232806 - RNA, 19 nt, Homo sapiens
aagagaaugugucaguauu

SEQ ID NO: 232807 - RNA, 19 nt, Homo sapiens
gaaagaggagcucaagaag

SEQ ID NO: 232808 - RNA, 19 nt, Homo sapiens
agaugaagguuacagagaa

SEQ ID NO: 232809 - RNA, 19 nt, Homo sapiens
gcaagaaccaguuuaacag

SEQ ID NO: 232810 - RNA, 19 nt, Homo sapiens
gcauuaagacucuguacug

SEQ ID NO: 232811 - RNA, 19 nt, Homo sapiens
gaacuacaaccagaacuuc

SEQ ID NO: 232812 - RNA, 19 nt, Homo sapiens
uaacauucuuggcacaaau

SEQ ID NO: 232813 - RNA, 19 nt, Homo sapiens
ugacauacaugaaguucgu

SEQ ID NO: 232814 - RNA, 19 nt, Homo sapiens
acagugguuugucuugaua

SEQ ID NO: 232815 - RNA, 19 nt, Homo sapiens
ucagccaccuguugaagaa

SEQ ID NO: 232816 - RNA, 19 nt, Homo sapiens
gagaagauggaguguaugu

SEQ ID NO: 232817 - RNA, 19 nt, Homo sapiens
gaacugauacauauuucuc

SEQ ID NO: 232818 - RNA, 19 nt, Homo sapiens
gaaguagaacucucguaug

SEQ ID NO: 232819 - RNA, 19 nt, Homo sapiens
cagagaagaucccaguaag

SEQ ID NO: 232820 - RNA, 19 nt, Homo sapiens
gagaugaagguuacagaga

SEQ ID NO: 232821 - RNA, 19 nt, Homo sapiens
uggcuuugcccauuucuua

SEQ ID NO: 232822 - RNA, 19 nt, Homo sapiens
acugugagacugaagauua

SEQ ID NO: 232823 - RNA, 19 nt, Homo sapiens
guauguagaagggcuguua

SEQ ID NO: 232824 - RNA, 19 nt, Homo sapiens
ugaauugcauuaagacucu

SEQ ID NO: 232825 - RNA, 19 nt, Homo sapiens
cuuuguaccuggugucuuu

SEQ ID NO: 232826 - RNA, 19 nt, Homo sapiens
ucaccaaggauauuauuga

SEQ ID NO: 232827 - RNA, 19 nt, Homo sapiens
aacuacaaguggaauguua

SEQ ID NO: 232828 - RNA, 19 nt, Homo sapiens
gaaggugucggagcugaaa

SEQ ID NO: 232829 - RNA, 19 nt, Homo sapiens
ggaacuacaaccagaacuu

SEQ ID NO: 232830 - RNA, 19 nt, Homo sapiens
cgaacucggugaaaggaau

SEQ ID NO: 232831 - RNA, 19 nt, Homo sapiens
cuaccuggguuacuaaaca

SEQ ID NO: 232832 - RNA, 19 nt, Homo sapiens
guaagagaaccucagcauu

SEQ ID NO: 232833 - RNA, 19 nt, Homo sapiens
caagaaccaguuuaacaga

SEQ ID NO: 232834 - RNA, 19 nt, Homo sapiens
ggcaagaaccaguuuaaca

SEQ ID NO: 232835 - RNA, 19 nt, Homo sapiens
acagaacacuggcucaaag

SEQ ID NO: 232836 - RNA, 19 nt, Homo sapiens
ugagauugcugcccgaaag

SEQ ID NO: 232837 - RNA, 19 nt, Homo sapiens
gaugaagguuacagagaag

SEQ ID NO: 232838 - RNA, 19 nt, Homo sapiens
gguauaauugggauugaaa

SEQ ID NO: 232839 - RNA, 19 nt, Homo sapiens
uaagagaaugugucaguau

SEQ ID NO: 232840 - RNA, 19 nt, Homo sapiens
gaacucucguaugcuaaga

SEQ ID NO: 232841 - RNA, 19 nt, Homo sapiens
ugaaguagaacucucguau

SEQ ID NO: 232842 - RNA, 19 nt, Homo sapiens
ucuuauggguauucucuaa

SEQ ID NO: 232843 - RNA, 19 nt, Homo sapiens
gauauugacauacaugaag

SEQ ID NO: 232844 - RNA, 19 nt, Homo sapiens
aaagagggguguuaaaaga

SEQ ID NO: 232845 - RNA, 19 nt, Homo sapiens
guagcugagugcuuugaug

SEQ ID NO: 232846 - RNA, 19 nt, Homo sapiens
guuacuuggugaagaagaa

SEQ ID NO: 232847 - RNA, 19 nt, Homo sapiens
aauguuacuuggugaagaa

SEQ ID NO: 232848 - RNA, 19 nt, Homo sapiens
acagagaagaucccaguaa

SEQ ID NO: 232849 - RNA, 19 nt, Homo sapiens
ugugaagguuaauaccaua

SEQ ID NO: 232850 - RNA, 19 nt, Homo sapiens
gcaccugucugaacuguua

SEQ ID NO: 232851 - RNA, 19 nt, Homo sapiens
ugacgcaucuguuuauuua

SEQ ID NO: 232852 - RNA, 19 nt, Homo sapiens
ugucugaacuguuaagaaa

SEQ ID NO: 232853 - RNA, 19 nt, Homo sapiens
uaaaucuccuguugaguga

SEQ ID NO: 232854 - RNA, 19 nt, Homo sapiens
ggaaaccccuucucuguga

SEQ ID NO: 232855 - RNA, 19 nt, Homo sapiens
gagaguaaccgcagauaca

SEQ ID NO: 232856 - RNA, 19 nt, Homo sapiens
gaaacgcgaagcucucuug

SEQ ID NO: 232857 - RNA, 19 nt, Homo sapiens
gcugagcccuuaaggagau

SEQ ID NO: 232858 - RNA, 19 nt, Homo sapiens
gaagggcaagccugaacua

SEQ ID NO: 232859 - RNA, 19 nt, Homo sapiens
gacagagggucacaguguu

SEQ ID NO: 232860 - RNA, 19 nt, Homo sapiens
cgagugagccugcccauuc

SEQ ID NO: 232861 - RNA, 19 nt, Homo sapiens
ccucuucucucucuucaug

SEQ ID NO: 232862 - RNA, 19 nt, Homo sapiens
ugauaaaucuccuguugag

SEQ ID NO: 232863 - RNA, 19 nt, Homo sapiens
aaccaacccucuugacuug

SEQ ID NO: 232864 - RNA, 19 nt, Homo sapiens
gguguuaauuuaugcacuu

SEQ ID NO: 232865 - RNA, 19 nt, Homo sapiens
gcacaaacacaaggucaug

SEQ ID NO: 232866 - RNA, 19 nt, Homo sapiens
gacacagacucauccugaa

SEQ ID NO: 232867 - RNA, 19 nt, Homo sapiens
ggacuccuuuggcccaguu

SEQ ID NO: 232868 - RNA, 19 nt, Homo sapiens
uuugauaaaucuccuguug

SEQ ID NO: 232869 - RNA, 19 nt, Homo sapiens
gccuaggccuggcuccaua

SEQ ID NO: 232870 - RNA, 19 nt, Homo sapiens
acagacagguuuucacaua

SEQ ID NO: 232871 - RNA, 19 nt, Homo sapiens
gagaaaggcaagggaggua

SEQ ID NO: 232872 - RNA, 19 nt, Homo sapiens
gaacuguuaagaaaucugu

SEQ ID NO: 232873 - RNA, 19 nt, Homo sapiens
gugcuuguguaauuuaugu

SEQ ID NO: 232874 - RNA, 19 nt, Homo sapiens
gcacaacucgucgcucuuc

SEQ ID NO: 232875 - RNA, 19 nt, Homo sapiens
gaauggucgcuuccuguuu

SEQ ID NO: 232876 - RNA, 19 nt, Homo sapiens
gauauguuccuuccugaau

SEQ ID NO: 232877 - RNA, 19 nt, Homo sapiens
uaacgugggauucagagaa

SEQ ID NO: 232878 - RNA, 19 nt, Homo sapiens
ccagggcugucaucugaau

SEQ ID NO: 232879 - RNA, 19 nt, Homo sapiens
uuucgcagcugagcccuua

SEQ ID NO: 232880 - RNA, 19 nt, Homo sapiens
uauguuccuuccugaauug

SEQ ID NO: 232881 - RNA, 19 nt, Homo sapiens
ggagagacccagucgaaac

SEQ ID NO: 232882 - RNA, 19 nt, Homo sapiens
ucugaacuguuaagaaauc

SEQ ID NO: 232883 - RNA, 19 nt, Homo sapiens
aaaccaacccucuugacuu

SEQ ID NO: 232884 - RNA, 19 nt, Homo sapiens
ucacacgccugcagaucug

SEQ ID NO: 232885 - RNA, 19 nt, Homo sapiens
agacagagggucacagugu

SEQ ID NO: 232886 - RNA, 19 nt, Homo sapiens
uucgaacccuguaggauuu

SEQ ID NO: 232887 - RNA, 19 nt, Homo sapiens
acagucuucuacuuucuaa

SEQ ID NO: 232888 - RNA, 19 nt, Homo sapiens
ccaacccucuugacuugug

SEQ ID NO: 232889 - RNA, 19 nt, Homo sapiens
gagugagccugcccauucu

SEQ ID NO: 232890 - RNA, 19 nt, Homo sapiens
aacgugggauucagagaaa

SEQ ID NO: 232891 - RNA, 19 nt, Homo sapiens
acgcagagcccauuagcuu

SEQ ID NO: 232892 - RNA, 19 nt, Homo sapiens
uaagguguuuucuguguaa

SEQ ID NO: 232893 - RNA, 19 nt, Homo sapiens
guuuacacuuuggaccuua

SEQ ID NO: 232894 - RNA, 19 nt, Homo sapiens
gggcugucaucugaauuug

SEQ ID NO: 232895 - RNA, 19 nt, Homo sapiens
cagagggucacaguguuua

SEQ ID NO: 232896 - RNA, 19 nt, Homo sapiens
gaaaggcaagggagguaag

SEQ ID NO: 232897 - RNA, 19 nt, Homo sapiens
ggucacgcagagcccauua

SEQ ID NO: 232898 - RNA, 19 nt, Homo sapiens
gacagucuucuacuuucua

SEQ ID NO: 232899 - RNA, 19 nt, Homo sapiens
ccacuucucaucacacaca

SEQ ID NO: 232900 - RNA, 19 nt, Homo sapiens
cauauagcaguuguucaua

SEQ ID NO: 232901 - RNA, 19 nt, Homo sapiens
gguacgcacagacagguuu

SEQ ID NO: 232902 - RNA, 19 nt, Homo sapiens
gcuacaacagccucacuug

SEQ ID NO: 232903 - RNA, 19 nt, Homo sapiens
gcucuucgcccugcagaau

SEQ ID NO: 232904 - RNA, 19 nt, Homo sapiens
ucggaggcgccuacacuua

SEQ ID NO: 232905 - RNA, 19 nt, Homo sapiens
ggauauguuccuuccugaa

SEQ ID NO: 232906 - RNA, 19 nt, Homo sapiens
cuuccugaauugucuaaga

SEQ ID NO: 232907 - RNA, 19 nt, Homo sapiens
caucacacacacauggaaa

SEQ ID NO: 232908 - RNA, 19 nt, Homo sapiens
gagacaucccuuccucaga

SEQ ID NO: 232909 - RNA, 19 nt, Homo sapiens
gcagcugagcccuuaagga

SEQ ID NO: 232910 - RNA, 19 nt, Homo sapiens
gcacuuauaagguguuuuc

SEQ ID NO: 232911 - RNA, 19 nt, Homo sapiens
auauguuccuuccugaauu

SEQ ID NO: 232912 - RNA, 19 nt, Homo sapiens
uauagcaguuguucauagg

SEQ ID NO: 232913 - RNA, 19 nt, Homo sapiens
auauagcaguuguucauag

SEQ ID NO: 232914 - RNA, 19 nt, Homo sapiens
caaaccaacccucuugacu

SEQ ID NO: 232915 - RNA, 19 nt, Homo sapiens
agacagguuuucacauaaa

SEQ ID NO: 232916 - RNA, 19 nt, Homo sapiens
uuccugaauugucuaagaa

SEQ ID NO: 232917 - RNA, 19 nt, Homo sapiens
acagagggucacaguguuu

SEQ ID NO: 232918 - RNA, 19 nt, Homo sapiens
ggagaguaaccgcagauac

SEQ ID NO: 232919 - RNA, 19 nt, Homo sapiens
cuucuugacgcaucuguuu

SEQ ID NO: 232920 - RNA, 19 nt, Homo sapiens
cagacagguuuucacauaa

SEQ ID NO: 232921 - RNA, 19 nt, Homo sapiens
ccacacaucccagcccaau

SEQ ID NO: 232922 - RNA, 19 nt, Homo sapiens
acauauagcaguuguucau

SEQ ID NO: 232923 - RNA, 19 nt, Homo sapiens
gauacacaaaggacagguu

SEQ ID NO: 232924 - RNA, 19 nt, Homo sapiens
cuugugggcuggacuccuu

SEQ ID NO: 232925 - RNA, 19 nt, Homo sapiens
ugucuaagaaggcugaguu

SEQ ID NO: 232926 - RNA, 19 nt, Homo sapiens
ccccagggcugucaucuga

SEQ ID NO: 232927 - RNA, 19 nt, Homo sapiens
uuucgaacccuguaggauu

SEQ ID NO: 232928 - RNA, 19 nt, Homo sapiens
gcuuguguaauuuauguga

SEQ ID NO: 232929 - RNA, 19 nt, Homo sapiens
gcacagacagguuuucaca

SEQ ID NO: 232930 - RNA, 19 nt, Homo sapiens
aauggucgcuuccuguuuu

SEQ ID NO: 232931 - RNA, 19 nt, Homo sapiens
uauaagguguuuucugugu

SEQ ID NO: 232932 - RNA, 19 nt, Homo sapiens
guucacaggucaccccuau

SEQ ID NO: 232933 - RNA, 19 nt, Homo sapiens
cuuauaagguguuuucugu

SEQ ID NO: 232934 - RNA, 19 nt, Homo sapiens
guuccuuccugaauugucu

SEQ ID NO: 232935 - RNA, 19 nt, Homo sapiens
ccagacagagggucacagu

SEQ ID NO: 232936 - RNA, 19 nt, Homo sapiens
ugacccacuucucaucaca

SEQ ID NO: 232937 - RNA, 19 nt, Homo sapiens
ugccgacacuguucuccuu

SEQ ID NO: 232938 - RNA, 19 nt, Homo sapiens
uacaacagccucacuuggu

SEQ ID NO: 232939 - RNA, 19 nt, Homo sapiens
gcaucgaccagauccucaa

SEQ ID NO: 232940 - RNA, 19 nt, Homo sapiens
ucuucucucucuucaugaa

SEQ ID NO: 232941 - RNA, 19 nt, Homo sapiens
gcucacaggugcuggaguu

SEQ ID NO: 232942 - RNA, 19 nt, Homo sapiens
gcacaacucgucgcucuuc

SEQ ID NO: 232943 - RNA, 19 nt, Homo sapiens
cacaggugcuggaguugga

SEQ ID NO: 232944 - RNA, 19 nt, Homo sapiens
caaccucccacaccacgaa

SEQ ID NO: 232945 - RNA, 19 nt, Homo sapiens
gaugcuggguccacacaac

SEQ ID NO: 232946 - RNA, 19 nt, Homo sapiens
gggcaggucauaggagaau

SEQ ID NO: 232947 - RNA, 19 nt, Homo sapiens
gcaggucauaggagaaugg

SEQ ID NO: 232948 - RNA, 19 nt, Homo sapiens
gcgagaggcuggcugauug

SEQ ID NO: 232949 - RNA, 19 nt, Homo sapiens
ucucaucccucaacuguaa

SEQ ID NO: 232950 - RNA, 19 nt, Homo sapiens
gcaggacaguagccaauga

SEQ ID NO: 232951 - RNA, 19 nt, Homo sapiens
gcucacaggugcuggaguu

SEQ ID NO: 232952 - RNA, 19 nt, Homo sapiens
ccaaaggugugaaggaaag

SEQ ID NO: 232953 - RNA, 19 nt, Homo sapiens
cgaccacggcgaagcaaua

SEQ ID NO: 232954 - RNA, 19 nt, Homo sapiens
uaccaaaggugugaaggaa

SEQ ID NO: 232955 - RNA, 19 nt, Homo sapiens
gcacaacucgucgcucuuc

SEQ ID NO: 232956 - RNA, 19 nt, Homo sapiens
cuuaagagccagcaaggaa

SEQ ID NO: 232957 - RNA, 19 nt, Homo sapiens
guaaaauaaucgcuaagga

SEQ ID NO: 232958 - RNA, 19 nt, Homo sapiens
acaacaaaguggcuucagu

SEQ ID NO: 232959 - RNA, 19 nt, Homo sapiens
caucucaucccucaacugu

SEQ ID NO: 232960 - RNA, 19 nt, Homo sapiens
guaccaaaggugugaagga

SEQ ID NO: 232961 - RNA, 19 nt, Homo sapiens
cacaggugcuggaguugga

SEQ ID NO: 232962 - RNA, 19 nt, Homo sapiens
ucccucaacuguaaaauaa

SEQ ID NO: 232963 - RNA, 19 nt, Homo sapiens
ucacuucacugccguuacg

SEQ ID NO: 232964 - RNA, 19 nt, Homo sapiens
gaugcuggguccacacaac

SEQ ID NO: 232965 - RNA, 19 nt, Homo sapiens
ggacaacaaaguggcuuca

SEQ ID NO: 232966 - RNA, 19 nt, Homo sapiens
ccacaccacgagccaauca

SEQ ID NO: 232967 - RNA, 19 nt, Homo sapiens
cugagggacucgaaauucu

SEQ ID NO: 232968 - RNA, 19 nt, Homo sapiens
gcagcccagcgucuauuug

SEQ ID NO: 232969 - RNA, 19 nt, Homo sapiens
gggccgaggacaacaaagu

SEQ ID NO: 232970 - RNA, 19 nt, Homo sapiens
cagggaugcugcuguuucg

SEQ ID NO: 232971 - RNA, 19 nt, Homo sapiens
gggcaucucaucccucaac

SEQ ID NO: 232972 - RNA, 19 nt, Homo sapiens
ccacggcgaagcaauagag

SEQ ID NO: 232973 - RNA, 19 nt, Homo sapiens
cugcguccauggucuagug

SEQ ID NO: 232974 - RNA, 19 nt, Homo sapiens
ggcugggucuguaccaaag

SEQ ID NO: 232975 - RNA, 19 nt, Homo sapiens
aaacagaacucccuucaaa

SEQ ID NO: 232976 - RNA, 19 nt, Homo sapiens
ggagaagggugguaaauau

SEQ ID NO: 232977 - RNA, 19 nt, Homo sapiens
gagaugcacuauauguuua

SEQ ID NO: 232978 - RNA, 19 nt, Homo sapiens
aaacaaacauggauacuuc

SEQ ID NO: 232979 - RNA, 19 nt, Homo sapiens
aagaagagaugcacuauau

SEQ ID NO: 232980 - RNA, 19 nt, Homo sapiens
aaucaaagcucauaaugga

SEQ ID NO: 232981 - RNA, 19 nt, Homo sapiens
caaacucucuaaacuggua

SEQ ID NO: 232982 - RNA, 19 nt, Homo sapiens
gaagagaugcacuauaugu

SEQ ID NO: 232983 - RNA, 19 nt, Homo sapiens
ucacggaacuggagaagga

SEQ ID NO: 232984 - RNA, 19 nt, Homo sapiens
ucucuaaacugguacaauu

SEQ ID NO: 232985 - RNA, 19 nt, Homo sapiens
gaagaagagaugcacuaua

SEQ ID NO: 232986 - RNA, 19 nt, Homo sapiens
gaaguuggcacauuucaug

SEQ ID NO: 232987 - RNA, 19 nt, Homo sapiens
cagauugggugccagcaua

SEQ ID NO: 232988 - RNA, 19 nt, Homo sapiens
ggaaucuucucaucuuuua

SEQ ID NO: 232989 - RNA, 19 nt, Homo sapiens
ggucuuaggaugucuguaa

SEQ ID NO: 232990 - RNA, 19 nt, Homo sapiens
guaaauacuuuguccuaag

SEQ ID NO: 232991 - RNA, 19 nt, Homo sapiens
caaaguaccacacugaguu

SEQ ID NO: 232992 - RNA, 19 nt, Homo sapiens
gcacaugcuuagcuuaucu

SEQ ID NO: 232993 - RNA, 19 nt, Homo sapiens
gggcucgccucaauacauu

SEQ ID NO: 232994 - RNA, 19 nt, Homo sapiens
ggauguugacguauauaua

SEQ ID NO: 232995 - RNA, 19 nt, Homo sapiens
gaaacaaacauggauacuu

SEQ ID NO: 232996 - RNA, 19 nt, Homo sapiens
gauggacaaugcaagaaug

SEQ ID NO: 232997 - RNA, 19 nt, Homo sapiens
cuaugaaguuggcacauuu

SEQ ID NO: 232998 - RNA, 19 nt, Homo sapiens
gcaccaacuucacuaccaa

SEQ ID NO: 232999 - RNA, 19 nt, Homo sapiens
ugaguuugcugguuguaaa

SEQ ID NO: 233000 - RNA, 19 nt, Homo sapiens
uaacaucccuccugcuuuu

SEQ ID NO: 233001 - RNA, 19 nt, Homo sapiens
gaccauaggauuacaacuu

SEQ ID NO: 233002 - RNA, 19 nt, Homo sapiens
gggagaagggugguaaaua

SEQ ID NO: 233003 - RNA, 19 nt, Homo sapiens
gagaagggugguaaauauu

SEQ ID NO: 233004 - RNA, 19 nt, Homo sapiens
guaccacacugaguucuau

SEQ ID NO: 233005 - RNA, 19 nt, Homo sapiens
cuuaggaugucuguaauaa

SEQ ID NO: 233006 - RNA, 19 nt, Homo sapiens
uaucaguuauccuuuguga

SEQ ID NO: 233007 - RNA, 19 nt, Homo sapiens
aaaguaggauauagcgaaa

SEQ ID NO: 233008 - RNA, 19 nt, Homo sapiens
ccaagcagcucacggaacu

SEQ ID NO: 233009 - RNA, 19 nt, Homo sapiens
ucaaagcucauaauggaaa

SEQ ID NO: 233010 - RNA, 19 nt, Homo sapiens
uaaaauuugugcuggguua

SEQ ID NO: 233011 - RNA, 19 nt, Homo sapiens
gaagggugguaaauauuuu

SEQ ID NO: 233012 - RNA, 19 nt, Homo sapiens
ucaaaccaauuucuuccuu

SEQ ID NO: 233013 - RNA, 19 nt, Homo sapiens
ggaugaaagucaaaagaaa

SEQ ID NO: 233014 - RNA, 19 nt, Homo sapiens
guauuuggcugggcuacaa

SEQ ID NO: 233015 - RNA, 19 nt, Homo sapiens
uggccaggauaauauauuu

SEQ ID NO: 233016 - RNA, 19 nt, Homo sapiens
cuagaaauguuuagguuac

SEQ ID NO: 233017 - RNA, 19 nt, Homo sapiens
uagcuuaucuuucuuucca

SEQ ID NO: 233018 - RNA, 19 nt, Homo sapiens
accauaggauuacaacuuu

SEQ ID NO: 233019 - RNA, 19 nt, Homo sapiens
gaggguagccuugauuugu

SEQ ID NO: 233020 - RNA, 19 nt, Homo sapiens
agagaugcacuauauguuu

SEQ ID NO: 233021 - RNA, 19 nt, Homo sapiens
gagggucucuugcccaucu

SEQ ID NO: 233022 - RNA, 19 nt, Homo sapiens
gcaugucgcacaauguuug

SEQ ID NO: 233023 - RNA, 19 nt, Homo sapiens
gcagagcacaaacuucaga

SEQ ID NO: 233024 - RNA, 19 nt, Homo sapiens
uagccuugauuuguucuua

SEQ ID NO: 233025 - RNA, 19 nt, Homo sapiens
ggaagaagagaugcacuau

SEQ ID NO: 233026 - RNA, 19 nt, Homo sapiens
cagggaaaguuggagagua

SEQ ID NO: 233027 - RNA, 19 nt, Homo sapiens
ucaauacauucaccacuca

SEQ ID NO: 233028 - RNA, 19 nt, Homo sapiens
gaacuucagugcgccuuac

SEQ ID NO: 233029 - RNA, 19 nt, Homo sapiens
agaagggugguaaauauuu

SEQ ID NO: 233030 - RNA, 19 nt, Homo sapiens
ccuaugaaguuggcacauu

SEQ ID NO: 233031 - RNA, 19 nt, Homo sapiens
cugagauccuggagugaua

SEQ ID NO: 233032 - RNA, 19 nt, Homo sapiens
ucagcucaauuguuaaugu

SEQ ID NO: 233033 - RNA, 19 nt, Homo sapiens
gggccacccucuguuuaaa

SEQ ID NO: 233034 - RNA, 19 nt, Homo sapiens
caacagaaacaugccagaa

SEQ ID NO: 233035 - RNA, 19 nt, Homo sapiens
gcuuaucuuucuuuccauu

SEQ ID NO: 233036 - RNA, 19 nt, Homo sapiens
caacgagacccaagugaag

SEQ ID NO: 233037 - RNA, 19 nt, Homo sapiens
guuaauuccuaugaaguug

SEQ ID NO: 233038 - RNA, 19 nt, Homo sapiens
caaguuucagguaugcuua

SEQ ID NO: 233039 - RNA, 19 nt, Homo sapiens
gcucaauuguuaaugugau

SEQ ID NO: 233040 - RNA, 19 nt, Homo sapiens
uuucuuccuuccacaguua

SEQ ID NO: 233041 - RNA, 19 nt, Homo sapiens
uccaggagcucaggaagaa

SEQ ID NO: 233042 - RNA, 19 nt, Homo sapiens
gaaacaugccagaaggaau

SEQ ID NO: 233043 - RNA, 19 nt, Homo sapiens
augcuuagcuuaucuuucu

SEQ ID NO: 233044 - RNA, 19 nt, Homo sapiens
uacagucucuuucuuccuu

SEQ ID NO: 233045 - RNA, 19 nt, Homo sapiens
ucaggaagcagacguaagu

SEQ ID NO: 233046 - RNA, 19 nt, Homo sapiens
acaguuaucuuagcuggau

SEQ ID NO: 233047 - RNA, 19 nt, Homo sapiens
aaacaugccagaaggaauc

SEQ ID NO: 233048 - RNA, 19 nt, Homo sapiens
ccuaugauauuccccauuu

SEQ ID NO: 233049 - RNA, 19 nt, Homo sapiens
uuugugagccuaugauauu

SEQ ID NO: 233050 - RNA, 19 nt, Homo sapiens
gcuaagucuuucccaaucu

SEQ ID NO: 233051 - RNA, 19 nt, Homo sapiens
caaaagaaacccucccaaa

SEQ ID NO: 233052 - RNA, 19 nt, Homo sapiens
ugaauagucuuuugcaugu

SEQ ID NO: 233053 - RNA, 19 nt, Homo sapiens
cagcucaauuguuaaugug

SEQ ID NO: 233054 - RNA, 19 nt, Homo sapiens
gagcacaaacuucagaaac

SEQ ID NO: 233055 - RNA, 19 nt, Homo sapiens
gggcaaacucucuaaacug

SEQ ID NO: 233056 - RNA, 19 nt, Homo sapiens
aaaagaaacccucccaaaa

SEQ ID NO: 233057 - RNA, 19 nt, Homo sapiens
gaaagggagaaggguggua

SEQ ID NO: 233058 - RNA, 19 nt, Homo sapiens
ggacaaugcaagaaugaac

SEQ ID NO: 233059 - RNA, 19 nt, Homo sapiens
cccauuuccuguacaauca

SEQ ID NO: 233060 - RNA, 19 nt, Homo sapiens
ggagaauucacagaaccua

SEQ ID NO: 233061 - RNA, 19 nt, Homo sapiens
gauggcacaaugaauguau

SEQ ID NO: 233062 - RNA, 19 nt, Homo sapiens
ggguagccuugauuuguuc

SEQ ID NO: 233063 - RNA, 19 nt, Homo sapiens
aaggaaucuucucaucuuu

SEQ ID NO: 233064 - RNA, 19 nt, Homo sapiens
ggaguuccacuucaacaag

SEQ ID NO: 233065 - RNA, 19 nt, Homo sapiens
gagaugggccuuuucuuga

SEQ ID NO: 233066 - RNA, 19 nt, Homo sapiens
caaguugugguccaagcua

SEQ ID NO: 233067 - RNA, 19 nt, Homo sapiens
ucucuuucuuccuuucuaa

SEQ ID NO: 233068 - RNA, 19 nt, Homo sapiens
ucaacgagacccaagugaa

SEQ ID NO: 233069 - RNA, 19 nt, Homo sapiens
gagaaaguuggcacaguca

SEQ ID NO: 233070 - RNA, 19 nt, Homo sapiens
cuuaagcauccguguauuu

SEQ ID NO: 233071 - RNA, 19 nt, Homo sapiens
gcagaguuuacgggucuua

SEQ ID NO: 233072 - RNA, 19 nt, Homo sapiens
cagaggguagccuugauuu

SEQ ID NO: 233073 - RNA, 19 nt, Homo sapiens
ucauuuaaacccaaucaga

SEQ ID NO: 233074 - RNA, 19 nt, Homo sapiens
gcuguuuacucuggaaauc

SEQ ID NO: 233075 - RNA, 19 nt, Homo sapiens
aaacagaacucccuucaaa

SEQ ID NO: 233076 - RNA, 19 nt, Homo sapiens
ggagaagggugguaaauau

SEQ ID NO: 233077 - RNA, 19 nt, Homo sapiens
gagaugcacuauauguuua

SEQ ID NO: 233078 - RNA, 19 nt, Homo sapiens
aaacaaacauggauacuuc

SEQ ID NO: 233079 - RNA, 19 nt, Homo sapiens
aagaagagaugcacuauau

SEQ ID NO: 233080 - RNA, 19 nt, Homo sapiens
aaucaaagcucauaaugga

SEQ ID NO: 233081 - RNA, 19 nt, Homo sapiens
caaacucucuaaacuggua

SEQ ID NO: 233082 - RNA, 19 nt, Homo sapiens
gaagagaugcacuauaugu

SEQ ID NO: 233083 - RNA, 19 nt, Homo sapiens
ucacggaacuggagaagga

SEQ ID NO: 233084 - RNA, 19 nt, Homo sapiens
ucucuaaacugguacaauu

SEQ ID NO: 233085 - RNA, 19 nt, Homo sapiens
gaagaagagaugcacuaua

SEQ ID NO: 233086 - RNA, 19 nt, Homo sapiens
gaaguuggcacauuucaug

SEQ ID NO: 233087 - RNA, 19 nt, Homo sapiens
cagauugggugccagcaua

SEQ ID NO: 233088 - RNA, 19 nt, Homo sapiens
ggaaucuucucaucuuuua

SEQ ID NO: 233089 - RNA, 19 nt, Homo sapiens
ggucuuaggaugucuguaa

SEQ ID NO: 233090 - RNA, 19 nt, Homo sapiens
guaaauacuuuguccuaag

SEQ ID NO: 233091 - RNA, 19 nt, Homo sapiens
caaaguaccacacugaguu

SEQ ID NO: 233092 - RNA, 19 nt, Homo sapiens
gcacaugcuuagcuuaucu

SEQ ID NO: 233093 - RNA, 19 nt, Homo sapiens
gaagcagacccaccaagaa

SEQ ID NO: 233094 - RNA, 19 nt, Homo sapiens
ggauguugacguauauaua

SEQ ID NO: 233095 - RNA, 19 nt, Homo sapiens
gaaacaaacauggauacuu

SEQ ID NO: 233096 - RNA, 19 nt, Homo sapiens
gauggacaaugcaagaaug

SEQ ID NO: 233097 - RNA, 19 nt, Homo sapiens
cuaugaaguuggcacauuu

SEQ ID NO: 233098 - RNA, 19 nt, Homo sapiens
gcaccaacuucacuaccaa

SEQ ID NO: 233099 - RNA, 19 nt, Homo sapiens
ggaagcagacccaccaaga

SEQ ID NO: 233100 - RNA, 19 nt, Homo sapiens
ugaguuugcugguuguaaa

SEQ ID NO: 233101 - RNA, 19 nt, Homo sapiens
uaacaucccuccugcuuuu

SEQ ID NO: 233102 - RNA, 19 nt, Homo sapiens
gaccauaggauuacaacuu

SEQ ID NO: 233103 - RNA, 19 nt, Homo sapiens
gggagaagggugguaaaua

SEQ ID NO: 233104 - RNA, 19 nt, Homo sapiens
gagaagggugguaaauauu

SEQ ID NO: 233105 - RNA, 19 nt, Homo sapiens
guaccacacugaguucuau

SEQ ID NO: 233106 - RNA, 19 nt, Homo sapiens
cuuaggaugucuguaauaa

SEQ ID NO: 233107 - RNA, 19 nt, Homo sapiens
uaucaguuauccuuuguga

SEQ ID NO: 233108 - RNA, 19 nt, Homo sapiens
aaaguaggauauagcgaaa

SEQ ID NO: 233109 - RNA, 19 nt, Homo sapiens
ccaagcagcucacggaacu

SEQ ID NO: 233110 - RNA, 19 nt, Homo sapiens
ucaaagcucauaauggaaa

SEQ ID NO: 233111 - RNA, 19 nt, Homo sapiens
uaaaauuugugcuggguua

SEQ ID NO: 233112 - RNA, 19 nt, Homo sapiens
gaagggugguaaauauuuu

SEQ ID NO: 233113 - RNA, 19 nt, Homo sapiens
ucaaaccaauuucuuccuu

SEQ ID NO: 233114 - RNA, 19 nt, Homo sapiens
ggaugaaagucaaaagaaa

SEQ ID NO: 233115 - RNA, 19 nt, Homo sapiens
guauuuggcugggcuacaa

SEQ ID NO: 233116 - RNA, 19 nt, Homo sapiens
uggccaggauaauauauuu

SEQ ID NO: 233117 - RNA, 19 nt, Homo sapiens
cuagaaauguuuagguuac

SEQ ID NO: 233118 - RNA, 19 nt, Homo sapiens
uagcuuaucuuucuuucca

SEQ ID NO: 233119 - RNA, 19 nt, Homo sapiens
gaggguagccuugauuugu

SEQ ID NO: 233120 - RNA, 19 nt, Homo sapiens
agagaugcacuauauguuu

SEQ ID NO: 233121 - RNA, 19 nt, Homo sapiens
gagggucucuugcccaucu

SEQ ID NO: 233122 - RNA, 19 nt, Homo sapiens
accauaggauuacaacuuu

SEQ ID NO: 233123 - RNA, 19 nt, Homo sapiens
gcaugucgcacaauguuug

SEQ ID NO: 233124 - RNA, 19 nt, Homo sapiens
gcagagcacaaacuucaga

SEQ ID NO: 233125 - RNA, 19 nt, Homo sapiens
uagccuugauuuguucuua

SEQ ID NO: 233126 - RNA, 19 nt, Homo sapiens
ggaagaagagaugcacuau

SEQ ID NO: 233127 - RNA, 19 nt, Homo sapiens
cagggaaaguuggagagua

SEQ ID NO: 233128 - RNA, 19 nt, Homo sapiens
gaacuucagugcgccuuac

SEQ ID NO: 233129 - RNA, 19 nt, Homo sapiens
agaagggugguaaauauuu

SEQ ID NO: 233130 - RNA, 19 nt, Homo sapiens
ccuaugaaguuggcacauu

SEQ ID NO: 233131 - RNA, 19 nt, Homo sapiens
cugagauccuggagugaua

SEQ ID NO: 233132 - RNA, 19 nt, Homo sapiens
ucagcucaauuguuaaugu

SEQ ID NO: 233133 - RNA, 19 nt, Homo sapiens
gggccacccucuguuuaaa

SEQ ID NO: 233134 - RNA, 19 nt, Homo sapiens
caacagaaacaugccagaa

SEQ ID NO: 233135 - RNA, 19 nt, Homo sapiens
gcuuaucuuucuuuccauu

SEQ ID NO: 233136 - RNA, 19 nt, Homo sapiens
caacgagacccaagugaag

SEQ ID NO: 233137 - RNA, 19 nt, Homo sapiens
guuaauuccuaugaaguug

SEQ ID NO: 233138 - RNA, 19 nt, Homo sapiens
caaguuucagguaugcuua

SEQ ID NO: 233139 - RNA, 19 nt, Homo sapiens
gcucaauuguuaaugugau

SEQ ID NO: 233140 - RNA, 19 nt, Homo sapiens
uuucuuccuuccacaguua

SEQ ID NO: 233141 - RNA, 19 nt, Homo sapiens
uccaggagcucaggaagaa

SEQ ID NO: 233142 - RNA, 19 nt, Homo sapiens
gaaacaugccagaaggaau

SEQ ID NO: 233143 - RNA, 19 nt, Homo sapiens
augcuuagcuuaucuuucu

SEQ ID NO: 233144 - RNA, 19 nt, Homo sapiens
uacagucucuuucuuccuu

SEQ ID NO: 233145 - RNA, 19 nt, Homo sapiens
acaguuaucuuagcuggau

SEQ ID NO: 233146 - RNA, 19 nt, Homo sapiens
aaacaugccagaaggaauc

SEQ ID NO: 233147 - RNA, 19 nt, Homo sapiens
ccuaugauauuccccauuu

SEQ ID NO: 233148 - RNA, 19 nt, Homo sapiens
uuugugagccuaugauauu

SEQ ID NO: 233149 - RNA, 19 nt, Homo sapiens
gcuaagucuuucccaaucu

SEQ ID NO: 233150 - RNA, 19 nt, Homo sapiens
caaaagaaacccucccaaa

SEQ ID NO: 233151 - RNA, 19 nt, Homo sapiens
ugaauagucuuuugcaugu

SEQ ID NO: 233152 - RNA, 19 nt, Homo sapiens
cagcucaauuguuaaugug

SEQ ID NO: 233153 - RNA, 19 nt, Homo sapiens
gagcacaaacuucagaaac

SEQ ID NO: 233154 - RNA, 19 nt, Homo sapiens
gggcaaacucucuaaacug

SEQ ID NO: 233155 - RNA, 19 nt, Homo sapiens
aaaagaaacccucccaaaa

SEQ ID NO: 233156 - RNA, 19 nt, Homo sapiens
gaaagggagaaggguggua

SEQ ID NO: 233157 - RNA, 19 nt, Homo sapiens
ggacaaugcaagaaugaac

SEQ ID NO: 233158 - RNA, 19 nt, Homo sapiens
cccauuuccuguacaauca

SEQ ID NO: 233159 - RNA, 19 nt, Homo sapiens
ggagaauucacagaaccua

SEQ ID NO: 233160 - RNA, 19 nt, Homo sapiens
gauggcacaaugaauguau

SEQ ID NO: 233161 - RNA, 19 nt, Homo sapiens
ggguagccuugauuuguuc

SEQ ID NO: 233162 - RNA, 19 nt, Homo sapiens
aaggaaucuucucaucuuu

SEQ ID NO: 233163 - RNA, 19 nt, Homo sapiens
ggaguuccacuucaacaag

SEQ ID NO: 233164 - RNA, 19 nt, Homo sapiens
gagaugggccuuuucuuga

SEQ ID NO: 233165 - RNA, 19 nt, Homo sapiens
caaguugugguccaagcua

SEQ ID NO: 233166 - RNA, 19 nt, Homo sapiens
ucucuuucuuccuuucuaa

SEQ ID NO: 233167 - RNA, 19 nt, Homo sapiens
ucaacgagacccaagugaa

SEQ ID NO: 233168 - RNA, 19 nt, Homo sapiens
gagaaaguuggcacaguca

SEQ ID NO: 233169 - RNA, 19 nt, Homo sapiens
cuuaagcauccguguauuu

SEQ ID NO: 233170 - RNA, 19 nt, Homo sapiens
gcagaguuuacgggucuua

SEQ ID NO: 233171 - RNA, 19 nt, Homo sapiens
cagaggguagccuugauuu

SEQ ID NO: 233172 - RNA, 19 nt, Homo sapiens
ucauuuaaacccaaucaga

SEQ ID NO: 233173 - RNA, 19 nt, Homo sapiens
aacuggauguugacguaua

SEQ ID NO: 233174 - RNA, 19 nt, Homo sapiens
gcuuaagcauccguguauu

SEQ ID NO: 233175 - RNA, 19 nt, Homo sapiens
gcaagaaagugaucauaua

SEQ ID NO: 233176 - RNA, 19 nt, Homo sapiens
gcagcgauauucuaugaua

SEQ ID NO: 233177 - RNA, 19 nt, Homo sapiens
gcugauacauuucaaaguu

SEQ ID NO: 233178 - RNA, 19 nt, Homo sapiens
gagcuggccuaaacaauga

SEQ ID NO: 233179 - RNA, 19 nt, Homo sapiens
caacaacccuuuaugugau

SEQ ID NO: 233180 - RNA, 19 nt, Homo sapiens
uagcagcgauauucuauga

SEQ ID NO: 233181 - RNA, 19 nt, Homo sapiens
ugacuagggcuucuaauaa

SEQ ID NO: 233182 - RNA, 19 nt, Homo sapiens
caaaguucaucaaucaaga

SEQ ID NO: 233183 - RNA, 19 nt, Homo sapiens
caaagcaucaccaaacaaa

SEQ ID NO: 233184 - RNA, 19 nt, Homo sapiens
gcagcaggcucccaaugga

SEQ ID NO: 233185 - RNA, 19 nt, Homo sapiens
aggagaaggccaugaauua

SEQ ID NO: 233186 - RNA, 19 nt, Homo sapiens
ccacaaagaaucccuggaa

SEQ ID NO: 233187 - RNA, 19 nt, Homo sapiens
ucaacaacccuuuauguga

SEQ ID NO: 233188 - RNA, 19 nt, Homo sapiens
caaagaaucccuggaaauc

SEQ ID NO: 233189 - RNA, 19 nt, Homo sapiens
gauuaaagcccaaauuguc

SEQ ID NO: 233190 - RNA, 19 nt, Homo sapiens
gacuagggcuucuaauaag

SEQ ID NO: 233191 - RNA, 19 nt, Homo sapiens
ggagcuggccuaaacaaug

SEQ ID NO: 233192 - RNA, 19 nt, Homo sapiens
cugagugccugacaucuuu

SEQ ID NO: 233193 - RNA, 19 nt, Homo sapiens
guaugaggccugcaagaaa

SEQ ID NO: 233194 - RNA, 19 nt, Homo sapiens
gugauucccugacccaguu

SEQ ID NO: 233195 - RNA, 19 nt, Homo sapiens
aaacaaagcaucaccaaac

SEQ ID NO: 233196 - RNA, 19 nt, Homo sapiens
cagaagcaaucaugugaca

SEQ ID NO: 233197 - RNA, 19 nt, Homo sapiens
cgacagucccguagauauu

SEQ ID NO: 233198 - RNA, 19 nt, Homo sapiens
uugcaggacuuuagcguuu

SEQ ID NO: 233199 - RNA, 19 nt, Homo sapiens
ugcagcaucugaauuacua

SEQ ID NO: 233200 - RNA, 19 nt, Homo sapiens
cacaaagaaucccuggaaa

SEQ ID NO: 233201 - RNA, 19 nt, Homo sapiens
ggauuugacugagagacaa

SEQ ID NO: 233202 - RNA, 19 nt, Homo sapiens
ccauacggcuguaaucagu

SEQ ID NO: 233203 - RNA, 19 nt, Homo sapiens
aaccuugucuccaugaauu

SEQ ID NO: 233204 - RNA, 19 nt, Homo sapiens
guagauauuucagcugaca

SEQ ID NO: 233205 - RNA, 19 nt, Homo sapiens
gcuuucagaugcaguuuca

SEQ ID NO: 233206 - RNA, 19 nt, Homo sapiens
gggcuucuaauaaguguuu

SEQ ID NO: 233207 - RNA, 19 nt, Homo sapiens
ccaaggagaaggccaugaa

SEQ ID NO: 233208 - RNA, 19 nt, Homo sapiens
cagacacacucaccacaau

SEQ ID NO: 233209 - RNA, 19 nt, Homo sapiens
gacagucccguagauauuu

SEQ ID NO: 233210 - RNA, 19 nt, Homo sapiens
ggcagaagcaaucauguga

SEQ ID NO: 233211 - RNA, 19 nt, Homo sapiens
cccugucgcugauacauuu

SEQ ID NO: 233212 - RNA, 19 nt, Homo sapiens
guucaaagucuucaaugga

SEQ ID NO: 233213 - RNA, 19 nt, Homo sapiens
uaacucaacaacccuuuau

SEQ ID NO: 233214 - RNA, 19 nt, Homo sapiens
uaugaggccugcaagaaag

SEQ ID NO: 233215 - RNA, 19 nt, Homo sapiens
cuccaugaauucaauaguu

SEQ ID NO: 233216 - RNA, 19 nt, Homo sapiens
aucaagaccucgacgcuuu

SEQ ID NO: 233217 - RNA, 19 nt, Homo sapiens
agaaggccaugaauuacga

SEQ ID NO: 233218 - RNA, 19 nt, Homo sapiens
cuuuaaguguugaggauuu

SEQ ID NO: 233219 - RNA, 19 nt, Homo sapiens
cuucuucuccucuuucuuu

SEQ ID NO: 233220 - RNA, 19 nt, Homo sapiens
uuucagaaccggaggauga

SEQ ID NO: 233221 - RNA, 19 nt, Homo sapiens
gaauuugagcgagagauug

SEQ ID NO: 233222 - RNA, 19 nt, Homo sapiens
gguccaauuucaaccuugu

SEQ ID NO: 233223 - RNA, 19 nt, Homo sapiens
ggagaaggccaugaauuac

SEQ ID NO: 233224 - RNA, 19 nt, Homo sapiens
acauugggaugcauuguca

SEQ ID NO: 233225 - RNA, 19 nt, Homo sapiens
ucacccaguuugccagguu

SEQ ID NO: 233226 - RNA, 19 nt, Homo sapiens
ugaggacuccgagaaagua

SEQ ID NO: 233227 - RNA, 19 nt, Homo sapiens
gucacaauuuauccucuuu

SEQ ID NO: 233228 - RNA, 19 nt, Homo sapiens
aacaaagcaucaccaaaca

SEQ ID NO: 233229 - RNA, 19 nt, Homo sapiens
acuugcagcaucugaauua

SEQ ID NO: 233230 - RNA, 19 nt, Homo sapiens
caacacacagcuucuagag

SEQ ID NO: 233231 - RNA, 19 nt, Homo sapiens
acaaagaaucccuggaaau

SEQ ID NO: 233232 - RNA, 19 nt, Homo sapiens
cgaauuugagcgagagauu

SEQ ID NO: 233233 - RNA, 19 nt, Homo sapiens
gcucauaacggguucuuuu

SEQ ID NO: 233234 - RNA, 19 nt, Homo sapiens
caaacagagccaucuuuua

SEQ ID NO: 233235 - RNA, 19 nt, Homo sapiens
gaugcaguuucacccaguu

SEQ ID NO: 233236 - RNA, 19 nt, Homo sapiens
gagagacaagugaaagugu

SEQ ID NO: 233237 - RNA, 19 nt, Homo sapiens
auacggcuguaaucaguga

SEQ ID NO: 233238 - RNA, 19 nt, Homo sapiens
caacaaugggccagaacug

SEQ ID NO: 233239 - RNA, 19 nt, Homo sapiens
aauggcgacucccaaaguu

SEQ ID NO: 233240 - RNA, 19 nt, Homo sapiens
aaacagcgaagggaaaugu

SEQ ID NO: 233241 - RNA, 19 nt, Homo sapiens
gggcagaagcaaucaugug

SEQ ID NO: 233242 - RNA, 19 nt, Homo sapiens
agagggaaggcuacacuuu

SEQ ID NO: 233243 - RNA, 19 nt, Homo sapiens
cagcgaagggaaauguaaa

SEQ ID NO: 233244 - RNA, 19 nt, Homo sapiens
gcugagugccugacaucuu

SEQ ID NO: 233245 - RNA, 19 nt, Homo sapiens
gguuuugccuucuuuuauu

SEQ ID NO: 233246 - RNA, 19 nt, Homo sapiens
guucccaacugcuugucaa

SEQ ID NO: 233247 - RNA, 19 nt, Homo sapiens
ccaaagccccuccaaaaga

SEQ ID NO: 233248 - RNA, 19 nt, Homo sapiens
cgucacaauuuauccucuu

SEQ ID NO: 233249 - RNA, 19 nt, Homo sapiens
cuaacucaacaacccuuua

SEQ ID NO: 233250 - RNA, 19 nt, Homo sapiens
guugaggauuuucuguuua

SEQ ID NO: 233251 - RNA, 19 nt, Homo sapiens
caauggcgacucccaaagu

SEQ ID NO: 233252 - RNA, 19 nt, Homo sapiens
gagggaaggcuacacuuuu

SEQ ID NO: 233253 - RNA, 19 nt, Homo sapiens
ggaggacgaggaagagaag

SEQ ID NO: 233254 - RNA, 19 nt, Homo sapiens
gcagacccagugcaaggaa

SEQ ID NO: 233255 - RNA, 19 nt, Homo sapiens
ccucgacagucccguagau

SEQ ID NO: 233256 - RNA, 19 nt, Homo sapiens
uagaggaggacgaggaaga

SEQ ID NO: 233257 - RNA, 19 nt, Homo sapiens
ugacugagagacaagugaa

SEQ ID NO: 233258 - RNA, 19 nt, Homo sapiens
aacaacccuuuaugugauu

SEQ ID NO: 233259 - RNA, 19 nt, Homo sapiens
ccuagcagcgauauucuau

SEQ ID NO: 233260 - RNA, 19 nt, Homo sapiens
ugauuaaagcccaaauugu

SEQ ID NO: 233261 - RNA, 19 nt, Homo sapiens
ucccaaaguuucccagucu

SEQ ID NO: 233262 - RNA, 19 nt, Homo sapiens
ggagagggaaggcuacacu

SEQ ID NO: 233263 - RNA, 19 nt, Homo sapiens
ugagaacugcuuacaccaa

SEQ ID NO: 233264 - RNA, 19 nt, Homo sapiens
ucaaaguucaucaaucaag

SEQ ID NO: 233265 - RNA, 19 nt, Homo sapiens
cugauacauuucaaaguuc

SEQ ID NO: 233266 - RNA, 19 nt, Homo sapiens
aaaugacuagggcuucuaa

SEQ ID NO: 233267 - RNA, 19 nt, Homo sapiens
ugucaacaaugggccagaa

SEQ ID NO: 233268 - RNA, 19 nt, Homo sapiens
ccacuguucccaacugcuu

SEQ ID NO: 233269 - RNA, 19 nt, Homo sapiens
gagaaggccaugaauuacg

SEQ ID NO: 233270 - RNA, 19 nt, Homo sapiens
augacuagggcuucuaaua

SEQ ID NO: 233271 - RNA, 19 nt, Homo sapiens
aaggagaaggccaugaauu

SEQ ID NO: 233272 - RNA, 19 nt, Homo sapiens
uugauuaaagcccaaauug

SEQ ID NO: 233273 - RNA, 19 nt, Homo sapiens
aaacagagccaucuuuuac

SEQ ID NO: 233274 - RNA, 19 nt, Homo sapiens
cagcaucugaauuacuaaa

SEQ ID NO: 233275 - RNA, 19 nt, Homo sapiens
caggguauaugaacaaauu

SEQ ID NO: 233276 - RNA, 19 nt, Homo sapiens
uaucugaacucuaugcauu

SEQ ID NO: 233277 - RNA, 19 nt, Homo sapiens
gaaacaggguauaugaaca

SEQ ID NO: 233278 - RNA, 19 nt, Homo sapiens
ccaacggguucgcuuauaa

SEQ ID NO: 233279 - RNA, 19 nt, Homo sapiens
gaauuuauuuccucuccuu

SEQ ID NO: 233280 - RNA, 19 nt, Homo sapiens
gagaaagaguuccacuuca

SEQ ID NO: 233281 - RNA, 19 nt, Homo sapiens
ggaaagaauugcuccaaaa

SEQ ID NO: 233282 - RNA, 19 nt, Homo sapiens
ggagaaagaguuccacuuc

SEQ ID NO: 233283 - RNA, 19 nt, Homo sapiens
gcacuccguuucccgguuu

SEQ ID NO: 233284 - RNA, 19 nt, Homo sapiens
gcaaggaugacuaagugua

SEQ ID NO: 233285 - RNA, 19 nt, Homo sapiens
agaaagaguuccacuucaa

SEQ ID NO: 233286 - RNA, 19 nt, Homo sapiens
gugcaaggaugacuaagug

SEQ ID NO: 233287 - RNA, 19 nt, Homo sapiens
uggaauggcuguaucauag

SEQ ID NO: 233288 - RNA, 19 nt, Homo sapiens
gaucgguaucuuuguaaua

SEQ ID NO: 233289 - RNA, 19 nt, Homo sapiens
ucagaaacaggguauauga

SEQ ID NO: 233290 - RNA, 19 nt, Homo sapiens
gaaagagucucgacaaaac

SEQ ID NO: 233291 - RNA, 19 nt, Homo sapiens
ugacuaaguguacgucuuu

SEQ ID NO: 233292 - RNA, 19 nt, Homo sapiens
gaucagaaacaggguauau

SEQ ID NO: 233293 - RNA, 19 nt, Homo sapiens
guggcuaucugaacucuau

SEQ ID NO: 233294 - RNA, 19 nt, Homo sapiens
ucaacagcgucccguauga

SEQ ID NO: 233295 - RNA, 19 nt, Homo sapiens
gaugaaagagucucgacaa

SEQ ID NO: 233296 - RNA, 19 nt, Homo sapiens
gccaacggguucgcuuaua

SEQ ID NO: 233297 - RNA, 19 nt, Homo sapiens
gaagcucggcgaauucuca

SEQ ID NO: 233298 - RNA, 19 nt, Homo sapiens
ugagaguucuucauuccuu

SEQ ID NO: 233299 - RNA, 19 nt, Homo sapiens
ggugaacagucagauuuau

SEQ ID NO: 233300 - RNA, 19 nt, Homo sapiens
ugguggagcuggagaaaga

SEQ ID NO: 233301 - RNA, 19 nt, Homo sapiens
cgccuaaaccucgguauua

SEQ ID NO: 233302 - RNA, 19 nt, Homo sapiens
ccuggaagcucggcgaauu

SEQ ID NO: 233303 - RNA, 19 nt, Homo sapiens
uaauauccguguuaagaag

SEQ ID NO: 233304 - RNA, 19 nt, Homo sapiens
ccugcugaauguaguauuu

SEQ ID NO: 233305 - RNA, 19 nt, Homo sapiens
gauuuagguuuguaacauc

SEQ ID NO: 233306 - RNA, 19 nt, Homo sapiens
ccagagaagauccagcuuu

SEQ ID NO: 233307 - RNA, 19 nt, Homo sapiens
ugaaacaacgcgaugcaaa

SEQ ID NO: 233308 - RNA, 19 nt, Homo sapiens
cagagaagauccagcuuuu

SEQ ID NO: 233309 - RNA, 19 nt, Homo sapiens
ugacguagcaaucuugguu

SEQ ID NO: 233310 - RNA, 19 nt, Homo sapiens
aaacgguaacgaugcaaua

SEQ ID NO: 233311 - RNA, 19 nt, Homo sapiens
gaagggcaagggcaugcua

SEQ ID NO: 233312 - RNA, 19 nt, Homo sapiens
cagaaucgccgcaugaagu

SEQ ID NO: 233313 - RNA, 19 nt, Homo sapiens
ucacugagcgccagaucaa

SEQ ID NO: 233314 - RNA, 19 nt, Homo sapiens
uuagacagcucaugaaacg

SEQ ID NO: 233315 - RNA, 19 nt, Homo sapiens
cugaauaauauccguguua

SEQ ID NO: 233316 - RNA, 19 nt, Homo sapiens
gagaagauccagcuuuuga

SEQ ID NO: 233317 - RNA, 19 nt, Homo sapiens
aggaaagaauugcuccaaa

SEQ ID NO: 233318 - RNA, 19 nt, Homo sapiens
aaacaggguauaugaacaa

SEQ ID NO: 233319 - RNA, 19 nt, Homo sapiens
gggaagaauucaggaagca

SEQ ID NO: 233320 - RNA, 19 nt, Homo sapiens
gaaacaacgcgaugcaaaa

SEQ ID NO: 233321 - RNA, 19 nt, Homo sapiens
cagaaacuaagaccagaaa

SEQ ID NO: 233322 - RNA, 19 nt, Homo sapiens
gcauuagcuuccugcugaa

SEQ ID NO: 233323 - RNA, 19 nt, Homo sapiens
uguauuggcguacuuagaa

SEQ ID NO: 233324 - RNA, 19 nt, Homo sapiens
gcaagcauugaauaaucua

SEQ ID NO: 233325 - RNA, 19 nt, Homo sapiens
gaaagaguuccacuucaac

SEQ ID NO: 233326 - RNA, 19 nt, Homo sapiens
ucacccaggucuccagcaa

SEQ ID NO: 233327 - RNA, 19 nt, Homo sapiens
agaauucuguacccugaug

SEQ ID NO: 233328 - RNA, 19 nt, Homo sapiens
uugcaagcauugaauaauc

SEQ ID NO: 233329 - RNA, 19 nt, Homo sapiens
aaucuugguugcuggaaug

SEQ ID NO: 233330 - RNA, 19 nt, Homo sapiens
ccagcccucuuuggucuaa

SEQ ID NO: 233331 - RNA, 19 nt, Homo sapiens
gaggaaagaauugcuccaa

SEQ ID NO: 233332 - RNA, 19 nt, Homo sapiens
gaagauccagcuuuugaaa

SEQ ID NO: 233333 - RNA, 19 nt, Homo sapiens
gugaacagucagauuuauu

SEQ ID NO: 233334 - RNA, 19 nt, Homo sapiens
augaaagagucucgacaaa

SEQ ID NO: 233335 - RNA, 19 nt, Homo sapiens
guauuuggcauucucugaa

SEQ ID NO: 233336 - RNA, 19 nt, Homo sapiens
cggaccaacuaacgccuaa

SEQ ID NO: 233337 - RNA, 19 nt, Homo sapiens
guauuggcguacuuagaau

SEQ ID NO: 233338 - RNA, 19 nt, Homo sapiens
agaaucgccgcaugaagua

SEQ ID NO: 233339 - RNA, 19 nt, Homo sapiens
caacggguucgcuuauaau

SEQ ID NO: 233340 - RNA, 19 nt, Homo sapiens
aagcugcgcuggcgacaag

SEQ ID NO: 233341 - RNA, 19 nt, Homo sapiens
gaugcuucgcggucuguua

SEQ ID NO: 233342 - RNA, 19 nt, Homo sapiens
cagaaacaggguauaugaa

SEQ ID NO: 233343 - RNA, 19 nt, Homo sapiens
ggucaacagcgucccguau

SEQ ID NO: 233344 - RNA, 19 nt, Homo sapiens
ggacugaacuggggagagu

SEQ ID NO: 233345 - RNA, 19 nt, Homo sapiens
caaauuuucuagucgaguu

SEQ ID NO: 233346 - RNA, 19 nt, Homo sapiens
gcccuuuccuuccuuccuu

SEQ ID NO: 233347 - RNA, 19 nt, Homo sapiens
gcagggcaacggcagcuau

SEQ ID NO: 233348 - RNA, 19 nt, Homo sapiens
ccaccuagccagccuccaa

SEQ ID NO: 233349 - RNA, 19 nt, Homo sapiens
cagccaacggguucgcuua

SEQ ID NO: 233350 - RNA, 19 nt, Homo sapiens
acagugauuuagguuugua

SEQ ID NO: 233351 - RNA, 19 nt, Homo sapiens
gcacuuuccgggagcaauc

SEQ ID NO: 233352 - RNA, 19 nt, Homo sapiens
cuucuccacucuuugauca

SEQ ID NO: 233353 - RNA, 19 nt, Homo sapiens
gcaaacggaggacugaacu

SEQ ID NO: 233354 - RNA, 19 nt, Homo sapiens
gaaaacagugauuuagguu

SEQ ID NO: 233355 - RNA, 19 nt, Homo sapiens
uaugugacguagcaaucuu

SEQ ID NO: 233356 - RNA, 19 nt, Homo sapiens
uaguuuaugugacguagca

SEQ ID NO: 233357 - RNA, 19 nt, Homo sapiens
cuggugaacagucagauuu

SEQ ID NO: 233358 - RNA, 19 nt, Homo sapiens
guaugcuggugaacaguca

SEQ ID NO: 233359 - RNA, 19 nt, Homo sapiens
ggaaucccagcauuagcuu

SEQ ID NO: 233360 - RNA, 19 nt, Homo sapiens
gaauaauauccguguuaag

SEQ ID NO: 233361 - RNA, 19 nt, Homo sapiens
caaggaugacuaaguguac

SEQ ID NO: 233362 - RNA, 19 nt, Homo sapiens
gaggggaagcgauuacuuu

SEQ ID NO: 233363 - RNA, 19 nt, Homo sapiens
cacuggcccugcacccuuu

SEQ ID NO: 233364 - RNA, 19 nt, Homo sapiens
cacaguggccaaacaaauc

SEQ ID NO: 233365 - RNA, 19 nt, Homo sapiens
gcacggaagaaacaaagac

SEQ ID NO: 233366 - RNA, 19 nt, Homo sapiens
ugaaaacagugauuuaggu

SEQ ID NO: 233367 - RNA, 19 nt, Homo sapiens
cgguaacgaugcaauaaaa

SEQ ID NO: 233368 - RNA, 19 nt, Homo sapiens
ucuguacccugaugguuca

SEQ ID NO: 233369 - RNA, 19 nt, Homo sapiens
cauccguucguauuuauau

SEQ ID NO: 233370 - RNA, 19 nt, Homo sapiens
caaucuugguugcuggaau

SEQ ID NO: 233371 - RNA, 19 nt, Homo sapiens
uuagcuuccugcugaaugu

SEQ ID NO: 233372 - RNA, 19 nt, Homo sapiens
gcaauaaaaccagagaaga

SEQ ID NO: 233373 - RNA, 19 nt, Homo sapiens
uggugaacagucagauuua

SEQ ID NO: 233374 - RNA, 19 nt, Homo sapiens
cuggaauggcuguaucaua

SEQ ID NO: 233375 - RNA, 19 nt, Homo sapiens
caucuuggcugucugcuaa

SEQ ID NO: 233376 - RNA, 19 nt, Homo sapiens
ggcagacuaucaucauuua

SEQ ID NO: 233377 - RNA, 19 nt, Homo sapiens
caggguauaugaacaaauu

SEQ ID NO: 233378 - RNA, 19 nt, Homo sapiens
uaucugaacucuaugcauu

SEQ ID NO: 233379 - RNA, 19 nt, Homo sapiens
gaaacaggguauaugaaca

SEQ ID NO: 233380 - RNA, 19 nt, Homo sapiens
ccaacggguucgcuuauaa

SEQ ID NO: 233381 - RNA, 19 nt, Homo sapiens
gaauuuauuuccucuccuu

SEQ ID NO: 233382 - RNA, 19 nt, Homo sapiens
gagaaagaguuccacuuca

SEQ ID NO: 233383 - RNA, 19 nt, Homo sapiens
ggaaagaauugcuccaaaa

SEQ ID NO: 233384 - RNA, 19 nt, Homo sapiens
ggagaaagaguuccacuuc

SEQ ID NO: 233385 - RNA, 19 nt, Homo sapiens
gcacuccguuucccgguuu

SEQ ID NO: 233386 - RNA, 19 nt, Homo sapiens
gacaauuccugguucagaa

SEQ ID NO: 233387 - RNA, 19 nt, Homo sapiens
gcaaggaugacuaagugua

SEQ ID NO: 233388 - RNA, 19 nt, Homo sapiens
agaaagaguuccacuucaa

SEQ ID NO: 233389 - RNA, 19 nt, Homo sapiens
gugcaaggaugacuaagug

SEQ ID NO: 233390 - RNA, 19 nt, Homo sapiens
uggaauggcuguaucauag

SEQ ID NO: 233391 - RNA, 19 nt, Homo sapiens
ggagacaauuccugguuca

SEQ ID NO: 233392 - RNA, 19 nt, Homo sapiens
gaucgguaucuuuguaaua

SEQ ID NO: 233393 - RNA, 19 nt, Homo sapiens
ucagaaacaggguauauga

SEQ ID NO: 233394 - RNA, 19 nt, Homo sapiens
gaaagagucucgacaaaac

SEQ ID NO: 233395 - RNA, 19 nt, Homo sapiens
ugacuaaguguacgucuuu

SEQ ID NO: 233396 - RNA, 19 nt, Homo sapiens
gaucagaaacaggguauau

SEQ ID NO: 233397 - RNA, 19 nt, Homo sapiens
guggcuaucugaacucuau

SEQ ID NO: 233398 - RNA, 19 nt, Homo sapiens
ucaacagcgucccguauga

SEQ ID NO: 233399 - RNA, 19 nt, Homo sapiens
gaugaaagagucucgacaa

SEQ ID NO: 233400 - RNA, 19 nt, Homo sapiens
gccaacggguucgcuuaua

SEQ ID NO: 233401 - RNA, 19 nt, Homo sapiens
gaagcucggcgaauucuca

SEQ ID NO: 233402 - RNA, 19 nt, Homo sapiens
ugagaguucuucauuccuu

SEQ ID NO: 233403 - RNA, 19 nt, Homo sapiens
ggugaacagucagauuuau

SEQ ID NO: 233404 - RNA, 19 nt, Homo sapiens
ugguggagcuggagaaaga

SEQ ID NO: 233405 - RNA, 19 nt, Homo sapiens
cgccuaaaccucgguauua

SEQ ID NO: 233406 - RNA, 19 nt, Homo sapiens
ccuggaagcucggcgaauu

SEQ ID NO: 233407 - RNA, 19 nt, Homo sapiens
uaauauccguguuaagaag

SEQ ID NO: 233408 - RNA, 19 nt, Homo sapiens
ccugcugaauguaguauuu

SEQ ID NO: 233409 - RNA, 19 nt, Homo sapiens
gauuuagguuuguaacauc

SEQ ID NO: 233410 - RNA, 19 nt, Homo sapiens
ccagagaagauccagcuuu

SEQ ID NO: 233411 - RNA, 19 nt, Homo sapiens
ugaaacaacgcgaugcaaa

SEQ ID NO: 233412 - RNA, 19 nt, Homo sapiens
cagagaagauccagcuuuu

SEQ ID NO: 233413 - RNA, 19 nt, Homo sapiens
ugacguagcaaucuugguu

SEQ ID NO: 233414 - RNA, 19 nt, Homo sapiens
aaucucaaauggcagacua

SEQ ID NO: 233415 - RNA, 19 nt, Homo sapiens
aaacgguaacgaugcaaua

SEQ ID NO: 233416 - RNA, 19 nt, Homo sapiens
gaagggcaagggcaugcua

SEQ ID NO: 233417 - RNA, 19 nt, Homo sapiens
cagaaucgccgcaugaagu

SEQ ID NO: 233418 - RNA, 19 nt, Homo sapiens
ucacugagcgccagaucaa

SEQ ID NO: 233419 - RNA, 19 nt, Homo sapiens
cugaauaauauccguguua

SEQ ID NO: 233420 - RNA, 19 nt, Homo sapiens
gagaagauccagcuuuuga

SEQ ID NO: 233421 - RNA, 19 nt, Homo sapiens
caguggaaauugaguguca

SEQ ID NO: 233422 - RNA, 19 nt, Homo sapiens
aggaaagaauugcuccaaa

SEQ ID NO: 233423 - RNA, 19 nt, Homo sapiens
aaacaggguauaugaacaa

SEQ ID NO: 233424 - RNA, 19 nt, Homo sapiens
gggaagaauucaggaagca

SEQ ID NO: 233425 - RNA, 19 nt, Homo sapiens
gaaacaacgcgaugcaaaa

SEQ ID NO: 233426 - RNA, 19 nt, Homo sapiens
gcauuagcuuccugcugaa

SEQ ID NO: 233427 - RNA, 19 nt, Homo sapiens
ucaaauggcagacuaucau

SEQ ID NO: 233428 - RNA, 19 nt, Homo sapiens
uguauuggcguacuuagaa

SEQ ID NO: 233429 - RNA, 19 nt, Homo sapiens
gcaagcauugaauaaucua

SEQ ID NO: 233430 - RNA, 19 nt, Homo sapiens
gaaagaguuccacuucaac

SEQ ID NO: 233431 - RNA, 19 nt, Homo sapiens
ucacccaggucuccagcaa

SEQ ID NO: 233432 - RNA, 19 nt, Homo sapiens
agaauucuguacccugaug

SEQ ID NO: 233433 - RNA, 19 nt, Homo sapiens
uugcaagcauugaauaauc

SEQ ID NO: 233434 - RNA, 19 nt, Homo sapiens
ccuagacucucaguggaaa

SEQ ID NO: 233435 - RNA, 19 nt, Homo sapiens
aaucuugguugcuggaaug

SEQ ID NO: 233436 - RNA, 19 nt, Homo sapiens
ccagcccucuuuggucuaa

SEQ ID NO: 233437 - RNA, 19 nt, Homo sapiens
gaggaaagaauugcuccaa

SEQ ID NO: 233438 - RNA, 19 nt, Homo sapiens
gaagauccagcuuuugaaa

SEQ ID NO: 233439 - RNA, 19 nt, Homo sapiens
gugaacagucagauuuauu

SEQ ID NO: 233440 - RNA, 19 nt, Homo sapiens
augaaagagucucgacaaa

SEQ ID NO: 233441 - RNA, 19 nt, Homo sapiens
guauuuggcauucucugaa

SEQ ID NO: 233442 - RNA, 19 nt, Homo sapiens
cggaccaacuaacgccuaa

SEQ ID NO: 233443 - RNA, 19 nt, Homo sapiens
guauuggcguacuuagaau

SEQ ID NO: 233444 - RNA, 19 nt, Homo sapiens
agaaucgccgcaugaagua

SEQ ID NO: 233445 - RNA, 19 nt, Homo sapiens
aagcugcgcuggcgacaag

SEQ ID NO: 233446 - RNA, 19 nt, Homo sapiens
caacggguucgcuuauaau

SEQ ID NO: 233447 - RNA, 19 nt, Homo sapiens
gaugcuucgcggucuguua

SEQ ID NO: 233448 - RNA, 19 nt, Homo sapiens
cagaaacaggguauaugaa

SEQ ID NO: 233449 - RNA, 19 nt, Homo sapiens
gacucucaguggaaauuga

SEQ ID NO: 233450 - RNA, 19 nt, Homo sapiens
ggucaacagcgucccguau

SEQ ID NO: 233451 - RNA, 19 nt, Homo sapiens
gcagacuaucaucauuuaa

SEQ ID NO: 233452 - RNA, 19 nt, Homo sapiens
ggacugaacuggggagagu

SEQ ID NO: 233453 - RNA, 19 nt, Homo sapiens
caaauuuucuagucgaguu

SEQ ID NO: 233454 - RNA, 19 nt, Homo sapiens
gcccuuuccuuccuuccuu

SEQ ID NO: 233455 - RNA, 19 nt, Homo sapiens
gcagggcaacggcagcuau

SEQ ID NO: 233456 - RNA, 19 nt, Homo sapiens
ccaccuagccagccuccaa

SEQ ID NO: 233457 - RNA, 19 nt, Homo sapiens
uggcagacuaucaucauuu

SEQ ID NO: 233458 - RNA, 19 nt, Homo sapiens
acagugauuuagguuugua

SEQ ID NO: 233459 - RNA, 19 nt, Homo sapiens
cagccaacggguucgcuua

SEQ ID NO: 233460 - RNA, 19 nt, Homo sapiens
gcacuuuccgggagcaauc

SEQ ID NO: 233461 - RNA, 19 nt, Homo sapiens
cuucuccacucuuugauca

SEQ ID NO: 233462 - RNA, 19 nt, Homo sapiens
gcaaacggaggacugaacu

SEQ ID NO: 233463 - RNA, 19 nt, Homo sapiens
gaaaacagugauuuagguu

SEQ ID NO: 233464 - RNA, 19 nt, Homo sapiens
uaugugacguagcaaucuu

SEQ ID NO: 233465 - RNA, 19 nt, Homo sapiens
uaguuuaugugacguagca

SEQ ID NO: 233466 - RNA, 19 nt, Homo sapiens
gccuggaguuggagacaau

SEQ ID NO: 233467 - RNA, 19 nt, Homo sapiens
cuggugaacagucagauuu

SEQ ID NO: 233468 - RNA, 19 nt, Homo sapiens
guaugcuggugaacaguca

SEQ ID NO: 233469 - RNA, 19 nt, Homo sapiens
ggaaucccagcauuagcuu

SEQ ID NO: 233470 - RNA, 19 nt, Homo sapiens
gaauaauauccguguuaag

SEQ ID NO: 233471 - RNA, 19 nt, Homo sapiens
gguucagaauuuaaacauc

SEQ ID NO: 233472 - RNA, 19 nt, Homo sapiens
caaggaugacuaaguguac

SEQ ID NO: 233473 - RNA, 19 nt, Homo sapiens
gaggggaagcgauuacuuu

SEQ ID NO: 233474 - RNA, 19 nt, Homo sapiens
cacuggcccugcacccuuu

SEQ ID NO: 233475 - RNA, 19 nt, Homo sapiens
caggguauaugaacaaauu

SEQ ID NO: 233476 - RNA, 19 nt, Homo sapiens
uaucugaacucuaugcauu

SEQ ID NO: 233477 - RNA, 19 nt, Homo sapiens
gaaacaggguauaugaaca

SEQ ID NO: 233478 - RNA, 19 nt, Homo sapiens
gaauuuauuuccucuccuu

SEQ ID NO: 233479 - RNA, 19 nt, Homo sapiens
gagaaagaguuccacuuca

SEQ ID NO: 233480 - RNA, 19 nt, Homo sapiens
ggaaagaauugcuccaaaa

SEQ ID NO: 233481 - RNA, 19 nt, Homo sapiens
ggagaaagaguuccacuuc

SEQ ID NO: 233482 - RNA, 19 nt, Homo sapiens
gcacuccguuucccgguuu

SEQ ID NO: 233483 - RNA, 19 nt, Homo sapiens
gcaaggaugacuaagugua

SEQ ID NO: 233484 - RNA, 19 nt, Homo sapiens
agaaagaguuccacuucaa

SEQ ID NO: 233485 - RNA, 19 nt, Homo sapiens
gugcaaggaugacuaagug

SEQ ID NO: 233486 - RNA, 19 nt, Homo sapiens
uggaauggcuguaucauag

SEQ ID NO: 233487 - RNA, 19 nt, Homo sapiens
gaucgguaucuuuguaaua

SEQ ID NO: 233488 - RNA, 19 nt, Homo sapiens
ucagaaacaggguauauga

SEQ ID NO: 233489 - RNA, 19 nt, Homo sapiens
gaaagagucucgacaaaac

SEQ ID NO: 233490 - RNA, 19 nt, Homo sapiens
ugacuaaguguacgucuuu

SEQ ID NO: 233491 - RNA, 19 nt, Homo sapiens
gaucagaaacaggguauau

SEQ ID NO: 233492 - RNA, 19 nt, Homo sapiens
guggcuaucugaacucuau

SEQ ID NO: 233493 - RNA, 19 nt, Homo sapiens
ucaacagcgucccguauga

SEQ ID NO: 233494 - RNA, 19 nt, Homo sapiens
gaugaaagagucucgacaa

SEQ ID NO: 233495 - RNA, 19 nt, Homo sapiens
gaagcucggcgaauucuca

SEQ ID NO: 233496 - RNA, 19 nt, Homo sapiens
ugagaguucuucauuccuu

SEQ ID NO: 233497 - RNA, 19 nt, Homo sapiens
ggugaacagucagauuuau

SEQ ID NO: 233498 - RNA, 19 nt, Homo sapiens
ugguggagcuggagaaaga

SEQ ID NO: 233499 - RNA, 19 nt, Homo sapiens
cgccuaaaccucgguauua

SEQ ID NO: 233500 - RNA, 19 nt, Homo sapiens
ccuggaagcucggcgaauu

SEQ ID NO: 233501 - RNA, 19 nt, Homo sapiens
uaauauccguguuaagaag

SEQ ID NO: 233502 - RNA, 19 nt, Homo sapiens
ccugcugaauguaguauuu

SEQ ID NO: 233503 - RNA, 19 nt, Homo sapiens
gauuuagguuuguaacauc

SEQ ID NO: 233504 - RNA, 19 nt, Homo sapiens
ccagagaagauccagcuuu

SEQ ID NO: 233505 - RNA, 19 nt, Homo sapiens
cagagaagauccagcuuuu

SEQ ID NO: 233506 - RNA, 19 nt, Homo sapiens
ugacguagcaaucuugguu

SEQ ID NO: 233507 - RNA, 19 nt, Homo sapiens
aaacgguaacgaugcaaua

SEQ ID NO: 233508 - RNA, 19 nt, Homo sapiens
gaagggcaagggcaugcua

SEQ ID NO: 233509 - RNA, 19 nt, Homo sapiens
cagaaucgccgcaugaagu

SEQ ID NO: 233510 - RNA, 19 nt, Homo sapiens
ucacugagcgccagaucaa

SEQ ID NO: 233511 - RNA, 19 nt, Homo sapiens
cugaauaauauccguguua

SEQ ID NO: 233512 - RNA, 19 nt, Homo sapiens
gagaagauccagcuuuuga

SEQ ID NO: 233513 - RNA, 19 nt, Homo sapiens
aggaaagaauugcuccaaa

SEQ ID NO: 233514 - RNA, 19 nt, Homo sapiens
aaacaggguauaugaacaa

SEQ ID NO: 233515 - RNA, 19 nt, Homo sapiens
gggaagaauucaggaagca

SEQ ID NO: 233516 - RNA, 19 nt, Homo sapiens
gcauuagcuuccugcugaa

SEQ ID NO: 233517 - RNA, 19 nt, Homo sapiens
uguauuggcguacuuagaa

SEQ ID NO: 233518 - RNA, 19 nt, Homo sapiens
gcaagcauugaauaaucua

SEQ ID NO: 233519 - RNA, 19 nt, Homo sapiens
gaaagaguuccacuucaac

SEQ ID NO: 233520 - RNA, 19 nt, Homo sapiens
ucacccaggucuccagcaa

SEQ ID NO: 233521 - RNA, 19 nt, Homo sapiens
agaauucuguacccugaug

SEQ ID NO: 233522 - RNA, 19 nt, Homo sapiens
uugcaagcauugaauaauc

SEQ ID NO: 233523 - RNA, 19 nt, Homo sapiens
aaucuugguugcuggaaug

SEQ ID NO: 233524 - RNA, 19 nt, Homo sapiens
ccagcccucuuuggucuaa

SEQ ID NO: 233525 - RNA, 19 nt, Homo sapiens
gaggaaagaauugcuccaa

SEQ ID NO: 233526 - RNA, 19 nt, Homo sapiens
gaagauccagcuuuugaaa

SEQ ID NO: 233527 - RNA, 19 nt, Homo sapiens
augaaagagucucgacaaa

SEQ ID NO: 233528 - RNA, 19 nt, Homo sapiens
gugaacagucagauuuauu

SEQ ID NO: 233529 - RNA, 19 nt, Homo sapiens
guauuuggcauucucugaa

SEQ ID NO: 233530 - RNA, 19 nt, Homo sapiens
cggaccaacuaacgccuaa

SEQ ID NO: 233531 - RNA, 19 nt, Homo sapiens
guauuggcguacuuagaau

SEQ ID NO: 233532 - RNA, 19 nt, Homo sapiens
aagcugcgcuggcgacaag

SEQ ID NO: 233533 - RNA, 19 nt, Homo sapiens
agaaucgccgcaugaagua

SEQ ID NO: 233534 - RNA, 19 nt, Homo sapiens
gaugcuucgcggucuguua

SEQ ID NO: 233535 - RNA, 19 nt, Homo sapiens
cagaaacaggguauaugaa

SEQ ID NO: 233536 - RNA, 19 nt, Homo sapiens
ggucaacagcgucccguau

SEQ ID NO: 233537 - RNA, 19 nt, Homo sapiens
ggacugaacuggggagagu

SEQ ID NO: 233538 - RNA, 19 nt, Homo sapiens
caaauuuucuagucgaguu

SEQ ID NO: 233539 - RNA, 19 nt, Homo sapiens
gcccuuuccuuccuuccuu

SEQ ID NO: 233540 - RNA, 19 nt, Homo sapiens
gcagggcaacggcagcuau

SEQ ID NO: 233541 - RNA, 19 nt, Homo sapiens
acagugauuuagguuugua

SEQ ID NO: 233542 - RNA, 19 nt, Homo sapiens
gcacuuuccgggagcaauc

SEQ ID NO: 233543 - RNA, 19 nt, Homo sapiens
cuucuccacucuuugauca

SEQ ID NO: 233544 - RNA, 19 nt, Homo sapiens
gcaaacggaggacugaacu

SEQ ID NO: 233545 - RNA, 19 nt, Homo sapiens
gaaaacagugauuuagguu

SEQ ID NO: 233546 - RNA, 19 nt, Homo sapiens
uaugugacguagcaaucuu

SEQ ID NO: 233547 - RNA, 19 nt, Homo sapiens
uaguuuaugugacguagca

SEQ ID NO: 233548 - RNA, 19 nt, Homo sapiens
cuggugaacagucagauuu

SEQ ID NO: 233549 - RNA, 19 nt, Homo sapiens
guaugcuggugaacaguca

SEQ ID NO: 233550 - RNA, 19 nt, Homo sapiens
ggaaucccagcauuagcuu

SEQ ID NO: 233551 - RNA, 19 nt, Homo sapiens
gaauaauauccguguuaag

SEQ ID NO: 233552 - RNA, 19 nt, Homo sapiens
caaggaugacuaaguguac

SEQ ID NO: 233553 - RNA, 19 nt, Homo sapiens
gaggggaagcgauuacuuu

SEQ ID NO: 233554 - RNA, 19 nt, Homo sapiens
cacuggcccugcacccuuu

SEQ ID NO: 233555 - RNA, 19 nt, Homo sapiens
gcacggaagaaacaaagac

SEQ ID NO: 233556 - RNA, 19 nt, Homo sapiens
ugaaaacagugauuuaggu

SEQ ID NO: 233557 - RNA, 19 nt, Homo sapiens
cgguaacgaugcaauaaaa

SEQ ID NO: 233558 - RNA, 19 nt, Homo sapiens
ucuguacccugaugguuca

SEQ ID NO: 233559 - RNA, 19 nt, Homo sapiens
cauccguucguauuuauau

SEQ ID NO: 233560 - RNA, 19 nt, Homo sapiens
cacaguggccaaacaaauc

SEQ ID NO: 233561 - RNA, 19 nt, Homo sapiens
caaucuugguugcuggaau

SEQ ID NO: 233562 - RNA, 19 nt, Homo sapiens
uuagcuuccugcugaaugu

SEQ ID NO: 233563 - RNA, 19 nt, Homo sapiens
gcaauaaaaccagagaaga

SEQ ID NO: 233564 - RNA, 19 nt, Homo sapiens
uggugaacagucagauuua

SEQ ID NO: 233565 - RNA, 19 nt, Homo sapiens
cuggaauggcuguaucaua

SEQ ID NO: 233566 - RNA, 19 nt, Homo sapiens
gagcaaggagaucgguauc

SEQ ID NO: 233567 - RNA, 19 nt, Homo sapiens
ugccggaaucccagcauua

SEQ ID NO: 233568 - RNA, 19 nt, Homo sapiens
gcacgcggagcgaaacagu

SEQ ID NO: 233569 - RNA, 19 nt, Homo sapiens
cagaggaugccgagcacuu

SEQ ID NO: 233570 - RNA, 19 nt, Homo sapiens
gcugugcacggaagaaaca

SEQ ID NO: 233571 - RNA, 19 nt, Homo sapiens
cggaagaaacaaagacauc

SEQ ID NO: 233572 - RNA, 19 nt, Homo sapiens
cccauccguucguauuuau

SEQ ID NO: 233573 - RNA, 19 nt, Homo sapiens
ugcaagcauugaauaaucu

SEQ ID NO: 233574 - RNA, 19 nt, Homo sapiens
cgucaggaggaaagaauug

SEQ ID NO: 233575 - RNA, 19 nt, Homo sapiens
cauccaagcuuguauuuaa

SEQ ID NO: 233576 - RNA, 19 nt, Homo sapiens
gacauacacuugcaucuuu

SEQ ID NO: 233577 - RNA, 19 nt, Homo sapiens
gggagugcauuuagacuua

SEQ ID NO: 233578 - RNA, 19 nt, Homo sapiens
gcaaggagcccguggugua

SEQ ID NO: 233579 - RNA, 19 nt, Homo sapiens
gaagaaagaccacaaacug

SEQ ID NO: 233580 - RNA, 19 nt, Homo sapiens
cuagagaucuuaaccaguu

SEQ ID NO: 233581 - RNA, 19 nt, Homo sapiens
gcacuucacaaauuaauga

SEQ ID NO: 233582 - RNA, 19 nt, Homo sapiens
gaucuuaaccaguuucuau

SEQ ID NO: 233583 - RNA, 19 nt, Homo sapiens
gaaagcagaagaagacaga

SEQ ID NO: 233584 - RNA, 19 nt, Homo sapiens
agacuuauguggaacugua

SEQ ID NO: 233585 - RNA, 19 nt, Homo sapiens
ggaccucacaagauuauuu

SEQ ID NO: 233586 - RNA, 19 nt, Homo sapiens
gagaacaguuguccaggau

SEQ ID NO: 233587 - RNA, 19 nt, Homo sapiens
gagauacuguugucaccuu

SEQ ID NO: 233588 - RNA, 19 nt, Homo sapiens
ggauucacuuggauucuga

SEQ ID NO: 233589 - RNA, 19 nt, Homo sapiens
gaugguaggugugacaugu

SEQ ID NO: 233590 - RNA, 19 nt, Homo sapiens
gaccucacaagauuauuua

SEQ ID NO: 233591 - RNA, 19 nt, Homo sapiens
gaagaagacagacccuuuc

SEQ ID NO: 233592 - RNA, 19 nt, Homo sapiens
gaagacauuauccgguuaa

SEQ ID NO: 233593 - RNA, 19 nt, Homo sapiens
uaagauguguagaccuuga

SEQ ID NO: 233594 - RNA, 19 nt, Homo sapiens
uacuugaccuugcauguaa

SEQ ID NO: 233595 - RNA, 19 nt, Homo sapiens
ggacauacacuugcaucuu

SEQ ID NO: 233596 - RNA, 19 nt, Homo sapiens
aagaugcgauccuccaauu

SEQ ID NO: 233597 - RNA, 19 nt, Homo sapiens
acacuugcaucuuuguuga

SEQ ID NO: 233598 - RNA, 19 nt, Homo sapiens
gauaaacuccaacuacauc

SEQ ID NO: 233599 - RNA, 19 nt, Homo sapiens
cauuuagacuuauguggaa

SEQ ID NO: 233600 - RNA, 19 nt, Homo sapiens
gaugcuggcugguggaaca

SEQ ID NO: 233601 - RNA, 19 nt, Homo sapiens
aaaguccucuggauugaga

SEQ ID NO: 233602 - RNA, 19 nt, Homo sapiens
ugguaggugugacauguua

SEQ ID NO: 233603 - RNA, 19 nt, Homo sapiens
agaagacauuauccgguua

SEQ ID NO: 233604 - RNA, 19 nt, Homo sapiens
agaaagccaugugcuaaga

SEQ ID NO: 233605 - RNA, 19 nt, Homo sapiens
gacauuauccgguuaagag

SEQ ID NO: 233606 - RNA, 19 nt, Homo sapiens
cauagaaagccaugugcua

SEQ ID NO: 233607 - RNA, 19 nt, Homo sapiens
cuuaagauguguagaccuu

SEQ ID NO: 233608 - RNA, 19 nt, Homo sapiens
gaaagccaugugcuaagaa

SEQ ID NO: 233609 - RNA, 19 nt, Homo sapiens
agaagaagacagacccuuu

SEQ ID NO: 233610 - RNA, 19 nt, Homo sapiens
ggaagaaagaccacaaacu

SEQ ID NO: 233611 - RNA, 19 nt, Homo sapiens
gagcuggauucacuuggau

SEQ ID NO: 233612 - RNA, 19 nt, Homo sapiens
ggagugcauuuagacuuau

SEQ ID NO: 233613 - RNA, 19 nt, Homo sapiens
ucuuggagcuggagaagga

SEQ ID NO: 233614 - RNA, 19 nt, Homo sapiens
gccaugugcuaagaauaaa

SEQ ID NO: 233615 - RNA, 19 nt, Homo sapiens
gaccauaauagacaccaaa

SEQ ID NO: 233616 - RNA, 19 nt, Homo sapiens
ugagauacuugaccuugca

SEQ ID NO: 233617 - RNA, 19 nt, Homo sapiens
auguggaacuguacaaauu

SEQ ID NO: 233618 - RNA, 19 nt, Homo sapiens
uuaagagucugugcugguu

SEQ ID NO: 233619 - RNA, 19 nt, Homo sapiens
ccauauaaucuucuagaga

SEQ ID NO: 233620 - RNA, 19 nt, Homo sapiens
caaaaguccucuggauuga

SEQ ID NO: 233621 - RNA, 19 nt, Homo sapiens
ggugugacauguuaguuuu

SEQ ID NO: 233622 - RNA, 19 nt, Homo sapiens
ggaccauaauagacaccaa

SEQ ID NO: 233623 - RNA, 19 nt, Homo sapiens
aaacaaaaguccucuggau

SEQ ID NO: 233624 - RNA, 19 nt, Homo sapiens
aaagccaugugcuaagaau

SEQ ID NO: 233625 - RNA, 19 nt, Homo sapiens
uugauaaacuccaacuaca

SEQ ID NO: 233626 - RNA, 19 nt, Homo sapiens
gcucauccaagcuuguauu

SEQ ID NO: 233627 - RNA, 19 nt, Homo sapiens
ugagcuggauucacuugga

SEQ ID NO: 233628 - RNA, 19 nt, Homo sapiens
gcuaagaauaaacuccauu

SEQ ID NO: 233629 - RNA, 19 nt, Homo sapiens
auagaaagccaugugcuaa

SEQ ID NO: 233630 - RNA, 19 nt, Homo sapiens
gggaaagcacaaacucaga

SEQ ID NO: 233631 - RNA, 19 nt, Homo sapiens
cuacaucgagcccaaguuc

SEQ ID NO: 233632 - RNA, 19 nt, Homo sapiens
cugaauaaaugaguagaca

SEQ ID NO: 233633 - RNA, 19 nt, Homo sapiens
acaaauuaaugaccaugag

SEQ ID NO: 233634 - RNA, 19 nt, Homo sapiens
agccaugugcuaagaauaa

SEQ ID NO: 233635 - RNA, 19 nt, Homo sapiens
guugaaagcagaagaagac

SEQ ID NO: 233636 - RNA, 19 nt, Homo sapiens
acauacacuugcaucuuug

SEQ ID NO: 233637 - RNA, 19 nt, Homo sapiens
uagagaucuuaaccaguuu

SEQ ID NO: 233638 - RNA, 19 nt, Homo sapiens
gauacuugaccuugcaugu

SEQ ID NO: 233639 - RNA, 19 nt, Homo sapiens
gagugcauuuagacuuaug

SEQ ID NO: 233640 - RNA, 19 nt, Homo sapiens
gaccacaaacugcccaaca

SEQ ID NO: 233641 - RNA, 19 nt, Homo sapiens
ggagaggggagugcauuua

SEQ ID NO: 233642 - RNA, 19 nt, Homo sapiens
ggacaccgccuaccccuau

SEQ ID NO: 233643 - RNA, 19 nt, Homo sapiens
uaaugaccaugagcucguu

SEQ ID NO: 233644 - RNA, 19 nt, Homo sapiens
cccguucccuccuccauau

SEQ ID NO: 233645 - RNA, 19 nt, Homo sapiens
auacuugaccuugcaugua

SEQ ID NO: 233646 - RNA, 19 nt, Homo sapiens
acaaccugcuggcccgaaa

SEQ ID NO: 233647 - RNA, 19 nt, Homo sapiens
caagaugcgauccuccaau

SEQ ID NO: 233648 - RNA, 19 nt, Homo sapiens
ccaaaacaaacccaaauug

SEQ ID NO: 233649 - RNA, 19 nt, Homo sapiens
aaacugcccaacaccaaga

SEQ ID NO: 233650 - RNA, 19 nt, Homo sapiens
acaaacugcccaacaccaa

SEQ ID NO: 233651 - RNA, 19 nt, Homo sapiens
acaaaaguccucuggauug

SEQ ID NO: 233652 - RNA, 19 nt, Homo sapiens
caagcuuguauuuaacuga

SEQ ID NO: 233653 - RNA, 19 nt, Homo sapiens
ccaagcuuguauuuaacug

SEQ ID NO: 233654 - RNA, 19 nt, Homo sapiens
gaugcgauccuccaauucg

SEQ ID NO: 233655 - RNA, 19 nt, Homo sapiens
gcccacacgcucuguuugu

SEQ ID NO: 233656 - RNA, 19 nt, Homo sapiens
cacaaauuaaugaccauga

SEQ ID NO: 233657 - RNA, 19 nt, Homo sapiens
cauaauagacaccaaaaca

SEQ ID NO: 233658 - RNA, 19 nt, Homo sapiens
ccaucuggaccauaauaga

SEQ ID NO: 233659 - RNA, 19 nt, Homo sapiens
ccuccuccauauaaucuuc

SEQ ID NO: 233660 - RNA, 19 nt, Homo sapiens
guggaccucacaagauuau

SEQ ID NO: 233661 - RNA, 19 nt, Homo sapiens
ucauccaagcuuguauuua

SEQ ID NO: 233662 - RNA, 19 nt, Homo sapiens
acuugcaucuuuguugaaa

SEQ ID NO: 233663 - RNA, 19 nt, Homo sapiens
gaagcaagcuguguuacuu

SEQ ID NO: 233664 - RNA, 19 nt, Homo sapiens
gcacauaagucaugacaac

SEQ ID NO: 233665 - RNA, 19 nt, Homo sapiens
gcuccaagcuguuaaagau

SEQ ID NO: 233666 - RNA, 19 nt, Homo sapiens
guacuaaggugacuuucug

SEQ ID NO: 233667 - RNA, 19 nt, Homo sapiens
uaucugagcguuuaaagua

SEQ ID NO: 233668 - RNA, 19 nt, Homo sapiens
cauaagucaugacaacaua

SEQ ID NO: 233669 - RNA, 19 nt, Homo sapiens
caaacuaccuauauuccuu

SEQ ID NO: 233670 - RNA, 19 nt, Homo sapiens
gaauggcuuugucuugaaa

SEQ ID NO: 233671 - RNA, 19 nt, Homo sapiens
gaaggaggauugaaauagc

SEQ ID NO: 233672 - RNA, 19 nt, Homo sapiens
cugaguaucugagcguuua

SEQ ID NO: 233673 - RNA, 19 nt, Homo sapiens
acuaccaguugcauaauua

SEQ ID NO: 233674 - RNA, 19 nt, Homo sapiens
gcagaaggaggauugaaau

SEQ ID NO: 233675 - RNA, 19 nt, Homo sapiens
gaaguguuccugucucaau

SEQ ID NO: 233676 - RNA, 19 nt, Homo sapiens
gugccaauguuguguguug

SEQ ID NO: 233677 - RNA, 19 nt, Homo sapiens
gacuaccaguugcauaauu

SEQ ID NO: 233678 - RNA, 19 nt, Homo sapiens
aaguagaucugcuuucugu

SEQ ID NO: 233679 - RNA, 19 nt, Homo sapiens
gaaacucccuuguguuccu

SEQ ID NO: 233680 - RNA, 19 nt, Homo sapiens
ugaauggcuuugucuugaa

SEQ ID NO: 233681 - RNA, 19 nt, Homo sapiens
cagaaggaggauugaaaua

SEQ ID NO: 233682 - RNA, 19 nt, Homo sapiens
cugaauggcuuugucuuga

SEQ ID NO: 233683 - RNA, 19 nt, Homo sapiens
ggccuuccgucccugagua

SEQ ID NO: 233684 - RNA, 19 nt, Homo sapiens
guagaucugcuuucuguuc

SEQ ID NO: 233685 - RNA, 19 nt, Homo sapiens
gcaugugcguggaaguguu

SEQ ID NO: 233686 - RNA, 19 nt, Homo sapiens
uccaagcuguuaaagauau

SEQ ID NO: 233687 - RNA, 19 nt, Homo sapiens
uaugaagcaagcuguguua

SEQ ID NO: 233688 - RNA, 19 nt, Homo sapiens
gcaagcugcacauaaguca

SEQ ID NO: 233689 - RNA, 19 nt, Homo sapiens
aaaucaagcacacauauca

SEQ ID NO: 233690 - RNA, 19 nt, Homo sapiens
ccaagcuguuaaagauauu

SEQ ID NO: 233691 - RNA, 19 nt, Homo sapiens
aaguguuccugucucaaua

SEQ ID NO: 233692 - RNA, 19 nt, Homo sapiens
guguugcacucaaguuguu

SEQ ID NO: 233693 - RNA, 19 nt, Homo sapiens
acaaaucaagcacacauau

SEQ ID NO: 233694 - RNA, 19 nt, Homo sapiens
uuaaucaugagccuguuua

SEQ ID NO: 233695 - RNA, 19 nt, Homo sapiens
uagaucugcuuucuguuca

SEQ ID NO: 233696 - RNA, 19 nt, Homo sapiens
cggacuaccaguugcauaa

SEQ ID NO: 233697 - RNA, 19 nt, Homo sapiens
gagccuguuuauugccauu

SEQ ID NO: 233698 - RNA, 19 nt, Homo sapiens
ccuucaaucucguuuagug

SEQ ID NO: 233699 - RNA, 19 nt, Homo sapiens
gaucugcuuucuguucauc

SEQ ID NO: 233700 - RNA, 19 nt, Homo sapiens
ccuguuuauugccauuaua

SEQ ID NO: 233701 - RNA, 19 nt, Homo sapiens
aucaugagccuguuuauug

SEQ ID NO: 233702 - RNA, 19 nt, Homo sapiens
guacggcuacggcuacaau

SEQ ID NO: 233703 - RNA, 19 nt, Homo sapiens
auaaguagaucugcuuucu

SEQ ID NO: 233704 - RNA, 19 nt, Homo sapiens
caaaucaagcacacauauc

SEQ ID NO: 233705 - RNA, 19 nt, Homo sapiens
ccacaaaucaagcacacau

SEQ ID NO: 233706 - RNA, 19 nt, Homo sapiens
gcuuucuguucaucucuuu

SEQ ID NO: 233707 - RNA, 19 nt, Homo sapiens
ucaguacuaaggugacuuu

SEQ ID NO: 233708 - RNA, 19 nt, Homo sapiens
cccuggagcuggagaagga

SEQ ID NO: 233709 - RNA, 19 nt, Homo sapiens
gauaauaagcugaaaagca

SEQ ID NO: 233710 - RNA, 19 nt, Homo sapiens
gcuauagacgcacaaacga

SEQ ID NO: 233711 - RNA, 19 nt, Homo sapiens
guauaaguagaucugcuuu

SEQ ID NO: 233712 - RNA, 19 nt, Homo sapiens
gccauuauagcgccuguau

SEQ ID NO: 233713 - RNA, 19 nt, Homo sapiens
agaaggaggauugaaauag

SEQ ID NO: 233714 - RNA, 19 nt, Homo sapiens
ggacuaccaguugcauaau

SEQ ID NO: 233715 - RNA, 19 nt, Homo sapiens
ucaugagccuguuuauugc

SEQ ID NO: 233716 - RNA, 19 nt, Homo sapiens
cacaaaucaagcacacaua

SEQ ID NO: 233717 - RNA, 19 nt, Homo sapiens
cugaaacucccuuguguuc

SEQ ID NO: 233718 - RNA, 19 nt, Homo sapiens
ugcggucgcuauccaaaug

SEQ ID NO: 233719 - RNA, 19 nt, Homo sapiens
cgcagaaggaggauugaaa

SEQ ID NO: 233720 - RNA, 19 nt, Homo sapiens
uaccugacccgcagaagga

SEQ ID NO: 233721 - RNA, 19 nt, Homo sapiens
cggcuacaauggcauggau

SEQ ID NO: 233722 - RNA, 19 nt, Homo sapiens
ccugaauggcuuugucuug

SEQ ID NO: 233723 - RNA, 19 nt, Homo sapiens
aaucaugagccuguuuauu

SEQ ID NO: 233724 - RNA, 19 nt, Homo sapiens
aaggaggauugaaauagca

SEQ ID NO: 233725 - RNA, 19 nt, Homo sapiens
gaccgcgagccacaaauca

SEQ ID NO: 233726 - RNA, 19 nt, Homo sapiens
gccuguuuauugccauuau

SEQ ID NO: 233727 - RNA, 19 nt, Homo sapiens
gaguaucugagcguuuaaa

SEQ ID NO: 233728 - RNA, 19 nt, Homo sapiens
guugcacucaaguuguuua

SEQ ID NO: 233729 - RNA, 19 nt, Homo sapiens
gcaagcgucugugcauuua

SEQ ID NO: 233730 - RNA, 19 nt, Homo sapiens
aaaacaagcucaucaauuc

SEQ ID NO: 233731 - RNA, 19 nt, Homo sapiens
gaaaacaagcucaucaauu

SEQ ID NO: 233732 - RNA, 19 nt, Homo sapiens
aagcgucugugcauuuauu

SEQ ID NO: 233733 - RNA, 19 nt, Homo sapiens
cacuggagcuggagaagga

SEQ ID NO: 233734 - RNA, 19 nt, Homo sapiens
ccucguguuucuauucuga

SEQ ID NO: 233735 - RNA, 19 nt, Homo sapiens
caaagcacuccaugacgaa

SEQ ID NO: 233736 - RNA, 19 nt, Homo sapiens
caccucaccuuguuucuac

SEQ ID NO: 233737 - RNA, 19 nt, Homo sapiens
cgucgagucucccggacaa

SEQ ID NO: 233738 - RNA, 19 nt, Homo sapiens
guacaccucaccuuguuuc

SEQ ID NO: 233739 - RNA, 19 nt, Homo sapiens
gggcaaagcacuccaugac

SEQ ID NO: 233740 - RNA, 19 nt, Homo sapiens
gcaaccuccuucggcuuug

SEQ ID NO: 233741 - RNA, 19 nt, Homo sapiens
gggacuaccugcacuuuuc

SEQ ID NO: 233742 - RNA, 19 nt, Homo sapiens
ucaccgagcgccagaucaa

SEQ ID NO: 233743 - RNA, 19 nt, Homo sapiens
ucguguuucuauucugaua

SEQ ID NO: 233744 - RNA, 19 nt, Homo sapiens
ggaugcagcggaugaacuc

SEQ ID NO: 233745 - RNA, 19 nt, Homo sapiens
acguacaccucaccuuguu

SEQ ID NO: 233746 - RNA, 19 nt, Homo sapiens
ggaaaacaagcucaucaau

SEQ ID NO: 233747 - RNA, 19 nt, Homo sapiens
gacguacaccucaccuugu

SEQ ID NO: 233748 - RNA, 19 nt, Homo sapiens
guguuucuauucugauaag

SEQ ID NO: 233749 - RNA, 19 nt, Homo sapiens
gggaggacucagaggcaaa

SEQ ID NO: 233750 - RNA, 19 nt, Homo sapiens
ggccucguguuucuauucu

SEQ ID NO: 233751 - RNA, 19 nt, Homo sapiens
ggaggacgaugaugaagaa

SEQ ID NO: 233752 - RNA, 19 nt, Homo sapiens
gcagugaccucgccaaagg

SEQ ID NO: 233753 - RNA, 19 nt, Homo sapiens
caacaaaucacaggucaaa

SEQ ID NO: 233754 - RNA, 19 nt, Homo sapiens
uuaagagacucacugguuu

SEQ ID NO: 233755 - RNA, 19 nt, Homo sapiens
gaaagagcauaaggacgaa

SEQ ID NO: 233756 - RNA, 19 nt, Homo sapiens
ggacgaugaugaagaagag

SEQ ID NO: 233757 - RNA, 19 nt, Homo sapiens
ggaagaaagagcauaagga

SEQ ID NO: 233758 - RNA, 19 nt, Homo sapiens
gaaagcugccggacaacaa

SEQ ID NO: 233759 - RNA, 19 nt, Homo sapiens
ucaccgagcgccagauuaa

SEQ ID NO: 233760 - RNA, 19 nt, Homo sapiens
guuccgggcuuauacaaug

SEQ ID NO: 233761 - RNA, 19 nt, Homo sapiens
gcucccaacucacagagaa

SEQ ID NO: 233762 - RNA, 19 nt, Homo sapiens
ggaagacgaggaggaauga

SEQ ID NO: 233763 - RNA, 19 nt, Homo sapiens
gcaugaaguggaagaaaga

SEQ ID NO: 233764 - RNA, 19 nt, Homo sapiens
gaaaaugggguuuggugua

SEQ ID NO: 233765 - RNA, 19 nt, Homo sapiens
caaaggcgccugcgacaag

SEQ ID NO: 233766 - RNA, 19 nt, Homo sapiens
acugaaagcugccggacaa

SEQ ID NO: 233767 - RNA, 19 nt, Homo sapiens
gagacugggucgccuugga

SEQ ID NO: 233768 - RNA, 19 nt, Homo sapiens
gggcuucucuguuccaaaa

SEQ ID NO: 233769 - RNA, 19 nt, Homo sapiens
aaaaugggguuugguguaa

SEQ ID NO: 233770 - RNA, 19 nt, Homo sapiens
gccgacuucuugcuccuuu

SEQ ID NO: 233771 - RNA, 19 nt, Homo sapiens
cgaggaggacgaugaugaa

SEQ ID NO: 233772 - RNA, 19 nt, Homo sapiens
uacuccagcucccaacuuu

SEQ ID NO: 233773 - RNA, 19 nt, Homo sapiens
uuuaagagacucacugguu

SEQ ID NO: 233774 - RNA, 19 nt, Homo sapiens
cgcuggagcuggagaagga

SEQ ID NO: 233775 - RNA, 19 nt, Homo sapiens
uauaucacucuaccucgua

SEQ ID NO: 233776 - RNA, 19 nt, Homo sapiens
cgcaugaaguggaagaaag

SEQ ID NO: 233777 - RNA, 19 nt, Homo sapiens
caaaucacaggucaaaauu

SEQ ID NO: 233778 - RNA, 19 nt, Homo sapiens
gggguguaauguuaucaua

SEQ ID NO: 233779 - RNA, 19 nt, Homo sapiens
aaaggcgccugcgacaaga

SEQ ID NO: 233780 - RNA, 19 nt, Homo sapiens
ugaguucuucguauuaugu

SEQ ID NO: 233781 - RNA, 19 nt, Homo sapiens
aaagcugccggacaacaaa

SEQ ID NO: 233782 - RNA, 19 nt, Homo sapiens
ucacaggucaaaauuauga

SEQ ID NO: 233783 - RNA, 19 nt, Homo sapiens
cgaccguuccgggcuuaua

SEQ ID NO: 233784 - RNA, 19 nt, Homo sapiens
ggguguaauguuaucauau

SEQ ID NO: 233785 - RNA, 19 nt, Homo sapiens
acgaggaggacgaugauga

SEQ ID NO: 233786 - RNA, 19 nt, Homo sapiens
cgacgaggaggacgaugau

SEQ ID NO: 233787 - RNA, 19 nt, Homo sapiens
cuccuuugcucccaacuca

SEQ ID NO: 233788 - RNA, 19 nt, Homo sapiens
gaaguggaagaaagagcau

SEQ ID NO: 233789 - RNA, 19 nt, Homo sapiens
gggcuuauacaaugucaac

SEQ ID NO: 233790 - RNA, 19 nt, Homo sapiens
gaacucagguuguuuauga

SEQ ID NO: 233791 - RNA, 19 nt, Homo sapiens
cagacaagcuugaauauug

SEQ ID NO: 233792 - RNA, 19 nt, Homo sapiens
ggaaaugaaugcugauugu

SEQ ID NO: 233793 - RNA, 19 nt, Homo sapiens
ggacggcaguugauagaga

SEQ ID NO: 233794 - RNA, 19 nt, Homo sapiens
gcacaaagcggcucuaaac

SEQ ID NO: 233795 - RNA, 19 nt, Homo sapiens
guauagcucuguaguggaa

SEQ ID NO: 233796 - RNA, 19 nt, Homo sapiens
cauuugggcuuauuuagaa

SEQ ID NO: 233797 - RNA, 19 nt, Homo sapiens
uaccuaggguuuaugcuua

SEQ ID NO: 233798 - RNA, 19 nt, Homo sapiens
gaugguaggcuguauaguu

SEQ ID NO: 233799 - RNA, 19 nt, Homo sapiens
gcugauagcuguguguguu

SEQ ID NO: 233800 - RNA, 19 nt, Homo sapiens
guaagaauuucccagugaa

SEQ ID NO: 233801 - RNA, 19 nt, Homo sapiens
uggaauaugucuucuguau

SEQ ID NO: 233802 - RNA, 19 nt, Homo sapiens
ggaauaugucuucuguaua

SEQ ID NO: 233803 - RNA, 19 nt, Homo sapiens
gaaaugaaugcugauugua

SEQ ID NO: 233804 - RNA, 19 nt, Homo sapiens
gaggagguauuguaagcuu

SEQ ID NO: 233805 - RNA, 19 nt, Homo sapiens
gaggaaauucggagcuaua

SEQ ID NO: 233806 - RNA, 19 nt, Homo sapiens
agauugcucugccaagaua

SEQ ID NO: 233807 - RNA, 19 nt, Homo sapiens
gaaauucggagcuauacau

SEQ ID NO: 233808 - RNA, 19 nt, Homo sapiens
gcauuuaagucuguccauu

SEQ ID NO: 233809 - RNA, 19 nt, Homo sapiens
uguaagaauuucccaguga

SEQ ID NO: 233810 - RNA, 19 nt, Homo sapiens
ugaccaaauuguuguguug

SEQ ID NO: 233811 - RNA, 19 nt, Homo sapiens
gacgaacagugaggaaauu

SEQ ID NO: 233812 - RNA, 19 nt, Homo sapiens
cauuuaagucuguccauua

SEQ ID NO: 233813 - RNA, 19 nt, Homo sapiens
gauggaggagguauuguaa

SEQ ID NO: 233814 - RNA, 19 nt, Homo sapiens
caacaaagaccgagcaaaa

SEQ ID NO: 233815 - RNA, 19 nt, Homo sapiens
gauucaaacuucuguguac

SEQ ID NO: 233816 - RNA, 19 nt, Homo sapiens
aaucagacaagcuugaaua

SEQ ID NO: 233817 - RNA, 19 nt, Homo sapiens
gcuguuaaccuaugauugu

SEQ ID NO: 233818 - RNA, 19 nt, Homo sapiens
uacaugaaaucugcaguuu

SEQ ID NO: 233819 - RNA, 19 nt, Homo sapiens
gcucuguaguggaauaugu

SEQ ID NO: 233820 - RNA, 19 nt, Homo sapiens
aggguaagcuagagagaaa

SEQ ID NO: 233821 - RNA, 19 nt, Homo sapiens
auacauaugugcagaaggu

SEQ ID NO: 233822 - RNA, 19 nt, Homo sapiens
gugaugccauuugggcuua

SEQ ID NO: 233823 - RNA, 19 nt, Homo sapiens
ccaaauuguuguguugaga

SEQ ID NO: 233824 - RNA, 19 nt, Homo sapiens
augguaggcuguauaguuu

SEQ ID NO: 233825 - RNA, 19 nt, Homo sapiens
gacggcaguugauagagaa

SEQ ID NO: 233826 - RNA, 19 nt, Homo sapiens
aaagacgagugaugccauu

SEQ ID NO: 233827 - RNA, 19 nt, Homo sapiens
aaacaaugcugagaaugag

SEQ ID NO: 233828 - RNA, 19 nt, Homo sapiens
agauuuguauccuugauga

SEQ ID NO: 233829 - RNA, 19 nt, Homo sapiens
gugaggaaauucggagcua

SEQ ID NO: 233830 - RNA, 19 nt, Homo sapiens
aguccugucuugucuauug

SEQ ID NO: 233831 - RNA, 19 nt, Homo sapiens
guaaaguagcuguaagaau

SEQ ID NO: 233832 - RNA, 19 nt, Homo sapiens
uuaagucuguccauuaucu

SEQ ID NO: 233833 - RNA, 19 nt, Homo sapiens
auucggagcuauacauaug

SEQ ID NO: 233834 - RNA, 19 nt, Homo sapiens
gauuguggaagauagaauu

SEQ ID NO: 233835 - RNA, 19 nt, Homo sapiens
ccauugugauuguggaaga

SEQ ID NO: 233836 - RNA, 19 nt, Homo sapiens
guuacuaccuaggguuuau

SEQ ID NO: 233837 - RNA, 19 nt, Homo sapiens
guagauuuguauccuugau

SEQ ID NO: 233838 - RNA, 19 nt, Homo sapiens
gauuguaaaguagcuguaa

SEQ ID NO: 233839 - RNA, 19 nt, Homo sapiens
ugauggaggagguauugua

SEQ ID NO: 233840 - RNA, 19 nt, Homo sapiens
gacgagugaugccauuugg

SEQ ID NO: 233841 - RNA, 19 nt, Homo sapiens
cccuggaacuggagaaaga

SEQ ID NO: 233842 - RNA, 19 nt, Homo sapiens
acaguugcauagaguauag

SEQ ID NO: 233843 - RNA, 19 nt, Homo sapiens
uguggaagauagaauucaa

SEQ ID NO: 233844 - RNA, 19 nt, Homo sapiens
ccauuugggcuuauuuaga

SEQ ID NO: 233845 - RNA, 19 nt, Homo sapiens
cauaaucagacaagcuuga

SEQ ID NO: 233846 - RNA, 19 nt, Homo sapiens
ggagguauuguaagcuuuc

SEQ ID NO: 233847 - RNA, 19 nt, Homo sapiens
ucuauauaguccugucuug

SEQ ID NO: 233848 - RNA, 19 nt, Homo sapiens
gucuguccauuaucuauau

SEQ ID NO: 233849 - RNA, 19 nt, Homo sapiens
ugaaaacaaugcugagaau

SEQ ID NO: 233850 - RNA, 19 nt, Homo sapiens
gaggaaaugaaugcugauu

SEQ ID NO: 233851 - RNA, 19 nt, Homo sapiens
aaauucggagcuauacaua

SEQ ID NO: 233852 - RNA, 19 nt, Homo sapiens
aaauuguuguguugagaug

SEQ ID NO: 233853 - RNA, 19 nt, Homo sapiens
ucagacaagcuugaauauu

SEQ ID NO: 233854 - RNA, 19 nt, Homo sapiens
aguggaauaugucuucugu

SEQ ID NO: 233855 - RNA, 19 nt, Homo sapiens
aaacaguugcauagaguau

SEQ ID NO: 233856 - RNA, 19 nt, Homo sapiens
aauuugaacucagguuguu

SEQ ID NO: 233857 - RNA, 19 nt, Homo sapiens
uuugaacucagguuguuua

SEQ ID NO: 233858 - RNA, 19 nt, Homo sapiens
guuccugacuuaaaacaaa

SEQ ID NO: 233859 - RNA, 19 nt, Homo sapiens
acauaugugcagaagguua

SEQ ID NO: 233860 - RNA, 19 nt, Homo sapiens
ugaggaaauucggagcuau

SEQ ID NO: 233861 - RNA, 19 nt, Homo sapiens
gaugccauuugggcuuauu

SEQ ID NO: 233862 - RNA, 19 nt, Homo sapiens
caaauuguuguguugagau

SEQ ID NO: 233863 - RNA, 19 nt, Homo sapiens
auagcucuguaguggaaua

SEQ ID NO: 233864 - RNA, 19 nt, Homo sapiens
agaggcaggucaagaucug

SEQ ID NO: 233865 - RNA, 19 nt, Homo sapiens
uuacaugaaaucugcaguu

SEQ ID NO: 233866 - RNA, 19 nt, Homo sapiens
guugaugguaggcuguaua

SEQ ID NO: 233867 - RNA, 19 nt, Homo sapiens
gaccaaauuguuguguuga

SEQ ID NO: 233868 - RNA, 19 nt, Homo sapiens
aaugaaugcugauuguaac

SEQ ID NO: 233869 - RNA, 19 nt, Homo sapiens
ucuaccuguuccugacuua

SEQ ID NO: 233870 - RNA, 19 nt, Homo sapiens
aaccucaggccacaucuuu

SEQ ID NO: 233871 - RNA, 19 nt, Homo sapiens
agacgaacagugaggaaau

SEQ ID NO: 233872 - RNA, 19 nt, Homo sapiens
cuguuaaccuaugauugua

SEQ ID NO: 233873 - RNA, 19 nt, Homo sapiens
acuacuacguggacucguu

SEQ ID NO: 233874 - RNA, 19 nt, Homo sapiens
ugauucaaacuucugugua

SEQ ID NO: 233875 - RNA, 19 nt, Homo sapiens
uuccagaaccgcaggauga

SEQ ID NO: 233876 - RNA, 19 nt, Homo sapiens
aaaacaaugcugagaauga

SEQ ID NO: 233877 - RNA, 19 nt, Homo sapiens
cuacugaccaaauuguugu

SEQ ID NO: 233878 - RNA, 19 nt, Homo sapiens
ggaaauucggagcuauaca

SEQ ID NO: 233879 - RNA, 19 nt, Homo sapiens
caaggccuacugaccaaau

SEQ ID NO: 233880 - RNA, 19 nt, Homo sapiens
cuaccuaggguuuaugcuu

SEQ ID NO: 233881 - RNA, 19 nt, Homo sapiens
gcuauacauaugugcagaa

SEQ ID NO: 233882 - RNA, 19 nt, Homo sapiens
uauauaguccugucuuguc

SEQ ID NO: 233883 - RNA, 19 nt, Homo sapiens
caauuugaacucagguugu

SEQ ID NO: 233884 - RNA, 19 nt, Homo sapiens
uggaggagguauuguaagc

SEQ ID NO: 233885 - RNA, 19 nt, Homo sapiens
ucguaggccugccgcuuug

SEQ ID NO: 233886 - RNA, 19 nt, Homo sapiens
ugaugcacccauugugauu

SEQ ID NO: 233887 - RNA, 19 nt, Homo sapiens
gggcauuagugcugauagc

SEQ ID NO: 233888 - RNA, 19 nt, Homo sapiens
gagcaaaagacgagugaug

SEQ ID NO: 233889 - RNA, 19 nt, Homo sapiens
agacgagugaugccauuug

SEQ ID NO: 233890 - RNA, 19 nt, Homo sapiens
gaacucagguuguuuauga

SEQ ID NO: 233891 - RNA, 19 nt, Homo sapiens
cagacaagcuugaauauug

SEQ ID NO: 233892 - RNA, 19 nt, Homo sapiens
ggaaaugaaugcugauugu

SEQ ID NO: 233893 - RNA, 19 nt, Homo sapiens
gcacaaagcggcucuaaac

SEQ ID NO: 233894 - RNA, 19 nt, Homo sapiens
guauagcucuguaguggaa

SEQ ID NO: 233895 - RNA, 19 nt, Homo sapiens
cauuugggcuuauuuagaa

SEQ ID NO: 233896 - RNA, 19 nt, Homo sapiens
uaccuaggguuuaugcuua

SEQ ID NO: 233897 - RNA, 19 nt, Homo sapiens
gaugguaggcuguauaguu

SEQ ID NO: 233898 - RNA, 19 nt, Homo sapiens
gcugauagcuguguguguu

SEQ ID NO: 233899 - RNA, 19 nt, Homo sapiens
guaagaauuucccagugaa

SEQ ID NO: 233900 - RNA, 19 nt, Homo sapiens
uggaauaugucuucuguau

SEQ ID NO: 233901 - RNA, 19 nt, Homo sapiens
ggaauaugucuucuguaua

SEQ ID NO: 233902 - RNA, 19 nt, Homo sapiens
gaaaugaaugcugauugua

SEQ ID NO: 233903 - RNA, 19 nt, Homo sapiens
gaggagguauuguaagcuu

SEQ ID NO: 233904 - RNA, 19 nt, Homo sapiens
gaggaaauucggagcuaua

SEQ ID NO: 233905 - RNA, 19 nt, Homo sapiens
agauugcucugccaagaua

SEQ ID NO: 233906 - RNA, 19 nt, Homo sapiens
gaaauucggagcuauacau

SEQ ID NO: 233907 - RNA, 19 nt, Homo sapiens
gcauuuaagucuguccauu

SEQ ID NO: 233908 - RNA, 19 nt, Homo sapiens
uguaagaauuucccaguga

SEQ ID NO: 233909 - RNA, 19 nt, Homo sapiens
ugaccaaauuguuguguug

SEQ ID NO: 233910 - RNA, 19 nt, Homo sapiens
gacgaacagugaggaaauu

SEQ ID NO: 233911 - RNA, 19 nt, Homo sapiens
cauuuaagucuguccauua

SEQ ID NO: 233912 - RNA, 19 nt, Homo sapiens
gauggaggagguauuguaa

SEQ ID NO: 233913 - RNA, 19 nt, Homo sapiens
caacaaagaccgagcaaaa

SEQ ID NO: 233914 - RNA, 19 nt, Homo sapiens
gauucaaacuucuguguac

SEQ ID NO: 233915 - RNA, 19 nt, Homo sapiens
aaucagacaagcuugaaua

SEQ ID NO: 233916 - RNA, 19 nt, Homo sapiens
gcuguuaaccuaugauugu

SEQ ID NO: 233917 - RNA, 19 nt, Homo sapiens
uacaugaaaucugcaguuu

SEQ ID NO: 233918 - RNA, 19 nt, Homo sapiens
gaaccgcugucggccagaa

SEQ ID NO: 233919 - RNA, 19 nt, Homo sapiens
gcucuguaguggaauaugu

SEQ ID NO: 233920 - RNA, 19 nt, Homo sapiens
aggguaagcuagagagaaa

SEQ ID NO: 233921 - RNA, 19 nt, Homo sapiens
auacauaugugcagaaggu

SEQ ID NO: 233922 - RNA, 19 nt, Homo sapiens
gugaugccauuugggcuua

SEQ ID NO: 233923 - RNA, 19 nt, Homo sapiens
gcuugacacucacacuuug

SEQ ID NO: 233924 - RNA, 19 nt, Homo sapiens
ccaaauuguuguguugaga

SEQ ID NO: 233925 - RNA, 19 nt, Homo sapiens
augguaggcuguauaguuu

SEQ ID NO: 233926 - RNA, 19 nt, Homo sapiens
aaagacgagugaugccauu

SEQ ID NO: 233927 - RNA, 19 nt, Homo sapiens
agauuuguauccuugauga

SEQ ID NO: 233928 - RNA, 19 nt, Homo sapiens
gugaggaaauucggagcua

SEQ ID NO: 233929 - RNA, 19 nt, Homo sapiens
aguccugucuugucuauug

SEQ ID NO: 233930 - RNA, 19 nt, Homo sapiens
guaaaguagcuguaagaau

SEQ ID NO: 233931 - RNA, 19 nt, Homo sapiens
aaacaaugcugagaaugag

SEQ ID NO: 233932 - RNA, 19 nt, Homo sapiens
uuaagucuguccauuaucu

SEQ ID NO: 233933 - RNA, 19 nt, Homo sapiens
ugacuaugcuugugguucu

SEQ ID NO: 233934 - RNA, 19 nt, Homo sapiens
auucggagcuauacauaug

SEQ ID NO: 233935 - RNA, 19 nt, Homo sapiens
gauuguggaagauagaauu

SEQ ID NO: 233936 - RNA, 19 nt, Homo sapiens
ccauugugauuguggaaga

SEQ ID NO: 233937 - RNA, 19 nt, Homo sapiens
guuacuaccuaggguuuau

SEQ ID NO: 233938 - RNA, 19 nt, Homo sapiens
guagauuuguauccuugau

SEQ ID NO: 233939 - RNA, 19 nt, Homo sapiens
gucccacgcuugacacuca

SEQ ID NO: 233940 - RNA, 19 nt, Homo sapiens
gauuguaaaguagcuguaa

SEQ ID NO: 233941 - RNA, 19 nt, Homo sapiens
ugauggaggagguauugua

SEQ ID NO: 233942 - RNA, 19 nt, Homo sapiens
gacgagugaugccauuugg

SEQ ID NO: 233943 - RNA, 19 nt, Homo sapiens
cccuggaacuggagaaaga

SEQ ID NO: 233944 - RNA, 19 nt, Homo sapiens
acaguugcauagaguauag

SEQ ID NO: 233945 - RNA, 19 nt, Homo sapiens
uguggaagauagaauucaa

SEQ ID NO: 233946 - RNA, 19 nt, Homo sapiens
ccauuugggcuuauuuaga

SEQ ID NO: 233947 - RNA, 19 nt, Homo sapiens
cauaaucagacaagcuuga

SEQ ID NO: 233948 - RNA, 19 nt, Homo sapiens
ggagguauuguaagcuuuc

SEQ ID NO: 233949 - RNA, 19 nt, Homo sapiens
ucuauauaguccugucuug

SEQ ID NO: 233950 - RNA, 19 nt, Homo sapiens
gucuguccauuaucuauau

SEQ ID NO: 233951 - RNA, 19 nt, Homo sapiens
ugaaaacaaugcugagaau

SEQ ID NO: 233952 - RNA, 19 nt, Homo sapiens
gaggaaaugaaugcugauu

SEQ ID NO: 233953 - RNA, 19 nt, Homo sapiens
aaauucggagcuauacaua

SEQ ID NO: 233954 - RNA, 19 nt, Homo sapiens
aaauuguuguguugagaug

SEQ ID NO: 233955 - RNA, 19 nt, Homo sapiens
ucagacaagcuugaauauu

SEQ ID NO: 233956 - RNA, 19 nt, Homo sapiens
aguggaauaugucuucugu

SEQ ID NO: 233957 - RNA, 19 nt, Homo sapiens
aaacaguugcauagaguau

SEQ ID NO: 233958 - RNA, 19 nt, Homo sapiens
aauuugaacucagguuguu

SEQ ID NO: 233959 - RNA, 19 nt, Homo sapiens
uuugaacucagguuguuua

SEQ ID NO: 233960 - RNA, 19 nt, Homo sapiens
guuccugacuuaaaacaaa

SEQ ID NO: 233961 - RNA, 19 nt, Homo sapiens
acauaugugcagaagguua

SEQ ID NO: 233962 - RNA, 19 nt, Homo sapiens
ugaggaaauucggagcuau

SEQ ID NO: 233963 - RNA, 19 nt, Homo sapiens
gaugccauuugggcuuauu

SEQ ID NO: 233964 - RNA, 19 nt, Homo sapiens
caaauuguuguguugagau

SEQ ID NO: 233965 - RNA, 19 nt, Homo sapiens
auagcucuguaguggaaua

SEQ ID NO: 233966 - RNA, 19 nt, Homo sapiens
uuacaugaaaucugcaguu

SEQ ID NO: 233967 - RNA, 19 nt, Homo sapiens
guugaugguaggcuguaua

SEQ ID NO: 233968 - RNA, 19 nt, Homo sapiens
agaggcaggucaagaucug

SEQ ID NO: 233969 - RNA, 19 nt, Homo sapiens
gaccaaauuguuguguuga

SEQ ID NO: 233970 - RNA, 19 nt, Homo sapiens
aaugaaugcugauuguaac

SEQ ID NO: 233971 - RNA, 19 nt, Homo sapiens
ucuaccuguuccugacuua

SEQ ID NO: 233972 - RNA, 19 nt, Homo sapiens
aaccucaggccacaucuuu

SEQ ID NO: 233973 - RNA, 19 nt, Homo sapiens
aaaacaaugcugagaauga

SEQ ID NO: 233974 - RNA, 19 nt, Homo sapiens
agacgaacagugaggaaau

SEQ ID NO: 233975 - RNA, 19 nt, Homo sapiens
cuguuaaccuaugauugua

SEQ ID NO: 233976 - RNA, 19 nt, Homo sapiens
ugauucaaacuucugugua

SEQ ID NO: 233977 - RNA, 19 nt, Homo sapiens
acuacuacguggacucguu

SEQ ID NO: 233978 - RNA, 19 nt, Homo sapiens
uuccagaaccgcaggauga

SEQ ID NO: 233979 - RNA, 19 nt, Homo sapiens
cuacugaccaaauuguugu

SEQ ID NO: 233980 - RNA, 19 nt, Homo sapiens
cuuugucccugacugacua

SEQ ID NO: 233981 - RNA, 19 nt, Homo sapiens
ggaaauucggagcuauaca

SEQ ID NO: 233982 - RNA, 19 nt, Homo sapiens
gugguucuccuccaguuga

SEQ ID NO: 233983 - RNA, 19 nt, Homo sapiens
caaggccuacugaccaaau

SEQ ID NO: 233984 - RNA, 19 nt, Homo sapiens
cuaccuaggguuuaugcuu

SEQ ID NO: 233985 - RNA, 19 nt, Homo sapiens
gcuauacauaugugcagaa

SEQ ID NO: 233986 - RNA, 19 nt, Homo sapiens
uauauaguccugucuuguc

SEQ ID NO: 233987 - RNA, 19 nt, Homo sapiens
caauuugaacucagguugu

SEQ ID NO: 233988 - RNA, 19 nt, Homo sapiens
uggaggagguauuguaagc

SEQ ID NO: 233989 - RNA, 19 nt, Homo sapiens
ucguaggccugccgcuuug

SEQ ID NO: 233990 - RNA, 19 nt, Homo sapiens
gcaaaugcauucuaucguu

SEQ ID NO: 233991 - RNA, 19 nt, Homo sapiens
caaaugcauucuaucguua

SEQ ID NO: 233992 - RNA, 19 nt, Homo sapiens
ggacuucucuuccaguuuc

SEQ ID NO: 233993 - RNA, 19 nt, Homo sapiens
ggagugcugugcuguguuu

SEQ ID NO: 233994 - RNA, 19 nt, Homo sapiens
caaauuaucccacaacaau

SEQ ID NO: 233995 - RNA, 19 nt, Homo sapiens
ggucaaaccuguagaugca

SEQ ID NO: 233996 - RNA, 19 nt, Homo sapiens
uaagauaucccagcuuuaa

SEQ ID NO: 233997 - RNA, 19 nt, Homo sapiens
agagauagauauuguccua

SEQ ID NO: 233998 - RNA, 19 nt, Homo sapiens
gcuuggugcugguuuauuu

SEQ ID NO: 233999 - RNA, 19 nt, Homo sapiens
gugcagggcugguuuguuc

SEQ ID NO: 234000 - RNA, 19 nt, Homo sapiens
uguaagauaucccagcuuu

SEQ ID NO: 234001 - RNA, 19 nt, Homo sapiens
ccaacuggcucacggcaaa

SEQ ID NO: 234002 - RNA, 19 nt, Homo sapiens
gcaaagaguggucggaaga

SEQ ID NO: 234003 - RNA, 19 nt, Homo sapiens
ccacaauucucccuaucuu

SEQ ID NO: 234004 - RNA, 19 nt, Homo sapiens
gauauuguccuaaguguca

SEQ ID NO: 234005 - RNA, 19 nt, Homo sapiens
gagaagggagacauuguuu

SEQ ID NO: 234006 - RNA, 19 nt, Homo sapiens
ucacagccaacuuuaauuu

SEQ ID NO: 234007 - RNA, 19 nt, Homo sapiens
gaaguuacaugcauaaaag

SEQ ID NO: 234008 - RNA, 19 nt, Homo sapiens
gaaaaugaaucgagaaaac

SEQ ID NO: 234009 - RNA, 19 nt, Homo sapiens
ggaugaaacugaagaaaau

SEQ ID NO: 234010 - RNA, 19 nt, Homo sapiens
gaguuucuguucaauaugu

SEQ ID NO: 234011 - RNA, 19 nt, Homo sapiens
ggagacauuguuuggauuu

SEQ ID NO: 234012 - RNA, 19 nt, Homo sapiens
gcugugcuguguuuaauca

SEQ ID NO: 234013 - RNA, 19 nt, Homo sapiens
gacgauguuuauguucuua

SEQ ID NO: 234014 - RNA, 19 nt, Homo sapiens
gaagggagacauuguuugg

SEQ ID NO: 234015 - RNA, 19 nt, Homo sapiens
gagcucacagccaacuuua

SEQ ID NO: 234016 - RNA, 19 nt, Homo sapiens
aauaaaagcuguggaauga

SEQ ID NO: 234017 - RNA, 19 nt, Homo sapiens
ggacaugcagguuggcaaa

SEQ ID NO: 234018 - RNA, 19 nt, Homo sapiens
gcucacagccaacuuuaau

SEQ ID NO: 234019 - RNA, 19 nt, Homo sapiens
gaaggaguuucuguucaau

SEQ ID NO: 234020 - RNA, 19 nt, Homo sapiens
uuaaaucgccuugaacaaa

SEQ ID NO: 234021 - RNA, 19 nt, Homo sapiens
gcugguuuguucugacuuu

SEQ ID NO: 234022 - RNA, 19 nt, Homo sapiens
gacaagcacaccacaauuc

SEQ ID NO: 234023 - RNA, 19 nt, Homo sapiens
gggagacauuguuuggauu

SEQ ID NO: 234024 - RNA, 19 nt, Homo sapiens
ggcuguagauaaauaaugu

SEQ ID NO: 234025 - RNA, 19 nt, Homo sapiens
ggagcucacagccaacuuu

SEQ ID NO: 234026 - RNA, 19 nt, Homo sapiens
gacuuuggcugauuuaaaa

SEQ ID NO: 234027 - RNA, 19 nt, Homo sapiens
gauagauauuguccuaagu

SEQ ID NO: 234028 - RNA, 19 nt, Homo sapiens
ggugcugguuuauuuguug

SEQ ID NO: 234029 - RNA, 19 nt, Homo sapiens
ccauagaccuguggcuaga

SEQ ID NO: 234030 - RNA, 19 nt, Homo sapiens
uaaaucgccuugaacaaaa

SEQ ID NO: 234031 - RNA, 19 nt, Homo sapiens
gcgcagaacaucaaagaag

SEQ ID NO: 234032 - RNA, 19 nt, Homo sapiens
ggucuuacauugccugacu

SEQ ID NO: 234033 - RNA, 19 nt, Homo sapiens
guaagauaucccagcuuua

SEQ ID NO: 234034 - RNA, 19 nt, Homo sapiens
ggcaaacgggcuugacuuu

SEQ ID NO: 234035 - RNA, 19 nt, Homo sapiens
cacuggagcuggagaagga

SEQ ID NO: 234036 - RNA, 19 nt, Homo sapiens
gcaaagccucgccggagaa

SEQ ID NO: 234037 - RNA, 19 nt, Homo sapiens
cgcagaacaucaaagaaga

SEQ ID NO: 234038 - RNA, 19 nt, Homo sapiens
ugacuuuggcugauuuaaa

SEQ ID NO: 234039 - RNA, 19 nt, Homo sapiens
gcuugacuuuggcugauuu

SEQ ID NO: 234040 - RNA, 19 nt, Homo sapiens
aaagccauaucaugcuaaa

SEQ ID NO: 234041 - RNA, 19 nt, Homo sapiens
aggaguuucuguucaauau

SEQ ID NO: 234042 - RNA, 19 nt, Homo sapiens
aauguuaguucuagcucua

SEQ ID NO: 234043 - RNA, 19 nt, Homo sapiens
gaaggccgaggucccauug

SEQ ID NO: 234044 - RNA, 19 nt, Homo sapiens
gcugguuuauuuguuguuu

SEQ ID NO: 234045 - RNA, 19 nt, Homo sapiens
cuagcucuauuuacuucua

SEQ ID NO: 234046 - RNA, 19 nt, Homo sapiens
ccuucuggcuguagauaaa

SEQ ID NO: 234047 - RNA, 19 nt, Homo sapiens
ccuuuauacugugaaguua

SEQ ID NO: 234048 - RNA, 19 nt, Homo sapiens
uuucagaaccgcaggauga

SEQ ID NO: 234049 - RNA, 19 nt, Homo sapiens
cucccuaucuugugaaguu

SEQ ID NO: 234050 - RNA, 19 nt, Homo sapiens
ugacaagcacaccacaauu

SEQ ID NO: 234051 - RNA, 19 nt, Homo sapiens
gaauaaaagcuguggaaug

SEQ ID NO: 234052 - RNA, 19 nt, Homo sapiens
uggauuuccuuuauacugu

SEQ ID NO: 234053 - RNA, 19 nt, Homo sapiens
agauagauauuguccuaag

SEQ ID NO: 234054 - RNA, 19 nt, Homo sapiens
gugcugugcuguguuuaau

SEQ ID NO: 234055 - RNA, 19 nt, Homo sapiens
ggaaggccgaggucccauu

SEQ ID NO: 234056 - RNA, 19 nt, Homo sapiens
gccaaauuaucccacaaca

SEQ ID NO: 234057 - RNA, 19 nt, Homo sapiens
acaccacaauucucccuau

SEQ ID NO: 234058 - RNA, 19 nt, Homo sapiens
gggcuggguuugcugucuu

SEQ ID NO: 234059 - RNA, 19 nt, Homo sapiens
uagauauuguccuaagugu

SEQ ID NO: 234060 - RNA, 19 nt, Homo sapiens
agacgauguuuauguucuu

SEQ ID NO: 234061 - RNA, 19 nt, Homo sapiens
gguaagcggaauaaacuag

SEQ ID NO: 234062 - RNA, 19 nt, Homo sapiens
ucaaagaagagagcuccua

SEQ ID NO: 234063 - RNA, 19 nt, Homo sapiens
gcaggaugaaacugaagaa

SEQ ID NO: 234064 - RNA, 19 nt, Homo sapiens
uaaaagcuguggaaugaag

SEQ ID NO: 234065 - RNA, 19 nt, Homo sapiens
gauuuccuuuauacuguga

SEQ ID NO: 234066 - RNA, 19 nt, Homo sapiens
guaagcggaauaaacuaga

SEQ ID NO: 234067 - RNA, 19 nt, Homo sapiens
ugaggucaauggugcaaag

SEQ ID NO: 234068 - RNA, 19 nt, Homo sapiens
ggacaaaugccccaaaguc

SEQ ID NO: 234069 - RNA, 19 nt, Homo sapiens
guuuggauuuccuuuauac

SEQ ID NO: 234070 - RNA, 19 nt, Homo sapiens
gagacauuguuuggauuuc

SEQ ID NO: 234071 - RNA, 19 nt, Homo sapiens
gugacaagcacaccacaau

SEQ ID NO: 234072 - RNA, 19 nt, Homo sapiens
gcauuuggaauuaguggau

SEQ ID NO: 234073 - RNA, 19 nt, Homo sapiens
ccaaauuaucccacaacaa

SEQ ID NO: 234074 - RNA, 19 nt, Homo sapiens
gggcuugacuuuggcugau

SEQ ID NO: 234075 - RNA, 19 nt, Homo sapiens
caaagaguggucggaagaa

SEQ ID NO: 234076 - RNA, 19 nt, Homo sapiens
cgaaauggccccugucuuc

SEQ ID NO: 234077 - RNA, 19 nt, Homo sapiens
agggagacauuguuuggau

SEQ ID NO: 234078 - RNA, 19 nt, Homo sapiens
ccauauccuucuggcugua

SEQ ID NO: 234079 - RNA, 19 nt, Homo sapiens
uuacauugccugacuaaaa

SEQ ID NO: 234080 - RNA, 19 nt, Homo sapiens
aggccgaggucccauuguu

SEQ ID NO: 234081 - RNA, 19 nt, Homo sapiens
gagauagauauuguccuaa

SEQ ID NO: 234082 - RNA, 19 nt, Homo sapiens
gccaucuccugggccguua

SEQ ID NO: 234083 - RNA, 19 nt, Homo sapiens
cugugaaguuacaugcaua

SEQ ID NO: 234084 - RNA, 19 nt, Homo sapiens
agagaagggagacauuguu

SEQ ID NO: 234085 - RNA, 19 nt, Homo sapiens
ccucuaaauuuccauaucc

SEQ ID NO: 234086 - RNA, 19 nt, Homo sapiens
gcagaacaucaaagaagag

SEQ ID NO: 234087 - RNA, 19 nt, Homo sapiens
aagaagagagcuccuacug

SEQ ID NO: 234088 - RNA, 19 nt, Homo sapiens
uaagcggaauaaacuagag

SEQ ID NO: 234089 - RNA, 19 nt, Homo sapiens
gggcaauuccaaaggugaa

SEQ ID NO: 234090 - RNA, 19 nt, Homo sapiens
gcaaaugcauucuaucguu

SEQ ID NO: 234091 - RNA, 19 nt, Homo sapiens
caaaugcauucuaucguua

SEQ ID NO: 234092 - RNA, 19 nt, Homo sapiens
ggacuucucuuccaguuuc

SEQ ID NO: 234093 - RNA, 19 nt, Homo sapiens
gcagcacgguacauuauuu

SEQ ID NO: 234094 - RNA, 19 nt, Homo sapiens
ggagugcugugcuguguuu

SEQ ID NO: 234095 - RNA, 19 nt, Homo sapiens
ggaaaugugucaaggcaau

SEQ ID NO: 234096 - RNA, 19 nt, Homo sapiens
ggucaaaccuguagaugca

SEQ ID NO: 234097 - RNA, 19 nt, Homo sapiens
uaagauaucccagcuuuaa

SEQ ID NO: 234098 - RNA, 19 nt, Homo sapiens
agagauagauauuguccua

SEQ ID NO: 234099 - RNA, 19 nt, Homo sapiens
gcuuggugcugguuuauuu

SEQ ID NO: 234100 - RNA, 19 nt, Homo sapiens
gugcagggcugguuuguuc

SEQ ID NO: 234101 - RNA, 19 nt, Homo sapiens
uguaagauaucccagcuuu

SEQ ID NO: 234102 - RNA, 19 nt, Homo sapiens
ccaacuggcucacggcaaa

SEQ ID NO: 234103 - RNA, 19 nt, Homo sapiens
gcaaagaguggucggaaga

SEQ ID NO: 234104 - RNA, 19 nt, Homo sapiens
gaagugauugguaugguaa

SEQ ID NO: 234105 - RNA, 19 nt, Homo sapiens
ccacaauucucccuaucuu

SEQ ID NO: 234106 - RNA, 19 nt, Homo sapiens
gauauuguccuaaguguca

SEQ ID NO: 234107 - RNA, 19 nt, Homo sapiens
gagaagggagacauuguuu

SEQ ID NO: 234108 - RNA, 19 nt, Homo sapiens
ucacagccaacuuuaauuu

SEQ ID NO: 234109 - RNA, 19 nt, Homo sapiens
gaaguuacaugcauaaaag

SEQ ID NO: 234110 - RNA, 19 nt, Homo sapiens
gaaaaugaaucgagaaaac

SEQ ID NO: 234111 - RNA, 19 nt, Homo sapiens
ggaugaaacugaagaaaau

SEQ ID NO: 234112 - RNA, 19 nt, Homo sapiens
gaguuucuguucaauaugu

SEQ ID NO: 234113 - RNA, 19 nt, Homo sapiens
gagcagcacgguacauuau

SEQ ID NO: 234114 - RNA, 19 nt, Homo sapiens
ggagacauuguuuggauuu

SEQ ID NO: 234115 - RNA, 19 nt, Homo sapiens
gcagcgauuucuuagaugu

SEQ ID NO: 234116 - RNA, 19 nt, Homo sapiens
gcugugcuguguuuaauca

SEQ ID NO: 234117 - RNA, 19 nt, Homo sapiens
gacgauguuuauguucuua

SEQ ID NO: 234118 - RNA, 19 nt, Homo sapiens
gaagggagacauuguuugg

SEQ ID NO: 234119 - RNA, 19 nt, Homo sapiens
gagcucacagccaacuuua

SEQ ID NO: 234120 - RNA, 19 nt, Homo sapiens
agaagugauugguauggua

SEQ ID NO: 234121 - RNA, 19 nt, Homo sapiens
aauaaaagcuguggaauga

SEQ ID NO: 234122 - RNA, 19 nt, Homo sapiens
ggacaugcagguuggcaaa

SEQ ID NO: 234123 - RNA, 19 nt, Homo sapiens
gcucacagccaacuuuaau

SEQ ID NO: 234124 - RNA, 19 nt, Homo sapiens
gaaggaguuucuguucaau

SEQ ID NO: 234125 - RNA, 19 nt, Homo sapiens
ggacucacccucaagaagu

SEQ ID NO: 234126 - RNA, 19 nt, Homo sapiens
uuaaaucgccuugaacaaa

SEQ ID NO: 234127 - RNA, 19 nt, Homo sapiens
gcugguuuguucugacuuu

SEQ ID NO: 234128 - RNA, 19 nt, Homo sapiens
gacaagcacaccacaauuc

SEQ ID NO: 234129 - RNA, 19 nt, Homo sapiens
gggagacauuguuuggauu

SEQ ID NO: 234130 - RNA, 19 nt, Homo sapiens
ggcuguagauaaauaaugu

SEQ ID NO: 234131 - RNA, 19 nt, Homo sapiens
ggagcucacagccaacuuu

SEQ ID NO: 234132 - RNA, 19 nt, Homo sapiens
gacuuuggcugauuuaaaa

SEQ ID NO: 234133 - RNA, 19 nt, Homo sapiens
gugacaauguggucguaaa

SEQ ID NO: 234134 - RNA, 19 nt, Homo sapiens
gauagauauuguccuaagu

SEQ ID NO: 234135 - RNA, 19 nt, Homo sapiens
ggugcugguuuauuuguug

SEQ ID NO: 234136 - RNA, 19 nt, Homo sapiens
uaaaucgccuugaacaaaa

SEQ ID NO: 234137 - RNA, 19 nt, Homo sapiens
ggucuuacauugccugacu

SEQ ID NO: 234138 - RNA, 19 nt, Homo sapiens
guaagauaucccagcuuua

SEQ ID NO: 234139 - RNA, 19 nt, Homo sapiens
ggcaaacgggcuugacuuu

SEQ ID NO: 234140 - RNA, 19 nt, Homo sapiens
cacuggagcuggagaagga

SEQ ID NO: 234141 - RNA, 19 nt, Homo sapiens
ugacuuuggcugauuuaaa

SEQ ID NO: 234142 - RNA, 19 nt, Homo sapiens
gcuugacuuuggcugauuu

SEQ ID NO: 234143 - RNA, 19 nt, Homo sapiens
aaagccauaucaugcuaaa

SEQ ID NO: 234144 - RNA, 19 nt, Homo sapiens
gcacuuccgaucaauguca

SEQ ID NO: 234145 - RNA, 19 nt, Homo sapiens
aggaguuucuguucaauau

SEQ ID NO: 234146 - RNA, 19 nt, Homo sapiens
ucaaggcaauuccaaaggu

SEQ ID NO: 234147 - RNA, 19 nt, Homo sapiens
guacauuauuucacuuguc

SEQ ID NO: 234148 - RNA, 19 nt, Homo sapiens
aauguuaguucuagcucua

SEQ ID NO: 234149 - RNA, 19 nt, Homo sapiens
gaaggccgaggucccauug

SEQ ID NO: 234150 - RNA, 19 nt, Homo sapiens
gcugguuuauuuguuguuu

SEQ ID NO: 234151 - RNA, 19 nt, Homo sapiens
cuagcucuauuuacuucua

SEQ ID NO: 234152 - RNA, 19 nt, Homo sapiens
ccuucuggcuguagauaaa

SEQ ID NO: 234153 - RNA, 19 nt, Homo sapiens
uugcagcgauuucuuagau

SEQ ID NO: 234154 - RNA, 19 nt, Homo sapiens
ccuuuauacugugaaguua

SEQ ID NO: 234155 - RNA, 19 nt, Homo sapiens
cggccaauuugcauauuug

SEQ ID NO: 234156 - RNA, 19 nt, Homo sapiens
gcaugauucuuggccuuug

SEQ ID NO: 234157 - RNA, 19 nt, Homo sapiens
uuucagaaccgcaggauga

SEQ ID NO: 234158 - RNA, 19 nt, Homo sapiens
cucaagaagugauugguau

SEQ ID NO: 234159 - RNA, 19 nt, Homo sapiens
cucccuaucuugugaaguu

SEQ ID NO: 234160 - RNA, 19 nt, Homo sapiens
ugacaagcacaccacaauu

SEQ ID NO: 234161 - RNA, 19 nt, Homo sapiens
gaauaaaagcuguggaaug

SEQ ID NO: 234162 - RNA, 19 nt, Homo sapiens
ggccuuuguucgcuucuga

SEQ ID NO: 234163 - RNA, 19 nt, Homo sapiens
uggauuuccuuuauacugu

SEQ ID NO: 234164 - RNA, 19 nt, Homo sapiens
gaaaugugucaaggcaauu

SEQ ID NO: 234165 - RNA, 19 nt, Homo sapiens
agauagauauuguccuaag

SEQ ID NO: 234166 - RNA, 19 nt, Homo sapiens
ggagcugguuuccgucucu

SEQ ID NO: 234167 - RNA, 19 nt, Homo sapiens
gugcugugcuguguuuaau

SEQ ID NO: 234168 - RNA, 19 nt, Homo sapiens
ggaaggccgaggucccauu

SEQ ID NO: 234169 - RNA, 19 nt, Homo sapiens
ccggccaauuugcauauuu

SEQ ID NO: 234170 - RNA, 19 nt, Homo sapiens
acaccacaauucucccuau

SEQ ID NO: 234171 - RNA, 19 nt, Homo sapiens
gggcuggguuugcugucuu

SEQ ID NO: 234172 - RNA, 19 nt, Homo sapiens
uagauauuguccuaagugu

SEQ ID NO: 234173 - RNA, 19 nt, Homo sapiens
ccucaagaagugauuggua

SEQ ID NO: 234174 - RNA, 19 nt, Homo sapiens
agacgauguuuauguucuu

SEQ ID NO: 234175 - RNA, 19 nt, Homo sapiens
gguaagcggaauaaacuag

SEQ ID NO: 234176 - RNA, 19 nt, Homo sapiens
gcaggaugaaacugaagaa

SEQ ID NO: 234177 - RNA, 19 nt, Homo sapiens
uaaaagcuguggaaugaag

SEQ ID NO: 234178 - RNA, 19 nt, Homo sapiens
gauuuccuuuauacuguga

SEQ ID NO: 234179 - RNA, 19 nt, Homo sapiens
guaagcggaauaaacuaga

SEQ ID NO: 234180 - RNA, 19 nt, Homo sapiens
gcgcacuuccgaucaaugu

SEQ ID NO: 234181 - RNA, 19 nt, Homo sapiens
ugaggucaauggugcaaag

SEQ ID NO: 234182 - RNA, 19 nt, Homo sapiens
gcgauuucuuagauguaaa

SEQ ID NO: 234183 - RNA, 19 nt, Homo sapiens
gacucacccucaagaagug

SEQ ID NO: 234184 - RNA, 19 nt, Homo sapiens
agagcagcacgguacauua

SEQ ID NO: 234185 - RNA, 19 nt, Homo sapiens
gguacauuauuucacuugu

SEQ ID NO: 234186 - RNA, 19 nt, Homo sapiens
guuuggauuuccuuuauac

SEQ ID NO: 234187 - RNA, 19 nt, Homo sapiens
gagacauuguuuggauuuc

SEQ ID NO: 234188 - RNA, 19 nt, Homo sapiens
gugacaagcacaccacaau

SEQ ID NO: 234189 - RNA, 19 nt, Homo sapiens
gcauuuggaauuaguggau

SEQ ID NO: 234190 - RNA, 19 nt, Homo sapiens
ggaaauggcuguggagugu

SEQ ID NO: 234191 - RNA, 19 nt, Homo sapiens
uaaacucgcucacugcuaa

SEQ ID NO: 234192 - RNA, 19 nt, Homo sapiens
gaaugaggcugcuuuccaa

SEQ ID NO: 234193 - RNA, 19 nt, Homo sapiens
caaauccacuccucuaaga

SEQ ID NO: 234194 - RNA, 19 nt, Homo sapiens
agagugagguggaauuauu

SEQ ID NO: 234195 - RNA, 19 nt, Homo sapiens
caagguagcccaauaaugg

SEQ ID NO: 234196 - RNA, 19 nt, Homo sapiens
gaagagggcugcaaauccu

SEQ ID NO: 234197 - RNA, 19 nt, Homo sapiens
gagaagcgccugcaacugu

SEQ ID NO: 234198 - RNA, 19 nt, Homo sapiens
ugagaucucugcaggaaau

SEQ ID NO: 234199 - RNA, 19 nt, Homo sapiens
caagccacauggugacuuu

SEQ ID NO: 234200 - RNA, 19 nt, Homo sapiens
uuaaaggcccuaucuguuu

SEQ ID NO: 234201 - RNA, 19 nt, Homo sapiens
cagcuagaaugacagguuu

SEQ ID NO: 234202 - RNA, 19 nt, Homo sapiens
auuaagaucucagugguua

SEQ ID NO: 234203 - RNA, 19 nt, Homo sapiens
gaaccaaagcgaauuuuaa

SEQ ID NO: 234204 - RNA, 19 nt, Homo sapiens
guaaugaaacuuggauuug

SEQ ID NO: 234205 - RNA, 19 nt, Homo sapiens
gcaguggagaaucauguua

SEQ ID NO: 234206 - RNA, 19 nt, Homo sapiens
gaaaagaggugugcaagag

SEQ ID NO: 234207 - RNA, 19 nt, Homo sapiens
caaccucacugaucgucaa

SEQ ID NO: 234208 - RNA, 19 nt, Homo sapiens
acagagaccguuuacagua

SEQ ID NO: 234209 - RNA, 19 nt, Homo sapiens
uaacagagaccguuuacag

SEQ ID NO: 234210 - RNA, 19 nt, Homo sapiens
ggaagcuucuggugaccuu

SEQ ID NO: 234211 - RNA, 19 nt, Homo sapiens
ggacuuggagguagcuuug

SEQ ID NO: 234212 - RNA, 19 nt, Homo sapiens
uaacauguauuugccaagu

SEQ ID NO: 234213 - RNA, 19 nt, Homo sapiens
gaaggaaccaaagcgaauu

SEQ ID NO: 234214 - RNA, 19 nt, Homo sapiens
gugguuaagauuccuaaua

SEQ ID NO: 234215 - RNA, 19 nt, Homo sapiens
cagcugcaguggagaauca

SEQ ID NO: 234216 - RNA, 19 nt, Homo sapiens
gcgucuacauuaacaaaga

SEQ ID NO: 234217 - RNA, 19 nt, Homo sapiens
gcucacugcuaagaauauu

SEQ ID NO: 234218 - RNA, 19 nt, Homo sapiens
ggaggaagggguaggauua

SEQ ID NO: 234219 - RNA, 19 nt, Homo sapiens
cugggacucucuugauuaa

SEQ ID NO: 234220 - RNA, 19 nt, Homo sapiens
auacagggaugguguucaa

SEQ ID NO: 234221 - RNA, 19 nt, Homo sapiens
uccaagagccugagaguga

SEQ ID NO: 234222 - RNA, 19 nt, Homo sapiens
gcaaauccacuccucuaag

SEQ ID NO: 234223 - RNA, 19 nt, Homo sapiens
cagcaaauccacuccucua

SEQ ID NO: 234224 - RNA, 19 nt, Homo sapiens
aaacuuggauuugcucagu

SEQ ID NO: 234225 - RNA, 19 nt, Homo sapiens
cccaaagccucgacacaga

SEQ ID NO: 234226 - RNA, 19 nt, Homo sapiens
ucuccagccucccuucuuu

SEQ ID NO: 234227 - RNA, 19 nt, Homo sapiens
uuacaguguuccgugguua

SEQ ID NO: 234228 - RNA, 19 nt, Homo sapiens
gagugagguggaauuauuu

SEQ ID NO: 234229 - RNA, 19 nt, Homo sapiens
uuucagaacaggagaauga

SEQ ID NO: 234230 - RNA, 19 nt, Homo sapiens
guagcccaauaauggauuu

SEQ ID NO: 234231 - RNA, 19 nt, Homo sapiens
ggacaagagcgccgagaag

SEQ ID NO: 234232 - RNA, 19 nt, Homo sapiens
cguaaugaaacuuggauuu

SEQ ID NO: 234233 - RNA, 19 nt, Homo sapiens
gcuccucuaacauguauuu

SEQ ID NO: 234234 - RNA, 19 nt, Homo sapiens
gcccaagguagcccaauaa

SEQ ID NO: 234235 - RNA, 19 nt, Homo sapiens
gaacaggagaaugaaggaa

SEQ ID NO: 234236 - RNA, 19 nt, Homo sapiens
acauguauuugccaaguug

SEQ ID NO: 234237 - RNA, 19 nt, Homo sapiens
ugagagugagguggaauua

SEQ ID NO: 234238 - RNA, 19 nt, Homo sapiens
uaaugaaacuuggauuugc

SEQ ID NO: 234239 - RNA, 19 nt, Homo sapiens
ucagagaguacgccauuga

SEQ ID NO: 234240 - RNA, 19 nt, Homo sapiens
ggaaaagagaugaugaaaa

SEQ ID NO: 234241 - RNA, 19 nt, Homo sapiens
gcaaucuggcccacugcua

SEQ ID NO: 234242 - RNA, 19 nt, Homo sapiens
ucacugcuaagaauauuug

SEQ ID NO: 234243 - RNA, 19 nt, Homo sapiens
ccacacguaaugaaacuug

SEQ ID NO: 234244 - RNA, 19 nt, Homo sapiens
gcaaauccuugugggaaaa

SEQ ID NO: 234245 - RNA, 19 nt, Homo sapiens
ggaagagggcugcaaaucc

SEQ ID NO: 234246 - RNA, 19 nt, Homo sapiens
cagagaccguuuacaguac

SEQ ID NO: 234247 - RNA, 19 nt, Homo sapiens
gagaccguuuacaguacua

SEQ ID NO: 234248 - RNA, 19 nt, Homo sapiens
ugaaggaaccaaagcgaau

SEQ ID NO: 234249 - RNA, 19 nt, Homo sapiens
ggaaccaaagcgaauuuua

SEQ ID NO: 234250 - RNA, 19 nt, Homo sapiens
ggucccugcuccucuaaca

SEQ ID NO: 234251 - RNA, 19 nt, Homo sapiens
ucacugaucgucaagucaa

SEQ ID NO: 234252 - RNA, 19 nt, Homo sapiens
ccaaugacauacuccuacu

SEQ ID NO: 234253 - RNA, 19 nt, Homo sapiens
ugcaaauccuugugggaaa

SEQ ID NO: 234254 - RNA, 19 nt, Homo sapiens
gguggaagagggcugcaaa

SEQ ID NO: 234255 - RNA, 19 nt, Homo sapiens
ucugggacucucuugauua

SEQ ID NO: 234256 - RNA, 19 nt, Homo sapiens
caguggagaaucauguuaa

SEQ ID NO: 234257 - RNA, 19 nt, Homo sapiens
gacaaagucaagccacaug

SEQ ID NO: 234258 - RNA, 19 nt, Homo sapiens
ccaagguagcccaauaaug

SEQ ID NO: 234259 - RNA, 19 nt, Homo sapiens
gucugggacucucuugauu

SEQ ID NO: 234260 - RNA, 19 nt, Homo sapiens
cucauuggcucuugaacug

SEQ ID NO: 234261 - RNA, 19 nt, Homo sapiens
cgucucggguccagauuuc

SEQ ID NO: 234262 - RNA, 19 nt, Homo sapiens
cagcgucuacauuaacaaa

SEQ ID NO: 234263 - RNA, 19 nt, Homo sapiens
gauuccagguggcaucagu

SEQ ID NO: 234264 - RNA, 19 nt, Homo sapiens
gauuaagaucucagugguu

SEQ ID NO: 234265 - RNA, 19 nt, Homo sapiens
ggucugggacucucuugau

SEQ ID NO: 234266 - RNA, 19 nt, Homo sapiens
cguggucccugcuccucua

SEQ ID NO: 234267 - RNA, 19 nt, Homo sapiens
uuuaaaggcccuaucuguu

SEQ ID NO: 234268 - RNA, 19 nt, Homo sapiens
agcccaagguagcccaaua

SEQ ID NO: 234269 - RNA, 19 nt, Homo sapiens
caaagagaagcgccugcaa

SEQ ID NO: 234270 - RNA, 19 nt, Homo sapiens
gcagucucguccaauuucu

SEQ ID NO: 234271 - RNA, 19 nt, Homo sapiens
aaagcugugugcucuccaa

SEQ ID NO: 234272 - RNA, 19 nt, Homo sapiens
cuucagagaguacgccauu

SEQ ID NO: 234273 - RNA, 19 nt, Homo sapiens
caugagauaauaugcagau

SEQ ID NO: 234274 - RNA, 19 nt, Homo sapiens
gggacaagagcgccgagaa

SEQ ID NO: 234275 - RNA, 19 nt, Homo sapiens
ccaccacacccucccucua

SEQ ID NO: 234276 - RNA, 19 nt, Homo sapiens
ugcaucagcuagaaugaca

SEQ ID NO: 234277 - RNA, 19 nt, Homo sapiens
gagagugagguggaauuau

SEQ ID NO: 234278 - RNA, 19 nt, Homo sapiens
gcuguggaguguggcaguu

SEQ ID NO: 234279 - RNA, 19 nt, Homo sapiens
ucagcuagaaugacagguu

SEQ ID NO: 234280 - RNA, 19 nt, Homo sapiens
caccacacguaaugaaacu

SEQ ID NO: 234281 - RNA, 19 nt, Homo sapiens
guacuacucagcaaaucca

SEQ ID NO: 234282 - RNA, 19 nt, Homo sapiens
cugcuccucuaacauguau

SEQ ID NO: 234283 - RNA, 19 nt, Homo sapiens
cacaggcuuucgaccaguu

SEQ ID NO: 234284 - RNA, 19 nt, Homo sapiens
gagcucggccaacgucuac

SEQ ID NO: 234285 - RNA, 19 nt, Homo sapiens
aaacucuccaccacacgua

SEQ ID NO: 234286 - RNA, 19 nt, Homo sapiens
ccaccuggcuuuucuuucu

SEQ ID NO: 234287 - RNA, 19 nt, Homo sapiens
ggaagggguaggauuacua

SEQ ID NO: 234288 - RNA, 19 nt, Homo sapiens
gcccaaugacauacuccua

SEQ ID NO: 234289 - RNA, 19 nt, Homo sapiens
caagagagggaugcaugga

SEQ ID NO: 234290 - RNA, 19 nt, Homo sapiens
ccacggagcucucuguguu

SEQ ID NO: 234291 - RNA, 19 nt, Homo sapiens
gcacuuggauacacacaga

SEQ ID NO: 234292 - RNA, 19 nt, Homo sapiens
gaucuacgccaacuucuuu

SEQ ID NO: 234293 - RNA, 19 nt, Homo sapiens
gagaaaaucuuccgccaaa

SEQ ID NO: 234294 - RNA, 19 nt, Homo sapiens
caaagcaaguaagcgguua

SEQ ID NO: 234295 - RNA, 19 nt, Homo sapiens
agugaaaccuuccaggaua

SEQ ID NO: 234296 - RNA, 19 nt, Homo sapiens
gggaggagaugcuggagau

SEQ ID NO: 234297 - RNA, 19 nt, Homo sapiens
ggugacgccuccaaguuug

SEQ ID NO: 234298 - RNA, 19 nt, Homo sapiens
gaaaagaggacugagaaaa

SEQ ID NO: 234299 - RNA, 19 nt, Homo sapiens
guggaugaguucaagaaga

SEQ ID NO: 234300 - RNA, 19 nt, Homo sapiens
gaauaaagucucauuucag

SEQ ID NO: 234301 - RNA, 19 nt, Homo sapiens
cagaauaaagucucauuuc

SEQ ID NO: 234302 - RNA, 19 nt, Homo sapiens
guacaagggcuuccucaag

SEQ ID NO: 234303 - RNA, 19 nt, Homo sapiens
uggagcaucucuguucuuu

SEQ ID NO: 234304 - RNA, 19 nt, Homo sapiens
gcaggccauuuacaagaug

SEQ ID NO: 234305 - RNA, 19 nt, Homo sapiens
gcacgucuuccgcaccuuu

SEQ ID NO: 234306 - RNA, 19 nt, Homo sapiens
ccaaauggagcaucucugu

SEQ ID NO: 234307 - RNA, 19 nt, Homo sapiens
gagaaagaggcuuccuuga

SEQ ID NO: 234308 - RNA, 19 nt, Homo sapiens
uggaugaguucaagaagau

SEQ ID NO: 234309 - RNA, 19 nt, Homo sapiens
guguggaguuggagaaaga

SEQ ID NO: 234310 - RNA, 19 nt, Homo sapiens
caacuucuuucccuauggu

SEQ ID NO: 234311 - RNA, 19 nt, Homo sapiens
aaauggagcaucucuguuc

SEQ ID NO: 234312 - RNA, 19 nt, Homo sapiens
gcagccaaauggagcaucu

SEQ ID NO: 234313 - RNA, 19 nt, Homo sapiens
gaaaaucuuccgccaaaug

SEQ ID NO: 234314 - RNA, 19 nt, Homo sapiens
gccaagccaccaagugaaa

SEQ ID NO: 234315 - RNA, 19 nt, Homo sapiens
ggacggcaacggcuacauc

SEQ ID NO: 234316 - RNA, 19 nt, Homo sapiens
agaaagaggcuuccuugag

SEQ ID NO: 234317 - RNA, 19 nt, Homo sapiens
caauguggaugaguucaag

SEQ ID NO: 234318 - RNA, 19 nt, Homo sapiens
gugcaggccauuuacaaga

SEQ ID NO: 234319 - RNA, 19 nt, Homo sapiens
ccauagacuuucgggaguu

SEQ ID NO: 234320 - RNA, 19 nt, Homo sapiens
gccaacuucuuucccuaug

SEQ ID NO: 234321 - RNA, 19 nt, Homo sapiens
caaauggagcaucucuguu

SEQ ID NO: 234322 - RNA, 19 nt, Homo sapiens
acacaggcccauagacaga

SEQ ID NO: 234323 - RNA, 19 nt, Homo sapiens
gugaaaccuuccaggauac

SEQ ID NO: 234324 - RNA, 19 nt, Homo sapiens
acacacaggcccauagaca

SEQ ID NO: 234325 - RNA, 19 nt, Homo sapiens
ccaaauggacacaaacaac

SEQ ID NO: 234326 - RNA, 19 nt, Homo sapiens
uuucgggaguucaucauug

SEQ ID NO: 234327 - RNA, 19 nt, Homo sapiens
ccagaggcaacaauagaga

SEQ ID NO: 234328 - RNA, 19 nt, Homo sapiens
gaaaccuuccaggauacua

SEQ ID NO: 234329 - RNA, 19 nt, Homo sapiens
auagacagaugggcagaug

SEQ ID NO: 234330 - RNA, 19 nt, Homo sapiens
aaucccagaggcaacaaua

SEQ ID NO: 234331 - RNA, 19 nt, Homo sapiens
uccacucccuuguguguau

SEQ ID NO: 234332 - RNA, 19 nt, Homo sapiens
ggagaucgugcaggccauu

SEQ ID NO: 234333 - RNA, 19 nt, Homo sapiens
uggugacgccuccaaguuu

SEQ ID NO: 234334 - RNA, 19 nt, Homo sapiens
gccaaauggacacaaacaa

SEQ ID NO: 234335 - RNA, 19 nt, Homo sapiens
aaagaggacugagaaaauc

SEQ ID NO: 234336 - RNA, 19 nt, Homo sapiens
cauagacuuucgggaguuc

SEQ ID NO: 234337 - RNA, 19 nt, Homo sapiens
aagaagaucuacgccaacu

SEQ ID NO: 234338 - RNA, 19 nt, Homo sapiens
ggccaagccaccaagugaa

SEQ ID NO: 234339 - RNA, 19 nt, Homo sapiens
ccacucccuuguguguauu

SEQ ID NO: 234340 - RNA, 19 nt, Homo sapiens
aaaagaggacugagaaaau

SEQ ID NO: 234341 - RNA, 19 nt, Homo sapiens
ggaaaagaggacugagaaa

SEQ ID NO: 234342 - RNA, 19 nt, Homo sapiens
gaugguuucguccgugaug

SEQ ID NO: 234343 - RNA, 19 nt, Homo sapiens
ccaacuucuuucccuaugg

SEQ ID NO: 234344 - RNA, 19 nt, Homo sapiens
acacacacaggcccauaga

SEQ ID NO: 234345 - RNA, 19 nt, Homo sapiens
ugcaggccauuuacaagau

SEQ ID NO: 234346 - RNA, 19 nt, Homo sapiens
gaucgugcaggccauuuac

SEQ ID NO: 234347 - RNA, 19 nt, Homo sapiens
gacggcaacggcuacauca

SEQ ID NO: 234348 - RNA, 19 nt, Homo sapiens
gaaagaagcgcgugccuua

SEQ ID NO: 234349 - RNA, 19 nt, Homo sapiens
gggaauacgccacgaauaa

SEQ ID NO: 234350 - RNA, 19 nt, Homo sapiens
ccacagaauucacuuuaug

SEQ ID NO: 234351 - RNA, 19 nt, Homo sapiens
gaaggcaacuugaagaaac

SEQ ID NO: 234352 - RNA, 19 nt, Homo sapiens
cuucagaacucguugcuuu

SEQ ID NO: 234353 - RNA, 19 nt, Homo sapiens
ucagauaaguuacgcaguu

SEQ ID NO: 234354 - RNA, 19 nt, Homo sapiens
ggaaagagaaagagacaga

SEQ ID NO: 234355 - RNA, 19 nt, Homo sapiens
gaguuuccaucccaacaua

SEQ ID NO: 234356 - RNA, 19 nt, Homo sapiens
acgagaagguacugaaaua

SEQ ID NO: 234357 - RNA, 19 nt, Homo sapiens
cagauaaguuacgcaguua

SEQ ID NO: 234358 - RNA, 19 nt, Homo sapiens
gcccagauaaugauaauaa

SEQ ID NO: 234359 - RNA, 19 nt, Homo sapiens
ccgacgagcucaacaagaa

SEQ ID NO: 234360 - RNA, 19 nt, Homo sapiens
gaagguacugaaauaauga

SEQ ID NO: 234361 - RNA, 19 nt, Homo sapiens
agaagguacugaaauaaug

SEQ ID NO: 234362 - RNA, 19 nt, Homo sapiens
gaaacgagaagguacugaa

SEQ ID NO: 234363 - RNA, 19 nt, Homo sapiens
ggaauacgccacgaauaaa

SEQ ID NO: 234364 - RNA, 19 nt, Homo sapiens
ccaaccagcugaaccuuuc

SEQ ID NO: 234365 - RNA, 19 nt, Homo sapiens
auaccaaggugcaauuaaa

SEQ ID NO: 234366 - RNA, 19 nt, Homo sapiens
gagaagguacugaaauaau

SEQ ID NO: 234367 - RNA, 19 nt, Homo sapiens
ucagguaaaucuuagugaa

SEQ ID NO: 234368 - RNA, 19 nt, Homo sapiens
gcggacaaguacauggaua

SEQ ID NO: 234369 - RNA, 19 nt, Homo sapiens
gaagaaugggaaagagaaa

SEQ ID NO: 234370 - RNA, 19 nt, Homo sapiens
cuaaacauuugcuggagaa

SEQ ID NO: 234371 - RNA, 19 nt, Homo sapiens
gaacccgggucgguaaugu

SEQ ID NO: 234372 - RNA, 19 nt, Homo sapiens
ugaaauuccuaccguuguu

SEQ ID NO: 234373 - RNA, 19 nt, Homo sapiens
gcaagaggccauuguaaac

SEQ ID NO: 234374 - RNA, 19 nt, Homo sapiens
gaaaaccacuaguuaaugg

SEQ ID NO: 234375 - RNA, 19 nt, Homo sapiens
cauaauggacuuugguuug

SEQ ID NO: 234376 - RNA, 19 nt, Homo sapiens
uuaagcgucugcucaggua

SEQ ID NO: 234377 - RNA, 19 nt, Homo sapiens
aagaaacgcuucagaacuc

SEQ ID NO: 234378 - RNA, 19 nt, Homo sapiens
gaacaggaggguuaaagag

SEQ ID NO: 234379 - RNA, 19 nt, Homo sapiens
gaauacgccacgaauaaau

SEQ ID NO: 234380 - RNA, 19 nt, Homo sapiens
aagaagcgcgugccuuaua

SEQ ID NO: 234381 - RNA, 19 nt, Homo sapiens
gauuagugauucaucuuca

SEQ ID NO: 234382 - RNA, 19 nt, Homo sapiens
ggacuuugguuugaacaca

SEQ ID NO: 234383 - RNA, 19 nt, Homo sapiens
acaggaggguuaaagagaa

SEQ ID NO: 234384 - RNA, 19 nt, Homo sapiens
cagaugauccacagaauuc

SEQ ID NO: 234385 - RNA, 19 nt, Homo sapiens
uaucagagugcauuagaaa

SEQ ID NO: 234386 - RNA, 19 nt, Homo sapiens
gaucauuugucuugguagu

SEQ ID NO: 234387 - RNA, 19 nt, Homo sapiens
ccauucccuuugcauguua

SEQ ID NO: 234388 - RNA, 19 nt, Homo sapiens
ucuggaaguugguuacaaa

SEQ ID NO: 234389 - RNA, 19 nt, Homo sapiens
caggaggguuaaagagaaa

SEQ ID NO: 234390 - RNA, 19 nt, Homo sapiens
auaauggacuuugguuuga

SEQ ID NO: 234391 - RNA, 19 nt, Homo sapiens
acacugcguuagaugguaa

SEQ ID NO: 234392 - RNA, 19 nt, Homo sapiens
guauuuaagugaucguuac

SEQ ID NO: 234393 - RNA, 19 nt, Homo sapiens
ggacaaacggaggcggaua

SEQ ID NO: 234394 - RNA, 19 nt, Homo sapiens
gaaagauuagugauucauc

SEQ ID NO: 234395 - RNA, 19 nt, Homo sapiens
gcauuagaaagauuaguga

SEQ ID NO: 234396 - RNA, 19 nt, Homo sapiens
ucagagugcauuagaaaga

SEQ ID NO: 234397 - RNA, 19 nt, Homo sapiens
gguaauaaucuggaaguug

SEQ ID NO: 234398 - RNA, 19 nt, Homo sapiens
ccacgacgaaucucucuga

SEQ ID NO: 234399 - RNA, 19 nt, Homo sapiens
ccuuagaccuguagauagu

SEQ ID NO: 234400 - RNA, 19 nt, Homo sapiens
ucaaccagcacauucguuu

SEQ ID NO: 234401 - RNA, 19 nt, Homo sapiens
ucauuugucuugguaguau

SEQ ID NO: 234402 - RNA, 19 nt, Homo sapiens
cgagaagguacugaaauaa

SEQ ID NO: 234403 - RNA, 19 nt, Homo sapiens
cgcaauuucagauaaguua

SEQ ID NO: 234404 - RNA, 19 nt, Homo sapiens
uuaauggaaucuacaacug

SEQ ID NO: 234405 - RNA, 19 nt, Homo sapiens
ggauaucagccacgacgaa

SEQ ID NO: 234406 - RNA, 19 nt, Homo sapiens
gacaaacggaggcggauau

SEQ ID NO: 234407 - RNA, 19 nt, Homo sapiens
gagugcauuagaaagauua

SEQ ID NO: 234408 - RNA, 19 nt, Homo sapiens
ccgggucgguaaugucuuu

SEQ ID NO: 234409 - RNA, 19 nt, Homo sapiens
gccauucccuuugcauguu

SEQ ID NO: 234410 - RNA, 19 nt, Homo sapiens
ugaagaaugggaaagagaa

SEQ ID NO: 234411 - RNA, 19 nt, Homo sapiens
gaggaucauuugucuuggu

SEQ ID NO: 234412 - RNA, 19 nt, Homo sapiens
gaaauuccuaccguuguug

SEQ ID NO: 234413 - RNA, 19 nt, Homo sapiens
gacacugcguuagauggua

SEQ ID NO: 234414 - RNA, 19 nt, Homo sapiens
caucagcccagcccguuaa

SEQ ID NO: 234415 - RNA, 19 nt, Homo sapiens
aauggaaucuacaacuguu

SEQ ID NO: 234416 - RNA, 19 nt, Homo sapiens
aaacgagaagguacugaaa

SEQ ID NO: 234417 - RNA, 19 nt, Homo sapiens
caucugcuuguccuucuua

SEQ ID NO: 234418 - RNA, 19 nt, Homo sapiens
cagcccagcccguuaaaug

SEQ ID NO: 234419 - RNA, 19 nt, Homo sapiens
gaagggagaaagggagaga

SEQ ID NO: 234420 - RNA, 19 nt, Homo sapiens
uggaauauuugcugugaag

SEQ ID NO: 234421 - RNA, 19 nt, Homo sapiens
cagguaaaucuuagugaaa

SEQ ID NO: 234422 - RNA, 19 nt, Homo sapiens
cgcaagaggccauuguaaa

SEQ ID NO: 234423 - RNA, 19 nt, Homo sapiens
ugcguuagaugguaauaau

SEQ ID NO: 234424 - RNA, 19 nt, Homo sapiens
cccaauauuugcuaaacau

SEQ ID NO: 234425 - RNA, 19 nt, Homo sapiens
uaauggacuuugguuugaa

SEQ ID NO: 234426 - RNA, 19 nt, Homo sapiens
caacauaauggacuuuggu

SEQ ID NO: 234427 - RNA, 19 nt, Homo sapiens
gcuggaacggccaaaugua

SEQ ID NO: 234428 - RNA, 19 nt, Homo sapiens
cagagugcauuagaaagau

SEQ ID NO: 234429 - RNA, 19 nt, Homo sapiens
gguuugaacacaauucguu

SEQ ID NO: 234430 - RNA, 19 nt, Homo sapiens
caagaggccauuguaaaca

SEQ ID NO: 234431 - RNA, 19 nt, Homo sapiens
gaucgagcccaccgucaug

SEQ ID NO: 234432 - RNA, 19 nt, Homo sapiens
gacuuugguuugaacacaa

SEQ ID NO: 234433 - RNA, 19 nt, Homo sapiens
ucagaugauccacagaauu

SEQ ID NO: 234434 - RNA, 19 nt, Homo sapiens
aggaucauuugucuuggua

SEQ ID NO: 234435 - RNA, 19 nt, Homo sapiens
aaagucaucaacaaacuga

SEQ ID NO: 234436 - RNA, 19 nt, Homo sapiens
uuagaccuguagauaguga

SEQ ID NO: 234437 - RNA, 19 nt, Homo sapiens
gauccacagaauucacuuu

SEQ ID NO: 234438 - RNA, 19 nt, Homo sapiens
uguggcauuugaacuauau

SEQ ID NO: 234439 - RNA, 19 nt, Homo sapiens
agagugcauuagaaagauu

SEQ ID NO: 234440 - RNA, 19 nt, Homo sapiens
uggcauuucccaauauuug

SEQ ID NO: 234441 - RNA, 19 nt, Homo sapiens
ccaccgucauguuucucua

SEQ ID NO: 234442 - RNA, 19 nt, Homo sapiens
gacagagacuggcauuuuc

SEQ ID NO: 234443 - RNA, 19 nt, Homo sapiens
aaagagaaagagacagaga

SEQ ID NO: 234444 - RNA, 19 nt, Homo sapiens
guuaucagagugcauuaga

SEQ ID NO: 234445 - RNA, 19 nt, Homo sapiens
ucauuccccugaaauauuu

SEQ ID NO: 234446 - RNA, 19 nt, Homo sapiens
gaaccuuucaggcuacaag

SEQ ID NO: 234447 - RNA, 19 nt, Homo sapiens
cugaggaucauuugucuug

SEQ ID NO: 234448 - RNA, 19 nt, Homo sapiens
ggaugaagguuaagagaaa

SEQ ID NO: 234449 - RNA, 19 nt, Homo sapiens
aaacacaggucaagauuug

SEQ ID NO: 234450 - RNA, 19 nt, Homo sapiens
gaaacacaggucaagauuu

SEQ ID NO: 234451 - RNA, 19 nt, Homo sapiens
ggaaacacccugcccuuca

SEQ ID NO: 234452 - RNA, 19 nt, Homo sapiens
ggaguuccauuucaacaag

SEQ ID NO: 234453 - RNA, 19 nt, Homo sapiens
caaggcagcugacagaacu

SEQ ID NO: 234454 - RNA, 19 nt, Homo sapiens
gagcagaccgcgagcuuug

SEQ ID NO: 234455 - RNA, 19 nt, Homo sapiens
ugacagaacuggaaaagga

SEQ ID NO: 234456 - RNA, 19 nt, Homo sapiens
ccacaaggcagcugacaga

SEQ ID NO: 234457 - RNA, 19 nt, Homo sapiens
gaaacacccugcccuucag

SEQ ID NO: 234458 - RNA, 19 nt, Homo sapiens
gcaccaacuucaccacaag

SEQ ID NO: 234459 - RNA, 19 nt, Homo sapiens
gcuacgggccuucucagua

SEQ ID NO: 234460 - RNA, 19 nt, Homo sapiens
gaugaacuccuucuuagag

SEQ ID NO: 234461 - RNA, 19 nt, Homo sapiens
ugaaacacaggucaagauu

SEQ ID NO: 234462 - RNA, 19 nt, Homo sapiens
cagcagaacuccggcuauc

SEQ ID NO: 234463 - RNA, 19 nt, Homo sapiens
gagaaacccacccaagaca

SEQ ID NO: 234464 - RNA, 19 nt, Homo sapiens
ucgacuggaugaagguuaa

SEQ ID NO: 234465 - RNA, 19 nt, Homo sapiens
cuacgggccuucucaguac

SEQ ID NO: 234466 - RNA, 19 nt, Homo sapiens
ggaugaacuccuucuuaga

SEQ ID NO: 234467 - RNA, 19 nt, Homo sapiens
gaaggagacggaggcuauu

SEQ ID NO: 234468 - RNA, 19 nt, Homo sapiens
agaaggagacggaggcuau

SEQ ID NO: 234469 - RNA, 19 nt, Homo sapiens
aagagaaacccacccaaga

SEQ ID NO: 234470 - RNA, 19 nt, Homo sapiens
gaagcgcgagcgagaggaa

SEQ ID NO: 234471 - RNA, 19 nt, Homo sapiens
uuccagaaccgacgaauga

SEQ ID NO: 234472 - RNA, 19 nt, Homo sapiens
gcagcugacagaacuggaa

SEQ ID NO: 234473 - RNA, 19 nt, Homo sapiens
ccucagaccagucgacaug

SEQ ID NO: 234474 - RNA, 19 nt, Homo sapiens
aaaaggaguuccauuucaa

SEQ ID NO: 234475 - RNA, 19 nt, Homo sapiens
caaggaggcagcuggagau

SEQ ID NO: 234476 - RNA, 19 nt, Homo sapiens
gcaccggccuaugcugauc

SEQ ID NO: 234477 - RNA, 19 nt, Homo sapiens
gacgaaugaagcagaagaa

SEQ ID NO: 234478 - RNA, 19 nt, Homo sapiens
cgacgaaugaagcagaaga

SEQ ID NO: 234479 - RNA, 19 nt, Homo sapiens
gaugaagguuaagagaaac

SEQ ID NO: 234480 - RNA, 19 nt, Homo sapiens
ucaggcgguugacagcuau

SEQ ID NO: 234481 - RNA, 19 nt, Homo sapiens
ucugucaccuccugaacug

SEQ ID NO: 234482 - RNA, 19 nt, Homo sapiens
cucaggcgguugacagcua

SEQ ID NO: 234483 - RNA, 19 nt, Homo sapiens
ucaaugaaacacaggucaa

SEQ ID NO: 234484 - RNA, 19 nt, Homo sapiens
ucagaccagucgacaugca

SEQ ID NO: 234485 - RNA, 19 nt, Homo sapiens
uggaugaagguuaagagaa

SEQ ID NO: 234486 - RNA, 19 nt, Homo sapiens
gcagaccgcgagcuuugca

SEQ ID NO: 234487 - RNA, 19 nt, Homo sapiens
cccuggagcucaaugaaac

SEQ ID NO: 234488 - RNA, 19 nt, Homo sapiens
gaguuccauuucaacaagu

SEQ ID NO: 234489 - RNA, 19 nt, Homo sapiens
cagcugacagaacuggaaa

SEQ ID NO: 234490 - RNA, 19 nt, Homo sapiens
cgcaccaacuucaccacaa

SEQ ID NO: 234491 - RNA, 19 nt, Homo sapiens
gagaaggaauuccacuuua

SEQ ID NO: 234492 - RNA, 19 nt, Homo sapiens
gaagaaauccgccaagaaa

SEQ ID NO: 234493 - RNA, 19 nt, Homo sapiens
ggagaaggaauuccacuuu

SEQ ID NO: 234494 - RNA, 19 nt, Homo sapiens
agaaggaauuccacuuuaa

SEQ ID NO: 234495 - RNA, 19 nt, Homo sapiens
gagaagaaauccgccaaga

SEQ ID NO: 234496 - RNA, 19 nt, Homo sapiens
ccaaugaaaucucaggaau

SEQ ID NO: 234497 - RNA, 19 nt, Homo sapiens
gggaaaguauuuauuguac

SEQ ID NO: 234498 - RNA, 19 nt, Homo sapiens
ggagacauuucaaacuuca

SEQ ID NO: 234499 - RNA, 19 nt, Homo sapiens
gguagacuccuuccaauga

SEQ ID NO: 234500 - RNA, 19 nt, Homo sapiens
caaaaucgcuccauuacau

SEQ ID NO: 234501 - RNA, 19 nt, Homo sapiens
gaaggaauuccacuuuaau

SEQ ID NO: 234502 - RNA, 19 nt, Homo sapiens
uaacuagagggaccuauuu

SEQ ID NO: 234503 - RNA, 19 nt, Homo sapiens
caaugaaaucucaggaaua

SEQ ID NO: 234504 - RNA, 19 nt, Homo sapiens
guagacuccuuccaaugaa

SEQ ID NO: 234505 - RNA, 19 nt, Homo sapiens
cgaguucccuuggaugaaa

SEQ ID NO: 234506 - RNA, 19 nt, Homo sapiens
gccuuuagccguucgcuua

SEQ ID NO: 234507 - RNA, 19 nt, Homo sapiens
ggaauuccacuuuaauaag

SEQ ID NO: 234508 - RNA, 19 nt, Homo sapiens
gagggagauuggguuuaua

SEQ ID NO: 234509 - RNA, 19 nt, Homo sapiens
caaggagucgacauuaauu

SEQ ID NO: 234510 - RNA, 19 nt, Homo sapiens
cauugaaagccaugaauuu

SEQ ID NO: 234511 - RNA, 19 nt, Homo sapiens
gaaaaggggaaaguauuua

SEQ ID NO: 234512 - RNA, 19 nt, Homo sapiens
ggaaaaggggaaaguauuu

SEQ ID NO: 234513 - RNA, 19 nt, Homo sapiens
caguuucccuaaccuguuu

SEQ ID NO: 234514 - RNA, 19 nt, Homo sapiens
agagggagauuggguuuau

SEQ ID NO: 234515 - RNA, 19 nt, Homo sapiens
ggaccuauuuuccucuuuu

SEQ ID NO: 234516 - RNA, 19 nt, Homo sapiens
cgacuccugucuccagcua

SEQ ID NO: 234517 - RNA, 19 nt, Homo sapiens
ugaaagccaugaauuuuga

SEQ ID NO: 234518 - RNA, 19 nt, Homo sapiens
gcaggucaaagucugguuu

SEQ ID NO: 234519 - RNA, 19 nt, Homo sapiens
ucaaggagucgacauuaau

SEQ ID NO: 234520 - RNA, 19 nt, Homo sapiens
gcacucgguuaucuuuuaa

SEQ ID NO: 234521 - RNA, 19 nt, Homo sapiens
gaaaggcaggucaaagucu

SEQ ID NO: 234522 - RNA, 19 nt, Homo sapiens
ggaugaaagagaagaaauc

SEQ ID NO: 234523 - RNA, 19 nt, Homo sapiens
gcgccaggauucaccuuuc

SEQ ID NO: 234524 - RNA, 19 nt, Homo sapiens
ccgagugucugacuuccuu

SEQ ID NO: 234525 - RNA, 19 nt, Homo sapiens
aaucaaggagucgacauua

SEQ ID NO: 234526 - RNA, 19 nt, Homo sapiens
ggcacucgguuaucuuuua

SEQ ID NO: 234527 - RNA, 19 nt, Homo sapiens
uuggagacauuucaaacuu

SEQ ID NO: 234528 - RNA, 19 nt, Homo sapiens
agacuuauguguuuugcua

SEQ ID NO: 234529 - RNA, 19 nt, Homo sapiens
gcaguuucccuaaccuguu

SEQ ID NO: 234530 - RNA, 19 nt, Homo sapiens
gagagggagauuggguuua

SEQ ID NO: 234531 - RNA, 19 nt, Homo sapiens
caaucaaggagucgacauu

SEQ ID NO: 234532 - RNA, 19 nt, Homo sapiens
agaagaaauccgccaagaa

SEQ ID NO: 234533 - RNA, 19 nt, Homo sapiens
aauauugggcacucgguua

SEQ ID NO: 234534 - RNA, 19 nt, Homo sapiens
caagaaacccagccaaucc

SEQ ID NO: 234535 - RNA, 19 nt, Homo sapiens
ccaagaaacccagccaauc

SEQ ID NO: 234536 - RNA, 19 nt, Homo sapiens
ucccuuggaugaaagagaa

SEQ ID NO: 234537 - RNA, 19 nt, Homo sapiens
uagacuccuuccaaugaaa

SEQ ID NO: 234538 - RNA, 19 nt, Homo sapiens
ccauugaaagccaugaauu

SEQ ID NO: 234539 - RNA, 19 nt, Homo sapiens
ccgaaaggcaggucaaagu

SEQ ID NO: 234540 - RNA, 19 nt, Homo sapiens
aucaaggagucgacauuaa

SEQ ID NO: 234541 - RNA, 19 nt, Homo sapiens
ccgaggaagagcuggauuu

SEQ ID NO: 234542 - RNA, 19 nt, Homo sapiens
gaauuugagagggagauug

SEQ ID NO: 234543 - RNA, 19 nt, Homo sapiens
gccaagaaacccagccaau

SEQ ID NO: 234544 - RNA, 19 nt, Homo sapiens
ugagagggagauuggguuu

SEQ ID NO: 234545 - RNA, 19 nt, Homo sapiens
uggagacauuucaaacuuc

SEQ ID NO: 234546 - RNA, 19 nt, Homo sapiens
ggucggaucgccugcagau

SEQ ID NO: 234547 - RNA, 19 nt, Homo sapiens
aaaucgcuccauuacauaa

SEQ ID NO: 234548 - RNA, 19 nt, Homo sapiens
cgaaaggcaggucaaaguc

SEQ ID NO: 234549 - RNA, 19 nt, Homo sapiens
gggagauuggguuuauaaa

SEQ ID NO: 234550 - RNA, 19 nt, Homo sapiens
agggagauuggguuuauaa

SEQ ID NO: 234551 - RNA, 19 nt, Homo sapiens
ggaacuggagaaggaauuc

SEQ ID NO: 234552 - RNA, 19 nt, Homo sapiens
ggggaaaguauuuauugua

SEQ ID NO: 234553 - RNA, 19 nt, Homo sapiens
gaccugcaguuucccuaac

SEQ ID NO: 234554 - RNA, 19 nt, Homo sapiens
cgaccugcaguuucccuaa

SEQ ID NO: 234555 - RNA, 19 nt, Homo sapiens
cagagacccaggagccaaa

SEQ ID NO: 234556 - RNA, 19 nt, Homo sapiens
aaacuucaucaaucaagga

SEQ ID NO: 234557 - RNA, 19 nt, Homo sapiens
ugcuggaacuggagaagga

SEQ ID NO: 234558 - RNA, 19 nt, Homo sapiens
ggacuuaccuuacaucuuu

SEQ ID NO: 234559 - RNA, 19 nt, Homo sapiens
ccaagaagcgcccaaauua

SEQ ID NO: 234560 - RNA, 19 nt, Homo sapiens
gaaaggaauccacaucaua

SEQ ID NO: 234561 - RNA, 19 nt, Homo sapiens
uaaggaaugucucuaaaga

SEQ ID NO: 234562 - RNA, 19 nt, Homo sapiens
uauccucucuccuuuguua

SEQ ID NO: 234563 - RNA, 19 nt, Homo sapiens
acacagaccucuccucuca

SEQ ID NO: 234564 - RNA, 19 nt, Homo sapiens
gagaaggaguuccauuuua

SEQ ID NO: 234565 - RNA, 19 nt, Homo sapiens
uaucaggccuuuccaaguu

SEQ ID NO: 234566 - RNA, 19 nt, Homo sapiens
caaaagagcugcugaacug

SEQ ID NO: 234567 - RNA, 19 nt, Homo sapiens
cugcugaacuguccguuua

SEQ ID NO: 234568 - RNA, 19 nt, Homo sapiens
ggaaaggaauccacaucau

SEQ ID NO: 234569 - RNA, 19 nt, Homo sapiens
caagaagcgcccaaauuaa

SEQ ID NO: 234570 - RNA, 19 nt, Homo sapiens
gcagaaagccaccuacuac

SEQ ID NO: 234571 - RNA, 19 nt, Homo sapiens
cuauggagcuuaaaguuca

SEQ ID NO: 234572 - RNA, 19 nt, Homo sapiens
gaaugucucuaaagaacca

SEQ ID NO: 234573 - RNA, 19 nt, Homo sapiens
ccuaaggaaugucucuaaa

SEQ ID NO: 234574 - RNA, 19 nt, Homo sapiens
gaaaagaggagccagagaa

SEQ ID NO: 234575 - RNA, 19 nt, Homo sapiens
ucaaccaccuuucccauca

SEQ ID NO: 234576 - RNA, 19 nt, Homo sapiens
ccucucuccuuuguuauua

SEQ ID NO: 234577 - RNA, 19 nt, Homo sapiens
ccaacggacuuaccuuaca

SEQ ID NO: 234578 - RNA, 19 nt, Homo sapiens
aaagggcgaacgaggauua

SEQ ID NO: 234579 - RNA, 19 nt, Homo sapiens
gcugaacuguccguuuaaa

SEQ ID NO: 234580 - RNA, 19 nt, Homo sapiens
caacggacuuaccuuacau

SEQ ID NO: 234581 - RNA, 19 nt, Homo sapiens
aaaggaauccacaucauau

SEQ ID NO: 234582 - RNA, 19 nt, Homo sapiens
ggcucgaugugaauauaua

SEQ ID NO: 234583 - RNA, 19 nt, Homo sapiens
ggaaagggcgaacgaggau

SEQ ID NO: 234584 - RNA, 19 nt, Homo sapiens
aaugggaucugcagaguuc

SEQ ID NO: 234585 - RNA, 19 nt, Homo sapiens
ccgggaaccuggacuacaa

SEQ ID NO: 234586 - RNA, 19 nt, Homo sapiens
agaaggaguuccauuuuaa

SEQ ID NO: 234587 - RNA, 19 nt, Homo sapiens
guagacaagagcuaagaaa

SEQ ID NO: 234588 - RNA, 19 nt, Homo sapiens
gcaaacguccaagcugaaa

SEQ ID NO: 234589 - RNA, 19 nt, Homo sapiens
caacuccacccucaccaaa

SEQ ID NO: 234590 - RNA, 19 nt, Homo sapiens
uggaagguaugaauagaau

SEQ ID NO: 234591 - RNA, 19 nt, Homo sapiens
cuaaagaaccaaaucaaag

SEQ ID NO: 234592 - RNA, 19 nt, Homo sapiens
gaacuguccguuuaaaugc

SEQ ID NO: 234593 - RNA, 19 nt, Homo sapiens
ccugagagguugcuuuuaa

SEQ ID NO: 234594 - RNA, 19 nt, Homo sapiens
uuaaauacguauccucucu

SEQ ID NO: 234595 - RNA, 19 nt, Homo sapiens
ugaacuguccguuuaaaug

SEQ ID NO: 234596 - RNA, 19 nt, Homo sapiens
ggauugcgguguggugguu

SEQ ID NO: 234597 - RNA, 19 nt, Homo sapiens
agauuucuauggagcuuaa

SEQ ID NO: 234598 - RNA, 19 nt, Homo sapiens
gguaaagcccaccagaaug

SEQ ID NO: 234599 - RNA, 19 nt, Homo sapiens
ggaggaagagagagacugu

SEQ ID NO: 234600 - RNA, 19 nt, Homo sapiens
gcaugaaguacaagaagga

SEQ ID NO: 234601 - RNA, 19 nt, Homo sapiens
guaaagcccaccagaaugc

SEQ ID NO: 234602 - RNA, 19 nt, Homo sapiens
ggagaaggaguuccauuuu

SEQ ID NO: 234603 - RNA, 19 nt, Homo sapiens
ugguggagcuggagaagga

SEQ ID NO: 234604 - RNA, 19 nt, Homo sapiens
ggaauccacaucauauugg

SEQ ID NO: 234605 - RNA, 19 nt, Homo sapiens
uauauuaugucugccuguu

SEQ ID NO: 234606 - RNA, 19 nt, Homo sapiens
gaaaaccauuaaucacuuc

SEQ ID NO: 234607 - RNA, 19 nt, Homo sapiens
ucguggaccuggaggauga

SEQ ID NO: 234608 - RNA, 19 nt, Homo sapiens
cguauccucucuccuuugu

SEQ ID NO: 234609 - RNA, 19 nt, Homo sapiens
ccagaaggccaagggauug

SEQ ID NO: 234610 - RNA, 19 nt, Homo sapiens
ugaaugggaucugcagagu

SEQ ID NO: 234611 - RNA, 19 nt, Homo sapiens
aaccaacggacuuaccuua

SEQ ID NO: 234612 - RNA, 19 nt, Homo sapiens
gccacuagcaacagcagua

SEQ ID NO: 234613 - RNA, 19 nt, Homo sapiens
gaaugggaucugcagaguu

SEQ ID NO: 234614 - RNA, 19 nt, Homo sapiens
aggaaugucucuaaagaac

SEQ ID NO: 234615 - RNA, 19 nt, Homo sapiens
gccauucuguguagacaag

SEQ ID NO: 234616 - RNA, 19 nt, Homo sapiens
ucaccaaccaacggacuua

SEQ ID NO: 234617 - RNA, 19 nt, Homo sapiens
gcuaggccaucaccaacca

SEQ ID NO: 234618 - RNA, 19 nt, Homo sapiens
uccaagaagcgcccaaauu

SEQ ID NO: 234619 - RNA, 19 nt, Homo sapiens
cgguaaagcccaccagaau

SEQ ID NO: 234620 - RNA, 19 nt, Homo sapiens
uaaagaaccaaaucaaagc

SEQ ID NO: 234621 - RNA, 19 nt, Homo sapiens
guacaagaaggaccagaag

SEQ ID NO: 234622 - RNA, 19 nt, Homo sapiens
cuccagcacuaccaaguug

SEQ ID NO: 234623 - RNA, 19 nt, Homo sapiens
uacguauccucucuccuuu

SEQ ID NO: 234624 - RNA, 19 nt, Homo sapiens
auacguauccucucuccuu

SEQ ID NO: 234625 - RNA, 19 nt, Homo sapiens
gcaauggcuucggcuucga

SEQ ID NO: 234626 - RNA, 19 nt, Homo sapiens
caacccaucggaaaggaau

SEQ ID NO: 234627 - RNA, 19 nt, Homo sapiens
ccacuagcaacagcaguaa

SEQ ID NO: 234628 - RNA, 19 nt, Homo sapiens
uaaggucagccgcuuggaa

SEQ ID NO: 234629 - RNA, 19 nt, Homo sapiens
ccucgucgguggcuaaggu

SEQ ID NO: 234630 - RNA, 19 nt, Homo sapiens
aaagauuucuauggagcuu

SEQ ID NO: 234631 - RNA, 19 nt, Homo sapiens
ggaagguaugaauagaauu

SEQ ID NO: 234632 - RNA, 19 nt, Homo sapiens
ggagugggguagaggaaga

SEQ ID NO: 234633 - RNA, 19 nt, Homo sapiens
gcuccagcacuaccaaguu

SEQ ID NO: 234634 - RNA, 19 nt, Homo sapiens
aagaagcgcccaaauuaac

SEQ ID NO: 234635 - RNA, 19 nt, Homo sapiens
uauuaugucugccuguucu

SEQ ID NO: 234636 - RNA, 19 nt, Homo sapiens
cggaaaggaauccacauca

SEQ ID NO: 234637 - RNA, 19 nt, Homo sapiens
augaaagagucgaggcaaa

SEQ ID NO: 234638 - RNA, 19 nt, Homo sapiens
agaaagccaccuacuacga

SEQ ID NO: 234639 - RNA, 19 nt, Homo sapiens
ccaaaucaaagcugcucuu

SEQ ID NO: 234640 - RNA, 19 nt, Homo sapiens
gcgagcggcagaucaagau

SEQ ID NO: 234641 - RNA, 19 nt, Homo sapiens
cacccucaccaaacagaua

SEQ ID NO: 234642 - RNA, 19 nt, Homo sapiens
gaaagggcgaacgaggauu

SEQ ID NO: 234643 - RNA, 19 nt, Homo sapiens
gaugggaaagggcgaacga

SEQ ID NO: 234644 - RNA, 19 nt, Homo sapiens
gcgcaugaaguacaagaag

SEQ ID NO: 234645 - RNA, 19 nt, Homo sapiens
gguagaggaagacgagaca

SEQ ID NO: 234646 - RNA, 19 nt, Homo sapiens
aggaauccacaucauauug

SEQ ID NO: 234647 - RNA, 19 nt, Homo sapiens
ggcaaacguccaagcugaa

SEQ ID NO: 234648 - RNA, 19 nt, Homo sapiens
guaucaggccuuuccaagu

SEQ ID NO: 234649 - RNA, 19 nt, Homo sapiens
gucagccgcuuggaacaga

SEQ ID NO: 234650 - RNA, 19 nt, Homo sapiens
gcugcucuuuggaagguau

SEQ ID NO: 234651 - RNA, 19 nt, Homo sapiens
gagacaggacgaggcagaa

SEQ ID NO: 234652 - RNA, 19 nt, Homo sapiens
gccaacccaucggaaagga

SEQ ID NO: 234653 - RNA, 19 nt, Homo sapiens
guguagagauggccaaccu

SEQ ID NO: 234654 - RNA, 19 nt, Homo sapiens
ugcagaaagccaccuacua

SEQ ID NO: 234655 - RNA, 19 nt, Homo sapiens
gcucgaugugaauauauau

SEQ ID NO: 234656 - RNA, 19 nt, Homo sapiens
cuaaggaaugucucuaaag

SEQ ID NO: 234657 - RNA, 19 nt, Homo sapiens
aagaggagccagagaaggu

SEQ ID NO: 234658 - RNA, 19 nt, Homo sapiens
gcaaagagcccgucgucua

SEQ ID NO: 234659 - RNA, 19 nt, Homo sapiens
ucaaaucucuugcuuucuu

SEQ ID NO: 234660 - RNA, 19 nt, Homo sapiens
gaaggaauuucacuacaac

SEQ ID NO: 234661 - RNA, 19 nt, Homo sapiens
gagaaggaauuucacuaca

SEQ ID NO: 234662 - RNA, 19 nt, Homo sapiens
ucucuugcuuucuuucuua

SEQ ID NO: 234663 - RNA, 19 nt, Homo sapiens
caaaucucuugcuuucuuu

SEQ ID NO: 234664 - RNA, 19 nt, Homo sapiens
agaaggaauuucacuacaa

SEQ ID NO: 234665 - RNA, 19 nt, Homo sapiens
gaaauuaauggcuaugagu

SEQ ID NO: 234666 - RNA, 19 nt, Homo sapiens
gggaagcuuuauuuauaga

SEQ ID NO: 234667 - RNA, 19 nt, Homo sapiens
uaauggcuaugaguucuuu

SEQ ID NO: 234668 - RNA, 19 nt, Homo sapiens
auucaaaucucuugcuuuc

SEQ ID NO: 234669 - RNA, 19 nt, Homo sapiens
ggagaaggaauuucacuac

SEQ ID NO: 234670 - RNA, 19 nt, Homo sapiens
aggggaagcuuuauuuaua

SEQ ID NO: 234671 - RNA, 19 nt, Homo sapiens
ucuuggagcuggagaagga

SEQ ID NO: 234672 - RNA, 19 nt, Homo sapiens
caaagagcccgucgucuac

SEQ ID NO: 234673 - RNA, 19 nt, Homo sapiens
aauauucacagagcgauua

SEQ ID NO: 234674 - RNA, 19 nt, Homo sapiens
gaauauucacagagcgauu

SEQ ID NO: 234675 - RNA, 19 nt, Homo sapiens
gaucaacucaaacuauguc

SEQ ID NO: 234676 - RNA, 19 nt, Homo sapiens
ggaggggaagcuuuauuua

SEQ ID NO: 234677 - RNA, 19 nt, Homo sapiens
gcacgguaaaccccaauua

SEQ ID NO: 234678 - RNA, 19 nt, Homo sapiens
agaaauuaauggcuaugag

SEQ ID NO: 234679 - RNA, 19 nt, Homo sapiens
ggagcuggagaaggaauuu

SEQ ID NO: 234680 - RNA, 19 nt, Homo sapiens
ggggaagcuuuauuuauag

SEQ ID NO: 234681 - RNA, 19 nt, Homo sapiens
gggaggggaagcuuuauuu

SEQ ID NO: 234682 - RNA, 19 nt, Homo sapiens
cuacaaccgcuaccugaca

SEQ ID NO: 234683 - RNA, 19 nt, Homo sapiens
cagaaauuaauggcuauga

SEQ ID NO: 234684 - RNA, 19 nt, Homo sapiens
gaggggaagcuuuauuuau

SEQ ID NO: 234685 - RNA, 19 nt, Homo sapiens
uggagaaggaauuucacua

SEQ ID NO: 234686 - RNA, 19 nt, Homo sapiens
cccagaaauuaauggcuau

SEQ ID NO: 234687 - RNA, 19 nt, Homo sapiens
ccacuccgcgugcaaagag

SEQ ID NO: 234688 - RNA, 19 nt, Homo sapiens
gaaagaagauagugagauu

SEQ ID NO: 234689 - RNA, 19 nt, Homo sapiens
gcccaaagcuuguaaauau

SEQ ID NO: 234690 - RNA, 19 nt, Homo sapiens
gaaauucgcauguuuaaug

SEQ ID NO: 234691 - RNA, 19 nt, Homo sapiens
ggaagaaggacaacaaauu

SEQ ID NO: 234692 - RNA, 19 nt, Homo sapiens
gaagaaggacaacaaauug

SEQ ID NO: 234693 - RNA, 19 nt, Homo sapiens
gcucuuacggcuacaauua

SEQ ID NO: 234694 - RNA, 19 nt, Homo sapiens
gaugaucgcuguauuuuga

SEQ ID NO: 234695 - RNA, 19 nt, Homo sapiens
gaagagagaaagaagauag

SEQ ID NO: 234696 - RNA, 19 nt, Homo sapiens
caucauaaaucgugaagca

SEQ ID NO: 234697 - RNA, 19 nt, Homo sapiens
gacuaucaguugcuaaauu

SEQ ID NO: 234698 - RNA, 19 nt, Homo sapiens
gcgaguggaugcugugcua

SEQ ID NO: 234699 - RNA, 19 nt, Homo sapiens
ccaucuguguucuaacuua

SEQ ID NO: 234700 - RNA, 19 nt, Homo sapiens
gaaggacaacaaauugaaa

SEQ ID NO: 234701 - RNA, 19 nt, Homo sapiens
gguauuuguuuguagcuuu

SEQ ID NO: 234702 - RNA, 19 nt, Homo sapiens
ccaaagggaugguauugag

SEQ ID NO: 234703 - RNA, 19 nt, Homo sapiens
gcuggaaacuucuguaagg

SEQ ID NO: 234704 - RNA, 19 nt, Homo sapiens
gggaguauacggaaacaaa

SEQ ID NO: 234705 - RNA, 19 nt, Homo sapiens
ccaagaccauuuguaguga

SEQ ID NO: 234706 - RNA, 19 nt, Homo sapiens
gagaagagagaaagaagau

SEQ ID NO: 234707 - RNA, 19 nt, Homo sapiens
gaaaaggaguuccacuuca

SEQ ID NO: 234708 - RNA, 19 nt, Homo sapiens
cgaccacgauccacaaauc

SEQ ID NO: 234709 - RNA, 19 nt, Homo sapiens
aaagaugaucgcuguauuu

SEQ ID NO: 234710 - RNA, 19 nt, Homo sapiens
gaagauagugagauuuaag

SEQ ID NO: 234711 - RNA, 19 nt, Homo sapiens
gagagaaagaagauaguga

SEQ ID NO: 234712 - RNA, 19 nt, Homo sapiens
ugaggaagcuucacaucag

SEQ ID NO: 234713 - RNA, 19 nt, Homo sapiens
ccaaaugagcucguacuuu

SEQ ID NO: 234714 - RNA, 19 nt, Homo sapiens
ggccuggucugggaguaua

SEQ ID NO: 234715 - RNA, 19 nt, Homo sapiens
ccaacucccuucugcuugu

SEQ ID NO: 234716 - RNA, 19 nt, Homo sapiens
gggaugguauugagaagag

SEQ ID NO: 234717 - RNA, 19 nt, Homo sapiens
gcucguacuuuguaaacuc

SEQ ID NO: 234718 - RNA, 19 nt, Homo sapiens
gauagugagauuuaaguuc

SEQ ID NO: 234719 - RNA, 19 nt, Homo sapiens
gugaagcacaggguuauaa

SEQ ID NO: 234720 - RNA, 19 nt, Homo sapiens
uggacugguuaucuuguua

SEQ ID NO: 234721 - RNA, 19 nt, Homo sapiens
ggauggaccucagcgucaa

SEQ ID NO: 234722 - RNA, 19 nt, Homo sapiens
gggcagacuccgcagauau

SEQ ID NO: 234723 - RNA, 19 nt, Homo sapiens
gagaaagaagauagugaga

SEQ ID NO: 234724 - RNA, 19 nt, Homo sapiens
caucuguguucuaacuuau

SEQ ID NO: 234725 - RNA, 19 nt, Homo sapiens
ggaagcggcaagccagcua

SEQ ID NO: 234726 - RNA, 19 nt, Homo sapiens
gugauucgcuuuugguauu

SEQ ID NO: 234727 - RNA, 19 nt, Homo sapiens
gcaugaaguggaagaagga

SEQ ID NO: 234728 - RNA, 19 nt, Homo sapiens
ggcagacuccgcagauauu

SEQ ID NO: 234729 - RNA, 19 nt, Homo sapiens
uuacccaucuugcuuccaa

SEQ ID NO: 234730 - RNA, 19 nt, Homo sapiens
ggcccaaagcuuguaaaua

SEQ ID NO: 234731 - RNA, 19 nt, Homo sapiens
ucacccaaaugagcucgua

SEQ ID NO: 234732 - RNA, 19 nt, Homo sapiens
ggacugguuaucuuguuau

SEQ ID NO: 234733 - RNA, 19 nt, Homo sapiens
cgccuuguguuacgauauu

SEQ ID NO: 234734 - RNA, 19 nt, Homo sapiens
guauuuguuuguagcuuuc

SEQ ID NO: 234735 - RNA, 19 nt, Homo sapiens
cagcuggaaacuucuguaa

SEQ ID NO: 234736 - RNA, 19 nt, Homo sapiens
gacugguuaucuuguuauu

SEQ ID NO: 234737 - RNA, 19 nt, Homo sapiens
gaagcggcaagccagcuaa

SEQ ID NO: 234738 - RNA, 19 nt, Homo sapiens
gggccugucucagugauuc

SEQ ID NO: 234739 - RNA, 19 nt, Homo sapiens
agaaggacaacaaauugaa

SEQ ID NO: 234740 - RNA, 19 nt, Homo sapiens
ggcaguggcagcucucuga

SEQ ID NO: 234741 - RNA, 19 nt, Homo sapiens
aaugagcucguacuuugua

SEQ ID NO: 234742 - RNA, 19 nt, Homo sapiens
aaagggaugguauugagaa

SEQ ID NO: 234743 - RNA, 19 nt, Homo sapiens
caguguuucugaauguuug

SEQ ID NO: 234744 - RNA, 19 nt, Homo sapiens
cccaaagcuuguaaauaug

SEQ ID NO: 234745 - RNA, 19 nt, Homo sapiens
caaagggaugguauugaga

SEQ ID NO: 234746 - RNA, 19 nt, Homo sapiens
uaacgaccacgauccacaa

SEQ ID NO: 234747 - RNA, 19 nt, Homo sapiens
caaauccgccaguguuucu

SEQ ID NO: 234748 - RNA, 19 nt, Homo sapiens
ccaaagcuuguaaauaugg

SEQ ID NO: 234749 - RNA, 19 nt, Homo sapiens
ugagcuggcuucggagaug

SEQ ID NO: 234750 - RNA, 19 nt, Homo sapiens
auucgcauguuuaauguga

SEQ ID NO: 234751 - RNA, 19 nt, Homo sapiens
gcuagagggcccaaagcuu

SEQ ID NO: 234752 - RNA, 19 nt, Homo sapiens
aagaaggacaacaaauuga

SEQ ID NO: 234753 - RNA, 19 nt, Homo sapiens
aaaaggaguuccacuucaa

SEQ ID NO: 234754 - RNA, 19 nt, Homo sapiens
cgugugaaaucugucuuug

SEQ ID NO: 234755 - RNA, 19 nt, Homo sapiens
gaugcugugcuacguguga

SEQ ID NO: 234756 - RNA, 19 nt, Homo sapiens
gagauggagucccuuuuca

SEQ ID NO: 234757 - RNA, 19 nt, Homo sapiens
ugagaagagagaaagaaga

SEQ ID NO: 234758 - RNA, 19 nt, Homo sapiens
gguauugagaagagagaaa

SEQ ID NO: 234759 - RNA, 19 nt, Homo sapiens
acaaaucaagcccuccaaa

SEQ ID NO: 234760 - RNA, 19 nt, Homo sapiens
gauccucagugcaaaaugu

SEQ ID NO: 234761 - RNA, 19 nt, Homo sapiens
gucugugguugcagucuuu

SEQ ID NO: 234762 - RNA, 19 nt, Homo sapiens
ccaguguuucugaauguuu

SEQ ID NO: 234763 - RNA, 19 nt, Homo sapiens
cgccaguguuucugaaugu

SEQ ID NO: 234764 - RNA, 19 nt, Homo sapiens
ugaaguggaagaaggacaa

SEQ ID NO: 234765 - RNA, 19 nt, Homo sapiens
gaccacgauccacaaauca

SEQ ID NO: 234766 - RNA, 19 nt, Homo sapiens
aaaagaugaucgcuguauu

SEQ ID NO: 234767 - RNA, 19 nt, Homo sapiens
ggacuaucaguugcuaaau

SEQ ID NO: 234768 - RNA, 19 nt, Homo sapiens
uccaagaccauuuguagug

SEQ ID NO: 234769 - RNA, 19 nt, Homo sapiens
aaaugauccucagugcaaa

SEQ ID NO: 234770 - RNA, 19 nt, Homo sapiens
caaaucaagcccuccaaaa

SEQ ID NO: 234771 - RNA, 19 nt, Homo sapiens
ccgccaguguuucugaaug

SEQ ID NO: 234772 - RNA, 19 nt, Homo sapiens
guggaagaaggacaacaaa

SEQ ID NO: 234773 - RNA, 19 nt, Homo sapiens
uccuggaagucaaauaaau

SEQ ID NO: 234774 - RNA, 19 nt, Homo sapiens
gagcucguacuuuguaaac

SEQ ID NO: 234775 - RNA, 19 nt, Homo sapiens
agacccaucucucccuuac

SEQ ID NO: 234776 - RNA, 19 nt, Homo sapiens
gauggagucccuuuucauu

SEQ ID NO: 234777 - RNA, 19 nt, Homo sapiens
ccagcuccagcgccaauuu

SEQ ID NO: 234778 - RNA, 19 nt, Homo sapiens
cggacuaucaguugcuaaa

SEQ ID NO: 234779 - RNA, 19 nt, Homo sapiens
ccuggaagucaaauaaaug

SEQ ID NO: 234780 - RNA, 19 nt, Homo sapiens
guauuucucugugaaucca

SEQ ID NO: 234781 - RNA, 19 nt, Homo sapiens
aaaaugauccucagugcaa

SEQ ID NO: 234782 - RNA, 19 nt, Homo sapiens
ccaugcacaccggcucuua

SEQ ID NO: 234783 - RNA, 19 nt, Homo sapiens
gcagacuccgcagauauuc

SEQ ID NO: 234784 - RNA, 19 nt, Homo sapiens
ggaugguauugagaagaga

SEQ ID NO: 234785 - RNA, 19 nt, Homo sapiens
ucugaauguuugugucugu

SEQ ID NO: 234786 - RNA, 19 nt, Homo sapiens
gccaguguuucugaauguu

SEQ ID NO: 234787 - RNA, 19 nt, Homo sapiens
ugcaaaaugucuuguguau

SEQ ID NO: 234788 - RNA, 19 nt, Homo sapiens
ugaaauacuucgaugauga

SEQ ID NO: 234789 - RNA, 19 nt, Homo sapiens
gaaggaguuucacuacaau

SEQ ID NO: 234790 - RNA, 19 nt, Homo sapiens
ucuggaagcugaagaagaa

SEQ ID NO: 234791 - RNA, 19 nt, Homo sapiens
gagcacauacuaccuagaa

SEQ ID NO: 234792 - RNA, 19 nt, Homo sapiens
gggacaauauuaucuggaa

SEQ ID NO: 234793 - RNA, 19 nt, Homo sapiens
agaaggaguuucacuacaa

SEQ ID NO: 234794 - RNA, 19 nt, Homo sapiens
gcuccagccucuugauauu

SEQ ID NO: 234795 - RNA, 19 nt, Homo sapiens
ggagcggacucacuugaug

SEQ ID NO: 234796 - RNA, 19 nt, Homo sapiens
gagaaggaguuucacuaca

SEQ ID NO: 234797 - RNA, 19 nt, Homo sapiens
gugcaacaguuccuccuuu

SEQ ID NO: 234798 - RNA, 19 nt, Homo sapiens
gacaagggcuuugccacuu

SEQ ID NO: 234799 - RNA, 19 nt, Homo sapiens
ggagaggcagaucaagaua

SEQ ID NO: 234800 - RNA, 19 nt, Homo sapiens
ccaaugaguuccuauuucg

SEQ ID NO: 234801 - RNA, 19 nt, Homo sapiens
gaaauacuucgaugaugau

SEQ ID NO: 234802 - RNA, 19 nt, Homo sapiens
gagugaaggugcuggaaag

SEQ ID NO: 234803 - RNA, 19 nt, Homo sapiens
ggaugcagcggaugaauuc

SEQ ID NO: 234804 - RNA, 19 nt, Homo sapiens
agaggcagaucaagauaug

SEQ ID NO: 234805 - RNA, 19 nt, Homo sapiens
gcacauacuaccuagaagu

SEQ ID NO: 234806 - RNA, 19 nt, Homo sapiens
ucacguugggacaauauua

SEQ ID NO: 234807 - RNA, 19 nt, Homo sapiens
ggagaaggaguuucacuac

SEQ ID NO: 234808 - RNA, 19 nt, Homo sapiens
cggacccgcugagacauua

SEQ ID NO: 234809 - RNA, 19 nt, Homo sapiens
gugaaauacuucgaugaug

SEQ ID NO: 234810 - RNA, 19 nt, Homo sapiens
auacuucgaugaugaugau

SEQ ID NO: 234811 - RNA, 19 nt, Homo sapiens
gagaggcagaucaagauau

SEQ ID NO: 234812 - RNA, 19 nt, Homo sapiens
ggagcacugucguccuuca

SEQ ID NO: 234813 - RNA, 19 nt, Homo sapiens
cccaaugaguuccuauuuc

SEQ ID NO: 234814 - RNA, 19 nt, Homo sapiens
cgugcacgguucaauggua

SEQ ID NO: 234815 - RNA, 19 nt, Homo sapiens
gaggagcggacucacuuga

SEQ ID NO: 234816 - RNA, 19 nt, Homo sapiens
ggacgugaaauacuucgau

SEQ ID NO: 234817 - RNA, 19 nt, Homo sapiens
ggacucacuugauguuucc

SEQ ID NO: 234818 - RNA, 19 nt, Homo sapiens
ugaagaagaaacugaauac

SEQ ID NO: 234819 - RNA, 19 nt, Homo sapiens
uguuuguagucuugucuua

SEQ ID NO: 234820 - RNA, 19 nt, Homo sapiens
cuaccuagaaguaagaaga

SEQ ID NO: 234821 - RNA, 19 nt, Homo sapiens
agagagagaggacgagaga

SEQ ID NO: 234822 - RNA, 19 nt, Homo sapiens
cgccagacauacacacguu

SEQ ID NO: 234823 - RNA, 19 nt, Homo sapiens
agacagaagagcagaagug

SEQ ID NO: 234824 - RNA, 19 nt, Homo sapiens
cugaagaagaaacugaaua

SEQ ID NO: 234825 - RNA, 19 nt, Homo sapiens
cggacucacuugauguuuc

SEQ ID NO: 234826 - RNA, 19 nt, Homo sapiens
gcucucacguugggacaau

SEQ ID NO: 234827 - RNA, 19 nt, Homo sapiens
cgcuggagcuggagaagga

SEQ ID NO: 234828 - RNA, 19 nt, Homo sapiens
ugacggagaggcagaucaa

SEQ ID NO: 234829 - RNA, 19 nt, Homo sapiens
cggaugaauucgugcaaca

SEQ ID NO: 234830 - RNA, 19 nt, Homo sapiens
acaagggcuuugccacuuc

SEQ ID NO: 234831 - RNA, 19 nt, Homo sapiens
cgaugaugaugaugaugau

SEQ ID NO: 234832 - RNA, 19 nt, Homo sapiens
ccacuggaaggagcacaua

SEQ ID NO: 234833 - RNA, 19 nt, Homo sapiens
cgagugaaggugcuggaaa

SEQ ID NO: 234834 - RNA, 19 nt, Homo sapiens
ucggagcacugucguccuu

SEQ ID NO: 234835 - RNA, 19 nt, Homo sapiens
uggagaaggaguuucacua

SEQ ID NO: 234836 - RNA, 19 nt, Homo sapiens
ugcaacaguuccuccuuug

SEQ ID NO: 234837 - RNA, 19 nt, Homo sapiens
gaugaugaugaugaugaua

SEQ ID NO: 234838 - RNA, 19 nt, Homo sapiens
ucgaugaugaugaugauga

SEQ ID NO: 234839 - RNA, 19 nt, Homo sapiens
aagaagaaacugaauacuc

SEQ ID NO: 234840 - RNA, 19 nt, Homo sapiens
gagcggacucacuugaugu

SEQ ID NO: 234841 - RNA, 19 nt, Homo sapiens
ugaugaugaugaugaugau

SEQ ID NO: 234842 - RNA, 19 nt, Homo sapiens
ugaugaugaugaugaugau

SEQ ID NO: 234843 - RNA, 19 nt, Homo sapiens
ugaugaugaugaugaugau

SEQ ID NO: 234844 - RNA, 19 nt, Homo sapiens
gaagaagaaacugaauacu

SEQ ID NO: 234845 - RNA, 19 nt, Homo sapiens
ucuuagcucuggacgugaa

SEQ ID NO: 234846 - RNA, 19 nt, Homo sapiens
agagagacccgggaaggaa

SEQ ID NO: 234847 - RNA, 19 nt, Homo sapiens
gaugaauucgugcaacagu

SEQ ID NO: 234848 - RNA, 19 nt, Homo sapiens
uuccagaaccgacgcauga

SEQ ID NO: 234849 - RNA, 19 nt, Homo sapiens
ugaauucgugcaacaguuc

SEQ ID NO: 234850 - RNA, 19 nt, Homo sapiens
ggccagcuaccgcucuauu

SEQ ID NO: 234851 - RNA, 19 nt, Homo sapiens
cgugaaauacuucgaugau

SEQ ID NO: 234852 - RNA, 19 nt, Homo sapiens
uagcucuggacgugaaaua

SEQ ID NO: 234853 - RNA, 19 nt, Homo sapiens
ucuauguguuguguuugua

SEQ ID NO: 234854 - RNA, 19 nt, Homo sapiens
gccagacauacacacguua

SEQ ID NO: 234855 - RNA, 19 nt, Homo sapiens
ucccaaugaguuccuauuu

SEQ ID NO: 234856 - RNA, 19 nt, Homo sapiens
aaggagcacauacuaccua

SEQ ID NO: 234857 - RNA, 19 nt, Homo sapiens
cggagaggcagaucaagau

SEQ ID NO: 234858 - RNA, 19 nt, Homo sapiens
cagaaccgacgcaugaagu

SEQ ID NO: 234859 - RNA, 19 nt, Homo sapiens
ggagcuggagaaggaguuu

SEQ ID NO: 234860 - RNA, 19 nt, Homo sapiens
acgguucaaugguagauuc

SEQ ID NO: 234861 - RNA, 19 nt, Homo sapiens
aaacaggccgagugaaggu

SEQ ID NO: 234862 - RNA, 19 nt, Homo sapiens
gcaacaguuccuccuuugg

SEQ ID NO: 234863 - RNA, 19 nt, Homo sapiens
ccacccauuccuuuaaauc

SEQ ID NO: 234864 - RNA, 19 nt, Homo sapiens
ggaagcugaagaagaaacu

SEQ ID NO: 234865 - RNA, 19 nt, Homo sapiens
gcaggacaagagcguguuc

SEQ ID NO: 234866 - RNA, 19 nt, Homo sapiens
gaagggagccggcagaaua

SEQ ID NO: 234867 - RNA, 19 nt, Homo sapiens
ggaacaagauggauggaaa

SEQ ID NO: 234868 - RNA, 19 nt, Homo sapiens
ugaaauacuucgaugauga

SEQ ID NO: 234869 - RNA, 19 nt, Homo sapiens
ggagaaaggcgaaggagaa

SEQ ID NO: 234870 - RNA, 19 nt, Homo sapiens
ggaucgaucuacgucauua

SEQ ID NO: 234871 - RNA, 19 nt, Homo sapiens
gaaggaguuucacuacaau

SEQ ID NO: 234872 - RNA, 19 nt, Homo sapiens
gcacaggccuaggagacua

SEQ ID NO: 234873 - RNA, 19 nt, Homo sapiens
caaagacggcuccauuaaa

SEQ ID NO: 234874 - RNA, 19 nt, Homo sapiens
cguaacagguuccuccuuu

SEQ ID NO: 234875 - RNA, 19 nt, Homo sapiens
uggcuuggcuuuacuuuga

SEQ ID NO: 234876 - RNA, 19 nt, Homo sapiens
gagcacauacuaccuagaa

SEQ ID NO: 234877 - RNA, 19 nt, Homo sapiens
cagguuggauuauuuguug

SEQ ID NO: 234878 - RNA, 19 nt, Homo sapiens
ccaaagacggcuccauuaa

SEQ ID NO: 234879 - RNA, 19 nt, Homo sapiens
agaaggaguuucacuacaa

SEQ ID NO: 234880 - RNA, 19 nt, Homo sapiens
ggcaggaguuacaaaguuu

SEQ ID NO: 234881 - RNA, 19 nt, Homo sapiens
ggagcggacucacuugaug

SEQ ID NO: 234882 - RNA, 19 nt, Homo sapiens
gaaaggcgaaggagaagga

SEQ ID NO: 234883 - RNA, 19 nt, Homo sapiens
ggccuuaagucccaacuga

SEQ ID NO: 234884 - RNA, 19 nt, Homo sapiens
gaggaagaguugagucugu

SEQ ID NO: 234885 - RNA, 19 nt, Homo sapiens
guuaggagauagaagaaga

SEQ ID NO: 234886 - RNA, 19 nt, Homo sapiens
gagaaggaguuucacuaca

SEQ ID NO: 234887 - RNA, 19 nt, Homo sapiens
ggucucagguuggauuauu

SEQ ID NO: 234888 - RNA, 19 nt, Homo sapiens
ggagauagaagaagauugg

SEQ ID NO: 234889 - RNA, 19 nt, Homo sapiens
gacaagggcuuugccacuu

SEQ ID NO: 234890 - RNA, 19 nt, Homo sapiens
gguacuggcuggagucugu

SEQ ID NO: 234891 - RNA, 19 nt, Homo sapiens
gauuaacggccuggauuua

SEQ ID NO: 234892 - RNA, 19 nt, Homo sapiens
ggagaggcagaucaagaua

SEQ ID NO: 234893 - RNA, 19 nt, Homo sapiens
guaacagguuccuccuuug

SEQ ID NO: 234894 - RNA, 19 nt, Homo sapiens
ggaaagggagggaaagaca

SEQ ID NO: 234895 - RNA, 19 nt, Homo sapiens
gggugacgcugaagaggaa

SEQ ID NO: 234896 - RNA, 19 nt, Homo sapiens
aaagacggcuccauuaaaa

SEQ ID NO: 234897 - RNA, 19 nt, Homo sapiens
ccaaugaguuccuauuucg

SEQ ID NO: 234898 - RNA, 19 nt, Homo sapiens
gaaauacuucgaugaugau

SEQ ID NO: 234899 - RNA, 19 nt, Homo sapiens
gagugaaggugcuggaaag

SEQ ID NO: 234900 - RNA, 19 nt, Homo sapiens
ggauuaacggccuggauuu

SEQ ID NO: 234901 - RNA, 19 nt, Homo sapiens
gaaagugaggagccguuaa

SEQ ID NO: 234902 - RNA, 19 nt, Homo sapiens
ggaugcagcggaugaauuc

SEQ ID NO: 234903 - RNA, 19 nt, Homo sapiens
agaggcagaucaagauaug

SEQ ID NO: 234904 - RNA, 19 nt, Homo sapiens
gaaagggagggaaagacaa

SEQ ID NO: 234905 - RNA, 19 nt, Homo sapiens
gaggagggaggaggaauaa

SEQ ID NO: 234906 - RNA, 19 nt, Homo sapiens
gcacauacuaccuagaagu

SEQ ID NO: 234907 - RNA, 19 nt, Homo sapiens
ggaaagacaagaugcaacu

SEQ ID NO: 234908 - RNA, 19 nt, Homo sapiens
uagccggacucgaaaguga

SEQ ID NO: 234909 - RNA, 19 nt, Homo sapiens
uggaucagaugguuguauu

SEQ ID NO: 234910 - RNA, 19 nt, Homo sapiens
gacaagaugcaacuaggaa

SEQ ID NO: 234911 - RNA, 19 nt, Homo sapiens
gaaagacaagaugcaacua

SEQ ID NO: 234912 - RNA, 19 nt, Homo sapiens
gaacaagauggauggaaag

SEQ ID NO: 234913 - RNA, 19 nt, Homo sapiens
cggccuggauuuaucauug

SEQ ID NO: 234914 - RNA, 19 nt, Homo sapiens
ggagaaggaguuucacuac

SEQ ID NO: 234915 - RNA, 19 nt, Homo sapiens
gaucagaugguuguauuuc

SEQ ID NO: 234916 - RNA, 19 nt, Homo sapiens
gugaggagccguuaaugug

SEQ ID NO: 234917 - RNA, 19 nt, Homo sapiens
aggcaggaguuacaaaguu

SEQ ID NO: 234918 - RNA, 19 nt, Homo sapiens
caacagugagugagacuuc

SEQ ID NO: 234919 - RNA, 19 nt, Homo sapiens
cggacccgcugagacauua

SEQ ID NO: 234920 - RNA, 19 nt, Homo sapiens
gugaaauacuucgaugaug

SEQ ID NO: 234921 - RNA, 19 nt, Homo sapiens
ccuccugggugcuauuuga

SEQ ID NO: 234922 - RNA, 19 nt, Homo sapiens
gauuauuuguuggccuuaa

SEQ ID NO: 234923 - RNA, 19 nt, Homo sapiens
aaucucggauauacuacua

SEQ ID NO: 234924 - RNA, 19 nt, Homo sapiens
caagaugcaacuaggaaga

SEQ ID NO: 234925 - RNA, 19 nt, Homo sapiens
auacuucgaugaugaugau

SEQ ID NO: 234926 - RNA, 19 nt, Homo sapiens
gagaggcagaucaagauau

SEQ ID NO: 234927 - RNA, 19 nt, Homo sapiens
ucuacgucauuacggauua

SEQ ID NO: 234928 - RNA, 19 nt, Homo sapiens
ggucaguguuggaucagau

SEQ ID NO: 234929 - RNA, 19 nt, Homo sapiens
ucaguuaggagauagaaga

SEQ ID NO: 234930 - RNA, 19 nt, Homo sapiens
ggagggaggaggaauaagg

SEQ ID NO: 234931 - RNA, 19 nt, Homo sapiens
cccaaugaguuccuauuuc

SEQ ID NO: 234932 - RNA, 19 nt, Homo sapiens
cgugcacgguucaauggua

SEQ ID NO: 234933 - RNA, 19 nt, Homo sapiens
gaggagcggacucacuuga

SEQ ID NO: 234934 - RNA, 19 nt, Homo sapiens
ggacgugaaauacuucgau

SEQ ID NO: 234935 - RNA, 19 nt, Homo sapiens
ggacucacuugauguuucc

SEQ ID NO: 234936 - RNA, 19 nt, Homo sapiens
ugggugggcaucucaguua

SEQ ID NO: 234937 - RNA, 19 nt, Homo sapiens
cgaaagugaggagccguua

SEQ ID NO: 234938 - RNA, 19 nt, Homo sapiens
caagaugaggcaccaggaa

SEQ ID NO: 234939 - RNA, 19 nt, Homo sapiens
uguuuguagucuugucuua

SEQ ID NO: 234940 - RNA, 19 nt, Homo sapiens
ucggauauacuacuaauag

SEQ ID NO: 234941 - RNA, 19 nt, Homo sapiens
gcaacuaggaagagacaca

SEQ ID NO: 234942 - RNA, 19 nt, Homo sapiens
ggauggaaagggagggaaa

SEQ ID NO: 234943 - RNA, 19 nt, Homo sapiens
uuaacggccuggauuuauc

SEQ ID NO: 234944 - RNA, 19 nt, Homo sapiens
ggaauaaggggaaggaaga

SEQ ID NO: 234945 - RNA, 19 nt, Homo sapiens
cuaccuagaaguaagaaga

SEQ ID NO: 234946 - RNA, 19 nt, Homo sapiens
cccaaucucggauauacua

SEQ ID NO: 234947 - RNA, 19 nt, Homo sapiens
cgccagacauacacacguu

SEQ ID NO: 234948 - RNA, 19 nt, Homo sapiens
ugaauucgugcaacaguga

SEQ ID NO: 234949 - RNA, 19 nt, Homo sapiens
agacagaagagcagaagug

SEQ ID NO: 234950 - RNA, 19 nt, Homo sapiens
cggacucacuugauguuuc

SEQ ID NO: 234951 - RNA, 19 nt, Homo sapiens
cgcuggagcuggagaagga

SEQ ID NO: 234952 - RNA, 19 nt, Homo sapiens
aaagugaggagccguuaau

SEQ ID NO: 234953 - RNA, 19 nt, Homo sapiens
ggaucagaugguuguauuu

SEQ ID NO: 234954 - RNA, 19 nt, Homo sapiens
ugacggagaggcagaucaa

SEQ ID NO: 234955 - RNA, 19 nt, Homo sapiens
cuacgucauuacggauuaa

SEQ ID NO: 234956 - RNA, 19 nt, Homo sapiens
accaaagacggcuccauua

SEQ ID NO: 234957 - RNA, 19 nt, Homo sapiens
aaccaaagacggcuccauu

SEQ ID NO: 234958 - RNA, 19 nt, Homo sapiens
cggaugaauucgugcaaca

SEQ ID NO: 234959 - RNA, 19 nt, Homo sapiens
acaagggcuuugccacuuc

SEQ ID NO: 234960 - RNA, 19 nt, Homo sapiens
cgaugaugaugaugaugau

SEQ ID NO: 234961 - RNA, 19 nt, Homo sapiens
uccauuagccggacucgaa

SEQ ID NO: 234962 - RNA, 19 nt, Homo sapiens
agaggagggaggaggaaua

SEQ ID NO: 234963 - RNA, 19 nt, Homo sapiens
ccacuggaaggagcacaua

SEQ ID NO: 234964 - RNA, 19 nt, Homo sapiens
cgagugaaggugcuggaaa

SEQ ID NO: 234965 - RNA, 19 nt, Homo sapiens
uggagaaggaguuucacua

SEQ ID NO: 234966 - RNA, 19 nt, Homo sapiens
ugaaauacuucgaugauga

SEQ ID NO: 234967 - RNA, 19 nt, Homo sapiens
ggagaaaggcgaaggagaa

SEQ ID NO: 234968 - RNA, 19 nt, Homo sapiens
gaaggaguuucacuacaau

SEQ ID NO: 234969 - RNA, 19 nt, Homo sapiens
gagcacauacuaccuagaa

SEQ ID NO: 234970 - RNA, 19 nt, Homo sapiens
agaaggaguuucacuacaa

SEQ ID NO: 234971 - RNA, 19 nt, Homo sapiens
gaaaggcgaaggagaagga

SEQ ID NO: 234972 - RNA, 19 nt, Homo sapiens
ggagcggacucacuugaug

SEQ ID NO: 234973 - RNA, 19 nt, Homo sapiens
gagaaggaguuucacuaca

SEQ ID NO: 234974 - RNA, 19 nt, Homo sapiens
gugcaacaguuccuccuuu

SEQ ID NO: 234975 - RNA, 19 nt, Homo sapiens
gacaagggcuuugccacuu

SEQ ID NO: 234976 - RNA, 19 nt, Homo sapiens
ggagaggcagaucaagaua

SEQ ID NO: 234977 - RNA, 19 nt, Homo sapiens
ccaaugaguuccuauuucg

SEQ ID NO: 234978 - RNA, 19 nt, Homo sapiens
gaaauacuucgaugaugau

SEQ ID NO: 234979 - RNA, 19 nt, Homo sapiens
gagugaaggugcuggaaag

SEQ ID NO: 234980 - RNA, 19 nt, Homo sapiens
ggaugcagcggaugaauuc

SEQ ID NO: 234981 - RNA, 19 nt, Homo sapiens
agaggcagaucaagauaug

SEQ ID NO: 234982 - RNA, 19 nt, Homo sapiens
gcacauacuaccuagaagu

SEQ ID NO: 234983 - RNA, 19 nt, Homo sapiens
uggaucagaugguuguauu

SEQ ID NO: 234984 - RNA, 19 nt, Homo sapiens
ggagaaggaguuucacuac

SEQ ID NO: 234985 - RNA, 19 nt, Homo sapiens
gaucagaugguuguauuuc

SEQ ID NO: 234986 - RNA, 19 nt, Homo sapiens
cggacccgcugagacauua

SEQ ID NO: 234987 - RNA, 19 nt, Homo sapiens
gugaaauacuucgaugaug

SEQ ID NO: 234988 - RNA, 19 nt, Homo sapiens
ccuccugggugcuauuuga

SEQ ID NO: 234989 - RNA, 19 nt, Homo sapiens
aaucucggauauacuacua

SEQ ID NO: 234990 - RNA, 19 nt, Homo sapiens
auacuucgaugaugaugau

SEQ ID NO: 234991 - RNA, 19 nt, Homo sapiens
gagaggcagaucaagauau

SEQ ID NO: 234992 - RNA, 19 nt, Homo sapiens
ggucaguguuggaucagau

SEQ ID NO: 234993 - RNA, 19 nt, Homo sapiens
cccaaugaguuccuauuuc

SEQ ID NO: 234994 - RNA, 19 nt, Homo sapiens
cgugcacgguucaauggua

SEQ ID NO: 234995 - RNA, 19 nt, Homo sapiens
gaggagcggacucacuuga

SEQ ID NO: 234996 - RNA, 19 nt, Homo sapiens
ggacgugaaauacuucgau

SEQ ID NO: 234997 - RNA, 19 nt, Homo sapiens
ggacucacuugauguuucc

SEQ ID NO: 234998 - RNA, 19 nt, Homo sapiens
uguuuguagucuugucuua

SEQ ID NO: 234999 - RNA, 19 nt, Homo sapiens
ucggauauacuacuaauag

SEQ ID NO: 235000 - RNA, 19 nt, Homo sapiens
cuaccuagaaguaagaaga

SEQ ID NO: 235001 - RNA, 19 nt, Homo sapiens
cgccagacauacacacguu

SEQ ID NO: 235002 - RNA, 19 nt, Homo sapiens
agacagaagagcagaagug

SEQ ID NO: 235003 - RNA, 19 nt, Homo sapiens
cccaaucucggauauacua

SEQ ID NO: 235004 - RNA, 19 nt, Homo sapiens
cggacucacuugauguuuc

SEQ ID NO: 235005 - RNA, 19 nt, Homo sapiens
cgcuggagcuggagaagga

SEQ ID NO: 235006 - RNA, 19 nt, Homo sapiens
ggaucagaugguuguauuu

SEQ ID NO: 235007 - RNA, 19 nt, Homo sapiens
ugacggagaggcagaucaa

SEQ ID NO: 235008 - RNA, 19 nt, Homo sapiens
cggaugaauucgugcaaca

SEQ ID NO: 235009 - RNA, 19 nt, Homo sapiens
acaagggcuuugccacuuc

SEQ ID NO: 235010 - RNA, 19 nt, Homo sapiens
cgaugaugaugaugaugau

SEQ ID NO: 235011 - RNA, 19 nt, Homo sapiens
ccacuggaaggagcacaua

SEQ ID NO: 235012 - RNA, 19 nt, Homo sapiens
cgagugaaggugcuggaaa

SEQ ID NO: 235013 - RNA, 19 nt, Homo sapiens
uggagaaggaguuucacua

SEQ ID NO: 235014 - RNA, 19 nt, Homo sapiens
ugcaacaguuccuccuuug

SEQ ID NO: 235015 - RNA, 19 nt, Homo sapiens
ucucggauauacuacuaau

SEQ ID NO: 235016 - RNA, 19 nt, Homo sapiens
gaugaugaugaugaugaua

SEQ ID NO: 235017 - RNA, 19 nt, Homo sapiens
ucgaugaugaugaugauga

SEQ ID NO: 235018 - RNA, 19 nt, Homo sapiens
gagcggacucacuugaugu

SEQ ID NO: 235019 - RNA, 19 nt, Homo sapiens
ugaugaugaugaugaugau

SEQ ID NO: 235020 - RNA, 19 nt, Homo sapiens
ugaugaugaugaugaugau

SEQ ID NO: 235021 - RNA, 19 nt, Homo sapiens
ugaugaugaugaugaugau

SEQ ID NO: 235022 - RNA, 19 nt, Homo sapiens
ucuuagcucuggacgugaa

SEQ ID NO: 235023 - RNA, 19 nt, Homo sapiens
agagagacccgggaaggaa

SEQ ID NO: 235024 - RNA, 19 nt, Homo sapiens
gaugaauucgugcaacagu

SEQ ID NO: 235025 - RNA, 19 nt, Homo sapiens
uuccagaaccgacgcauga

SEQ ID NO: 235026 - RNA, 19 nt, Homo sapiens
gagaaaggcgaaggagaag

SEQ ID NO: 235027 - RNA, 19 nt, Homo sapiens
ugaauucgugcaacaguuc

SEQ ID NO: 235028 - RNA, 19 nt, Homo sapiens
ggccagcuaccgcucuauu

SEQ ID NO: 235029 - RNA, 19 nt, Homo sapiens
cgugaaauacuucgaugau

SEQ ID NO: 235030 - RNA, 19 nt, Homo sapiens
uagcucuggacgugaaaua

SEQ ID NO: 235031 - RNA, 19 nt, Homo sapiens
ucuauguguuguguuugua

SEQ ID NO: 235032 - RNA, 19 nt, Homo sapiens
cgaaggagaaggaggaaaa

SEQ ID NO: 235033 - RNA, 19 nt, Homo sapiens
gccagacauacacacguua

SEQ ID NO: 235034 - RNA, 19 nt, Homo sapiens
ucccaaugaguuccuauuu

SEQ ID NO: 235035 - RNA, 19 nt, Homo sapiens
aaggagcacauacuaccua

SEQ ID NO: 235036 - RNA, 19 nt, Homo sapiens
cggagaggcagaucaagau

SEQ ID NO: 235037 - RNA, 19 nt, Homo sapiens
ccugggugcuauuugacaa

SEQ ID NO: 235038 - RNA, 19 nt, Homo sapiens
ucagaugguuguauuuccu

SEQ ID NO: 235039 - RNA, 19 nt, Homo sapiens
aaacccaaucucggauaua

SEQ ID NO: 235040 - RNA, 19 nt, Homo sapiens
cagaaccgacgcaugaagu

SEQ ID NO: 235041 - RNA, 19 nt, Homo sapiens
ugggugcuauuugacaauu

SEQ ID NO: 235042 - RNA, 19 nt, Homo sapiens
ggagcuggagaaggaguuu

SEQ ID NO: 235043 - RNA, 19 nt, Homo sapiens
acgguucaaugguagauuc

SEQ ID NO: 235044 - RNA, 19 nt, Homo sapiens
aaacaggccgagugaaggu

SEQ ID NO: 235045 - RNA, 19 nt, Homo sapiens
gcaacaguuccuccuuugg

SEQ ID NO: 235046 - RNA, 19 nt, Homo sapiens
gcaggacaagagcguguuc

SEQ ID NO: 235047 - RNA, 19 nt, Homo sapiens
ggacucuaauucuguaaua

SEQ ID NO: 235048 - RNA, 19 nt, Homo sapiens
aaagacagaucaagauuug

SEQ ID NO: 235049 - RNA, 19 nt, Homo sapiens
gaaagacagaucaagauuu

SEQ ID NO: 235050 - RNA, 19 nt, Homo sapiens
guguaaaucuggacucuaa

SEQ ID NO: 235051 - RNA, 19 nt, Homo sapiens
caaaucauccggccaaauu

SEQ ID NO: 235052 - RNA, 19 nt, Homo sapiens
gagaguaacuuccggaucu

SEQ ID NO: 235053 - RNA, 19 nt, Homo sapiens
ucaggaaacucaaaucgaa

SEQ ID NO: 235054 - RNA, 19 nt, Homo sapiens
aaacgucccugccuacaaa

SEQ ID NO: 235055 - RNA, 19 nt, Homo sapiens
ggaaagacagaucaagauu

SEQ ID NO: 235056 - RNA, 19 nt, Homo sapiens
ggaggaagaggaagaguga

SEQ ID NO: 235057 - RNA, 19 nt, Homo sapiens
gaaagucugucagguuugg

SEQ ID NO: 235058 - RNA, 19 nt, Homo sapiens
gaauuuaccuccccuuuuc

SEQ ID NO: 235059 - RNA, 19 nt, Homo sapiens
aggaaagucugucagguuu

SEQ ID NO: 235060 - RNA, 19 nt, Homo sapiens
caaaucgaauagggaagua

SEQ ID NO: 235061 - RNA, 19 nt, Homo sapiens
guaaaucuggacucuaauu

SEQ ID NO: 235062 - RNA, 19 nt, Homo sapiens
gagccgaguuccuucaaca

SEQ ID NO: 235063 - RNA, 19 nt, Homo sapiens
gagaaagggcagaggaaga

SEQ ID NO: 235064 - RNA, 19 nt, Homo sapiens
ggagcuggagaaagaauuu

SEQ ID NO: 235065 - RNA, 19 nt, Homo sapiens
ccucuuuaaugcugucuuu

SEQ ID NO: 235066 - RNA, 19 nt, Homo sapiens
ggagaaaggagaaauuuug

SEQ ID NO: 235067 - RNA, 19 nt, Homo sapiens
ggaagagacaugagaaagg

SEQ ID NO: 235068 - RNA, 19 nt, Homo sapiens
uguaagcccucuuuaaugc

SEQ ID NO: 235069 - RNA, 19 nt, Homo sapiens
gaggaagagacaugagaaa

SEQ ID NO: 235070 - RNA, 19 nt, Homo sapiens
cccuggagcuggagaaaga

SEQ ID NO: 235071 - RNA, 19 nt, Homo sapiens
gagggagaaaggagaaauu

SEQ ID NO: 235072 - RNA, 19 nt, Homo sapiens
gacugugggucuggacuaa

SEQ ID NO: 235073 - RNA, 19 nt, Homo sapiens
ggacugugggucuggacua

SEQ ID NO: 235074 - RNA, 19 nt, Homo sapiens
gaaaggagaaauuuugguu

SEQ ID NO: 235075 - RNA, 19 nt, Homo sapiens
guauuaugcgaaugcuuua

SEQ ID NO: 235076 - RNA, 19 nt, Homo sapiens
cuaaauauccagccucaag

SEQ ID NO: 235077 - RNA, 19 nt, Homo sapiens
uguauuaugcgaaugcuuu

SEQ ID NO: 235078 - RNA, 19 nt, Homo sapiens
uaucaaggaaucucguaaa

SEQ ID NO: 235079 - RNA, 19 nt, Homo sapiens
guagcuuucuggaauuuac

SEQ ID NO: 235080 - RNA, 19 nt, Homo sapiens
gggcagaggaagagacaug

SEQ ID NO: 235081 - RNA, 19 nt, Homo sapiens
aaucuggacucuaauucug

SEQ ID NO: 235082 - RNA, 19 nt, Homo sapiens
uaccggagccuucccagaa

SEQ ID NO: 235083 - RNA, 19 nt, Homo sapiens
ucuggacucuaauucugua

SEQ ID NO: 235084 - RNA, 19 nt, Homo sapiens
gcgaaugcuuuauuuucua

SEQ ID NO: 235085 - RNA, 19 nt, Homo sapiens
uaggaaagucugucagguu

SEQ ID NO: 235086 - RNA, 19 nt, Homo sapiens
aauacuaccuauaggaaag

SEQ ID NO: 235087 - RNA, 19 nt, Homo sapiens
aggaaacucaaaucgaaua

SEQ ID NO: 235088 - RNA, 19 nt, Homo sapiens
ggaaagucugucagguuug

SEQ ID NO: 235089 - RNA, 19 nt, Homo sapiens
aaaucauccggccaaauua

SEQ ID NO: 235090 - RNA, 19 nt, Homo sapiens
uaaaucuggacucuaauuc

SEQ ID NO: 235091 - RNA, 19 nt, Homo sapiens
ugaguucauuguauuaugc

SEQ ID NO: 235092 - RNA, 19 nt, Homo sapiens
ggaauuuaccuccccuuuu

SEQ ID NO: 235093 - RNA, 19 nt, Homo sapiens
cagaggaagagacaugaga

SEQ ID NO: 235094 - RNA, 19 nt, Homo sapiens
ggaaacucaaaucgaauag

SEQ ID NO: 235095 - RNA, 19 nt, Homo sapiens
gaucaagauuugguuucag

SEQ ID NO: 235096 - RNA, 19 nt, Homo sapiens
cggaaagacagaucaagau

SEQ ID NO: 235097 - RNA, 19 nt, Homo sapiens
agaguaacuuccggaucua

SEQ ID NO: 235098 - RNA, 19 nt, Homo sapiens
cauucuguguguaucuaaa

SEQ ID NO: 235099 - RNA, 19 nt, Homo sapiens
uuuguaagcccucuuuaau

SEQ ID NO: 235100 - RNA, 19 nt, Homo sapiens
gcuauuguaaggucuuugu

SEQ ID NO: 235101 - RNA, 19 nt, Homo sapiens
gaaucaggaaacucaaauc

SEQ ID NO: 235102 - RNA, 19 nt, Homo sapiens
agaucaagauuugguuuca

SEQ ID NO: 235103 - RNA, 19 nt, Homo sapiens
ucuguagcuuucuggaauu

SEQ ID NO: 235104 - RNA, 19 nt, Homo sapiens
ggagggagaaaggagaaau

SEQ ID NO: 235105 - RNA, 19 nt, Homo sapiens
aaauauccagccucaaguu

SEQ ID NO: 235106 - RNA, 19 nt, Homo sapiens
gaaagggcagaggaagaga

SEQ ID NO: 235107 - RNA, 19 nt, Homo sapiens
aaucgaauagggaaguaaa

SEQ ID NO: 235108 - RNA, 19 nt, Homo sapiens
ugaaucaggaaacucaaau

SEQ ID NO: 235109 - RNA, 19 nt, Homo sapiens
cagaggaggaagaggaaga

SEQ ID NO: 235110 - RNA, 19 nt, Homo sapiens
cuuuaaugcugucuuugug

SEQ ID NO: 235111 - RNA, 19 nt, Homo sapiens
caaggaaucucguaaaacc

SEQ ID NO: 235112 - RNA, 19 nt, Homo sapiens
uaaauauccagccucaagu

SEQ ID NO: 235113 - RNA, 19 nt, Homo sapiens
uaccuguucuguagcuuuc

SEQ ID NO: 235114 - RNA, 19 nt, Homo sapiens
cgaguuccuucaacaugca

SEQ ID NO: 235115 - RNA, 19 nt, Homo sapiens
aucaagauuugguuucaga

SEQ ID NO: 235116 - RNA, 19 nt, Homo sapiens
agacagaucaagauuuggu

SEQ ID NO: 235117 - RNA, 19 nt, Homo sapiens
aaucauccggccaaauuau

SEQ ID NO: 235118 - RNA, 19 nt, Homo sapiens
uauaucaaggaaucucgua

SEQ ID NO: 235119 - RNA, 19 nt, Homo sapiens
acagaucaagauuugguuu

SEQ ID NO: 235120 - RNA, 19 nt, Homo sapiens
cuauguugcuauuguaagg

SEQ ID NO: 235121 - RNA, 19 nt, Homo sapiens
agaggaagagacaugagaa

SEQ ID NO: 235122 - RNA, 19 nt, Homo sapiens
agugagggauggagaaagg

SEQ ID NO: 235123 - RNA, 19 nt, Homo sapiens
ucaaaucgaauagggaagu

SEQ ID NO: 235124 - RNA, 19 nt, Homo sapiens
ccggccaaauuaugaguuc

SEQ ID NO: 235125 - RNA, 19 nt, Homo sapiens
augcgaagcucaggaacug

SEQ ID NO: 235126 - RNA, 19 nt, Homo sapiens
gccgaguuccuucaacaug

SEQ ID NO: 235127 - RNA, 19 nt, Homo sapiens
cguaauagcuucugugugu

SEQ ID NO: 235128 - RNA, 19 nt, Homo sapiens
guucuuagguuuacuguga

SEQ ID NO: 235129 - RNA, 19 nt, Homo sapiens
gaaaagggcggaagaguua

SEQ ID NO: 235130 - RNA, 19 nt, Homo sapiens
ggagggagggcuaauuaua

SEQ ID NO: 235131 - RNA, 19 nt, Homo sapiens
ugaacgugcuucuuuguaa

SEQ ID NO: 235132 - RNA, 19 nt, Homo sapiens
gcggaagaguuacaauaaa

SEQ ID NO: 235133 - RNA, 19 nt, Homo sapiens
gaacgugcuucuuuguaau

SEQ ID NO: 235134 - RNA, 19 nt, Homo sapiens
gugguaguaucucguaaua

SEQ ID NO: 235135 - RNA, 19 nt, Homo sapiens
agggagggcuaauuauaua

SEQ ID NO: 235136 - RNA, 19 nt, Homo sapiens
gagggagggcuaauuauau

SEQ ID NO: 235137 - RNA, 19 nt, Homo sapiens
uuacaaguguucuuagguu

SEQ ID NO: 235138 - RNA, 19 nt, Homo sapiens
gguaguaucucguaauagc

SEQ ID NO: 235139 - RNA, 19 nt, Homo sapiens
gggcggaagaguuacaaua

SEQ ID NO: 235140 - RNA, 19 nt, Homo sapiens
ggcggaagaguuacaauaa

SEQ ID NO: 235141 - RNA, 19 nt, Homo sapiens
aggaggagcuggagaaaca

SEQ ID NO: 235142 - RNA, 19 nt, Homo sapiens
ggagggcuaauuauauauu

SEQ ID NO: 235143 - RNA, 19 nt, Homo sapiens
cggaagaguuacaauaaag

SEQ ID NO: 235144 - RNA, 19 nt, Homo sapiens
ugaccaagguaccgauuuc

SEQ ID NO: 235145 - RNA, 19 nt, Homo sapiens
gaaaaggauuuaagcaaag

SEQ ID NO: 235146 - RNA, 19 nt, Homo sapiens
ucaacucacuguucuccaa

SEQ ID NO: 235147 - RNA, 19 nt, Homo sapiens
gcagaagggcgacaagaag

SEQ ID NO: 235148 - RNA, 19 nt, Homo sapiens
ucacuguucuccaaauaca

SEQ ID NO: 235149 - RNA, 19 nt, Homo sapiens
gcgcugugggcaauuguua

SEQ ID NO: 235150 - RNA, 19 nt, Homo sapiens
gcuaaguucucccaacaac

SEQ ID NO: 235151 - RNA, 19 nt, Homo sapiens
gcucuuauuucgucaacuc

SEQ ID NO: 235152 - RNA, 19 nt, Homo sapiens
acaaguguucuuagguuua

SEQ ID NO: 235153 - RNA, 19 nt, Homo sapiens
uacaaguguucuuagguuu

SEQ ID NO: 235154 - RNA, 19 nt, Homo sapiens
acucacuguucuccaaaua

SEQ ID NO: 235155 - RNA, 19 nt, Homo sapiens
ggaagaguuacaauaaagu

SEQ ID NO: 235156 - RNA, 19 nt, Homo sapiens
ucuauacuuuguucuguug

SEQ ID NO: 235157 - RNA, 19 nt, Homo sapiens
gagguuacuuuaguuagca

SEQ ID NO: 235158 - RNA, 19 nt, Homo sapiens
gguuuacugugaagagaau

SEQ ID NO: 235159 - RNA, 19 nt, Homo sapiens
ugucuuaaguguuucucaa

SEQ ID NO: 235160 - RNA, 19 nt, Homo sapiens
caaguguucuuagguuuac

SEQ ID NO: 235161 - RNA, 19 nt, Homo sapiens
uaaguucucccaacaacau

SEQ ID NO: 235162 - RNA, 19 nt, Homo sapiens
guaccgauuucugcuaagu

SEQ ID NO: 235163 - RNA, 19 nt, Homo sapiens
cgagaucuucuucgccuuu

SEQ ID NO: 235164 - RNA, 19 nt, Homo sapiens
cccuuugguuugacaauuu

SEQ ID NO: 235165 - RNA, 19 nt, Homo sapiens
caacaugaaacugccuauu

SEQ ID NO: 235166 - RNA, 19 nt, Homo sapiens
aaagagaacaacaaagaca

SEQ ID NO: 235167 - RNA, 19 nt, Homo sapiens
cgucgcaaauccaggaguu

SEQ ID NO: 235168 - RNA, 19 nt, Homo sapiens
uguuguuccucuauacuuu

SEQ ID NO: 235169 - RNA, 19 nt, Homo sapiens
uaauagcuucuguguguga

SEQ ID NO: 235170 - RNA, 19 nt, Homo sapiens
agaagggcgacaagaagua

SEQ ID NO: 235171 - RNA, 19 nt, Homo sapiens
gcaggaggagcuggagaaa

SEQ ID NO: 235172 - RNA, 19 nt, Homo sapiens
cccuggagcuggagaagga

SEQ ID NO: 235173 - RNA, 19 nt, Homo sapiens
caacucacuguucuccaaa

SEQ ID NO: 235174 - RNA, 19 nt, Homo sapiens
aaagccuccuugugcaauu

SEQ ID NO: 235175 - RNA, 19 nt, Homo sapiens
gaagggcgacaagaaguag

SEQ ID NO: 235176 - RNA, 19 nt, Homo sapiens
ccuuugaacgugcuucuuu

SEQ ID NO: 235177 - RNA, 19 nt, Homo sapiens
ugugugagcuaccguggau

SEQ ID NO: 235178 - RNA, 19 nt, Homo sapiens
ggggagggagggcuaauua

SEQ ID NO: 235179 - RNA, 19 nt, Homo sapiens
cugcuaaguucucccaaca

SEQ ID NO: 235180 - RNA, 19 nt, Homo sapiens
ggaaagaaaaggauuuaag

SEQ ID NO: 235181 - RNA, 19 nt, Homo sapiens
guuccuauuuaaucccuau

SEQ ID NO: 235182 - RNA, 19 nt, Homo sapiens
guuccucuauacuuuguuc

SEQ ID NO: 235183 - RNA, 19 nt, Homo sapiens
gcaaauccaggaguucuac

SEQ ID NO: 235184 - RNA, 19 nt, Homo sapiens
ccucuauacuuuguucugu

SEQ ID NO: 235185 - RNA, 19 nt, Homo sapiens
aacaugaaacugccuauuc

SEQ ID NO: 235186 - RNA, 19 nt, Homo sapiens
aucccuaucugacucguaa

SEQ ID NO: 235187 - RNA, 19 nt, Homo sapiens
cuauuuaaucccuaucuga

SEQ ID NO: 235188 - RNA, 19 nt, Homo sapiens
gggagggagggcuaauuau

SEQ ID NO: 235189 - RNA, 19 nt, Homo sapiens
agguaccgauuucugcuaa

SEQ ID NO: 235190 - RNA, 19 nt, Homo sapiens
uuccagaaccggaggauga

SEQ ID NO: 235191 - RNA, 19 nt, Homo sapiens
gcccugggacugacagaga

SEQ ID NO: 235192 - RNA, 19 nt, Homo sapiens
gagcucuuauuucgucaac

SEQ ID NO: 235193 - RNA, 19 nt, Homo sapiens
gaaagaaaaggauuuaagc

SEQ ID NO: 235194 - RNA, 19 nt, Homo sapiens
cuagugguaguaucucgua

SEQ ID NO: 235195 - RNA, 19 nt, Homo sapiens
cagaagggcgacaagaagu

SEQ ID NO: 235196 - RNA, 19 nt, Homo sapiens
gagaacaacaaagacaagu

SEQ ID NO: 235197 - RNA, 19 nt, Homo sapiens
gcaacgccagagccuauuc

SEQ ID NO: 235198 - RNA, 19 nt, Homo sapiens
uagguuuacugugaagaga

SEQ ID NO: 235199 - RNA, 19 nt, Homo sapiens
cucucuggcuucucucuuu

SEQ ID NO: 235200 - RNA, 19 nt, Homo sapiens
cuuugaacgugcuucuuug

SEQ ID NO: 235201 - RNA, 19 nt, Homo sapiens
gcgcagaagggcgacaaga

SEQ ID NO: 235202 - RNA, 19 nt, Homo sapiens
gaggagcuggagaaacaga

SEQ ID NO: 235203 - RNA, 19 nt, Homo sapiens
gggagggcuaauuauauau

SEQ ID NO: 235204 - RNA, 19 nt, Homo sapiens
uguauucuguauccgugaa

SEQ ID NO: 235205 - RNA, 19 nt, Homo sapiens
cgcagaagggcgacaagaa

SEQ ID NO: 235206 - RNA, 19 nt, Homo sapiens
agaacaacaaagacaaguu

SEQ ID NO: 235207 - RNA, 19 nt, Homo sapiens
gggcaaagaguaaagauua

SEQ ID NO: 235208 - RNA, 19 nt, Homo sapiens
agaaauaguugguuccuaa

SEQ ID NO: 235209 - RNA, 19 nt, Homo sapiens
gaucauaagucacgagagu

SEQ ID NO: 235210 - RNA, 19 nt, Homo sapiens
gaaccucccuccuuuccuu

SEQ ID NO: 235211 - RNA, 19 nt, Homo sapiens
gugauugucucgcuuguuu

SEQ ID NO: 235212 - RNA, 19 nt, Homo sapiens
gaccaucgcacaccaaauu

SEQ ID NO: 235213 - RNA, 19 nt, Homo sapiens
ccuagaaccucccuccuuu

SEQ ID NO: 235214 - RNA, 19 nt, Homo sapiens
ggcaaagaguaaagauuaa

SEQ ID NO: 235215 - RNA, 19 nt, Homo sapiens
gagcucuaauuguuuguuu

SEQ ID NO: 235216 - RNA, 19 nt, Homo sapiens
ggacauuccaguagaaguu

SEQ ID NO: 235217 - RNA, 19 nt, Homo sapiens
gauaaugucugagaauguc

SEQ ID NO: 235218 - RNA, 19 nt, Homo sapiens
gggaggccgugcugucuaa

SEQ ID NO: 235219 - RNA, 19 nt, Homo sapiens
cccaaaggcugcagcauug

SEQ ID NO: 235220 - RNA, 19 nt, Homo sapiens
gaguuucuguucaauaugu

SEQ ID NO: 235221 - RNA, 19 nt, Homo sapiens
gagaauuuauugugaaucg

SEQ ID NO: 235222 - RNA, 19 nt, Homo sapiens
gcucugaaaucaacucucu

SEQ ID NO: 235223 - RNA, 19 nt, Homo sapiens
guagagccuugacaauguu

SEQ ID NO: 235224 - RNA, 19 nt, Homo sapiens
cagcagacauccacacaca

SEQ ID NO: 235225 - RNA, 19 nt, Homo sapiens
cguagagccuugacaaugu

SEQ ID NO: 235226 - RNA, 19 nt, Homo sapiens
gaagauagaaauaguuggu

SEQ ID NO: 235227 - RNA, 19 nt, Homo sapiens
ggagaaaguuuuguugauu

SEQ ID NO: 235228 - RNA, 19 nt, Homo sapiens
gugcuuguguuucgugauu

SEQ ID NO: 235229 - RNA, 19 nt, Homo sapiens
gggagucucucuuccaagu

SEQ ID NO: 235230 - RNA, 19 nt, Homo sapiens
gaaggaguuucuguucaau

SEQ ID NO: 235231 - RNA, 19 nt, Homo sapiens
gaaacagucccgcgugcaa

SEQ ID NO: 235232 - RNA, 19 nt, Homo sapiens
cgaaugagaauuuauugug

SEQ ID NO: 235233 - RNA, 19 nt, Homo sapiens
cuacacagcucagcagaca

SEQ ID NO: 235234 - RNA, 19 nt, Homo sapiens
ucaacucucuucggucgua

SEQ ID NO: 235235 - RNA, 19 nt, Homo sapiens
ugcaggaaauguuuaauuc

SEQ ID NO: 235236 - RNA, 19 nt, Homo sapiens
aauaguugguuccuaagaa

SEQ ID NO: 235237 - RNA, 19 nt, Homo sapiens
gcccaaaggcugcagcauu

SEQ ID NO: 235238 - RNA, 19 nt, Homo sapiens
ggaagauggagcaaaccua

SEQ ID NO: 235239 - RNA, 19 nt, Homo sapiens
caaccaccauucagucaag

SEQ ID NO: 235240 - RNA, 19 nt, Homo sapiens
ccuaguaugcccuguaauu

SEQ ID NO: 235241 - RNA, 19 nt, Homo sapiens
ggagcagggcaaagaguaa

SEQ ID NO: 235242 - RNA, 19 nt, Homo sapiens
aaagagaggccggaucaaa

SEQ ID NO: 235243 - RNA, 19 nt, Homo sapiens
gccaggagaguccgaauga

SEQ ID NO: 235244 - RNA, 19 nt, Homo sapiens
guucaucugugcaccacuu

SEQ ID NO: 235245 - RNA, 19 nt, Homo sapiens
cagggacacuccaacucua

SEQ ID NO: 235246 - RNA, 19 nt, Homo sapiens
aggaguuucuguucaauau

SEQ ID NO: 235247 - RNA, 19 nt, Homo sapiens
gccgugcugucuaaucaaa

SEQ ID NO: 235248 - RNA, 19 nt, Homo sapiens
cagucaagcuccuaguaug

SEQ ID NO: 235249 - RNA, 19 nt, Homo sapiens
ccaucucacucuuaguuau

SEQ ID NO: 235250 - RNA, 19 nt, Homo sapiens
ugaaauugugcuuguguuu

SEQ ID NO: 235251 - RNA, 19 nt, Homo sapiens
gcagacauccacacacagu

SEQ ID NO: 235252 - RNA, 19 nt, Homo sapiens
gcacgcccgaguacaguuu

SEQ ID NO: 235253 - RNA, 19 nt, Homo sapiens
gcuagaaaguacaagaaaa

SEQ ID NO: 235254 - RNA, 19 nt, Homo sapiens
ggauaaugucugagaaugu

SEQ ID NO: 235255 - RNA, 19 nt, Homo sapiens
agacauccacacacaguaa

SEQ ID NO: 235256 - RNA, 19 nt, Homo sapiens
acaaagagaggccggauca

SEQ ID NO: 235257 - RNA, 19 nt, Homo sapiens
gaguccgaaugagaauuua

SEQ ID NO: 235258 - RNA, 19 nt, Homo sapiens
cagcuugccuguuucuucu

SEQ ID NO: 235259 - RNA, 19 nt, Homo sapiens
gaauaaggagcagggcaaa

SEQ ID NO: 235260 - RNA, 19 nt, Homo sapiens
cggauaaugucugagaaug

SEQ ID NO: 235261 - RNA, 19 nt, Homo sapiens
gugaaauugugcuuguguu

SEQ ID NO: 235262 - RNA, 19 nt, Homo sapiens
gacuguagcuucucuugcu

SEQ ID NO: 235263 - RNA, 19 nt, Homo sapiens
ccaccaacauauacauuuu

SEQ ID NO: 235264 - RNA, 19 nt, Homo sapiens
cuaguaugcccuguaauuu

SEQ ID NO: 235265 - RNA, 19 nt, Homo sapiens
gagcagggcaaagaguaaa

SEQ ID NO: 235266 - RNA, 19 nt, Homo sapiens
gaaggaagcgaggacaaag

SEQ ID NO: 235267 - RNA, 19 nt, Homo sapiens
cgaaggaagcgaggacaaa

SEQ ID NO: 235268 - RNA, 19 nt, Homo sapiens
ggucguagagccuugacaa

SEQ ID NO: 235269 - RNA, 19 nt, Homo sapiens
caggagaguccgaaugaga

SEQ ID NO: 235270 - RNA, 19 nt, Homo sapiens
uaucuuagguggagcuacu

SEQ ID NO: 235271 - RNA, 19 nt, Homo sapiens
gggcuagaaaguacaagaa

SEQ ID NO: 235272 - RNA, 19 nt, Homo sapiens
caauaaaauuugcgaagga

SEQ ID NO: 235273 - RNA, 19 nt, Homo sapiens
uagaaauaguugguuccua

SEQ ID NO: 235274 - RNA, 19 nt, Homo sapiens
ggagcuagagaaggaguuu

SEQ ID NO: 235275 - RNA, 19 nt, Homo sapiens
uguguuucgugauuucuuu

SEQ ID NO: 235276 - RNA, 19 nt, Homo sapiens
cagcauugccauaccauuc

SEQ ID NO: 235277 - RNA, 19 nt, Homo sapiens
ugucugggauguauucaag

SEQ ID NO: 235278 - RNA, 19 nt, Homo sapiens
ccagucaagcuccuaguau

SEQ ID NO: 235279 - RNA, 19 nt, Homo sapiens
gaaauaguugguuccuaag

SEQ ID NO: 235280 - RNA, 19 nt, Homo sapiens
agaguccgaaugagaauuu

SEQ ID NO: 235281 - RNA, 19 nt, Homo sapiens
cuccuaguaugcccuguaa

SEQ ID NO: 235282 - RNA, 19 nt, Homo sapiens
gugaugggccacaaggaaa

SEQ ID NO: 235283 - RNA, 19 nt, Homo sapiens
cgugcugucuaaucaaaga

SEQ ID NO: 235284 - RNA, 19 nt, Homo sapiens
aauguuuaauuccgcauga

SEQ ID NO: 235285 - RNA, 19 nt, Homo sapiens
gagcucacaaccaccauuc

SEQ ID NO: 235286 - RNA, 19 nt, Homo sapiens
acuuccagcuugccuguuu

SEQ ID NO: 235287 - RNA, 19 nt, Homo sapiens
aagggagucucucuuccaa

SEQ ID NO: 235288 - RNA, 19 nt, Homo sapiens
gacauuccaguagaaguuu

SEQ ID NO: 235289 - RNA, 19 nt, Homo sapiens
gcaaggggacauuccagua

SEQ ID NO: 235290 - RNA, 19 nt, Homo sapiens
gggccuggaugcagaucug

SEQ ID NO: 235291 - RNA, 19 nt, Homo sapiens
ggagaguccgaaugagaau

SEQ ID NO: 235292 - RNA, 19 nt, Homo sapiens
gugcaccacuugacagacu

SEQ ID NO: 235293 - RNA, 19 nt, Homo sapiens
ggucaaacugugggucgua

SEQ ID NO: 235294 - RNA, 19 nt, Homo sapiens
ccaccucccaccaacauau

SEQ ID NO: 235295 - RNA, 19 nt, Homo sapiens
ggcuagaaaguacaagaaa

SEQ ID NO: 235296 - RNA, 19 nt, Homo sapiens
auaguugguuccuaagaau

SEQ ID NO: 235297 - RNA, 19 nt, Homo sapiens
gcuuguguuucgugauuuc

SEQ ID NO: 235298 - RNA, 19 nt, Homo sapiens
aaauugugcuuguguuucg

SEQ ID NO: 235299 - RNA, 19 nt, Homo sapiens
guccgaaugagaauuuauu

SEQ ID NO: 235300 - RNA, 19 nt, Homo sapiens
cucccuagcucugaaauca

SEQ ID NO: 235301 - RNA, 19 nt, Homo sapiens
caaaagaaggucaaacugu

SEQ ID NO: 235302 - RNA, 19 nt, Homo sapiens
uuaugaagguaucuuaggu

SEQ ID NO: 235303 - RNA, 19 nt, Homo sapiens
ugaggugacacuccaguug

SEQ ID NO: 235304 - RNA, 19 nt, Homo sapiens
gcagggcaaagaguaaaga

SEQ ID NO: 235305 - RNA, 19 nt, Homo sapiens
gcgcugucccuacaccaaa

SEQ ID NO: 235306 - RNA, 19 nt, Homo sapiens
gucgugaaauugugcuugu

SEQ ID NO: 235307 - RNA, 19 nt, Homo sapiens
acacacaaauugacucuua

SEQ ID NO: 235308 - RNA, 19 nt, Homo sapiens
ggaauuagagaaagaguuu

SEQ ID NO: 235309 - RNA, 19 nt, Homo sapiens
cuacaucgauccgaaauuu

SEQ ID NO: 235310 - RNA, 19 nt, Homo sapiens
ccagaggguuggaaauuaa

SEQ ID NO: 235311 - RNA, 19 nt, Homo sapiens
gccagaggguuggaaauua

SEQ ID NO: 235312 - RNA, 19 nt, Homo sapiens
uugcaacucuccuuaauuu

SEQ ID NO: 235313 - RNA, 19 nt, Homo sapiens
gaacacaguccggaauauu

SEQ ID NO: 235314 - RNA, 19 nt, Homo sapiens
gggcaucucucucuuccuu

SEQ ID NO: 235315 - RNA, 19 nt, Homo sapiens
ggacauuaccagguuauaa

SEQ ID NO: 235316 - RNA, 19 nt, Homo sapiens
gcagcaaguccuggaauua

SEQ ID NO: 235317 - RNA, 19 nt, Homo sapiens
gcaagcaacccauagucua

SEQ ID NO: 235318 - RNA, 19 nt, Homo sapiens
uguaagagccuaaccauug

SEQ ID NO: 235319 - RNA, 19 nt, Homo sapiens
gacauuaccagguuauaaa

SEQ ID NO: 235320 - RNA, 19 nt, Homo sapiens
ggaaauuaaugaucaugag

SEQ ID NO: 235321 - RNA, 19 nt, Homo sapiens
cagaggacauuaccagguu

SEQ ID NO: 235322 - RNA, 19 nt, Homo sapiens
cguauuugauggacucuaa

SEQ ID NO: 235323 - RNA, 19 nt, Homo sapiens
cuacaucccugaacacagu

SEQ ID NO: 235324 - RNA, 19 nt, Homo sapiens
gguuggaaauuaaugauca

SEQ ID NO: 235325 - RNA, 19 nt, Homo sapiens
ccugggcgcucccuucauu

SEQ ID NO: 235326 - RNA, 19 nt, Homo sapiens
gauccgaaauuuccuccau

SEQ ID NO: 235327 - RNA, 19 nt, Homo sapiens
aucaugagcucguauuuga

SEQ ID NO: 235328 - RNA, 19 nt, Homo sapiens
ggcagcaaguccuggaauu

SEQ ID NO: 235329 - RNA, 19 nt, Homo sapiens
agaaaugacgucagaauca

SEQ ID NO: 235330 - RNA, 19 nt, Homo sapiens
gaucaugagcucguauuug

SEQ ID NO: 235331 - RNA, 19 nt, Homo sapiens
guaagagccuaaccauugc

SEQ ID NO: 235332 - RNA, 19 nt, Homo sapiens
agcaugugauguugucuua

SEQ ID NO: 235333 - RNA, 19 nt, Homo sapiens
ccaaaaccgucgcaugaaa

SEQ ID NO: 235334 - RNA, 19 nt, Homo sapiens
aacacaguccggaauauua

SEQ ID NO: 235335 - RNA, 19 nt, Homo sapiens
gcaacgggcagaggacauu

SEQ ID NO: 235336 - RNA, 19 nt, Homo sapiens
ggagagagggagagugaca

SEQ ID NO: 235337 - RNA, 19 nt, Homo sapiens
gaaugcaggagcaggaguu

SEQ ID NO: 235338 - RNA, 19 nt, Homo sapiens
ggccagaggguuggaaauu

SEQ ID NO: 235339 - RNA, 19 nt, Homo sapiens
agaggacauuaccagguua

SEQ ID NO: 235340 - RNA, 19 nt, Homo sapiens
gcacggugaaccccaauua

SEQ ID NO: 235341 - RNA, 19 nt, Homo sapiens
ugaacacaguccggaauau

SEQ ID NO: 235342 - RNA, 19 nt, Homo sapiens
ccagaaaugacgucagaau

SEQ ID NO: 235343 - RNA, 19 nt, Homo sapiens
gauguugucuuagcauggu

SEQ ID NO: 235344 - RNA, 19 nt, Homo sapiens
uaacuacaucgauccgaaa

SEQ ID NO: 235345 - RNA, 19 nt, Homo sapiens
cuccagaaaugacgucaga

SEQ ID NO: 235346 - RNA, 19 nt, Homo sapiens
aaagagagugggagagaga

SEQ ID NO: 235347 - RNA, 19 nt, Homo sapiens
gcaacucuccuuaauuuug

SEQ ID NO: 235348 - RNA, 19 nt, Homo sapiens
caacgggcagaggacauua

SEQ ID NO: 235349 - RNA, 19 nt, Homo sapiens
gaaggagaaggaucgagau

SEQ ID NO: 235350 - RNA, 19 nt, Homo sapiens
ggagagagagaggcagaga

SEQ ID NO: 235351 - RNA, 19 nt, Homo sapiens
ggucuggcuugggugaauu

SEQ ID NO: 235352 - RNA, 19 nt, Homo sapiens
caugagcucguauuugaug

SEQ ID NO: 235353 - RNA, 19 nt, Homo sapiens
ggaagacgagaaagagagu

SEQ ID NO: 235354 - RNA, 19 nt, Homo sapiens
gaaugagggaagacgagaa

SEQ ID NO: 235355 - RNA, 19 nt, Homo sapiens
cacacaaauugacucuuau

SEQ ID NO: 235356 - RNA, 19 nt, Homo sapiens
gaggguuggaaauuaauga

SEQ ID NO: 235357 - RNA, 19 nt, Homo sapiens
gcaugaaauggaagaagga

SEQ ID NO: 235358 - RNA, 19 nt, Homo sapiens
cggcagcggcacagaauga

SEQ ID NO: 235359 - RNA, 19 nt, Homo sapiens
uuaagcaugugauguuguc

SEQ ID NO: 235360 - RNA, 19 nt, Homo sapiens
uaaugaucaugagcucgua

SEQ ID NO: 235361 - RNA, 19 nt, Homo sapiens
agaaagagagugggagaga

SEQ ID NO: 235362 - RNA, 19 nt, Homo sapiens
ugagggaagacgagaaaga

SEQ ID NO: 235363 - RNA, 19 nt, Homo sapiens
uaccugacccgaaggagaa

SEQ ID NO: 235364 - RNA, 19 nt, Homo sapiens
ccuugucccuugucaguuc

SEQ ID NO: 235365 - RNA, 19 nt, Homo sapiens
cagcaaguccuggaauuag

SEQ ID NO: 235366 - RNA, 19 nt, Homo sapiens
caagcaacccauagucuac

SEQ ID NO: 235367 - RNA, 19 nt, Homo sapiens
cagaaaugacgucagaauc

SEQ ID NO: 235368 - RNA, 19 nt, Homo sapiens
caacucuccuuaauuuugu

SEQ ID NO: 235369 - RNA, 19 nt, Homo sapiens
caugugauguugucuuagc

SEQ ID NO: 235370 - RNA, 19 nt, Homo sapiens
ccccagaccuccagaaaug

SEQ ID NO: 235371 - RNA, 19 nt, Homo sapiens
gagggaagacgagaaagag

SEQ ID NO: 235372 - RNA, 19 nt, Homo sapiens
ucuugcaacucuccuuaau

SEQ ID NO: 235373 - RNA, 19 nt, Homo sapiens
gcaaguccuggaauuagag

SEQ ID NO: 235374 - RNA, 19 nt, Homo sapiens
agcaaguccuggaauuaga

SEQ ID NO: 235375 - RNA, 19 nt, Homo sapiens
cugaacacaguccggaaua

SEQ ID NO: 235376 - RNA, 19 nt, Homo sapiens
aaugagggaagacgagaaa

SEQ ID NO: 235377 - RNA, 19 nt, Homo sapiens
caaacagacaaaacagaua

SEQ ID NO: 235378 - RNA, 19 nt, Homo sapiens
cuugucaguuccaaacaga

SEQ ID NO: 235379 - RNA, 19 nt, Homo sapiens
gaggacauuaccagguuau

SEQ ID NO: 235380 - RNA, 19 nt, Homo sapiens
gcucgaggacagccuauac

SEQ ID NO: 235381 - RNA, 19 nt, Homo sapiens
ggacucuaacuacaucgau

SEQ ID NO: 235382 - RNA, 19 nt, Homo sapiens
ggcgcucccuucauuagca

SEQ ID NO: 235383 - RNA, 19 nt, Homo sapiens
uugauggacucuaacuaca

SEQ ID NO: 235384 - RNA, 19 nt, Homo sapiens
cuucuugcaacucuccuua

SEQ ID NO: 235385 - RNA, 19 nt, Homo sapiens
acacacaaauugacucuua

SEQ ID NO: 235386 - RNA, 19 nt, Homo sapiens
ggaauuagagaaagaguuu

SEQ ID NO: 235387 - RNA, 19 nt, Homo sapiens
cuacaucgauccgaaauuu

SEQ ID NO: 235388 - RNA, 19 nt, Homo sapiens
gaacacaguccggaauauu

SEQ ID NO: 235389 - RNA, 19 nt, Homo sapiens
ggacauuaccagguuauaa

SEQ ID NO: 235390 - RNA, 19 nt, Homo sapiens
gcagcaaguccuggaauua

SEQ ID NO: 235391 - RNA, 19 nt, Homo sapiens
gcaagcaacccauagucua

SEQ ID NO: 235392 - RNA, 19 nt, Homo sapiens
gacauuaccagguuauaaa

SEQ ID NO: 235393 - RNA, 19 nt, Homo sapiens
cagaggacauuaccagguu

SEQ ID NO: 235394 - RNA, 19 nt, Homo sapiens
cguauuugauggacucuaa

SEQ ID NO: 235395 - RNA, 19 nt, Homo sapiens
cuacaucccugaacacagu

SEQ ID NO: 235396 - RNA, 19 nt, Homo sapiens
gauccgaaauuuccuccau

SEQ ID NO: 235397 - RNA, 19 nt, Homo sapiens
aucaugagcucguauuuga

SEQ ID NO: 235398 - RNA, 19 nt, Homo sapiens
ggcagcaaguccuggaauu

SEQ ID NO: 235399 - RNA, 19 nt, Homo sapiens
gaucaugagcucguauuug

SEQ ID NO: 235400 - RNA, 19 nt, Homo sapiens
cuccagaaauuaaugauca

SEQ ID NO: 235401 - RNA, 19 nt, Homo sapiens
agcaugugauguugucuua

SEQ ID NO: 235402 - RNA, 19 nt, Homo sapiens
ccaaaaccgucgcaugaaa

SEQ ID NO: 235403 - RNA, 19 nt, Homo sapiens
aacacaguccggaauauua

SEQ ID NO: 235404 - RNA, 19 nt, Homo sapiens
gcaacgggcagaggacauu

SEQ ID NO: 235405 - RNA, 19 nt, Homo sapiens
agaggacauuaccagguua

SEQ ID NO: 235406 - RNA, 19 nt, Homo sapiens
gcacggugaaccccaauua

SEQ ID NO: 235407 - RNA, 19 nt, Homo sapiens
ugaacacaguccggaauau

SEQ ID NO: 235408 - RNA, 19 nt, Homo sapiens
gauguugucuuagcauggu

SEQ ID NO: 235409 - RNA, 19 nt, Homo sapiens
uaacuacaucgauccgaaa

SEQ ID NO: 235410 - RNA, 19 nt, Homo sapiens
caacgggcagaggacauua

SEQ ID NO: 235411 - RNA, 19 nt, Homo sapiens
gaaggagaaggaucgagau

SEQ ID NO: 235412 - RNA, 19 nt, Homo sapiens
ggucuggcuugggugaauu

SEQ ID NO: 235413 - RNA, 19 nt, Homo sapiens
caugagcucguauuugaug

SEQ ID NO: 235414 - RNA, 19 nt, Homo sapiens
cacacaaauugacucuuau

SEQ ID NO: 235415 - RNA, 19 nt, Homo sapiens
gcaugaaauggaagaagga

SEQ ID NO: 235416 - RNA, 19 nt, Homo sapiens
uuaagcaugugauguuguc

SEQ ID NO: 235417 - RNA, 19 nt, Homo sapiens
uaaugaucaugagcucgua

SEQ ID NO: 235418 - RNA, 19 nt, Homo sapiens
uaccugacccgaaggagaa

SEQ ID NO: 235419 - RNA, 19 nt, Homo sapiens
ccuugucccuugucaguuc

SEQ ID NO: 235420 - RNA, 19 nt, Homo sapiens
cagcaaguccuggaauuag

SEQ ID NO: 235421 - RNA, 19 nt, Homo sapiens
ccacuccagaaauuaauga

SEQ ID NO: 235422 - RNA, 19 nt, Homo sapiens
caagcaacccauagucuac

SEQ ID NO: 235423 - RNA, 19 nt, Homo sapiens
caugugauguugucuuagc

SEQ ID NO: 235424 - RNA, 19 nt, Homo sapiens
gcaaguccuggaauuagag

SEQ ID NO: 235425 - RNA, 19 nt, Homo sapiens
agcaaguccuggaauuaga

SEQ ID NO: 235426 - RNA, 19 nt, Homo sapiens
cugaacacaguccggaaua

SEQ ID NO: 235427 - RNA, 19 nt, Homo sapiens
caaacagacaaaacagaua

SEQ ID NO: 235428 - RNA, 19 nt, Homo sapiens
cuugucaguuccaaacaga

SEQ ID NO: 235429 - RNA, 19 nt, Homo sapiens
ggacucuaacuacaucgau

SEQ ID NO: 235430 - RNA, 19 nt, Homo sapiens
gaggacauuaccagguuau

SEQ ID NO: 235431 - RNA, 19 nt, Homo sapiens
gcucgaggacagccuauac

SEQ ID NO: 235432 - RNA, 19 nt, Homo sapiens
uugauggacucuaacuaca

SEQ ID NO: 235433 - RNA, 19 nt, Homo sapiens
gaagaaagauuccaaaaug

SEQ ID NO: 235434 - RNA, 19 nt, Homo sapiens
gcauagagaucgccaacaa

SEQ ID NO: 235435 - RNA, 19 nt, Homo sapiens
caaaucacccuuaaucaaa

SEQ ID NO: 235436 - RNA, 19 nt, Homo sapiens
ggauuggacuuaagcauca

SEQ ID NO: 235437 - RNA, 19 nt, Homo sapiens
ccuauaacaugcaaacuug

SEQ ID NO: 235438 - RNA, 19 nt, Homo sapiens
ccaauaucccugccuauaa

SEQ ID NO: 235439 - RNA, 19 nt, Homo sapiens
gguccuuccugaaacuaua

SEQ ID NO: 235440 - RNA, 19 nt, Homo sapiens
ucacaaaucacccuuaauc

SEQ ID NO: 235441 - RNA, 19 nt, Homo sapiens
cacaguugcucuaugcuuu

SEQ ID NO: 235442 - RNA, 19 nt, Homo sapiens
uaaccucgcccucuccuuu

SEQ ID NO: 235443 - RNA, 19 nt, Homo sapiens
guagccaauucauucuaua

SEQ ID NO: 235444 - RNA, 19 nt, Homo sapiens
caauaucccugccuauaac

SEQ ID NO: 235445 - RNA, 19 nt, Homo sapiens
gcgagagucuggcccuaga

SEQ ID NO: 235446 - RNA, 19 nt, Homo sapiens
gcaaacuugugggaacuau

SEQ ID NO: 235447 - RNA, 19 nt, Homo sapiens
cuacguagccaauucauuc

SEQ ID NO: 235448 - RNA, 19 nt, Homo sapiens
aaagagagaacaggacuaa

SEQ ID NO: 235449 - RNA, 19 nt, Homo sapiens
ggacuuaagcaucacuuuc

SEQ ID NO: 235450 - RNA, 19 nt, Homo sapiens
ccaauucauucuauaagca

SEQ ID NO: 235451 - RNA, 19 nt, Homo sapiens
agucacaaaucacccuuaa

SEQ ID NO: 235452 - RNA, 19 nt, Homo sapiens
ggaugaaguggaagaaaga

SEQ ID NO: 235453 - RNA, 19 nt, Homo sapiens
gcuccuacguagccaauuc

SEQ ID NO: 235454 - RNA, 19 nt, Homo sapiens
acaaaucacccuuaaucaa

SEQ ID NO: 235455 - RNA, 19 nt, Homo sapiens
cauagucccugccacgaau

SEQ ID NO: 235456 - RNA, 19 nt, Homo sapiens
cgacuaaacuagauuuuca

SEQ ID NO: 235457 - RNA, 19 nt, Homo sapiens
ugaccaaacugcacaugag

SEQ ID NO: 235458 - RNA, 19 nt, Homo sapiens
gcccuuugcugucccauag

SEQ ID NO: 235459 - RNA, 19 nt, Homo sapiens
ggaacucgagaaagaauuc

SEQ ID NO: 235460 - RNA, 19 nt, Homo sapiens
guacugcuacggcggauug

SEQ ID NO: 235461 - RNA, 19 nt, Homo sapiens
agagaucgccaacaacuug

SEQ ID NO: 235462 - RNA, 19 nt, Homo sapiens
cguacaggcuggcgcagaa

SEQ ID NO: 235463 - RNA, 19 nt, Homo sapiens
cgaagcggcuccucugaac

SEQ ID NO: 235464 - RNA, 19 nt, Homo sapiens
cguagccaauucauucuau

SEQ ID NO: 235465 - RNA, 19 nt, Homo sapiens
ugaaguggaagaaagauuc

SEQ ID NO: 235466 - RNA, 19 nt, Homo sapiens
gcucuaugcuuuccaaacc

SEQ ID NO: 235467 - RNA, 19 nt, Homo sapiens
cgccuuuccucucuauauu

SEQ ID NO: 235468 - RNA, 19 nt, Homo sapiens
ccaacuauuuauugacucu

SEQ ID NO: 235469 - RNA, 19 nt, Homo sapiens
cagauuuacccguggauga

SEQ ID NO: 235470 - RNA, 19 nt, Homo sapiens
cccaauaucccugccuaua

SEQ ID NO: 235471 - RNA, 19 nt, Homo sapiens
cuacggcggauuggacuua

SEQ ID NO: 235472 - RNA, 19 nt, Homo sapiens
uucaaagagucacaaauca

SEQ ID NO: 235473 - RNA, 19 nt, Homo sapiens
cuucaaagagucacaaauc

SEQ ID NO: 235474 - RNA, 19 nt, Homo sapiens
gccuauaacaugcaaacuu

SEQ ID NO: 235475 - RNA, 19 nt, Homo sapiens
guccaacuauuuauugacu

SEQ ID NO: 235476 - RNA, 19 nt, Homo sapiens
aaugagagacagaucaaga

SEQ ID NO: 235477 - RNA, 19 nt, Homo sapiens
ucaaugagagacagaucaa

SEQ ID NO: 235478 - RNA, 19 nt, Homo sapiens
uaaagagagaacaggacua

SEQ ID NO: 235479 - RNA, 19 nt, Homo sapiens
gccaauucauucuauaagc

SEQ ID NO: 235480 - RNA, 19 nt, Homo sapiens
aggaugaaguggaagaaag

SEQ ID NO: 235481 - RNA, 19 nt, Homo sapiens
cucuggaacucgagaaaga

SEQ ID NO: 235482 - RNA, 19 nt, Homo sapiens
gagucacaaaucacccuua

SEQ ID NO: 235483 - RNA, 19 nt, Homo sapiens
ccacaguugcucuaugcuu

SEQ ID NO: 235484 - RNA, 19 nt, Homo sapiens
ccuuguagcgacuaaacua

SEQ ID NO: 235485 - RNA, 19 nt, Homo sapiens
ccuuuccucucuauauuuc

SEQ ID NO: 235486 - RNA, 19 nt, Homo sapiens
acccauugcuguuguccaa

SEQ ID NO: 235487 - RNA, 19 nt, Homo sapiens
gcaggaugaaguggaagaa

SEQ ID NO: 235488 - RNA, 19 nt, Homo sapiens
uuccagaaccgcaggauga

SEQ ID NO: 235489 - RNA, 19 nt, Homo sapiens
uguagcgacuaaacuagau

SEQ ID NO: 235490 - RNA, 19 nt, Homo sapiens
aaacuugugggaacuaugg

SEQ ID NO: 235491 - RNA, 19 nt, Homo sapiens
cacaaaucacccuuaauca

SEQ ID NO: 235492 - RNA, 19 nt, Homo sapiens
uagcgacuaaacuagauuu

SEQ ID NO: 235493 - RNA, 19 nt, Homo sapiens
cagaaccgcaggaugaagu

SEQ ID NO: 235494 - RNA, 19 nt, Homo sapiens
gacgaagcggcuccucuga

SEQ ID NO: 235495 - RNA, 19 nt, Homo sapiens
ucaaauaaagagagaacag

SEQ ID NO: 235496 - RNA, 19 nt, Homo sapiens
caacuucaaagagucacaa

SEQ ID NO: 235497 - RNA, 19 nt, Homo sapiens
gccuuuccucucuauauuu

SEQ ID NO: 235498 - RNA, 19 nt, Homo sapiens
cgccaugagcuccuacgua

SEQ ID NO: 235499 - RNA, 19 nt, Homo sapiens
ccauagucccugccacgaa

SEQ ID NO: 235500 - RNA, 19 nt, Homo sapiens
aaccuuaucuccacaaccu

SEQ ID NO: 235501 - RNA, 19 nt, Homo sapiens
ucuaugcuuuccaaaccuu

SEQ ID NO: 235502 - RNA, 19 nt, Homo sapiens
guugcucuaugcuuuccaa

SEQ ID NO: 235503 - RNA, 19 nt, Homo sapiens
uauaacaugcaaacuugug

SEQ ID NO: 235504 - RNA, 19 nt, Homo sapiens
gcaaagggaugaauuccua

SEQ ID NO: 235505 - RNA, 19 nt, Homo sapiens
agaaagacaugcucucaaa

SEQ ID NO: 235506 - RNA, 19 nt, Homo sapiens
gaaagccaguauccagauu

SEQ ID NO: 235507 - RNA, 19 nt, Homo sapiens
gguccguucucgaauauuu

SEQ ID NO: 235508 - RNA, 19 nt, Homo sapiens
gaacucagacucuacagau

SEQ ID NO: 235509 - RNA, 19 nt, Homo sapiens
caaaacaccuuaggacaua

SEQ ID NO: 235510 - RNA, 19 nt, Homo sapiens
gauuggagccgucccuaua

SEQ ID NO: 235511 - RNA, 19 nt, Homo sapiens
uguggucucuguauuuaua

SEQ ID NO: 235512 - RNA, 19 nt, Homo sapiens
guguuacccuccuguauaa

SEQ ID NO: 235513 - RNA, 19 nt, Homo sapiens
ucacuucaaucgcuaccua

SEQ ID NO: 235514 - RNA, 19 nt, Homo sapiens
gagaaugucguguucaguu

SEQ ID NO: 235515 - RNA, 19 nt, Homo sapiens
caaacuggagacagaaaua

SEQ ID NO: 235516 - RNA, 19 nt, Homo sapiens
aauaaaucccuucguguua

SEQ ID NO: 235517 - RNA, 19 nt, Homo sapiens
cuauggaucuaauuccuuu

SEQ ID NO: 235518 - RNA, 19 nt, Homo sapiens
aagccaguauccagauuua

SEQ ID NO: 235519 - RNA, 19 nt, Homo sapiens
aaucacacacucuguauuu

SEQ ID NO: 235520 - RNA, 19 nt, Homo sapiens
cagaagaggagaagcagaa

SEQ ID NO: 235521 - RNA, 19 nt, Homo sapiens
ucacuaacccuuccuuauc

SEQ ID NO: 235522 - RNA, 19 nt, Homo sapiens
aaauaaaucccuucguguu

SEQ ID NO: 235523 - RNA, 19 nt, Homo sapiens
ucaauuccaccgccuauga

SEQ ID NO: 235524 - RNA, 19 nt, Homo sapiens
cagauugcccuccaaguga

SEQ ID NO: 235525 - RNA, 19 nt, Homo sapiens
ccuccucgcucccuugcua

SEQ ID NO: 235526 - RNA, 19 nt, Homo sapiens
cguguuacccuccuguaua

SEQ ID NO: 235527 - RNA, 19 nt, Homo sapiens
caguguuccuauccaauuu

SEQ ID NO: 235528 - RNA, 19 nt, Homo sapiens
ggagaagcagaaagaguga

SEQ ID NO: 235529 - RNA, 19 nt, Homo sapiens
gaucuacucgacucccuuu

SEQ ID NO: 235530 - RNA, 19 nt, Homo sapiens
uuuguggucucuguauuua

SEQ ID NO: 235531 - RNA, 19 nt, Homo sapiens
ggaacuggagaaggaauuu

SEQ ID NO: 235532 - RNA, 19 nt, Homo sapiens
guuccuauccaauuucaaa

SEQ ID NO: 235533 - RNA, 19 nt, Homo sapiens
aguacaaacuggagacaga

SEQ ID NO: 235534 - RNA, 19 nt, Homo sapiens
ucacacacucuguauuuau

SEQ ID NO: 235535 - RNA, 19 nt, Homo sapiens
guaugacuauggaucuaau

SEQ ID NO: 235536 - RNA, 19 nt, Homo sapiens
aaacuggagacagaaauaa

SEQ ID NO: 235537 - RNA, 19 nt, Homo sapiens
gcccagcccaggcaaauug

SEQ ID NO: 235538 - RNA, 19 nt, Homo sapiens
gaccguuucugugugaaga

SEQ ID NO: 235539 - RNA, 19 nt, Homo sapiens
agucaaacguggaccugaa

SEQ ID NO: 235540 - RNA, 19 nt, Homo sapiens
gguaaaggcaaagggauga

SEQ ID NO: 235541 - RNA, 19 nt, Homo sapiens
gugaaugacguuuguuuag

SEQ ID NO: 235542 - RNA, 19 nt, Homo sapiens
ccuaaucacacacucugua

SEQ ID NO: 235543 - RNA, 19 nt, Homo sapiens
ugaggcauuucucgaccua

SEQ ID NO: 235544 - RNA, 19 nt, Homo sapiens
cacacacucuguauuuauc

SEQ ID NO: 235545 - RNA, 19 nt, Homo sapiens
acaggagaaugucguguuc

SEQ ID NO: 235546 - RNA, 19 nt, Homo sapiens
aagaggagaagcagaaaga

SEQ ID NO: 235547 - RNA, 19 nt, Homo sapiens
agaaugucguguucaguuc

SEQ ID NO: 235548 - RNA, 19 nt, Homo sapiens
cuggguccguucucgaaua

SEQ ID NO: 235549 - RNA, 19 nt, Homo sapiens
ucaguguuccuauccaauu

SEQ ID NO: 235550 - RNA, 19 nt, Homo sapiens
caacgucgcccucaauucc

SEQ ID NO: 235551 - RNA, 19 nt, Homo sapiens
guacaaacuggagacagaa

SEQ ID NO: 235552 - RNA, 19 nt, Homo sapiens
guucucggcuugucuacag

SEQ ID NO: 235553 - RNA, 19 nt, Homo sapiens
cuggagacagaaauaaaua

SEQ ID NO: 235554 - RNA, 19 nt, Homo sapiens
gaggagaagcagaaagagu

SEQ ID NO: 235555 - RNA, 19 nt, Homo sapiens
gacguuuguuuagccagua

SEQ ID NO: 235556 - RNA, 19 nt, Homo sapiens
gaagaggagaagcagaaag

SEQ ID NO: 235557 - RNA, 19 nt, Homo sapiens
ucauagaccgaccagguaa

SEQ ID NO: 235558 - RNA, 19 nt, Homo sapiens
auuuaucacuggcacaauu

SEQ ID NO: 235559 - RNA, 19 nt, Homo sapiens
agugaaugacguuuguuua

SEQ ID NO: 235560 - RNA, 19 nt, Homo sapiens
ugugaccguuucuguguga

SEQ ID NO: 235561 - RNA, 19 nt, Homo sapiens
acagauugcccuccaagug

SEQ ID NO: 235562 - RNA, 19 nt, Homo sapiens
gaacuggagaaggaauuuc

SEQ ID NO: 235563 - RNA, 19 nt, Homo sapiens
gaaagacaugcucucaaac

SEQ ID NO: 235564 - RNA, 19 nt, Homo sapiens
cgucaguguuccuauccaa

SEQ ID NO: 235565 - RNA, 19 nt, Homo sapiens
agggaugaauuccuacuuc

SEQ ID NO: 235566 - RNA, 19 nt, Homo sapiens
gcucucaaacugcagacaa

SEQ ID NO: 235567 - RNA, 19 nt, Homo sapiens
aaaggcaaagggaugaauu

SEQ ID NO: 235568 - RNA, 19 nt, Homo sapiens
ugaaugacguuuguuuagc

SEQ ID NO: 235569 - RNA, 19 nt, Homo sapiens
aagacaugcucucaaacug

SEQ ID NO: 235570 - RNA, 19 nt, Homo sapiens
auaaaucccuucguguuac

SEQ ID NO: 235571 - RNA, 19 nt, Homo sapiens
aaaagugaaugacguuugu

SEQ ID NO: 235572 - RNA, 19 nt, Homo sapiens
uauuuguggucucuguauu

SEQ ID NO: 235573 - RNA, 19 nt, Homo sapiens
cccuggaacuggagaagga

SEQ ID NO: 235574 - RNA, 19 nt, Homo sapiens
acucagacucuacagauug

SEQ ID NO: 235575 - RNA, 19 nt, Homo sapiens
ucaccgcacaacucucuuu

SEQ ID NO: 235576 - RNA, 19 nt, Homo sapiens
ccgaccagguaaaggcaaa

SEQ ID NO: 235577 - RNA, 19 nt, Homo sapiens
cuaaucacacacucuguau

SEQ ID NO: 235578 - RNA, 19 nt, Homo sapiens
agacagaagaggagaagca

SEQ ID NO: 235579 - RNA, 19 nt, Homo sapiens
aaagacaugcucucaaacu

SEQ ID NO: 235580 - RNA, 19 nt, Homo sapiens
ggauuggagccgucccuau

SEQ ID NO: 235581 - RNA, 19 nt, Homo sapiens
aggcauuucucgaccuaug

SEQ ID NO: 235582 - RNA, 19 nt, Homo sapiens
guauuuguggucucuguau

SEQ ID NO: 235583 - RNA, 19 nt, Homo sapiens
aaucucacauccacucucu

SEQ ID NO: 235584 - RNA, 19 nt, Homo sapiens
aaagccaguauccagauuu

SEQ ID NO: 235585 - RNA, 19 nt, Homo sapiens
uaacacacagaccucaauc

SEQ ID NO: 235586 - RNA, 19 nt, Homo sapiens
aucacacacucuguauuua

SEQ ID NO: 235587 - RNA, 19 nt, Homo sapiens
gacuauggaucuaauuccu

SEQ ID NO: 235588 - RNA, 19 nt, Homo sapiens
uggguccguucucgaauau

SEQ ID NO: 235589 - RNA, 19 nt, Homo sapiens
uuacccuccuguauaaauc

SEQ ID NO: 235590 - RNA, 19 nt, Homo sapiens
guuacccuccuguauaaau

SEQ ID NO: 235591 - RNA, 19 nt, Homo sapiens
ugaccgagcgacagaucaa

SEQ ID NO: 235592 - RNA, 19 nt, Homo sapiens
caccuuaggacauaacaca

SEQ ID NO: 235593 - RNA, 19 nt, Homo sapiens
guccguucucgaauauuua

SEQ ID NO: 235594 - RNA, 19 nt, Homo sapiens
cuacucgacucccuuuuau

SEQ ID NO: 235595 - RNA, 19 nt, Homo sapiens
gcccagaaccggaucuacu

SEQ ID NO: 235596 - RNA, 19 nt, Homo sapiens
caucuaguuccgaguacaa

SEQ ID NO: 235597 - RNA, 19 nt, Homo sapiens
guauuuaucacuggcacaa

SEQ ID NO: 235598 - RNA, 19 nt, Homo sapiens
caccaacucuccccuaauc

SEQ ID NO: 235599 - RNA, 19 nt, Homo sapiens
uggaugcagcgaaugaauu

SEQ ID NO: 235600 - RNA, 19 nt, Homo sapiens
gcauuucucgaccuaugga

SEQ ID NO: 235601 - RNA, 19 nt, Homo sapiens
ccguaugacuauggaucua

SEQ ID NO: 235602 - RNA, 19 nt, Homo sapiens
aaacguggaccugaaaguc

SEQ ID NO: 235603 - RNA, 19 nt, Homo sapiens
gucaaacguggaccugaaa

SEQ ID NO: 235604 - RNA, 19 nt, Homo sapiens
agaaagacaugcucucaaa

SEQ ID NO: 235605 - RNA, 19 nt, Homo sapiens
gaaagccaguauccagauu

SEQ ID NO: 235606 - RNA, 19 nt, Homo sapiens
uugcaacucuccuuaauuu

SEQ ID NO: 235607 - RNA, 19 nt, Homo sapiens
gguccguucucgaauauuu

SEQ ID NO: 235608 - RNA, 19 nt, Homo sapiens
gaacucagacucuacagau

SEQ ID NO: 235609 - RNA, 19 nt, Homo sapiens
caaaacaccuuaggacaua

SEQ ID NO: 235610 - RNA, 19 nt, Homo sapiens
gggcaucucucucuuccuu

SEQ ID NO: 235611 - RNA, 19 nt, Homo sapiens
uguggucucuguauuuaua

SEQ ID NO: 235612 - RNA, 19 nt, Homo sapiens
guguuacccuccuguauaa

SEQ ID NO: 235613 - RNA, 19 nt, Homo sapiens
ucacuucaaucgcuaccua

SEQ ID NO: 235614 - RNA, 19 nt, Homo sapiens
gagaaugucguguucaguu

SEQ ID NO: 235615 - RNA, 19 nt, Homo sapiens
aauaaaucccuucguguua

SEQ ID NO: 235616 - RNA, 19 nt, Homo sapiens
cuauggaucuaauuccuuu

SEQ ID NO: 235617 - RNA, 19 nt, Homo sapiens
aagccaguauccagauuua

SEQ ID NO: 235618 - RNA, 19 nt, Homo sapiens
aaucacacacucuguauuu

SEQ ID NO: 235619 - RNA, 19 nt, Homo sapiens
cagaagaggagaagcagaa

SEQ ID NO: 235620 - RNA, 19 nt, Homo sapiens
aaauaaaucccuucguguu

SEQ ID NO: 235621 - RNA, 19 nt, Homo sapiens
ucaauuccaccgccuauga

SEQ ID NO: 235622 - RNA, 19 nt, Homo sapiens
cagauugcccuccaaguga

SEQ ID NO: 235623 - RNA, 19 nt, Homo sapiens
ccuccucgcucccuugcua

SEQ ID NO: 235624 - RNA, 19 nt, Homo sapiens
cguguuacccuccuguaua

SEQ ID NO: 235625 - RNA, 19 nt, Homo sapiens
caguguuccuauccaauuu

SEQ ID NO: 235626 - RNA, 19 nt, Homo sapiens
ggagaagcagaaagaguga

SEQ ID NO: 235627 - RNA, 19 nt, Homo sapiens
gaucuacucgacucccuuu

SEQ ID NO: 235628 - RNA, 19 nt, Homo sapiens
uuuguggucucuguauuua

SEQ ID NO: 235629 - RNA, 19 nt, Homo sapiens
ggaacuggagaaggaauuu

SEQ ID NO: 235630 - RNA, 19 nt, Homo sapiens
guuccuauccaauuucaaa

SEQ ID NO: 235631 - RNA, 19 nt, Homo sapiens
ucacacacucuguauuuau

SEQ ID NO: 235632 - RNA, 19 nt, Homo sapiens
guaugacuauggaucuaau

SEQ ID NO: 235633 - RNA, 19 nt, Homo sapiens
gaaugcaggagcaggaguu

SEQ ID NO: 235634 - RNA, 19 nt, Homo sapiens
ggagagagggagagugaca

SEQ ID NO: 235635 - RNA, 19 nt, Homo sapiens
gcccagcccaggcaaauug

SEQ ID NO: 235636 - RNA, 19 nt, Homo sapiens
gaccguuucugugugaaga

SEQ ID NO: 235637 - RNA, 19 nt, Homo sapiens
agucaaacguggaccugaa

SEQ ID NO: 235638 - RNA, 19 nt, Homo sapiens
gugaaugacguuuguuuag

SEQ ID NO: 235639 - RNA, 19 nt, Homo sapiens
ccuaaucacacacucugua

SEQ ID NO: 235640 - RNA, 19 nt, Homo sapiens
ugaggcauuucucgaccua

SEQ ID NO: 235641 - RNA, 19 nt, Homo sapiens
cacacacucuguauuuauc

SEQ ID NO: 235642 - RNA, 19 nt, Homo sapiens
gcaacucuccuuaauuuug

SEQ ID NO: 235643 - RNA, 19 nt, Homo sapiens
acaggagaaugucguguuc

SEQ ID NO: 235644 - RNA, 19 nt, Homo sapiens
aaagagagugggagagaga

SEQ ID NO: 235645 - RNA, 19 nt, Homo sapiens
aagaggagaagcagaaaga

SEQ ID NO: 235646 - RNA, 19 nt, Homo sapiens
agaaugucguguucaguuc

SEQ ID NO: 235647 - RNA, 19 nt, Homo sapiens
ggagagagagaggcagaga

SEQ ID NO: 235648 - RNA, 19 nt, Homo sapiens
cuggguccguucucgaaua

SEQ ID NO: 235649 - RNA, 19 nt, Homo sapiens
ucaguguuccuauccaauu

SEQ ID NO: 235650 - RNA, 19 nt, Homo sapiens
caacgucgcccucaauucc

SEQ ID NO: 235651 - RNA, 19 nt, Homo sapiens
ggaagacgagaaagagagu

SEQ ID NO: 235652 - RNA, 19 nt, Homo sapiens
gaaugagggaagacgagaa

SEQ ID NO: 235653 - RNA, 19 nt, Homo sapiens
guucucggcuugucuacag

SEQ ID NO: 235654 - RNA, 19 nt, Homo sapiens
gaggagaagcagaaagagu

SEQ ID NO: 235655 - RNA, 19 nt, Homo sapiens
gacguuuguuuagccagua

SEQ ID NO: 235656 - RNA, 19 nt, Homo sapiens
gaagaggagaagcagaaag

SEQ ID NO: 235657 - RNA, 19 nt, Homo sapiens
cggcagcggcacagaauga

SEQ ID NO: 235658 - RNA, 19 nt, Homo sapiens
auuuaucacuggcacaauu

SEQ ID NO: 235659 - RNA, 19 nt, Homo sapiens
agaaagagagugggagaga

SEQ ID NO: 235660 - RNA, 19 nt, Homo sapiens
ugagggaagacgagaaaga

SEQ ID NO: 235661 - RNA, 19 nt, Homo sapiens
agugaaugacguuuguuua

SEQ ID NO: 235662 - RNA, 19 nt, Homo sapiens
ugugaccguuucuguguga

SEQ ID NO: 235663 - RNA, 19 nt, Homo sapiens
acagauugcccuccaagug

SEQ ID NO: 235664 - RNA, 19 nt, Homo sapiens
gaacuggagaaggaauuuc

SEQ ID NO: 235665 - RNA, 19 nt, Homo sapiens
gaaagacaugcucucaaac

SEQ ID NO: 235666 - RNA, 19 nt, Homo sapiens
cgucaguguuccuauccaa

SEQ ID NO: 235667 - RNA, 19 nt, Homo sapiens
caacucuccuuaauuuugu

SEQ ID NO: 235668 - RNA, 19 nt, Homo sapiens
gcucucaaacugcagacaa

SEQ ID NO: 235669 - RNA, 19 nt, Homo sapiens
ugaaugacguuuguuuagc

SEQ ID NO: 235670 - RNA, 19 nt, Homo sapiens
aagacaugcucucaaacug

SEQ ID NO: 235671 - RNA, 19 nt, Homo sapiens
auaaaucccuucguguuac

SEQ ID NO: 235672 - RNA, 19 nt, Homo sapiens
gagggaagacgagaaagag

SEQ ID NO: 235673 - RNA, 19 nt, Homo sapiens
aaaagugaaugacguuugu

SEQ ID NO: 235674 - RNA, 19 nt, Homo sapiens
uauuuguggucucuguauu

SEQ ID NO: 235675 - RNA, 19 nt, Homo sapiens
cccuggaacuggagaagga

SEQ ID NO: 235676 - RNA, 19 nt, Homo sapiens
acucagacucuacagauug

SEQ ID NO: 235677 - RNA, 19 nt, Homo sapiens
ucaccgcacaacucucuuu

SEQ ID NO: 235678 - RNA, 19 nt, Homo sapiens
ucuugcaacucuccuuaau

SEQ ID NO: 235679 - RNA, 19 nt, Homo sapiens
cuaaucacacacucuguau

SEQ ID NO: 235680 - RNA, 19 nt, Homo sapiens
agacagaagaggagaagca

SEQ ID NO: 235681 - RNA, 19 nt, Homo sapiens
aaagacaugcucucaaacu

SEQ ID NO: 235682 - RNA, 19 nt, Homo sapiens
aggcauuucucgaccuaug

SEQ ID NO: 235683 - RNA, 19 nt, Homo sapiens
aaugagggaagacgagaaa

SEQ ID NO: 235684 - RNA, 19 nt, Homo sapiens
guauuuguggucucuguau

SEQ ID NO: 235685 - RNA, 19 nt, Homo sapiens
aaucucacauccacucucu

SEQ ID NO: 235686 - RNA, 19 nt, Homo sapiens
aaagccaguauccagauuu

SEQ ID NO: 235687 - RNA, 19 nt, Homo sapiens
uaacacacagaccucaauc

SEQ ID NO: 235688 - RNA, 19 nt, Homo sapiens
aucacacacucuguauuua

SEQ ID NO: 235689 - RNA, 19 nt, Homo sapiens
gacuauggaucuaauuccu

SEQ ID NO: 235690 - RNA, 19 nt, Homo sapiens
uggguccguucucgaauau

SEQ ID NO: 235691 - RNA, 19 nt, Homo sapiens
uuacccuccuguauaaauc

SEQ ID NO: 235692 - RNA, 19 nt, Homo sapiens
guuacccuccuguauaaau

SEQ ID NO: 235693 - RNA, 19 nt, Homo sapiens
ugaccgagcgacagaucaa

SEQ ID NO: 235694 - RNA, 19 nt, Homo sapiens
caccuuaggacauaacaca

SEQ ID NO: 235695 - RNA, 19 nt, Homo sapiens
guccguucucgaauauuua

SEQ ID NO: 235696 - RNA, 19 nt, Homo sapiens
guauuuaucacuggcacaa

SEQ ID NO: 235697 - RNA, 19 nt, Homo sapiens
caccaacucuccccuaauc

SEQ ID NO: 235698 - RNA, 19 nt, Homo sapiens
uggaugcagcgaaugaauu

SEQ ID NO: 235699 - RNA, 19 nt, Homo sapiens
ccguaugacuauggaucua

SEQ ID NO: 235700 - RNA, 19 nt, Homo sapiens
cuacucgacucccuuuuau

SEQ ID NO: 235701 - RNA, 19 nt, Homo sapiens
gcccagaaccggaucuacu

SEQ ID NO: 235702 - RNA, 19 nt, Homo sapiens
gcauuucucgaccuaugga

SEQ ID NO: 235703 - RNA, 19 nt, Homo sapiens
cuucuugcaacucuccuua

SEQ ID NO: 235704 - RNA, 19 nt, Homo sapiens
caaggccacuuaaaucaaa

SEQ ID NO: 235705 - RNA, 19 nt, Homo sapiens
ggacaaggccacuuaaauc

SEQ ID NO: 235706 - RNA, 19 nt, Homo sapiens
gcaguggacggcaaacuua

SEQ ID NO: 235707 - RNA, 19 nt, Homo sapiens
gaaaugaggaagaggagaa

SEQ ID NO: 235708 - RNA, 19 nt, Homo sapiens
gaacaacaaggauaaacug

SEQ ID NO: 235709 - RNA, 19 nt, Homo sapiens
cgaaggacaaggccacuua

SEQ ID NO: 235710 - RNA, 19 nt, Homo sapiens
gcaccacguucaagacuuc

SEQ ID NO: 235711 - RNA, 19 nt, Homo sapiens
ggaagaaggaaaugaggaa

SEQ ID NO: 235712 - RNA, 19 nt, Homo sapiens
gaguuucucuuuaauccuu

SEQ ID NO: 235713 - RNA, 19 nt, Homo sapiens
cagaacccgugcucgcuua

SEQ ID NO: 235714 - RNA, 19 nt, Homo sapiens
uaucagaccuuggaacuag

SEQ ID NO: 235715 - RNA, 19 nt, Homo sapiens
gcaauaucccgacuguaaa

SEQ ID NO: 235716 - RNA, 19 nt, Homo sapiens
gaagguggaggaagaagga

SEQ ID NO: 235717 - RNA, 19 nt, Homo sapiens
gaaggacaaggccacuuaa

SEQ ID NO: 235718 - RNA, 19 nt, Homo sapiens
gacaaggccacuuaaauca

SEQ ID NO: 235719 - RNA, 19 nt, Homo sapiens
ggagaaagaagaggaggaa

SEQ ID NO: 235720 - RNA, 19 nt, Homo sapiens
ugcaauaucccgacuguaa

SEQ ID NO: 235721 - RNA, 19 nt, Homo sapiens
aggagaagguggaggaaga

SEQ ID NO: 235722 - RNA, 19 nt, Homo sapiens
ggagaacaacaaggauaaa

SEQ ID NO: 235723 - RNA, 19 nt, Homo sapiens
ggacugaccgagagacaag

SEQ ID NO: 235724 - RNA, 19 nt, Homo sapiens
ggugcaauaucccgacugu

SEQ ID NO: 235725 - RNA, 19 nt, Homo sapiens
ggaggaagaaggaaaugag

SEQ ID NO: 235726 - RNA, 19 nt, Homo sapiens
cccuggaaccggccuauua

SEQ ID NO: 235727 - RNA, 19 nt, Homo sapiens
caauaucccgacuguaaau

SEQ ID NO: 235728 - RNA, 19 nt, Homo sapiens
aggcgagcguggugcaaua

SEQ ID NO: 235729 - RNA, 19 nt, Homo sapiens
ggagaagguggaggaagaa

SEQ ID NO: 235730 - RNA, 19 nt, Homo sapiens
ggaagaggagaaagaagag

SEQ ID NO: 235731 - RNA, 19 nt, Homo sapiens
aaggagaacaacaaggaua

SEQ ID NO: 235732 - RNA, 19 nt, Homo sapiens
agaaggaaaugaggaagag

SEQ ID NO: 235733 - RNA, 19 nt, Homo sapiens
cagcaugagcuccuacuuc

SEQ ID NO: 235734 - RNA, 19 nt, Homo sapiens
agagacaagugaagaucug

SEQ ID NO: 235735 - RNA, 19 nt, Homo sapiens
gacaagugaagaucugguu

SEQ ID NO: 235736 - RNA, 19 nt, Homo sapiens
uaacaguagcgaaggacaa

SEQ ID NO: 235737 - RNA, 19 nt, Homo sapiens
ccagacagucccuuuaugg

SEQ ID NO: 235738 - RNA, 19 nt, Homo sapiens
ugaggaagaggagaaagaa

SEQ ID NO: 235739 - RNA, 19 nt, Homo sapiens
ggagccaugcgcuggugua

SEQ ID NO: 235740 - RNA, 19 nt, Homo sapiens
ggaagaaaacaaggacuaa

SEQ ID NO: 235741 - RNA, 19 nt, Homo sapiens
aggaagaggagaaagaaga

SEQ ID NO: 235742 - RNA, 19 nt, Homo sapiens
uuccagaaccgaaggauga

SEQ ID NO: 235743 - RNA, 19 nt, Homo sapiens
aaacuuacagccgguauca

SEQ ID NO: 235744 - RNA, 19 nt, Homo sapiens
aggagaacaacaaggauaa

SEQ ID NO: 235745 - RNA, 19 nt, Homo sapiens
ggaaaaggaagaaaacaag

SEQ ID NO: 235746 - RNA, 19 nt, Homo sapiens
gaaagaagaggaggaaaag

SEQ ID NO: 235747 - RNA, 19 nt, Homo sapiens
gagacgccuccaaauucua

SEQ ID NO: 235748 - RNA, 19 nt, Homo sapiens
accgaaggaugaaguggaa

SEQ ID NO: 235749 - RNA, 19 nt, Homo sapiens
gagagacaagugaagaucu

SEQ ID NO: 235750 - RNA, 19 nt, Homo sapiens
ccuguucuccaaauacaaa

SEQ ID NO: 235751 - RNA, 19 nt, Homo sapiens
gcaaacuuacagccgguau

SEQ ID NO: 235752 - RNA, 19 nt, Homo sapiens
gcacgcuucgcaccacguu

SEQ ID NO: 235753 - RNA, 19 nt, Homo sapiens
gacugccgguucccucaga

SEQ ID NO: 235754 - RNA, 19 nt, Homo sapiens
gaaaacgucggauugaagu

SEQ ID NO: 235755 - RNA, 19 nt, Homo sapiens
gguaucagaccuuggaacu

SEQ ID NO: 235756 - RNA, 19 nt, Homo sapiens
cccagacagucccuuuaug

SEQ ID NO: 235757 - RNA, 19 nt, Homo sapiens
gagaacaacaaggauaaac

SEQ ID NO: 235758 - RNA, 19 nt, Homo sapiens
guaucagaccuuggaacua

SEQ ID NO: 235759 - RNA, 19 nt, Homo sapiens
acaaggccacuuaaaucaa

SEQ ID NO: 235760 - RNA, 19 nt, Homo sapiens
gagaaagaagaggaggaaa

SEQ ID NO: 235761 - RNA, 19 nt, Homo sapiens
gguggaggaagaaggaaau

SEQ ID NO: 235762 - RNA, 19 nt, Homo sapiens
agacgccuccaaauucuau

SEQ ID NO: 235763 - RNA, 19 nt, Homo sapiens
aagaaggaaaugaggaaga

SEQ ID NO: 235764 - RNA, 19 nt, Homo sapiens
aggacaaggccacuuaaau

SEQ ID NO: 235765 - RNA, 19 nt, Homo sapiens
uaaauccuccgccaacacu

SEQ ID NO: 235766 - RNA, 19 nt, Homo sapiens
guacuugaaucgcuauauu

SEQ ID NO: 235767 - RNA, 19 nt, Homo sapiens
cgaaauaaaugacacauac

SEQ ID NO: 235768 - RNA, 19 nt, Homo sapiens
gcucaucucucacgacaau

SEQ ID NO: 235769 - RNA, 19 nt, Homo sapiens
ggaaagagcaagauagaca

SEQ ID NO: 235770 - RNA, 19 nt, Homo sapiens
gaguuucucuucaauaugu

SEQ ID NO: 235771 - RNA, 19 nt, Homo sapiens
acacacacauacaugauaa

SEQ ID NO: 235772 - RNA, 19 nt, Homo sapiens
guaacgugcuucuguuugu

SEQ ID NO: 235773 - RNA, 19 nt, Homo sapiens
ugacuugauuguucuguga

SEQ ID NO: 235774 - RNA, 19 nt, Homo sapiens
gaaagagcaagauagacaa

SEQ ID NO: 235775 - RNA, 19 nt, Homo sapiens
cagagaagccaguacuuga

SEQ ID NO: 235776 - RNA, 19 nt, Homo sapiens
guacauauacaguucauac

SEQ ID NO: 235777 - RNA, 19 nt, Homo sapiens
uuaccugacuugauuguuc

SEQ ID NO: 235778 - RNA, 19 nt, Homo sapiens
agaaaacucuugcgauuug

SEQ ID NO: 235779 - RNA, 19 nt, Homo sapiens
cagcgcaaccgaaauaaau

SEQ ID NO: 235780 - RNA, 19 nt, Homo sapiens
guucaguguugagauauug

SEQ ID NO: 235781 - RNA, 19 nt, Homo sapiens
aggaguuucucuucaauau

SEQ ID NO: 235782 - RNA, 19 nt, Homo sapiens
gagaagccaguacuugaau

SEQ ID NO: 235783 - RNA, 19 nt, Homo sapiens
gcccuguguuaauauauug

SEQ ID NO: 235784 - RNA, 19 nt, Homo sapiens
gcgcaaccgaaauaaauga

SEQ ID NO: 235785 - RNA, 19 nt, Homo sapiens
uaacgugcuucuguuuguu

SEQ ID NO: 235786 - RNA, 19 nt, Homo sapiens
cagaaucgaaggaugaaga

SEQ ID NO: 235787 - RNA, 19 nt, Homo sapiens
aaucgaaggaugaagauga

SEQ ID NO: 235788 - RNA, 19 nt, Homo sapiens
gcagcuacccggacuacau

SEQ ID NO: 235789 - RNA, 19 nt, Homo sapiens
uggacucgcucaucucuca

SEQ ID NO: 235790 - RNA, 19 nt, Homo sapiens
aggguucaguguugagaua

SEQ ID NO: 235791 - RNA, 19 nt, Homo sapiens
gugccggacuguagcgauu

SEQ ID NO: 235792 - RNA, 19 nt, Homo sapiens
cgacaaugaagaccuccua

SEQ ID NO: 235793 - RNA, 19 nt, Homo sapiens
gguucaguguugagauauu

SEQ ID NO: 235794 - RNA, 19 nt, Homo sapiens
gacacacacacauacauga

SEQ ID NO: 235795 - RNA, 19 nt, Homo sapiens
gcaagcacaaagaggagaa

SEQ ID NO: 235796 - RNA, 19 nt, Homo sapiens
gcuucuguuuguuauggua

SEQ ID NO: 235797 - RNA, 19 nt, Homo sapiens
ccuguaacgugcuucuguu

SEQ ID NO: 235798 - RNA, 19 nt, Homo sapiens
ucagagaagccaguacuug

SEQ ID NO: 235799 - RNA, 19 nt, Homo sapiens
cacacacacauacaugaua

SEQ ID NO: 235800 - RNA, 19 nt, Homo sapiens
ccuccuagcguccagguuu

SEQ ID NO: 235801 - RNA, 19 nt, Homo sapiens
ccgaaauaaaugacacaua

SEQ ID NO: 235802 - RNA, 19 nt, Homo sapiens
guguugagauauugguguu

SEQ ID NO: 235803 - RNA, 19 nt, Homo sapiens
uacauaguguucccucuca

SEQ ID NO: 235804 - RNA, 19 nt, Homo sapiens
gccuugggcuguacauagu

SEQ ID NO: 235805 - RNA, 19 nt, Homo sapiens
aaggaaagagcaagauaga

SEQ ID NO: 235806 - RNA, 19 nt, Homo sapiens
aaagagcaagauagacaaa

SEQ ID NO: 235807 - RNA, 19 nt, Homo sapiens
agucguccgugguauauca

SEQ ID NO: 235808 - RNA, 19 nt, Homo sapiens
agagaagccaguacuugaa

SEQ ID NO: 235809 - RNA, 19 nt, Homo sapiens
gugcuucuguuuguuaugg

SEQ ID NO: 235810 - RNA, 19 nt, Homo sapiens
caaggaaggggaaaagaaa

SEQ ID NO: 235811 - RNA, 19 nt, Homo sapiens
aaaggaaagagcaagauag

SEQ ID NO: 235812 - RNA, 19 nt, Homo sapiens
ggaguuucucuucaauaug

SEQ ID NO: 235813 - RNA, 19 nt, Homo sapiens
ggcccaucaguaacuauua

SEQ ID NO: 235814 - RNA, 19 nt, Homo sapiens
cgcuggaacuggagaagga

SEQ ID NO: 235815 - RNA, 19 nt, Homo sapiens
agacacacacacauacaug

SEQ ID NO: 235816 - RNA, 19 nt, Homo sapiens
ccagcgcaaccgaaauaaa

SEQ ID NO: 235817 - RNA, 19 nt, Homo sapiens
uugggaggguucaguguug

SEQ ID NO: 235818 - RNA, 19 nt, Homo sapiens
gggcccaucaguaacuauu

SEQ ID NO: 235819 - RNA, 19 nt, Homo sapiens
uuucagaaucgaaggauga

SEQ ID NO: 235820 - RNA, 19 nt, Homo sapiens
cagcuacccggacuacaug

SEQ ID NO: 235821 - RNA, 19 nt, Homo sapiens
acacacauacaugauaaug

SEQ ID NO: 235822 - RNA, 19 nt, Homo sapiens
guugagauauugguguuuu

SEQ ID NO: 235823 - RNA, 19 nt, Homo sapiens
gaagccaguacuugaaucg

SEQ ID NO: 235824 - RNA, 19 nt, Homo sapiens
gcaaccgaaauaaaugaca

SEQ ID NO: 235825 - RNA, 19 nt, Homo sapiens
gcuacccggacuacaugua

SEQ ID NO: 235826 - RNA, 19 nt, Homo sapiens
cacacauacaugauaauga

SEQ ID NO: 235827 - RNA, 19 nt, Homo sapiens
aaaaggaaagagcaagaua

SEQ ID NO: 235828 - RNA, 19 nt, Homo sapiens
ucaccgagcggcaggucaa

SEQ ID NO: 235829 - RNA, 19 nt, Homo sapiens
gaacugaccuccaauuuua

SEQ ID NO: 235830 - RNA, 19 nt, Homo sapiens
gcauguagcuuccuuaaug

SEQ ID NO: 235831 - RNA, 19 nt, Homo sapiens
gagauuagcaagaccauua

SEQ ID NO: 235832 - RNA, 19 nt, Homo sapiens
gcaaagagcggaaggaaga

SEQ ID NO: 235833 - RNA, 19 nt, Homo sapiens
gaacauagcaaagcaaaga

SEQ ID NO: 235834 - RNA, 19 nt, Homo sapiens
gagaaugucugcugcaugu

SEQ ID NO: 235835 - RNA, 19 nt, Homo sapiens
gaaauuucauccagaggaa

SEQ ID NO: 235836 - RNA, 19 nt, Homo sapiens
ggaguuguguuauuuaaag

SEQ ID NO: 235837 - RNA, 19 nt, Homo sapiens
gcuguaguauugcuccuua

SEQ ID NO: 235838 - RNA, 19 nt, Homo sapiens
cuaagaaucugcuugaagu

SEQ ID NO: 235839 - RNA, 19 nt, Homo sapiens
gcaagaccauuaaccuuac

SEQ ID NO: 235840 - RNA, 19 nt, Homo sapiens
aaagugaguuucccugaga

SEQ ID NO: 235841 - RNA, 19 nt, Homo sapiens
gcaaagcaaagacagaaug

SEQ ID NO: 235842 - RNA, 19 nt, Homo sapiens
gaguguggcuggugugugu

SEQ ID NO: 235843 - RNA, 19 nt, Homo sapiens
cuaguaacaucucagaaau

SEQ ID NO: 235844 - RNA, 19 nt, Homo sapiens
gcagaaucguuccuuccuu

SEQ ID NO: 235845 - RNA, 19 nt, Homo sapiens
ccacuuaaagcaugagaaa

SEQ ID NO: 235846 - RNA, 19 nt, Homo sapiens
gcccagacaccucggauaa

SEQ ID NO: 235847 - RNA, 19 nt, Homo sapiens
gcucuaagaaucugcuuga

SEQ ID NO: 235848 - RNA, 19 nt, Homo sapiens
gggaacugaccuccaauuu

SEQ ID NO: 235849 - RNA, 19 nt, Homo sapiens
gucaaaaucugguuucaaa

SEQ ID NO: 235850 - RNA, 19 nt, Homo sapiens
gagcacaggcagaaucguu

SEQ ID NO: 235851 - RNA, 19 nt, Homo sapiens
ucugggaguuguguuauuu

SEQ ID NO: 235852 - RNA, 19 nt, Homo sapiens
ggaaaguucggcuaguguu

SEQ ID NO: 235853 - RNA, 19 nt, Homo sapiens
gaaaacaccacaggaaauu

SEQ ID NO: 235854 - RNA, 19 nt, Homo sapiens
gcagaaugaaacucaagaa

SEQ ID NO: 235855 - RNA, 19 nt, Homo sapiens
cagaaugaaacucaagaaa

SEQ ID NO: 235856 - RNA, 19 nt, Homo sapiens
ugggaguuguguuauuuaa

SEQ ID NO: 235857 - RNA, 19 nt, Homo sapiens
gcagagcacaggcagaauc

SEQ ID NO: 235858 - RNA, 19 nt, Homo sapiens
ucuaguaacaucucagaaa

SEQ ID NO: 235859 - RNA, 19 nt, Homo sapiens
cuugaagucucguauuugu

SEQ ID NO: 235860 - RNA, 19 nt, Homo sapiens
gaaaguucggcuaguguuc

SEQ ID NO: 235861 - RNA, 19 nt, Homo sapiens
gaaaaugaaccgagagaau

SEQ ID NO: 235862 - RNA, 19 nt, Homo sapiens
agcaagaccauuaaccuua

SEQ ID NO: 235863 - RNA, 19 nt, Homo sapiens
aagaagaggugccccuaua

SEQ ID NO: 235864 - RNA, 19 nt, Homo sapiens
gcacucacacacagcauuc

SEQ ID NO: 235865 - RNA, 19 nt, Homo sapiens
cuuugugccuggugauaua

SEQ ID NO: 235866 - RNA, 19 nt, Homo sapiens
ugcuugaagucucguauuu

SEQ ID NO: 235867 - RNA, 19 nt, Homo sapiens
cccagucgcucuaagaauc

SEQ ID NO: 235868 - RNA, 19 nt, Homo sapiens
gcaaaguuaagaucgaauc

SEQ ID NO: 235869 - RNA, 19 nt, Homo sapiens
ggaacugaccuccaauuuu

SEQ ID NO: 235870 - RNA, 19 nt, Homo sapiens
uguggugugugcccucaua

SEQ ID NO: 235871 - RNA, 19 nt, Homo sapiens
cuccuccgcuguaguauug

SEQ ID NO: 235872 - RNA, 19 nt, Homo sapiens
gaagcgaaagaggagauaa

SEQ ID NO: 235873 - RNA, 19 nt, Homo sapiens
ucgaauccauccgcuugua

SEQ ID NO: 235874 - RNA, 19 nt, Homo sapiens
gcagaaaacaccacaggaa

SEQ ID NO: 235875 - RNA, 19 nt, Homo sapiens
aauagaacauagcaaagca

SEQ ID NO: 235876 - RNA, 19 nt, Homo sapiens
ggcuaguguucguguguuu

SEQ ID NO: 235877 - RNA, 19 nt, Homo sapiens
gcauguacagcgcagagaa

SEQ ID NO: 235878 - RNA, 19 nt, Homo sapiens
uguucuccaugcaaaguua

SEQ ID NO: 235879 - RNA, 19 nt, Homo sapiens
caagggaccugugguucgu

SEQ ID NO: 235880 - RNA, 19 nt, Homo sapiens
uagcaaagcaaagacagaa

SEQ ID NO: 235881 - RNA, 19 nt, Homo sapiens
gcauuuccuccuuagacua

SEQ ID NO: 235882 - RNA, 19 nt, Homo sapiens
uugcugcauuuccuccuua

SEQ ID NO: 235883 - RNA, 19 nt, Homo sapiens
acuuaaagcaugagaaaug

SEQ ID NO: 235884 - RNA, 19 nt, Homo sapiens
ggagcgcaggcauguauau

SEQ ID NO: 235885 - RNA, 19 nt, Homo sapiens
caagaccauuaaccuuaca

SEQ ID NO: 235886 - RNA, 19 nt, Homo sapiens
gaaugucugcugcauguac

SEQ ID NO: 235887 - RNA, 19 nt, Homo sapiens
ucucguauuuguacugcuu

SEQ ID NO: 235888 - RNA, 19 nt, Homo sapiens
guuccuuccuugcugcauu

SEQ ID NO: 235889 - RNA, 19 nt, Homo sapiens
caugcaaaguuaagaucga

SEQ ID NO: 235890 - RNA, 19 nt, Homo sapiens
uagaacauagcaaagcaaa

SEQ ID NO: 235891 - RNA, 19 nt, Homo sapiens
cagcaaagagcggaaggaa

SEQ ID NO: 235892 - RNA, 19 nt, Homo sapiens
cauguagcuuccuuaaugg

SEQ ID NO: 235893 - RNA, 19 nt, Homo sapiens
gggaguuguguuauuuaaa

SEQ ID NO: 235894 - RNA, 19 nt, Homo sapiens
ugaagucucguauuuguac

SEQ ID NO: 235895 - RNA, 19 nt, Homo sapiens
acccagagccuccaccaaa

SEQ ID NO: 235896 - RNA, 19 nt, Homo sapiens
gaggagauaaaggcagaaa

SEQ ID NO: 235897 - RNA, 19 nt, Homo sapiens
ggcaaagaccucagacucu

SEQ ID NO: 235898 - RNA, 19 nt, Homo sapiens
uagcaagaccauuaaccuu

SEQ ID NO: 235899 - RNA, 19 nt, Homo sapiens
ccagacaccucggauaacg

SEQ ID NO: 235900 - RNA, 19 nt, Homo sapiens
ccagaaucauaauccucaa

SEQ ID NO: 235901 - RNA, 19 nt, Homo sapiens
uagcuuccuuaauggagaa

SEQ ID NO: 235902 - RNA, 19 nt, Homo sapiens
ggugugugcccucauagau

SEQ ID NO: 235903 - RNA, 19 nt, Homo sapiens
aagcgaaagaggagauaaa

SEQ ID NO: 235904 - RNA, 19 nt, Homo sapiens
gcuccuacccaccuagugu

SEQ ID NO: 235905 - RNA, 19 nt, Homo sapiens
uaauagacguuuuggaaag

SEQ ID NO: 235906 - RNA, 19 nt, Homo sapiens
aaguuaagaucgaauccau

SEQ ID NO: 235907 - RNA, 19 nt, Homo sapiens
aaucggauccgggaacuga

SEQ ID NO: 235908 - RNA, 19 nt, Homo sapiens
gcaauguaacuccgaacuc

SEQ ID NO: 235909 - RNA, 19 nt, Homo sapiens
agacaccucggauaacgaa

SEQ ID NO: 235910 - RNA, 19 nt, Homo sapiens
caucuaguaacaucucaga

SEQ ID NO: 235911 - RNA, 19 nt, Homo sapiens
ugugccuggugauauauuu

SEQ ID NO: 235912 - RNA, 19 nt, Homo sapiens
aaacaccacaggaaauugg

SEQ ID NO: 235913 - RNA, 19 nt, Homo sapiens
ccggagcgcaggcauguau

SEQ ID NO: 235914 - RNA, 19 nt, Homo sapiens
cuuaaagcaugagaaaugg

SEQ ID NO: 235915 - RNA, 19 nt, Homo sapiens
cauuaaccuuacagacaga

SEQ ID NO: 235916 - RNA, 19 nt, Homo sapiens
cacaggaaauuggcugaca

SEQ ID NO: 235917 - RNA, 19 nt, Homo sapiens
cagaaucauaauccucaaa

SEQ ID NO: 235918 - RNA, 19 nt, Homo sapiens
cuacccaccuagugucaag

SEQ ID NO: 235919 - RNA, 19 nt, Homo sapiens
caaaaucgcagaaugaaac

SEQ ID NO: 235920 - RNA, 19 nt, Homo sapiens
gagcgcaggcauguauaug

SEQ ID NO: 235921 - RNA, 19 nt, Homo sapiens
gcgccgaacaucuggaauc

SEQ ID NO: 235922 - RNA, 19 nt, Homo sapiens
gucugggaguuguguuauu

SEQ ID NO: 235923 - RNA, 19 nt, Homo sapiens
ucgcagagcacaggcagaa

SEQ ID NO: 235924 - RNA, 19 nt, Homo sapiens
uccgggaacugaccuccaa

SEQ ID NO: 235925 - RNA, 19 nt, Homo sapiens
aaaccccucucucugaaaa

SEQ ID NO: 235926 - RNA, 19 nt, Homo sapiens
uuguacugcuuucugcuuu

SEQ ID NO: 235927 - RNA, 19 nt, Homo sapiens
gcuugaagucucguauuug

SEQ ID NO: 235928 - RNA, 19 nt, Homo sapiens
gccucgcccucaacaccua

SEQ ID NO: 235929 - RNA, 19 nt, Homo sapiens
gaacaauccucgaacuaaa

SEQ ID NO: 235930 - RNA, 19 nt, Homo sapiens
gaaccuuccuuugaaauuu

SEQ ID NO: 235931 - RNA, 19 nt, Homo sapiens
gagaccggcugcaguauuu

SEQ ID NO: 235932 - RNA, 19 nt, Homo sapiens
gcaagaagcgcugcccuua

SEQ ID NO: 235933 - RNA, 19 nt, Homo sapiens
gagaggagaacgauguuua

SEQ ID NO: 235934 - RNA, 19 nt, Homo sapiens
caacguguauaucaacaaa

SEQ ID NO: 235935 - RNA, 19 nt, Homo sapiens
ggagaacgauguuuaacuc

SEQ ID NO: 235936 - RNA, 19 nt, Homo sapiens
gccaagacuuugauuuaaa

SEQ ID NO: 235937 - RNA, 19 nt, Homo sapiens
ggccaagacuuugauuuaa

SEQ ID NO: 235938 - RNA, 19 nt, Homo sapiens
aagaagcgcugcccuuauu

SEQ ID NO: 235939 - RNA, 19 nt, Homo sapiens
gcauugagguuuccacauc

SEQ ID NO: 235940 - RNA, 19 nt, Homo sapiens
guagaaccuuccuuugaaa

SEQ ID NO: 235941 - RNA, 19 nt, Homo sapiens
gcgcugcccuuauucgaaa

SEQ ID NO: 235942 - RNA, 19 nt, Homo sapiens
gggaaauccucugcuguaa

SEQ ID NO: 235943 - RNA, 19 nt, Homo sapiens
gaacagaaggaugaaagaa

SEQ ID NO: 235944 - RNA, 19 nt, Homo sapiens
caucucgccuucccaaauu

SEQ ID NO: 235945 - RNA, 19 nt, Homo sapiens
uguagaaccuuccuuugaa

SEQ ID NO: 235946 - RNA, 19 nt, Homo sapiens
ucaccgagauccucaugaa

SEQ ID NO: 235947 - RNA, 19 nt, Homo sapiens
cuucauggauuuauagcua

SEQ ID NO: 235948 - RNA, 19 nt, Homo sapiens
ccagagggauugcugugaa

SEQ ID NO: 235949 - RNA, 19 nt, Homo sapiens
gaaaagauccgcuaagaca

SEQ ID NO: 235950 - RNA, 19 nt, Homo sapiens
gaaauccucugcuguaacc

SEQ ID NO: 235951 - RNA, 19 nt, Homo sapiens
gauccugccuugcugugaa

SEQ ID NO: 235952 - RNA, 19 nt, Homo sapiens
cgaacaauccucgaacuaa

SEQ ID NO: 235953 - RNA, 19 nt, Homo sapiens
gguggcaaauaaagauaaa

SEQ ID NO: 235954 - RNA, 19 nt, Homo sapiens
aaacacaccucggcgacaa

SEQ ID NO: 235955 - RNA, 19 nt, Homo sapiens
gcgccgaggccaagacuuu

SEQ ID NO: 235956 - RNA, 19 nt, Homo sapiens
gguguuaggugugcaaagu

SEQ ID NO: 235957 - RNA, 19 nt, Homo sapiens
agggauugcugugaaauuu

SEQ ID NO: 235958 - RNA, 19 nt, Homo sapiens
cagagggauugcugugaaa

SEQ ID NO: 235959 - RNA, 19 nt, Homo sapiens
guguagaaccuuccuuuga

SEQ ID NO: 235960 - RNA, 19 nt, Homo sapiens
aggccaagacuuugauuua

SEQ ID NO: 235961 - RNA, 19 nt, Homo sapiens
gugcaaaguccguguccua

SEQ ID NO: 235962 - RNA, 19 nt, Homo sapiens
caguugcacuuacuacaug

SEQ ID NO: 235963 - RNA, 19 nt, Homo sapiens
gcaguagggagaugggauu

SEQ ID NO: 235964 - RNA, 19 nt, Homo sapiens
cgggaaauccucugcugua

SEQ ID NO: 235965 - RNA, 19 nt, Homo sapiens
gaaccugacggaccgacaa

SEQ ID NO: 235966 - RNA, 19 nt, Homo sapiens
acagaaggaugaaagaaaa

SEQ ID NO: 235967 - RNA, 19 nt, Homo sapiens
caagaagcgcugcccuuau

SEQ ID NO: 235968 - RNA, 19 nt, Homo sapiens
gagggauugcugugaaauu

SEQ ID NO: 235969 - RNA, 19 nt, Homo sapiens
auaaauuucccaagcguuu

SEQ ID NO: 235970 - RNA, 19 nt, Homo sapiens
agaggagaacgauguuuaa

SEQ ID NO: 235971 - RNA, 19 nt, Homo sapiens
caaaguccguguccuaccu

SEQ ID NO: 235972 - RNA, 19 nt, Homo sapiens
gugaaaagauccgcuaaga

SEQ ID NO: 235973 - RNA, 19 nt, Homo sapiens
aaaagaaacugagcagaga

SEQ ID NO: 235974 - RNA, 19 nt, Homo sapiens
uuucagaacagaaggauga

SEQ ID NO: 235975 - RNA, 19 nt, Homo sapiens
gaacagcguccugccucaa

SEQ ID NO: 235976 - RNA, 19 nt, Homo sapiens
ucaaaucacgcaucucuac

SEQ ID NO: 235977 - RNA, 19 nt, Homo sapiens
gaaauuucuguaccuucaa

SEQ ID NO: 235978 - RNA, 19 nt, Homo sapiens
cugccuugcugugaaauuu

SEQ ID NO: 235979 - RNA, 19 nt, Homo sapiens
acguguauaucaacaaaga

SEQ ID NO: 235980 - RNA, 19 nt, Homo sapiens
gagccgaacaauccucgaa

SEQ ID NO: 235981 - RNA, 19 nt, Homo sapiens
ggagaggagaacgauguuu

SEQ ID NO: 235982 - RNA, 19 nt, Homo sapiens
cagcuacuccuccugcuau

SEQ ID NO: 235983 - RNA, 19 nt, Homo sapiens
gaggccaagacuuugauuu

SEQ ID NO: 235984 - RNA, 19 nt, Homo sapiens
caggagaggagaacgaugu

SEQ ID NO: 235985 - RNA, 19 nt, Homo sapiens
aacagaaggaugaaagaaa

SEQ ID NO: 235986 - RNA, 19 nt, Homo sapiens
ccacuucauggauuuauag

SEQ ID NO: 235987 - RNA, 19 nt, Homo sapiens
ggugaagggaagugucuga

SEQ ID NO: 235988 - RNA, 19 nt, Homo sapiens
cccacuucauggauuuaua

SEQ ID NO: 235989 - RNA, 19 nt, Homo sapiens
ccgaacaauccucgaacua

SEQ ID NO: 235990 - RNA, 19 nt, Homo sapiens
cagaacagaaggaugaaag

SEQ ID NO: 235991 - RNA, 19 nt, Homo sapiens
ggaaauccucugcuguaac

SEQ ID NO: 235992 - RNA, 19 nt, Homo sapiens
cuuacuacaugcccgaguu

SEQ ID NO: 235993 - RNA, 19 nt, Homo sapiens
augcagucguuaccucuuu

SEQ ID NO: 235994 - RNA, 19 nt, Homo sapiens
aaauuugguuucagaacag

SEQ ID NO: 235995 - RNA, 19 nt, Homo sapiens
guguauaucaacaaagaga

SEQ ID NO: 235996 - RNA, 19 nt, Homo sapiens
cugaggaggagaacacaaa

SEQ ID NO: 235997 - RNA, 19 nt, Homo sapiens
acuccucagucaacaagaa

SEQ ID NO: 235998 - RNA, 19 nt, Homo sapiens
agaaccuuccuuugaaauu

SEQ ID NO: 235999 - RNA, 19 nt, Homo sapiens
gaaccuccuggacccucua

SEQ ID NO: 236000 - RNA, 19 nt, Homo sapiens
uuucuaacucgucuucuuu

SEQ ID NO: 236001 - RNA, 19 nt, Homo sapiens
ugacggaccgacaagugaa

SEQ ID NO: 236002 - RNA, 19 nt, Homo sapiens
uaccuucaaccugguguua

SEQ ID NO: 236003 - RNA, 19 nt, Homo sapiens
aaccuuccuuugaaauuuc

SEQ ID NO: 236004 - RNA, 19 nt, Homo sapiens
ugaagggaagugucugaug

SEQ ID NO: 236005 - RNA, 19 nt, Homo sapiens
gaggaggagaacacaaauc

SEQ ID NO: 236006 - RNA, 19 nt, Homo sapiens
ccaguugcacuuacuacau

SEQ ID NO: 236007 - RNA, 19 nt, Homo sapiens
gccgaacaauccucgaacu

SEQ ID NO: 236008 - RNA, 19 nt, Homo sapiens
ugugaaauuucuguaccuu

SEQ ID NO: 236009 - RNA, 19 nt, Homo sapiens
guauaucaacaaagagaag

SEQ ID NO: 236010 - RNA, 19 nt, Homo sapiens
cucaagccuucgaccguuu

SEQ ID NO: 236011 - RNA, 19 nt, Homo sapiens
ucagaccgcuugaaucuua

SEQ ID NO: 236012 - RNA, 19 nt, Homo sapiens
uuucagaaccggagaauga

SEQ ID NO: 236013 - RNA, 19 nt, Homo sapiens
gagcauaaucuccugaauc

SEQ ID NO: 236014 - RNA, 19 nt, Homo sapiens
gcgaguuucuggucaacga

SEQ ID NO: 236015 - RNA, 19 nt, Homo sapiens
gggagacaccuucuacuuc

SEQ ID NO: 236016 - RNA, 19 nt, Homo sapiens
caagcucucuccuucuuuu

SEQ ID NO: 236017 - RNA, 19 nt, Homo sapiens
ggucaacgaguucaucaca

SEQ ID NO: 236018 - RNA, 19 nt, Homo sapiens
gcaagcucucuccuucuuu

SEQ ID NO: 236019 - RNA, 19 nt, Homo sapiens
gcaggucaagaucugguuu

SEQ ID NO: 236020 - RNA, 19 nt, Homo sapiens
gcaagcccuauucgaaguu

SEQ ID NO: 236021 - RNA, 19 nt, Homo sapiens
gaagaagcgcaagcccuau

SEQ ID NO: 236022 - RNA, 19 nt, Homo sapiens
caagcccuauucgaaguug

SEQ ID NO: 236023 - RNA, 19 nt, Homo sapiens
aacagccgcucucggaaga

SEQ ID NO: 236024 - RNA, 19 nt, Homo sapiens
ggacggcaaggguuacuac

SEQ ID NO: 236025 - RNA, 19 nt, Homo sapiens
ucucagaccgcuugaaucu

SEQ ID NO: 236026 - RNA, 19 nt, Homo sapiens
gcucaacgagggcaacaag

SEQ ID NO: 236027 - RNA, 19 nt, Homo sapiens
agcaagcucucuccuucuu

SEQ ID NO: 236028 - RNA, 19 nt, Homo sapiens
uggaggacggcaaggguua

SEQ ID NO: 236029 - RNA, 19 nt, Homo sapiens
ucuccugaaucccggguuu

SEQ ID NO: 236030 - RNA, 19 nt, Homo sapiens
cgagcauaaucuccugaau

SEQ ID NO: 236031 - RNA, 19 nt, Homo sapiens
cgggagacaccuucuacuu

SEQ ID NO: 236032 - RNA, 19 nt, Homo sapiens
gaauccgacuccaguucgu

SEQ ID NO: 236033 - RNA, 19 nt, Homo sapiens
cgcaagcccuauucgaagu

SEQ ID NO: 236034 - RNA, 19 nt, Homo sapiens
gcagcccagugucucucaa

SEQ ID NO: 236035 - RNA, 19 nt, Homo sapiens
ucagaaccggagaaugaaa

SEQ ID NO: 236036 - RNA, 19 nt, Homo sapiens
aagaagcgcaagcccuauu

SEQ ID NO: 236037 - RNA, 19 nt, Homo sapiens
agcauaaucuccugaaucc

SEQ ID NO: 236038 - RNA, 19 nt, Homo sapiens
gaaauguucaucaggaaua

SEQ ID NO: 236039 - RNA, 19 nt, Homo sapiens
gcacugggcucucuccaau

SEQ ID NO: 236040 - RNA, 19 nt, Homo sapiens
gcagaagaguauuuaaugu

SEQ ID NO: 236041 - RNA, 19 nt, Homo sapiens
ucaauuagcuagauguaga

SEQ ID NO: 236042 - RNA, 19 nt, Homo sapiens
caaagucccuguccaguca

SEQ ID NO: 236043 - RNA, 19 nt, Homo sapiens
ggauaaacaucucuuccaa

SEQ ID NO: 236044 - RNA, 19 nt, Homo sapiens
ugaaggagcuagagaagga

SEQ ID NO: 236045 - RNA, 19 nt, Homo sapiens
gaggaaagcuagaggaucu

SEQ ID NO: 236046 - RNA, 19 nt, Homo sapiens
gaaugacuccucacacuuu

SEQ ID NO: 236047 - RNA, 19 nt, Homo sapiens
gcaaguucaucaccaaaga

SEQ ID NO: 236048 - RNA, 19 nt, Homo sapiens
gaaugacaauguacugaau

SEQ ID NO: 236049 - RNA, 19 nt, Homo sapiens
gcgcagagcccaaucauuc

SEQ ID NO: 236050 - RNA, 19 nt, Homo sapiens
gcgcucaccuugccagaaa

SEQ ID NO: 236051 - RNA, 19 nt, Homo sapiens
ggaaggcugucgaccucua

SEQ ID NO: 236052 - RNA, 19 nt, Homo sapiens
gaagaucuggcccucaauu

SEQ ID NO: 236053 - RNA, 19 nt, Homo sapiens
guauggauguuuccguaaa

SEQ ID NO: 236054 - RNA, 19 nt, Homo sapiens
ccucacacuuucaccuuua

SEQ ID NO: 236055 - RNA, 19 nt, Homo sapiens
gagagugggucccucaaca

SEQ ID NO: 236056 - RNA, 19 nt, Homo sapiens
agaagaagguggucagcaa

SEQ ID NO: 236057 - RNA, 19 nt, Homo sapiens
acacuaaggugcagcugaa

SEQ ID NO: 236058 - RNA, 19 nt, Homo sapiens
uaacaguucccuccucaaa

SEQ ID NO: 236059 - RNA, 19 nt, Homo sapiens
ggcaagauuucccaguaaa

SEQ ID NO: 236060 - RNA, 19 nt, Homo sapiens
caaccaagaaacugcauuu

SEQ ID NO: 236061 - RNA, 19 nt, Homo sapiens
uaggcaagauuucccagua

SEQ ID NO: 236062 - RNA, 19 nt, Homo sapiens
gaagaagguggucagcaaa

SEQ ID NO: 236063 - RNA, 19 nt, Homo sapiens
acaauguacugaaugcaaa

SEQ ID NO: 236064 - RNA, 19 nt, Homo sapiens
cuauuuaugucuccgcuuu

SEQ ID NO: 236065 - RNA, 19 nt, Homo sapiens
aagaagaucuggcccucaa

SEQ ID NO: 236066 - RNA, 19 nt, Homo sapiens
ggacucacguggcuucaac

SEQ ID NO: 236067 - RNA, 19 nt, Homo sapiens
ggaaugacuccucacacuu

SEQ ID NO: 236068 - RNA, 19 nt, Homo sapiens
guauugugaugucugaaug

SEQ ID NO: 236069 - RNA, 19 nt, Homo sapiens
ggaaauccaaggaggacaa

SEQ ID NO: 236070 - RNA, 19 nt, Homo sapiens
gugacgaccuguccucuag

SEQ ID NO: 236071 - RNA, 19 nt, Homo sapiens
caagauuucccaguaaaga

SEQ ID NO: 236072 - RNA, 19 nt, Homo sapiens
aaagucguguuaauacuca

SEQ ID NO: 236073 - RNA, 19 nt, Homo sapiens
aggcaagauuucccaguaa

SEQ ID NO: 236074 - RNA, 19 nt, Homo sapiens
gacaauguacugaaugcaa

SEQ ID NO: 236075 - RNA, 19 nt, Homo sapiens
guucugcucucucagucaa

SEQ ID NO: 236076 - RNA, 19 nt, Homo sapiens
ggccggagagccuuaugua

SEQ ID NO: 236077 - RNA, 19 nt, Homo sapiens
gagugggucccucaacaaa

SEQ ID NO: 236078 - RNA, 19 nt, Homo sapiens
ggcacuagcccaggaauga

SEQ ID NO: 236079 - RNA, 19 nt, Homo sapiens
gugggucccucaacaaagu

SEQ ID NO: 236080 - RNA, 19 nt, Homo sapiens
gaaauccaaggaggacaaa

SEQ ID NO: 236081 - RNA, 19 nt, Homo sapiens
ggaauuccguaaaagcauu

SEQ ID NO: 236082 - RNA, 19 nt, Homo sapiens
gcuccucucuccucucucu

SEQ ID NO: 236083 - RNA, 19 nt, Homo sapiens
uucaacagcuuuggaaaug

SEQ ID NO: 236084 - RNA, 19 nt, Homo sapiens
gugcagaagaguauuuaau

SEQ ID NO: 236085 - RNA, 19 nt, Homo sapiens
uaaccgaacccacggaaag

SEQ ID NO: 236086 - RNA, 19 nt, Homo sapiens
ugaaugacaauguacugaa

SEQ ID NO: 236087 - RNA, 19 nt, Homo sapiens
aagaucuggcccucaauua

SEQ ID NO: 236088 - RNA, 19 nt, Homo sapiens
cuagcaaguucaucaccaa

SEQ ID NO: 236089 - RNA, 19 nt, Homo sapiens
acaguucccuccucaaagg

SEQ ID NO: 236090 - RNA, 19 nt, Homo sapiens
acuuucaccuuuacugauu

SEQ ID NO: 236091 - RNA, 19 nt, Homo sapiens
gugguaagguuggggauua

SEQ ID NO: 236092 - RNA, 19 nt, Homo sapiens
gggcuccucucuccucucu

SEQ ID NO: 236093 - RNA, 19 nt, Homo sapiens
cuaaauagggcuccucucu

SEQ ID NO: 236094 - RNA, 19 nt, Homo sapiens
gcccaaucauuccaaccaa

SEQ ID NO: 236095 - RNA, 19 nt, Homo sapiens
ccuucccacuggugcauua

SEQ ID NO: 236096 - RNA, 19 nt, Homo sapiens
ccagucaccuuuccaucag

SEQ ID NO: 236097 - RNA, 19 nt, Homo sapiens
guacagaagcagaacuuuu

SEQ ID NO: 236098 - RNA, 19 nt, Homo sapiens
cccaaucauuccaaccaaa

SEQ ID NO: 236099 - RNA, 19 nt, Homo sapiens
gauuggaguauggauguuu

SEQ ID NO: 236100 - RNA, 19 nt, Homo sapiens
gcaagauuucccaguaaag

SEQ ID NO: 236101 - RNA, 19 nt, Homo sapiens
gcacuccuuaggcaagauu

SEQ ID NO: 236102 - RNA, 19 nt, Homo sapiens
auaguauugugaugucuga

SEQ ID NO: 236103 - RNA, 19 nt, Homo sapiens
ucuccucucucucucucua

SEQ ID NO: 236104 - RNA, 19 nt, Homo sapiens
cguguuaauacucaugaua

SEQ ID NO: 236105 - RNA, 19 nt, Homo sapiens
ucuccgcuuuguaccauaa

SEQ ID NO: 236106 - RNA, 19 nt, Homo sapiens
cggagagccuuauguacgu

SEQ ID NO: 236107 - RNA, 19 nt, Homo sapiens
ccaccacgaaccucucuga

SEQ ID NO: 236108 - RNA, 19 nt, Homo sapiens
auacgcggcuagcaaguuc

SEQ ID NO: 236109 - RNA, 19 nt, Homo sapiens
gauuucccaguaaagauuu

SEQ ID NO: 236110 - RNA, 19 nt, Homo sapiens
ugcagaagaguauuuaaug

SEQ ID NO: 236111 - RNA, 19 nt, Homo sapiens
gggugcagaagaguauuua

SEQ ID NO: 236112 - RNA, 19 nt, Homo sapiens
ccaggugggagcugccuuu

SEQ ID NO: 236113 - RNA, 19 nt, Homo sapiens
gaagguggucagcaaaucg

SEQ ID NO: 236114 - RNA, 19 nt, Homo sapiens
gaucuggcccucaauuagc

SEQ ID NO: 236115 - RNA, 19 nt, Homo sapiens
acacuuucaccuuuacuga

SEQ ID NO: 236116 - RNA, 19 nt, Homo sapiens
gauuaguccagguacagaa

SEQ ID NO: 236117 - RNA, 19 nt, Homo sapiens
gcugggacagucaggugua

SEQ ID NO: 236118 - RNA, 19 nt, Homo sapiens
ggugacgaccuguccucua

SEQ ID NO: 236119 - RNA, 19 nt, Homo sapiens
ucagucaacauguggaaau

SEQ ID NO: 236120 - RNA, 19 nt, Homo sapiens
cauccuaugaccaggcuuu

SEQ ID NO: 236121 - RNA, 19 nt, Homo sapiens
agaagguggucagcaaauc

SEQ ID NO: 236122 - RNA, 19 nt, Homo sapiens
guucaucaccaaagagaag

SEQ ID NO: 236123 - RNA, 19 nt, Homo sapiens
gcccucaauuagcuagaug

SEQ ID NO: 236124 - RNA, 19 nt, Homo sapiens
aauccaaggaggacaaaga

SEQ ID NO: 236125 - RNA, 19 nt, Homo sapiens
cuaaggugcagcugaagga

SEQ ID NO: 236126 - RNA, 19 nt, Homo sapiens
aaacgcgugcccuacacua

SEQ ID NO: 236127 - RNA, 19 nt, Homo sapiens
ccucaauuagcuagaugua

SEQ ID NO: 236128 - RNA, 19 nt, Homo sapiens
gcggcuagcaaguucauca

SEQ ID NO: 236129 - RNA, 19 nt, Homo sapiens
agauuucccaguaaagauu

SEQ ID NO: 236130 - RNA, 19 nt, Homo sapiens
caagaggcaagaagaucug

SEQ ID NO: 236131 - RNA, 19 nt, Homo sapiens
ucaagaggcaagaagaucu

SEQ ID NO: 236132 - RNA, 19 nt, Homo sapiens
guucaagaggcaagaagau

SEQ ID NO: 236133 - RNA, 19 nt, Homo sapiens
ggauuaguccagguacaga

SEQ ID NO: 236134 - RNA, 19 nt, Homo sapiens
gcugaaggagcuagagaag

SEQ ID NO: 236135 - RNA, 19 nt, Homo sapiens
aagcuggaauuccguaaaa

SEQ ID NO: 236136 - RNA, 19 nt, Homo sapiens
ccucuagggccaaggaguu

SEQ ID NO: 236137 - RNA, 19 nt, Homo sapiens
auucuugccucauccuaug

SEQ ID NO: 236138 - RNA, 19 nt, Homo sapiens
gcaaugaccuuauaaguga

SEQ ID NO: 236139 - RNA, 19 nt, Homo sapiens
ggacaaggcuacauauauu

SEQ ID NO: 236140 - RNA, 19 nt, Homo sapiens
uacaaucgcuguuuaguua

SEQ ID NO: 236141 - RNA, 19 nt, Homo sapiens
ccacuaaguuuaucaagaa

SEQ ID NO: 236142 - RNA, 19 nt, Homo sapiens
gaacaaauccacagaaugg

SEQ ID NO: 236143 - RNA, 19 nt, Homo sapiens
cagacuauauguccagaua

SEQ ID NO: 236144 - RNA, 19 nt, Homo sapiens
gguuaugauuugugucuua

SEQ ID NO: 236145 - RNA, 19 nt, Homo sapiens
ggaugaaagugaagaggaa

SEQ ID NO: 236146 - RNA, 19 nt, Homo sapiens
gguaaagaguagaaucuga

SEQ ID NO: 236147 - RNA, 19 nt, Homo sapiens
guaagccacuuguuugguu

SEQ ID NO: 236148 - RNA, 19 nt, Homo sapiens
uaaaggacaaggcuacaua

SEQ ID NO: 236149 - RNA, 19 nt, Homo sapiens
gcagaguggcagaccauua

SEQ ID NO: 236150 - RNA, 19 nt, Homo sapiens
guuacuagaugaacaaauc

SEQ ID NO: 236151 - RNA, 19 nt, Homo sapiens
gaagagcaccugcccaaag

SEQ ID NO: 236152 - RNA, 19 nt, Homo sapiens
uaagccacuuguuugguua

SEQ ID NO: 236153 - RNA, 19 nt, Homo sapiens
guaaagaguagaaucugaa

SEQ ID NO: 236154 - RNA, 19 nt, Homo sapiens
cagaauggguaaagaguag

SEQ ID NO: 236155 - RNA, 19 nt, Homo sapiens
gaguagaaucugaacuaua

SEQ ID NO: 236156 - RNA, 19 nt, Homo sapiens
gcacgaauuucagcaccaa

SEQ ID NO: 236157 - RNA, 19 nt, Homo sapiens
gcaccaagcaacugacaga

SEQ ID NO: 236158 - RNA, 19 nt, Homo sapiens
guuagggucuccuugaugu

SEQ ID NO: 236159 - RNA, 19 nt, Homo sapiens
gagcaccugcccaaaguuu

SEQ ID NO: 236160 - RNA, 19 nt, Homo sapiens
gaccauuaguugcugaguu

SEQ ID NO: 236161 - RNA, 19 nt, Homo sapiens
uuaguuggcuuccgaguuc

SEQ ID NO: 236162 - RNA, 19 nt, Homo sapiens
ggaaaugaaguacuuuagu

SEQ ID NO: 236163 - RNA, 19 nt, Homo sapiens
agacuuaggagcucaguuu

SEQ ID NO: 236164 - RNA, 19 nt, Homo sapiens
cauagcauguaaaggguuu

SEQ ID NO: 236165 - RNA, 19 nt, Homo sapiens
gaaucugaacuauaucuug

SEQ ID NO: 236166 - RNA, 19 nt, Homo sapiens
gaugauacaaucgcuguuu

SEQ ID NO: 236167 - RNA, 19 nt, Homo sapiens
ccaagcaacugacagaacu

SEQ ID NO: 236168 - RNA, 19 nt, Homo sapiens
ccaucccuaucuagacuua

SEQ ID NO: 236169 - RNA, 19 nt, Homo sapiens
gcaacugacagaacuggaa

SEQ ID NO: 236170 - RNA, 19 nt, Homo sapiens
ggauggaggugggagaaca

SEQ ID NO: 236171 - RNA, 19 nt, Homo sapiens
aagaguagaaucugaacua

SEQ ID NO: 236172 - RNA, 19 nt, Homo sapiens
ccacuuguuugguuaugau

SEQ ID NO: 236173 - RNA, 19 nt, Homo sapiens
gcaucgagauagccaacug

SEQ ID NO: 236174 - RNA, 19 nt, Homo sapiens
gaccuuauaagugacauuu

SEQ ID NO: 236175 - RNA, 19 nt, Homo sapiens
caacugacagaacuggaaa

SEQ ID NO: 236176 - RNA, 19 nt, Homo sapiens
gaugaacaaauccacagaa

SEQ ID NO: 236177 - RNA, 19 nt, Homo sapiens
augauacaaucgcuguuua

SEQ ID NO: 236178 - RNA, 19 nt, Homo sapiens
guccagauauuaauugacu

SEQ ID NO: 236179 - RNA, 19 nt, Homo sapiens
gagaugaccaaagcuaguu

SEQ ID NO: 236180 - RNA, 19 nt, Homo sapiens
guauauuaggccacuauuu

SEQ ID NO: 236181 - RNA, 19 nt, Homo sapiens
gagcucaguuugggaugga

SEQ ID NO: 236182 - RNA, 19 nt, Homo sapiens
gcgcgauccgcacgaauuu

SEQ ID NO: 236183 - RNA, 19 nt, Homo sapiens
aagagcaccugcccaaagu

SEQ ID NO: 236184 - RNA, 19 nt, Homo sapiens
ucgaguggaugaaagugaa

SEQ ID NO: 236185 - RNA, 19 nt, Homo sapiens
aggaaugccucuaagaaag

SEQ ID NO: 236186 - RNA, 19 nt, Homo sapiens
gaauggguaaagaguagaa

SEQ ID NO: 236187 - RNA, 19 nt, Homo sapiens
gaagaaaagggaacgagaa

SEQ ID NO: 236188 - RNA, 19 nt, Homo sapiens
cccacuaaguuuaucaaga

SEQ ID NO: 236189 - RNA, 19 nt, Homo sapiens
gacaaggcuacauauauuc

SEQ ID NO: 236190 - RNA, 19 nt, Homo sapiens
cuugggaaaugaaguacuu

SEQ ID NO: 236191 - RNA, 19 nt, Homo sapiens
agaguagaaucugaacuau

SEQ ID NO: 236192 - RNA, 19 nt, Homo sapiens
ggaaugccucuaagaaagg

SEQ ID NO: 236193 - RNA, 19 nt, Homo sapiens
cuaugugccugagugauga

SEQ ID NO: 236194 - RNA, 19 nt, Homo sapiens
cacauuugcacuccaguuu

SEQ ID NO: 236195 - RNA, 19 nt, Homo sapiens
ucagcggccagguggauua

SEQ ID NO: 236196 - RNA, 19 nt, Homo sapiens
gggaaaugaaguacuuuag

SEQ ID NO: 236197 - RNA, 19 nt, Homo sapiens
gcaggaugaaacagaagaa

SEQ ID NO: 236198 - RNA, 19 nt, Homo sapiens
ccugagugaugauacaauc

SEQ ID NO: 236199 - RNA, 19 nt, Homo sapiens
gaaugccucuaagaaaggu

SEQ ID NO: 236200 - RNA, 19 nt, Homo sapiens
guuucuaccucucuaugug

SEQ ID NO: 236201 - RNA, 19 nt, Homo sapiens
cagaguggcagaccauuag

SEQ ID NO: 236202 - RNA, 19 nt, Homo sapiens
cuuguuugguuaugauuug

SEQ ID NO: 236203 - RNA, 19 nt, Homo sapiens
acagaauggguaaagagua

SEQ ID NO: 236204 - RNA, 19 nt, Homo sapiens
cuaguuagggucuccuuga

SEQ ID NO: 236205 - RNA, 19 nt, Homo sapiens
gcgauccgcacgaauuuca

SEQ ID NO: 236206 - RNA, 19 nt, Homo sapiens
aggacaaggcuacauauau

SEQ ID NO: 236207 - RNA, 19 nt, Homo sapiens
cuuccgaguuccagacuau

SEQ ID NO: 236208 - RNA, 19 nt, Homo sapiens
ugggaaaugaaguacuuua

SEQ ID NO: 236209 - RNA, 19 nt, Homo sapiens
gaauuucagcaccaagcaa

SEQ ID NO: 236210 - RNA, 19 nt, Homo sapiens
ccacagaauggguaaagag

SEQ ID NO: 236211 - RNA, 19 nt, Homo sapiens
aaggacaaggcuacauaua

SEQ ID NO: 236212 - RNA, 19 nt, Homo sapiens
accauuaguugcugaguuc

SEQ ID NO: 236213 - RNA, 19 nt, Homo sapiens
ccaacugcuugcaccugaa

SEQ ID NO: 236214 - RNA, 19 nt, Homo sapiens
ugcaaugaccuuauaagug

SEQ ID NO: 236215 - RNA, 19 nt, Homo sapiens
ugaacaaauccacagaaug

SEQ ID NO: 236216 - RNA, 19 nt, Homo sapiens
augaacaaauccacagaau

SEQ ID NO: 236217 - RNA, 19 nt, Homo sapiens
gauacaaucgcuguuuagu

SEQ ID NO: 236218 - RNA, 19 nt, Homo sapiens
ugcuugcaaugaccuuaua

SEQ ID NO: 236219 - RNA, 19 nt, Homo sapiens
aaaggacaaggcuacauau

SEQ ID NO: 236220 - RNA, 19 nt, Homo sapiens
ccagauauuaauugacugu

SEQ ID NO: 236221 - RNA, 19 nt, Homo sapiens
uuccagaaccgcaggauga

SEQ ID NO: 236222 - RNA, 19 nt, Homo sapiens
auacaaucgcuguuuaguu

SEQ ID NO: 236223 - RNA, 19 nt, Homo sapiens
gccacuuguuugguuauga

SEQ ID NO: 236224 - RNA, 19 nt, Homo sapiens
caacugcuugcaccugaau

SEQ ID NO: 236225 - RNA, 19 nt, Homo sapiens
gugccugagugaugauaca

SEQ ID NO: 236226 - RNA, 19 nt, Homo sapiens
gcgggucucacguccacua

SEQ ID NO: 236227 - RNA, 19 nt, Homo sapiens
uaucuuugccucacuuagu

SEQ ID NO: 236228 - RNA, 19 nt, Homo sapiens
cuuguaagccacuuguuug

SEQ ID NO: 236229 - RNA, 19 nt, Homo sapiens
ucuuguaagccacuuguuu

SEQ ID NO: 236230 - RNA, 19 nt, Homo sapiens
gauggaggugggagaacaa

SEQ ID NO: 236231 - RNA, 19 nt, Homo sapiens
ucugaacuauaucuugaca

SEQ ID NO: 236232 - RNA, 19 nt, Homo sapiens
caaucgcuguuuaguuacu

SEQ ID NO: 236233 - RNA, 19 nt, Homo sapiens
uaguuagggucuccuugau

SEQ ID NO: 236234 - RNA, 19 nt, Homo sapiens
ggcuacauauauucagcuu

SEQ ID NO: 236235 - RNA, 19 nt, Homo sapiens
gcuaucuuugccucacuua

SEQ ID NO: 236236 - RNA, 19 nt, Homo sapiens
acaaggcuacauauauuca

SEQ ID NO: 236237 - RNA, 19 nt, Homo sapiens
gaguggcagaccauuaguu

SEQ ID NO: 236238 - RNA, 19 nt, Homo sapiens
caaaggagcugaacucaau

SEQ ID NO: 236239 - RNA, 19 nt, Homo sapiens
ggacuaaacuaucuguauu

SEQ ID NO: 236240 - RNA, 19 nt, Homo sapiens
caaauugucugguacuauu

SEQ ID NO: 236241 - RNA, 19 nt, Homo sapiens
gaaagagucucgacagaac

SEQ ID NO: 236242 - RNA, 19 nt, Homo sapiens
gaaggcugcuuacuaugaa

SEQ ID NO: 236243 - RNA, 19 nt, Homo sapiens
gcgcgcagcugguggaauu

SEQ ID NO: 236244 - RNA, 19 nt, Homo sapiens
ggauuaagaccgcaaauug

SEQ ID NO: 236245 - RNA, 19 nt, Homo sapiens
caacacacuuuggucauuu

SEQ ID NO: 236246 - RNA, 19 nt, Homo sapiens
caccacaguuuauugauuu

SEQ ID NO: 236247 - RNA, 19 nt, Homo sapiens
acacacacauacauaauug

SEQ ID NO: 236248 - RNA, 19 nt, Homo sapiens
ucauuucguucccugauua

SEQ ID NO: 236249 - RNA, 19 nt, Homo sapiens
ccacagauaucaaaagaaa

SEQ ID NO: 236250 - RNA, 19 nt, Homo sapiens
ccaaaucacagcccaauau

SEQ ID NO: 236251 - RNA, 19 nt, Homo sapiens
aaucacagcccaauaugua

SEQ ID NO: 236252 - RNA, 19 nt, Homo sapiens
gcaaaacuacggacacuua

SEQ ID NO: 236253 - RNA, 19 nt, Homo sapiens
gauccuucccuguaaauuu

SEQ ID NO: 236254 - RNA, 19 nt, Homo sapiens
gcccagcucucucaggauu

SEQ ID NO: 236255 - RNA, 19 nt, Homo sapiens
cagccgagcuuaggaauuc

SEQ ID NO: 236256 - RNA, 19 nt, Homo sapiens
gaaaaggaauuccacuuca

SEQ ID NO: 236257 - RNA, 19 nt, Homo sapiens
ucaccacaguuuauugauu

SEQ ID NO: 236258 - RNA, 19 nt, Homo sapiens
gaaaacacacacauacaua

SEQ ID NO: 236259 - RNA, 19 nt, Homo sapiens
ggacuccaaucugguaaug

SEQ ID NO: 236260 - RNA, 19 nt, Homo sapiens
ugaacuaguugagagagua

SEQ ID NO: 236261 - RNA, 19 nt, Homo sapiens
guaauggugucccaaaggu

SEQ ID NO: 236262 - RNA, 19 nt, Homo sapiens
ccacaguccucaccacagu

SEQ ID NO: 236263 - RNA, 19 nt, Homo sapiens
acacuuuggucauuucuca

SEQ ID NO: 236264 - RNA, 19 nt, Homo sapiens
gauuaagaccgcaaauugu

SEQ ID NO: 236265 - RNA, 19 nt, Homo sapiens
uucguucccugauuauuua

SEQ ID NO: 236266 - RNA, 19 nt, Homo sapiens
guaguugacauaaaggauu

SEQ ID NO: 236267 - RNA, 19 nt, Homo sapiens
gaccgcaaauuguccuuca

SEQ ID NO: 236268 - RNA, 19 nt, Homo sapiens
acaacacacuuuggucauu

SEQ ID NO: 236269 - RNA, 19 nt, Homo sapiens
ugaagcgagucauuucguu

SEQ ID NO: 236270 - RNA, 19 nt, Homo sapiens
gacacugacuauccagguu

SEQ ID NO: 236271 - RNA, 19 nt, Homo sapiens
gcaucggacuaaacuaucu

SEQ ID NO: 236272 - RNA, 19 nt, Homo sapiens
ccacuucaaccgcuacuug

SEQ ID NO: 236273 - RNA, 19 nt, Homo sapiens
agaaggcugcuuacuauga

SEQ ID NO: 236274 - RNA, 19 nt, Homo sapiens
guuuguaguugacauaaag

SEQ ID NO: 236275 - RNA, 19 nt, Homo sapiens
cgaacucgcggcaaaauua

SEQ ID NO: 236276 - RNA, 19 nt, Homo sapiens
caaaucacagcccaauaug

SEQ ID NO: 236277 - RNA, 19 nt, Homo sapiens
gcaugaaguacaagaagga

SEQ ID NO: 236278 - RNA, 19 nt, Homo sapiens
ggauucagcagacauugga

SEQ ID NO: 236279 - RNA, 19 nt, Homo sapiens
cauuggagguggcagugaa

SEQ ID NO: 236280 - RNA, 19 nt, Homo sapiens
ugaaagagucucgacagaa

SEQ ID NO: 236281 - RNA, 19 nt, Homo sapiens
ccacaaaggagcugaacuc

SEQ ID NO: 236282 - RNA, 19 nt, Homo sapiens
agugaaggauacaguggua

SEQ ID NO: 236283 - RNA, 19 nt, Homo sapiens
acagugguagucaauguua

SEQ ID NO: 236284 - RNA, 19 nt, Homo sapiens
aaccguggcugguguuugu

SEQ ID NO: 236285 - RNA, 19 nt, Homo sapiens
ccaaacugacgcaucugua

SEQ ID NO: 236286 - RNA, 19 nt, Homo sapiens
auacagugguagucaaugu

SEQ ID NO: 236287 - RNA, 19 nt, Homo sapiens
caaacugacgcaucuguag

SEQ ID NO: 236288 - RNA, 19 nt, Homo sapiens
aauuaccucucuugcugua

SEQ ID NO: 236289 - RNA, 19 nt, Homo sapiens
gagguggcagugaaggaua

SEQ ID NO: 236290 - RNA, 19 nt, Homo sapiens
gacagaacuccaagcagaa

SEQ ID NO: 236291 - RNA, 19 nt, Homo sapiens
gaacuaguugagagaguag

SEQ ID NO: 236292 - RNA, 19 nt, Homo sapiens
ggauacagugguagucaau

SEQ ID NO: 236293 - RNA, 19 nt, Homo sapiens
ucacggaacgccagaucaa

SEQ ID NO: 236294 - RNA, 19 nt, Homo sapiens
uggccaaccugcugaaucu

SEQ ID NO: 236295 - RNA, 19 nt, Homo sapiens
ugacauaaaggauuaagac

SEQ ID NO: 236296 - RNA, 19 nt, Homo sapiens
ggccacauuucaccuccuu

SEQ ID NO: 236297 - RNA, 19 nt, Homo sapiens
guggagugccugccaagaa

SEQ ID NO: 236298 - RNA, 19 nt, Homo sapiens
guacaagaaggaccagaag

SEQ ID NO: 236299 - RNA, 19 nt, Homo sapiens
ccagcucucucaggauuca

SEQ ID NO: 236300 - RNA, 19 nt, Homo sapiens
ccucaccacaguuuauuga

SEQ ID NO: 236301 - RNA, 19 nt, Homo sapiens
gucauuucguucccugauu

SEQ ID NO: 236302 - RNA, 19 nt, Homo sapiens
uugggugacucgccauaaa

SEQ ID NO: 236303 - RNA, 19 nt, Homo sapiens
gcaacuucgucgaguccau

SEQ ID NO: 236304 - RNA, 19 nt, Homo sapiens
gguguuuguaguugacaua

SEQ ID NO: 236305 - RNA, 19 nt, Homo sapiens
uuucguucccugauuauuu

SEQ ID NO: 236306 - RNA, 19 nt, Homo sapiens
cggacuaaacuaucuguau

SEQ ID NO: 236307 - RNA, 19 nt, Homo sapiens
aauggugucccaaagguaa

SEQ ID NO: 236308 - RNA, 19 nt, Homo sapiens
auccuucccuguaaauuug

SEQ ID NO: 236309 - RNA, 19 nt, Homo sapiens
caucccaccuacacagauc

SEQ ID NO: 236310 - RNA, 19 nt, Homo sapiens
gccaaaucacagcccaaua

SEQ ID NO: 236311 - RNA, 19 nt, Homo sapiens
ucaagaaaacacacacaua

SEQ ID NO: 236312 - RNA, 19 nt, Homo sapiens
augaaagagucucgacaga

SEQ ID NO: 236313 - RNA, 19 nt, Homo sapiens
uggagugccugccaagaag

SEQ ID NO: 236314 - RNA, 19 nt, Homo sapiens
ccacauuucaccuccuuag

SEQ ID NO: 236315 - RNA, 19 nt, Homo sapiens
uuaccucucuugcuguagu

SEQ ID NO: 236316 - RNA, 19 nt, Homo sapiens
ggagguggcagugaaggau

SEQ ID NO: 236317 - RNA, 19 nt, Homo sapiens
ucaaauugucugguacuau

SEQ ID NO: 236318 - RNA, 19 nt, Homo sapiens
uggcugguguuuguaguug

SEQ ID NO: 236319 - RNA, 19 nt, Homo sapiens
gcgcaugaaguacaagaag

SEQ ID NO: 236320 - RNA, 19 nt, Homo sapiens
aaaaggaauuccacuucaa

SEQ ID NO: 236321 - RNA, 19 nt, Homo sapiens
gcagcugguggaauuggaa

SEQ ID NO: 236322 - RNA, 19 nt, Homo sapiens
gagcagcagccaccacaac

SEQ ID NO: 236323 - RNA, 19 nt, Homo sapiens
gagaguaguuuugaacagu

SEQ ID NO: 236324 - RNA, 19 nt, Homo sapiens
auccuugucugaauguauu

SEQ ID NO: 236325 - RNA, 19 nt, Homo sapiens
cgucuagcuuaguuucaga

SEQ ID NO: 236326 - RNA, 19 nt, Homo sapiens
caagaaaacacacacauac

SEQ ID NO: 236327 - RNA, 19 nt, Homo sapiens
aaaggugggcccaaugcuu

SEQ ID NO: 236328 - RNA, 19 nt, Homo sapiens
uaauggugucccaaaggua

SEQ ID NO: 236329 - RNA, 19 nt, Homo sapiens
acuccaaucugguaauggu

SEQ ID NO: 236330 - RNA, 19 nt, Homo sapiens
acaaaggagcugaacucaa

SEQ ID NO: 236331 - RNA, 19 nt, Homo sapiens
acaguccucaccacaguuu

SEQ ID NO: 236332 - RNA, 19 nt, Homo sapiens
ucaggauucagcagacauu

SEQ ID NO: 236333 - RNA, 19 nt, Homo sapiens
gguaauggugucccaaagg

SEQ ID NO: 236334 - RNA, 19 nt, Homo sapiens
aauuugacagugccacaua

SEQ ID NO: 236335 - RNA, 19 nt, Homo sapiens
gugguagucaauguuauuu

SEQ ID NO: 236336 - RNA, 19 nt, Homo sapiens
gaaggauacagugguaguc

SEQ ID NO: 236337 - RNA, 19 nt, Homo sapiens
ccgcaaauuguccuucaug

SEQ ID NO: 236338 - RNA, 19 nt, Homo sapiens
gggauucucucucuaagua

SEQ ID NO: 236339 - RNA, 19 nt, Homo sapiens
ucacauggcugcccaacuu

SEQ ID NO: 236340 - RNA, 19 nt, Homo sapiens
gauucucucucuaaguaua

SEQ ID NO: 236341 - RNA, 19 nt, Homo sapiens
ugaagaaggugcacgugaa

SEQ ID NO: 236342 - RNA, 19 nt, Homo sapiens
ucaccucgcugggcucuaa

SEQ ID NO: 236343 - RNA, 19 nt, Homo sapiens
gaucauaagcugcccaaca

SEQ ID NO: 236344 - RNA, 19 nt, Homo sapiens
gaaauuaauggucaugagu

SEQ ID NO: 236345 - RNA, 19 nt, Homo sapiens
acacggaccugacgaccuu

SEQ ID NO: 236346 - RNA, 19 nt, Homo sapiens
ggucaugaguucguauaug

SEQ ID NO: 236347 - RNA, 19 nt, Homo sapiens
gaagaaggugcacgugaau

SEQ ID NO: 236348 - RNA, 19 nt, Homo sapiens
gagcuacugagaacauaaa

SEQ ID NO: 236349 - RNA, 19 nt, Homo sapiens
uggcgagucauuaaacuua

SEQ ID NO: 236350 - RNA, 19 nt, Homo sapiens
ucucaaaugugccauagca

SEQ ID NO: 236351 - RNA, 19 nt, Homo sapiens
ccaacccggugauaaacuu

SEQ ID NO: 236352 - RNA, 19 nt, Homo sapiens
gcuacuugauuacacguau

SEQ ID NO: 236353 - RNA, 19 nt, Homo sapiens
gucaugaguucguauaugg

SEQ ID NO: 236354 - RNA, 19 nt, Homo sapiens
ggagggcccuauggaagga

SEQ ID NO: 236355 - RNA, 19 nt, Homo sapiens
ggcaggagcuacugagaac

SEQ ID NO: 236356 - RNA, 19 nt, Homo sapiens
gcgagucauuaaacuuaug

SEQ ID NO: 236357 - RNA, 19 nt, Homo sapiens
ggucaucguccucaucuuc

SEQ ID NO: 236358 - RNA, 19 nt, Homo sapiens
cauaagcugcccaacacua

SEQ ID NO: 236359 - RNA, 19 nt, Homo sapiens
gcacgugaauucggugaac

SEQ ID NO: 236360 - RNA, 19 nt, Homo sapiens
ugaaauuaauggucaugag

SEQ ID NO: 236361 - RNA, 19 nt, Homo sapiens
gcucucaaaugugccauag

SEQ ID NO: 236362 - RNA, 19 nt, Homo sapiens
aaucuuggcgagucauuaa

SEQ ID NO: 236363 - RNA, 19 nt, Homo sapiens
ggaccugacgaccuuauag

SEQ ID NO: 236364 - RNA, 19 nt, Homo sapiens
gcaaguccuagaacuggaa

SEQ ID NO: 236365 - RNA, 19 nt, Homo sapiens
ggagcuacugagaacauaa

SEQ ID NO: 236366 - RNA, 19 nt, Homo sapiens
gcagcaaguccuagaacug

SEQ ID NO: 236367 - RNA, 19 nt, Homo sapiens
ggcgagucauuaaacuuau

SEQ ID NO: 236368 - RNA, 19 nt, Homo sapiens
uggcuggccuggucacaug

SEQ ID NO: 236369 - RNA, 19 nt, Homo sapiens
ugacgaccuuauagaagug

SEQ ID NO: 236370 - RNA, 19 nt, Homo sapiens
gaccugacgaccuuauaga

SEQ ID NO: 236371 - RNA, 19 nt, Homo sapiens
uacagccgauggccaaaga

SEQ ID NO: 236372 - RNA, 19 nt, Homo sapiens
cguauauggugaacuccaa

SEQ ID NO: 236373 - RNA, 19 nt, Homo sapiens
cuugauuacacguauguua

SEQ ID NO: 236374 - RNA, 19 nt, Homo sapiens
cugacgaccuuauagaagu

SEQ ID NO: 236375 - RNA, 19 nt, Homo sapiens
ggcaggggcucucaaaugu

SEQ ID NO: 236376 - RNA, 19 nt, Homo sapiens
uuuaacagguaucugacaa

SEQ ID NO: 236377 - RNA, 19 nt, Homo sapiens
uaauggucaugaguucgua

SEQ ID NO: 236378 - RNA, 19 nt, Homo sapiens
agaaggugcacgugaauuc

SEQ ID NO: 236379 - RNA, 19 nt, Homo sapiens
aauuaauggucaugaguuc

SEQ ID NO: 236380 - RNA, 19 nt, Homo sapiens
auaagcugcccaacacuaa

SEQ ID NO: 236381 - RNA, 19 nt, Homo sapiens
caucuuccuccucaucuug

SEQ ID NO: 236382 - RNA, 19 nt, Homo sapiens
uuccagaaccggaggauga

SEQ ID NO: 236383 - RNA, 19 nt, Homo sapiens
cuacuugauuacacguaug

SEQ ID NO: 236384 - RNA, 19 nt, Homo sapiens
uaagcugcccaacacuaaa

SEQ ID NO: 236385 - RNA, 19 nt, Homo sapiens
acauggcugcccaacuuua

SEQ ID NO: 236386 - RNA, 19 nt, Homo sapiens
uuuauucaguugacagcaa

SEQ ID NO: 236387 - RNA, 19 nt, Homo sapiens
auggugaacuccaaguaug

SEQ ID NO: 236388 - RNA, 19 nt, Homo sapiens
gcaggucaucguccucauc

SEQ ID NO: 236389 - RNA, 19 nt, Homo sapiens
ugucggagcgccagaucaa

SEQ ID NO: 236390 - RNA, 19 nt, Homo sapiens
ggcagcaaguccuagaacu

SEQ ID NO: 236391 - RNA, 19 nt, Homo sapiens
uauggugaacuccaaguau

SEQ ID NO: 236392 - RNA, 19 nt, Homo sapiens
cugcccaacuuuauucagu

SEQ ID NO: 236393 - RNA, 19 nt, Homo sapiens
aggagcuacugagaacaua

SEQ ID NO: 236394 - RNA, 19 nt, Homo sapiens
ccgaaggccugacaaauua

SEQ ID NO: 236395 - RNA, 19 nt, Homo sapiens
caacguaaacuuccuaaug

SEQ ID NO: 236396 - RNA, 19 nt, Homo sapiens
aaucagagcucgucuccuu

SEQ ID NO: 236397 - RNA, 19 nt, Homo sapiens
uuacggauacgauaacuua

SEQ ID NO: 236398 - RNA, 19 nt, Homo sapiens
cccaagagcuggaggaaga

SEQ ID NO: 236399 - RNA, 19 nt, Homo sapiens
ccagaccacuuaaaucaga

SEQ ID NO: 236400 - RNA, 19 nt, Homo sapiens
ugucugagcuagugauuug

SEQ ID NO: 236401 - RNA, 19 nt, Homo sapiens
gcaagaggccgagcuggua

SEQ ID NO: 236402 - RNA, 19 nt, Homo sapiens
aacguaaacuuccuaauga

SEQ ID NO: 236403 - RNA, 19 nt, Homo sapiens
cauagaagcuguccuugag

SEQ ID NO: 236404 - RNA, 19 nt, Homo sapiens
aggccgagcugguacaaua

SEQ ID NO: 236405 - RNA, 19 nt, Homo sapiens
auacugaccuuguagcuau

SEQ ID NO: 236406 - RNA, 19 nt, Homo sapiens
gaccuuaccuguguuucaa

SEQ ID NO: 236407 - RNA, 19 nt, Homo sapiens
ggacaaauuucccguuucc

SEQ ID NO: 236408 - RNA, 19 nt, Homo sapiens
acaagcagcuccugguaga

SEQ ID NO: 236409 - RNA, 19 nt, Homo sapiens
gccgaaggccugacaaauu

SEQ ID NO: 236410 - RNA, 19 nt, Homo sapiens
ggacccagaccacuuaaau

SEQ ID NO: 236411 - RNA, 19 nt, Homo sapiens
gguacaauauccugacugu

SEQ ID NO: 236412 - RNA, 19 nt, Homo sapiens
uuacagagacagccgauuu

SEQ ID NO: 236413 - RNA, 19 nt, Homo sapiens
gagagggauuuggguguuu

SEQ ID NO: 236414 - RNA, 19 nt, Homo sapiens
acaauauccugacuguaaa

SEQ ID NO: 236415 - RNA, 19 nt, Homo sapiens
ccugacaaauuaacuucua

SEQ ID NO: 236416 - RNA, 19 nt, Homo sapiens
aaagaagaaucgagguuuc

SEQ ID NO: 236417 - RNA, 19 nt, Homo sapiens
guaauuugauacugaccuu

SEQ ID NO: 236418 - RNA, 19 nt, Homo sapiens
gaagaggaagacaaaccua

SEQ ID NO: 236419 - RNA, 19 nt, Homo sapiens
cgaggacccagaccacuua

SEQ ID NO: 236420 - RNA, 19 nt, Homo sapiens
aaggacaaauuucccguuu

SEQ ID NO: 236421 - RNA, 19 nt, Homo sapiens
gagcucgucuccuucucaa

SEQ ID NO: 236422 - RNA, 19 nt, Homo sapiens
guaaaucguccagugguaa

SEQ ID NO: 236423 - RNA, 19 nt, Homo sapiens
gggcgucggcgauuauauu

SEQ ID NO: 236424 - RNA, 19 nt, Homo sapiens
agacgaagaggaagacaaa

SEQ ID NO: 236425 - RNA, 19 nt, Homo sapiens
caacaacguaaacuuccua

SEQ ID NO: 236426 - RNA, 19 nt, Homo sapiens
gaaggguaauuugauacug

SEQ ID NO: 236427 - RNA, 19 nt, Homo sapiens
ucacauagaagcuguccuu

SEQ ID NO: 236428 - RNA, 19 nt, Homo sapiens
aaggguaauuugauacuga

SEQ ID NO: 236429 - RNA, 19 nt, Homo sapiens
ccaucaaucccacuuacua

SEQ ID NO: 236430 - RNA, 19 nt, Homo sapiens
agagggauuuggguguuua

SEQ ID NO: 236431 - RNA, 19 nt, Homo sapiens
acaggagaaugaaauggaa

SEQ ID NO: 236432 - RNA, 19 nt, Homo sapiens
ccacaagcagcuccuggua

SEQ ID NO: 236433 - RNA, 19 nt, Homo sapiens
gcucgucuccuucucaaau

SEQ ID NO: 236434 - RNA, 19 nt, Homo sapiens
uguaaaucguccaguggua

SEQ ID NO: 236435 - RNA, 19 nt, Homo sapiens
ugaacccgcuguacuccaa

SEQ ID NO: 236436 - RNA, 19 nt, Homo sapiens
auggaaggguaauuugaua

SEQ ID NO: 236437 - RNA, 19 nt, Homo sapiens
ucacugcucuugagguuuu

SEQ ID NO: 236438 - RNA, 19 nt, Homo sapiens
ggaccuuaccuguguuuca

SEQ ID NO: 236439 - RNA, 19 nt, Homo sapiens
uuaccuguguuucaagcua

SEQ ID NO: 236440 - RNA, 19 nt, Homo sapiens
ugagagggauuuggguguu

SEQ ID NO: 236441 - RNA, 19 nt, Homo sapiens
ugucacugcucuugagguu

SEQ ID NO: 236442 - RNA, 19 nt, Homo sapiens
guuucaagcuaccuucaug

SEQ ID NO: 236443 - RNA, 19 nt, Homo sapiens
cagaacaggagaaugaaau

SEQ ID NO: 236444 - RNA, 19 nt, Homo sapiens
gauacugaccuuguagcua

SEQ ID NO: 236445 - RNA, 19 nt, Homo sapiens
gagccgaaggccugacaaa

SEQ ID NO: 236446 - RNA, 19 nt, Homo sapiens
gaacaggagaaugaaaugg

SEQ ID NO: 236447 - RNA, 19 nt, Homo sapiens
gaaaagaagaaucgagguu

SEQ ID NO: 236448 - RNA, 19 nt, Homo sapiens
uacagucgcuuccaaacuc

SEQ ID NO: 236449 - RNA, 19 nt, Homo sapiens
caaauguuuccguggauga

SEQ ID NO: 236450 - RNA, 19 nt, Homo sapiens
cguaaacuuccuaaugauu

SEQ ID NO: 236451 - RNA, 19 nt, Homo sapiens
cuagugauuugccucaaca

SEQ ID NO: 236452 - RNA, 19 nt, Homo sapiens
uuuaaugucugagcuagug

SEQ ID NO: 236453 - RNA, 19 nt, Homo sapiens
uuacuacgacugucacuuc

SEQ ID NO: 236454 - RNA, 19 nt, Homo sapiens
gacaccaccuauuuucuuu

SEQ ID NO: 236455 - RNA, 19 nt, Homo sapiens
ggccaucaaucccacuuac

SEQ ID NO: 236456 - RNA, 19 nt, Homo sapiens
ccucaacaacguaaacuuc

SEQ ID NO: 236457 - RNA, 19 nt, Homo sapiens
ccaccuauuuucuuuguug

SEQ ID NO: 236458 - RNA, 19 nt, Homo sapiens
ggaaggguaauuugauacu

SEQ ID NO: 236459 - RNA, 19 nt, Homo sapiens
ccagaacaggagaaugaaa

SEQ ID NO: 236460 - RNA, 19 nt, Homo sapiens
ccgcgaaguuuuacggaua

SEQ ID NO: 236461 - RNA, 19 nt, Homo sapiens
gcgaggacccagaccacuu

SEQ ID NO: 236462 - RNA, 19 nt, Homo sapiens
ugauuugccucaacaacgu

SEQ ID NO: 236463 - RNA, 19 nt, Homo sapiens
cuugagcuguccuauggaa

SEQ ID NO: 236464 - RNA, 19 nt, Homo sapiens
acauagaagcuguccuuga

SEQ ID NO: 236465 - RNA, 19 nt, Homo sapiens
ccacuuacuacgacuguca

SEQ ID NO: 236466 - RNA, 19 nt, Homo sapiens
uuccagaacaggagaauga

SEQ ID NO: 236467 - RNA, 19 nt, Homo sapiens
ccugguagacgaagaggaa

SEQ ID NO: 236468 - RNA, 19 nt, Homo sapiens
gcuagugauuugccucaac

SEQ ID NO: 236469 - RNA, 19 nt, Homo sapiens
ugaccuuguagcuauauuu

SEQ ID NO: 236470 - RNA, 19 nt, Homo sapiens
uccuugagcuguccuaugg

SEQ ID NO: 236471 - RNA, 19 nt, Homo sapiens
ggacaccaccuauuuucuu

SEQ ID NO: 236472 - RNA, 19 nt, Homo sapiens
ccacagacuauuaaaacua

SEQ ID NO: 236473 - RNA, 19 nt, Homo sapiens
cgaaggccugacaaauuaa

SEQ ID NO: 236474 - RNA, 19 nt, Homo sapiens
ucaugucacugcucuugag

SEQ ID NO: 236475 - RNA, 19 nt, Homo sapiens
acccagaccacuuaaauca

SEQ ID NO: 236476 - RNA, 19 nt, Homo sapiens
uaaaucguccagugguaau

SEQ ID NO: 236477 - RNA, 19 nt, Homo sapiens
cuauggaaggguaauuuga

SEQ ID NO: 236478 - RNA, 19 nt, Homo sapiens
cggauacgauaacuuacag

SEQ ID NO: 236479 - RNA, 19 nt, Homo sapiens
cucgcucucuggcugcuua

SEQ ID NO: 236480 - RNA, 19 nt, Homo sapiens
gacccagaccacuuaaauc

SEQ ID NO: 236481 - RNA, 19 nt, Homo sapiens
cccaaugaguucguacuuc

SEQ ID NO: 236482 - RNA, 19 nt, Homo sapiens
uauccugacuguaaaucgu

SEQ ID NO: 236483 - RNA, 19 nt, Homo sapiens
uauggaaggguaauuugau

SEQ ID NO: 236484 - RNA, 19 nt, Homo sapiens
gagggauuuggguguuuaa

SEQ ID NO: 236485 - RNA, 19 nt, Homo sapiens
ucaagcuaccuucauguca

SEQ ID NO: 236486 - RNA, 19 nt, Homo sapiens
cuaauaaucaccauaugcu

SEQ ID NO: 236487 - RNA, 19 nt, Homo sapiens
gaaggacggggaaacgaaa

SEQ ID NO: 236488 - RNA, 19 nt, Homo sapiens
gaaaacaacaaggacaaau

SEQ ID NO: 236489 - RNA, 19 nt, Homo sapiens
ucaccgagagacagguaaa

SEQ ID NO: 236490 - RNA, 19 nt, Homo sapiens
ccuauggaaggguaauuug

SEQ ID NO: 236491 - RNA, 19 nt, Homo sapiens
gcgcuuauguugaugauuu

SEQ ID NO: 236492 - RNA, 19 nt, Homo sapiens
gaaaagugcuguaguuuag

SEQ ID NO: 236493 - RNA, 19 nt, Homo sapiens
ggagcccucucuuguguaa

SEQ ID NO: 236494 - RNA, 19 nt, Homo sapiens
gaauuccucuucaacaugu

SEQ ID NO: 236495 - RNA, 19 nt, Homo sapiens
aagaagaagcgaacaaaua

SEQ ID NO: 236496 - RNA, 19 nt, Homo sapiens
gguguuuggugcuugauuu

SEQ ID NO: 236497 - RNA, 19 nt, Homo sapiens
ccaaauaccagacgcuuga

SEQ ID NO: 236498 - RNA, 19 nt, Homo sapiens
gcaagaagaagcgaacaaa

SEQ ID NO: 236499 - RNA, 19 nt, Homo sapiens
gaaacucuccagcgacuug

SEQ ID NO: 236500 - RNA, 19 nt, Homo sapiens
guuggucucugagguauuu

SEQ ID NO: 236501 - RNA, 19 nt, Homo sapiens
cagcggauuuguuguuguu

SEQ ID NO: 236502 - RNA, 19 nt, Homo sapiens
gcucaagggcagcggauuu

SEQ ID NO: 236503 - RNA, 19 nt, Homo sapiens
gaguucgccucguguaguu

SEQ ID NO: 236504 - RNA, 19 nt, Homo sapiens
cgacuuggacuucuucuuc

SEQ ID NO: 236505 - RNA, 19 nt, Homo sapiens
agaagaagcgaacaaauag

SEQ ID NO: 236506 - RNA, 19 nt, Homo sapiens
cgcuugagcuggagaaaga

SEQ ID NO: 236507 - RNA, 19 nt, Homo sapiens
ggccaggauucucaaccua

SEQ ID NO: 236508 - RNA, 19 nt, Homo sapiens
gcuacgagguggccaggau

SEQ ID NO: 236509 - RNA, 19 nt, Homo sapiens
uuucagaaccguaggauga

SEQ ID NO: 236510 - RNA, 19 nt, Homo sapiens
ggaccucgguggagaucuc

SEQ ID NO: 236511 - RNA, 19 nt, Homo sapiens
caagaagaagcgaacaaau

SEQ ID NO: 236512 - RNA, 19 nt, Homo sapiens
ggcggacaguguaauguug

SEQ ID NO: 236513 - RNA, 19 nt, Homo sapiens
gggcagcggauuuguuguu

SEQ ID NO: 236514 - RNA, 19 nt, Homo sapiens
ggaccgagggcugcaagaa

SEQ ID NO: 236515 - RNA, 19 nt, Homo sapiens
ucucuuuccugcuccauug

SEQ ID NO: 236516 - RNA, 19 nt, Homo sapiens
uaacagagagacaggucaa

SEQ ID NO: 236517 - RNA, 19 nt, Homo sapiens
cuacguggacucgcuuaua

SEQ ID NO: 236518 - RNA, 19 nt, Homo sapiens
gaagaagcgaacaaauagu

SEQ ID NO: 236519 - RNA, 19 nt, Homo sapiens
ucagaaccguaggaugaaa

SEQ ID NO: 236520 - RNA, 19 nt, Homo sapiens
uacguggacucgcuuauag

SEQ ID NO: 236521 - RNA, 19 nt, Homo sapiens
ugaaaagugcuguaguuua

SEQ ID NO: 236522 - RNA, 19 nt, Homo sapiens
uccauugguuccuuaagaa

SEQ ID NO: 236523 - RNA, 19 nt, Homo sapiens
gcagcggauuuguuguugu

SEQ ID NO: 236524 - RNA, 19 nt, Homo sapiens
gcagcaacuugacccaaac

SEQ ID NO: 236525 - RNA, 19 nt, Homo sapiens
caagggcagcggauuuguu

SEQ ID NO: 236526 - RNA, 19 nt, Homo sapiens
gccaggauucucaaccuaa

SEQ ID NO: 236527 - RNA, 19 nt, Homo sapiens
aaagugcuguaguuuaguc

SEQ ID NO: 236528 - RNA, 19 nt, Homo sapiens
cucggaagcuggagaguca

SEQ ID NO: 236529 - RNA, 19 nt, Homo sapiens
cuccauugguuccuuaaga

SEQ ID NO: 236530 - RNA, 19 nt, Homo sapiens
ggcagcggauuuguuguug

SEQ ID NO: 236531 - RNA, 19 nt, Homo sapiens
gcugcuagcccacggugaa

SEQ ID NO: 236532 - RNA, 19 nt, Homo sapiens
gaaggcagagcgacaacag

SEQ ID NO: 236533 - RNA, 19 nt, Homo sapiens
accgagggcugcaagaaga

SEQ ID NO: 236534 - RNA, 19 nt, Homo sapiens
ggagaaaugccccaaagga

SEQ ID NO: 236535 - RNA, 19 nt, Homo sapiens
ggccugcgggcucuaauug

SEQ ID NO: 236536 - RNA, 19 nt, Homo sapiens
gagguggccaggauucuca

SEQ ID NO: 236537 - RNA, 19 nt, Homo sapiens
ugaaggaggaggagaagca

SEQ ID NO: 236538 - RNA, 19 nt, Homo sapiens
uguauuugcucguuuacgu

SEQ ID NO: 236539 - RNA, 19 nt, Homo sapiens
uagaagugacugugugguu

SEQ ID NO: 236540 - RNA, 19 nt, Homo sapiens
gacuuggacuucuucuucu

SEQ ID NO: 236541 - RNA, 19 nt, Homo sapiens
ccagcgacuuggacuucuu

SEQ ID NO: 236542 - RNA, 19 nt, Homo sapiens
uggaugcggucgcgucugu

SEQ ID NO: 236543 - RNA, 19 nt, Homo sapiens
gcgcugucccuacaccaaa

SEQ ID NO: 236544 - RNA, 19 nt, Homo sapiens
cugauuuacucccgguauu

SEQ ID NO: 236545 - RNA, 19 nt, Homo sapiens
agcagcaacuugacccaaa

SEQ ID NO: 236546 - RNA, 19 nt, Homo sapiens
cugcuccauugguuccuua

SEQ ID NO: 236547 - RNA, 19 nt, Homo sapiens
guggcacccucagcaacua

SEQ ID NO: 236548 - RNA, 19 nt, Homo sapiens
gaucuccagugaggcuuag

SEQ ID NO: 236549 - RNA, 19 nt, Homo sapiens
ucugaaaagugcuguaguu

SEQ ID NO: 236550 - RNA, 19 nt, Homo sapiens
ccauugguuccuuaagaaa

SEQ ID NO: 236551 - RNA, 19 nt, Homo sapiens
cucuguauuugcucguuua

SEQ ID NO: 236552 - RNA, 19 nt, Homo sapiens
gugguuggucucugaggua

SEQ ID NO: 236553 - RNA, 19 nt, Homo sapiens
guggguguuuggugcuuga

SEQ ID NO: 236554 - RNA, 19 nt, Homo sapiens
ccaggauucucaaccuaac

SEQ ID NO: 236555 - RNA, 19 nt, Homo sapiens
ggggagcccucucuugugu

SEQ ID NO: 236556 - RNA, 19 nt, Homo sapiens
aagggcagcggauuuguug

SEQ ID NO: 236557 - RNA, 19 nt, Homo sapiens
gaccgagggcugcaagaag

SEQ ID NO: 236558 - RNA, 19 nt, Homo sapiens
gcaacuugacccaaacaac

SEQ ID NO: 236559 - RNA, 19 nt, Homo sapiens
agcccucucuuguguaaau

SEQ ID NO: 236560 - RNA, 19 nt, Homo sapiens
aaagaugagcaaggagaaa

SEQ ID NO: 236561 - RNA, 19 nt, Homo sapiens
agaauuccucuucaacaug

SEQ ID NO: 236562 - RNA, 19 nt, Homo sapiens
gcugucccuacaccaaaua

SEQ ID NO: 236563 - RNA, 19 nt, Homo sapiens
aagaagcgaacaaauaguc

SEQ ID NO: 236564 - RNA, 19 nt, Homo sapiens
gguuuguccucagugcauu

SEQ ID NO: 236565 - RNA, 19 nt, Homo sapiens
auugguuccuuaagaaaug

SEQ ID NO: 236566 - RNA, 19 nt, Homo sapiens
uuagcggacugauuuacuc

SEQ ID NO: 236567 - RNA, 19 nt, Homo sapiens
gaggaggagaagcagcauu

SEQ ID NO: 236568 - RNA, 19 nt, Homo sapiens
gaacagaucuugucgaaua

SEQ ID NO: 236569 - RNA, 19 nt, Homo sapiens
gcaauuggcucacugcaaa

SEQ ID NO: 236570 - RNA, 19 nt, Homo sapiens
gaaugaaacucaagaagau

SEQ ID NO: 236571 - RNA, 19 nt, Homo sapiens
gaaugugcauccuuauaua

SEQ ID NO: 236572 - RNA, 19 nt, Homo sapiens
gaaggcagcuccacuguca

SEQ ID NO: 236573 - RNA, 19 nt, Homo sapiens
gaauacauccaguacuuua

SEQ ID NO: 236574 - RNA, 19 nt, Homo sapiens
guaugaaugugcauccuua

SEQ ID NO: 236575 - RNA, 19 nt, Homo sapiens
gaaagaagaggugcccuua

SEQ ID NO: 236576 - RNA, 19 nt, Homo sapiens
aaacuuagcacguguaauu

SEQ ID NO: 236577 - RNA, 19 nt, Homo sapiens
ucauuugggucuuaacuua

SEQ ID NO: 236578 - RNA, 19 nt, Homo sapiens
gcaccaaacgcuggaauua

SEQ ID NO: 236579 - RNA, 19 nt, Homo sapiens
gcaaagaguggcagaaaga

SEQ ID NO: 236580 - RNA, 19 nt, Homo sapiens
gacacaaucucucuucuuc

SEQ ID NO: 236581 - RNA, 19 nt, Homo sapiens
gaagugaaccaccaaaaua

SEQ ID NO: 236582 - RNA, 19 nt, Homo sapiens
ccaccaacauuaaggaaga

SEQ ID NO: 236583 - RNA, 19 nt, Homo sapiens
aagaggaaaucaagucuga

SEQ ID NO: 236584 - RNA, 19 nt, Homo sapiens
gcaaagaggaaaucaaguc

SEQ ID NO: 236585 - RNA, 19 nt, Homo sapiens
gaaggaaagcaaagaggaa

SEQ ID NO: 236586 - RNA, 19 nt, Homo sapiens
ccgaacagaucuugucgaa

SEQ ID NO: 236587 - RNA, 19 nt, Homo sapiens
gaugucagccuacaaagga

SEQ ID NO: 236588 - RNA, 19 nt, Homo sapiens
cgaaugaaacucaagaaga

SEQ ID NO: 236589 - RNA, 19 nt, Homo sapiens
cacaaucucucuucuucaa

SEQ ID NO: 236590 - RNA, 19 nt, Homo sapiens
cgaauagagcaaccuguua

SEQ ID NO: 236591 - RNA, 19 nt, Homo sapiens
gauaagcgcaacaaacuca

SEQ ID NO: 236592 - RNA, 19 nt, Homo sapiens
guagacaguuggacagauc

SEQ ID NO: 236593 - RNA, 19 nt, Homo sapiens
caaucucucuucuucaaau

SEQ ID NO: 236594 - RNA, 19 nt, Homo sapiens
aagaagaggugcccuuaca

SEQ ID NO: 236595 - RNA, 19 nt, Homo sapiens
acaggcaggucaagauuug

SEQ ID NO: 236596 - RNA, 19 nt, Homo sapiens
gaauagagcaaccuguuac

SEQ ID NO: 236597 - RNA, 19 nt, Homo sapiens
ugaaugugcauccuuauau

SEQ ID NO: 236598 - RNA, 19 nt, Homo sapiens
uugaauacauccaguacuu

SEQ ID NO: 236599 - RNA, 19 nt, Homo sapiens
uuucaugucuuuccuaaca

SEQ ID NO: 236600 - RNA, 19 nt, Homo sapiens
accaaacgcuggaauuaga

SEQ ID NO: 236601 - RNA, 19 nt, Homo sapiens
ggacacaaucucucuucuu

SEQ ID NO: 236602 - RNA, 19 nt, Homo sapiens
uguaaucccuaugaguaua

SEQ ID NO: 236603 - RNA, 19 nt, Homo sapiens
cuucaccgcucuuuguuug

SEQ ID NO: 236604 - RNA, 19 nt, Homo sapiens
acccaagaguacaauaaua

SEQ ID NO: 236605 - RNA, 19 nt, Homo sapiens
gagaucaguaagagcguua

SEQ ID NO: 236606 - RNA, 19 nt, Homo sapiens
ucuguaaucccuaugagua

SEQ ID NO: 236607 - RNA, 19 nt, Homo sapiens
aaacccaagaguacaauaa

SEQ ID NO: 236608 - RNA, 19 nt, Homo sapiens
uccaauugcugcauguauu

SEQ ID NO: 236609 - RNA, 19 nt, Homo sapiens
gaauccaauugcugcaugu

SEQ ID NO: 236610 - RNA, 19 nt, Homo sapiens
agaggugcccuuacacuaa

SEQ ID NO: 236611 - RNA, 19 nt, Homo sapiens
gccaggagcccaccaaagu

SEQ ID NO: 236612 - RNA, 19 nt, Homo sapiens
uuauauaccucaaguagac

SEQ ID NO: 236613 - RNA, 19 nt, Homo sapiens
uuuaguagauuccuugauc

SEQ ID NO: 236614 - RNA, 19 nt, Homo sapiens
gaagaugagccgagagaac

SEQ ID NO: 236615 - RNA, 19 nt, Homo sapiens
cgacaggcaggucaagauu

SEQ ID NO: 236616 - RNA, 19 nt, Homo sapiens
gaaagcaaagaggaaauca

SEQ ID NO: 236617 - RNA, 19 nt, Homo sapiens
ggaaagcaaagaggaaauc

SEQ ID NO: 236618 - RNA, 19 nt, Homo sapiens
guaaugcaggguaacuauu

SEQ ID NO: 236619 - RNA, 19 nt, Homo sapiens
cuuagcacguguaauuuau

SEQ ID NO: 236620 - RNA, 19 nt, Homo sapiens
ucaccgcucuuuguuuguu

SEQ ID NO: 236621 - RNA, 19 nt, Homo sapiens
gaagaggugcccuuacacu

SEQ ID NO: 236622 - RNA, 19 nt, Homo sapiens
uaacuuauuggaacuguag

SEQ ID NO: 236623 - RNA, 19 nt, Homo sapiens
ggucaagauuugguuucaa

SEQ ID NO: 236624 - RNA, 19 nt, Homo sapiens
gacaggcaggucaagauuu

SEQ ID NO: 236625 - RNA, 19 nt, Homo sapiens
gcaggagaaggaaagcaaa

SEQ ID NO: 236626 - RNA, 19 nt, Homo sapiens
agagaugucagccuacaaa

SEQ ID NO: 236627 - RNA, 19 nt, Homo sapiens
gcaggucaagauuugguuu

SEQ ID NO: 236628 - RNA, 19 nt, Homo sapiens
caaaggacacaaucucucu

SEQ ID NO: 236629 - RNA, 19 nt, Homo sapiens
gaucuguaaucccuaugag

SEQ ID NO: 236630 - RNA, 19 nt, Homo sapiens
gaagugcaggagaaggaaa

SEQ ID NO: 236631 - RNA, 19 nt, Homo sapiens
gaccuacgccaccgggaaa

SEQ ID NO: 236632 - RNA, 19 nt, Homo sapiens
caaaauauggguaugaaug

SEQ ID NO: 236633 - RNA, 19 nt, Homo sapiens
gaguucuuguucaauaugu

SEQ ID NO: 236634 - RNA, 19 nt, Homo sapiens
caaagaguggcagaaagaa

SEQ ID NO: 236635 - RNA, 19 nt, Homo sapiens
gauacaccaaccagcaauu

SEQ ID NO: 236636 - RNA, 19 nt, Homo sapiens
ggagaaggaaagcaaagag

SEQ ID NO: 236637 - RNA, 19 nt, Homo sapiens
uuaaggaagaauccaauug

SEQ ID NO: 236638 - RNA, 19 nt, Homo sapiens
uauuggaacuguagagcau

SEQ ID NO: 236639 - RNA, 19 nt, Homo sapiens
acuuagcacguguaauuua

SEQ ID NO: 236640 - RNA, 19 nt, Homo sapiens
guaaucccuaugaguauau

SEQ ID NO: 236641 - RNA, 19 nt, Homo sapiens
caaacgcuggaauuagaaa

SEQ ID NO: 236642 - RNA, 19 nt, Homo sapiens
cugcauguauucugauaag

SEQ ID NO: 236643 - RNA, 19 nt, Homo sapiens
ugaauacauccaguacuuu

SEQ ID NO: 236644 - RNA, 19 nt, Homo sapiens
uuaguagauuccuugauca

SEQ ID NO: 236645 - RNA, 19 nt, Homo sapiens
aagaguggcagaaagaaga

SEQ ID NO: 236646 - RNA, 19 nt, Homo sapiens
caaagaggaaaucaagucu

SEQ ID NO: 236647 - RNA, 19 nt, Homo sapiens
aagcaaagaggaaaucaag

SEQ ID NO: 236648 - RNA, 19 nt, Homo sapiens
ccaauugcugcauguauuc

SEQ ID NO: 236649 - RNA, 19 nt, Homo sapiens
uaaggaagaauccaauugc

SEQ ID NO: 236650 - RNA, 19 nt, Homo sapiens
uaccucaaguagacaguug

SEQ ID NO: 236651 - RNA, 19 nt, Homo sapiens
gaacucauggcauuuugaa

SEQ ID NO: 236652 - RNA, 19 nt, Homo sapiens
ggucagaggccaggauugg

SEQ ID NO: 236653 - RNA, 19 nt, Homo sapiens
gaaccggauccgagaacug

SEQ ID NO: 236654 - RNA, 19 nt, Homo sapiens
gccuagagaucaguaagag

SEQ ID NO: 236655 - RNA, 19 nt, Homo sapiens
ccaaacgcuggaauuagaa

SEQ ID NO: 236656 - RNA, 19 nt, Homo sapiens
aaauauggguaugaaugug

SEQ ID NO: 236657 - RNA, 19 nt, Homo sapiens
ccugcuagaaugugacuuu

SEQ ID NO: 236658 - RNA, 19 nt, Homo sapiens
gucccgaagugcaggagaa

SEQ ID NO: 236659 - RNA, 19 nt, Homo sapiens
cccaagaguacaauaauag

SEQ ID NO: 236660 - RNA, 19 nt, Homo sapiens
ucgaauagagcaaccuguu

SEQ ID NO: 236661 - RNA, 19 nt, Homo sapiens
gcucuuuguuuguuguuuu

SEQ ID NO: 236662 - RNA, 19 nt, Homo sapiens
cagcagcgccagcauguac

SEQ ID NO: 236663 - RNA, 19 nt, Homo sapiens
aagaggugcccuuacacua

SEQ ID NO: 236664 - RNA, 19 nt, Homo sapiens
cuacaaaggacacaaucuc

SEQ ID NO: 236665 - RNA, 19 nt, Homo sapiens
gcuggucccugagucuugu

SEQ ID NO: 236666 - RNA, 19 nt, Homo sapiens
uagagcaaccuguuacaca

SEQ ID NO: 236667 - RNA, 19 nt, Homo sapiens
cuagagaugucagccuaca

SEQ ID NO: 236668 - RNA, 19 nt, Homo sapiens
gaaugcagguuauuuaaac

SEQ ID NO: 236669 - RNA, 19 nt, Homo sapiens
ggugaaugcagguuauuua

SEQ ID NO: 236670 - RNA, 19 nt, Homo sapiens
ccacuguccuuggguuuaa

SEQ ID NO: 236671 - RNA, 19 nt, Homo sapiens
gggcuacgcucccuacuac

SEQ ID NO: 236672 - RNA, 19 nt, Homo sapiens
aaaagaaacugaacagaga

SEQ ID NO: 236673 - RNA, 19 nt, Homo sapiens
gaaaagacuucaacucucu

SEQ ID NO: 236674 - RNA, 19 nt, Homo sapiens
gcagguuauuuaaacuuug

SEQ ID NO: 236675 - RNA, 19 nt, Homo sapiens
uuuaagagaucccuuccuu

SEQ ID NO: 236676 - RNA, 19 nt, Homo sapiens
ggaaaaugguaaaugcaaa

SEQ ID NO: 236677 - RNA, 19 nt, Homo sapiens
gugaaugcagguuauuuaa

SEQ ID NO: 236678 - RNA, 19 nt, Homo sapiens
gaagagcagcagcgcaguu

SEQ ID NO: 236679 - RNA, 19 nt, Homo sapiens
uuaaugacgucucuucucu

SEQ ID NO: 236680 - RNA, 19 nt, Homo sapiens
gccgagcggauccuaauaa

SEQ ID NO: 236681 - RNA, 19 nt, Homo sapiens
gcuagaaggcgcugguguu

SEQ ID NO: 236682 - RNA, 19 nt, Homo sapiens
gggcugcgccuacuaugug

SEQ ID NO: 236683 - RNA, 19 nt, Homo sapiens
uagcaagccuucguuccuu

SEQ ID NO: 236684 - RNA, 19 nt, Homo sapiens
ggccggacgugcucuucaa

SEQ ID NO: 236685 - RNA, 19 nt, Homo sapiens
agaaggcgcugguguuuug

SEQ ID NO: 236686 - RNA, 19 nt, Homo sapiens
ggaaaccccuuauuuugag

SEQ ID NO: 236687 - RNA, 19 nt, Homo sapiens
cagaaucgcaggaugaaag

SEQ ID NO: 236688 - RNA, 19 nt, Homo sapiens
cuagaaggcgcugguguuu

SEQ ID NO: 236689 - RNA, 19 nt, Homo sapiens
aaugacgucucuucucugu

SEQ ID NO: 236690 - RNA, 19 nt, Homo sapiens
gagcgcagccagcauguac

SEQ ID NO: 236691 - RNA, 19 nt, Homo sapiens
gagaaaagacuucaacucu

SEQ ID NO: 236692 - RNA, 19 nt, Homo sapiens
cgucugacuucgcuagcaa

SEQ ID NO: 236693 - RNA, 19 nt, Homo sapiens
cuguggaacuucacgauuc

SEQ ID NO: 236694 - RNA, 19 nt, Homo sapiens
ucucuucucuguggaacuu

SEQ ID NO: 236695 - RNA, 19 nt, Homo sapiens
cagguuauuuaaacuuugg

SEQ ID NO: 236696 - RNA, 19 nt, Homo sapiens
ggaaauguacuuuuagucu

SEQ ID NO: 236697 - RNA, 19 nt, Homo sapiens
aaucgcaggaugaaagaaa

SEQ ID NO: 236698 - RNA, 19 nt, Homo sapiens
gcaagccuucguuccuuuc

SEQ ID NO: 236699 - RNA, 19 nt, Homo sapiens
ccgagcggauccuaauaag

SEQ ID NO: 236700 - RNA, 19 nt, Homo sapiens
ggccgagcggauccuaaua

SEQ ID NO: 236701 - RNA, 19 nt, Homo sapiens
acguguacauaaacaaaga

SEQ ID NO: 236702 - RNA, 19 nt, Homo sapiens
ccacucacccacccuccuu

SEQ ID NO: 236703 - RNA, 19 nt, Homo sapiens
agcaagccuucguuccuuu

SEQ ID NO: 236704 - RNA, 19 nt, Homo sapiens
cguccugccagaugacuuu

SEQ ID NO: 236705 - RNA, 19 nt, Homo sapiens
cacagggcuucgaccaguu

SEQ ID NO: 236706 - RNA, 19 nt, Homo sapiens
gguuuaaugacgucucuuc

SEQ ID NO: 236707 - RNA, 19 nt, Homo sapiens
gaccgucugcaguauuuca

SEQ ID NO: 236708 - RNA, 19 nt, Homo sapiens
ucaaagcggccaaguauga

SEQ ID NO: 236709 - RNA, 19 nt, Homo sapiens
uaugugggcucgcuucuga

SEQ ID NO: 236710 - RNA, 19 nt, Homo sapiens
gccagacucuuucuacuuc

SEQ ID NO: 236711 - RNA, 19 nt, Homo sapiens
gaacaggcguaugaagaag

SEQ ID NO: 236712 - RNA, 19 nt, Homo sapiens
gcagaaacgcaaggaauug

SEQ ID NO: 236713 - RNA, 19 nt, Homo sapiens
ccgaagagcaggcuaaguu

SEQ ID NO: 236714 - RNA, 19 nt, Homo sapiens
cagaacaggcguaugaaga

SEQ ID NO: 236715 - RNA, 19 nt, Homo sapiens
ucucaaagcggccaaguau

SEQ ID NO: 236716 - RNA, 19 nt, Homo sapiens
ggcagaaacgcaaggaauu

SEQ ID NO: 236717 - RNA, 19 nt, Homo sapiens
cuacagagcgggcuaugug

SEQ ID NO: 236718 - RNA, 19 nt, Homo sapiens
ggaguuggagaacgaauuc

SEQ ID NO: 236719 - RNA, 19 nt, Homo sapiens
gaaccucagcgaccagcaa

SEQ ID NO: 236720 - RNA, 19 nt, Homo sapiens
gguaaacggugcccaugcu

SEQ ID NO: 236721 - RNA, 19 nt, Homo sapiens
agaacaggcguaugaagaa

SEQ ID NO: 236722 - RNA, 19 nt, Homo sapiens
acaggcguaugaagaagaa

SEQ ID NO: 236723 - RNA, 19 nt, Homo sapiens
gaagagcaggcuaaguucu

SEQ ID NO: 236724 - RNA, 19 nt, Homo sapiens
ccaaagacggacccgaaga

SEQ ID NO: 236725 - RNA, 19 nt, Homo sapiens
gcagcagauugcggaguug

SEQ ID NO: 236726 - RNA, 19 nt, Homo sapiens
ugagcgcagucucuacaga

SEQ ID NO: 236727 - RNA, 19 nt, Homo sapiens
ucaacgaauucaucaacag

SEQ ID NO: 236728 - RNA, 19 nt, Homo sapiens
aagagcaggcuaaguucua

SEQ ID NO: 236729 - RNA, 19 nt, Homo sapiens
caaagacggacccgaagag

SEQ ID NO: 236730 - RNA, 19 nt, Homo sapiens
gucaacgaauucaucaaca

SEQ ID NO: 236731 - RNA, 19 nt, Homo sapiens
agagcaggcuaaguucuau

SEQ ID NO: 236732 - RNA, 19 nt, Homo sapiens
cgaagagcaggcuaaguuc

SEQ ID NO: 236733 - RNA, 19 nt, Homo sapiens
uuccagaacaggcguauga

SEQ ID NO: 236734 - RNA, 19 nt, Homo sapiens
acacgaagcagcagauugc

SEQ ID NO: 236735 - RNA, 19 nt, Homo sapiens
gacccgaagagcaggcuaa

SEQ ID NO: 236736 - RNA, 19 nt, Homo sapiens
ugggcucgcuucugaaucu

SEQ ID NO: 236737 - RNA, 19 nt, Homo sapiens
cagcgaccagcaagucaaa

SEQ ID NO: 236738 - RNA, 19 nt, Homo sapiens
cagaaacgcaaggaauugu

SEQ ID NO: 236739 - RNA, 19 nt, Homo sapiens
uugcggaguuggagaacga

SEQ ID NO: 236740 - RNA, 19 nt, Homo sapiens
agcagcagauugcggaguu

SEQ ID NO: 236741 - RNA, 19 nt, Homo sapiens
ggaaacccuacacgaagca

SEQ ID NO: 236742 - RNA, 19 nt, Homo sapiens
ggaaagacuugaauaugua

SEQ ID NO: 236743 - RNA, 19 nt, Homo sapiens
gaaccuaucugagagacaa

SEQ ID NO: 236744 - RNA, 19 nt, Homo sapiens
gagagugccuuacaccaaa

SEQ ID NO: 236745 - RNA, 19 nt, Homo sapiens
ggaagaagagagugccuua

SEQ ID NO: 236746 - RNA, 19 nt, Homo sapiens
uuaaagaacuggagaacga

SEQ ID NO: 236747 - RNA, 19 nt, Homo sapiens
gaacgaguaugccauuaac

SEQ ID NO: 236748 - RNA, 19 nt, Homo sapiens
acaccaaacugcagcuuaa

SEQ ID NO: 236749 - RNA, 19 nt, Homo sapiens
uggaaagacuugaauaugu

SEQ ID NO: 236750 - RNA, 19 nt, Homo sapiens
gagaacgaguaugccauua

SEQ ID NO: 236751 - RNA, 19 nt, Homo sapiens
gaagagugaaggacaagaa

SEQ ID NO: 236752 - RNA, 19 nt, Homo sapiens
agaaugcgcucaagucauc

SEQ ID NO: 236753 - RNA, 19 nt, Homo sapiens
gauacugucuccugaugug

SEQ ID NO: 236754 - RNA, 19 nt, Homo sapiens
caaccugacuuuguaguuc

SEQ ID NO: 236755 - RNA, 19 nt, Homo sapiens
ggagaacgaguaugccauu

SEQ ID NO: 236756 - RNA, 19 nt, Homo sapiens
agagacaagugaccauuug

SEQ ID NO: 236757 - RNA, 19 nt, Homo sapiens
uaaaucagccggacaugug

SEQ ID NO: 236758 - RNA, 19 nt, Homo sapiens
gagagacaagugaccauuu

SEQ ID NO: 236759 - RNA, 19 nt, Homo sapiens
ggauguggcucuaaaucag

SEQ ID NO: 236760 - RNA, 19 nt, Homo sapiens
gaagagggaggaagaagag

SEQ ID NO: 236761 - RNA, 19 nt, Homo sapiens
gcagaaugcgcucaaguca

SEQ ID NO: 236762 - RNA, 19 nt, Homo sapiens
gcuacgaaccuaucugaga

SEQ ID NO: 236763 - RNA, 19 nt, Homo sapiens
ucuccaagcucaaagauac

SEQ ID NO: 236764 - RNA, 19 nt, Homo sapiens
ccaaacugcagcuuaaaga

SEQ ID NO: 236765 - RNA, 19 nt, Homo sapiens
gccauucgguugucuccaa

SEQ ID NO: 236766 - RNA, 19 nt, Homo sapiens
ccacaggggucccacuuuu

SEQ ID NO: 236767 - RNA, 19 nt, Homo sapiens
ugcccaaccugacuuugua

SEQ ID NO: 236768 - RNA, 19 nt, Homo sapiens
uacuacagcugccguaugu

SEQ ID NO: 236769 - RNA, 19 nt, Homo sapiens
uuucagaaccgaagaguga

SEQ ID NO: 236770 - RNA, 19 nt, Homo sapiens
cggcguaucucggcugcua

SEQ ID NO: 236771 - RNA, 19 nt, Homo sapiens
cgaguaugccauuaacaaa

SEQ ID NO: 236772 - RNA, 19 nt, Homo sapiens
caaacugcagcuuaaagaa

SEQ ID NO: 236773 - RNA, 19 nt, Homo sapiens
gaguaugccauuaacaaau

SEQ ID NO: 236774 - RNA, 19 nt, Homo sapiens
gcuuucccguggagaagua

SEQ ID NO: 236775 - RNA, 19 nt, Homo sapiens
aagauacugucuccugaug

SEQ ID NO: 236776 - RNA, 19 nt, Homo sapiens
gggauguggcucuaaauca

SEQ ID NO: 236777 - RNA, 19 nt, Homo sapiens
ggccacagacagcuuagaa

SEQ ID NO: 236778 - RNA, 19 nt, Homo sapiens
gguccagguuggccacaga

SEQ ID NO: 236779 - RNA, 19 nt, Homo sapiens
cgaagagggaggaagaaga

SEQ ID NO: 236780 - RNA, 19 nt, Homo sapiens
agaacgaguaugccauuaa

SEQ ID NO: 236781 - RNA, 19 nt, Homo sapiens
gggcuacggcuaccacuuc

SEQ ID NO: 236782 - RNA, 19 nt, Homo sapiens
gaaguacauggacguguca

SEQ ID NO: 236783 - RNA, 19 nt, Homo sapiens
ggaacagccagguguacug

SEQ ID NO: 236784 - RNA, 19 nt, Homo sapiens
ccauucgguugucuccaaa

SEQ ID NO: 236785 - RNA, 19 nt, Homo sapiens
gacuuuguaguucugauuu

SEQ ID NO: 236786 - RNA, 19 nt, Homo sapiens
guccucuucugccguugua

SEQ ID NO: 236787 - RNA, 19 nt, Homo sapiens
guaugccauuaacaaauuc

SEQ ID NO: 236788 - RNA, 19 nt, Homo sapiens
aagaagagagugccuuaca

SEQ ID NO: 236789 - RNA, 19 nt, Homo sapiens
agagagugccuuacaccaa

SEQ ID NO: 236790 - RNA, 19 nt, Homo sapiens
gguggaacagccaggugua

SEQ ID NO: 236791 - RNA, 19 nt, Homo sapiens
caguauaaagggacuugaa

SEQ ID NO: 236792 - RNA, 19 nt, Homo sapiens
ugacuuuguaguucugauu

SEQ ID NO: 236793 - RNA, 19 nt, Homo sapiens
ccaaccugacuuuguaguu

SEQ ID NO: 236794 - RNA, 19 nt, Homo sapiens
guuggccacagacagcuua

SEQ ID NO: 236795 - RNA, 19 nt, Homo sapiens
acgaguaugccauuaacaa

SEQ ID NO: 236796 - RNA, 19 nt, Homo sapiens
aaacugcagcuuaaagaac

SEQ ID NO: 236797 - RNA, 19 nt, Homo sapiens
uacaccaaacugcagcuua

SEQ ID NO: 236798 - RNA, 19 nt, Homo sapiens
gagggaggaagaagagagu

SEQ ID NO: 236799 - RNA, 19 nt, Homo sapiens
ugagagacaagugaccauu

SEQ ID NO: 236800 - RNA, 19 nt, Homo sapiens
guaucucggcugcuacgaa

SEQ ID NO: 236801 - RNA, 19 nt, Homo sapiens
gaacuggagaacgaguaug

SEQ ID NO: 236802 - RNA, 19 nt, Homo sapiens
gaagaagagagugccuuac

SEQ ID NO: 236803 - RNA, 19 nt, Homo sapiens
gaaguggaguguauugugu

SEQ ID NO: 236804 - RNA, 19 nt, Homo sapiens
gcuguugugugguauuuau

SEQ ID NO: 236805 - RNA, 19 nt, Homo sapiens
gaucuacgccaacuucuuc

SEQ ID NO: 236806 - RNA, 19 nt, Homo sapiens
cggcgacgcuuccaaguuc

SEQ ID NO: 236807 - RNA, 19 nt, Homo sapiens
ggucuggcauuuccgguau

SEQ ID NO: 236808 - RNA, 19 nt, Homo sapiens
ggucuguccucccuguuga

SEQ ID NO: 236809 - RNA, 19 nt, Homo sapiens
gcagauggacaccaacaau

SEQ ID NO: 236810 - RNA, 19 nt, Homo sapiens
guaggucccguauuuaaug

SEQ ID NO: 236811 - RNA, 19 nt, Homo sapiens
caccaacaaugacggcaaa

SEQ ID NO: 236812 - RNA, 19 nt, Homo sapiens
gagaagcgcacagacaaga

SEQ ID NO: 236813 - RNA, 19 nt, Homo sapiens
guacaagggcuuccucaag

SEQ ID NO: 236814 - RNA, 19 nt, Homo sapiens
uuguguaggucccguauuu

SEQ ID NO: 236815 - RNA, 19 nt, Homo sapiens
caacaaugacggcaaacug

SEQ ID NO: 236816 - RNA, 19 nt, Homo sapiens
ugaagaugccggaggauga

SEQ ID NO: 236817 - RNA, 19 nt, Homo sapiens
caaacuguccuuggaagaa

SEQ ID NO: 236818 - RNA, 19 nt, Homo sapiens
guugauuggucuggcauuu

SEQ ID NO: 236819 - RNA, 19 nt, Homo sapiens
ucaggcagauggacaccaa

SEQ ID NO: 236820 - RNA, 19 nt, Homo sapiens
aagauggugucgucuguga

SEQ ID NO: 236821 - RNA, 19 nt, Homo sapiens
guguaggucccguauuuaa

SEQ ID NO: 236822 - RNA, 19 nt, Homo sapiens
gcaaacuguccuuggaaga

SEQ ID NO: 236823 - RNA, 19 nt, Homo sapiens
guauuuaugcucucuuugu

SEQ ID NO: 236824 - RNA, 19 nt, Homo sapiens
aaacuguccuuggaagaau

SEQ ID NO: 236825 - RNA, 19 nt, Homo sapiens
cacagccgcuugcacguau

SEQ ID NO: 236826 - RNA, 19 nt, Homo sapiens
gcacagacaagaucuucag

SEQ ID NO: 236827 - RNA, 19 nt, Homo sapiens
acaagauggugucgucugu

SEQ ID NO: 236828 - RNA, 19 nt, Homo sapiens
gcauuugugucuggucugu

SEQ ID NO: 236829 - RNA, 19 nt, Homo sapiens
ccgcuugcacguauagaua

SEQ ID NO: 236830 - RNA, 19 nt, Homo sapiens
ggacggcaacggcuacauc

SEQ ID NO: 236831 - RNA, 19 nt, Homo sapiens
gauccucccauccguguug

SEQ ID NO: 236832 - RNA, 19 nt, Homo sapiens
cuggacaguugcagagaaa

SEQ ID NO: 236833 - RNA, 19 nt, Homo sapiens
gaagcgcacagacaagauc

SEQ ID NO: 236834 - RNA, 19 nt, Homo sapiens
gauggugucgucugugaug

SEQ ID NO: 236835 - RNA, 19 nt, Homo sapiens
ucuggcauuuccgguauua

SEQ ID NO: 236836 - RNA, 19 nt, Homo sapiens
ccacagccgcuugcacgua

SEQ ID NO: 236837 - RNA, 19 nt, Homo sapiens
agauggacaccaacaauga

SEQ ID NO: 236838 - RNA, 19 nt, Homo sapiens
guggacgaguucaagaaga

SEQ ID NO: 236839 - RNA, 19 nt, Homo sapiens
aauuauguauggugaagug

SEQ ID NO: 236840 - RNA, 19 nt, Homo sapiens
uggcauuuccgguauuaaa

SEQ ID NO: 236841 - RNA, 19 nt, Homo sapiens
ugguauuuaugcucucuuu

SEQ ID NO: 236842 - RNA, 19 nt, Homo sapiens
gucgugccguuuaagcuuu

SEQ ID NO: 236843 - RNA, 19 nt, Homo sapiens
gugcaggccaucuacaaga

SEQ ID NO: 236844 - RNA, 19 nt, Homo sapiens
gcgagaugcuggagaucgu

SEQ ID NO: 236845 - RNA, 19 nt, Homo sapiens
gccuggcuguuguguggua

SEQ ID NO: 236846 - RNA, 19 nt, Homo sapiens
caugcaggguucaaguguu

SEQ ID NO: 236847 - RNA, 19 nt, Homo sapiens
ugucgucugugaugaagau

SEQ ID NO: 236848 - RNA, 19 nt, Homo sapiens
uggacgaguucaagaagau

SEQ ID NO: 236849 - RNA, 19 nt, Homo sapiens
ggugaaguggaguguauug

SEQ ID NO: 236850 - RNA, 19 nt, Homo sapiens
cagauggacaccaacaaug

SEQ ID NO: 236851 - RNA, 19 nt, Homo sapiens
cggagaagcgcacagacaa

SEQ ID NO: 236852 - RNA, 19 nt, Homo sapiens
cgacggcaccaucgacuuc

SEQ ID NO: 236853 - RNA, 19 nt, Homo sapiens
ccuggacaguugcagagaa

SEQ ID NO: 236854 - RNA, 19 nt, Homo sapiens
ccuggucucugguguaguc

SEQ ID NO: 236855 - RNA, 19 nt, Homo sapiens
uggcuguugugugguauuu

SEQ ID NO: 236856 - RNA, 19 nt, Homo sapiens
ugaaguggaguguauugug

SEQ ID NO: 236857 - RNA, 19 nt, Homo sapiens
gcaaacagaacagcaagcu

SEQ ID NO: 236858 - RNA, 19 nt, Homo sapiens
cagcagugccagucaguuc

SEQ ID NO: 236859 - RNA, 19 nt, Homo sapiens
ggggcaagcuggagcagaa

SEQ ID NO: 236860 - RNA, 19 nt, Homo sapiens
ggagaagcgcacagacaag

SEQ ID NO: 236861 - RNA, 19 nt, Homo sapiens
gaagaugccggaggaugag

SEQ ID NO: 236862 - RNA, 19 nt, Homo sapiens
gcccugagccgugaugauc

SEQ ID NO: 236863 - RNA, 19 nt, Homo sapiens
uauuuaugcucucuuuguc

SEQ ID NO: 236864 - RNA, 19 nt, Homo sapiens
uggaguguauuguguaggu

SEQ ID NO: 236865 - RNA, 19 nt, Homo sapiens
gcaggggcauggucuagug

SEQ ID NO: 236866 - RNA, 19 nt, Homo sapiens
gcgcacagacaagaucuuc

SEQ ID NO: 236867 - RNA, 19 nt, Homo sapiens
gccucugacugccuuugaa

SEQ ID NO: 236868 - RNA, 19 nt, Homo sapiens
gguccccuuucuuuuaaua

SEQ ID NO: 236869 - RNA, 19 nt, Homo sapiens
ggcuugucgugccguuuaa

SEQ ID NO: 236870 - RNA, 19 nt, Homo sapiens
aggcuugucgugccguuua

SEQ ID NO: 236871 - RNA, 19 nt, Homo sapiens
auggugaaguggaguguau

SEQ ID NO: 236872 - RNA, 19 nt, Homo sapiens
augcaggguucaaguguuc

SEQ ID NO: 236873 - RNA, 19 nt, Homo sapiens
aagaagaucuacgccaacu

SEQ ID NO: 236874 - RNA, 19 nt, Homo sapiens
gugguccccuuucuuuuaa

SEQ ID NO: 236875 - RNA, 19 nt, Homo sapiens
gacaugcaggguucaagug

SEQ ID NO: 236876 - RNA, 19 nt, Homo sapiens
ugacaugcaggguucaagu

SEQ ID NO: 236877 - RNA, 19 nt, Homo sapiens
gacggcaacggcuacauca

SEQ ID NO: 236878 - RNA, 19 nt, Homo sapiens
aagugggccuucagcaugu

SEQ ID NO: 236879 - RNA, 19 nt, Homo sapiens
gaaguggaguguauugugu

SEQ ID NO: 236880 - RNA, 19 nt, Homo sapiens
gcgguuugcuucucuuuaa

SEQ ID NO: 236881 - RNA, 19 nt, Homo sapiens
gaaaugagaacgcacugaa

SEQ ID NO: 236882 - RNA, 19 nt, Homo sapiens
ggugacaggugaaaugaga

SEQ ID NO: 236883 - RNA, 19 nt, Homo sapiens
gcuguugugugguauuuau

SEQ ID NO: 236884 - RNA, 19 nt, Homo sapiens
gaucuacgccaacuucuuc

SEQ ID NO: 236885 - RNA, 19 nt, Homo sapiens
gcacacagggcauggucua

SEQ ID NO: 236886 - RNA, 19 nt, Homo sapiens
cggcgacgcuuccaaguuc

SEQ ID NO: 236887 - RNA, 19 nt, Homo sapiens
ggucuggcauuuccgguau

SEQ ID NO: 236888 - RNA, 19 nt, Homo sapiens
ggucuguccucccuguuga

SEQ ID NO: 236889 - RNA, 19 nt, Homo sapiens
gcagauggacaccaacaau

SEQ ID NO: 236890 - RNA, 19 nt, Homo sapiens
guaggucccguauuuaaug

SEQ ID NO: 236891 - RNA, 19 nt, Homo sapiens
caccaacaaugacggcaaa

SEQ ID NO: 236892 - RNA, 19 nt, Homo sapiens
gagaagcgcacagacaaga

SEQ ID NO: 236893 - RNA, 19 nt, Homo sapiens
guacaagggcuuccucaag

SEQ ID NO: 236894 - RNA, 19 nt, Homo sapiens
uuguguaggucccguauuu

SEQ ID NO: 236895 - RNA, 19 nt, Homo sapiens
caacaaugacggcaaacug

SEQ ID NO: 236896 - RNA, 19 nt, Homo sapiens
ugaagaugccggaggauga

SEQ ID NO: 236897 - RNA, 19 nt, Homo sapiens
caaacuguccuuggaagaa

SEQ ID NO: 236898 - RNA, 19 nt, Homo sapiens
guugauuggucuggcauuu

SEQ ID NO: 236899 - RNA, 19 nt, Homo sapiens
ucaggcagauggacaccaa

SEQ ID NO: 236900 - RNA, 19 nt, Homo sapiens
aagauggugucgucuguga

SEQ ID NO: 236901 - RNA, 19 nt, Homo sapiens
guguaggucccguauuuaa

SEQ ID NO: 236902 - RNA, 19 nt, Homo sapiens
gcaaacuguccuuggaaga

SEQ ID NO: 236903 - RNA, 19 nt, Homo sapiens
guauuuaugcucucuuugu

SEQ ID NO: 236904 - RNA, 19 nt, Homo sapiens
aaacuguccuuggaagaau

SEQ ID NO: 236905 - RNA, 19 nt, Homo sapiens
cacagccgcuugcacguau

SEQ ID NO: 236906 - RNA, 19 nt, Homo sapiens
gcacagacaagaucuucag

SEQ ID NO: 236907 - RNA, 19 nt, Homo sapiens
acaagauggugucgucugu

SEQ ID NO: 236908 - RNA, 19 nt, Homo sapiens
gcauuugugucuggucugu

SEQ ID NO: 236909 - RNA, 19 nt, Homo sapiens
ccgcuugcacguauagaua

SEQ ID NO: 236910 - RNA, 19 nt, Homo sapiens
ggacggcaacggcuacauc

SEQ ID NO: 236911 - RNA, 19 nt, Homo sapiens
gauccucccauccguguug

SEQ ID NO: 236912 - RNA, 19 nt, Homo sapiens
cuggacaguugcagagaaa

SEQ ID NO: 236913 - RNA, 19 nt, Homo sapiens
gaagcgcacagacaagauc

SEQ ID NO: 236914 - RNA, 19 nt, Homo sapiens
gauggugucgucugugaug

SEQ ID NO: 236915 - RNA, 19 nt, Homo sapiens
ucuggcauuuccgguauua

SEQ ID NO: 236916 - RNA, 19 nt, Homo sapiens
ccacagccgcuugcacgua

SEQ ID NO: 236917 - RNA, 19 nt, Homo sapiens
agauggacaccaacaauga

SEQ ID NO: 236918 - RNA, 19 nt, Homo sapiens
guggacgaguucaagaaga

SEQ ID NO: 236919 - RNA, 19 nt, Homo sapiens
ccaccagcuccauuccuua

SEQ ID NO: 236920 - RNA, 19 nt, Homo sapiens
aauuauguauggugaagug

SEQ ID NO: 236921 - RNA, 19 nt, Homo sapiens
uggcauuuccgguauuaaa

SEQ ID NO: 236922 - RNA, 19 nt, Homo sapiens
ugguauuuaugcucucuuu

SEQ ID NO: 236923 - RNA, 19 nt, Homo sapiens
gucgugccguuuaagcuuu

SEQ ID NO: 236924 - RNA, 19 nt, Homo sapiens
aaugagaacgcacugaaga

SEQ ID NO: 236925 - RNA, 19 nt, Homo sapiens
gugcaggccaucuacaaga

SEQ ID NO: 236926 - RNA, 19 nt, Homo sapiens
gcgagaugcuggagaucgu

SEQ ID NO: 236927 - RNA, 19 nt, Homo sapiens
gccuggcuguuguguggua

SEQ ID NO: 236928 - RNA, 19 nt, Homo sapiens
cacagggcauggucuagug

SEQ ID NO: 236929 - RNA, 19 nt, Homo sapiens
caugcaggguucaaguguu

SEQ ID NO: 236930 - RNA, 19 nt, Homo sapiens
ugucgucugugaugaagau

SEQ ID NO: 236931 - RNA, 19 nt, Homo sapiens
uggacgaguucaagaagau

SEQ ID NO: 236932 - RNA, 19 nt, Homo sapiens
ggugaaguggaguguauug

SEQ ID NO: 236933 - RNA, 19 nt, Homo sapiens
cagauggacaccaacaaug

SEQ ID NO: 236934 - RNA, 19 nt, Homo sapiens
cggagaagcgcacagacaa

SEQ ID NO: 236935 - RNA, 19 nt, Homo sapiens
cgacggcaccaucgacuuc

SEQ ID NO: 236936 - RNA, 19 nt, Homo sapiens
ccuggacaguugcagagaa

SEQ ID NO: 236937 - RNA, 19 nt, Homo sapiens
uggcuguugugugguauuu

SEQ ID NO: 236938 - RNA, 19 nt, Homo sapiens
ugaaguggaguguauugug

SEQ ID NO: 236939 - RNA, 19 nt, Homo sapiens
cagcagugccagucaguuc

SEQ ID NO: 236940 - RNA, 19 nt, Homo sapiens
ggggcaagcuggagcagaa

SEQ ID NO: 236941 - RNA, 19 nt, Homo sapiens
gcaaacagaacagcaagcu

SEQ ID NO: 236942 - RNA, 19 nt, Homo sapiens
ggagaagcgcacagacaag

SEQ ID NO: 236943 - RNA, 19 nt, Homo sapiens
gaagaugccggaggaugag

SEQ ID NO: 236944 - RNA, 19 nt, Homo sapiens
cccaccagcuccauuccuu

SEQ ID NO: 236945 - RNA, 19 nt, Homo sapiens
ggucgcgguuugcuucucu

SEQ ID NO: 236946 - RNA, 19 nt, Homo sapiens
gcccugagccgugaugauc

SEQ ID NO: 236947 - RNA, 19 nt, Homo sapiens
uauuuaugcucucuuuguc

SEQ ID NO: 236948 - RNA, 19 nt, Homo sapiens
uggaguguauuguguaggu

SEQ ID NO: 236949 - RNA, 19 nt, Homo sapiens
uguuccagcuccaaagaga

SEQ ID NO: 236950 - RNA, 19 nt, Homo sapiens
gcgcacagacaagaucuuc

SEQ ID NO: 236951 - RNA, 19 nt, Homo sapiens
cgguuugcuucucuuuaaa

SEQ ID NO: 236952 - RNA, 19 nt, Homo sapiens
gccucugacugccuuugaa

SEQ ID NO: 236953 - RNA, 19 nt, Homo sapiens
gguccccuuucuuuuaaua

SEQ ID NO: 236954 - RNA, 19 nt, Homo sapiens
ggcuugucgugccguuuaa

SEQ ID NO: 236955 - RNA, 19 nt, Homo sapiens
aggcuugucgugccguuua

SEQ ID NO: 236956 - RNA, 19 nt, Homo sapiens
auggugaaguggaguguau

SEQ ID NO: 236957 - RNA, 19 nt, Homo sapiens
augcaggguucaaguguuc

SEQ ID NO: 236958 - RNA, 19 nt, Homo sapiens
aagaagaucuacgccaacu

SEQ ID NO: 236959 - RNA, 19 nt, Homo sapiens
gugguccccuuucuuuuaa

SEQ ID NO: 236960 - RNA, 19 nt, Homo sapiens
gacaugcaggguucaagug

SEQ ID NO: 236961 - RNA, 19 nt, Homo sapiens
ugacaugcaggguucaagu

SEQ ID NO: 236962 - RNA, 19 nt, Homo sapiens
gacggcaacggcuacauca

SEQ ID NO: 236963 - RNA, 19 nt, Homo sapiens
aagugggccuucagcaugu

SEQ ID NO: 236964 - RNA, 19 nt, Homo sapiens
gaucaaucaugacgacuua

SEQ ID NO: 236965 - RNA, 19 nt, Homo sapiens
ugacuaagaucaaucauga

SEQ ID NO: 236966 - RNA, 19 nt, Homo sapiens
aggaauauguggacuauaa

SEQ ID NO: 236967 - RNA, 19 nt, Homo sapiens
ggucagccauguaaucaaa

SEQ ID NO: 236968 - RNA, 19 nt, Homo sapiens
gcagcaagaugggcuuuga

SEQ ID NO: 236969 - RNA, 19 nt, Homo sapiens
gaacuacaucggccaauuc

SEQ ID NO: 236970 - RNA, 19 nt, Homo sapiens
ggaagauugugacuacauc

SEQ ID NO: 236971 - RNA, 19 nt, Homo sapiens
acaaagagaugggcgauca

SEQ ID NO: 236972 - RNA, 19 nt, Homo sapiens
gguggaagauugugacuac

SEQ ID NO: 236973 - RNA, 19 nt, Homo sapiens
gcaagaagaagucccagau

SEQ ID NO: 236974 - RNA, 19 nt, Homo sapiens
gagaugaucgaccacauug

SEQ ID NO: 236975 - RNA, 19 nt, Homo sapiens
gcuccagcccucccgauua

SEQ ID NO: 236976 - RNA, 19 nt, Homo sapiens
ccaggaauauguggacuau

SEQ ID NO: 236977 - RNA, 19 nt, Homo sapiens
caaaugcagucuggagaug

SEQ ID NO: 236978 - RNA, 19 nt, Homo sapiens
cuacaucggccaauucuug

SEQ ID NO: 236979 - RNA, 19 nt, Homo sapiens
acaaacaacugcgggagaa

SEQ ID NO: 236980 - RNA, 19 nt, Homo sapiens
ggagaugaucgaccacauu

SEQ ID NO: 236981 - RNA, 19 nt, Homo sapiens
caacuucaacucacuguuc

SEQ ID NO: 236982 - RNA, 19 nt, Homo sapiens
gagguggucagccauguaa

SEQ ID NO: 236983 - RNA, 19 nt, Homo sapiens
uaugaagaguccaucaaga

SEQ ID NO: 236984 - RNA, 19 nt, Homo sapiens
ugaaggacauugcguucga

SEQ ID NO: 236985 - RNA, 19 nt, Homo sapiens
aagggaagauuguguuugu

SEQ ID NO: 236986 - RNA, 19 nt, Homo sapiens
uggagaagaugaacuacau

SEQ ID NO: 236987 - RNA, 19 nt, Homo sapiens
ugaacuacaucggccaauu

SEQ ID NO: 236988 - RNA, 19 nt, Homo sapiens
cuccagcccucccgauuaa

SEQ ID NO: 236989 - RNA, 19 nt, Homo sapiens
ucaccaacauggagaccaa

SEQ ID NO: 236990 - RNA, 19 nt, Homo sapiens
agagaggccuggaguucuu

SEQ ID NO: 236991 - RNA, 19 nt, Homo sapiens
gugacuacaucgugcagaa

SEQ ID NO: 236992 - RNA, 19 nt, Homo sapiens
ccauugugguggccaacua

SEQ ID NO: 236993 - RNA, 19 nt, Homo sapiens
agucccagauccaggaaua

SEQ ID NO: 236994 - RNA, 19 nt, Homo sapiens
gccaauucuugccuggaua

SEQ ID NO: 236995 - RNA, 19 nt, Homo sapiens
gguagagcaagacaaguuu

SEQ ID NO: 236996 - RNA, 19 nt, Homo sapiens
ggguagagcaagacaaguu

SEQ ID NO: 236997 - RNA, 19 nt, Homo sapiens
gaugggcuuugaaccucua

SEQ ID NO: 236998 - RNA, 19 nt, Homo sapiens
uuccuaaacugcccaaaug

SEQ ID NO: 236999 - RNA, 19 nt, Homo sapiens
cugcagaucuucaccaaac

SEQ ID NO: 237000 - RNA, 19 nt, Homo sapiens
agaucaaggugaaggagaa

SEQ ID NO: 237001 - RNA, 19 nt, Homo sapiens
cggccaagaucaaggugaa

SEQ ID NO: 237002 - RNA, 19 nt, Homo sapiens
ggagguggucagccaugua

SEQ ID NO: 237003 - RNA, 19 nt, Homo sapiens
ggccaauucuugccuggau

SEQ ID NO: 237004 - RNA, 19 nt, Homo sapiens
cagcacaucgcucucaaga

SEQ ID NO: 237005 - RNA, 19 nt, Homo sapiens
uugcugugcugcagacgua

SEQ ID NO: 237006 - RNA, 19 nt, Homo sapiens
ugaaaauccugguggacua

SEQ ID NO: 237007 - RNA, 19 nt, Homo sapiens
gaagacggccaagaucaag

SEQ ID NO: 237008 - RNA, 19 nt, Homo sapiens
gaccgaagacaucaucaca

SEQ ID NO: 237009 - RNA, 19 nt, Homo sapiens
cguucgagguggaagauug

SEQ ID NO: 237010 - RNA, 19 nt, Homo sapiens
ugaagacggccaagaucaa

SEQ ID NO: 237011 - RNA, 19 nt, Homo sapiens
gccuggaguucuuaucugu

SEQ ID NO: 237012 - RNA, 19 nt, Homo sapiens
gagaggccuggaguucuua

SEQ ID NO: 237013 - RNA, 19 nt, Homo sapiens
ucaugacgacuuacaguga

SEQ ID NO: 237014 - RNA, 19 nt, Homo sapiens
gguggacuacgacgagaaa

SEQ ID NO: 237015 - RNA, 19 nt, Homo sapiens
uaucuguucccuccacgua

SEQ ID NO: 237016 - RNA, 19 nt, Homo sapiens
caagaagaagucccagauc

SEQ ID NO: 237017 - RNA, 19 nt, Homo sapiens
cgacuuacagugacaaagg

SEQ ID NO: 237018 - RNA, 19 nt, Homo sapiens
cuggaguucuuaucuguuc

SEQ ID NO: 237019 - RNA, 19 nt, Homo sapiens
gagagagaggccuggaguu

SEQ ID NO: 237020 - RNA, 19 nt, Homo sapiens
caagaccgaagacaucauc

SEQ ID NO: 237021 - RNA, 19 nt, Homo sapiens
caagaugggcuuugaaccu

SEQ ID NO: 237022 - RNA, 19 nt, Homo sapiens
ccaaaugcagucuggagau

SEQ ID NO: 237023 - RNA, 19 nt, Homo sapiens
caagggaagauuguguuug

SEQ ID NO: 237024 - RNA, 19 nt, Homo sapiens
ggccuggaguucuuaucug

SEQ ID NO: 237025 - RNA, 19 nt, Homo sapiens
gcaggugcacacggaauau

SEQ ID NO: 237026 - RNA, 19 nt, Homo sapiens
ccaauucuugccuggauau

SEQ ID NO: 237027 - RNA, 19 nt, Homo sapiens
guagagcaagacaaguuug

SEQ ID NO: 237028 - RNA, 19 nt, Homo sapiens
ucagccauguaaucaaaca

SEQ ID NO: 237029 - RNA, 19 nt, Homo sapiens
ggagguuugacuaagauca

SEQ ID NO: 237030 - RNA, 19 nt, Homo sapiens
caaggugaaggagaacauu

SEQ ID NO: 237031 - RNA, 19 nt, Homo sapiens
gcugaagacggccaagauc

SEQ ID NO: 237032 - RNA, 19 nt, Homo sapiens
ucucaagaccgaagacauc

SEQ ID NO: 237033 - RNA, 19 nt, Homo sapiens
guaaucaaacaagggaaga

SEQ ID NO: 237034 - RNA, 19 nt, Homo sapiens
ucauucuacugcagcaaga

SEQ ID NO: 237035 - RNA, 19 nt, Homo sapiens
gggagguggucagccaugu

SEQ ID NO: 237036 - RNA, 19 nt, Homo sapiens
aaggcuaccuccugcagau

SEQ ID NO: 237037 - RNA, 19 nt, Homo sapiens
gagagaggccuggaguucu

SEQ ID NO: 237038 - RNA, 19 nt, Homo sapiens
agagagaggccuggaguuc

SEQ ID NO: 237039 - RNA, 19 nt, Homo sapiens
caggugcacacggaauaua

SEQ ID NO: 237040 - RNA, 19 nt, Homo sapiens
gggguaaccucaccaacau

SEQ ID NO: 237041 - RNA, 19 nt, Homo sapiens
ccagauccaggaauaugug

SEQ ID NO: 237042 - RNA, 19 nt, Homo sapiens
gaagucccagauccaggaa

SEQ ID NO: 237043 - RNA, 19 nt, Homo sapiens
gguggucagccauguaauc

SEQ ID NO: 237044 - RNA, 19 nt, Homo sapiens
acucacuguucaaggcuuu

SEQ ID NO: 237045 - RNA, 19 nt, Homo sapiens
gcuaccuccugcagaucuu

SEQ ID NO: 237046 - RNA, 19 nt, Homo sapiens
gacaucaucacagcgauuc

SEQ ID NO: 237047 - RNA, 19 nt, Homo sapiens
ggaauauguggacuauaac

SEQ ID NO: 237048 - RNA, 19 nt, Homo sapiens
ugggaaaccagccugauca

SEQ ID NO: 237049 - RNA, 19 nt, Homo sapiens
ggagauacuugaauuguua

SEQ ID NO: 237050 - RNA, 19 nt, Homo sapiens
guacuggaauguugucaua

SEQ ID NO: 237051 - RNA, 19 nt, Homo sapiens
ggcauaagcuuguuuguau

SEQ ID NO: 237052 - RNA, 19 nt, Homo sapiens
guaaacauaucccagauga

SEQ ID NO: 237053 - RNA, 19 nt, Homo sapiens
gaacaucaaugaacaucug

SEQ ID NO: 237054 - RNA, 19 nt, Homo sapiens
caauauacauucugcuuug

SEQ ID NO: 237055 - RNA, 19 nt, Homo sapiens
cauugaagaugaugcuuua

SEQ ID NO: 237056 - RNA, 19 nt, Homo sapiens
ggaauguugucauaucuug

SEQ ID NO: 237057 - RNA, 19 nt, Homo sapiens
cagaggcgcugcugcuuaa

SEQ ID NO: 237058 - RNA, 19 nt, Homo sapiens
ggugaaggcggcaucauua

SEQ ID NO: 237059 - RNA, 19 nt, Homo sapiens
ucagcuaucuuaagaauca

SEQ ID NO: 237060 - RNA, 19 nt, Homo sapiens
ugucauaucuugcccuauu

SEQ ID NO: 237061 - RNA, 19 nt, Homo sapiens
ggacuaguagccuucaaua

SEQ ID NO: 237062 - RNA, 19 nt, Homo sapiens
ugauauggauuuccuagaa

SEQ ID NO: 237063 - RNA, 19 nt, Homo sapiens
gacagaaaguaacugauug

SEQ ID NO: 237064 - RNA, 19 nt, Homo sapiens
caauaaugcuggagugaau

SEQ ID NO: 237065 - RNA, 19 nt, Homo sapiens
uaauaacucuggucuagau

SEQ ID NO: 237066 - RNA, 19 nt, Homo sapiens
aaacauaucccagaugaaa

SEQ ID NO: 237067 - RNA, 19 nt, Homo sapiens
uuaagaugcucaacaagaa

SEQ ID NO: 237068 - RNA, 19 nt, Homo sapiens
gaaaacugcuguauggaaa

SEQ ID NO: 237069 - RNA, 19 nt, Homo sapiens
acuaguagccuucaauaua

SEQ ID NO: 237070 - RNA, 19 nt, Homo sapiens
ggcagugacuaaucaguaa

SEQ ID NO: 237071 - RNA, 19 nt, Homo sapiens
ugauaacacucauugaaga

SEQ ID NO: 237072 - RNA, 19 nt, Homo sapiens
uagaaguacuggaauguug

SEQ ID NO: 237073 - RNA, 19 nt, Homo sapiens
uaacacagccauccuugaa

SEQ ID NO: 237074 - RNA, 19 nt, Homo sapiens
gauugacacuguugauuca

SEQ ID NO: 237075 - RNA, 19 nt, Homo sapiens
guaaaacacucacauacaa

SEQ ID NO: 237076 - RNA, 19 nt, Homo sapiens
gaagaugaugcuuuaaaug

SEQ ID NO: 237077 - RNA, 19 nt, Homo sapiens
gaaggcggcaucauuauca

SEQ ID NO: 237078 - RNA, 19 nt, Homo sapiens
caugugagauugauaugga

SEQ ID NO: 237079 - RNA, 19 nt, Homo sapiens
guugucagcuaucuuaaga

SEQ ID NO: 237080 - RNA, 19 nt, Homo sapiens
uauaccaucuuucaacuga

SEQ ID NO: 237081 - RNA, 19 nt, Homo sapiens
acaauugccuucacuuuua

SEQ ID NO: 237082 - RNA, 19 nt, Homo sapiens
guauagcuaucaaggaaau

SEQ ID NO: 237083 - RNA, 19 nt, Homo sapiens
ugacagaaaguaacugauu

SEQ ID NO: 237084 - RNA, 19 nt, Homo sapiens
ugaagcagguguacagugu

SEQ ID NO: 237085 - RNA, 19 nt, Homo sapiens
gaccaaaggcuagguugua

SEQ ID NO: 237086 - RNA, 19 nt, Homo sapiens
gaaaacaugggacaauaua

SEQ ID NO: 237087 - RNA, 19 nt, Homo sapiens
gcaguaauuaacacuagua

SEQ ID NO: 237088 - RNA, 19 nt, Homo sapiens
gaugaaaacugcuguaugg

SEQ ID NO: 237089 - RNA, 19 nt, Homo sapiens
guuguaaucuugauagucu

SEQ ID NO: 237090 - RNA, 19 nt, Homo sapiens
caacuccauuucaagcaaa

SEQ ID NO: 237091 - RNA, 19 nt, Homo sapiens
ugauacaacuccauuucaa

SEQ ID NO: 237092 - RNA, 19 nt, Homo sapiens
gaugucgguuugcccagua

SEQ ID NO: 237093 - RNA, 19 nt, Homo sapiens
ucaaugaacaucugauaga

SEQ ID NO: 237094 - RNA, 19 nt, Homo sapiens
cuaguagccuucaauauac

SEQ ID NO: 237095 - RNA, 19 nt, Homo sapiens
aaacaauugccuucacuuu

SEQ ID NO: 237096 - RNA, 19 nt, Homo sapiens
aaacuguaaucaggcauaa

SEQ ID NO: 237097 - RNA, 19 nt, Homo sapiens
gauauggauuuccuagaag

SEQ ID NO: 237098 - RNA, 19 nt, Homo sapiens
ggauugauaacacucauug

SEQ ID NO: 237099 - RNA, 19 nt, Homo sapiens
gcacagcagccgguuuauu

SEQ ID NO: 237100 - RNA, 19 nt, Homo sapiens
cacagcagccgguuuauug

SEQ ID NO: 237101 - RNA, 19 nt, Homo sapiens
cauaacaacacagacauaa

SEQ ID NO: 237102 - RNA, 19 nt, Homo sapiens
gcacgugaacggcaaagug

SEQ ID NO: 237103 - RNA, 19 nt, Homo sapiens
caacugagagacacuuuua

SEQ ID NO: 237104 - RNA, 19 nt, Homo sapiens
ugacucauccugucugcua

SEQ ID NO: 237105 - RNA, 19 nt, Homo sapiens
ccaaugaacagcuuaugug

SEQ ID NO: 237106 - RNA, 19 nt, Homo sapiens
ugucagcuaucuuaagaau

SEQ ID NO: 237107 - RNA, 19 nt, Homo sapiens
acacagccauccuugaauc

SEQ ID NO: 237108 - RNA, 19 nt, Homo sapiens
uggcauaguuggauucaca

SEQ ID NO: 237109 - RNA, 19 nt, Homo sapiens
gcugugagguuuugcuuuu

SEQ ID NO: 237110 - RNA, 19 nt, Homo sapiens
gugccuacccuucaauaaa

SEQ ID NO: 237111 - RNA, 19 nt, Homo sapiens
uaugaacaguggugugaga

SEQ ID NO: 237112 - RNA, 19 nt, Homo sapiens
caaaguagugaacaucaau

SEQ ID NO: 237113 - RNA, 19 nt, Homo sapiens
gcagucaaggaauaaacua

SEQ ID NO: 237114 - RNA, 19 nt, Homo sapiens
acaaaguagugaacaucaa

SEQ ID NO: 237115 - RNA, 19 nt, Homo sapiens
gccaaaucuuuccauguga

SEQ ID NO: 237116 - RNA, 19 nt, Homo sapiens
agccaaaucuuuccaugug

SEQ ID NO: 237117 - RNA, 19 nt, Homo sapiens
gaauaguuaguacuccaaa

SEQ ID NO: 237118 - RNA, 19 nt, Homo sapiens
guaacugauugacacuguu

SEQ ID NO: 237119 - RNA, 19 nt, Homo sapiens
caguaucacuuaucuucug

SEQ ID NO: 237120 - RNA, 19 nt, Homo sapiens
uaaacuguaaucaggcaua

SEQ ID NO: 237121 - RNA, 19 nt, Homo sapiens
ccacaacuguaaauguuuu

SEQ ID NO: 237122 - RNA, 19 nt, Homo sapiens
agccacaacuguaaauguu

SEQ ID NO: 237123 - RNA, 19 nt, Homo sapiens
caaaggcuagguuguaauc

SEQ ID NO: 237124 - RNA, 19 nt, Homo sapiens
ucaagacuaugauacaacu

SEQ ID NO: 237125 - RNA, 19 nt, Homo sapiens
caaugaacaucugauagag

SEQ ID NO: 237126 - RNA, 19 nt, Homo sapiens
caauaugucaucuuuagca

SEQ ID NO: 237127 - RNA, 19 nt, Homo sapiens
gcggcaucauuaucaauau

SEQ ID NO: 237128 - RNA, 19 nt, Homo sapiens
ggcggcaucauuaucaaua

SEQ ID NO: 237129 - RNA, 19 nt, Homo sapiens
gacaaaguagugaacauca

SEQ ID NO: 237130 - RNA, 19 nt, Homo sapiens
cuccauaaauuacuuaguc

SEQ ID NO: 237131 - RNA, 19 nt, Homo sapiens
gaaauguuacaguuugaag

SEQ ID NO: 237132 - RNA, 19 nt, Homo sapiens
uggagugaauaaugagaaa

SEQ ID NO: 237133 - RNA, 19 nt, Homo sapiens
cugcuaaucuuaugaacag

SEQ ID NO: 237134 - RNA, 19 nt, Homo sapiens
aguaaaugaugucgguuug

SEQ ID NO: 237135 - RNA, 19 nt, Homo sapiens
uaagcuuguuuguauguuc

SEQ ID NO: 237136 - RNA, 19 nt, Homo sapiens
gucauaucuugcccuauuu

SEQ ID NO: 237137 - RNA, 19 nt, Homo sapiens
ucauaacaacacagacaua

SEQ ID NO: 237138 - RNA, 19 nt, Homo sapiens
accaaaggcuagguuguaa

SEQ ID NO: 237139 - RNA, 19 nt, Homo sapiens
gauaacacucauugaagau

SEQ ID NO: 237140 - RNA, 19 nt, Homo sapiens
caugggacaauauauagaa

SEQ ID NO: 237141 - RNA, 19 nt, Homo sapiens
agguagcgcugguggauug

SEQ ID NO: 237142 - RNA, 19 nt, Homo sapiens
agaagacucuguucaucca

SEQ ID NO: 237143 - RNA, 19 nt, Homo sapiens
uaacucuggucuagauuuu

SEQ ID NO: 237144 - RNA, 19 nt, Homo sapiens
auuaauaacucuggucuag

SEQ ID NO: 237145 - RNA, 19 nt, Homo sapiens
gaaaacaauugccuucacu

SEQ ID NO: 237146 - RNA, 19 nt, Homo sapiens
aagcaguaauuaacacuag

SEQ ID NO: 237147 - RNA, 19 nt, Homo sapiens
uaagaugcucaacaagaaa

SEQ ID NO: 237148 - RNA, 19 nt, Homo sapiens
aggcuagguuguaaucuug

SEQ ID NO: 237149 - RNA, 19 nt, Homo sapiens
cgacagcgguggucccuuu

SEQ ID NO: 237150 - RNA, 19 nt, Homo sapiens
caauggcgcugacuucuau

SEQ ID NO: 237151 - RNA, 19 nt, Homo sapiens
gggaugcucuuuaaauaau

SEQ ID NO: 237152 - RNA, 19 nt, Homo sapiens
gcagugacauggcgcagaa

SEQ ID NO: 237153 - RNA, 19 nt, Homo sapiens
gaggagaacagcaacgaua

SEQ ID NO: 237154 - RNA, 19 nt, Homo sapiens
gcaaugaugucugcaaugg

SEQ ID NO: 237155 - RNA, 19 nt, Homo sapiens
gaugaugggaugcucuuua

SEQ ID NO: 237156 - RNA, 19 nt, Homo sapiens
gcgcugacuucuauggaaa

SEQ ID NO: 237157 - RNA, 19 nt, Homo sapiens
gagaacagcaacgauauug

SEQ ID NO: 237158 - RNA, 19 nt, Homo sapiens
gaugggaugcucuuuaaau

SEQ ID NO: 237159 - RNA, 19 nt, Homo sapiens
gcaauggcgcugacuucua

SEQ ID NO: 237160 - RNA, 19 nt, Homo sapiens
ggagaacagcaacgauauu

SEQ ID NO: 237161 - RNA, 19 nt, Homo sapiens
gaauacauccagccugugu

SEQ ID NO: 237162 - RNA, 19 nt, Homo sapiens
gcaacacgcaguacuaugg

SEQ ID NO: 237163 - RNA, 19 nt, Homo sapiens
caagucagccuucgcuaug

SEQ ID NO: 237164 - RNA, 19 nt, Homo sapiens
augggaugcucuuuaaaua

SEQ ID NO: 237165 - RNA, 19 nt, Homo sapiens
gccagggaaucauuaacaa

SEQ ID NO: 237166 - RNA, 19 nt, Homo sapiens
gcaagucagccuucgcuau

SEQ ID NO: 237167 - RNA, 19 nt, Homo sapiens
cagcaaugaugucugcaau

SEQ ID NO: 237168 - RNA, 19 nt, Homo sapiens
gcaguacuauggccaacag

SEQ ID NO: 237169 - RNA, 19 nt, Homo sapiens
augaugggaugcucuuuaa

SEQ ID NO: 237170 - RNA, 19 nt, Homo sapiens
cagggaaucauuaacaaga

SEQ ID NO: 237171 - RNA, 19 nt, Homo sapiens
gaucaagcccaagauguuc

SEQ ID NO: 237172 - RNA, 19 nt, Homo sapiens
ggucagccagggaaucauu

SEQ ID NO: 237173 - RNA, 19 nt, Homo sapiens
ggcgcugacuucuauggaa

SEQ ID NO: 237174 - RNA, 19 nt, Homo sapiens
ccauguaaauauuguucug

SEQ ID NO: 237175 - RNA, 19 nt, Homo sapiens
ugggaugcucuuuaaauaa

SEQ ID NO: 237176 - RNA, 19 nt, Homo sapiens
gcucauggucuuugacaag

SEQ ID NO: 237177 - RNA, 19 nt, Homo sapiens
gggcaacacgcaguacuau

SEQ ID NO: 237178 - RNA, 19 nt, Homo sapiens
gaucuuccaggccauaaag

SEQ ID NO: 237179 - RNA, 19 nt, Homo sapiens
uguguggcauugugaguug

SEQ ID NO: 237180 - RNA, 19 nt, Homo sapiens
gcacgucgggcuucuucug

SEQ ID NO: 237181 - RNA, 19 nt, Homo sapiens
gaggucagccagggaauca

SEQ ID NO: 237182 - RNA, 19 nt, Homo sapiens
ccuccaggguccucucuuc

SEQ ID NO: 237183 - RNA, 19 nt, Homo sapiens
agaucaagcccaagauguu

SEQ ID NO: 237184 - RNA, 19 nt, Homo sapiens
guggauggcaagaucugua

SEQ ID NO: 237185 - RNA, 19 nt, Homo sapiens
cagcgguggucccuuugug

SEQ ID NO: 237186 - RNA, 19 nt, Homo sapiens
ugauggagcacaccucugu

SEQ ID NO: 237187 - RNA, 19 nt, Homo sapiens
ccagaucaagcccaagaug

SEQ ID NO: 237188 - RNA, 19 nt, Homo sapiens
ccugguggauggcaagauc

SEQ ID NO: 237189 - RNA, 19 nt, Homo sapiens
cagaucaagcccaagaugu

SEQ ID NO: 237190 - RNA, 19 nt, Homo sapiens
ccaggcgucuacaccaaag

SEQ ID NO: 237191 - RNA, 19 nt, Homo sapiens
caagguggcagcucucacu

SEQ ID NO: 237192 - RNA, 19 nt, Homo sapiens
ggugcaggcuguggucuac

SEQ ID NO: 237193 - RNA, 19 nt, Homo sapiens
aacaagaggcagugacaug

SEQ ID NO: 237194 - RNA, 19 nt, Homo sapiens
ggaucuuccaggccauaaa

SEQ ID NO: 237195 - RNA, 19 nt, Homo sapiens
ccagaagccaggcgucuac

SEQ ID NO: 237196 - RNA, 19 nt, Homo sapiens
guggucccuuuguguguga

SEQ ID NO: 237197 - RNA, 19 nt, Homo sapiens
cgucgggcuucuucugugu

SEQ ID NO: 237198 - RNA, 19 nt, Homo sapiens
gaccauagcugagaacuaa

SEQ ID NO: 237199 - RNA, 19 nt, Homo sapiens
gagauaaacuuccugaaug

SEQ ID NO: 237200 - RNA, 19 nt, Homo sapiens
gcaaugaugucacggauau

SEQ ID NO: 237201 - RNA, 19 nt, Homo sapiens
aagaagcaguggauaaaua

SEQ ID NO: 237202 - RNA, 19 nt, Homo sapiens
ucacggauauuucagauga

SEQ ID NO: 237203 - RNA, 19 nt, Homo sapiens
agaaggugcuuguuaauga

SEQ ID NO: 237204 - RNA, 19 nt, Homo sapiens
gggccacgcugaucaauga

SEQ ID NO: 237205 - RNA, 19 nt, Homo sapiens
gauaagaagcaguggauaa

SEQ ID NO: 237206 - RNA, 19 nt, Homo sapiens
ggagauaaacuuccugaau

SEQ ID NO: 237207 - RNA, 19 nt, Homo sapiens
agaaggagauggaguauac

SEQ ID NO: 237208 - RNA, 19 nt, Homo sapiens
gaacgaacacaccuucugu

SEQ ID NO: 237209 - RNA, 19 nt, Homo sapiens
aaauaaggcuguuggagau

SEQ ID NO: 237210 - RNA, 19 nt, Homo sapiens
gauggaguauacaccuuaa

SEQ ID NO: 237211 - RNA, 19 nt, Homo sapiens
gcugaucaaugaacaaugg

SEQ ID NO: 237212 - RNA, 19 nt, Homo sapiens
gcacuguacucaggcaaug

SEQ ID NO: 237213 - RNA, 19 nt, Homo sapiens
ucaucaaacucaaacagaa

SEQ ID NO: 237214 - RNA, 19 nt, Homo sapiens
guacgcggcugggauccua

SEQ ID NO: 237215 - RNA, 19 nt, Homo sapiens
gcugugcuguggcugagua

SEQ ID NO: 237216 - RNA, 19 nt, Homo sapiens
uaaacuuccugaaugugaa

SEQ ID NO: 237217 - RNA, 19 nt, Homo sapiens
gagauggaguauacaccuu

SEQ ID NO: 237218 - RNA, 19 nt, Homo sapiens
agauaaacuuccugaaugu

SEQ ID NO: 237219 - RNA, 19 nt, Homo sapiens
acgauugcauaacgcauua

SEQ ID NO: 237220 - RNA, 19 nt, Homo sapiens
agaagcaguggauaaauaa

SEQ ID NO: 237221 - RNA, 19 nt, Homo sapiens
gcugggauccuaagcuuug

SEQ ID NO: 237222 - RNA, 19 nt, Homo sapiens
gcagugccuuugccguuca

SEQ ID NO: 237223 - RNA, 19 nt, Homo sapiens
gcacaugccccaaauggaa

SEQ ID NO: 237224 - RNA, 19 nt, Homo sapiens
uaaggcuguuggagauaaa

SEQ ID NO: 237225 - RNA, 19 nt, Homo sapiens
gauugcaaauggcuaugug

SEQ ID NO: 237226 - RNA, 19 nt, Homo sapiens
uaaacuuacugaccaucug

SEQ ID NO: 237227 - RNA, 19 nt, Homo sapiens
auaaggcuguuggagauaa

SEQ ID NO: 237228 - RNA, 19 nt, Homo sapiens
cacagaaggagauggagua

SEQ ID NO: 237229 - RNA, 19 nt, Homo sapiens
agaagaccauagcugagaa

SEQ ID NO: 237230 - RNA, 19 nt, Homo sapiens
gauccuaagcuuugauaag

SEQ ID NO: 237231 - RNA, 19 nt, Homo sapiens
auccuaagcuuugauaaga

SEQ ID NO: 237232 - RNA, 19 nt, Homo sapiens
caaagaauuaugcagaagu

SEQ ID NO: 237233 - RNA, 19 nt, Homo sapiens
gaguaugguguguauguga

SEQ ID NO: 237234 - RNA, 19 nt, Homo sapiens
gggauccuaagcuuugaua

SEQ ID NO: 237235 - RNA, 19 nt, Homo sapiens
gccuguggcugaccaauac

SEQ ID NO: 237236 - RNA, 19 nt, Homo sapiens
ccacgcugaucaaugaaca

SEQ ID NO: 237237 - RNA, 19 nt, Homo sapiens
auaagaagcaguggauaaa

SEQ ID NO: 237238 - RNA, 19 nt, Homo sapiens
cagaagaccauagcugaga

SEQ ID NO: 237239 - RNA, 19 nt, Homo sapiens
cggcugggauccuaagcuu

SEQ ID NO: 237240 - RNA, 19 nt, Homo sapiens
cugaccaucugaaguaugu

SEQ ID NO: 237241 - RNA, 19 nt, Homo sapiens
ucaaagaauuaugcagaag

SEQ ID NO: 237242 - RNA, 19 nt, Homo sapiens
gcaccgaagagcccuguag

SEQ ID NO: 237243 - RNA, 19 nt, Homo sapiens
aaguagggcguguggguua

SEQ ID NO: 237244 - RNA, 19 nt, Homo sapiens
ucaaacagaaggugcuugu

SEQ ID NO: 237245 - RNA, 19 nt, Homo sapiens
agauggaguauacaccuua

SEQ ID NO: 237246 - RNA, 19 nt, Homo sapiens
aaugaugucacggauauuu

SEQ ID NO: 237247 - RNA, 19 nt, Homo sapiens
cagaaggugcuuguuaaug

SEQ ID NO: 237248 - RNA, 19 nt, Homo sapiens
gauaaauaaggcuguugga

SEQ ID NO: 237249 - RNA, 19 nt, Homo sapiens
gcgcacagaaggagaugga

SEQ ID NO: 237250 - RNA, 19 nt, Homo sapiens
gaccugggagcugucauuu

SEQ ID NO: 237251 - RNA, 19 nt, Homo sapiens
aaacuuacugaccaucuga

SEQ ID NO: 237252 - RNA, 19 nt, Homo sapiens
gcuaccaguguaagaacua

SEQ ID NO: 237253 - RNA, 19 nt, Homo sapiens
ggcugaguaugguguguau

SEQ ID NO: 237254 - RNA, 19 nt, Homo sapiens
ccugggagcugucauuucc

SEQ ID NO: 237255 - RNA, 19 nt, Homo sapiens
uggaggaggacaccuggua

SEQ ID NO: 237256 - RNA, 19 nt, Homo sapiens
ugaaugugaagcaguaugu

SEQ ID NO: 237257 - RNA, 19 nt, Homo sapiens
uccugaaugugaagcagua

SEQ ID NO: 237258 - RNA, 19 nt, Homo sapiens
auaaacuuccugaauguga

SEQ ID NO: 237259 - RNA, 19 nt, Homo sapiens
guggauaaauaaggcuguu

SEQ ID NO: 237260 - RNA, 19 nt, Homo sapiens
uaagaagcaguggauaaau

SEQ ID NO: 237261 - RNA, 19 nt, Homo sapiens
gcguguggguuacgugucu

SEQ ID NO: 237262 - RNA, 19 nt, Homo sapiens
guacucaggcaaugauguc

SEQ ID NO: 237263 - RNA, 19 nt, Homo sapiens
caacagcgaaagacauugc

SEQ ID NO: 237264 - RNA, 19 nt, Homo sapiens
ggcaaugaugucacggaua

SEQ ID NO: 237265 - RNA, 19 nt, Homo sapiens
gauaaacuuccugaaugug

SEQ ID NO: 237266 - RNA, 19 nt, Homo sapiens
aguaugguguguaugugaa

SEQ ID NO: 237267 - RNA, 19 nt, Homo sapiens
cuauguggagcacuuguuu

SEQ ID NO: 237268 - RNA, 19 nt, Homo sapiens
cagaaggagauggaguaua

SEQ ID NO: 237269 - RNA, 19 nt, Homo sapiens
gugacaacuuuaaacuuac

SEQ ID NO: 237270 - RNA, 19 nt, Homo sapiens
uuguagagauugagaaggu

SEQ ID NO: 237271 - RNA, 19 nt, Homo sapiens
ugucacggauauuucagau

SEQ ID NO: 237272 - RNA, 19 nt, Homo sapiens
gggugcagcccauacugaa

SEQ ID NO: 237273 - RNA, 19 nt, Homo sapiens
gaccaucugaaguauguca

SEQ ID NO: 237274 - RNA, 19 nt, Homo sapiens
ugagauugcaaauggcuau

SEQ ID NO: 237275 - RNA, 19 nt, Homo sapiens
caucaaacucaaacagaag

SEQ ID NO: 237276 - RNA, 19 nt, Homo sapiens
gcuauguggagcacuuguu

SEQ ID NO: 237277 - RNA, 19 nt, Homo sapiens
ugcaacagcgaaagacauu

SEQ ID NO: 237278 - RNA, 19 nt, Homo sapiens
ugaguaugguguguaugug

SEQ ID NO: 237279 - RNA, 19 nt, Homo sapiens
gcuguuggagauaaacuuc

SEQ ID NO: 237280 - RNA, 19 nt, Homo sapiens
gauaugcccuugacuauaa

SEQ ID NO: 237281 - RNA, 19 nt, Homo sapiens
ggaaacaucuggaguccua

SEQ ID NO: 237282 - RNA, 19 nt, Homo sapiens
gaugaucucucaacuuuaa

SEQ ID NO: 237283 - RNA, 19 nt, Homo sapiens
ucaaagcacugaauagaaa

SEQ ID NO: 237284 - RNA, 19 nt, Homo sapiens
gaacucauaucuguaagaa

SEQ ID NO: 237285 - RNA, 19 nt, Homo sapiens
ggacaggacugaacgucuu

SEQ ID NO: 237286 - RNA, 19 nt, Homo sapiens
gcaaaacaaugcagacuuu

SEQ ID NO: 237287 - RNA, 19 nt, Homo sapiens
ggaaagaauagaagugauu

SEQ ID NO: 237288 - RNA, 19 nt, Homo sapiens
gugaaacauugaacucaua

SEQ ID NO: 237289 - RNA, 19 nt, Homo sapiens
cugaagagcuauuguaaug

SEQ ID NO: 237290 - RNA, 19 nt, Homo sapiens
uugcugaccugcuggauua

SEQ ID NO: 237291 - RNA, 19 nt, Homo sapiens
caucaaagacagcaucuaa

SEQ ID NO: 237292 - RNA, 19 nt, Homo sapiens
gauauaagccagacuuugu

SEQ ID NO: 237293 - RNA, 19 nt, Homo sapiens
gaagagcuauuguaaugac

SEQ ID NO: 237294 - RNA, 19 nt, Homo sapiens
gggaggccaucacauugua

SEQ ID NO: 237295 - RNA, 19 nt, Homo sapiens
gacagcaucuaagaaguuu

SEQ ID NO: 237296 - RNA, 19 nt, Homo sapiens
gcaguauaauccaaagaug

SEQ ID NO: 237297 - RNA, 19 nt, Homo sapiens
caaguuuguuguaggauau

SEQ ID NO: 237298 - RNA, 19 nt, Homo sapiens
gaaagaauagaagugauug

SEQ ID NO: 237299 - RNA, 19 nt, Homo sapiens
cuauugacaucgccaguaa

SEQ ID NO: 237300 - RNA, 19 nt, Homo sapiens
gaaucauguuugugucauu

SEQ ID NO: 237301 - RNA, 19 nt, Homo sapiens
agugauagauccauuccua

SEQ ID NO: 237302 - RNA, 19 nt, Homo sapiens
ucaaagacagcaucuaaga

SEQ ID NO: 237303 - RNA, 19 nt, Homo sapiens
guaagaagcagucaauuuu

SEQ ID NO: 237304 - RNA, 19 nt, Homo sapiens
guucuguccuggaauuauu

SEQ ID NO: 237305 - RNA, 19 nt, Homo sapiens
acauugaacucauaucugu

SEQ ID NO: 237306 - RNA, 19 nt, Homo sapiens
ggauaugcccuugacuaua

SEQ ID NO: 237307 - RNA, 19 nt, Homo sapiens
gagaugugaugaaggagau

SEQ ID NO: 237308 - RNA, 19 nt, Homo sapiens
ugaaauuccagacaaguuu

SEQ ID NO: 237309 - RNA, 19 nt, Homo sapiens
gccagacuuuguuggauuu

SEQ ID NO: 237310 - RNA, 19 nt, Homo sapiens
caaagacagcaucuaagaa

SEQ ID NO: 237311 - RNA, 19 nt, Homo sapiens
gaaauuccagacaaguuug

SEQ ID NO: 237312 - RNA, 19 nt, Homo sapiens
cacgaaguguuggauauaa

SEQ ID NO: 237313 - RNA, 19 nt, Homo sapiens
caucaaagcacugaauaga

SEQ ID NO: 237314 - RNA, 19 nt, Homo sapiens
gcggauuguuguuuaacuu

SEQ ID NO: 237315 - RNA, 19 nt, Homo sapiens
gcccuugacuauaaugaau

SEQ ID NO: 237316 - RNA, 19 nt, Homo sapiens
gacugaagagcuauuguaa

SEQ ID NO: 237317 - RNA, 19 nt, Homo sapiens
gucaguugcugcauuccua

SEQ ID NO: 237318 - RNA, 19 nt, Homo sapiens
uaagaugagaguucaaguu

SEQ ID NO: 237319 - RNA, 19 nt, Homo sapiens
ccacgaaguguuggauaua

SEQ ID NO: 237320 - RNA, 19 nt, Homo sapiens
aguaagaagcagucaauuu

SEQ ID NO: 237321 - RNA, 19 nt, Homo sapiens
acuauugagugaaacauug

SEQ ID NO: 237322 - RNA, 19 nt, Homo sapiens
ggauauaagccagacuuug

SEQ ID NO: 237323 - RNA, 19 nt, Homo sapiens
guuuauuccucauggacua

SEQ ID NO: 237324 - RNA, 19 nt, Homo sapiens
agacugaagagcuauugua

SEQ ID NO: 237325 - RNA, 19 nt, Homo sapiens
ggauuguuguuuaacuugu

SEQ ID NO: 237326 - RNA, 19 nt, Homo sapiens
auacaaagccuaagaugag

SEQ ID NO: 237327 - RNA, 19 nt, Homo sapiens
agacuuuguuggauuugaa

SEQ ID NO: 237328 - RNA, 19 nt, Homo sapiens
gaacgucuugcucgagaug

SEQ ID NO: 237329 - RNA, 19 nt, Homo sapiens
gauuagugaugaugaacca

SEQ ID NO: 237330 - RNA, 19 nt, Homo sapiens
aaagacagcaucuaagaag

SEQ ID NO: 237331 - RNA, 19 nt, Homo sapiens
aaaguaagaagcagucaau

SEQ ID NO: 237332 - RNA, 19 nt, Homo sapiens
ccugcuggauuacaucaaa

SEQ ID NO: 237333 - RNA, 19 nt, Homo sapiens
gcaggaaagaauagaagug

SEQ ID NO: 237334 - RNA, 19 nt, Homo sapiens
uuaaaccacagcacuauug

SEQ ID NO: 237335 - RNA, 19 nt, Homo sapiens
aagaugagaguucaaguug

SEQ ID NO: 237336 - RNA, 19 nt, Homo sapiens
gcaguucccuuuuaaaugc

SEQ ID NO: 237337 - RNA, 19 nt, Homo sapiens
caggaaagaauagaaguga

SEQ ID NO: 237338 - RNA, 19 nt, Homo sapiens
ucauuaugcugaggauuug

SEQ ID NO: 237339 - RNA, 19 nt, Homo sapiens
uaggauaugcccuugacua

SEQ ID NO: 237340 - RNA, 19 nt, Homo sapiens
agacuuugcuuuccuuggu

SEQ ID NO: 237341 - RNA, 19 nt, Homo sapiens
ugacaucgccaguaaaauu

SEQ ID NO: 237342 - RNA, 19 nt, Homo sapiens
gaaaaggaccccacgaagu

SEQ ID NO: 237343 - RNA, 19 nt, Homo sapiens
ccucauggacuaauuaugg

SEQ ID NO: 237344 - RNA, 19 nt, Homo sapiens
ugucagcaguucccuuuua

SEQ ID NO: 237345 - RNA, 19 nt, Homo sapiens
agacagcaucuaagaaguu

SEQ ID NO: 237346 - RNA, 19 nt, Homo sapiens
uagacuaucaguucccuuu

SEQ ID NO: 237347 - RNA, 19 nt, Homo sapiens
uaaaccacagcacuauuga

SEQ ID NO: 237348 - RNA, 19 nt, Homo sapiens
cuguuuauuugcacuauga

SEQ ID NO: 237349 - RNA, 19 nt, Homo sapiens
uaguaguguuucaguaaug

SEQ ID NO: 237350 - RNA, 19 nt, Homo sapiens
gguuaugaccuugauuuau

SEQ ID NO: 237351 - RNA, 19 nt, Homo sapiens
caaugcagacuuugcuuuc

SEQ ID NO: 237352 - RNA, 19 nt, Homo sapiens
cgugauuagugaugaugaa

SEQ ID NO: 237353 - RNA, 19 nt, Homo sapiens
gacuguagauuuuaucaga

SEQ ID NO: 237354 - RNA, 19 nt, Homo sapiens
uugggcggauuguuguuua

SEQ ID NO: 237355 - RNA, 19 nt, Homo sapiens
gacuaucaguucccuuugg

SEQ ID NO: 237356 - RNA, 19 nt, Homo sapiens
uacaaagccuaagaugaga

SEQ ID NO: 237357 - RNA, 19 nt, Homo sapiens
aauacaaagccuaagauga

SEQ ID NO: 237358 - RNA, 19 nt, Homo sapiens
cccacgaaguguuggauau

SEQ ID NO: 237359 - RNA, 19 nt, Homo sapiens
gauccauuccuaugacugu

SEQ ID NO: 237360 - RNA, 19 nt, Homo sapiens
uaucaauguucuaguucug

SEQ ID NO: 237361 - RNA, 19 nt, Homo sapiens
gacaucgccaguaaaauua

SEQ ID NO: 237362 - RNA, 19 nt, Homo sapiens
caaaauacaaagccuaaga

SEQ ID NO: 237363 - RNA, 19 nt, Homo sapiens
ucucaacuuuaacuggaaa

SEQ ID NO: 237364 - RNA, 19 nt, Homo sapiens
gcccuggcgucgugauuag

SEQ ID NO: 237365 - RNA, 19 nt, Homo sapiens
gcagucaauuuucacauca

SEQ ID NO: 237366 - RNA, 19 nt, Homo sapiens
guggccaucugcuuaguag

SEQ ID NO: 237367 - RNA, 19 nt, Homo sapiens
gaauacuucagggauuuga

SEQ ID NO: 237368 - RNA, 19 nt, Homo sapiens
gaaauagugauagauccau

SEQ ID NO: 237369 - RNA, 19 nt, Homo sapiens
gaaucuuugucagcaguuc

SEQ ID NO: 237370 - RNA, 19 nt, Homo sapiens
uauuaccagugaaucuuug

SEQ ID NO: 237371 - RNA, 19 nt, Homo sapiens
uacaucaaagcacugaaua

SEQ ID NO: 237372 - RNA, 19 nt, Homo sapiens
cucgagaugugaugaagga

SEQ ID NO: 237373 - RNA, 19 nt, Homo sapiens
acaaugcagacuuugcuuu

SEQ ID NO: 237374 - RNA, 19 nt, Homo sapiens
aaacaucuggaguccuauu

SEQ ID NO: 237375 - RNA, 19 nt, Homo sapiens
agccagacuuuguuggauu

SEQ ID NO: 237376 - RNA, 19 nt, Homo sapiens
ggcaguauaauccaaagau

SEQ ID NO: 237377 - RNA, 19 nt, Homo sapiens
ggauuuggaaaggguguuu

SEQ ID NO: 237378 - RNA, 19 nt, Homo sapiens
uaagccagacuuuguugga

SEQ ID NO: 237379 - RNA, 19 nt, Homo sapiens
auuauaccaccguguguua

SEQ ID NO: 237380 - RNA, 19 nt, Homo sapiens
gcaccuggcuggaguuuaa

SEQ ID NO: 237381 - RNA, 19 nt, Homo sapiens
gaugugauaugucuaguuu

SEQ ID NO: 237382 - RNA, 19 nt, Homo sapiens
ggacagaucaggaguuuga

SEQ ID NO: 237383 - RNA, 19 nt, Homo sapiens
gaucagagcucagguagca

SEQ ID NO: 237384 - RNA, 19 nt, Homo sapiens
gauaagcccuugcuaaguc

SEQ ID NO: 237385 - RNA, 19 nt, Homo sapiens
gguaggugcucaauaaaug

SEQ ID NO: 237386 - RNA, 19 nt, Homo sapiens
ggccaaggcuuucuccaaa

SEQ ID NO: 237387 - RNA, 19 nt, Homo sapiens
gaacccacauguuggucua

SEQ ID NO: 237388 - RNA, 19 nt, Homo sapiens
ugugguaggugcucaauaa

SEQ ID NO: 237389 - RNA, 19 nt, Homo sapiens
gaacuagaacccacauguu

SEQ ID NO: 237390 - RNA, 19 nt, Homo sapiens
gagugaacauccugaauca

SEQ ID NO: 237391 - RNA, 19 nt, Homo sapiens
ggaucuguguuccuccuua

SEQ ID NO: 237392 - RNA, 19 nt, Homo sapiens
caccuacuauuucccuuua

SEQ ID NO: 237393 - RNA, 19 nt, Homo sapiens
gaucuguguuccuccuuaa

SEQ ID NO: 237394 - RNA, 19 nt, Homo sapiens
gaucaggaguuugaagaga

SEQ ID NO: 237395 - RNA, 19 nt, Homo sapiens
cccuugaucuuucuauaua

SEQ ID NO: 237396 - RNA, 19 nt, Homo sapiens
gguacaaacuccagaugau

SEQ ID NO: 237397 - RNA, 19 nt, Homo sapiens
gccagaggauggacaaguu

SEQ ID NO: 237398 - RNA, 19 nt, Homo sapiens
ccaagcugcuggcauucua

SEQ ID NO: 237399 - RNA, 19 nt, Homo sapiens
ggaggaacaucaccauggu

SEQ ID NO: 237400 - RNA, 19 nt, Homo sapiens
gcugauaagcccuugcuaa

SEQ ID NO: 237401 - RNA, 19 nt, Homo sapiens
acuaaggucuggucucuga

SEQ ID NO: 237402 - RNA, 19 nt, Homo sapiens
gagaaguuccuguccagaa

SEQ ID NO: 237403 - RNA, 19 nt, Homo sapiens
ggaagcuccugcgcuacua

SEQ ID NO: 237404 - RNA, 19 nt, Homo sapiens
ggagugaacauccugaauc

SEQ ID NO: 237405 - RNA, 19 nt, Homo sapiens
ggaacuagaacccacaugu

SEQ ID NO: 237406 - RNA, 19 nt, Homo sapiens
guauguccuucaccuguuu

SEQ ID NO: 237407 - RNA, 19 nt, Homo sapiens
aaacuaaggucuggucucu

SEQ ID NO: 237408 - RNA, 19 nt, Homo sapiens
ccaugacgaugcuggagaa

SEQ ID NO: 237409 - RNA, 19 nt, Homo sapiens
cauggaugcccuucagaua

SEQ ID NO: 237410 - RNA, 19 nt, Homo sapiens
uggcaaguuucuucuauuc

SEQ ID NO: 237411 - RNA, 19 nt, Homo sapiens
acuccaagcugcuggcauu

SEQ ID NO: 237412 - RNA, 19 nt, Homo sapiens
agaaguuccuguccagaau

SEQ ID NO: 237413 - RNA, 19 nt, Homo sapiens
gcuccuacuuccugugguu

SEQ ID NO: 237414 - RNA, 19 nt, Homo sapiens
gugaagagcaggaggaaca

SEQ ID NO: 237415 - RNA, 19 nt, Homo sapiens
cagcagaggacgacauuca

SEQ ID NO: 237416 - RNA, 19 nt, Homo sapiens
ggucauuguuaucacugaa

SEQ ID NO: 237417 - RNA, 19 nt, Homo sapiens
ucccucaacugcagucaaa

SEQ ID NO: 237418 - RNA, 19 nt, Homo sapiens
ucugugagcugugcauaga

SEQ ID NO: 237419 - RNA, 19 nt, Homo sapiens
ggugcgcccuggauugaga

SEQ ID NO: 237420 - RNA, 19 nt, Homo sapiens
caugguguccuaccuagaa

SEQ ID NO: 237421 - RNA, 19 nt, Homo sapiens
gaagcuguaugugcucaag

SEQ ID NO: 237422 - RNA, 19 nt, Homo sapiens
auaaauaacacaggaguga

SEQ ID NO: 237423 - RNA, 19 nt, Homo sapiens
gcagucagagaaugaggaa

SEQ ID NO: 237424 - RNA, 19 nt, Homo sapiens
ccuggcaaguuucuucuau

SEQ ID NO: 237425 - RNA, 19 nt, Homo sapiens
gaaguuccuguccagaaug

SEQ ID NO: 237426 - RNA, 19 nt, Homo sapiens
gaggagacuacuacaggaa

SEQ ID NO: 237427 - RNA, 19 nt, Homo sapiens
cuggacagaucaggaguuu

SEQ ID NO: 237428 - RNA, 19 nt, Homo sapiens
ugacgaugcuggagaagcu

SEQ ID NO: 237429 - RNA, 19 nt, Homo sapiens
ccagaggauggacaaguuu

SEQ ID NO: 237430 - RNA, 19 nt, Homo sapiens
ucuagacccuucugucagu

SEQ ID NO: 237431 - RNA, 19 nt, Homo sapiens
caggguggugugaggauua

SEQ ID NO: 237432 - RNA, 19 nt, Homo sapiens
guacaaacuccagaugauc

SEQ ID NO: 237433 - RNA, 19 nt, Homo sapiens
ggguacaaacuccagauga

SEQ ID NO: 237434 - RNA, 19 nt, Homo sapiens
cagagaaugaggaagaaga

SEQ ID NO: 237435 - RNA, 19 nt, Homo sapiens
acggucaucuuauccgaaa

SEQ ID NO: 237436 - RNA, 19 nt, Homo sapiens
gugcucaaguaccuguuug

SEQ ID NO: 237437 - RNA, 19 nt, Homo sapiens
aauggcaacuuccuguaug

SEQ ID NO: 237438 - RNA, 19 nt, Homo sapiens
cagaucaggaguuugaaga

SEQ ID NO: 237439 - RNA, 19 nt, Homo sapiens
ggagaagaagcugaaggaa

SEQ ID NO: 237440 - RNA, 19 nt, Homo sapiens
gcggcuggaugugauaugu

SEQ ID NO: 237441 - RNA, 19 nt, Homo sapiens
cugauggaauggcaaugaa

SEQ ID NO: 237442 - RNA, 19 nt, Homo sapiens
gcagagacggagacagaca

SEQ ID NO: 237443 - RNA, 19 nt, Homo sapiens
cugcagagacggagacaga

SEQ ID NO: 237444 - RNA, 19 nt, Homo sapiens
uaacacaggagugaacauc

SEQ ID NO: 237445 - RNA, 19 nt, Homo sapiens
ggaugugauaugucuaguu

SEQ ID NO: 237446 - RNA, 19 nt, Homo sapiens
gaggaagcccacccagcaa

SEQ ID NO: 237447 - RNA, 19 nt, Homo sapiens
agucagagaaugaggaaga

SEQ ID NO: 237448 - RNA, 19 nt, Homo sapiens
uguccuaccuagaagacuu

SEQ ID NO: 237449 - RNA, 19 nt, Homo sapiens
gaugccaacgugaaggaaa

SEQ ID NO: 237450 - RNA, 19 nt, Homo sapiens
gcacagcagaggacgacau

SEQ ID NO: 237451 - RNA, 19 nt, Homo sapiens
gucagagaaugaggaagaa

SEQ ID NO: 237452 - RNA, 19 nt, Homo sapiens
uaaauaacacaggagugaa

SEQ ID NO: 237453 - RNA, 19 nt, Homo sapiens
gcccagagauuuggauucc

SEQ ID NO: 237454 - RNA, 19 nt, Homo sapiens
caacaugcuagugcuucua

SEQ ID NO: 237455 - RNA, 19 nt, Homo sapiens
agcuguaugugcucaagua

SEQ ID NO: 237456 - RNA, 19 nt, Homo sapiens
uguauguccuucaccuguu

SEQ ID NO: 237457 - RNA, 19 nt, Homo sapiens
ucaggaguuugaagagagu

SEQ ID NO: 237458 - RNA, 19 nt, Homo sapiens
ucaccuacuauuucccuuu

SEQ ID NO: 237459 - RNA, 19 nt, Homo sapiens
aacuagaacccacauguug

SEQ ID NO: 237460 - RNA, 19 nt, Homo sapiens
ccaacaugcuagugcuucu

SEQ ID NO: 237461 - RNA, 19 nt, Homo sapiens
ccaggguggugugaggauu

SEQ ID NO: 237462 - RNA, 19 nt, Homo sapiens
cacccuugcuugccacugu

SEQ ID NO: 237463 - RNA, 19 nt, Homo sapiens
gcccugcaccugucuguca

SEQ ID NO: 237464 - RNA, 19 nt, Homo sapiens
gcaccugcaggaccaagug

SEQ ID NO: 237465 - RNA, 19 nt, Homo sapiens
gagcaccuggcuggaguuu

SEQ ID NO: 237466 - RNA, 19 nt, Homo sapiens
acuguggacggucaucuua

SEQ ID NO: 237467 - RNA, 19 nt, Homo sapiens
cuggcaaguuucuucuauu

SEQ ID NO: 237468 - RNA, 19 nt, Homo sapiens
caacuuccuguauguccuu

SEQ ID NO: 237469 - RNA, 19 nt, Homo sapiens
gcaggaggaacaucaccau

SEQ ID NO: 237470 - RNA, 19 nt, Homo sapiens
cugcuggcauucuacucua

SEQ ID NO: 237471 - RNA, 19 nt, Homo sapiens
uguggacggucaucuuauc

SEQ ID NO: 237472 - RNA, 19 nt, Homo sapiens
ugauaugucuaguuuaacc

SEQ ID NO: 237473 - RNA, 19 nt, Homo sapiens
ggcuggaugugauaugucu

SEQ ID NO: 237474 - RNA, 19 nt, Homo sapiens
gaauggacccagggacaag

SEQ ID NO: 237475 - RNA, 19 nt, Homo sapiens
caaguaccuguuugaagug

SEQ ID NO: 237476 - RNA, 19 nt, Homo sapiens
guaggugcucaauaaaugu

SEQ ID NO: 237477 - RNA, 19 nt, Homo sapiens
uggagaagaagcugaagga

SEQ ID NO: 237478 - RNA, 19 nt, Homo sapiens
agacggagacagacagcuu

SEQ ID NO: 237479 - RNA, 19 nt, Homo sapiens
aaauggcaacuuccuguau

SEQ ID NO: 237480 - RNA, 19 nt, Homo sapiens
caaaguugcuccaagauga

SEQ ID NO: 237481 - RNA, 19 nt, Homo sapiens
gaaaggauacccaaaguug

SEQ ID NO: 237482 - RNA, 19 nt, Homo sapiens
ucagagagauggaagaauu

SEQ ID NO: 237483 - RNA, 19 nt, Homo sapiens
uggcauagcuggcccauug

SEQ ID NO: 237484 - RNA, 19 nt, Homo sapiens
gagaaaggauacccaaagu

SEQ ID NO: 237485 - RNA, 19 nt, Homo sapiens
ucagauggcuggagcuuug

SEQ ID NO: 237486 - RNA, 19 nt, Homo sapiens
ggaugcagcuguggaaugu

SEQ ID NO: 237487 - RNA, 19 nt, Homo sapiens
cgaagcggcuggagaagga

SEQ ID NO: 237488 - RNA, 19 nt, Homo sapiens
gggaggcuauacccuagua

SEQ ID NO: 237489 - RNA, 19 nt, Homo sapiens
ggagaaaggauacccaaag

SEQ ID NO: 237490 - RNA, 19 nt, Homo sapiens
ggacaaagucuggguauac

SEQ ID NO: 237491 - RNA, 19 nt, Homo sapiens
uaacucauguuccgccaau

SEQ ID NO: 237492 - RNA, 19 nt, Homo sapiens
gggacaaagucuggguaua

SEQ ID NO: 237493 - RNA, 19 nt, Homo sapiens
ugucugcacugacgucuga

SEQ ID NO: 237494 - RNA, 19 nt, Homo sapiens
gcacccagguauaugucuu

SEQ ID NO: 237495 - RNA, 19 nt, Homo sapiens
ucacaacagugucuuucug

SEQ ID NO: 237496 - RNA, 19 nt, Homo sapiens
gacggagccuuguguaugg

SEQ ID NO: 237497 - RNA, 19 nt, Homo sapiens
ggcuggagcuuugaugcua

SEQ ID NO: 237498 - RNA, 19 nt, Homo sapiens
cauccauggucccaauuug

SEQ ID NO: 237499 - RNA, 19 nt, Homo sapiens
aacagugucuuucugauca

SEQ ID NO: 237500 - RNA, 19 nt, Homo sapiens
guggaagagucacaaaugg

SEQ ID NO: 237501 - RNA, 19 nt, Homo sapiens
ccaauggucccggcuugua

SEQ ID NO: 237502 - RNA, 19 nt, Homo sapiens
caccauggcccugaguaua

SEQ ID NO: 237503 - RNA, 19 nt, Homo sapiens
uggagaaugucaagcugaa

SEQ ID NO: 237504 - RNA, 19 nt, Homo sapiens
ggaaugucaccguggagaa

SEQ ID NO: 237505 - RNA, 19 nt, Homo sapiens
ggucuucucggcuccauau

SEQ ID NO: 237506 - RNA, 19 nt, Homo sapiens
caacagugucuuucugauc

SEQ ID NO: 237507 - RNA, 19 nt, Homo sapiens
cuaccacccuggaugacaa

SEQ ID NO: 237508 - RNA, 19 nt, Homo sapiens
uagcccacaucuagucuug

SEQ ID NO: 237509 - RNA, 19 nt, Homo sapiens
gcccacaucuagucuuguc

SEQ ID NO: 237510 - RNA, 19 nt, Homo sapiens
gaaugucaccguggagaau

SEQ ID NO: 237511 - RNA, 19 nt, Homo sapiens
cagagagauggaagaauuu

SEQ ID NO: 237512 - RNA, 19 nt, Homo sapiens
acccaaaguugcuccaaga

SEQ ID NO: 237513 - RNA, 19 nt, Homo sapiens
ccucauccauggucccaau

SEQ ID NO: 237514 - RNA, 19 nt, Homo sapiens
guagacggagccuugugua

SEQ ID NO: 237515 - RNA, 19 nt, Homo sapiens
ccaaaguugcuccaagaug

SEQ ID NO: 237516 - RNA, 19 nt, Homo sapiens
ggagccuuguguauggaaa

SEQ ID NO: 237517 - RNA, 19 nt, Homo sapiens
ccaugggaauguugcugaa

SEQ ID NO: 237518 - RNA, 19 nt, Homo sapiens
gcuccaagaugaauuuccu

SEQ ID NO: 237519 - RNA, 19 nt, Homo sapiens
aaaagaaggagaaaggaua

SEQ ID NO: 237520 - RNA, 19 nt, Homo sapiens
ugugguggcuggaccugaa

SEQ ID NO: 237521 - RNA, 19 nt, Homo sapiens
ccauggcccugaguauaug

SEQ ID NO: 237522 - RNA, 19 nt, Homo sapiens
gucccaauuuguacugcua

SEQ ID NO: 237523 - RNA, 19 nt, Homo sapiens
agacggagccuuguguaug

SEQ ID NO: 237524 - RNA, 19 nt, Homo sapiens
cgggauggcuggcauagcu

SEQ ID NO: 237525 - RNA, 19 nt, Homo sapiens
gguauacccuccugaaaag

SEQ ID NO: 237526 - RNA, 19 nt, Homo sapiens
gcuggucucuggccauugc

SEQ ID NO: 237527 - RNA, 19 nt, Homo sapiens
ccagggcacccagguauau

SEQ ID NO: 237528 - RNA, 19 nt, Homo sapiens
gcuggcccauugcucauca

SEQ ID NO: 237529 - RNA, 19 nt, Homo sapiens
cacaacagugucuuucuga

SEQ ID NO: 237530 - RNA, 19 nt, Homo sapiens
uccauggucccaauuugua

SEQ ID NO: 237531 - RNA, 19 nt, Homo sapiens
aaaagucccuuggcccuaa

SEQ ID NO: 237532 - RNA, 19 nt, Homo sapiens
cacccuggaugacaaugga

SEQ ID NO: 237533 - RNA, 19 nt, Homo sapiens
gcgagugguucugggacuu

SEQ ID NO: 237534 - RNA, 19 nt, Homo sapiens
agaaaggauacccaaaguu

SEQ ID NO: 237535 - RNA, 19 nt, Homo sapiens
gaaaagaaggagaaaggau

SEQ ID NO: 237536 - RNA, 19 nt, Homo sapiens
gguagacggagccuugugu

SEQ ID NO: 237537 - RNA, 19 nt, Homo sapiens
ggccauggacacaggaaug

SEQ ID NO: 237538 - RNA, 19 nt, Homo sapiens
cuacgggaaccaugaagga

SEQ ID NO: 237539 - RNA, 19 nt, Homo sapiens
cccagaaugugaccagucu

SEQ ID NO: 237540 - RNA, 19 nt, Homo sapiens
gacaaagucuggguauacc

SEQ ID NO: 237541 - RNA, 19 nt, Homo sapiens
ggucacaacagugucuuuc

SEQ ID NO: 237542 - RNA, 19 nt, Homo sapiens
ggauguccgagacuacuuc

SEQ ID NO: 237543 - RNA, 19 nt, Homo sapiens
cuuccaggguaaccaauuc

SEQ ID NO: 237544 - RNA, 19 nt, Homo sapiens
acaacagugucuuucugau

SEQ ID NO: 237545 - RNA, 19 nt, Homo sapiens
ugacaaagggaggcuauac

SEQ ID NO: 237546 - RNA, 19 nt, Homo sapiens
ccaccauggcccugaguau

SEQ ID NO: 237547 - RNA, 19 nt, Homo sapiens
uguccgagacuacuucaug

SEQ ID NO: 237548 - RNA, 19 nt, Homo sapiens
ggccagcuguugggaacug

SEQ ID NO: 237549 - RNA, 19 nt, Homo sapiens
augcagcuguggaauguca

SEQ ID NO: 237550 - RNA, 19 nt, Homo sapiens
guugcuccaagaugaauuu

SEQ ID NO: 237551 - RNA, 19 nt, Homo sapiens
aaaguugcuccaagaugaa

SEQ ID NO: 237552 - RNA, 19 nt, Homo sapiens
guccagggcacccagguau

SEQ ID NO: 237553 - RNA, 19 nt, Homo sapiens
cugaguauaugcgcuguag

SEQ ID NO: 237554 - RNA, 19 nt, Homo sapiens
cugcuccucugcccugaga

SEQ ID NO: 237555 - RNA, 19 nt, Homo sapiens
gucaaggucacaacagugu

SEQ ID NO: 237556 - RNA, 19 nt, Homo sapiens
ggaagcagguggucauuga

SEQ ID NO: 237557 - RNA, 19 nt, Homo sapiens
ucaacaacaccaagucuuu

SEQ ID NO: 237558 - RNA, 19 nt, Homo sapiens
ccauccagcugauccagaa

SEQ ID NO: 237559 - RNA, 19 nt, Homo sapiens
gaacccuccugaugagagu

SEQ ID NO: 237560 - RNA, 19 nt, Homo sapiens
guacagggagcagaucaaa

SEQ ID NO: 237561 - RNA, 19 nt, Homo sapiens
gcugaacccuccugaugag

SEQ ID NO: 237562 - RNA, 19 nt, Homo sapiens
uugaggacauccaccagua

SEQ ID NO: 237563 - RNA, 19 nt, Homo sapiens
gaguggaggaugccuucua

SEQ ID NO: 237564 - RNA, 19 nt, Homo sapiens
agacgugccuguuggacau

SEQ ID NO: 237565 - RNA, 19 nt, Homo sapiens
aagcugaacccuccugaug

SEQ ID NO: 237566 - RNA, 19 nt, Homo sapiens
gggagggcuuccugugugu

SEQ ID NO: 237567 - RNA, 19 nt, Homo sapiens
gcaagagugcgcugaccau

SEQ ID NO: 237568 - RNA, 19 nt, Homo sapiens
gggugaaggacucggauga

SEQ ID NO: 237569 - RNA, 19 nt, Homo sapiens
agagugcgcugaccaucca

SEQ ID NO: 237570 - RNA, 19 nt, Homo sapiens
gggcuuccuguguguguuu

SEQ ID NO: 237571 - RNA, 19 nt, Homo sapiens
cgaauacgaccccacuaua

SEQ ID NO: 237572 - RNA, 19 nt, Homo sapiens
gaggacauccaccaguaca

SEQ ID NO: 237573 - RNA, 19 nt, Homo sapiens
gaauacgaccccacuauag

SEQ ID NO: 237574 - RNA, 19 nt, Homo sapiens
gaagcagguggucauugau

SEQ ID NO: 237575 - RNA, 19 nt, Homo sapiens
gaagcugaacccuccugau

SEQ ID NO: 237576 - RNA, 19 nt, Homo sapiens
cggaugacgugcccauggu

SEQ ID NO: 237577 - RNA, 19 nt, Homo sapiens
caacaacaccaagucuuuu

SEQ ID NO: 237578 - RNA, 19 nt, Homo sapiens
gaacaaagcugguuuacag

SEQ ID NO: 237579 - RNA, 19 nt, Homo sapiens
gaucuuagcuuuaaacaca

SEQ ID NO: 237580 - RNA, 19 nt, Homo sapiens
gaaaugaagucuguaaaca

SEQ ID NO: 237581 - RNA, 19 nt, Homo sapiens
caaccaauccuuucuuaua

SEQ ID NO: 237582 - RNA, 19 nt, Homo sapiens
ggaaauagaucagccacuu

SEQ ID NO: 237583 - RNA, 19 nt, Homo sapiens
gaugauagaucuucagcaa

SEQ ID NO: 237584 - RNA, 19 nt, Homo sapiens
ucacugaucuuagcuuuaa

SEQ ID NO: 237585 - RNA, 19 nt, Homo sapiens
ugauagaucuucagcaauu

SEQ ID NO: 237586 - RNA, 19 nt, Homo sapiens
caacacugcacuuaaauaa

SEQ ID NO: 237587 - RNA, 19 nt, Homo sapiens
caacagcuacagccaauuu

SEQ ID NO: 237588 - RNA, 19 nt, Homo sapiens
uuaaggugcugucauauau

SEQ ID NO: 237589 - RNA, 19 nt, Homo sapiens
gcagccaccuccaguaaug

SEQ ID NO: 237590 - RNA, 19 nt, Homo sapiens
gaagcaauuugaccuuuua

SEQ ID NO: 237591 - RNA, 19 nt, Homo sapiens
caccaacacugcacuuaaa

SEQ ID NO: 237592 - RNA, 19 nt, Homo sapiens
gcucuucuauuuauacaug

SEQ ID NO: 237593 - RNA, 19 nt, Homo sapiens
gugcauaucaguauuugua

SEQ ID NO: 237594 - RNA, 19 nt, Homo sapiens
gaaauagaucagccacuuu

SEQ ID NO: 237595 - RNA, 19 nt, Homo sapiens
gcacuguugucuuguuuca

SEQ ID NO: 237596 - RNA, 19 nt, Homo sapiens
agacaaauaugcagcacuu

SEQ ID NO: 237597 - RNA, 19 nt, Homo sapiens
aagccugcauuguguauua

SEQ ID NO: 237598 - RNA, 19 nt, Homo sapiens
gcaccaacacugcacuuaa

SEQ ID NO: 237599 - RNA, 19 nt, Homo sapiens
ugucauauaucuuggaaug

SEQ ID NO: 237600 - RNA, 19 nt, Homo sapiens
uggaagugcugcaucagua

SEQ ID NO: 237601 - RNA, 19 nt, Homo sapiens
guagcgguaucauguauau

SEQ ID NO: 237602 - RNA, 19 nt, Homo sapiens
uaagugaucucggcucaga

SEQ ID NO: 237603 - RNA, 19 nt, Homo sapiens
aaacagauuuggcuaggau

SEQ ID NO: 237604 - RNA, 19 nt, Homo sapiens
gcgguaucauguauauuaa

SEQ ID NO: 237605 - RNA, 19 nt, Homo sapiens
ucacacaacaggaaauuga

SEQ ID NO: 237606 - RNA, 19 nt, Homo sapiens
gcucaucaaccaauccuuu

SEQ ID NO: 237607 - RNA, 19 nt, Homo sapiens
ucaaaccacugaaaucucu

SEQ ID NO: 237608 - RNA, 19 nt, Homo sapiens
ggaaaguaacagagucaaa

SEQ ID NO: 237609 - RNA, 19 nt, Homo sapiens
caaacaaagccaguaguaa

SEQ ID NO: 237610 - RNA, 19 nt, Homo sapiens
gcaagucacucuccuuuuc

SEQ ID NO: 237611 - RNA, 19 nt, Homo sapiens
aaacuuugaugcauuugga

SEQ ID NO: 237612 - RNA, 19 nt, Homo sapiens
acaggaagcucaucaacca

SEQ ID NO: 237613 - RNA, 19 nt, Homo sapiens
ggacguacgccuuccacaa

SEQ ID NO: 237614 - RNA, 19 nt, Homo sapiens
gaagaagcaauuugaccuu

SEQ ID NO: 237615 - RNA, 19 nt, Homo sapiens
ccacacagggugaaaucua

SEQ ID NO: 237616 - RNA, 19 nt, Homo sapiens
ggaagugcugcaucaguaa

SEQ ID NO: 237617 - RNA, 19 nt, Homo sapiens
ucuagugguucgaguaauu

SEQ ID NO: 237618 - RNA, 19 nt, Homo sapiens
ggacaaacaaagccaguag

SEQ ID NO: 237619 - RNA, 19 nt, Homo sapiens
gacguacgccuuccacaaa

SEQ ID NO: 237620 - RNA, 19 nt, Homo sapiens
gacacagccugcuucauca

SEQ ID NO: 237621 - RNA, 19 nt, Homo sapiens
gauaccacauucauuaugc

SEQ ID NO: 237622 - RNA, 19 nt, Homo sapiens
gcuggaguaucuaguaauc

SEQ ID NO: 237623 - RNA, 19 nt, Homo sapiens
acaaacaaagccaguagua

SEQ ID NO: 237624 - RNA, 19 nt, Homo sapiens
gcacagacacagccugcuu

SEQ ID NO: 237625 - RNA, 19 nt, Homo sapiens
aaaucuaucuccaugacaa

SEQ ID NO: 237626 - RNA, 19 nt, Homo sapiens
ggaaaugaagucuguaaac

SEQ ID NO: 237627 - RNA, 19 nt, Homo sapiens
uuacaucucuccaccucuu

SEQ ID NO: 237628 - RNA, 19 nt, Homo sapiens
ugacaacauucacacaaca

SEQ ID NO: 237629 - RNA, 19 nt, Homo sapiens
caacgaacaaagcugguuu

SEQ ID NO: 237630 - RNA, 19 nt, Homo sapiens
ccaacacugcacuuaaaua

SEQ ID NO: 237631 - RNA, 19 nt, Homo sapiens
uggcuaggauuauuugaug

SEQ ID NO: 237632 - RNA, 19 nt, Homo sapiens
ggguagcgguaucauguau

SEQ ID NO: 237633 - RNA, 19 nt, Homo sapiens
gaagugcugcaucaguaaa

SEQ ID NO: 237634 - RNA, 19 nt, Homo sapiens
gaaaguaacagagucaaaa

SEQ ID NO: 237635 - RNA, 19 nt, Homo sapiens
aaaccgagggcuccaguaa

SEQ ID NO: 237636 - RNA, 19 nt, Homo sapiens
ucaagugcaucuucagaca

SEQ ID NO: 237637 - RNA, 19 nt, Homo sapiens
cagcaagucacucuccuuu

SEQ ID NO: 237638 - RNA, 19 nt, Homo sapiens
gcuccucagucaacagcua

SEQ ID NO: 237639 - RNA, 19 nt, Homo sapiens
gcaccaacaggacaauuuc

SEQ ID NO: 237640 - RNA, 19 nt, Homo sapiens
gcacauuucaacagucaug

SEQ ID NO: 237641 - RNA, 19 nt, Homo sapiens
uugcuaacuuugcacauuu

SEQ ID NO: 237642 - RNA, 19 nt, Homo sapiens
aagaagcaauuugaccuuu

SEQ ID NO: 237643 - RNA, 19 nt, Homo sapiens
gcugucauauaucuuggaa

SEQ ID NO: 237644 - RNA, 19 nt, Homo sapiens
aaccaauccuuucuuauag

SEQ ID NO: 237645 - RNA, 19 nt, Homo sapiens
ggaagcucaucaaccaauc

SEQ ID NO: 237646 - RNA, 19 nt, Homo sapiens
aaacaaagccaguaguaac

SEQ ID NO: 237647 - RNA, 19 nt, Homo sapiens
caagugugccugcuccauu

SEQ ID NO: 237648 - RNA, 19 nt, Homo sapiens
agacacagccugcuucauc

SEQ ID NO: 237649 - RNA, 19 nt, Homo sapiens
caucagcuguuaguaaagu

SEQ ID NO: 237650 - RNA, 19 nt, Homo sapiens
gaucucggcucagacaucu

SEQ ID NO: 237651 - RNA, 19 nt, Homo sapiens
gcagaacuagacagcguuu

SEQ ID NO: 237652 - RNA, 19 nt, Homo sapiens
agcaucagcuguuaguaaa

SEQ ID NO: 237653 - RNA, 19 nt, Homo sapiens
uuuggaaccuucaauacuu

SEQ ID NO: 237654 - RNA, 19 nt, Homo sapiens
cacacagggugaaaucuau

SEQ ID NO: 237655 - RNA, 19 nt, Homo sapiens
gaaaagaaaagaugguaug

SEQ ID NO: 237656 - RNA, 19 nt, Homo sapiens
gagcucuucuauuuauaca

SEQ ID NO: 237657 - RNA, 19 nt, Homo sapiens
gaguaucuaguaauccuuu

SEQ ID NO: 237658 - RNA, 19 nt, Homo sapiens
gucaacagcuacagccaau

SEQ ID NO: 237659 - RNA, 19 nt, Homo sapiens
gaggagaagcaccugaaga

SEQ ID NO: 237660 - RNA, 19 nt, Homo sapiens
ugaaaucuaucuccaugac

SEQ ID NO: 237661 - RNA, 19 nt, Homo sapiens
agcgguaucauguauauua

SEQ ID NO: 237662 - RNA, 19 nt, Homo sapiens
aagugugccugcuccauuu

SEQ ID NO: 237663 - RNA, 19 nt, Homo sapiens
uuaaauaagggcacaccua

SEQ ID NO: 237664 - RNA, 19 nt, Homo sapiens
ccaaagucguggcaucagu

SEQ ID NO: 237665 - RNA, 19 nt, Homo sapiens
acauggaaaugaagucugu

SEQ ID NO: 237666 - RNA, 19 nt, Homo sapiens
ggaagcaggaggagaagca

SEQ ID NO: 237667 - RNA, 19 nt, Homo sapiens
gauagaucuucagcaauuc

SEQ ID NO: 237668 - RNA, 19 nt, Homo sapiens
ccacugaaaucucuuuuag

SEQ ID NO: 237669 - RNA, 19 nt, Homo sapiens
uuaaacaccagguaauaug

SEQ ID NO: 237670 - RNA, 19 nt, Homo sapiens
gagcaacagcggcaaccuu

SEQ ID NO: 237671 - RNA, 19 nt, Homo sapiens
ggucaaaccacugaaaucu

SEQ ID NO: 237672 - RNA, 19 nt, Homo sapiens
caaagucguggcaucaguu

SEQ ID NO: 237673 - RNA, 19 nt, Homo sapiens
gcauaucaguauuuguaac

SEQ ID NO: 237674 - RNA, 19 nt, Homo sapiens
caacagcggcaaccuuugg

SEQ ID NO: 237675 - RNA, 19 nt, Homo sapiens
ucagucaagugcaucuuca

SEQ ID NO: 237676 - RNA, 19 nt, Homo sapiens
ggcagcagcaggagaagaa

SEQ ID NO: 237677 - RNA, 19 nt, Homo sapiens
ggagaagcaccugaagaug

SEQ ID NO: 237678 - RNA, 19 nt, Homo sapiens
gcagagagauugaacuuug

SEQ ID NO: 237679 - RNA, 19 nt, Homo sapiens
gaauggagcuguauaacug

SEQ ID NO: 237680 - RNA, 19 nt, Homo sapiens
gauaugggcuuucucuuug

SEQ ID NO: 237681 - RNA, 19 nt, Homo sapiens
uggaaauucugccuuauua

SEQ ID NO: 237682 - RNA, 19 nt, Homo sapiens
guacuagguuuaucucauu

SEQ ID NO: 237683 - RNA, 19 nt, Homo sapiens
gcaaugagaacuucaagaa

SEQ ID NO: 237684 - RNA, 19 nt, Homo sapiens
gaaggaaccaagugcauuu

SEQ ID NO: 237685 - RNA, 19 nt, Homo sapiens
caagaacuguugcaaugaa

SEQ ID NO: 237686 - RNA, 19 nt, Homo sapiens
ccaagaggaugauagagaa

SEQ ID NO: 237687 - RNA, 19 nt, Homo sapiens
uuaacaaugugcccucuua

SEQ ID NO: 237688 - RNA, 19 nt, Homo sapiens
gaaaccuugucucuacuaa

SEQ ID NO: 237689 - RNA, 19 nt, Homo sapiens
gaaccacccuggaaauucu

SEQ ID NO: 237690 - RNA, 19 nt, Homo sapiens
aaagagcacuucacacaga

SEQ ID NO: 237691 - RNA, 19 nt, Homo sapiens
caugguagcucaagccuau

SEQ ID NO: 237692 - RNA, 19 nt, Homo sapiens
ggaggaagcagaaucuuug

SEQ ID NO: 237693 - RNA, 19 nt, Homo sapiens
caagagaauucugcauauu

SEQ ID NO: 237694 - RNA, 19 nt, Homo sapiens
gagacagacuucuaugaug

SEQ ID NO: 237695 - RNA, 19 nt, Homo sapiens
caucaaauguuaacagagu

SEQ ID NO: 237696 - RNA, 19 nt, Homo sapiens
gcuaaguguccauuauuua

SEQ ID NO: 237697 - RNA, 19 nt, Homo sapiens
cagaaaccauuguucagaa

SEQ ID NO: 237698 - RNA, 19 nt, Homo sapiens
gaaauguaccaucaaaugu

SEQ ID NO: 237699 - RNA, 19 nt, Homo sapiens
ucaagagaauucugcauau

SEQ ID NO: 237700 - RNA, 19 nt, Homo sapiens
aagaagacauucaagagaa

SEQ ID NO: 237701 - RNA, 19 nt, Homo sapiens
ggaacaaguuaacacuaga

SEQ ID NO: 237702 - RNA, 19 nt, Homo sapiens
guaaagacauaggaacaug

SEQ ID NO: 237703 - RNA, 19 nt, Homo sapiens
gaacagcugacauggaguu

SEQ ID NO: 237704 - RNA, 19 nt, Homo sapiens
ucagaccuguuucuuguaa

SEQ ID NO: 237705 - RNA, 19 nt, Homo sapiens
ggcuaaguguccauuauuu

SEQ ID NO: 237706 - RNA, 19 nt, Homo sapiens
gacaaacucuacugcuuuc

SEQ ID NO: 237707 - RNA, 19 nt, Homo sapiens
agacagacuucuaugaugu

SEQ ID NO: 237708 - RNA, 19 nt, Homo sapiens
gaaaagagcacuucacaca

SEQ ID NO: 237709 - RNA, 19 nt, Homo sapiens
gaccaaagaacacucgaaa

SEQ ID NO: 237710 - RNA, 19 nt, Homo sapiens
caagaagacauucaagaga

SEQ ID NO: 237711 - RNA, 19 nt, Homo sapiens
ugaaauguaccaucaaaug

SEQ ID NO: 237712 - RNA, 19 nt, Homo sapiens
gacgaaggccuguguguug

SEQ ID NO: 237713 - RNA, 19 nt, Homo sapiens
gggccugguuucucucuuu

SEQ ID NO: 237714 - RNA, 19 nt, Homo sapiens
ucagguaccuuaaguaucg

SEQ ID NO: 237715 - RNA, 19 nt, Homo sapiens
aacacuagauggcagauaa

SEQ ID NO: 237716 - RNA, 19 nt, Homo sapiens
caauuccuccugccucuua

SEQ ID NO: 237717 - RNA, 19 nt, Homo sapiens
uacaucaacuccacacuga

SEQ ID NO: 237718 - RNA, 19 nt, Homo sapiens
acacaggccuggauuacau

SEQ ID NO: 237719 - RNA, 19 nt, Homo sapiens
ugacugccaucaucaacuu

SEQ ID NO: 237720 - RNA, 19 nt, Homo sapiens
agacauacaggauuuaaga

SEQ ID NO: 237721 - RNA, 19 nt, Homo sapiens
cagagagauugaacuuuga

SEQ ID NO: 237722 - RNA, 19 nt, Homo sapiens
ugugaguucuguuguguuu

SEQ ID NO: 237723 - RNA, 19 nt, Homo sapiens
ggaagcagaaucuuugcaa

SEQ ID NO: 237724 - RNA, 19 nt, Homo sapiens
guaucuggguugcacauga

SEQ ID NO: 237725 - RNA, 19 nt, Homo sapiens
ugauaugggcuuucucuuu

SEQ ID NO: 237726 - RNA, 19 nt, Homo sapiens
gaggugggcagaucauuug

SEQ ID NO: 237727 - RNA, 19 nt, Homo sapiens
cuaguuaugugagaaaguu

SEQ ID NO: 237728 - RNA, 19 nt, Homo sapiens
gagaugaaauccccaguug

SEQ ID NO: 237729 - RNA, 19 nt, Homo sapiens
gaacaaucaaggcaacuag

SEQ ID NO: 237730 - RNA, 19 nt, Homo sapiens
ggucagaaaccauuguuca

SEQ ID NO: 237731 - RNA, 19 nt, Homo sapiens
gaccuucaauuacagagau

SEQ ID NO: 237732 - RNA, 19 nt, Homo sapiens
ggagacauacaggauuuaa

SEQ ID NO: 237733 - RNA, 19 nt, Homo sapiens
agucagaccuguuucuugu

SEQ ID NO: 237734 - RNA, 19 nt, Homo sapiens
ucagaagaccucccuguga

SEQ ID NO: 237735 - RNA, 19 nt, Homo sapiens
gaacauguaguuuuacuug

SEQ ID NO: 237736 - RNA, 19 nt, Homo sapiens
gcaaauugagguucagcaa

SEQ ID NO: 237737 - RNA, 19 nt, Homo sapiens
uaacugugcagagacuuua

SEQ ID NO: 237738 - RNA, 19 nt, Homo sapiens
gcaccugggcuuucuggaa

SEQ ID NO: 237739 - RNA, 19 nt, Homo sapiens
gcaacaaaaugauccuuau

SEQ ID NO: 237740 - RNA, 19 nt, Homo sapiens
agacaaacucuacugcuuu

SEQ ID NO: 237741 - RNA, 19 nt, Homo sapiens
ugauagagaaguagacaaa

SEQ ID NO: 237742 - RNA, 19 nt, Homo sapiens
gaacaaguuaacacuagau

SEQ ID NO: 237743 - RNA, 19 nt, Homo sapiens
ugcaugaucugucaaagug

SEQ ID NO: 237744 - RNA, 19 nt, Homo sapiens
aaggucacauagcuaguua

SEQ ID NO: 237745 - RNA, 19 nt, Homo sapiens
ugagagagguacccaaggu

SEQ ID NO: 237746 - RNA, 19 nt, Homo sapiens
aauccaaaccacagucuua

SEQ ID NO: 237747 - RNA, 19 nt, Homo sapiens
agaggaugauagagaagua

SEQ ID NO: 237748 - RNA, 19 nt, Homo sapiens
cuacaaggccguacgacaa

SEQ ID NO: 237749 - RNA, 19 nt, Homo sapiens
ggacuaagaagauguuuug

SEQ ID NO: 237750 - RNA, 19 nt, Homo sapiens
gcuaaaccacaauauguau

SEQ ID NO: 237751 - RNA, 19 nt, Homo sapiens
ucuuaagugugcacagaua

SEQ ID NO: 237752 - RNA, 19 nt, Homo sapiens
ggacgaaggccuguguguu

SEQ ID NO: 237753 - RNA, 19 nt, Homo sapiens
ucugcuggaucccuuauuu

SEQ ID NO: 237754 - RNA, 19 nt, Homo sapiens
gcacaugaaccgcgaaagg

SEQ ID NO: 237755 - RNA, 19 nt, Homo sapiens
ucuaugaugucaccugguu

SEQ ID NO: 237756 - RNA, 19 nt, Homo sapiens
acagacaaguggcuaagug

SEQ ID NO: 237757 - RNA, 19 nt, Homo sapiens
uagaagacaagauguguga

SEQ ID NO: 237758 - RNA, 19 nt, Homo sapiens
gugcuaaaccacaauaugu

SEQ ID NO: 237759 - RNA, 19 nt, Homo sapiens
ugaguucuguuguguuugu

SEQ ID NO: 237760 - RNA, 19 nt, Homo sapiens
gugcacagauacacauaca

SEQ ID NO: 237761 - RNA, 19 nt, Homo sapiens
aagaaagucagaccuguuu

SEQ ID NO: 237762 - RNA, 19 nt, Homo sapiens
caccugggcuuucuggaau

SEQ ID NO: 237763 - RNA, 19 nt, Homo sapiens
ucagauaccaccacagaga

SEQ ID NO: 237764 - RNA, 19 nt, Homo sapiens
gccaagaggaugauagaga

SEQ ID NO: 237765 - RNA, 19 nt, Homo sapiens
ggaaauucugccuuauuau

SEQ ID NO: 237766 - RNA, 19 nt, Homo sapiens
gagccucuuuaacagcuuu

SEQ ID NO: 237767 - RNA, 19 nt, Homo sapiens
ggaauggagcuguauaacu

SEQ ID NO: 237768 - RNA, 19 nt, Homo sapiens
uggaacaaguuaacacuag

SEQ ID NO: 237769 - RNA, 19 nt, Homo sapiens
uaucuggguugcacaugaa

SEQ ID NO: 237770 - RNA, 19 nt, Homo sapiens
cuagauggcagauaacaga

SEQ ID NO: 237771 - RNA, 19 nt, Homo sapiens
uugaaugguugcacguuaa

SEQ ID NO: 237772 - RNA, 19 nt, Homo sapiens
uuugaaugguugcacguua

SEQ ID NO: 237773 - RNA, 19 nt, Homo sapiens
caagaaagucagaccuguu

SEQ ID NO: 237774 - RNA, 19 nt, Homo sapiens
gaaaccauuguucagaaga

SEQ ID NO: 237775 - RNA, 19 nt, Homo sapiens
guuaacagaguuugauaug

SEQ ID NO: 237776 - RNA, 19 nt, Homo sapiens
ccaaugagccuccccaauu

SEQ ID NO: 237777 - RNA, 19 nt, Homo sapiens
aaagagagagagaaucaga

SEQ ID NO: 237778 - RNA, 19 nt, Homo sapiens
gaagcuacguugacuauuu

SEQ ID NO: 237779 - RNA, 19 nt, Homo sapiens
gaagaugucuccaaggaau

SEQ ID NO: 237780 - RNA, 19 nt, Homo sapiens
gaugaugucuccauugaau

SEQ ID NO: 237781 - RNA, 19 nt, Homo sapiens
ggaagaugaugaaggagaa

SEQ ID NO: 237782 - RNA, 19 nt, Homo sapiens
ggaagaagaugaggaugug

SEQ ID NO: 237783 - RNA, 19 nt, Homo sapiens
ggagaucacaguccaguuu

SEQ ID NO: 237784 - RNA, 19 nt, Homo sapiens
ugaagaagaugacaaugau

SEQ ID NO: 237785 - RNA, 19 nt, Homo sapiens
ggaugaagaugucucagau

SEQ ID NO: 237786 - RNA, 19 nt, Homo sapiens
gcaccaaggccaugaagaa

SEQ ID NO: 237787 - RNA, 19 nt, Homo sapiens
caaagaggguccaucaaag

SEQ ID NO: 237788 - RNA, 19 nt, Homo sapiens
ugaagaagaugacgaugau

SEQ ID NO: 237789 - RNA, 19 nt, Homo sapiens
gaugaugucuccacugagu

SEQ ID NO: 237790 - RNA, 19 nt, Homo sapiens
ggaggucucugcugagcuu

SEQ ID NO: 237791 - RNA, 19 nt, Homo sapiens
ggaaagcggugaggacaca

SEQ ID NO: 237792 - RNA, 19 nt, Homo sapiens
gcaaagccaccaagaugaa

SEQ ID NO: 237793 - RNA, 19 nt, Homo sapiens
ucaaagaggguccaucaaa

SEQ ID NO: 237794 - RNA, 19 nt, Homo sapiens
gagaaaggcacccaucaug

SEQ ID NO: 237795 - RNA, 19 nt, Homo sapiens
acaaggauguuuccacaga

SEQ ID NO: 237796 - RNA, 19 nt, Homo sapiens
gcaccgaagccaugaagaa

SEQ ID NO: 237797 - RNA, 19 nt, Homo sapiens
caaggaauaugggcaccua

SEQ ID NO: 237798 - RNA, 19 nt, Homo sapiens
ccaccaagaugaagaaacu

SEQ ID NO: 237799 - RNA, 19 nt, Homo sapiens
ggaugaggaugaaguugug

SEQ ID NO: 237800 - RNA, 19 nt, Homo sapiens
ccacaagagugaugaagag

SEQ ID NO: 237801 - RNA, 19 nt, Homo sapiens
ccacagagacgaggaagaa

SEQ ID NO: 237802 - RNA, 19 nt, Homo sapiens
ggaagaagaggaagacaag

SEQ ID NO: 237803 - RNA, 19 nt, Homo sapiens
gaaacuggccauggucaaa

SEQ ID NO: 237804 - RNA, 19 nt, Homo sapiens
ugaagaaacuggccauggu

SEQ ID NO: 237805 - RNA, 19 nt, Homo sapiens
agaggaagguggacagaga

SEQ ID NO: 237806 - RNA, 19 nt, Homo sapiens
ugacaaugaugaugaugau

SEQ ID NO: 237807 - RNA, 19 nt, Homo sapiens
gcaccaaggccacgggauu

SEQ ID NO: 237808 - RNA, 19 nt, Homo sapiens
ccaaggccaugaagaagau

SEQ ID NO: 237809 - RNA, 19 nt, Homo sapiens
ggucaaagaggguccauca

SEQ ID NO: 237810 - RNA, 19 nt, Homo sapiens
ggacuuccaagaugaguau

SEQ ID NO: 237811 - RNA, 19 nt, Homo sapiens
gcaccaagaccacagaaag

SEQ ID NO: 237812 - RNA, 19 nt, Homo sapiens
ccacgagcuauauuuauuu

SEQ ID NO: 237813 - RNA, 19 nt, Homo sapiens
ccacagaaaggaagagguu

SEQ ID NO: 237814 - RNA, 19 nt, Homo sapiens
ugaagaggaugaagauguc

SEQ ID NO: 237815 - RNA, 19 nt, Homo sapiens
caaaggagagacacagaga

SEQ ID NO: 237816 - RNA, 19 nt, Homo sapiens
ggacaaagaccccaacguu

SEQ ID NO: 237817 - RNA, 19 nt, Homo sapiens
uccacgagcuauauuuauu

SEQ ID NO: 237818 - RNA, 19 nt, Homo sapiens
acacaguggucaaggauag

SEQ ID NO: 237819 - RNA, 19 nt, Homo sapiens
aagaggacuuccaagauga

SEQ ID NO: 237820 - RNA, 19 nt, Homo sapiens
gaagaugacaaugaugaug

SEQ ID NO: 237821 - RNA, 19 nt, Homo sapiens
ugaggaaggaugauucuga

SEQ ID NO: 237822 - RNA, 19 nt, Homo sapiens
gaggguccaucaaagagau

SEQ ID NO: 237823 - RNA, 19 nt, Homo sapiens
ggagugaagacacggaaga

SEQ ID NO: 237824 - RNA, 19 nt, Homo sapiens
ggaggaggaagaagaggaa

SEQ ID NO: 237825 - RNA, 19 nt, Homo sapiens
aaagaggguccaucaaaga

SEQ ID NO: 237826 - RNA, 19 nt, Homo sapiens
ccgaagccaugaagaagau

SEQ ID NO: 237827 - RNA, 19 nt, Homo sapiens
gaagaugacgaugaugaug

SEQ ID NO: 237828 - RNA, 19 nt, Homo sapiens
ggacaccgaggccaugaug

SEQ ID NO: 237829 - RNA, 19 nt, Homo sapiens
ccacagcccuagagaccau

SEQ ID NO: 237830 - RNA, 19 nt, Homo sapiens
gaaccaggaggaggaagaa

SEQ ID NO: 237831 - RNA, 19 nt, Homo sapiens
ggaagaagaggagaucaca

SEQ ID NO: 237832 - RNA, 19 nt, Homo sapiens
gaggauguguccacugaac

SEQ ID NO: 237833 - RNA, 19 nt, Homo sapiens
ugacgaugaugaugaugau

SEQ ID NO: 237834 - RNA, 19 nt, Homo sapiens
gggcuaggcuucagaaacc

SEQ ID NO: 237835 - RNA, 19 nt, Homo sapiens
aaaggaggaugaagauguc

SEQ ID NO: 237836 - RNA, 19 nt, Homo sapiens
ccaggaagaugaggaggau

SEQ ID NO: 237837 - RNA, 19 nt, Homo sapiens
gagagaaaggcacccauca

SEQ ID NO: 237838 - RNA, 19 nt, Homo sapiens
ugaggaagacgaugaaagu

SEQ ID NO: 237839 - RNA, 19 nt, Homo sapiens
gagacgaggaagaagauga

SEQ ID NO: 237840 - RNA, 19 nt, Homo sapiens
aagaagaugacaaugauga

SEQ ID NO: 237841 - RNA, 19 nt, Homo sapiens
ggaugauucugaggaggaa

SEQ ID NO: 237842 - RNA, 19 nt, Homo sapiens
gaagccauuugaggaagga

SEQ ID NO: 237843 - RNA, 19 nt, Homo sapiens
gacacacaguggucaagga

SEQ ID NO: 237844 - RNA, 19 nt, Homo sapiens
ggcaaagccaccaagauga

SEQ ID NO: 237845 - RNA, 19 nt, Homo sapiens
gaagaagaugacaaugaug

SEQ ID NO: 237846 - RNA, 19 nt, Homo sapiens
ggauugaagaggaugaaga

SEQ ID NO: 237847 - RNA, 19 nt, Homo sapiens
gcagcaaggaccagaggaa

SEQ ID NO: 237848 - RNA, 19 nt, Homo sapiens
aagcuacguugacuauuuc

SEQ ID NO: 237849 - RNA, 19 nt, Homo sapiens
ggaagagagggcugagguu

SEQ ID NO: 237850 - RNA, 19 nt, Homo sapiens
gugaagaggaugaggaugu

SEQ ID NO: 237851 - RNA, 19 nt, Homo sapiens
agacgaggaugaggaugaa

SEQ ID NO: 237852 - RNA, 19 nt, Homo sapiens
ccacagagaaugggcauca

SEQ ID NO: 237853 - RNA, 19 nt, Homo sapiens
cagaugagaacaaggaugu

SEQ ID NO: 237854 - RNA, 19 nt, Homo sapiens
aaggauagaagccauuuga

SEQ ID NO: 237855 - RNA, 19 nt, Homo sapiens
cuuccaagaugaguauaaa

SEQ ID NO: 237856 - RNA, 19 nt, Homo sapiens
gauugaagaggaugaagau

SEQ ID NO: 237857 - RNA, 19 nt, Homo sapiens
augaugaugucuccauuga

SEQ ID NO: 237858 - RNA, 19 nt, Homo sapiens
aagaagaugacgaugauga

SEQ ID NO: 237859 - RNA, 19 nt, Homo sapiens
cgagcuauauuuauuucuc

SEQ ID NO: 237860 - RNA, 19 nt, Homo sapiens
guucagagcagggagagaa

SEQ ID NO: 237861 - RNA, 19 nt, Homo sapiens
augaagaugucuccaagga

SEQ ID NO: 237862 - RNA, 19 nt, Homo sapiens
cacaggaugcucaggagua

SEQ ID NO: 237863 - RNA, 19 nt, Homo sapiens
caacguuuguccacauugc

SEQ ID NO: 237864 - RNA, 19 nt, Homo sapiens
augaugaugucuccacuga

SEQ ID NO: 237865 - RNA, 19 nt, Homo sapiens
caaugaugaugaugauguc

SEQ ID NO: 237866 - RNA, 19 nt, Homo sapiens
gaugaugaugucuccauug

SEQ ID NO: 237867 - RNA, 19 nt, Homo sapiens
ccacaaagucggagaugag

SEQ ID NO: 237868 - RNA, 19 nt, Homo sapiens
cacgagcuauauuuauuuc

SEQ ID NO: 237869 - RNA, 19 nt, Homo sapiens
ugaggaggaugaggaggaa

SEQ ID NO: 237870 - RNA, 19 nt, Homo sapiens
gagaucacaguccaguuug

SEQ ID NO: 237871 - RNA, 19 nt, Homo sapiens
accauggccuuguagauga

SEQ ID NO: 237872 - RNA, 19 nt, Homo sapiens
gaagccaugaagaagauga

SEQ ID NO: 237873 - RNA, 19 nt, Homo sapiens
ccacgggauugaagaggau

SEQ ID NO: 237874 - RNA, 19 nt, Homo sapiens
ugaugaugaugucuccauu

SEQ ID NO: 237875 - RNA, 19 nt, Homo sapiens
gcaaggaccagaggaaggu

SEQ ID NO: 237876 - RNA, 19 nt, Homo sapiens
ggaggucuuugcagagcau

SEQ ID NO: 237877 - RNA, 19 nt, Homo sapiens
gaggagaggagggaagaga

SEQ ID NO: 237878 - RNA, 19 nt, Homo sapiens
gaagagagaucaaauggaa

SEQ ID NO: 237879 - RNA, 19 nt, Homo sapiens
ggacuuaacucuaauucua

SEQ ID NO: 237880 - RNA, 19 nt, Homo sapiens
gagcagauuuguucuauga

SEQ ID NO: 237881 - RNA, 19 nt, Homo sapiens
acaaagcccuugagaagua

SEQ ID NO: 237882 - RNA, 19 nt, Homo sapiens
cuacaucacuugagacaaa

SEQ ID NO: 237883 - RNA, 19 nt, Homo sapiens
gaaaagagauggccugaga

SEQ ID NO: 237884 - RNA, 19 nt, Homo sapiens
ccacaaacauccucuaaag

SEQ ID NO: 237885 - RNA, 19 nt, Homo sapiens
caacaaagcccuugagaag

SEQ ID NO: 237886 - RNA, 19 nt, Homo sapiens
gguaauagcuacaagacau

SEQ ID NO: 237887 - RNA, 19 nt, Homo sapiens
caaccuacuuucauacuga

SEQ ID NO: 237888 - RNA, 19 nt, Homo sapiens
ucagagugauugacuuuaa

SEQ ID NO: 237889 - RNA, 19 nt, Homo sapiens
ugaaagagaucacucacau

SEQ ID NO: 237890 - RNA, 19 nt, Homo sapiens
gcagauuuguucuaugaug

SEQ ID NO: 237891 - RNA, 19 nt, Homo sapiens
gaucggacaauguaaggua

SEQ ID NO: 237892 - RNA, 19 nt, Homo sapiens
gagauggccugagaagaga

SEQ ID NO: 237893 - RNA, 19 nt, Homo sapiens
acaaagaggagaaugauga

SEQ ID NO: 237894 - RNA, 19 nt, Homo sapiens
gaacaugagaacaucaaug

SEQ ID NO: 237895 - RNA, 19 nt, Homo sapiens
agaggagaaugaugacuuu

SEQ ID NO: 237896 - RNA, 19 nt, Homo sapiens
uacaagacauucccaugaa

SEQ ID NO: 237897 - RNA, 19 nt, Homo sapiens
acaaggcccuccuccacua

SEQ ID NO: 237898 - RNA, 19 nt, Homo sapiens
caagggaugguuuaacaaa

SEQ ID NO: 237899 - RNA, 19 nt, Homo sapiens
gagaagagagaucaaaugg

SEQ ID NO: 237900 - RNA, 19 nt, Homo sapiens
gccaugauuuccaagacua

SEQ ID NO: 237901 - RNA, 19 nt, Homo sapiens
gacuuuaacugcaccacaa

SEQ ID NO: 237902 - RNA, 19 nt, Homo sapiens
ccacugccaugauuuccaa

SEQ ID NO: 237903 - RNA, 19 nt, Homo sapiens
cagagcagauuuguucuau

SEQ ID NO: 237904 - RNA, 19 nt, Homo sapiens
gcagagcagauuuguucua

SEQ ID NO: 237905 - RNA, 19 nt, Homo sapiens
uaccugggcauacuaauaa

SEQ ID NO: 237906 - RNA, 19 nt, Homo sapiens
ccaccaagccuccauucaa

SEQ ID NO: 237907 - RNA, 19 nt, Homo sapiens
cuacaagacauucccauga

SEQ ID NO: 237908 - RNA, 19 nt, Homo sapiens
auacugagcgcuacagaaa

SEQ ID NO: 237909 - RNA, 19 nt, Homo sapiens
gaaauacuggaaugacugu

SEQ ID NO: 237910 - RNA, 19 nt, Homo sapiens
gaaguucaagaguggguuu

SEQ ID NO: 237911 - RNA, 19 nt, Homo sapiens
gaaagagaucacucacaug

SEQ ID NO: 237912 - RNA, 19 nt, Homo sapiens
guccgguccucauagauuu

SEQ ID NO: 237913 - RNA, 19 nt, Homo sapiens
cggacaauguaagguaaua

SEQ ID NO: 237914 - RNA, 19 nt, Homo sapiens
ucagugcugccuauuagua

SEQ ID NO: 237915 - RNA, 19 nt, Homo sapiens
caccaagccuccauucaag

SEQ ID NO: 237916 - RNA, 19 nt, Homo sapiens
gggcaugagcguucuucua

SEQ ID NO: 237917 - RNA, 19 nt, Homo sapiens
ugacuuugccucuuucaga

SEQ ID NO: 237918 - RNA, 19 nt, Homo sapiens
caauguaagguaauagcua

SEQ ID NO: 237919 - RNA, 19 nt, Homo sapiens
uuccuggacuuaacucuaa

SEQ ID NO: 237920 - RNA, 19 nt, Homo sapiens
guacaaagaggagaaugau

SEQ ID NO: 237921 - RNA, 19 nt, Homo sapiens
uccacaaguuuccauguuu

SEQ ID NO: 237922 - RNA, 19 nt, Homo sapiens
ccgacucccuccucuaaga

SEQ ID NO: 237923 - RNA, 19 nt, Homo sapiens
ggacuuggaaagcccgaaa

SEQ ID NO: 237924 - RNA, 19 nt, Homo sapiens
cagauuuguucuaugaugu

SEQ ID NO: 237925 - RNA, 19 nt, Homo sapiens
cuucagcacuggccaauac

SEQ ID NO: 237926 - RNA, 19 nt, Homo sapiens
gaaauagugaucggacaau

SEQ ID NO: 237927 - RNA, 19 nt, Homo sapiens
gcaagggaugguuuaacaa

SEQ ID NO: 237928 - RNA, 19 nt, Homo sapiens
agaaagcucuagaccugau

SEQ ID NO: 237929 - RNA, 19 nt, Homo sapiens
ccaacaaagcccuugagaa

SEQ ID NO: 237930 - RNA, 19 nt, Homo sapiens
cacaaguucugucucuuca

SEQ ID NO: 237931 - RNA, 19 nt, Homo sapiens
guaauagcuacaagacauu

SEQ ID NO: 237932 - RNA, 19 nt, Homo sapiens
acucagugcugccuauuag

SEQ ID NO: 237933 - RNA, 19 nt, Homo sapiens
gaacucagugcugccuauu

SEQ ID NO: 237934 - RNA, 19 nt, Homo sapiens
ccacaaguuuccauguuuu

SEQ ID NO: 237935 - RNA, 19 nt, Homo sapiens
gcgacgggauggcuaccuu

SEQ ID NO: 237936 - RNA, 19 nt, Homo sapiens
gaacaugauacccauagac

SEQ ID NO: 237937 - RNA, 19 nt, Homo sapiens
ccacaaguucugucucuuc

SEQ ID NO: 237938 - RNA, 19 nt, Homo sapiens
uguagaagccuuggacuug

SEQ ID NO: 237939 - RNA, 19 nt, Homo sapiens
ccucagagugauugacuuu

SEQ ID NO: 237940 - RNA, 19 nt, Homo sapiens
agacguccaucugaaauag

SEQ ID NO: 237941 - RNA, 19 nt, Homo sapiens
augaugacuuugccucuuu

SEQ ID NO: 237942 - RNA, 19 nt, Homo sapiens
guaagguaauagcuacaag

SEQ ID NO: 237943 - RNA, 19 nt, Homo sapiens
auagugaucggacaaugua

SEQ ID NO: 237944 - RNA, 19 nt, Homo sapiens
gauugcugaugcccacuug

SEQ ID NO: 237945 - RNA, 19 nt, Homo sapiens
ucacuugagacaaaucuau

SEQ ID NO: 237946 - RNA, 19 nt, Homo sapiens
agcaagggaugguuuaaca

SEQ ID NO: 237947 - RNA, 19 nt, Homo sapiens
ugagaagagagaucaaaug

SEQ ID NO: 237948 - RNA, 19 nt, Homo sapiens
gaaggcgaggcccagguaa

SEQ ID NO: 237949 - RNA, 19 nt, Homo sapiens
ccacaagccacacgaacau

SEQ ID NO: 237950 - RNA, 19 nt, Homo sapiens
ggcaugagcguucuucuac

SEQ ID NO: 237951 - RNA, 19 nt, Homo sapiens
ucaggaacaugagaacauc

SEQ ID NO: 237952 - RNA, 19 nt, Homo sapiens
gucauaaacugugaagucu

SEQ ID NO: 237953 - RNA, 19 nt, Homo sapiens
gagagaguugcaagaguga

SEQ ID NO: 237954 - RNA, 19 nt, Homo sapiens
gauacugagcgcuacagaa

SEQ ID NO: 237955 - RNA, 19 nt, Homo sapiens
caccacaaacauccucuaa

SEQ ID NO: 237956 - RNA, 19 nt, Homo sapiens
uaccgacucccuccucuaa

SEQ ID NO: 237957 - RNA, 19 nt, Homo sapiens
ugaacaugauacccauaga

SEQ ID NO: 237958 - RNA, 19 nt, Homo sapiens
uagaagccuuggacuugga

SEQ ID NO: 237959 - RNA, 19 nt, Homo sapiens
gagaguugcaagagugaga

SEQ ID NO: 237960 - RNA, 19 nt, Homo sapiens
caccacaaguucugucucu

SEQ ID NO: 237961 - RNA, 19 nt, Homo sapiens
uaagguaauagcuacaaga

SEQ ID NO: 237962 - RNA, 19 nt, Homo sapiens
auaccugggcauacuaaua

SEQ ID NO: 237963 - RNA, 19 nt, Homo sapiens
agagauggccugagaagag

SEQ ID NO: 237964 - RNA, 19 nt, Homo sapiens
caugagcguucuucuacca

SEQ ID NO: 237965 - RNA, 19 nt, Homo sapiens
uuacuuagucuuagaugug

SEQ ID NO: 237966 - RNA, 19 nt, Homo sapiens
gaaguacaaagaggagaau

SEQ ID NO: 237967 - RNA, 19 nt, Homo sapiens
gcacuggccaauaccaaag

SEQ ID NO: 237968 - RNA, 19 nt, Homo sapiens
agaacucagugcugccuau

SEQ ID NO: 237969 - RNA, 19 nt, Homo sapiens
gcaccacaaacauccucua

SEQ ID NO: 237970 - RNA, 19 nt, Homo sapiens
cccauguccugcucaaguu

SEQ ID NO: 237971 - RNA, 19 nt, Homo sapiens
ugaaauagugaucggacaa

SEQ ID NO: 237972 - RNA, 19 nt, Homo sapiens
aaauagugaucggacaaug

SEQ ID NO: 237973 - RNA, 19 nt, Homo sapiens
ugacugcagugcuguugag

SEQ ID NO: 237974 - RNA, 19 nt, Homo sapiens
ugucauaaacugugaaguc

SEQ ID NO: 237975 - RNA, 19 nt, Homo sapiens
gugcaagaaucggacuguu

SEQ ID NO: 237976 - RNA, 19 nt, Homo sapiens
gaccaguaauugugaaaau

SEQ ID NO: 237977 - RNA, 19 nt, Homo sapiens
agacaaauuggaucugugu

SEQ ID NO: 237978 - RNA, 19 nt, Homo sapiens
gaacuuagcucccuuuuaa

SEQ ID NO: 237979 - RNA, 19 nt, Homo sapiens
guaaacacccucuugcuua

SEQ ID NO: 237980 - RNA, 19 nt, Homo sapiens
ggcaaggucuucugcaaua

SEQ ID NO: 237981 - RNA, 19 nt, Homo sapiens
uaagggagcugcuguuuag

SEQ ID NO: 237982 - RNA, 19 nt, Homo sapiens
gguaauagcccuagccauu

SEQ ID NO: 237983 - RNA, 19 nt, Homo sapiens
uaaacacccucuugcuuaa

SEQ ID NO: 237984 - RNA, 19 nt, Homo sapiens
gcacaaagccacagugaca

SEQ ID NO: 237985 - RNA, 19 nt, Homo sapiens
gcaaucauaccaccucuaa

SEQ ID NO: 237986 - RNA, 19 nt, Homo sapiens
uagaagguguugcuuaauu

SEQ ID NO: 237987 - RNA, 19 nt, Homo sapiens
gaagguguugcuuaauuua

SEQ ID NO: 237988 - RNA, 19 nt, Homo sapiens
gcaaaguccaggucaauga

SEQ ID NO: 237989 - RNA, 19 nt, Homo sapiens
uggcauaguugucacauug

SEQ ID NO: 237990 - RNA, 19 nt, Homo sapiens
agaagguguugcuuaauuu

SEQ ID NO: 237991 - RNA, 19 nt, Homo sapiens
cuuagaagguguugcuuaa

SEQ ID NO: 237992 - RNA, 19 nt, Homo sapiens
cuacugaugggaaugauua

SEQ ID NO: 237993 - RNA, 19 nt, Homo sapiens
gcacagccuccauucuuaa

SEQ ID NO: 237994 - RNA, 19 nt, Homo sapiens
cgccaucucucuggucuua

SEQ ID NO: 237995 - RNA, 19 nt, Homo sapiens
gcaauguggucgucugucu

SEQ ID NO: 237996 - RNA, 19 nt, Homo sapiens
ccaagaggaucaaucacau

SEQ ID NO: 237997 - RNA, 19 nt, Homo sapiens
aagaggaucaaucacauua

SEQ ID NO: 237998 - RNA, 19 nt, Homo sapiens
gcaaggucuucugcaauau

SEQ ID NO: 237999 - RNA, 19 nt, Homo sapiens
gacagugccucggauucua

SEQ ID NO: 238000 - RNA, 19 nt, Homo sapiens
caugagcacuuuguaaaca

SEQ ID NO: 238001 - RNA, 19 nt, Homo sapiens
gagcacaaagccacaguga

SEQ ID NO: 238002 - RNA, 19 nt, Homo sapiens
ugcacagccuccauucuua

SEQ ID NO: 238003 - RNA, 19 nt, Homo sapiens
ucucucuucuucauucaua

SEQ ID NO: 238004 - RNA, 19 nt, Homo sapiens
guaauagcccuagccauug

SEQ ID NO: 238005 - RNA, 19 nt, Homo sapiens
aaacuucucugagguccaa

SEQ ID NO: 238006 - RNA, 19 nt, Homo sapiens
gcaaccugaccaauuguuu

SEQ ID NO: 238007 - RNA, 19 nt, Homo sapiens
ucaugugcaucaccuacua

SEQ ID NO: 238008 - RNA, 19 nt, Homo sapiens
uggcacagccucuuccuuu

SEQ ID NO: 238009 - RNA, 19 nt, Homo sapiens
ugccaucaaugagguguua

SEQ ID NO: 238010 - RNA, 19 nt, Homo sapiens
ggugcugguuuauguucua

SEQ ID NO: 238011 - RNA, 19 nt, Homo sapiens
cuuaaccucuucaugauca

SEQ ID NO: 238012 - RNA, 19 nt, Homo sapiens
gaggaucaaucacauuagc

SEQ ID NO: 238013 - RNA, 19 nt, Homo sapiens
caaaguccaggucaaugaa

SEQ ID NO: 238014 - RNA, 19 nt, Homo sapiens
uuaagggagcugcuguuua

SEQ ID NO: 238015 - RNA, 19 nt, Homo sapiens
caaccgcaacucccacaaa

SEQ ID NO: 238016 - RNA, 19 nt, Homo sapiens
ucuaggaacucuucaugag

SEQ ID NO: 238017 - RNA, 19 nt, Homo sapiens
uaauagcccuagccauugg

SEQ ID NO: 238018 - RNA, 19 nt, Homo sapiens
caagaggaucaaucacauu

SEQ ID NO: 238019 - RNA, 19 nt, Homo sapiens
uggaugggcuggucaccuu

SEQ ID NO: 238020 - RNA, 19 nt, Homo sapiens
gcccuucucugccaucuac

SEQ ID NO: 238021 - RNA, 19 nt, Homo sapiens
gcugguuuauguucuagga

SEQ ID NO: 238022 - RNA, 19 nt, Homo sapiens
uuuagguggugcugguuua

SEQ ID NO: 238023 - RNA, 19 nt, Homo sapiens
cauccugcaugacaccaaa

SEQ ID NO: 238024 - RNA, 19 nt, Homo sapiens
uaauuugggucaucuccau

SEQ ID NO: 238025 - RNA, 19 nt, Homo sapiens
ccaucucucuggucuuaau

SEQ ID NO: 238026 - RNA, 19 nt, Homo sapiens
gaacucuucaugagcacuu

SEQ ID NO: 238027 - RNA, 19 nt, Homo sapiens
gguguuagaagccaucguu

SEQ ID NO: 238028 - RNA, 19 nt, Homo sapiens
aaucauaccaccucuaagu

SEQ ID NO: 238029 - RNA, 19 nt, Homo sapiens
ccauuacccuguccuuucu

SEQ ID NO: 238030 - RNA, 19 nt, Homo sapiens
ggucuuaauuugggucauc

SEQ ID NO: 238031 - RNA, 19 nt, Homo sapiens
gcccagagucagucauuga

SEQ ID NO: 238032 - RNA, 19 nt, Homo sapiens
gccaagaggaucaaucaca

SEQ ID NO: 238033 - RNA, 19 nt, Homo sapiens
uccgcaaccugaccaauug

SEQ ID NO: 238034 - RNA, 19 nt, Homo sapiens
gaaaagcagcccagaguca

SEQ ID NO: 238035 - RNA, 19 nt, Homo sapiens
guagaacuuagcucccuuu

SEQ ID NO: 238036 - RNA, 19 nt, Homo sapiens
gcaggaacgagaccagcaa

SEQ ID NO: 238037 - RNA, 19 nt, Homo sapiens
auucuuaaccucuucauga

SEQ ID NO: 238038 - RNA, 19 nt, Homo sapiens
ggaugcuacugaugggaau

SEQ ID NO: 238039 - RNA, 19 nt, Homo sapiens
gagccacagacagguaaua

SEQ ID NO: 238040 - RNA, 19 nt, Homo sapiens
augcugcgcugaacagaga

SEQ ID NO: 238041 - RNA, 19 nt, Homo sapiens
ucuaccagcuguccugcaa

SEQ ID NO: 238042 - RNA, 19 nt, Homo sapiens
caaccugaccaauuguuuc

SEQ ID NO: 238043 - RNA, 19 nt, Homo sapiens
ucucucuggucuuaauuug

SEQ ID NO: 238044 - RNA, 19 nt, Homo sapiens
gcucugcacagccuccauu

SEQ ID NO: 238045 - RNA, 19 nt, Homo sapiens
ccaggcaacaggaagagaa

SEQ ID NO: 238046 - RNA, 19 nt, Homo sapiens
cagcugcgucuccacauga

SEQ ID NO: 238047 - RNA, 19 nt, Homo sapiens
ggagcaggcaccagcuaug

SEQ ID NO: 238048 - RNA, 19 nt, Homo sapiens
gggagccacagacagguaa

SEQ ID NO: 238049 - RNA, 19 nt, Homo sapiens
ccaaagccaccgccagaca

SEQ ID NO: 238050 - RNA, 19 nt, Homo sapiens
uguaaacacccucuugcuu

SEQ ID NO: 238051 - RNA, 19 nt, Homo sapiens
gggaucaggccaagaggau

SEQ ID NO: 238052 - RNA, 19 nt, Homo sapiens
uccagugguuggcauaguu

SEQ ID NO: 238053 - RNA, 19 nt, Homo sapiens
cuucaugagcacuuuguaa

SEQ ID NO: 238054 - RNA, 19 nt, Homo sapiens
gguguggagugggacagaa

SEQ ID NO: 238055 - RNA, 19 nt, Homo sapiens
gaccgguacugcgcuguca

SEQ ID NO: 238056 - RNA, 19 nt, Homo sapiens
ggacacauuuuggaucugu

SEQ ID NO: 238057 - RNA, 19 nt, Homo sapiens
gauuaagggagcugcuguu

SEQ ID NO: 238058 - RNA, 19 nt, Homo sapiens
cugcacagccuccauucuu

SEQ ID NO: 238059 - RNA, 19 nt, Homo sapiens
uaccagcuguccugcaagu

SEQ ID NO: 238060 - RNA, 19 nt, Homo sapiens
ccugaccaauuguuucauc

SEQ ID NO: 238061 - RNA, 19 nt, Homo sapiens
gcaugcaagaucaccauca

SEQ ID NO: 238062 - RNA, 19 nt, Homo sapiens
gcacagccucuuccuuuug

SEQ ID NO: 238063 - RNA, 19 nt, Homo sapiens
gagcaggcaccagcuaugg

SEQ ID NO: 238064 - RNA, 19 nt, Homo sapiens
caucaaugagguguuagaa

SEQ ID NO: 238065 - RNA, 19 nt, Homo sapiens
ccagacagugccucggauu

SEQ ID NO: 238066 - RNA, 19 nt, Homo sapiens
gugcaaaguccaggucaau

SEQ ID NO: 238067 - RNA, 19 nt, Homo sapiens
caaggucuucugcaauauc

SEQ ID NO: 238068 - RNA, 19 nt, Homo sapiens
ggagauccccaguacuuga

SEQ ID NO: 238069 - RNA, 19 nt, Homo sapiens
uucaugagcacuuuguaaa

SEQ ID NO: 238070 - RNA, 19 nt, Homo sapiens
cagcccagagucagucauu

SEQ ID NO: 238071 - RNA, 19 nt, Homo sapiens
ccaauggcacagccucuuc

SEQ ID NO: 238072 - RNA, 19 nt, Homo sapiens
gggagcaggcaccagcuau

SEQ ID NO: 238073 - RNA, 19 nt, Homo sapiens
ugacccauccugcaugaca

SEQ ID NO: 238074 - RNA, 19 nt, Homo sapiens
guagacgucuuccaaauaa

SEQ ID NO: 238075 - RNA, 19 nt, Homo sapiens
gaaacgcgauugagaaaug

SEQ ID NO: 238076 - RNA, 19 nt, Homo sapiens
gaugacaguugaugcuuua

SEQ ID NO: 238077 - RNA, 19 nt, Homo sapiens
ggaagcacguggaugagua

SEQ ID NO: 238078 - RNA, 19 nt, Homo sapiens
gacaguugaugcuuuauuu

SEQ ID NO: 238079 - RNA, 19 nt, Homo sapiens
gcaaauuucugaucuagag

SEQ ID NO: 238080 - RNA, 19 nt, Homo sapiens
ggaccugccugcuguuuga

SEQ ID NO: 238081 - RNA, 19 nt, Homo sapiens
caucgcacaugcucaauaa

SEQ ID NO: 238082 - RNA, 19 nt, Homo sapiens
gaucaucagucucuucugu

SEQ ID NO: 238083 - RNA, 19 nt, Homo sapiens
uuucaaagcccaaguauaa

SEQ ID NO: 238084 - RNA, 19 nt, Homo sapiens
gaacauucacuccacauug

SEQ ID NO: 238085 - RNA, 19 nt, Homo sapiens
ggacaacgcguacgaguuc

SEQ ID NO: 238086 - RNA, 19 nt, Homo sapiens
ggagaaacgcgauugagaa

SEQ ID NO: 238087 - RNA, 19 nt, Homo sapiens
gagaaacgcgauugagaaa

SEQ ID NO: 238088 - RNA, 19 nt, Homo sapiens
ucugaaaucuuuagcaguu

SEQ ID NO: 238089 - RNA, 19 nt, Homo sapiens
gagcugcgcuucgacauca

SEQ ID NO: 238090 - RNA, 19 nt, Homo sapiens
gaacggcuuugcugacauc

SEQ ID NO: 238091 - RNA, 19 nt, Homo sapiens
gcacaugcucaauaaauau

SEQ ID NO: 238092 - RNA, 19 nt, Homo sapiens
ugucugcccucuagaagua

SEQ ID NO: 238093 - RNA, 19 nt, Homo sapiens
ggaaagcagugugcauauc

SEQ ID NO: 238094 - RNA, 19 nt, Homo sapiens
ggagaaggcacaugucugu

SEQ ID NO: 238095 - RNA, 19 nt, Homo sapiens
cgcacaugcucaauaaaua

SEQ ID NO: 238096 - RNA, 19 nt, Homo sapiens
gaaguaggcuguguuucca

SEQ ID NO: 238097 - RNA, 19 nt, Homo sapiens
uaagagaacuauggcaaca

SEQ ID NO: 238098 - RNA, 19 nt, Homo sapiens
gaacacaagcaaaccaagu

SEQ ID NO: 238099 - RNA, 19 nt, Homo sapiens
ugagaaccgugcaaauuuc

SEQ ID NO: 238100 - RNA, 19 nt, Homo sapiens
gaaccgugcaaauuucuga

SEQ ID NO: 238101 - RNA, 19 nt, Homo sapiens
gcccaaguauaaccacauu

SEQ ID NO: 238102 - RNA, 19 nt, Homo sapiens
ucaggugacugucccagaa

SEQ ID NO: 238103 - RNA, 19 nt, Homo sapiens
gaaagcagugugcauaucu

SEQ ID NO: 238104 - RNA, 19 nt, Homo sapiens
caugagaaccgugcaaauu

SEQ ID NO: 238105 - RNA, 19 nt, Homo sapiens
aacauucacuccacauuga

SEQ ID NO: 238106 - RNA, 19 nt, Homo sapiens
ggucacggguucaguugug

SEQ ID NO: 238107 - RNA, 19 nt, Homo sapiens
gcacuauauugcaguugga

SEQ ID NO: 238108 - RNA, 19 nt, Homo sapiens
gaccagccacgaacaacua

SEQ ID NO: 238109 - RNA, 19 nt, Homo sapiens
gacaaaccacugcagauug

SEQ ID NO: 238110 - RNA, 19 nt, Homo sapiens
gaucgaguccauccuguau

SEQ ID NO: 238111 - RNA, 19 nt, Homo sapiens
ucaguuguguugcagagaa

SEQ ID NO: 238112 - RNA, 19 nt, Homo sapiens
guugaugcuuuauuuggaa

SEQ ID NO: 238113 - RNA, 19 nt, Homo sapiens
ucugaaccgugcacuauau

SEQ ID NO: 238114 - RNA, 19 nt, Homo sapiens
cugcagugcugauaggauu

SEQ ID NO: 238115 - RNA, 19 nt, Homo sapiens
guggguacauuccggcaaa

SEQ ID NO: 238116 - RNA, 19 nt, Homo sapiens
acaaaccacugcagauugg

SEQ ID NO: 238117 - RNA, 19 nt, Homo sapiens
uguagacgucuuccaaaua

SEQ ID NO: 238118 - RNA, 19 nt, Homo sapiens
guguagacgucuuccaaau

SEQ ID NO: 238119 - RNA, 19 nt, Homo sapiens
gcacacuccugcgaaaguc

SEQ ID NO: 238120 - RNA, 19 nt, Homo sapiens
aagcagacgcuguucauga

SEQ ID NO: 238121 - RNA, 19 nt, Homo sapiens
ggaagcagacgcuguucau

SEQ ID NO: 238122 - RNA, 19 nt, Homo sapiens
gugcaaauuucugaucuag

SEQ ID NO: 238123 - RNA, 19 nt, Homo sapiens
caacuaaauaccacagugu

SEQ ID NO: 238124 - RNA, 19 nt, Homo sapiens
gaguacagccagaggaguu

SEQ ID NO: 238125 - RNA, 19 nt, Homo sapiens
agagaacuauggcaacauc

SEQ ID NO: 238126 - RNA, 19 nt, Homo sapiens
cagaacggcuuugcugaca

SEQ ID NO: 238127 - RNA, 19 nt, Homo sapiens
gggcugcuguggguacauu

SEQ ID NO: 238128 - RNA, 19 nt, Homo sapiens
agacaaaccacugcagauu

SEQ ID NO: 238129 - RNA, 19 nt, Homo sapiens
agaugacaguugaugcuuu

SEQ ID NO: 238130 - RNA, 19 nt, Homo sapiens
gcgaaagucggugaacauu

SEQ ID NO: 238131 - RNA, 19 nt, Homo sapiens
ucucuucugugcacacuau

SEQ ID NO: 238132 - RNA, 19 nt, Homo sapiens
cggcuuugcugacaucauc

SEQ ID NO: 238133 - RNA, 19 nt, Homo sapiens
gugucauccugcagaauaa

SEQ ID NO: 238134 - RNA, 19 nt, Homo sapiens
gcagaccagccacgaacaa

SEQ ID NO: 238135 - RNA, 19 nt, Homo sapiens
gcuccauguuccuaagcua

SEQ ID NO: 238136 - RNA, 19 nt, Homo sapiens
gcagagccuaagagaacua

SEQ ID NO: 238137 - RNA, 19 nt, Homo sapiens
cuagaaguaggcuguguuu

SEQ ID NO: 238138 - RNA, 19 nt, Homo sapiens
ggagcuccauguuccuaag

SEQ ID NO: 238139 - RNA, 19 nt, Homo sapiens
gagacaaaccacugcagau

SEQ ID NO: 238140 - RNA, 19 nt, Homo sapiens
augagaaccgugcaaauuu

SEQ ID NO: 238141 - RNA, 19 nt, Homo sapiens
cugaaaucuuuagcaguua

SEQ ID NO: 238142 - RNA, 19 nt, Homo sapiens
acacguggcaggaugaaga

SEQ ID NO: 238143 - RNA, 19 nt, Homo sapiens
gaaacccaguguggagaag

SEQ ID NO: 238144 - RNA, 19 nt, Homo sapiens
ggacaugagaaccgugcaa

SEQ ID NO: 238145 - RNA, 19 nt, Homo sapiens
gaaccgugcacuauauugc

SEQ ID NO: 238146 - RNA, 19 nt, Homo sapiens
auucuuauccugagacaaa

SEQ ID NO: 238147 - RNA, 19 nt, Homo sapiens
cuaggacgcacgcauauca

SEQ ID NO: 238148 - RNA, 19 nt, Homo sapiens
aaagcagugugcauaucuu

SEQ ID NO: 238149 - RNA, 19 nt, Homo sapiens
ugacaguugaugcuuuauu

SEQ ID NO: 238150 - RNA, 19 nt, Homo sapiens
uagccaaggugcucuucug

SEQ ID NO: 238151 - RNA, 19 nt, Homo sapiens
uggacgugcuggugucuga

SEQ ID NO: 238152 - RNA, 19 nt, Homo sapiens
guacuucggcagcuaugga

SEQ ID NO: 238153 - RNA, 19 nt, Homo sapiens
cgugcaaauuucugaucua

SEQ ID NO: 238154 - RNA, 19 nt, Homo sapiens
gagccuaagagaacuaugg

SEQ ID NO: 238155 - RNA, 19 nt, Homo sapiens
cggagaaacgcgauugaga

SEQ ID NO: 238156 - RNA, 19 nt, Homo sapiens
ucaggguccuucacagaca

SEQ ID NO: 238157 - RNA, 19 nt, Homo sapiens
gacaugagaaccgugcaaa

SEQ ID NO: 238158 - RNA, 19 nt, Homo sapiens
ccaaguauaaccacauuuu

SEQ ID NO: 238159 - RNA, 19 nt, Homo sapiens
agugucauccugcagaaua

SEQ ID NO: 238160 - RNA, 19 nt, Homo sapiens
ucgcacaugcucaauaaau

SEQ ID NO: 238161 - RNA, 19 nt, Homo sapiens
ccaucgcacaugcucaaua

SEQ ID NO: 238162 - RNA, 19 nt, Homo sapiens
ggugaugaacacaagcaaa

SEQ ID NO: 238163 - RNA, 19 nt, Homo sapiens
ggagaugacaguugaugcu

SEQ ID NO: 238164 - RNA, 19 nt, Homo sapiens
ggcaacaucaggugacugu

SEQ ID NO: 238165 - RNA, 19 nt, Homo sapiens
gaagcagacgcuguucaug

SEQ ID NO: 238166 - RNA, 19 nt, Homo sapiens
gggacaacgcguacgaguu

SEQ ID NO: 238167 - RNA, 19 nt, Homo sapiens
agcagaagguggaggaugu

SEQ ID NO: 238168 - RNA, 19 nt, Homo sapiens
acgcauaucagcccgugua

SEQ ID NO: 238169 - RNA, 19 nt, Homo sapiens
cccagugucugcccucuag

SEQ ID NO: 238170 - RNA, 19 nt, Homo sapiens
gacaagaccccacaucuca

SEQ ID NO: 238171 - RNA, 19 nt, Homo sapiens
gguggaggccagugagaug

SEQ ID NO: 238172 - RNA, 19 nt, Homo sapiens
uaaauaccacagugucauc

SEQ ID NO: 238173 - RNA, 19 nt, Homo sapiens
agacgucuuccaaauaaau

SEQ ID NO: 238174 - RNA, 19 nt, Homo sapiens
ucaaagauguggccauuaa

SEQ ID NO: 238175 - RNA, 19 nt, Homo sapiens
cgacaugucuugcaucaaa

SEQ ID NO: 238176 - RNA, 19 nt, Homo sapiens
uaaaggagguggacaucua

SEQ ID NO: 238177 - RNA, 19 nt, Homo sapiens
gcaacuccauguuucauaa

SEQ ID NO: 238178 - RNA, 19 nt, Homo sapiens
cgucaaagccaacaaguua

SEQ ID NO: 238179 - RNA, 19 nt, Homo sapiens
gacaugacauccaaagauu

SEQ ID NO: 238180 - RNA, 19 nt, Homo sapiens
guacaaagacuacaagauc

SEQ ID NO: 238181 - RNA, 19 nt, Homo sapiens
gaagguggcaucaucauca

SEQ ID NO: 238182 - RNA, 19 nt, Homo sapiens
guuccaguaucucugauua

SEQ ID NO: 238183 - RNA, 19 nt, Homo sapiens
ggaagcagacgguguucua

SEQ ID NO: 238184 - RNA, 19 nt, Homo sapiens
ggacaugacauccaaagau

SEQ ID NO: 238185 - RNA, 19 nt, Homo sapiens
ggacaucuauaccgucaag

SEQ ID NO: 238186 - RNA, 19 nt, Homo sapiens
caccaacgccugccucaua

SEQ ID NO: 238187 - RNA, 19 nt, Homo sapiens
gcccaacgcugaggacaug

SEQ ID NO: 238188 - RNA, 19 nt, Homo sapiens
cgaacugcaucauggagaa

SEQ ID NO: 238189 - RNA, 19 nt, Homo sapiens
gcuacugccucuucuacga

SEQ ID NO: 238190 - RNA, 19 nt, Homo sapiens
gagggcacaucgugacugu

SEQ ID NO: 238191 - RNA, 19 nt, Homo sapiens
acgaggagaugcugaagga

SEQ ID NO: 238192 - RNA, 19 nt, Homo sapiens
ggcauccucugcauguuug

SEQ ID NO: 238193 - RNA, 19 nt, Homo sapiens
ggagaagguggcaucauca

SEQ ID NO: 238194 - RNA, 19 nt, Homo sapiens
uggagaagguggcaucauc

SEQ ID NO: 238195 - RNA, 19 nt, Homo sapiens
ccaucgaccuggacuucaa

SEQ ID NO: 238196 - RNA, 19 nt, Homo sapiens
gcucaacaccgugcucuau

SEQ ID NO: 238197 - RNA, 19 nt, Homo sapiens
ugacauccaaagauuacua

SEQ ID NO: 238198 - RNA, 19 nt, Homo sapiens
gagcguuccuaggcgguuu

SEQ ID NO: 238199 - RNA, 19 nt, Homo sapiens
accaacgccugccucauaa

SEQ ID NO: 238200 - RNA, 19 nt, Homo sapiens
guguauggcuucgacaugu

SEQ ID NO: 238201 - RNA, 19 nt, Homo sapiens
ucaaagccaacaaguuaga

SEQ ID NO: 238202 - RNA, 19 nt, Homo sapiens
gcaccggcauccucugcau

SEQ ID NO: 238203 - RNA, 19 nt, Homo sapiens
uccaguaucucugauuaug

SEQ ID NO: 238204 - RNA, 19 nt, Homo sapiens
uaccgcaacuccauguuuc

SEQ ID NO: 238205 - RNA, 19 nt, Homo sapiens
ugacuccuacgcacacuuu

SEQ ID NO: 238206 - RNA, 19 nt, Homo sapiens
gcgaguggaugggcuacug

SEQ ID NO: 238207 - RNA, 19 nt, Homo sapiens
gcagacgguguucuacaug

SEQ ID NO: 238208 - RNA, 19 nt, Homo sapiens
cugaggacaugacauccaa

SEQ ID NO: 238209 - RNA, 19 nt, Homo sapiens
acaugacauccaaagauua

SEQ ID NO: 238210 - RNA, 19 nt, Homo sapiens
gaagacgggcgaggagauc

SEQ ID NO: 238211 - RNA, 19 nt, Homo sapiens
caagugaagcggaaugacu

SEQ ID NO: 238212 - RNA, 19 nt, Homo sapiens
caacgccugccucauaaag

SEQ ID NO: 238213 - RNA, 19 nt, Homo sapiens
gcaguacaaagacuacaag

SEQ ID NO: 238214 - RNA, 19 nt, Homo sapiens
gaugggcuacugccucuuc

SEQ ID NO: 238215 - RNA, 19 nt, Homo sapiens
cggcauccucugcauguuu

SEQ ID NO: 238216 - RNA, 19 nt, Homo sapiens
aggacuaccugaccgugaa

SEQ ID NO: 238217 - RNA, 19 nt, Homo sapiens
ggugggagaacguguaugg

SEQ ID NO: 238218 - RNA, 19 nt, Homo sapiens
gaacugcaucauggagaau

SEQ ID NO: 238219 - RNA, 19 nt, Homo sapiens
ucaacaccgugcucuaugc

SEQ ID NO: 238220 - RNA, 19 nt, Homo sapiens
cauccaaagauuacuacuu

SEQ ID NO: 238221 - RNA, 19 nt, Homo sapiens
ucacuuaccgcaacuccau

SEQ ID NO: 238222 - RNA, 19 nt, Homo sapiens
agacgguguucuacaugga

SEQ ID NO: 238223 - RNA, 19 nt, Homo sapiens
aagugaagcggaaugacua

SEQ ID NO: 238224 - RNA, 19 nt, Homo sapiens
uuaccgcaacuccauguuu

SEQ ID NO: 238225 - RNA, 19 nt, Homo sapiens
acgccugccucauaaagga

SEQ ID NO: 238226 - RNA, 19 nt, Homo sapiens
gagaagguggcaucaucau

SEQ ID NO: 238227 - RNA, 19 nt, Homo sapiens
gacaugucuugcaucaaag

SEQ ID NO: 238228 - RNA, 19 nt, Homo sapiens
gaucgucaaagccaacaag

SEQ ID NO: 238229 - RNA, 19 nt, Homo sapiens
caugacauccaaagauuac

SEQ ID NO: 238230 - RNA, 19 nt, Homo sapiens
gaggacaugacauccaaag

SEQ ID NO: 238231 - RNA, 19 nt, Homo sapiens
gguugcauuuacgccaaua

SEQ ID NO: 238232 - RNA, 19 nt, Homo sapiens
aaaggagguggacaucuau

SEQ ID NO: 238233 - RNA, 19 nt, Homo sapiens
caaccgggaccuggacuuc

SEQ ID NO: 238234 - RNA, 19 nt, Homo sapiens
uguucuacauggaggacua

SEQ ID NO: 238235 - RNA, 19 nt, Homo sapiens
acugcaucauggagaauuu

SEQ ID NO: 238236 - RNA, 19 nt, Homo sapiens
ggauugcgccuuuguauua

SEQ ID NO: 238237 - RNA, 19 nt, Homo sapiens
aaagauagcucgcggcauu

SEQ ID NO: 238238 - RNA, 19 nt, Homo sapiens
agagagagcuguauuaagu

SEQ ID NO: 238239 - RNA, 19 nt, Homo sapiens
cauauuggauugcgccuuu

SEQ ID NO: 238240 - RNA, 19 nt, Homo sapiens
ccaguuugcuuuccucauu

SEQ ID NO: 238241 - RNA, 19 nt, Homo sapiens
gaagagcaagaauaaauga

SEQ ID NO: 238242 - RNA, 19 nt, Homo sapiens
caucaaagccuauuaugga

SEQ ID NO: 238243 - RNA, 19 nt, Homo sapiens
gaacagcgcuacugaucac

SEQ ID NO: 238244 - RNA, 19 nt, Homo sapiens
gaaaaugccagcugauaua

SEQ ID NO: 238245 - RNA, 19 nt, Homo sapiens
agacgaagagcaagaauaa

SEQ ID NO: 238246 - RNA, 19 nt, Homo sapiens
caaagccuauuauggagaa

SEQ ID NO: 238247 - RNA, 19 nt, Homo sapiens
gagcaagaauaaaugaaag

SEQ ID NO: 238248 - RNA, 19 nt, Homo sapiens
guagagagagcuguauuaa

SEQ ID NO: 238249 - RNA, 19 nt, Homo sapiens
ugacugaccaugcacuaua

SEQ ID NO: 238250 - RNA, 19 nt, Homo sapiens
gcacagaaagucaucaaag

SEQ ID NO: 238251 - RNA, 19 nt, Homo sapiens
cagcugauauaauggagaa

SEQ ID NO: 238252 - RNA, 19 nt, Homo sapiens
gugaaagucucaaguaaaa

SEQ ID NO: 238253 - RNA, 19 nt, Homo sapiens
uggaugcucugaagaaaga

SEQ ID NO: 238254 - RNA, 19 nt, Homo sapiens
cuaaacaggaacuugaaua

SEQ ID NO: 238255 - RNA, 19 nt, Homo sapiens
aauaaacccucagcacuug

SEQ ID NO: 238256 - RNA, 19 nt, Homo sapiens
uaauaaacccucagcacuu

SEQ ID NO: 238257 - RNA, 19 nt, Homo sapiens
agagagcuguauuaaguga

SEQ ID NO: 238258 - RNA, 19 nt, Homo sapiens
aaugccagcugauauaaug

SEQ ID NO: 238259 - RNA, 19 nt, Homo sapiens
gcucagaugacauuucguu

SEQ ID NO: 238260 - RNA, 19 nt, Homo sapiens
gacugaccaugcacuauau

SEQ ID NO: 238261 - RNA, 19 nt, Homo sapiens
gaaagucaucaaagccuau

SEQ ID NO: 238262 - RNA, 19 nt, Homo sapiens
aacaggaacuugaauacug

SEQ ID NO: 238263 - RNA, 19 nt, Homo sapiens
gaccaugcacuauauuugu

SEQ ID NO: 238264 - RNA, 19 nt, Homo sapiens
ccaaguagccacaaaauau

SEQ ID NO: 238265 - RNA, 19 nt, Homo sapiens
cgaagagcaagaauaaaug

SEQ ID NO: 238266 - RNA, 19 nt, Homo sapiens
uguagagagagcuguauua

SEQ ID NO: 238267 - RNA, 19 nt, Homo sapiens
gaaggcggacauucuggaa

SEQ ID NO: 238268 - RNA, 19 nt, Homo sapiens
gauugcgccuuuguauuau

SEQ ID NO: 238269 - RNA, 19 nt, Homo sapiens
gagaggcggcuaagguguu

SEQ ID NO: 238270 - RNA, 19 nt, Homo sapiens
gaaagucucaaguaaaaga

SEQ ID NO: 238271 - RNA, 19 nt, Homo sapiens
ggaacagcgcuacugauca

SEQ ID NO: 238272 - RNA, 19 nt, Homo sapiens
uuaagugacugaccaugca

SEQ ID NO: 238273 - RNA, 19 nt, Homo sapiens
caacacgacaccggauaaa

SEQ ID NO: 238274 - RNA, 19 nt, Homo sapiens
acgaagagcaagaauaaau

SEQ ID NO: 238275 - RNA, 19 nt, Homo sapiens
gagaaaagacgaagagcaa

SEQ ID NO: 238276 - RNA, 19 nt, Homo sapiens
gagcacagaaagucaucaa

SEQ ID NO: 238277 - RNA, 19 nt, Homo sapiens
cgacaccggauaaaccaaa

SEQ ID NO: 238278 - RNA, 19 nt, Homo sapiens
accaugcacuauauuugua

SEQ ID NO: 238279 - RNA, 19 nt, Homo sapiens
uugugaaagucucaaguaa

SEQ ID NO: 238280 - RNA, 19 nt, Homo sapiens
uauaaaagcucagaugaca

SEQ ID NO: 238281 - RNA, 19 nt, Homo sapiens
caaguagccacaaaauaua

SEQ ID NO: 238282 - RNA, 19 nt, Homo sapiens
caagugugcuggggaagua

SEQ ID NO: 238283 - RNA, 19 nt, Homo sapiens
ggaaaaugccagcugauau

SEQ ID NO: 238284 - RNA, 19 nt, Homo sapiens
uaaaagcucagaugacauu

SEQ ID NO: 238285 - RNA, 19 nt, Homo sapiens
uaaacaggaacuugaauac

SEQ ID NO: 238286 - RNA, 19 nt, Homo sapiens
ccaacugcaugacccagau

SEQ ID NO: 238287 - RNA, 19 nt, Homo sapiens
gaaaagacgaagagcaaga

SEQ ID NO: 238288 - RNA, 19 nt, Homo sapiens
ucaacacgacaccggauaa

SEQ ID NO: 238289 - RNA, 19 nt, Homo sapiens
cacagaaagucaucaaagc

SEQ ID NO: 238290 - RNA, 19 nt, Homo sapiens
aaccaaagacagcaucuga

SEQ ID NO: 238291 - RNA, 19 nt, Homo sapiens
gcucaguaguuuugugaaa

SEQ ID NO: 238292 - RNA, 19 nt, Homo sapiens
ugaccaugcacuauauuug

SEQ ID NO: 238293 - RNA, 19 nt, Homo sapiens
agaggcggcuaagguguuu

SEQ ID NO: 238294 - RNA, 19 nt, Homo sapiens
ugugaaagucucaaguaaa

SEQ ID NO: 238295 - RNA, 19 nt, Homo sapiens
aggcggacauucuggaaau

SEQ ID NO: 238296 - RNA, 19 nt, Homo sapiens
gcaagaauaaaugaaaguc

SEQ ID NO: 238297 - RNA, 19 nt, Homo sapiens
uugcgccuuuguauuauaa

SEQ ID NO: 238298 - RNA, 19 nt, Homo sapiens
gggaaguuuauuugagaaa

SEQ ID NO: 238299 - RNA, 19 nt, Homo sapiens
gagagagcuguauuaagug

SEQ ID NO: 238300 - RNA, 19 nt, Homo sapiens
gaugcucugaagaaagaua

SEQ ID NO: 238301 - RNA, 19 nt, Homo sapiens
aagacgaagagcaagaaua

SEQ ID NO: 238302 - RNA, 19 nt, Homo sapiens
aagcucagaugacauuucg

SEQ ID NO: 238303 - RNA, 19 nt, Homo sapiens
cagcgcuacugaucaccaa

SEQ ID NO: 238304 - RNA, 19 nt, Homo sapiens
uaugugaugccaaagaugu

SEQ ID NO: 238305 - RNA, 19 nt, Homo sapiens
acucuaaacaggaacuuga

SEQ ID NO: 238306 - RNA, 19 nt, Homo sapiens
ccgauggccaguuugcuuu

SEQ ID NO: 238307 - RNA, 19 nt, Homo sapiens
uuuaugugaugccaaagau

SEQ ID NO: 238308 - RNA, 19 nt, Homo sapiens
uggaacagcgcuacugauc

SEQ ID NO: 238309 - RNA, 19 nt, Homo sapiens
caguuugcuuuccucauuc

SEQ ID NO: 238310 - RNA, 19 nt, Homo sapiens
gagcuggugcugauaacag

SEQ ID NO: 238311 - RNA, 19 nt, Homo sapiens
uuugugaaagucucaagua

SEQ ID NO: 238312 - RNA, 19 nt, Homo sapiens
ugggagagaagaggacuuu

SEQ ID NO: 238313 - RNA, 19 nt, Homo sapiens
gcugagcacagacccaagu

SEQ ID NO: 238314 - RNA, 19 nt, Homo sapiens
gucaacacgacaccggaua

SEQ ID NO: 238315 - RNA, 19 nt, Homo sapiens
gacgaagagcaagaauaaa

SEQ ID NO: 238316 - RNA, 19 nt, Homo sapiens
gauaaaccaaagacagcau

SEQ ID NO: 238317 - RNA, 19 nt, Homo sapiens
gacaccggauaaaccaaag

SEQ ID NO: 238318 - RNA, 19 nt, Homo sapiens
uggaagaacuggaaaguga

SEQ ID NO: 238319 - RNA, 19 nt, Homo sapiens
gcagaugcaagauaaauuu

SEQ ID NO: 238320 - RNA, 19 nt, Homo sapiens
gagaauugaugauaugagu

SEQ ID NO: 238321 - RNA, 19 nt, Homo sapiens
gcagcuaacuacuaugugu

SEQ ID NO: 238322 - RNA, 19 nt, Homo sapiens
caugguaucuucacaucuu

SEQ ID NO: 238323 - RNA, 19 nt, Homo sapiens
ucaguugugcuauucauua

SEQ ID NO: 238324 - RNA, 19 nt, Homo sapiens
aguugaagguugcuaauaa

SEQ ID NO: 238325 - RNA, 19 nt, Homo sapiens
gcauucuuaucaccuagua

SEQ ID NO: 238326 - RNA, 19 nt, Homo sapiens
gauaugaguagucgcauug

SEQ ID NO: 238327 - RNA, 19 nt, Homo sapiens
gaauugaugauaugaguag

SEQ ID NO: 238328 - RNA, 19 nt, Homo sapiens
gaacaugguaucuucacau

SEQ ID NO: 238329 - RNA, 19 nt, Homo sapiens
guugaagguugcuaauaau

SEQ ID NO: 238330 - RNA, 19 nt, Homo sapiens
ggaagaacuggaaagugaa

SEQ ID NO: 238331 - RNA, 19 nt, Homo sapiens
ccagaucauugggagaauu

SEQ ID NO: 238332 - RNA, 19 nt, Homo sapiens
gaguugaagguugcuaaua

SEQ ID NO: 238333 - RNA, 19 nt, Homo sapiens
cuuaucaccuaguauauag

SEQ ID NO: 238334 - RNA, 19 nt, Homo sapiens
ucgcauugaugaucuggaa

SEQ ID NO: 238335 - RNA, 19 nt, Homo sapiens
gaccagaucauugggagaa

SEQ ID NO: 238336 - RNA, 19 nt, Homo sapiens
caguugugcuauucauuau

SEQ ID NO: 238337 - RNA, 19 nt, Homo sapiens
auacuggaaucuggcauuu

SEQ ID NO: 238338 - RNA, 19 nt, Homo sapiens
gaugcaagauaaauuucag

SEQ ID NO: 238339 - RNA, 19 nt, Homo sapiens
ugggagaauugaugauaug

SEQ ID NO: 238340 - RNA, 19 nt, Homo sapiens
ugaguagucgcauugauga

SEQ ID NO: 238341 - RNA, 19 nt, Homo sapiens
guuaguuuguagagugauu

SEQ ID NO: 238342 - RNA, 19 nt, Homo sapiens
ugauaugaguagucgcauu

SEQ ID NO: 238343 - RNA, 19 nt, Homo sapiens
ggucaguugugcuauucau

SEQ ID NO: 238344 - RNA, 19 nt, Homo sapiens
uaugcauucuuaucaccua

SEQ ID NO: 238345 - RNA, 19 nt, Homo sapiens
guagucgcauugaugaucu

SEQ ID NO: 238346 - RNA, 19 nt, Homo sapiens
gggagauggccgagacuga

SEQ ID NO: 238347 - RNA, 19 nt, Homo sapiens
cuuuggcgguucuugcaua

SEQ ID NO: 238348 - RNA, 19 nt, Homo sapiens
uaguuaguuuguagaguga

SEQ ID NO: 238349 - RNA, 19 nt, Homo sapiens
cagcagaugcaagauaaau

SEQ ID NO: 238350 - RNA, 19 nt, Homo sapiens
cagcuaacuacuaugugua

SEQ ID NO: 238351 - RNA, 19 nt, Homo sapiens
uugaugaucuggaaaagaa

SEQ ID NO: 238352 - RNA, 19 nt, Homo sapiens
cagaucauugggagaauug

SEQ ID NO: 238353 - RNA, 19 nt, Homo sapiens
gcagcagaugcaagauaaa

SEQ ID NO: 238354 - RNA, 19 nt, Homo sapiens
gauaaauuucagaccaugu

SEQ ID NO: 238355 - RNA, 19 nt, Homo sapiens
uugggagaauugaugauau

SEQ ID NO: 238356 - RNA, 19 nt, Homo sapiens
caccuaguauauaguuagu

SEQ ID NO: 238357 - RNA, 19 nt, Homo sapiens
gggagaauugaugauauga

SEQ ID NO: 238358 - RNA, 19 nt, Homo sapiens
aacaugguaucuucacauc

SEQ ID NO: 238359 - RNA, 19 nt, Homo sapiens
uaugaguagucgcauugau

SEQ ID NO: 238360 - RNA, 19 nt, Homo sapiens
cuuggucaguugugcuauu

SEQ ID NO: 238361 - RNA, 19 nt, Homo sapiens
ggagaauugaugauaugag

SEQ ID NO: 238362 - RNA, 19 nt, Homo sapiens
ucaccuaguauauaguuag

SEQ ID NO: 238363 - RNA, 19 nt, Homo sapiens
gaugaucuggaaaagaaua

SEQ ID NO: 238364 - RNA, 19 nt, Homo sapiens
ggaaaguucuccacuguua

SEQ ID NO: 238365 - RNA, 19 nt, Homo sapiens
guauucaccuucucuuaua

SEQ ID NO: 238366 - RNA, 19 nt, Homo sapiens
gaggacaguucuacuauau

SEQ ID NO: 238367 - RNA, 19 nt, Homo sapiens
gaagguuucuguccuaauc

SEQ ID NO: 238368 - RNA, 19 nt, Homo sapiens
gagagucuaucaugaaugu

SEQ ID NO: 238369 - RNA, 19 nt, Homo sapiens
ggacaguucuacuauaucu

SEQ ID NO: 238370 - RNA, 19 nt, Homo sapiens
guacccagcuccuguuaga

SEQ ID NO: 238371 - RNA, 19 nt, Homo sapiens
gcuaacggguggaaucuga

SEQ ID NO: 238372 - RNA, 19 nt, Homo sapiens
ccaaagcuaugauaaccuu

SEQ ID NO: 238373 - RNA, 19 nt, Homo sapiens
agaaggagcugaaggagau

SEQ ID NO: 238374 - RNA, 19 nt, Homo sapiens
gaugagccauuccugaaga

SEQ ID NO: 238375 - RNA, 19 nt, Homo sapiens
cgaggacaguucuacuaua

SEQ ID NO: 238376 - RNA, 19 nt, Homo sapiens
acaaggaaaucauccagaa

SEQ ID NO: 238377 - RNA, 19 nt, Homo sapiens
ccuguacacuugugccuua

SEQ ID NO: 238378 - RNA, 19 nt, Homo sapiens
ccacaccgccuguaucauu

SEQ ID NO: 238379 - RNA, 19 nt, Homo sapiens
ugacagagaugugcaugug

SEQ ID NO: 238380 - RNA, 19 nt, Homo sapiens
ggaggaagccaagcagaaa

SEQ ID NO: 238381 - RNA, 19 nt, Homo sapiens
aaggagacauucuggauga

SEQ ID NO: 238382 - RNA, 19 nt, Homo sapiens
gacaggagcaggaggguuu

SEQ ID NO: 238383 - RNA, 19 nt, Homo sapiens
ggcuggagcugccuuguga

SEQ ID NO: 238384 - RNA, 19 nt, Homo sapiens
guccaagacucagugauuu

SEQ ID NO: 238385 - RNA, 19 nt, Homo sapiens
uaagaaggcucagcgagau

SEQ ID NO: 238386 - RNA, 19 nt, Homo sapiens
gaaaguucuccacuguuaa

SEQ ID NO: 238387 - RNA, 19 nt, Homo sapiens
ucacagagagucuaucaug

SEQ ID NO: 238388 - RNA, 19 nt, Homo sapiens
gaauggccaugaagaagag

SEQ ID NO: 238389 - RNA, 19 nt, Homo sapiens
ggaaggagacauucuggau

SEQ ID NO: 238390 - RNA, 19 nt, Homo sapiens
gugcauguggguauuguua

SEQ ID NO: 238391 - RNA, 19 nt, Homo sapiens
uaucaugaaugucaaugug

SEQ ID NO: 238392 - RNA, 19 nt, Homo sapiens
cagagagucuaucaugaau

SEQ ID NO: 238393 - RNA, 19 nt, Homo sapiens
ccacauagucacauuguca

SEQ ID NO: 238394 - RNA, 19 nt, Homo sapiens
cuuuaucccugauguauug

SEQ ID NO: 238395 - RNA, 19 nt, Homo sapiens
gggauccugucaaguguug

SEQ ID NO: 238396 - RNA, 19 nt, Homo sapiens
uaaacgaggcccugaacaa

SEQ ID NO: 238397 - RNA, 19 nt, Homo sapiens
cacagagagucuaucauga

SEQ ID NO: 238398 - RNA, 19 nt, Homo sapiens
gaacaagaccaagcugaca

SEQ ID NO: 238399 - RNA, 19 nt, Homo sapiens
ccaagacucagugauuuaa

SEQ ID NO: 238400 - RNA, 19 nt, Homo sapiens
gcggcacccuguacacuug

SEQ ID NO: 238401 - RNA, 19 nt, Homo sapiens
ucaugaaugucaaugugaa

SEQ ID NO: 238402 - RNA, 19 nt, Homo sapiens
ccacccuccuggccucaua

SEQ ID NO: 238403 - RNA, 19 nt, Homo sapiens
gaaugucaaugugaaaggu

SEQ ID NO: 238404 - RNA, 19 nt, Homo sapiens
acaaugggauccugucaag

SEQ ID NO: 238405 - RNA, 19 nt, Homo sapiens
ggacgucucggucaucauc

SEQ ID NO: 238406 - RNA, 19 nt, Homo sapiens
gauuuaaggaugacagaga

SEQ ID NO: 238407 - RNA, 19 nt, Homo sapiens
ccagaauggccaugaagaa

SEQ ID NO: 238408 - RNA, 19 nt, Homo sapiens
gaugacacgccucaccaaa

SEQ ID NO: 238409 - RNA, 19 nt, Homo sapiens
guacacuugugccuuacga

SEQ ID NO: 238410 - RNA, 19 nt, Homo sapiens
acagagagucuaucaugaa

SEQ ID NO: 238411 - RNA, 19 nt, Homo sapiens
ugaaggagaucagggucuu

SEQ ID NO: 238412 - RNA, 19 nt, Homo sapiens
gggaggaagccaagcagaa

SEQ ID NO: 238413 - RNA, 19 nt, Homo sapiens
gcguauucaccuucucuua

SEQ ID NO: 238414 - RNA, 19 nt, Homo sapiens
gagugauuccugcuacuuu

SEQ ID NO: 238415 - RNA, 19 nt, Homo sapiens
gagaugugcauguggguau

SEQ ID NO: 238416 - RNA, 19 nt, Homo sapiens
ucaggccaauuuacaccua

SEQ ID NO: 238417 - RNA, 19 nt, Homo sapiens
ugucaaguguuggaaaguu

SEQ ID NO: 238418 - RNA, 19 nt, Homo sapiens
uagcugauucugaacaauu

SEQ ID NO: 238419 - RNA, 19 nt, Homo sapiens
cauccagaauggccaugaa

SEQ ID NO: 238420 - RNA, 19 nt, Homo sapiens
gcccuucaaccgccacaua

SEQ ID NO: 238421 - RNA, 19 nt, Homo sapiens
ugacacgccucaccaaagc

SEQ ID NO: 238422 - RNA, 19 nt, Homo sapiens
ugaaggagaaggagcugaa

SEQ ID NO: 238423 - RNA, 19 nt, Homo sapiens
guuagaggccuguguccaa

SEQ ID NO: 238424 - RNA, 19 nt, Homo sapiens
cuuauuguauuccucaugu

SEQ ID NO: 238425 - RNA, 19 nt, Homo sapiens
ucauacaauggccaacuua

SEQ ID NO: 238426 - RNA, 19 nt, Homo sapiens
acgaggcccugaacaacaa

SEQ ID NO: 238427 - RNA, 19 nt, Homo sapiens
auacaauggccaacuuauu

SEQ ID NO: 238428 - RNA, 19 nt, Homo sapiens
gaaagugacaagggcacaa

SEQ ID NO: 238429 - RNA, 19 nt, Homo sapiens
cguauucaccuucucuuau

SEQ ID NO: 238430 - RNA, 19 nt, Homo sapiens
cgacccauguauaucuaug

SEQ ID NO: 238431 - RNA, 19 nt, Homo sapiens
aaggaaaucauccagaaug

SEQ ID NO: 238432 - RNA, 19 nt, Homo sapiens
aaucuuccauuccuucaca

SEQ ID NO: 238433 - RNA, 19 nt, Homo sapiens
acucuuaaaugagaaagga

SEQ ID NO: 238434 - RNA, 19 nt, Homo sapiens
gagcuccauuucuacucuu

SEQ ID NO: 238435 - RNA, 19 nt, Homo sapiens
ucauauaccagaggaaaga

SEQ ID NO: 238436 - RNA, 19 nt, Homo sapiens
ucccugauguauuggauug

SEQ ID NO: 238437 - RNA, 19 nt, Homo sapiens
gucaaguguuggaaaguuc

SEQ ID NO: 238438 - RNA, 19 nt, Homo sapiens
caacaaugggauccuguca

SEQ ID NO: 238439 - RNA, 19 nt, Homo sapiens
ggccuucggaccagaauug

SEQ ID NO: 238440 - RNA, 19 nt, Homo sapiens
gagucuaucaugaauguca

SEQ ID NO: 238441 - RNA, 19 nt, Homo sapiens
cacaccgccuguaucauug

SEQ ID NO: 238442 - RNA, 19 nt, Homo sapiens
caauuuagggacucuuuua

SEQ ID NO: 238443 - RNA, 19 nt, Homo sapiens
uccaagacucagugauuua

SEQ ID NO: 238444 - RNA, 19 nt, Homo sapiens
ucuguuuccuggugaguga

SEQ ID NO: 238445 - RNA, 19 nt, Homo sapiens
uaacggguggaaucugaaa

SEQ ID NO: 238446 - RNA, 19 nt, Homo sapiens
agaauggccaugaagaaga

SEQ ID NO: 238447 - RNA, 19 nt, Homo sapiens
caaggaaaucauccagaau

SEQ ID NO: 238448 - RNA, 19 nt, Homo sapiens
cuccauuucuacucuuaaa

SEQ ID NO: 238449 - RNA, 19 nt, Homo sapiens
cuacucaggccaauuuaca

SEQ ID NO: 238450 - RNA, 19 nt, Homo sapiens
uuaauuacacccugagcaa

SEQ ID NO: 238451 - RNA, 19 nt, Homo sapiens
gucuucaucuacaccagua

SEQ ID NO: 238452 - RNA, 19 nt, Homo sapiens
aaucauauaccagaggaaa

SEQ ID NO: 238453 - RNA, 19 nt, Homo sapiens
cugccucccuuucauacaa

SEQ ID NO: 238454 - RNA, 19 nt, Homo sapiens
ccucaccaaagcuaugaua

SEQ ID NO: 238455 - RNA, 19 nt, Homo sapiens
gagaggaauuuucuaaacu

SEQ ID NO: 238456 - RNA, 19 nt, Homo sapiens
uacgacccauguauaucua

SEQ ID NO: 238457 - RNA, 19 nt, Homo sapiens
gugccagucuucaucuaca

SEQ ID NO: 238458 - RNA, 19 nt, Homo sapiens
ucuaaacuccagaacaaga

SEQ ID NO: 238459 - RNA, 19 nt, Homo sapiens
gcugauucugaacaauuua

SEQ ID NO: 238460 - RNA, 19 nt, Homo sapiens
caccaaagcuaugauaacc

SEQ ID NO: 238461 - RNA, 19 nt, Homo sapiens
agugauuccugcuacuuug

SEQ ID NO: 238462 - RNA, 19 nt, Homo sapiens
aaugggauccugucaagug

SEQ ID NO: 238463 - RNA, 19 nt, Homo sapiens
cuccuggccucauacagaa

SEQ ID NO: 238464 - RNA, 19 nt, Homo sapiens
gcuaauggguggaaucuaa

SEQ ID NO: 238465 - RNA, 19 nt, Homo sapiens
ggaaaguucucuacaguca

SEQ ID NO: 238466 - RNA, 19 nt, Homo sapiens
ucacacaguucaacauaaa

SEQ ID NO: 238467 - RNA, 19 nt, Homo sapiens
ggugauaccuuguacacuu

SEQ ID NO: 238468 - RNA, 19 nt, Homo sapiens
ccacccaccuggcuucaua

SEQ ID NO: 238469 - RNA, 19 nt, Homo sapiens
guuaggaaaugucaucaaa

SEQ ID NO: 238470 - RNA, 19 nt, Homo sapiens
gagaguccaucaugaaugu

SEQ ID NO: 238471 - RNA, 19 nt, Homo sapiens
gaacaauuguggucucucu

SEQ ID NO: 238472 - RNA, 19 nt, Homo sapiens
ccaccuggcuucauacaga

SEQ ID NO: 238473 - RNA, 19 nt, Homo sapiens
caaauaguguguucaccuu

SEQ ID NO: 238474 - RNA, 19 nt, Homo sapiens
ccaaagcuaugauaaccuu

SEQ ID NO: 238475 - RNA, 19 nt, Homo sapiens
ggaccaagcugacuguacu

SEQ ID NO: 238476 - RNA, 19 nt, Homo sapiens
uaaaugaggcccugaacaa

SEQ ID NO: 238477 - RNA, 19 nt, Homo sapiens
acaaggaaaucauccagaa

SEQ ID NO: 238478 - RNA, 19 nt, Homo sapiens
ccacaccgccuguaucauu

SEQ ID NO: 238479 - RNA, 19 nt, Homo sapiens
caagaaggcucagcgagau

SEQ ID NO: 238480 - RNA, 19 nt, Homo sapiens
agaaggaacugaaggagau

SEQ ID NO: 238481 - RNA, 19 nt, Homo sapiens
caauuguggucucucuuaa

SEQ ID NO: 238482 - RNA, 19 nt, Homo sapiens
agcgagaucuggcguauaa

SEQ ID NO: 238483 - RNA, 19 nt, Homo sapiens
ugacagagaugugcaugug

SEQ ID NO: 238484 - RNA, 19 nt, Homo sapiens
gagguucucuuuugacuaa

SEQ ID NO: 238485 - RNA, 19 nt, Homo sapiens
ggaggaagccaagcagaaa

SEQ ID NO: 238486 - RNA, 19 nt, Homo sapiens
gcguuaagacccacauaua

SEQ ID NO: 238487 - RNA, 19 nt, Homo sapiens
aaggagacauucuggauga

SEQ ID NO: 238488 - RNA, 19 nt, Homo sapiens
ggcuggagcugccuuguga

SEQ ID NO: 238489 - RNA, 19 nt, Homo sapiens
guccaagacucagugauuu

SEQ ID NO: 238490 - RNA, 19 nt, Homo sapiens
caucaugaaugucaaugug

SEQ ID NO: 238491 - RNA, 19 nt, Homo sapiens
agauggagccuuccuuuaa

SEQ ID NO: 238492 - RNA, 19 nt, Homo sapiens
uuaauuacauccugagcaa

SEQ ID NO: 238493 - RNA, 19 nt, Homo sapiens
cuuguacacuugugcguua

SEQ ID NO: 238494 - RNA, 19 nt, Homo sapiens
guacccagcuacuguugga

SEQ ID NO: 238495 - RNA, 19 nt, Homo sapiens
gugcauguggguauuguua

SEQ ID NO: 238496 - RNA, 19 nt, Homo sapiens
cagaagacaaacaauauga

SEQ ID NO: 238497 - RNA, 19 nt, Homo sapiens
caccagaagacaaacaaua

SEQ ID NO: 238498 - RNA, 19 nt, Homo sapiens
ucacagagaguccaucaug

SEQ ID NO: 238499 - RNA, 19 nt, Homo sapiens
ccaacuuacugucuucuuc

SEQ ID NO: 238500 - RNA, 19 nt, Homo sapiens
ucacacaaugcccaacuua

SEQ ID NO: 238501 - RNA, 19 nt, Homo sapiens
ggucaauucuauuacaucu

SEQ ID NO: 238502 - RNA, 19 nt, Homo sapiens
gggauccugucaaguguug

SEQ ID NO: 238503 - RNA, 19 nt, Homo sapiens
ccagaacggccacgaagaa

SEQ ID NO: 238504 - RNA, 19 nt, Homo sapiens
acaauuguggucucucuua

SEQ ID NO: 238505 - RNA, 19 nt, Homo sapiens
gauggagccuuccuuuaac

SEQ ID NO: 238506 - RNA, 19 nt, Homo sapiens
uguccgaggucaauucuau

SEQ ID NO: 238507 - RNA, 19 nt, Homo sapiens
uaggaaaugucaucaaacu

SEQ ID NO: 238508 - RNA, 19 nt, Homo sapiens
cgaggucaauucuauuaca

SEQ ID NO: 238509 - RNA, 19 nt, Homo sapiens
uguggucucucuuaacuug

SEQ ID NO: 238510 - RNA, 19 nt, Homo sapiens
ccaagacucagugauuuaa

SEQ ID NO: 238511 - RNA, 19 nt, Homo sapiens
ccaauuuacuccuaucaac

SEQ ID NO: 238512 - RNA, 19 nt, Homo sapiens
cagauggagccuuccuuua

SEQ ID NO: 238513 - RNA, 19 nt, Homo sapiens
gaacggccacgaagaagag

SEQ ID NO: 238514 - RNA, 19 nt, Homo sapiens
ugugaaagguacccagcua

SEQ ID NO: 238515 - RNA, 19 nt, Homo sapiens
ucaugaaugucaaugugaa

SEQ ID NO: 238516 - RNA, 19 nt, Homo sapiens
cacagagaguccaucauga

SEQ ID NO: 238517 - RNA, 19 nt, Homo sapiens
ccacacagucacauuauca

SEQ ID NO: 238518 - RNA, 19 nt, Homo sapiens
gugauaccuuguacacuug

SEQ ID NO: 238519 - RNA, 19 nt, Homo sapiens
gaaugucaaugugaaaggu

SEQ ID NO: 238520 - RNA, 19 nt, Homo sapiens
ggaugagccauuccugaaa

SEQ ID NO: 238521 - RNA, 19 nt, Homo sapiens
gaacuuucuguccuaauca

SEQ ID NO: 238522 - RNA, 19 nt, Homo sapiens
ccagauggagccuuccuuu

SEQ ID NO: 238523 - RNA, 19 nt, Homo sapiens
gaggucaauucuauuacau

SEQ ID NO: 238524 - RNA, 19 nt, Homo sapiens
acaaugggauccugucaag

SEQ ID NO: 238525 - RNA, 19 nt, Homo sapiens
guacacuugugcguuaaga

SEQ ID NO: 238526 - RNA, 19 nt, Homo sapiens
gauuuaaggaugacagaga

SEQ ID NO: 238527 - RNA, 19 nt, Homo sapiens
gaugagccauuccugaaaa

SEQ ID NO: 238528 - RNA, 19 nt, Homo sapiens
ggcugauucugaacaauug

SEQ ID NO: 238529 - RNA, 19 nt, Homo sapiens
gaugacacgccucaccaaa

SEQ ID NO: 238530 - RNA, 19 nt, Homo sapiens
guuaagacccacauauauc

SEQ ID NO: 238531 - RNA, 19 nt, Homo sapiens
gaggaucguccgccuguug

SEQ ID NO: 238532 - RNA, 19 nt, Homo sapiens
ucucuuaacuugagguucu

SEQ ID NO: 238533 - RNA, 19 nt, Homo sapiens
gggaggaagccaagcagaa

SEQ ID NO: 238534 - RNA, 19 nt, Homo sapiens
gagaugugcauguggguau

SEQ ID NO: 238535 - RNA, 19 nt, Homo sapiens
caauaugauuugcuguuac

SEQ ID NO: 238536 - RNA, 19 nt, Homo sapiens
ucuccagcaucuucuguuu

SEQ ID NO: 238537 - RNA, 19 nt, Homo sapiens
ugucaaguguuggaaaguu

SEQ ID NO: 238538 - RNA, 19 nt, Homo sapiens
acagagaguccaucaugaa

SEQ ID NO: 238539 - RNA, 19 nt, Homo sapiens
caacuuacugucuucuuca

SEQ ID NO: 238540 - RNA, 19 nt, Homo sapiens
ucauacaccagaagacaaa

SEQ ID NO: 238541 - RNA, 19 nt, Homo sapiens
gcauguggguauuguuagg

SEQ ID NO: 238542 - RNA, 19 nt, Homo sapiens
gcacaaggagacccugaag

SEQ ID NO: 238543 - RNA, 19 nt, Homo sapiens
ugacacgccucaccaaagc

SEQ ID NO: 238544 - RNA, 19 nt, Homo sapiens
cguuaagacccacauauau

SEQ ID NO: 238545 - RNA, 19 nt, Homo sapiens
gaaagguacccagcuacug

SEQ ID NO: 238546 - RNA, 19 nt, Homo sapiens
caaucuaaguuacgguuac

SEQ ID NO: 238547 - RNA, 19 nt, Homo sapiens
ucucuuuaaucuccuauuc

SEQ ID NO: 238548 - RNA, 19 nt, Homo sapiens
ccagaagacaaacaauaug

SEQ ID NO: 238549 - RNA, 19 nt, Homo sapiens
ggaagagaaggaacugaag

SEQ ID NO: 238550 - RNA, 19 nt, Homo sapiens
acaaggagacccugaaguc

SEQ ID NO: 238551 - RNA, 19 nt, Homo sapiens
gggucacgcuagaaucaga

SEQ ID NO: 238552 - RNA, 19 nt, Homo sapiens
aaaguucucuacagucaac

SEQ ID NO: 238553 - RNA, 19 nt, Homo sapiens
gaacaggaccaagcugacu

SEQ ID NO: 238554 - RNA, 19 nt, Homo sapiens
ggaggcccauuccuuucug

SEQ ID NO: 238555 - RNA, 19 nt, Homo sapiens
ccuauuccuucacacaguu

SEQ ID NO: 238556 - RNA, 19 nt, Homo sapiens
ccucuuaaaugagaaagca

SEQ ID NO: 238557 - RNA, 19 nt, Homo sapiens
cuucagaccagaauugaga

SEQ ID NO: 238558 - RNA, 19 nt, Homo sapiens
ccgccacacagucacauua

SEQ ID NO: 238559 - RNA, 19 nt, Homo sapiens
gaaaguucucuacagucaa

SEQ ID NO: 238560 - RNA, 19 nt, Homo sapiens
aaagguacccagcuacugu

SEQ ID NO: 238561 - RNA, 19 nt, Homo sapiens
ugaaggagacauucuggau

SEQ ID NO: 238562 - RNA, 19 nt, Homo sapiens
cuucacacaguucaacaua

SEQ ID NO: 238563 - RNA, 19 nt, Homo sapiens
cuuacugucuucuucaugu

SEQ ID NO: 238564 - RNA, 19 nt, Homo sapiens
gaagagagauggcuuauca

SEQ ID NO: 238565 - RNA, 19 nt, Homo sapiens
gaaaguggcuuauccaaug

SEQ ID NO: 238566 - RNA, 19 nt, Homo sapiens
gaaggcaguuucugggaua

SEQ ID NO: 238567 - RNA, 19 nt, Homo sapiens
uaucugagcucuuaucuau

SEQ ID NO: 238568 - RNA, 19 nt, Homo sapiens
guagaaagcucuguagguu

SEQ ID NO: 238569 - RNA, 19 nt, Homo sapiens
gcuauaauauggacagauu

SEQ ID NO: 238570 - RNA, 19 nt, Homo sapiens
gcaaagggaucggaagaga

SEQ ID NO: 238571 - RNA, 19 nt, Homo sapiens
gaagaaguguauuaugaca

SEQ ID NO: 238572 - RNA, 19 nt, Homo sapiens
ggacuguucugucucaugu

SEQ ID NO: 238573 - RNA, 19 nt, Homo sapiens
ggaaagaaagugauuguca

SEQ ID NO: 238574 - RNA, 19 nt, Homo sapiens
ucugagcucuuaucuauga

SEQ ID NO: 238575 - RNA, 19 nt, Homo sapiens
ucaacgagcuauaauaugg

SEQ ID NO: 238576 - RNA, 19 nt, Homo sapiens
gaauuucucuacucaacga

SEQ ID NO: 238577 - RNA, 19 nt, Homo sapiens
ggaagauccuggaauuucu

SEQ ID NO: 238578 - RNA, 19 nt, Homo sapiens
gccaagaagaaguguauua

SEQ ID NO: 238579 - RNA, 19 nt, Homo sapiens
caccaacacuucuuugaau

SEQ ID NO: 238580 - RNA, 19 nt, Homo sapiens
agaaauccaugcaggaaga

SEQ ID NO: 238581 - RNA, 19 nt, Homo sapiens
cagagaugcuccaaggaaa

SEQ ID NO: 238582 - RNA, 19 nt, Homo sapiens
ggacuagacaugcucauuc

SEQ ID NO: 238583 - RNA, 19 nt, Homo sapiens
ggaaaguggcuuauccaau

SEQ ID NO: 238584 - RNA, 19 nt, Homo sapiens
auucauaacugguagcuau

SEQ ID NO: 238585 - RNA, 19 nt, Homo sapiens
caacacuucuuugaaucuu

SEQ ID NO: 238586 - RNA, 19 nt, Homo sapiens
gaccuucgcagagcaauuu

SEQ ID NO: 238587 - RNA, 19 nt, Homo sapiens
ggacagauucauaaacaag

SEQ ID NO: 238588 - RNA, 19 nt, Homo sapiens
agaaaggaauauucagugu

SEQ ID NO: 238589 - RNA, 19 nt, Homo sapiens
uauucaggaugguucuuua

SEQ ID NO: 238590 - RNA, 19 nt, Homo sapiens
ggaccacucuucugaucag

SEQ ID NO: 238591 - RNA, 19 nt, Homo sapiens
caagaagaaguguauuaug

SEQ ID NO: 238592 - RNA, 19 nt, Homo sapiens
ccagagaugcuccaaggaa

SEQ ID NO: 238593 - RNA, 19 nt, Homo sapiens
acugguagcuauaacuuga

SEQ ID NO: 238594 - RNA, 19 nt, Homo sapiens
ggaguuccucuaacauuug

SEQ ID NO: 238595 - RNA, 19 nt, Homo sapiens
ccaagaagaaguguauuau

SEQ ID NO: 238596 - RNA, 19 nt, Homo sapiens
caucagaaaggaauauuca

SEQ ID NO: 238597 - RNA, 19 nt, Homo sapiens
caaaagaaacucuacagaa

SEQ ID NO: 238598 - RNA, 19 nt, Homo sapiens
ggaauucagaccagagaug

SEQ ID NO: 238599 - RNA, 19 nt, Homo sapiens
ccagagacaugcaagucau

SEQ ID NO: 238600 - RNA, 19 nt, Homo sapiens
gacuagacaugcucauucu

SEQ ID NO: 238601 - RNA, 19 nt, Homo sapiens
aaaagaaacucuacagaag

SEQ ID NO: 238602 - RNA, 19 nt, Homo sapiens
ccaaggaaagaaagugauu

SEQ ID NO: 238603 - RNA, 19 nt, Homo sapiens
cuuaggagguuguagaaag

SEQ ID NO: 238604 - RNA, 19 nt, Homo sapiens
gcaaaagcauggaagucaa

SEQ ID NO: 238605 - RNA, 19 nt, Homo sapiens
uaacugguagcuauaacuu

SEQ ID NO: 238606 - RNA, 19 nt, Homo sapiens
aagaaacucuacagaaggu

SEQ ID NO: 238607 - RNA, 19 nt, Homo sapiens
aaagggaucggaagagaga

SEQ ID NO: 238608 - RNA, 19 nt, Homo sapiens
gcgccaagaagaaguguau

SEQ ID NO: 238609 - RNA, 19 nt, Homo sapiens
ccucauagacacagaaaca

SEQ ID NO: 238610 - RNA, 19 nt, Homo sapiens
auguuuaucugagcucuua

SEQ ID NO: 238611 - RNA, 19 nt, Homo sapiens
acuguucugucucauguuu

SEQ ID NO: 238612 - RNA, 19 nt, Homo sapiens
ucaccaacacuucuuugaa

SEQ ID NO: 238613 - RNA, 19 nt, Homo sapiens
gagaugcuccaaggaaaga

SEQ ID NO: 238614 - RNA, 19 nt, Homo sapiens
gaaugugcccuggagauca

SEQ ID NO: 238615 - RNA, 19 nt, Homo sapiens
acacagaaacagccaugaa

SEQ ID NO: 238616 - RNA, 19 nt, Homo sapiens
guucuuggccucauagaca

SEQ ID NO: 238617 - RNA, 19 nt, Homo sapiens
guucuucuccuccaucaga

SEQ ID NO: 238618 - RNA, 19 nt, Homo sapiens
ucggauggcuuuuaugaaa

SEQ ID NO: 238619 - RNA, 19 nt, Homo sapiens
cuacuacuauucugcaaac

SEQ ID NO: 238620 - RNA, 19 nt, Homo sapiens
cagcaaagggaucggaaga

SEQ ID NO: 238621 - RNA, 19 nt, Homo sapiens
ucaggaugguucuuuaaac

SEQ ID NO: 238622 - RNA, 19 nt, Homo sapiens
acucaacgagcuauaauau

SEQ ID NO: 238623 - RNA, 19 nt, Homo sapiens
ccuggaauuucucuacuca

SEQ ID NO: 238624 - RNA, 19 nt, Homo sapiens
ggaaugugcccuggagauc

SEQ ID NO: 238625 - RNA, 19 nt, Homo sapiens
gaggaauucagaccagaga

SEQ ID NO: 238626 - RNA, 19 nt, Homo sapiens
gagcuauaauauggacaga

SEQ ID NO: 238627 - RNA, 19 nt, Homo sapiens
gauaguccauaugcaagca

SEQ ID NO: 238628 - RNA, 19 nt, Homo sapiens
aaccauaaacuguacaaug

SEQ ID NO: 238629 - RNA, 19 nt, Homo sapiens
ucagaaauccaugcaggaa

SEQ ID NO: 238630 - RNA, 19 nt, Homo sapiens
auggacagauucauaaaca

SEQ ID NO: 238631 - RNA, 19 nt, Homo sapiens
augaugauauucaccaugu

SEQ ID NO: 238632 - RNA, 19 nt, Homo sapiens
uagacaugcucauucucaa

SEQ ID NO: 238633 - RNA, 19 nt, Homo sapiens
gccagcaguuguaaaauug

SEQ ID NO: 238634 - RNA, 19 nt, Homo sapiens
ucagaaaggaauauucagu

SEQ ID NO: 238635 - RNA, 19 nt, Homo sapiens
gagcagccucagcacacua

SEQ ID NO: 238636 - RNA, 19 nt, Homo sapiens
gcagccagcaguuguaaaa

SEQ ID NO: 238637 - RNA, 19 nt, Homo sapiens
uuucugggauaguccauau

SEQ ID NO: 238638 - RNA, 19 nt, Homo sapiens
gggaaaguggcuuauccaa

SEQ ID NO: 238639 - RNA, 19 nt, Homo sapiens
cuagacaugcucauucuca

SEQ ID NO: 238640 - RNA, 19 nt, Homo sapiens
ucauaacugguagcuauaa

SEQ ID NO: 238641 - RNA, 19 nt, Homo sapiens
caacgagcuauaauaugga

SEQ ID NO: 238642 - RNA, 19 nt, Homo sapiens
uggaauuucucuacucaac

SEQ ID NO: 238643 - RNA, 19 nt, Homo sapiens
gagcucugcgccaagaaga

SEQ ID NO: 238644 - RNA, 19 nt, Homo sapiens
caaggaaagaaagugauug

SEQ ID NO: 238645 - RNA, 19 nt, Homo sapiens
ccacaucaccaacacuucu

SEQ ID NO: 238646 - RNA, 19 nt, Homo sapiens
uccaaugguugcugccuau

SEQ ID NO: 238647 - RNA, 19 nt, Homo sapiens
cuucauggccuacuacuac

SEQ ID NO: 238648 - RNA, 19 nt, Homo sapiens
gaugcuccaaggaaagaaa

SEQ ID NO: 238649 - RNA, 19 nt, Homo sapiens
uguucugucucauguuuau

SEQ ID NO: 238650 - RNA, 19 nt, Homo sapiens
gauccuggaauuucucuac

SEQ ID NO: 238651 - RNA, 19 nt, Homo sapiens
gaagauccuggaauuucuc

SEQ ID NO: 238652 - RNA, 19 nt, Homo sapiens
ucaaucacucucuguguuc

SEQ ID NO: 238653 - RNA, 19 nt, Homo sapiens
aaaguggcuuauccaaugg

SEQ ID NO: 238654 - RNA, 19 nt, Homo sapiens
acagcgaggucaaaagaaa

SEQ ID NO: 238655 - RNA, 19 nt, Homo sapiens
ucacaccugacaaauggaa

SEQ ID NO: 238656 - RNA, 19 nt, Homo sapiens
gguuguagaaagcucugua

SEQ ID NO: 238657 - RNA, 19 nt, Homo sapiens
aaugguugcugccuauucu

SEQ ID NO: 238658 - RNA, 19 nt, Homo sapiens
guuacgugguccugacugu

SEQ ID NO: 238659 - RNA, 19 nt, Homo sapiens
gagcuuauucaggaugguu

SEQ ID NO: 238660 - RNA, 19 nt, Homo sapiens
aucaaucacucucuguguu

SEQ ID NO: 238661 - RNA, 19 nt, Homo sapiens
ggagcagccucagcacacu

SEQ ID NO: 238662 - RNA, 19 nt, Homo sapiens
ggaagagagauggcuuauc

SEQ ID NO: 238663 - RNA, 19 nt, Homo sapiens
gacagauucauaaacaagu

SEQ ID NO: 238664 - RNA, 19 nt, Homo sapiens
gcaaggagacggccaagaa

SEQ ID NO: 238665 - RNA, 19 nt, Homo sapiens
ucacaggacucugcagaua

SEQ ID NO: 238666 - RNA, 19 nt, Homo sapiens
gcauggaggugaauuucuu

SEQ ID NO: 238667 - RNA, 19 nt, Homo sapiens
agacuucacugcagccuuu

SEQ ID NO: 238668 - RNA, 19 nt, Homo sapiens
gaccaaaccaggagacauu

SEQ ID NO: 238669 - RNA, 19 nt, Homo sapiens
caacaacgcaggccacaau

SEQ ID NO: 238670 - RNA, 19 nt, Homo sapiens
ggccaagguuucccaguga

SEQ ID NO: 238671 - RNA, 19 nt, Homo sapiens
gcacuugcaugggcaguuc

SEQ ID NO: 238672 - RNA, 19 nt, Homo sapiens
caacgcaggccacaaugaa

SEQ ID NO: 238673 - RNA, 19 nt, Homo sapiens
ccucuccacuguuucauga

SEQ ID NO: 238674 - RNA, 19 nt, Homo sapiens
caagacagagucagugaga

SEQ ID NO: 238675 - RNA, 19 nt, Homo sapiens
gauagugccucugcaaacu

SEQ ID NO: 238676 - RNA, 19 nt, Homo sapiens
gcagauggaccugaccaaa

SEQ ID NO: 238677 - RNA, 19 nt, Homo sapiens
cagggaagcauguacugua

SEQ ID NO: 238678 - RNA, 19 nt, Homo sapiens
ggaugggagucucaugcaa

SEQ ID NO: 238679 - RNA, 19 nt, Homo sapiens
caaggagacggccaagaaa

SEQ ID NO: 238680 - RNA, 19 nt, Homo sapiens
cugcaggccuucuucauca

SEQ ID NO: 238681 - RNA, 19 nt, Homo sapiens
ucauguacuucauccacua

SEQ ID NO: 238682 - RNA, 19 nt, Homo sapiens
agacagagucagugagaaa

SEQ ID NO: 238683 - RNA, 19 nt, Homo sapiens
gggaaaagcgcaagcaauu

SEQ ID NO: 238684 - RNA, 19 nt, Homo sapiens
uggccaaccugccucaaga

SEQ ID NO: 238685 - RNA, 19 nt, Homo sapiens
gugccucagugcugcaauu

SEQ ID NO: 238686 - RNA, 19 nt, Homo sapiens
acaggacucugcagauagu

SEQ ID NO: 238687 - RNA, 19 nt, Homo sapiens
cugcgccucuccacuguuu

SEQ ID NO: 238688 - RNA, 19 nt, Homo sapiens
ggacuacaucgagcacuug

SEQ ID NO: 238689 - RNA, 19 nt, Homo sapiens
guagcugcauggaggugaa

SEQ ID NO: 238690 - RNA, 19 nt, Homo sapiens
gacccuggccuaaagaauc

SEQ ID NO: 238691 - RNA, 19 nt, Homo sapiens
ccuggacccuggccuaaag

SEQ ID NO: 238692 - RNA, 19 nt, Homo sapiens
caaacuaaggagugacuag

SEQ ID NO: 238693 - RNA, 19 nt, Homo sapiens
gcaauugagggcuaaaucc

SEQ ID NO: 238694 - RNA, 19 nt, Homo sapiens
guacuucauccacuacuac

SEQ ID NO: 238695 - RNA, 19 nt, Homo sapiens
uguacuucauccacuacua

SEQ ID NO: 238696 - RNA, 19 nt, Homo sapiens
ccaccguauuggaguugaa

SEQ ID NO: 238697 - RNA, 19 nt, Homo sapiens
ggagacggccaagaaacug

SEQ ID NO: 238698 - RNA, 19 nt, Homo sapiens
aggccacaaugaaguaguu

SEQ ID NO: 238699 - RNA, 19 nt, Homo sapiens
ggcuaaaucccaagugucu

SEQ ID NO: 238700 - RNA, 19 nt, Homo sapiens
gcaaacuaaggagugacua

SEQ ID NO: 238701 - RNA, 19 nt, Homo sapiens
gcugcauggaggugaauuu

SEQ ID NO: 238702 - RNA, 19 nt, Homo sapiens
ggacccuggccuaaagaau

SEQ ID NO: 238703 - RNA, 19 nt, Homo sapiens
ggucaaggucagcaucauc

SEQ ID NO: 238704 - RNA, 19 nt, Homo sapiens
ucugcaaacuaaggaguga

SEQ ID NO: 238705 - RNA, 19 nt, Homo sapiens
ugagccaugugcaccuaug

SEQ ID NO: 238706 - RNA, 19 nt, Homo sapiens
cauggaggugaauuucuuu

SEQ ID NO: 238707 - RNA, 19 nt, Homo sapiens
gaaauaaacagccauauga

SEQ ID NO: 238708 - RNA, 19 nt, Homo sapiens
ggacaacugugauaaugug

SEQ ID NO: 238709 - RNA, 19 nt, Homo sapiens
gcagugggcucaugucugu

SEQ ID NO: 238710 - RNA, 19 nt, Homo sapiens
ggacgaaaccaacacauau

SEQ ID NO: 238711 - RNA, 19 nt, Homo sapiens
gcacggacauccacaccuu

SEQ ID NO: 238712 - RNA, 19 nt, Homo sapiens
caacugugauaaugugauu

SEQ ID NO: 238713 - RNA, 19 nt, Homo sapiens
caacacauauacaaucauc

SEQ ID NO: 238714 - RNA, 19 nt, Homo sapiens
gaaaccaacacauauacaa

SEQ ID NO: 238715 - RNA, 19 nt, Homo sapiens
gcaaggacccacucuggaa

SEQ ID NO: 238716 - RNA, 19 nt, Homo sapiens
ccaaagugcugggauuaga

SEQ ID NO: 238717 - RNA, 19 nt, Homo sapiens
ucccagagcuucaaagugu

SEQ ID NO: 238718 - RNA, 19 nt, Homo sapiens
gacgaaaccaacacauaua

SEQ ID NO: 238719 - RNA, 19 nt, Homo sapiens
uaagauagaucgcguuagc

SEQ ID NO: 238720 - RNA, 19 nt, Homo sapiens
cgaagcaggugauaucaag

SEQ ID NO: 238721 - RNA, 19 nt, Homo sapiens
ccacagcaagcaagucuuu

SEQ ID NO: 238722 - RNA, 19 nt, Homo sapiens
acagccauaugaagagaua

SEQ ID NO: 238723 - RNA, 19 nt, Homo sapiens
cgauggcugucgccuguaa

SEQ ID NO: 238724 - RNA, 19 nt, Homo sapiens
ggaaugaggauccuacaac

SEQ ID NO: 238725 - RNA, 19 nt, Homo sapiens
guggguggcuaauuaagau

SEQ ID NO: 238726 - RNA, 19 nt, Homo sapiens
gaacccacaccugcuugua

SEQ ID NO: 238727 - RNA, 19 nt, Homo sapiens
aaacagccauaugaagaga

SEQ ID NO: 238728 - RNA, 19 nt, Homo sapiens
auaaacagccauaugaaga

SEQ ID NO: 238729 - RNA, 19 nt, Homo sapiens
gggcgaagcaggugauauc

SEQ ID NO: 238730 - RNA, 19 nt, Homo sapiens
ccagcaaccaggacaguuu

SEQ ID NO: 238731 - RNA, 19 nt, Homo sapiens
uggacgugcugguguguaa

SEQ ID NO: 238732 - RNA, 19 nt, Homo sapiens
cgggaucccuggagacguu

SEQ ID NO: 238733 - RNA, 19 nt, Homo sapiens
agaaauaaacagccauaug

SEQ ID NO: 238734 - RNA, 19 nt, Homo sapiens
gacaggagaaggucagaga

SEQ ID NO: 238735 - RNA, 19 nt, Homo sapiens
ugacaacguaagacuguaa

SEQ ID NO: 238736 - RNA, 19 nt, Homo sapiens
gcaaggccaguccagauuc

SEQ ID NO: 238737 - RNA, 19 nt, Homo sapiens
gcauggacaacugugauaa

SEQ ID NO: 238738 - RNA, 19 nt, Homo sapiens
gaagcauggacaacuguga

SEQ ID NO: 238739 - RNA, 19 nt, Homo sapiens
ggaaguguucggcgacguu

SEQ ID NO: 238740 - RNA, 19 nt, Homo sapiens
agcuguggguggcuaauua

SEQ ID NO: 238741 - RNA, 19 nt, Homo sapiens
gcgagagucuggcgguucu

SEQ ID NO: 238742 - RNA, 19 nt, Homo sapiens
gagcgugggaggauugaug

SEQ ID NO: 238743 - RNA, 19 nt, Homo sapiens
gcuaggaacccuggacgaa

SEQ ID NO: 238744 - RNA, 19 nt, Homo sapiens
guaagacuguaaccauggu

SEQ ID NO: 238745 - RNA, 19 nt, Homo sapiens
cccaacgccuuuacuuuca

SEQ ID NO: 238746 - RNA, 19 nt, Homo sapiens
ccucugugcuggacgugaa

SEQ ID NO: 238747 - RNA, 19 nt, Homo sapiens
ccaggacaguuuguuguuc

SEQ ID NO: 238748 - RNA, 19 nt, Homo sapiens
acccacaccugcuuguaaa

SEQ ID NO: 238749 - RNA, 19 nt, Homo sapiens
gauaaugugauugggcaaa

SEQ ID NO: 238750 - RNA, 19 nt, Homo sapiens
gccuuucaaugacguuuau

SEQ ID NO: 238751 - RNA, 19 nt, Homo sapiens
ggacccgcaggaaggcuua

SEQ ID NO: 238752 - RNA, 19 nt, Homo sapiens
uggacgaaaccaacacaua

SEQ ID NO: 238753 - RNA, 19 nt, Homo sapiens
gcuguggguggcuaauuaa

SEQ ID NO: 238754 - RNA, 19 nt, Homo sapiens
ggacguaagggacucaaaa

SEQ ID NO: 238755 - RNA, 19 nt, Homo sapiens
gagagacgaaaggcuguuu

SEQ ID NO: 238756 - RNA, 19 nt, Homo sapiens
caacgccuuuacuuucaca

SEQ ID NO: 238757 - RNA, 19 nt, Homo sapiens
uaggaacccuggacgaaac

SEQ ID NO: 238758 - RNA, 19 nt, Homo sapiens
caugacaacguaagacugu

SEQ ID NO: 238759 - RNA, 19 nt, Homo sapiens
gaaggucagagagacgaaa

SEQ ID NO: 238760 - RNA, 19 nt, Homo sapiens
ugcccagccucaaagcaua

SEQ ID NO: 238761 - RNA, 19 nt, Homo sapiens
caaggccaguccagauucu

SEQ ID NO: 238762 - RNA, 19 nt, Homo sapiens
gguggcuaauuaagauaga

SEQ ID NO: 238763 - RNA, 19 nt, Homo sapiens
cuacaacccacaaucagau

SEQ ID NO: 238764 - RNA, 19 nt, Homo sapiens
cagcaaggccaguccagau

SEQ ID NO: 238765 - RNA, 19 nt, Homo sapiens
gagaccagccagagcaaca

SEQ ID NO: 238766 - RNA, 19 nt, Homo sapiens
ccagauucuuugggccuuu

SEQ ID NO: 238767 - RNA, 19 nt, Homo sapiens
gcgaagcaggugauaucaa

SEQ ID NO: 238768 - RNA, 19 nt, Homo sapiens
gcaaccaggacaguuuguu

SEQ ID NO: 238769 - RNA, 19 nt, Homo sapiens
ucacagccucugcagcaaa

SEQ ID NO: 238770 - RNA, 19 nt, Homo sapiens
accaacacauauacaauca

SEQ ID NO: 238771 - RNA, 19 nt, Homo sapiens
caggagaaggucagagaga

SEQ ID NO: 238772 - RNA, 19 nt, Homo sapiens
gagcaggagcuucuaucuc

SEQ ID NO: 238773 - RNA, 19 nt, Homo sapiens
uaaacagccauaugaagag

SEQ ID NO: 238774 - RNA, 19 nt, Homo sapiens
gauccuacaacccacaauc

SEQ ID NO: 238775 - RNA, 19 nt, Homo sapiens
caaggacccacucuggaau

SEQ ID NO: 238776 - RNA, 19 nt, Homo sapiens
ccagagcaacacagugaga

SEQ ID NO: 238777 - RNA, 19 nt, Homo sapiens
gcuggacgugaauguagua

SEQ ID NO: 238778 - RNA, 19 nt, Homo sapiens
gggccuuugugcagcauuc

SEQ ID NO: 238779 - RNA, 19 nt, Homo sapiens
ugagggaccugaaaacaca

SEQ ID NO: 238780 - RNA, 19 nt, Homo sapiens
ccagagcuucaaaguguau

SEQ ID NO: 238781 - RNA, 19 nt, Homo sapiens
cagcaaccaggacaguuug

SEQ ID NO: 238782 - RNA, 19 nt, Homo sapiens
ccaacaugacaacguaaga

SEQ ID NO: 238783 - RNA, 19 nt, Homo sapiens
aaagaggacaggagaaggu

SEQ ID NO: 238784 - RNA, 19 nt, Homo sapiens
gaaaagaggacaggagaag

SEQ ID NO: 238785 - RNA, 19 nt, Homo sapiens
cccagagcuucaaagugua

SEQ ID NO: 238786 - RNA, 19 nt, Homo sapiens
aggcuuauccuugagauug

SEQ ID NO: 238787 - RNA, 19 nt, Homo sapiens
ucccaacgccuuuacuuuc

SEQ ID NO: 238788 - RNA, 19 nt, Homo sapiens
cuaggaacccuggacgaaa

SEQ ID NO: 238789 - RNA, 19 nt, Homo sapiens
cagauucuuugggccuuug

SEQ ID NO: 238790 - RNA, 19 nt, Homo sapiens
auggacaacugugauaaug

SEQ ID NO: 238791 - RNA, 19 nt, Homo sapiens
auuaagauagaucgcguua

SEQ ID NO: 238792 - RNA, 19 nt, Homo sapiens
acaccgccuucauggagaa

SEQ ID NO: 238793 - RNA, 19 nt, Homo sapiens
ggccguacgucuggcuuca

SEQ ID NO: 238794 - RNA, 19 nt, Homo sapiens
cgaaaccaacacauauaca

SEQ ID NO: 238795 - RNA, 19 nt, Homo sapiens
ccuacaacccacaaucaga

SEQ ID NO: 238796 - RNA, 19 nt, Homo sapiens
aauaaacagccauaugaag

SEQ ID NO: 238797 - RNA, 19 nt, Homo sapiens
agccagagcaacacaguga

SEQ ID NO: 238798 - RNA, 19 nt, Homo sapiens
gugcuggacgugaauguag

SEQ ID NO: 238799 - RNA, 19 nt, Homo sapiens
ucaaaguguaugccacguu

SEQ ID NO: 238800 - RNA, 19 nt, Homo sapiens
cauggacaacugugauaau

SEQ ID NO: 238801 - RNA, 19 nt, Homo sapiens
ccaagcagugggcucaugu

SEQ ID NO: 238802 - RNA, 19 nt, Homo sapiens
acacauauacaaucaucuc

SEQ ID NO: 238803 - RNA, 19 nt, Homo sapiens
caacguaagacuguaacca

SEQ ID NO: 238804 - RNA, 19 nt, Homo sapiens
cccgaacccuguccuuugg

SEQ ID NO: 238805 - RNA, 19 nt, Homo sapiens
gaacauuucuucugggaua

SEQ ID NO: 238806 - RNA, 19 nt, Homo sapiens
caagacugcugaugaguuu

SEQ ID NO: 238807 - RNA, 19 nt, Homo sapiens
cgacugcaaugacaaagua

SEQ ID NO: 238808 - RNA, 19 nt, Homo sapiens
ggaggagugugaagauuau

SEQ ID NO: 238809 - RNA, 19 nt, Homo sapiens
ugacacagcuaauucugaa

SEQ ID NO: 238810 - RNA, 19 nt, Homo sapiens
gcaaugacaaaguaucuaa

SEQ ID NO: 238811 - RNA, 19 nt, Homo sapiens
ggucucauccugaacauuu

SEQ ID NO: 238812 - RNA, 19 nt, Homo sapiens
gggaggagugugaagauua

SEQ ID NO: 238813 - RNA, 19 nt, Homo sapiens
agaaaggucucauccugaa

SEQ ID NO: 238814 - RNA, 19 nt, Homo sapiens
gaacgcaccggaugaaauc

SEQ ID NO: 238815 - RNA, 19 nt, Homo sapiens
uaaccaagacugcugauga

SEQ ID NO: 238816 - RNA, 19 nt, Homo sapiens
caagaggaauauaaagcaa

SEQ ID NO: 238817 - RNA, 19 nt, Homo sapiens
ugaaacauauggaaucaag

SEQ ID NO: 238818 - RNA, 19 nt, Homo sapiens
cagcuaauucugaaacaua

SEQ ID NO: 238819 - RNA, 19 nt, Homo sapiens
gagcagaccagcacuucaa

SEQ ID NO: 238820 - RNA, 19 nt, Homo sapiens
caagaugacacagcuaauu

SEQ ID NO: 238821 - RNA, 19 nt, Homo sapiens
cuacgagcauauuaaagaa

SEQ ID NO: 238822 - RNA, 19 nt, Homo sapiens
aaacguggacucaauguug

SEQ ID NO: 238823 - RNA, 19 nt, Homo sapiens
cuacagcggugccuuccaa

SEQ ID NO: 238824 - RNA, 19 nt, Homo sapiens
gcaagaggaauauaaagca

SEQ ID NO: 238825 - RNA, 19 nt, Homo sapiens
uaacaucaccuccguaguc

SEQ ID NO: 238826 - RNA, 19 nt, Homo sapiens
uggcauaccugaagcucaa

SEQ ID NO: 238827 - RNA, 19 nt, Homo sapiens
aggcauagaauacacauuu

SEQ ID NO: 238828 - RNA, 19 nt, Homo sapiens
ucacagaggcauagaauac

SEQ ID NO: 238829 - RNA, 19 nt, Homo sapiens
uuacugaacuacuggaaag

SEQ ID NO: 238830 - RNA, 19 nt, Homo sapiens
caaccuaguccgcugaaga

SEQ ID NO: 238831 - RNA, 19 nt, Homo sapiens
caucuacgagcauauuaaa

SEQ ID NO: 238832 - RNA, 19 nt, Homo sapiens
ccucauccauuguaacauc

SEQ ID NO: 238833 - RNA, 19 nt, Homo sapiens
ucaauguuguccuuauuag

SEQ ID NO: 238834 - RNA, 19 nt, Homo sapiens
ggugaggaguccagcacaa

SEQ ID NO: 238835 - RNA, 19 nt, Homo sapiens
caaaugugauaaccaagac

SEQ ID NO: 238836 - RNA, 19 nt, Homo sapiens
ggucacagaggcauagaau

SEQ ID NO: 238837 - RNA, 19 nt, Homo sapiens
ucuacgagcauauuaaaga

SEQ ID NO: 238838 - RNA, 19 nt, Homo sapiens
gacaucuacgagcauauua

SEQ ID NO: 238839 - RNA, 19 nt, Homo sapiens
cuaguccgcugaagaugga

SEQ ID NO: 238840 - RNA, 19 nt, Homo sapiens
ccaagacugcugaugaguu

SEQ ID NO: 238841 - RNA, 19 nt, Homo sapiens
caacaaugucggaaugcuu

SEQ ID NO: 238842 - RNA, 19 nt, Homo sapiens
aaacuugcaggcuuagaaa

SEQ ID NO: 238843 - RNA, 19 nt, Homo sapiens
uagaggccauugccacaga

SEQ ID NO: 238844 - RNA, 19 nt, Homo sapiens
gggacguccuggaacaguu

SEQ ID NO: 238845 - RNA, 19 nt, Homo sapiens
caaaagaagucaucaucca

SEQ ID NO: 238846 - RNA, 19 nt, Homo sapiens
uccagagccucauccauug

SEQ ID NO: 238847 - RNA, 19 nt, Homo sapiens
agucaacaaugucggaaug

SEQ ID NO: 238848 - RNA, 19 nt, Homo sapiens
gggauagcccuguuuccuu

SEQ ID NO: 238849 - RNA, 19 nt, Homo sapiens
ugacaucuacgagcauauu

SEQ ID NO: 238850 - RNA, 19 nt, Homo sapiens
ggaaagcguacucguucga

SEQ ID NO: 238851 - RNA, 19 nt, Homo sapiens
acucaauguuguccuuauu

SEQ ID NO: 238852 - RNA, 19 nt, Homo sapiens
gacucaauguuguccuuau

SEQ ID NO: 238853 - RNA, 19 nt, Homo sapiens
guggcugccuugcccauga

SEQ ID NO: 238854 - RNA, 19 nt, Homo sapiens
gucauugaauuaugucaca

SEQ ID NO: 238855 - RNA, 19 nt, Homo sapiens
acaaaugugauaaccaaga

SEQ ID NO: 238856 - RNA, 19 nt, Homo sapiens
ucugaaacauauggaauca

SEQ ID NO: 238857 - RNA, 19 nt, Homo sapiens
cuugcaggcuuagaaauug

SEQ ID NO: 238858 - RNA, 19 nt, Homo sapiens
aaaggcugcuccugacaca

SEQ ID NO: 238859 - RNA, 19 nt, Homo sapiens
ggagcaggcgauggaauug

SEQ ID NO: 238860 - RNA, 19 nt, Homo sapiens
cagagccucauccauugua

SEQ ID NO: 238861 - RNA, 19 nt, Homo sapiens
gaagauuauacaagcagau

SEQ ID NO: 238862 - RNA, 19 nt, Homo sapiens
ggagugugaagauuauaca

SEQ ID NO: 238863 - RNA, 19 nt, Homo sapiens
ggacagugggcagugauca

SEQ ID NO: 238864 - RNA, 19 nt, Homo sapiens
ggaguccagcacaaccuuu

SEQ ID NO: 238865 - RNA, 19 nt, Homo sapiens
cucaauguuguccuuauua

SEQ ID NO: 238866 - RNA, 19 nt, Homo sapiens
acagagaucgagcggacua

SEQ ID NO: 238867 - RNA, 19 nt, Homo sapiens
ugaacgcaccggaugaaau

SEQ ID NO: 238868 - RNA, 19 nt, Homo sapiens
uaugcugucucgacugcaa

SEQ ID NO: 238869 - RNA, 19 nt, Homo sapiens
gcgaagugcgugagauucu

SEQ ID NO: 238870 - RNA, 19 nt, Homo sapiens
aagaugacacagcuaauuc

SEQ ID NO: 238871 - RNA, 19 nt, Homo sapiens
gucccaugcuggcugaaga

SEQ ID NO: 238872 - RNA, 19 nt, Homo sapiens
aaccaagacugcugaugag

SEQ ID NO: 238873 - RNA, 19 nt, Homo sapiens
ucaccuccguagucaagau

SEQ ID NO: 238874 - RNA, 19 nt, Homo sapiens
ggcauagaauacacauuuu

SEQ ID NO: 238875 - RNA, 19 nt, Homo sapiens
uggagcaggcgauggaauu

SEQ ID NO: 238876 - RNA, 19 nt, Homo sapiens
ccugcaagaggaauauaaa

SEQ ID NO: 238877 - RNA, 19 nt, Homo sapiens
gaugacacagcuaauucug

SEQ ID NO: 238878 - RNA, 19 nt, Homo sapiens
caucaccuccguagucaag

SEQ ID NO: 238879 - RNA, 19 nt, Homo sapiens
auccagagccucauccauu

SEQ ID NO: 238880 - RNA, 19 nt, Homo sapiens
ucaacaccaaggucaggua

SEQ ID NO: 238881 - RNA, 19 nt, Homo sapiens
gcaaaacguggacucaaug

SEQ ID NO: 238882 - RNA, 19 nt, Homo sapiens
ggagcagaccagcacuuca

SEQ ID NO: 238883 - RNA, 19 nt, Homo sapiens
accugaagcucaacaccaa

SEQ ID NO: 238884 - RNA, 19 nt, Homo sapiens
ggacuacagggaggagugu

SEQ ID NO: 238885 - RNA, 19 nt, Homo sapiens
aaaggucucauccugaaca

SEQ ID NO: 238886 - RNA, 19 nt, Homo sapiens
gaggagcagaccagcacuu

SEQ ID NO: 238887 - RNA, 19 nt, Homo sapiens
ggaaucaaggcagaaaggu

SEQ ID NO: 238888 - RNA, 19 nt, Homo sapiens
agagccucauccauuguaa

SEQ ID NO: 238889 - RNA, 19 nt, Homo sapiens
gaggagugugaagauuaua

SEQ ID NO: 238890 - RNA, 19 nt, Homo sapiens
uggaaaggcuggcaucuua

SEQ ID NO: 238891 - RNA, 19 nt, Homo sapiens
gcccagagcucuaagaaug

SEQ ID NO: 238892 - RNA, 19 nt, Homo sapiens
gagcugggcuucacgguau

SEQ ID NO: 238893 - RNA, 19 nt, Homo sapiens
uuacuuaucuggccaagaa

SEQ ID NO: 238894 - RNA, 19 nt, Homo sapiens
gggaauaugauuaugcuua

SEQ ID NO: 238895 - RNA, 19 nt, Homo sapiens
ccucauguauacuuacuua

SEQ ID NO: 238896 - RNA, 19 nt, Homo sapiens
uaaaguugcuuccauccaa

SEQ ID NO: 238897 - RNA, 19 nt, Homo sapiens
gaauuaaaguugcuuccau

SEQ ID NO: 238898 - RNA, 19 nt, Homo sapiens
gcugaggaauugcgaagaa

SEQ ID NO: 238899 - RNA, 19 nt, Homo sapiens
gggaaaagcuggagaagga

SEQ ID NO: 238900 - RNA, 19 nt, Homo sapiens
ggaggcuuccuaacaaaua

SEQ ID NO: 238901 - RNA, 19 nt, Homo sapiens
caaagaagucggaauguca

SEQ ID NO: 238902 - RNA, 19 nt, Homo sapiens
gaagagcccuuuugccuau

SEQ ID NO: 238903 - RNA, 19 nt, Homo sapiens
gccgugaacuucuuuggaa

SEQ ID NO: 238904 - RNA, 19 nt, Homo sapiens
ggaaugucauagucuugaa

SEQ ID NO: 238905 - RNA, 19 nt, Homo sapiens
uaagaaugccuaacuacaa

SEQ ID NO: 238906 - RNA, 19 nt, Homo sapiens
gaucugccuugcucacuau

SEQ ID NO: 238907 - RNA, 19 nt, Homo sapiens
ggaucugccuugcucacua

SEQ ID NO: 238908 - RNA, 19 nt, Homo sapiens
cgaagccagugcagauaaa

SEQ ID NO: 238909 - RNA, 19 nt, Homo sapiens
gaaaggcuggcaucuuaug

SEQ ID NO: 238910 - RNA, 19 nt, Homo sapiens
cccaggagcugaggaauug

SEQ ID NO: 238911 - RNA, 19 nt, Homo sapiens
gcaagucacugagaaugag

SEQ ID NO: 238912 - RNA, 19 nt, Homo sapiens
ggaaaggcgcuuacuugug

SEQ ID NO: 238913 - RNA, 19 nt, Homo sapiens
ucuuaugacugacuacaaa

SEQ ID NO: 238914 - RNA, 19 nt, Homo sapiens
gaggcuuccuaacaaauau

SEQ ID NO: 238915 - RNA, 19 nt, Homo sapiens
ccuggaggcuuccuaacaa

SEQ ID NO: 238916 - RNA, 19 nt, Homo sapiens
aauggaagcccucaaagaa

SEQ ID NO: 238917 - RNA, 19 nt, Homo sapiens
gcucacuauuugccuauug

SEQ ID NO: 238918 - RNA, 19 nt, Homo sapiens
ccuauuggcauauaugauu

SEQ ID NO: 238919 - RNA, 19 nt, Homo sapiens
aagggaggcuggugaaugu

SEQ ID NO: 238920 - RNA, 19 nt, Homo sapiens
caauggaagcccucaaaga

SEQ ID NO: 238921 - RNA, 19 nt, Homo sapiens
accauguucucaucaguua

SEQ ID NO: 238922 - RNA, 19 nt, Homo sapiens
cauccagcaugcuaucuug

SEQ ID NO: 238923 - RNA, 19 nt, Homo sapiens
ucaaagaagucggaauguc

SEQ ID NO: 238924 - RNA, 19 nt, Homo sapiens
ccgcugagguacaggaaga

SEQ ID NO: 238925 - RNA, 19 nt, Homo sapiens
caucuuauggcucaucaaa

SEQ ID NO: 238926 - RNA, 19 nt, Homo sapiens
gcauggccgugaacuucuu

SEQ ID NO: 238927 - RNA, 19 nt, Homo sapiens
gggaaaggcgcuuacuugu

SEQ ID NO: 238928 - RNA, 19 nt, Homo sapiens
caaccuggaggcuuccuaa

SEQ ID NO: 238929 - RNA, 19 nt, Homo sapiens
gaaugucauagucuugaaa

SEQ ID NO: 238930 - RNA, 19 nt, Homo sapiens
uggaagcccucaaagaagu

SEQ ID NO: 238931 - RNA, 19 nt, Homo sapiens
uaaaguuguuucccacucu

SEQ ID NO: 238932 - RNA, 19 nt, Homo sapiens
ggccaggacuacaucuuag

SEQ ID NO: 238933 - RNA, 19 nt, Homo sapiens
cggccaggacuacaucuua

SEQ ID NO: 238934 - RNA, 19 nt, Homo sapiens
ggaaaggcuggcaucuuau

SEQ ID NO: 238935 - RNA, 19 nt, Homo sapiens
ggugacagguggugauugc

SEQ ID NO: 238936 - RNA, 19 nt, Homo sapiens
aagaaugccuaacuacaag

SEQ ID NO: 238937 - RNA, 19 nt, Homo sapiens
guuaugagacuggagcuuu

SEQ ID NO: 238938 - RNA, 19 nt, Homo sapiens
ccucaaagaagucggaaug

SEQ ID NO: 238939 - RNA, 19 nt, Homo sapiens
gggcugugaucaacaaugc

SEQ ID NO: 238940 - RNA, 19 nt, Homo sapiens
ucacgaagccagugcagau

SEQ ID NO: 238941 - RNA, 19 nt, Homo sapiens
gccaugcuuugugcaagua

SEQ ID NO: 238942 - RNA, 19 nt, Homo sapiens
ggcaauggaagcccucaaa

SEQ ID NO: 238943 - RNA, 19 nt, Homo sapiens
gaaugccuaacuacaagaa

SEQ ID NO: 238944 - RNA, 19 nt, Homo sapiens
ucacugagaaugagcacuu

SEQ ID NO: 238945 - RNA, 19 nt, Homo sapiens
gcauauaugauuacuuugc

SEQ ID NO: 238946 - RNA, 19 nt, Homo sapiens
ggacauccagcaugcuauc

SEQ ID NO: 238947 - RNA, 19 nt, Homo sapiens
gaagucggaaugucauagu

SEQ ID NO: 238948 - RNA, 19 nt, Homo sapiens
gcucuaagaaugccuaacu

SEQ ID NO: 238949 - RNA, 19 nt, Homo sapiens
gaccauguucucaucaguu

SEQ ID NO: 238950 - RNA, 19 nt, Homo sapiens
ucuuauggcucaucaaagg

SEQ ID NO: 238951 - RNA, 19 nt, Homo sapiens
ccaaagggaggcuggugaa

SEQ ID NO: 238952 - RNA, 19 nt, Homo sapiens
aaucuaugcucagucgaaa

SEQ ID NO: 238953 - RNA, 19 nt, Homo sapiens
cuucuugacucucuguuca

SEQ ID NO: 238954 - RNA, 19 nt, Homo sapiens
gcuuccucauguauacuua

SEQ ID NO: 238955 - RNA, 19 nt, Homo sapiens
ugaaagggaaacugggaaa

SEQ ID NO: 238956 - RNA, 19 nt, Homo sapiens
gaauuuccuccuauugauc

SEQ ID NO: 238957 - RNA, 19 nt, Homo sapiens
gcccaggagcugaggaauu

SEQ ID NO: 238958 - RNA, 19 nt, Homo sapiens
ggguuucucauuaaaguug

SEQ ID NO: 238959 - RNA, 19 nt, Homo sapiens
gcaauggaagcccucaaag

SEQ ID NO: 238960 - RNA, 19 nt, Homo sapiens
cugccuugcucacuauuug

SEQ ID NO: 238961 - RNA, 19 nt, Homo sapiens
caaaggcggcugugaccau

SEQ ID NO: 238962 - RNA, 19 nt, Homo sapiens
gcagcaagucacugagaau

SEQ ID NO: 238963 - RNA, 19 nt, Homo sapiens
agggaaaggcgcuuacuug

SEQ ID NO: 238964 - RNA, 19 nt, Homo sapiens
gcccugagcacuugaaggu

SEQ ID NO: 238965 - RNA, 19 nt, Homo sapiens
ggaggucacaaagacguuu

SEQ ID NO: 238966 - RNA, 19 nt, Homo sapiens
ggccaugcuuugugcaagu

SEQ ID NO: 238967 - RNA, 19 nt, Homo sapiens
gcaggccucugugcagucu

SEQ ID NO: 238968 - RNA, 19 nt, Homo sapiens
ucacuggcccugagcacuu

SEQ ID NO: 238969 - RNA, 19 nt, Homo sapiens
ugacugacuacaaacaaug

SEQ ID NO: 238970 - RNA, 19 nt, Homo sapiens
gauggggagcuucuucuua

SEQ ID NO: 238971 - RNA, 19 nt, Homo sapiens
cuaagaaugccuaacuaca

SEQ ID NO: 238972 - RNA, 19 nt, Homo sapiens
uuaugagacuggagcuuuc

SEQ ID NO: 238973 - RNA, 19 nt, Homo sapiens
uaaucuaugcucagucgaa

SEQ ID NO: 238974 - RNA, 19 nt, Homo sapiens
cauguucucaucaguuaug

SEQ ID NO: 238975 - RNA, 19 nt, Homo sapiens
aaagggaggcuggugaaug

SEQ ID NO: 238976 - RNA, 19 nt, Homo sapiens
caacaaugcuggggugcuu

SEQ ID NO: 238977 - RNA, 19 nt, Homo sapiens
cacgguauuugccggaguu

SEQ ID NO: 238978 - RNA, 19 nt, Homo sapiens
aagggaaacugggaaacug

SEQ ID NO: 238979 - RNA, 19 nt, Homo sapiens
cuggaggcuuccuaacaaa

SEQ ID NO: 238980 - RNA, 19 nt, Homo sapiens
aacaaugcauggccgugaa

SEQ ID NO: 238981 - RNA, 19 nt, Homo sapiens
ccuauugaucaacucguua

SEQ ID NO: 238982 - RNA, 19 nt, Homo sapiens
caucuuagcacagcggaau

SEQ ID NO: 238983 - RNA, 19 nt, Homo sapiens
gaaugagcacuuucuucuc

SEQ ID NO: 238984 - RNA, 19 nt, Homo sapiens
gaaggcaguccuggugaca

SEQ ID NO: 238985 - RNA, 19 nt, Homo sapiens
cagcaagucacugagaaug

SEQ ID NO: 238986 - RNA, 19 nt, Homo sapiens
gucggaaugucauagucuu

SEQ ID NO: 238987 - RNA, 19 nt, Homo sapiens
cucuaagaaugccuaacua

SEQ ID NO: 238988 - RNA, 19 nt, Homo sapiens
gcgcuuacuuguggaucug

SEQ ID NO: 238989 - RNA, 19 nt, Homo sapiens
ucaacucguuagccagcaa

SEQ ID NO: 238990 - RNA, 19 nt, Homo sapiens
caagguagcuguagccaua

SEQ ID NO: 238991 - RNA, 19 nt, Homo sapiens
gaacuuauaugccacaauc

SEQ ID NO: 238992 - RNA, 19 nt, Homo sapiens
ccaagaaacuggagacauu

SEQ ID NO: 238993 - RNA, 19 nt, Homo sapiens
gaugaagacugggauauaa

SEQ ID NO: 238994 - RNA, 19 nt, Homo sapiens
ggagaaugguggcuuguuu

SEQ ID NO: 238995 - RNA, 19 nt, Homo sapiens
gaaggaaacagaauucauu

SEQ ID NO: 238996 - RNA, 19 nt, Homo sapiens
uauauaagcuagcacauga

SEQ ID NO: 238997 - RNA, 19 nt, Homo sapiens
uaugauggguggaggauua

SEQ ID NO: 238998 - RNA, 19 nt, Homo sapiens
gacaaacucuacaaacuga

SEQ ID NO: 238999 - RNA, 19 nt, Homo sapiens
gcacacuacacuauuaaua

SEQ ID NO: 239000 - RNA, 19 nt, Homo sapiens
ggaagaagaucugugacuu

SEQ ID NO: 239001 - RNA, 19 nt, Homo sapiens
gaauagauguuguggucaa

SEQ ID NO: 239002 - RNA, 19 nt, Homo sapiens
guauuugaguggcauauaa

SEQ ID NO: 239003 - RNA, 19 nt, Homo sapiens
acacauugauccuaacuuu

SEQ ID NO: 239004 - RNA, 19 nt, Homo sapiens
gaagaagaucugugacuuu

SEQ ID NO: 239005 - RNA, 19 nt, Homo sapiens
ggucaacaaugcuggaauu

SEQ ID NO: 239006 - RNA, 19 nt, Homo sapiens
caacaaugcuggaauucug

SEQ ID NO: 239007 - RNA, 19 nt, Homo sapiens
caacuaugauucaguggaa

SEQ ID NO: 239008 - RNA, 19 nt, Homo sapiens
gaaagaggagcguuaguug

SEQ ID NO: 239009 - RNA, 19 nt, Homo sapiens
gaaaagugguucuggaaaa

SEQ ID NO: 239010 - RNA, 19 nt, Homo sapiens
gaaaagcaguggccaacua

SEQ ID NO: 239011 - RNA, 19 nt, Homo sapiens
acccaaauaugcuugauua

SEQ ID NO: 239012 - RNA, 19 nt, Homo sapiens
agacagcccuggaugcuuu

SEQ ID NO: 239013 - RNA, 19 nt, Homo sapiens
cagaguaccuuuguauuug

SEQ ID NO: 239014 - RNA, 19 nt, Homo sapiens
gaagaucugugacuuugag

SEQ ID NO: 239015 - RNA, 19 nt, Homo sapiens
aggaauauauggcaacuuu

SEQ ID NO: 239016 - RNA, 19 nt, Homo sapiens
gaagaaaguaaaugcugua

SEQ ID NO: 239017 - RNA, 19 nt, Homo sapiens
gaaggaaggaaacagaauu

SEQ ID NO: 239018 - RNA, 19 nt, Homo sapiens
gauaccaccucucuuaauc

SEQ ID NO: 239019 - RNA, 19 nt, Homo sapiens
ugaaggaaguucugauuuc

SEQ ID NO: 239020 - RNA, 19 nt, Homo sapiens
ggccugagguggugaagaa

SEQ ID NO: 239021 - RNA, 19 nt, Homo sapiens
acagauaccaccucucuua

SEQ ID NO: 239022 - RNA, 19 nt, Homo sapiens
gagagaagguugugaagac

SEQ ID NO: 239023 - RNA, 19 nt, Homo sapiens
guucugauuucuccuguuu

SEQ ID NO: 239024 - RNA, 19 nt, Homo sapiens
gggaacacaugaagaaaca

SEQ ID NO: 239025 - RNA, 19 nt, Homo sapiens
gauuauccuucuguucuua

SEQ ID NO: 239026 - RNA, 19 nt, Homo sapiens
ucagauaacugcagauuuu

SEQ ID NO: 239027 - RNA, 19 nt, Homo sapiens
gauaaaggauccgguguag

SEQ ID NO: 239028 - RNA, 19 nt, Homo sapiens
gaacuggaagcuauuaugu

SEQ ID NO: 239029 - RNA, 19 nt, Homo sapiens
gccagaaacucccuccauu

SEQ ID NO: 239030 - RNA, 19 nt, Homo sapiens
guaacaccauugcuccuaa

SEQ ID NO: 239031 - RNA, 19 nt, Homo sapiens
caacaaucauacuuucaga

SEQ ID NO: 239032 - RNA, 19 nt, Homo sapiens
aaacugagauguggaagga

SEQ ID NO: 239033 - RNA, 19 nt, Homo sapiens
gaaggaaguucugauuucu

SEQ ID NO: 239034 - RNA, 19 nt, Homo sapiens
ggagcaggauggauuggaa

SEQ ID NO: 239035 - RNA, 19 nt, Homo sapiens
gcgggaagcuucagaguac

SEQ ID NO: 239036 - RNA, 19 nt, Homo sapiens
uaaaggauccgguguagug

SEQ ID NO: 239037 - RNA, 19 nt, Homo sapiens
gauauaauccacagaguuc

SEQ ID NO: 239038 - RNA, 19 nt, Homo sapiens
gugauagcauugauaaguu

SEQ ID NO: 239039 - RNA, 19 nt, Homo sapiens
gaagggcacacuacacuau

SEQ ID NO: 239040 - RNA, 19 nt, Homo sapiens
ucagaguaccuuuguauuu

SEQ ID NO: 239041 - RNA, 19 nt, Homo sapiens
ggacaaacucuacaaacug

SEQ ID NO: 239042 - RNA, 19 nt, Homo sapiens
gccagaaacuucagaugau

SEQ ID NO: 239043 - RNA, 19 nt, Homo sapiens
gagcaguacuuagaguuau

SEQ ID NO: 239044 - RNA, 19 nt, Homo sapiens
gaacacaugaagaaacaga

SEQ ID NO: 239045 - RNA, 19 nt, Homo sapiens
ccagaaacuucagaugauu

SEQ ID NO: 239046 - RNA, 19 nt, Homo sapiens
uuacagcaguuugcagaua

SEQ ID NO: 239047 - RNA, 19 nt, Homo sapiens
gcagaaauuccuggacuuu

SEQ ID NO: 239048 - RNA, 19 nt, Homo sapiens
uaucauaggucagaaaucu

SEQ ID NO: 239049 - RNA, 19 nt, Homo sapiens
ugauaagguuguugaagaa

SEQ ID NO: 239050 - RNA, 19 nt, Homo sapiens
gauccuaacuuugcuaguc

SEQ ID NO: 239051 - RNA, 19 nt, Homo sapiens
gcuguagccauaccuaaua

SEQ ID NO: 239052 - RNA, 19 nt, Homo sapiens
aagaagaucugugacuuug

SEQ ID NO: 239053 - RNA, 19 nt, Homo sapiens
cccaaguccuguuuccuua

SEQ ID NO: 239054 - RNA, 19 nt, Homo sapiens
auacggaacuggaagcuau

SEQ ID NO: 239055 - RNA, 19 nt, Homo sapiens
cugauaagguuguugaaga

SEQ ID NO: 239056 - RNA, 19 nt, Homo sapiens
uucaucagcuucaggaaua

SEQ ID NO: 239057 - RNA, 19 nt, Homo sapiens
uaagcuagcacaugauuau

SEQ ID NO: 239058 - RNA, 19 nt, Homo sapiens
ggaaucccuuacacauuga

SEQ ID NO: 239059 - RNA, 19 nt, Homo sapiens
aaacagaaguauggaagga

SEQ ID NO: 239060 - RNA, 19 nt, Homo sapiens
ggagagcaguacuuagagu

SEQ ID NO: 239061 - RNA, 19 nt, Homo sapiens
ccagaaacucccuccauuu

SEQ ID NO: 239062 - RNA, 19 nt, Homo sapiens
ucaguucucucucuuucuu

SEQ ID NO: 239063 - RNA, 19 nt, Homo sapiens
uugcugauguccuagauaa

SEQ ID NO: 239064 - RNA, 19 nt, Homo sapiens
caaguccuguuuccuuaga

SEQ ID NO: 239065 - RNA, 19 nt, Homo sapiens
gcacaugauuauccuucug

SEQ ID NO: 239066 - RNA, 19 nt, Homo sapiens
uacagcaguuugcagauaa

SEQ ID NO: 239067 - RNA, 19 nt, Homo sapiens
ggaugucuauucuuauucu

SEQ ID NO: 239068 - RNA, 19 nt, Homo sapiens
acuggaagcuauuauguau

SEQ ID NO: 239069 - RNA, 19 nt, Homo sapiens
ccagcaagccucagaguau

SEQ ID NO: 239070 - RNA, 19 nt, Homo sapiens
uuauagugcugcaaaguug

SEQ ID NO: 239071 - RNA, 19 nt, Homo sapiens
acagaaguauggaaggauu

SEQ ID NO: 239072 - RNA, 19 nt, Homo sapiens
gaauauauggcaacuuugg

SEQ ID NO: 239073 - RNA, 19 nt, Homo sapiens
ggaagaaggagagaagguu

SEQ ID NO: 239074 - RNA, 19 nt, Homo sapiens
gguggaggauuagcagaaa

SEQ ID NO: 239075 - RNA, 19 nt, Homo sapiens
ggaguuucagcaaaucaua

SEQ ID NO: 239076 - RNA, 19 nt, Homo sapiens
gaaggaggaguuucagcaa

SEQ ID NO: 239077 - RNA, 19 nt, Homo sapiens
ugauagcauugauaaguug

SEQ ID NO: 239078 - RNA, 19 nt, Homo sapiens
aaaccaagguccaagaaac

SEQ ID NO: 239079 - RNA, 19 nt, Homo sapiens
ccuaauagaccuccugaug

SEQ ID NO: 239080 - RNA, 19 nt, Homo sapiens
gauccgguguagugauuau

SEQ ID NO: 239081 - RNA, 19 nt, Homo sapiens
ggaguuaucauaggucaga

SEQ ID NO: 239082 - RNA, 19 nt, Homo sapiens
gagcguuaguuguugugaa

SEQ ID NO: 239083 - RNA, 19 nt, Homo sapiens
ccaauuauagugcugcaaa

SEQ ID NO: 239084 - RNA, 19 nt, Homo sapiens
ggaaggauuauuaugacuu

SEQ ID NO: 239085 - RNA, 19 nt, Homo sapiens
gacaagcccauauuacaug

SEQ ID NO: 239086 - RNA, 19 nt, Homo sapiens
uaauagaccuccugaugcu

SEQ ID NO: 239087 - RNA, 19 nt, Homo sapiens
gcaggaaaauuaaaaugug

SEQ ID NO: 239088 - RNA, 19 nt, Homo sapiens
gccugaagaucuuguggaa

SEQ ID NO: 239089 - RNA, 19 nt, Homo sapiens
ugaagaaacagaaguaugg

SEQ ID NO: 239090 - RNA, 19 nt, Homo sapiens
ccacagagauacacagaua

SEQ ID NO: 239091 - RNA, 19 nt, Homo sapiens
gcagagaucuauaaacaga

SEQ ID NO: 239092 - RNA, 19 nt, Homo sapiens
ggaagcagcuggugcacua

SEQ ID NO: 239093 - RNA, 19 nt, Homo sapiens
ucaacaagcucauucaguu

SEQ ID NO: 239094 - RNA, 19 nt, Homo sapiens
gacaguggcucagcacauu

SEQ ID NO: 239095 - RNA, 19 nt, Homo sapiens
gcagaagcaugcccagcaa

SEQ ID NO: 239096 - RNA, 19 nt, Homo sapiens
ccugaagagugaagacaua

SEQ ID NO: 239097 - RNA, 19 nt, Homo sapiens
aggcagagaucuauaaaca

SEQ ID NO: 239098 - RNA, 19 nt, Homo sapiens
gagaacagcagcccggauu

SEQ ID NO: 239099 - RNA, 19 nt, Homo sapiens
ggacaagaaugagcucagu

SEQ ID NO: 239100 - RNA, 19 nt, Homo sapiens
ccaaguacuucaagcacaa

SEQ ID NO: 239101 - RNA, 19 nt, Homo sapiens
cacauuccaugcccaagua

SEQ ID NO: 239102 - RNA, 19 nt, Homo sapiens
guucauagucagaauugua

SEQ ID NO: 239103 - RNA, 19 nt, Homo sapiens
gaagagugaagacauaaag

SEQ ID NO: 239104 - RNA, 19 nt, Homo sapiens
ggacaagacaggcagagau

SEQ ID NO: 239105 - RNA, 19 nt, Homo sapiens
gagauacacagauauauac

SEQ ID NO: 239106 - RNA, 19 nt, Homo sapiens
acagagauacacagauaua

SEQ ID NO: 239107 - RNA, 19 nt, Homo sapiens
caagacaggcagagaucua

SEQ ID NO: 239108 - RNA, 19 nt, Homo sapiens
gacaggcagagaucuauaa

SEQ ID NO: 239109 - RNA, 19 nt, Homo sapiens
gaacagcagcccggauuca

SEQ ID NO: 239110 - RNA, 19 nt, Homo sapiens
aggaggugcugcccaagua

SEQ ID NO: 239111 - RNA, 19 nt, Homo sapiens
uagccugccuggacaagaa

SEQ ID NO: 239112 - RNA, 19 nt, Homo sapiens
agaggaaagugaccagugu

SEQ ID NO: 239113 - RNA, 19 nt, Homo sapiens
gacagcagccuggccagua

SEQ ID NO: 239114 - RNA, 19 nt, Homo sapiens
ugcggcagcucaacaugua

SEQ ID NO: 239115 - RNA, 19 nt, Homo sapiens
aacagaaagucgucaacaa

SEQ ID NO: 239116 - RNA, 19 nt, Homo sapiens
ccaagcuccuggccaugaa

SEQ ID NO: 239117 - RNA, 19 nt, Homo sapiens
gaacaucaagaggaaagug

SEQ ID NO: 239118 - RNA, 19 nt, Homo sapiens
gcacauuccaugcccaagu

SEQ ID NO: 239119 - RNA, 19 nt, Homo sapiens
caacaagcucauucaguuc

SEQ ID NO: 239120 - RNA, 19 nt, Homo sapiens
uguccacccugaagaguga

SEQ ID NO: 239121 - RNA, 19 nt, Homo sapiens
uaaacagacaggcucuaaa

SEQ ID NO: 239122 - RNA, 19 nt, Homo sapiens
acaagaaugagcucaguga

SEQ ID NO: 239123 - RNA, 19 nt, Homo sapiens
caacagaaagucgucaaca

SEQ ID NO: 239124 - RNA, 19 nt, Homo sapiens
acaacaacauggccagcuu

SEQ ID NO: 239125 - RNA, 19 nt, Homo sapiens
ugacggacgugcagcugau

SEQ ID NO: 239126 - RNA, 19 nt, Homo sapiens
uggauaaccugcagaccau

SEQ ID NO: 239127 - RNA, 19 nt, Homo sapiens
gagaacaucaagaggaaag

SEQ ID NO: 239128 - RNA, 19 nt, Homo sapiens
agagaucuauaaacagaca

SEQ ID NO: 239129 - RNA, 19 nt, Homo sapiens
acagcagccuggccaguau

SEQ ID NO: 239130 - RNA, 19 nt, Homo sapiens
gacaagacaggcagagauc

SEQ ID NO: 239131 - RNA, 19 nt, Homo sapiens
gagugaagacauaaagauc

SEQ ID NO: 239132 - RNA, 19 nt, Homo sapiens
aaacagacaggcucuaaaa

SEQ ID NO: 239133 - RNA, 19 nt, Homo sapiens
gagccugccugaccuugac

SEQ ID NO: 239134 - RNA, 19 nt, Homo sapiens
gacugacccugcagguugu

SEQ ID NO: 239135 - RNA, 19 nt, Homo sapiens
agacaggcagagaucuaua

SEQ ID NO: 239136 - RNA, 19 nt, Homo sapiens
acagaaagucgucaacaag

SEQ ID NO: 239137 - RNA, 19 nt, Homo sapiens
auaaacagacaggcucuaa

SEQ ID NO: 239138 - RNA, 19 nt, Homo sapiens
ggaagcaggagugcaugga

SEQ ID NO: 239139 - RNA, 19 nt, Homo sapiens
ugaagagugaagacauaaa

SEQ ID NO: 239140 - RNA, 19 nt, Homo sapiens
ccuccuugcucgagaugga

SEQ ID NO: 239141 - RNA, 19 nt, Homo sapiens
agaaagucgucaacaagcu

SEQ ID NO: 239142 - RNA, 19 nt, Homo sapiens
ccaaguauagccggcaguu

SEQ ID NO: 239143 - RNA, 19 nt, Homo sapiens
guucgaccagggccaguuu

SEQ ID NO: 239144 - RNA, 19 nt, Homo sapiens
agagagacgacacggaguu

SEQ ID NO: 239145 - RNA, 19 nt, Homo sapiens
agagugaagacauaaagau

SEQ ID NO: 239146 - RNA, 19 nt, Homo sapiens
cagagauacacagauauau

SEQ ID NO: 239147 - RNA, 19 nt, Homo sapiens
cccaucaucuccgacauca

SEQ ID NO: 239148 - RNA, 19 nt, Homo sapiens
gagagacgacacggaguuc

SEQ ID NO: 239149 - RNA, 19 nt, Homo sapiens
aagcaugcccagcaacaga

SEQ ID NO: 239150 - RNA, 19 nt, Homo sapiens
cgaccugccggugcuguuu

SEQ ID NO: 239151 - RNA, 19 nt, Homo sapiens
gugaccacuuggaugcuau

SEQ ID NO: 239152 - RNA, 19 nt, Homo sapiens
gcagcuccuugagaacauc

SEQ ID NO: 239153 - RNA, 19 nt, Homo sapiens
gcaugcccagcaacagaaa

SEQ ID NO: 239154 - RNA, 19 nt, Homo sapiens
ggaaggaggugucagaauu

SEQ ID NO: 239155 - RNA, 19 nt, Homo sapiens
uuacucagcugcauaguua

SEQ ID NO: 239156 - RNA, 19 nt, Homo sapiens
gaacauaaagugccuguau

SEQ ID NO: 239157 - RNA, 19 nt, Homo sapiens
gaaagauuguccaguuuau

SEQ ID NO: 239158 - RNA, 19 nt, Homo sapiens
gcacaacagcaacaaguua

SEQ ID NO: 239159 - RNA, 19 nt, Homo sapiens
gaaggaggugucagaauua

SEQ ID NO: 239160 - RNA, 19 nt, Homo sapiens
agaaagagaugguccugua

SEQ ID NO: 239161 - RNA, 19 nt, Homo sapiens
ucaaagacguuuauucaug

SEQ ID NO: 239162 - RNA, 19 nt, Homo sapiens
caaugaauguugaguacua

SEQ ID NO: 239163 - RNA, 19 nt, Homo sapiens
ggaagacaauuuagcauag

SEQ ID NO: 239164 - RNA, 19 nt, Homo sapiens
guucagagaaguucauuua

SEQ ID NO: 239165 - RNA, 19 nt, Homo sapiens
gcagagcuuucagguguua

SEQ ID NO: 239166 - RNA, 19 nt, Homo sapiens
ucaaagaaccaacugauaa

SEQ ID NO: 239167 - RNA, 19 nt, Homo sapiens
caaagacguuuauucaugu

SEQ ID NO: 239168 - RNA, 19 nt, Homo sapiens
gggagaggauuucagauga

SEQ ID NO: 239169 - RNA, 19 nt, Homo sapiens
cagagaaguucauuuaugu

SEQ ID NO: 239170 - RNA, 19 nt, Homo sapiens
ugaggcaacugaauaugua

SEQ ID NO: 239171 - RNA, 19 nt, Homo sapiens
ccaaauauuucaagcacaa

SEQ ID NO: 239172 - RNA, 19 nt, Homo sapiens
ucagagaaguucauuuaug

SEQ ID NO: 239173 - RNA, 19 nt, Homo sapiens
ccacagauuacaucaauaa

SEQ ID NO: 239174 - RNA, 19 nt, Homo sapiens
gaaccuguuucagcacaua

SEQ ID NO: 239175 - RNA, 19 nt, Homo sapiens
uaucgacucuggaauugua

SEQ ID NO: 239176 - RNA, 19 nt, Homo sapiens
gaagacaauuuagcauaga

SEQ ID NO: 239177 - RNA, 19 nt, Homo sapiens
gguuccagcuccauauaua

SEQ ID NO: 239178 - RNA, 19 nt, Homo sapiens
uaaagugccuguaucuugu

SEQ ID NO: 239179 - RNA, 19 nt, Homo sapiens
uggauuaucuugacaguau

SEQ ID NO: 239180 - RNA, 19 nt, Homo sapiens
agguugagcuguuggauua

SEQ ID NO: 239181 - RNA, 19 nt, Homo sapiens
guccaggcuuucugaauua

SEQ ID NO: 239182 - RNA, 19 nt, Homo sapiens
gagcaaagcaugcacaaca

SEQ ID NO: 239183 - RNA, 19 nt, Homo sapiens
gagaaugagucccuuugga

SEQ ID NO: 239184 - RNA, 19 nt, Homo sapiens
gagaugguccuguagaauu

SEQ ID NO: 239185 - RNA, 19 nt, Homo sapiens
gcagaugaaucccacagau

SEQ ID NO: 239186 - RNA, 19 nt, Homo sapiens
cgaaagauuguccaguuua

SEQ ID NO: 239187 - RNA, 19 nt, Homo sapiens
gcucagaagguucagauaa

SEQ ID NO: 239188 - RNA, 19 nt, Homo sapiens
gaacccugcuucuucuguu

SEQ ID NO: 239189 - RNA, 19 nt, Homo sapiens
gaagauccagugaccauga

SEQ ID NO: 239190 - RNA, 19 nt, Homo sapiens
aaucagauacuguggaaua

SEQ ID NO: 239191 - RNA, 19 nt, Homo sapiens
gaaacuaccaagaacaaug

SEQ ID NO: 239192 - RNA, 19 nt, Homo sapiens
gauuagaaacuaccaagaa

SEQ ID NO: 239193 - RNA, 19 nt, Homo sapiens
guucaaagacguuuauuca

SEQ ID NO: 239194 - RNA, 19 nt, Homo sapiens
gcaacaaguuauucgaaag

SEQ ID NO: 239195 - RNA, 19 nt, Homo sapiens
guacauaucgacucuggaa

SEQ ID NO: 239196 - RNA, 19 nt, Homo sapiens
gcacauuauuggcguaucu

SEQ ID NO: 239197 - RNA, 19 nt, Homo sapiens
cauagaaguugaugagcuu

SEQ ID NO: 239198 - RNA, 19 nt, Homo sapiens
gaaugaaccagccagagaa

SEQ ID NO: 239199 - RNA, 19 nt, Homo sapiens
gaagaaaauaucccaguua

SEQ ID NO: 239200 - RNA, 19 nt, Homo sapiens
uaaaaggccucuacuucua

SEQ ID NO: 239201 - RNA, 19 nt, Homo sapiens
acaauaauauggcaagcuu

SEQ ID NO: 239202 - RNA, 19 nt, Homo sapiens
caaguuauucgaaagauug

SEQ ID NO: 239203 - RNA, 19 nt, Homo sapiens
guucgaacgugccggcuuu

SEQ ID NO: 239204 - RNA, 19 nt, Homo sapiens
gcguucggguguagaauuu

SEQ ID NO: 239205 - RNA, 19 nt, Homo sapiens
cuaaugguauaacuccuaa

SEQ ID NO: 239206 - RNA, 19 nt, Homo sapiens
gaaacuaaugaggauguua

SEQ ID NO: 239207 - RNA, 19 nt, Homo sapiens
gauaaacccauagaaguug

SEQ ID NO: 239208 - RNA, 19 nt, Homo sapiens
gggaaagguugagcuguug

SEQ ID NO: 239209 - RNA, 19 nt, Homo sapiens
caaagaaccaacugauaau

SEQ ID NO: 239210 - RNA, 19 nt, Homo sapiens
caaaauaaccaacuuguga

SEQ ID NO: 239211 - RNA, 19 nt, Homo sapiens
caacaaguuauucgaaaga

SEQ ID NO: 239212 - RNA, 19 nt, Homo sapiens
cuauuugcauugaguguaa

SEQ ID NO: 239213 - RNA, 19 nt, Homo sapiens
uugaugagcuucuggauag

SEQ ID NO: 239214 - RNA, 19 nt, Homo sapiens
gagaaguucauuuauguuc

SEQ ID NO: 239215 - RNA, 19 nt, Homo sapiens
gcuaucaggaagacaauuu

SEQ ID NO: 239216 - RNA, 19 nt, Homo sapiens
gccagagaaucccuaaguu

SEQ ID NO: 239217 - RNA, 19 nt, Homo sapiens
caagggagaggauuucaga

SEQ ID NO: 239218 - RNA, 19 nt, Homo sapiens
ucgaaagauuguccaguuu

SEQ ID NO: 239219 - RNA, 19 nt, Homo sapiens
agaugguccuguagaauuu

SEQ ID NO: 239220 - RNA, 19 nt, Homo sapiens
ggaauuguaaagcaagaaa

SEQ ID NO: 239221 - RNA, 19 nt, Homo sapiens
cauaucgacucuggaauug

SEQ ID NO: 239222 - RNA, 19 nt, Homo sapiens
gcauugaguguaagucauu

SEQ ID NO: 239223 - RNA, 19 nt, Homo sapiens
gccauugacugaagcugaa

SEQ ID NO: 239224 - RNA, 19 nt, Homo sapiens
gcacauagucaaagaacca

SEQ ID NO: 239225 - RNA, 19 nt, Homo sapiens
cucagaagguucagauaaa

SEQ ID NO: 239226 - RNA, 19 nt, Homo sapiens
caacaggaaagacaaagug

SEQ ID NO: 239227 - RNA, 19 nt, Homo sapiens
uuaaucagauacuguggaa

SEQ ID NO: 239228 - RNA, 19 nt, Homo sapiens
guagauaaacccauagaag

SEQ ID NO: 239229 - RNA, 19 nt, Homo sapiens
cagcagcccucucaugucu

SEQ ID NO: 239230 - RNA, 19 nt, Homo sapiens
ucugaucccuccaacugua

SEQ ID NO: 239231 - RNA, 19 nt, Homo sapiens
caacugaauauguaugguu

SEQ ID NO: 239232 - RNA, 19 nt, Homo sapiens
ccagaaccaacccaaagua

SEQ ID NO: 239233 - RNA, 19 nt, Homo sapiens
caauguaguucagccaguu

SEQ ID NO: 239234 - RNA, 19 nt, Homo sapiens
gcagcccucucaugucuag

SEQ ID NO: 239235 - RNA, 19 nt, Homo sapiens
cguugaagaugacaaugaa

SEQ ID NO: 239236 - RNA, 19 nt, Homo sapiens
ccaguacccugauauuguc

SEQ ID NO: 239237 - RNA, 19 nt, Homo sapiens
ucauaaaguuccacacagu

SEQ ID NO: 239238 - RNA, 19 nt, Homo sapiens
uagaauuucagcauccuua

SEQ ID NO: 239239 - RNA, 19 nt, Homo sapiens
aagcuucucugcuccaguu

SEQ ID NO: 239240 - RNA, 19 nt, Homo sapiens
guuugaugcugucuauuug

SEQ ID NO: 239241 - RNA, 19 nt, Homo sapiens
gaaccaacccaaaguaagc

SEQ ID NO: 239242 - RNA, 19 nt, Homo sapiens
gaagaugacaaugaagaug

SEQ ID NO: 239243 - RNA, 19 nt, Homo sapiens
gucaaagaaccaacugaua

SEQ ID NO: 239244 - RNA, 19 nt, Homo sapiens
aguccaggcuuucugaauu

SEQ ID NO: 239245 - RNA, 19 nt, Homo sapiens
gcauaguuacgcagaugua

SEQ ID NO: 239246 - RNA, 19 nt, Homo sapiens
guacaacagcaucaucaga

SEQ ID NO: 239247 - RNA, 19 nt, Homo sapiens
ugggaaagguugagcuguu

SEQ ID NO: 239248 - RNA, 19 nt, Homo sapiens
cagagaaucccuaaguuca

SEQ ID NO: 239249 - RNA, 19 nt, Homo sapiens
gagaggauuucagaugaca

SEQ ID NO: 239250 - RNA, 19 nt, Homo sapiens
cauaaaguuccacacagua

SEQ ID NO: 239251 - RNA, 19 nt, Homo sapiens
ccaguuuauuguuacauug

SEQ ID NO: 239252 - RNA, 19 nt, Homo sapiens
ucagcauccuuacuucaaa

SEQ ID NO: 239253 - RNA, 19 nt, Homo sapiens
auaaagugccuguaucuug

SEQ ID NO: 239254 - RNA, 19 nt, Homo sapiens
gacuaucccugcacauaaa

SEQ ID NO: 239255 - RNA, 19 nt, Homo sapiens
gagacaaauuugggccuua

SEQ ID NO: 239256 - RNA, 19 nt, Homo sapiens
agagaaagcugucccugau

SEQ ID NO: 239257 - RNA, 19 nt, Homo sapiens
cgacuaucccugcacauaa

SEQ ID NO: 239258 - RNA, 19 nt, Homo sapiens
gagaauggacccugaugga

SEQ ID NO: 239259 - RNA, 19 nt, Homo sapiens
gggaccaguuuccucguaa

SEQ ID NO: 239260 - RNA, 19 nt, Homo sapiens
uccagucgccuucuacuua

SEQ ID NO: 239261 - RNA, 19 nt, Homo sapiens
acauggagcuguccuugau

SEQ ID NO: 239262 - RNA, 19 nt, Homo sapiens
gcccaacaccugccaaguu

SEQ ID NO: 239263 - RNA, 19 nt, Homo sapiens
gcaagcugauccagugucu

SEQ ID NO: 239264 - RNA, 19 nt, Homo sapiens
ggacaggagcccagagagu

SEQ ID NO: 239265 - RNA, 19 nt, Homo sapiens
cccaacaccugccaaguuc

SEQ ID NO: 239266 - RNA, 19 nt, Homo sapiens
gcugauccagugucucuuu

SEQ ID NO: 239267 - RNA, 19 nt, Homo sapiens
ggacccugauggacuugga

SEQ ID NO: 239268 - RNA, 19 nt, Homo sapiens
guucaacaccugcccucua

SEQ ID NO: 239269 - RNA, 19 nt, Homo sapiens
caacaccugccaaguucaa

SEQ ID NO: 239270 - RNA, 19 nt, Homo sapiens
ggaagguggugagcaucga

SEQ ID NO: 239271 - RNA, 19 nt, Homo sapiens
cgggaccaguuuccucgua

SEQ ID NO: 239272 - RNA, 19 nt, Homo sapiens
ggaccaguuuccucguaag

SEQ ID NO: 239273 - RNA, 19 nt, Homo sapiens
gggcuuuaaccauuuauag

SEQ ID NO: 239274 - RNA, 19 nt, Homo sapiens
agacaaauuugggccuuag

SEQ ID NO: 239275 - RNA, 19 nt, Homo sapiens
ccgacuaucccugcacaua

SEQ ID NO: 239276 - RNA, 19 nt, Homo sapiens
gaaccugcagggccucuag

SEQ ID NO: 239277 - RNA, 19 nt, Homo sapiens
gagaaagcugucccugaug

SEQ ID NO: 239278 - RNA, 19 nt, Homo sapiens
cagcagcaccgggucauug

SEQ ID NO: 239279 - RNA, 19 nt, Homo sapiens
ugggcgaggugcaggcuuu

SEQ ID NO: 239280 - RNA, 19 nt, Homo sapiens
gcuuuaaccauuuauagca

SEQ ID NO: 239281 - RNA, 19 nt, Homo sapiens
aauggacccugauggacuu

SEQ ID NO: 239282 - RNA, 19 nt, Homo sapiens
cccaguauuucaagcauag

SEQ ID NO: 239283 - RNA, 19 nt, Homo sapiens
ccagucgccuucuacuuac

SEQ ID NO: 239284 - RNA, 19 nt, Homo sapiens
ugacaucccagaagacucu

SEQ ID NO: 239285 - RNA, 19 nt, Homo sapiens
cagcagaacgagaucuugu

SEQ ID NO: 239286 - RNA, 19 nt, Homo sapiens
cugcagggccucuagaugu

SEQ ID NO: 239287 - RNA, 19 nt, Homo sapiens
ugauggacuuggacaugga

SEQ ID NO: 239288 - RNA, 19 nt, Homo sapiens
gcccaggaaugcccaacag

SEQ ID NO: 239289 - RNA, 19 nt, Homo sapiens
caaugcaggaggcaagaga

SEQ ID NO: 239290 - RNA, 19 nt, Homo sapiens
uuucaagcauagcaacaug

SEQ ID NO: 239291 - RNA, 19 nt, Homo sapiens
gcagcagaacgagaucuug

SEQ ID NO: 239292 - RNA, 19 nt, Homo sapiens
ugcgccaacucaacaugua

SEQ ID NO: 239293 - RNA, 19 nt, Homo sapiens
agccugagcuggcggucaa

SEQ ID NO: 239294 - RNA, 19 nt, Homo sapiens
ccgcugcacauccuucuug

SEQ ID NO: 239295 - RNA, 19 nt, Homo sapiens
ucaagaaaguguggaaccu

SEQ ID NO: 239296 - RNA, 19 nt, Homo sapiens
gcaggaggcaagagaaagc

SEQ ID NO: 239297 - RNA, 19 nt, Homo sapiens
uaagcgaccagagccguuu

SEQ ID NO: 239298 - RNA, 19 nt, Homo sapiens
gcgagaauggacccugaug

SEQ ID NO: 239299 - RNA, 19 nt, Homo sapiens
ucaggcagcagaacgagau

SEQ ID NO: 239300 - RNA, 19 nt, Homo sapiens
ggagguggcaguagucuua

SEQ ID NO: 239301 - RNA, 19 nt, Homo sapiens
cagaaucgcugcacaguuc

SEQ ID NO: 239302 - RNA, 19 nt, Homo sapiens
ggaggcagcugggaagaaa

SEQ ID NO: 239303 - RNA, 19 nt, Homo sapiens
uugcagagcucuuugauga

SEQ ID NO: 239304 - RNA, 19 nt, Homo sapiens
cauaugaagugcugucuga

SEQ ID NO: 239305 - RNA, 19 nt, Homo sapiens
ccagaaagcugaggagugu

SEQ ID NO: 239306 - RNA, 19 nt, Homo sapiens
gggaggugguguaugguua

SEQ ID NO: 239307 - RNA, 19 nt, Homo sapiens
ggagccagguugcauuuau

SEQ ID NO: 239308 - RNA, 19 nt, Homo sapiens
gggaagaaaugcuggaagu

SEQ ID NO: 239309 - RNA, 19 nt, Homo sapiens
ccucucagcuguccagauu

SEQ ID NO: 239310 - RNA, 19 nt, Homo sapiens
caagcucccuccacaaguu

SEQ ID NO: 239311 - RNA, 19 nt, Homo sapiens
auaaagaguuugcugagaa

SEQ ID NO: 239312 - RNA, 19 nt, Homo sapiens
gagccagguugcauuuauu

SEQ ID NO: 239313 - RNA, 19 nt, Homo sapiens
gaagaaaugcuggaaguca

SEQ ID NO: 239314 - RNA, 19 nt, Homo sapiens
ucaauggugucccagauga

SEQ ID NO: 239315 - RNA, 19 nt, Homo sapiens
gacaggaacuggcccaucu

SEQ ID NO: 239316 - RNA, 19 nt, Homo sapiens
gaagugcguccgcugauga

SEQ ID NO: 239317 - RNA, 19 nt, Homo sapiens
gaaaugcuggaagucaaua

SEQ ID NO: 239318 - RNA, 19 nt, Homo sapiens
gcaugccgcugcuuguaug

SEQ ID NO: 239319 - RNA, 19 nt, Homo sapiens
gaggcuggcucacccugaa

SEQ ID NO: 239320 - RNA, 19 nt, Homo sapiens
gcucugaccgucucuguug

SEQ ID NO: 239321 - RNA, 19 nt, Homo sapiens
ugaagucagucacaaucaa

SEQ ID NO: 239322 - RNA, 19 nt, Homo sapiens
caucuugggacauguagua

SEQ ID NO: 239323 - RNA, 19 nt, Homo sapiens
uuacggagcugugcaucuu

SEQ ID NO: 239324 - RNA, 19 nt, Homo sapiens
ggaggggacugcacccaua

SEQ ID NO: 239325 - RNA, 19 nt, Homo sapiens
gggccuggcuucaccuuca

SEQ ID NO: 239326 - RNA, 19 nt, Homo sapiens
gcgcaucgcuugcuuucac

SEQ ID NO: 239327 - RNA, 19 nt, Homo sapiens
gaggagccagguugcauuu

SEQ ID NO: 239328 - RNA, 19 nt, Homo sapiens
gaagucagucacaaucaau

SEQ ID NO: 239329 - RNA, 19 nt, Homo sapiens
ggagguggccgaggcauau

SEQ ID NO: 239330 - RNA, 19 nt, Homo sapiens
uaaagaguuugcugagaag

SEQ ID NO: 239331 - RNA, 19 nt, Homo sapiens
aagaaaugcuggaagucaa

SEQ ID NO: 239332 - RNA, 19 nt, Homo sapiens
ggacuuggccuaggguugu

SEQ ID NO: 239333 - RNA, 19 nt, Homo sapiens
agaguuugcugagaagaaa

SEQ ID NO: 239334 - RNA, 19 nt, Homo sapiens
gaccgucucuguugcuucu

SEQ ID NO: 239335 - RNA, 19 nt, Homo sapiens
gagcagcagccgucaguca

SEQ ID NO: 239336 - RNA, 19 nt, Homo sapiens
uggcaggguuguagaugaa

SEQ ID NO: 239337 - RNA, 19 nt, Homo sapiens
aaacccagauaauaaagag

SEQ ID NO: 239338 - RNA, 19 nt, Homo sapiens
ggugggagguggcaguagu

SEQ ID NO: 239339 - RNA, 19 nt, Homo sapiens
cugaagaggugggauagga

SEQ ID NO: 239340 - RNA, 19 nt, Homo sapiens
ggcuaggacucccuucuuc

SEQ ID NO: 239341 - RNA, 19 nt, Homo sapiens
ucucagcuguccagauuca

SEQ ID NO: 239342 - RNA, 19 nt, Homo sapiens
aauaaagaguuugcugaga

SEQ ID NO: 239343 - RNA, 19 nt, Homo sapiens
ggagauuuacgaccgcuau

SEQ ID NO: 239344 - RNA, 19 nt, Homo sapiens
guagggcugugagaucuuc

SEQ ID NO: 239345 - RNA, 19 nt, Homo sapiens
cagguugcauuuauuggau

SEQ ID NO: 239346 - RNA, 19 nt, Homo sapiens
ggggagauuuugucuuuug

SEQ ID NO: 239347 - RNA, 19 nt, Homo sapiens
ggacuacaaaucccagagu

SEQ ID NO: 239348 - RNA, 19 nt, Homo sapiens
cgaagugcguccgcugaug

SEQ ID NO: 239349 - RNA, 19 nt, Homo sapiens
cuacaucuaccaccuuugu

SEQ ID NO: 239350 - RNA, 19 nt, Homo sapiens
uguaguagcccaggucuug

SEQ ID NO: 239351 - RNA, 19 nt, Homo sapiens
ccugugcacucucuuccuu

SEQ ID NO: 239352 - RNA, 19 nt, Homo sapiens
ccaaggcccagcaccaaga

SEQ ID NO: 239353 - RNA, 19 nt, Homo sapiens
aaucaauggugucccagau

SEQ ID NO: 239354 - RNA, 19 nt, Homo sapiens
agcacaagcgggagauuua

SEQ ID NO: 239355 - RNA, 19 nt, Homo sapiens
ccaguggcacccagacaaa

SEQ ID NO: 239356 - RNA, 19 nt, Homo sapiens
ggccgaggcauaugaagug

SEQ ID NO: 239357 - RNA, 19 nt, Homo sapiens
gaugccggguuccagaauc

SEQ ID NO: 239358 - RNA, 19 nt, Homo sapiens
gauguguucugagcuggau

SEQ ID NO: 239359 - RNA, 19 nt, Homo sapiens
cccagauaauaaagaguuu

SEQ ID NO: 239360 - RNA, 19 nt, Homo sapiens
gggcugacagggacaggaa

SEQ ID NO: 239361 - RNA, 19 nt, Homo sapiens
uugcuucucuucugguguu

SEQ ID NO: 239362 - RNA, 19 nt, Homo sapiens
cagcagccgucagucacuu

SEQ ID NO: 239363 - RNA, 19 nt, Homo sapiens
gauuucuccuccucaucuu

SEQ ID NO: 239364 - RNA, 19 nt, Homo sapiens
ggagccagucgcuguaaca

SEQ ID NO: 239365 - RNA, 19 nt, Homo sapiens
ccauacugcuucccuacca

SEQ ID NO: 239366 - RNA, 19 nt, Homo sapiens
ccgagaaggccucaaugug

SEQ ID NO: 239367 - RNA, 19 nt, Homo sapiens
ccagguugcauuuauugga

SEQ ID NO: 239368 - RNA, 19 nt, Homo sapiens
cgaggagccagguugcauu

SEQ ID NO: 239369 - RNA, 19 nt, Homo sapiens
gaggaugggcagcugaagu

SEQ ID NO: 239370 - RNA, 19 nt, Homo sapiens
ggaagaaaugcuggaaguc

SEQ ID NO: 239371 - RNA, 19 nt, Homo sapiens
gugcaucuugggacaugua

SEQ ID NO: 239372 - RNA, 19 nt, Homo sapiens
cugcuucccuaccacaaau

SEQ ID NO: 239373 - RNA, 19 nt, Homo sapiens
gcacaagcgggagauuuac

SEQ ID NO: 239374 - RNA, 19 nt, Homo sapiens
ccucagagacgaaccaaaa

SEQ ID NO: 239375 - RNA, 19 nt, Homo sapiens
gguggagccagucgcugua

SEQ ID NO: 239376 - RNA, 19 nt, Homo sapiens
gcccauucuuuccaacauc

SEQ ID NO: 239377 - RNA, 19 nt, Homo sapiens
cuggcaggguuguagauga

SEQ ID NO: 239378 - RNA, 19 nt, Homo sapiens
gcugugagauggggagauu

SEQ ID NO: 239379 - RNA, 19 nt, Homo sapiens
gcccucacccucagacuag

SEQ ID NO: 239380 - RNA, 19 nt, Homo sapiens
cugcuuguauggcuuucuu

SEQ ID NO: 239381 - RNA, 19 nt, Homo sapiens
ccagaaucgcugcacaguu

SEQ ID NO: 239382 - RNA, 19 nt, Homo sapiens
gcaaccaaacgcaguccau

SEQ ID NO: 239383 - RNA, 19 nt, Homo sapiens
cccauucuuuccaacauca

SEQ ID NO: 239384 - RNA, 19 nt, Homo sapiens
ggcuuucuuuggccucuga

SEQ ID NO: 239385 - RNA, 19 nt, Homo sapiens
gcuuguauggcuuucuuug

SEQ ID NO: 239386 - RNA, 19 nt, Homo sapiens
ggcaugccgcugcuuguau

SEQ ID NO: 239387 - RNA, 19 nt, Homo sapiens
gcugagaagaaauuuaagg

SEQ ID NO: 239388 - RNA, 19 nt, Homo sapiens
gggcgcaucgcuugcuuuc

SEQ ID NO: 239389 - RNA, 19 nt, Homo sapiens
aagcacaagcgggagauuu

SEQ ID NO: 239390 - RNA, 19 nt, Homo sapiens
ugguuucugugccauguug

SEQ ID NO: 239391 - RNA, 19 nt, Homo sapiens
aguguggacuugggauuug

SEQ ID NO: 239392 - RNA, 19 nt, Homo sapiens
gaagagaagaggggaguau

SEQ ID NO: 239393 - RNA, 19 nt, Homo sapiens
ucccugggcacuccgauuu

SEQ ID NO: 239394 - RNA, 19 nt, Homo sapiens
ggaauuauaugacaaagga

SEQ ID NO: 239395 - RNA, 19 nt, Homo sapiens
ggagagaaguuuaaacaga

SEQ ID NO: 239396 - RNA, 19 nt, Homo sapiens
gugaaggacuguaaucaua

SEQ ID NO: 239397 - RNA, 19 nt, Homo sapiens
ggaagagacugaugagaug

SEQ ID NO: 239398 - RNA, 19 nt, Homo sapiens
gaagauaguucgagagaag

SEQ ID NO: 239399 - RNA, 19 nt, Homo sapiens
gauaggaccuggaaugguu

SEQ ID NO: 239400 - RNA, 19 nt, Homo sapiens
guagagugcugucccaauu

SEQ ID NO: 239401 - RNA, 19 nt, Homo sapiens
gauaucaaguguguacuaa

SEQ ID NO: 239402 - RNA, 19 nt, Homo sapiens
gaggagaacaggcaauuaa

SEQ ID NO: 239403 - RNA, 19 nt, Homo sapiens
gagagaaguuuaaacagau

SEQ ID NO: 239404 - RNA, 19 nt, Homo sapiens
gaggaaggaugcagagaga

SEQ ID NO: 239405 - RNA, 19 nt, Homo sapiens
ugacaaaugugaagguaga

SEQ ID NO: 239406 - RNA, 19 nt, Homo sapiens
gauaagaacccaaaugaag

SEQ ID NO: 239407 - RNA, 19 nt, Homo sapiens
guacaucagcucucaguaa

SEQ ID NO: 239408 - RNA, 19 nt, Homo sapiens
gaaggacuguaaucauaau

SEQ ID NO: 239409 - RNA, 19 nt, Homo sapiens
gaaguucucucugaugcaa

SEQ ID NO: 239410 - RNA, 19 nt, Homo sapiens
gaucaguccuaaagauaga

SEQ ID NO: 239411 - RNA, 19 nt, Homo sapiens
gaaagauggccagaagaua

SEQ ID NO: 239412 - RNA, 19 nt, Homo sapiens
gaaguaccauccugauaag

SEQ ID NO: 239413 - RNA, 19 nt, Homo sapiens
ucaaguguguacuaaauga

SEQ ID NO: 239414 - RNA, 19 nt, Homo sapiens
gcauggagauaucaagugu

SEQ ID NO: 239415 - RNA, 19 nt, Homo sapiens
ggacauacagcucguugaa

SEQ ID NO: 239416 - RNA, 19 nt, Homo sapiens
aaagauggccagaagauaa

SEQ ID NO: 239417 - RNA, 19 nt, Homo sapiens
gagaacaggcaauuaaaga

SEQ ID NO: 239418 - RNA, 19 nt, Homo sapiens
aaacagauuucucaagcuu

SEQ ID NO: 239419 - RNA, 19 nt, Homo sapiens
ugaaguaccauccugauaa

SEQ ID NO: 239420 - RNA, 19 nt, Homo sapiens
gaaagaaacaacuuacuac

SEQ ID NO: 239421 - RNA, 19 nt, Homo sapiens
gaagauaacauuccauggu

SEQ ID NO: 239422 - RNA, 19 nt, Homo sapiens
agaaacaacuuacuacgau

SEQ ID NO: 239423 - RNA, 19 nt, Homo sapiens
ggaaggaugcagagagaaa

SEQ ID NO: 239424 - RNA, 19 nt, Homo sapiens
ccauggacaucuuugauau

SEQ ID NO: 239425 - RNA, 19 nt, Homo sapiens
aguagaagauggugaaaga

SEQ ID NO: 239426 - RNA, 19 nt, Homo sapiens
auaauaugcucacuacuug

SEQ ID NO: 239427 - RNA, 19 nt, Homo sapiens
gagaagaccuuuucaugug

SEQ ID NO: 239428 - RNA, 19 nt, Homo sapiens
gaagguagaggagguaaga

SEQ ID NO: 239429 - RNA, 19 nt, Homo sapiens
uaucguagaccauaugaaa

SEQ ID NO: 239430 - RNA, 19 nt, Homo sapiens
caugaaagauggccagaag

SEQ ID NO: 239431 - RNA, 19 nt, Homo sapiens
guacuggaaugcaaauaag

SEQ ID NO: 239432 - RNA, 19 nt, Homo sapiens
gguaaacuuuccugagaau

SEQ ID NO: 239433 - RNA, 19 nt, Homo sapiens
gacaaaggcaugaaagaug

SEQ ID NO: 239434 - RNA, 19 nt, Homo sapiens
ggcuuucucucuccugaua

SEQ ID NO: 239435 - RNA, 19 nt, Homo sapiens
aagguaaacuuuccugaga

SEQ ID NO: 239436 - RNA, 19 nt, Homo sapiens
cuuaauggccagugaauaa

SEQ ID NO: 239437 - RNA, 19 nt, Homo sapiens
uaaacugucuuugcuggaa

SEQ ID NO: 239438 - RNA, 19 nt, Homo sapiens
augaaggcaugccaauuua

SEQ ID NO: 239439 - RNA, 19 nt, Homo sapiens
aaugaaggcaugccaauuu

SEQ ID NO: 239440 - RNA, 19 nt, Homo sapiens
gguacuggaaugcaaauaa

SEQ ID NO: 239441 - RNA, 19 nt, Homo sapiens
ggaggagaacaggcaauua

SEQ ID NO: 239442 - RNA, 19 nt, Homo sapiens
ugagauggaccaaguagaa

SEQ ID NO: 239443 - RNA, 19 nt, Homo sapiens
ggaagauaguucgagagaa

SEQ ID NO: 239444 - RNA, 19 nt, Homo sapiens
gcggaucaguccuaaagau

SEQ ID NO: 239445 - RNA, 19 nt, Homo sapiens
caaaugaaggagagaaguu

SEQ ID NO: 239446 - RNA, 19 nt, Homo sapiens
ccacuacaauggagaagca

SEQ ID NO: 239447 - RNA, 19 nt, Homo sapiens
acucacugcuggcauuuaa

SEQ ID NO: 239448 - RNA, 19 nt, Homo sapiens
gaaggcaugccaauuuauc

SEQ ID NO: 239449 - RNA, 19 nt, Homo sapiens
ggagauaucaaguguguac

SEQ ID NO: 239450 - RNA, 19 nt, Homo sapiens
gagcggaucaguccuaaag

SEQ ID NO: 239451 - RNA, 19 nt, Homo sapiens
ugaaggacuguaaucauaa

SEQ ID NO: 239452 - RNA, 19 nt, Homo sapiens
caauuuaucguagaccaua

SEQ ID NO: 239453 - RNA, 19 nt, Homo sapiens
aagccaauaucuacucuug

SEQ ID NO: 239454 - RNA, 19 nt, Homo sapiens
uagaagauggugaaagaaa

SEQ ID NO: 239455 - RNA, 19 nt, Homo sapiens
gaagauggugaaagaaaca

SEQ ID NO: 239456 - RNA, 19 nt, Homo sapiens
uagaacugguggacuuuga

SEQ ID NO: 239457 - RNA, 19 nt, Homo sapiens
gagaagcauaugaggauga

SEQ ID NO: 239458 - RNA, 19 nt, Homo sapiens
gccuaaucaucgaauuuaa

SEQ ID NO: 239459 - RNA, 19 nt, Homo sapiens
gaaaagggucgccuaauca

SEQ ID NO: 239460 - RNA, 19 nt, Homo sapiens
uggaaugguucagcaaauu

SEQ ID NO: 239461 - RNA, 19 nt, Homo sapiens
ggagaacaggcaauuaaag

SEQ ID NO: 239462 - RNA, 19 nt, Homo sapiens
gccaauaucuacucuugac

SEQ ID NO: 239463 - RNA, 19 nt, Homo sapiens
gauaacauuccauggugaa

SEQ ID NO: 239464 - RNA, 19 nt, Homo sapiens
uaagaaaggagcaguagag

SEQ ID NO: 239465 - RNA, 19 nt, Homo sapiens
gcucacuacuugcucuugu

SEQ ID NO: 239466 - RNA, 19 nt, Homo sapiens
gaagaccuuuucaugugua

SEQ ID NO: 239467 - RNA, 19 nt, Homo sapiens
gggagcggaucaguccuaa

SEQ ID NO: 239468 - RNA, 19 nt, Homo sapiens
ucagauaggaccuggaaug

SEQ ID NO: 239469 - RNA, 19 nt, Homo sapiens
caggucagauugucaagca

SEQ ID NO: 239470 - RNA, 19 nt, Homo sapiens
ugaaagauggccagaagau

SEQ ID NO: 239471 - RNA, 19 nt, Homo sapiens
cggaucaguccuaaagaua

SEQ ID NO: 239472 - RNA, 19 nt, Homo sapiens
cugauaagaacccaaauga

SEQ ID NO: 239473 - RNA, 19 nt, Homo sapiens
caauaucuacucuugacaa

SEQ ID NO: 239474 - RNA, 19 nt, Homo sapiens
ccaaugcuacucaggaaga

SEQ ID NO: 239475 - RNA, 19 nt, Homo sapiens
caucagauaggaccuggaa

SEQ ID NO: 239476 - RNA, 19 nt, Homo sapiens
uagaggagguaagaaagga

SEQ ID NO: 239477 - RNA, 19 nt, Homo sapiens
cuuacgaaguucucucuga

SEQ ID NO: 239478 - RNA, 19 nt, Homo sapiens
aagcauaugaggaugauga

SEQ ID NO: 239479 - RNA, 19 nt, Homo sapiens
aaacugucuuugcuggaaa

SEQ ID NO: 239480 - RNA, 19 nt, Homo sapiens
uaagaacccaaaugaagga

SEQ ID NO: 239481 - RNA, 19 nt, Homo sapiens
uuacgaaguucucucugau

SEQ ID NO: 239482 - RNA, 19 nt, Homo sapiens
gagagaaaggagagguaaa

SEQ ID NO: 239483 - RNA, 19 nt, Homo sapiens
cugaugagauggaccaagu

SEQ ID NO: 239484 - RNA, 19 nt, Homo sapiens
cgccuaaucaucgaauuua

SEQ ID NO: 239485 - RNA, 19 nt, Homo sapiens
uaaaugaaggcaugccaau

SEQ ID NO: 239486 - RNA, 19 nt, Homo sapiens
caaccgaaccaucgucauc

SEQ ID NO: 239487 - RNA, 19 nt, Homo sapiens
gcaaauaagaauucaucag

SEQ ID NO: 239488 - RNA, 19 nt, Homo sapiens
uauaauggugcaacaagaa

SEQ ID NO: 239489 - RNA, 19 nt, Homo sapiens
aaugugcaguagugaauga

SEQ ID NO: 239490 - RNA, 19 nt, Homo sapiens
cauaugaggaugaugaaca

SEQ ID NO: 239491 - RNA, 19 nt, Homo sapiens
gaacugguggacuuugauc

SEQ ID NO: 239492 - RNA, 19 nt, Homo sapiens
gaaggaaguggaagagacu

SEQ ID NO: 239493 - RNA, 19 nt, Homo sapiens
ugaaaagggucgccuaauc

SEQ ID NO: 239494 - RNA, 19 nt, Homo sapiens
gcaacgugcucaucuuuga

SEQ ID NO: 239495 - RNA, 19 nt, Homo sapiens
gagaucgacucccuguuug

SEQ ID NO: 239496 - RNA, 19 nt, Homo sapiens
gacuuugcauuuccuagua

SEQ ID NO: 239497 - RNA, 19 nt, Homo sapiens
agaagaaggugcuggacaa

SEQ ID NO: 239498 - RNA, 19 nt, Homo sapiens
acacuuaacucaggccauu

SEQ ID NO: 239499 - RNA, 19 nt, Homo sapiens
gaauuuauacugccaucuu

SEQ ID NO: 239500 - RNA, 19 nt, Homo sapiens
guuugucaguucucaauuu

SEQ ID NO: 239501 - RNA, 19 nt, Homo sapiens
uggaggaguucaagagaaa

SEQ ID NO: 239502 - RNA, 19 nt, Homo sapiens
ugaccaagaugaaggagau

SEQ ID NO: 239503 - RNA, 19 nt, Homo sapiens
agaaggugcuggacaagug

SEQ ID NO: 239504 - RNA, 19 nt, Homo sapiens
gaagagcgccguggaggau

SEQ ID NO: 239505 - RNA, 19 nt, Homo sapiens
gaucaacgacggagacaag

SEQ ID NO: 239506 - RNA, 19 nt, Homo sapiens
gaucgacgacggcaucuuc

SEQ ID NO: 239507 - RNA, 19 nt, Homo sapiens
gcuucaagacuuugcauuu

SEQ ID NO: 239508 - RNA, 19 nt, Homo sapiens
gcgcaacgugcucaucuuu

SEQ ID NO: 239509 - RNA, 19 nt, Homo sapiens
guggaggaguucaagagaa

SEQ ID NO: 239510 - RNA, 19 nt, Homo sapiens
gaaccggcauggccaaagc

SEQ ID NO: 239511 - RNA, 19 nt, Homo sapiens
agaacgcccuggaguccua

SEQ ID NO: 239512 - RNA, 19 nt, Homo sapiens
gagagggugucagccaaga

SEQ ID NO: 239513 - RNA, 19 nt, Homo sapiens
agaaggacaucagccagaa

SEQ ID NO: 239514 - RNA, 19 nt, Homo sapiens
agagggccaugacgaaaga

SEQ ID NO: 239515 - RNA, 19 nt, Homo sapiens
gcgcugaacccgcagaaca

SEQ ID NO: 239516 - RNA, 19 nt, Homo sapiens
guauuucuguuugucaguu

SEQ ID NO: 239517 - RNA, 19 nt, Homo sapiens
cuucaagacuuugcauuuc

SEQ ID NO: 239518 - RNA, 19 nt, Homo sapiens
cgugaugacugcccugauc

SEQ ID NO: 239519 - RNA, 19 nt, Homo sapiens
ggacgaguuugagcacaag

SEQ ID NO: 239520 - RNA, 19 nt, Homo sapiens
gcgagagggccaugacgaa

SEQ ID NO: 239521 - RNA, 19 nt, Homo sapiens
ccaagcagacgcagaucuu

SEQ ID NO: 239522 - RNA, 19 nt, Homo sapiens
gggaggacuuugacaacag

SEQ ID NO: 239523 - RNA, 19 nt, Homo sapiens
ccaaggugcaggugagcua

SEQ ID NO: 239524 - RNA, 19 nt, Homo sapiens
ccgagaaggacgaguuuga

SEQ ID NO: 239525 - RNA, 19 nt, Homo sapiens
gaccugaacaagagcauca

SEQ ID NO: 239526 - RNA, 19 nt, Homo sapiens
ggacaucagccagaacaag

SEQ ID NO: 239527 - RNA, 19 nt, Homo sapiens
gcagagaugaauuuauacu

SEQ ID NO: 239528 - RNA, 19 nt, Homo sapiens
guucucaauuuccuguguu

SEQ ID NO: 239529 - RNA, 19 nt, Homo sapiens
ugcaggaggcggagaagua

SEQ ID NO: 239530 - RNA, 19 nt, Homo sapiens
ccaccaagcagacgcagau

SEQ ID NO: 239531 - RNA, 19 nt, Homo sapiens
ugacgaaagacaacaaucu

SEQ ID NO: 239532 - RNA, 19 nt, Homo sapiens
agaaccagguggcgcugaa

SEQ ID NO: 239533 - RNA, 19 nt, Homo sapiens
guccuacgccuucaacaug

SEQ ID NO: 239534 - RNA, 19 nt, Homo sapiens
gacgaaagacaacaaucug

SEQ ID NO: 239535 - RNA, 19 nt, Homo sapiens
caucuuacgacuauuucuu

SEQ ID NO: 239536 - RNA, 19 nt, Homo sapiens
uacaugcagagaugaauuu

SEQ ID NO: 239537 - RNA, 19 nt, Homo sapiens
gaaggugcuggacaagugu

SEQ ID NO: 239538 - RNA, 19 nt, Homo sapiens
gcgacaguccacuaccuuu

SEQ ID NO: 239539 - RNA, 19 nt, Homo sapiens
ggacaaggcccagauucac

SEQ ID NO: 239540 - RNA, 19 nt, Homo sapiens
ggacaccaaggcauucuac

SEQ ID NO: 239541 - RNA, 19 nt, Homo sapiens
cuacaugcagagaugaauu

SEQ ID NO: 239542 - RNA, 19 nt, Homo sapiens
gagagggccaugacgaaag

SEQ ID NO: 239543 - RNA, 19 nt, Homo sapiens
cgagagggccaugacgaaa

SEQ ID NO: 239544 - RNA, 19 nt, Homo sapiens
gcugugcuccgaccuguuc

SEQ ID NO: 239545 - RNA, 19 nt, Homo sapiens
guuucuacaugcagagaug

SEQ ID NO: 239546 - RNA, 19 nt, Homo sapiens
ggcgcgaccugaacaagag

SEQ ID NO: 239547 - RNA, 19 nt, Homo sapiens
ucaauuuccuguguuugca

SEQ ID NO: 239548 - RNA, 19 nt, Homo sapiens
gaagaaggugcuggacaag

SEQ ID NO: 239549 - RNA, 19 nt, Homo sapiens
acugccaucuuacgacuau

SEQ ID NO: 239550 - RNA, 19 nt, Homo sapiens
agagcgccguggaggauga

SEQ ID NO: 239551 - RNA, 19 nt, Homo sapiens
ucucgcggauccaguguuc

SEQ ID NO: 239552 - RNA, 19 nt, Homo sapiens
caaggaugcgggugugauc

SEQ ID NO: 239553 - RNA, 19 nt, Homo sapiens
ggccgagaaggacgaguuu

SEQ ID NO: 239554 - RNA, 19 nt, Homo sapiens
gcaggaggcggagaaguac

SEQ ID NO: 239555 - RNA, 19 nt, Homo sapiens
ccaacggcauccugaacgu

SEQ ID NO: 239556 - RNA, 19 nt, Homo sapiens
uugagggcaucgacuucua

SEQ ID NO: 239557 - RNA, 19 nt, Homo sapiens
uuuggagcuucaagacuuu

SEQ ID NO: 239558 - RNA, 19 nt, Homo sapiens
caucaucagcggacuguac

SEQ ID NO: 239559 - RNA, 19 nt, Homo sapiens
guggugcagucggacauga

SEQ ID NO: 239560 - RNA, 19 nt, Homo sapiens
gauccaguguuccguuucc

SEQ ID NO: 239561 - RNA, 19 nt, Homo sapiens
uuugucaguucucaauuuc

SEQ ID NO: 239562 - RNA, 19 nt, Homo sapiens
acaugaagcacuggccuuu

SEQ ID NO: 239563 - RNA, 19 nt, Homo sapiens
uccuacgccuucaacauga

SEQ ID NO: 239564 - RNA, 19 nt, Homo sapiens
gggugcugauccaggugua

SEQ ID NO: 239565 - RNA, 19 nt, Homo sapiens
guaauuagcuggcuucauu

SEQ ID NO: 239566 - RNA, 19 nt, Homo sapiens
gcaacgugcucaucuuuga

SEQ ID NO: 239567 - RNA, 19 nt, Homo sapiens
uuagcuggcuucauuauuu

SEQ ID NO: 239568 - RNA, 19 nt, Homo sapiens
gcaccggcguguugaguuu

SEQ ID NO: 239569 - RNA, 19 nt, Homo sapiens
caaccgauauguucauuag

SEQ ID NO: 239570 - RNA, 19 nt, Homo sapiens
gagaucgacucccuguuug

SEQ ID NO: 239571 - RNA, 19 nt, Homo sapiens
cugcuucacuucuuuguaa

SEQ ID NO: 239572 - RNA, 19 nt, Homo sapiens
gcucuuugcugcuucacuu

SEQ ID NO: 239573 - RNA, 19 nt, Homo sapiens
ggucaggcccuaccauuga

SEQ ID NO: 239574 - RNA, 19 nt, Homo sapiens
ccauugaggagguggauua

SEQ ID NO: 239575 - RNA, 19 nt, Homo sapiens
gggccuuuguucuuuagua

SEQ ID NO: 239576 - RNA, 19 nt, Homo sapiens
uggaggaguucaagagaaa

SEQ ID NO: 239577 - RNA, 19 nt, Homo sapiens
ugaccaagaugaaggagau

SEQ ID NO: 239578 - RNA, 19 nt, Homo sapiens
guuguaaccugaugguaau

SEQ ID NO: 239579 - RNA, 19 nt, Homo sapiens
gguguuucguucccuuuaa

SEQ ID NO: 239580 - RNA, 19 nt, Homo sapiens
ggacuuugcugcuguuuuc

SEQ ID NO: 239581 - RNA, 19 nt, Homo sapiens
gaagagcgccguggaggau

SEQ ID NO: 239582 - RNA, 19 nt, Homo sapiens
gaucaacgacggagacaag

SEQ ID NO: 239583 - RNA, 19 nt, Homo sapiens
gaucgacgacggcaucuuc

SEQ ID NO: 239584 - RNA, 19 nt, Homo sapiens
ccgaaggacugagcucuug

SEQ ID NO: 239585 - RNA, 19 nt, Homo sapiens
gcgcaacgugcucaucuuu

SEQ ID NO: 239586 - RNA, 19 nt, Homo sapiens
guggaggaguucaagagaa

SEQ ID NO: 239587 - RNA, 19 nt, Homo sapiens
cuacaaaggcugggaaugu

SEQ ID NO: 239588 - RNA, 19 nt, Homo sapiens
agaacgcccuggaguccua

SEQ ID NO: 239589 - RNA, 19 nt, Homo sapiens
gagagggugucagccaaga

SEQ ID NO: 239590 - RNA, 19 nt, Homo sapiens
accgauauguucauuagaa

SEQ ID NO: 239591 - RNA, 19 nt, Homo sapiens
gaggguccgcuucgucuuu

SEQ ID NO: 239592 - RNA, 19 nt, Homo sapiens
caaggacuuugcugcuguu

SEQ ID NO: 239593 - RNA, 19 nt, Homo sapiens
ggccuuuguucuuuaguau

SEQ ID NO: 239594 - RNA, 19 nt, Homo sapiens
agaaggacaucagccagaa

SEQ ID NO: 239595 - RNA, 19 nt, Homo sapiens
guaaccugaugguaauuag

SEQ ID NO: 239596 - RNA, 19 nt, Homo sapiens
ucuuugagguggacuguug

SEQ ID NO: 239597 - RNA, 19 nt, Homo sapiens
agagggccaugacgaaaga

SEQ ID NO: 239598 - RNA, 19 nt, Homo sapiens
guaguacaaccgauauguu

SEQ ID NO: 239599 - RNA, 19 nt, Homo sapiens
gcgcugaacccgcagaaca

SEQ ID NO: 239600 - RNA, 19 nt, Homo sapiens
guguuucguucccuuuaaa

SEQ ID NO: 239601 - RNA, 19 nt, Homo sapiens
cgugaugacugcccugauc

SEQ ID NO: 239602 - RNA, 19 nt, Homo sapiens
ggacgaguuugagcacaag

SEQ ID NO: 239603 - RNA, 19 nt, Homo sapiens
gcgagagggccaugacgaa

SEQ ID NO: 239604 - RNA, 19 nt, Homo sapiens
ccaagcagacgcagaucuu

SEQ ID NO: 239605 - RNA, 19 nt, Homo sapiens
gggaggacuuugacaacag

SEQ ID NO: 239606 - RNA, 19 nt, Homo sapiens
ccaaggugcaggugagcua

SEQ ID NO: 239607 - RNA, 19 nt, Homo sapiens
ccgagaaggacgaguuuga

SEQ ID NO: 239608 - RNA, 19 nt, Homo sapiens
gaccugaacaagagcauca

SEQ ID NO: 239609 - RNA, 19 nt, Homo sapiens
ggacaucagccagaacaag

SEQ ID NO: 239610 - RNA, 19 nt, Homo sapiens
ugcaggaggcggagaagua

SEQ ID NO: 239611 - RNA, 19 nt, Homo sapiens
ccaccaagcagacgcagau

SEQ ID NO: 239612 - RNA, 19 nt, Homo sapiens
ccgauauguucauuagaau

SEQ ID NO: 239613 - RNA, 19 nt, Homo sapiens
ccuuuguucuuuaguaugu

SEQ ID NO: 239614 - RNA, 19 nt, Homo sapiens
ugacgaaagacaacaaucu

SEQ ID NO: 239615 - RNA, 19 nt, Homo sapiens
caaaggcugggaauguaug

SEQ ID NO: 239616 - RNA, 19 nt, Homo sapiens
agaaccagguggcgcugaa

SEQ ID NO: 239617 - RNA, 19 nt, Homo sapiens
guccuacgccuucaacaug

SEQ ID NO: 239618 - RNA, 19 nt, Homo sapiens
gacgaaagacaacaaucug

SEQ ID NO: 239619 - RNA, 19 nt, Homo sapiens
ggacaaggcccagauucac

SEQ ID NO: 239620 - RNA, 19 nt, Homo sapiens
guacaaccgauauguucau

SEQ ID NO: 239621 - RNA, 19 nt, Homo sapiens
gagagggccaugacgaaag

SEQ ID NO: 239622 - RNA, 19 nt, Homo sapiens
cgagagggccaugacgaaa

SEQ ID NO: 239623 - RNA, 19 nt, Homo sapiens
gcugugcuccgaccuguuc

SEQ ID NO: 239624 - RNA, 19 nt, Homo sapiens
uacaaccgauauguucauu

SEQ ID NO: 239625 - RNA, 19 nt, Homo sapiens
uaguacaaccgauauguuc

SEQ ID NO: 239626 - RNA, 19 nt, Homo sapiens
ggcgcgaccugaacaagag

SEQ ID NO: 239627 - RNA, 19 nt, Homo sapiens
uguaaccugaugguaauua

SEQ ID NO: 239628 - RNA, 19 nt, Homo sapiens
cuucgucuuucgagaguga

SEQ ID NO: 239629 - RNA, 19 nt, Homo sapiens
gaaggacugagcucuuguc

SEQ ID NO: 239630 - RNA, 19 nt, Homo sapiens
uaauguugauacuguaagg

SEQ ID NO: 239631 - RNA, 19 nt, Homo sapiens
gggagaccaaggcauucua

SEQ ID NO: 239632 - RNA, 19 nt, Homo sapiens
ggguguuucguucccuuua

SEQ ID NO: 239633 - RNA, 19 nt, Homo sapiens
gguggacuguugggacuca

SEQ ID NO: 239634 - RNA, 19 nt, Homo sapiens
gggucaggcccuaccauug

SEQ ID NO: 239635 - RNA, 19 nt, Homo sapiens
agagcgccguggaggauga

SEQ ID NO: 239636 - RNA, 19 nt, Homo sapiens
caaggaugcgggugugauc

SEQ ID NO: 239637 - RNA, 19 nt, Homo sapiens
uuucguucccuuuaaauga

SEQ ID NO: 239638 - RNA, 19 nt, Homo sapiens
aguuguaaccugaugguaa

SEQ ID NO: 239639 - RNA, 19 nt, Homo sapiens
ggccgagaaggacgaguuu

SEQ ID NO: 239640 - RNA, 19 nt, Homo sapiens
gcaggaggcggagaaguac

SEQ ID NO: 239641 - RNA, 19 nt, Homo sapiens
ccaacggcauccugaacgu

SEQ ID NO: 239642 - RNA, 19 nt, Homo sapiens
uugagggcaucgacuucua

SEQ ID NO: 239643 - RNA, 19 nt, Homo sapiens
aggcugggaauguauguuu

SEQ ID NO: 239644 - RNA, 19 nt, Homo sapiens
ucagagcggagcccacaga

SEQ ID NO: 239645 - RNA, 19 nt, Homo sapiens
uucguucccuuuaaaugaa

SEQ ID NO: 239646 - RNA, 19 nt, Homo sapiens
caucaucagcggacuguac

SEQ ID NO: 239647 - RNA, 19 nt, Homo sapiens
guggugcagucggacauga

SEQ ID NO: 239648 - RNA, 19 nt, Homo sapiens
acaaaggcugggaauguau

SEQ ID NO: 239649 - RNA, 19 nt, Homo sapiens
cccuuuaaaugaaucaaca

SEQ ID NO: 239650 - RNA, 19 nt, Homo sapiens
ggagaccaaggcauucuac

SEQ ID NO: 239651 - RNA, 19 nt, Homo sapiens
uagcuggcuucauuauuuu

SEQ ID NO: 239652 - RNA, 19 nt, Homo sapiens
acaugaagcacuggccuuu

SEQ ID NO: 239653 - RNA, 19 nt, Homo sapiens
gaagguucuggacaagugu

SEQ ID NO: 239654 - RNA, 19 nt, Homo sapiens
uccuacgccuucaacauga

SEQ ID NO: 239655 - RNA, 19 nt, Homo sapiens
gggugcugauccaggugua

SEQ ID NO: 239656 - RNA, 19 nt, Homo sapiens
ggaaaucucuucgauggua

SEQ ID NO: 239657 - RNA, 19 nt, Homo sapiens
ggacaagucugagaaggua

SEQ ID NO: 239658 - RNA, 19 nt, Homo sapiens
uaaaggaggucaaggagaa

SEQ ID NO: 239659 - RNA, 19 nt, Homo sapiens
gagcauguguucucugauu

SEQ ID NO: 239660 - RNA, 19 nt, Homo sapiens
caccagagcucgauuugaa

SEQ ID NO: 239661 - RNA, 19 nt, Homo sapiens
ccaaaguccuuguguccua

SEQ ID NO: 239662 - RNA, 19 nt, Homo sapiens
uaaaccgugugauguauuu

SEQ ID NO: 239663 - RNA, 19 nt, Homo sapiens
ccaaugguauucucaaugu

SEQ ID NO: 239664 - RNA, 19 nt, Homo sapiens
ucaaucaacuggcagagaa

SEQ ID NO: 239665 - RNA, 19 nt, Homo sapiens
gaccagaccugaaucuaag

SEQ ID NO: 239666 - RNA, 19 nt, Homo sapiens
uaggaugccucuacaugua

SEQ ID NO: 239667 - RNA, 19 nt, Homo sapiens
cgugaugacugcccugaua

SEQ ID NO: 239668 - RNA, 19 nt, Homo sapiens
gaacugaagcauccuagga

SEQ ID NO: 239669 - RNA, 19 nt, Homo sapiens
ugaagaguguugugaguga

SEQ ID NO: 239670 - RNA, 19 nt, Homo sapiens
aagcagauaugaaacuuug

SEQ ID NO: 239671 - RNA, 19 nt, Homo sapiens
gaacgacauguccugauuu

SEQ ID NO: 239672 - RNA, 19 nt, Homo sapiens
ggagacugcugaggccuuu

SEQ ID NO: 239673 - RNA, 19 nt, Homo sapiens
gcaaagaaugccuuagaau

SEQ ID NO: 239674 - RNA, 19 nt, Homo sapiens
caagauggauaaggcuaaa

SEQ ID NO: 239675 - RNA, 19 nt, Homo sapiens
caaagaaugccuuagaauc

SEQ ID NO: 239676 - RNA, 19 nt, Homo sapiens
gacgugaucucaacaagag

SEQ ID NO: 239677 - RNA, 19 nt, Homo sapiens
guaacccuaucaucacaaa

SEQ ID NO: 239678 - RNA, 19 nt, Homo sapiens
gcauugacuucuauacauc

SEQ ID NO: 239679 - RNA, 19 nt, Homo sapiens
agaacgacauguccugauu

SEQ ID NO: 239680 - RNA, 19 nt, Homo sapiens
ggcaggaaauuuaaugauc

SEQ ID NO: 239681 - RNA, 19 nt, Homo sapiens
guauuuaggcugugaaugu

SEQ ID NO: 239682 - RNA, 19 nt, Homo sapiens
gcuuauuugucaaucagua

SEQ ID NO: 239683 - RNA, 19 nt, Homo sapiens
gaaaucucuucgaugguau

SEQ ID NO: 239684 - RNA, 19 nt, Homo sapiens
gaucauaagagaaaggaau

SEQ ID NO: 239685 - RNA, 19 nt, Homo sapiens
ggcauugacuucuauacau

SEQ ID NO: 239686 - RNA, 19 nt, Homo sapiens
gagacuaggccucagagaa

SEQ ID NO: 239687 - RNA, 19 nt, Homo sapiens
ugaccagaccugaaucuaa

SEQ ID NO: 239688 - RNA, 19 nt, Homo sapiens
ugaguuugaucauaagaga

SEQ ID NO: 239689 - RNA, 19 nt, Homo sapiens
gcagauguguaacccuauc

SEQ ID NO: 239690 - RNA, 19 nt, Homo sapiens
uaaugauccuguuguacaa

SEQ ID NO: 239691 - RNA, 19 nt, Homo sapiens
uauuuaggcugugaaugua

SEQ ID NO: 239692 - RNA, 19 nt, Homo sapiens
ccucacauccuguuucuga

SEQ ID NO: 239693 - RNA, 19 nt, Homo sapiens
ggaugccucuacauguauu

SEQ ID NO: 239694 - RNA, 19 nt, Homo sapiens
agagaaagaugaguuugau

SEQ ID NO: 239695 - RNA, 19 nt, Homo sapiens
gguuugaccugacuggaau

SEQ ID NO: 239696 - RNA, 19 nt, Homo sapiens
gguuugaagggcaagauua

SEQ ID NO: 239697 - RNA, 19 nt, Homo sapiens
gagcucgauuugaagaguu

SEQ ID NO: 239698 - RNA, 19 nt, Homo sapiens
auauaaagcugaagaugag

SEQ ID NO: 239699 - RNA, 19 nt, Homo sapiens
gcgagagggccaugacaaa

SEQ ID NO: 239700 - RNA, 19 nt, Homo sapiens
ggacgugaucucaacaaga

SEQ ID NO: 239701 - RNA, 19 nt, Homo sapiens
uaccaucccuuggaaauuc

SEQ ID NO: 239702 - RNA, 19 nt, Homo sapiens
gcaagauuagugagucuga

SEQ ID NO: 239703 - RNA, 19 nt, Homo sapiens
ugcaaagaaugccuuagaa

SEQ ID NO: 239704 - RNA, 19 nt, Homo sapiens
caaccuagaaauugauuca

SEQ ID NO: 239705 - RNA, 19 nt, Homo sapiens
uggaggaguucaagaggaa

SEQ ID NO: 239706 - RNA, 19 nt, Homo sapiens
agaaagaugaguuugauca

SEQ ID NO: 239707 - RNA, 19 nt, Homo sapiens
cagagaaagaugaguuuga

SEQ ID NO: 239708 - RNA, 19 nt, Homo sapiens
agaucgaggugacguuuga

SEQ ID NO: 239709 - RNA, 19 nt, Homo sapiens
caccuacucugacaaccaa

SEQ ID NO: 239710 - RNA, 19 nt, Homo sapiens
ccuagaaauugauucacuu

SEQ ID NO: 239711 - RNA, 19 nt, Homo sapiens
ugugauugcuggacuuaau

SEQ ID NO: 239712 - RNA, 19 nt, Homo sapiens
ucaagugauuaaugaagga

SEQ ID NO: 239713 - RNA, 19 nt, Homo sapiens
gaaccagguagcaaugaau

SEQ ID NO: 239714 - RNA, 19 nt, Homo sapiens
uaaguuaccaucccuugga

SEQ ID NO: 239715 - RNA, 19 nt, Homo sapiens
guugugcaguuugauauug

SEQ ID NO: 239716 - RNA, 19 nt, Homo sapiens
gaagaguguugugagugau

SEQ ID NO: 239717 - RNA, 19 nt, Homo sapiens
caugaagaguguugugagu

SEQ ID NO: 239718 - RNA, 19 nt, Homo sapiens
ccaagaaccagguagcaau

SEQ ID NO: 239719 - RNA, 19 nt, Homo sapiens
caagaucaccaucaccaau

SEQ ID NO: 239720 - RNA, 19 nt, Homo sapiens
caauggacgugaucucaac

SEQ ID NO: 239721 - RNA, 19 nt, Homo sapiens
cuucaggacuacuucaaug

SEQ ID NO: 239722 - RNA, 19 nt, Homo sapiens
gggaugccaagauggauaa

SEQ ID NO: 239723 - RNA, 19 nt, Homo sapiens
gugcuaagaaucaucaaug

SEQ ID NO: 239724 - RNA, 19 nt, Homo sapiens
uguacaagcagauaugaaa

SEQ ID NO: 239725 - RNA, 19 nt, Homo sapiens
aaacuaggccccucuuuaa

SEQ ID NO: 239726 - RNA, 19 nt, Homo sapiens
ggagauugagcgcaugguu

SEQ ID NO: 239727 - RNA, 19 nt, Homo sapiens
uaaggaugcaggugugauu

SEQ ID NO: 239728 - RNA, 19 nt, Homo sapiens
caagaaccagguagcaaug

SEQ ID NO: 239729 - RNA, 19 nt, Homo sapiens
gaaggaggcaagcccaaag

SEQ ID NO: 239730 - RNA, 19 nt, Homo sapiens
auaugaaacuuuggccuuu

SEQ ID NO: 239731 - RNA, 19 nt, Homo sapiens
gaugcuuauuugucaauca

SEQ ID NO: 239732 - RNA, 19 nt, Homo sapiens
uguggaugcuuauuuguca

SEQ ID NO: 239733 - RNA, 19 nt, Homo sapiens
cgugugauguauuugaaug

SEQ ID NO: 239734 - RNA, 19 nt, Homo sapiens
gauuagugagucugauaaa

SEQ ID NO: 239735 - RNA, 19 nt, Homo sapiens
gaucucaacaagagcauca

SEQ ID NO: 239736 - RNA, 19 nt, Homo sapiens
ccaagauggauaaggcuaa

SEQ ID NO: 239737 - RNA, 19 nt, Homo sapiens
aggccaaccuagaaauuga

SEQ ID NO: 239738 - RNA, 19 nt, Homo sapiens
gcacccaggccaaccuaga

SEQ ID NO: 239739 - RNA, 19 nt, Homo sapiens
gguauugacuaaguugaag

SEQ ID NO: 239740 - RNA, 19 nt, Homo sapiens
acaagcagauaugaaacuu

SEQ ID NO: 239741 - RNA, 19 nt, Homo sapiens
cuuccuguguggaugcuua

SEQ ID NO: 239742 - RNA, 19 nt, Homo sapiens
cugaucggcaggaaauuua

SEQ ID NO: 239743 - RNA, 19 nt, Homo sapiens
agaaccagguagcaaugaa

SEQ ID NO: 239744 - RNA, 19 nt, Homo sapiens
ccaccaagcagacacagau

SEQ ID NO: 239745 - RNA, 19 nt, Homo sapiens
ugaugaggccguagcauau

SEQ ID NO: 239746 - RNA, 19 nt, Homo sapiens
cugaugaggccguagcaua

SEQ ID NO: 239747 - RNA, 19 nt, Homo sapiens
gggccacccugucaccaau

SEQ ID NO: 239748 - RNA, 19 nt, Homo sapiens
uuaaugauccuguuguaca

SEQ ID NO: 239749 - RNA, 19 nt, Homo sapiens
agaaugccuuagaauccua

SEQ ID NO: 239750 - RNA, 19 nt, Homo sapiens
gggaggacuuugacaacag

SEQ ID NO: 239751 - RNA, 19 nt, Homo sapiens
gguggaggcacauuugaug

SEQ ID NO: 239752 - RNA, 19 nt, Homo sapiens
cuucgaugguauugacuaa

SEQ ID NO: 239753 - RNA, 19 nt, Homo sapiens
gaaggcgucgggagacuag

SEQ ID NO: 239754 - RNA, 19 nt, Homo sapiens
gcagagaaagaugaguuug

SEQ ID NO: 239755 - RNA, 19 nt, Homo sapiens
ccaagggaaucgccauagg

SEQ ID NO: 239756 - RNA, 19 nt, Homo sapiens
gcaaacaaaugcauaaaug

SEQ ID NO: 239757 - RNA, 19 nt, Homo sapiens
ggacuaagcuugcacucaa

SEQ ID NO: 239758 - RNA, 19 nt, Homo sapiens
gcaaggagcugaacaagag

SEQ ID NO: 239759 - RNA, 19 nt, Homo sapiens
gaaaccagauggcagagaa

SEQ ID NO: 239760 - RNA, 19 nt, Homo sapiens
agaaagagcucgaaagagu

SEQ ID NO: 239761 - RNA, 19 nt, Homo sapiens
gcagaaagagcucgaaaga

SEQ ID NO: 239762 - RNA, 19 nt, Homo sapiens
ggagaggugcaacaacuua

SEQ ID NO: 239763 - RNA, 19 nt, Homo sapiens
aaacuaaacugaacauugc

SEQ ID NO: 239764 - RNA, 19 nt, Homo sapiens
ucacgaagaugaaggagau

SEQ ID NO: 239765 - RNA, 19 nt, Homo sapiens
gcucaaugccgaccucuuu

SEQ ID NO: 239766 - RNA, 19 nt, Homo sapiens
ggagauuuguuugagauga

SEQ ID NO: 239767 - RNA, 19 nt, Homo sapiens
gaaaggagaggugcaacaa

SEQ ID NO: 239768 - RNA, 19 nt, Homo sapiens
gcacucaagucagcguaaa

SEQ ID NO: 239769 - RNA, 19 nt, Homo sapiens
agagaaagaugaguaugaa

SEQ ID NO: 239770 - RNA, 19 nt, Homo sapiens
ucaacuggcucgaccgaaa

SEQ ID NO: 239771 - RNA, 19 nt, Homo sapiens
uauucgagguuucucuuua

SEQ ID NO: 239772 - RNA, 19 nt, Homo sapiens
ggaagucuuugguauaugc

SEQ ID NO: 239773 - RNA, 19 nt, Homo sapiens
ccaaguacgagaucuauug

SEQ ID NO: 239774 - RNA, 19 nt, Homo sapiens
gaaagagcucgaaagaguu

SEQ ID NO: 239775 - RNA, 19 nt, Homo sapiens
caagagcaccgguaaggaa

SEQ ID NO: 239776 - RNA, 19 nt, Homo sapiens
guaaaccucuuugccuuuc

SEQ ID NO: 239777 - RNA, 19 nt, Homo sapiens
agaacgugcucaucuuuga

SEQ ID NO: 239778 - RNA, 19 nt, Homo sapiens
gagaagaacgugcucaucu

SEQ ID NO: 239779 - RNA, 19 nt, Homo sapiens
cagcaaacuuuaccaaggu

SEQ ID NO: 239780 - RNA, 19 nt, Homo sapiens
cagagaaagaugaguauga

SEQ ID NO: 239781 - RNA, 19 nt, Homo sapiens
guacaaaucggaagaugag

SEQ ID NO: 239782 - RNA, 19 nt, Homo sapiens
ccaaagugcaaguagagua

SEQ ID NO: 239783 - RNA, 19 nt, Homo sapiens
aguacgagaucuauuguug

SEQ ID NO: 239784 - RNA, 19 nt, Homo sapiens
guagaagcuuggaaacagu

SEQ ID NO: 239785 - RNA, 19 nt, Homo sapiens
gagaugagaaaccuuaagu

SEQ ID NO: 239786 - RNA, 19 nt, Homo sapiens
gcauggagauuuguuugag

SEQ ID NO: 239787 - RNA, 19 nt, Homo sapiens
aaagagcucgaaagaguuu

SEQ ID NO: 239788 - RNA, 19 nt, Homo sapiens
gcacagcgcggucauaacg

SEQ ID NO: 239789 - RNA, 19 nt, Homo sapiens
ccacagugcagucggauau

SEQ ID NO: 239790 - RNA, 19 nt, Homo sapiens
uuaaggacagguauacuuu

SEQ ID NO: 239791 - RNA, 19 nt, Homo sapiens
gaaguggacuaagcuugca

SEQ ID NO: 239792 - RNA, 19 nt, Homo sapiens
aaaucaccaucaccaauga

SEQ ID NO: 239793 - RNA, 19 nt, Homo sapiens
gagcugaacaagagcauca

SEQ ID NO: 239794 - RNA, 19 nt, Homo sapiens
acaagauccucgacaagug

SEQ ID NO: 239795 - RNA, 19 nt, Homo sapiens
guuggaagucuuugguaua

SEQ ID NO: 239796 - RNA, 19 nt, Homo sapiens
gucaggaggugaucaacug

SEQ ID NO: 239797 - RNA, 19 nt, Homo sapiens
aauggcauccuuaacguua

SEQ ID NO: 239798 - RNA, 19 nt, Homo sapiens
cgagguuucucuuuaaugc

SEQ ID NO: 239799 - RNA, 19 nt, Homo sapiens
uacgagaucuauuguugga

SEQ ID NO: 239800 - RNA, 19 nt, Homo sapiens
caucgaagaaguggacuaa

SEQ ID NO: 239801 - RNA, 19 nt, Homo sapiens
aaacugaggggcaagauua

SEQ ID NO: 239802 - RNA, 19 nt, Homo sapiens
ccuacggccuggacaagaa

SEQ ID NO: 239803 - RNA, 19 nt, Homo sapiens
ccaauggcauccuuaacgu

SEQ ID NO: 239804 - RNA, 19 nt, Homo sapiens
cgacaaaucagagaaugug

SEQ ID NO: 239805 - RNA, 19 nt, Homo sapiens
agaaccagguggccaugaa

SEQ ID NO: 239806 - RNA, 19 nt, Homo sapiens
guuaaggacagguauacuu

SEQ ID NO: 239807 - RNA, 19 nt, Homo sapiens
gagauuuguuugagaugag

SEQ ID NO: 239808 - RNA, 19 nt, Homo sapiens
gaagaaguggacuaagcuu

SEQ ID NO: 239809 - RNA, 19 nt, Homo sapiens
ccucaucggcgacaaauca

SEQ ID NO: 239810 - RNA, 19 nt, Homo sapiens
guaauguuaaggacaggua

SEQ ID NO: 239811 - RNA, 19 nt, Homo sapiens
ucaagcagacgguggaaga

SEQ ID NO: 239812 - RNA, 19 nt, Homo sapiens
caucaccaaugacaaaggu

SEQ ID NO: 239813 - RNA, 19 nt, Homo sapiens
gaaaacaaaaucaccauca

SEQ ID NO: 239814 - RNA, 19 nt, Homo sapiens
gcguacuggugcagguaua

SEQ ID NO: 239815 - RNA, 19 nt, Homo sapiens
gugcacagcgcggucauaa

SEQ ID NO: 239816 - RNA, 19 nt, Homo sapiens
uugcacaccuguucuguag

SEQ ID NO: 239817 - RNA, 19 nt, Homo sapiens
gaccugggcaccaccuauu

SEQ ID NO: 239818 - RNA, 19 nt, Homo sapiens
cauggagauuuguuugaga

SEQ ID NO: 239819 - RNA, 19 nt, Homo sapiens
auucgagguuucucuuuaa

SEQ ID NO: 239820 - RNA, 19 nt, Homo sapiens
gguacaaaucggaagauga

SEQ ID NO: 239821 - RNA, 19 nt, Homo sapiens
caccaucaccaaugacaaa

SEQ ID NO: 239822 - RNA, 19 nt, Homo sapiens
uuggaagucuuugguauau

SEQ ID NO: 239823 - RNA, 19 nt, Homo sapiens
acagugcagucggauauga

SEQ ID NO: 239824 - RNA, 19 nt, Homo sapiens
agaaagaugaguaugaaca

SEQ ID NO: 239825 - RNA, 19 nt, Homo sapiens
uggcagagaaagaugagua

SEQ ID NO: 239826 - RNA, 19 nt, Homo sapiens
uguagaagcuuggaaacag

SEQ ID NO: 239827 - RNA, 19 nt, Homo sapiens
aaggagaggugcaacaacu

SEQ ID NO: 239828 - RNA, 19 nt, Homo sapiens
caagauccucgacaagugu

SEQ ID NO: 239829 - RNA, 19 nt, Homo sapiens
ccaugaccaaggacaauaa

SEQ ID NO: 239830 - RNA, 19 nt, Homo sapiens
ccaagcagacgcagaccuu

SEQ ID NO: 239831 - RNA, 19 nt, Homo sapiens
uaaguuugcacaccuguuc

SEQ ID NO: 239832 - RNA, 19 nt, Homo sapiens
ucgaagaaguggacuaagc

SEQ ID NO: 239833 - RNA, 19 nt, Homo sapiens
gagcaaggacgacauugac

SEQ ID NO: 239834 - RNA, 19 nt, Homo sapiens
gaggcugauuggacggaaa

SEQ ID NO: 239835 - RNA, 19 nt, Homo sapiens
gcaaauguaaaguaaagcu

SEQ ID NO: 239836 - RNA, 19 nt, Homo sapiens
gaaagaugaguaugaacac

SEQ ID NO: 239837 - RNA, 19 nt, Homo sapiens
gacaagagcaccgguaagg

SEQ ID NO: 239838 - RNA, 19 nt, Homo sapiens
caaguacgagaucuauugu

SEQ ID NO: 239839 - RNA, 19 nt, Homo sapiens
ccagauggcagagaaagau

SEQ ID NO: 239840 - RNA, 19 nt, Homo sapiens
aaaacaagauccucgacaa

SEQ ID NO: 239841 - RNA, 19 nt, Homo sapiens
ggcaaggagcugaacaaga

SEQ ID NO: 239842 - RNA, 19 nt, Homo sapiens
ccagccauauggaaguuca

SEQ ID NO: 239843 - RNA, 19 nt, Homo sapiens
ccaugguccucacgaagau

SEQ ID NO: 239844 - RNA, 19 nt, Homo sapiens
uuugagaugagaaaccuua

SEQ ID NO: 239845 - RNA, 19 nt, Homo sapiens
gaucuauuguuggaagucu

SEQ ID NO: 239846 - RNA, 19 nt, Homo sapiens
ugagcaaggacgacauuga

SEQ ID NO: 239847 - RNA, 19 nt, Homo sapiens
acaaaggucgucugagcaa

SEQ ID NO: 239848 - RNA, 19 nt, Homo sapiens
gccaugaccaaggacaaua

SEQ ID NO: 239849 - RNA, 19 nt, Homo sapiens
ggcgacaaaucagagaaug

SEQ ID NO: 239850 - RNA, 19 nt, Homo sapiens
caaagugcaaguagaguac

SEQ ID NO: 239851 - RNA, 19 nt, Homo sapiens
uagaagcuuggaaacagua

SEQ ID NO: 239852 - RNA, 19 nt, Homo sapiens
cguaaaccucuuugccuuu

SEQ ID NO: 239853 - RNA, 19 nt, Homo sapiens
gacccaccaucgaagaagu

SEQ ID NO: 239854 - RNA, 19 nt, Homo sapiens
aaagaugaguaugaacaca

SEQ ID NO: 239855 - RNA, 19 nt, Homo sapiens
gacgguggaagacgagaaa

SEQ ID NO: 239856 - RNA, 19 nt, Homo sapiens
gcaacuggcugaaagguua

SEQ ID NO: 239857 - RNA, 19 nt, Homo sapiens
gaaaugaguuggaaagcua

SEQ ID NO: 239858 - RNA, 19 nt, Homo sapiens
gaacauacuugguuuccua

SEQ ID NO: 239859 - RNA, 19 nt, Homo sapiens
gaacuuaagucucgaaugu

SEQ ID NO: 239860 - RNA, 19 nt, Homo sapiens
gcaauaggguuaaauggua

SEQ ID NO: 239861 - RNA, 19 nt, Homo sapiens
gaagaagucugauauugau

SEQ ID NO: 239862 - RNA, 19 nt, Homo sapiens
caaagacgcuggaacuauu

SEQ ID NO: 239863 - RNA, 19 nt, Homo sapiens
gcaaagaugucaggaaaga

SEQ ID NO: 239864 - RNA, 19 nt, Homo sapiens
gauaaucaaccaacuguua

SEQ ID NO: 239865 - RNA, 19 nt, Homo sapiens
gaggagcuguuacugaaua

SEQ ID NO: 239866 - RNA, 19 nt, Homo sapiens
gggcaaagaugucaggaaa

SEQ ID NO: 239867 - RNA, 19 nt, Homo sapiens
gaaacuccaucucuacuga

SEQ ID NO: 239868 - RNA, 19 nt, Homo sapiens
caauagagcugugcagaaa

SEQ ID NO: 239869 - RNA, 19 nt, Homo sapiens
gaucuuggauggugacauu

SEQ ID NO: 239870 - RNA, 19 nt, Homo sapiens
gaaauugaguccuucuaug

SEQ ID NO: 239871 - RNA, 19 nt, Homo sapiens
gaaguuaauccacaucuuu

SEQ ID NO: 239872 - RNA, 19 nt, Homo sapiens
gaauguaauuggaaucuuc

SEQ ID NO: 239873 - RNA, 19 nt, Homo sapiens
ccaccaagaugcugacauu

SEQ ID NO: 239874 - RNA, 19 nt, Homo sapiens
gagcuguuacugaauauua

SEQ ID NO: 239875 - RNA, 19 nt, Homo sapiens
ggaaagcuaugccuauucu

SEQ ID NO: 239876 - RNA, 19 nt, Homo sapiens
gacauuugcuccugaagaa

SEQ ID NO: 239877 - RNA, 19 nt, Homo sapiens
gaucacugguauuaacuuu

SEQ ID NO: 239878 - RNA, 19 nt, Homo sapiens
gaaaggaugguuaaugaug

SEQ ID NO: 239879 - RNA, 19 nt, Homo sapiens
ucgaaaggaugguuaauga

SEQ ID NO: 239880 - RNA, 19 nt, Homo sapiens
gaagucaccuuugagauag

SEQ ID NO: 239881 - RNA, 19 nt, Homo sapiens
ccaagaugcugacauugaa

SEQ ID NO: 239882 - RNA, 19 nt, Homo sapiens
gcugaaagguuaauucucu

SEQ ID NO: 239883 - RNA, 19 nt, Homo sapiens
agaaggaacuggaagaaau

SEQ ID NO: 239884 - RNA, 19 nt, Homo sapiens
ggaagauucugauuugaag

SEQ ID NO: 239885 - RNA, 19 nt, Homo sapiens
gaaaucgaaaggaugguua

SEQ ID NO: 239886 - RNA, 19 nt, Homo sapiens
guuggaagauucugauuug

SEQ ID NO: 239887 - RNA, 19 nt, Homo sapiens
ucccugaaauuucucauua

SEQ ID NO: 239888 - RNA, 19 nt, Homo sapiens
gggaguauuugguauguug

SEQ ID NO: 239889 - RNA, 19 nt, Homo sapiens
ugaagucaccuuugagaua

SEQ ID NO: 239890 - RNA, 19 nt, Homo sapiens
ggaagaaauuguucaacca

SEQ ID NO: 239891 - RNA, 19 nt, Homo sapiens
gaaggaacuggaagaaauu

SEQ ID NO: 239892 - RNA, 19 nt, Homo sapiens
aaacuuuccucugaagaua

SEQ ID NO: 239893 - RNA, 19 nt, Homo sapiens
cauacuugguuuccuauuu

SEQ ID NO: 239894 - RNA, 19 nt, Homo sapiens
ccaacuggcuggcaagaug

SEQ ID NO: 239895 - RNA, 19 nt, Homo sapiens
uaaaggcaaugguuugugu

SEQ ID NO: 239896 - RNA, 19 nt, Homo sapiens
acaccaaacucuuaauuag

SEQ ID NO: 239897 - RNA, 19 nt, Homo sapiens
ugaaacugcuauagccuaa

SEQ ID NO: 239898 - RNA, 19 nt, Homo sapiens
ggaaccaucccguggcaua

SEQ ID NO: 239899 - RNA, 19 nt, Homo sapiens
auacagccauuaaagauga

SEQ ID NO: 239900 - RNA, 19 nt, Homo sapiens
acacuuggauuucauuugu

SEQ ID NO: 239901 - RNA, 19 nt, Homo sapiens
acagacagauugaccuauu

SEQ ID NO: 239902 - RNA, 19 nt, Homo sapiens
aaacccagaugaagcugua

SEQ ID NO: 239903 - RNA, 19 nt, Homo sapiens
gaagucugauauugaugaa

SEQ ID NO: 239904 - RNA, 19 nt, Homo sapiens
gcacagacagauugaccua

SEQ ID NO: 239905 - RNA, 19 nt, Homo sapiens
ggucuaauguuugugagaa

SEQ ID NO: 239906 - RNA, 19 nt, Homo sapiens
gaagaagaauuggccaucu

SEQ ID NO: 239907 - RNA, 19 nt, Homo sapiens
gaagaaauuguucaaccaa

SEQ ID NO: 239908 - RNA, 19 nt, Homo sapiens
gaagaaggaacuggaagaa

SEQ ID NO: 239909 - RNA, 19 nt, Homo sapiens
gcgcugugcuccugugcua

SEQ ID NO: 239910 - RNA, 19 nt, Homo sapiens
ugaagaagucugauauuga

SEQ ID NO: 239911 - RNA, 19 nt, Homo sapiens
gggcagacccugagcagaa

SEQ ID NO: 239912 - RNA, 19 nt, Homo sapiens
caacaccaaacucuuaauu

SEQ ID NO: 239913 - RNA, 19 nt, Homo sapiens
uuacacuggucuaauguuu

SEQ ID NO: 239914 - RNA, 19 nt, Homo sapiens
uaagugacaccaauaaaug

SEQ ID NO: 239915 - RNA, 19 nt, Homo sapiens
uaaugaugcugagaaguuu

SEQ ID NO: 239916 - RNA, 19 nt, Homo sapiens
agaugaagcuguagcguau

SEQ ID NO: 239917 - RNA, 19 nt, Homo sapiens
ccagguaaaugguaugauc

SEQ ID NO: 239918 - RNA, 19 nt, Homo sapiens
gauaaggaaacacuucuau

SEQ ID NO: 239919 - RNA, 19 nt, Homo sapiens
caaggucuaugaaggugaa

SEQ ID NO: 239920 - RNA, 19 nt, Homo sapiens
ugaagaggauacagcagaa

SEQ ID NO: 239921 - RNA, 19 nt, Homo sapiens
cagaaaguguuggaagauu

SEQ ID NO: 239922 - RNA, 19 nt, Homo sapiens
cugaggagcuguuacugaa

SEQ ID NO: 239923 - RNA, 19 nt, Homo sapiens
gaaaaggggagagaaguua

SEQ ID NO: 239924 - RNA, 19 nt, Homo sapiens
gaugaaauuguucuuguug

SEQ ID NO: 239925 - RNA, 19 nt, Homo sapiens
gaucuguuccggucuacua

SEQ ID NO: 239926 - RNA, 19 nt, Homo sapiens
gaacacuucaucaaacugu

SEQ ID NO: 239927 - RNA, 19 nt, Homo sapiens
gaagguuacccaugcaguu

SEQ ID NO: 239928 - RNA, 19 nt, Homo sapiens
caauacagccauuaaagau

SEQ ID NO: 239929 - RNA, 19 nt, Homo sapiens
ccaauacagccauuaaaga

SEQ ID NO: 239930 - RNA, 19 nt, Homo sapiens
gaccaucuuugccaacaug

SEQ ID NO: 239931 - RNA, 19 nt, Homo sapiens
gaaucuccaucccugaaau

SEQ ID NO: 239932 - RNA, 19 nt, Homo sapiens
guaaagguauauugugaac

SEQ ID NO: 239933 - RNA, 19 nt, Homo sapiens
gagagaaguuaauccacau

SEQ ID NO: 239934 - RNA, 19 nt, Homo sapiens
gaugaguuguagacacuga

SEQ ID NO: 239935 - RNA, 19 nt, Homo sapiens
gcgcauugauacuagaaau

SEQ ID NO: 239936 - RNA, 19 nt, Homo sapiens
gaaguuguggccacuaaug

SEQ ID NO: 239937 - RNA, 19 nt, Homo sapiens
gguuuaggauuacuuagau

SEQ ID NO: 239938 - RNA, 19 nt, Homo sapiens
acuuaagucucgaauguaa

SEQ ID NO: 239939 - RNA, 19 nt, Homo sapiens
uguagacacugaucugcua

SEQ ID NO: 239940 - RNA, 19 nt, Homo sapiens
agauagaugugaaugguau

SEQ ID NO: 239941 - RNA, 19 nt, Homo sapiens
ucaaccaacuguuacaauc

SEQ ID NO: 239942 - RNA, 19 nt, Homo sapiens
ccaauacugcccaaggaua

SEQ ID NO: 239943 - RNA, 19 nt, Homo sapiens
gaaguuugcugaggaagac

SEQ ID NO: 239944 - RNA, 19 nt, Homo sapiens
ccugacaccugaagaaauc

SEQ ID NO: 239945 - RNA, 19 nt, Homo sapiens
agauugaagucaccuuuga

SEQ ID NO: 239946 - RNA, 19 nt, Homo sapiens
uauuuacacuggucuaaug

SEQ ID NO: 239947 - RNA, 19 nt, Homo sapiens
ggaacuggaagaaauuguu

SEQ ID NO: 239948 - RNA, 19 nt, Homo sapiens
aaauugaguccuucuauga

SEQ ID NO: 239949 - RNA, 19 nt, Homo sapiens
ggaggugggcaaacaaaga

SEQ ID NO: 239950 - RNA, 19 nt, Homo sapiens
agucuucccuuaccucaaa

SEQ ID NO: 239951 - RNA, 19 nt, Homo sapiens
uagauuguguuccugaaga

SEQ ID NO: 239952 - RNA, 19 nt, Homo sapiens
gacauugaaacuacacuaa

SEQ ID NO: 239953 - RNA, 19 nt, Homo sapiens
ugagaccacaggcuuguua

SEQ ID NO: 239954 - RNA, 19 nt, Homo sapiens
acacuggucuaauguuugu

SEQ ID NO: 239955 - RNA, 19 nt, Homo sapiens
ugacaccaauaaauguuug

SEQ ID NO: 239956 - RNA, 19 nt, Homo sapiens
gcaaggagcugaacaagag

SEQ ID NO: 239957 - RNA, 19 nt, Homo sapiens
ggacaaaugugagaaagug

SEQ ID NO: 239958 - RNA, 19 nt, Homo sapiens
gaaagccacugcuggagau

SEQ ID NO: 239959 - RNA, 19 nt, Homo sapiens
agagggagcuggagcaaau

SEQ ID NO: 239960 - RNA, 19 nt, Homo sapiens
ggacaagauucccgaagag

SEQ ID NO: 239961 - RNA, 19 nt, Homo sapiens
ccaagcagacccagacuuu

SEQ ID NO: 239962 - RNA, 19 nt, Homo sapiens
guacaaggcugaggaugag

SEQ ID NO: 239963 - RNA, 19 nt, Homo sapiens
cagagaaggaggaguauga

SEQ ID NO: 239964 - RNA, 19 nt, Homo sapiens
acaaccagcuggcagagaa

SEQ ID NO: 239965 - RNA, 19 nt, Homo sapiens
gcacagguaaggcuaacaa

SEQ ID NO: 239966 - RNA, 19 nt, Homo sapiens
ccaaggugccgguaucgua

SEQ ID NO: 239967 - RNA, 19 nt, Homo sapiens
uggagaggaugguucauga

SEQ ID NO: 239968 - RNA, 19 nt, Homo sapiens
ggacaaggcccagauucau

SEQ ID NO: 239969 - RNA, 19 nt, Homo sapiens
ccuuugacauugaugcuaa

SEQ ID NO: 239970 - RNA, 19 nt, Homo sapiens
gagcugaacaagagcauca

SEQ ID NO: 239971 - RNA, 19 nt, Homo sapiens
gaggagaggacuucgacaa

SEQ ID NO: 239972 - RNA, 19 nt, Homo sapiens
gugagaaagugcaggaucu

SEQ ID NO: 239973 - RNA, 19 nt, Homo sapiens
caagaucaccaucaccaau

SEQ ID NO: 239974 - RNA, 19 nt, Homo sapiens
uggcagagaaggaggagua

SEQ ID NO: 239975 - RNA, 19 nt, Homo sapiens
ccacgcugauccagaggaa

SEQ ID NO: 239976 - RNA, 19 nt, Homo sapiens
gacaaggcccagauucaug

SEQ ID NO: 239977 - RNA, 19 nt, Homo sapiens
gcuggaggcccaugucuuc

SEQ ID NO: 239978 - RNA, 19 nt, Homo sapiens
cagguaaggcuaacaagau

SEQ ID NO: 239979 - RNA, 19 nt, Homo sapiens
ugucgguucucuccauuga

SEQ ID NO: 239980 - RNA, 19 nt, Homo sapiens
gaaggaggaguaugagcau

SEQ ID NO: 239981 - RNA, 19 nt, Homo sapiens
gaagaggacaggcgcaaaa

SEQ ID NO: 239982 - RNA, 19 nt, Homo sapiens
gaagagggagcuggagcaa

SEQ ID NO: 239983 - RNA, 19 nt, Homo sapiens
gggaggacaagacguucua

SEQ ID NO: 239984 - RNA, 19 nt, Homo sapiens
ggagaggaugguucaugaa

SEQ ID NO: 239985 - RNA, 19 nt, Homo sapiens
gcuaacaagaucaccauca

SEQ ID NO: 239986 - RNA, 19 nt, Homo sapiens
gagaggaugguucaugaag

SEQ ID NO: 239987 - RNA, 19 nt, Homo sapiens
acaaggcccagauucauga

SEQ ID NO: 239988 - RNA, 19 nt, Homo sapiens
ggaaagccuuagggacaag

SEQ ID NO: 239989 - RNA, 19 nt, Homo sapiens
caucacucgugcccgcuuu

SEQ ID NO: 239990 - RNA, 19 nt, Homo sapiens
ucauugaggagguugauug

SEQ ID NO: 239991 - RNA, 19 nt, Homo sapiens
agaucaccaucaccaauga

SEQ ID NO: 239992 - RNA, 19 nt, Homo sapiens
ggagcacagguaaggcuaa

SEQ ID NO: 239993 - RNA, 19 nt, Homo sapiens
aagcagacccagacuuuca

SEQ ID NO: 239994 - RNA, 19 nt, Homo sapiens
ggaggcccaugucuuccau

SEQ ID NO: 239995 - RNA, 19 nt, Homo sapiens
agagggccaugaccaagga

SEQ ID NO: 239996 - RNA, 19 nt, Homo sapiens
ggcaaggagcugaacaaga

SEQ ID NO: 239997 - RNA, 19 nt, Homo sapiens
ggagcuggagcaaaucugu

SEQ ID NO: 239998 - RNA, 19 nt, Homo sapiens
aggaggagguggagaggau

SEQ ID NO: 239999 - RNA, 19 nt, Homo sapiens
ucgagggcguggacuucua

SEQ ID NO: 240000 - RNA, 19 nt, Homo sapiens
gagcacagguaaggcuaac

SEQ ID NO: 240001 - RNA, 19 nt, Homo sapiens
cagcaguuguggcacucaa

SEQ ID NO: 240002 - RNA, 19 nt, Homo sapiens
gaguaugagcaucagaaga

SEQ ID NO: 240003 - RNA, 19 nt, Homo sapiens
cuaacaagaucaccaucac

SEQ ID NO: 240004 - RNA, 19 nt, Homo sapiens
ggugaccuuugacauugau

SEQ ID NO: 240005 - RNA, 19 nt, Homo sapiens
aggaaagccuuagggacaa

SEQ ID NO: 240006 - RNA, 19 nt, Homo sapiens
ggaguaugagcaucagaag

SEQ ID NO: 240007 - RNA, 19 nt, Homo sapiens
aguacaaggcugaggauga

SEQ ID NO: 240008 - RNA, 19 nt, Homo sapiens
gcaguacaaggcugaggau

SEQ ID NO: 240009 - RNA, 19 nt, Homo sapiens
gacaggagcacagguaagg

SEQ ID NO: 240010 - RNA, 19 nt, Homo sapiens
ggaggaguaugagcaucag

SEQ ID NO: 240011 - RNA, 19 nt, Homo sapiens
gcaaaaugcaagacaagug

SEQ ID NO: 240012 - RNA, 19 nt, Homo sapiens
gcaagaggaaagccuuagg

SEQ ID NO: 240013 - RNA, 19 nt, Homo sapiens
acagguaaggcuaacaaga

SEQ ID NO: 240014 - RNA, 19 nt, Homo sapiens
ggauguggcuccccugucu

SEQ ID NO: 240015 - RNA, 19 nt, Homo sapiens
acaaccggcucgugaacca

SEQ ID NO: 240016 - RNA, 19 nt, Homo sapiens
agguaaggcuaacaagauc

SEQ ID NO: 240017 - RNA, 19 nt, Homo sapiens
cauugaggagguugauuga

SEQ ID NO: 240018 - RNA, 19 nt, Homo sapiens
aguaugagcaucagaagag

SEQ ID NO: 240019 - RNA, 19 nt, Homo sapiens
gcagagaaggaggaguaug

SEQ ID NO: 240020 - RNA, 19 nt, Homo sapiens
cccagacuuucaccaccua

SEQ ID NO: 240021 - RNA, 19 nt, Homo sapiens
aggccacccuggagauaga

SEQ ID NO: 240022 - RNA, 19 nt, Homo sapiens
ggacaaguguaaugaaauu

SEQ ID NO: 240023 - RNA, 19 nt, Homo sapiens
gaaacgugcucaucuuuga

SEQ ID NO: 240024 - RNA, 19 nt, Homo sapiens
guacaaagcugaagaugag

SEQ ID NO: 240025 - RNA, 19 nt, Homo sapiens
ugacaaagaugaaggaaau

SEQ ID NO: 240026 - RNA, 19 nt, Homo sapiens
agaaagagcuggagaaagu

SEQ ID NO: 240027 - RNA, 19 nt, Homo sapiens
ugaaggaccuaaauucgua

SEQ ID NO: 240028 - RNA, 19 nt, Homo sapiens
gaaaagaacugaauaagag

SEQ ID NO: 240029 - RNA, 19 nt, Homo sapiens
caaagaugcuggaacuauu

SEQ ID NO: 240030 - RNA, 19 nt, Homo sapiens
ggaggugucuucuaugguu

SEQ ID NO: 240031 - RNA, 19 nt, Homo sapiens
aaguuaagcugcuauagua

SEQ ID NO: 240032 - RNA, 19 nt, Homo sapiens
gaacaagagagcuguaaga

SEQ ID NO: 240033 - RNA, 19 nt, Homo sapiens
cagaggaggugucuucuau

SEQ ID NO: 240034 - RNA, 19 nt, Homo sapiens
gaucgauucucucuaugaa

SEQ ID NO: 240035 - RNA, 19 nt, Homo sapiens
ggacgcagauuugaugaug

SEQ ID NO: 240036 - RNA, 19 nt, Homo sapiens
agaauucacuugaguccua

SEQ ID NO: 240037 - RNA, 19 nt, Homo sapiens
gaaagaaacgugcucaucu

SEQ ID NO: 240038 - RNA, 19 nt, Homo sapiens
ggaagacuguuaccaaugc

SEQ ID NO: 240039 - RNA, 19 nt, Homo sapiens
gaaggaagaauuugaacau

SEQ ID NO: 240040 - RNA, 19 nt, Homo sapiens
gaacucgccugcagcucuu

SEQ ID NO: 240041 - RNA, 19 nt, Homo sapiens
gaccuaaauucguagcaaa

SEQ ID NO: 240042 - RNA, 19 nt, Homo sapiens
ccaaccaaguguagaugua

SEQ ID NO: 240043 - RNA, 19 nt, Homo sapiens
gauuaacgaugaggacaaa

SEQ ID NO: 240044 - RNA, 19 nt, Homo sapiens
cugagaauguucaagauuu

SEQ ID NO: 240045 - RNA, 19 nt, Homo sapiens
ggaagacauugaacguaug

SEQ ID NO: 240046 - RNA, 19 nt, Homo sapiens
gaacaagauuacuaucacu

SEQ ID NO: 240047 - RNA, 19 nt, Homo sapiens
gagaaagcccuucgagaug

SEQ ID NO: 240048 - RNA, 19 nt, Homo sapiens
caacuggcuugauaagaau

SEQ ID NO: 240049 - RNA, 19 nt, Homo sapiens
aaacuucaaggcaagauua

SEQ ID NO: 240050 - RNA, 19 nt, Homo sapiens
aagcugcuauaguaaguua

SEQ ID NO: 240051 - RNA, 19 nt, Homo sapiens
gagaacaagauuacuauca

SEQ ID NO: 240052 - RNA, 19 nt, Homo sapiens
ggacaucagugagaacaag

SEQ ID NO: 240053 - RNA, 19 nt, Homo sapiens
gaggaggugucuucuaugg

SEQ ID NO: 240054 - RNA, 19 nt, Homo sapiens
ggaccuaaauucguagcaa

SEQ ID NO: 240055 - RNA, 19 nt, Homo sapiens
agucacagauucaugauau

SEQ ID NO: 240056 - RNA, 19 nt, Homo sapiens
caagggaccugcaguuggu

SEQ ID NO: 240057 - RNA, 19 nt, Homo sapiens
uuacugggcauucucaaua

SEQ ID NO: 240058 - RNA, 19 nt, Homo sapiens
gagcaaggaagacauugaa

SEQ ID NO: 240059 - RNA, 19 nt, Homo sapiens
gcauuguuccacacauuua

SEQ ID NO: 240060 - RNA, 19 nt, Homo sapiens
ugagaauguucaagauuug

SEQ ID NO: 240061 - RNA, 19 nt, Homo sapiens
uauugaggauggaaucuuu

SEQ ID NO: 240062 - RNA, 19 nt, Homo sapiens
agaaucaaguugcaaugaa

SEQ ID NO: 240063 - RNA, 19 nt, Homo sapiens
ccaggaagcugagaaguac

SEQ ID NO: 240064 - RNA, 19 nt, Homo sapiens
agucugauaugaaacauug

SEQ ID NO: 240065 - RNA, 19 nt, Homo sapiens
ccauugaagagguugauua

SEQ ID NO: 240066 - RNA, 19 nt, Homo sapiens
gaaucaaguugcaaugaac

SEQ ID NO: 240067 - RNA, 19 nt, Homo sapiens
cgacuucuauaccuccauu

SEQ ID NO: 240068 - RNA, 19 nt, Homo sapiens
ggaaucgacuucuauaccu

SEQ ID NO: 240069 - RNA, 19 nt, Homo sapiens
aaggcaagauuaacgauga

SEQ ID NO: 240070 - RNA, 19 nt, Homo sapiens
cuagacaagucacagauuc

SEQ ID NO: 240071 - RNA, 19 nt, Homo sapiens
guaagacgccuccguacug

SEQ ID NO: 240072 - RNA, 19 nt, Homo sapiens
gaguuuaagcgcaagcaua

SEQ ID NO: 240073 - RNA, 19 nt, Homo sapiens
uaugaaacauuggcccuuu

SEQ ID NO: 240074 - RNA, 19 nt, Homo sapiens
uagcauuguuccacacauu

SEQ ID NO: 240075 - RNA, 19 nt, Homo sapiens
aaguguagauguagcauug

SEQ ID NO: 240076 - RNA, 19 nt, Homo sapiens
gaacugaauaagagcauca

SEQ ID NO: 240077 - RNA, 19 nt, Homo sapiens
ccaaagaugcuggaacuau

SEQ ID NO: 240078 - RNA, 19 nt, Homo sapiens
caaauucuguggcaguuuu

SEQ ID NO: 240079 - RNA, 19 nt, Homo sapiens
gccugcagcucuuggguuu

SEQ ID NO: 240080 - RNA, 19 nt, Homo sapiens
aggaagacauugaacguau

SEQ ID NO: 240081 - RNA, 19 nt, Homo sapiens
gaaaagagaacaagauuac

SEQ ID NO: 240082 - RNA, 19 nt, Homo sapiens
acacagaccuucacuaccu

SEQ ID NO: 240083 - RNA, 19 nt, Homo sapiens
cguaauaccaccauuccua

SEQ ID NO: 240084 - RNA, 19 nt, Homo sapiens
ggaaaagaacugaauaaga

SEQ ID NO: 240085 - RNA, 19 nt, Homo sapiens
caaagaaucaaguugcaau

SEQ ID NO: 240086 - RNA, 19 nt, Homo sapiens
ccucagggcccaccauuga

SEQ ID NO: 240087 - RNA, 19 nt, Homo sapiens
gaaguacaaagcugaagau

SEQ ID NO: 240088 - RNA, 19 nt, Homo sapiens
caagcuaugucgccuuuac

SEQ ID NO: 240089 - RNA, 19 nt, Homo sapiens
guuggugguucuacucgua

SEQ ID NO: 240090 - RNA, 19 nt, Homo sapiens
gccaacugcugcugcuauu

SEQ ID NO: 240091 - RNA, 19 nt, Homo sapiens
uguccagucugauaugaaa

SEQ ID NO: 240092 - RNA, 19 nt, Homo sapiens
gaccugcaguugguauuga

SEQ ID NO: 240093 - RNA, 19 nt, Homo sapiens
ggaaaagagaacaagauua

SEQ ID NO: 240094 - RNA, 19 nt, Homo sapiens
agagaaagcccuucgagau

SEQ ID NO: 240095 - RNA, 19 nt, Homo sapiens
gagaacaagagagcuguaa

SEQ ID NO: 240096 - RNA, 19 nt, Homo sapiens
gcuguuguccagucugaua

SEQ ID NO: 240097 - RNA, 19 nt, Homo sapiens
agaaggacaucagugagaa

SEQ ID NO: 240098 - RNA, 19 nt, Homo sapiens
cauugaagagguugauuaa

SEQ ID NO: 240099 - RNA, 19 nt, Homo sapiens
aggaagaauuugaacauca

SEQ ID NO: 240100 - RNA, 19 nt, Homo sapiens
gaucggugaugccgcaaag

SEQ ID NO: 240101 - RNA, 19 nt, Homo sapiens
gaccuucacuaccuauucu

SEQ ID NO: 240102 - RNA, 19 nt, Homo sapiens
cagauuugaugaugcuguu

SEQ ID NO: 240103 - RNA, 19 nt, Homo sapiens
ggaaaagucgagauaauug

SEQ ID NO: 240104 - RNA, 19 nt, Homo sapiens
ccgaaccacuccaagcuau

SEQ ID NO: 240105 - RNA, 19 nt, Homo sapiens
gaaacuucaaggcaagauu

SEQ ID NO: 240106 - RNA, 19 nt, Homo sapiens
gaauucacuugaguccuau

SEQ ID NO: 240107 - RNA, 19 nt, Homo sapiens
ggaaaccgaaccacuccaa

SEQ ID NO: 240108 - RNA, 19 nt, Homo sapiens
gcacggaaaagucgagaua

SEQ ID NO: 240109 - RNA, 19 nt, Homo sapiens
cuggacaaguguaaugaaa

SEQ ID NO: 240110 - RNA, 19 nt, Homo sapiens
acaagucacagauucauga

SEQ ID NO: 240111 - RNA, 19 nt, Homo sapiens
ugcuauugcuuacggcuua

SEQ ID NO: 240112 - RNA, 19 nt, Homo sapiens
gaaccacuccaagcuaugu

SEQ ID NO: 240113 - RNA, 19 nt, Homo sapiens
uaccaaagaugcuggaacu

SEQ ID NO: 240114 - RNA, 19 nt, Homo sapiens
ggcccaagguccaaguaga

SEQ ID NO: 240115 - RNA, 19 nt, Homo sapiens
ugagaaggaagaauuugaa

SEQ ID NO: 240116 - RNA, 19 nt, Homo sapiens
ccuucgagaugccaaacua

SEQ ID NO: 240117 - RNA, 19 nt, Homo sapiens
gaugaaggaaauugcagaa

SEQ ID NO: 240118 - RNA, 19 nt, Homo sapiens
gaaagagcuggagaaaguu

SEQ ID NO: 240119 - RNA, 19 nt, Homo sapiens
gaugaggacaaacagaaga

SEQ ID NO: 240120 - RNA, 19 nt, Homo sapiens
caaggugucauccaagaau

SEQ ID NO: 240121 - RNA, 19 nt, Homo sapiens
gcacccaggccaguauuga

SEQ ID NO: 240122 - RNA, 19 nt, Homo sapiens
gaaacgugcucaucuuuga

SEQ ID NO: 240123 - RNA, 19 nt, Homo sapiens
ugacaaagaugaaggaaau

SEQ ID NO: 240124 - RNA, 19 nt, Homo sapiens
ugaaggaccuaaauucgua

SEQ ID NO: 240125 - RNA, 19 nt, Homo sapiens
gaaaagaacugaauaagag

SEQ ID NO: 240126 - RNA, 19 nt, Homo sapiens
caaagaugcuggaacuauu

SEQ ID NO: 240127 - RNA, 19 nt, Homo sapiens
ggaggugucuucuaugguu

SEQ ID NO: 240128 - RNA, 19 nt, Homo sapiens
aaguuaagcugcuauagua

SEQ ID NO: 240129 - RNA, 19 nt, Homo sapiens
gaacaagagagcuguaaga

SEQ ID NO: 240130 - RNA, 19 nt, Homo sapiens
cagaggaggugucuucuau

SEQ ID NO: 240131 - RNA, 19 nt, Homo sapiens
gaucgauucucucuaugaa

SEQ ID NO: 240132 - RNA, 19 nt, Homo sapiens
ggacgcagauuugaugaug

SEQ ID NO: 240133 - RNA, 19 nt, Homo sapiens
gaaagaaacgugcucaucu

SEQ ID NO: 240134 - RNA, 19 nt, Homo sapiens
ggaagacuguuaccaaugc

SEQ ID NO: 240135 - RNA, 19 nt, Homo sapiens
gaacucgccugcagcucuu

SEQ ID NO: 240136 - RNA, 19 nt, Homo sapiens
gaccuaaauucguagcaaa

SEQ ID NO: 240137 - RNA, 19 nt, Homo sapiens
ccaaccaaguguagaugua

SEQ ID NO: 240138 - RNA, 19 nt, Homo sapiens
cugagaauguucaagauuu

SEQ ID NO: 240139 - RNA, 19 nt, Homo sapiens
gagaaagcccuucgagaug

SEQ ID NO: 240140 - RNA, 19 nt, Homo sapiens
aagcugcuauaguaaguua

SEQ ID NO: 240141 - RNA, 19 nt, Homo sapiens
ggacaucagugagaacaag

SEQ ID NO: 240142 - RNA, 19 nt, Homo sapiens
gaggaggugucuucuaugg

SEQ ID NO: 240143 - RNA, 19 nt, Homo sapiens
ggaccuaaauucguagcaa

SEQ ID NO: 240144 - RNA, 19 nt, Homo sapiens
agucacagauucaugauau

SEQ ID NO: 240145 - RNA, 19 nt, Homo sapiens
caagggaccugcaguuggu

SEQ ID NO: 240146 - RNA, 19 nt, Homo sapiens
uuacugggcauucucaaua

SEQ ID NO: 240147 - RNA, 19 nt, Homo sapiens
gcauuguuccacacauuua

SEQ ID NO: 240148 - RNA, 19 nt, Homo sapiens
ugagaauguucaagauuug

SEQ ID NO: 240149 - RNA, 19 nt, Homo sapiens
uauugaggauggaaucuuu

SEQ ID NO: 240150 - RNA, 19 nt, Homo sapiens
agaaucaaguugcaaugaa

SEQ ID NO: 240151 - RNA, 19 nt, Homo sapiens
agucugauaugaaacauug

SEQ ID NO: 240152 - RNA, 19 nt, Homo sapiens
ccauugaagagguugauua

SEQ ID NO: 240153 - RNA, 19 nt, Homo sapiens
gaaucaaguugcaaugaac

SEQ ID NO: 240154 - RNA, 19 nt, Homo sapiens
cgacuucuauaccuccauu

SEQ ID NO: 240155 - RNA, 19 nt, Homo sapiens
ggaaucgacuucuauaccu

SEQ ID NO: 240156 - RNA, 19 nt, Homo sapiens
cuagacaagucacagauuc

SEQ ID NO: 240157 - RNA, 19 nt, Homo sapiens
guaagacgccuccguacug

SEQ ID NO: 240158 - RNA, 19 nt, Homo sapiens
gaguuuaagcgcaagcaua

SEQ ID NO: 240159 - RNA, 19 nt, Homo sapiens
uaugaaacauuggcccuuu

SEQ ID NO: 240160 - RNA, 19 nt, Homo sapiens
uagcauuguuccacacauu

SEQ ID NO: 240161 - RNA, 19 nt, Homo sapiens
aaguguagauguagcauug

SEQ ID NO: 240162 - RNA, 19 nt, Homo sapiens
gaacugaauaagagcauca

SEQ ID NO: 240163 - RNA, 19 nt, Homo sapiens
ccaaagaugcuggaacuau

SEQ ID NO: 240164 - RNA, 19 nt, Homo sapiens
caaauucuguggcaguuuu

SEQ ID NO: 240165 - RNA, 19 nt, Homo sapiens
gccugcagcucuuggguuu

SEQ ID NO: 240166 - RNA, 19 nt, Homo sapiens
acacagaccuucacuaccu

SEQ ID NO: 240167 - RNA, 19 nt, Homo sapiens
cguaauaccaccauuccua

SEQ ID NO: 240168 - RNA, 19 nt, Homo sapiens
ggaaaagaacugaauaaga

SEQ ID NO: 240169 - RNA, 19 nt, Homo sapiens
caaagaaucaaguugcaau

SEQ ID NO: 240170 - RNA, 19 nt, Homo sapiens
ccucagggcccaccauuga

SEQ ID NO: 240171 - RNA, 19 nt, Homo sapiens
guuggugguucuacucgua

SEQ ID NO: 240172 - RNA, 19 nt, Homo sapiens
gccaacugcugcugcuauu

SEQ ID NO: 240173 - RNA, 19 nt, Homo sapiens
uguccagucugauaugaaa

SEQ ID NO: 240174 - RNA, 19 nt, Homo sapiens
caagcuaugucgccuuuac

SEQ ID NO: 240175 - RNA, 19 nt, Homo sapiens
gaccugcaguugguauuga

SEQ ID NO: 240176 - RNA, 19 nt, Homo sapiens
agagaaagcccuucgagau

SEQ ID NO: 240177 - RNA, 19 nt, Homo sapiens
gagaacaagagagcuguaa

SEQ ID NO: 240178 - RNA, 19 nt, Homo sapiens
gcuguuguccagucugaua

SEQ ID NO: 240179 - RNA, 19 nt, Homo sapiens
agaaggacaucagugagaa

SEQ ID NO: 240180 - RNA, 19 nt, Homo sapiens
cauugaagagguugauuaa

SEQ ID NO: 240181 - RNA, 19 nt, Homo sapiens
gaccuucacuaccuauucu

SEQ ID NO: 240182 - RNA, 19 nt, Homo sapiens
ggaaaagucgagauaauug

SEQ ID NO: 240183 - RNA, 19 nt, Homo sapiens
cagauuugaugaugcuguu

SEQ ID NO: 240184 - RNA, 19 nt, Homo sapiens
gaucggugaugccgcaaag

SEQ ID NO: 240185 - RNA, 19 nt, Homo sapiens
ccgaaccacuccaagcuau

SEQ ID NO: 240186 - RNA, 19 nt, Homo sapiens
ggaaaccgaaccacuccaa

SEQ ID NO: 240187 - RNA, 19 nt, Homo sapiens
gcacggaaaagucgagaua

SEQ ID NO: 240188 - RNA, 19 nt, Homo sapiens
acaagucacagauucauga

SEQ ID NO: 240189 - RNA, 19 nt, Homo sapiens
gaaccacuccaagcuaugu

SEQ ID NO: 240190 - RNA, 19 nt, Homo sapiens
ugcuauugcuuacggcuua

SEQ ID NO: 240191 - RNA, 19 nt, Homo sapiens
uaccaaagaugcuggaacu

SEQ ID NO: 240192 - RNA, 19 nt, Homo sapiens
ggcccaagguccaaguaga

SEQ ID NO: 240193 - RNA, 19 nt, Homo sapiens
ccuucgagaugccaaacua

SEQ ID NO: 240194 - RNA, 19 nt, Homo sapiens
gaugaaggaaauugcagaa

SEQ ID NO: 240195 - RNA, 19 nt, Homo sapiens
gcacccaggccaguauuga

SEQ ID NO: 240196 - RNA, 19 nt, Homo sapiens
guguagauguagcauuguu

SEQ ID NO: 240197 - RNA, 19 nt, Homo sapiens
ucacagauucaugauauug

SEQ ID NO: 240198 - RNA, 19 nt, Homo sapiens
auaagaaggacaucaguga

SEQ ID NO: 240199 - RNA, 19 nt, Homo sapiens
cuucuaugguucugacaaa

SEQ ID NO: 240200 - RNA, 19 nt, Homo sapiens
ccaagguccaaguagaaua

SEQ ID NO: 240201 - RNA, 19 nt, Homo sapiens
aaacauuggcccuuuaugg

SEQ ID NO: 240202 - RNA, 19 nt, Homo sapiens
uugaagagguugauuaagc

SEQ ID NO: 240203 - RNA, 19 nt, Homo sapiens
cauuacccgugcccgauuu

SEQ ID NO: 240204 - RNA, 19 nt, Homo sapiens
uccaagcuaugucgccuuu

SEQ ID NO: 240205 - RNA, 19 nt, Homo sapiens
gcccaagguccaaguagaa

SEQ ID NO: 240206 - RNA, 19 nt, Homo sapiens
augaaacauuggcccuuua

SEQ ID NO: 240207 - RNA, 19 nt, Homo sapiens
ugauuaagccaaccaagug

SEQ ID NO: 240208 - RNA, 19 nt, Homo sapiens
ggaugucacuccucuuucc

SEQ ID NO: 240209 - RNA, 19 nt, Homo sapiens
ucacagugccagcuuacuu

SEQ ID NO: 240210 - RNA, 19 nt, Homo sapiens
gggaagacuguuaccaaug

SEQ ID NO: 240211 - RNA, 19 nt, Homo sapiens
ugggaagacuguuaccaau

SEQ ID NO: 240212 - RNA, 19 nt, Homo sapiens
caacccugaugaagcuguu

SEQ ID NO: 240213 - RNA, 19 nt, Homo sapiens
aaagaugcuggaacuauug

SEQ ID NO: 240214 - RNA, 19 nt, Homo sapiens
ccuuuaugguggugaauga

SEQ ID NO: 240215 - RNA, 19 nt, Homo sapiens
gcaaauucuguggcaguuu

SEQ ID NO: 240216 - RNA, 19 nt, Homo sapiens
acugaaugcugaccuguuc

SEQ ID NO: 240217 - RNA, 19 nt, Homo sapiens
aaaguuaagcugcuauagu

SEQ ID NO: 240218 - RNA, 19 nt, Homo sapiens
gcaaugaaccccaccaaca

SEQ ID NO: 240219 - RNA, 19 nt, Homo sapiens
cacagugccagcuuacuuu

SEQ ID NO: 240220 - RNA, 19 nt, Homo sapiens
gaaacauuggcccuuuaug

SEQ ID NO: 240221 - RNA, 19 nt, Homo sapiens
uuaagcugcuauaguaagu

SEQ ID NO: 240222 - RNA, 19 nt, Homo sapiens
gcaacaagcugaaagaaga

SEQ ID NO: 240223 - RNA, 19 nt, Homo sapiens
gaugagauccuucuaguua

SEQ ID NO: 240224 - RNA, 19 nt, Homo sapiens
gaaugaggcuagaccuuua

SEQ ID NO: 240225 - RNA, 19 nt, Homo sapiens
uaaagaugcuggccagaua

SEQ ID NO: 240226 - RNA, 19 nt, Homo sapiens
gaaguuacauuugacauug

SEQ ID NO: 240227 - RNA, 19 nt, Homo sapiens
gaaaugagaccacauaugg

SEQ ID NO: 240228 - RNA, 19 nt, Homo sapiens
gaaauaugcugaagaagac

SEQ ID NO: 240229 - RNA, 19 nt, Homo sapiens
ggaauggccuuagucauga

SEQ ID NO: 240230 - RNA, 19 nt, Homo sapiens
aaaccaagauggaagaauu

SEQ ID NO: 240231 - RNA, 19 nt, Homo sapiens
gaagaagaccggcgaaaga

SEQ ID NO: 240232 - RNA, 19 nt, Homo sapiens
gcagaggaaucuagaacaa

SEQ ID NO: 240233 - RNA, 19 nt, Homo sapiens
aaacgcaaguggaaauuaa

SEQ ID NO: 240234 - RNA, 19 nt, Homo sapiens
caaagucauugcuguauau

SEQ ID NO: 240235 - RNA, 19 nt, Homo sapiens
gaggugaaauccacaaaug

SEQ ID NO: 240236 - RNA, 19 nt, Homo sapiens
ggaacgaguugaagcaguu

SEQ ID NO: 240237 - RNA, 19 nt, Homo sapiens
ggacagugauucuaacagu

SEQ ID NO: 240238 - RNA, 19 nt, Homo sapiens
agagaaauaugcugaagaa

SEQ ID NO: 240239 - RNA, 19 nt, Homo sapiens
gaaagagacugcagaaaau

SEQ ID NO: 240240 - RNA, 19 nt, Homo sapiens
ggacaacauaugaagcuua

SEQ ID NO: 240241 - RNA, 19 nt, Homo sapiens
uaauauggcugaaggaauc

SEQ ID NO: 240242 - RNA, 19 nt, Homo sapiens
cgagaaggcucuggaaguu

SEQ ID NO: 240243 - RNA, 19 nt, Homo sapiens
ggaaugaggcuagaccuuu

SEQ ID NO: 240244 - RNA, 19 nt, Homo sapiens
gaucuaaucagaaggacua

SEQ ID NO: 240245 - RNA, 19 nt, Homo sapiens
gagcauuuguguugaugaa

SEQ ID NO: 240246 - RNA, 19 nt, Homo sapiens
ccaauuaccugcugaugag

SEQ ID NO: 240247 - RNA, 19 nt, Homo sapiens
ugacauaggagaagugauu

SEQ ID NO: 240248 - RNA, 19 nt, Homo sapiens
agacaaaucagaagacaaa

SEQ ID NO: 240249 - RNA, 19 nt, Homo sapiens
gcauuuguguugaugaaga

SEQ ID NO: 240250 - RNA, 19 nt, Homo sapiens
gacagugauucuaacagua

SEQ ID NO: 240251 - RNA, 19 nt, Homo sapiens
caaaggugcuggagaaugc

SEQ ID NO: 240252 - RNA, 19 nt, Homo sapiens
gcacacagcaaugaaggua

SEQ ID NO: 240253 - RNA, 19 nt, Homo sapiens
gagguaggaugaauugauc

SEQ ID NO: 240254 - RNA, 19 nt, Homo sapiens
gacccaagcauuugaauau

SEQ ID NO: 240255 - RNA, 19 nt, Homo sapiens
acaaagucauugcuguaua

SEQ ID NO: 240256 - RNA, 19 nt, Homo sapiens
ggauuaagcaaagaugaua

SEQ ID NO: 240257 - RNA, 19 nt, Homo sapiens
ggaggugucuuuaccaaac

SEQ ID NO: 240258 - RNA, 19 nt, Homo sapiens
ccaagcauuugaauaugaa

SEQ ID NO: 240259 - RNA, 19 nt, Homo sapiens
gaagguagucauccauaga

SEQ ID NO: 240260 - RNA, 19 nt, Homo sapiens
gacaacauaugaagcuuag

SEQ ID NO: 240261 - RNA, 19 nt, Homo sapiens
ccaaugggauaguacaugu

SEQ ID NO: 240262 - RNA, 19 nt, Homo sapiens
cagcaagagugacauagga

SEQ ID NO: 240263 - RNA, 19 nt, Homo sapiens
gauuggagcauuuguguug

SEQ ID NO: 240264 - RNA, 19 nt, Homo sapiens
ugggaaacuuagcuauuua

SEQ ID NO: 240265 - RNA, 19 nt, Homo sapiens
ccauagacuugaaaugaga

SEQ ID NO: 240266 - RNA, 19 nt, Homo sapiens
ccagaaggacaacauauga

SEQ ID NO: 240267 - RNA, 19 nt, Homo sapiens
gagcaguuguugguauuga

SEQ ID NO: 240268 - RNA, 19 nt, Homo sapiens
agaggaaucuagaacaaug

SEQ ID NO: 240269 - RNA, 19 nt, Homo sapiens
gaaaugggcgaacuucagu

SEQ ID NO: 240270 - RNA, 19 nt, Homo sapiens
agaaauaugcugaagaaga

SEQ ID NO: 240271 - RNA, 19 nt, Homo sapiens
ggacccaagcauuugaaua

SEQ ID NO: 240272 - RNA, 19 nt, Homo sapiens
gaaguacagaaagacauua

SEQ ID NO: 240273 - RNA, 19 nt, Homo sapiens
gggagcaguuguugguauu

SEQ ID NO: 240274 - RNA, 19 nt, Homo sapiens
cuugaugauuguucucuua

SEQ ID NO: 240275 - RNA, 19 nt, Homo sapiens
caacugaggccuugcaagu

SEQ ID NO: 240276 - RNA, 19 nt, Homo sapiens
caacauaugaagcuuagga

SEQ ID NO: 240277 - RNA, 19 nt, Homo sapiens
gcagagacaggccacuaaa

SEQ ID NO: 240278 - RNA, 19 nt, Homo sapiens
gaaagaaggaacgaguuga

SEQ ID NO: 240279 - RNA, 19 nt, Homo sapiens
gcagagaaauaugcugaag

SEQ ID NO: 240280 - RNA, 19 nt, Homo sapiens
caaacgcaaguggaaauua

SEQ ID NO: 240281 - RNA, 19 nt, Homo sapiens
ggguugauuugacuaaaga

SEQ ID NO: 240282 - RNA, 19 nt, Homo sapiens
ucacagucccagcuuauuu

SEQ ID NO: 240283 - RNA, 19 nt, Homo sapiens
gcaaguggaaauuaaagug

SEQ ID NO: 240284 - RNA, 19 nt, Homo sapiens
uugaagggauugucacuga

SEQ ID NO: 240285 - RNA, 19 nt, Homo sapiens
ugggcgaacuucagucuuu

SEQ ID NO: 240286 - RNA, 19 nt, Homo sapiens
cacugaagcuguucgaaau

SEQ ID NO: 240287 - RNA, 19 nt, Homo sapiens
guacauguuucugcuaaag

SEQ ID NO: 240288 - RNA, 19 nt, Homo sapiens
ccaagaagagccagguauu

SEQ ID NO: 240289 - RNA, 19 nt, Homo sapiens
cccaagcauuugaauauga

SEQ ID NO: 240290 - RNA, 19 nt, Homo sapiens
ggaaauucagaaaggagua

SEQ ID NO: 240291 - RNA, 19 nt, Homo sapiens
gaugaaagagacugcagaa

SEQ ID NO: 240292 - RNA, 19 nt, Homo sapiens
gcgauaugaugauccugaa

SEQ ID NO: 240293 - RNA, 19 nt, Homo sapiens
caacccaaacaauacauuu

SEQ ID NO: 240294 - RNA, 19 nt, Homo sapiens
ggagguaggaugaauugau

SEQ ID NO: 240295 - RNA, 19 nt, Homo sapiens
gaacgaguugaagcaguua

SEQ ID NO: 240296 - RNA, 19 nt, Homo sapiens
uaguacauguuucugcuaa

SEQ ID NO: 240297 - RNA, 19 nt, Homo sapiens
ugacaucaauuugcccuau

SEQ ID NO: 240298 - RNA, 19 nt, Homo sapiens
gaucacagucccagcuuau

SEQ ID NO: 240299 - RNA, 19 nt, Homo sapiens
gguauugauuuggguacua

SEQ ID NO: 240300 - RNA, 19 nt, Homo sapiens
gaggcuagaccuuuaacuu

SEQ ID NO: 240301 - RNA, 19 nt, Homo sapiens
uaauggacagugauucuaa

SEQ ID NO: 240302 - RNA, 19 nt, Homo sapiens
gaaggaacgaguugaagca

SEQ ID NO: 240303 - RNA, 19 nt, Homo sapiens
ugacuaggaugcccaaggu

SEQ ID NO: 240304 - RNA, 19 nt, Homo sapiens
gcauuugaauaugaaguug

SEQ ID NO: 240305 - RNA, 19 nt, Homo sapiens
uagaacaaugggaaacuua

SEQ ID NO: 240306 - RNA, 19 nt, Homo sapiens
auaugaagcuuaggaguga

SEQ ID NO: 240307 - RNA, 19 nt, Homo sapiens
ucacugaagcuguucgaaa

SEQ ID NO: 240308 - RNA, 19 nt, Homo sapiens
cgaaagaaggaacgaguug

SEQ ID NO: 240309 - RNA, 19 nt, Homo sapiens
caaaucagaagacaaaguc

SEQ ID NO: 240310 - RNA, 19 nt, Homo sapiens
gaaugugcuucgggugauu

SEQ ID NO: 240311 - RNA, 19 nt, Homo sapiens
gagcagaaaugggcgaacu

SEQ ID NO: 240312 - RNA, 19 nt, Homo sapiens
gagacuuccugagcagaaa

SEQ ID NO: 240313 - RNA, 19 nt, Homo sapiens
gggagcuccuggcuagaaa

SEQ ID NO: 240314 - RNA, 19 nt, Homo sapiens
ccucguacuccuccauuua

SEQ ID NO: 240315 - RNA, 19 nt, Homo sapiens
ggacgugagcagcagauug

SEQ ID NO: 240316 - RNA, 19 nt, Homo sapiens
ggacaguuuacuuugauug

SEQ ID NO: 240317 - RNA, 19 nt, Homo sapiens
agagauggcuggagacaac

SEQ ID NO: 240318 - RNA, 19 nt, Homo sapiens
cgagucagauuggagcauu

SEQ ID NO: 240319 - RNA, 19 nt, Homo sapiens
gcaaaggugcuggagaaug

SEQ ID NO: 240320 - RNA, 19 nt, Homo sapiens
gaguugaagcaguuaauau

SEQ ID NO: 240321 - RNA, 19 nt, Homo sapiens
agacaaagucauugcugua

SEQ ID NO: 240322 - RNA, 19 nt, Homo sapiens
ggacgagcauggcuacauc

SEQ ID NO: 240323 - RNA, 19 nt, Homo sapiens
ggaguggucgcagugguua

SEQ ID NO: 240324 - RNA, 19 nt, Homo sapiens
gagaucaccaucccaguca

SEQ ID NO: 240325 - RNA, 19 nt, Homo sapiens
ugagacugccgccaaguaa

SEQ ID NO: 240326 - RNA, 19 nt, Homo sapiens
gcagagucagccagcauga

SEQ ID NO: 240327 - RNA, 19 nt, Homo sapiens
gagacugccgccaaguaaa

SEQ ID NO: 240328 - RNA, 19 nt, Homo sapiens
gccgccaaguaaagccuua

SEQ ID NO: 240329 - RNA, 19 nt, Homo sapiens
gcgugucccuggaugucaa

SEQ ID NO: 240330 - RNA, 19 nt, Homo sapiens
gagcagagucagccagcau

SEQ ID NO: 240331 - RNA, 19 nt, Homo sapiens
ccaccuguguguucuuuug

SEQ ID NO: 240332 - RNA, 19 nt, Homo sapiens
cgccaccuguguguucuuu

SEQ ID NO: 240333 - RNA, 19 nt, Homo sapiens
ccacgcaguccaacgagau

SEQ ID NO: 240334 - RNA, 19 nt, Homo sapiens
ggaggaggcagccauaguu

SEQ ID NO: 240335 - RNA, 19 nt, Homo sapiens
gcccaccacuccagaggua

SEQ ID NO: 240336 - RNA, 19 nt, Homo sapiens
gguccacaauguaugguuu

SEQ ID NO: 240337 - RNA, 19 nt, Homo sapiens
ggagcugaauaaacccaaa

SEQ ID NO: 240338 - RNA, 19 nt, Homo sapiens
ucauagccuugguuuaguu

SEQ ID NO: 240339 - RNA, 19 nt, Homo sapiens
gugcaugguccacaaugua

SEQ ID NO: 240340 - RNA, 19 nt, Homo sapiens
ggacacagaggucaaugag

SEQ ID NO: 240341 - RNA, 19 nt, Homo sapiens
gcugcucucucccaugaug

SEQ ID NO: 240342 - RNA, 19 nt, Homo sapiens
aaaggugcaugguccacaa

SEQ ID NO: 240343 - RNA, 19 nt, Homo sapiens
ggguggagcugaauaaacc

SEQ ID NO: 240344 - RNA, 19 nt, Homo sapiens
ugucauagccuugguuuag

SEQ ID NO: 240345 - RNA, 19 nt, Homo sapiens
gaggaggcagccauaguug

SEQ ID NO: 240346 - RNA, 19 nt, Homo sapiens
gaaggccuccugccagaag

SEQ ID NO: 240347 - RNA, 19 nt, Homo sapiens
gagcccugauugccacaga

SEQ ID NO: 240348 - RNA, 19 nt, Homo sapiens
ggugcaugguccacaaugu

SEQ ID NO: 240349 - RNA, 19 nt, Homo sapiens
gccgacauuuggacacaga

SEQ ID NO: 240350 - RNA, 19 nt, Homo sapiens
ggaggcagccauaguugag

SEQ ID NO: 240351 - RNA, 19 nt, Homo sapiens
acucuaccauggcuacuau

SEQ ID NO: 240352 - RNA, 19 nt, Homo sapiens
gcaaguuccaggcauuucu

SEQ ID NO: 240353 - RNA, 19 nt, Homo sapiens
gggcaaguuccaggcauuu

SEQ ID NO: 240354 - RNA, 19 nt, Homo sapiens
gagcugaauaaacccaaau

SEQ ID NO: 240355 - RNA, 19 nt, Homo sapiens
caccgccgaguacgaauuu

SEQ ID NO: 240356 - RNA, 19 nt, Homo sapiens
cauaguugagcccugauug

SEQ ID NO: 240357 - RNA, 19 nt, Homo sapiens
cccagcaaaucccucucua

SEQ ID NO: 240358 - RNA, 19 nt, Homo sapiens
agaggaggaggcagccaua

SEQ ID NO: 240359 - RNA, 19 nt, Homo sapiens
gucauagccuugguuuagu

SEQ ID NO: 240360 - RNA, 19 nt, Homo sapiens
caugucauagccuugguuu

SEQ ID NO: 240361 - RNA, 19 nt, Homo sapiens
ccagacgaggugacuguga

SEQ ID NO: 240362 - RNA, 19 nt, Homo sapiens
gaagggaaaggugcauggu

SEQ ID NO: 240363 - RNA, 19 nt, Homo sapiens
agacccagcacccagcaaa

SEQ ID NO: 240364 - RNA, 19 nt, Homo sapiens
ggaaagagcugcauauuaa

SEQ ID NO: 240365 - RNA, 19 nt, Homo sapiens
gcagauaucucuaugauug

SEQ ID NO: 240366 - RNA, 19 nt, Homo sapiens
gaagugaucuauaugauug

SEQ ID NO: 240367 - RNA, 19 nt, Homo sapiens
gaaggaacgugauaaagaa

SEQ ID NO: 240368 - RNA, 19 nt, Homo sapiens
uaaaggagauugugaagaa

SEQ ID NO: 240369 - RNA, 19 nt, Homo sapiens
uauaagagcuugaccaaug

SEQ ID NO: 240370 - RNA, 19 nt, Homo sapiens
agacaaaccugaaauugaa

SEQ ID NO: 240371 - RNA, 19 nt, Homo sapiens
aaacauggcuuagaaguga

SEQ ID NO: 240372 - RNA, 19 nt, Homo sapiens
gcuuagaacucuuuacuga

SEQ ID NO: 240373 - RNA, 19 nt, Homo sapiens
uuucagagcuguuaaggua

SEQ ID NO: 240374 - RNA, 19 nt, Homo sapiens
gggaaagagcugcauauua

SEQ ID NO: 240375 - RNA, 19 nt, Homo sapiens
agaaacaccuggagauaaa

SEQ ID NO: 240376 - RNA, 19 nt, Homo sapiens
ggaucucccucuaaacaua

SEQ ID NO: 240377 - RNA, 19 nt, Homo sapiens
gaaagagucggaagacaaa

SEQ ID NO: 240378 - RNA, 19 nt, Homo sapiens
gaaauucuaugagcaguuc

SEQ ID NO: 240379 - RNA, 19 nt, Homo sapiens
ggaacgugauaaagaagua

SEQ ID NO: 240380 - RNA, 19 nt, Homo sapiens
guacaucgaucaagaagag

SEQ ID NO: 240381 - RNA, 19 nt, Homo sapiens
aaacugcgcuccugucuuc

SEQ ID NO: 240382 - RNA, 19 nt, Homo sapiens
ucaauaaccuugguacuau

SEQ ID NO: 240383 - RNA, 19 nt, Homo sapiens
uaugaaagcuugacagauc

SEQ ID NO: 240384 - RNA, 19 nt, Homo sapiens
ugaaagacauauuggagaa

SEQ ID NO: 240385 - RNA, 19 nt, Homo sapiens
uaaauuagacucugggaaa

SEQ ID NO: 240386 - RNA, 19 nt, Homo sapiens
ugaaggaucuggucaucuu

SEQ ID NO: 240387 - RNA, 19 nt, Homo sapiens
gaagacaaaccugaaauug

SEQ ID NO: 240388 - RNA, 19 nt, Homo sapiens
aaacauaucccgugagaug

SEQ ID NO: 240389 - RNA, 19 nt, Homo sapiens
cagcaaacauggagagaau

SEQ ID NO: 240390 - RNA, 19 nt, Homo sapiens
ggauaucccauuacucuuu

SEQ ID NO: 240391 - RNA, 19 nt, Homo sapiens
gaauaaaggagauugugaa

SEQ ID NO: 240392 - RNA, 19 nt, Homo sapiens
gaccaaagcguucauggaa

SEQ ID NO: 240393 - RNA, 19 nt, Homo sapiens
ugacagaucccaguaaauu

SEQ ID NO: 240394 - RNA, 19 nt, Homo sapiens
uaacucagccuuuguggaa

SEQ ID NO: 240395 - RNA, 19 nt, Homo sapiens
gcaccagaaugaaggagaa

SEQ ID NO: 240396 - RNA, 19 nt, Homo sapiens
gcuaaucccugaauaucug

SEQ ID NO: 240397 - RNA, 19 nt, Homo sapiens
ccagaaaucccgacgauau

SEQ ID NO: 240398 - RNA, 19 nt, Homo sapiens
ggaagacaaaccugaaauu

SEQ ID NO: 240399 - RNA, 19 nt, Homo sapiens
ggagaaggaacgugauaaa

SEQ ID NO: 240400 - RNA, 19 nt, Homo sapiens
gaacaaaaguuauccuaca

SEQ ID NO: 240401 - RNA, 19 nt, Homo sapiens
gaaauugcccaguugaugu

SEQ ID NO: 240402 - RNA, 19 nt, Homo sapiens
ugaaggagaugacgacaca

SEQ ID NO: 240403 - RNA, 19 nt, Homo sapiens
uuacugaacuggcggaaga

SEQ ID NO: 240404 - RNA, 19 nt, Homo sapiens
ucagagcccuucuauuugu

SEQ ID NO: 240405 - RNA, 19 nt, Homo sapiens
gaucgaacucucacuauug

SEQ ID NO: 240406 - RNA, 19 nt, Homo sapiens
gaucaucaauacuuucuac

SEQ ID NO: 240407 - RNA, 19 nt, Homo sapiens
uccaacagcugaaggaauu

SEQ ID NO: 240408 - RNA, 19 nt, Homo sapiens
auucagagcccuucuauuu

SEQ ID NO: 240409 - RNA, 19 nt, Homo sapiens
gaaggacaguuggaauuca

SEQ ID NO: 240410 - RNA, 19 nt, Homo sapiens
gaaggauggugacaagaag

SEQ ID NO: 240411 - RNA, 19 nt, Homo sapiens
uaacugugaucaccaaaca

SEQ ID NO: 240412 - RNA, 19 nt, Homo sapiens
cuaaacauaucccgugaga

SEQ ID NO: 240413 - RNA, 19 nt, Homo sapiens
gacagaucccaguaaauua

SEQ ID NO: 240414 - RNA, 19 nt, Homo sapiens
gaaugaaggagaaccagaa

SEQ ID NO: 240415 - RNA, 19 nt, Homo sapiens
gaccagaaaucccgacgau

SEQ ID NO: 240416 - RNA, 19 nt, Homo sapiens
gaacaaacaagaucgaacu

SEQ ID NO: 240417 - RNA, 19 nt, Homo sapiens
gugcagauaucucuaugau

SEQ ID NO: 240418 - RNA, 19 nt, Homo sapiens
gaucuggucaucuugcuuu

SEQ ID NO: 240419 - RNA, 19 nt, Homo sapiens
gauaaacccugaccauucc

SEQ ID NO: 240420 - RNA, 19 nt, Homo sapiens
agagacaacucaacaaugg

SEQ ID NO: 240421 - RNA, 19 nt, Homo sapiens
ccaaggaccagguagcuaa

SEQ ID NO: 240422 - RNA, 19 nt, Homo sapiens
ucaagaagagcucaacaaa

SEQ ID NO: 240423 - RNA, 19 nt, Homo sapiens
ugauugagcccauugauga

SEQ ID NO: 240424 - RNA, 19 nt, Homo sapiens
gaaccagaaacauaucuau

SEQ ID NO: 240425 - RNA, 19 nt, Homo sapiens
ucuaugagcaguucucuaa

SEQ ID NO: 240426 - RNA, 19 nt, Homo sapiens
aaagaaggauggugacaag

SEQ ID NO: 240427 - RNA, 19 nt, Homo sapiens
gagauaaacccugaccauu

SEQ ID NO: 240428 - RNA, 19 nt, Homo sapiens
gaagaagaagauuaaggaa

SEQ ID NO: 240429 - RNA, 19 nt, Homo sapiens
aggcugacuugaucaauaa

SEQ ID NO: 240430 - RNA, 19 nt, Homo sapiens
caagaucgaacucucacua

SEQ ID NO: 240431 - RNA, 19 nt, Homo sapiens
cgacaagucugugaaggau

SEQ ID NO: 240432 - RNA, 19 nt, Homo sapiens
aaagaaacaccuggagaua

SEQ ID NO: 240433 - RNA, 19 nt, Homo sapiens
uuacauggcagcaaagaaa

SEQ ID NO: 240434 - RNA, 19 nt, Homo sapiens
ucggaaacauggcuuagaa

SEQ ID NO: 240435 - RNA, 19 nt, Homo sapiens
gaacgucuucggaaacaug

SEQ ID NO: 240436 - RNA, 19 nt, Homo sapiens
ggauaacugugaggagcua

SEQ ID NO: 240437 - RNA, 19 nt, Homo sapiens
caaagaaacaccuggagau

SEQ ID NO: 240438 - RNA, 19 nt, Homo sapiens
gcaaacauggagagaauca

SEQ ID NO: 240439 - RNA, 19 nt, Homo sapiens
gaaacauggcuuagaagug

SEQ ID NO: 240440 - RNA, 19 nt, Homo sapiens
ucaauacuuucuacucgaa

SEQ ID NO: 240441 - RNA, 19 nt, Homo sapiens
ggaguacggagaauucuau

SEQ ID NO: 240442 - RNA, 19 nt, Homo sapiens
acaagaagaagaagaagaa

SEQ ID NO: 240443 - RNA, 19 nt, Homo sapiens
agaaggaacgugauaaaga

SEQ ID NO: 240444 - RNA, 19 nt, Homo sapiens
gaaccuaugggucguggaa

SEQ ID NO: 240445 - RNA, 19 nt, Homo sapiens
ccaaacauaacgaugauga

SEQ ID NO: 240446 - RNA, 19 nt, Homo sapiens
cauggaagaaguagacuaa

SEQ ID NO: 240447 - RNA, 19 nt, Homo sapiens
caaagaaggccuggaacuu

SEQ ID NO: 240448 - RNA, 19 nt, Homo sapiens
guagcuaacucagccuuug

SEQ ID NO: 240449 - RNA, 19 nt, Homo sapiens
acauaaagcuuggaauaca

SEQ ID NO: 240450 - RNA, 19 nt, Homo sapiens
gaauucagagcccuucuau

SEQ ID NO: 240451 - RNA, 19 nt, Homo sapiens
aaaggaagacaaagaagaa

SEQ ID NO: 240452 - RNA, 19 nt, Homo sapiens
aaggcugacuugaucaaua

SEQ ID NO: 240453 - RNA, 19 nt, Homo sapiens
gagaaccucugcaaaauca

SEQ ID NO: 240454 - RNA, 19 nt, Homo sapiens
aaggagaaccagaaacaua

SEQ ID NO: 240455 - RNA, 19 nt, Homo sapiens
gagcugcauauuaaccuua

SEQ ID NO: 240456 - RNA, 19 nt, Homo sapiens
ugaaaguuaucaggaagaa

SEQ ID NO: 240457 - RNA, 19 nt, Homo sapiens
ggagcuaaucccugaauau

SEQ ID NO: 240458 - RNA, 19 nt, Homo sapiens
agaaaucccgacgauauua

SEQ ID NO: 240459 - RNA, 19 nt, Homo sapiens
gagaaagagucggaagaca

SEQ ID NO: 240460 - RNA, 19 nt, Homo sapiens
gcugagaaaguaacuguga

SEQ ID NO: 240461 - RNA, 19 nt, Homo sapiens
gaagauaaagagaacuaca

SEQ ID NO: 240462 - RNA, 19 nt, Homo sapiens
ggaauucagagcccuucua

SEQ ID NO: 240463 - RNA, 19 nt, Homo sapiens
guacggagaauucuauaag

SEQ ID NO: 240464 - RNA, 19 nt, Homo sapiens
caucacagcucuugaaaug

SEQ ID NO: 240465 - RNA, 19 nt, Homo sapiens
gaaaugggcuucgcaguca

SEQ ID NO: 240466 - RNA, 19 nt, Homo sapiens
gaagauagcgggaaauaca

SEQ ID NO: 240467 - RNA, 19 nt, Homo sapiens
gcagaaaguuggcgagaag

SEQ ID NO: 240468 - RNA, 19 nt, Homo sapiens
gacaaagaauucacuguuc

SEQ ID NO: 240469 - RNA, 19 nt, Homo sapiens
gguauucccugaggacuaa

SEQ ID NO: 240470 - RNA, 19 nt, Homo sapiens
gcagagcuguggcggaaga

SEQ ID NO: 240471 - RNA, 19 nt, Homo sapiens
gagccgagauuucaugcuu

SEQ ID NO: 240472 - RNA, 19 nt, Homo sapiens
gggcccagaugcugucuuu

SEQ ID NO: 240473 - RNA, 19 nt, Homo sapiens
ggaagcgccuuguguugug

SEQ ID NO: 240474 - RNA, 19 nt, Homo sapiens
gcacugauaagcaauacuu

SEQ ID NO: 240475 - RNA, 19 nt, Homo sapiens
gggaauucauugauaagga

SEQ ID NO: 240476 - RNA, 19 nt, Homo sapiens
ccagccaacugacaaagaa

SEQ ID NO: 240477 - RNA, 19 nt, Homo sapiens
ccaggaagauagcgggaaa

SEQ ID NO: 240478 - RNA, 19 nt, Homo sapiens
gugcaaagaugaaccuagu

SEQ ID NO: 240479 - RNA, 19 nt, Homo sapiens
ugccagaaaugagagauua

SEQ ID NO: 240480 - RNA, 19 nt, Homo sapiens
auaaguggauugccagaaa

SEQ ID NO: 240481 - RNA, 19 nt, Homo sapiens
gguaugcuaugacccgaaa

SEQ ID NO: 240482 - RNA, 19 nt, Homo sapiens
ccacaacuccgccuuugaa

SEQ ID NO: 240483 - RNA, 19 nt, Homo sapiens
cggaagaacuacaacaaca

SEQ ID NO: 240484 - RNA, 19 nt, Homo sapiens
gaacucugaugggaagaau

SEQ ID NO: 240485 - RNA, 19 nt, Homo sapiens
caacuccgccuuugaauac

SEQ ID NO: 240486 - RNA, 19 nt, Homo sapiens
aaacaagcccauucaguug

SEQ ID NO: 240487 - RNA, 19 nt, Homo sapiens
cagggucgcuucucuguca

SEQ ID NO: 240488 - RNA, 19 nt, Homo sapiens
ccaaagagagcgacagugu

SEQ ID NO: 240489 - RNA, 19 nt, Homo sapiens
ugacaaagaauucacuguu

SEQ ID NO: 240490 - RNA, 19 nt, Homo sapiens
gcaggucaccguucaggaa

SEQ ID NO: 240491 - RNA, 19 nt, Homo sapiens
caguaugaaugccauguga

SEQ ID NO: 240492 - RNA, 19 nt, Homo sapiens
uggaaugguuuguauggaa

SEQ ID NO: 240493 - RNA, 19 nt, Homo sapiens
gagcaagcgucccaagaac

SEQ ID NO: 240494 - RNA, 19 nt, Homo sapiens
gaguuacagugcaaagaug

SEQ ID NO: 240495 - RNA, 19 nt, Homo sapiens
ucaaagagccacaccucaa

SEQ ID NO: 240496 - RNA, 19 nt, Homo sapiens
ccaguggcauguggucuaa

SEQ ID NO: 240497 - RNA, 19 nt, Homo sapiens
ggaguuacagugcaaagau

SEQ ID NO: 240498 - RNA, 19 nt, Homo sapiens
gauggcgaguggcagauug

SEQ ID NO: 240499 - RNA, 19 nt, Homo sapiens
caacgacgcacucuucuac

SEQ ID NO: 240500 - RNA, 19 nt, Homo sapiens
aaacuguucucuggagcua

SEQ ID NO: 240501 - RNA, 19 nt, Homo sapiens
gaggaagcgccuuguguug

SEQ ID NO: 240502 - RNA, 19 nt, Homo sapiens
gagagcaggcagccaagaa

SEQ ID NO: 240503 - RNA, 19 nt, Homo sapiens
cagcgacuccuuugacuug

SEQ ID NO: 240504 - RNA, 19 nt, Homo sapiens
gcaauaucauguggcuaga

SEQ ID NO: 240505 - RNA, 19 nt, Homo sapiens
uaaguggauugccagaaau

SEQ ID NO: 240506 - RNA, 19 nt, Homo sapiens
gaugggucgugguaugcua

SEQ ID NO: 240507 - RNA, 19 nt, Homo sapiens
gcucaugguggaaugguuu

SEQ ID NO: 240508 - RNA, 19 nt, Homo sapiens
agccagaacucccacuuug

SEQ ID NO: 240509 - RNA, 19 nt, Homo sapiens
ggacgagggccaguaugaa

SEQ ID NO: 240510 - RNA, 19 nt, Homo sapiens
acuguucucuggagcuaua

SEQ ID NO: 240511 - RNA, 19 nt, Homo sapiens
agaauguucccgaccguua

SEQ ID NO: 240512 - RNA, 19 nt, Homo sapiens
gcccagcccucagaaggaa

SEQ ID NO: 240513 - RNA, 19 nt, Homo sapiens
gcucugguauguccacaag

SEQ ID NO: 240514 - RNA, 19 nt, Homo sapiens
agcaauacuuugggaguua

SEQ ID NO: 240515 - RNA, 19 nt, Homo sapiens
gcucucccuuucucuguga

SEQ ID NO: 240516 - RNA, 19 nt, Homo sapiens
gaagaggaagcgccuugug

SEQ ID NO: 240517 - RNA, 19 nt, Homo sapiens
cggcauccguguucuagau

SEQ ID NO: 240518 - RNA, 19 nt, Homo sapiens
ccaaugccacggucucuga

SEQ ID NO: 240519 - RNA, 19 nt, Homo sapiens
ggaggacgagggccaguau

SEQ ID NO: 240520 - RNA, 19 nt, Homo sapiens
gcaagcgucccaagaacau

SEQ ID NO: 240521 - RNA, 19 nt, Homo sapiens
caacuacgccugguacaag

SEQ ID NO: 240522 - RNA, 19 nt, Homo sapiens
gcacaucacagaucuucag

SEQ ID NO: 240523 - RNA, 19 nt, Homo sapiens
gagagcaagcgucccaaga

SEQ ID NO: 240524 - RNA, 19 nt, Homo sapiens
ggcagaaaguuggcgagaa

SEQ ID NO: 240525 - RNA, 19 nt, Homo sapiens
gcaauuacuccugccaugu

SEQ ID NO: 240526 - RNA, 19 nt, Homo sapiens
cccaagauacaggcaauua

SEQ ID NO: 240527 - RNA, 19 nt, Homo sapiens
gaccuacagcgacuccuuu

SEQ ID NO: 240528 - RNA, 19 nt, Homo sapiens
gccgagauuucaugcuuca

SEQ ID NO: 240529 - RNA, 19 nt, Homo sapiens
gacuugcaguguaucauca

SEQ ID NO: 240530 - RNA, 19 nt, Homo sapiens
gacgagggccaguaugaau

SEQ ID NO: 240531 - RNA, 19 nt, Homo sapiens
acaacuccgccuuugaaua

SEQ ID NO: 240532 - RNA, 19 nt, Homo sapiens
gcaacaacguccgccuaag

SEQ ID NO: 240533 - RNA, 19 nt, Homo sapiens
gcaauacuuugggaguuac

SEQ ID NO: 240534 - RNA, 19 nt, Homo sapiens
caagauacaggcaauuacu

SEQ ID NO: 240535 - RNA, 19 nt, Homo sapiens
gcaggcagccaagaacaau

SEQ ID NO: 240536 - RNA, 19 nt, Homo sapiens
ggucaccguucaggaagga

SEQ ID NO: 240537 - RNA, 19 nt, Homo sapiens
gcccucagaaggaauggua

SEQ ID NO: 240538 - RNA, 19 nt, Homo sapiens
gcaagcuuauccugaagac

SEQ ID NO: 240539 - RNA, 19 nt, Homo sapiens
gaagcgccuuguguugugu

SEQ ID NO: 240540 - RNA, 19 nt, Homo sapiens
ugaaugccaugugacugaa

SEQ ID NO: 240541 - RNA, 19 nt, Homo sapiens
gaacauccccaucauaguc

SEQ ID NO: 240542 - RNA, 19 nt, Homo sapiens
agagcaagcgucccaagaa

SEQ ID NO: 240543 - RNA, 19 nt, Homo sapiens
ccuggaggcucagaauguu

SEQ ID NO: 240544 - RNA, 19 nt, Homo sapiens
aagcaauacuuugggaguu

SEQ ID NO: 240545 - RNA, 19 nt, Homo sapiens
agccggaacuccagcaaga

SEQ ID NO: 240546 - RNA, 19 nt, Homo sapiens
caauuacuccugccaugug

SEQ ID NO: 240547 - RNA, 19 nt, Homo sapiens
gacgccaccuuccacuaug

SEQ ID NO: 240548 - RNA, 19 nt, Homo sapiens
ugacgccaccuuccacuau

SEQ ID NO: 240549 - RNA, 19 nt, Homo sapiens
gaaaacaagcccauucagu

SEQ ID NO: 240550 - RNA, 19 nt, Homo sapiens
caggugagcaaaucgaaga

SEQ ID NO: 240551 - RNA, 19 nt, Homo sapiens
auuaggagcugggagaaga

SEQ ID NO: 240552 - RNA, 19 nt, Homo sapiens
ccggaugggucgugguaug

SEQ ID NO: 240553 - RNA, 19 nt, Homo sapiens
ucaacccuauugcacauca

SEQ ID NO: 240554 - RNA, 19 nt, Homo sapiens
caacaacguccgccuaagc

SEQ ID NO: 240555 - RNA, 19 nt, Homo sapiens
ccagcacugauaagcaaua

SEQ ID NO: 240556 - RNA, 19 nt, Homo sapiens
cgacgacgacgacccaaca

SEQ ID NO: 240557 - RNA, 19 nt, Homo sapiens
agguacagcuggagugugu

SEQ ID NO: 240558 - RNA, 19 nt, Homo sapiens
ggagcugggagaagaggaa

SEQ ID NO: 240559 - RNA, 19 nt, Homo sapiens
gagcaggcagccaagaaca

SEQ ID NO: 240560 - RNA, 19 nt, Homo sapiens
aaaacaagcccauucaguu

SEQ ID NO: 240561 - RNA, 19 nt, Homo sapiens
ucagcaccauggacucuuc

SEQ ID NO: 240562 - RNA, 19 nt, Homo sapiens
aggaagauagcgggaaaua

SEQ ID NO: 240563 - RNA, 19 nt, Homo sapiens
agaggaagcgccuuguguu

SEQ ID NO: 240564 - RNA, 19 nt, Homo sapiens
gaccaaagcugaucucaua

SEQ ID NO: 240565 - RNA, 19 nt, Homo sapiens
gcagacaucuccaugauug

SEQ ID NO: 240566 - RNA, 19 nt, Homo sapiens
gaaagaagaggaagauaaa

SEQ ID NO: 240567 - RNA, 19 nt, Homo sapiens
guaaagagcugaaaauuga

SEQ ID NO: 240568 - RNA, 19 nt, Homo sapiens
ggacagcugugaugaguug

SEQ ID NO: 240569 - RNA, 19 nt, Homo sapiens
gaaauacauugaucaggaa

SEQ ID NO: 240570 - RNA, 19 nt, Homo sapiens
gaagaagucgauuagguua

SEQ ID NO: 240571 - RNA, 19 nt, Homo sapiens
aaagugauccuccaucuua

SEQ ID NO: 240572 - RNA, 19 nt, Homo sapiens
cuaagaagaucaaagagaa

SEQ ID NO: 240573 - RNA, 19 nt, Homo sapiens
ucaaagaaguagugaagaa

SEQ ID NO: 240574 - RNA, 19 nt, Homo sapiens
gauuggauguuguguauug

SEQ ID NO: 240575 - RNA, 19 nt, Homo sapiens
caaggagaauuacaagaaa

SEQ ID NO: 240576 - RNA, 19 nt, Homo sapiens
cagaagacaaggagaauua

SEQ ID NO: 240577 - RNA, 19 nt, Homo sapiens
gaaauucuaugaggcauuc

SEQ ID NO: 240578 - RNA, 19 nt, Homo sapiens
acaagagccucacuaauga

SEQ ID NO: 240579 - RNA, 19 nt, Homo sapiens
gcacaacgaugaugaacag

SEQ ID NO: 240580 - RNA, 19 nt, Homo sapiens
caacgaugaugaacaguau

SEQ ID NO: 240581 - RNA, 19 nt, Homo sapiens
ucacaaagcacaacgauga

SEQ ID NO: 240582 - RNA, 19 nt, Homo sapiens
gaagcauucucaguucaua

SEQ ID NO: 240583 - RNA, 19 nt, Homo sapiens
gaacguacccugacuuugg

SEQ ID NO: 240584 - RNA, 19 nt, Homo sapiens
gcaguuugguguuggcuuu

SEQ ID NO: 240585 - RNA, 19 nt, Homo sapiens
ggaagagccuggucucagu

SEQ ID NO: 240586 - RNA, 19 nt, Homo sapiens
acacagaaguccaucuauu

SEQ ID NO: 240587 - RNA, 19 nt, Homo sapiens
ggaagaagucgauuagguu

SEQ ID NO: 240588 - RNA, 19 nt, Homo sapiens
gaugacagcgguaaggaua

SEQ ID NO: 240589 - RNA, 19 nt, Homo sapiens
ugacagacccuucgaaguu

SEQ ID NO: 240590 - RNA, 19 nt, Homo sapiens
cacagaaguccaucuauua

SEQ ID NO: 240591 - RNA, 19 nt, Homo sapiens
caacucaugucccucauca

SEQ ID NO: 240592 - RNA, 19 nt, Homo sapiens
gaagaccacuuggcaguca

SEQ ID NO: 240593 - RNA, 19 nt, Homo sapiens
caaagcugaucucauaaau

SEQ ID NO: 240594 - RNA, 19 nt, Homo sapiens
agagaaaggugagaaagaa

SEQ ID NO: 240595 - RNA, 19 nt, Homo sapiens
gaaauugcccaacucaugu

SEQ ID NO: 240596 - RNA, 19 nt, Homo sapiens
gccuugagcucuucucuga

SEQ ID NO: 240597 - RNA, 19 nt, Homo sapiens
gcuaucccaucacccuuua

SEQ ID NO: 240598 - RNA, 19 nt, Homo sapiens
caagaugccugaggaagug

SEQ ID NO: 240599 - RNA, 19 nt, Homo sapiens
gaaggucaguuggaauuca

SEQ ID NO: 240600 - RNA, 19 nt, Homo sapiens
guaaggauaagaagaagaa

SEQ ID NO: 240601 - RNA, 19 nt, Homo sapiens
gaucgaagauguggguuca

SEQ ID NO: 240602 - RNA, 19 nt, Homo sapiens
uacaagagccucacuaaug

SEQ ID NO: 240603 - RNA, 19 nt, Homo sapiens
gcuucgaggugguauauau

SEQ ID NO: 240604 - RNA, 19 nt, Homo sapiens
agaaagaagaggaagauaa

SEQ ID NO: 240605 - RNA, 19 nt, Homo sapiens
ggaaauuagugaugaugag

SEQ ID NO: 240606 - RNA, 19 nt, Homo sapiens
caucaucaauaccuucuau

SEQ ID NO: 240607 - RNA, 19 nt, Homo sapiens
aggaggagguggagacuuu

SEQ ID NO: 240608 - RNA, 19 nt, Homo sapiens
gaaguuggacagugguaaa

SEQ ID NO: 240609 - RNA, 19 nt, Homo sapiens
gguuaggaguucauaguug

SEQ ID NO: 240610 - RNA, 19 nt, Homo sapiens
ucugcaagcucaugaaaga

SEQ ID NO: 240611 - RNA, 19 nt, Homo sapiens
gaagagagcaaggcaaagu

SEQ ID NO: 240612 - RNA, 19 nt, Homo sapiens
gaguauguuucucgcauga

SEQ ID NO: 240613 - RNA, 19 nt, Homo sapiens
ggaagagaaaggugagaaa

SEQ ID NO: 240614 - RNA, 19 nt, Homo sapiens
ggacaagauucgcuaugag

SEQ ID NO: 240615 - RNA, 19 nt, Homo sapiens
gcauggaagaagucgauua

SEQ ID NO: 240616 - RNA, 19 nt, Homo sapiens
gaagauguggguucagaug

SEQ ID NO: 240617 - RNA, 19 nt, Homo sapiens
gacagacccuucgaaguug

SEQ ID NO: 240618 - RNA, 19 nt, Homo sapiens
gcaagcucaugaaagaaau

SEQ ID NO: 240619 - RNA, 19 nt, Homo sapiens
aagaagaucagacagagua

SEQ ID NO: 240620 - RNA, 19 nt, Homo sapiens
acaaggagaauuacaagaa

SEQ ID NO: 240621 - RNA, 19 nt, Homo sapiens
uaaacaagaccaagccuau

SEQ ID NO: 240622 - RNA, 19 nt, Homo sapiens
gauguuguguauugugguu

SEQ ID NO: 240623 - RNA, 19 nt, Homo sapiens
aaaccgcccugcuaucuuc

SEQ ID NO: 240624 - RNA, 19 nt, Homo sapiens
cagcugugaugaguugaua

SEQ ID NO: 240625 - RNA, 19 nt, Homo sapiens
ccaaagugauccuccaucu

SEQ ID NO: 240626 - RNA, 19 nt, Homo sapiens
gugcagacaucuccaugau

SEQ ID NO: 240627 - RNA, 19 nt, Homo sapiens
aaacuugugcccuuguaua

SEQ ID NO: 240628 - RNA, 19 nt, Homo sapiens
gaaaacuugugcccuugua

SEQ ID NO: 240629 - RNA, 19 nt, Homo sapiens
ggaacccaaugcugcaguu

SEQ ID NO: 240630 - RNA, 19 nt, Homo sapiens
ccugcuaucuucuggcuuu

SEQ ID NO: 240631 - RNA, 19 nt, Homo sapiens
gaagaaaacuaagaagauc

SEQ ID NO: 240632 - RNA, 19 nt, Homo sapiens
gaagaggaagauaaagaug

SEQ ID NO: 240633 - RNA, 19 nt, Homo sapiens
gcagagaaagugguuguga

SEQ ID NO: 240634 - RNA, 19 nt, Homo sapiens
ccaaagcugaucucauaaa

SEQ ID NO: 240635 - RNA, 19 nt, Homo sapiens
auaagaagguugagaaggu

SEQ ID NO: 240636 - RNA, 19 nt, Homo sapiens
ugcagcagcucaaggaauu

SEQ ID NO: 240637 - RNA, 19 nt, Homo sapiens
uaccagaguaucucaauuu

SEQ ID NO: 240638 - RNA, 19 nt, Homo sapiens
caaagcacaacgaugauga

SEQ ID NO: 240639 - RNA, 19 nt, Homo sapiens
gcgguaaggauaagaagaa

SEQ ID NO: 240640 - RNA, 19 nt, Homo sapiens
gacaagauucgcuaugaga

SEQ ID NO: 240641 - RNA, 19 nt, Homo sapiens
gcaugaaggagacacagaa

SEQ ID NO: 240642 - RNA, 19 nt, Homo sapiens
ggucaaagaaguagugaag

SEQ ID NO: 240643 - RNA, 19 nt, Homo sapiens
cuacguugcucacuauuac

SEQ ID NO: 240644 - RNA, 19 nt, Homo sapiens
agaggaguauggagaauuc

SEQ ID NO: 240645 - RNA, 19 nt, Homo sapiens
gcagaaauugcccaacuca

SEQ ID NO: 240646 - RNA, 19 nt, Homo sapiens
aggauuggauguuguguau

SEQ ID NO: 240647 - RNA, 19 nt, Homo sapiens
uggacaagauucgcuauga

SEQ ID NO: 240648 - RNA, 19 nt, Homo sapiens
caagaaugauaaggcaguu

SEQ ID NO: 240649 - RNA, 19 nt, Homo sapiens
agaaauugcccaacucaug

SEQ ID NO: 240650 - RNA, 19 nt, Homo sapiens
gcuaugagagccugacaga

SEQ ID NO: 240651 - RNA, 19 nt, Homo sapiens
ugccaagucugguacuaaa

SEQ ID NO: 240652 - RNA, 19 nt, Homo sapiens
uggaagaagucgauuaggu

SEQ ID NO: 240653 - RNA, 19 nt, Homo sapiens
uagaaggucaguuggaauu

SEQ ID NO: 240654 - RNA, 19 nt, Homo sapiens
gaagaucaaagagaaauac

SEQ ID NO: 240655 - RNA, 19 nt, Homo sapiens
agaggaagauaaagaugau

SEQ ID NO: 240656 - RNA, 19 nt, Homo sapiens
cagagaaagugguugugau

SEQ ID NO: 240657 - RNA, 19 nt, Homo sapiens
agaaugauaaggcaguuaa

SEQ ID NO: 240658 - RNA, 19 nt, Homo sapiens
agaagaagaagauggaaga

SEQ ID NO: 240659 - RNA, 19 nt, Homo sapiens
agaaguccaucuauuacau

SEQ ID NO: 240660 - RNA, 19 nt, Homo sapiens
ucuaugaggcauucucuaa

SEQ ID NO: 240661 - RNA, 19 nt, Homo sapiens
uauggagaauucuacaaga

SEQ ID NO: 240662 - RNA, 19 nt, Homo sapiens
gagaaagaagaggaagaua

SEQ ID NO: 240663 - RNA, 19 nt, Homo sapiens
gaagagaaaggugagaaag

SEQ ID NO: 240664 - RNA, 19 nt, Homo sapiens
gaagaacagugauuauuga

SEQ ID NO: 240665 - RNA, 19 nt, Homo sapiens
gaaagaaccagcuuaaaga

SEQ ID NO: 240666 - RNA, 19 nt, Homo sapiens
cauaaucgcugaagauguu

SEQ ID NO: 240667 - RNA, 19 nt, Homo sapiens
caggagaggugugauguua

SEQ ID NO: 240668 - RNA, 19 nt, Homo sapiens
ggaagaacagugauuauug

SEQ ID NO: 240669 - RNA, 19 nt, Homo sapiens
gacuagugcuuuaccuuua

SEQ ID NO: 240670 - RNA, 19 nt, Homo sapiens
ugugagaacugcuuuauug

SEQ ID NO: 240671 - RNA, 19 nt, Homo sapiens
ugaaggaucuuugauaguu

SEQ ID NO: 240672 - RNA, 19 nt, Homo sapiens
uacaagagcugcuguugaa

SEQ ID NO: 240673 - RNA, 19 nt, Homo sapiens
gaggcuauauuucuccaua

SEQ ID NO: 240674 - RNA, 19 nt, Homo sapiens
gaaagggugucaucacagu

SEQ ID NO: 240675 - RNA, 19 nt, Homo sapiens
gcaaaguuccucagaaguu

SEQ ID NO: 240676 - RNA, 19 nt, Homo sapiens
gaaguuugaucgaggcuau

SEQ ID NO: 240677 - RNA, 19 nt, Homo sapiens
guacugcuuucaacuuaaa

SEQ ID NO: 240678 - RNA, 19 nt, Homo sapiens
caagugauguugaagugaa

SEQ ID NO: 240679 - RNA, 19 nt, Homo sapiens
uaaguacacucgucuugaa

SEQ ID NO: 240680 - RNA, 19 nt, Homo sapiens
agaaccagcuuaaagauau

SEQ ID NO: 240681 - RNA, 19 nt, Homo sapiens
gagaacugcuuuauuggau

SEQ ID NO: 240682 - RNA, 19 nt, Homo sapiens
gaaggaucuuugauaguug

SEQ ID NO: 240683 - RNA, 19 nt, Homo sapiens
gaaaagaaagacagaguua

SEQ ID NO: 240684 - RNA, 19 nt, Homo sapiens
aaacggagacaaagaaauu

SEQ ID NO: 240685 - RNA, 19 nt, Homo sapiens
agaaaucauugagcaguua

SEQ ID NO: 240686 - RNA, 19 nt, Homo sapiens
guguacugcuuucaacuua

SEQ ID NO: 240687 - RNA, 19 nt, Homo sapiens
gcaguguuccucaccaaua

SEQ ID NO: 240688 - RNA, 19 nt, Homo sapiens
gguguggccucucuguuaa

SEQ ID NO: 240689 - RNA, 19 nt, Homo sapiens
gauguuagcuguugaugcu

SEQ ID NO: 240690 - RNA, 19 nt, Homo sapiens
ccucagaaguugguuauga

SEQ ID NO: 240691 - RNA, 19 nt, Homo sapiens
caaaguuccucagaaguug

SEQ ID NO: 240692 - RNA, 19 nt, Homo sapiens
gacaagugauguugaagug

SEQ ID NO: 240693 - RNA, 19 nt, Homo sapiens
gaucuuugauaguugagaa

SEQ ID NO: 240694 - RNA, 19 nt, Homo sapiens
gaaguugguuaugaugcua

SEQ ID NO: 240695 - RNA, 19 nt, Homo sapiens
uucaagauguugccaauaa

SEQ ID NO: 240696 - RNA, 19 nt, Homo sapiens
gcacagguugcuacgauuu

SEQ ID NO: 240697 - RNA, 19 nt, Homo sapiens
ugaagaaauugcacagguu

SEQ ID NO: 240698 - RNA, 19 nt, Homo sapiens
gaaccagcuuaaagauaug

SEQ ID NO: 240699 - RNA, 19 nt, Homo sapiens
uaacacaaaugaagaagcu

SEQ ID NO: 240700 - RNA, 19 nt, Homo sapiens
guugaaggaucuuugauag

SEQ ID NO: 240701 - RNA, 19 nt, Homo sapiens
gaaaucaggagagguguga

SEQ ID NO: 240702 - RNA, 19 nt, Homo sapiens
gaucgaggcuauauuucuc

SEQ ID NO: 240703 - RNA, 19 nt, Homo sapiens
cauuggagcuaaacuuguu

SEQ ID NO: 240704 - RNA, 19 nt, Homo sapiens
ccaaagggaagaacaguga

SEQ ID NO: 240705 - RNA, 19 nt, Homo sapiens
guacacucgucuugaauag

SEQ ID NO: 240706 - RNA, 19 nt, Homo sapiens
cauuguaccugcucuugaa

SEQ ID NO: 240707 - RNA, 19 nt, Homo sapiens
gcaaacggagacaaagaaa

SEQ ID NO: 240708 - RNA, 19 nt, Homo sapiens
gggaagaacagugauuauu

SEQ ID NO: 240709 - RNA, 19 nt, Homo sapiens
caguguuccucaccaauaa

SEQ ID NO: 240710 - RNA, 19 nt, Homo sapiens
gaagagaaggacccuggaa

SEQ ID NO: 240711 - RNA, 19 nt, Homo sapiens
ggaugccuauguucuguug

SEQ ID NO: 240712 - RNA, 19 nt, Homo sapiens
gcagaugcccgagccuuaa

SEQ ID NO: 240713 - RNA, 19 nt, Homo sapiens
gaagucaguuggagaaaau

SEQ ID NO: 240714 - RNA, 19 nt, Homo sapiens
uggagaagcucuaaguaca

SEQ ID NO: 240715 - RNA, 19 nt, Homo sapiens
guacaaaguagagaaguau

SEQ ID NO: 240716 - RNA, 19 nt, Homo sapiens
uuaaagauauggcuauugc

SEQ ID NO: 240717 - RNA, 19 nt, Homo sapiens
ccuauguucuguugaguga

SEQ ID NO: 240718 - RNA, 19 nt, Homo sapiens
ggugugauguuagcuguug

SEQ ID NO: 240719 - RNA, 19 nt, Homo sapiens
uguacaaaguagagaagua

SEQ ID NO: 240720 - RNA, 19 nt, Homo sapiens
uaugggagguggcauguuc

SEQ ID NO: 240721 - RNA, 19 nt, Homo sapiens
gaaagacagaguuacagau

SEQ ID NO: 240722 - RNA, 19 nt, Homo sapiens
ugaaugaacggcuugcaaa

SEQ ID NO: 240723 - RNA, 19 nt, Homo sapiens
aaagauauggcuauugcua

SEQ ID NO: 240724 - RNA, 19 nt, Homo sapiens
uauguucuguugagugaaa

SEQ ID NO: 240725 - RNA, 19 nt, Homo sapiens
ccaauaacacaaaugaaga

SEQ ID NO: 240726 - RNA, 19 nt, Homo sapiens
gagugagaauaauugugua

SEQ ID NO: 240727 - RNA, 19 nt, Homo sapiens
caagagcugcuguugaaga

SEQ ID NO: 240728 - RNA, 19 nt, Homo sapiens
gcuuaaagauauggcuauu

SEQ ID NO: 240729 - RNA, 19 nt, Homo sapiens
gauggagaagcucuaagua

SEQ ID NO: 240730 - RNA, 19 nt, Homo sapiens
gaaauuauugaaggcauga

SEQ ID NO: 240731 - RNA, 19 nt, Homo sapiens
gcacuaccacugcuacugu

SEQ ID NO: 240732 - RNA, 19 nt, Homo sapiens
cguucagccucaugacuua

SEQ ID NO: 240733 - RNA, 19 nt, Homo sapiens
gcagaaaugcuucgguuac

SEQ ID NO: 240734 - RNA, 19 nt, Homo sapiens
agaaagaaccagcuuaaag

SEQ ID NO: 240735 - RNA, 19 nt, Homo sapiens
aagaaagggugucaucaca

SEQ ID NO: 240736 - RNA, 19 nt, Homo sapiens
ggacaagugauguugaagu

SEQ ID NO: 240737 - RNA, 19 nt, Homo sapiens
ugaagauguugauggagaa

SEQ ID NO: 240738 - RNA, 19 nt, Homo sapiens
gaaaugugaauuccaggau

SEQ ID NO: 240739 - RNA, 19 nt, Homo sapiens
ggagaggugugauguuagc

SEQ ID NO: 240740 - RNA, 19 nt, Homo sapiens
aaagguuggucuucagguu

SEQ ID NO: 240741 - RNA, 19 nt, Homo sapiens
gaaauugcacagguugcua

SEQ ID NO: 240742 - RNA, 19 nt, Homo sapiens
gaaguuaagcagccuuucu

SEQ ID NO: 240743 - RNA, 19 nt, Homo sapiens
acagaugcccuuaaugcua

SEQ ID NO: 240744 - RNA, 19 nt, Homo sapiens
gauguugaagugaaugaaa

SEQ ID NO: 240745 - RNA, 19 nt, Homo sapiens
ggucauaaucgcugaagau

SEQ ID NO: 240746 - RNA, 19 nt, Homo sapiens
guaagccuuuggucauaau

SEQ ID NO: 240747 - RNA, 19 nt, Homo sapiens
ccguaagccuuuggucaua

SEQ ID NO: 240748 - RNA, 19 nt, Homo sapiens
gaccaccccugaagaaauu

SEQ ID NO: 240749 - RNA, 19 nt, Homo sapiens
aagagcugcuguugaagaa

SEQ ID NO: 240750 - RNA, 19 nt, Homo sapiens
aaagaaagacagaguuaca

SEQ ID NO: 240751 - RNA, 19 nt, Homo sapiens
gaagguuggugggacaagu

SEQ ID NO: 240752 - RNA, 19 nt, Homo sapiens
gacgaugccaugcucuuaa

SEQ ID NO: 240753 - RNA, 19 nt, Homo sapiens
uugaaggcaugaaguuuga

SEQ ID NO: 240754 - RNA, 19 nt, Homo sapiens
guacuggcacgcucuauag

SEQ ID NO: 240755 - RNA, 19 nt, Homo sapiens
gggcuuaugccaaagaugu

SEQ ID NO: 240756 - RNA, 19 nt, Homo sapiens
gagguggcauguucuaacu

SEQ ID NO: 240757 - RNA, 19 nt, Homo sapiens
gagaagcucuaaguacacu

SEQ ID NO: 240758 - RNA, 19 nt, Homo sapiens
cguaagccuuuggucauaa

SEQ ID NO: 240759 - RNA, 19 nt, Homo sapiens
gaagaaagggugucaucac

SEQ ID NO: 240760 - RNA, 19 nt, Homo sapiens
gccaauaacacaaaugaag

SEQ ID NO: 240761 - RNA, 19 nt, Homo sapiens
gagaaguuaagcagccuuu

SEQ ID NO: 240762 - RNA, 19 nt, Homo sapiens
aaagacagaguuacagaug

SEQ ID NO: 240763 - RNA, 19 nt, Homo sapiens
ggugacaaggcucaaauug

SEQ ID NO: 240764 - RNA, 19 nt, Homo sapiens
gaaaguacguagacugaaa

SEQ ID NO: 240765 - RNA, 19 nt, Homo sapiens
ggacaagcguuuagaaagu

SEQ ID NO: 240766 - RNA, 19 nt, Homo sapiens
guacugauauaaacacuuc

SEQ ID NO: 240767 - RNA, 19 nt, Homo sapiens
ccacugaaguucugaaauc

SEQ ID NO: 240768 - RNA, 19 nt, Homo sapiens
ccaaaguaguucuagauga

SEQ ID NO: 240769 - RNA, 19 nt, Homo sapiens
ugaaauggcaucaacauga

SEQ ID NO: 240770 - RNA, 19 nt, Homo sapiens
gcaccaaaguaguucuaga

SEQ ID NO: 240771 - RNA, 19 nt, Homo sapiens
gacaagcguuuagaaaguu

SEQ ID NO: 240772 - RNA, 19 nt, Homo sapiens
cugaaguucugaaaucuuu

SEQ ID NO: 240773 - RNA, 19 nt, Homo sapiens
caaaguaguucuagaugac

SEQ ID NO: 240774 - RNA, 19 nt, Homo sapiens
guacguagacugaaauaag

SEQ ID NO: 240775 - RNA, 19 nt, Homo sapiens
gaaaggagugcugcugaaa

SEQ ID NO: 240776 - RNA, 19 nt, Homo sapiens
ugaaaggagugcugcugaa

SEQ ID NO: 240777 - RNA, 19 nt, Homo sapiens
aggaaaggguggagagauu

SEQ ID NO: 240778 - RNA, 19 nt, Homo sapiens
gaccgaguauugguugaaa

SEQ ID NO: 240779 - RNA, 19 nt, Homo sapiens
gagugcugcugaaacugua

SEQ ID NO: 240780 - RNA, 19 nt, Homo sapiens
ggaucggguucuaaaggaa

SEQ ID NO: 240781 - RNA, 19 nt, Homo sapiens
gcaggacaagcguuuagaa

SEQ ID NO: 240782 - RNA, 19 nt, Homo sapiens
ccaaaauuguuuccuugua

SEQ ID NO: 240783 - RNA, 19 nt, Homo sapiens
gaauauggaggcaccaaag

SEQ ID NO: 240784 - RNA, 19 nt, Homo sapiens
gugacauucuuggaaagua

SEQ ID NO: 240785 - RNA, 19 nt, Homo sapiens
gauggugacauucuuggaa

SEQ ID NO: 240786 - RNA, 19 nt, Homo sapiens
gaaaggguggagagauuca

SEQ ID NO: 240787 - RNA, 19 nt, Homo sapiens
gcuguuggaucggguucua

SEQ ID NO: 240788 - RNA, 19 nt, Homo sapiens
auuuagagauggugacauu

SEQ ID NO: 240789 - RNA, 19 nt, Homo sapiens
ggagugcugcugaaacugu

SEQ ID NO: 240790 - RNA, 19 nt, Homo sapiens
uacguagacugaaauaagu

SEQ ID NO: 240791 - RNA, 19 nt, Homo sapiens
gaucggguucuaaaggaaa

SEQ ID NO: 240792 - RNA, 19 nt, Homo sapiens
caggacaagcguuuagaaa

SEQ ID NO: 240793 - RNA, 19 nt, Homo sapiens
acaagcguuuagaaaguuu

SEQ ID NO: 240794 - RNA, 19 nt, Homo sapiens
guaaccaaaggaggcauua

SEQ ID NO: 240795 - RNA, 19 nt, Homo sapiens
ggaaaggguggagagauuc

SEQ ID NO: 240796 - RNA, 19 nt, Homo sapiens
ggaaaguacguagacugaa

SEQ ID NO: 240797 - RNA, 19 nt, Homo sapiens
uagagauggugacauucuu

SEQ ID NO: 240798 - RNA, 19 nt, Homo sapiens
ugacauucuuggaaaguac

SEQ ID NO: 240799 - RNA, 19 nt, Homo sapiens
uggaaaguacguagacuga

SEQ ID NO: 240800 - RNA, 19 nt, Homo sapiens
uggaucggguucuaaagga

SEQ ID NO: 240801 - RNA, 19 nt, Homo sapiens
ugcugaaacuguaaccaaa

SEQ ID NO: 240802 - RNA, 19 nt, Homo sapiens
caaaauuguuuccuuguac

SEQ ID NO: 240803 - RNA, 19 nt, Homo sapiens
aaggagugcugcugaaacu

SEQ ID NO: 240804 - RNA, 19 nt, Homo sapiens
caccaaaguaguucuagau

SEQ ID NO: 240805 - RNA, 19 nt, Homo sapiens
ccauuccacugaaguucug

SEQ ID NO: 240806 - RNA, 19 nt, Homo sapiens
uggagagauucaaccaguu

SEQ ID NO: 240807 - RNA, 19 nt, Homo sapiens
auauggaggcaccaaagua

SEQ ID NO: 240808 - RNA, 19 nt, Homo sapiens
aaccaaaggaggcauuaug

SEQ ID NO: 240809 - RNA, 19 nt, Homo sapiens
auggugacauucuuggaaa

SEQ ID NO: 240810 - RNA, 19 nt, Homo sapiens
caacaugaugcugcccauu

SEQ ID NO: 240811 - RNA, 19 nt, Homo sapiens
aaaguacguagacugaaau

SEQ ID NO: 240812 - RNA, 19 nt, Homo sapiens
uauggaggcaccaaaguag

SEQ ID NO: 240813 - RNA, 19 nt, Homo sapiens
gcugaaacuguaaccaaag

SEQ ID NO: 240814 - RNA, 19 nt, Homo sapiens
gcucagaccuuuagacuca

SEQ ID NO: 240815 - RNA, 19 nt, Homo sapiens
gaacgucuguaaauauguu

SEQ ID NO: 240816 - RNA, 19 nt, Homo sapiens
gcacagcccuagauacaau

SEQ ID NO: 240817 - RNA, 19 nt, Homo sapiens
ggacauugaugacccauuc

SEQ ID NO: 240818 - RNA, 19 nt, Homo sapiens
gaccagaccuccaacaaca

SEQ ID NO: 240819 - RNA, 19 nt, Homo sapiens
gcugauaucgucuuuguuu

SEQ ID NO: 240820 - RNA, 19 nt, Homo sapiens
gugaucaguuugugcuuua

SEQ ID NO: 240821 - RNA, 19 nt, Homo sapiens
uuccagagcucaaggauuu

SEQ ID NO: 240822 - RNA, 19 nt, Homo sapiens
gaaagagcauucgaaacga

SEQ ID NO: 240823 - RNA, 19 nt, Homo sapiens
ggaaagagcauucgaaacg

SEQ ID NO: 240824 - RNA, 19 nt, Homo sapiens
gaagugcgacagcauuaaa

SEQ ID NO: 240825 - RNA, 19 nt, Homo sapiens
gcuucuggcugguagauaa

SEQ ID NO: 240826 - RNA, 19 nt, Homo sapiens
cgacagcauuaaagacuga

SEQ ID NO: 240827 - RNA, 19 nt, Homo sapiens
gcagccaccucucccuuga

SEQ ID NO: 240828 - RNA, 19 nt, Homo sapiens
gaaaucccuuugacaccuu

SEQ ID NO: 240829 - RNA, 19 nt, Homo sapiens
cagcugauaucgucuuugu

SEQ ID NO: 240830 - RNA, 19 nt, Homo sapiens
cauggacuauggacucuuu

SEQ ID NO: 240831 - RNA, 19 nt, Homo sapiens
cauuaaagacugaugcuaa

SEQ ID NO: 240832 - RNA, 19 nt, Homo sapiens
ggucuuugcuucugauuac

SEQ ID NO: 240833 - RNA, 19 nt, Homo sapiens
gagcagguucuuccaauau

SEQ ID NO: 240834 - RNA, 19 nt, Homo sapiens
ggucacacucuuuacauuu

SEQ ID NO: 240835 - RNA, 19 nt, Homo sapiens
ggacugaccagggaccuuu

SEQ ID NO: 240836 - RNA, 19 nt, Homo sapiens
ugagcagguucuuccaaua

SEQ ID NO: 240837 - RNA, 19 nt, Homo sapiens
ggucauggguaaagacuac

SEQ ID NO: 240838 - RNA, 19 nt, Homo sapiens
gauacaaucccuuuugaua

SEQ ID NO: 240839 - RNA, 19 nt, Homo sapiens
caacaacauuccagcugau

SEQ ID NO: 240840 - RNA, 19 nt, Homo sapiens
uguggaacgucuguaaaua

SEQ ID NO: 240841 - RNA, 19 nt, Homo sapiens
gcagguucuuccaauauag

SEQ ID NO: 240842 - RNA, 19 nt, Homo sapiens
gcucugaugucauuuaucc

SEQ ID NO: 240843 - RNA, 19 nt, Homo sapiens
uugagaaccuaaacuauuc

SEQ ID NO: 240844 - RNA, 19 nt, Homo sapiens
cauaauggaauucugaaga

SEQ ID NO: 240845 - RNA, 19 nt, Homo sapiens
uggaacgucuguaaauaug

SEQ ID NO: 240846 - RNA, 19 nt, Homo sapiens
gggucacacucuuuacauu

SEQ ID NO: 240847 - RNA, 19 nt, Homo sapiens
agauggcucugaugucauu

SEQ ID NO: 240848 - RNA, 19 nt, Homo sapiens
caacaugagaccaaagugu

SEQ ID NO: 240849 - RNA, 19 nt, Homo sapiens
gacuauggacucuuucaaa

SEQ ID NO: 240850 - RNA, 19 nt, Homo sapiens
ugaauguccucacuuugug

SEQ ID NO: 240851 - RNA, 19 nt, Homo sapiens
guauuugucucccaugucu

SEQ ID NO: 240852 - RNA, 19 nt, Homo sapiens
gagccagccuccagugagu

SEQ ID NO: 240853 - RNA, 19 nt, Homo sapiens
gaggaaggcauggacauug

SEQ ID NO: 240854 - RNA, 19 nt, Homo sapiens
gaagcugaauguccucacu

SEQ ID NO: 240855 - RNA, 19 nt, Homo sapiens
ucuguugugugaucaguuu

SEQ ID NO: 240856 - RNA, 19 nt, Homo sapiens
gcgaaaaguuccuggagaa

SEQ ID NO: 240857 - RNA, 19 nt, Homo sapiens
ggaggaaggcauggacauu

SEQ ID NO: 240858 - RNA, 19 nt, Homo sapiens
agccagugcucucuguaua

SEQ ID NO: 240859 - RNA, 19 nt, Homo sapiens
uauaguugguguacacuca

SEQ ID NO: 240860 - RNA, 19 nt, Homo sapiens
gcugguagauaaugucaac

SEQ ID NO: 240861 - RNA, 19 nt, Homo sapiens
ggaccuuucuaccaguugu

SEQ ID NO: 240862 - RNA, 19 nt, Homo sapiens
aggaaggcauggacauuga

SEQ ID NO: 240863 - RNA, 19 nt, Homo sapiens
gaccaaagugugugacuag

SEQ ID NO: 240864 - RNA, 19 nt, Homo sapiens
guggaacgucuguaaauau

SEQ ID NO: 240865 - RNA, 19 nt, Homo sapiens
gucacacucuuuacauuuc

SEQ ID NO: 240866 - RNA, 19 nt, Homo sapiens
cagagcauauauuacaauc

SEQ ID NO: 240867 - RNA, 19 nt, Homo sapiens
caacauuccagcugauauc

SEQ ID NO: 240868 - RNA, 19 nt, Homo sapiens
gagaccagaccuccaacaa

SEQ ID NO: 240869 - RNA, 19 nt, Homo sapiens
ggacuugaucccucugugu

SEQ ID NO: 240870 - RNA, 19 nt, Homo sapiens
uaucugagcuccccaagga

SEQ ID NO: 240871 - RNA, 19 nt, Homo sapiens
guggaaagaaggaaccaaa

SEQ ID NO: 240872 - RNA, 19 nt, Homo sapiens
gcuaccacccggacaagaa

SEQ ID NO: 240873 - RNA, 19 nt, Homo sapiens
agaccaaagugugugacua

SEQ ID NO: 240874 - RNA, 19 nt, Homo sapiens
ggacuauggacucuuucaa

SEQ ID NO: 240875 - RNA, 19 nt, Homo sapiens
agcagguucuuccaauaua

SEQ ID NO: 240876 - RNA, 19 nt, Homo sapiens
ggaguuggaacaaaugucu

SEQ ID NO: 240877 - RNA, 19 nt, Homo sapiens
gaucaguuugugcuuuauu

SEQ ID NO: 240878 - RNA, 19 nt, Homo sapiens
cauguuugcugaguucuuc

SEQ ID NO: 240879 - RNA, 19 nt, Homo sapiens
gaaagaaggaaccaaaauc

SEQ ID NO: 240880 - RNA, 19 nt, Homo sapiens
gaaggcauggacauugaug

SEQ ID NO: 240881 - RNA, 19 nt, Homo sapiens
gaaggggaguuggaacaaa

SEQ ID NO: 240882 - RNA, 19 nt, Homo sapiens
ccagaccuccaacaacauu

SEQ ID NO: 240883 - RNA, 19 nt, Homo sapiens
uaccaguuguggaccauga

SEQ ID NO: 240884 - RNA, 19 nt, Homo sapiens
ucagaccuuuagacucauu

SEQ ID NO: 240885 - RNA, 19 nt, Homo sapiens
ccaguggcccagguaauuu

SEQ ID NO: 240886 - RNA, 19 nt, Homo sapiens
agggagggcuuucguacug

SEQ ID NO: 240887 - RNA, 19 nt, Homo sapiens
guggggaccucauuauuga

SEQ ID NO: 240888 - RNA, 19 nt, Homo sapiens
ccuggagaauucugucuuc

SEQ ID NO: 240889 - RNA, 19 nt, Homo sapiens
ugugaucaguuugugcuuu

SEQ ID NO: 240890 - RNA, 19 nt, Homo sapiens
ggacaagccccacaauauc

SEQ ID NO: 240891 - RNA, 19 nt, Homo sapiens
ggaaagaaggaaccaaaau

SEQ ID NO: 240892 - RNA, 19 nt, Homo sapiens
cuaaacuauuccugcagaa

SEQ ID NO: 240893 - RNA, 19 nt, Homo sapiens
gcuuuauucuguauuuguc

SEQ ID NO: 240894 - RNA, 19 nt, Homo sapiens
gugccaaugguaccucuuu

SEQ ID NO: 240895 - RNA, 19 nt, Homo sapiens
guuugugcuuuauucugua

SEQ ID NO: 240896 - RNA, 19 nt, Homo sapiens
aggagaaguucaaggagau

SEQ ID NO: 240897 - RNA, 19 nt, Homo sapiens
ccgaggagaaguucaagga

SEQ ID NO: 240898 - RNA, 19 nt, Homo sapiens
caaccugcagucuugauuc

SEQ ID NO: 240899 - RNA, 19 nt, Homo sapiens
cugaauguccucacuuugu

SEQ ID NO: 240900 - RNA, 19 nt, Homo sapiens
gaauucugucuucucuuug

SEQ ID NO: 240901 - RNA, 19 nt, Homo sapiens
uggcucugaugucauuuau

SEQ ID NO: 240902 - RNA, 19 nt, Homo sapiens
gacggaaagagcauucgaa

SEQ ID NO: 240903 - RNA, 19 nt, Homo sapiens
ccagugcucucuguauagg

SEQ ID NO: 240904 - RNA, 19 nt, Homo sapiens
uagauacaaucccuuuuga

SEQ ID NO: 240905 - RNA, 19 nt, Homo sapiens
uggcagaaaucccuuugac

SEQ ID NO: 240906 - RNA, 19 nt, Homo sapiens
gcagccagugcucucugua

SEQ ID NO: 240907 - RNA, 19 nt, Homo sapiens
uaguugguguacacucaaa

SEQ ID NO: 240908 - RNA, 19 nt, Homo sapiens
ccagagcauauauuacaau

SEQ ID NO: 240909 - RNA, 19 nt, Homo sapiens
ggaaggcauggacauugau

SEQ ID NO: 240910 - RNA, 19 nt, Homo sapiens
gaagaagggguggaaagaa

SEQ ID NO: 240911 - RNA, 19 nt, Homo sapiens
ugaagugcgacagcauuaa

SEQ ID NO: 240912 - RNA, 19 nt, Homo sapiens
agcugaauguccucacuuu

SEQ ID NO: 240913 - RNA, 19 nt, Homo sapiens
cagcuacacauuccaugga

SEQ ID NO: 240914 - RNA, 19 nt, Homo sapiens
gaccucuccuuacuuauua

SEQ ID NO: 240915 - RNA, 19 nt, Homo sapiens
gaaccacaguccaugacaa

SEQ ID NO: 240916 - RNA, 19 nt, Homo sapiens
ggaccucuccuuacuuauu

SEQ ID NO: 240917 - RNA, 19 nt, Homo sapiens
ugacaagucugcccaccaa

SEQ ID NO: 240918 - RNA, 19 nt, Homo sapiens
gcaggagggugggugaauu

SEQ ID NO: 240919 - RNA, 19 nt, Homo sapiens
ggacuccacuuugagaaau

SEQ ID NO: 240920 - RNA, 19 nt, Homo sapiens
gaccagcuccgcucaggua

SEQ ID NO: 240921 - RNA, 19 nt, Homo sapiens
cuggaccucuccuuacuua

SEQ ID NO: 240922 - RNA, 19 nt, Homo sapiens
ccagacccaguacuuauua

SEQ ID NO: 240923 - RNA, 19 nt, Homo sapiens
gcaugggccugcacuacau

SEQ ID NO: 240924 - RNA, 19 nt, Homo sapiens
gaaauccugaccugcacua

SEQ ID NO: 240925 - RNA, 19 nt, Homo sapiens
ggaggaagcaggaguccau

SEQ ID NO: 240926 - RNA, 19 nt, Homo sapiens
gacccaguacuuauuauga

SEQ ID NO: 240927 - RNA, 19 nt, Homo sapiens
ggacaggcaaagggagaua

SEQ ID NO: 240928 - RNA, 19 nt, Homo sapiens
gaaguuaaacgagcuuucu

SEQ ID NO: 240929 - RNA, 19 nt, Homo sapiens
gcacuaugccugaaacacu

SEQ ID NO: 240930 - RNA, 19 nt, Homo sapiens
cagcagcaacacaaacaaa

SEQ ID NO: 240931 - RNA, 19 nt, Homo sapiens
gagcuuucuucuccaaguc

SEQ ID NO: 240932 - RNA, 19 nt, Homo sapiens
gcacugaggaaguuaaacg

SEQ ID NO: 240933 - RNA, 19 nt, Homo sapiens
cuucaaauucccaggagua

SEQ ID NO: 240934 - RNA, 19 nt, Homo sapiens
acccaguacuuauuaugaa

SEQ ID NO: 240935 - RNA, 19 nt, Homo sapiens
caagucugcccaccaaaca

SEQ ID NO: 240936 - RNA, 19 nt, Homo sapiens
ggaguagaccagcaucucu

SEQ ID NO: 240937 - RNA, 19 nt, Homo sapiens
caaauucccaggaguagac

SEQ ID NO: 240938 - RNA, 19 nt, Homo sapiens
gaccugcacuaugccugaa

SEQ ID NO: 240939 - RNA, 19 nt, Homo sapiens
ugccagcacugaggaaguu

SEQ ID NO: 240940 - RNA, 19 nt, Homo sapiens
guacucuugugucucucaa

SEQ ID NO: 240941 - RNA, 19 nt, Homo sapiens
uggcaggugcucaauggua

SEQ ID NO: 240942 - RNA, 19 nt, Homo sapiens
guccagacccaguacuuau

SEQ ID NO: 240943 - RNA, 19 nt, Homo sapiens
gaugggcugggcuugguuu

SEQ ID NO: 240944 - RNA, 19 nt, Homo sapiens
cgagcuuucuucuccaagu

SEQ ID NO: 240945 - RNA, 19 nt, Homo sapiens
ggaaguuaaacgagcuuuc

SEQ ID NO: 240946 - RNA, 19 nt, Homo sapiens
uacauugccuucaggugau

SEQ ID NO: 240947 - RNA, 19 nt, Homo sapiens
guacugccuccuccucaug

SEQ ID NO: 240948 - RNA, 19 nt, Homo sapiens
cagcuccgcucagguaguc

SEQ ID NO: 240949 - RNA, 19 nt, Homo sapiens
gcagggccucuggguauga

SEQ ID NO: 240950 - RNA, 19 nt, Homo sapiens
gcagcagcaacacaaacaa

SEQ ID NO: 240951 - RNA, 19 nt, Homo sapiens
ccacaguccaugacaaguc

SEQ ID NO: 240952 - RNA, 19 nt, Homo sapiens
gguacugccuccuccucau

SEQ ID NO: 240953 - RNA, 19 nt, Homo sapiens
ugaggcagcagcaacacaa

SEQ ID NO: 240954 - RNA, 19 nt, Homo sapiens
cacaguccaugacaagucu

SEQ ID NO: 240955 - RNA, 19 nt, Homo sapiens
cagacccaguacuuauuau

SEQ ID NO: 240956 - RNA, 19 nt, Homo sapiens
gacaggcaaagggagauaa

SEQ ID NO: 240957 - RNA, 19 nt, Homo sapiens
ugaaggguguggcccaaaa

SEQ ID NO: 240958 - RNA, 19 nt, Homo sapiens
gggaguggcaggugcucaa

SEQ ID NO: 240959 - RNA, 19 nt, Homo sapiens
cagcacugaggaaguuaaa

SEQ ID NO: 240960 - RNA, 19 nt, Homo sapiens
ccugccugcucuugagaaa

SEQ ID NO: 240961 - RNA, 19 nt, Homo sapiens
ggcaugggccugcacuaca

SEQ ID NO: 240962 - RNA, 19 nt, Homo sapiens
ggcagcagcaacacaaaca

SEQ ID NO: 240963 - RNA, 19 nt, Homo sapiens
gaggcagcagcaacacaaa

SEQ ID NO: 240964 - RNA, 19 nt, Homo sapiens
ccugguggcugaguugaag

SEQ ID NO: 240965 - RNA, 19 nt, Homo sapiens
gcaacaagguggacuccua

SEQ ID NO: 240966 - RNA, 19 nt, Homo sapiens
gugcaaggcuggcuucuuu

SEQ ID NO: 240967 - RNA, 19 nt, Homo sapiens
ggaacgagcugcugcacuu

SEQ ID NO: 240968 - RNA, 19 nt, Homo sapiens
gcagggacaugucugauga

SEQ ID NO: 240969 - RNA, 19 nt, Homo sapiens
caacaaggcucuggacaug

SEQ ID NO: 240970 - RNA, 19 nt, Homo sapiens
gcgcugcgauggugacuuu

SEQ ID NO: 240971 - RNA, 19 nt, Homo sapiens
cugaugagcucaauuguga

SEQ ID NO: 240972 - RNA, 19 nt, Homo sapiens
gcacagacaucgcgacacu

SEQ ID NO: 240973 - RNA, 19 nt, Homo sapiens
gagccuauuuccacgauga

SEQ ID NO: 240974 - RNA, 19 nt, Homo sapiens
guaacaacaucauccuaga

SEQ ID NO: 240975 - RNA, 19 nt, Homo sapiens
gcaacaacaucaugcuagu

SEQ ID NO: 240976 - RNA, 19 nt, Homo sapiens
ggagugggcaccucagaaa

SEQ ID NO: 240977 - RNA, 19 nt, Homo sapiens
gcacaagcguggaggaaac

SEQ ID NO: 240978 - RNA, 19 nt, Homo sapiens
caacacacaccacgagcua

SEQ ID NO: 240979 - RNA, 19 nt, Homo sapiens
ccaagugguuguccuuuca

SEQ ID NO: 240980 - RNA, 19 nt, Homo sapiens
gcacagccacucuacaugu

SEQ ID NO: 240981 - RNA, 19 nt, Homo sapiens
ccacgcagcugcagaucga

SEQ ID NO: 240982 - RNA, 19 nt, Homo sapiens
gagaccagguugucagugu

SEQ ID NO: 240983 - RNA, 19 nt, Homo sapiens
ccgcagagguuccauccaa

SEQ ID NO: 240984 - RNA, 19 nt, Homo sapiens
gaaggugacacacucauca

SEQ ID NO: 240985 - RNA, 19 nt, Homo sapiens
ggacauaugggcucaugga

SEQ ID NO: 240986 - RNA, 19 nt, Homo sapiens
gggagacccuggaucugaa

SEQ ID NO: 240987 - RNA, 19 nt, Homo sapiens
gagcugugaugcccacuuc

SEQ ID NO: 240988 - RNA, 19 nt, Homo sapiens
ccacggaucaggcccagua

SEQ ID NO: 240989 - RNA, 19 nt, Homo sapiens
guacccagcuccguugguu

SEQ ID NO: 240990 - RNA, 19 nt, Homo sapiens
ggacauagagaccgucaca

SEQ ID NO: 240991 - RNA, 19 nt, Homo sapiens
gagcugacgucaccuucau

SEQ ID NO: 240992 - RNA, 19 nt, Homo sapiens
gggcucagauucaggagau

SEQ ID NO: 240993 - RNA, 19 nt, Homo sapiens
auucguaccuuucugauga

SEQ ID NO: 240994 - RNA, 19 nt, Homo sapiens
ggaguuccgcuaugaguug

SEQ ID NO: 240995 - RNA, 19 nt, Homo sapiens
gcagauuucaucagcuaaa

SEQ ID NO: 240996 - RNA, 19 nt, Homo sapiens
ugaaugcaauggccacuca

SEQ ID NO: 240997 - RNA, 19 nt, Homo sapiens
uccgagcccuggugaauuu

SEQ ID NO: 240998 - RNA, 19 nt, Homo sapiens
gagagcagcagcuaugugu

SEQ ID NO: 240999 - RNA, 19 nt, Homo sapiens
caucgaagccucugucauc

SEQ ID NO: 241000 - RNA, 19 nt, Homo sapiens
ggacggcagcgaugagcua

SEQ ID NO: 241001 - RNA, 19 nt, Homo sapiens
gaugcaggcuccagagagu

SEQ ID NO: 241002 - RNA, 19 nt, Homo sapiens
ggcaaacacucgaccucaa

SEQ ID NO: 241003 - RNA, 19 nt, Homo sapiens
cagagcugcuggucacuga

SEQ ID NO: 241004 - RNA, 19 nt, Homo sapiens
ugaggagccuggucacuuc

SEQ ID NO: 241005 - RNA, 19 nt, Homo sapiens
gauugggaauugucuuuag

SEQ ID NO: 241006 - RNA, 19 nt, Homo sapiens
cagagcgucucaacaagga

SEQ ID NO: 241007 - RNA, 19 nt, Homo sapiens
ggaugcugcuguacaaugg

SEQ ID NO: 241008 - RNA, 19 nt, Homo sapiens
ccgaugggaugcugcugua

SEQ ID NO: 241009 - RNA, 19 nt, Homo sapiens
gcaguucucacuccuagga

SEQ ID NO: 241010 - RNA, 19 nt, Homo sapiens
ggacauggcauagcagagu

SEQ ID NO: 241011 - RNA, 19 nt, Homo sapiens
gcgaggagaucgucuucca

SEQ ID NO: 241012 - RNA, 19 nt, Homo sapiens
gcacuaggcacagcacaga

SEQ ID NO: 241013 - RNA, 19 nt, Homo sapiens
caagcaagcccaucacagu

SEQ ID NO: 241014 - RNA, 19 nt, Homo sapiens
gaacugaugaagccaacug

SEQ ID NO: 241015 - RNA, 19 nt, Homo sapiens
ggacacauucguaccuuuc

SEQ ID NO: 241016 - RNA, 19 nt, Homo sapiens
ggauugggaauugucuuua

SEQ ID NO: 241017 - RNA, 19 nt, Homo sapiens
gugucgagauggaaucaaa

SEQ ID NO: 241018 - RNA, 19 nt, Homo sapiens
ggaccucaccuacaguuuc

SEQ ID NO: 241019 - RNA, 19 nt, Homo sapiens
cugcagauuucaucagcua

SEQ ID NO: 241020 - RNA, 19 nt, Homo sapiens
ggacccaucccaccuguca

SEQ ID NO: 241021 - RNA, 19 nt, Homo sapiens
gcgaguaugugugccaugu

SEQ ID NO: 241022 - RNA, 19 nt, Homo sapiens
ggugggaaguugcgauaca

SEQ ID NO: 241023 - RNA, 19 nt, Homo sapiens
gcaggucacgccucagcua

SEQ ID NO: 241024 - RNA, 19 nt, Homo sapiens
guacgugugccgaguguug

SEQ ID NO: 241025 - RNA, 19 nt, Homo sapiens
caacccagagaacauguuu

SEQ ID NO: 241026 - RNA, 19 nt, Homo sapiens
gcccauaggcugcaacugu

SEQ ID NO: 241027 - RNA, 19 nt, Homo sapiens
caacaagguggacuccuau

SEQ ID NO: 241028 - RNA, 19 nt, Homo sapiens
ggagucggaguacuugaaa

SEQ ID NO: 241029 - RNA, 19 nt, Homo sapiens
agagcuggguggccuguuu

SEQ ID NO: 241030 - RNA, 19 nt, Homo sapiens
acaggaaguucgagaucaa

SEQ ID NO: 241031 - RNA, 19 nt, Homo sapiens
ucaaggaugccuacaggaa

SEQ ID NO: 241032 - RNA, 19 nt, Homo sapiens
caucuguccuggucacaau

SEQ ID NO: 241033 - RNA, 19 nt, Homo sapiens
ggucagagcgcacagacau

SEQ ID NO: 241034 - RNA, 19 nt, Homo sapiens
cgagcuaugugaaugcaau

SEQ ID NO: 241035 - RNA, 19 nt, Homo sapiens
gcaguacggagccuauuuc

SEQ ID NO: 241036 - RNA, 19 nt, Homo sapiens
gccaagggacguauauaug

SEQ ID NO: 241037 - RNA, 19 nt, Homo sapiens
caccugcgguugcaccaaa

SEQ ID NO: 241038 - RNA, 19 nt, Homo sapiens
cagcucagguacccaggaa

SEQ ID NO: 241039 - RNA, 19 nt, Homo sapiens
ucacugaggcuccaagcaa

SEQ ID NO: 241040 - RNA, 19 nt, Homo sapiens
gaggaaggugugacaguga

SEQ ID NO: 241041 - RNA, 19 nt, Homo sapiens
gaacgagcugcugcacuuu

SEQ ID NO: 241042 - RNA, 19 nt, Homo sapiens
ggcagacccuggaccugaa

SEQ ID NO: 241043 - RNA, 19 nt, Homo sapiens
gcagcuccgugccucuaga

SEQ ID NO: 241044 - RNA, 19 nt, Homo sapiens
gaucaggcccaguacuugu

SEQ ID NO: 241045 - RNA, 19 nt, Homo sapiens
uauggccacugccugaauu

SEQ ID NO: 241046 - RNA, 19 nt, Homo sapiens
ugaccaacccgaugacuuc

SEQ ID NO: 241047 - RNA, 19 nt, Homo sapiens
ucaaaggagaccuguguga

SEQ ID NO: 241048 - RNA, 19 nt, Homo sapiens
ggcauacgauggcuugucu

SEQ ID NO: 241049 - RNA, 19 nt, Homo sapiens
gcugcaagguaacaacauc

SEQ ID NO: 241050 - RNA, 19 nt, Homo sapiens
gaggagagcugcgcuucac

SEQ ID NO: 241051 - RNA, 19 nt, Homo sapiens
ggaccucaacugccugguu

SEQ ID NO: 241052 - RNA, 19 nt, Homo sapiens
ggaccugaacugccucguu

SEQ ID NO: 241053 - RNA, 19 nt, Homo sapiens
gggcaacaacaucaugcua

SEQ ID NO: 241054 - RNA, 19 nt, Homo sapiens
ggccuacggugggaaguug

SEQ ID NO: 241055 - RNA, 19 nt, Homo sapiens
cagcugccauggccacuca

SEQ ID NO: 241056 - RNA, 19 nt, Homo sapiens
cccaugggcugagggcaua

SEQ ID NO: 241057 - RNA, 19 nt, Homo sapiens
cugcagagcgucucaacaa

SEQ ID NO: 241058 - RNA, 19 nt, Homo sapiens
ggguggcuauccugacuau

SEQ ID NO: 241059 - RNA, 19 nt, Homo sapiens
gcagcuggcaccacacaau

SEQ ID NO: 241060 - RNA, 19 nt, Homo sapiens
caggugacauggagcaaag

SEQ ID NO: 241061 - RNA, 19 nt, Homo sapiens
cuagagaccaagagcauug

SEQ ID NO: 241062 - RNA, 19 nt, Homo sapiens
guaccuuucugaugaugag

SEQ ID NO: 241063 - RNA, 19 nt, Homo sapiens
gggcacagccacucuacau

SEQ ID NO: 241064 - RNA, 19 nt, Homo sapiens
aaucuccaccgauccaaua

SEQ ID NO: 241065 - RNA, 19 nt, Homo sapiens
ggaaauaucccgagaugga

SEQ ID NO: 241066 - RNA, 19 nt, Homo sapiens
ucuccaagcugcuguauaa

SEQ ID NO: 241067 - RNA, 19 nt, Homo sapiens
gcacagaaccugccaaagu

SEQ ID NO: 241068 - RNA, 19 nt, Homo sapiens
ggacaaacgucacaaagac

SEQ ID NO: 241069 - RNA, 19 nt, Homo sapiens
gaaguucgcugucgagcau

SEQ ID NO: 241070 - RNA, 19 nt, Homo sapiens
gcaacaaccugaacuucug

SEQ ID NO: 241071 - RNA, 19 nt, Homo sapiens
ugacgcaccuguccaacua

SEQ ID NO: 241072 - RNA, 19 nt, Homo sapiens
caacuacuuugauucagaa

SEQ ID NO: 241073 - RNA, 19 nt, Homo sapiens
ucaaaucacuccaccuaug

SEQ ID NO: 241074 - RNA, 19 nt, Homo sapiens
gcacacaucccaaacuuca

SEQ ID NO: 241075 - RNA, 19 nt, Homo sapiens
uaaaguacaccuuccauga

SEQ ID NO: 241076 - RNA, 19 nt, Homo sapiens
acaaaggcaucgacuggua

SEQ ID NO: 241077 - RNA, 19 nt, Homo sapiens
gggagcugcuggacaagua

SEQ ID NO: 241078 - RNA, 19 nt, Homo sapiens
gagacagacuggacauuuc

SEQ ID NO: 241079 - RNA, 19 nt, Homo sapiens
gcaaacugcuucgcacaga

SEQ ID NO: 241080 - RNA, 19 nt, Homo sapiens
ggagacagacuggacauuu

SEQ ID NO: 241081 - RNA, 19 nt, Homo sapiens
gcgcacacaucccaaacuu

SEQ ID NO: 241082 - RNA, 19 nt, Homo sapiens
gagaacauccucaaguaug

SEQ ID NO: 241083 - RNA, 19 nt, Homo sapiens
gccagacacuucccacuug

SEQ ID NO: 241084 - RNA, 19 nt, Homo sapiens
cacagaaccugccaaagug

SEQ ID NO: 241085 - RNA, 19 nt, Homo sapiens
ccaacuacuuugauucaga

SEQ ID NO: 241086 - RNA, 19 nt, Homo sapiens
ccacugcccucuaccuguu

SEQ ID NO: 241087 - RNA, 19 nt, Homo sapiens
cuaagucucugugaauuug

SEQ ID NO: 241088 - RNA, 19 nt, Homo sapiens
ccaagcugcuguauaagau

SEQ ID NO: 241089 - RNA, 19 nt, Homo sapiens
caaaucacuccaccuauga

SEQ ID NO: 241090 - RNA, 19 nt, Homo sapiens
ggucuuggauggcaaacug

SEQ ID NO: 241091 - RNA, 19 nt, Homo sapiens
ccaaggagaagacguguga

SEQ ID NO: 241092 - RNA, 19 nt, Homo sapiens
gguuugccauggugacaua

SEQ ID NO: 241093 - RNA, 19 nt, Homo sapiens
ggcgaggacuggacgguuu

SEQ ID NO: 241094 - RNA, 19 nt, Homo sapiens
aguauucgcugccauaugu

SEQ ID NO: 241095 - RNA, 19 nt, Homo sapiens
ggacgugaaggcccuguuu

SEQ ID NO: 241096 - RNA, 19 nt, Homo sapiens
agacugaacguuugugaaa

SEQ ID NO: 241097 - RNA, 19 nt, Homo sapiens
gggcaucauuggcuucuuc

SEQ ID NO: 241098 - RNA, 19 nt, Homo sapiens
caacaccaccuccgacuuc

SEQ ID NO: 241099 - RNA, 19 nt, Homo sapiens
caaacugcuucgcacagaa

SEQ ID NO: 241100 - RNA, 19 nt, Homo sapiens
ccggaaauaucccgagaug

SEQ ID NO: 241101 - RNA, 19 nt, Homo sapiens
ugaaggaguucuggugguu

SEQ ID NO: 241102 - RNA, 19 nt, Homo sapiens
cagccagacugaacguuug

SEQ ID NO: 241103 - RNA, 19 nt, Homo sapiens
ccaaagugauggacauggu

SEQ ID NO: 241104 - RNA, 19 nt, Homo sapiens
acaaagacaucugguccaa

SEQ ID NO: 241105 - RNA, 19 nt, Homo sapiens
ucacacacaccaucuucua

SEQ ID NO: 241106 - RNA, 19 nt, Homo sapiens
ugucguaugugaaggaguu

SEQ ID NO: 241107 - RNA, 19 nt, Homo sapiens
caaauaccgcacagagauu

SEQ ID NO: 241108 - RNA, 19 nt, Homo sapiens
ucaaauaccgcacagagau

SEQ ID NO: 241109 - RNA, 19 nt, Homo sapiens
ggaagcagguguggagcau

SEQ ID NO: 241110 - RNA, 19 nt, Homo sapiens
ggcguacgcuuccuaaguc

SEQ ID NO: 241111 - RNA, 19 nt, Homo sapiens
ugauggacauggugcagaa

SEQ ID NO: 241112 - RNA, 19 nt, Homo sapiens
ggccacaacuaucacaaag

SEQ ID NO: 241113 - RNA, 19 nt, Homo sapiens
cugaaggacugcagcauca

SEQ ID NO: 241114 - RNA, 19 nt, Homo sapiens
ucccaaagcuccucaucau

SEQ ID NO: 241115 - RNA, 19 nt, Homo sapiens
ccuaucagcaucuucauga

SEQ ID NO: 241116 - RNA, 19 nt, Homo sapiens
gagcagauggccuugaaca

SEQ ID NO: 241117 - RNA, 19 nt, Homo sapiens
ccgagcagauggccuugaa

SEQ ID NO: 241118 - RNA, 19 nt, Homo sapiens
caucucggccuacuaccua

SEQ ID NO: 241119 - RNA, 19 nt, Homo sapiens
ugaccaacaccauugacua

SEQ ID NO: 241120 - RNA, 19 nt, Homo sapiens
gggcaugcacccugaccua

SEQ ID NO: 241121 - RNA, 19 nt, Homo sapiens
gaagguggaggacgugaag

SEQ ID NO: 241122 - RNA, 19 nt, Homo sapiens
gacuggacauuucccuguu

SEQ ID NO: 241123 - RNA, 19 nt, Homo sapiens
ccuccgacuucuacuuuga

SEQ ID NO: 241124 - RNA, 19 nt, Homo sapiens
cauccacaauggcaucaug

SEQ ID NO: 241125 - RNA, 19 nt, Homo sapiens
gcuucgcccucaucaucua

SEQ ID NO: 241126 - RNA, 19 nt, Homo sapiens
ggacauggugcagaaguuc

SEQ ID NO: 241127 - RNA, 19 nt, Homo sapiens
gcagcccucuugcccaaag

SEQ ID NO: 241128 - RNA, 19 nt, Homo sapiens
ggaguccagccgcuucaaa

SEQ ID NO: 241129 - RNA, 19 nt, Homo sapiens
ccacgagacucuuuucugu

SEQ ID NO: 241130 - RNA, 19 nt, Homo sapiens
gggcguacgcuuccuaagu

SEQ ID NO: 241131 - RNA, 19 nt, Homo sapiens
ccacacagguaccaaugcu

SEQ ID NO: 241132 - RNA, 19 nt, Homo sapiens
gagcuggacaagaucauca

SEQ ID NO: 241133 - RNA, 19 nt, Homo sapiens
ugacacacagaacgaacua

SEQ ID NO: 241134 - RNA, 19 nt, Homo sapiens
agucaaaucacuccaccua

SEQ ID NO: 241135 - RNA, 19 nt, Homo sapiens
ggacauuucccuguuucga

SEQ ID NO: 241136 - RNA, 19 nt, Homo sapiens
caccauugacuaccacaaa

SEQ ID NO: 241137 - RNA, 19 nt, Homo sapiens
uuaauggccacaacuauca

SEQ ID NO: 241138 - RNA, 19 nt, Homo sapiens
gaggacaaacgucacaaag

SEQ ID NO: 241139 - RNA, 19 nt, Homo sapiens
ccacaauggcaucaugguu

SEQ ID NO: 241140 - RNA, 19 nt, Homo sapiens
cugcugcugucguauguga

SEQ ID NO: 241141 - RNA, 19 nt, Homo sapiens
gaucugcugcugucguaug

SEQ ID NO: 241142 - RNA, 19 nt, Homo sapiens
ccuaagucucugugaauuu

SEQ ID NO: 241143 - RNA, 19 nt, Homo sapiens
ccaacaccauugacuacca

SEQ ID NO: 241144 - RNA, 19 nt, Homo sapiens
gaccaacaccauugacuac

SEQ ID NO: 241145 - RNA, 19 nt, Homo sapiens
gugaaggcccuguuugaca

SEQ ID NO: 241146 - RNA, 19 nt, Homo sapiens
acucaaaccugggccugaa

SEQ ID NO: 241147 - RNA, 19 nt, Homo sapiens
guuggucaguggacgauuc

SEQ ID NO: 241148 - RNA, 19 nt, Homo sapiens
cuagcgagguggagaaagg

SEQ ID NO: 241149 - RNA, 19 nt, Homo sapiens
ggccagacacuucccacuu

SEQ ID NO: 241150 - RNA, 19 nt, Homo sapiens
gcucugacgcauccucgaa

SEQ ID NO: 241151 - RNA, 19 nt, Homo sapiens
caccuccgacuucuacuuu

SEQ ID NO: 241152 - RNA, 19 nt, Homo sapiens
cacacaccaucuucuacaa

SEQ ID NO: 241153 - RNA, 19 nt, Homo sapiens
gaguccagccgcuucaaau

SEQ ID NO: 241154 - RNA, 19 nt, Homo sapiens
cgaggacaaacgucacaaa

SEQ ID NO: 241155 - RNA, 19 nt, Homo sapiens
acaauggcaucaugguucu

SEQ ID NO: 241156 - RNA, 19 nt, Homo sapiens
ggagggcacacgcaugaag

SEQ ID NO: 241157 - RNA, 19 nt, Homo sapiens
aaggagggcacacgcauga

SEQ ID NO: 241158 - RNA, 19 nt, Homo sapiens
ggacgguuuuccagucaaa

SEQ ID NO: 241159 - RNA, 19 nt, Homo sapiens
uaagaugggccagacacuu

SEQ ID NO: 241160 - RNA, 19 nt, Homo sapiens
caagggcguacgcuuccua

SEQ ID NO: 241161 - RNA, 19 nt, Homo sapiens
gcaguuggcgcagaaguac

SEQ ID NO: 241162 - RNA, 19 nt, Homo sapiens
ucccaaacuucaccuucaa

SEQ ID NO: 241163 - RNA, 19 nt, Homo sapiens
gacaaacgucacaaagaca

SEQ ID NO: 241164 - RNA, 19 nt, Homo sapiens
ugaccagcacggaggagua

SEQ ID NO: 241165 - RNA, 19 nt, Homo sapiens
gcacuaaucuucuaacaaa

SEQ ID NO: 241166 - RNA, 19 nt, Homo sapiens
gcaauacucuuucacuuaa

SEQ ID NO: 241167 - RNA, 19 nt, Homo sapiens
aaacagacaugucaagaaa

SEQ ID NO: 241168 - RNA, 19 nt, Homo sapiens
cauaaucugucccugaaua

SEQ ID NO: 241169 - RNA, 19 nt, Homo sapiens
auacagacguugauuauga

SEQ ID NO: 241170 - RNA, 19 nt, Homo sapiens
ccaacaggcuggaagaauu

SEQ ID NO: 241171 - RNA, 19 nt, Homo sapiens
gaagggauacuaauuacuu

SEQ ID NO: 241172 - RNA, 19 nt, Homo sapiens
ugaaagcacuaaucuucua

SEQ ID NO: 241173 - RNA, 19 nt, Homo sapiens
gaagaauucuguucgacau

SEQ ID NO: 241174 - RNA, 19 nt, Homo sapiens
acagacaugucaagaaauu

SEQ ID NO: 241175 - RNA, 19 nt, Homo sapiens
ugaagaagauacagacguu

SEQ ID NO: 241176 - RNA, 19 nt, Homo sapiens
ggcaauacucuuucacuua

SEQ ID NO: 241177 - RNA, 19 nt, Homo sapiens
ccuuuagucuucucauuua

SEQ ID NO: 241178 - RNA, 19 nt, Homo sapiens
ucccagugcuguacgauua

SEQ ID NO: 241179 - RNA, 19 nt, Homo sapiens
gcuggauucuggaccauuu

SEQ ID NO: 241180 - RNA, 19 nt, Homo sapiens
ucauuuauauggccauuga

SEQ ID NO: 241181 - RNA, 19 nt, Homo sapiens
uggaugagguauaugaauu

SEQ ID NO: 241182 - RNA, 19 nt, Homo sapiens
gaaagcacuaaucuucuaa

SEQ ID NO: 241183 - RNA, 19 nt, Homo sapiens
ugagcacucuccaaauaaa

SEQ ID NO: 241184 - RNA, 19 nt, Homo sapiens
auugagcacucuccaaaua

SEQ ID NO: 241185 - RNA, 19 nt, Homo sapiens
caugaaagcacuaaucuuc

SEQ ID NO: 241186 - RNA, 19 nt, Homo sapiens
ggaugagguauaugaauuu

SEQ ID NO: 241187 - RNA, 19 nt, Homo sapiens
gggaagggauacuaauuac

SEQ ID NO: 241188 - RNA, 19 nt, Homo sapiens
guguugauccggaauauaa

SEQ ID NO: 241189 - RNA, 19 nt, Homo sapiens
agaauucuguucgacauaa

SEQ ID NO: 241190 - RNA, 19 nt, Homo sapiens
gagggucuuccaauuguua

SEQ ID NO: 241191 - RNA, 19 nt, Homo sapiens
ccucaaagaaucugauauu

SEQ ID NO: 241192 - RNA, 19 nt, Homo sapiens
ugaaaagauugcaggauua

SEQ ID NO: 241193 - RNA, 19 nt, Homo sapiens
gaugaacucacaaacuuga

SEQ ID NO: 241194 - RNA, 19 nt, Homo sapiens
ggauuaagccagauuuaca

SEQ ID NO: 241195 - RNA, 19 nt, Homo sapiens
gaagauacagacguugauu

SEQ ID NO: 241196 - RNA, 19 nt, Homo sapiens
gaucacaauuacagugcaa

SEQ ID NO: 241197 - RNA, 19 nt, Homo sapiens
gagaugaugugcgauccuu

SEQ ID NO: 241198 - RNA, 19 nt, Homo sapiens
gggaagugauggcagugaa

SEQ ID NO: 241199 - RNA, 19 nt, Homo sapiens
gugagggucuuccaauugu

SEQ ID NO: 241200 - RNA, 19 nt, Homo sapiens
ggaaugacuccagauaaga

SEQ ID NO: 241201 - RNA, 19 nt, Homo sapiens
ugauggcagugaaggauuu

SEQ ID NO: 241202 - RNA, 19 nt, Homo sapiens
ccaccagcauugauccaaa

SEQ ID NO: 241203 - RNA, 19 nt, Homo sapiens
ggcaaugcauuucaucauc

SEQ ID NO: 241204 - RNA, 19 nt, Homo sapiens
gcaaagacacaaaaucaaa

SEQ ID NO: 241205 - RNA, 19 nt, Homo sapiens
ggaguuacggcaaugcauu

SEQ ID NO: 241206 - RNA, 19 nt, Homo sapiens
ggauaucaaagccauaaug

SEQ ID NO: 241207 - RNA, 19 nt, Homo sapiens
ggaauucguacauguuuag

SEQ ID NO: 241208 - RNA, 19 nt, Homo sapiens
agacguugauuaugaagau

SEQ ID NO: 241209 - RNA, 19 nt, Homo sapiens
aaagaggaguuacggcaau

SEQ ID NO: 241210 - RNA, 19 nt, Homo sapiens
uggaauucguacauguuua

SEQ ID NO: 241211 - RNA, 19 nt, Homo sapiens
gugcgaaaccucaaagaau

SEQ ID NO: 241212 - RNA, 19 nt, Homo sapiens
gaauucuguucgacauaau

SEQ ID NO: 241213 - RNA, 19 nt, Homo sapiens
gauuaagccagauuuacaa

SEQ ID NO: 241214 - RNA, 19 nt, Homo sapiens
augaugaacucacaaacuu

SEQ ID NO: 241215 - RNA, 19 nt, Homo sapiens
agggaagggauacuaauua

SEQ ID NO: 241216 - RNA, 19 nt, Homo sapiens
ccuaauaaguacugcaaag

SEQ ID NO: 241217 - RNA, 19 nt, Homo sapiens
caacaggcuggaagaauuc

SEQ ID NO: 241218 - RNA, 19 nt, Homo sapiens
gaugaugugcgauccuuug

SEQ ID NO: 241219 - RNA, 19 nt, Homo sapiens
aauaaguacugcaaagaca

SEQ ID NO: 241220 - RNA, 19 nt, Homo sapiens
caaagaggcagcuggaucu

SEQ ID NO: 241221 - RNA, 19 nt, Homo sapiens
gaagccauggcaagguuaa

SEQ ID NO: 241222 - RNA, 19 nt, Homo sapiens
aagaagccauggcaagguu

SEQ ID NO: 241223 - RNA, 19 nt, Homo sapiens
ccauugagcacucuccaaa

SEQ ID NO: 241224 - RNA, 19 nt, Homo sapiens
ugacauagagggagaugau

SEQ ID NO: 241225 - RNA, 19 nt, Homo sapiens
gguagggaagggauacuaa

SEQ ID NO: 241226 - RNA, 19 nt, Homo sapiens
guuaguccauuguaugaca

SEQ ID NO: 241227 - RNA, 19 nt, Homo sapiens
ugucuucccugucuucugu

SEQ ID NO: 241228 - RNA, 19 nt, Homo sapiens
gaguuacggcaaugcauuu

SEQ ID NO: 241229 - RNA, 19 nt, Homo sapiens
gaaaagauugcaggauuaa

SEQ ID NO: 241230 - RNA, 19 nt, Homo sapiens
gcaccaacaggcuggaaga

SEQ ID NO: 241231 - RNA, 19 nt, Homo sapiens
gaaauuuauagcuggauuc

SEQ ID NO: 241232 - RNA, 19 nt, Homo sapiens
gcaggauuaagccagauuu

SEQ ID NO: 241233 - RNA, 19 nt, Homo sapiens
uacagacguugauuaugaa

SEQ ID NO: 241234 - RNA, 19 nt, Homo sapiens
aagauacagacguugauua

SEQ ID NO: 241235 - RNA, 19 nt, Homo sapiens
ugcgaaaccucaaagaauc

SEQ ID NO: 241236 - RNA, 19 nt, Homo sapiens
uuuaagcucuguaaucaag

SEQ ID NO: 241237 - RNA, 19 nt, Homo sapiens
ccauacuccuuuagucuuc

SEQ ID NO: 241238 - RNA, 19 nt, Homo sapiens
uggcaauacucuuucacuu

SEQ ID NO: 241239 - RNA, 19 nt, Homo sapiens
cuuuaucaccucacuauuu

SEQ ID NO: 241240 - RNA, 19 nt, Homo sapiens
aauaaauguuugccuguca

SEQ ID NO: 241241 - RNA, 19 nt, Homo sapiens
gaaugacuccagauaagag

SEQ ID NO: 241242 - RNA, 19 nt, Homo sapiens
ugagucagcagaugaugaa

SEQ ID NO: 241243 - RNA, 19 nt, Homo sapiens
ggacagugagucagcagau

SEQ ID NO: 241244 - RNA, 19 nt, Homo sapiens
caggauuaagccagauuua

SEQ ID NO: 241245 - RNA, 19 nt, Homo sapiens
gcacugaagaagcaaccuu

SEQ ID NO: 241246 - RNA, 19 nt, Homo sapiens
uagcgugucuucccugucu

SEQ ID NO: 241247 - RNA, 19 nt, Homo sapiens
gaugaugaacucacaaacu

SEQ ID NO: 241248 - RNA, 19 nt, Homo sapiens
ccagauaagagagcugaaa

SEQ ID NO: 241249 - RNA, 19 nt, Homo sapiens
agauacagacguugauuau

SEQ ID NO: 241250 - RNA, 19 nt, Homo sapiens
cagcauugauccaaaagaa

SEQ ID NO: 241251 - RNA, 19 nt, Homo sapiens
cccaggagcugaaaagauu

SEQ ID NO: 241252 - RNA, 19 nt, Homo sapiens
gacagugagucagcagaug

SEQ ID NO: 241253 - RNA, 19 nt, Homo sapiens
auucguacauguuuagguu

SEQ ID NO: 241254 - RNA, 19 nt, Homo sapiens
cucaaagaaucugauauug

SEQ ID NO: 241255 - RNA, 19 nt, Homo sapiens
ggugcgaaaccucaaagaa

SEQ ID NO: 241256 - RNA, 19 nt, Homo sapiens
aagugagggucuuccaauu

SEQ ID NO: 241257 - RNA, 19 nt, Homo sapiens
ggaauauaaacccaaucuu

SEQ ID NO: 241258 - RNA, 19 nt, Homo sapiens
cagaugaugaacucacaaa

SEQ ID NO: 241259 - RNA, 19 nt, Homo sapiens
uagggaagggauacuaauu

SEQ ID NO: 241260 - RNA, 19 nt, Homo sapiens
ggaccauuuuccauauuuu

SEQ ID NO: 241261 - RNA, 19 nt, Homo sapiens
gcacucuccaaauaaaugu

SEQ ID NO: 241262 - RNA, 19 nt, Homo sapiens
gaaaacagacaugucaaga

SEQ ID NO: 241263 - RNA, 19 nt, Homo sapiens
cugaaaagauugcaggauu

SEQ ID NO: 241264 - RNA, 19 nt, Homo sapiens
cuaauaaguacugcaaaga

SEQ ID NO: 241265 - RNA, 19 nt, Homo sapiens
gaaagaccaugauuuagug

SEQ ID NO: 241266 - RNA, 19 nt, Homo sapiens
auacuucccuuccuaauua

SEQ ID NO: 241267 - RNA, 19 nt, Homo sapiens
gaaauucauuccucuccaa

SEQ ID NO: 241268 - RNA, 19 nt, Homo sapiens
cagcuucacugacuucuug

SEQ ID NO: 241269 - RNA, 19 nt, Homo sapiens
ucacugcuguuucugagua

SEQ ID NO: 241270 - RNA, 19 nt, Homo sapiens
ggacucagccaacuaugaa

SEQ ID NO: 241271 - RNA, 19 nt, Homo sapiens
auaaggcaauggagaauaa

SEQ ID NO: 241272 - RNA, 19 nt, Homo sapiens
gauuagcgcugauucacau

SEQ ID NO: 241273 - RNA, 19 nt, Homo sapiens
caugauacuucccuuccua

SEQ ID NO: 241274 - RNA, 19 nt, Homo sapiens
agucuuggcucucaugauu

SEQ ID NO: 241275 - RNA, 19 nt, Homo sapiens
gggacuauggaucaaauua

SEQ ID NO: 241276 - RNA, 19 nt, Homo sapiens
ugucuuugcuuuagucuug

SEQ ID NO: 241277 - RNA, 19 nt, Homo sapiens
gaccaugauuuagugaauu

SEQ ID NO: 241278 - RNA, 19 nt, Homo sapiens
gacuauggaucaaauuauc

SEQ ID NO: 241279 - RNA, 19 nt, Homo sapiens
ggacuauggaucaaauuau

SEQ ID NO: 241280 - RNA, 19 nt, Homo sapiens
agacuucacuucagcuuca

SEQ ID NO: 241281 - RNA, 19 nt, Homo sapiens
gauacuucccuuccuaauu

SEQ ID NO: 241282 - RNA, 19 nt, Homo sapiens
gggcaugauuauagagguu

SEQ ID NO: 241283 - RNA, 19 nt, Homo sapiens
cuucuugacucuccucuug

SEQ ID NO: 241284 - RNA, 19 nt, Homo sapiens
gacaauugauauccuuagu

SEQ ID NO: 241285 - RNA, 19 nt, Homo sapiens
agaaagaccaugauuuagu

SEQ ID NO: 241286 - RNA, 19 nt, Homo sapiens
ucacugacuucuugacucu

SEQ ID NO: 241287 - RNA, 19 nt, Homo sapiens
gcaugauuauagagguuug

SEQ ID NO: 241288 - RNA, 19 nt, Homo sapiens
caucgagaauuuccauuuu

SEQ ID NO: 241289 - RNA, 19 nt, Homo sapiens
agaccaugauuuagugaau

SEQ ID NO: 241290 - RNA, 19 nt, Homo sapiens
cauaaggcaauggagaaua

SEQ ID NO: 241291 - RNA, 19 nt, Homo sapiens
aaaggacucagccaacuau

SEQ ID NO: 241292 - RNA, 19 nt, Homo sapiens
gcuuuagucuuggcucuca

SEQ ID NO: 241293 - RNA, 19 nt, Homo sapiens
ugacuggcaaauucacuuu

SEQ ID NO: 241294 - RNA, 19 nt, Homo sapiens
caucauaccgcaucacacu

SEQ ID NO: 241295 - RNA, 19 nt, Homo sapiens
gaaaauuccaugaaaagca

SEQ ID NO: 241296 - RNA, 19 nt, Homo sapiens
acaucgagaauuuccauuu

SEQ ID NO: 241297 - RNA, 19 nt, Homo sapiens
ucuuggcucucaugauuuc

SEQ ID NO: 241298 - RNA, 19 nt, Homo sapiens
gauauccuuaguaaucaug

SEQ ID NO: 241299 - RNA, 19 nt, Homo sapiens
accaugauuuagugaauuc

SEQ ID NO: 241300 - RNA, 19 nt, Homo sapiens
auacuucccuuccuaauua

SEQ ID NO: 241301 - RNA, 19 nt, Homo sapiens
gaaauucauuccucuccaa

SEQ ID NO: 241302 - RNA, 19 nt, Homo sapiens
ucacugcuguuucugagua

SEQ ID NO: 241303 - RNA, 19 nt, Homo sapiens
ggacucagccaacuaugaa

SEQ ID NO: 241304 - RNA, 19 nt, Homo sapiens
auaaggcaaugcagaauaa

SEQ ID NO: 241305 - RNA, 19 nt, Homo sapiens
ggacucguguauucucauu

SEQ ID NO: 241306 - RNA, 19 nt, Homo sapiens
ggauucuccucuugaguaa

SEQ ID NO: 241307 - RNA, 19 nt, Homo sapiens
ggcuauagaucaaauuauc

SEQ ID NO: 241308 - RNA, 19 nt, Homo sapiens
gcuuuggacucguguauuc

SEQ ID NO: 241309 - RNA, 19 nt, Homo sapiens
gauacuucccuuccuaauu

SEQ ID NO: 241310 - RNA, 19 nt, Homo sapiens
cauaaggcaaugcagaaua

SEQ ID NO: 241311 - RNA, 19 nt, Homo sapiens
aaucuuggcucucaugcuu

SEQ ID NO: 241312 - RNA, 19 nt, Homo sapiens
agacuucacuucagcuuca

SEQ ID NO: 241313 - RNA, 19 nt, Homo sapiens
gacuggagcugauucacau

SEQ ID NO: 241314 - RNA, 19 nt, Homo sapiens
gacaauugauaucuucagu

SEQ ID NO: 241315 - RNA, 19 nt, Homo sapiens
gcaugauuauggagguuug

SEQ ID NO: 241316 - RNA, 19 nt, Homo sapiens
gcuuuaaucuuggcucuca

SEQ ID NO: 241317 - RNA, 19 nt, Homo sapiens
ugauucacaugcaaagaga

SEQ ID NO: 241318 - RNA, 19 nt, Homo sapiens
ggagcugauucacaugcaa

SEQ ID NO: 241319 - RNA, 19 nt, Homo sapiens
acucguguauucucauuug

SEQ ID NO: 241320 - RNA, 19 nt, Homo sapiens
gagcugauucacaugcaaa

SEQ ID NO: 241321 - RNA, 19 nt, Homo sapiens
uggauucuccucuugagua

SEQ ID NO: 241322 - RNA, 19 nt, Homo sapiens
cguguauucucauuuguca

SEQ ID NO: 241323 - RNA, 19 nt, Homo sapiens
aaaggacucagccaacuau

SEQ ID NO: 241324 - RNA, 19 nt, Homo sapiens
gaaaauuccaugaaaagca

SEQ ID NO: 241325 - RNA, 19 nt, Homo sapiens
gggcaugauuauggagguu

SEQ ID NO: 241326 - RNA, 19 nt, Homo sapiens
ucacugacuucuggauucu

SEQ ID NO: 241327 - RNA, 19 nt, Homo sapiens
aauucuguguuucaggaua

SEQ ID NO: 241328 - RNA, 19 nt, Homo sapiens
cuucuggauucuccucuug

SEQ ID NO: 241329 - RNA, 19 nt, Homo sapiens
ggauacuucccuuccuaau

SEQ ID NO: 241330 - RNA, 19 nt, Homo sapiens
ugacuggagcugauucaca

SEQ ID NO: 241331 - RNA, 19 nt, Homo sapiens
accaugauuuagugaauuc

SEQ ID NO: 241332 - RNA, 19 nt, Homo sapiens
ugacuggcaaauucgcuuu

SEQ ID NO: 241333 - RNA, 19 nt, Homo sapiens
gaucauggcuacacuaucu

SEQ ID NO: 241334 - RNA, 19 nt, Homo sapiens
gaacguggccaauuaucuu

SEQ ID NO: 241335 - RNA, 19 nt, Homo sapiens
ugcagaacguggccaauua

SEQ ID NO: 241336 - RNA, 19 nt, Homo sapiens
gcgcucaucucgcucacuu

SEQ ID NO: 241337 - RNA, 19 nt, Homo sapiens
ccaucgcgcuggacaggua

SEQ ID NO: 241338 - RNA, 19 nt, Homo sapiens
caucguggcucuuguucug

SEQ ID NO: 241339 - RNA, 19 nt, Homo sapiens
caagaagagugugaaugga

SEQ ID NO: 241340 - RNA, 19 nt, Homo sapiens
gcagaacguggccaauuau

SEQ ID NO: 241341 - RNA, 19 nt, Homo sapiens
ccaagaagagugugaaugg

SEQ ID NO: 241342 - RNA, 19 nt, Homo sapiens
ccacaugcccacccuguug

SEQ ID NO: 241343 - RNA, 19 nt, Homo sapiens
uaacuucugccgccaguga

SEQ ID NO: 241344 - RNA, 19 nt, Homo sapiens
cgagagaggaagacaguga

SEQ ID NO: 241345 - RNA, 19 nt, Homo sapiens
gcguuuaagaagaucauua

SEQ ID NO: 241346 - RNA, 19 nt, Homo sapiens
cacuaucuauuccaccuuu

SEQ ID NO: 241347 - RNA, 19 nt, Homo sapiens
acgcauacuucaacaagga

SEQ ID NO: 241348 - RNA, 19 nt, Homo sapiens
ucaauuggcugggcuacuc

SEQ ID NO: 241349 - RNA, 19 nt, Homo sapiens
cuuauuggcuuccucaucu

SEQ ID NO: 241350 - RNA, 19 nt, Homo sapiens
gagagaggaagacagugaa

SEQ ID NO: 241351 - RNA, 19 nt, Homo sapiens
cuuuggagcuuucuacauc

SEQ ID NO: 241352 - RNA, 19 nt, Homo sapiens
ucgcucacuuggcuuauug

SEQ ID NO: 241353 - RNA, 19 nt, Homo sapiens
ugaagacgcugggcaucau

SEQ ID NO: 241354 - RNA, 19 nt, Homo sapiens
uacuccaacucucugcuua

SEQ ID NO: 241355 - RNA, 19 nt, Homo sapiens
gaagaucauuaaguguaac

SEQ ID NO: 241356 - RNA, 19 nt, Homo sapiens
cguggccaauuaucuuauu

SEQ ID NO: 241357 - RNA, 19 nt, Homo sapiens
gagaggaagacagugaaga

SEQ ID NO: 241358 - RNA, 19 nt, Homo sapiens
gacagguacugggccauca

SEQ ID NO: 241359 - RNA, 19 nt, Homo sapiens
cgagagcagcugccacaug

SEQ ID NO: 241360 - RNA, 19 nt, Homo sapiens
gcucaugcugguucucuau

SEQ ID NO: 241361 - RNA, 19 nt, Homo sapiens
gggcaacaacaccacauca

SEQ ID NO: 241362 - RNA, 19 nt, Homo sapiens
caacaaggacuuucaaaac

SEQ ID NO: 241363 - RNA, 19 nt, Homo sapiens
gaccgucagcuaccaagug

SEQ ID NO: 241364 - RNA, 19 nt, Homo sapiens
gguaaccugcgaccuguuc

SEQ ID NO: 241365 - RNA, 19 nt, Homo sapiens
caaggaucauggcuacacu

SEQ ID NO: 241366 - RNA, 19 nt, Homo sapiens
caucaugggcaccuucauc

SEQ ID NO: 241367 - RNA, 19 nt, Homo sapiens
gcaaggaucauggcuacac

SEQ ID NO: 241368 - RNA, 19 nt, Homo sapiens
accgucagcuaccaaguga

SEQ ID NO: 241369 - RNA, 19 nt, Homo sapiens
gcaccauuagcaaggauca

SEQ ID NO: 241370 - RNA, 19 nt, Homo sapiens
ucgacuacgugaacaagag

SEQ ID NO: 241371 - RNA, 19 nt, Homo sapiens
gcugggcacgcucaucuuc

SEQ ID NO: 241372 - RNA, 19 nt, Homo sapiens
gaagacgcugggcaucauc

SEQ ID NO: 241373 - RNA, 19 nt, Homo sapiens
gugaagacgcugggcauca

SEQ ID NO: 241374 - RNA, 19 nt, Homo sapiens
ggaaaguacugcugguuau

SEQ ID NO: 241375 - RNA, 19 nt, Homo sapiens
aaacaagcauuccauaaac

SEQ ID NO: 241376 - RNA, 19 nt, Homo sapiens
gcgccaaggacuacauuua

SEQ ID NO: 241377 - RNA, 19 nt, Homo sapiens
ucacauggcugggcuaucu

SEQ ID NO: 241378 - RNA, 19 nt, Homo sapiens
gcaaagaugccugcugguu

SEQ ID NO: 241379 - RNA, 19 nt, Homo sapiens
uaucucaacucccucauca

SEQ ID NO: 241380 - RNA, 19 nt, Homo sapiens
cgucggacaucacuuguug

SEQ ID NO: 241381 - RNA, 19 nt, Homo sapiens
gagccuuuauuguguguug

SEQ ID NO: 241382 - RNA, 19 nt, Homo sapiens
aagaggaggugucggaaug

SEQ ID NO: 241383 - RNA, 19 nt, Homo sapiens
ccaccacgcucuccaaugc

SEQ ID NO: 241384 - RNA, 19 nt, Homo sapiens
gacccgagcccagcugaua

SEQ ID NO: 241385 - RNA, 19 nt, Homo sapiens
gaauccggaucuccugugu

SEQ ID NO: 241386 - RNA, 19 nt, Homo sapiens
uggcuacccuucuucauca

SEQ ID NO: 241387 - RNA, 19 nt, Homo sapiens
gaaaguacugcugguuaug

SEQ ID NO: 241388 - RNA, 19 nt, Homo sapiens
uggaaaguacugcugguua

SEQ ID NO: 241389 - RNA, 19 nt, Homo sapiens
gaagaggaggugucggaau

SEQ ID NO: 241390 - RNA, 19 nt, Homo sapiens
ggacuuuaaacaagcauuc

SEQ ID NO: 241391 - RNA, 19 nt, Homo sapiens
cguccucggucaccucuau

SEQ ID NO: 241392 - RNA, 19 nt, Homo sapiens
uauuggcgcucaucaccuu

SEQ ID NO: 241393 - RNA, 19 nt, Homo sapiens
gcucuccaaugccuuugug

SEQ ID NO: 241394 - RNA, 19 nt, Homo sapiens
guacugcugguuaugcuau

SEQ ID NO: 241395 - RNA, 19 nt, Homo sapiens
uucaucaucucccuaguga

SEQ ID NO: 241396 - RNA, 19 nt, Homo sapiens
agcauuccauaaacugaua

SEQ ID NO: 241397 - RNA, 19 nt, Homo sapiens
caagcauuccauaaacuga

SEQ ID NO: 241398 - RNA, 19 nt, Homo sapiens
agugaugccuaucugcaaa

SEQ ID NO: 241399 - RNA, 19 nt, Homo sapiens
ccggaucuccuguguaugu

SEQ ID NO: 241400 - RNA, 19 nt, Homo sapiens
gagcgcaaagccaccaaga

SEQ ID NO: 241401 - RNA, 19 nt, Homo sapiens
auccggaucuccuguguau

SEQ ID NO: 241402 - RNA, 19 nt, Homo sapiens
ucagcaccauguacacugu

SEQ ID NO: 241403 - RNA, 19 nt, Homo sapiens
ugaaacagacgcccaacag

SEQ ID NO: 241404 - RNA, 19 nt, Homo sapiens
uguguuggcuacccuucuu

SEQ ID NO: 241405 - RNA, 19 nt, Homo sapiens
ucggucaccucuauuaacu

SEQ ID NO: 241406 - RNA, 19 nt, Homo sapiens
uaaucuauaccauguccaa

SEQ ID NO: 241407 - RNA, 19 nt, Homo sapiens
uugggagccuuuauugugu

SEQ ID NO: 241408 - RNA, 19 nt, Homo sapiens
gcuaaaaggacucccaaga

SEQ ID NO: 241409 - RNA, 19 nt, Homo sapiens
gccguggaguacucagcua

SEQ ID NO: 241410 - RNA, 19 nt, Homo sapiens
cuccaaugccuuugugauu

SEQ ID NO: 241411 - RNA, 19 nt, Homo sapiens
caucuuugacuucuucaca

SEQ ID NO: 241412 - RNA, 19 nt, Homo sapiens
ccaagacccuagggaucau

SEQ ID NO: 241413 - RNA, 19 nt, Homo sapiens
gggagccuuuauugugugu

SEQ ID NO: 241414 - RNA, 19 nt, Homo sapiens
cacggugggugcuuucuac

SEQ ID NO: 241415 - RNA, 19 nt, Homo sapiens
ggucuucuccaucucuauc

SEQ ID NO: 241416 - RNA, 19 nt, Homo sapiens
ugggccagguggucuguga

SEQ ID NO: 241417 - RNA, 19 nt, Homo sapiens
ucuuugacuucuucacaug

SEQ ID NO: 241418 - RNA, 19 nt, Homo sapiens
ccaccuagccaucuuugac

SEQ ID NO: 241419 - RNA, 19 nt, Homo sapiens
ccucggucaccucuauuaa

SEQ ID NO: 241420 - RNA, 19 nt, Homo sapiens
acaccgaccacauccucua

SEQ ID NO: 241421 - RNA, 19 nt, Homo sapiens
gugugggucuucuccaucu

SEQ ID NO: 241422 - RNA, 19 nt, Homo sapiens
ggagagagauucagaaguu

SEQ ID NO: 241423 - RNA, 19 nt, Homo sapiens
uuagagauguugagucuua

SEQ ID NO: 241424 - RNA, 19 nt, Homo sapiens
gaagagaaagacaguauuu

SEQ ID NO: 241425 - RNA, 19 nt, Homo sapiens
gugaacaccucucagauuu

SEQ ID NO: 241426 - RNA, 19 nt, Homo sapiens
caacuguacuuagagaaua

SEQ ID NO: 241427 - RNA, 19 nt, Homo sapiens
gagagagauucagaaguua

SEQ ID NO: 241428 - RNA, 19 nt, Homo sapiens
gggcaggacugaagauuuc

SEQ ID NO: 241429 - RNA, 19 nt, Homo sapiens
ucacagaugcccuggaaua

SEQ ID NO: 241430 - RNA, 19 nt, Homo sapiens
gaaggaaggagccaaaugu

SEQ ID NO: 241431 - RNA, 19 nt, Homo sapiens
ggaaggccuccuagucuua

SEQ ID NO: 241432 - RNA, 19 nt, Homo sapiens
ggccaaaucuugugugaca

SEQ ID NO: 241433 - RNA, 19 nt, Homo sapiens
uaaaggagggugaauaaga

SEQ ID NO: 241434 - RNA, 19 nt, Homo sapiens
ucucagcauucuucaaaua

SEQ ID NO: 241435 - RNA, 19 nt, Homo sapiens
agacuuggauuaauucaug

SEQ ID NO: 241436 - RNA, 19 nt, Homo sapiens
gaccugaauugaaagagaa

SEQ ID NO: 241437 - RNA, 19 nt, Homo sapiens
ggugaugacucuuguuauc

SEQ ID NO: 241438 - RNA, 19 nt, Homo sapiens
ggaagaagugugugaccua

SEQ ID NO: 241439 - RNA, 19 nt, Homo sapiens
caaauaguccggucuuguu

SEQ ID NO: 241440 - RNA, 19 nt, Homo sapiens
gagaaaggaaagccacuaa

SEQ ID NO: 241441 - RNA, 19 nt, Homo sapiens
caagauuccugguugauac

SEQ ID NO: 241442 - RNA, 19 nt, Homo sapiens
gcaagaaucccagggcauu

SEQ ID NO: 241443 - RNA, 19 nt, Homo sapiens
aguccggucuuguuuaaua

SEQ ID NO: 241444 - RNA, 19 nt, Homo sapiens
gaaguucucauuaaacaca

SEQ ID NO: 241445 - RNA, 19 nt, Homo sapiens
aaaggagggugaauaagau

SEQ ID NO: 241446 - RNA, 19 nt, Homo sapiens
ucaccuggcuaggcuauuu

SEQ ID NO: 241447 - RNA, 19 nt, Homo sapiens
ccaccgaccucuugguuuc

SEQ ID NO: 241448 - RNA, 19 nt, Homo sapiens
gcagaaggaugacuuugcu

SEQ ID NO: 241449 - RNA, 19 nt, Homo sapiens
uccagaaucguuucaauua

SEQ ID NO: 241450 - RNA, 19 nt, Homo sapiens
uuaaaucucucccaguugu

SEQ ID NO: 241451 - RNA, 19 nt, Homo sapiens
ucugagacuuggauuaauu

SEQ ID NO: 241452 - RNA, 19 nt, Homo sapiens
ucauugcucuggacaggua

SEQ ID NO: 241453 - RNA, 19 nt, Homo sapiens
ggaaggcucucuggucuac

SEQ ID NO: 241454 - RNA, 19 nt, Homo sapiens
gaugacucuuguuaucuuu

SEQ ID NO: 241455 - RNA, 19 nt, Homo sapiens
cugagucuuucuuagauua

SEQ ID NO: 241456 - RNA, 19 nt, Homo sapiens
ggagggugaauaagauuaa

SEQ ID NO: 241457 - RNA, 19 nt, Homo sapiens
ccucaucaauccaauaauc

SEQ ID NO: 241458 - RNA, 19 nt, Homo sapiens
gaaaggaaagccacuaaaa

SEQ ID NO: 241459 - RNA, 19 nt, Homo sapiens
aaucacagaugcccuggaa

SEQ ID NO: 241460 - RNA, 19 nt, Homo sapiens
ggaugacuuugcucuguug

SEQ ID NO: 241461 - RNA, 19 nt, Homo sapiens
ccacugagucuuucuuaga

SEQ ID NO: 241462 - RNA, 19 nt, Homo sapiens
uauuuaaacucccucauca

SEQ ID NO: 241463 - RNA, 19 nt, Homo sapiens
gaagcagaaggaugacuuu

SEQ ID NO: 241464 - RNA, 19 nt, Homo sapiens
gagaauagucuggucuuga

SEQ ID NO: 241465 - RNA, 19 nt, Homo sapiens
cauuagagauguugagucu

SEQ ID NO: 241466 - RNA, 19 nt, Homo sapiens
ccaaagugcugggauuaca

SEQ ID NO: 241467 - RNA, 19 nt, Homo sapiens
uaccugagaucuauaugga

SEQ ID NO: 241468 - RNA, 19 nt, Homo sapiens
cuacaagauuccugguuga

SEQ ID NO: 241469 - RNA, 19 nt, Homo sapiens
gaacaccucucagauuucc

SEQ ID NO: 241470 - RNA, 19 nt, Homo sapiens
ccugagacaucuugggauu

SEQ ID NO: 241471 - RNA, 19 nt, Homo sapiens
gaugauauagagugacuug

SEQ ID NO: 241472 - RNA, 19 nt, Homo sapiens
ucacaguuccucuuuguug

SEQ ID NO: 241473 - RNA, 19 nt, Homo sapiens
ccacaguccucuccaaugc

SEQ ID NO: 241474 - RNA, 19 nt, Homo sapiens
ccggucuuguuuaauauua

SEQ ID NO: 241475 - RNA, 19 nt, Homo sapiens
ugaccugaauugaaagaga

SEQ ID NO: 241476 - RNA, 19 nt, Homo sapiens
agaagugugugaccuacaa

SEQ ID NO: 241477 - RNA, 19 nt, Homo sapiens
gaauccacccucacucuau

SEQ ID NO: 241478 - RNA, 19 nt, Homo sapiens
gcuaaauccagaaucguuu

SEQ ID NO: 241479 - RNA, 19 nt, Homo sapiens
ccucuugguuuccaucuug

SEQ ID NO: 241480 - RNA, 19 nt, Homo sapiens
ucuaacaaauucagcaugu

SEQ ID NO: 241481 - RNA, 19 nt, Homo sapiens
ggaggucugugggaagaga

SEQ ID NO: 241482 - RNA, 19 nt, Homo sapiens
ccaccagugugaagcagaa

SEQ ID NO: 241483 - RNA, 19 nt, Homo sapiens
gcaacuguacuuagagaau

SEQ ID NO: 241484 - RNA, 19 nt, Homo sapiens
gagaaagacaguauuugca

SEQ ID NO: 241485 - RNA, 19 nt, Homo sapiens
gcaccuugauuggaaaaua

SEQ ID NO: 241486 - RNA, 19 nt, Homo sapiens
cagaaucguuucaauuacu

SEQ ID NO: 241487 - RNA, 19 nt, Homo sapiens
uaacaaauucagcaugugu

SEQ ID NO: 241488 - RNA, 19 nt, Homo sapiens
cuuaaaggagggugaauaa

SEQ ID NO: 241489 - RNA, 19 nt, Homo sapiens
ugaugacucuuguuaucuu

SEQ ID NO: 241490 - RNA, 19 nt, Homo sapiens
caccaggcccagcuaauuu

SEQ ID NO: 241491 - RNA, 19 nt, Homo sapiens
ggacuacaaacguguguca

SEQ ID NO: 241492 - RNA, 19 nt, Homo sapiens
uaaacucccucaucaaucc

SEQ ID NO: 241493 - RNA, 19 nt, Homo sapiens
auaguccggucuuguuuaa

SEQ ID NO: 241494 - RNA, 19 nt, Homo sapiens
cugaaguucucauuaaaca

SEQ ID NO: 241495 - RNA, 19 nt, Homo sapiens
agaucuauauggagcuuaa

SEQ ID NO: 241496 - RNA, 19 nt, Homo sapiens
ggaguguaguggcacaauc

SEQ ID NO: 241497 - RNA, 19 nt, Homo sapiens
gaggcuaaauccagaaucg

SEQ ID NO: 241498 - RNA, 19 nt, Homo sapiens
gggaagagagagccaccua

SEQ ID NO: 241499 - RNA, 19 nt, Homo sapiens
uauugcaacuguacuuaga

SEQ ID NO: 241500 - RNA, 19 nt, Homo sapiens
gugaagagaaagacaguau

SEQ ID NO: 241501 - RNA, 19 nt, Homo sapiens
gggugaauaagauuaauga

SEQ ID NO: 241502 - RNA, 19 nt, Homo sapiens
gcuuaaaggagggugaaua

SEQ ID NO: 241503 - RNA, 19 nt, Homo sapiens
acaucuggcuguccucuga

SEQ ID NO: 241504 - RNA, 19 nt, Homo sapiens
guacggcucccaccagugu

SEQ ID NO: 241505 - RNA, 19 nt, Homo sapiens
agaauagucuggucuugag

SEQ ID NO: 241506 - RNA, 19 nt, Homo sapiens
gaaguugaaacccaugauc

SEQ ID NO: 241507 - RNA, 19 nt, Homo sapiens
ccagaaucguuucaauuac

SEQ ID NO: 241508 - RNA, 19 nt, Homo sapiens
cugcaucucugugucauug

SEQ ID NO: 241509 - RNA, 19 nt, Homo sapiens
guaguugucucagcauucu

SEQ ID NO: 241510 - RNA, 19 nt, Homo sapiens
ccuguacccuuccuucuuc

SEQ ID NO: 241511 - RNA, 19 nt, Homo sapiens
ccagauugacuacccugua

SEQ ID NO: 241512 - RNA, 19 nt, Homo sapiens
gacagguacugggcaauca

SEQ ID NO: 241513 - RNA, 19 nt, Homo sapiens
ccucuccaaugccuuugua

SEQ ID NO: 241514 - RNA, 19 nt, Homo sapiens
uccaacagaucccugaaug

SEQ ID NO: 241515 - RNA, 19 nt, Homo sapiens
uuagagaucugaaaacuca

SEQ ID NO: 241516 - RNA, 19 nt, Homo sapiens
cagauugacuacccuguac

SEQ ID NO: 241517 - RNA, 19 nt, Homo sapiens
agagugacuuggagagaga

SEQ ID NO: 241518 - RNA, 19 nt, Homo sapiens
ugugugaccuacaagauuc

SEQ ID NO: 241519 - RNA, 19 nt, Homo sapiens
uaucuugagucuugguuca

SEQ ID NO: 241520 - RNA, 19 nt, Homo sapiens
cggaaggccuccuagucuu

SEQ ID NO: 241521 - RNA, 19 nt, Homo sapiens
gaacgcaagaggauuucug

SEQ ID NO: 241522 - RNA, 19 nt, Homo sapiens
ccacauagcugaacaaauu

SEQ ID NO: 241523 - RNA, 19 nt, Homo sapiens
gaacuuggcugugaucaug

SEQ ID NO: 241524 - RNA, 19 nt, Homo sapiens
gagcauacuuagacuguaa

SEQ ID NO: 241525 - RNA, 19 nt, Homo sapiens
gaacacaagagaccacaua

SEQ ID NO: 241526 - RNA, 19 nt, Homo sapiens
cauguuaucuacaccauuu

SEQ ID NO: 241527 - RNA, 19 nt, Homo sapiens
gaucaacccucugcucuau

SEQ ID NO: 241528 - RNA, 19 nt, Homo sapiens
gcacagauagccagaauuc

SEQ ID NO: 241529 - RNA, 19 nt, Homo sapiens
ccaagagccuuuaccagaa

SEQ ID NO: 241530 - RNA, 19 nt, Homo sapiens
guaaguauguguggucuug

SEQ ID NO: 241531 - RNA, 19 nt, Homo sapiens
ccaaagugcuggaauuaca

SEQ ID NO: 241532 - RNA, 19 nt, Homo sapiens
caggagaguuuguaaguau

SEQ ID NO: 241533 - RNA, 19 nt, Homo sapiens
caagagccuuuaccagaaa

SEQ ID NO: 241534 - RNA, 19 nt, Homo sapiens
ccaacuaccuaaucuguuc

SEQ ID NO: 241535 - RNA, 19 nt, Homo sapiens
gggugcaacuuauuaauuc

SEQ ID NO: 241536 - RNA, 19 nt, Homo sapiens
ccucuggucuuaucuguga

SEQ ID NO: 241537 - RNA, 19 nt, Homo sapiens
gcuggaagcuuggguacuu

SEQ ID NO: 241538 - RNA, 19 nt, Homo sapiens
ccaagaccaucacugagaa

SEQ ID NO: 241539 - RNA, 19 nt, Homo sapiens
gaaacaagggaaacaugaa

SEQ ID NO: 241540 - RNA, 19 nt, Homo sapiens
ccacagaguuugaaaaguu

SEQ ID NO: 241541 - RNA, 19 nt, Homo sapiens
ugacguggcucgguuaugu

SEQ ID NO: 241542 - RNA, 19 nt, Homo sapiens
gaaacaugaacaucacaaa

SEQ ID NO: 241543 - RNA, 19 nt, Homo sapiens
cuucgaggcuacauaguuu

SEQ ID NO: 241544 - RNA, 19 nt, Homo sapiens
gauucugggugcauucauu

SEQ ID NO: 241545 - RNA, 19 nt, Homo sapiens
ucaggagaguuuguaagua

SEQ ID NO: 241546 - RNA, 19 nt, Homo sapiens
guuugaggauuguuauuug

SEQ ID NO: 241547 - RNA, 19 nt, Homo sapiens
cagauagccagaauucuuu

SEQ ID NO: 241548 - RNA, 19 nt, Homo sapiens
gagaagaugcucauuugca

SEQ ID NO: 241549 - RNA, 19 nt, Homo sapiens
gcuguggcccuucccuuua

SEQ ID NO: 241550 - RNA, 19 nt, Homo sapiens
ggucuuguuuccuuguuug

SEQ ID NO: 241551 - RNA, 19 nt, Homo sapiens
gcacgcaccguccacaaga

SEQ ID NO: 241552 - RNA, 19 nt, Homo sapiens
gaacgucagcagaucucua

SEQ ID NO: 241553 - RNA, 19 nt, Homo sapiens
gacccaagaccaucacuga

SEQ ID NO: 241554 - RNA, 19 nt, Homo sapiens
gaaaauggaacacaagaga

SEQ ID NO: 241555 - RNA, 19 nt, Homo sapiens
ucaccacccucaccacguu

SEQ ID NO: 241556 - RNA, 19 nt, Homo sapiens
ugaaacaagggaaacauga

SEQ ID NO: 241557 - RNA, 19 nt, Homo sapiens
aggcgaaccuucacucaga

SEQ ID NO: 241558 - RNA, 19 nt, Homo sapiens
ccucagacccuaccacaga

SEQ ID NO: 241559 - RNA, 19 nt, Homo sapiens
aauuauagccuccuuacaa

SEQ ID NO: 241560 - RNA, 19 nt, Homo sapiens
gcccuucccuuuaccaaca

SEQ ID NO: 241561 - RNA, 19 nt, Homo sapiens
gacgggauuucaccauguu

SEQ ID NO: 241562 - RNA, 19 nt, Homo sapiens
gagagcauacuuagacugu

SEQ ID NO: 241563 - RNA, 19 nt, Homo sapiens
acagauagccagaauucuu

SEQ ID NO: 241564 - RNA, 19 nt, Homo sapiens
ggaagaggacggccaagag

SEQ ID NO: 241565 - RNA, 19 nt, Homo sapiens
ggaaacaugaacaucacaa

SEQ ID NO: 241566 - RNA, 19 nt, Homo sapiens
cuuguuuccuuguuuguuu

SEQ ID NO: 241567 - RNA, 19 nt, Homo sapiens
uaugugaauucucugauca

SEQ ID NO: 241568 - RNA, 19 nt, Homo sapiens
gauacugauucucuauuac

SEQ ID NO: 241569 - RNA, 19 nt, Homo sapiens
ccucugcucuauacgaguu

SEQ ID NO: 241570 - RNA, 19 nt, Homo sapiens
aagcacagauagccagaau

SEQ ID NO: 241571 - RNA, 19 nt, Homo sapiens
gauucucuauuaccggauu

SEQ ID NO: 241572 - RNA, 19 nt, Homo sapiens
cgccucagcuuccuaguag

SEQ ID NO: 241573 - RNA, 19 nt, Homo sapiens
guacugggccaucaccaau

SEQ ID NO: 241574 - RNA, 19 nt, Homo sapiens
ccaccagccugccaacuac

SEQ ID NO: 241575 - RNA, 19 nt, Homo sapiens
ucaccacguugcugaacuu

SEQ ID NO: 241576 - RNA, 19 nt, Homo sapiens
gcugugaucauggcuauug

SEQ ID NO: 241577 - RNA, 19 nt, Homo sapiens
ucaacccucugcucuauac

SEQ ID NO: 241578 - RNA, 19 nt, Homo sapiens
caaauuauagccuccuuac

SEQ ID NO: 241579 - RNA, 19 nt, Homo sapiens
ccuaguagcugggauugca

SEQ ID NO: 241580 - RNA, 19 nt, Homo sapiens
uugcugaacuuggcuguga

SEQ ID NO: 241581 - RNA, 19 nt, Homo sapiens
acaugaacaucacaaacug

SEQ ID NO: 241582 - RNA, 19 nt, Homo sapiens
ugauccagcucaggagaaa

SEQ ID NO: 241583 - RNA, 19 nt, Homo sapiens
caucuacauugucauggau

SEQ ID NO: 241584 - RNA, 19 nt, Homo sapiens
gcacagucucaccucauug

SEQ ID NO: 241585 - RNA, 19 nt, Homo sapiens
ggaauuacaggcgaaccuu

SEQ ID NO: 241586 - RNA, 19 nt, Homo sapiens
gagaccacauagcugaaca

SEQ ID NO: 241587 - RNA, 19 nt, Homo sapiens
ggagaguuuguaaguaugu

SEQ ID NO: 241588 - RNA, 19 nt, Homo sapiens
ugacuuugauacugauucu

SEQ ID NO: 241589 - RNA, 19 nt, Homo sapiens
ggcgaaccuucacucagaa

SEQ ID NO: 241590 - RNA, 19 nt, Homo sapiens
ggccaucaccaaugcuauu

SEQ ID NO: 241591 - RNA, 19 nt, Homo sapiens
agacgggauuucaccaugu

SEQ ID NO: 241592 - RNA, 19 nt, Homo sapiens
ucccaaagugcuggaauua

SEQ ID NO: 241593 - RNA, 19 nt, Homo sapiens
gcaacagaagcacagauag

SEQ ID NO: 241594 - RNA, 19 nt, Homo sapiens
ucaucuacauugucaugga

SEQ ID NO: 241595 - RNA, 19 nt, Homo sapiens
caucaucuacauugucaug

SEQ ID NO: 241596 - RNA, 19 nt, Homo sapiens
uguguggucuuguuuccuu

SEQ ID NO: 241597 - RNA, 19 nt, Homo sapiens
gagcaucaucuacauuguc

SEQ ID NO: 241598 - RNA, 19 nt, Homo sapiens
guggcucgguuaugugaau

SEQ ID NO: 241599 - RNA, 19 nt, Homo sapiens
cuucgacaaugaucuagau

SEQ ID NO: 241600 - RNA, 19 nt, Homo sapiens
caacagaagcacagauagc

SEQ ID NO: 241601 - RNA, 19 nt, Homo sapiens
gacagguacugggccauca

SEQ ID NO: 241602 - RNA, 19 nt, Homo sapiens
acaaauuauagccuccuua

SEQ ID NO: 241603 - RNA, 19 nt, Homo sapiens
cacauagcugaacaaauua

SEQ ID NO: 241604 - RNA, 19 nt, Homo sapiens
aaguauguguggucuuguu

SEQ ID NO: 241605 - RNA, 19 nt, Homo sapiens
cagcuggacgugccgguuu

SEQ ID NO: 241606 - RNA, 19 nt, Homo sapiens
aaacuuacacagacuuucu

SEQ ID NO: 241607 - RNA, 19 nt, Homo sapiens
agucggcacuuaagcaaca

SEQ ID NO: 241608 - RNA, 19 nt, Homo sapiens
gaccacauagcugaacaaa

SEQ ID NO: 241609 - RNA, 19 nt, Homo sapiens
ucgguuaugugaauucucu

SEQ ID NO: 241610 - RNA, 19 nt, Homo sapiens
ggagaacgucagcagaucu

SEQ ID NO: 241611 - RNA, 19 nt, Homo sapiens
caggagaacgucagcagau

SEQ ID NO: 241612 - RNA, 19 nt, Homo sapiens
cccaagaccaucacugaga

SEQ ID NO: 241613 - RNA, 19 nt, Homo sapiens
uggccaugcuggucuugaa

SEQ ID NO: 241614 - RNA, 19 nt, Homo sapiens
gccgagagcauacuuagac

SEQ ID NO: 241615 - RNA, 19 nt, Homo sapiens
uggcugugaucauggcuau

SEQ ID NO: 241616 - RNA, 19 nt, Homo sapiens
cacaagagaccacauagcu

SEQ ID NO: 241617 - RNA, 19 nt, Homo sapiens
gagcggguuccgagugaga

SEQ ID NO: 241618 - RNA, 19 nt, Homo sapiens
gagaguuuguaaguaugug

SEQ ID NO: 241619 - RNA, 19 nt, Homo sapiens
agcaacagaagcacagaua

SEQ ID NO: 241620 - RNA, 19 nt, Homo sapiens
ccaacagcuucuccacagu

SEQ ID NO: 241621 - RNA, 19 nt, Homo sapiens
uauagccuccuuacaagug

SEQ ID NO: 241622 - RNA, 19 nt, Homo sapiens
agagagagcuggauuaugg

SEQ ID NO: 241623 - RNA, 19 nt, Homo sapiens
caaguaggauugcaaagga

SEQ ID NO: 241624 - RNA, 19 nt, Homo sapiens
caaguggucugugacauuu

SEQ ID NO: 241625 - RNA, 19 nt, Homo sapiens
gaaaagcacuaaaucaguu

SEQ ID NO: 241626 - RNA, 19 nt, Homo sapiens
gcacugaugacaacaacua

SEQ ID NO: 241627 - RNA, 19 nt, Homo sapiens
ggucugaauucaagcauga

SEQ ID NO: 241628 - RNA, 19 nt, Homo sapiens
caugagaaaucuuggagaa

SEQ ID NO: 241629 - RNA, 19 nt, Homo sapiens
gagcagcaaagacauuaua

SEQ ID NO: 241630 - RNA, 19 nt, Homo sapiens
ugugaucgcugcaauuauu

SEQ ID NO: 241631 - RNA, 19 nt, Homo sapiens
uagcagagaugaugaaugc

SEQ ID NO: 241632 - RNA, 19 nt, Homo sapiens
aaucuugggugcauuugua

SEQ ID NO: 241633 - RNA, 19 nt, Homo sapiens
gcaaguggucugugacauu

SEQ ID NO: 241634 - RNA, 19 nt, Homo sapiens
guaucucaauucccuuaua

SEQ ID NO: 241635 - RNA, 19 nt, Homo sapiens
ccaaggaacuagcagagau

SEQ ID NO: 241636 - RNA, 19 nt, Homo sapiens
caaaagaucucagguacaa

SEQ ID NO: 241637 - RNA, 19 nt, Homo sapiens
ccacauuguuuccaccauu

SEQ ID NO: 241638 - RNA, 19 nt, Homo sapiens
gaaaaggacuccaaagcau

SEQ ID NO: 241639 - RNA, 19 nt, Homo sapiens
gaacuagcagagaugauga

SEQ ID NO: 241640 - RNA, 19 nt, Homo sapiens
cuaaaucaguuuccacauc

SEQ ID NO: 241641 - RNA, 19 nt, Homo sapiens
ucaauucccuuauaaaucc

SEQ ID NO: 241642 - RNA, 19 nt, Homo sapiens
ggaggugaauggccaaguc

SEQ ID NO: 241643 - RNA, 19 nt, Homo sapiens
gaacggaaagcagccacua

SEQ ID NO: 241644 - RNA, 19 nt, Homo sapiens
caaaggaggaggugaaugg

SEQ ID NO: 241645 - RNA, 19 nt, Homo sapiens
gacauuauaccacaagaga

SEQ ID NO: 241646 - RNA, 19 nt, Homo sapiens
ggaacuagcagagaugaug

SEQ ID NO: 241647 - RNA, 19 nt, Homo sapiens
ccacuacccugggauuaau

SEQ ID NO: 241648 - RNA, 19 nt, Homo sapiens
caaagacauuauaccacaa

SEQ ID NO: 241649 - RNA, 19 nt, Homo sapiens
ccauccagccaauuauuua

SEQ ID NO: 241650 - RNA, 19 nt, Homo sapiens
guaauauguuggcuuccuu

SEQ ID NO: 241651 - RNA, 19 nt, Homo sapiens
uaaacagaaugccauccaa

SEQ ID NO: 241652 - RNA, 19 nt, Homo sapiens
acuaucaacucccuuguga

SEQ ID NO: 241653 - RNA, 19 nt, Homo sapiens
ggauuaaucuugggugcau

SEQ ID NO: 241654 - RNA, 19 nt, Homo sapiens
gagacaagcaaguaggauu

SEQ ID NO: 241655 - RNA, 19 nt, Homo sapiens
cacauuguuuccaccauuu

SEQ ID NO: 241656 - RNA, 19 nt, Homo sapiens
gugcauuuguaauauguug

SEQ ID NO: 241657 - RNA, 19 nt, Homo sapiens
aaagaucucagguacaaga

SEQ ID NO: 241658 - RNA, 19 nt, Homo sapiens
aaacagaaugccauccaaa

SEQ ID NO: 241659 - RNA, 19 nt, Homo sapiens
cacaagagacaagcaagua

SEQ ID NO: 241660 - RNA, 19 nt, Homo sapiens
gcauugauuuugauccuuu

SEQ ID NO: 241661 - RNA, 19 nt, Homo sapiens
uggcuuggguaucucaauu

SEQ ID NO: 241662 - RNA, 19 nt, Homo sapiens
gcagagaugaugaaugcau

SEQ ID NO: 241663 - RNA, 19 nt, Homo sapiens
caagaaagcauuccaaaag

SEQ ID NO: 241664 - RNA, 19 nt, Homo sapiens
ugaauucaagcaugagaaa

SEQ ID NO: 241665 - RNA, 19 nt, Homo sapiens
gugagagagagcuggauua

SEQ ID NO: 241666 - RNA, 19 nt, Homo sapiens
ggguaucucaauucccuua

SEQ ID NO: 241667 - RNA, 19 nt, Homo sapiens
gucuuuaucugacccauca

SEQ ID NO: 241668 - RNA, 19 nt, Homo sapiens
uagagcagcaaagacauua

SEQ ID NO: 241669 - RNA, 19 nt, Homo sapiens
ggcauuaugauuacaauag

SEQ ID NO: 241670 - RNA, 19 nt, Homo sapiens
uggcauggcuuggguaucu

SEQ ID NO: 241671 - RNA, 19 nt, Homo sapiens
ccacuggcauugauuuuga

SEQ ID NO: 241672 - RNA, 19 nt, Homo sapiens
cagaugcuguugaguaugc

SEQ ID NO: 241673 - RNA, 19 nt, Homo sapiens
gacauuuggcugaguguug

SEQ ID NO: 241674 - RNA, 19 nt, Homo sapiens
gggugcauuuguaauaugu

SEQ ID NO: 241675 - RNA, 19 nt, Homo sapiens
cagcaaagacauuauacca

SEQ ID NO: 241676 - RNA, 19 nt, Homo sapiens
caccauuuacucaacauuu

SEQ ID NO: 241677 - RNA, 19 nt, Homo sapiens
acauuuggcugaguguuga

SEQ ID NO: 241678 - RNA, 19 nt, Homo sapiens
gcaccauccagccaauuau

SEQ ID NO: 241679 - RNA, 19 nt, Homo sapiens
gugaauggccaaguccuuu

SEQ ID NO: 241680 - RNA, 19 nt, Homo sapiens
agacaagcaaguaggauug

SEQ ID NO: 241681 - RNA, 19 nt, Homo sapiens
ggaucgguaucgagcaauc

SEQ ID NO: 241682 - RNA, 19 nt, Homo sapiens
cuugugaucgcugcaauua

SEQ ID NO: 241683 - RNA, 19 nt, Homo sapiens
caacauuuggagcuuucua

SEQ ID NO: 241684 - RNA, 19 nt, Homo sapiens
ugagagagagcuggauuau

SEQ ID NO: 241685 - RNA, 19 nt, Homo sapiens
gccacuacccugggauuaa

SEQ ID NO: 241686 - RNA, 19 nt, Homo sapiens
cauccagccaauuauuuaa

SEQ ID NO: 241687 - RNA, 19 nt, Homo sapiens
ggaaaaggacuccaaagca

SEQ ID NO: 241688 - RNA, 19 nt, Homo sapiens
uugcaucucucagcuauag

SEQ ID NO: 241689 - RNA, 19 nt, Homo sapiens
ugacaacaacuaucaacuc

SEQ ID NO: 241690 - RNA, 19 nt, Homo sapiens
accauuuacucaacauuug

SEQ ID NO: 241691 - RNA, 19 nt, Homo sapiens
caaggaacuagcagagaug

SEQ ID NO: 241692 - RNA, 19 nt, Homo sapiens
cuugggugcauuuguaaua

SEQ ID NO: 241693 - RNA, 19 nt, Homo sapiens
ugucugggcuggcacugau

SEQ ID NO: 241694 - RNA, 19 nt, Homo sapiens
ugacccaucaacagacuuu

SEQ ID NO: 241695 - RNA, 19 nt, Homo sapiens
cauuguguauauugugaga

SEQ ID NO: 241696 - RNA, 19 nt, Homo sapiens
cuugugcgaugucgauguu

SEQ ID NO: 241697 - RNA, 19 nt, Homo sapiens
uaauauguuggcuuccuuu

SEQ ID NO: 241698 - RNA, 19 nt, Homo sapiens
cauuauaccacaagagaca

SEQ ID NO: 241699 - RNA, 19 nt, Homo sapiens
uggcugaguguugacauua

SEQ ID NO: 241700 - RNA, 19 nt, Homo sapiens
gagagagagcuggauuaug

SEQ ID NO: 241701 - RNA, 19 nt, Homo sapiens
cuucagcauuguguauauu

SEQ ID NO: 241702 - RNA, 19 nt, Homo sapiens
ccacaagagacaagcaagu

SEQ ID NO: 241703 - RNA, 19 nt, Homo sapiens
cuacaucccacuggcauug

SEQ ID NO: 241704 - RNA, 19 nt, Homo sapiens
ccuucagcauuguguauau

SEQ ID NO: 241705 - RNA, 19 nt, Homo sapiens
gcaaaggaggaggugaaug

SEQ ID NO: 241706 - RNA, 19 nt, Homo sapiens
cagaaugccauccaaaauu

SEQ ID NO: 241707 - RNA, 19 nt, Homo sapiens
caccauccagccaauuauu

SEQ ID NO: 241708 - RNA, 19 nt, Homo sapiens
auuuggagcuuucuacauc

SEQ ID NO: 241709 - RNA, 19 nt, Homo sapiens
ucagcauuguguauauugu

SEQ ID NO: 241710 - RNA, 19 nt, Homo sapiens
cucuaugccuccucuauuc

SEQ ID NO: 241711 - RNA, 19 nt, Homo sapiens
ucuugcaucucucagcuau

SEQ ID NO: 241712 - RNA, 19 nt, Homo sapiens
ugcaccauccagccaauua

SEQ ID NO: 241713 - RNA, 19 nt, Homo sapiens
gaugacaacaacuaucaac

SEQ ID NO: 241714 - RNA, 19 nt, Homo sapiens
gaauucaagcaugagaaau

SEQ ID NO: 241715 - RNA, 19 nt, Homo sapiens
cccuugcagucacagauuu

SEQ ID NO: 241716 - RNA, 19 nt, Homo sapiens
gagaaaagcacuaaaucag

SEQ ID NO: 241717 - RNA, 19 nt, Homo sapiens
acucaacauuuggagcuuu

SEQ ID NO: 241718 - RNA, 19 nt, Homo sapiens
gggcuggcacugaugacaa

SEQ ID NO: 241719 - RNA, 19 nt, Homo sapiens
agcauuguguauauuguga

SEQ ID NO: 241720 - RNA, 19 nt, Homo sapiens
gauuaaucuugggugcauu

SEQ ID NO: 241721 - RNA, 19 nt, Homo sapiens
cauccuauguacuagaaaa

SEQ ID NO: 241722 - RNA, 19 nt, Homo sapiens
gaaccaaccuuuccuguga

SEQ ID NO: 241723 - RNA, 19 nt, Homo sapiens
gcaggugacuuuccuauga

SEQ ID NO: 241724 - RNA, 19 nt, Homo sapiens
gaagcuacuuuguguguaa

SEQ ID NO: 241725 - RNA, 19 nt, Homo sapiens
gauaaugacugcucaaugg

SEQ ID NO: 241726 - RNA, 19 nt, Homo sapiens
uaacacuucugaugcauuu

SEQ ID NO: 241727 - RNA, 19 nt, Homo sapiens
aaacagcacuaucgaggua

SEQ ID NO: 241728 - RNA, 19 nt, Homo sapiens
ccaaaugccuuucuagcaa

SEQ ID NO: 241729 - RNA, 19 nt, Homo sapiens
caucaugcaugcacucuuu

SEQ ID NO: 241730 - RNA, 19 nt, Homo sapiens
ugaauauaauggccucuua

SEQ ID NO: 241731 - RNA, 19 nt, Homo sapiens
ggauugaguugguuaccua

SEQ ID NO: 241732 - RNA, 19 nt, Homo sapiens
gcaaagaguccugcaauga

SEQ ID NO: 241733 - RNA, 19 nt, Homo sapiens
ucaagucacuccagaaaga

SEQ ID NO: 241734 - RNA, 19 nt, Homo sapiens
gaacuaaggcauuucugaa

SEQ ID NO: 241735 - RNA, 19 nt, Homo sapiens
gaccauaucaguagguaua

SEQ ID NO: 241736 - RNA, 19 nt, Homo sapiens
gcaaaaggaugauuuaaca

SEQ ID NO: 241737 - RNA, 19 nt, Homo sapiens
gcugugagcuuucugauac

SEQ ID NO: 241738 - RNA, 19 nt, Homo sapiens
guaacuugcugugaaauga

SEQ ID NO: 241739 - RNA, 19 nt, Homo sapiens
gugaucaccuacuuucuaa

SEQ ID NO: 241740 - RNA, 19 nt, Homo sapiens
gcucuacaguaaugacuuu

SEQ ID NO: 241741 - RNA, 19 nt, Homo sapiens
ccaguguggucuuguuuaa

SEQ ID NO: 241742 - RNA, 19 nt, Homo sapiens
gcaaauuucuagauaugag

SEQ ID NO: 241743 - RNA, 19 nt, Homo sapiens
aguguggucuuguuuaaua

SEQ ID NO: 241744 - RNA, 19 nt, Homo sapiens
guggaaaccuugcugcuau

SEQ ID NO: 241745 - RNA, 19 nt, Homo sapiens
cgagguauuugguaacuug

SEQ ID NO: 241746 - RNA, 19 nt, Homo sapiens
gaauauaauggccucuuaa

SEQ ID NO: 241747 - RNA, 19 nt, Homo sapiens
aaacuggucugcuuuacug

SEQ ID NO: 241748 - RNA, 19 nt, Homo sapiens
gcucgugcauguaauccua

SEQ ID NO: 241749 - RNA, 19 nt, Homo sapiens
ucagauccaucgguuuaua

SEQ ID NO: 241750 - RNA, 19 nt, Homo sapiens
ucacaagguugcuggcauu

SEQ ID NO: 241751 - RNA, 19 nt, Homo sapiens
gcuaugcuguucauugaug

SEQ ID NO: 241752 - RNA, 19 nt, Homo sapiens
gaaacauacucgucaucau

SEQ ID NO: 241753 - RNA, 19 nt, Homo sapiens
cgaacucccuaaugcaauu

SEQ ID NO: 241754 - RNA, 19 nt, Homo sapiens
gccaagaguuugagaccaa

SEQ ID NO: 241755 - RNA, 19 nt, Homo sapiens
cagguaaacugaugcuuuc

SEQ ID NO: 241756 - RNA, 19 nt, Homo sapiens
agacauggauauucuuugu

SEQ ID NO: 241757 - RNA, 19 nt, Homo sapiens
ccacuagucuacacacugu

SEQ ID NO: 241758 - RNA, 19 nt, Homo sapiens
caaccuggguaacaaagug

SEQ ID NO: 241759 - RNA, 19 nt, Homo sapiens
gcagaaugccaccaacuau

SEQ ID NO: 241760 - RNA, 19 nt, Homo sapiens
ucaccuacuuucuaacuau

SEQ ID NO: 241761 - RNA, 19 nt, Homo sapiens
ugacagccguagugauuau

SEQ ID NO: 241762 - RNA, 19 nt, Homo sapiens
acauggauauucuuuguga

SEQ ID NO: 241763 - RNA, 19 nt, Homo sapiens
ccuaggacaucucuguaaa

SEQ ID NO: 241764 - RNA, 19 nt, Homo sapiens
gagcaguaaauguauauug

SEQ ID NO: 241765 - RNA, 19 nt, Homo sapiens
caaaugccuuucuagcaau

SEQ ID NO: 241766 - RNA, 19 nt, Homo sapiens
gaaaaucgaaccaaccuuu

SEQ ID NO: 241767 - RNA, 19 nt, Homo sapiens
gggccaaauuagcuucuuu

SEQ ID NO: 241768 - RNA, 19 nt, Homo sapiens
gcuggcauuugcugcauuu

SEQ ID NO: 241769 - RNA, 19 nt, Homo sapiens
caaaaugugugcuuggaaa

SEQ ID NO: 241770 - RNA, 19 nt, Homo sapiens
agaaugccaccaacuauuu

SEQ ID NO: 241771 - RNA, 19 nt, Homo sapiens
ugacagugguagaguccua

SEQ ID NO: 241772 - RNA, 19 nt, Homo sapiens
ggaaacauacucgucauca

SEQ ID NO: 241773 - RNA, 19 nt, Homo sapiens
gagaugggaggaucacuug

SEQ ID NO: 241774 - RNA, 19 nt, Homo sapiens
ggcauuugcugcauuucaa

SEQ ID NO: 241775 - RNA, 19 nt, Homo sapiens
ccaagacaacagauaauga

SEQ ID NO: 241776 - RNA, 19 nt, Homo sapiens
aaagcaagaugccaagaca

SEQ ID NO: 241777 - RNA, 19 nt, Homo sapiens
caccaacuauuuccugaug

SEQ ID NO: 241778 - RNA, 19 nt, Homo sapiens
aaacauacucgucaucaug

SEQ ID NO: 241779 - RNA, 19 nt, Homo sapiens
aacuauugcuggaaacaua

SEQ ID NO: 241780 - RNA, 19 nt, Homo sapiens
gcuuagacauggauauucu

SEQ ID NO: 241781 - RNA, 19 nt, Homo sapiens
caaaauccuugccuucaaa

SEQ ID NO: 241782 - RNA, 19 nt, Homo sapiens
guaacugugucaggauuga

SEQ ID NO: 241783 - RNA, 19 nt, Homo sapiens
cauguaauccuagcacuuu

SEQ ID NO: 241784 - RNA, 19 nt, Homo sapiens
cugcuaugcuguucauuga

SEQ ID NO: 241785 - RNA, 19 nt, Homo sapiens
ccucagaguucuuugucuu

SEQ ID NO: 241786 - RNA, 19 nt, Homo sapiens
caagguugcuggcauuugc

SEQ ID NO: 241787 - RNA, 19 nt, Homo sapiens
gaucgguuaucucucuuca

SEQ ID NO: 241788 - RNA, 19 nt, Homo sapiens
gaaaaucauugcuguuugg

SEQ ID NO: 241789 - RNA, 19 nt, Homo sapiens
uuucagauccaucgguuua

SEQ ID NO: 241790 - RNA, 19 nt, Homo sapiens
gcagaaacuauaaccuguu

SEQ ID NO: 241791 - RNA, 19 nt, Homo sapiens
gacaugggauugaguuggu

SEQ ID NO: 241792 - RNA, 19 nt, Homo sapiens
gacaauagcgacggaguga

SEQ ID NO: 241793 - RNA, 19 nt, Homo sapiens
uaucaagucacuccagaaa

SEQ ID NO: 241794 - RNA, 19 nt, Homo sapiens
caacagagugagacccuau

SEQ ID NO: 241795 - RNA, 19 nt, Homo sapiens
uaugaagcccuaaguaaau

SEQ ID NO: 241796 - RNA, 19 nt, Homo sapiens
cugauaugcugcuggguuu

SEQ ID NO: 241797 - RNA, 19 nt, Homo sapiens
gaucggcucuuuuguguca

SEQ ID NO: 241798 - RNA, 19 nt, Homo sapiens
agaccaaccuggguaacaa

SEQ ID NO: 241799 - RNA, 19 nt, Homo sapiens
aaucaucuauugaguguac

SEQ ID NO: 241800 - RNA, 19 nt, Homo sapiens
cuaucgagguauuugguaa

SEQ ID NO: 241801 - RNA, 19 nt, Homo sapiens
uuaugaagcccuaaguaaa

SEQ ID NO: 241802 - RNA, 19 nt, Homo sapiens
caauagcgacggagugaau

SEQ ID NO: 241803 - RNA, 19 nt, Homo sapiens
cacgguauauucaguguca

SEQ ID NO: 241804 - RNA, 19 nt, Homo sapiens
gcagucaacccacuagucu

SEQ ID NO: 241805 - RNA, 19 nt, Homo sapiens
acucgccgaugauaacuuu

SEQ ID NO: 241806 - RNA, 19 nt, Homo sapiens
auucgaaggucuuuaagga

SEQ ID NO: 241807 - RNA, 19 nt, Homo sapiens
gaaggcacacugagcaagu

SEQ ID NO: 241808 - RNA, 19 nt, Homo sapiens
ugaacacaauaccggcuuu

SEQ ID NO: 241809 - RNA, 19 nt, Homo sapiens
caaagaguccugcaaugag

SEQ ID NO: 241810 - RNA, 19 nt, Homo sapiens
cauguuaaccauccuguau

SEQ ID NO: 241811 - RNA, 19 nt, Homo sapiens
cagaaugccaccaacuauu

SEQ ID NO: 241812 - RNA, 19 nt, Homo sapiens
ggcagugucccuagagaaa

SEQ ID NO: 241813 - RNA, 19 nt, Homo sapiens
guggguacaucaaggugaa

SEQ ID NO: 241814 - RNA, 19 nt, Homo sapiens
cuccagaacuaaggcauuu

SEQ ID NO: 241815 - RNA, 19 nt, Homo sapiens
ucacuugccauagcugaua

SEQ ID NO: 241816 - RNA, 19 nt, Homo sapiens
caacuacgaacucccuaau

SEQ ID NO: 241817 - RNA, 19 nt, Homo sapiens
ccaucgguuuauacuauuu

SEQ ID NO: 241818 - RNA, 19 nt, Homo sapiens
caccucaucugcuacaagu

SEQ ID NO: 241819 - RNA, 19 nt, Homo sapiens
gaugacaugggauugaguu

SEQ ID NO: 241820 - RNA, 19 nt, Homo sapiens
acacuucugaugcauuuaa

SEQ ID NO: 241821 - RNA, 19 nt, Homo sapiens
gcugcuuucucuucuacuu

SEQ ID NO: 241822 - RNA, 19 nt, Homo sapiens
gaagaaggcuuacuuaguc

SEQ ID NO: 241823 - RNA, 19 nt, Homo sapiens
ugaguaagaugaugaauga

SEQ ID NO: 241824 - RNA, 19 nt, Homo sapiens
cgaagaacauccacaauug

SEQ ID NO: 241825 - RNA, 19 nt, Homo sapiens
gcaaauggcucucucuuac

SEQ ID NO: 241826 - RNA, 19 nt, Homo sapiens
ggagauauuuguguggaua

SEQ ID NO: 241827 - RNA, 19 nt, Homo sapiens
ggacaagauuauuccauga

SEQ ID NO: 241828 - RNA, 19 nt, Homo sapiens
caacucaggugaugaaaca

SEQ ID NO: 241829 - RNA, 19 nt, Homo sapiens
gcaaguuaguuauguauag

SEQ ID NO: 241830 - RNA, 19 nt, Homo sapiens
ugaaugagauguaaaugug

SEQ ID NO: 241831 - RNA, 19 nt, Homo sapiens
gaugaugaaugagauguaa

SEQ ID NO: 241832 - RNA, 19 nt, Homo sapiens
gcaguugucaucaaacaua

SEQ ID NO: 241833 - RNA, 19 nt, Homo sapiens
caagaaacauggaauucga

SEQ ID NO: 241834 - RNA, 19 nt, Homo sapiens
gaacagagagccucaaagg

SEQ ID NO: 241835 - RNA, 19 nt, Homo sapiens
ucacaccucuugcaauuau

SEQ ID NO: 241836 - RNA, 19 nt, Homo sapiens
ggauuaacccugccaugua

SEQ ID NO: 241837 - RNA, 19 nt, Homo sapiens
guaaaugugcccagaauau

SEQ ID NO: 241838 - RNA, 19 nt, Homo sapiens
gaacuucaaagcacaauuc

SEQ ID NO: 241839 - RNA, 19 nt, Homo sapiens
gcgaagaacauccacaauu

SEQ ID NO: 241840 - RNA, 19 nt, Homo sapiens
agaagaagcugcaguaugc

SEQ ID NO: 241841 - RNA, 19 nt, Homo sapiens
ggaauccaauggcagagaa

SEQ ID NO: 241842 - RNA, 19 nt, Homo sapiens
gcauuuggccgauauauca

SEQ ID NO: 241843 - RNA, 19 nt, Homo sapiens
ccaaacuacucuccaaaug

SEQ ID NO: 241844 - RNA, 19 nt, Homo sapiens
uggugucccuucuuuauua

SEQ ID NO: 241845 - RNA, 19 nt, Homo sapiens
acaguggugugguuaauuu

SEQ ID NO: 241846 - RNA, 19 nt, Homo sapiens
ccaaugaggcuccgaaguu

SEQ ID NO: 241847 - RNA, 19 nt, Homo sapiens
uuaaagggauagagacuga

SEQ ID NO: 241848 - RNA, 19 nt, Homo sapiens
ccauuucaguggaucguua

SEQ ID NO: 241849 - RNA, 19 nt, Homo sapiens
caaaucaucucuuuaaccu

SEQ ID NO: 241850 - RNA, 19 nt, Homo sapiens
ggaauucgaaaugggauua

SEQ ID NO: 241851 - RNA, 19 nt, Homo sapiens
ucuacacccucuucaauaa

SEQ ID NO: 241852 - RNA, 19 nt, Homo sapiens
uaaccaaacuacucuccaa

SEQ ID NO: 241853 - RNA, 19 nt, Homo sapiens
uaaaugugcccagaauaua

SEQ ID NO: 241854 - RNA, 19 nt, Homo sapiens
gaagagcaaguuaguuaug

SEQ ID NO: 241855 - RNA, 19 nt, Homo sapiens
cugaagagcaaguuaguua

SEQ ID NO: 241856 - RNA, 19 nt, Homo sapiens
guaagaugaugaaugagau

SEQ ID NO: 241857 - RNA, 19 nt, Homo sapiens
aaacauggaauucgaaaug

SEQ ID NO: 241858 - RNA, 19 nt, Homo sapiens
gauauaucaccugcaauua

SEQ ID NO: 241859 - RNA, 19 nt, Homo sapiens
cuucacaccucuugcaauu

SEQ ID NO: 241860 - RNA, 19 nt, Homo sapiens
guggacaacccaaacaaua

SEQ ID NO: 241861 - RNA, 19 nt, Homo sapiens
uaacuggucuggauuacag

SEQ ID NO: 241862 - RNA, 19 nt, Homo sapiens
guucaaccauucagucuuc

SEQ ID NO: 241863 - RNA, 19 nt, Homo sapiens
gcuccgaaguucaaccauu

SEQ ID NO: 241864 - RNA, 19 nt, Homo sapiens
gcagaccauuuccaacgaa

SEQ ID NO: 241865 - RNA, 19 nt, Homo sapiens
gagaagaagcugcaguaug

SEQ ID NO: 241866 - RNA, 19 nt, Homo sapiens
cugggcagcucuucugaua

SEQ ID NO: 241867 - RNA, 19 nt, Homo sapiens
gauuaacccugccauguac

SEQ ID NO: 241868 - RNA, 19 nt, Homo sapiens
uaaccaugcugaccacugu

SEQ ID NO: 241869 - RNA, 19 nt, Homo sapiens
gugauaauacccacaauug

SEQ ID NO: 241870 - RNA, 19 nt, Homo sapiens
cagaggaaaugaaacagau

SEQ ID NO: 241871 - RNA, 19 nt, Homo sapiens
agaaaacgcuccaguaaga

SEQ ID NO: 241872 - RNA, 19 nt, Homo sapiens
cgauauaucaccugcaauu

SEQ ID NO: 241873 - RNA, 19 nt, Homo sapiens
gagcaccuuuguucacguu

SEQ ID NO: 241874 - RNA, 19 nt, Homo sapiens
gauaauacccacaauuggu

SEQ ID NO: 241875 - RNA, 19 nt, Homo sapiens
caaugaggcuccgaaguuc

SEQ ID NO: 241876 - RNA, 19 nt, Homo sapiens
ucaccuacuuucucacuau

SEQ ID NO: 241877 - RNA, 19 nt, Homo sapiens
gggcagcucuucugauacu

SEQ ID NO: 241878 - RNA, 19 nt, Homo sapiens
gcaccuuuguucacguuau

SEQ ID NO: 241879 - RNA, 19 nt, Homo sapiens
ugacaaaacugaagagcaa

SEQ ID NO: 241880 - RNA, 19 nt, Homo sapiens
ucuauguccugccugguua

SEQ ID NO: 241881 - RNA, 19 nt, Homo sapiens
caauaauguuugaggcuau

SEQ ID NO: 241882 - RNA, 19 nt, Homo sapiens
gccgauauaucaccugcaa

SEQ ID NO: 241883 - RNA, 19 nt, Homo sapiens
ggaugcauuuggccgauau

SEQ ID NO: 241884 - RNA, 19 nt, Homo sapiens
uauguggugucccuucuuu

SEQ ID NO: 241885 - RNA, 19 nt, Homo sapiens
ggacaacccaaacaauauc

SEQ ID NO: 241886 - RNA, 19 nt, Homo sapiens
gcuacagcauucaucaaga

SEQ ID NO: 241887 - RNA, 19 nt, Homo sapiens
acagaagaaggcuuacuua

SEQ ID NO: 241888 - RNA, 19 nt, Homo sapiens
gaggaaaugaaacagauug

SEQ ID NO: 241889 - RNA, 19 nt, Homo sapiens
gccauuccagucccuauua

SEQ ID NO: 241890 - RNA, 19 nt, Homo sapiens
cuacagcauucaucaagau

SEQ ID NO: 241891 - RNA, 19 nt, Homo sapiens
caauccaggccaaucaaua

SEQ ID NO: 241892 - RNA, 19 nt, Homo sapiens
gagugaauccuuuggucua

SEQ ID NO: 241893 - RNA, 19 nt, Homo sapiens
gaaacacuuaugcgaagaa

SEQ ID NO: 241894 - RNA, 19 nt, Homo sapiens
gguggaaauacccuuguua

SEQ ID NO: 241895 - RNA, 19 nt, Homo sapiens
gagcaaguuaguuauguau

SEQ ID NO: 241896 - RNA, 19 nt, Homo sapiens
agagcaaguuaguuaugua

SEQ ID NO: 241897 - RNA, 19 nt, Homo sapiens
gaagaacauccacaauugg

SEQ ID NO: 241898 - RNA, 19 nt, Homo sapiens
ccauuccagucccuauuaa

SEQ ID NO: 241899 - RNA, 19 nt, Homo sapiens
gaaggcuuacuuagucaaa

SEQ ID NO: 241900 - RNA, 19 nt, Homo sapiens
gcacaauuccugagcacau

SEQ ID NO: 241901 - RNA, 19 nt, Homo sapiens
aaacuacucuccaaaugcu

SEQ ID NO: 241902 - RNA, 19 nt, Homo sapiens
ucaaagguccuagggauug

SEQ ID NO: 241903 - RNA, 19 nt, Homo sapiens
uucaguggaucguuacaua

SEQ ID NO: 241904 - RNA, 19 nt, Homo sapiens
ccaauugcccucuugacaa

SEQ ID NO: 241905 - RNA, 19 nt, Homo sapiens
ggucuacacccucuucaau

SEQ ID NO: 241906 - RNA, 19 nt, Homo sapiens
gcaucucugugccauuuca

SEQ ID NO: 241907 - RNA, 19 nt, Homo sapiens
gcacugggcagcucuucug

SEQ ID NO: 241908 - RNA, 19 nt, Homo sapiens
caguugucaucaaacauaa

SEQ ID NO: 241909 - RNA, 19 nt, Homo sapiens
cugguuggauuguuuguga

SEQ ID NO: 241910 - RNA, 19 nt, Homo sapiens
cacaauuccugagcacauu

SEQ ID NO: 241911 - RNA, 19 nt, Homo sapiens
gggaugcauuuggccgaua

SEQ ID NO: 241912 - RNA, 19 nt, Homo sapiens
gguccuagggauuguguuu

SEQ ID NO: 241913 - RNA, 19 nt, Homo sapiens
agaagaaggcuuacuuagu

SEQ ID NO: 241914 - RNA, 19 nt, Homo sapiens
gaugccaauugcccucuug

SEQ ID NO: 241915 - RNA, 19 nt, Homo sapiens
ggugauaauacccacaauu

SEQ ID NO: 241916 - RNA, 19 nt, Homo sapiens
cugauuugcugguuggauu

SEQ ID NO: 241917 - RNA, 19 nt, Homo sapiens
ugugauuccuguaaccaaa

SEQ ID NO: 241918 - RNA, 19 nt, Homo sapiens
cagcauucaucaagauuac

SEQ ID NO: 241919 - RNA, 19 nt, Homo sapiens
ugaggaacagggaaauaaa

SEQ ID NO: 241920 - RNA, 19 nt, Homo sapiens
ccuuggcgguggcugauuu

SEQ ID NO: 241921 - RNA, 19 nt, Homo sapiens
gggauuaacccugccaugu

SEQ ID NO: 241922 - RNA, 19 nt, Homo sapiens
gaaccuagccuguuaauuu

SEQ ID NO: 241923 - RNA, 19 nt, Homo sapiens
gaaaugagaucccagaguu

SEQ ID NO: 241924 - RNA, 19 nt, Homo sapiens
cagaauagcugauagaaga

SEQ ID NO: 241925 - RNA, 19 nt, Homo sapiens
uggaagagcugcuguauuu

SEQ ID NO: 241926 - RNA, 19 nt, Homo sapiens
uauaauagguggagacuaa

SEQ ID NO: 241927 - RNA, 19 nt, Homo sapiens
gagcauagccguuucaauu

SEQ ID NO: 241928 - RNA, 19 nt, Homo sapiens
ggacauuuguucuggguua

SEQ ID NO: 241929 - RNA, 19 nt, Homo sapiens
gcaacagacugccuuauau

SEQ ID NO: 241930 - RNA, 19 nt, Homo sapiens
gaaaauggcugaagaaaca

SEQ ID NO: 241931 - RNA, 19 nt, Homo sapiens
gcucacagcacauuuguua

SEQ ID NO: 241932 - RNA, 19 nt, Homo sapiens
cuucguagcuuucuucaua

SEQ ID NO: 241933 - RNA, 19 nt, Homo sapiens
gcaaaguguugucuuauuc

SEQ ID NO: 241934 - RNA, 19 nt, Homo sapiens
gcccaaauauuacaugaaa

SEQ ID NO: 241935 - RNA, 19 nt, Homo sapiens
cuacagaaguggaaggaua

SEQ ID NO: 241936 - RNA, 19 nt, Homo sapiens
guauagagaugcaaguuga

SEQ ID NO: 241937 - RNA, 19 nt, Homo sapiens
uaagauagguucugcuuuc

SEQ ID NO: 241938 - RNA, 19 nt, Homo sapiens
gcaccuaauuggccuauug

SEQ ID NO: 241939 - RNA, 19 nt, Homo sapiens
uaaagaaguccaugugaua

SEQ ID NO: 241940 - RNA, 19 nt, Homo sapiens
gaauuuagaguuaccagua

SEQ ID NO: 241941 - RNA, 19 nt, Homo sapiens
gaagauugcuauuguuugg

SEQ ID NO: 241942 - RNA, 19 nt, Homo sapiens
gaagaaagaagacgcgauu

SEQ ID NO: 241943 - RNA, 19 nt, Homo sapiens
gaagggcauucuccaacua

SEQ ID NO: 241944 - RNA, 19 nt, Homo sapiens
gagaaguccuguaaccaaa

SEQ ID NO: 241945 - RNA, 19 nt, Homo sapiens
gauagguucugcuuucuga

SEQ ID NO: 241946 - RNA, 19 nt, Homo sapiens
gguggagacuaacuuauuu

SEQ ID NO: 241947 - RNA, 19 nt, Homo sapiens
gaugcaaguugagaauuua

SEQ ID NO: 241948 - RNA, 19 nt, Homo sapiens
ccgacaagcuuugauguua

SEQ ID NO: 241949 - RNA, 19 nt, Homo sapiens
ggacuaaggccaucaugaa

SEQ ID NO: 241950 - RNA, 19 nt, Homo sapiens
gacaauagguggcaacauc

SEQ ID NO: 241951 - RNA, 19 nt, Homo sapiens
gaagagcugcuguauuuga

SEQ ID NO: 241952 - RNA, 19 nt, Homo sapiens
ccaaauagcuuuucacuuc

SEQ ID NO: 241953 - RNA, 19 nt, Homo sapiens
ggaaggauaaugagaugua

SEQ ID NO: 241954 - RNA, 19 nt, Homo sapiens
ugaugaaccuagccuguua

SEQ ID NO: 241955 - RNA, 19 nt, Homo sapiens
caacacacaguauagauaa

SEQ ID NO: 241956 - RNA, 19 nt, Homo sapiens
gaaggauaaugagauguaa

SEQ ID NO: 241957 - RNA, 19 nt, Homo sapiens
gaacucuucuucugucugu

SEQ ID NO: 241958 - RNA, 19 nt, Homo sapiens
cuaccugccuugccuguua

SEQ ID NO: 241959 - RNA, 19 nt, Homo sapiens
gcacaugacagugguuaua

SEQ ID NO: 241960 - RNA, 19 nt, Homo sapiens
gcaccgaucuucccgauac

SEQ ID NO: 241961 - RNA, 19 nt, Homo sapiens
gcuaguggguuaucagcua

SEQ ID NO: 241962 - RNA, 19 nt, Homo sapiens
caagcaaacugaaauuagu

SEQ ID NO: 241963 - RNA, 19 nt, Homo sapiens
guugcaaaguguugucuua

SEQ ID NO: 241964 - RNA, 19 nt, Homo sapiens
aaacuuugguugcuuaaga

SEQ ID NO: 241965 - RNA, 19 nt, Homo sapiens
ggccaaacaucagucauuu

SEQ ID NO: 241966 - RNA, 19 nt, Homo sapiens
gcaauuauaagguagagaa

SEQ ID NO: 241967 - RNA, 19 nt, Homo sapiens
ggaucgguauguagcaaua

SEQ ID NO: 241968 - RNA, 19 nt, Homo sapiens
gcucauagcacauguuuua

SEQ ID NO: 241969 - RNA, 19 nt, Homo sapiens
ugaaguagugugaguguua

SEQ ID NO: 241970 - RNA, 19 nt, Homo sapiens
gaauugggcccuuagaaug

SEQ ID NO: 241971 - RNA, 19 nt, Homo sapiens
caacgaagaagaaagaaga

SEQ ID NO: 241972 - RNA, 19 nt, Homo sapiens
cagacugccuuauauuauu

SEQ ID NO: 241973 - RNA, 19 nt, Homo sapiens
guaauuauccucaaguugu

SEQ ID NO: 241974 - RNA, 19 nt, Homo sapiens
aaacaucagucauuugcuu

SEQ ID NO: 241975 - RNA, 19 nt, Homo sapiens
ugauuaaacugggaaauga

SEQ ID NO: 241976 - RNA, 19 nt, Homo sapiens
ugacagugguuauauuuca

SEQ ID NO: 241977 - RNA, 19 nt, Homo sapiens
gaauguguuuguuuggauu

SEQ ID NO: 241978 - RNA, 19 nt, Homo sapiens
gaacucgggauuacagaaa

SEQ ID NO: 241979 - RNA, 19 nt, Homo sapiens
gaaucaauccucuggugua

SEQ ID NO: 241980 - RNA, 19 nt, Homo sapiens
gaagcagaaugagaugauu

SEQ ID NO: 241981 - RNA, 19 nt, Homo sapiens
cauaugaacucuucuucug

SEQ ID NO: 241982 - RNA, 19 nt, Homo sapiens
gcacugcaguuauuuacca

SEQ ID NO: 241983 - RNA, 19 nt, Homo sapiens
cuaauuggccuauugguuu

SEQ ID NO: 241984 - RNA, 19 nt, Homo sapiens
gcuugagcaugcccaaaua

SEQ ID NO: 241985 - RNA, 19 nt, Homo sapiens
gaaugugccucucaguauc

SEQ ID NO: 241986 - RNA, 19 nt, Homo sapiens
ggaaaaggcugcagcuaau

SEQ ID NO: 241987 - RNA, 19 nt, Homo sapiens
cuacagaauugggcccuua

SEQ ID NO: 241988 - RNA, 19 nt, Homo sapiens
gggagggagcuuaauguua

SEQ ID NO: 241989 - RNA, 19 nt, Homo sapiens
gaaaguccuugggauuguu

SEQ ID NO: 241990 - RNA, 19 nt, Homo sapiens
ccaaauuucguucuuauug

SEQ ID NO: 241991 - RNA, 19 nt, Homo sapiens
gacccaaauuucguucuua

SEQ ID NO: 241992 - RNA, 19 nt, Homo sapiens
agaguaguguaguuaguua

SEQ ID NO: 241993 - RNA, 19 nt, Homo sapiens
caacagacugccuuauauu

SEQ ID NO: 241994 - RNA, 19 nt, Homo sapiens
gaaagaagacgcgauuagu

SEQ ID NO: 241995 - RNA, 19 nt, Homo sapiens
gcacauguuuuacaaagaa

SEQ ID NO: 241996 - RNA, 19 nt, Homo sapiens
ugagcaugcccaaauauua

SEQ ID NO: 241997 - RNA, 19 nt, Homo sapiens
gcagcuaauuugugaaagu

SEQ ID NO: 241998 - RNA, 19 nt, Homo sapiens
gauuaaggacuacagaauu

SEQ ID NO: 241999 - RNA, 19 nt, Homo sapiens
ggaauacggccgaggaaga

SEQ ID NO: 242000 - RNA, 19 nt, Homo sapiens
gaaacacagcaugcauuua

SEQ ID NO: 242001 - RNA, 19 nt, Homo sapiens
caacaagcaaacugaaauu

SEQ ID NO: 242002 - RNA, 19 nt, Homo sapiens
gaucauguggugcccauuu

SEQ ID NO: 242003 - RNA, 19 nt, Homo sapiens
ucaugaagauugcuauugu

SEQ ID NO: 242004 - RNA, 19 nt, Homo sapiens
ucacagauuuccaaaagua

SEQ ID NO: 242005 - RNA, 19 nt, Homo sapiens
gaucugaaguagugugagu

SEQ ID NO: 242006 - RNA, 19 nt, Homo sapiens
uaugguaccucugucuaua

SEQ ID NO: 242007 - RNA, 19 nt, Homo sapiens
gaucucagcauccuggaaa

SEQ ID NO: 242008 - RNA, 19 nt, Homo sapiens
gugguuagcgaaaggauua

SEQ ID NO: 242009 - RNA, 19 nt, Homo sapiens
ucauaccgcugacgauuau

SEQ ID NO: 242010 - RNA, 19 nt, Homo sapiens
gaaaagaaacugcacaaug

SEQ ID NO: 242011 - RNA, 19 nt, Homo sapiens
aaacacagcaugcauuuag

SEQ ID NO: 242012 - RNA, 19 nt, Homo sapiens
gaaaguggcaagcucuuca

SEQ ID NO: 242013 - RNA, 19 nt, Homo sapiens
ggcagaaccuagucuuguu

SEQ ID NO: 242014 - RNA, 19 nt, Homo sapiens
gcgaaaggauuagcagugu

SEQ ID NO: 242015 - RNA, 19 nt, Homo sapiens
agaugcaaguugagaauuu

SEQ ID NO: 242016 - RNA, 19 nt, Homo sapiens
cgagaaagccagugacaau

SEQ ID NO: 242017 - RNA, 19 nt, Homo sapiens
gccacuaccuagauauuug

SEQ ID NO: 242018 - RNA, 19 nt, Homo sapiens
gaagaaggacugaagaaaa

SEQ ID NO: 242019 - RNA, 19 nt, Homo sapiens
gaaaggauuagcagugugu

SEQ ID NO: 242020 - RNA, 19 nt, Homo sapiens
gaaagccagugacaaugag

SEQ ID NO: 242021 - RNA, 19 nt, Homo sapiens
gcguugcaauuauaaggua

SEQ ID NO: 242022 - RNA, 19 nt, Homo sapiens
guacuggacugaugaguuu

SEQ ID NO: 242023 - RNA, 19 nt, Homo sapiens
uaacuacuaugcagaaaug

SEQ ID NO: 242024 - RNA, 19 nt, Homo sapiens
gcacuccuaugcuuggaaa

SEQ ID NO: 242025 - RNA, 19 nt, Homo sapiens
caucggcacuccucucauu

SEQ ID NO: 242026 - RNA, 19 nt, Homo sapiens
ucaaugaguucguggaugu

SEQ ID NO: 242027 - RNA, 19 nt, Homo sapiens
caacguggaugagaagaau

SEQ ID NO: 242028 - RNA, 19 nt, Homo sapiens
agaaucgccuggcuacuuu

SEQ ID NO: 242029 - RNA, 19 nt, Homo sapiens
ucucauuggugucuacuuu

SEQ ID NO: 242030 - RNA, 19 nt, Homo sapiens
caauucaucucagcaauca

SEQ ID NO: 242031 - RNA, 19 nt, Homo sapiens
gaugggagugggaagaaua

SEQ ID NO: 242032 - RNA, 19 nt, Homo sapiens
cagcuucccugaacacuca

SEQ ID NO: 242033 - RNA, 19 nt, Homo sapiens
gaaguucuauguggucauc

SEQ ID NO: 242034 - RNA, 19 nt, Homo sapiens
ggacaucaacaucucuuug

SEQ ID NO: 242035 - RNA, 19 nt, Homo sapiens
aagcugcuauuccacauuu

SEQ ID NO: 242036 - RNA, 19 nt, Homo sapiens
gagaaucgccuggcuacuu

SEQ ID NO: 242037 - RNA, 19 nt, Homo sapiens
guacgaggcuucucuaacc

SEQ ID NO: 242038 - RNA, 19 nt, Homo sapiens
caaauaucccguacgugua

SEQ ID NO: 242039 - RNA, 19 nt, Homo sapiens
caaccaccguauccauuga

SEQ ID NO: 242040 - RNA, 19 nt, Homo sapiens
acacaggccugauaacucu

SEQ ID NO: 242041 - RNA, 19 nt, Homo sapiens
ucgcugaccuucaccaguu

SEQ ID NO: 242042 - RNA, 19 nt, Homo sapiens
guggaacccugaggacuuu

SEQ ID NO: 242043 - RNA, 19 nt, Homo sapiens
ccauugacgucauugucua

SEQ ID NO: 242044 - RNA, 19 nt, Homo sapiens
aauaagggacuuuggaauu

SEQ ID NO: 242045 - RNA, 19 nt, Homo sapiens
gaauaagggacuuuggaau

SEQ ID NO: 242046 - RNA, 19 nt, Homo sapiens
uaaguccacucuaguugug

SEQ ID NO: 242047 - RNA, 19 nt, Homo sapiens
cuacuacacaggccugaua

SEQ ID NO: 242048 - RNA, 19 nt, Homo sapiens
ccaguuggcugcacaccau

SEQ ID NO: 242049 - RNA, 19 nt, Homo sapiens
ugcugaggcugucggauua

SEQ ID NO: 242050 - RNA, 19 nt, Homo sapiens
ucugaacccuuccaccaaa

SEQ ID NO: 242051 - RNA, 19 nt, Homo sapiens
aaagucccgugcccuguuu

SEQ ID NO: 242052 - RNA, 19 nt, Homo sapiens
auaagggacuuuggaauuc

SEQ ID NO: 242053 - RNA, 19 nt, Homo sapiens
guuaugcucugguccaucu

SEQ ID NO: 242054 - RNA, 19 nt, Homo sapiens
gcauggcucugcuggugau

SEQ ID NO: 242055 - RNA, 19 nt, Homo sapiens
ccuguagccucgacaucua

SEQ ID NO: 242056 - RNA, 19 nt, Homo sapiens
ugagggagcagucaacuuc

SEQ ID NO: 242057 - RNA, 19 nt, Homo sapiens
gccgagaccaucuucauug

SEQ ID NO: 242058 - RNA, 19 nt, Homo sapiens
aacaugcucucuuagauca

SEQ ID NO: 242059 - RNA, 19 nt, Homo sapiens
ugaauaagggacuuuggaa

SEQ ID NO: 242060 - RNA, 19 nt, Homo sapiens
acaggagugucuucaugaa

SEQ ID NO: 242061 - RNA, 19 nt, Homo sapiens
guggggaagucuccaaaua

SEQ ID NO: 242062 - RNA, 19 nt, Homo sapiens
ggacaucgugggcuucuac

SEQ ID NO: 242063 - RNA, 19 nt, Homo sapiens
gacaucaacaucucuuugu

SEQ ID NO: 242064 - RNA, 19 nt, Homo sapiens
cauugacccucaccugaau

SEQ ID NO: 242065 - RNA, 19 nt, Homo sapiens
gcagcucaccauggcuuua

SEQ ID NO: 242066 - RNA, 19 nt, Homo sapiens
caaagucccgugcccuguu

SEQ ID NO: 242067 - RNA, 19 nt, Homo sapiens
gcauggaaagcaguaacua

SEQ ID NO: 242068 - RNA, 19 nt, Homo sapiens
ccgagaccaucuucauugu

SEQ ID NO: 242069 - RNA, 19 nt, Homo sapiens
aaauaucccguacguguau

SEQ ID NO: 242070 - RNA, 19 nt, Homo sapiens
ccaaccaccguauccauug

SEQ ID NO: 242071 - RNA, 19 nt, Homo sapiens
ucauuggugucuacuuugu

SEQ ID NO: 242072 - RNA, 19 nt, Homo sapiens
caggcuggcugggacauga

SEQ ID NO: 242073 - RNA, 19 nt, Homo sapiens
gccaauucaucucagcaau

SEQ ID NO: 242074 - RNA, 19 nt, Homo sapiens
gcucugcuggugauaaguu

SEQ ID NO: 242075 - RNA, 19 nt, Homo sapiens
gcuacucggucuuccugau

SEQ ID NO: 242076 - RNA, 19 nt, Homo sapiens
uugacaacaucaccaaguu

SEQ ID NO: 242077 - RNA, 19 nt, Homo sapiens
ccauugacccucaccugaa

SEQ ID NO: 242078 - RNA, 19 nt, Homo sapiens
gaagagcccgagggacaga

SEQ ID NO: 242079 - RNA, 19 nt, Homo sapiens
aaacaugcucucuuagauc

SEQ ID NO: 242080 - RNA, 19 nt, Homo sapiens
gaaggacugauugcaggaa

SEQ ID NO: 242081 - RNA, 19 nt, Homo sapiens
ccaaugccaauucaucuca

SEQ ID NO: 242082 - RNA, 19 nt, Homo sapiens
uacagcaucacccugguua

SEQ ID NO: 242083 - RNA, 19 nt, Homo sapiens
gccaaccaccguauccauu

SEQ ID NO: 242084 - RNA, 19 nt, Homo sapiens
caaaaccaacucucuacua

SEQ ID NO: 242085 - RNA, 19 nt, Homo sapiens
uaagggacuuuggaauucu

SEQ ID NO: 242086 - RNA, 19 nt, Homo sapiens
caccauggcuuuaaaacau

SEQ ID NO: 242087 - RNA, 19 nt, Homo sapiens
cagcucaccauggcuuuaa

SEQ ID NO: 242088 - RNA, 19 nt, Homo sapiens
ucaagacacagacaaaguc

SEQ ID NO: 242089 - RNA, 19 nt, Homo sapiens
cagcaucacccugguuaug

SEQ ID NO: 242090 - RNA, 19 nt, Homo sapiens
cguauccauugacgucauu

SEQ ID NO: 242091 - RNA, 19 nt, Homo sapiens
ggccgagaccaucuucauu

SEQ ID NO: 242092 - RNA, 19 nt, Homo sapiens
guaacuacuaugcagaaau

SEQ ID NO: 242093 - RNA, 19 nt, Homo sapiens
ugaggacuuugacaacauc

SEQ ID NO: 242094 - RNA, 19 nt, Homo sapiens
ggagugucuucaugaacca

SEQ ID NO: 242095 - RNA, 19 nt, Homo sapiens
ccugaggacuuugacaaca

SEQ ID NO: 242096 - RNA, 19 nt, Homo sapiens
ggaacccugaggacuuuga

SEQ ID NO: 242097 - RNA, 19 nt, Homo sapiens
gaugaugggagugggaaga

SEQ ID NO: 242098 - RNA, 19 nt, Homo sapiens
ggacuuuggaauucugcuu

SEQ ID NO: 242099 - RNA, 19 nt, Homo sapiens
cggauuaccuuuugaccaa

SEQ ID NO: 242100 - RNA, 19 nt, Homo sapiens
aaacucgggcacucccuaa

SEQ ID NO: 242101 - RNA, 19 nt, Homo sapiens
gcucagccaugggaaacca

SEQ ID NO: 242102 - RNA, 19 nt, Homo sapiens
ggggaagucuccaaauauc

SEQ ID NO: 242103 - RNA, 19 nt, Homo sapiens
uaaaacaugcucucuuaga

SEQ ID NO: 242104 - RNA, 19 nt, Homo sapiens
aaggacugauugcaggaaa

SEQ ID NO: 242105 - RNA, 19 nt, Homo sapiens
uuggaaagcucgcuaugcu

SEQ ID NO: 242106 - RNA, 19 nt, Homo sapiens
ccuaaguccacucuaguug

SEQ ID NO: 242107 - RNA, 19 nt, Homo sapiens
aaaacaugcucucuuagau

SEQ ID NO: 242108 - RNA, 19 nt, Homo sapiens
ccaauucaucucagcaauc

SEQ ID NO: 242109 - RNA, 19 nt, Homo sapiens
ccagggagagugggaguug

SEQ ID NO: 242110 - RNA, 19 nt, Homo sapiens
acaucaacaucucuuugug

SEQ ID NO: 242111 - RNA, 19 nt, Homo sapiens
gccucgacaucuacaacuu

SEQ ID NO: 242112 - RNA, 19 nt, Homo sapiens
caucaaggcgaaguucaga

SEQ ID NO: 242113 - RNA, 19 nt, Homo sapiens
ucccggacauucucaucaa

SEQ ID NO: 242114 - RNA, 19 nt, Homo sapiens
gccaggaggagccgaaaca

SEQ ID NO: 242115 - RNA, 19 nt, Homo sapiens
gcuccgugcuggacaagcu

SEQ ID NO: 242116 - RNA, 19 nt, Homo sapiens
ucaccugguucuggagaga

SEQ ID NO: 242117 - RNA, 19 nt, Homo sapiens
ggagugggaagaauaaaau

SEQ ID NO: 242118 - RNA, 19 nt, Homo sapiens
ggaagccaaccaccguauc

SEQ ID NO: 242119 - RNA, 19 nt, Homo sapiens
aaccaacucucuacuacac

SEQ ID NO: 242120 - RNA, 19 nt, Homo sapiens
cugcugaggcugucggauu

SEQ ID NO: 242121 - RNA, 19 nt, Homo sapiens
uagcggugcuggccuacag

SEQ ID NO: 242122 - RNA, 19 nt, Homo sapiens
ggaagaaacuuuggaauaa

SEQ ID NO: 242123 - RNA, 19 nt, Homo sapiens
gaacgacccuccucauuug

SEQ ID NO: 242124 - RNA, 19 nt, Homo sapiens
ucacugaugucuccaaaua

SEQ ID NO: 242125 - RNA, 19 nt, Homo sapiens
ggagauaacuguuggaagu

SEQ ID NO: 242126 - RNA, 19 nt, Homo sapiens
gaucuuggcugugguuuaa

SEQ ID NO: 242127 - RNA, 19 nt, Homo sapiens
gagggaagcugaagacaga

SEQ ID NO: 242128 - RNA, 19 nt, Homo sapiens
caagacaucuggauuuaug

SEQ ID NO: 242129 - RNA, 19 nt, Homo sapiens
gcauuucucuggauaggua

SEQ ID NO: 242130 - RNA, 19 nt, Homo sapiens
caugugagauucugacuuu

SEQ ID NO: 242131 - RNA, 19 nt, Homo sapiens
ggacaugcuccauuuauuu

SEQ ID NO: 242132 - RNA, 19 nt, Homo sapiens
ggacaaacuugaugcuaau

SEQ ID NO: 242133 - RNA, 19 nt, Homo sapiens
ggaacgacccuccucauuu

SEQ ID NO: 242134 - RNA, 19 nt, Homo sapiens
gaacugaaaccgacaggaa

SEQ ID NO: 242135 - RNA, 19 nt, Homo sapiens
ggaauaacauuggcauaau

SEQ ID NO: 242136 - RNA, 19 nt, Homo sapiens
gcugugagaucuugaauag

SEQ ID NO: 242137 - RNA, 19 nt, Homo sapiens
ucauggugcuggccuauua

SEQ ID NO: 242138 - RNA, 19 nt, Homo sapiens
caucguagguguuuauuag

SEQ ID NO: 242139 - RNA, 19 nt, Homo sapiens
gaagaaacuuuggaauaag

SEQ ID NO: 242140 - RNA, 19 nt, Homo sapiens
gcaucuaugucacagcuaa

SEQ ID NO: 242141 - RNA, 19 nt, Homo sapiens
gaacgggacgucuucuaaa

SEQ ID NO: 242142 - RNA, 19 nt, Homo sapiens
caaacaagcugugagaucu

SEQ ID NO: 242143 - RNA, 19 nt, Homo sapiens
uagcaucucaggauuauuu

SEQ ID NO: 242144 - RNA, 19 nt, Homo sapiens
ugugagaucuugaauagug

SEQ ID NO: 242145 - RNA, 19 nt, Homo sapiens
ccaauauuguggauccuuu

SEQ ID NO: 242146 - RNA, 19 nt, Homo sapiens
gcuuauaaggugucaguua

SEQ ID NO: 242147 - RNA, 19 nt, Homo sapiens
cuagaggaccuuuaaguuu

SEQ ID NO: 242148 - RNA, 19 nt, Homo sapiens
uauuguggauccuuucaua

SEQ ID NO: 242149 - RNA, 19 nt, Homo sapiens
ccaacucacucaugcuuau

SEQ ID NO: 242150 - RNA, 19 nt, Homo sapiens
uggacaaacuugaugcuaa

SEQ ID NO: 242151 - RNA, 19 nt, Homo sapiens
gggcagggcuagcaacauc

SEQ ID NO: 242152 - RNA, 19 nt, Homo sapiens
cauaauggccuccuuguuc

SEQ ID NO: 242153 - RNA, 19 nt, Homo sapiens
aaccagaacucuaacucua

SEQ ID NO: 242154 - RNA, 19 nt, Homo sapiens
gaagagaagauugaccaaa

SEQ ID NO: 242155 - RNA, 19 nt, Homo sapiens
ggaauaaggaagagaagau

SEQ ID NO: 242156 - RNA, 19 nt, Homo sapiens
gaauaguguucuuucaucu

SEQ ID NO: 242157 - RNA, 19 nt, Homo sapiens
gcuuuguccuucagauuaa

SEQ ID NO: 242158 - RNA, 19 nt, Homo sapiens
gaaauccaacucacucaug

SEQ ID NO: 242159 - RNA, 19 nt, Homo sapiens
gcaaacaagcugugagauc

SEQ ID NO: 242160 - RNA, 19 nt, Homo sapiens
gcuccugucuugcuuacuu

SEQ ID NO: 242161 - RNA, 19 nt, Homo sapiens
gaaagagggccagguccua

SEQ ID NO: 242162 - RNA, 19 nt, Homo sapiens
gaucuugaauaguguucuu

SEQ ID NO: 242163 - RNA, 19 nt, Homo sapiens
guucaagacaucuggauuu

SEQ ID NO: 242164 - RNA, 19 nt, Homo sapiens
gaauaaggaagagaagauu

SEQ ID NO: 242165 - RNA, 19 nt, Homo sapiens
gccagcaacuucuccuuug

SEQ ID NO: 242166 - RNA, 19 nt, Homo sapiens
aggaagaaacuuuggaaua

SEQ ID NO: 242167 - RNA, 19 nt, Homo sapiens
gaagacacagggucagaga

SEQ ID NO: 242168 - RNA, 19 nt, Homo sapiens
caaacuugaugcuaaugug

SEQ ID NO: 242169 - RNA, 19 nt, Homo sapiens
agacgugccuuccucauca

SEQ ID NO: 242170 - RNA, 19 nt, Homo sapiens
guuauuguuuccauuguug

SEQ ID NO: 242171 - RNA, 19 nt, Homo sapiens
acaacaguaugcugcuaua

SEQ ID NO: 242172 - RNA, 19 nt, Homo sapiens
ggucacugaugucuccaaa

SEQ ID NO: 242173 - RNA, 19 nt, Homo sapiens
agaggaaguucaaccagaa

SEQ ID NO: 242174 - RNA, 19 nt, Homo sapiens
gaugagcgcuaccgaagac

SEQ ID NO: 242175 - RNA, 19 nt, Homo sapiens
uuaauagcaucucaggauu

SEQ ID NO: 242176 - RNA, 19 nt, Homo sapiens
uaauggauccacacaugua

SEQ ID NO: 242177 - RNA, 19 nt, Homo sapiens
gcucugugguggccuucua

SEQ ID NO: 242178 - RNA, 19 nt, Homo sapiens
ggacaggcagcucaggaaa

SEQ ID NO: 242179 - RNA, 19 nt, Homo sapiens
ccaaaggagauaacuguug

SEQ ID NO: 242180 - RNA, 19 nt, Homo sapiens
ugugugggcuuccagauau

SEQ ID NO: 242181 - RNA, 19 nt, Homo sapiens
gccaagacccugugcauca

SEQ ID NO: 242182 - RNA, 19 nt, Homo sapiens
uucaagacaucuggauuua

SEQ ID NO: 242183 - RNA, 19 nt, Homo sapiens
uagaggaccuuuaaguuuu

SEQ ID NO: 242184 - RNA, 19 nt, Homo sapiens
aggcaaugcuguacuugaa

SEQ ID NO: 242185 - RNA, 19 nt, Homo sapiens
cccaugaacuugugauauc

SEQ ID NO: 242186 - RNA, 19 nt, Homo sapiens
gauucugacuuugaucuug

SEQ ID NO: 242187 - RNA, 19 nt, Homo sapiens
gccagacgcuaacacacuu

SEQ ID NO: 242188 - RNA, 19 nt, Homo sapiens
aggcgucgcuccugucuug

SEQ ID NO: 242189 - RNA, 19 nt, Homo sapiens
cuaaggagcaugcccauca

SEQ ID NO: 242190 - RNA, 19 nt, Homo sapiens
gcaaggcuggaauaacauu

SEQ ID NO: 242191 - RNA, 19 nt, Homo sapiens
augcaaggcuggaauaaca

SEQ ID NO: 242192 - RNA, 19 nt, Homo sapiens
gaccaaaccauccaaaugc

SEQ ID NO: 242193 - RNA, 19 nt, Homo sapiens
ucuuggcugugguuuaaua

SEQ ID NO: 242194 - RNA, 19 nt, Homo sapiens
uucaggaucuuucccauga

SEQ ID NO: 242195 - RNA, 19 nt, Homo sapiens
gcucacaacggcaucgauu

SEQ ID NO: 242196 - RNA, 19 nt, Homo sapiens
aagagaagauugaccaaac

SEQ ID NO: 242197 - RNA, 19 nt, Homo sapiens
aauagcaucucaggauuau

SEQ ID NO: 242198 - RNA, 19 nt, Homo sapiens
uggaauaacauuggcauaa

SEQ ID NO: 242199 - RNA, 19 nt, Homo sapiens
ugaccaaaccauccaaaug

SEQ ID NO: 242200 - RNA, 19 nt, Homo sapiens
uaaggugucaguuauuguu

SEQ ID NO: 242201 - RNA, 19 nt, Homo sapiens
gggaagcugaagacagaua

SEQ ID NO: 242202 - RNA, 19 nt, Homo sapiens
ccucucuguuccugucuua

SEQ ID NO: 242203 - RNA, 19 nt, Homo sapiens
guucaaccacaaccauuaa

SEQ ID NO: 242204 - RNA, 19 nt, Homo sapiens
uggcucggcuauaucaauu

SEQ ID NO: 242205 - RNA, 19 nt, Homo sapiens
ccagagccaugugagauuc

SEQ ID NO: 242206 - RNA, 19 nt, Homo sapiens
gucaguggcucuugcgaau

SEQ ID NO: 242207 - RNA, 19 nt, Homo sapiens
guaauggacaaacuugaug

SEQ ID NO: 242208 - RNA, 19 nt, Homo sapiens
ucacagccauguucaagcu

SEQ ID NO: 242209 - RNA, 19 nt, Homo sapiens
auaauggccuccuuguuca

SEQ ID NO: 242210 - RNA, 19 nt, Homo sapiens
ucuacgccuucuugaauaa

SEQ ID NO: 242211 - RNA, 19 nt, Homo sapiens
ccuauuaccgcaucuaugu

SEQ ID NO: 242212 - RNA, 19 nt, Homo sapiens
gcuuccagauaucaacaaa

SEQ ID NO: 242213 - RNA, 19 nt, Homo sapiens
ggacaaugacccagaagac

SEQ ID NO: 242214 - RNA, 19 nt, Homo sapiens
auuaauggauccacacaug

SEQ ID NO: 242215 - RNA, 19 nt, Homo sapiens
gccagacugucccuuguuc

SEQ ID NO: 242216 - RNA, 19 nt, Homo sapiens
gugagauucugacuuugau

SEQ ID NO: 242217 - RNA, 19 nt, Homo sapiens
gaagccagaggacccaaau

SEQ ID NO: 242218 - RNA, 19 nt, Homo sapiens
ccaugaacuugugauauca

SEQ ID NO: 242219 - RNA, 19 nt, Homo sapiens
uucaggacaugcuccauuu

SEQ ID NO: 242220 - RNA, 19 nt, Homo sapiens
acguuucucucgacgguua

SEQ ID NO: 242221 - RNA, 19 nt, Homo sapiens
ggaaccugcuggugauggu

SEQ ID NO: 242222 - RNA, 19 nt, Homo sapiens
cuacaaggcugccaaguuc

SEQ ID NO: 242223 - RNA, 19 nt, Homo sapiens
gaaggacucugccaaacag

SEQ ID NO: 242224 - RNA, 19 nt, Homo sapiens
caacagcgccuucaagaac

SEQ ID NO: 242225 - RNA, 19 nt, Homo sapiens
gcaagugcgucuccaacgu

SEQ ID NO: 242226 - RNA, 19 nt, Homo sapiens
caauagcgucucacccaua

SEQ ID NO: 242227 - RNA, 19 nt, Homo sapiens
ggugaaggacucugccaaa

SEQ ID NO: 242228 - RNA, 19 nt, Homo sapiens
aauagcgucucacccauau

SEQ ID NO: 242229 - RNA, 19 nt, Homo sapiens
ggauuuaccagugaaccua

SEQ ID NO: 242230 - RNA, 19 nt, Homo sapiens
cuauacggcuuucaacaag

SEQ ID NO: 242231 - RNA, 19 nt, Homo sapiens
auacggcuuucaacaagaa

SEQ ID NO: 242232 - RNA, 19 nt, Homo sapiens
ucacgcgccacauggaaua

SEQ ID NO: 242233 - RNA, 19 nt, Homo sapiens
uacuccaacuccuucuuua

SEQ ID NO: 242234 - RNA, 19 nt, Homo sapiens
ccgaagcuguggaggugaa

SEQ ID NO: 242235 - RNA, 19 nt, Homo sapiens
guguggugcucuucgugua

SEQ ID NO: 242236 - RNA, 19 nt, Homo sapiens
cuacuccaacuccuucuuu

SEQ ID NO: 242237 - RNA, 19 nt, Homo sapiens
cagugaaccuaaccuccuu

SEQ ID NO: 242238 - RNA, 19 nt, Homo sapiens
uacaacagcgccuucaaga

SEQ ID NO: 242239 - RNA, 19 nt, Homo sapiens
gauuuaccagugaaccuaa

SEQ ID NO: 242240 - RNA, 19 nt, Homo sapiens
cagcgaggagugccaggua

SEQ ID NO: 242241 - RNA, 19 nt, Homo sapiens
caaccacagccucggcaaa

SEQ ID NO: 242242 - RNA, 19 nt, Homo sapiens
ugaaggacucugccaaaca

SEQ ID NO: 242243 - RNA, 19 nt, Homo sapiens
acacguggcgggagcagaa

SEQ ID NO: 242244 - RNA, 19 nt, Homo sapiens
uauacggcuuucaacaaga

SEQ ID NO: 242245 - RNA, 19 nt, Homo sapiens
ucuauacggcuuucaacaa

SEQ ID NO: 242246 - RNA, 19 nt, Homo sapiens
gugaaggacucugccaaac

SEQ ID NO: 242247 - RNA, 19 nt, Homo sapiens
ucuacaaggcugccaaguu

SEQ ID NO: 242248 - RNA, 19 nt, Homo sapiens
ccauggccgucucggaugu

SEQ ID NO: 242249 - RNA, 19 nt, Homo sapiens
ggucuucggagugcuuauu

SEQ ID NO: 242250 - RNA, 19 nt, Homo sapiens
cauccucauuggcguguuc

SEQ ID NO: 242251 - RNA, 19 nt, Homo sapiens
gcuccaggaagaccaauag

SEQ ID NO: 242252 - RNA, 19 nt, Homo sapiens
acaacagcgccuucaagaa

SEQ ID NO: 242253 - RNA, 19 nt, Homo sapiens
cuacaacagcgccuucaag

SEQ ID NO: 242254 - RNA, 19 nt, Homo sapiens
cauggugggcauccucauu

SEQ ID NO: 242255 - RNA, 19 nt, Homo sapiens
acucuccgcugucaucucu

SEQ ID NO: 242256 - RNA, 19 nt, Homo sapiens
caucacgcgccacauggaa

SEQ ID NO: 242257 - RNA, 19 nt, Homo sapiens
ggacucagauucggacuca

SEQ ID NO: 242258 - RNA, 19 nt, Homo sapiens
ggagcuggauugagcagaa

SEQ ID NO: 242259 - RNA, 19 nt, Homo sapiens
ucacauggcuggguuacug

SEQ ID NO: 242260 - RNA, 19 nt, Homo sapiens
gcaggcgucuagccacgaa

SEQ ID NO: 242261 - RNA, 19 nt, Homo sapiens
caacacguccaacuucuuc

SEQ ID NO: 242262 - RNA, 19 nt, Homo sapiens
ccacgaagcacagcaggaa

SEQ ID NO: 242263 - RNA, 19 nt, Homo sapiens
gcgcaacacguccaacuuc

SEQ ID NO: 242264 - RNA, 19 nt, Homo sapiens
ccucuucgauguccucaca

SEQ ID NO: 242265 - RNA, 19 nt, Homo sapiens
caucaucuacccacucuuc

SEQ ID NO: 242266 - RNA, 19 nt, Homo sapiens
gcaacacguccaacuucuu

SEQ ID NO: 242267 - RNA, 19 nt, Homo sapiens
cuucacgucugaccugaug

SEQ ID NO: 242268 - RNA, 19 nt, Homo sapiens
cgucgggccucaccuucuu

SEQ ID NO: 242269 - RNA, 19 nt, Homo sapiens
ccauaugcuucaccuacug

SEQ ID NO: 242270 - RNA, 19 nt, Homo sapiens
ggcugcaagucuccuagaa

SEQ ID NO: 242271 - RNA, 19 nt, Homo sapiens
caucuacccacucuucaug

SEQ ID NO: 242272 - RNA, 19 nt, Homo sapiens
gcuacaagcugcgcaugac

SEQ ID NO: 242273 - RNA, 19 nt, Homo sapiens
ugaccugguugcccuucuu

SEQ ID NO: 242274 - RNA, 19 nt, Homo sapiens
gcccaaauagccacacugu

SEQ ID NO: 242275 - RNA, 19 nt, Homo sapiens
ucacugcgcaccucucaca

SEQ ID NO: 242276 - RNA, 19 nt, Homo sapiens
cugggcauguucuuuguga

SEQ ID NO: 242277 - RNA, 19 nt, Homo sapiens
ggaccgccuucgacgugau

SEQ ID NO: 242278 - RNA, 19 nt, Homo sapiens
gaccugguugcccuucuuu

SEQ ID NO: 242279 - RNA, 19 nt, Homo sapiens
gccauaugcuucaccuacu

SEQ ID NO: 242280 - RNA, 19 nt, Homo sapiens
ucaauuucuucaacaucga

SEQ ID NO: 242281 - RNA, 19 nt, Homo sapiens
cucaaccucugccucauca

SEQ ID NO: 242282 - RNA, 19 nt, Homo sapiens
gagucgcggucuguucuca

SEQ ID NO: 242283 - RNA, 19 nt, Homo sapiens
gcagggaucauagcugacu

SEQ ID NO: 242284 - RNA, 19 nt, Homo sapiens
gcauccugcugggcauguu

SEQ ID NO: 242285 - RNA, 19 nt, Homo sapiens
gaagugaccguauauauua

SEQ ID NO: 242286 - RNA, 19 nt, Homo sapiens
gcaauucuguccucugauu

SEQ ID NO: 242287 - RNA, 19 nt, Homo sapiens
ccauugacauugcuucuua

SEQ ID NO: 242288 - RNA, 19 nt, Homo sapiens
gaaagacaguagaugagaa

SEQ ID NO: 242289 - RNA, 19 nt, Homo sapiens
ggucagauacauauuguua

SEQ ID NO: 242290 - RNA, 19 nt, Homo sapiens
gaacaggucucaggaugga

SEQ ID NO: 242291 - RNA, 19 nt, Homo sapiens
uaugcaaacucucucauua

SEQ ID NO: 242292 - RNA, 19 nt, Homo sapiens
ggaaaugcauggcgaagau

SEQ ID NO: 242293 - RNA, 19 nt, Homo sapiens
gaaugcagcuucuguccuu

SEQ ID NO: 242294 - RNA, 19 nt, Homo sapiens
ggaauucugacauggauua

SEQ ID NO: 242295 - RNA, 19 nt, Homo sapiens
gcagaacaauggagaagga

SEQ ID NO: 242296 - RNA, 19 nt, Homo sapiens
gauaaggugugcuugauca

SEQ ID NO: 242297 - RNA, 19 nt, Homo sapiens
caccuuaccuccacucuuu

SEQ ID NO: 242298 - RNA, 19 nt, Homo sapiens
cagugaagcucaaguggua

SEQ ID NO: 242299 - RNA, 19 nt, Homo sapiens
gcauaaacauguucauucu

SEQ ID NO: 242300 - RNA, 19 nt, Homo sapiens
gaucagugcuauugugugu

SEQ ID NO: 242301 - RNA, 19 nt, Homo sapiens
ggagggcacuguccuuuca

SEQ ID NO: 242302 - RNA, 19 nt, Homo sapiens
gagagaagcauacaacaug

SEQ ID NO: 242303 - RNA, 19 nt, Homo sapiens
gaaauaaagcaacguaagu

SEQ ID NO: 242304 - RNA, 19 nt, Homo sapiens
ugacauggauuauggacuu

SEQ ID NO: 242305 - RNA, 19 nt, Homo sapiens
gauuauggacuucuucuaa

SEQ ID NO: 242306 - RNA, 19 nt, Homo sapiens
ggaagagugugcaaaccuu

SEQ ID NO: 242307 - RNA, 19 nt, Homo sapiens
agagugaacugaaagagaa

SEQ ID NO: 242308 - RNA, 19 nt, Homo sapiens
ggagugggaugccuucugu

SEQ ID NO: 242309 - RNA, 19 nt, Homo sapiens
aaagcaagcuguccucuca

SEQ ID NO: 242310 - RNA, 19 nt, Homo sapiens
gacaguagaugagaauaga

SEQ ID NO: 242311 - RNA, 19 nt, Homo sapiens
gacuuuggcuauacgauuu

SEQ ID NO: 242312 - RNA, 19 nt, Homo sapiens
gaauagaagaguaccugua

SEQ ID NO: 242313 - RNA, 19 nt, Homo sapiens
ggaccacucuugggaaaug

SEQ ID NO: 242314 - RNA, 19 nt, Homo sapiens
gaagagugcugccaaacac

SEQ ID NO: 242315 - RNA, 19 nt, Homo sapiens
ggauaaaguggaauucuga

SEQ ID NO: 242316 - RNA, 19 nt, Homo sapiens
gcuauacgauuuacucuac

SEQ ID NO: 242317 - RNA, 19 nt, Homo sapiens
gaagaagugugggaaugau

SEQ ID NO: 242318 - RNA, 19 nt, Homo sapiens
guuucaagcuucugucaaa

SEQ ID NO: 242319 - RNA, 19 nt, Homo sapiens
ugagggagauggugacuuc

SEQ ID NO: 242320 - RNA, 19 nt, Homo sapiens
ugaagugaccguauauauu

SEQ ID NO: 242321 - RNA, 19 nt, Homo sapiens
ugauaagagugaacugaaa

SEQ ID NO: 242322 - RNA, 19 nt, Homo sapiens
gcgcgaugauggacguuaa

SEQ ID NO: 242323 - RNA, 19 nt, Homo sapiens
ggaagaagugugggaauga

SEQ ID NO: 242324 - RNA, 19 nt, Homo sapiens
cagcuucuguccuuucuug

SEQ ID NO: 242325 - RNA, 19 nt, Homo sapiens
gaagucauuugcugagucu

SEQ ID NO: 242326 - RNA, 19 nt, Homo sapiens
ucaaaugugugccuaagca

SEQ ID NO: 242327 - RNA, 19 nt, Homo sapiens
gugcaaaccuuucgagacu

SEQ ID NO: 242328 - RNA, 19 nt, Homo sapiens
uagugaagcuccagaagga

SEQ ID NO: 242329 - RNA, 19 nt, Homo sapiens
ggacuuuggcuauacgauu

SEQ ID NO: 242330 - RNA, 19 nt, Homo sapiens
aagcaauucuguccucuga

SEQ ID NO: 242331 - RNA, 19 nt, Homo sapiens
gggcucagaauguaaauga

SEQ ID NO: 242332 - RNA, 19 nt, Homo sapiens
gcaacguaaguaacaauuu

SEQ ID NO: 242333 - RNA, 19 nt, Homo sapiens
gagcaguguuuguuucaag

SEQ ID NO: 242334 - RNA, 19 nt, Homo sapiens
ccucaagcaugaaaggaaa

SEQ ID NO: 242335 - RNA, 19 nt, Homo sapiens
cgagacuccucaagcauga

SEQ ID NO: 242336 - RNA, 19 nt, Homo sapiens
gaagagugugcaaaccuuu

SEQ ID NO: 242337 - RNA, 19 nt, Homo sapiens
aaaguggaauucugacaug

SEQ ID NO: 242338 - RNA, 19 nt, Homo sapiens
gcaacugccugguggugau

SEQ ID NO: 242339 - RNA, 19 nt, Homo sapiens
ccagagcaguguuuguuuc

SEQ ID NO: 242340 - RNA, 19 nt, Homo sapiens
caucagcuaauacaaauga

SEQ ID NO: 242341 - RNA, 19 nt, Homo sapiens
gaacaauggagaaggaagu

SEQ ID NO: 242342 - RNA, 19 nt, Homo sapiens
guggaucuuuggacacuuu

SEQ ID NO: 242343 - RNA, 19 nt, Homo sapiens
uaaagcaacguaaguaaca

SEQ ID NO: 242344 - RNA, 19 nt, Homo sapiens
aagcuucugucaaauaguu

SEQ ID NO: 242345 - RNA, 19 nt, Homo sapiens
gaucuguuguacacacuau

SEQ ID NO: 242346 - RNA, 19 nt, Homo sapiens
gaugauaaggugugcuuga

SEQ ID NO: 242347 - RNA, 19 nt, Homo sapiens
acagaaagacaguagauga

SEQ ID NO: 242348 - RNA, 19 nt, Homo sapiens
agagaagcauacaacauga

SEQ ID NO: 242349 - RNA, 19 nt, Homo sapiens
ucaagcuucugucaaauag

SEQ ID NO: 242350 - RNA, 19 nt, Homo sapiens
gucaucagcuaauacaaau

SEQ ID NO: 242351 - RNA, 19 nt, Homo sapiens
caugagacagaauguauuu

SEQ ID NO: 242352 - RNA, 19 nt, Homo sapiens
ggaagagugcugccaaaca

SEQ ID NO: 242353 - RNA, 19 nt, Homo sapiens
uggaugggcucagaaugua

SEQ ID NO: 242354 - RNA, 19 nt, Homo sapiens
uaaaccaaauugugugaag

SEQ ID NO: 242355 - RNA, 19 nt, Homo sapiens
gcuauuguguguucucagu

SEQ ID NO: 242356 - RNA, 19 nt, Homo sapiens
gaccugaguuugugcuaca

SEQ ID NO: 242357 - RNA, 19 nt, Homo sapiens
gggaaaugcuucagaacac

SEQ ID NO: 242358 - RNA, 19 nt, Homo sapiens
gcaguaagcacaccaacag

SEQ ID NO: 242359 - RNA, 19 nt, Homo sapiens
uguacacacuaucuuauga

SEQ ID NO: 242360 - RNA, 19 nt, Homo sapiens
ggagagaagcauacaacau

SEQ ID NO: 242361 - RNA, 19 nt, Homo sapiens
ugaauaugcaggaaucauu

SEQ ID NO: 242362 - RNA, 19 nt, Homo sapiens
ucagugcuauuguguguuc

SEQ ID NO: 242363 - RNA, 19 nt, Homo sapiens
caggaagagugcugccaaa

SEQ ID NO: 242364 - RNA, 19 nt, Homo sapiens
uugcugaagugaccguaua

SEQ ID NO: 242365 - RNA, 19 nt, Homo sapiens
ugagcugcauuguguuaaa

SEQ ID NO: 242366 - RNA, 19 nt, Homo sapiens
caugaaaugugaugcuucu

SEQ ID NO: 242367 - RNA, 19 nt, Homo sapiens
uauuguguguucucaguuu

SEQ ID NO: 242368 - RNA, 19 nt, Homo sapiens
gauggugacuucuccuuuu

SEQ ID NO: 242369 - RNA, 19 nt, Homo sapiens
agagagaccugaguuugug

SEQ ID NO: 242370 - RNA, 19 nt, Homo sapiens
gcugaaauaaagcaacgua

SEQ ID NO: 242371 - RNA, 19 nt, Homo sapiens
ucacaaggccccucacaua

SEQ ID NO: 242372 - RNA, 19 nt, Homo sapiens
gagcuaaggagacagaaag

SEQ ID NO: 242373 - RNA, 19 nt, Homo sapiens
ggcauaaacauguucauuc

SEQ ID NO: 242374 - RNA, 19 nt, Homo sapiens
gcuaggcuaugcaaacucu

SEQ ID NO: 242375 - RNA, 19 nt, Homo sapiens
gcucagaauguaaaugaug

SEQ ID NO: 242376 - RNA, 19 nt, Homo sapiens
guugagcugcauuguguua

SEQ ID NO: 242377 - RNA, 19 nt, Homo sapiens
gggcauaaacauguucauu

SEQ ID NO: 242378 - RNA, 19 nt, Homo sapiens
uauguuauguggaagaagu

SEQ ID NO: 242379 - RNA, 19 nt, Homo sapiens
agaauccagucaucagcua

SEQ ID NO: 242380 - RNA, 19 nt, Homo sapiens
ggagacagaaagacaguag

SEQ ID NO: 242381 - RNA, 19 nt, Homo sapiens
ccagagagaccugaguuug

SEQ ID NO: 242382 - RNA, 19 nt, Homo sapiens
aaacaucuccaucuuuaag

SEQ ID NO: 242383 - RNA, 19 nt, Homo sapiens
gaugggcucagaauguaaa

SEQ ID NO: 242384 - RNA, 19 nt, Homo sapiens
gauaagagugaacugaaag

SEQ ID NO: 242385 - RNA, 19 nt, Homo sapiens
gaagugaccguauauauua

SEQ ID NO: 242386 - RNA, 19 nt, Homo sapiens
gaacaauggagaugaaaua

SEQ ID NO: 242387 - RNA, 19 nt, Homo sapiens
gcaauucuguccucugauu

SEQ ID NO: 242388 - RNA, 19 nt, Homo sapiens
ccauugacauugcuucuua

SEQ ID NO: 242389 - RNA, 19 nt, Homo sapiens
gaaagacaguagaugagaa

SEQ ID NO: 242390 - RNA, 19 nt, Homo sapiens
ggucagauacauauuguua

SEQ ID NO: 242391 - RNA, 19 nt, Homo sapiens
gaacaggucucaggaugga

SEQ ID NO: 242392 - RNA, 19 nt, Homo sapiens
uaugcaaacucucucauua

SEQ ID NO: 242393 - RNA, 19 nt, Homo sapiens
ggaaaugcauggcgaagau

SEQ ID NO: 242394 - RNA, 19 nt, Homo sapiens
gaaugcagcuucuguccuu

SEQ ID NO: 242395 - RNA, 19 nt, Homo sapiens
gcagaacaauggagaugaa

SEQ ID NO: 242396 - RNA, 19 nt, Homo sapiens
ggaauucugacauggauua

SEQ ID NO: 242397 - RNA, 19 nt, Homo sapiens
gauaaggugugcuugauca

SEQ ID NO: 242398 - RNA, 19 nt, Homo sapiens
caccuuaccuccacucuuu

SEQ ID NO: 242399 - RNA, 19 nt, Homo sapiens
cagugaagcucaaguggua

SEQ ID NO: 242400 - RNA, 19 nt, Homo sapiens
gcauaaacauguucauucu

SEQ ID NO: 242401 - RNA, 19 nt, Homo sapiens
gaucagugcuauugugugu

SEQ ID NO: 242402 - RNA, 19 nt, Homo sapiens
aaauagagguggaaacaga

SEQ ID NO: 242403 - RNA, 19 nt, Homo sapiens
ggagggcacuguccuuuca

SEQ ID NO: 242404 - RNA, 19 nt, Homo sapiens
gagagaagcauacaacaug

SEQ ID NO: 242405 - RNA, 19 nt, Homo sapiens
gaaauaaagcaacguaagu

SEQ ID NO: 242406 - RNA, 19 nt, Homo sapiens
ugacauggauuauggacuu

SEQ ID NO: 242407 - RNA, 19 nt, Homo sapiens
gauuauggacuucuucuaa

SEQ ID NO: 242408 - RNA, 19 nt, Homo sapiens
ggaagagugugcaaaccuu

SEQ ID NO: 242409 - RNA, 19 nt, Homo sapiens
agagugaacugaaagagaa

SEQ ID NO: 242410 - RNA, 19 nt, Homo sapiens
ggagugggaugccuucugu

SEQ ID NO: 242411 - RNA, 19 nt, Homo sapiens
caauggagaugaaauaaac

SEQ ID NO: 242412 - RNA, 19 nt, Homo sapiens
aaagcaagcuguccucuca

SEQ ID NO: 242413 - RNA, 19 nt, Homo sapiens
gacaguagaugagaauaga

SEQ ID NO: 242414 - RNA, 19 nt, Homo sapiens
gacuuuggcuauacgauuu

SEQ ID NO: 242415 - RNA, 19 nt, Homo sapiens
gaauagaagaguaccugua

SEQ ID NO: 242416 - RNA, 19 nt, Homo sapiens
ggaccacucuugggaaaug

SEQ ID NO: 242417 - RNA, 19 nt, Homo sapiens
gaagagugcugccaaacac

SEQ ID NO: 242418 - RNA, 19 nt, Homo sapiens
ggauaaaguggaauucuga

SEQ ID NO: 242419 - RNA, 19 nt, Homo sapiens
gcuauacgauuuacucuac

SEQ ID NO: 242420 - RNA, 19 nt, Homo sapiens
gaagaagugugggaaugau

SEQ ID NO: 242421 - RNA, 19 nt, Homo sapiens
guuucaagcuucugucaaa

SEQ ID NO: 242422 - RNA, 19 nt, Homo sapiens
ugagggagauggugacuuc

SEQ ID NO: 242423 - RNA, 19 nt, Homo sapiens
ugaagugaccguauauauu

SEQ ID NO: 242424 - RNA, 19 nt, Homo sapiens
ugauaagagugaacugaaa

SEQ ID NO: 242425 - RNA, 19 nt, Homo sapiens
gcgcgaugauggacguuaa

SEQ ID NO: 242426 - RNA, 19 nt, Homo sapiens
ggaagaagugugggaauga

SEQ ID NO: 242427 - RNA, 19 nt, Homo sapiens
gaaacagaaggaagucauu

SEQ ID NO: 242428 - RNA, 19 nt, Homo sapiens
cagcuucuguccuuucuug

SEQ ID NO: 242429 - RNA, 19 nt, Homo sapiens
gaagucauuugcugagucu

SEQ ID NO: 242430 - RNA, 19 nt, Homo sapiens
ucaaaugugugccuaagca

SEQ ID NO: 242431 - RNA, 19 nt, Homo sapiens
gugcaaaccuuucgagacu

SEQ ID NO: 242432 - RNA, 19 nt, Homo sapiens
uagugaagcuccagaagga

SEQ ID NO: 242433 - RNA, 19 nt, Homo sapiens
ggacuuuggcuauacgauu

SEQ ID NO: 242434 - RNA, 19 nt, Homo sapiens
aagcaauucuguccucuga

SEQ ID NO: 242435 - RNA, 19 nt, Homo sapiens
gaaaagaggccaccgguau

SEQ ID NO: 242436 - RNA, 19 nt, Homo sapiens
gggcucagaauguaaauga

SEQ ID NO: 242437 - RNA, 19 nt, Homo sapiens
gcaacguaaguaacaauuu

SEQ ID NO: 242438 - RNA, 19 nt, Homo sapiens
gagcaguguuuguuucaag

SEQ ID NO: 242439 - RNA, 19 nt, Homo sapiens
ccucaagcaugaaaggaaa

SEQ ID NO: 242440 - RNA, 19 nt, Homo sapiens
cgagacuccucaagcauga

SEQ ID NO: 242441 - RNA, 19 nt, Homo sapiens
gaagagugugcaaaccuuu

SEQ ID NO: 242442 - RNA, 19 nt, Homo sapiens
aaaguggaauucugacaug

SEQ ID NO: 242443 - RNA, 19 nt, Homo sapiens
gcaacugccugguggugau

SEQ ID NO: 242444 - RNA, 19 nt, Homo sapiens
ccagagcaguguuuguuuc

SEQ ID NO: 242445 - RNA, 19 nt, Homo sapiens
caucagcuaauacaaauga

SEQ ID NO: 242446 - RNA, 19 nt, Homo sapiens
guggaucuuuggacacuuu

SEQ ID NO: 242447 - RNA, 19 nt, Homo sapiens
uaaagcaacguaaguaaca

SEQ ID NO: 242448 - RNA, 19 nt, Homo sapiens
aagcuucugucaaauaguu

SEQ ID NO: 242449 - RNA, 19 nt, Homo sapiens
gaucuguuguacacacuau

SEQ ID NO: 242450 - RNA, 19 nt, Homo sapiens
gaugauaaggugugcuuga

SEQ ID NO: 242451 - RNA, 19 nt, Homo sapiens
acagaaagacaguagauga

SEQ ID NO: 242452 - RNA, 19 nt, Homo sapiens
agagaagcauacaacauga

SEQ ID NO: 242453 - RNA, 19 nt, Homo sapiens
ucaagcuucugucaaauag

SEQ ID NO: 242454 - RNA, 19 nt, Homo sapiens
gucaucagcuaauacaaau

SEQ ID NO: 242455 - RNA, 19 nt, Homo sapiens
caugagacagaauguauuu

SEQ ID NO: 242456 - RNA, 19 nt, Homo sapiens
gcuacaaucuccagaccau

SEQ ID NO: 242457 - RNA, 19 nt, Homo sapiens
ggaagagugcugccaaaca

SEQ ID NO: 242458 - RNA, 19 nt, Homo sapiens
uggaugggcucagaaugua

SEQ ID NO: 242459 - RNA, 19 nt, Homo sapiens
uaaaccaaauugugugaag

SEQ ID NO: 242460 - RNA, 19 nt, Homo sapiens
gcuauuguguguucucagu

SEQ ID NO: 242461 - RNA, 19 nt, Homo sapiens
gggaaaugcuucagaacac

SEQ ID NO: 242462 - RNA, 19 nt, Homo sapiens
gcaguaagcacaccaacag

SEQ ID NO: 242463 - RNA, 19 nt, Homo sapiens
uguacacacuaucuuauga

SEQ ID NO: 242464 - RNA, 19 nt, Homo sapiens
ggagagaagcauacaacau

SEQ ID NO: 242465 - RNA, 19 nt, Homo sapiens
ugaauaugcaggaaucauu

SEQ ID NO: 242466 - RNA, 19 nt, Homo sapiens
ucagugcuauuguguguuc

SEQ ID NO: 242467 - RNA, 19 nt, Homo sapiens
caggaagagugcugccaaa

SEQ ID NO: 242468 - RNA, 19 nt, Homo sapiens
uugcugaagugaccguaua

SEQ ID NO: 242469 - RNA, 19 nt, Homo sapiens
ugagcugcauuguguuaaa

SEQ ID NO: 242470 - RNA, 19 nt, Homo sapiens
caugaaaugugaugcuucu

SEQ ID NO: 242471 - RNA, 19 nt, Homo sapiens
uauuguguguucucaguuu

SEQ ID NO: 242472 - RNA, 19 nt, Homo sapiens
gauggugacuucuccuuuu

SEQ ID NO: 242473 - RNA, 19 nt, Homo sapiens
agagagaccugaguuugug

SEQ ID NO: 242474 - RNA, 19 nt, Homo sapiens
gcugaaauaaagcaacgua

SEQ ID NO: 242475 - RNA, 19 nt, Homo sapiens
gagcuaaggagacagaaag

SEQ ID NO: 242476 - RNA, 19 nt, Homo sapiens
ggcauaaacauguucauuc

SEQ ID NO: 242477 - RNA, 19 nt, Homo sapiens
ucacaaggccccucacaua

SEQ ID NO: 242478 - RNA, 19 nt, Homo sapiens
caaggagggugcuguugag

SEQ ID NO: 242479 - RNA, 19 nt, Homo sapiens
gcuaggcuaugcaaacucu

SEQ ID NO: 242480 - RNA, 19 nt, Homo sapiens
gcucagaauguaaaugaug

SEQ ID NO: 242481 - RNA, 19 nt, Homo sapiens
guugagcugcauuguguua

SEQ ID NO: 242482 - RNA, 19 nt, Homo sapiens
gggcauaaacauguucauu

SEQ ID NO: 242483 - RNA, 19 nt, Homo sapiens
uauguuauguggaagaagu

SEQ ID NO: 242484 - RNA, 19 nt, Homo sapiens
agaauccagucaucagcua

SEQ ID NO: 242485 - RNA, 19 nt, Homo sapiens
gaagugaccguauauauua

SEQ ID NO: 242486 - RNA, 19 nt, Homo sapiens
gaacaauggagaugaaaua

SEQ ID NO: 242487 - RNA, 19 nt, Homo sapiens
gcaauucuguccucugauu

SEQ ID NO: 242488 - RNA, 19 nt, Homo sapiens
ccauugacauugcuucuua

SEQ ID NO: 242489 - RNA, 19 nt, Homo sapiens
gaaagacaguagaugagaa

SEQ ID NO: 242490 - RNA, 19 nt, Homo sapiens
ggucagauacauauuguua

SEQ ID NO: 242491 - RNA, 19 nt, Homo sapiens
gaacaggucucaggaugga

SEQ ID NO: 242492 - RNA, 19 nt, Homo sapiens
uaugcaaacucucucauua

SEQ ID NO: 242493 - RNA, 19 nt, Homo sapiens
ggaaaugcauggcgaagau

SEQ ID NO: 242494 - RNA, 19 nt, Homo sapiens
gaaugcagcuucuguccuu

SEQ ID NO: 242495 - RNA, 19 nt, Homo sapiens
gcagaacaauggagaugaa

SEQ ID NO: 242496 - RNA, 19 nt, Homo sapiens
ggaauucugacauggauua

SEQ ID NO: 242497 - RNA, 19 nt, Homo sapiens
gauaaggugugcuugauca

SEQ ID NO: 242498 - RNA, 19 nt, Homo sapiens
caccuuaccuccacucuuu

SEQ ID NO: 242499 - RNA, 19 nt, Homo sapiens
cagugaagcucaaguggua

SEQ ID NO: 242500 - RNA, 19 nt, Homo sapiens
gcauaaacauguucauucu

SEQ ID NO: 242501 - RNA, 19 nt, Homo sapiens
gaucagugcuauugugugu

SEQ ID NO: 242502 - RNA, 19 nt, Homo sapiens
aaauagagguggaaacaga

SEQ ID NO: 242503 - RNA, 19 nt, Homo sapiens
ggagggcacuguccuuuca

SEQ ID NO: 242504 - RNA, 19 nt, Homo sapiens
gagagaagcauacaacaug

SEQ ID NO: 242505 - RNA, 19 nt, Homo sapiens
gaaauaaagcaacguaagu

SEQ ID NO: 242506 - RNA, 19 nt, Homo sapiens
ugacauggauuauggacuu

SEQ ID NO: 242507 - RNA, 19 nt, Homo sapiens
gaccugaguuugugcugua

SEQ ID NO: 242508 - RNA, 19 nt, Homo sapiens
gauuauggacuucuucuaa

SEQ ID NO: 242509 - RNA, 19 nt, Homo sapiens
ggaagagugugcaaaccuu

SEQ ID NO: 242510 - RNA, 19 nt, Homo sapiens
agagugaacugaaagagaa

SEQ ID NO: 242511 - RNA, 19 nt, Homo sapiens
ggagugggaugccuucugu

SEQ ID NO: 242512 - RNA, 19 nt, Homo sapiens
caauggagaugaaauaaac

SEQ ID NO: 242513 - RNA, 19 nt, Homo sapiens
aaagcaagcuguccucuca

SEQ ID NO: 242514 - RNA, 19 nt, Homo sapiens
gacaguagaugagaauaga

SEQ ID NO: 242515 - RNA, 19 nt, Homo sapiens
gacuuuggcuauacgauuu

SEQ ID NO: 242516 - RNA, 19 nt, Homo sapiens
gaauagaagaguaccugua

SEQ ID NO: 242517 - RNA, 19 nt, Homo sapiens
ggaccacucuugggaaaug

SEQ ID NO: 242518 - RNA, 19 nt, Homo sapiens
gaagagugcugccaaacac

SEQ ID NO: 242519 - RNA, 19 nt, Homo sapiens
ggauaaaguggaauucuga

SEQ ID NO: 242520 - RNA, 19 nt, Homo sapiens
gcuauacgauuuacucuac

SEQ ID NO: 242521 - RNA, 19 nt, Homo sapiens
gaagaagugugggaaugau

SEQ ID NO: 242522 - RNA, 19 nt, Homo sapiens
guuucaagcuucugucaaa

SEQ ID NO: 242523 - RNA, 19 nt, Homo sapiens
ugagggagauggugacuuc

SEQ ID NO: 242524 - RNA, 19 nt, Homo sapiens
ugaagugaccguauauauu

SEQ ID NO: 242525 - RNA, 19 nt, Homo sapiens
ugauaagagugaacugaaa

SEQ ID NO: 242526 - RNA, 19 nt, Homo sapiens
gcgcgaugauggacguuaa

SEQ ID NO: 242527 - RNA, 19 nt, Homo sapiens
ggaagaagugugggaauga

SEQ ID NO: 242528 - RNA, 19 nt, Homo sapiens
gaaacagaaggaagucauu

SEQ ID NO: 242529 - RNA, 19 nt, Homo sapiens
cagcuucuguccuuucuug

SEQ ID NO: 242530 - RNA, 19 nt, Homo sapiens
gaagucauuugcugagucu

SEQ ID NO: 242531 - RNA, 19 nt, Homo sapiens
ucaaaugugugccuaagca

SEQ ID NO: 242532 - RNA, 19 nt, Homo sapiens
gugcaaaccuuucgagacu

SEQ ID NO: 242533 - RNA, 19 nt, Homo sapiens
uagugaagcuccagaagga

SEQ ID NO: 242534 - RNA, 19 nt, Homo sapiens
ggacuuuggcuauacgauu

SEQ ID NO: 242535 - RNA, 19 nt, Homo sapiens
aagcaauucuguccucuga

SEQ ID NO: 242536 - RNA, 19 nt, Homo sapiens
gggcucagaauguaaauga

SEQ ID NO: 242537 - RNA, 19 nt, Homo sapiens
gcaacguaaguaacaauuu

SEQ ID NO: 242538 - RNA, 19 nt, Homo sapiens
gagcaguguuuguuucaag

SEQ ID NO: 242539 - RNA, 19 nt, Homo sapiens
ccucaagcaugaaaggaaa

SEQ ID NO: 242540 - RNA, 19 nt, Homo sapiens
cgagacuccucaagcauga

SEQ ID NO: 242541 - RNA, 19 nt, Homo sapiens
gaagagugugcaaaccuuu

SEQ ID NO: 242542 - RNA, 19 nt, Homo sapiens
aaaguggaauucugacaug

SEQ ID NO: 242543 - RNA, 19 nt, Homo sapiens
gcaacugccugguggugau

SEQ ID NO: 242544 - RNA, 19 nt, Homo sapiens
ccagagcaguguuuguuuc

SEQ ID NO: 242545 - RNA, 19 nt, Homo sapiens
caucagcuaauacaaauga

SEQ ID NO: 242546 - RNA, 19 nt, Homo sapiens
guggaucuuuggacacuuu

SEQ ID NO: 242547 - RNA, 19 nt, Homo sapiens
uaaagcaacguaaguaaca

SEQ ID NO: 242548 - RNA, 19 nt, Homo sapiens
aagcuucugucaaauaguu

SEQ ID NO: 242549 - RNA, 19 nt, Homo sapiens
gaucuguuguacacacuau

SEQ ID NO: 242550 - RNA, 19 nt, Homo sapiens
gaugauaaggugugcuuga

SEQ ID NO: 242551 - RNA, 19 nt, Homo sapiens
acagaaagacaguagauga

SEQ ID NO: 242552 - RNA, 19 nt, Homo sapiens
agagaagcauacaacauga

SEQ ID NO: 242553 - RNA, 19 nt, Homo sapiens
ucaagcuucugucaaauag

SEQ ID NO: 242554 - RNA, 19 nt, Homo sapiens
gucaucagcuaauacaaau

SEQ ID NO: 242555 - RNA, 19 nt, Homo sapiens
caugagacagaauguauuu

SEQ ID NO: 242556 - RNA, 19 nt, Homo sapiens
ggaagagugcugccaaaca

SEQ ID NO: 242557 - RNA, 19 nt, Homo sapiens
uggaugggcucagaaugua

SEQ ID NO: 242558 - RNA, 19 nt, Homo sapiens
uaaaccaaauugugugaag

SEQ ID NO: 242559 - RNA, 19 nt, Homo sapiens
gcuauuguguguucucagu

SEQ ID NO: 242560 - RNA, 19 nt, Homo sapiens
gggaaaugcuucagaacac

SEQ ID NO: 242561 - RNA, 19 nt, Homo sapiens
gcaguaagcacaccaacag

SEQ ID NO: 242562 - RNA, 19 nt, Homo sapiens
uguacacacuaucuuauga

SEQ ID NO: 242563 - RNA, 19 nt, Homo sapiens
ggagagaagcauacaacau

SEQ ID NO: 242564 - RNA, 19 nt, Homo sapiens
ugaauaugcaggaaucauu

SEQ ID NO: 242565 - RNA, 19 nt, Homo sapiens
ucagugcuauuguguguuc

SEQ ID NO: 242566 - RNA, 19 nt, Homo sapiens
caggaagagugcugccaaa

SEQ ID NO: 242567 - RNA, 19 nt, Homo sapiens
uugcugaagugaccguaua

SEQ ID NO: 242568 - RNA, 19 nt, Homo sapiens
ugagcugcauuguguuaaa

SEQ ID NO: 242569 - RNA, 19 nt, Homo sapiens
caugaaaugugaugcuucu

SEQ ID NO: 242570 - RNA, 19 nt, Homo sapiens
uauuguguguucucaguuu

SEQ ID NO: 242571 - RNA, 19 nt, Homo sapiens
gauggugacuucuccuuuu

SEQ ID NO: 242572 - RNA, 19 nt, Homo sapiens
agagagaccugaguuugug

SEQ ID NO: 242573 - RNA, 19 nt, Homo sapiens
gcugaaauaaagcaacgua

SEQ ID NO: 242574 - RNA, 19 nt, Homo sapiens
gagcuaaggagacagaaag

SEQ ID NO: 242575 - RNA, 19 nt, Homo sapiens
ggcauaaacauguucauuc

SEQ ID NO: 242576 - RNA, 19 nt, Homo sapiens
ucacaaggccccucacaua

SEQ ID NO: 242577 - RNA, 19 nt, Homo sapiens
gcuaggcuaugcaaacucu

SEQ ID NO: 242578 - RNA, 19 nt, Homo sapiens
gcucagaauguaaaugaug

SEQ ID NO: 242579 - RNA, 19 nt, Homo sapiens
guugagcugcauuguguua

SEQ ID NO: 242580 - RNA, 19 nt, Homo sapiens
gggcauaaacauguucauu

SEQ ID NO: 242581 - RNA, 19 nt, Homo sapiens
uauguuauguggaagaagu

SEQ ID NO: 242582 - RNA, 19 nt, Homo sapiens
agaauccagucaucagcua

SEQ ID NO: 242583 - RNA, 19 nt, Homo sapiens
aaacagaaggaagucauuu

SEQ ID NO: 242584 - RNA, 19 nt, Homo sapiens
ggagacagaaagacaguag

SEQ ID NO: 242585 - RNA, 19 nt, Homo sapiens
aaacgaaacuucuaaggua

SEQ ID NO: 242586 - RNA, 19 nt, Homo sapiens
acaaaggccuuaugcaaua

SEQ ID NO: 242587 - RNA, 19 nt, Homo sapiens
gaagugcacauagauauua

SEQ ID NO: 242588 - RNA, 19 nt, Homo sapiens
aaaccuagauggagaauug

SEQ ID NO: 242589 - RNA, 19 nt, Homo sapiens
gaugagaccauauuucuuu

SEQ ID NO: 242590 - RNA, 19 nt, Homo sapiens
uaagguaucaucuguguua

SEQ ID NO: 242591 - RNA, 19 nt, Homo sapiens
aaacauacccaucauauug

SEQ ID NO: 242592 - RNA, 19 nt, Homo sapiens
ugucacagcugcagcauuu

SEQ ID NO: 242593 - RNA, 19 nt, Homo sapiens
aagcuuaacuucauccuuu

SEQ ID NO: 242594 - RNA, 19 nt, Homo sapiens
gaacuucuucaacgaauuu

SEQ ID NO: 242595 - RNA, 19 nt, Homo sapiens
gaccauauuucuuugaugu

SEQ ID NO: 242596 - RNA, 19 nt, Homo sapiens
gaaacaaacgaaacuucua

SEQ ID NO: 242597 - RNA, 19 nt, Homo sapiens
uaucaucuguguuaaguga

SEQ ID NO: 242598 - RNA, 19 nt, Homo sapiens
gaaacauacccaucauauu

SEQ ID NO: 242599 - RNA, 19 nt, Homo sapiens
auaacaagauggugcauuu

SEQ ID NO: 242600 - RNA, 19 nt, Homo sapiens
gcagagacuuugucaggau

SEQ ID NO: 242601 - RNA, 19 nt, Homo sapiens
aaucauggcucaccgcauu

SEQ ID NO: 242602 - RNA, 19 nt, Homo sapiens
cgucauguauuuagacuug

SEQ ID NO: 242603 - RNA, 19 nt, Homo sapiens
ccacaaaggccuuaugcaa

SEQ ID NO: 242604 - RNA, 19 nt, Homo sapiens
gaaauuguggaaggacuua

SEQ ID NO: 242605 - RNA, 19 nt, Homo sapiens
gaaacugaauuaguaugug

SEQ ID NO: 242606 - RNA, 19 nt, Homo sapiens
ccugggagcuugguacuuu

SEQ ID NO: 242607 - RNA, 19 nt, Homo sapiens
caucagcaaucaccuuguu

SEQ ID NO: 242608 - RNA, 19 nt, Homo sapiens
gugacaagcuggcuaaugg

SEQ ID NO: 242609 - RNA, 19 nt, Homo sapiens
acacacaguuggauaaaca

SEQ ID NO: 242610 - RNA, 19 nt, Homo sapiens
gagggugucucugcagaaa

SEQ ID NO: 242611 - RNA, 19 nt, Homo sapiens
cgacacacuguacuuauuu

SEQ ID NO: 242612 - RNA, 19 nt, Homo sapiens
ccguggagcuguuaucuau

SEQ ID NO: 242613 - RNA, 19 nt, Homo sapiens
gguaucaucuguguuaagu

SEQ ID NO: 242614 - RNA, 19 nt, Homo sapiens
cacagucagucuugcauuu

SEQ ID NO: 242615 - RNA, 19 nt, Homo sapiens
ucucauugauguugugaaa

SEQ ID NO: 242616 - RNA, 19 nt, Homo sapiens
ugaagacuaugaagagugu

SEQ ID NO: 242617 - RNA, 19 nt, Homo sapiens
ggagugcagugccacaauc

SEQ ID NO: 242618 - RNA, 19 nt, Homo sapiens
ugaaacauacccaucauau

SEQ ID NO: 242619 - RNA, 19 nt, Homo sapiens
guuaagugaugagaccaua

SEQ ID NO: 242620 - RNA, 19 nt, Homo sapiens
acacgaaucaguaacauga

SEQ ID NO: 242621 - RNA, 19 nt, Homo sapiens
gagaccauauuucuuugau

SEQ ID NO: 242622 - RNA, 19 nt, Homo sapiens
guaguagccagaauucgua

SEQ ID NO: 242623 - RNA, 19 nt, Homo sapiens
acaaguaaaucccacaaag

SEQ ID NO: 242624 - RNA, 19 nt, Homo sapiens
cugauaagcuuaacuucau

SEQ ID NO: 242625 - RNA, 19 nt, Homo sapiens
ggucccagauccugauguu

SEQ ID NO: 242626 - RNA, 19 nt, Homo sapiens
guggagcuguuaucuaugu

SEQ ID NO: 242627 - RNA, 19 nt, Homo sapiens
guggacaugauaaacauua

SEQ ID NO: 242628 - RNA, 19 nt, Homo sapiens
ccaucauauuguccuauua

SEQ ID NO: 242629 - RNA, 19 nt, Homo sapiens
uaucggaucugucguucug

SEQ ID NO: 242630 - RNA, 19 nt, Homo sapiens
gcacaucgacacacuguac

SEQ ID NO: 242631 - RNA, 19 nt, Homo sapiens
caaaggccuuaugcaauau

SEQ ID NO: 242632 - RNA, 19 nt, Homo sapiens
uaugaagaguguuguggaa

SEQ ID NO: 242633 - RNA, 19 nt, Homo sapiens
caccacacccagcuaauuu

SEQ ID NO: 242634 - RNA, 19 nt, Homo sapiens
uaagugaugagaccauauu

SEQ ID NO: 242635 - RNA, 19 nt, Homo sapiens
gcuaacaucggaaaacuua

SEQ ID NO: 242636 - RNA, 19 nt, Homo sapiens
gcugaagugcacauagaua

SEQ ID NO: 242637 - RNA, 19 nt, Homo sapiens
ccacugccuugguuacuca

SEQ ID NO: 242638 - RNA, 19 nt, Homo sapiens
gacacacuguacuuauuug

SEQ ID NO: 242639 - RNA, 19 nt, Homo sapiens
ucgacacacuguacuuauu

SEQ ID NO: 242640 - RNA, 19 nt, Homo sapiens
uuaaagaucuuggaaaucc

SEQ ID NO: 242641 - RNA, 19 nt, Homo sapiens
gauccugauguuaguauuu

SEQ ID NO: 242642 - RNA, 19 nt, Homo sapiens
ucuaagguaucaucugugu

SEQ ID NO: 242643 - RNA, 19 nt, Homo sapiens
caucgacacacuguacuua

SEQ ID NO: 242644 - RNA, 19 nt, Homo sapiens
guggaaggacuuacaagaa

SEQ ID NO: 242645 - RNA, 19 nt, Homo sapiens
gagcuguuaucuaugucaa

SEQ ID NO: 242646 - RNA, 19 nt, Homo sapiens
gggccugucugaaccacuu

SEQ ID NO: 242647 - RNA, 19 nt, Homo sapiens
caaacgaaacuucuaaggu

SEQ ID NO: 242648 - RNA, 19 nt, Homo sapiens
uggcugaagugcacauaga

SEQ ID NO: 242649 - RNA, 19 nt, Homo sapiens
cgaaacuucuaagguauca

SEQ ID NO: 242650 - RNA, 19 nt, Homo sapiens
gcacagucagucuugcauu

SEQ ID NO: 242651 - RNA, 19 nt, Homo sapiens
acgugucccuucaguauuu

SEQ ID NO: 242652 - RNA, 19 nt, Homo sapiens
uuaucuaugucaagcagua

SEQ ID NO: 242653 - RNA, 19 nt, Homo sapiens
caaacugacuaauaaacac

SEQ ID NO: 242654 - RNA, 19 nt, Homo sapiens
cuucuaagguaucaucugu

SEQ ID NO: 242655 - RNA, 19 nt, Homo sapiens
gaucugucguucuggaaag

SEQ ID NO: 242656 - RNA, 19 nt, Homo sapiens
acagaaacguggaacacau

SEQ ID NO: 242657 - RNA, 19 nt, Homo sapiens
gcucaugucuguuuugcuu

SEQ ID NO: 242658 - RNA, 19 nt, Homo sapiens
agacgugucccuucaguau

SEQ ID NO: 242659 - RNA, 19 nt, Homo sapiens
cacaaaggccuuaugcaau

SEQ ID NO: 242660 - RNA, 19 nt, Homo sapiens
gagguggacaugauaaaca

SEQ ID NO: 242661 - RNA, 19 nt, Homo sapiens
ggcgcgaccuuuucuguua

SEQ ID NO: 242662 - RNA, 19 nt, Homo sapiens
ggaagcuccuacaguuucu

SEQ ID NO: 242663 - RNA, 19 nt, Homo sapiens
gcacccaugaggacagaaa

SEQ ID NO: 242664 - RNA, 19 nt, Homo sapiens
uaguauguguuacaacuca

SEQ ID NO: 242665 - RNA, 19 nt, Homo sapiens
gggagcuccuucugccauu

SEQ ID NO: 242666 - RNA, 19 nt, Homo sapiens
uggaaggacuuacaagaac

SEQ ID NO: 242667 - RNA, 19 nt, Homo sapiens
ggaaauuguggaaggacuu

SEQ ID NO: 242668 - RNA, 19 nt, Homo sapiens
gugaugagaccauauuucu

SEQ ID NO: 242669 - RNA, 19 nt, Homo sapiens
gagugagcaugugguguga

SEQ ID NO: 242670 - RNA, 19 nt, Homo sapiens
caacaaguaaaucccacaa

SEQ ID NO: 242671 - RNA, 19 nt, Homo sapiens
ugaagugcacauagauauu

SEQ ID NO: 242672 - RNA, 19 nt, Homo sapiens
cagcaaucaccuuguuauu

SEQ ID NO: 242673 - RNA, 19 nt, Homo sapiens
cuugaagacugcccagaau

SEQ ID NO: 242674 - RNA, 19 nt, Homo sapiens
ccaccacacccagcuaauu

SEQ ID NO: 242675 - RNA, 19 nt, Homo sapiens
cccaucauauuguccuauu

SEQ ID NO: 242676 - RNA, 19 nt, Homo sapiens
uuaacuucauccuuuguga

SEQ ID NO: 242677 - RNA, 19 nt, Homo sapiens
gcagaaaacaaugagauuu

SEQ ID NO: 242678 - RNA, 19 nt, Homo sapiens
ugaagaguguuguggaaaa

SEQ ID NO: 242679 - RNA, 19 nt, Homo sapiens
acugguagaugugcucauu

SEQ ID NO: 242680 - RNA, 19 nt, Homo sapiens
ggguuuagguuguaauucc

SEQ ID NO: 242681 - RNA, 19 nt, Homo sapiens
cagaauucguaaagcuguu

SEQ ID NO: 242682 - RNA, 19 nt, Homo sapiens
auuuagacuugguguagua

SEQ ID NO: 242683 - RNA, 19 nt, Homo sapiens
guauuuagacuugguguag

SEQ ID NO: 242684 - RNA, 19 nt, Homo sapiens
caaguaaaucccacaaagg

SEQ ID NO: 242685 - RNA, 19 nt, Homo sapiens
guggagagcuuccggauua

SEQ ID NO: 242686 - RNA, 19 nt, Homo sapiens
gcaggaggcugacacagua

SEQ ID NO: 242687 - RNA, 19 nt, Homo sapiens
caaagaaccugaaauugga

SEQ ID NO: 242688 - RNA, 19 nt, Homo sapiens
gacaugagcugcccuaaug

SEQ ID NO: 242689 - RNA, 19 nt, Homo sapiens
cagaagagcucaaccauca

SEQ ID NO: 242690 - RNA, 19 nt, Homo sapiens
gacaguaccugauuguauu

SEQ ID NO: 242691 - RNA, 19 nt, Homo sapiens
guagauggcuugugugugu

SEQ ID NO: 242692 - RNA, 19 nt, Homo sapiens
guacuuaccugcaccugaa

SEQ ID NO: 242693 - RNA, 19 nt, Homo sapiens
gaacucuccuguccaaaug

SEQ ID NO: 242694 - RNA, 19 nt, Homo sapiens
gggcaucagucaccgguua

SEQ ID NO: 242695 - RNA, 19 nt, Homo sapiens
gagaaucuuugcagagaaa

SEQ ID NO: 242696 - RNA, 19 nt, Homo sapiens
gggcugagauuguuacaga

SEQ ID NO: 242697 - RNA, 19 nt, Homo sapiens
gcagaacucuccuguccaa

SEQ ID NO: 242698 - RNA, 19 nt, Homo sapiens
gagaaagugccagaaauua

SEQ ID NO: 242699 - RNA, 19 nt, Homo sapiens
cagaguaccuugucgugua

SEQ ID NO: 242700 - RNA, 19 nt, Homo sapiens
gaaauugaacucuauggaa

SEQ ID NO: 242701 - RNA, 19 nt, Homo sapiens
gagugcagcuuccaagaaa

SEQ ID NO: 242702 - RNA, 19 nt, Homo sapiens
ccaagcaacuucagaaauc

SEQ ID NO: 242703 - RNA, 19 nt, Homo sapiens
cagaggagguuccagauau

SEQ ID NO: 242704 - RNA, 19 nt, Homo sapiens
ugacagaagugacggaaga

SEQ ID NO: 242705 - RNA, 19 nt, Homo sapiens
gagcuuagaggccucauaa

SEQ ID NO: 242706 - RNA, 19 nt, Homo sapiens
ggaagaggcucacaaucuc

SEQ ID NO: 242707 - RNA, 19 nt, Homo sapiens
gcaggugucuuucuugcuu

SEQ ID NO: 242708 - RNA, 19 nt, Homo sapiens
ggacaguaccugauuguau

SEQ ID NO: 242709 - RNA, 19 nt, Homo sapiens
ggacuuaacaggucucaga

SEQ ID NO: 242710 - RNA, 19 nt, Homo sapiens
gaacguaccagggacuuaa

SEQ ID NO: 242711 - RNA, 19 nt, Homo sapiens
ucaaagcagccacucauua

SEQ ID NO: 242712 - RNA, 19 nt, Homo sapiens
ggagacaucuguggaagug

SEQ ID NO: 242713 - RNA, 19 nt, Homo sapiens
ggcauaugcugcuggauuu

SEQ ID NO: 242714 - RNA, 19 nt, Homo sapiens
uuugacagcuuucuaguaa

SEQ ID NO: 242715 - RNA, 19 nt, Homo sapiens
gcaauacuguuuccauuuu

SEQ ID NO: 242716 - RNA, 19 nt, Homo sapiens
gacaacaucgcaauaguuu

SEQ ID NO: 242717 - RNA, 19 nt, Homo sapiens
gagaaaggcagacacaaga

SEQ ID NO: 242718 - RNA, 19 nt, Homo sapiens
caagaaacaccacuuccua

SEQ ID NO: 242719 - RNA, 19 nt, Homo sapiens
gaccagacguccaccauca

SEQ ID NO: 242720 - RNA, 19 nt, Homo sapiens
gacgaugcguggagaauga

SEQ ID NO: 242721 - RNA, 19 nt, Homo sapiens
caacugauuugaagucuac

SEQ ID NO: 242722 - RNA, 19 nt, Homo sapiens
uaacuggcauuggcuauga

SEQ ID NO: 242723 - RNA, 19 nt, Homo sapiens
caaagcagccacucauuau

SEQ ID NO: 242724 - RNA, 19 nt, Homo sapiens
aggcagcuauugacaguua

SEQ ID NO: 242725 - RNA, 19 nt, Homo sapiens
gaaagugccagaaauuaca

SEQ ID NO: 242726 - RNA, 19 nt, Homo sapiens
gcgagaaagugccagaaau

SEQ ID NO: 242727 - RNA, 19 nt, Homo sapiens
gguacacccuccaugguaa

SEQ ID NO: 242728 - RNA, 19 nt, Homo sapiens
uaauaucucuggugcugaa

SEQ ID NO: 242729 - RNA, 19 nt, Homo sapiens
aaagagaccuucacaacag

SEQ ID NO: 242730 - RNA, 19 nt, Homo sapiens
gugaauggcauguguguuu

SEQ ID NO: 242731 - RNA, 19 nt, Homo sapiens
gagcucaagugucccaaug

SEQ ID NO: 242732 - RNA, 19 nt, Homo sapiens
ggcauuggcuaugagguua

SEQ ID NO: 242733 - RNA, 19 nt, Homo sapiens
uggagacuguggaauauaa

SEQ ID NO: 242734 - RNA, 19 nt, Homo sapiens
gcaagaguaugagauaucu

SEQ ID NO: 242735 - RNA, 19 nt, Homo sapiens
gcaacaagccucugugucu

SEQ ID NO: 242736 - RNA, 19 nt, Homo sapiens
gcgcaaacgggcauaaauu

SEQ ID NO: 242737 - RNA, 19 nt, Homo sapiens
gauuugaagucuacucugu

SEQ ID NO: 242738 - RNA, 19 nt, Homo sapiens
gaaacaccacuuccuaugu

SEQ ID NO: 242739 - RNA, 19 nt, Homo sapiens
caaggcagcuauugacagu

SEQ ID NO: 242740 - RNA, 19 nt, Homo sapiens
gagcugcccuaaugacugu

SEQ ID NO: 242741 - RNA, 19 nt, Homo sapiens
acaguuaugucaucuccua

SEQ ID NO: 242742 - RNA, 19 nt, Homo sapiens
gaauaugggauuggaguuu

SEQ ID NO: 242743 - RNA, 19 nt, Homo sapiens
aaacauuucuggacaguac

SEQ ID NO: 242744 - RNA, 19 nt, Homo sapiens
gcaauaugauccagaccau

SEQ ID NO: 242745 - RNA, 19 nt, Homo sapiens
cgagaaagugccagaaauu

SEQ ID NO: 242746 - RNA, 19 nt, Homo sapiens
guacagggguaguuuguuu

SEQ ID NO: 242747 - RNA, 19 nt, Homo sapiens
gaaggcauccacugaacaa

SEQ ID NO: 242748 - RNA, 19 nt, Homo sapiens
agacaccguuggccaaauu

SEQ ID NO: 242749 - RNA, 19 nt, Homo sapiens
cagauugucuucacacauc

SEQ ID NO: 242750 - RNA, 19 nt, Homo sapiens
gcagauccuucuccaccuu

SEQ ID NO: 242751 - RNA, 19 nt, Homo sapiens
cagagaggcuacugaauac

SEQ ID NO: 242752 - RNA, 19 nt, Homo sapiens
gaaugccuuugacagcuuu

SEQ ID NO: 242753 - RNA, 19 nt, Homo sapiens
ugaacgaacugcccauauc

SEQ ID NO: 242754 - RNA, 19 nt, Homo sapiens
gcuggagacuguggaauau

SEQ ID NO: 242755 - RNA, 19 nt, Homo sapiens
caaagagaccuucacaaca

SEQ ID NO: 242756 - RNA, 19 nt, Homo sapiens
gagcugaccuacggcauca

SEQ ID NO: 242757 - RNA, 19 nt, Homo sapiens
ggaguacuuuauccgugua

SEQ ID NO: 242758 - RNA, 19 nt, Homo sapiens
ucaagaagaucagggacaa

SEQ ID NO: 242759 - RNA, 19 nt, Homo sapiens
gcaaagauuaaauguguca

SEQ ID NO: 242760 - RNA, 19 nt, Homo sapiens
gaauacacacugagaaucu

SEQ ID NO: 242761 - RNA, 19 nt, Homo sapiens
ggaccacgcugagguugau

SEQ ID NO: 242762 - RNA, 19 nt, Homo sapiens
gcauguguguuugugauga

SEQ ID NO: 242763 - RNA, 19 nt, Homo sapiens
aagcaauacuguuuccauu

SEQ ID NO: 242764 - RNA, 19 nt, Homo sapiens
ggccaugacucagcuguug

SEQ ID NO: 242765 - RNA, 19 nt, Homo sapiens
gaauucacacuuucaggaa

SEQ ID NO: 242766 - RNA, 19 nt, Homo sapiens
aaacaccacuuccuauguc

SEQ ID NO: 242767 - RNA, 19 nt, Homo sapiens
ggagugggauccucuagac

SEQ ID NO: 242768 - RNA, 19 nt, Homo sapiens
gaauggagucugcaucugu

SEQ ID NO: 242769 - RNA, 19 nt, Homo sapiens
uggagaaccuggugucuuc

SEQ ID NO: 242770 - RNA, 19 nt, Homo sapiens
uaccaaagcaucaauacaa

SEQ ID NO: 242771 - RNA, 19 nt, Homo sapiens
ggaacacaguggaguaugc

SEQ ID NO: 242772 - RNA, 19 nt, Homo sapiens
gggaugcccucaaacucaa

SEQ ID NO: 242773 - RNA, 19 nt, Homo sapiens
ggagugcagcuuccaagaa

SEQ ID NO: 242774 - RNA, 19 nt, Homo sapiens
ccaacaagccacaaccaaa

SEQ ID NO: 242775 - RNA, 19 nt, Homo sapiens
gaaauucaaguccaucaag

SEQ ID NO: 242776 - RNA, 19 nt, Homo sapiens
guacuuuauccguguauuu

SEQ ID NO: 242777 - RNA, 19 nt, Homo sapiens
ccaauucugcugaaaguga

SEQ ID NO: 242778 - RNA, 19 nt, Homo sapiens
ggagauauggggacaauaa

SEQ ID NO: 242779 - RNA, 19 nt, Homo sapiens
ggaaagugaaccugucuca

SEQ ID NO: 242780 - RNA, 19 nt, Homo sapiens
ggacaacugauuugaaguc

SEQ ID NO: 242781 - RNA, 19 nt, Homo sapiens
gaacgaacugcccauaucu

SEQ ID NO: 242782 - RNA, 19 nt, Homo sapiens
gcuguuggcaggugucuuu

SEQ ID NO: 242783 - RNA, 19 nt, Homo sapiens
gaagacaccguuggccaaa

SEQ ID NO: 242784 - RNA, 19 nt, Homo sapiens
ggaacugaauaugggauug

SEQ ID NO: 242785 - RNA, 19 nt, Homo sapiens
gcacacacaugcauacuua

SEQ ID NO: 242786 - RNA, 19 nt, Homo sapiens
gagcagcgguggauuaaug

SEQ ID NO: 242787 - RNA, 19 nt, Homo sapiens
ucaaauacaugcacaguca

SEQ ID NO: 242788 - RNA, 19 nt, Homo sapiens
caggaaauuuggaggauaa

SEQ ID NO: 242789 - RNA, 19 nt, Homo sapiens
cuacaacuaugacuuucua

SEQ ID NO: 242790 - RNA, 19 nt, Homo sapiens
acacugaguugcacauauu

SEQ ID NO: 242791 - RNA, 19 nt, Homo sapiens
gcaccaguccagcaaauaa

SEQ ID NO: 242792 - RNA, 19 nt, Homo sapiens
ggaagagcauguggugauu

SEQ ID NO: 242793 - RNA, 19 nt, Homo sapiens
gcaaauaaagcagucauga

SEQ ID NO: 242794 - RNA, 19 nt, Homo sapiens
ggccagggcuuccucaaau

SEQ ID NO: 242795 - RNA, 19 nt, Homo sapiens
gaacugcagcaaucacaaa

SEQ ID NO: 242796 - RNA, 19 nt, Homo sapiens
ggaagucacagauguaugu

SEQ ID NO: 242797 - RNA, 19 nt, Homo sapiens
ucacaaaggcugacauuca

SEQ ID NO: 242798 - RNA, 19 nt, Homo sapiens
gcaaggucauagacaauuc

SEQ ID NO: 242799 - RNA, 19 nt, Homo sapiens
gcacauauugagaaccuaa

SEQ ID NO: 242800 - RNA, 19 nt, Homo sapiens
guccagaucuucuaugaca

SEQ ID NO: 242801 - RNA, 19 nt, Homo sapiens
ccagagcagcgguggauua

SEQ ID NO: 242802 - RNA, 19 nt, Homo sapiens
gccagggcuuccucaaaua

SEQ ID NO: 242803 - RNA, 19 nt, Homo sapiens
gaaccaaggaaucauguca

SEQ ID NO: 242804 - RNA, 19 nt, Homo sapiens
uauguggacuuauucauuc

SEQ ID NO: 242805 - RNA, 19 nt, Homo sapiens
cgauauggcccaaggcuuu

SEQ ID NO: 242806 - RNA, 19 nt, Homo sapiens
gacaauuccuccagagaca

SEQ ID NO: 242807 - RNA, 19 nt, Homo sapiens
cauauucccugcacacaca

SEQ ID NO: 242808 - RNA, 19 nt, Homo sapiens
acacaugcauacuuacaga

SEQ ID NO: 242809 - RNA, 19 nt, Homo sapiens
acaaugaggcuaugaggaa

SEQ ID NO: 242810 - RNA, 19 nt, Homo sapiens
agacuggaauaguggcaua

SEQ ID NO: 242811 - RNA, 19 nt, Homo sapiens
gcacagggaagucacagau

SEQ ID NO: 242812 - RNA, 19 nt, Homo sapiens
caaugaggcuaugaggaaa

SEQ ID NO: 242813 - RNA, 19 nt, Homo sapiens
caagucauggucacaguaa

SEQ ID NO: 242814 - RNA, 19 nt, Homo sapiens
caggauuucugguggaaga

SEQ ID NO: 242815 - RNA, 19 nt, Homo sapiens
gauauggcccaaggcuuua

SEQ ID NO: 242816 - RNA, 19 nt, Homo sapiens
ucaggaaauuuggaggaua

SEQ ID NO: 242817 - RNA, 19 nt, Homo sapiens
cagcagacaccauucauuc

SEQ ID NO: 242818 - RNA, 19 nt, Homo sapiens
uuccugaccuuacucgaua

SEQ ID NO: 242819 - RNA, 19 nt, Homo sapiens
caaauaaagcagucaugau

SEQ ID NO: 242820 - RNA, 19 nt, Homo sapiens
ggaugucagugucuucgau

SEQ ID NO: 242821 - RNA, 19 nt, Homo sapiens
acagggaagucacagaugu

SEQ ID NO: 242822 - RNA, 19 nt, Homo sapiens
cagaaugccagccugauug

SEQ ID NO: 242823 - RNA, 19 nt, Homo sapiens
gucaggccaucaaggagua

SEQ ID NO: 242824 - RNA, 19 nt, Homo sapiens
caagaaccaaggaaucaug

SEQ ID NO: 242825 - RNA, 19 nt, Homo sapiens
aaauacaugcacagucaua

SEQ ID NO: 242826 - RNA, 19 nt, Homo sapiens
gugauuggccacacacuga

SEQ ID NO: 242827 - RNA, 19 nt, Homo sapiens
gcccuucucugcagucaag

SEQ ID NO: 242828 - RNA, 19 nt, Homo sapiens
gggacaccaaggacauuua

SEQ ID NO: 242829 - RNA, 19 nt, Homo sapiens
ccagaaugccagccugauu

SEQ ID NO: 242830 - RNA, 19 nt, Homo sapiens
gcccugacaugacaauuuu

SEQ ID NO: 242831 - RNA, 19 nt, Homo sapiens
aagcagucaugauuuacuu

SEQ ID NO: 242832 - RNA, 19 nt, Homo sapiens
gcacagucauacaagucau

SEQ ID NO: 242833 - RNA, 19 nt, Homo sapiens
gaagagcauguggugauug

SEQ ID NO: 242834 - RNA, 19 nt, Homo sapiens
ugacacgacaaaccacuuu

SEQ ID NO: 242835 - RNA, 19 nt, Homo sapiens
cccugcaggucaauguuua

SEQ ID NO: 242836 - RNA, 19 nt, Homo sapiens
ggcccugacaugacaauuu

SEQ ID NO: 242837 - RNA, 19 nt, Homo sapiens
cagagcagcgguggauuaa

SEQ ID NO: 242838 - RNA, 19 nt, Homo sapiens
cuacugaguuugugguaac

SEQ ID NO: 242839 - RNA, 19 nt, Homo sapiens
gaggcuaugaggaaacuga

SEQ ID NO: 242840 - RNA, 19 nt, Homo sapiens
cacaaaggcugacauucac

SEQ ID NO: 242841 - RNA, 19 nt, Homo sapiens
ggguugaccuguccuuggu

SEQ ID NO: 242842 - RNA, 19 nt, Homo sapiens
gaguugcacauauugagaa

SEQ ID NO: 242843 - RNA, 19 nt, Homo sapiens
gcagacaccauucauucca

SEQ ID NO: 242844 - RNA, 19 nt, Homo sapiens
cacacugaguugcacauau

SEQ ID NO: 242845 - RNA, 19 nt, Homo sapiens
ugggugagcugggaaaaua

SEQ ID NO: 242846 - RNA, 19 nt, Homo sapiens
guccauaugcaucuacuug

SEQ ID NO: 242847 - RNA, 19 nt, Homo sapiens
ccacagcagacaccauuca

SEQ ID NO: 242848 - RNA, 19 nt, Homo sapiens
gcauaaggaguuagaacca

SEQ ID NO: 242849 - RNA, 19 nt, Homo sapiens
aauaguggcauaaggaguu

SEQ ID NO: 242850 - RNA, 19 nt, Homo sapiens
cuuacagacuggaauagug

SEQ ID NO: 242851 - RNA, 19 nt, Homo sapiens
auacuuacagacuggaaua

SEQ ID NO: 242852 - RNA, 19 nt, Homo sapiens
gcuguggaguucaaauguc

SEQ ID NO: 242853 - RNA, 19 nt, Homo sapiens
caacuaugacuuucuaagc

SEQ ID NO: 242854 - RNA, 19 nt, Homo sapiens
ggacaccaaggacauuuac

SEQ ID NO: 242855 - RNA, 19 nt, Homo sapiens
cauaccugcuccugacuuc

SEQ ID NO: 242856 - RNA, 19 nt, Homo sapiens
ucuuugaacugcagcaauc

SEQ ID NO: 242857 - RNA, 19 nt, Homo sapiens
auaguggcauaaggaguua

SEQ ID NO: 242858 - RNA, 19 nt, Homo sapiens
aaagcccuccuccuccuua

SEQ ID NO: 242859 - RNA, 19 nt, Homo sapiens
ggcaaggucauagacaauu

SEQ ID NO: 242860 - RNA, 19 nt, Homo sapiens
ccuuaacccugccaguuuc

SEQ ID NO: 242861 - RNA, 19 nt, Homo sapiens
cagggaagucacagaugua

SEQ ID NO: 242862 - RNA, 19 nt, Homo sapiens
ucucagggcuggcagucau

SEQ ID NO: 242863 - RNA, 19 nt, Homo sapiens
ccacucuucccagaacaua

SEQ ID NO: 242864 - RNA, 19 nt, Homo sapiens
cggaagagcauguggugau

SEQ ID NO: 242865 - RNA, 19 nt, Homo sapiens
aggaguauauggacacuac

SEQ ID NO: 242866 - RNA, 19 nt, Homo sapiens
ggaaucggagacuuugcaa

SEQ ID NO: 242867 - RNA, 19 nt, Homo sapiens
cugcuacaacuaugacuuu

SEQ ID NO: 242868 - RNA, 19 nt, Homo sapiens
gcccuugcacuccuacuga

SEQ ID NO: 242869 - RNA, 19 nt, Homo sapiens
uaagcacguugcccaaggu

SEQ ID NO: 242870 - RNA, 19 nt, Homo sapiens
aaucacaaaggcugacauu

SEQ ID NO: 242871 - RNA, 19 nt, Homo sapiens
uggaauaguggcauaagga

SEQ ID NO: 242872 - RNA, 19 nt, Homo sapiens
gcccugcaggucaauguuu

SEQ ID NO: 242873 - RNA, 19 nt, Homo sapiens
caugucaggccaucaagga

SEQ ID NO: 242874 - RNA, 19 nt, Homo sapiens
uacaagaaccaaggaauca

SEQ ID NO: 242875 - RNA, 19 nt, Homo sapiens
aggcacagcacccugauug

SEQ ID NO: 242876 - RNA, 19 nt, Homo sapiens
ccuacugaguuugugguaa

SEQ ID NO: 242877 - RNA, 19 nt, Homo sapiens
aggcugacauucacugagu

SEQ ID NO: 242878 - RNA, 19 nt, Homo sapiens
ggugugagcggaagagcau

SEQ ID NO: 242879 - RNA, 19 nt, Homo sapiens
ucccagaacauaugucaug

SEQ ID NO: 242880 - RNA, 19 nt, Homo sapiens
cagccacucuucccagaac

SEQ ID NO: 242881 - RNA, 19 nt, Homo sapiens
caccaguccagcaaauaaa

SEQ ID NO: 242882 - RNA, 19 nt, Homo sapiens
gggaaucggagacuuugca

SEQ ID NO: 242883 - RNA, 19 nt, Homo sapiens
cauaugucauggccucagu

SEQ ID NO: 242884 - RNA, 19 nt, Homo sapiens
cuuauucauuccucacaau

SEQ ID NO: 242885 - RNA, 19 nt, Homo sapiens
gcacacacaugcauacuua

SEQ ID NO: 242886 - RNA, 19 nt, Homo sapiens
ucaaauacaugcacaguca

SEQ ID NO: 242887 - RNA, 19 nt, Homo sapiens
caggaaauuuggaggauaa

SEQ ID NO: 242888 - RNA, 19 nt, Homo sapiens
cuacaacuaugacuuucua

SEQ ID NO: 242889 - RNA, 19 nt, Homo sapiens
acacugaguugcacauauu

SEQ ID NO: 242890 - RNA, 19 nt, Homo sapiens
gcaccaguccagcaaauaa

SEQ ID NO: 242891 - RNA, 19 nt, Homo sapiens
ggaagagcauguggugauu

SEQ ID NO: 242892 - RNA, 19 nt, Homo sapiens
gcaaauaaagcagucauga

SEQ ID NO: 242893 - RNA, 19 nt, Homo sapiens
ggccagggcuuccucaaau

SEQ ID NO: 242894 - RNA, 19 nt, Homo sapiens
gaacugcagcaaucacaaa

SEQ ID NO: 242895 - RNA, 19 nt, Homo sapiens
ggaagucacagauguaugu

SEQ ID NO: 242896 - RNA, 19 nt, Homo sapiens
ucacaaaggcugacauuca

SEQ ID NO: 242897 - RNA, 19 nt, Homo sapiens
gcaaggucauagacaauuc

SEQ ID NO: 242898 - RNA, 19 nt, Homo sapiens
gcacauauugagaaccuaa

SEQ ID NO: 242899 - RNA, 19 nt, Homo sapiens
guccagaucuucuaugaca

SEQ ID NO: 242900 - RNA, 19 nt, Homo sapiens
gccagggcuuccucaaaua

SEQ ID NO: 242901 - RNA, 19 nt, Homo sapiens
gaaccaaggaaucauguca

SEQ ID NO: 242902 - RNA, 19 nt, Homo sapiens
gcagucaugauuuacuuaa

SEQ ID NO: 242903 - RNA, 19 nt, Homo sapiens
uauguggacuuauucauuc

SEQ ID NO: 242904 - RNA, 19 nt, Homo sapiens
cgauauggcccaaggcuuu

SEQ ID NO: 242905 - RNA, 19 nt, Homo sapiens
gacaauuccuccagagaca

SEQ ID NO: 242906 - RNA, 19 nt, Homo sapiens
cauauucccugcacacaca

SEQ ID NO: 242907 - RNA, 19 nt, Homo sapiens
acacaugcauacuuacaga

SEQ ID NO: 242908 - RNA, 19 nt, Homo sapiens
acaaugaggcuaugaggaa

SEQ ID NO: 242909 - RNA, 19 nt, Homo sapiens
agacuggaauaguggcaua

SEQ ID NO: 242910 - RNA, 19 nt, Homo sapiens
gcacagggaagucacagau

SEQ ID NO: 242911 - RNA, 19 nt, Homo sapiens
caaugaggcuaugaggaaa

SEQ ID NO: 242912 - RNA, 19 nt, Homo sapiens
caagucauggucacaguaa

SEQ ID NO: 242913 - RNA, 19 nt, Homo sapiens
gauauggcccaaggcuuua

SEQ ID NO: 242914 - RNA, 19 nt, Homo sapiens
cagcagacaccauucauuc

SEQ ID NO: 242915 - RNA, 19 nt, Homo sapiens
uuccugaccuuacucgaua

SEQ ID NO: 242916 - RNA, 19 nt, Homo sapiens
ucaggaaauuuggaggaua

SEQ ID NO: 242917 - RNA, 19 nt, Homo sapiens
caaauaaagcagucaugau

SEQ ID NO: 242918 - RNA, 19 nt, Homo sapiens
ggaugucagugucuucgau

SEQ ID NO: 242919 - RNA, 19 nt, Homo sapiens
acagggaagucacagaugu

SEQ ID NO: 242920 - RNA, 19 nt, Homo sapiens
cagaaugccagccugauug

SEQ ID NO: 242921 - RNA, 19 nt, Homo sapiens
gucaggccaucaaggagua

SEQ ID NO: 242922 - RNA, 19 nt, Homo sapiens
caagaaccaaggaaucaug

SEQ ID NO: 242923 - RNA, 19 nt, Homo sapiens
aaauacaugcacagucaua

SEQ ID NO: 242924 - RNA, 19 nt, Homo sapiens
gugauuggccacacacuga

SEQ ID NO: 242925 - RNA, 19 nt, Homo sapiens
gcccuucucugcagucaag

SEQ ID NO: 242926 - RNA, 19 nt, Homo sapiens
gggacaccaaggacauuua

SEQ ID NO: 242927 - RNA, 19 nt, Homo sapiens
ccagaaugccagccugauu

SEQ ID NO: 242928 - RNA, 19 nt, Homo sapiens
gcccugacaugacaauuuu

SEQ ID NO: 242929 - RNA, 19 nt, Homo sapiens
aagcagucaugauuuacuu

SEQ ID NO: 242930 - RNA, 19 nt, Homo sapiens
gcacagucauacaagucau

SEQ ID NO: 242931 - RNA, 19 nt, Homo sapiens
gaagagcauguggugauug

SEQ ID NO: 242932 - RNA, 19 nt, Homo sapiens
ugacacgacaaaccacuuu

SEQ ID NO: 242933 - RNA, 19 nt, Homo sapiens
ggcccugacaugacaauuu

SEQ ID NO: 242934 - RNA, 19 nt, Homo sapiens
cuacugaguuugugguaac

SEQ ID NO: 242935 - RNA, 19 nt, Homo sapiens
gaggcuaugaggaaacuga

SEQ ID NO: 242936 - RNA, 19 nt, Homo sapiens
cacaaaggcugacauucac

SEQ ID NO: 242937 - RNA, 19 nt, Homo sapiens
gaguugcacauauugagaa

SEQ ID NO: 242938 - RNA, 19 nt, Homo sapiens
gcagacaccauucauucca

SEQ ID NO: 242939 - RNA, 19 nt, Homo sapiens
cacacugaguugcacauau

SEQ ID NO: 242940 - RNA, 19 nt, Homo sapiens
ugggugagcugggaaaaua

SEQ ID NO: 242941 - RNA, 19 nt, Homo sapiens
guccauaugcaucuacuug

SEQ ID NO: 242942 - RNA, 19 nt, Homo sapiens
ccacagcagacaccauuca

SEQ ID NO: 242943 - RNA, 19 nt, Homo sapiens
gcauaaggaguuagaacca

SEQ ID NO: 242944 - RNA, 19 nt, Homo sapiens
aauaguggcauaaggaguu

SEQ ID NO: 242945 - RNA, 19 nt, Homo sapiens
cuuacagacuggaauagug

SEQ ID NO: 242946 - RNA, 19 nt, Homo sapiens
auacuuacagacuggaaua

SEQ ID NO: 242947 - RNA, 19 nt, Homo sapiens
gcuguggaguucaaauguc

SEQ ID NO: 242948 - RNA, 19 nt, Homo sapiens
caacuaugacuuucuaagc

SEQ ID NO: 242949 - RNA, 19 nt, Homo sapiens
ggacaccaaggacauuuac

SEQ ID NO: 242950 - RNA, 19 nt, Homo sapiens
cauaccugcuccugacuuc

SEQ ID NO: 242951 - RNA, 19 nt, Homo sapiens
ucuuugaacugcagcaauc

SEQ ID NO: 242952 - RNA, 19 nt, Homo sapiens
auaguggcauaaggaguua

SEQ ID NO: 242953 - RNA, 19 nt, Homo sapiens
aaagcccuccuccuccuua

SEQ ID NO: 242954 - RNA, 19 nt, Homo sapiens
ggcaaggucauagacaauu

SEQ ID NO: 242955 - RNA, 19 nt, Homo sapiens
ccuuaacccugccaguuuc

SEQ ID NO: 242956 - RNA, 19 nt, Homo sapiens
cagggaagucacagaugua

SEQ ID NO: 242957 - RNA, 19 nt, Homo sapiens
ucucagggcuggcagucau

SEQ ID NO: 242958 - RNA, 19 nt, Homo sapiens
cggaagagcauguggugau

SEQ ID NO: 242959 - RNA, 19 nt, Homo sapiens
aggaguauauggacacuac

SEQ ID NO: 242960 - RNA, 19 nt, Homo sapiens
cugcuacaacuaugacuuu

SEQ ID NO: 242961 - RNA, 19 nt, Homo sapiens
gcccuugcacuccuacuga

SEQ ID NO: 242962 - RNA, 19 nt, Homo sapiens
uaagcacguugcccaaggu

SEQ ID NO: 242963 - RNA, 19 nt, Homo sapiens
aaucacaaaggcugacauu

SEQ ID NO: 242964 - RNA, 19 nt, Homo sapiens
uggaauaguggcauaagga

SEQ ID NO: 242965 - RNA, 19 nt, Homo sapiens
caugucaggccaucaagga

SEQ ID NO: 242966 - RNA, 19 nt, Homo sapiens
uacaagaaccaaggaauca

SEQ ID NO: 242967 - RNA, 19 nt, Homo sapiens
aggcacagcacccugauug

SEQ ID NO: 242968 - RNA, 19 nt, Homo sapiens
ccuacugaguuugugguaa

SEQ ID NO: 242969 - RNA, 19 nt, Homo sapiens
aggcugacauucacugagu

SEQ ID NO: 242970 - RNA, 19 nt, Homo sapiens
ggugugagcggaagagcau

SEQ ID NO: 242971 - RNA, 19 nt, Homo sapiens
caccaguccagcaaauaaa

SEQ ID NO: 242972 - RNA, 19 nt, Homo sapiens
cuuauucauuccucacaau

SEQ ID NO: 242973 - RNA, 19 nt, Homo sapiens
aaccacagcagacaccauu

SEQ ID NO: 242974 - RNA, 19 nt, Homo sapiens
acacucagccacugucaca

SEQ ID NO: 242975 - RNA, 19 nt, Homo sapiens
aagagcauguggugauugg

SEQ ID NO: 242976 - RNA, 19 nt, Homo sapiens
ugccggugcugcccuaugu

SEQ ID NO: 242977 - RNA, 19 nt, Homo sapiens
cagacaccauucauuccau

SEQ ID NO: 242978 - RNA, 19 nt, Homo sapiens
ggagggcacagggaaguca

SEQ ID NO: 242979 - RNA, 19 nt, Homo sapiens
gucaggaaauuuggaggau

SEQ ID NO: 242980 - RNA, 19 nt, Homo sapiens
acaagucauggucacagua

SEQ ID NO: 242981 - RNA, 19 nt, Homo sapiens
caugcacagucauacaagu

SEQ ID NO: 242982 - RNA, 19 nt, Homo sapiens
ggcaccaguccagcaaaua

SEQ ID NO: 242983 - RNA, 19 nt, Homo sapiens
ccauguccauaugcaucua

SEQ ID NO: 242984 - RNA, 19 nt, Homo sapiens
gaaccacagcagacaccau

SEQ ID NO: 242985 - RNA, 19 nt, Homo sapiens
gcacacacaugcauacuua

SEQ ID NO: 242986 - RNA, 19 nt, Homo sapiens
ucaaauacaugcacaguca

SEQ ID NO: 242987 - RNA, 19 nt, Homo sapiens
cuacaacuaugacuuucua

SEQ ID NO: 242988 - RNA, 19 nt, Homo sapiens
acacugaguugcacauauu

SEQ ID NO: 242989 - RNA, 19 nt, Homo sapiens
gcaccaguccagcaaauaa

SEQ ID NO: 242990 - RNA, 19 nt, Homo sapiens
ggaagagcauguggugauu

SEQ ID NO: 242991 - RNA, 19 nt, Homo sapiens
gcaaauaaagcagucauga

SEQ ID NO: 242992 - RNA, 19 nt, Homo sapiens
ggccagggcuuccucaaau

SEQ ID NO: 242993 - RNA, 19 nt, Homo sapiens
gaacugcagcaaucacaaa

SEQ ID NO: 242994 - RNA, 19 nt, Homo sapiens
ggaagucacagauguaugu

SEQ ID NO: 242995 - RNA, 19 nt, Homo sapiens
ucacaaaggcugacauuca

SEQ ID NO: 242996 - RNA, 19 nt, Homo sapiens
gcaaggucauagacaauuc

SEQ ID NO: 242997 - RNA, 19 nt, Homo sapiens
gaaaagauccacgaaagua

SEQ ID NO: 242998 - RNA, 19 nt, Homo sapiens
gcacauauugagaaccuaa

SEQ ID NO: 242999 - RNA, 19 nt, Homo sapiens
guccagaucuucuaugaca

SEQ ID NO: 243000 - RNA, 19 nt, Homo sapiens
gagaagcuagucuugaauu

SEQ ID NO: 243001 - RNA, 19 nt, Homo sapiens
gccagggcuuccucaaaua

SEQ ID NO: 243002 - RNA, 19 nt, Homo sapiens
gcagccacguggacaaaga

SEQ ID NO: 243003 - RNA, 19 nt, Homo sapiens
gaaccaaggaaucauguca

SEQ ID NO: 243004 - RNA, 19 nt, Homo sapiens
gcagucaugauuuacuuaa

SEQ ID NO: 243005 - RNA, 19 nt, Homo sapiens
uauguggacuuauucauuc

SEQ ID NO: 243006 - RNA, 19 nt, Homo sapiens
cgauauggcccaaggcuuu

SEQ ID NO: 243007 - RNA, 19 nt, Homo sapiens
gacaauuccuccagagaca

SEQ ID NO: 243008 - RNA, 19 nt, Homo sapiens
cugagaagcuagucuugaa

SEQ ID NO: 243009 - RNA, 19 nt, Homo sapiens
ccaaagugcugggauuaca

SEQ ID NO: 243010 - RNA, 19 nt, Homo sapiens
cauauucccugcacacaca

SEQ ID NO: 243011 - RNA, 19 nt, Homo sapiens
acacaugcauacuuacaga

SEQ ID NO: 243012 - RNA, 19 nt, Homo sapiens
gagcacaagacacgaaaga

SEQ ID NO: 243013 - RNA, 19 nt, Homo sapiens
gaacacucccugagcacaa

SEQ ID NO: 243014 - RNA, 19 nt, Homo sapiens
acaaugaggcuaugaggaa

SEQ ID NO: 243015 - RNA, 19 nt, Homo sapiens
agacuggaauaguggcaua

SEQ ID NO: 243016 - RNA, 19 nt, Homo sapiens
gcacagggaagucacagau

SEQ ID NO: 243017 - RNA, 19 nt, Homo sapiens
caaugaggcuaugaggaaa

SEQ ID NO: 243018 - RNA, 19 nt, Homo sapiens
caagucauggucacaguaa

SEQ ID NO: 243019 - RNA, 19 nt, Homo sapiens
gauauggcccaaggcuuua

SEQ ID NO: 243020 - RNA, 19 nt, Homo sapiens
cagcagacaccauucauuc

SEQ ID NO: 243021 - RNA, 19 nt, Homo sapiens
uuccugaccuuacucgaua

SEQ ID NO: 243022 - RNA, 19 nt, Homo sapiens
gcacaagacacgaaagaac

SEQ ID NO: 243023 - RNA, 19 nt, Homo sapiens
caaauaaagcagucaugau

SEQ ID NO: 243024 - RNA, 19 nt, Homo sapiens
ggaugucagugucuucgau

SEQ ID NO: 243025 - RNA, 19 nt, Homo sapiens
acagggaagucacagaugu

SEQ ID NO: 243026 - RNA, 19 nt, Homo sapiens
cagaaugccagccugauug

SEQ ID NO: 243027 - RNA, 19 nt, Homo sapiens
aaagauccacgaaaguaaa

SEQ ID NO: 243028 - RNA, 19 nt, Homo sapiens
gucaggccaucaaggagua

SEQ ID NO: 243029 - RNA, 19 nt, Homo sapiens
caagaaccaaggaaucaug

SEQ ID NO: 243030 - RNA, 19 nt, Homo sapiens
aaauacaugcacagucaua

SEQ ID NO: 243031 - RNA, 19 nt, Homo sapiens
gugauuggccacacacuga

SEQ ID NO: 243032 - RNA, 19 nt, Homo sapiens
gcccuucucugcagucaag

SEQ ID NO: 243033 - RNA, 19 nt, Homo sapiens
gggacaccaaggacauuua

SEQ ID NO: 243034 - RNA, 19 nt, Homo sapiens
ccagaaugccagccugauu

SEQ ID NO: 243035 - RNA, 19 nt, Homo sapiens
gcccugacaugacaauuuu

SEQ ID NO: 243036 - RNA, 19 nt, Homo sapiens
aagcagucaugauuuacuu

SEQ ID NO: 243037 - RNA, 19 nt, Homo sapiens
gcacagucauacaagucau

SEQ ID NO: 243038 - RNA, 19 nt, Homo sapiens
gaagagcauguggugauug

SEQ ID NO: 243039 - RNA, 19 nt, Homo sapiens
ugacacgacaaaccacuuu

SEQ ID NO: 243040 - RNA, 19 nt, Homo sapiens
ggcccugacaugacaauuu

SEQ ID NO: 243041 - RNA, 19 nt, Homo sapiens
cuacugaguuugugguaac

SEQ ID NO: 243042 - RNA, 19 nt, Homo sapiens
gaggcuaugaggaaacuga

SEQ ID NO: 243043 - RNA, 19 nt, Homo sapiens
cacaaaggcugacauucac

SEQ ID NO: 243044 - RNA, 19 nt, Homo sapiens
gaguugcacauauugagaa

SEQ ID NO: 243045 - RNA, 19 nt, Homo sapiens
agaagcuagucuugaauuc

SEQ ID NO: 243046 - RNA, 19 nt, Homo sapiens
gcagacaccauucauucca

SEQ ID NO: 243047 - RNA, 19 nt, Homo sapiens
cacacugaguugcacauau

SEQ ID NO: 243048 - RNA, 19 nt, Homo sapiens
ugggugagcugggaaaaua

SEQ ID NO: 243049 - RNA, 19 nt, Homo sapiens
guccauaugcaucuacuug

SEQ ID NO: 243050 - RNA, 19 nt, Homo sapiens
ccacagcagacaccauuca

SEQ ID NO: 243051 - RNA, 19 nt, Homo sapiens
gcauaaggaguuagaacca

SEQ ID NO: 243052 - RNA, 19 nt, Homo sapiens
aauaguggcauaaggaguu

SEQ ID NO: 243053 - RNA, 19 nt, Homo sapiens
cuuacagacuggaauagug

SEQ ID NO: 243054 - RNA, 19 nt, Homo sapiens
auacuuacagacuggaaua

SEQ ID NO: 243055 - RNA, 19 nt, Homo sapiens
gcuguggaguucaaauguc

SEQ ID NO: 243056 - RNA, 19 nt, Homo sapiens
gccuagggcccaucaaugu

SEQ ID NO: 243057 - RNA, 19 nt, Homo sapiens
caacuaugacuuucuaagc

SEQ ID NO: 243058 - RNA, 19 nt, Homo sapiens
ggacaccaaggacauuuac

SEQ ID NO: 243059 - RNA, 19 nt, Homo sapiens
cauaccugcuccugacuuc

SEQ ID NO: 243060 - RNA, 19 nt, Homo sapiens
ucuuugaacugcagcaauc

SEQ ID NO: 243061 - RNA, 19 nt, Homo sapiens
ugacauucuuuacuuacca

SEQ ID NO: 243062 - RNA, 19 nt, Homo sapiens
auaguggcauaaggaguua

SEQ ID NO: 243063 - RNA, 19 nt, Homo sapiens
aaagcccuccuccuccuua

SEQ ID NO: 243064 - RNA, 19 nt, Homo sapiens
ggcaaggucauagacaauu

SEQ ID NO: 243065 - RNA, 19 nt, Homo sapiens
ccuuaacccugccaguuuc

SEQ ID NO: 243066 - RNA, 19 nt, Homo sapiens
cagggaagucacagaugua

SEQ ID NO: 243067 - RNA, 19 nt, Homo sapiens
ucucagggcuggcagucau

SEQ ID NO: 243068 - RNA, 19 nt, Homo sapiens
cggaagagcauguggugau

SEQ ID NO: 243069 - RNA, 19 nt, Homo sapiens
aggaguauauggacacuac

SEQ ID NO: 243070 - RNA, 19 nt, Homo sapiens
cugcuacaacuaugacuuu

SEQ ID NO: 243071 - RNA, 19 nt, Homo sapiens
gcccuugcacuccuacuga

SEQ ID NO: 243072 - RNA, 19 nt, Homo sapiens
uaagcacguugcccaaggu

SEQ ID NO: 243073 - RNA, 19 nt, Homo sapiens
aaucacaaaggcugacauu

SEQ ID NO: 243074 - RNA, 19 nt, Homo sapiens
uggaauaguggcauaagga

SEQ ID NO: 243075 - RNA, 19 nt, Homo sapiens
caugucaggccaucaagga

SEQ ID NO: 243076 - RNA, 19 nt, Homo sapiens
uacaagaaccaaggaauca

SEQ ID NO: 243077 - RNA, 19 nt, Homo sapiens
aggcacagcacccugauug

SEQ ID NO: 243078 - RNA, 19 nt, Homo sapiens
ccuacugaguuugugguaa

SEQ ID NO: 243079 - RNA, 19 nt, Homo sapiens
aggcugacauucacugagu

SEQ ID NO: 243080 - RNA, 19 nt, Homo sapiens
ggugugagcggaagagcau

SEQ ID NO: 243081 - RNA, 19 nt, Homo sapiens
gauccacgaaaguaaagug

SEQ ID NO: 243082 - RNA, 19 nt, Homo sapiens
caccaguccagcaaauaaa

SEQ ID NO: 243083 - RNA, 19 nt, Homo sapiens
cuuauucauuccucacaau

SEQ ID NO: 243084 - RNA, 19 nt, Homo sapiens
aaccacagcagacaccauu

SEQ ID NO: 243085 - RNA, 19 nt, Homo sapiens
gcacacacaugcauacuua

SEQ ID NO: 243086 - RNA, 19 nt, Homo sapiens
ucaaauacaugcacaguca

SEQ ID NO: 243087 - RNA, 19 nt, Homo sapiens
caggaaauuuggaggauaa

SEQ ID NO: 243088 - RNA, 19 nt, Homo sapiens
cuacaacuaugacuuucua

SEQ ID NO: 243089 - RNA, 19 nt, Homo sapiens
acacugaguugcacauauu

SEQ ID NO: 243090 - RNA, 19 nt, Homo sapiens
gcaccaguccagcaaauaa

SEQ ID NO: 243091 - RNA, 19 nt, Homo sapiens
ggaagagcauguggugauu

SEQ ID NO: 243092 - RNA, 19 nt, Homo sapiens
gcaaauaaagcagucauga

SEQ ID NO: 243093 - RNA, 19 nt, Homo sapiens
ggccagggcuuccucaaau

SEQ ID NO: 243094 - RNA, 19 nt, Homo sapiens
gaacugcagcaaucacaaa

SEQ ID NO: 243095 - RNA, 19 nt, Homo sapiens
ggaagucacagauguaugu

SEQ ID NO: 243096 - RNA, 19 nt, Homo sapiens
ucacaaaggcugacauuca

SEQ ID NO: 243097 - RNA, 19 nt, Homo sapiens
gcaaggucauagacaauuc

SEQ ID NO: 243098 - RNA, 19 nt, Homo sapiens
gcacauauugagaaccuaa

SEQ ID NO: 243099 - RNA, 19 nt, Homo sapiens
guccagaucuucuaugaca

SEQ ID NO: 243100 - RNA, 19 nt, Homo sapiens
gccagggcuuccucaaaua

SEQ ID NO: 243101 - RNA, 19 nt, Homo sapiens
gcagucaugauuuacuuaa

SEQ ID NO: 243102 - RNA, 19 nt, Homo sapiens
uauguggacuuauucauuc

SEQ ID NO: 243103 - RNA, 19 nt, Homo sapiens
cgauauggcccaaggcuuu

SEQ ID NO: 243104 - RNA, 19 nt, Homo sapiens
gacaauuccuccagagaca

SEQ ID NO: 243105 - RNA, 19 nt, Homo sapiens
cauauucccugcacacaca

SEQ ID NO: 243106 - RNA, 19 nt, Homo sapiens
acacaugcauacuuacaga

SEQ ID NO: 243107 - RNA, 19 nt, Homo sapiens
acaaugaggcuaugaggaa

SEQ ID NO: 243108 - RNA, 19 nt, Homo sapiens
agacuggaauaguggcaua

SEQ ID NO: 243109 - RNA, 19 nt, Homo sapiens
gcacagggaagucacagau

SEQ ID NO: 243110 - RNA, 19 nt, Homo sapiens
caaugaggcuaugaggaaa

SEQ ID NO: 243111 - RNA, 19 nt, Homo sapiens
caagucauggucacaguaa

SEQ ID NO: 243112 - RNA, 19 nt, Homo sapiens
gauauggcccaaggcuuua

SEQ ID NO: 243113 - RNA, 19 nt, Homo sapiens
cagcagacaccauucauuc

SEQ ID NO: 243114 - RNA, 19 nt, Homo sapiens
ucaggaaauuuggaggaua

SEQ ID NO: 243115 - RNA, 19 nt, Homo sapiens
uuccugaccuuacucgaua

SEQ ID NO: 243116 - RNA, 19 nt, Homo sapiens
caaauaaagcagucaugau

SEQ ID NO: 243117 - RNA, 19 nt, Homo sapiens
ggaugucagugucuucgau

SEQ ID NO: 243118 - RNA, 19 nt, Homo sapiens
acagggaagucacagaugu

SEQ ID NO: 243119 - RNA, 19 nt, Homo sapiens
cagaaugccagccugauug

SEQ ID NO: 243120 - RNA, 19 nt, Homo sapiens
gucaggccaucaaggagua

SEQ ID NO: 243121 - RNA, 19 nt, Homo sapiens
aaauacaugcacagucaua

SEQ ID NO: 243122 - RNA, 19 nt, Homo sapiens
gugauuggccacacacuga

SEQ ID NO: 243123 - RNA, 19 nt, Homo sapiens
gcccuucucugcagucaag

SEQ ID NO: 243124 - RNA, 19 nt, Homo sapiens
gggacaccaaggacauuua

SEQ ID NO: 243125 - RNA, 19 nt, Homo sapiens
ccagaaugccagccugauu

SEQ ID NO: 243126 - RNA, 19 nt, Homo sapiens
gcccugacaugacaauuuu

SEQ ID NO: 243127 - RNA, 19 nt, Homo sapiens
aagcagucaugauuuacuu

SEQ ID NO: 243128 - RNA, 19 nt, Homo sapiens
gcacagucauacaagucau

SEQ ID NO: 243129 - RNA, 19 nt, Homo sapiens
gaagagcauguggugauug

SEQ ID NO: 243130 - RNA, 19 nt, Homo sapiens
ugacacgacaaaccacuuu

SEQ ID NO: 243131 - RNA, 19 nt, Homo sapiens
ggcccugacaugacaauuu

SEQ ID NO: 243132 - RNA, 19 nt, Homo sapiens
cuacugaguuugugguaac

SEQ ID NO: 243133 - RNA, 19 nt, Homo sapiens
gaggcuaugaggaaacuga

SEQ ID NO: 243134 - RNA, 19 nt, Homo sapiens
cacaaaggcugacauucac

SEQ ID NO: 243135 - RNA, 19 nt, Homo sapiens
gaguugcacauauugagaa

SEQ ID NO: 243136 - RNA, 19 nt, Homo sapiens
gcagacaccauucauucca

SEQ ID NO: 243137 - RNA, 19 nt, Homo sapiens
cacacugaguugcacauau

SEQ ID NO: 243138 - RNA, 19 nt, Homo sapiens
guccauaugcaucuacuug

SEQ ID NO: 243139 - RNA, 19 nt, Homo sapiens
ccacagcagacaccauuca

SEQ ID NO: 243140 - RNA, 19 nt, Homo sapiens
gcauaaggaguuagaacca

SEQ ID NO: 243141 - RNA, 19 nt, Homo sapiens
aauaguggcauaaggaguu

SEQ ID NO: 243142 - RNA, 19 nt, Homo sapiens
cuuacagacuggaauagug

SEQ ID NO: 243143 - RNA, 19 nt, Homo sapiens
auacuuacagacuggaaua

SEQ ID NO: 243144 - RNA, 19 nt, Homo sapiens
gcuguggaguucaaauguc

SEQ ID NO: 243145 - RNA, 19 nt, Homo sapiens
caacuaugacuuucuaagc

SEQ ID NO: 243146 - RNA, 19 nt, Homo sapiens
ggacaccaaggacauuuac

SEQ ID NO: 243147 - RNA, 19 nt, Homo sapiens
cauaccugcuccugacuuc

SEQ ID NO: 243148 - RNA, 19 nt, Homo sapiens
ucuuugaacugcagcaauc

SEQ ID NO: 243149 - RNA, 19 nt, Homo sapiens
auaguggcauaaggaguua

SEQ ID NO: 243150 - RNA, 19 nt, Homo sapiens
aaagcccuccuccuccuua

SEQ ID NO: 243151 - RNA, 19 nt, Homo sapiens
ggcaaggucauagacaauu

SEQ ID NO: 243152 - RNA, 19 nt, Homo sapiens
ccuuaacccugccaguuuc

SEQ ID NO: 243153 - RNA, 19 nt, Homo sapiens
cagggaagucacagaugua

SEQ ID NO: 243154 - RNA, 19 nt, Homo sapiens
ucucagggcuggcagucau

SEQ ID NO: 243155 - RNA, 19 nt, Homo sapiens
cggaagagcauguggugau

SEQ ID NO: 243156 - RNA, 19 nt, Homo sapiens
aggaguauauggacacuac

SEQ ID NO: 243157 - RNA, 19 nt, Homo sapiens
cugcuacaacuaugacuuu

SEQ ID NO: 243158 - RNA, 19 nt, Homo sapiens
gcccuugcacuccuacuga

SEQ ID NO: 243159 - RNA, 19 nt, Homo sapiens
uaagcacguugcccaaggu

SEQ ID NO: 243160 - RNA, 19 nt, Homo sapiens
aaucacaaaggcugacauu

SEQ ID NO: 243161 - RNA, 19 nt, Homo sapiens
uggaauaguggcauaagga

SEQ ID NO: 243162 - RNA, 19 nt, Homo sapiens
caugucaggccaucaagga

SEQ ID NO: 243163 - RNA, 19 nt, Homo sapiens
aggcacagcacccugauug

SEQ ID NO: 243164 - RNA, 19 nt, Homo sapiens
ccuacugaguuugugguaa

SEQ ID NO: 243165 - RNA, 19 nt, Homo sapiens
aggcugacauucacugagu

SEQ ID NO: 243166 - RNA, 19 nt, Homo sapiens
ggugugagcggaagagcau

SEQ ID NO: 243167 - RNA, 19 nt, Homo sapiens
caccaguccagcaaauaaa

SEQ ID NO: 243168 - RNA, 19 nt, Homo sapiens
cuuauucauuccucacaau

SEQ ID NO: 243169 - RNA, 19 nt, Homo sapiens
aaccacagcagacaccauu

SEQ ID NO: 243170 - RNA, 19 nt, Homo sapiens
acacucagccacugucaca

SEQ ID NO: 243171 - RNA, 19 nt, Homo sapiens
aagagcauguggugauugg

SEQ ID NO: 243172 - RNA, 19 nt, Homo sapiens
ugccggugcugcccuaugu

SEQ ID NO: 243173 - RNA, 19 nt, Homo sapiens
cagacaccauucauuccau

SEQ ID NO: 243174 - RNA, 19 nt, Homo sapiens
ggagggcacagggaaguca

SEQ ID NO: 243175 - RNA, 19 nt, Homo sapiens
gucaggaaauuuggaggau

SEQ ID NO: 243176 - RNA, 19 nt, Homo sapiens
acaagucauggucacagua

SEQ ID NO: 243177 - RNA, 19 nt, Homo sapiens
caugcacagucauacaagu

SEQ ID NO: 243178 - RNA, 19 nt, Homo sapiens
ggcaccaguccagcaaaua

SEQ ID NO: 243179 - RNA, 19 nt, Homo sapiens
ccauguccauaugcaucua

SEQ ID NO: 243180 - RNA, 19 nt, Homo sapiens
gaaccacagcagacaccau

SEQ ID NO: 243181 - RNA, 19 nt, Homo sapiens
gaguucaaaugucgaugcu

SEQ ID NO: 243182 - RNA, 19 nt, Homo sapiens
ggugcccucucacuugaag

SEQ ID NO: 243183 - RNA, 19 nt, Homo sapiens
aaucaugucaggccaucaa

SEQ ID NO: 243184 - RNA, 19 nt, Homo sapiens
gcacacacaugcauacuua

SEQ ID NO: 243185 - RNA, 19 nt, Homo sapiens
ucaaauacaugcacaguca

SEQ ID NO: 243186 - RNA, 19 nt, Homo sapiens
caggaaauuuggaggauaa

SEQ ID NO: 243187 - RNA, 19 nt, Homo sapiens
cuacaacuaugacuuucua

SEQ ID NO: 243188 - RNA, 19 nt, Homo sapiens
acacugaguugcacauauu

SEQ ID NO: 243189 - RNA, 19 nt, Homo sapiens
gcaccaguccagcaaauaa

SEQ ID NO: 243190 - RNA, 19 nt, Homo sapiens
ggaagagcauguggugauu

SEQ ID NO: 243191 - RNA, 19 nt, Homo sapiens
gcaaauaaagcagucauga

SEQ ID NO: 243192 - RNA, 19 nt, Homo sapiens
ggccagggcuuccucaaau

SEQ ID NO: 243193 - RNA, 19 nt, Homo sapiens
gaacugcagcaaucacaaa

SEQ ID NO: 243194 - RNA, 19 nt, Homo sapiens
ggaagucacagauguaugu

SEQ ID NO: 243195 - RNA, 19 nt, Homo sapiens
ucacaaaggcugacauuca

SEQ ID NO: 243196 - RNA, 19 nt, Homo sapiens
gcaaggucauagacaauuc

SEQ ID NO: 243197 - RNA, 19 nt, Homo sapiens
gcacauauugagaaccuaa

SEQ ID NO: 243198 - RNA, 19 nt, Homo sapiens
guccagaucuucuaugaca

SEQ ID NO: 243199 - RNA, 19 nt, Homo sapiens
gccagggcuuccucaaaua

SEQ ID NO: 243200 - RNA, 19 nt, Homo sapiens
gaaccaaggaaucauguca

SEQ ID NO: 243201 - RNA, 19 nt, Homo sapiens
gcagucaugauuuacuuaa

SEQ ID NO: 243202 - RNA, 19 nt, Homo sapiens
uauguggacuuauucauuc

SEQ ID NO: 243203 - RNA, 19 nt, Homo sapiens
gacaauuccuccagagaca

SEQ ID NO: 243204 - RNA, 19 nt, Homo sapiens
cauauucccugcacacaca

SEQ ID NO: 243205 - RNA, 19 nt, Homo sapiens
acacaugcauacuuacaga

SEQ ID NO: 243206 - RNA, 19 nt, Homo sapiens
acaaugaggcuaugaggaa

SEQ ID NO: 243207 - RNA, 19 nt, Homo sapiens
agacuggaauaguggcaua

SEQ ID NO: 243208 - RNA, 19 nt, Homo sapiens
gcacagggaagucacagau

SEQ ID NO: 243209 - RNA, 19 nt, Homo sapiens
caaugaggcuaugaggaaa

SEQ ID NO: 243210 - RNA, 19 nt, Homo sapiens
caagucauggucacaguaa

SEQ ID NO: 243211 - RNA, 19 nt, Homo sapiens
cagcagacaccauucauuc

SEQ ID NO: 243212 - RNA, 19 nt, Homo sapiens
ucaggaaauuuggaggaua

SEQ ID NO: 243213 - RNA, 19 nt, Homo sapiens
caaauaaagcagucaugau

SEQ ID NO: 243214 - RNA, 19 nt, Homo sapiens
acagggaagucacagaugu

SEQ ID NO: 243215 - RNA, 19 nt, Homo sapiens
gucaggccaucaaggagua

SEQ ID NO: 243216 - RNA, 19 nt, Homo sapiens
caagaaccaaggaaucaug

SEQ ID NO: 243217 - RNA, 19 nt, Homo sapiens
aaauacaugcacagucaua

SEQ ID NO: 243218 - RNA, 19 nt, Homo sapiens
gugauuggccacacacuga

SEQ ID NO: 243219 - RNA, 19 nt, Homo sapiens
gcccuucucugcagucaag

SEQ ID NO: 243220 - RNA, 19 nt, Homo sapiens
gggacaccaaggacauuua

SEQ ID NO: 243221 - RNA, 19 nt, Homo sapiens
aagcagucaugauuuacuu

SEQ ID NO: 243222 - RNA, 19 nt, Homo sapiens
gcacagucauacaagucau

SEQ ID NO: 243223 - RNA, 19 nt, Homo sapiens
gaagagcauguggugauug

SEQ ID NO: 243224 - RNA, 19 nt, Homo sapiens
ugacacgacaaaccacuuu

SEQ ID NO: 243225 - RNA, 19 nt, Homo sapiens
cuacugaguuugugguaac

SEQ ID NO: 243226 - RNA, 19 nt, Homo sapiens
gaggcuaugaggaaacuga

SEQ ID NO: 243227 - RNA, 19 nt, Homo sapiens
cacaaaggcugacauucac

SEQ ID NO: 243228 - RNA, 19 nt, Homo sapiens
gaguugcacauauugagaa

SEQ ID NO: 243229 - RNA, 19 nt, Homo sapiens
gcagacaccauucauucca

SEQ ID NO: 243230 - RNA, 19 nt, Homo sapiens
cacacugaguugcacauau

SEQ ID NO: 243231 - RNA, 19 nt, Homo sapiens
ugggugagcugggaaaaua

SEQ ID NO: 243232 - RNA, 19 nt, Homo sapiens
guccauaugcaucuacuug

SEQ ID NO: 243233 - RNA, 19 nt, Homo sapiens
ccacagcagacaccauuca

SEQ ID NO: 243234 - RNA, 19 nt, Homo sapiens
gcauaaggaguuagaacca

SEQ ID NO: 243235 - RNA, 19 nt, Homo sapiens
aauaguggcauaaggaguu

SEQ ID NO: 243236 - RNA, 19 nt, Homo sapiens
cuuacagacuggaauagug

SEQ ID NO: 243237 - RNA, 19 nt, Homo sapiens
auacuuacagacuggaaua

SEQ ID NO: 243238 - RNA, 19 nt, Homo sapiens
cauaccugcuccugacuuc

SEQ ID NO: 243239 - RNA, 19 nt, Homo sapiens
gcuguggaguucaaauguc

SEQ ID NO: 243240 - RNA, 19 nt, Homo sapiens
ggacaccaaggacauuuac

SEQ ID NO: 243241 - RNA, 19 nt, Homo sapiens
caacuaugacuuucuaagc

SEQ ID NO: 243242 - RNA, 19 nt, Homo sapiens
ucuuugaacugcagcaauc

SEQ ID NO: 243243 - RNA, 19 nt, Homo sapiens
auaguggcauaaggaguua

SEQ ID NO: 243244 - RNA, 19 nt, Homo sapiens
aaagcccuccuccuccuua

SEQ ID NO: 243245 - RNA, 19 nt, Homo sapiens
ggcaaggucauagacaauu

SEQ ID NO: 243246 - RNA, 19 nt, Homo sapiens
ucucagggcuggcagucau

SEQ ID NO: 243247 - RNA, 19 nt, Homo sapiens
ccuuaacccugccaguuuc

SEQ ID NO: 243248 - RNA, 19 nt, Homo sapiens
cagggaagucacagaugua

SEQ ID NO: 243249 - RNA, 19 nt, Homo sapiens
cggaagagcauguggugau

SEQ ID NO: 243250 - RNA, 19 nt, Homo sapiens
aggaguauauggacacuac

SEQ ID NO: 243251 - RNA, 19 nt, Homo sapiens
cugcuacaacuaugacuuu

SEQ ID NO: 243252 - RNA, 19 nt, Homo sapiens
gcccuugcacuccuacuga

SEQ ID NO: 243253 - RNA, 19 nt, Homo sapiens
uaagcacguugcccaaggu

SEQ ID NO: 243254 - RNA, 19 nt, Homo sapiens
aaucacaaaggcugacauu

SEQ ID NO: 243255 - RNA, 19 nt, Homo sapiens
uggaauaguggcauaagga

SEQ ID NO: 243256 - RNA, 19 nt, Homo sapiens
aggcacagcacccugauug

SEQ ID NO: 243257 - RNA, 19 nt, Homo sapiens
caugucaggccaucaagga

SEQ ID NO: 243258 - RNA, 19 nt, Homo sapiens
uacaagaaccaaggaauca

SEQ ID NO: 243259 - RNA, 19 nt, Homo sapiens
ccuacugaguuugugguaa

SEQ ID NO: 243260 - RNA, 19 nt, Homo sapiens
aggcugacauucacugagu

SEQ ID NO: 243261 - RNA, 19 nt, Homo sapiens
ggugugagcggaagagcau

SEQ ID NO: 243262 - RNA, 19 nt, Homo sapiens
caccaguccagcaaauaaa

SEQ ID NO: 243263 - RNA, 19 nt, Homo sapiens
cuuauucauuccucacaau

SEQ ID NO: 243264 - RNA, 19 nt, Homo sapiens
aaccacagcagacaccauu

SEQ ID NO: 243265 - RNA, 19 nt, Homo sapiens
acacucagccacugucaca

SEQ ID NO: 243266 - RNA, 19 nt, Homo sapiens
aagagcauguggugauugg

SEQ ID NO: 243267 - RNA, 19 nt, Homo sapiens
ugccggugcugcccuaugu

SEQ ID NO: 243268 - RNA, 19 nt, Homo sapiens
ggagggcacagggaaguca

SEQ ID NO: 243269 - RNA, 19 nt, Homo sapiens
cagacaccauucauuccau

SEQ ID NO: 243270 - RNA, 19 nt, Homo sapiens
gucaggaaauuuggaggau

SEQ ID NO: 243271 - RNA, 19 nt, Homo sapiens
acaagucauggucacagua

SEQ ID NO: 243272 - RNA, 19 nt, Homo sapiens
caugcacagucauacaagu

SEQ ID NO: 243273 - RNA, 19 nt, Homo sapiens
ggcaccaguccagcaaaua

SEQ ID NO: 243274 - RNA, 19 nt, Homo sapiens
ccauguccauaugcaucua

SEQ ID NO: 243275 - RNA, 19 nt, Homo sapiens
gaaccacagcagacaccau

SEQ ID NO: 243276 - RNA, 19 nt, Homo sapiens
gaguucaaaugucgaugcu

SEQ ID NO: 243277 - RNA, 19 nt, Homo sapiens
ggugcccucucacuugaag

SEQ ID NO: 243278 - RNA, 19 nt, Homo sapiens
aaucaugucaggccaucaa

SEQ ID NO: 243279 - RNA, 19 nt, Homo sapiens
auacaagaaccaaggaauc

SEQ ID NO: 243280 - RNA, 19 nt, Homo sapiens
gcacacacaugcauacuua

SEQ ID NO: 243281 - RNA, 19 nt, Homo sapiens
ucaaauacaugcacaguca

SEQ ID NO: 243282 - RNA, 19 nt, Homo sapiens
caggaaauuuggaggauaa

SEQ ID NO: 243283 - RNA, 19 nt, Homo sapiens
acacugaguugcacauauu

SEQ ID NO: 243284 - RNA, 19 nt, Homo sapiens
gcaccaguccagcaaauaa

SEQ ID NO: 243285 - RNA, 19 nt, Homo sapiens
ggaagagcauguggugauu

SEQ ID NO: 243286 - RNA, 19 nt, Homo sapiens
gcaaauaaagcagucauga

SEQ ID NO: 243287 - RNA, 19 nt, Homo sapiens
ggccagggcuuccucaaau

SEQ ID NO: 243288 - RNA, 19 nt, Homo sapiens
gaacugcagcaaucacaaa

SEQ ID NO: 243289 - RNA, 19 nt, Homo sapiens
ucacaaaggcugacauuca

SEQ ID NO: 243290 - RNA, 19 nt, Homo sapiens
gcaaggucauagacaauuc

SEQ ID NO: 243291 - RNA, 19 nt, Homo sapiens
gcacauauugagaaccuaa

SEQ ID NO: 243292 - RNA, 19 nt, Homo sapiens
gccagggcuuccucaaaua

SEQ ID NO: 243293 - RNA, 19 nt, Homo sapiens
gaaccaaggaaucauguca

SEQ ID NO: 243294 - RNA, 19 nt, Homo sapiens
gcagucaugauuuacuuaa

SEQ ID NO: 243295 - RNA, 19 nt, Homo sapiens
uauguggacuuauucauuc

SEQ ID NO: 243296 - RNA, 19 nt, Homo sapiens
cgauauggcccaaggcuuu

SEQ ID NO: 243297 - RNA, 19 nt, Homo sapiens
gacaauuccuccagagaca

SEQ ID NO: 243298 - RNA, 19 nt, Homo sapiens
cauauucccugcacacaca

SEQ ID NO: 243299 - RNA, 19 nt, Homo sapiens
acacaugcauacuuacaga

SEQ ID NO: 243300 - RNA, 19 nt, Homo sapiens
acaaugaggcuaugaggaa

SEQ ID NO: 243301 - RNA, 19 nt, Homo sapiens
agacuggaauaguggcaua

SEQ ID NO: 243302 - RNA, 19 nt, Homo sapiens
caaugaggcuaugaggaaa

SEQ ID NO: 243303 - RNA, 19 nt, Homo sapiens
caagucauggucacaguaa

SEQ ID NO: 243304 - RNA, 19 nt, Homo sapiens
gauauggcccaaggcuuua

SEQ ID NO: 243305 - RNA, 19 nt, Homo sapiens
ucaggaaauuuggaggaua

SEQ ID NO: 243306 - RNA, 19 nt, Homo sapiens
cagcagacaccauucauuc

SEQ ID NO: 243307 - RNA, 19 nt, Homo sapiens
uuccugaccuuacucgaua

SEQ ID NO: 243308 - RNA, 19 nt, Homo sapiens
caaauaaagcagucaugau

SEQ ID NO: 243309 - RNA, 19 nt, Homo sapiens
ggaugucagugucuucgau

SEQ ID NO: 243310 - RNA, 19 nt, Homo sapiens
cagaaugccagccugauug

SEQ ID NO: 243311 - RNA, 19 nt, Homo sapiens
gucaggccaucaaggagua

SEQ ID NO: 243312 - RNA, 19 nt, Homo sapiens
caagaaccaaggaaucaug

SEQ ID NO: 243313 - RNA, 19 nt, Homo sapiens
aaauacaugcacagucaua

SEQ ID NO: 243314 - RNA, 19 nt, Homo sapiens
gugauuggccacacacuga

SEQ ID NO: 243315 - RNA, 19 nt, Homo sapiens
gcccuucucugcagucaag

SEQ ID NO: 243316 - RNA, 19 nt, Homo sapiens
gggacaccaaggacauuua

SEQ ID NO: 243317 - RNA, 19 nt, Homo sapiens
ccagaaugccagccugauu

SEQ ID NO: 243318 - RNA, 19 nt, Homo sapiens
gcccugacaugacaauuuu

SEQ ID NO: 243319 - RNA, 19 nt, Homo sapiens
aagcagucaugauuuacuu

SEQ ID NO: 243320 - RNA, 19 nt, Homo sapiens
gcacagucauacaagucau

SEQ ID NO: 243321 - RNA, 19 nt, Homo sapiens
gaagagcauguggugauug

SEQ ID NO: 243322 - RNA, 19 nt, Homo sapiens
ggcccugacaugacaauuu

SEQ ID NO: 243323 - RNA, 19 nt, Homo sapiens
cuacugaguuugugguaac

SEQ ID NO: 243324 - RNA, 19 nt, Homo sapiens
gaggcuaugaggaaacuga

SEQ ID NO: 243325 - RNA, 19 nt, Homo sapiens
cacaaaggcugacauucac

SEQ ID NO: 243326 - RNA, 19 nt, Homo sapiens
gaguugcacauauugagaa

SEQ ID NO: 243327 - RNA, 19 nt, Homo sapiens
gcagacaccauucauucca

SEQ ID NO: 243328 - RNA, 19 nt, Homo sapiens
cacacugaguugcacauau

SEQ ID NO: 243329 - RNA, 19 nt, Homo sapiens
ugggugagcugggaaaaua

SEQ ID NO: 243330 - RNA, 19 nt, Homo sapiens
guccauaugcaucuacuug

SEQ ID NO: 243331 - RNA, 19 nt, Homo sapiens
ccacagcagacaccauuca

SEQ ID NO: 243332 - RNA, 19 nt, Homo sapiens
gcauaaggaguuagaacca

SEQ ID NO: 243333 - RNA, 19 nt, Homo sapiens
aauaguggcauaaggaguu

SEQ ID NO: 243334 - RNA, 19 nt, Homo sapiens
cuuacagacuggaauagug

SEQ ID NO: 243335 - RNA, 19 nt, Homo sapiens
auacuuacagacuggaaua

SEQ ID NO: 243336 - RNA, 19 nt, Homo sapiens
gcuguggaguucaaauguc

SEQ ID NO: 243337 - RNA, 19 nt, Homo sapiens
ggacaccaaggacauuuac

SEQ ID NO: 243338 - RNA, 19 nt, Homo sapiens
cauaccugcuccugacuuc

SEQ ID NO: 243339 - RNA, 19 nt, Homo sapiens
ucuuugaacugcagcaauc

SEQ ID NO: 243340 - RNA, 19 nt, Homo sapiens
auaguggcauaaggaguua

SEQ ID NO: 243341 - RNA, 19 nt, Homo sapiens
aaagcccuccuccuccuua

SEQ ID NO: 243342 - RNA, 19 nt, Homo sapiens
ggcaaggucauagacaauu

SEQ ID NO: 243343 - RNA, 19 nt, Homo sapiens
ccuuaacccugccaguuuc

SEQ ID NO: 243344 - RNA, 19 nt, Homo sapiens
ucucagggcuggcagucau

SEQ ID NO: 243345 - RNA, 19 nt, Homo sapiens
cggaagagcauguggugau

SEQ ID NO: 243346 - RNA, 19 nt, Homo sapiens
aggaguauauggacacuac

SEQ ID NO: 243347 - RNA, 19 nt, Homo sapiens
gcccuugcacuccuacuga

SEQ ID NO: 243348 - RNA, 19 nt, Homo sapiens
uaagcacguugcccaaggu

SEQ ID NO: 243349 - RNA, 19 nt, Homo sapiens
aaucacaaaggcugacauu

SEQ ID NO: 243350 - RNA, 19 nt, Homo sapiens
uggaauaguggcauaagga

SEQ ID NO: 243351 - RNA, 19 nt, Homo sapiens
caugucaggccaucaagga

SEQ ID NO: 243352 - RNA, 19 nt, Homo sapiens
uacaagaaccaaggaauca

SEQ ID NO: 243353 - RNA, 19 nt, Homo sapiens
aggcacagcacccugauug

SEQ ID NO: 243354 - RNA, 19 nt, Homo sapiens
ccuacugaguuugugguaa

SEQ ID NO: 243355 - RNA, 19 nt, Homo sapiens
aggcugacauucacugagu

SEQ ID NO: 243356 - RNA, 19 nt, Homo sapiens
ggugugagcggaagagcau

SEQ ID NO: 243357 - RNA, 19 nt, Homo sapiens
caccaguccagcaaauaaa

SEQ ID NO: 243358 - RNA, 19 nt, Homo sapiens
cuuauucauuccucacaau

SEQ ID NO: 243359 - RNA, 19 nt, Homo sapiens
aaccacagcagacaccauu

SEQ ID NO: 243360 - RNA, 19 nt, Homo sapiens
acacucagccacugucaca

SEQ ID NO: 243361 - RNA, 19 nt, Homo sapiens
aagagcauguggugauugg

SEQ ID NO: 243362 - RNA, 19 nt, Homo sapiens
cagacaccauucauuccau

SEQ ID NO: 243363 - RNA, 19 nt, Homo sapiens
acaagucauggucacagua

SEQ ID NO: 243364 - RNA, 19 nt, Homo sapiens
caugcacagucauacaagu

SEQ ID NO: 243365 - RNA, 19 nt, Homo sapiens
gucaggaaauuuggaggau

SEQ ID NO: 243366 - RNA, 19 nt, Homo sapiens
ggcaccaguccagcaaaua

SEQ ID NO: 243367 - RNA, 19 nt, Homo sapiens
ccauguccauaugcaucua

SEQ ID NO: 243368 - RNA, 19 nt, Homo sapiens
gaaccacagcagacaccau

SEQ ID NO: 243369 - RNA, 19 nt, Homo sapiens
gaguucaaaugucgaugcu

SEQ ID NO: 243370 - RNA, 19 nt, Homo sapiens
ggugcccucucacuugaag

SEQ ID NO: 243371 - RNA, 19 nt, Homo sapiens
aaucaugucaggccaucaa

SEQ ID NO: 243372 - RNA, 19 nt, Homo sapiens
auacaagaaccaaggaauc

SEQ ID NO: 243373 - RNA, 19 nt, Homo sapiens
gcacacacaugcauacuua

SEQ ID NO: 243374 - RNA, 19 nt, Homo sapiens
ucaaauacaugcacaguca

SEQ ID NO: 243375 - RNA, 19 nt, Homo sapiens
caggaaauuuggaggauaa

SEQ ID NO: 243376 - RNA, 19 nt, Homo sapiens
acacugaguugcacauauu

SEQ ID NO: 243377 - RNA, 19 nt, Homo sapiens
gcaccaguccagcaaauaa

SEQ ID NO: 243378 - RNA, 19 nt, Homo sapiens
ggaagagcauguggugauu

SEQ ID NO: 243379 - RNA, 19 nt, Homo sapiens
gcaaauaaagcagucauga

SEQ ID NO: 243380 - RNA, 19 nt, Homo sapiens
ggccagggcuuccucaaau

SEQ ID NO: 243381 - RNA, 19 nt, Homo sapiens
gaacugcagcaaucacaaa

SEQ ID NO: 243382 - RNA, 19 nt, Homo sapiens
ggaagucacagauguaugu

SEQ ID NO: 243383 - RNA, 19 nt, Homo sapiens
ucacaaaggcugacauuca

SEQ ID NO: 243384 - RNA, 19 nt, Homo sapiens
gcaaggucauagacaauuc

SEQ ID NO: 243385 - RNA, 19 nt, Homo sapiens
gcacauauugagaaccuaa

SEQ ID NO: 243386 - RNA, 19 nt, Homo sapiens
guccagaucuucuaugaca

SEQ ID NO: 243387 - RNA, 19 nt, Homo sapiens
gccagggcuuccucaaaua

SEQ ID NO: 243388 - RNA, 19 nt, Homo sapiens
gaaccaaggaaucauguca

SEQ ID NO: 243389 - RNA, 19 nt, Homo sapiens
gcagucaugauuuacuuaa

SEQ ID NO: 243390 - RNA, 19 nt, Homo sapiens
uauguggacuuauucauuc

SEQ ID NO: 243391 - RNA, 19 nt, Homo sapiens
gacaauuccuccagagaca

SEQ ID NO: 243392 - RNA, 19 nt, Homo sapiens
cauauucccugcacacaca

SEQ ID NO: 243393 - RNA, 19 nt, Homo sapiens
acacaugcauacuuacaga

SEQ ID NO: 243394 - RNA, 19 nt, Homo sapiens
acaaugaggcuaugaggaa

SEQ ID NO: 243395 - RNA, 19 nt, Homo sapiens
gcacagggaagucacagau

SEQ ID NO: 243396 - RNA, 19 nt, Homo sapiens
agacuggaauaguggcaua

SEQ ID NO: 243397 - RNA, 19 nt, Homo sapiens
caaugaggcuaugaggaaa

SEQ ID NO: 243398 - RNA, 19 nt, Homo sapiens
caagucauggucacaguaa

SEQ ID NO: 243399 - RNA, 19 nt, Homo sapiens
ucaggaaauuuggaggaua

SEQ ID NO: 243400 - RNA, 19 nt, Homo sapiens
cagcagacaccauucauuc

SEQ ID NO: 243401 - RNA, 19 nt, Homo sapiens
caaauaaagcagucaugau

SEQ ID NO: 243402 - RNA, 19 nt, Homo sapiens
acagggaagucacagaugu

SEQ ID NO: 243403 - RNA, 19 nt, Homo sapiens
gucaggccaucaaggagua

SEQ ID NO: 243404 - RNA, 19 nt, Homo sapiens
caagaaccaaggaaucaug

SEQ ID NO: 243405 - RNA, 19 nt, Homo sapiens
aaauacaugcacagucaua

SEQ ID NO: 243406 - RNA, 19 nt, Homo sapiens
gugauuggccacacacuga

SEQ ID NO: 243407 - RNA, 19 nt, Homo sapiens
gcccuucucugcagucaag

SEQ ID NO: 243408 - RNA, 19 nt, Homo sapiens
aagcagucaugauuuacuu

SEQ ID NO: 243409 - RNA, 19 nt, Homo sapiens
gcacagucauacaagucau

SEQ ID NO: 243410 - RNA, 19 nt, Homo sapiens
gaagagcauguggugauug

SEQ ID NO: 243411 - RNA, 19 nt, Homo sapiens
ugacacgacaaaccacuuu

SEQ ID NO: 243412 - RNA, 19 nt, Homo sapiens
cuacugaguuugugguaac

SEQ ID NO: 243413 - RNA, 19 nt, Homo sapiens
gaggcuaugaggaaacuga

SEQ ID NO: 243414 - RNA, 19 nt, Homo sapiens
cacaaaggcugacauucac

SEQ ID NO: 243415 - RNA, 19 nt, Homo sapiens
gaguugcacauauugagaa

SEQ ID NO: 243416 - RNA, 19 nt, Homo sapiens
gcagacaccauucauucca

SEQ ID NO: 243417 - RNA, 19 nt, Homo sapiens
cacacugaguugcacauau

SEQ ID NO: 243418 - RNA, 19 nt, Homo sapiens
ugggugagcugggaaaaua

SEQ ID NO: 243419 - RNA, 19 nt, Homo sapiens
guccauaugcaucuacuug

SEQ ID NO: 243420 - RNA, 19 nt, Homo sapiens
ccacagcagacaccauuca

SEQ ID NO: 243421 - RNA, 19 nt, Homo sapiens
gcauaaggaguuagaacca

SEQ ID NO: 243422 - RNA, 19 nt, Homo sapiens
aauaguggcauaaggaguu

SEQ ID NO: 243423 - RNA, 19 nt, Homo sapiens
cuuacagacuggaauagug

SEQ ID NO: 243424 - RNA, 19 nt, Homo sapiens
auacuuacagacuggaaua

SEQ ID NO: 243425 - RNA, 19 nt, Homo sapiens
gcuguggaguucaaauguc

SEQ ID NO: 243426 - RNA, 19 nt, Homo sapiens
ucuuugaacugcagcaauc

SEQ ID NO: 243427 - RNA, 19 nt, Homo sapiens
auaguggcauaaggaguua

SEQ ID NO: 243428 - RNA, 19 nt, Homo sapiens
aaagcccuccuccuccuua

SEQ ID NO: 243429 - RNA, 19 nt, Homo sapiens
cagggaagucacagaugua

SEQ ID NO: 243430 - RNA, 19 nt, Homo sapiens
ggcaaggucauagacaauu

SEQ ID NO: 243431 - RNA, 19 nt, Homo sapiens
ccuuaacccugccaguuuc

SEQ ID NO: 243432 - RNA, 19 nt, Homo sapiens
cggaagagcauguggugau

SEQ ID NO: 243433 - RNA, 19 nt, Homo sapiens
aggaguauauggacacuac

SEQ ID NO: 243434 - RNA, 19 nt, Homo sapiens
gcccuugcacuccuacuga

SEQ ID NO: 243435 - RNA, 19 nt, Homo sapiens
uaagcacguugcccaaggu

SEQ ID NO: 243436 - RNA, 19 nt, Homo sapiens
aaucacaaaggcugacauu

SEQ ID NO: 243437 - RNA, 19 nt, Homo sapiens
uggaauaguggcauaagga

SEQ ID NO: 243438 - RNA, 19 nt, Homo sapiens
caugucaggccaucaagga

SEQ ID NO: 243439 - RNA, 19 nt, Homo sapiens
uacaagaaccaaggaauca

SEQ ID NO: 243440 - RNA, 19 nt, Homo sapiens
ccuacugaguuugugguaa

SEQ ID NO: 243441 - RNA, 19 nt, Homo sapiens
aggcugacauucacugagu

SEQ ID NO: 243442 - RNA, 19 nt, Homo sapiens
ggugugagcggaagagcau

SEQ ID NO: 243443 - RNA, 19 nt, Homo sapiens
caccaguccagcaaauaaa

SEQ ID NO: 243444 - RNA, 19 nt, Homo sapiens
cuuauucauuccucacaau

SEQ ID NO: 243445 - RNA, 19 nt, Homo sapiens
aaccacagcagacaccauu

SEQ ID NO: 243446 - RNA, 19 nt, Homo sapiens
acacucagccacugucaca

SEQ ID NO: 243447 - RNA, 19 nt, Homo sapiens
ugccggugcugcccuaugu

SEQ ID NO: 243448 - RNA, 19 nt, Homo sapiens
aagagcauguggugauugg

SEQ ID NO: 243449 - RNA, 19 nt, Homo sapiens
cagacaccauucauuccau

SEQ ID NO: 243450 - RNA, 19 nt, Homo sapiens
ggagggcacagggaaguca

SEQ ID NO: 243451 - RNA, 19 nt, Homo sapiens
acaagucauggucacagua

SEQ ID NO: 243452 - RNA, 19 nt, Homo sapiens
caugcacagucauacaagu

SEQ ID NO: 243453 - RNA, 19 nt, Homo sapiens
gucaggaaauuuggaggau

SEQ ID NO: 243454 - RNA, 19 nt, Homo sapiens
ggcaccaguccagcaaaua

SEQ ID NO: 243455 - RNA, 19 nt, Homo sapiens
ccauguccauaugcaucua

SEQ ID NO: 243456 - RNA, 19 nt, Homo sapiens
aaucaugucaggccaucaa

SEQ ID NO: 243457 - RNA, 19 nt, Homo sapiens
gaaccacagcagacaccau

SEQ ID NO: 243458 - RNA, 19 nt, Homo sapiens
auacaagaaccaaggaauc

SEQ ID NO: 243459 - RNA, 19 nt, Homo sapiens
gaguucaaaugucgaugcu

SEQ ID NO: 243460 - RNA, 19 nt, Homo sapiens
ggugcccucucacuugaag

SEQ ID NO: 243461 - RNA, 19 nt, Homo sapiens
gcacacacaugcauacuua

SEQ ID NO: 243462 - RNA, 19 nt, Homo sapiens
ucaaauacaugcacaguca

SEQ ID NO: 243463 - RNA, 19 nt, Homo sapiens
caggaaauuuggaggauaa

SEQ ID NO: 243464 - RNA, 19 nt, Homo sapiens
acacugaguugcacauauu

SEQ ID NO: 243465 - RNA, 19 nt, Homo sapiens
gcaccaguccagcaaauaa

SEQ ID NO: 243466 - RNA, 19 nt, Homo sapiens
ggaagagcauguggugauu

SEQ ID NO: 243467 - RNA, 19 nt, Homo sapiens
gcaaauaaagcagucauga

SEQ ID NO: 243468 - RNA, 19 nt, Homo sapiens
ggccagggcuuccucaaau

SEQ ID NO: 243469 - RNA, 19 nt, Homo sapiens
gaacugcagcaaucacaaa

SEQ ID NO: 243470 - RNA, 19 nt, Homo sapiens
ucacaaaggcugacauuca

SEQ ID NO: 243471 - RNA, 19 nt, Homo sapiens
gcaaggucauagacaauuc

SEQ ID NO: 243472 - RNA, 19 nt, Homo sapiens
gcacauauugagaaccuaa

SEQ ID NO: 243473 - RNA, 19 nt, Homo sapiens
gccagggcuuccucaaaua

SEQ ID NO: 243474 - RNA, 19 nt, Homo sapiens
gaaccaaggaaucauguca

SEQ ID NO: 243475 - RNA, 19 nt, Homo sapiens
gcagucaugauuuacuuaa

SEQ ID NO: 243476 - RNA, 19 nt, Homo sapiens
uauguggacuuauucauuc

SEQ ID NO: 243477 - RNA, 19 nt, Homo sapiens
gacaauuccuccagagaca

SEQ ID NO: 243478 - RNA, 19 nt, Homo sapiens
cauauucccugcacacaca

SEQ ID NO: 243479 - RNA, 19 nt, Homo sapiens
acacaugcauacuuacaga

SEQ ID NO: 243480 - RNA, 19 nt, Homo sapiens
acaaugaggcuaugaggaa

SEQ ID NO: 243481 - RNA, 19 nt, Homo sapiens
agacuggaauaguggcaua

SEQ ID NO: 243482 - RNA, 19 nt, Homo sapiens
caaugaggcuaugaggaaa

SEQ ID NO: 243483 - RNA, 19 nt, Homo sapiens
caagucauggucacaguaa

SEQ ID NO: 243484 - RNA, 19 nt, Homo sapiens
ucaggaaauuuggaggaua

SEQ ID NO: 243485 - RNA, 19 nt, Homo sapiens
cagcagacaccauucauuc

SEQ ID NO: 243486 - RNA, 19 nt, Homo sapiens
caaauaaagcagucaugau

SEQ ID NO: 243487 - RNA, 19 nt, Homo sapiens
gucaggccaucaaggagua

SEQ ID NO: 243488 - RNA, 19 nt, Homo sapiens
caagaaccaaggaaucaug

SEQ ID NO: 243489 - RNA, 19 nt, Homo sapiens
aaauacaugcacagucaua

SEQ ID NO: 243490 - RNA, 19 nt, Homo sapiens
gugauuggccacacacuga

SEQ ID NO: 243491 - RNA, 19 nt, Homo sapiens
gcccuucucugcagucaag

SEQ ID NO: 243492 - RNA, 19 nt, Homo sapiens
aagcagucaugauuuacuu

SEQ ID NO: 243493 - RNA, 19 nt, Homo sapiens
gcacagucauacaagucau

SEQ ID NO: 243494 - RNA, 19 nt, Homo sapiens
gaagagcauguggugauug

SEQ ID NO: 243495 - RNA, 19 nt, Homo sapiens
cuacugaguuugugguaac

SEQ ID NO: 243496 - RNA, 19 nt, Homo sapiens
gaggcuaugaggaaacuga

SEQ ID NO: 243497 - RNA, 19 nt, Homo sapiens
cacaaaggcugacauucac

SEQ ID NO: 243498 - RNA, 19 nt, Homo sapiens
gaguugcacauauugagaa

SEQ ID NO: 243499 - RNA, 19 nt, Homo sapiens
ugggugagcugggaaaaua

SEQ ID NO: 243500 - RNA, 19 nt, Homo sapiens
gcagacaccauucauucca

SEQ ID NO: 243501 - RNA, 19 nt, Homo sapiens
cacacugaguugcacauau

SEQ ID NO: 243502 - RNA, 19 nt, Homo sapiens
guccauaugcaucuacuug

SEQ ID NO: 243503 - RNA, 19 nt, Homo sapiens
ccacagcagacaccauuca

SEQ ID NO: 243504 - RNA, 19 nt, Homo sapiens
gcauaaggaguuagaacca

SEQ ID NO: 243505 - RNA, 19 nt, Homo sapiens
aauaguggcauaaggaguu

SEQ ID NO: 243506 - RNA, 19 nt, Homo sapiens
cuuacagacuggaauagug

SEQ ID NO: 243507 - RNA, 19 nt, Homo sapiens
auacuuacagacuggaaua

SEQ ID NO: 243508 - RNA, 19 nt, Homo sapiens
gcuguggaguucaaauguc

SEQ ID NO: 243509 - RNA, 19 nt, Homo sapiens
ucuuugaacugcagcaauc

SEQ ID NO: 243510 - RNA, 19 nt, Homo sapiens
auaguggcauaaggaguua

SEQ ID NO: 243511 - RNA, 19 nt, Homo sapiens
aaagcccuccuccuccuua

SEQ ID NO: 243512 - RNA, 19 nt, Homo sapiens
ggcaaggucauagacaauu

SEQ ID NO: 243513 - RNA, 19 nt, Homo sapiens
ccuuaacccugccaguuuc

SEQ ID NO: 243514 - RNA, 19 nt, Homo sapiens
cggaagagcauguggugau

SEQ ID NO: 243515 - RNA, 19 nt, Homo sapiens
aggaguauauggacacuac

SEQ ID NO: 243516 - RNA, 19 nt, Homo sapiens
gcccuugcacuccuacuga

SEQ ID NO: 243517 - RNA, 19 nt, Homo sapiens
uaagcacguugcccaaggu

SEQ ID NO: 243518 - RNA, 19 nt, Homo sapiens
aaucacaaaggcugacauu

SEQ ID NO: 243519 - RNA, 19 nt, Homo sapiens
caugucaggccaucaagga

SEQ ID NO: 243520 - RNA, 19 nt, Homo sapiens
uggaauaguggcauaagga

SEQ ID NO: 243521 - RNA, 19 nt, Homo sapiens
uacaagaaccaaggaauca

SEQ ID NO: 243522 - RNA, 19 nt, Homo sapiens
ccuacugaguuugugguaa

SEQ ID NO: 243523 - RNA, 19 nt, Homo sapiens
aggcugacauucacugagu

SEQ ID NO: 243524 - RNA, 19 nt, Homo sapiens
ggugugagcggaagagcau

SEQ ID NO: 243525 - RNA, 19 nt, Homo sapiens
caccaguccagcaaauaaa

SEQ ID NO: 243526 - RNA, 19 nt, Homo sapiens
cuuauucauuccucacaau

SEQ ID NO: 243527 - RNA, 19 nt, Homo sapiens
aaccacagcagacaccauu

SEQ ID NO: 243528 - RNA, 19 nt, Homo sapiens
acacucagccacugucaca

SEQ ID NO: 243529 - RNA, 19 nt, Homo sapiens
aagagcauguggugauugg

SEQ ID NO: 243530 - RNA, 19 nt, Homo sapiens
cagacaccauucauuccau

SEQ ID NO: 243531 - RNA, 19 nt, Homo sapiens
acaagucauggucacagua

SEQ ID NO: 243532 - RNA, 19 nt, Homo sapiens
caugcacagucauacaagu

SEQ ID NO: 243533 - RNA, 19 nt, Homo sapiens
gucaggaaauuuggaggau

SEQ ID NO: 243534 - RNA, 19 nt, Homo sapiens
ggcaccaguccagcaaaua

SEQ ID NO: 243535 - RNA, 19 nt, Homo sapiens
ccauguccauaugcaucua

SEQ ID NO: 243536 - RNA, 19 nt, Homo sapiens
gaaccacagcagacaccau

SEQ ID NO: 243537 - RNA, 19 nt, Homo sapiens
aaucaugucaggccaucaa

SEQ ID NO: 243538 - RNA, 19 nt, Homo sapiens
auacaagaaccaaggaauc

SEQ ID NO: 243539 - RNA, 19 nt, Homo sapiens
ggugcccucucacuugaag

SEQ ID NO: 243540 - RNA, 19 nt, Homo sapiens
gaguucaaaugucgaugcu

SEQ ID NO: 243541 - RNA, 19 nt, Homo sapiens
uaacuaaggucccauaaua

SEQ ID NO: 243542 - RNA, 19 nt, Homo sapiens
gcagugagcuucuauuaaa

SEQ ID NO: 243543 - RNA, 19 nt, Homo sapiens
ggacauauaccuucucaaa

SEQ ID NO: 243544 - RNA, 19 nt, Homo sapiens
gaaccuugguaaauuguaa

SEQ ID NO: 243545 - RNA, 19 nt, Homo sapiens
agagagagccacugaauua

SEQ ID NO: 243546 - RNA, 19 nt, Homo sapiens
gcaaguauuucucauugug

SEQ ID NO: 243547 - RNA, 19 nt, Homo sapiens
cuagugauuuccuguauaa

SEQ ID NO: 243548 - RNA, 19 nt, Homo sapiens
caacaacuuuggugccauu

SEQ ID NO: 243549 - RNA, 19 nt, Homo sapiens
gagagccacugaauuacuu

SEQ ID NO: 243550 - RNA, 19 nt, Homo sapiens
gugaauauauggucugugu

SEQ ID NO: 243551 - RNA, 19 nt, Homo sapiens
gcaaaccucagucauauuc

SEQ ID NO: 243552 - RNA, 19 nt, Homo sapiens
cagcagugagcuucuauua

SEQ ID NO: 243553 - RNA, 19 nt, Homo sapiens
gaaguuauucuugacauga

SEQ ID NO: 243554 - RNA, 19 nt, Homo sapiens
gauacaagcuuggacucuu

SEQ ID NO: 243555 - RNA, 19 nt, Homo sapiens
ugauauugcugacauugaa

SEQ ID NO: 243556 - RNA, 19 nt, Homo sapiens
gaauauauggucugugugu

SEQ ID NO: 243557 - RNA, 19 nt, Homo sapiens
ucuugaagcuuucuuucua

SEQ ID NO: 243558 - RNA, 19 nt, Homo sapiens
caagaggaaugcaguagag

SEQ ID NO: 243559 - RNA, 19 nt, Homo sapiens
ucugaaagcuacacccauu

SEQ ID NO: 243560 - RNA, 19 nt, Homo sapiens
gguaaauuguaaacagcua

SEQ ID NO: 243561 - RNA, 19 nt, Homo sapiens
guuugaaccuugguaaauu

SEQ ID NO: 243562 - RNA, 19 nt, Homo sapiens
gcacagguuuaagaacgaa

SEQ ID NO: 243563 - RNA, 19 nt, Homo sapiens
auacaagcuuggacucuuu

SEQ ID NO: 243564 - RNA, 19 nt, Homo sapiens
caacgcagcgccuggcaaa

SEQ ID NO: 243565 - RNA, 19 nt, Homo sapiens
cugcaaguauuucucauug

SEQ ID NO: 243566 - RNA, 19 nt, Homo sapiens
gcaagaggaaugcaguaga

SEQ ID NO: 243567 - RNA, 19 nt, Homo sapiens
ccugauaagcaaauuagua

SEQ ID NO: 243568 - RNA, 19 nt, Homo sapiens
cuacacccauugaaaguca

SEQ ID NO: 243569 - RNA, 19 nt, Homo sapiens
uugcugacauugaaacauu

SEQ ID NO: 243570 - RNA, 19 nt, Homo sapiens
gcaggagaaucgcuugaac

SEQ ID NO: 243571 - RNA, 19 nt, Homo sapiens
ugaauuacuugccccuuua

SEQ ID NO: 243572 - RNA, 19 nt, Homo sapiens
gaaagcuacacccauugaa

SEQ ID NO: 243573 - RNA, 19 nt, Homo sapiens
aaaccucagucauauucuu

SEQ ID NO: 243574 - RNA, 19 nt, Homo sapiens
ggugacaugugccuguaau

SEQ ID NO: 243575 - RNA, 19 nt, Homo sapiens
ggugaaacccugucucuac

SEQ ID NO: 243576 - RNA, 19 nt, Homo sapiens
gaucacaaggucaggaguu

SEQ ID NO: 243577 - RNA, 19 nt, Homo sapiens
aaagagagagccacugaau

SEQ ID NO: 243578 - RNA, 19 nt, Homo sapiens
gaagcuuucuuucuaucag

SEQ ID NO: 243579 - RNA, 19 nt, Homo sapiens
cgcagcgccuggcaaauuu

SEQ ID NO: 243580 - RNA, 19 nt, Homo sapiens
ucuagugauuuccuguaua

SEQ ID NO: 243581 - RNA, 19 nt, Homo sapiens
gaggaaugcaguagagguu

SEQ ID NO: 243582 - RNA, 19 nt, Homo sapiens
acuaaggucccauaauaaa

SEQ ID NO: 243583 - RNA, 19 nt, Homo sapiens
ggaaugcaguagagguuuu

SEQ ID NO: 243584 - RNA, 19 nt, Homo sapiens
caacuuuggugccauucuc

SEQ ID NO: 243585 - RNA, 19 nt, Homo sapiens
gcagugagccgagauugca

SEQ ID NO: 243586 - RNA, 19 nt, Homo sapiens
uuaaagagagagccacuga

SEQ ID NO: 243587 - RNA, 19 nt, Homo sapiens
gccauucucucaucuacca

SEQ ID NO: 243588 - RNA, 19 nt, Homo sapiens
ggacaauguaacucuauag

SEQ ID NO: 243589 - RNA, 19 nt, Homo sapiens
ugaaagcuacacccauuga

SEQ ID NO: 243590 - RNA, 19 nt, Homo sapiens
gcauugaaccaucugaaag

SEQ ID NO: 243591 - RNA, 19 nt, Homo sapiens
ugaaguuauucuugacaug

SEQ ID NO: 243592 - RNA, 19 nt, Homo sapiens
gcuaggacauauaccuucu

SEQ ID NO: 243593 - RNA, 19 nt, Homo sapiens
ugucugauguuuguugcua

SEQ ID NO: 243594 - RNA, 19 nt, Homo sapiens
aaagcuacacccauugaaa

SEQ ID NO: 243595 - RNA, 19 nt, Homo sapiens
uagcagcagugagcuucua

SEQ ID NO: 243596 - RNA, 19 nt, Homo sapiens
caacgugggauccaauaca

SEQ ID NO: 243597 - RNA, 19 nt, Homo sapiens
aggguuucauuguguguua

SEQ ID NO: 243598 - RNA, 19 nt, Homo sapiens
gugaaacccugucucuacu

SEQ ID NO: 243599 - RNA, 19 nt, Homo sapiens
gagaaaaucaguaauugga

SEQ ID NO: 243600 - RNA, 19 nt, Homo sapiens
uccugaagcugcaaguauu

SEQ ID NO: 243601 - RNA, 19 nt, Homo sapiens
guaguuugaaccuugguaa

SEQ ID NO: 243602 - RNA, 19 nt, Homo sapiens
ugaaagucaucagguggaa

SEQ ID NO: 243603 - RNA, 19 nt, Homo sapiens
cagcuacucaggaggcuaa

SEQ ID NO: 243604 - RNA, 19 nt, Homo sapiens
uaggacauauaccuucuca

SEQ ID NO: 243605 - RNA, 19 nt, Homo sapiens
uaauuuaacagugcccuuu

SEQ ID NO: 243606 - RNA, 19 nt, Homo sapiens
aggacaauguaacucuaua

SEQ ID NO: 243607 - RNA, 19 nt, Homo sapiens
gaggacaauguaacucuau

SEQ ID NO: 243608 - RNA, 19 nt, Homo sapiens
gugagcuucuauuaaaugu

SEQ ID NO: 243609 - RNA, 19 nt, Homo sapiens
uuugaaccuugguaaauug

SEQ ID NO: 243610 - RNA, 19 nt, Homo sapiens
gauauugcugacauugaaa

SEQ ID NO: 243611 - RNA, 19 nt, Homo sapiens
guggugacaugugccugua

SEQ ID NO: 243612 - RNA, 19 nt, Homo sapiens
ugugcucucuguugcauug

SEQ ID NO: 243613 - RNA, 19 nt, Homo sapiens
gaaagucaucagguggaaa

SEQ ID NO: 243614 - RNA, 19 nt, Homo sapiens
cagugagcuucuauuaaau

SEQ ID NO: 243615 - RNA, 19 nt, Homo sapiens
cuugaagcuuucuuucuau

SEQ ID NO: 243616 - RNA, 19 nt, Homo sapiens
auacauauggcaagaggaa

SEQ ID NO: 243617 - RNA, 19 nt, Homo sapiens
augcaacacugccacaugu

SEQ ID NO: 243618 - RNA, 19 nt, Homo sapiens
gcugcaaguauuucucauu

SEQ ID NO: 243619 - RNA, 19 nt, Homo sapiens
acauauaccuucucaaaag

SEQ ID NO: 243620 - RNA, 19 nt, Homo sapiens
gcugacauugaaacauuaa

SEQ ID NO: 243621 - RNA, 19 nt, Homo sapiens
gacaauguaacucuauagu

SEQ ID NO: 243622 - RNA, 19 nt, Homo sapiens
gcaggguauugcgaaacaa

SEQ ID NO: 243623 - RNA, 19 nt, Homo sapiens
cgugggauccaauacauau

SEQ ID NO: 243624 - RNA, 19 nt, Homo sapiens
aaccucagucauauucuua

SEQ ID NO: 243625 - RNA, 19 nt, Homo sapiens
ggcacagguuuaagaacga

SEQ ID NO: 243626 - RNA, 19 nt, Homo sapiens
ugcugacauugaaacauua

SEQ ID NO: 243627 - RNA, 19 nt, Homo sapiens
uaaagagagagccacugaa

SEQ ID NO: 243628 - RNA, 19 nt, Homo sapiens
gaaaauuugagaagcaaug

SEQ ID NO: 243629 - RNA, 19 nt, Homo sapiens
acgcagcgccuggcaaauu

SEQ ID NO: 243630 - RNA, 19 nt, Homo sapiens
gguauugcgaaacaacuug

SEQ ID NO: 243631 - RNA, 19 nt, Homo sapiens
aacccugucucuacuggaa

SEQ ID NO: 243632 - RNA, 19 nt, Homo sapiens
gacaugagaaaaucaguaa

SEQ ID NO: 243633 - RNA, 19 nt, Homo sapiens
uaugcaggguauugcgaaa

SEQ ID NO: 243634 - RNA, 19 nt, Homo sapiens
gcagcagugagcuucuauu

SEQ ID NO: 243635 - RNA, 19 nt, Homo sapiens
ccuguuaagcaauuccuuu

SEQ ID NO: 243636 - RNA, 19 nt, Homo sapiens
ucucaguggcacagguuua

SEQ ID NO: 243637 - RNA, 19 nt, Homo sapiens
ccugaagcugcaaguauuu

SEQ ID NO: 243638 - RNA, 19 nt, Homo sapiens
guucuagugauuuccugua

SEQ ID NO: 243639 - RNA, 19 nt, Homo sapiens
caaugggcauccugaagcu

SEQ ID NO: 243640 - RNA, 19 nt, Homo sapiens
cuauuaaucgugucuucaa

SEQ ID NO: 243641 - RNA, 19 nt, Homo sapiens
gaacauaucugaauagugu

SEQ ID NO: 243642 - RNA, 19 nt, Homo sapiens
gcacgugacuggacaauuu

SEQ ID NO: 243643 - RNA, 19 nt, Homo sapiens
ggaagaagaugaaacugua

SEQ ID NO: 243644 - RNA, 19 nt, Homo sapiens
gaaggaacauaucugaaua

SEQ ID NO: 243645 - RNA, 19 nt, Homo sapiens
caacggaggugacagauuu

SEQ ID NO: 243646 - RNA, 19 nt, Homo sapiens
gaagggaucugaacuggaa

SEQ ID NO: 243647 - RNA, 19 nt, Homo sapiens
acaguaaucuucacacuua

SEQ ID NO: 243648 - RNA, 19 nt, Homo sapiens
ggucagcccuucccuaauu

SEQ ID NO: 243649 - RNA, 19 nt, Homo sapiens
gaguggaagucuacuguua

SEQ ID NO: 243650 - RNA, 19 nt, Homo sapiens
gagcaauugugaugagaua

SEQ ID NO: 243651 - RNA, 19 nt, Homo sapiens
gaucugaacuggaaauuac

SEQ ID NO: 243652 - RNA, 19 nt, Homo sapiens
gugcauaugucaaucuuaa

SEQ ID NO: 243653 - RNA, 19 nt, Homo sapiens
ucaagauccuucaguauuu

SEQ ID NO: 243654 - RNA, 19 nt, Homo sapiens
caacuggacugccucacua

SEQ ID NO: 243655 - RNA, 19 nt, Homo sapiens
gugaagacuuugaauauga

SEQ ID NO: 243656 - RNA, 19 nt, Homo sapiens
ugaacaagguggaguauug

SEQ ID NO: 243657 - RNA, 19 nt, Homo sapiens
agacugaaauggcagcuua

SEQ ID NO: 243658 - RNA, 19 nt, Homo sapiens
gagaagaauugauugacaa

SEQ ID NO: 243659 - RNA, 19 nt, Homo sapiens
ccaccaagcuccuuacuuc

SEQ ID NO: 243660 - RNA, 19 nt, Homo sapiens
caaaugggauugauuaguc

SEQ ID NO: 243661 - RNA, 19 nt, Homo sapiens
ccacacagaguucauauuu

SEQ ID NO: 243662 - RNA, 19 nt, Homo sapiens
gaaaucacaguguacuaua

SEQ ID NO: 243663 - RNA, 19 nt, Homo sapiens
ccgcaucucugaaguguuu

SEQ ID NO: 243664 - RNA, 19 nt, Homo sapiens
gcacauagacacacacaug

SEQ ID NO: 243665 - RNA, 19 nt, Homo sapiens
ccaccaaggucuucuguau

SEQ ID NO: 243666 - RNA, 19 nt, Homo sapiens
ugucagcccucuauaaauu

SEQ ID NO: 243667 - RNA, 19 nt, Homo sapiens
acacauacaugcacauaga

SEQ ID NO: 243668 - RNA, 19 nt, Homo sapiens
gaaagaaauugugguuauc

SEQ ID NO: 243669 - RNA, 19 nt, Homo sapiens
gcaaucugguuccaacuga

SEQ ID NO: 243670 - RNA, 19 nt, Homo sapiens
gugaggagcuggagcaguu

SEQ ID NO: 243671 - RNA, 19 nt, Homo sapiens
ggucaaguuuguagauauu

SEQ ID NO: 243672 - RNA, 19 nt, Homo sapiens
gaaggaggaagaaauagaa

SEQ ID NO: 243673 - RNA, 19 nt, Homo sapiens
ugaacacacugaagauauu

SEQ ID NO: 243674 - RNA, 19 nt, Homo sapiens
ccacaagaguguuuaaugg

SEQ ID NO: 243675 - RNA, 19 nt, Homo sapiens
ccagaaggaggaagaaaua

SEQ ID NO: 243676 - RNA, 19 nt, Homo sapiens
ucaagucuuuggagaagua

SEQ ID NO: 243677 - RNA, 19 nt, Homo sapiens
caaugccuaucgcuucuua

SEQ ID NO: 243678 - RNA, 19 nt, Homo sapiens
agaggacgauuacucauuu

SEQ ID NO: 243679 - RNA, 19 nt, Homo sapiens
gauggaggauugugucaug

SEQ ID NO: 243680 - RNA, 19 nt, Homo sapiens
ugagauccuugaaagauuu

SEQ ID NO: 243681 - RNA, 19 nt, Homo sapiens
gcauguaacacuccacuuu

SEQ ID NO: 243682 - RNA, 19 nt, Homo sapiens
cagaguggguuucauguug

SEQ ID NO: 243683 - RNA, 19 nt, Homo sapiens
aaaccaaacugacuuacug

SEQ ID NO: 243684 - RNA, 19 nt, Homo sapiens
guucauauuuaccaccaua

SEQ ID NO: 243685 - RNA, 19 nt, Homo sapiens
gcccacaguuuauuucuau

SEQ ID NO: 243686 - RNA, 19 nt, Homo sapiens
gaauugauguaccagaauc

SEQ ID NO: 243687 - RNA, 19 nt, Homo sapiens
uagauauucugaccaauug

SEQ ID NO: 243688 - RNA, 19 nt, Homo sapiens
gcagaaaaccuccgcuuua

SEQ ID NO: 243689 - RNA, 19 nt, Homo sapiens
ggaaauuggcugaaagaug

SEQ ID NO: 243690 - RNA, 19 nt, Homo sapiens
cuaaagcuguuucugaaug

SEQ ID NO: 243691 - RNA, 19 nt, Homo sapiens
acacagaguucauauuuac

SEQ ID NO: 243692 - RNA, 19 nt, Homo sapiens
gaagaacugucaggagcaa

SEQ ID NO: 243693 - RNA, 19 nt, Homo sapiens
gccgauggauugacuuuga

SEQ ID NO: 243694 - RNA, 19 nt, Homo sapiens
uaaagcuguuucugaauga

SEQ ID NO: 243695 - RNA, 19 nt, Homo sapiens
cacacagaguucauauuua

SEQ ID NO: 243696 - RNA, 19 nt, Homo sapiens
ggacaaccgccuuucaaga

SEQ ID NO: 243697 - RNA, 19 nt, Homo sapiens
guagauauucugaccaauu

SEQ ID NO: 243698 - RNA, 19 nt, Homo sapiens
gacaaccgccuuucaagaa

SEQ ID NO: 243699 - RNA, 19 nt, Homo sapiens
cagacacuccucuaauuua

SEQ ID NO: 243700 - RNA, 19 nt, Homo sapiens
gcaauugugaugagauauu

SEQ ID NO: 243701 - RNA, 19 nt, Homo sapiens
gaacuggaaauuacacuca

SEQ ID NO: 243702 - RNA, 19 nt, Homo sapiens
gaacacacugaagauauuu

SEQ ID NO: 243703 - RNA, 19 nt, Homo sapiens
caauugguauguuagaaug

SEQ ID NO: 243704 - RNA, 19 nt, Homo sapiens
caucaggacuuugaaggaa

SEQ ID NO: 243705 - RNA, 19 nt, Homo sapiens
gaaagacucacucccuguu

SEQ ID NO: 243706 - RNA, 19 nt, Homo sapiens
cgagaagaauugauugaca

SEQ ID NO: 243707 - RNA, 19 nt, Homo sapiens
gauaagacacugggaauca

SEQ ID NO: 243708 - RNA, 19 nt, Homo sapiens
cuaguacucuucuuuguca

SEQ ID NO: 243709 - RNA, 19 nt, Homo sapiens
caacaguucuaguacucuu

SEQ ID NO: 243710 - RNA, 19 nt, Homo sapiens
caagauccuucaguauuug

SEQ ID NO: 243711 - RNA, 19 nt, Homo sapiens
ugagaccucuugaugaaau

SEQ ID NO: 243712 - RNA, 19 nt, Homo sapiens
gcauguacuuaucaauguu

SEQ ID NO: 243713 - RNA, 19 nt, Homo sapiens
cagcagacuucuagcaugu

SEQ ID NO: 243714 - RNA, 19 nt, Homo sapiens
gccaugaauugcacgauga

SEQ ID NO: 243715 - RNA, 19 nt, Homo sapiens
ucaagaacguaauugugaa

SEQ ID NO: 243716 - RNA, 19 nt, Homo sapiens
gaucagacacuccucuaau

SEQ ID NO: 243717 - RNA, 19 nt, Homo sapiens
accaaggucuucuguauga

SEQ ID NO: 243718 - RNA, 19 nt, Homo sapiens
agagaaagccccaacauua

SEQ ID NO: 243719 - RNA, 19 nt, Homo sapiens
ccagaaaugcaauauguga

SEQ ID NO: 243720 - RNA, 19 nt, Homo sapiens
ggauuuuccuggauaauuu

SEQ ID NO: 243721 - RNA, 19 nt, Homo sapiens
guacagaagauagaaguga

SEQ ID NO: 243722 - RNA, 19 nt, Homo sapiens
aaugguagaugaaggaaug

SEQ ID NO: 243723 - RNA, 19 nt, Homo sapiens
ggagaaguauaucauugag

SEQ ID NO: 243724 - RNA, 19 nt, Homo sapiens
gauugacccuguuucuguu

SEQ ID NO: 243725 - RNA, 19 nt, Homo sapiens
gaaugaaccgcagaagauu

SEQ ID NO: 243726 - RNA, 19 nt, Homo sapiens
ugugaaggaugcugacaaa

SEQ ID NO: 243727 - RNA, 19 nt, Homo sapiens
acaacuaugugaaggaaga

SEQ ID NO: 243728 - RNA, 19 nt, Homo sapiens
ugacaacuaugugaaggaa

SEQ ID NO: 243729 - RNA, 19 nt, Homo sapiens
gcuuaccuguggaauauga

SEQ ID NO: 243730 - RNA, 19 nt, Homo sapiens
uggcuuaccuguggaauau

SEQ ID NO: 243731 - RNA, 19 nt, Homo sapiens
gcggguacaauuaaagaua

SEQ ID NO: 243732 - RNA, 19 nt, Homo sapiens
caacaacagcagacuucua

SEQ ID NO: 243733 - RNA, 19 nt, Homo sapiens
ggaaauuacagaagacauc

SEQ ID NO: 243734 - RNA, 19 nt, Homo sapiens
gaucaacaguucuaguacu

SEQ ID NO: 243735 - RNA, 19 nt, Homo sapiens
ugacguccaucaagcaguu

SEQ ID NO: 243736 - RNA, 19 nt, Homo sapiens
ucuauaaauuggagaguga

SEQ ID NO: 243737 - RNA, 19 nt, Homo sapiens
ugaagacuguguauguuuc

SEQ ID NO: 243738 - RNA, 19 nt, Homo sapiens
caaaaugcuucaacaaguu

SEQ ID NO: 243739 - RNA, 19 nt, Homo sapiens
gaacuuggaagagugauca

SEQ ID NO: 243740 - RNA, 19 nt, Homo sapiens
ccuaugcucagguucauua

SEQ ID NO: 243741 - RNA, 19 nt, Homo sapiens
gaacauaucugaauagugu

SEQ ID NO: 243742 - RNA, 19 nt, Homo sapiens
gcacgugacuggacaauuu

SEQ ID NO: 243743 - RNA, 19 nt, Homo sapiens
ggaagaagaugaaacugua

SEQ ID NO: 243744 - RNA, 19 nt, Homo sapiens
gaaggaacauaucugaaua

SEQ ID NO: 243745 - RNA, 19 nt, Homo sapiens
caacggaggugacagauuu

SEQ ID NO: 243746 - RNA, 19 nt, Homo sapiens
gaagggaucugaacuggaa

SEQ ID NO: 243747 - RNA, 19 nt, Homo sapiens
acaguaaucuucacacuua

SEQ ID NO: 243748 - RNA, 19 nt, Homo sapiens
ggucagcccuucccuaauu

SEQ ID NO: 243749 - RNA, 19 nt, Homo sapiens
gaguggaagucuacuguua

SEQ ID NO: 243750 - RNA, 19 nt, Homo sapiens
gagcaauugugaugagaua

SEQ ID NO: 243751 - RNA, 19 nt, Homo sapiens
gaucugaacuggaaauuac

SEQ ID NO: 243752 - RNA, 19 nt, Homo sapiens
gugcauaugucaaucuuaa

SEQ ID NO: 243753 - RNA, 19 nt, Homo sapiens
ucaagauccuucaguauuu

SEQ ID NO: 243754 - RNA, 19 nt, Homo sapiens
caacuggacugccucacua

SEQ ID NO: 243755 - RNA, 19 nt, Homo sapiens
gugaagacuuugaauauga

SEQ ID NO: 243756 - RNA, 19 nt, Homo sapiens
ugaacaagguggaguauug

SEQ ID NO: 243757 - RNA, 19 nt, Homo sapiens
agacugaaauggcagcuua

SEQ ID NO: 243758 - RNA, 19 nt, Homo sapiens
gagaagaauugauugacaa

SEQ ID NO: 243759 - RNA, 19 nt, Homo sapiens
ccaccaagcuccuuacuuc

SEQ ID NO: 243760 - RNA, 19 nt, Homo sapiens
caaaugggauugauuaguc

SEQ ID NO: 243761 - RNA, 19 nt, Homo sapiens
ccacacagaguucauauuu

SEQ ID NO: 243762 - RNA, 19 nt, Homo sapiens
gaaaucacaguguacuaua

SEQ ID NO: 243763 - RNA, 19 nt, Homo sapiens
ccgcaucucugaaguguuu

SEQ ID NO: 243764 - RNA, 19 nt, Homo sapiens
gcacauagacacacacaug

SEQ ID NO: 243765 - RNA, 19 nt, Homo sapiens
ccaccaaggucuucuguau

SEQ ID NO: 243766 - RNA, 19 nt, Homo sapiens
ugucagcccucuauaaauu

SEQ ID NO: 243767 - RNA, 19 nt, Homo sapiens
acacauacaugcacauaga

SEQ ID NO: 243768 - RNA, 19 nt, Homo sapiens
gaaagaaauugugguuauc

SEQ ID NO: 243769 - RNA, 19 nt, Homo sapiens
gcaaucugguuccaacuga

SEQ ID NO: 243770 - RNA, 19 nt, Homo sapiens
gugaggagcuggagcaguu

SEQ ID NO: 243771 - RNA, 19 nt, Homo sapiens
ggucaaguuuguagauauu

SEQ ID NO: 243772 - RNA, 19 nt, Homo sapiens
gaaggaggaagaaauagaa

SEQ ID NO: 243773 - RNA, 19 nt, Homo sapiens
ugaacacacugaagauauu

SEQ ID NO: 243774 - RNA, 19 nt, Homo sapiens
ccacaagaguguuuaaugg

SEQ ID NO: 243775 - RNA, 19 nt, Homo sapiens
ccagaaggaggaagaaaua

SEQ ID NO: 243776 - RNA, 19 nt, Homo sapiens
ucaagucuuuggagaagua

SEQ ID NO: 243777 - RNA, 19 nt, Homo sapiens
caaugccuaucgcuucuua

SEQ ID NO: 243778 - RNA, 19 nt, Homo sapiens
agaggacgauuacucauuu

SEQ ID NO: 243779 - RNA, 19 nt, Homo sapiens
gauggaggauugugucaug

SEQ ID NO: 243780 - RNA, 19 nt, Homo sapiens
ugagauccuugaaagauuu

SEQ ID NO: 243781 - RNA, 19 nt, Homo sapiens
gcauguaacacuccacuuu

SEQ ID NO: 243782 - RNA, 19 nt, Homo sapiens
cagaguggguuucauguug

SEQ ID NO: 243783 - RNA, 19 nt, Homo sapiens
aaaccaaacugacuuacug

SEQ ID NO: 243784 - RNA, 19 nt, Homo sapiens
guucauauuuaccaccaua

SEQ ID NO: 243785 - RNA, 19 nt, Homo sapiens
gcccacaguuuauuucuau

SEQ ID NO: 243786 - RNA, 19 nt, Homo sapiens
gaauugauguaccagaauc

SEQ ID NO: 243787 - RNA, 19 nt, Homo sapiens
uagauauucugaccaauug

SEQ ID NO: 243788 - RNA, 19 nt, Homo sapiens
gcagaaaaccuccgcuuua

SEQ ID NO: 243789 - RNA, 19 nt, Homo sapiens
ggaaauuggcugaaagaug

SEQ ID NO: 243790 - RNA, 19 nt, Homo sapiens
cuaaagcuguuucugaaug

SEQ ID NO: 243791 - RNA, 19 nt, Homo sapiens
acacagaguucauauuuac

SEQ ID NO: 243792 - RNA, 19 nt, Homo sapiens
gaagaacugucaggagcaa

SEQ ID NO: 243793 - RNA, 19 nt, Homo sapiens
gccgauggauugacuuuga

SEQ ID NO: 243794 - RNA, 19 nt, Homo sapiens
uaaagcuguuucugaauga

SEQ ID NO: 243795 - RNA, 19 nt, Homo sapiens
cacacagaguucauauuua

SEQ ID NO: 243796 - RNA, 19 nt, Homo sapiens
ggacaaccgccuuucaaga

SEQ ID NO: 243797 - RNA, 19 nt, Homo sapiens
aacaguagcacaagauuua

SEQ ID NO: 243798 - RNA, 19 nt, Homo sapiens
guagauauucugaccaauu

SEQ ID NO: 243799 - RNA, 19 nt, Homo sapiens
gacaaccgccuuucaagaa

SEQ ID NO: 243800 - RNA, 19 nt, Homo sapiens
cagacacuccucuaauuua

SEQ ID NO: 243801 - RNA, 19 nt, Homo sapiens
gcaauugugaugagauauu

SEQ ID NO: 243802 - RNA, 19 nt, Homo sapiens
gaacuggaaauuacacuca

SEQ ID NO: 243803 - RNA, 19 nt, Homo sapiens
gaacacacugaagauauuu

SEQ ID NO: 243804 - RNA, 19 nt, Homo sapiens
caauugguauguuagaaug

SEQ ID NO: 243805 - RNA, 19 nt, Homo sapiens
caucaggacuuugaaggaa

SEQ ID NO: 243806 - RNA, 19 nt, Homo sapiens
gaaagacucacucccuguu

SEQ ID NO: 243807 - RNA, 19 nt, Homo sapiens
gaaacaguagcacaagauu

SEQ ID NO: 243808 - RNA, 19 nt, Homo sapiens
cgagaagaauugauugaca

SEQ ID NO: 243809 - RNA, 19 nt, Homo sapiens
gauaagacacugggaauca

SEQ ID NO: 243810 - RNA, 19 nt, Homo sapiens
cuaguacucuucuuuguca

SEQ ID NO: 243811 - RNA, 19 nt, Homo sapiens
caacaguucuaguacucuu

SEQ ID NO: 243812 - RNA, 19 nt, Homo sapiens
caagauccuucaguauuug

SEQ ID NO: 243813 - RNA, 19 nt, Homo sapiens
ugagaccucuugaugaaau

SEQ ID NO: 243814 - RNA, 19 nt, Homo sapiens
gcauguacuuaucaauguu

SEQ ID NO: 243815 - RNA, 19 nt, Homo sapiens
cagcagacuucuagcaugu

SEQ ID NO: 243816 - RNA, 19 nt, Homo sapiens
gccaugaauugcacgauga

SEQ ID NO: 243817 - RNA, 19 nt, Homo sapiens
ucaagaacguaauugugaa

SEQ ID NO: 243818 - RNA, 19 nt, Homo sapiens
gaucagacacuccucuaau

SEQ ID NO: 243819 - RNA, 19 nt, Homo sapiens
accaaggucuucuguauga

SEQ ID NO: 243820 - RNA, 19 nt, Homo sapiens
agagaaagccccaacauua

SEQ ID NO: 243821 - RNA, 19 nt, Homo sapiens
ccagaaaugcaauauguga

SEQ ID NO: 243822 - RNA, 19 nt, Homo sapiens
ggauuuuccuggauaauuu

SEQ ID NO: 243823 - RNA, 19 nt, Homo sapiens
guacagaagauagaaguga

SEQ ID NO: 243824 - RNA, 19 nt, Homo sapiens
aaugguagaugaaggaaug

SEQ ID NO: 243825 - RNA, 19 nt, Homo sapiens
ggagaaguauaucauugag

SEQ ID NO: 243826 - RNA, 19 nt, Homo sapiens
gauugacccuguuucuguu

SEQ ID NO: 243827 - RNA, 19 nt, Homo sapiens
gaaugaaccgcagaagauu

SEQ ID NO: 243828 - RNA, 19 nt, Homo sapiens
ugugaaggaugcugacaaa

SEQ ID NO: 243829 - RNA, 19 nt, Homo sapiens
acaacuaugugaaggaaga

SEQ ID NO: 243830 - RNA, 19 nt, Homo sapiens
ugacaacuaugugaaggaa

SEQ ID NO: 243831 - RNA, 19 nt, Homo sapiens
gcuuaccuguggaauauga

SEQ ID NO: 243832 - RNA, 19 nt, Homo sapiens
uggcuuaccuguggaauau

SEQ ID NO: 243833 - RNA, 19 nt, Homo sapiens
gcggguacaauuaaagaua

SEQ ID NO: 243834 - RNA, 19 nt, Homo sapiens
caacaacagcagacuucua

SEQ ID NO: 243835 - RNA, 19 nt, Homo sapiens
ggaaauuacagaagacauc

SEQ ID NO: 243836 - RNA, 19 nt, Homo sapiens
gaucaacaguucuaguacu

SEQ ID NO: 243837 - RNA, 19 nt, Homo sapiens
ugacguccaucaagcaguu

SEQ ID NO: 243838 - RNA, 19 nt, Homo sapiens
ucuauaaauuggagaguga

SEQ ID NO: 243839 - RNA, 19 nt, Homo sapiens
ugaagacuguguauguuuc

SEQ ID NO: 243840 - RNA, 19 nt, Homo sapiens
caaaaugcuucaacaaguu

SEQ ID NO: 243841 - RNA, 19 nt, Homo sapiens
gaaggaaagugaugaagaa

SEQ ID NO: 243842 - RNA, 19 nt, Homo sapiens
ggaaagugaugaagaagaa

SEQ ID NO: 243843 - RNA, 19 nt, Homo sapiens
gaaugaagaugaagacucu

SEQ ID NO: 243844 - RNA, 19 nt, Homo sapiens
gcuaugauggucagaauua

SEQ ID NO: 243845 - RNA, 19 nt, Homo sapiens
gaagaggaaggaaaugaaa

SEQ ID NO: 243846 - RNA, 19 nt, Homo sapiens
uuacaagcaugccuacuuu

SEQ ID NO: 243847 - RNA, 19 nt, Homo sapiens
acaacaaccucuccaaaug

SEQ ID NO: 243848 - RNA, 19 nt, Homo sapiens
caauccagcuucccaagaa

SEQ ID NO: 243849 - RNA, 19 nt, Homo sapiens
gaagacugcuuuaauuuug

SEQ ID NO: 243850 - RNA, 19 nt, Homo sapiens
gcagaaggcaccacagaga

SEQ ID NO: 243851 - RNA, 19 nt, Homo sapiens
ggaaggaaaugaaaacgaa

SEQ ID NO: 243852 - RNA, 19 nt, Homo sapiens
guacagcuacuuuaaagga

SEQ ID NO: 243853 - RNA, 19 nt, Homo sapiens
caagaaggcuggggauaua

SEQ ID NO: 243854 - RNA, 19 nt, Homo sapiens
guacaggccacgauauuau

SEQ ID NO: 243855 - RNA, 19 nt, Homo sapiens
aaaauggggucuuuaagua

SEQ ID NO: 243856 - RNA, 19 nt, Homo sapiens
ggaagaggaaggaaaugaa

SEQ ID NO: 243857 - RNA, 19 nt, Homo sapiens
gaggaaauacucaaucugu

SEQ ID NO: 243858 - RNA, 19 nt, Homo sapiens
ccacaagucuauagaacca

SEQ ID NO: 243859 - RNA, 19 nt, Homo sapiens
aagaggagacuucaaauga

SEQ ID NO: 243860 - RNA, 19 nt, Homo sapiens
ggaauggccugugcuuucu

SEQ ID NO: 243861 - RNA, 19 nt, Homo sapiens
ggaggaagaggaaggaaau

SEQ ID NO: 243862 - RNA, 19 nt, Homo sapiens
ugagagggcagaggaaaua

SEQ ID NO: 243863 - RNA, 19 nt, Homo sapiens
gacaacaaccucuccaaau

SEQ ID NO: 243864 - RNA, 19 nt, Homo sapiens
aaauggagaugacaguuca

SEQ ID NO: 243865 - RNA, 19 nt, Homo sapiens
gggaauggccugugcuuuc

SEQ ID NO: 243866 - RNA, 19 nt, Homo sapiens
gaagaaagcgaagcagaag

SEQ ID NO: 243867 - RNA, 19 nt, Homo sapiens
cgaagaaagcgaagcagaa

SEQ ID NO: 243868 - RNA, 19 nt, Homo sapiens
aaacaaagcuacaaaagag

SEQ ID NO: 243869 - RNA, 19 nt, Homo sapiens
gagaugacaguucagaaga

SEQ ID NO: 243870 - RNA, 19 nt, Homo sapiens
ggccugugcuuucucaaug

SEQ ID NO: 243871 - RNA, 19 nt, Homo sapiens
gacaauggauaugaaaucu

SEQ ID NO: 243872 - RNA, 19 nt, Homo sapiens
caaaagagaaggaaaguga

SEQ ID NO: 243873 - RNA, 19 nt, Homo sapiens
cagaggaaauacucaaucu

SEQ ID NO: 243874 - RNA, 19 nt, Homo sapiens
ggacaauuaccgagccuau

SEQ ID NO: 243875 - RNA, 19 nt, Homo sapiens
ggcauaaacggcaccagua

SEQ ID NO: 243876 - RNA, 19 nt, Homo sapiens
acaauuaccgagccuauga

SEQ ID NO: 243877 - RNA, 19 nt, Homo sapiens
gaagcaaucaccaaaauga

SEQ ID NO: 243878 - RNA, 19 nt, Homo sapiens
cacaggguauacaggguua

SEQ ID NO: 243879 - RNA, 19 nt, Homo sapiens
cuacaacacugggcuaugg

SEQ ID NO: 243880 - RNA, 19 nt, Homo sapiens
ggagaugacaguucagaag

SEQ ID NO: 243881 - RNA, 19 nt, Homo sapiens
cagaagaggaggaggaaga

SEQ ID NO: 243882 - RNA, 19 nt, Homo sapiens
aaaccaccaccguugaaua

SEQ ID NO: 243883 - RNA, 19 nt, Homo sapiens
gcugagaauaccacacuuu

SEQ ID NO: 243884 - RNA, 19 nt, Homo sapiens
agaaucgaaugaagaugaa

SEQ ID NO: 243885 - RNA, 19 nt, Homo sapiens
aaauagaggauucugaaga

SEQ ID NO: 243886 - RNA, 19 nt, Homo sapiens
caacaaccucuccaaaugg

SEQ ID NO: 243887 - RNA, 19 nt, Homo sapiens
gaaaauggggucuuuaagu

SEQ ID NO: 243888 - RNA, 19 nt, Homo sapiens
gcaauccagcuucccaaga

SEQ ID NO: 243889 - RNA, 19 nt, Homo sapiens
caacagcacagaggcagaa

SEQ ID NO: 243890 - RNA, 19 nt, Homo sapiens
gcagaggaaauacucaauc

SEQ ID NO: 243891 - RNA, 19 nt, Homo sapiens
aagaaucgaaugaagauga

SEQ ID NO: 243892 - RNA, 19 nt, Homo sapiens
uuaccgagccuaugaagau

SEQ ID NO: 243893 - RNA, 19 nt, Homo sapiens
cgacaauggauaugaaauc

SEQ ID NO: 243894 - RNA, 19 nt, Homo sapiens
ugaagaaucgaaugaagau

SEQ ID NO: 243895 - RNA, 19 nt, Homo sapiens
acaaugaagaaucgaauga

SEQ ID NO: 243896 - RNA, 19 nt, Homo sapiens
gagccuaugaagaugagua

SEQ ID NO: 243897 - RNA, 19 nt, Homo sapiens
ccaccaccguugaauacga

SEQ ID NO: 243898 - RNA, 19 nt, Homo sapiens
caaaauagaggauucugaa

SEQ ID NO: 243899 - RNA, 19 nt, Homo sapiens
agacaacaaccucuccaaa

SEQ ID NO: 243900 - RNA, 19 nt, Homo sapiens
ggcaagggcaccucgaaga

SEQ ID NO: 243901 - RNA, 19 nt, Homo sapiens
uuaaguacaggccacgaua

SEQ ID NO: 243902 - RNA, 19 nt, Homo sapiens
aagcagaaguggaugaaaa

SEQ ID NO: 243903 - RNA, 19 nt, Homo sapiens
ggauauaacaaacaaagcu

SEQ ID NO: 243904 - RNA, 19 nt, Homo sapiens
uuaaaacgauuuccaguuc

SEQ ID NO: 243905 - RNA, 19 nt, Homo sapiens
agaaggaaagugaugaaga

SEQ ID NO: 243906 - RNA, 19 nt, Homo sapiens
uaaaggacaaggcuacgau

SEQ ID NO: 243907 - RNA, 19 nt, Homo sapiens
agaaagcgaagcagaagug

SEQ ID NO: 243908 - RNA, 19 nt, Homo sapiens
aaugaagaaucgaaugaag

SEQ ID NO: 243909 - RNA, 19 nt, Homo sapiens
caaugaagaaucgaaugaa

SEQ ID NO: 243910 - RNA, 19 nt, Homo sapiens
gcauaaacggcaccaguac

SEQ ID NO: 243911 - RNA, 19 nt, Homo sapiens
agaggaagcaaucaccaaa

SEQ ID NO: 243912 - RNA, 19 nt, Homo sapiens
caaacaaagcuacaaaaga

SEQ ID NO: 243913 - RNA, 19 nt, Homo sapiens
caaaaugaagacugcuuua

SEQ ID NO: 243914 - RNA, 19 nt, Homo sapiens
gccugugcuuucucaauga

SEQ ID NO: 243915 - RNA, 19 nt, Homo sapiens
caccacaagucuauagaac

SEQ ID NO: 243916 - RNA, 19 nt, Homo sapiens
gaagcagaaguggaugaaa

SEQ ID NO: 243917 - RNA, 19 nt, Homo sapiens
gaaaugaaaacgaagaaag

SEQ ID NO: 243918 - RNA, 19 nt, Homo sapiens
ugaagaagaagaggaggaa

SEQ ID NO: 243919 - RNA, 19 nt, Homo sapiens
aaagagaaggaaagugaug

SEQ ID NO: 243920 - RNA, 19 nt, Homo sapiens
gaaaaccaccaccguugaa

SEQ ID NO: 243921 - RNA, 19 nt, Homo sapiens
ccaccacaagucuauagaa

SEQ ID NO: 243922 - RNA, 19 nt, Homo sapiens
agaaguggaugaaaacgaa

SEQ ID NO: 243923 - RNA, 19 nt, Homo sapiens
gggcagaggaaauacucaa

SEQ ID NO: 243924 - RNA, 19 nt, Homo sapiens
ggaaaaccaccaccguuga

SEQ ID NO: 243925 - RNA, 19 nt, Homo sapiens
aaacgaacaaggcauaaac

SEQ ID NO: 243926 - RNA, 19 nt, Homo sapiens
uaaguacaggccacgauau

SEQ ID NO: 243927 - RNA, 19 nt, Homo sapiens
gcgaagcagaaguggauga

SEQ ID NO: 243928 - RNA, 19 nt, Homo sapiens
uuacuaccaccaccaguga

SEQ ID NO: 243929 - RNA, 19 nt, Homo sapiens
uggcuaugauggucagaau

SEQ ID NO: 243930 - RNA, 19 nt, Homo sapiens
cagcuacuuuaaaggacaa

SEQ ID NO: 243931 - RNA, 19 nt, Homo sapiens
aagggcaccucgaagacaa

SEQ ID NO: 243932 - RNA, 19 nt, Homo sapiens
aaacgaagaaagcgaagca

SEQ ID NO: 243933 - RNA, 19 nt, Homo sapiens
aagaagaagaggaggaaga

SEQ ID NO: 243934 - RNA, 19 nt, Homo sapiens
ucagggcaguagugacuca

SEQ ID NO: 243935 - RNA, 19 nt, Homo sapiens
gcaagggcaccucgaagac

SEQ ID NO: 243936 - RNA, 19 nt, Homo sapiens
agaagaggaggaagaggaa

SEQ ID NO: 243937 - RNA, 19 nt, Homo sapiens
ugaaaacgaacaaggcaua

SEQ ID NO: 243938 - RNA, 19 nt, Homo sapiens
aguacaggccacgauauua

SEQ ID NO: 243939 - RNA, 19 nt, Homo sapiens
aagcgaagcagaaguggau

SEQ ID NO: 243940 - RNA, 19 nt, Homo sapiens
aaagugaugaagaagaaga

SEQ ID NO: 243941 - RNA, 19 nt, Homo sapiens
gaaggaagaugaacauguu

SEQ ID NO: 243942 - RNA, 19 nt, Homo sapiens
caacggcccuguuuauauu

SEQ ID NO: 243943 - RNA, 19 nt, Homo sapiens
caagauaagucaguuguaa

SEQ ID NO: 243944 - RNA, 19 nt, Homo sapiens
gaaagcaauuguacucuau

SEQ ID NO: 243945 - RNA, 19 nt, Homo sapiens
gaagauggauguuugucaa

SEQ ID NO: 243946 - RNA, 19 nt, Homo sapiens
ggacacaaaugcaguuauc

SEQ ID NO: 243947 - RNA, 19 nt, Homo sapiens
gaaccugucuggacuuauc

SEQ ID NO: 243948 - RNA, 19 nt, Homo sapiens
gagaaccugucuggacuua

SEQ ID NO: 243949 - RNA, 19 nt, Homo sapiens
gcaauuguacucuaucaaa

SEQ ID NO: 243950 - RNA, 19 nt, Homo sapiens
ggaccuggaugccaagcua

SEQ ID NO: 243951 - RNA, 19 nt, Homo sapiens
cgaaagcaauuguacucua

SEQ ID NO: 243952 - RNA, 19 nt, Homo sapiens
ggacuuaucgaaagcaauu

SEQ ID NO: 243953 - RNA, 19 nt, Homo sapiens
gaugcaaucucuugucuca

SEQ ID NO: 243954 - RNA, 19 nt, Homo sapiens
gaggauauguuucuugucu

SEQ ID NO: 243955 - RNA, 19 nt, Homo sapiens
uagcagaaguauaaaguga

SEQ ID NO: 243956 - RNA, 19 nt, Homo sapiens
ggagcacuauuauggauga

SEQ ID NO: 243957 - RNA, 19 nt, Homo sapiens
cgaagcaggccuuuauuaa

SEQ ID NO: 243958 - RNA, 19 nt, Homo sapiens
gcagaaguauaaagugauc

SEQ ID NO: 243959 - RNA, 19 nt, Homo sapiens
guaaauaagaugcaacaga

SEQ ID NO: 243960 - RNA, 19 nt, Homo sapiens
ggacuuacaggaucgauau

SEQ ID NO: 243961 - RNA, 19 nt, Homo sapiens
ggauauguuucuugucuca

SEQ ID NO: 243962 - RNA, 19 nt, Homo sapiens
cgauaaagaacacgaauug

SEQ ID NO: 243963 - RNA, 19 nt, Homo sapiens
ugaaggugcugacaaagau

SEQ ID NO: 243964 - RNA, 19 nt, Homo sapiens
acaagcaaauggagaaguu

SEQ ID NO: 243965 - RNA, 19 nt, Homo sapiens
ggacgugucucaggagcuu

SEQ ID NO: 243966 - RNA, 19 nt, Homo sapiens
gaggagcacuauuauggau

SEQ ID NO: 243967 - RNA, 19 nt, Homo sapiens
gaagaaggaagaugaacau

SEQ ID NO: 243968 - RNA, 19 nt, Homo sapiens
gaacagugcaggacggaau

SEQ ID NO: 243969 - RNA, 19 nt, Homo sapiens
caucaacaauagaagaaga

SEQ ID NO: 243970 - RNA, 19 nt, Homo sapiens
ugagugagaucuucaaugc

SEQ ID NO: 243971 - RNA, 19 nt, Homo sapiens
ggaucgauaugcucaagau

SEQ ID NO: 243972 - RNA, 19 nt, Homo sapiens
ggucaacggcccuguuuau

SEQ ID NO: 243973 - RNA, 19 nt, Homo sapiens
ucucuugucucacaugcua

SEQ ID NO: 243974 - RNA, 19 nt, Homo sapiens
ucccaagguuuccaagaua

SEQ ID NO: 243975 - RNA, 19 nt, Homo sapiens
ccagaccucuacaagcaaa

SEQ ID NO: 243976 - RNA, 19 nt, Homo sapiens
cgaaauccuuugugucgau

SEQ ID NO: 243977 - RNA, 19 nt, Homo sapiens
aagaugaccugcugcuguu

SEQ ID NO: 243978 - RNA, 19 nt, Homo sapiens
ggaagaaggaagaugaaca

SEQ ID NO: 243979 - RNA, 19 nt, Homo sapiens
ccaagcaagguuauaauau

SEQ ID NO: 243980 - RNA, 19 nt, Homo sapiens
agacgaagcaggccuuuau

SEQ ID NO: 243981 - RNA, 19 nt, Homo sapiens
gaagguacaaacacaagug

SEQ ID NO: 243982 - RNA, 19 nt, Homo sapiens
auacuuggcugacggugaa

SEQ ID NO: 243983 - RNA, 19 nt, Homo sapiens
agugagaucuucaaugcuu

SEQ ID NO: 243984 - RNA, 19 nt, Homo sapiens
ucaggaagguacaaacaca

SEQ ID NO: 243985 - RNA, 19 nt, Homo sapiens
uuacaggccucgcuacaag

SEQ ID NO: 243986 - RNA, 19 nt, Homo sapiens
cccaagguuuccaagauaa

SEQ ID NO: 243987 - RNA, 19 nt, Homo sapiens
guagagagagagaaacuca

SEQ ID NO: 243988 - RNA, 19 nt, Homo sapiens
cuagagcuguuucauucaa

SEQ ID NO: 243989 - RNA, 19 nt, Homo sapiens
ucaacggcccuguuuauau

SEQ ID NO: 243990 - RNA, 19 nt, Homo sapiens
aauugaagauggauguuug

SEQ ID NO: 243991 - RNA, 19 nt, Homo sapiens
ccacagggaagaaggaaga

SEQ ID NO: 243992 - RNA, 19 nt, Homo sapiens
ggagcgagcagaugcaauc

SEQ ID NO: 243993 - RNA, 19 nt, Homo sapiens
gggaguagagagagagaaa

SEQ ID NO: 243994 - RNA, 19 nt, Homo sapiens
gcucaaugcaugaaucugu

SEQ ID NO: 243995 - RNA, 19 nt, Homo sapiens
uagaggagcacuauuaugg

SEQ ID NO: 243996 - RNA, 19 nt, Homo sapiens
ggaugaaggacgugucuca

SEQ ID NO: 243997 - RNA, 19 nt, Homo sapiens
uaacuuauccucucaugcu

SEQ ID NO: 243998 - RNA, 19 nt, Homo sapiens
aaaacgaacugggaaaauu

SEQ ID NO: 243999 - RNA, 19 nt, Homo sapiens
acgaagcaggccuuuauua

SEQ ID NO: 244000 - RNA, 19 nt, Homo sapiens
cccaagcaagguuauaaua

SEQ ID NO: 244001 - RNA, 19 nt, Homo sapiens
ggaauauagaggagcacua

SEQ ID NO: 244002 - RNA, 19 nt, Homo sapiens
cagggaagaaggaagauga

SEQ ID NO: 244003 - RNA, 19 nt, Homo sapiens
gcuagcagaaguauaaagu

SEQ ID NO: 244004 - RNA, 19 nt, Homo sapiens
gaucgauaugcucaagaua

SEQ ID NO: 244005 - RNA, 19 nt, Homo sapiens
cucaaugcaugaaucugua

SEQ ID NO: 244006 - RNA, 19 nt, Homo sapiens
ugcaaucucuugucucaca

SEQ ID NO: 244007 - RNA, 19 nt, Homo sapiens
ccaaaucaucaacaauaga

SEQ ID NO: 244008 - RNA, 19 nt, Homo sapiens
ugucuggacuuaucgaaag

SEQ ID NO: 244009 - RNA, 19 nt, Homo sapiens
ucgauaugcucaagauaag

SEQ ID NO: 244010 - RNA, 19 nt, Homo sapiens
gugcaggacggaauauaga

SEQ ID NO: 244011 - RNA, 19 nt, Homo sapiens
gucaacggcccuguuuaua

SEQ ID NO: 244012 - RNA, 19 nt, Homo sapiens
gauaugcucaagauaaguc

SEQ ID NO: 244013 - RNA, 19 nt, Homo sapiens
ccagacaggcucagguuuc

SEQ ID NO: 244014 - RNA, 19 nt, Homo sapiens
cccaaaucaucaacaauag

SEQ ID NO: 244015 - RNA, 19 nt, Homo sapiens
caggaaaggcccucugcuu

SEQ ID NO: 244016 - RNA, 19 nt, Homo sapiens
aaccagagcaggaaagaug

SEQ ID NO: 244017 - RNA, 19 nt, Homo sapiens
aagcaauuguacucuauca

SEQ ID NO: 244018 - RNA, 19 nt, Homo sapiens
uuucuucgaucccaagguu

SEQ ID NO: 244019 - RNA, 19 nt, Homo sapiens
caacaauagaagaagaaga

SEQ ID NO: 244020 - RNA, 19 nt, Homo sapiens
agaaauauugggagacgaa

SEQ ID NO: 244021 - RNA, 19 nt, Homo sapiens
gagacgaagcaggccuuua

SEQ ID NO: 244022 - RNA, 19 nt, Homo sapiens
gcuguugagugagaucuuc

SEQ ID NO: 244023 - RNA, 19 nt, Homo sapiens
aaauggagaaguucaggaa

SEQ ID NO: 244024 - RNA, 19 nt, Homo sapiens
agagcuguuucauucaauu

SEQ ID NO: 244025 - RNA, 19 nt, Homo sapiens
gaugaccugcugcuguuga

SEQ ID NO: 244026 - RNA, 19 nt, Homo sapiens
aaaaguggaucuucuugga

SEQ ID NO: 244027 - RNA, 19 nt, Homo sapiens
ggagaaguucaggaaggua

SEQ ID NO: 244028 - RNA, 19 nt, Homo sapiens
cuuacgaaauccuuugugu

SEQ ID NO: 244029 - RNA, 19 nt, Homo sapiens
agaugcaacagaaauauug

SEQ ID NO: 244030 - RNA, 19 nt, Homo sapiens
ucaagauaagucaguugua

SEQ ID NO: 244031 - RNA, 19 nt, Homo sapiens
gcuagcaacauaccagcuu

SEQ ID NO: 244032 - RNA, 19 nt, Homo sapiens
caaaagaggauauguuucu

SEQ ID NO: 244033 - RNA, 19 nt, Homo sapiens
gacgaagcaggccuuuauu

SEQ ID NO: 244034 - RNA, 19 nt, Homo sapiens
ggcccuguuuauauuggua

SEQ ID NO: 244035 - RNA, 19 nt, Homo sapiens
gaaaaccgauaaagaacac

SEQ ID NO: 244036 - RNA, 19 nt, Homo sapiens
ccaagguuuccaagauaaa

SEQ ID NO: 244037 - RNA, 19 nt, Homo sapiens
agaaggaagaugaacaugu

SEQ ID NO: 244038 - RNA, 19 nt, Homo sapiens
ggggcuagcagaaguauaa

SEQ ID NO: 244039 - RNA, 19 nt, Homo sapiens
gagggcgaguucagcaaag

SEQ ID NO: 244040 - RNA, 19 nt, Homo sapiens
gcaaucucuugucucacau

SEQ ID NO: 244041 - RNA, 19 nt, Homo sapiens
gacaaaggcucuacacaua

SEQ ID NO: 244042 - RNA, 19 nt, Homo sapiens
gaaggaagaugaacauguu

SEQ ID NO: 244043 - RNA, 19 nt, Homo sapiens
caacggcccuguuuauauu

SEQ ID NO: 244044 - RNA, 19 nt, Homo sapiens
caagauaagucaguuguaa

SEQ ID NO: 244045 - RNA, 19 nt, Homo sapiens
gaaagcaauuguacucuau

SEQ ID NO: 244046 - RNA, 19 nt, Homo sapiens
gaagauggauguuugucaa

SEQ ID NO: 244047 - RNA, 19 nt, Homo sapiens
ggacaaacuuacuauggaa

SEQ ID NO: 244048 - RNA, 19 nt, Homo sapiens
gaggagggcuguaggaaga

SEQ ID NO: 244049 - RNA, 19 nt, Homo sapiens
gagccgagccaauuaauuu

SEQ ID NO: 244050 - RNA, 19 nt, Homo sapiens
ggacacaaaugcaguuauc

SEQ ID NO: 244051 - RNA, 19 nt, Homo sapiens
gaaccugucuggacuuauc

SEQ ID NO: 244052 - RNA, 19 nt, Homo sapiens
gagcugggcuucucuccaa

SEQ ID NO: 244053 - RNA, 19 nt, Homo sapiens
gagaaccugucuggacuua

SEQ ID NO: 244054 - RNA, 19 nt, Homo sapiens
gcaauuguacucuaucaaa

SEQ ID NO: 244055 - RNA, 19 nt, Homo sapiens
ggaccuggaugccaagcua

SEQ ID NO: 244056 - RNA, 19 nt, Homo sapiens
cgaaagcaauuguacucua

SEQ ID NO: 244057 - RNA, 19 nt, Homo sapiens
ggacuuaucgaaagcaauu

SEQ ID NO: 244058 - RNA, 19 nt, Homo sapiens
gaugcaaucucuugucuca

SEQ ID NO: 244059 - RNA, 19 nt, Homo sapiens
gaggauauguuucuugucu

SEQ ID NO: 244060 - RNA, 19 nt, Homo sapiens
uagcagaaguauaaaguga

SEQ ID NO: 244061 - RNA, 19 nt, Homo sapiens
gaugaacuauuagacauga

SEQ ID NO: 244062 - RNA, 19 nt, Homo sapiens
ggagcacuauuauggauga

SEQ ID NO: 244063 - RNA, 19 nt, Homo sapiens
gaaagaagagaagaagaaa

SEQ ID NO: 244064 - RNA, 19 nt, Homo sapiens
caugagaguuucaaagguu

SEQ ID NO: 244065 - RNA, 19 nt, Homo sapiens
cgaagcaggccuuuauuaa

SEQ ID NO: 244066 - RNA, 19 nt, Homo sapiens
gcaggagccgagccaauua

SEQ ID NO: 244067 - RNA, 19 nt, Homo sapiens
gcagaaguauaaagugauc

SEQ ID NO: 244068 - RNA, 19 nt, Homo sapiens
agaccacucugcuucauuu

SEQ ID NO: 244069 - RNA, 19 nt, Homo sapiens
ggacuuacaggaucgauau

SEQ ID NO: 244070 - RNA, 19 nt, Homo sapiens
guaaauaagaugcaacaga

SEQ ID NO: 244071 - RNA, 19 nt, Homo sapiens
gcucaggacccauagauga

SEQ ID NO: 244072 - RNA, 19 nt, Homo sapiens
ggauauguuucuugucuca

SEQ ID NO: 244073 - RNA, 19 nt, Homo sapiens
cgauaaagaacacgaauug

SEQ ID NO: 244074 - RNA, 19 nt, Homo sapiens
ugaaggugcugacaaagau

SEQ ID NO: 244075 - RNA, 19 nt, Homo sapiens
acaagcaaauggagaaguu

SEQ ID NO: 244076 - RNA, 19 nt, Homo sapiens
ggacgugucucaggagcuu

SEQ ID NO: 244077 - RNA, 19 nt, Homo sapiens
gaggagcacuauuauggau

SEQ ID NO: 244078 - RNA, 19 nt, Homo sapiens
gaagaaggaagaugaacau

SEQ ID NO: 244079 - RNA, 19 nt, Homo sapiens
gaacagugcaggacggaau

SEQ ID NO: 244080 - RNA, 19 nt, Homo sapiens
ucagaagccuacuuugaug

SEQ ID NO: 244081 - RNA, 19 nt, Homo sapiens
ugagugagaucuucaaugc

SEQ ID NO: 244082 - RNA, 19 nt, Homo sapiens
caacauaccagaccacucu

SEQ ID NO: 244083 - RNA, 19 nt, Homo sapiens
ggaucgauaugcucaagau

SEQ ID NO: 244084 - RNA, 19 nt, Homo sapiens
uuaaaugccuuccuucucu

SEQ ID NO: 244085 - RNA, 19 nt, Homo sapiens
gaagccuacuuugauggua

SEQ ID NO: 244086 - RNA, 19 nt, Homo sapiens
ggucaacggcccuguuuau

SEQ ID NO: 244087 - RNA, 19 nt, Homo sapiens
agaaagaagagaagaagaa

SEQ ID NO: 244088 - RNA, 19 nt, Homo sapiens
ucucuugucucacaugcua

SEQ ID NO: 244089 - RNA, 19 nt, Homo sapiens
ucccaagguuuccaagaua

SEQ ID NO: 244090 - RNA, 19 nt, Homo sapiens
gcaggaggcuagcaaagcu

SEQ ID NO: 244091 - RNA, 19 nt, Homo sapiens
caaaggcucuacacauacu

SEQ ID NO: 244092 - RNA, 19 nt, Homo sapiens
gcaggaaaguacagaugca

SEQ ID NO: 244093 - RNA, 19 nt, Homo sapiens
ccagaccucuacaagcaaa

SEQ ID NO: 244094 - RNA, 19 nt, Homo sapiens
cgaaauccuuugugucgau

SEQ ID NO: 244095 - RNA, 19 nt, Homo sapiens
aagaugaccugcugcuguu

SEQ ID NO: 244096 - RNA, 19 nt, Homo sapiens
agacgaagcaggccuuuau

SEQ ID NO: 244097 - RNA, 19 nt, Homo sapiens
ggaagaaggaagaugaaca

SEQ ID NO: 244098 - RNA, 19 nt, Homo sapiens
gaaauucagaagccuacuu

SEQ ID NO: 244099 - RNA, 19 nt, Homo sapiens
caugaaaucugaggaaggu

SEQ ID NO: 244100 - RNA, 19 nt, Homo sapiens
gaagguacaaacacaagug

SEQ ID NO: 244101 - RNA, 19 nt, Homo sapiens
auacuuggcugacggugaa

SEQ ID NO: 244102 - RNA, 19 nt, Homo sapiens
ggaagcagccauauuugag

SEQ ID NO: 244103 - RNA, 19 nt, Homo sapiens
agugagaucuucaaugcuu

SEQ ID NO: 244104 - RNA, 19 nt, Homo sapiens
gaaaacuucucacacuaug

SEQ ID NO: 244105 - RNA, 19 nt, Homo sapiens
ucaggaagguacaaacaca

SEQ ID NO: 244106 - RNA, 19 nt, Homo sapiens
uuacaggccucgcuacaag

SEQ ID NO: 244107 - RNA, 19 nt, Homo sapiens
cccaagguuuccaagauaa

SEQ ID NO: 244108 - RNA, 19 nt, Homo sapiens
cuagagcuguuucauucaa

SEQ ID NO: 244109 - RNA, 19 nt, Homo sapiens
ucaacggcccuguuuauau

SEQ ID NO: 244110 - RNA, 19 nt, Homo sapiens
ccacagggaagaaggaaga

SEQ ID NO: 244111 - RNA, 19 nt, Homo sapiens
aauugaagauggauguuug

SEQ ID NO: 244112 - RNA, 19 nt, Homo sapiens
ggagggcuguaggaagauu

SEQ ID NO: 244113 - RNA, 19 nt, Homo sapiens
ugaaugacguguccuacag

SEQ ID NO: 244114 - RNA, 19 nt, Homo sapiens
ugagauccaaguugaaauu

SEQ ID NO: 244115 - RNA, 19 nt, Homo sapiens
ggagcgagcagaugcaauc

SEQ ID NO: 244116 - RNA, 19 nt, Homo sapiens
gcucaaugcaugaaucugu

SEQ ID NO: 244117 - RNA, 19 nt, Homo sapiens
uagaggagcacuauuaugg

SEQ ID NO: 244118 - RNA, 19 nt, Homo sapiens
ccaagccaccuuccaguga

SEQ ID NO: 244119 - RNA, 19 nt, Homo sapiens
ggaugaaggacgugucuca

SEQ ID NO: 244120 - RNA, 19 nt, Homo sapiens
uauaaaggguuuucgugua

SEQ ID NO: 244121 - RNA, 19 nt, Homo sapiens
gagaaagaagagaagaaga

SEQ ID NO: 244122 - RNA, 19 nt, Homo sapiens
acgaagcaggccuuuauua

SEQ ID NO: 244123 - RNA, 19 nt, Homo sapiens
aaaacgaacugggaaaauu

SEQ ID NO: 244124 - RNA, 19 nt, Homo sapiens
gcuagcaaagcuuuaaaug

SEQ ID NO: 244125 - RNA, 19 nt, Homo sapiens
ggaauauagaggagcacua

SEQ ID NO: 244126 - RNA, 19 nt, Homo sapiens
gaagcagccauauuugagu

SEQ ID NO: 244127 - RNA, 19 nt, Homo sapiens
ccaaggacaaacuuacuau

SEQ ID NO: 244128 - RNA, 19 nt, Homo sapiens
gaggcuagcaaagcuuuaa

SEQ ID NO: 244129 - RNA, 19 nt, Homo sapiens
gaugguagguuugaaugac

SEQ ID NO: 244130 - RNA, 19 nt, Homo sapiens
agacaaaggcucuacacau

SEQ ID NO: 244131 - RNA, 19 nt, Homo sapiens
cagggaagaaggaagauga

SEQ ID NO: 244132 - RNA, 19 nt, Homo sapiens
aggacaaacuuacuaugga

SEQ ID NO: 244133 - RNA, 19 nt, Homo sapiens
aaauucagaagccuacuuu

SEQ ID NO: 244134 - RNA, 19 nt, Homo sapiens
gcuagcagaaguauaaagu

SEQ ID NO: 244135 - RNA, 19 nt, Homo sapiens
gaucgauaugcucaagaua

SEQ ID NO: 244136 - RNA, 19 nt, Homo sapiens
ggagccgagccaauuaauu

SEQ ID NO: 244137 - RNA, 19 nt, Homo sapiens
gagcuuacaagacccuaug

SEQ ID NO: 244138 - RNA, 19 nt, Homo sapiens
cucaaugcaugaaucugua

SEQ ID NO: 244139 - RNA, 19 nt, Homo sapiens
gaagagaagaagaaaauca

SEQ ID NO: 244140 - RNA, 19 nt, Homo sapiens
ugcaaucucuugucucaca

SEQ ID NO: 244141 - RNA, 19 nt, Homo sapiens
gacaaaggcucuacacaua

SEQ ID NO: 244142 - RNA, 19 nt, Homo sapiens
gaaggaagaugaacauguu

SEQ ID NO: 244143 - RNA, 19 nt, Homo sapiens
caacggcccuguuuauauu

SEQ ID NO: 244144 - RNA, 19 nt, Homo sapiens
caagauaagucaguuguaa

SEQ ID NO: 244145 - RNA, 19 nt, Homo sapiens
gaaagcaauuguacucuau

SEQ ID NO: 244146 - RNA, 19 nt, Homo sapiens
gaagauggauguuugucaa

SEQ ID NO: 244147 - RNA, 19 nt, Homo sapiens
gagccgagccaauuaauuu

SEQ ID NO: 244148 - RNA, 19 nt, Homo sapiens
ggacacaaaugcaguuauc

SEQ ID NO: 244149 - RNA, 19 nt, Homo sapiens
gaaccugucuggacuuauc

SEQ ID NO: 244150 - RNA, 19 nt, Homo sapiens
gagaaccugucuggacuua

SEQ ID NO: 244151 - RNA, 19 nt, Homo sapiens
gcaauuguacucuaucaaa

SEQ ID NO: 244152 - RNA, 19 nt, Homo sapiens
ggaccuggaugccaagcua

SEQ ID NO: 244153 - RNA, 19 nt, Homo sapiens
cgaaagcaauuguacucua

SEQ ID NO: 244154 - RNA, 19 nt, Homo sapiens
ggacuuaucgaaagcaauu

SEQ ID NO: 244155 - RNA, 19 nt, Homo sapiens
gaugcaaucucuugucuca

SEQ ID NO: 244156 - RNA, 19 nt, Homo sapiens
uagcagaaguauaaaguga

SEQ ID NO: 244157 - RNA, 19 nt, Homo sapiens
gaugaacuauuagacauga

SEQ ID NO: 244158 - RNA, 19 nt, Homo sapiens
ggagcacuauuauggauga

SEQ ID NO: 244159 - RNA, 19 nt, Homo sapiens
gaaagaagagaagaagaaa

SEQ ID NO: 244160 - RNA, 19 nt, Homo sapiens
caugagaguuucaaagguu

SEQ ID NO: 244161 - RNA, 19 nt, Homo sapiens
cgaagcaggccuuuauuaa

SEQ ID NO: 244162 - RNA, 19 nt, Homo sapiens
gcaggagccgagccaauua

SEQ ID NO: 244163 - RNA, 19 nt, Homo sapiens
gcagaaguauaaagugauc

SEQ ID NO: 244164 - RNA, 19 nt, Homo sapiens
agaccacucugcuucauuu

SEQ ID NO: 244165 - RNA, 19 nt, Homo sapiens
guaaauaagaugcaacaga

SEQ ID NO: 244166 - RNA, 19 nt, Homo sapiens
ggacuuacaggaucgauau

SEQ ID NO: 244167 - RNA, 19 nt, Homo sapiens
gcucaggacccauagauga

SEQ ID NO: 244168 - RNA, 19 nt, Homo sapiens
cgauaaagaacacgaauug

SEQ ID NO: 244169 - RNA, 19 nt, Homo sapiens
ugaaggugcugacaaagau

SEQ ID NO: 244170 - RNA, 19 nt, Homo sapiens
acaagcaaauggagaaguu

SEQ ID NO: 244171 - RNA, 19 nt, Homo sapiens
ggacgugucucaggagcuu

SEQ ID NO: 244172 - RNA, 19 nt, Homo sapiens
gaggagcacuauuauggau

SEQ ID NO: 244173 - RNA, 19 nt, Homo sapiens
gaagaaggaagaugaacau

SEQ ID NO: 244174 - RNA, 19 nt, Homo sapiens
gaacagugcaggacggaau

SEQ ID NO: 244175 - RNA, 19 nt, Homo sapiens
caucaacaauagaagaaga

SEQ ID NO: 244176 - RNA, 19 nt, Homo sapiens
ugagugagaucuucaaugc

SEQ ID NO: 244177 - RNA, 19 nt, Homo sapiens
caacauaccagaccacucu

SEQ ID NO: 244178 - RNA, 19 nt, Homo sapiens
ggaucgauaugcucaagau

SEQ ID NO: 244179 - RNA, 19 nt, Homo sapiens
ggucaacggcccuguuuau

SEQ ID NO: 244180 - RNA, 19 nt, Homo sapiens
agaaagaagagaagaagaa

SEQ ID NO: 244181 - RNA, 19 nt, Homo sapiens
ucucuugucucacaugcua

SEQ ID NO: 244182 - RNA, 19 nt, Homo sapiens
ucccaagguuuccaagaua

SEQ ID NO: 244183 - RNA, 19 nt, Homo sapiens
gggcuccgagguuauaaua

SEQ ID NO: 244184 - RNA, 19 nt, Homo sapiens
caaaggcucuacacauacu

SEQ ID NO: 244185 - RNA, 19 nt, Homo sapiens
gcaggaaaguacagaugca

SEQ ID NO: 244186 - RNA, 19 nt, Homo sapiens
ccagaccucuacaagcaaa

SEQ ID NO: 244187 - RNA, 19 nt, Homo sapiens
cgaaauccuuugugucgau

SEQ ID NO: 244188 - RNA, 19 nt, Homo sapiens
aagaugaccugcugcuguu

SEQ ID NO: 244189 - RNA, 19 nt, Homo sapiens
ggaagaaggaagaugaaca

SEQ ID NO: 244190 - RNA, 19 nt, Homo sapiens
agacgaagcaggccuuuau

SEQ ID NO: 244191 - RNA, 19 nt, Homo sapiens
caugaaaucugaggaaggu

SEQ ID NO: 244192 - RNA, 19 nt, Homo sapiens
gaagguacaaacacaagug

SEQ ID NO: 244193 - RNA, 19 nt, Homo sapiens
auacuuggcugacggugaa

SEQ ID NO: 244194 - RNA, 19 nt, Homo sapiens
gaggauauguucauuuuag

SEQ ID NO: 244195 - RNA, 19 nt, Homo sapiens
agugagaucuucaaugcuu

SEQ ID NO: 244196 - RNA, 19 nt, Homo sapiens
gaaaacuucucacacuaug

SEQ ID NO: 244197 - RNA, 19 nt, Homo sapiens
ucaggaagguacaaacaca

SEQ ID NO: 244198 - RNA, 19 nt, Homo sapiens
uuacaggccucgcuacaag

SEQ ID NO: 244199 - RNA, 19 nt, Homo sapiens
cccaagguuuccaagauaa

SEQ ID NO: 244200 - RNA, 19 nt, Homo sapiens
cuagagcuguuucauucaa

SEQ ID NO: 244201 - RNA, 19 nt, Homo sapiens
ucaacggcccuguuuauau

SEQ ID NO: 244202 - RNA, 19 nt, Homo sapiens
aauugaagauggauguuug

SEQ ID NO: 244203 - RNA, 19 nt, Homo sapiens
ccacagggaagaaggaaga

SEQ ID NO: 244204 - RNA, 19 nt, Homo sapiens
ggagcgagcagaugcaauc

SEQ ID NO: 244205 - RNA, 19 nt, Homo sapiens
gcucaaugcaugaaucugu

SEQ ID NO: 244206 - RNA, 19 nt, Homo sapiens
uagaggagcacuauuaugg

SEQ ID NO: 244207 - RNA, 19 nt, Homo sapiens
ggaugaaggacgugucuca

SEQ ID NO: 244208 - RNA, 19 nt, Homo sapiens
gagaaagaagagaagaaga

SEQ ID NO: 244209 - RNA, 19 nt, Homo sapiens
aaaacgaacugggaaaauu

SEQ ID NO: 244210 - RNA, 19 nt, Homo sapiens
uaacuuauccucucaugcu

SEQ ID NO: 244211 - RNA, 19 nt, Homo sapiens
acgaagcaggccuuuauua

SEQ ID NO: 244212 - RNA, 19 nt, Homo sapiens
ggaauauagaggagcacua

SEQ ID NO: 244213 - RNA, 19 nt, Homo sapiens
agacaaaggcucuacacau

SEQ ID NO: 244214 - RNA, 19 nt, Homo sapiens
cagggaagaaggaagauga

SEQ ID NO: 244215 - RNA, 19 nt, Homo sapiens
gcuagcagaaguauaaagu

SEQ ID NO: 244216 - RNA, 19 nt, Homo sapiens
gaucgauaugcucaagaua

SEQ ID NO: 244217 - RNA, 19 nt, Homo sapiens
ggagccgagccaauuaauu

SEQ ID NO: 244218 - RNA, 19 nt, Homo sapiens
gagcuuacaagacccuaug

SEQ ID NO: 244219 - RNA, 19 nt, Homo sapiens
ccaaaucaucaacaauaga

SEQ ID NO: 244220 - RNA, 19 nt, Homo sapiens
cucaaugcaugaaucugua

SEQ ID NO: 244221 - RNA, 19 nt, Homo sapiens
gaagagaagaagaaaauca

SEQ ID NO: 244222 - RNA, 19 nt, Homo sapiens
ugcaaucucuugucucaca

SEQ ID NO: 244223 - RNA, 19 nt, Homo sapiens
ugucuggacuuaucgaaag

SEQ ID NO: 244224 - RNA, 19 nt, Homo sapiens
cgagccaauuaauuucauu

SEQ ID NO: 244225 - RNA, 19 nt, Homo sapiens
gugcaggacggaauauaga

SEQ ID NO: 244226 - RNA, 19 nt, Homo sapiens
ucgauaugcucaagauaag

SEQ ID NO: 244227 - RNA, 19 nt, Homo sapiens
gucaacggcccuguuuaua

SEQ ID NO: 244228 - RNA, 19 nt, Homo sapiens
ccagacaggcucagguuuc

SEQ ID NO: 244229 - RNA, 19 nt, Homo sapiens
cccaaaucaucaacaauag

SEQ ID NO: 244230 - RNA, 19 nt, Homo sapiens
gauaugcucaagauaaguc

SEQ ID NO: 244231 - RNA, 19 nt, Homo sapiens
caggaaaggcccucugcuu

SEQ ID NO: 244232 - RNA, 19 nt, Homo sapiens
aaccagagcaggaaagaug

SEQ ID NO: 244233 - RNA, 19 nt, Homo sapiens
ggccaaggcaggaggauca

SEQ ID NO: 244234 - RNA, 19 nt, Homo sapiens
aagcaauuguacucuauca

SEQ ID NO: 244235 - RNA, 19 nt, Homo sapiens
caacaauagaagaagaaga

SEQ ID NO: 244236 - RNA, 19 nt, Homo sapiens
augagaguuucaaagguua

SEQ ID NO: 244237 - RNA, 19 nt, Homo sapiens
agaaauauugggagacgaa

SEQ ID NO: 244238 - RNA, 19 nt, Homo sapiens
uuucuucgaucccaagguu

SEQ ID NO: 244239 - RNA, 19 nt, Homo sapiens
gagacgaagcaggccuuua

SEQ ID NO: 244240 - RNA, 19 nt, Homo sapiens
gcuguugagugagaucuuc

SEQ ID NO: 244241 - RNA, 19 nt, Homo sapiens
gaacagaguggaagacaua

SEQ ID NO: 244242 - RNA, 19 nt, Homo sapiens
gaagauagccaaccaaugu

SEQ ID NO: 244243 - RNA, 19 nt, Homo sapiens
gagcaagacucaagacaug

SEQ ID NO: 244244 - RNA, 19 nt, Homo sapiens
caccacaccuggcaaauuu

SEQ ID NO: 244245 - RNA, 19 nt, Homo sapiens
gaggagagaucaccaugga

SEQ ID NO: 244246 - RNA, 19 nt, Homo sapiens
guucacagguucagagauu

SEQ ID NO: 244247 - RNA, 19 nt, Homo sapiens
ggaccgaggugacagugaa

SEQ ID NO: 244248 - RNA, 19 nt, Homo sapiens
gaaacuugcugccuauugg

SEQ ID NO: 244249 - RNA, 19 nt, Homo sapiens
gcugacgugugcaguaaua

SEQ ID NO: 244250 - RNA, 19 nt, Homo sapiens
ccacagacuuacagaagaa

SEQ ID NO: 244251 - RNA, 19 nt, Homo sapiens
gguagcagccgcagucaua

SEQ ID NO: 244252 - RNA, 19 nt, Homo sapiens
gcaagaagauagccaacca

SEQ ID NO: 244253 - RNA, 19 nt, Homo sapiens
caaccaaugugcuauucaa

SEQ ID NO: 244254 - RNA, 19 nt, Homo sapiens
caucugaucuguagucaca

SEQ ID NO: 244255 - RNA, 19 nt, Homo sapiens
gggcacugcugucuacuga

SEQ ID NO: 244256 - RNA, 19 nt, Homo sapiens
ccacgcaucugaucuguag

SEQ ID NO: 244257 - RNA, 19 nt, Homo sapiens
gaagaaguggcccuccaua

SEQ ID NO: 244258 - RNA, 19 nt, Homo sapiens
caugguaccugcacaccua

SEQ ID NO: 244259 - RNA, 19 nt, Homo sapiens
caugauugauggauguuaa

SEQ ID NO: 244260 - RNA, 19 nt, Homo sapiens
gagccaaggugacgcugaa

SEQ ID NO: 244261 - RNA, 19 nt, Homo sapiens
ggaacaaccggaaggugua

SEQ ID NO: 244262 - RNA, 19 nt, Homo sapiens
agcggaagaucaagaaaua

SEQ ID NO: 244263 - RNA, 19 nt, Homo sapiens
agacauguguagcaucaaa

SEQ ID NO: 244264 - RNA, 19 nt, Homo sapiens
guuaaagucuagccugaug

SEQ ID NO: 244265 - RNA, 19 nt, Homo sapiens
caagaaauacagacuacaa

SEQ ID NO: 244266 - RNA, 19 nt, Homo sapiens
gaucaagaaauacagacua

SEQ ID NO: 244267 - RNA, 19 nt, Homo sapiens
gcucaagugucuaaaggau

SEQ ID NO: 244268 - RNA, 19 nt, Homo sapiens
gaugggcagucaacagcua

SEQ ID NO: 244269 - RNA, 19 nt, Homo sapiens
ccagacuuccuuuguguua

SEQ ID NO: 244270 - RNA, 19 nt, Homo sapiens
ggaauaugcccaagcuaug

SEQ ID NO: 244271 - RNA, 19 nt, Homo sapiens
gcugaggcccacagacuua

SEQ ID NO: 244272 - RNA, 19 nt, Homo sapiens
acgcugagcuccucugcua

SEQ ID NO: 244273 - RNA, 19 nt, Homo sapiens
ggcuggagcuguuugagaa

SEQ ID NO: 244274 - RNA, 19 nt, Homo sapiens
gaagaucaagaaauacaga

SEQ ID NO: 244275 - RNA, 19 nt, Homo sapiens
cugaguagcugggaccaua

SEQ ID NO: 244276 - RNA, 19 nt, Homo sapiens
gagcucaagugucuaaagg

SEQ ID NO: 244277 - RNA, 19 nt, Homo sapiens
ggaaggagcaagacucaag

SEQ ID NO: 244278 - RNA, 19 nt, Homo sapiens
gggaauaugcccaagcuau

SEQ ID NO: 244279 - RNA, 19 nt, Homo sapiens
gcuaugccuuguccucuug

SEQ ID NO: 244280 - RNA, 19 nt, Homo sapiens
cauucaaggucaccaggua

SEQ ID NO: 244281 - RNA, 19 nt, Homo sapiens
acacaaaggcccacacuuc

SEQ ID NO: 244282 - RNA, 19 nt, Homo sapiens
caacugggaaauacugaaa

SEQ ID NO: 244283 - RNA, 19 nt, Homo sapiens
ucacaugacuaagccaaga

SEQ ID NO: 244284 - RNA, 19 nt, Homo sapiens
uguaugaacugagcaaugu

SEQ ID NO: 244285 - RNA, 19 nt, Homo sapiens
gacauacaacugggaaaua

SEQ ID NO: 244286 - RNA, 19 nt, Homo sapiens
ugauggauguuaaagucua

SEQ ID NO: 244287 - RNA, 19 nt, Homo sapiens
ccaaugugcuauucaaacu

SEQ ID NO: 244288 - RNA, 19 nt, Homo sapiens
gcccagacuuccuuugugu

SEQ ID NO: 244289 - RNA, 19 nt, Homo sapiens
acugggagcuugcacuauu

SEQ ID NO: 244290 - RNA, 19 nt, Homo sapiens
ggacauacaacugggaaau

SEQ ID NO: 244291 - RNA, 19 nt, Homo sapiens
ugagcaaugugcaagaaga

SEQ ID NO: 244292 - RNA, 19 nt, Homo sapiens
ccagugggcaagaaccuua

SEQ ID NO: 244293 - RNA, 19 nt, Homo sapiens
gggcugggacuucucauug

SEQ ID NO: 244294 - RNA, 19 nt, Homo sapiens
gaaggagcaagacucaaga

SEQ ID NO: 244295 - RNA, 19 nt, Homo sapiens
ccaacgugauucugacgaa

SEQ ID NO: 244296 - RNA, 19 nt, Homo sapiens
aaaccuuccucaccgugua

SEQ ID NO: 244297 - RNA, 19 nt, Homo sapiens
caacaccacaccuggcaaa

SEQ ID NO: 244298 - RNA, 19 nt, Homo sapiens
caucaucacugugguagca

SEQ ID NO: 244299 - RNA, 19 nt, Homo sapiens
ucacugcagucuugaccuu

SEQ ID NO: 244300 - RNA, 19 nt, Homo sapiens
uauguaggcuaaaugaaca

SEQ ID NO: 244301 - RNA, 19 nt, Homo sapiens
gcuccgugcuggugacaug

SEQ ID NO: 244302 - RNA, 19 nt, Homo sapiens
cggcugacgugugcaguaa

SEQ ID NO: 244303 - RNA, 19 nt, Homo sapiens
gcaaugugcaagaagauag

SEQ ID NO: 244304 - RNA, 19 nt, Homo sapiens
agaaguggcccuccauaga

SEQ ID NO: 244305 - RNA, 19 nt, Homo sapiens
ggagcuucguguccuguau

SEQ ID NO: 244306 - RNA, 19 nt, Homo sapiens
gaagccagaggucucagaa

SEQ ID NO: 244307 - RNA, 19 nt, Homo sapiens
gaaguggcccuccauagac

SEQ ID NO: 244308 - RNA, 19 nt, Homo sapiens
gaaauacagacuacaacag

SEQ ID NO: 244309 - RNA, 19 nt, Homo sapiens
cccaagggcuggagcuguu

SEQ ID NO: 244310 - RNA, 19 nt, Homo sapiens
gaacaaccggaagguguau

SEQ ID NO: 244311 - RNA, 19 nt, Homo sapiens
uauauggacugguaauggu

SEQ ID NO: 244312 - RNA, 19 nt, Homo sapiens
gaggaaggagcaagacuca

SEQ ID NO: 244313 - RNA, 19 nt, Homo sapiens
auacauuucugccaguguu

SEQ ID NO: 244314 - RNA, 19 nt, Homo sapiens
aaacugacaccuuuguuag

SEQ ID NO: 244315 - RNA, 19 nt, Homo sapiens
ccaguuuccugcagugauc

SEQ ID NO: 244316 - RNA, 19 nt, Homo sapiens
auagacauguguagcauca

SEQ ID NO: 244317 - RNA, 19 nt, Homo sapiens
agacauagccccaccauga

SEQ ID NO: 244318 - RNA, 19 nt, Homo sapiens
uaccagcuauuuauugagu

SEQ ID NO: 244319 - RNA, 19 nt, Homo sapiens
gcaagacucaagacaugau

SEQ ID NO: 244320 - RNA, 19 nt, Homo sapiens
ggagcaagacucaagacau

SEQ ID NO: 244321 - RNA, 19 nt, Homo sapiens
ccucggccuucccauauug

SEQ ID NO: 244322 - RNA, 19 nt, Homo sapiens
gacugucacucgagaucuu

SEQ ID NO: 244323 - RNA, 19 nt, Homo sapiens
caugagugcccagggaaua

SEQ ID NO: 244324 - RNA, 19 nt, Homo sapiens
ugggaaauacugaaacuug

SEQ ID NO: 244325 - RNA, 19 nt, Homo sapiens
ccaagaggaaggagcaaga

SEQ ID NO: 244326 - RNA, 19 nt, Homo sapiens
ggacguggccagaaaauuc

SEQ ID NO: 244327 - RNA, 19 nt, Homo sapiens
uauucaaacugcccugaug

SEQ ID NO: 244328 - RNA, 19 nt, Homo sapiens
ccuaccagcuccagaccuu

SEQ ID NO: 244329 - RNA, 19 nt, Homo sapiens
aauaaagcuuucucaacug

SEQ ID NO: 244330 - RNA, 19 nt, Homo sapiens
ccacaccuggcaaauuuga

SEQ ID NO: 244331 - RNA, 19 nt, Homo sapiens
ccccaaaacugacaccuuu

SEQ ID NO: 244332 - RNA, 19 nt, Homo sapiens
gcacuauauggacugguaa

SEQ ID NO: 244333 - RNA, 19 nt, Homo sapiens
gauggauguuaaagucuag

SEQ ID NO: 244334 - RNA, 19 nt, Homo sapiens
cugcaggccucagcacgua

SEQ ID NO: 244335 - RNA, 19 nt, Homo sapiens
uaaaugaacauaggucucu

SEQ ID NO: 244336 - RNA, 19 nt, Homo sapiens
ggcauuguccucagucaga

SEQ ID NO: 244337 - RNA, 19 nt, Homo sapiens
gccaaccaaugugcuauuc

SEQ ID NO: 244338 - RNA, 19 nt, Homo sapiens
gaccauaggcucacaacac

SEQ ID NO: 244339 - RNA, 19 nt, Homo sapiens
ucacugggagcuugcacua

SEQ ID NO: 244340 - RNA, 19 nt, Homo sapiens
ccagcuauuuauugagugu

SEQ ID NO: 244341 - RNA, 19 nt, Homo sapiens
gcaaugagacucugcacua

SEQ ID NO: 244342 - RNA, 19 nt, Homo sapiens
gcaaguccuucaccauuga

SEQ ID NO: 244343 - RNA, 19 nt, Homo sapiens
ucaaacaucucccaugaca

SEQ ID NO: 244344 - RNA, 19 nt, Homo sapiens
gcagagacuugggacauug

SEQ ID NO: 244345 - RNA, 19 nt, Homo sapiens
ucucaaacaucucccauga

SEQ ID NO: 244346 - RNA, 19 nt, Homo sapiens
ggcaaguccuucaccauug

SEQ ID NO: 244347 - RNA, 19 nt, Homo sapiens
aagcaggagucaaugaauu

SEQ ID NO: 244348 - RNA, 19 nt, Homo sapiens
ggaagcaggagucaaugaa

SEQ ID NO: 244349 - RNA, 19 nt, Homo sapiens
gggcaaguccuucaccauu

SEQ ID NO: 244350 - RNA, 19 nt, Homo sapiens
cgaacaggcucaguggaaa

SEQ ID NO: 244351 - RNA, 19 nt, Homo sapiens
caaugagacucugcacuau

SEQ ID NO: 244352 - RNA, 19 nt, Homo sapiens
ggcaacaucuuucacaaac

SEQ ID NO: 244353 - RNA, 19 nt, Homo sapiens
caacaucuuucacaaacac

SEQ ID NO: 244354 - RNA, 19 nt, Homo sapiens
gaucggaugagaagguauu

SEQ ID NO: 244355 - RNA, 19 nt, Homo sapiens
gcaacaucuuucacaaaca

SEQ ID NO: 244356 - RNA, 19 nt, Homo sapiens
augagacucugcacuauga

SEQ ID NO: 244357 - RNA, 19 nt, Homo sapiens
gaagcaggagucaaugaau

SEQ ID NO: 244358 - RNA, 19 nt, Homo sapiens
aacauuacuuggucucaaa

SEQ ID NO: 244359 - RNA, 19 nt, Homo sapiens
aaacauuacuuggucucaa

SEQ ID NO: 244360 - RNA, 19 nt, Homo sapiens
agaccucucuaaauaagau

SEQ ID NO: 244361 - RNA, 19 nt, Homo sapiens
caucuguccugcucugcuu

SEQ ID NO: 244362 - RNA, 19 nt, Homo sapiens
gggaagcaggagucaauga

SEQ ID NO: 244363 - RNA, 19 nt, Homo sapiens
ugagaagguauucgaggua

SEQ ID NO: 244364 - RNA, 19 nt, Homo sapiens
caggcucaguggaaacauu

SEQ ID NO: 244365 - RNA, 19 nt, Homo sapiens
guacacgugaggccaaaga

SEQ ID NO: 244366 - RNA, 19 nt, Homo sapiens
ucacgguggugucgguguu

SEQ ID NO: 244367 - RNA, 19 nt, Homo sapiens
ggacagccucacccucuuc

SEQ ID NO: 244368 - RNA, 19 nt, Homo sapiens
guggcaacaucuuucacaa

SEQ ID NO: 244369 - RNA, 19 nt, Homo sapiens
ugacacugcaacccacuuu

SEQ ID NO: 244370 - RNA, 19 nt, Homo sapiens
gaaacauuacuuggucuca

SEQ ID NO: 244371 - RNA, 19 nt, Homo sapiens
gaacaggcucaguggaaac

SEQ ID NO: 244372 - RNA, 19 nt, Homo sapiens
guccugcucugcuucaucu

SEQ ID NO: 244373 - RNA, 19 nt, Homo sapiens
ggaggccacagccacauuc

SEQ ID NO: 244374 - RNA, 19 nt, Homo sapiens
ucaguggaaacauuacuug

SEQ ID NO: 244375 - RNA, 19 nt, Homo sapiens
uuucuagcccgaauacaaa

SEQ ID NO: 244376 - RNA, 19 nt, Homo sapiens
uggcugugcuggacuugau

SEQ ID NO: 244377 - RNA, 19 nt, Homo sapiens
ggauggccaccgcaacuuc

SEQ ID NO: 244378 - RNA, 19 nt, Homo sapiens
aggagucaaugaauuccaa

SEQ ID NO: 244379 - RNA, 19 nt, Homo sapiens
aggcucaguggaaacauua

SEQ ID NO: 244380 - RNA, 19 nt, Homo sapiens
uggcaacaucuuucacaaa

SEQ ID NO: 244381 - RNA, 19 nt, Homo sapiens
gaggauggccaccgcaacu

SEQ ID NO: 244382 - RNA, 19 nt, Homo sapiens
gacaggcagcagagacuug

SEQ ID NO: 244383 - RNA, 19 nt, Homo sapiens
caucuucggccagcacuug

SEQ ID NO: 244384 - RNA, 19 nt, Homo sapiens
gagacucugcacuaugaga

SEQ ID NO: 244385 - RNA, 19 nt, Homo sapiens
ccgggaagcaggagucaau

SEQ ID NO: 244386 - RNA, 19 nt, Homo sapiens
aggaucggaugagaaggua

SEQ ID NO: 244387 - RNA, 19 nt, Homo sapiens
acgaacaggcucaguggaa

SEQ ID NO: 244388 - RNA, 19 nt, Homo sapiens
gacuugggacauugccuuu

SEQ ID NO: 244389 - RNA, 19 nt, Homo sapiens
cagcagagacuugggacau

SEQ ID NO: 244390 - RNA, 19 nt, Homo sapiens
gguggcaacaucuuucaca

SEQ ID NO: 244391 - RNA, 19 nt, Homo sapiens
gcacagaacuggacaugca

SEQ ID NO: 244392 - RNA, 19 nt, Homo sapiens
gaacugcaguacugauugu

SEQ ID NO: 244393 - RNA, 19 nt, Homo sapiens
ugcaauggcucccagauaa

SEQ ID NO: 244394 - RNA, 19 nt, Homo sapiens
caauaaagccuucaaacuc

SEQ ID NO: 244395 - RNA, 19 nt, Homo sapiens
gagcggcaguuaccauguu

SEQ ID NO: 244396 - RNA, 19 nt, Homo sapiens
caacuucagcuaaaugcua

SEQ ID NO: 244397 - RNA, 19 nt, Homo sapiens
cacuugaaauggaaagaua

SEQ ID NO: 244398 - RNA, 19 nt, Homo sapiens
ccucuaacaucaccgugua

SEQ ID NO: 244399 - RNA, 19 nt, Homo sapiens
uaaaugcuaccgagaguga

SEQ ID NO: 244400 - RNA, 19 nt, Homo sapiens
gcuaaaugcuaccgagagu

SEQ ID NO: 244401 - RNA, 19 nt, Homo sapiens
caacguaacacauaauggu

SEQ ID NO: 244402 - RNA, 19 nt, Homo sapiens
agacgucccuaucaaagga

SEQ ID NO: 244403 - RNA, 19 nt, Homo sapiens
ucagauuccgcaccaauaa

SEQ ID NO: 244404 - RNA, 19 nt, Homo sapiens
gcagccagcucaacuucag

SEQ ID NO: 244405 - RNA, 19 nt, Homo sapiens
ccacagugaccgugaguug

SEQ ID NO: 244406 - RNA, 19 nt, Homo sapiens
auaacaggcuccucuaaca

SEQ ID NO: 244407 - RNA, 19 nt, Homo sapiens
ccaauaaagccuucaaacu

SEQ ID NO: 244408 - RNA, 19 nt, Homo sapiens
ggagacgucccuaucaaag

SEQ ID NO: 244409 - RNA, 19 nt, Homo sapiens
gaacuugacggucuuuagc

SEQ ID NO: 244410 - RNA, 19 nt, Homo sapiens
gggagaacuugacggucuu

SEQ ID NO: 244411 - RNA, 19 nt, Homo sapiens
gggaccagaugcugaaugc

SEQ ID NO: 244412 - RNA, 19 nt, Homo sapiens
ccagaacccugugcucucu

SEQ ID NO: 244413 - RNA, 19 nt, Homo sapiens
gauaacaggcuccucuaac

SEQ ID NO: 244414 - RNA, 19 nt, Homo sapiens
gcucaacuucagcuaaaug

SEQ ID NO: 244415 - RNA, 19 nt, Homo sapiens
ugaaugcgacagucaugaa

SEQ ID NO: 244416 - RNA, 19 nt, Homo sapiens
gcacuugaaauggaaagau

SEQ ID NO: 244417 - RNA, 19 nt, Homo sapiens
gcgaguucuugcacaggaa

SEQ ID NO: 244418 - RNA, 19 nt, Homo sapiens
cggauccucugcucagugu

SEQ ID NO: 244419 - RNA, 19 nt, Homo sapiens
gcaccaauaaagccuucaa

SEQ ID NO: 244420 - RNA, 19 nt, Homo sapiens
uuugugaacugcaguacug

SEQ ID NO: 244421 - RNA, 19 nt, Homo sapiens
gugaacugcaguacugauu

SEQ ID NO: 244422 - RNA, 19 nt, Homo sapiens
uaacaggcuccucuaacau

SEQ ID NO: 244423 - RNA, 19 nt, Homo sapiens
cgacggacgcagcuucuuc

SEQ ID NO: 244424 - RNA, 19 nt, Homo sapiens
gacggucuuuagcuuccua

SEQ ID NO: 244425 - RNA, 19 nt, Homo sapiens
gcuuggcugugcccucaga

SEQ ID NO: 244426 - RNA, 19 nt, Homo sapiens
caugagggguccacaguga

SEQ ID NO: 244427 - RNA, 19 nt, Homo sapiens
ccacggagccccuuucuca

SEQ ID NO: 244428 - RNA, 19 nt, Homo sapiens
cugcaauggcucccagaua

SEQ ID NO: 244429 - RNA, 19 nt, Homo sapiens
cagauuccgcaccaauaaa

SEQ ID NO: 244430 - RNA, 19 nt, Homo sapiens
cagauaacaggcuccucua

SEQ ID NO: 244431 - RNA, 19 nt, Homo sapiens
caacggagcggcaguuacc

SEQ ID NO: 244432 - RNA, 19 nt, Homo sapiens
gggcagccagcucaacuuc

SEQ ID NO: 244433 - RNA, 19 nt, Homo sapiens
gagaacuugacggucuuua

SEQ ID NO: 244434 - RNA, 19 nt, Homo sapiens
gauugucccagcucugaga

SEQ ID NO: 244435 - RNA, 19 nt, Homo sapiens
ggagaacuugacggucuuu

SEQ ID NO: 244436 - RNA, 19 nt, Homo sapiens
ggcugggacuguucgugaa

SEQ ID NO: 244437 - RNA, 19 nt, Homo sapiens
uuggagacgucccuaucaa

SEQ ID NO: 244438 - RNA, 19 nt, Homo sapiens
ucgucaacguaacacauaa

SEQ ID NO: 244439 - RNA, 19 nt, Homo sapiens
ggucuuuagcuuccuagga

SEQ ID NO: 244440 - RNA, 19 nt, Homo sapiens
acaggcuccucuaacauca

SEQ ID NO: 244441 - RNA, 19 nt, Homo sapiens
agauaacaggcuccucuaa

SEQ ID NO: 244442 - RNA, 19 nt, Homo sapiens
uaucguacuggccuuaaug

SEQ ID NO: 244443 - RNA, 19 nt, Homo sapiens
caauggcucccagauaaca

SEQ ID NO: 244444 - RNA, 19 nt, Homo sapiens
ugaacugcaguacugauug

SEQ ID NO: 244445 - RNA, 19 nt, Homo sapiens
gcaauggcucccagauaac

SEQ ID NO: 244446 - RNA, 19 nt, Homo sapiens
agcggcaguuaccauguua

SEQ ID NO: 244447 - RNA, 19 nt, Homo sapiens
cguggugacuaucguacug

SEQ ID NO: 244448 - RNA, 19 nt, Homo sapiens
gggcguggugacuaucgua

SEQ ID NO: 244449 - RNA, 19 nt, Homo sapiens
gcugaaugcgacagucaug

SEQ ID NO: 244450 - RNA, 19 nt, Homo sapiens
gcagccgacagaagcaaug

SEQ ID NO: 244451 - RNA, 19 nt, Homo sapiens
cccagcacuugaaauggaa

SEQ ID NO: 244452 - RNA, 19 nt, Homo sapiens
ugggcagccuucaaucuca

SEQ ID NO: 244453 - RNA, 19 nt, Homo sapiens
gcacgacccugucuccaaa

SEQ ID NO: 244454 - RNA, 19 nt, Homo sapiens
gcaagugccuagcuaugaa

SEQ ID NO: 244455 - RNA, 19 nt, Homo sapiens
gaagccgggucaucuauuc

SEQ ID NO: 244456 - RNA, 19 nt, Homo sapiens
ggaacccucuggaaucaau

SEQ ID NO: 244457 - RNA, 19 nt, Homo sapiens
gaccuugaccuacgaguuu

SEQ ID NO: 244458 - RNA, 19 nt, Homo sapiens
gaaacaaucuggggaaaug

SEQ ID NO: 244459 - RNA, 19 nt, Homo sapiens
ggaagucagugcagcucaa

SEQ ID NO: 244460 - RNA, 19 nt, Homo sapiens
caacagcucggcacccauu

SEQ ID NO: 244461 - RNA, 19 nt, Homo sapiens
agaggaauaugaaacaauc

SEQ ID NO: 244462 - RNA, 19 nt, Homo sapiens
uuccaucgcugcccuugua

SEQ ID NO: 244463 - RNA, 19 nt, Homo sapiens
ggucaucuauuccgaaagc

SEQ ID NO: 244464 - RNA, 19 nt, Homo sapiens
caggaucaccgccuacaaa

SEQ ID NO: 244465 - RNA, 19 nt, Homo sapiens
ggaagccgggucaucuauu

SEQ ID NO: 244466 - RNA, 19 nt, Homo sapiens
ggaccucagugcccuucug

SEQ ID NO: 244467 - RNA, 19 nt, Homo sapiens
ggucuuaaagggcaggaaa

SEQ ID NO: 244468 - RNA, 19 nt, Homo sapiens
uuaaagggcaggaaauaca

SEQ ID NO: 244469 - RNA, 19 nt, Homo sapiens
gggcaggaaauacacuuug

SEQ ID NO: 244470 - RNA, 19 nt, Homo sapiens
cgggucaucuauuccgaaa

SEQ ID NO: 244471 - RNA, 19 nt, Homo sapiens
ccucuggaaucaauaaagg

SEQ ID NO: 244472 - RNA, 19 nt, Homo sapiens
gaacccucuggaaucaaua

SEQ ID NO: 244473 - RNA, 19 nt, Homo sapiens
ccuguaaucccagcacuuu

SEQ ID NO: 244474 - RNA, 19 nt, Homo sapiens
cuaugcaagugccuagcua

SEQ ID NO: 244475 - RNA, 19 nt, Homo sapiens
ugaguugggaggauccuuu

SEQ ID NO: 244476 - RNA, 19 nt, Homo sapiens
gcaccuguggucccagcua

SEQ ID NO: 244477 - RNA, 19 nt, Homo sapiens
ucuuaaagggcaggaaaua

SEQ ID NO: 244478 - RNA, 19 nt, Homo sapiens
ggcaggaaauacacuuugc

SEQ ID NO: 244479 - RNA, 19 nt, Homo sapiens
agucagugcagcucaauug

SEQ ID NO: 244480 - RNA, 19 nt, Homo sapiens
gaagucagugcagcucaau

SEQ ID NO: 244481 - RNA, 19 nt, Homo sapiens
ugaagucccaggcguaaag

SEQ ID NO: 244482 - RNA, 19 nt, Homo sapiens
uaugaagucccaggcguaa

SEQ ID NO: 244483 - RNA, 19 nt, Homo sapiens
ccaacgugaccuugaccua

SEQ ID NO: 244484 - RNA, 19 nt, Homo sapiens
ugugggcgcugcguaccua

SEQ ID NO: 244485 - RNA, 19 nt, Homo sapiens
uagggauccuccucacugu

SEQ ID NO: 244486 - RNA, 19 nt, Homo sapiens
gaguugggaggauccuuug

SEQ ID NO: 244487 - RNA, 19 nt, Homo sapiens
cugcguaccuaugcaagug

SEQ ID NO: 244488 - RNA, 19 nt, Homo sapiens
gcucggcacccauuacacu

SEQ ID NO: 244489 - RNA, 19 nt, Homo sapiens
gccuggaucuggccaacgu

SEQ ID NO: 244490 - RNA, 19 nt, Homo sapiens
gcacgacccugucuccaaa

SEQ ID NO: 244491 - RNA, 19 nt, Homo sapiens
gcaagugccuagcuaugaa

SEQ ID NO: 244492 - RNA, 19 nt, Homo sapiens
gaagccgggucaucuauuc

SEQ ID NO: 244493 - RNA, 19 nt, Homo sapiens
ggaacccucuggaaucaau

SEQ ID NO: 244494 - RNA, 19 nt, Homo sapiens
gaccuugaccuacgaguuu

SEQ ID NO: 244495 - RNA, 19 nt, Homo sapiens
gaaacaaucuggggaaaug

SEQ ID NO: 244496 - RNA, 19 nt, Homo sapiens
ggaagucagugcagcucaa

SEQ ID NO: 244497 - RNA, 19 nt, Homo sapiens
caacagcucggcacccauu

SEQ ID NO: 244498 - RNA, 19 nt, Homo sapiens
agaggaauaugaaacaauc

SEQ ID NO: 244499 - RNA, 19 nt, Homo sapiens
uuccaucgcugcccuugua

SEQ ID NO: 244500 - RNA, 19 nt, Homo sapiens
ggucaucuauuccgaaagc

SEQ ID NO: 244501 - RNA, 19 nt, Homo sapiens
caggaucaccgccuacaaa

SEQ ID NO: 244502 - RNA, 19 nt, Homo sapiens
ggaagccgggucaucuauu

SEQ ID NO: 244503 - RNA, 19 nt, Homo sapiens
ggaccucagugcccuucug

SEQ ID NO: 244504 - RNA, 19 nt, Homo sapiens
ggucuuaaagggcaggaaa

SEQ ID NO: 244505 - RNA, 19 nt, Homo sapiens
uuaaagggcaggaaauaca

SEQ ID NO: 244506 - RNA, 19 nt, Homo sapiens
gggcaggaaauacacuuug

SEQ ID NO: 244507 - RNA, 19 nt, Homo sapiens
uguguuccguuccuaauuc

SEQ ID NO: 244508 - RNA, 19 nt, Homo sapiens
cgggucaucuauuccgaaa

SEQ ID NO: 244509 - RNA, 19 nt, Homo sapiens
ccucuggaaucaauaaagg

SEQ ID NO: 244510 - RNA, 19 nt, Homo sapiens
gaacccucuggaaucaaua

SEQ ID NO: 244511 - RNA, 19 nt, Homo sapiens
ccuguaaucccagcacuuu

SEQ ID NO: 244512 - RNA, 19 nt, Homo sapiens
cuaugcaagugccuagcua

SEQ ID NO: 244513 - RNA, 19 nt, Homo sapiens
ugaguugggaggauccuuu

SEQ ID NO: 244514 - RNA, 19 nt, Homo sapiens
gcaccuguggucccagcua

SEQ ID NO: 244515 - RNA, 19 nt, Homo sapiens
ucuuaaagggcaggaaaua

SEQ ID NO: 244516 - RNA, 19 nt, Homo sapiens
ggcaggaaauacacuuugc

SEQ ID NO: 244517 - RNA, 19 nt, Homo sapiens
agucagugcagcucaauug

SEQ ID NO: 244518 - RNA, 19 nt, Homo sapiens
gaagucagugcagcucaau

SEQ ID NO: 244519 - RNA, 19 nt, Homo sapiens
ugaagucccaggcguaaag

SEQ ID NO: 244520 - RNA, 19 nt, Homo sapiens
uaugaagucccaggcguaa

SEQ ID NO: 244521 - RNA, 19 nt, Homo sapiens
ccaacgugaccuugaccua

SEQ ID NO: 244522 - RNA, 19 nt, Homo sapiens
ugugggcgcugcguaccua

SEQ ID NO: 244523 - RNA, 19 nt, Homo sapiens
uagggauccuccucacugu

SEQ ID NO: 244524 - RNA, 19 nt, Homo sapiens
gaguugggaggauccuuug

SEQ ID NO: 244525 - RNA, 19 nt, Homo sapiens
cugcguaccuaugcaagug

SEQ ID NO: 244526 - RNA, 19 nt, Homo sapiens
gcucggcacccauuacacu

SEQ ID NO: 244527 - RNA, 19 nt, Homo sapiens
gccuggaucuggccaacgu

SEQ ID NO: 244528 - RNA, 19 nt, Homo sapiens
gaaacacgcuggcaagcaa

SEQ ID NO: 244529 - RNA, 19 nt, Homo sapiens
gaaugaaguuacagagaug

SEQ ID NO: 244530 - RNA, 19 nt, Homo sapiens
gcauagcccugccgagaug

SEQ ID NO: 244531 - RNA, 19 nt, Homo sapiens
gaguagacguuuaauacga

SEQ ID NO: 244532 - RNA, 19 nt, Homo sapiens
ugaauaagagcccagauuu

SEQ ID NO: 244533 - RNA, 19 nt, Homo sapiens
gugaucagcuucuacuaug

SEQ ID NO: 244534 - RNA, 19 nt, Homo sapiens
ugaaugaaguuacagagau

SEQ ID NO: 244535 - RNA, 19 nt, Homo sapiens
ggacugauuugggagaaug

SEQ ID NO: 244536 - RNA, 19 nt, Homo sapiens
ggagugcggucgcucugaa

SEQ ID NO: 244537 - RNA, 19 nt, Homo sapiens
aaagggaaguuuaaagaag

SEQ ID NO: 244538 - RNA, 19 nt, Homo sapiens
gaggaguagacguuuaaua

SEQ ID NO: 244539 - RNA, 19 nt, Homo sapiens
gaaccagccacuuggaaga

SEQ ID NO: 244540 - RNA, 19 nt, Homo sapiens
gcaucaugauuaaagaaug

SEQ ID NO: 244541 - RNA, 19 nt, Homo sapiens
ucgacgagcugaucaagga

SEQ ID NO: 244542 - RNA, 19 nt, Homo sapiens
gcaaaggcaggcccaacaa

SEQ ID NO: 244543 - RNA, 19 nt, Homo sapiens
gcaacgccguggugugcaa

SEQ ID NO: 244544 - RNA, 19 nt, Homo sapiens
cauacaaaguuuaccgaau

SEQ ID NO: 244545 - RNA, 19 nt, Homo sapiens
gcaggguggugcugugcuu

SEQ ID NO: 244546 - RNA, 19 nt, Homo sapiens
gaaaucgacgagcugauca

SEQ ID NO: 244547 - RNA, 19 nt, Homo sapiens
gauugacaguagcauguau

SEQ ID NO: 244548 - RNA, 19 nt, Homo sapiens
caaaguuuaccgaauuguu

SEQ ID NO: 244549 - RNA, 19 nt, Homo sapiens
gagguuacgcugugcuuug

SEQ ID NO: 244550 - RNA, 19 nt, Homo sapiens
uuccggauguuuccagaua

SEQ ID NO: 244551 - RNA, 19 nt, Homo sapiens
ggugaucagcuucuacuau

SEQ ID NO: 244552 - RNA, 19 nt, Homo sapiens
uacaaaguuuaccgaauug

SEQ ID NO: 244553 - RNA, 19 nt, Homo sapiens
agccuucuguggacgauua

SEQ ID NO: 244554 - RNA, 19 nt, Homo sapiens
ucggaggaguagacguuua

SEQ ID NO: 244555 - RNA, 19 nt, Homo sapiens
gaauaagagcccagauuuu

SEQ ID NO: 244556 - RNA, 19 nt, Homo sapiens
uuuaaggccugggcaguuu

SEQ ID NO: 244557 - RNA, 19 nt, Homo sapiens
ccggauguuuccagauauu

SEQ ID NO: 244558 - RNA, 19 nt, Homo sapiens
ucgagcagauugacaguag

SEQ ID NO: 244559 - RNA, 19 nt, Homo sapiens
aguagacguuuaauacgaa

SEQ ID NO: 244560 - RNA, 19 nt, Homo sapiens
ugccuuacuuugcacuuaa

SEQ ID NO: 244561 - RNA, 19 nt, Homo sapiens
acagaucaccgucuaagug

SEQ ID NO: 244562 - RNA, 19 nt, Homo sapiens
ggauguuuccagauauuug

SEQ ID NO: 244563 - RNA, 19 nt, Homo sapiens
gcauccaucucccuguuac

SEQ ID NO: 244564 - RNA, 19 nt, Homo sapiens
caacagaucaccgucuaag

SEQ ID NO: 244565 - RNA, 19 nt, Homo sapiens
ccacuuggaagacgagguu

SEQ ID NO: 244566 - RNA, 19 nt, Homo sapiens
cggaggaguagacguuuaa

SEQ ID NO: 244567 - RNA, 19 nt, Homo sapiens
ggugggaugccuuacuuug

SEQ ID NO: 244568 - RNA, 19 nt, Homo sapiens
agauugagcagcuguaugu

SEQ ID NO: 244569 - RNA, 19 nt, Homo sapiens
caggaugugugaccggaau

SEQ ID NO: 244570 - RNA, 19 nt, Homo sapiens
aaaguuuaccgaauuguuc

SEQ ID NO: 244571 - RNA, 19 nt, Homo sapiens
ggacauuuccgagccauac

SEQ ID NO: 244572 - RNA, 19 nt, Homo sapiens
ggaaacacgcuggcaagca

SEQ ID NO: 244573 - RNA, 19 nt, Homo sapiens
gagcccagauuuugaggaa

SEQ ID NO: 244574 - RNA, 19 nt, Homo sapiens
guuacgcugugcuuugaau

SEQ ID NO: 244575 - RNA, 19 nt, Homo sapiens
aauacgaaguggcgcauag

SEQ ID NO: 244576 - RNA, 19 nt, Homo sapiens
gcagauugagcagcuguau

SEQ ID NO: 244577 - RNA, 19 nt, Homo sapiens
cuacgacgcgcaccauuca

SEQ ID NO: 244578 - RNA, 19 nt, Homo sapiens
gugaaugaaguuacagaga

SEQ ID NO: 244579 - RNA, 19 nt, Homo sapiens
accaacagaucaccgucua

SEQ ID NO: 244580 - RNA, 19 nt, Homo sapiens
gauguuuccagauauuugu

SEQ ID NO: 244581 - RNA, 19 nt, Homo sapiens
cagauugacaguagcaugu

SEQ ID NO: 244582 - RNA, 19 nt, Homo sapiens
gcugugcuuugaauaagag

SEQ ID NO: 244583 - RNA, 19 nt, Homo sapiens
aggaguagacguuuaauac

SEQ ID NO: 244584 - RNA, 19 nt, Homo sapiens
ugggaugccuuacuuugca

SEQ ID NO: 244585 - RNA, 19 nt, Homo sapiens
cuggcaagcaagauuauaa

SEQ ID NO: 244586 - RNA, 19 nt, Homo sapiens
uccgagccauacaaaguuu

SEQ ID NO: 244587 - RNA, 19 nt, Homo sapiens
gggcauucucggaggagua

SEQ ID NO: 244588 - RNA, 19 nt, Homo sapiens
ugaaaucgacgagcugauc

SEQ ID NO: 244589 - RNA, 19 nt, Homo sapiens
cugcauccaucucccuguu

SEQ ID NO: 244590 - RNA, 19 nt, Homo sapiens
gcagaagaggcugggaaga

SEQ ID NO: 244591 - RNA, 19 nt, Homo sapiens
gagcagauugacaguagca

SEQ ID NO: 244592 - RNA, 19 nt, Homo sapiens
ggaguagacguuuaauacg

SEQ ID NO: 244593 - RNA, 19 nt, Homo sapiens
cagaagaggcugggaagag

SEQ ID NO: 244594 - RNA, 19 nt, Homo sapiens
cccuugcgcuccaaacuca

SEQ ID NO: 244595 - RNA, 19 nt, Homo sapiens
ugucggugauggccugaug

SEQ ID NO: 244596 - RNA, 19 nt, Homo sapiens
gcccgcaucaugauuaaag

SEQ ID NO: 244597 - RNA, 19 nt, Homo sapiens
ccaacagaucaccgucuaa

SEQ ID NO: 244598 - RNA, 19 nt, Homo sapiens
gaagaguuuccggauaugg

SEQ ID NO: 244599 - RNA, 19 nt, Homo sapiens
uugaauaagagcccagauu

SEQ ID NO: 244600 - RNA, 19 nt, Homo sapiens
gggagaaugaggagaagag

SEQ ID NO: 244601 - RNA, 19 nt, Homo sapiens
ccucacaccagagaucauu

SEQ ID NO: 244602 - RNA, 19 nt, Homo sapiens
gcuggcaagcaagauuaua

SEQ ID NO: 244603 - RNA, 19 nt, Homo sapiens
caaaggcaggcccaacaag

SEQ ID NO: 244604 - RNA, 19 nt, Homo sapiens
ggcagggcguguucgucaa

SEQ ID NO: 244605 - RNA, 19 nt, Homo sapiens
acgcuggcaagcaagauua

SEQ ID NO: 244606 - RNA, 19 nt, Homo sapiens
cugcgugaaugaaguuaca

SEQ ID NO: 244607 - RNA, 19 nt, Homo sapiens
agaaugaggagaagagcau

SEQ ID NO: 244608 - RNA, 19 nt, Homo sapiens
caggacugauuugggagaa

SEQ ID NO: 244609 - RNA, 19 nt, Homo sapiens
agguuacgcugugcuuuga

SEQ ID NO: 244610 - RNA, 19 nt, Homo sapiens
aaacuaggcguggcaacug

SEQ ID NO: 244611 - RNA, 19 nt, Homo sapiens
aauaagagcccagauuuug

SEQ ID NO: 244612 - RNA, 19 nt, Homo sapiens
cuagaucgcuugacaauau

SEQ ID NO: 244613 - RNA, 19 nt, Homo sapiens
gaagucagguuccauuugg

SEQ ID NO: 244614 - RNA, 19 nt, Homo sapiens
gcacugaguucaagagcau

SEQ ID NO: 244615 - RNA, 19 nt, Homo sapiens
ugucaaaccuuaauaaugc

SEQ ID NO: 244616 - RNA, 19 nt, Homo sapiens
gcaggagggucgacaugga

SEQ ID NO: 244617 - RNA, 19 nt, Homo sapiens
gaaagacggcacugaguuc

SEQ ID NO: 244618 - RNA, 19 nt, Homo sapiens
cauagaaucaggauagaaa

SEQ ID NO: 244619 - RNA, 19 nt, Homo sapiens
gcagaagucagguuccauu

SEQ ID NO: 244620 - RNA, 19 nt, Homo sapiens
ugaacaaagugaauuccaa

SEQ ID NO: 244621 - RNA, 19 nt, Homo sapiens
ggcagaaugugaacaaagu

SEQ ID NO: 244622 - RNA, 19 nt, Homo sapiens
agauagccaucacgcauaa

SEQ ID NO: 244623 - RNA, 19 nt, Homo sapiens
caaagcaagccgacaguga

SEQ ID NO: 244624 - RNA, 19 nt, Homo sapiens
cauaaggagauuucuguuu

SEQ ID NO: 244625 - RNA, 19 nt, Homo sapiens
aaacaagaucaacagguua

SEQ ID NO: 244626 - RNA, 19 nt, Homo sapiens
uaauaaugcaccucaugua

SEQ ID NO: 244627 - RNA, 19 nt, Homo sapiens
gagagcagccgcuaucagu

SEQ ID NO: 244628 - RNA, 19 nt, Homo sapiens
gagaggacuuucacaccau

SEQ ID NO: 244629 - RNA, 19 nt, Homo sapiens
gcagaaaauucgagacaug

SEQ ID NO: 244630 - RNA, 19 nt, Homo sapiens
gguugcagacgucuuuaua

SEQ ID NO: 244631 - RNA, 19 nt, Homo sapiens
gggaaaggcugagacaaaa

SEQ ID NO: 244632 - RNA, 19 nt, Homo sapiens
gagcagccgcuaucaguuc

SEQ ID NO: 244633 - RNA, 19 nt, Homo sapiens
cgggaaaggcugagacaaa

SEQ ID NO: 244634 - RNA, 19 nt, Homo sapiens
uauaggcagucaccauguu

SEQ ID NO: 244635 - RNA, 19 nt, Homo sapiens
agaggacuuucacaccaua

SEQ ID NO: 244636 - RNA, 19 nt, Homo sapiens
ggagccaucacaagaaugu

SEQ ID NO: 244637 - RNA, 19 nt, Homo sapiens
gggucgacauggacugaaa

SEQ ID NO: 244638 - RNA, 19 nt, Homo sapiens
aaaacaagaucaacagguu

SEQ ID NO: 244639 - RNA, 19 nt, Homo sapiens
acagugacaucccucuaga

SEQ ID NO: 244640 - RNA, 19 nt, Homo sapiens
aaacaugaaucgggaaagg

SEQ ID NO: 244641 - RNA, 19 nt, Homo sapiens
gaaugugaacaaagugaau

SEQ ID NO: 244642 - RNA, 19 nt, Homo sapiens
aauaaugcaccucauguau

SEQ ID NO: 244643 - RNA, 19 nt, Homo sapiens
cgaaggagccaacaaaaga

SEQ ID NO: 244644 - RNA, 19 nt, Homo sapiens
agaaagacggcacugaguu

SEQ ID NO: 244645 - RNA, 19 nt, Homo sapiens
gcagucaccauguugucaa

SEQ ID NO: 244646 - RNA, 19 nt, Homo sapiens
gcuaucaguuccggaaucu

SEQ ID NO: 244647 - RNA, 19 nt, Homo sapiens
ccucauguauuagucacaa

SEQ ID NO: 244648 - RNA, 19 nt, Homo sapiens
auaaugcaccucauguauu

SEQ ID NO: 244649 - RNA, 19 nt, Homo sapiens
cagauugccugcagaaaau

SEQ ID NO: 244650 - RNA, 19 nt, Homo sapiens
augcuugucuauaacauug

SEQ ID NO: 244651 - RNA, 19 nt, Homo sapiens
gaaaggcugagacaaaaga

SEQ ID NO: 244652 - RNA, 19 nt, Homo sapiens
caccgaaggagccaacaaa

SEQ ID NO: 244653 - RNA, 19 nt, Homo sapiens
uucgagacaugaucacuga

SEQ ID NO: 244654 - RNA, 19 nt, Homo sapiens
cagaagucagguuccauuu

SEQ ID NO: 244655 - RNA, 19 nt, Homo sapiens
cauuggagccaucacaaga

SEQ ID NO: 244656 - RNA, 19 nt, Homo sapiens
aagauagccaucacgcaua

SEQ ID NO: 244657 - RNA, 19 nt, Homo sapiens
cagaaugugaacaaaguga

SEQ ID NO: 244658 - RNA, 19 nt, Homo sapiens
uaacauuggagccaucaca

SEQ ID NO: 244659 - RNA, 19 nt, Homo sapiens
cuucauagaaucaggauag

SEQ ID NO: 244660 - RNA, 19 nt, Homo sapiens
gcaagccgacagugacauc

SEQ ID NO: 244661 - RNA, 19 nt, Homo sapiens
cagucaccauguugucaaa

SEQ ID NO: 244662 - RNA, 19 nt, Homo sapiens
gacagugacaucccucuag

SEQ ID NO: 244663 - RNA, 19 nt, Homo sapiens
gcuguuaaugcuugucuau

SEQ ID NO: 244664 - RNA, 19 nt, Homo sapiens
gcaccucauguauuaguca

SEQ ID NO: 244665 - RNA, 19 nt, Homo sapiens
accauguugucaaaccuua

SEQ ID NO: 244666 - RNA, 19 nt, Homo sapiens
ucauucugcuguaaagaca

SEQ ID NO: 244667 - RNA, 19 nt, Homo sapiens
agacggcacugaguucaag

SEQ ID NO: 244668 - RNA, 19 nt, Homo sapiens
gaaaacaugaaucgggaaa

SEQ ID NO: 244669 - RNA, 19 nt, Homo sapiens
cgacagugacaucccucua

SEQ ID NO: 244670 - RNA, 19 nt, Homo sapiens
uuaauaaugcaccucaugu

SEQ ID NO: 244671 - RNA, 19 nt, Homo sapiens
gggcagaaugugaacaaag

SEQ ID NO: 244672 - RNA, 19 nt, Homo sapiens
gcuugucuauaacauugga

SEQ ID NO: 244673 - RNA, 19 nt, Homo sapiens
gcagaaugugaacaaagug

SEQ ID NO: 244674 - RNA, 19 nt, Homo sapiens
caagaucaacagguuagga

SEQ ID NO: 244675 - RNA, 19 nt, Homo sapiens
cagaaagacggcacugagu

SEQ ID NO: 244676 - RNA, 19 nt, Homo sapiens
agaagucagguuccauuug

SEQ ID NO: 244677 - RNA, 19 nt, Homo sapiens
uugcagacgucuuuauagg

SEQ ID NO: 244678 - RNA, 19 nt, Homo sapiens
gaaggagccaacaaaagaa

SEQ ID NO: 244679 - RNA, 19 nt, Homo sapiens
cgacauggacugaaaucac

SEQ ID NO: 244680 - RNA, 19 nt, Homo sapiens
gagggucgacauggacuga

SEQ ID NO: 244681 - RNA, 19 nt, Homo sapiens
gacuuucacaccauaagga

SEQ ID NO: 244682 - RNA, 19 nt, Homo sapiens
ggacuuucacaccauaagg

SEQ ID NO: 244683 - RNA, 19 nt, Homo sapiens
gcagcugagaggacuuuca

SEQ ID NO: 244684 - RNA, 19 nt, Homo sapiens
ggaaauugcuuuguauugu

SEQ ID NO: 244685 - RNA, 19 nt, Homo sapiens
ggauuccacucguguguuu

SEQ ID NO: 244686 - RNA, 19 nt, Homo sapiens
ugaggaaauugcuuuguau

SEQ ID NO: 244687 - RNA, 19 nt, Homo sapiens
cugaggaaauugcuuugua

SEQ ID NO: 244688 - RNA, 19 nt, Homo sapiens
ucagggaccuucaguugga

SEQ ID NO: 244689 - RNA, 19 nt, Homo sapiens
gcuccucucugcacaccua

SEQ ID NO: 244690 - RNA, 19 nt, Homo sapiens
ccacucguguguuucuauu

SEQ ID NO: 244691 - RNA, 19 nt, Homo sapiens
caucagggaccuucaguug

SEQ ID NO: 244692 - RNA, 19 nt, Homo sapiens
gaggaaauugcuuuguauu

SEQ ID NO: 244693 - RNA, 19 nt, Homo sapiens
guuuggugcuucucagauu

SEQ ID NO: 244694 - RNA, 19 nt, Homo sapiens
ugagcaagguggagauucu

SEQ ID NO: 244695 - RNA, 19 nt, Homo sapiens
gagcagagcguggccaucu

SEQ ID NO: 244696 - RNA, 19 nt, Homo sapiens
caugaacggcuguuacuca

SEQ ID NO: 244697 - RNA, 19 nt, Homo sapiens
cgccaagaaucaugaaagu

SEQ ID NO: 244698 - RNA, 19 nt, Homo sapiens
gugcugcucuacgacauga

SEQ ID NO: 244699 - RNA, 19 nt, Homo sapiens
gcacgucaucgacuacauc

SEQ ID NO: 244700 - RNA, 19 nt, Homo sapiens
gacaugaacggcuguuacu

SEQ ID NO: 244701 - RNA, 19 nt, Homo sapiens
cgacaugaacggcuguuac

SEQ ID NO: 244702 - RNA, 19 nt, Homo sapiens
aggaaauugcuuuguauug

SEQ ID NO: 244703 - RNA, 19 nt, Homo sapiens
ggacgaucgcaucuugugu

SEQ ID NO: 244704 - RNA, 19 nt, Homo sapiens
uuuggugcuucucagauuu

SEQ ID NO: 244705 - RNA, 19 nt, Homo sapiens
uccagcacgucaucgacua

SEQ ID NO: 244706 - RNA, 19 nt, Homo sapiens
gagguggugcgcugucugu

SEQ ID NO: 244707 - RNA, 19 nt, Homo sapiens
ggucacguuuggugcuucu

SEQ ID NO: 244708 - RNA, 19 nt, Homo sapiens
ugaauucccuucugaguua

SEQ ID NO: 244709 - RNA, 19 nt, Homo sapiens
caacaacaacaacaacaaa

SEQ ID NO: 244710 - RNA, 19 nt, Homo sapiens
caacaacaacaacaaauuc

SEQ ID NO: 244711 - RNA, 19 nt, Homo sapiens
uaagcgguguucaugauuu

SEQ ID NO: 244712 - RNA, 19 nt, Homo sapiens
ggacucgcaucccacuauu

SEQ ID NO: 244713 - RNA, 19 nt, Homo sapiens
gaauaagcgguguucauga

SEQ ID NO: 244714 - RNA, 19 nt, Homo sapiens
gcacuguguggcugaauaa

SEQ ID NO: 244715 - RNA, 19 nt, Homo sapiens
cgaugagccugcuauacaa

SEQ ID NO: 244716 - RNA, 19 nt, Homo sapiens
acaagaaggugagcaagau

SEQ ID NO: 244717 - RNA, 19 nt, Homo sapiens
ucacaaggaggacaaguug

SEQ ID NO: 244718 - RNA, 19 nt, Homo sapiens
aauaagcgguguucaugau

SEQ ID NO: 244719 - RNA, 19 nt, Homo sapiens
cuucugaguuaaugucaaa

SEQ ID NO: 244720 - RNA, 19 nt, Homo sapiens
ccucaucgacuacaucuug

SEQ ID NO: 244721 - RNA, 19 nt, Homo sapiens
gaauucccuucugaguuaa

SEQ ID NO: 244722 - RNA, 19 nt, Homo sapiens
cuucugaauucccuucuga

SEQ ID NO: 244723 - RNA, 19 nt, Homo sapiens
caaguugaauggaccuuuu

SEQ ID NO: 244724 - RNA, 19 nt, Homo sapiens
cugaguuaaugucaaauga

SEQ ID NO: 244725 - RNA, 19 nt, Homo sapiens
acaaggaggacaaguugaa

SEQ ID NO: 244726 - RNA, 19 nt, Homo sapiens
ccgaugagccugcuauaca

SEQ ID NO: 244727 - RNA, 19 nt, Homo sapiens
gcacaacaacaacaacaac

SEQ ID NO: 244728 - RNA, 19 nt, Homo sapiens
cuugcaggcuucugaauuc

SEQ ID NO: 244729 - RNA, 19 nt, Homo sapiens
ugcagcaccucaucgacua

SEQ ID NO: 244730 - RNA, 19 nt, Homo sapiens
cagccugcaucaccagaga

SEQ ID NO: 244731 - RNA, 19 nt, Homo sapiens
gaaggugagcaagauggaa

SEQ ID NO: 244732 - RNA, 19 nt, Homo sapiens
cgugagguccguuaggaaa

SEQ ID NO: 244733 - RNA, 19 nt, Homo sapiens
cgguguucaugauuucuuu

SEQ ID NO: 244734 - RNA, 19 nt, Homo sapiens
caagaaggugagcaagaug

SEQ ID NO: 244735 - RNA, 19 nt, Homo sapiens
gaccacagccugggcaucu

SEQ ID NO: 244736 - RNA, 19 nt, Homo sapiens
acaacaacaacaacaacaa

SEQ ID NO: 244737 - RNA, 19 nt, Homo sapiens
aagcgguguucaugauuuc

SEQ ID NO: 244738 - RNA, 19 nt, Homo sapiens
gcaccucaucgacuacauc

SEQ ID NO: 244739 - RNA, 19 nt, Homo sapiens
agcacuguguggcugaaua

SEQ ID NO: 244740 - RNA, 19 nt, Homo sapiens
caaggaggacaaguugaau

SEQ ID NO: 244741 - RNA, 19 nt, Homo sapiens
ucgcaucccacuauuguca

SEQ ID NO: 244742 - RNA, 19 nt, Homo sapiens
aaggugagcaagauggaaa

SEQ ID NO: 244743 - RNA, 19 nt, Homo sapiens
agaacaagaaggugagcaa

SEQ ID NO: 244744 - RNA, 19 nt, Homo sapiens
ugagcaagauggaaauccu

SEQ ID NO: 244745 - RNA, 19 nt, Homo sapiens
ggaagaaguagaaaggaua

SEQ ID NO: 244746 - RNA, 19 nt, Homo sapiens
ggaaggugacuuucuguaa

SEQ ID NO: 244747 - RNA, 19 nt, Homo sapiens
ccacuugacuucaccaaau

SEQ ID NO: 244748 - RNA, 19 nt, Homo sapiens
gaagaaguagaaaggauaa

SEQ ID NO: 244749 - RNA, 19 nt, Homo sapiens
gaaggacugugaacuugug

SEQ ID NO: 244750 - RNA, 19 nt, Homo sapiens
gcgaaggacugugaacuug

SEQ ID NO: 244751 - RNA, 19 nt, Homo sapiens
gaaggugacuuucuguaac

SEQ ID NO: 244752 - RNA, 19 nt, Homo sapiens
cacagcaccucacuucuuu

SEQ ID NO: 244753 - RNA, 19 nt, Homo sapiens
guaacaaugcgauguauau

SEQ ID NO: 244754 - RNA, 19 nt, Homo sapiens
uggcugcucuccaaacuau

SEQ ID NO: 244755 - RNA, 19 nt, Homo sapiens
gcaggaagaaguagaaagg

SEQ ID NO: 244756 - RNA, 19 nt, Homo sapiens
ccgagaggcacucagcuua

SEQ ID NO: 244757 - RNA, 19 nt, Homo sapiens
ucacagcaccucacuucuu

SEQ ID NO: 244758 - RNA, 19 nt, Homo sapiens
acaggaaggugacuuucug

SEQ ID NO: 244759 - RNA, 19 nt, Homo sapiens
gaacuuguggccugaagag

SEQ ID NO: 244760 - RNA, 19 nt, Homo sapiens
ccugauuuaugaacucuau

SEQ ID NO: 244761 - RNA, 19 nt, Homo sapiens
guucuaaggucuuuucaga

SEQ ID NO: 244762 - RNA, 19 nt, Homo sapiens
gugacuuucuguaacaaug

SEQ ID NO: 244763 - RNA, 19 nt, Homo sapiens
gggcaccucuggacucacu

SEQ ID NO: 244764 - RNA, 19 nt, Homo sapiens
gcguggagguguggaagga

SEQ ID NO: 244765 - RNA, 19 nt, Homo sapiens
ccucacagcaccucacuuc

SEQ ID NO: 244766 - RNA, 19 nt, Homo sapiens
cagcuuagccagguggaaa

SEQ ID NO: 244767 - RNA, 19 nt, Homo sapiens
aaggugacuuucuguaaca

SEQ ID NO: 244768 - RNA, 19 nt, Homo sapiens
caggagcgaaggacuguga

SEQ ID NO: 244769 - RNA, 19 nt, Homo sapiens
aggaagaaguagaaaggau

SEQ ID NO: 244770 - RNA, 19 nt, Homo sapiens
gcgcgucaucgacuacauu

SEQ ID NO: 244771 - RNA, 19 nt, Homo sapiens
gagaggcacucagcuuagc

SEQ ID NO: 244772 - RNA, 19 nt, Homo sapiens
cccaaguucuaaggucuuu

SEQ ID NO: 244773 - RNA, 19 nt, Homo sapiens
gcaccucacuucuuuuggu

SEQ ID NO: 244774 - RNA, 19 nt, Homo sapiens
guagaaaggauaaaaugga

SEQ ID NO: 244775 - RNA, 19 nt, Homo sapiens
uguaacaaugcgauguaua

SEQ ID NO: 244776 - RNA, 19 nt, Homo sapiens
ucagcaggaagaaguagaa

SEQ ID NO: 244777 - RNA, 19 nt, Homo sapiens
cugaggagccgcugagcuu

SEQ ID NO: 244778 - RNA, 19 nt, Homo sapiens
ucuguaacaaugcgaugua

SEQ ID NO: 244779 - RNA, 19 nt, Homo sapiens
cacuugacuucaccaaauc

SEQ ID NO: 244780 - RNA, 19 nt, Homo sapiens
cgagaggcacucagcuuag

SEQ ID NO: 244781 - RNA, 19 nt, Homo sapiens
cgaaggacugugaacuugu

SEQ ID NO: 244782 - RNA, 19 nt, Homo sapiens
uacagcgcgucaucgacua

SEQ ID NO: 244783 - RNA, 19 nt, Homo sapiens
gagcaaagauucccucgua

SEQ ID NO: 244784 - RNA, 19 nt, Homo sapiens
ggaaaugcuuggauccuua

SEQ ID NO: 244785 - RNA, 19 nt, Homo sapiens
gaccgcaucuagauuauuu

SEQ ID NO: 244786 - RNA, 19 nt, Homo sapiens
ugacaggacugauaaauag

SEQ ID NO: 244787 - RNA, 19 nt, Homo sapiens
gacaaacucuuggaaauga

SEQ ID NO: 244788 - RNA, 19 nt, Homo sapiens
uuacagagcucuugauauc

SEQ ID NO: 244789 - RNA, 19 nt, Homo sapiens
gcaaagauucccucguaaa

SEQ ID NO: 244790 - RNA, 19 nt, Homo sapiens
gggaagagcagaaguuaga

SEQ ID NO: 244791 - RNA, 19 nt, Homo sapiens
gaaaucugcuguuuuauca

SEQ ID NO: 244792 - RNA, 19 nt, Homo sapiens
aagaguagauccgacuuua

SEQ ID NO: 244793 - RNA, 19 nt, Homo sapiens
gauaugaacgacugcuaua

SEQ ID NO: 244794 - RNA, 19 nt, Homo sapiens
aaugaacacuuucugcuuu

SEQ ID NO: 244795 - RNA, 19 nt, Homo sapiens
agauuucucugucuuguaa

SEQ ID NO: 244796 - RNA, 19 nt, Homo sapiens
gagcgacccucccgucaau

SEQ ID NO: 244797 - RNA, 19 nt, Homo sapiens
ccagagcauuguagauauu

SEQ ID NO: 244798 - RNA, 19 nt, Homo sapiens
aauagaagaucaagaguag

SEQ ID NO: 244799 - RNA, 19 nt, Homo sapiens
caugagauguuuaaucaca

SEQ ID NO: 244800 - RNA, 19 nt, Homo sapiens
cuaguggucuugcaugauu

SEQ ID NO: 244801 - RNA, 19 nt, Homo sapiens
ggacaaacucuuggaaaug

SEQ ID NO: 244802 - RNA, 19 nt, Homo sapiens
uuaaggaguuuacgaaauc

SEQ ID NO: 244803 - RNA, 19 nt, Homo sapiens
gaaaugcuuggauccuuaa

SEQ ID NO: 244804 - RNA, 19 nt, Homo sapiens
gaguagauccgacuuuaga

SEQ ID NO: 244805 - RNA, 19 nt, Homo sapiens
ugcaugagauguuuaauca

SEQ ID NO: 244806 - RNA, 19 nt, Homo sapiens
uaacugcugugaauuguac

SEQ ID NO: 244807 - RNA, 19 nt, Homo sapiens
uacgaaaucugcuguuuua

SEQ ID NO: 244808 - RNA, 19 nt, Homo sapiens
acagagcucuugauaucuu

SEQ ID NO: 244809 - RNA, 19 nt, Homo sapiens
ugaccaaggagcucaauuu

SEQ ID NO: 244810 - RNA, 19 nt, Homo sapiens
gugacaggacugauaaaua

SEQ ID NO: 244811 - RNA, 19 nt, Homo sapiens
gcugugaauuguacauuuc

SEQ ID NO: 244812 - RNA, 19 nt, Homo sapiens
caacaagaaagucagcaaa

SEQ ID NO: 244813 - RNA, 19 nt, Homo sapiens
cauaugggaugaggaaaug

SEQ ID NO: 244814 - RNA, 19 nt, Homo sapiens
caacugaggucaaaaugga

SEQ ID NO: 244815 - RNA, 19 nt, Homo sapiens
uaccagagcauuguagaua

SEQ ID NO: 244816 - RNA, 19 nt, Homo sapiens
ggacugauaaauagaagau

SEQ ID NO: 244817 - RNA, 19 nt, Homo sapiens
gagcagaaguuagagaaaa

SEQ ID NO: 244818 - RNA, 19 nt, Homo sapiens
caagaaagucagcaaagug

SEQ ID NO: 244819 - RNA, 19 nt, Homo sapiens
gaaaauacaccuuaucagu

SEQ ID NO: 244820 - RNA, 19 nt, Homo sapiens
uggccuggcucuuaauuug

SEQ ID NO: 244821 - RNA, 19 nt, Homo sapiens
cuauaagugugagaaagua

SEQ ID NO: 244822 - RNA, 19 nt, Homo sapiens
ccauguauauauagagaug

SEQ ID NO: 244823 - RNA, 19 nt, Homo sapiens
ucuuggaaaugaacacuuu

SEQ ID NO: 244824 - RNA, 19 nt, Homo sapiens
cuugauaucuugaaugucu

SEQ ID NO: 244825 - RNA, 19 nt, Homo sapiens
gaagagcagaaguuagaga

SEQ ID NO: 244826 - RNA, 19 nt, Homo sapiens
gagagagagaggaaagaaa

SEQ ID NO: 244827 - RNA, 19 nt, Homo sapiens
acacuaaagcuuaauguca

SEQ ID NO: 244828 - RNA, 19 nt, Homo sapiens
aguauagacucggaaguaa

SEQ ID NO: 244829 - RNA, 19 nt, Homo sapiens
caguauagacucggaagua

SEQ ID NO: 244830 - RNA, 19 nt, Homo sapiens
gggaauauuucuuuuggaa

SEQ ID NO: 244831 - RNA, 19 nt, Homo sapiens
ugagugacauuucauacca

SEQ ID NO: 244832 - RNA, 19 nt, Homo sapiens
gcacguucauaaacauucu

SEQ ID NO: 244833 - RNA, 19 nt, Homo sapiens
guagauuucucugucuugu

SEQ ID NO: 244834 - RNA, 19 nt, Homo sapiens
aagucgaucuucaaacauu

SEQ ID NO: 244835 - RNA, 19 nt, Homo sapiens
gcauaugggaugaggaaau

SEQ ID NO: 244836 - RNA, 19 nt, Homo sapiens
cagaguaaguguuuguuuu

SEQ ID NO: 244837 - RNA, 19 nt, Homo sapiens
guacaggguuuuauagugu

SEQ ID NO: 244838 - RNA, 19 nt, Homo sapiens
acaagaaagucagcaaagu

SEQ ID NO: 244839 - RNA, 19 nt, Homo sapiens
cuuaaggaguuuacgaaau

SEQ ID NO: 244840 - RNA, 19 nt, Homo sapiens
caagaguagauccgacuuu

SEQ ID NO: 244841 - RNA, 19 nt, Homo sapiens
gcuacugucccaucucuug

SEQ ID NO: 244842 - RNA, 19 nt, Homo sapiens
ggauaaaagucgaucuuca

SEQ ID NO: 244843 - RNA, 19 nt, Homo sapiens
aggacaaacucuuggaaau

SEQ ID NO: 244844 - RNA, 19 nt, Homo sapiens
gaauuguacauuucugugu

SEQ ID NO: 244845 - RNA, 19 nt, Homo sapiens
agucgaucuucaaacauua

SEQ ID NO: 244846 - RNA, 19 nt, Homo sapiens
aaaagucgaucuucaaaca

SEQ ID NO: 244847 - RNA, 19 nt, Homo sapiens
gagauccugcagcacguua

SEQ ID NO: 244848 - RNA, 19 nt, Homo sapiens
gauugcaugagauguuuaa

SEQ ID NO: 244849 - RNA, 19 nt, Homo sapiens
gcauacauguugaaaauac

SEQ ID NO: 244850 - RNA, 19 nt, Homo sapiens
uauaacugcugugaauugu

SEQ ID NO: 244851 - RNA, 19 nt, Homo sapiens
caagagagagagaggaaag

SEQ ID NO: 244852 - RNA, 19 nt, Homo sapiens
guucugaguccauucaaau

SEQ ID NO: 244853 - RNA, 19 nt, Homo sapiens
uagaagaucaagaguagau

SEQ ID NO: 244854 - RNA, 19 nt, Homo sapiens
cauaauggcaaauccuuca

SEQ ID NO: 244855 - RNA, 19 nt, Homo sapiens
guucucugcuugcuaccaa

SEQ ID NO: 244856 - RNA, 19 nt, Homo sapiens
caaaggacaaacucuugga

SEQ ID NO: 244857 - RNA, 19 nt, Homo sapiens
caaagauucccucguaaaa

SEQ ID NO: 244858 - RNA, 19 nt, Homo sapiens
gauaaaagucgaucuucaa

SEQ ID NO: 244859 - RNA, 19 nt, Homo sapiens
aaaguagauuucucugucu

SEQ ID NO: 244860 - RNA, 19 nt, Homo sapiens
uaaguuucaugucuguaca

SEQ ID NO: 244861 - RNA, 19 nt, Homo sapiens
uguuuggccuggcucuuaa

SEQ ID NO: 244862 - RNA, 19 nt, Homo sapiens
aauuacagagcucuugaua

SEQ ID NO: 244863 - RNA, 19 nt, Homo sapiens
uuauaacugcugugaauug

SEQ ID NO: 244864 - RNA, 19 nt, Homo sapiens
caagcagggcgacagcauu

SEQ ID NO: 244865 - RNA, 19 nt, Homo sapiens
gcagcacguuaucgacuac

SEQ ID NO: 244866 - RNA, 19 nt, Homo sapiens
gcuauguuacgcuaagcua

SEQ ID NO: 244867 - RNA, 19 nt, Homo sapiens
acaaacucuuggaaaugaa

SEQ ID NO: 244868 - RNA, 19 nt, Homo sapiens
gcgacccucccgucaauug

SEQ ID NO: 244869 - RNA, 19 nt, Homo sapiens
gcucuuaauuugcuuuugu

SEQ ID NO: 244870 - RNA, 19 nt, Homo sapiens
gagccaggagcacuagaga

SEQ ID NO: 244871 - RNA, 19 nt, Homo sapiens
uuuacgaaaucugcuguuu

SEQ ID NO: 244872 - RNA, 19 nt, Homo sapiens
cugcuuuccuuccuccaaa

SEQ ID NO: 244873 - RNA, 19 nt, Homo sapiens
aguuauagcuaguggucuu

SEQ ID NO: 244874 - RNA, 19 nt, Homo sapiens
uauagacucggaaguaaca

SEQ ID NO: 244875 - RNA, 19 nt, Homo sapiens
cgauaugaacgacugcuau

SEQ ID NO: 244876 - RNA, 19 nt, Homo sapiens
aaaugaacacuuucugcuu

SEQ ID NO: 244877 - RNA, 19 nt, Homo sapiens
gucacuaaguuucaugucu

SEQ ID NO: 244878 - RNA, 19 nt, Homo sapiens
gaugaggaaaugcuuggau

SEQ ID NO: 244879 - RNA, 19 nt, Homo sapiens
ugaaugauuuugcauaugg

SEQ ID NO: 244880 - RNA, 19 nt, Homo sapiens
acagaguaaguguuuguuu

SEQ ID NO: 244881 - RNA, 19 nt, Homo sapiens
gcgauaugaacgacugcua

SEQ ID NO: 244882 - RNA, 19 nt, Homo sapiens
gaccaaggagcucaauuuu

SEQ ID NO: 244883 - RNA, 19 nt, Homo sapiens
gacaagagcuacugaaauu

SEQ ID NO: 244884 - RNA, 19 nt, Homo sapiens
ucaaagggcuggguuaaua

SEQ ID NO: 244885 - RNA, 19 nt, Homo sapiens
acacugagguugcauauuu

SEQ ID NO: 244886 - RNA, 19 nt, Homo sapiens
gaacaaagaaauacccuaa

SEQ ID NO: 244887 - RNA, 19 nt, Homo sapiens
gaaaucaucucccagcaau

SEQ ID NO: 244888 - RNA, 19 nt, Homo sapiens
gaaguuacgugcagaagga

SEQ ID NO: 244889 - RNA, 19 nt, Homo sapiens
caaggaagauaucaucaaa

SEQ ID NO: 244890 - RNA, 19 nt, Homo sapiens
caaagcaccucagagaaua

SEQ ID NO: 244891 - RNA, 19 nt, Homo sapiens
gcucacagcggaauauuua

SEQ ID NO: 244892 - RNA, 19 nt, Homo sapiens
gaagcuaucugcugagugu

SEQ ID NO: 244893 - RNA, 19 nt, Homo sapiens
gaaaucacauuaccaaguc

SEQ ID NO: 244894 - RNA, 19 nt, Homo sapiens
guggagagcauaccaauua

SEQ ID NO: 244895 - RNA, 19 nt, Homo sapiens
gacagaggaugguuuguuu

SEQ ID NO: 244896 - RNA, 19 nt, Homo sapiens
gaggaaggauuauuacaug

SEQ ID NO: 244897 - RNA, 19 nt, Homo sapiens
ugacuaaucuggugguaaa

SEQ ID NO: 244898 - RNA, 19 nt, Homo sapiens
agaagaaugugaugaauga

SEQ ID NO: 244899 - RNA, 19 nt, Homo sapiens
uaaagacacuuaccaagga

SEQ ID NO: 244900 - RNA, 19 nt, Homo sapiens
gaaguggccuggacuaaag

SEQ ID NO: 244901 - RNA, 19 nt, Homo sapiens
gaaggauuauuacauguug

SEQ ID NO: 244902 - RNA, 19 nt, Homo sapiens
ucaaaugccuuuacuagug

SEQ ID NO: 244903 - RNA, 19 nt, Homo sapiens
gaacaugaccgaauucaag

SEQ ID NO: 244904 - RNA, 19 nt, Homo sapiens
guggaagcuuucuuaauua

SEQ ID NO: 244905 - RNA, 19 nt, Homo sapiens
gaggaugguuuguuuauca

SEQ ID NO: 244906 - RNA, 19 nt, Homo sapiens
guacaaacaagaagcuaua

SEQ ID NO: 244907 - RNA, 19 nt, Homo sapiens
gaugaaaguugcaaagaca

SEQ ID NO: 244908 - RNA, 19 nt, Homo sapiens
gaaaccacauauuaacuuc

SEQ ID NO: 244909 - RNA, 19 nt, Homo sapiens
aguggaagcuuucuuaauu

SEQ ID NO: 244910 - RNA, 19 nt, Homo sapiens
ggacuaaagaugaguuaaa

SEQ ID NO: 244911 - RNA, 19 nt, Homo sapiens
gaaauuccauucugcuuac

SEQ ID NO: 244912 - RNA, 19 nt, Homo sapiens
gcaaagcaccucagagaau

SEQ ID NO: 244913 - RNA, 19 nt, Homo sapiens
caucuuggccacuuuaaua

SEQ ID NO: 244914 - RNA, 19 nt, Homo sapiens
ccagggaaauggauucuug

SEQ ID NO: 244915 - RNA, 19 nt, Homo sapiens
gaaggcuugucucaacuuu

SEQ ID NO: 244916 - RNA, 19 nt, Homo sapiens
gauaaacucagaccagaaa

SEQ ID NO: 244917 - RNA, 19 nt, Homo sapiens
gaccgaggaaggauuauua

SEQ ID NO: 244918 - RNA, 19 nt, Homo sapiens
gagaauaggaaaucacauu

SEQ ID NO: 244919 - RNA, 19 nt, Homo sapiens
caaaguacuucuuaugagu

SEQ ID NO: 244920 - RNA, 19 nt, Homo sapiens
gaauuuagaccugacuuaa

SEQ ID NO: 244921 - RNA, 19 nt, Homo sapiens
uaacauggccuauuuguac

SEQ ID NO: 244922 - RNA, 19 nt, Homo sapiens
aaucaaauccuggucauua

SEQ ID NO: 244923 - RNA, 19 nt, Homo sapiens
caagaaggcauugauguaa

SEQ ID NO: 244924 - RNA, 19 nt, Homo sapiens
gaauacagccaguuucuca

SEQ ID NO: 244925 - RNA, 19 nt, Homo sapiens
agaaggaccucaagaaugg

SEQ ID NO: 244926 - RNA, 19 nt, Homo sapiens
gccacaaccugaagugauu

SEQ ID NO: 244927 - RNA, 19 nt, Homo sapiens
ugcgaucucuuaacaauuu

SEQ ID NO: 244928 - RNA, 19 nt, Homo sapiens
ugaacacccuuuccaagaa

SEQ ID NO: 244929 - RNA, 19 nt, Homo sapiens
gagcauaccaauuacuauu

SEQ ID NO: 244930 - RNA, 19 nt, Homo sapiens
gagguugcauauuuaaaga

SEQ ID NO: 244931 - RNA, 19 nt, Homo sapiens
uaagauugcaggaauauug

SEQ ID NO: 244932 - RNA, 19 nt, Homo sapiens
gcaugaagguccuggaagu

SEQ ID NO: 244933 - RNA, 19 nt, Homo sapiens
ccaagaaggcauugaugua

SEQ ID NO: 244934 - RNA, 19 nt, Homo sapiens
gguaucaaaguacuucuua

SEQ ID NO: 244935 - RNA, 19 nt, Homo sapiens
ggagaguucccaugucaaa

SEQ ID NO: 244936 - RNA, 19 nt, Homo sapiens
gaacacccuuuccaagaag

SEQ ID NO: 244937 - RNA, 19 nt, Homo sapiens
ggaaaucacauuaccaagu

SEQ ID NO: 244938 - RNA, 19 nt, Homo sapiens
agacagguuugcacaguuu

SEQ ID NO: 244939 - RNA, 19 nt, Homo sapiens
gagagcauaccaauuacua

SEQ ID NO: 244940 - RNA, 19 nt, Homo sapiens
ggccaaugguaucaaagua

SEQ ID NO: 244941 - RNA, 19 nt, Homo sapiens
gaagugauucagaacauga

SEQ ID NO: 244942 - RNA, 19 nt, Homo sapiens
cgacugcgcuggcuaaugc

SEQ ID NO: 244943 - RNA, 19 nt, Homo sapiens
gcagaaggaccucaagaau

SEQ ID NO: 244944 - RNA, 19 nt, Homo sapiens
gcaaaaugcugaccugaau

SEQ ID NO: 244945 - RNA, 19 nt, Homo sapiens
acaaagaaauacccuaaag

SEQ ID NO: 244946 - RNA, 19 nt, Homo sapiens
uauaugcgaucucuuaaca

SEQ ID NO: 244947 - RNA, 19 nt, Homo sapiens
ugaaauuccauucugcuua

SEQ ID NO: 244948 - RNA, 19 nt, Homo sapiens
gaagcuuucuuaauuacca

SEQ ID NO: 244949 - RNA, 19 nt, Homo sapiens
cagaguggaagcuuucuua

SEQ ID NO: 244950 - RNA, 19 nt, Homo sapiens
ccaccucacuaccuagaaa

SEQ ID NO: 244951 - RNA, 19 nt, Homo sapiens
ugaacaugcucauaccaaa

SEQ ID NO: 244952 - RNA, 19 nt, Homo sapiens
gaagacacccucauugaac

SEQ ID NO: 244953 - RNA, 19 nt, Homo sapiens
gaccugaaugggaaauuua

SEQ ID NO: 244954 - RNA, 19 nt, Homo sapiens
cuuaauggcuguuuguguu

SEQ ID NO: 244955 - RNA, 19 nt, Homo sapiens
aaauauugcuggcuuaagu

SEQ ID NO: 244956 - RNA, 19 nt, Homo sapiens
uaagguauccguccauguu

SEQ ID NO: 244957 - RNA, 19 nt, Homo sapiens
uagaggacaugacagaaga

SEQ ID NO: 244958 - RNA, 19 nt, Homo sapiens
ugucacggcugcacauuga

SEQ ID NO: 244959 - RNA, 19 nt, Homo sapiens
gaaaauggcuaccuuugag

SEQ ID NO: 244960 - RNA, 19 nt, Homo sapiens
ggacagguaacaaauauac

SEQ ID NO: 244961 - RNA, 19 nt, Homo sapiens
caaagaaauacccuaaaga

SEQ ID NO: 244962 - RNA, 19 nt, Homo sapiens
aagaagcucuggaugaugu

SEQ ID NO: 244963 - RNA, 19 nt, Homo sapiens
acuguaacauggccuauuu

SEQ ID NO: 244964 - RNA, 19 nt, Homo sapiens
ggaaggauuauuacauguu

SEQ ID NO: 244965 - RNA, 19 nt, Homo sapiens
ggaaggagcccgagguuuu

SEQ ID NO: 244966 - RNA, 19 nt, Homo sapiens
ccacuuuaauaguuucuga

SEQ ID NO: 244967 - RNA, 19 nt, Homo sapiens
cgagauauacuaccaaaca

SEQ ID NO: 244968 - RNA, 19 nt, Homo sapiens
agaccugacuuaauagaga

SEQ ID NO: 244969 - RNA, 19 nt, Homo sapiens
ggcuagagcuggccaaugg

SEQ ID NO: 244970 - RNA, 19 nt, Homo sapiens
ugaccugaaugggaaauuu

SEQ ID NO: 244971 - RNA, 19 nt, Homo sapiens
ccuggagacucuuucaauu

SEQ ID NO: 244972 - RNA, 19 nt, Homo sapiens
aaacugaucgcacagaaga

SEQ ID NO: 244973 - RNA, 19 nt, Homo sapiens
gagacucuuucaauuggaa

SEQ ID NO: 244974 - RNA, 19 nt, Homo sapiens
gagaagaaugugaugaaug

SEQ ID NO: 244975 - RNA, 19 nt, Homo sapiens
aaagccaccucacuaccua

SEQ ID NO: 244976 - RNA, 19 nt, Homo sapiens
gaauuaugcagaugguuga

SEQ ID NO: 244977 - RNA, 19 nt, Homo sapiens
ucaaaguacuucuuaugag

SEQ ID NO: 244978 - RNA, 19 nt, Homo sapiens
cacugagguugcauauuua

SEQ ID NO: 244979 - RNA, 19 nt, Homo sapiens
caggcugcauuaggaauua

SEQ ID NO: 244980 - RNA, 19 nt, Homo sapiens
uaugcgaucucuuaacaau

SEQ ID NO: 244981 - RNA, 19 nt, Homo sapiens
acagaagagugguauggaa

SEQ ID NO: 244982 - RNA, 19 nt, Homo sapiens
cuacugaaauuccauucug

SEQ ID NO: 244983 - RNA, 19 nt, Homo sapiens
gagcaaagcuugauaacaa

SEQ ID NO: 244984 - RNA, 19 nt, Homo sapiens
guaaagaccuugcugaaug

SEQ ID NO: 244985 - RNA, 19 nt, Homo sapiens
gcauuaaacuugcacauga

SEQ ID NO: 244986 - RNA, 19 nt, Homo sapiens
ggacuuggcugcuugcauu

SEQ ID NO: 244987 - RNA, 19 nt, Homo sapiens
gcaaggagaugaaaugaca

SEQ ID NO: 244988 - RNA, 19 nt, Homo sapiens
gcacacaguuccuuccaaa

SEQ ID NO: 244989 - RNA, 19 nt, Homo sapiens
gggaaguucuggugucaua

SEQ ID NO: 244990 - RNA, 19 nt, Homo sapiens
guacauaacuuugaagaag

SEQ ID NO: 244991 - RNA, 19 nt, Homo sapiens
caagauaagucaauugaag

SEQ ID NO: 244992 - RNA, 19 nt, Homo sapiens
guaacuaggucuacagguu

SEQ ID NO: 244993 - RNA, 19 nt, Homo sapiens
gagcuaagaaggauaauug

SEQ ID NO: 244994 - RNA, 19 nt, Homo sapiens
caaacuagcucaggccaaa

SEQ ID NO: 244995 - RNA, 19 nt, Homo sapiens
gagauaaccuacacaccaa

SEQ ID NO: 244996 - RNA, 19 nt, Homo sapiens
ggaauucgguuaguacuca

SEQ ID NO: 244997 - RNA, 19 nt, Homo sapiens
gaacauggcaagggacuuu

SEQ ID NO: 244998 - RNA, 19 nt, Homo sapiens
gguaaaaccuaucaucaua

SEQ ID NO: 244999 - RNA, 19 nt, Homo sapiens
gggaauugauuaaagagaa

SEQ ID NO: 245000 - RNA, 19 nt, Homo sapiens
gaacuggggugauaagaaa

SEQ ID NO: 245001 - RNA, 19 nt, Homo sapiens
guucauaccugagcuaaga

SEQ ID NO: 245002 - RNA, 19 nt, Homo sapiens
ggagaaaacuugaagauca

SEQ ID NO: 245003 - RNA, 19 nt, Homo sapiens
gcaacguucugacuacuug

SEQ ID NO: 245004 - RNA, 19 nt, Homo sapiens
gagaugaaaugacacgaau

SEQ ID NO: 245005 - RNA, 19 nt, Homo sapiens
gagaagccauuaucugcaa

SEQ ID NO: 245006 - RNA, 19 nt, Homo sapiens
uaucuuaucuucuccugaa

SEQ ID NO: 245007 - RNA, 19 nt, Homo sapiens
ccaauagacuaaauacugu

SEQ ID NO: 245008 - RNA, 19 nt, Homo sapiens
gaagccagaguuuaucuuu

SEQ ID NO: 245009 - RNA, 19 nt, Homo sapiens
uggaagaagucucuauuga

SEQ ID NO: 245010 - RNA, 19 nt, Homo sapiens
gaagaggguugaggaguuc

SEQ ID NO: 245011 - RNA, 19 nt, Homo sapiens
ugucauagauaucccguuu

SEQ ID NO: 245012 - RNA, 19 nt, Homo sapiens
cauuugaguucauggauaa

SEQ ID NO: 245013 - RNA, 19 nt, Homo sapiens
ugaagaagguggugguguu

SEQ ID NO: 245014 - RNA, 19 nt, Homo sapiens
ugaagauacugcagucauu

SEQ ID NO: 245015 - RNA, 19 nt, Homo sapiens
gcgauaaacuacauucagu

SEQ ID NO: 245016 - RNA, 19 nt, Homo sapiens
gcaaagcuugauaacaaua

SEQ ID NO: 245017 - RNA, 19 nt, Homo sapiens
gcauaauguuggcgucaaa

SEQ ID NO: 245018 - RNA, 19 nt, Homo sapiens
ggaauuggaucuacauagc

SEQ ID NO: 245019 - RNA, 19 nt, Homo sapiens
agaaaucuauucacuguca

SEQ ID NO: 245020 - RNA, 19 nt, Homo sapiens
gaagauacugcagucauuu

SEQ ID NO: 245021 - RNA, 19 nt, Homo sapiens
gagguagagcugugcauua

SEQ ID NO: 245022 - RNA, 19 nt, Homo sapiens
uaaagaccuugcugaaugu

SEQ ID NO: 245023 - RNA, 19 nt, Homo sapiens
gaauacauuugaguucaug

SEQ ID NO: 245024 - RNA, 19 nt, Homo sapiens
gguuaguacucauuuguau

SEQ ID NO: 245025 - RNA, 19 nt, Homo sapiens
gaugaaaugacacgaauca

SEQ ID NO: 245026 - RNA, 19 nt, Homo sapiens
ccaaauggcucugucuaag

SEQ ID NO: 245027 - RNA, 19 nt, Homo sapiens
gaagcuauaaagaagcaua

SEQ ID NO: 245028 - RNA, 19 nt, Homo sapiens
guagagcugugcauuaaac

SEQ ID NO: 245029 - RNA, 19 nt, Homo sapiens
agaagaggguugaggaguu

SEQ ID NO: 245030 - RNA, 19 nt, Homo sapiens
gagcugugcauuaaacuug

SEQ ID NO: 245031 - RNA, 19 nt, Homo sapiens
guucuggugucauagauau

SEQ ID NO: 245032 - RNA, 19 nt, Homo sapiens
ccacaguauugcucccuaa

SEQ ID NO: 245033 - RNA, 19 nt, Homo sapiens
uaacuaggucuacagguuu

SEQ ID NO: 245034 - RNA, 19 nt, Homo sapiens
ugaaacaaauguggaaauc

SEQ ID NO: 245035 - RNA, 19 nt, Homo sapiens
caccaaggaugcugcagaa

SEQ ID NO: 245036 - RNA, 19 nt, Homo sapiens
uagcucaggccaaacuuua

SEQ ID NO: 245037 - RNA, 19 nt, Homo sapiens
guucauggauaaacuugga

SEQ ID NO: 245038 - RNA, 19 nt, Homo sapiens
guacaagucccaguuugaa

SEQ ID NO: 245039 - RNA, 19 nt, Homo sapiens
gcaguacaagucccaguuu

SEQ ID NO: 245040 - RNA, 19 nt, Homo sapiens
ggaguccgguuugggauug

SEQ ID NO: 245041 - RNA, 19 nt, Homo sapiens
ggaagaagucucuauugag

SEQ ID NO: 245042 - RNA, 19 nt, Homo sapiens
caauacagagcaacugauu

SEQ ID NO: 245043 - RNA, 19 nt, Homo sapiens
ucuauucacugucaagguu

SEQ ID NO: 245044 - RNA, 19 nt, Homo sapiens
uagcauauuucauccaagu

SEQ ID NO: 245045 - RNA, 19 nt, Homo sapiens
gcugaauguuuccaauaga

SEQ ID NO: 245046 - RNA, 19 nt, Homo sapiens
agguagagcugugcauuaa

SEQ ID NO: 245047 - RNA, 19 nt, Homo sapiens
gaaguucuggugucauaga

SEQ ID NO: 245048 - RNA, 19 nt, Homo sapiens
caucauaggucgucaugcu

SEQ ID NO: 245049 - RNA, 19 nt, Homo sapiens
aaacaaauguggaaaucac

SEQ ID NO: 245050 - RNA, 19 nt, Homo sapiens
ggagaugaaaugacacgaa

SEQ ID NO: 245051 - RNA, 19 nt, Homo sapiens
cgaaucauuugggaauuga

SEQ ID NO: 245052 - RNA, 19 nt, Homo sapiens
ccuaggaauucgguuagua

SEQ ID NO: 245053 - RNA, 19 nt, Homo sapiens
ggucuacagguuuacauuu

SEQ ID NO: 245054 - RNA, 19 nt, Homo sapiens
acauuugaguucauggaua

SEQ ID NO: 245055 - RNA, 19 nt, Homo sapiens
gaguuuggaauccggaaua

SEQ ID NO: 245056 - RNA, 19 nt, Homo sapiens
gaauguuuccaauagacua

SEQ ID NO: 245057 - RNA, 19 nt, Homo sapiens
gaaaucuauucacugucaa

SEQ ID NO: 245058 - RNA, 19 nt, Homo sapiens
gaaggauaauugucuuuug

SEQ ID NO: 245059 - RNA, 19 nt, Homo sapiens
ggcccaagcuaugaaauca

SEQ ID NO: 245060 - RNA, 19 nt, Homo sapiens
gaaauaugaugggcguuuu

SEQ ID NO: 245061 - RNA, 19 nt, Homo sapiens
gcacugggaguccgguuug

SEQ ID NO: 245062 - RNA, 19 nt, Homo sapiens
ucauaggucgucaugcuua

SEQ ID NO: 245063 - RNA, 19 nt, Homo sapiens
caggagacguccaccaauc

SEQ ID NO: 245064 - RNA, 19 nt, Homo sapiens
gaaacaaauguggaaauca

SEQ ID NO: 245065 - RNA, 19 nt, Homo sapiens
gaugcaaggagaugaaaug

SEQ ID NO: 245066 - RNA, 19 nt, Homo sapiens
gaagaagguggugguguug

SEQ ID NO: 245067 - RNA, 19 nt, Homo sapiens
caguggcgguucuguggua

SEQ ID NO: 245068 - RNA, 19 nt, Homo sapiens
cgucaaaugugccacuauc

SEQ ID NO: 245069 - RNA, 19 nt, Homo sapiens
cagaagcuauaaagaagca

SEQ ID NO: 245070 - RNA, 19 nt, Homo sapiens
caaggaugcugcagaagcu

SEQ ID NO: 245071 - RNA, 19 nt, Homo sapiens
gacuucugcuggccuguuu

SEQ ID NO: 245072 - RNA, 19 nt, Homo sapiens
gaauccggaauaaauacua

SEQ ID NO: 245073 - RNA, 19 nt, Homo sapiens
caaauguguugaagauacu

SEQ ID NO: 245074 - RNA, 19 nt, Homo sapiens
guacucauuuguauucacu

SEQ ID NO: 245075 - RNA, 19 nt, Homo sapiens
gggaggaacuggggugaua

SEQ ID NO: 245076 - RNA, 19 nt, Homo sapiens
cugcuugcauuaaagguuu

SEQ ID NO: 245077 - RNA, 19 nt, Homo sapiens
cccaagcuaugaaaucaga

SEQ ID NO: 245078 - RNA, 19 nt, Homo sapiens
acacaguuccuuccaaaug

SEQ ID NO: 245079 - RNA, 19 nt, Homo sapiens
gcuauaaagaagcauaaug

SEQ ID NO: 245080 - RNA, 19 nt, Homo sapiens
ggugauaagaaaucuauuc

SEQ ID NO: 245081 - RNA, 19 nt, Homo sapiens
ucauuuguauucacuguca

SEQ ID NO: 245082 - RNA, 19 nt, Homo sapiens
acucaaggauaaaggcaaa

SEQ ID NO: 245083 - RNA, 19 nt, Homo sapiens
gaugagaugacccguauua

SEQ ID NO: 245084 - RNA, 19 nt, Homo sapiens
guacaaggccacagacuuu

SEQ ID NO: 245085 - RNA, 19 nt, Homo sapiens
agaauaagaucugguauga

SEQ ID NO: 245086 - RNA, 19 nt, Homo sapiens
gcacagcugcuuccaguau

SEQ ID NO: 245087 - RNA, 19 nt, Homo sapiens
ggagauggauggugaugag

SEQ ID NO: 245088 - RNA, 19 nt, Homo sapiens
caagaacaccauacugaaa

SEQ ID NO: 245089 - RNA, 19 nt, Homo sapiens
ggacauccagcuaaaguau

SEQ ID NO: 245090 - RNA, 19 nt, Homo sapiens
gugaugagaugacccguau

SEQ ID NO: 245091 - RNA, 19 nt, Homo sapiens
caagaacuaugacggagau

SEQ ID NO: 245092 - RNA, 19 nt, Homo sapiens
cguauuaucuggcaguuca

SEQ ID NO: 245093 - RNA, 19 nt, Homo sapiens
acauccagcuaaaguauuu

SEQ ID NO: 245094 - RNA, 19 nt, Homo sapiens
gaacuaugacggagaugug

SEQ ID NO: 245095 - RNA, 19 nt, Homo sapiens
gauggauggugaugagaug

SEQ ID NO: 245096 - RNA, 19 nt, Homo sapiens
ggaccaagcccaucaccau

SEQ ID NO: 245097 - RNA, 19 nt, Homo sapiens
gaagcuggaugggaaccaa

SEQ ID NO: 245098 - RNA, 19 nt, Homo sapiens
gaaauggccgcuguacaug

SEQ ID NO: 245099 - RNA, 19 nt, Homo sapiens
acaagaauaagaucuggua

SEQ ID NO: 245100 - RNA, 19 nt, Homo sapiens
gcgccacuaugccgacaaa

SEQ ID NO: 245101 - RNA, 19 nt, Homo sapiens
ccaagaacaccauacugaa

SEQ ID NO: 245102 - RNA, 19 nt, Homo sapiens
caguguggcugucaagugu

SEQ ID NO: 245103 - RNA, 19 nt, Homo sapiens
agaccgacuucgacaagaa

SEQ ID NO: 245104 - RNA, 19 nt, Homo sapiens
agaaauggccgcuguacau

SEQ ID NO: 245105 - RNA, 19 nt, Homo sapiens
gaacgagcacuuccugaac

SEQ ID NO: 245106 - RNA, 19 nt, Homo sapiens
gaccaagcccaucaccauu

SEQ ID NO: 245107 - RNA, 19 nt, Homo sapiens
guggagccaugaccaagga

SEQ ID NO: 245108 - RNA, 19 nt, Homo sapiens
gaccgucacccgccacuau

SEQ ID NO: 245109 - RNA, 19 nt, Homo sapiens
uccaggagaucuuugacaa

SEQ ID NO: 245110 - RNA, 19 nt, Homo sapiens
gcucagguccucaagucuu

SEQ ID NO: 245111 - RNA, 19 nt, Homo sapiens
ucaaggagugggaagugua

SEQ ID NO: 245112 - RNA, 19 nt, Homo sapiens
ugagaugacccguauuauc

SEQ ID NO: 245113 - RNA, 19 nt, Homo sapiens
ugaacgagcacuuccugaa

SEQ ID NO: 245114 - RNA, 19 nt, Homo sapiens
gaagaaauggccgcuguac

SEQ ID NO: 245115 - RNA, 19 nt, Homo sapiens
aguaugccauccagaagaa

SEQ ID NO: 245116 - RNA, 19 nt, Homo sapiens
gcaaugugaagcugaacga

SEQ ID NO: 245117 - RNA, 19 nt, Homo sapiens
guccuggucugcccugaug

SEQ ID NO: 245118 - RNA, 19 nt, Homo sapiens
acggagaugugcagucaga

SEQ ID NO: 245119 - RNA, 19 nt, Homo sapiens
gagcaccaagaacaccaua

SEQ ID NO: 245120 - RNA, 19 nt, Homo sapiens
gcaccaagaacaccauacu

SEQ ID NO: 245121 - RNA, 19 nt, Homo sapiens
acgaguccaucucagguuu

SEQ ID NO: 245122 - RNA, 19 nt, Homo sapiens
aaacaucccacgccuaguc

SEQ ID NO: 245123 - RNA, 19 nt, Homo sapiens
ggcaguucaucaaggagaa

SEQ ID NO: 245124 - RNA, 19 nt, Homo sapiens
ggagaugugcagucagaca

SEQ ID NO: 245125 - RNA, 19 nt, Homo sapiens
gggagcccaucaucugcaa

SEQ ID NO: 245126 - RNA, 19 nt, Homo sapiens
caagagcaaccuggacaga

SEQ ID NO: 245127 - RNA, 19 nt, Homo sapiens
aaagauggcagugguguca

SEQ ID NO: 245128 - RNA, 19 nt, Homo sapiens
uggcucagguccucaaguc

SEQ ID NO: 245129 - RNA, 19 nt, Homo sapiens
uaagaccgacuucgacaag

SEQ ID NO: 245130 - RNA, 19 nt, Homo sapiens
accaagaacaccauacuga

SEQ ID NO: 245131 - RNA, 19 nt, Homo sapiens
gacauccagcuaaaguauu

SEQ ID NO: 245132 - RNA, 19 nt, Homo sapiens
cgaagcccgugguggagau

SEQ ID NO: 245133 - RNA, 19 nt, Homo sapiens
ugaugaggcccguguggaa

SEQ ID NO: 245134 - RNA, 19 nt, Homo sapiens
gcaggagcagugcguuuua

SEQ ID NO: 245135 - RNA, 19 nt, Homo sapiens
aacgagcacuuccugaaca

SEQ ID NO: 245136 - RNA, 19 nt, Homo sapiens
gggccugcaagaacuauga

SEQ ID NO: 245137 - RNA, 19 nt, Homo sapiens
uacaugagcaccaagaaca

SEQ ID NO: 245138 - RNA, 19 nt, Homo sapiens
ugaagaagauguggaaaag

SEQ ID NO: 245139 - RNA, 19 nt, Homo sapiens
aagaauaagaucugguaug

SEQ ID NO: 245140 - RNA, 19 nt, Homo sapiens
ucuuugacaagcacuauaa

SEQ ID NO: 245141 - RNA, 19 nt, Homo sapiens
gaucuuugacaagcacuau

SEQ ID NO: 245142 - RNA, 19 nt, Homo sapiens
cacagcugcuuccaguaug

SEQ ID NO: 245143 - RNA, 19 nt, Homo sapiens
ucuggcaguucaucaagga

SEQ ID NO: 245144 - RNA, 19 nt, Homo sapiens
uaccucagccagucaguau

SEQ ID NO: 245145 - RNA, 19 nt, Homo sapiens
caagucuucggguggcuuu

SEQ ID NO: 245146 - RNA, 19 nt, Homo sapiens
gcacuauaagaccgacuuc

SEQ ID NO: 245147 - RNA, 19 nt, Homo sapiens
guacaugagcaccaagaac

SEQ ID NO: 245148 - RNA, 19 nt, Homo sapiens
aaauggccgcuguacauga

SEQ ID NO: 245149 - RNA, 19 nt, Homo sapiens
caaaccgugaccagacuga

SEQ ID NO: 245150 - RNA, 19 nt, Homo sapiens
caagaauaagaucugguau

SEQ ID NO: 245151 - RNA, 19 nt, Homo sapiens
ccacccagaaguacagugu

SEQ ID NO: 245152 - RNA, 19 nt, Homo sapiens
agaagaaauggccgcugua

SEQ ID NO: 245153 - RNA, 19 nt, Homo sapiens
aagaacaccauacugaaag

SEQ ID NO: 245154 - RNA, 19 nt, Homo sapiens
caguaugccauccagaaga

SEQ ID NO: 245155 - RNA, 19 nt, Homo sapiens
gucaaggagugggaagugu

SEQ ID NO: 245156 - RNA, 19 nt, Homo sapiens
aagaagauguggaaaaguc

SEQ ID NO: 245157 - RNA, 19 nt, Homo sapiens
gcagaaagcuguaaagaua

SEQ ID NO: 245158 - RNA, 19 nt, Homo sapiens
ggaaaucugucgccgagua

SEQ ID NO: 245159 - RNA, 19 nt, Homo sapiens
gcagagagcuaguacuuca

SEQ ID NO: 245160 - RNA, 19 nt, Homo sapiens
gaacgucacugccauucaa

SEQ ID NO: 245161 - RNA, 19 nt, Homo sapiens
gagugaaugugguauauuu

SEQ ID NO: 245162 - RNA, 19 nt, Homo sapiens
gcacaaagccaacaucaug

SEQ ID NO: 245163 - RNA, 19 nt, Homo sapiens
gcucuuggguucaaaguaa

SEQ ID NO: 245164 - RNA, 19 nt, Homo sapiens
gaacuugggaugcuauuaa

SEQ ID NO: 245165 - RNA, 19 nt, Homo sapiens
ggaaagagcuugacaaaag

SEQ ID NO: 245166 - RNA, 19 nt, Homo sapiens
gcuaaagaguccauggaua

SEQ ID NO: 245167 - RNA, 19 nt, Homo sapiens
gaauugaggcugcguguuu

SEQ ID NO: 245168 - RNA, 19 nt, Homo sapiens
guaaauaacaggauacaga

SEQ ID NO: 245169 - RNA, 19 nt, Homo sapiens
ugaguggacuguaucauuu

SEQ ID NO: 245170 - RNA, 19 nt, Homo sapiens
gaaccucuguuuagaauac

SEQ ID NO: 245171 - RNA, 19 nt, Homo sapiens
acaagauccuucccaauuu

SEQ ID NO: 245172 - RNA, 19 nt, Homo sapiens
uuaaugagauguaccuuga

SEQ ID NO: 245173 - RNA, 19 nt, Homo sapiens
gaacacagaaggagaauac

SEQ ID NO: 245174 - RNA, 19 nt, Homo sapiens
ccacaugaaccucuguuua

SEQ ID NO: 245175 - RNA, 19 nt, Homo sapiens
gaauugagcaugugauugu

SEQ ID NO: 245176 - RNA, 19 nt, Homo sapiens
gaaggagaauacaguggaa

SEQ ID NO: 245177 - RNA, 19 nt, Homo sapiens
caagauccuucccaauuug

SEQ ID NO: 245178 - RNA, 19 nt, Homo sapiens
cuaaagaguccauggauaa

SEQ ID NO: 245179 - RNA, 19 nt, Homo sapiens
gguauuggcccagaaauuu

SEQ ID NO: 245180 - RNA, 19 nt, Homo sapiens
ccaauuugauguucuuguu

SEQ ID NO: 245181 - RNA, 19 nt, Homo sapiens
gcagggaaguugcagaaag

SEQ ID NO: 245182 - RNA, 19 nt, Homo sapiens
ggucacccaucuaugaauu

SEQ ID NO: 245183 - RNA, 19 nt, Homo sapiens
cagaagggcugaguguauu

SEQ ID NO: 245184 - RNA, 19 nt, Homo sapiens
caaagacacaaauguauug

SEQ ID NO: 245185 - RNA, 19 nt, Homo sapiens
aaugagauguaccuugaua

SEQ ID NO: 245186 - RNA, 19 nt, Homo sapiens
gacaguaacuuuaauucca

SEQ ID NO: 245187 - RNA, 19 nt, Homo sapiens
gauuuguccuuuacagaaa

SEQ ID NO: 245188 - RNA, 19 nt, Homo sapiens
ucacccaucuaugaauuua

SEQ ID NO: 245189 - RNA, 19 nt, Homo sapiens
ucaaggaccuggaggaaag

SEQ ID NO: 245190 - RNA, 19 nt, Homo sapiens
uaagaugacauuccaaaga

SEQ ID NO: 245191 - RNA, 19 nt, Homo sapiens
ugaccaugcugcaagaauu

SEQ ID NO: 245192 - RNA, 19 nt, Homo sapiens
gcaaggacauggcgaaucc

SEQ ID NO: 245193 - RNA, 19 nt, Homo sapiens
ugacuugugugcaggauug

SEQ ID NO: 245194 - RNA, 19 nt, Homo sapiens
gaaauuucagcugcaguua

SEQ ID NO: 245195 - RNA, 19 nt, Homo sapiens
uuacaucagucacucuaaa

SEQ ID NO: 245196 - RNA, 19 nt, Homo sapiens
guucagacaguaacuuuaa

SEQ ID NO: 245197 - RNA, 19 nt, Homo sapiens
ugggaaaguucacaucaaa

SEQ ID NO: 245198 - RNA, 19 nt, Homo sapiens
gaaagagcuugacaaaaga

SEQ ID NO: 245199 - RNA, 19 nt, Homo sapiens
ggauacagaauuaacaaga

SEQ ID NO: 245200 - RNA, 19 nt, Homo sapiens
gauuaacacuucuacaacu

SEQ ID NO: 245201 - RNA, 19 nt, Homo sapiens
gaaaucugucgccgaguaa

SEQ ID NO: 245202 - RNA, 19 nt, Homo sapiens
cuucagacacucacuauuu

SEQ ID NO: 245203 - RNA, 19 nt, Homo sapiens
uaaaugggcacaagagaau

SEQ ID NO: 245204 - RNA, 19 nt, Homo sapiens
uacaagauccuucccaauu

SEQ ID NO: 245205 - RNA, 19 nt, Homo sapiens
gagaauacaguggaauuga

SEQ ID NO: 245206 - RNA, 19 nt, Homo sapiens
guaaauauugugaccauuc

SEQ ID NO: 245207 - RNA, 19 nt, Homo sapiens
cgaaaggcccgaacacaug

SEQ ID NO: 245208 - RNA, 19 nt, Homo sapiens
gauacagaauuaacaagag

SEQ ID NO: 245209 - RNA, 19 nt, Homo sapiens
ccaaugggguugcaauuuu

SEQ ID NO: 245210 - RNA, 19 nt, Homo sapiens
caagcgcauugcugaguuu

SEQ ID NO: 245211 - RNA, 19 nt, Homo sapiens
gagagcuaguacuucauuu

SEQ ID NO: 245212 - RNA, 19 nt, Homo sapiens
gaaauuacugagugugaau

SEQ ID NO: 245213 - RNA, 19 nt, Homo sapiens
caaaaugacacucuucuaa

SEQ ID NO: 245214 - RNA, 19 nt, Homo sapiens
gaaaggcccgaacacaugu

SEQ ID NO: 245215 - RNA, 19 nt, Homo sapiens
gacaccaaguggcaacauu

SEQ ID NO: 245216 - RNA, 19 nt, Homo sapiens
ccucagcaguaccaguaua

SEQ ID NO: 245217 - RNA, 19 nt, Homo sapiens
ccagaagggcugaguguau

SEQ ID NO: 245218 - RNA, 19 nt, Homo sapiens
uaaauggacaccacaugaa

SEQ ID NO: 245219 - RNA, 19 nt, Homo sapiens
gaccaugugucucuaucga

SEQ ID NO: 245220 - RNA, 19 nt, Homo sapiens
aagaguccauggauaagaa

SEQ ID NO: 245221 - RNA, 19 nt, Homo sapiens
ggcccgaacacauguauuu

SEQ ID NO: 245222 - RNA, 19 nt, Homo sapiens
gauacaaagacacaaaugu

SEQ ID NO: 245223 - RNA, 19 nt, Homo sapiens
cagcugcaguuaugaagau

SEQ ID NO: 245224 - RNA, 19 nt, Homo sapiens
gauggagucgugcagagua

SEQ ID NO: 245225 - RNA, 19 nt, Homo sapiens
cuaaauggacaccacauga

SEQ ID NO: 245226 - RNA, 19 nt, Homo sapiens
ggagacauccuuagugacu

SEQ ID NO: 245227 - RNA, 19 nt, Homo sapiens
guuugaauaugguacaaga

SEQ ID NO: 245228 - RNA, 19 nt, Homo sapiens
ggagaauacaguggaauug

SEQ ID NO: 245229 - RNA, 19 nt, Homo sapiens
caacuggcauuuacaucag

SEQ ID NO: 245230 - RNA, 19 nt, Homo sapiens
uaguuucucuucagcugua

SEQ ID NO: 245231 - RNA, 19 nt, Homo sapiens
agacauccuuagugacuug

SEQ ID NO: 245232 - RNA, 19 nt, Homo sapiens
ucucuucagcuguaaauaa

SEQ ID NO: 245233 - RNA, 19 nt, Homo sapiens
ugggacggcuccagacauu

SEQ ID NO: 245234 - RNA, 19 nt, Homo sapiens
gaaguugcagaaagcugua

SEQ ID NO: 245235 - RNA, 19 nt, Homo sapiens
gcaugugauuguugaugga

SEQ ID NO: 245236 - RNA, 19 nt, Homo sapiens
ggaacuugggaugcuauua

SEQ ID NO: 245237 - RNA, 19 nt, Homo sapiens
gcauugguuugcuuguuuc

SEQ ID NO: 245238 - RNA, 19 nt, Homo sapiens
ugcauugguuugcuuguuu

SEQ ID NO: 245239 - RNA, 19 nt, Homo sapiens
aauuucagcugcaguuaug

SEQ ID NO: 245240 - RNA, 19 nt, Homo sapiens
uugcugaguuugccuuuga

SEQ ID NO: 245241 - RNA, 19 nt, Homo sapiens
gcgaauguccgaccaugug

SEQ ID NO: 245242 - RNA, 19 nt, Homo sapiens
caaccaaagacaacucaug

SEQ ID NO: 245243 - RNA, 19 nt, Homo sapiens
gcaguaccaguauaagaug

SEQ ID NO: 245244 - RNA, 19 nt, Homo sapiens
gggcugaguguauuguaaa

SEQ ID NO: 245245 - RNA, 19 nt, Homo sapiens
aaacuucagauccaagaaa

SEQ ID NO: 245246 - RNA, 19 nt, Homo sapiens
agaaauuacugagugugaa

SEQ ID NO: 245247 - RNA, 19 nt, Homo sapiens
aaagagugaaugugguaua

SEQ ID NO: 245248 - RNA, 19 nt, Homo sapiens
ugaguuugccuuugaguau

SEQ ID NO: 245249 - RNA, 19 nt, Homo sapiens
uaucccaaagcaccaauua

SEQ ID NO: 245250 - RNA, 19 nt, Homo sapiens
cuugggaugcuauuaauuu

SEQ ID NO: 245251 - RNA, 19 nt, Homo sapiens
uccaagagcuuuuaaugaa

SEQ ID NO: 245252 - RNA, 19 nt, Homo sapiens
acaugaaccucuguuuaga

SEQ ID NO: 245253 - RNA, 19 nt, Homo sapiens
gcaaaaugcucagacuuca

SEQ ID NO: 245254 - RNA, 19 nt, Homo sapiens
ggaauugagcaugugauug

SEQ ID NO: 245255 - RNA, 19 nt, Homo sapiens
acaccgauguaaauauugu

SEQ ID NO: 245256 - RNA, 19 nt, Homo sapiens
cagaaauuacugaguguga

SEQ ID NO: 245257 - RNA, 19 nt, Homo sapiens
gagcuagccuccuaugaua

SEQ ID NO: 245258 - RNA, 19 nt, Homo sapiens
cauguaagguguucaauaa

SEQ ID NO: 245259 - RNA, 19 nt, Homo sapiens
gcagaauccuuaccaguuu

SEQ ID NO: 245260 - RNA, 19 nt, Homo sapiens
ggacuuauuugccaacgua

SEQ ID NO: 245261 - RNA, 19 nt, Homo sapiens
gaacaaaguggccaucauu

SEQ ID NO: 245262 - RNA, 19 nt, Homo sapiens
ugagugaggugcagaauau

SEQ ID NO: 245263 - RNA, 19 nt, Homo sapiens
ugaagaaggugaucaaagu

SEQ ID NO: 245264 - RNA, 19 nt, Homo sapiens
ccacauggaugaugaugau

SEQ ID NO: 245265 - RNA, 19 nt, Homo sapiens
guaagguguucaauaaaga

SEQ ID NO: 245266 - RNA, 19 nt, Homo sapiens
gagcuagagcccuuuauuu

SEQ ID NO: 245267 - RNA, 19 nt, Homo sapiens
gcagugggcaggaauauag

SEQ ID NO: 245268 - RNA, 19 nt, Homo sapiens
cuagagcccuuuauuucuu

SEQ ID NO: 245269 - RNA, 19 nt, Homo sapiens
gaagaaggugaucaaaguu

SEQ ID NO: 245270 - RNA, 19 nt, Homo sapiens
guacagcucucuggaacau

SEQ ID NO: 245271 - RNA, 19 nt, Homo sapiens
gcauggagaggucugagua

SEQ ID NO: 245272 - RNA, 19 nt, Homo sapiens
gcagugcugugaggaaguu

SEQ ID NO: 245273 - RNA, 19 nt, Homo sapiens
ccacaaggccaacaucaug

SEQ ID NO: 245274 - RNA, 19 nt, Homo sapiens
agacaaugaucauagacaa

SEQ ID NO: 245275 - RNA, 19 nt, Homo sapiens
ggccaucauuggaaagauu

SEQ ID NO: 245276 - RNA, 19 nt, Homo sapiens
ggagcuagagcccuuuauu

SEQ ID NO: 245277 - RNA, 19 nt, Homo sapiens
gcugucggcuuccaacaug

SEQ ID NO: 245278 - RNA, 19 nt, Homo sapiens
gugauugaguguuugaaga

SEQ ID NO: 245279 - RNA, 19 nt, Homo sapiens
caaaguggccaucauugga

SEQ ID NO: 245280 - RNA, 19 nt, Homo sapiens
gagcuauagugcagaauac

SEQ ID NO: 245281 - RNA, 19 nt, Homo sapiens
ucggucaccugcagacuaa

SEQ ID NO: 245282 - RNA, 19 nt, Homo sapiens
cagaauacgcagucuuuga

SEQ ID NO: 245283 - RNA, 19 nt, Homo sapiens
caacguaguccaugugaag

SEQ ID NO: 245284 - RNA, 19 nt, Homo sapiens
ugaguuccaugaaggagaa

SEQ ID NO: 245285 - RNA, 19 nt, Homo sapiens
uguaagguguucaauaaag

SEQ ID NO: 245286 - RNA, 19 nt, Homo sapiens
ccauguaagguguucaaua

SEQ ID NO: 245287 - RNA, 19 nt, Homo sapiens
gcaggaauauagccaaucc

SEQ ID NO: 245288 - RNA, 19 nt, Homo sapiens
gccaacaucaugaaacuug

SEQ ID NO: 245289 - RNA, 19 nt, Homo sapiens
gauugaguguuugaagauu

SEQ ID NO: 245290 - RNA, 19 nt, Homo sapiens
acagcucucuggaacauga

SEQ ID NO: 245291 - RNA, 19 nt, Homo sapiens
gcaucuuaaucuugaguau

SEQ ID NO: 245292 - RNA, 19 nt, Homo sapiens
ugagagcuauagugcagaa

SEQ ID NO: 245293 - RNA, 19 nt, Homo sapiens
ggucacugcuguccacaag

SEQ ID NO: 245294 - RNA, 19 nt, Homo sapiens
ggaaacauggcggcauuga

SEQ ID NO: 245295 - RNA, 19 nt, Homo sapiens
cagaugcggugaagaaggu

SEQ ID NO: 245296 - RNA, 19 nt, Homo sapiens
ggaguacagcucucuggaa

SEQ ID NO: 245297 - RNA, 19 nt, Homo sapiens
gggcaggaauauagccaau

SEQ ID NO: 245298 - RNA, 19 nt, Homo sapiens
caauaaagaacaugaacca

SEQ ID NO: 245299 - RNA, 19 nt, Homo sapiens
cagaauccuuaccaguuug

SEQ ID NO: 245300 - RNA, 19 nt, Homo sapiens
ugacauggguggcuaugcu

SEQ ID NO: 245301 - RNA, 19 nt, Homo sapiens
gaacuguaccccaaaauca

SEQ ID NO: 245302 - RNA, 19 nt, Homo sapiens
gaauacgcagucuuugaga

SEQ ID NO: 245303 - RNA, 19 nt, Homo sapiens
gcuagagcccuuuauuucu

SEQ ID NO: 245304 - RNA, 19 nt, Homo sapiens
caaucucuaugggaacauu

SEQ ID NO: 245305 - RNA, 19 nt, Homo sapiens
gcuagccuccuaugauaug

SEQ ID NO: 245306 - RNA, 19 nt, Homo sapiens
caggccacauggaugauga

SEQ ID NO: 245307 - RNA, 19 nt, Homo sapiens
gcccaggccacauggauga

SEQ ID NO: 245308 - RNA, 19 nt, Homo sapiens
agagcuauagugcagaaua

SEQ ID NO: 245309 - RNA, 19 nt, Homo sapiens
gagacaaugaucauagaca

SEQ ID NO: 245310 - RNA, 19 nt, Homo sapiens
guauaugacucggcacaac

SEQ ID NO: 245311 - RNA, 19 nt, Homo sapiens
ucacuuccuggguauauga

SEQ ID NO: 245312 - RNA, 19 nt, Homo sapiens
aaaguggccaucauuggaa

SEQ ID NO: 245313 - RNA, 19 nt, Homo sapiens
ucacugaggcugucauugc

SEQ ID NO: 245314 - RNA, 19 nt, Homo sapiens
ccacaaccgacuucaucaa

SEQ ID NO: 245315 - RNA, 19 nt, Homo sapiens
gcagaauacgcagucuuug

SEQ ID NO: 245316 - RNA, 19 nt, Homo sapiens
uugagacaaugaucauaga

SEQ ID NO: 245317 - RNA, 19 nt, Homo sapiens
gcuaugcuacuugccauga

SEQ ID NO: 245318 - RNA, 19 nt, Homo sapiens
agaacaaaguggccaucau

SEQ ID NO: 245319 - RNA, 19 nt, Homo sapiens
cauggaugaugaugauucu

SEQ ID NO: 245320 - RNA, 19 nt, Homo sapiens
ugcggcaucuuaaucuuga

SEQ ID NO: 245321 - RNA, 19 nt, Homo sapiens
ccaugaaggagaacaaagu

SEQ ID NO: 245322 - RNA, 19 nt, Homo sapiens
ugcagaauacgcagucuuu

SEQ ID NO: 245323 - RNA, 19 nt, Homo sapiens
ucuaugggaacauuauuga

SEQ ID NO: 245324 - RNA, 19 nt, Homo sapiens
ccaacguaguccaugugaa

SEQ ID NO: 245325 - RNA, 19 nt, Homo sapiens
gcugcggcaucuuaaucuu

SEQ ID NO: 245326 - RNA, 19 nt, Homo sapiens
gagaacaaaguggccauca

SEQ ID NO: 245327 - RNA, 19 nt, Homo sapiens
gaaacauggcggcauugag

SEQ ID NO: 245328 - RNA, 19 nt, Homo sapiens
caaggccaacaucaugaaa

SEQ ID NO: 245329 - RNA, 19 nt, Homo sapiens
uagagcccuuuauuucuuc

SEQ ID NO: 245330 - RNA, 19 nt, Homo sapiens
caccacaaccgacuucauc

SEQ ID NO: 245331 - RNA, 19 nt, Homo sapiens
aagaaggugaucaaaguug

SEQ ID NO: 245332 - RNA, 19 nt, Homo sapiens
gugaagaaggugaucaaag

SEQ ID NO: 245333 - RNA, 19 nt, Homo sapiens
ugcagaauccuuaccaguu

SEQ ID NO: 245334 - RNA, 19 nt, Homo sapiens
caaauuugagacaaugauc

SEQ ID NO: 245335 - RNA, 19 nt, Homo sapiens
gacauggguggcuaugcua

SEQ ID NO: 245336 - RNA, 19 nt, Homo sapiens
uaugggaacauuauugaca

SEQ ID NO: 245337 - RNA, 19 nt, Homo sapiens
cacaaggccaacaucauga

SEQ ID NO: 245338 - RNA, 19 nt, Homo sapiens
ggggugugauugaguguuu

SEQ ID NO: 245339 - RNA, 19 nt, Homo sapiens
ugacucggcacaacaaucu

SEQ ID NO: 245340 - RNA, 19 nt, Homo sapiens
ccaguuugaugugcuugug

SEQ ID NO: 245341 - RNA, 19 nt, Homo sapiens
ucacacgagccaagucuca

SEQ ID NO: 245342 - RNA, 19 nt, Homo sapiens
caaugaucauagacaacug

SEQ ID NO: 245343 - RNA, 19 nt, Homo sapiens
cguaguccaugugaaguca

SEQ ID NO: 245344 - RNA, 19 nt, Homo sapiens
ccauaggcccuguccauac

SEQ ID NO: 245345 - RNA, 19 nt, Homo sapiens
gagcccaggccacauggau

SEQ ID NO: 245346 - RNA, 19 nt, Homo sapiens
ggugaagaaggugaucaaa

SEQ ID NO: 245347 - RNA, 19 nt, Homo sapiens
ggcagugggcaggaauaua

SEQ ID NO: 245348 - RNA, 19 nt, Homo sapiens
ggugcugaguuccaugaag

SEQ ID NO: 245349 - RNA, 19 nt, Homo sapiens
ucagcggauugcaaaguuc

SEQ ID NO: 245350 - RNA, 19 nt, Homo sapiens
cucagcggauugcaaaguu

SEQ ID NO: 245351 - RNA, 19 nt, Homo sapiens
caugaaggagaacaaagug

SEQ ID NO: 245352 - RNA, 19 nt, Homo sapiens
gaccuugugccucuaagca

SEQ ID NO: 245353 - RNA, 19 nt, Homo sapiens
gcaccacaaccgacuucau

SEQ ID NO: 245354 - RNA, 19 nt, Homo sapiens
agaauacgcagucuuugag

SEQ ID NO: 245355 - RNA, 19 nt, Homo sapiens
cccauaggcccuguccaua

SEQ ID NO: 245356 - RNA, 19 nt, Homo sapiens
ggguagagccuagguuguc

SEQ ID NO: 245357 - RNA, 19 nt, Homo sapiens
gagcuagccuccuaugaua

SEQ ID NO: 245358 - RNA, 19 nt, Homo sapiens
cauguaagguguucaauaa

SEQ ID NO: 245359 - RNA, 19 nt, Homo sapiens
gcagaauccuuaccaguuu

SEQ ID NO: 245360 - RNA, 19 nt, Homo sapiens
ggacuuauuugccaacgua

SEQ ID NO: 245361 - RNA, 19 nt, Homo sapiens
gaucaaaguuggcaagguu

SEQ ID NO: 245362 - RNA, 19 nt, Homo sapiens
gaacaaaguggccaucauu

SEQ ID NO: 245363 - RNA, 19 nt, Homo sapiens
ugagugaggugcagaauau

SEQ ID NO: 245364 - RNA, 19 nt, Homo sapiens
ugaagaaggugaucaaagu

SEQ ID NO: 245365 - RNA, 19 nt, Homo sapiens
guaagguguucaauaaaga

SEQ ID NO: 245366 - RNA, 19 nt, Homo sapiens
gcagugggcaggaauauag

SEQ ID NO: 245367 - RNA, 19 nt, Homo sapiens
gaagaaggugaucaaaguu

SEQ ID NO: 245368 - RNA, 19 nt, Homo sapiens
guacagcucucuggaacau

SEQ ID NO: 245369 - RNA, 19 nt, Homo sapiens
gcauggagaggucugagua

SEQ ID NO: 245370 - RNA, 19 nt, Homo sapiens
gcagugcugugaggaaguu

SEQ ID NO: 245371 - RNA, 19 nt, Homo sapiens
ccacaaggccaacaucaug

SEQ ID NO: 245372 - RNA, 19 nt, Homo sapiens
agacaaugaucauagacaa

SEQ ID NO: 245373 - RNA, 19 nt, Homo sapiens
ggccaucauuggaaagauu

SEQ ID NO: 245374 - RNA, 19 nt, Homo sapiens
gcugucggcuuccaacaug

SEQ ID NO: 245375 - RNA, 19 nt, Homo sapiens
gugauugaguguuugaaga

SEQ ID NO: 245376 - RNA, 19 nt, Homo sapiens
caaaguggccaucauugga

SEQ ID NO: 245377 - RNA, 19 nt, Homo sapiens
gagcuauagugcagaauac

SEQ ID NO: 245378 - RNA, 19 nt, Homo sapiens
cagaauacgcagucuuuga

SEQ ID NO: 245379 - RNA, 19 nt, Homo sapiens
caacguaguccaugugaag

SEQ ID NO: 245380 - RNA, 19 nt, Homo sapiens
ugaguuccaugaaggagaa

SEQ ID NO: 245381 - RNA, 19 nt, Homo sapiens
uguaagguguucaauaaag

SEQ ID NO: 245382 - RNA, 19 nt, Homo sapiens
ccauguaagguguucaaua

SEQ ID NO: 245383 - RNA, 19 nt, Homo sapiens
gcaggaauauagccaaucc

SEQ ID NO: 245384 - RNA, 19 nt, Homo sapiens
gccaacaucaugaaacuug

SEQ ID NO: 245385 - RNA, 19 nt, Homo sapiens
gauugaguguuugaagauu

SEQ ID NO: 245386 - RNA, 19 nt, Homo sapiens
acagcucucuggaacauga

SEQ ID NO: 245387 - RNA, 19 nt, Homo sapiens
gcaucuuaaucuugaguau

SEQ ID NO: 245388 - RNA, 19 nt, Homo sapiens
ugagagcuauagugcagaa

SEQ ID NO: 245389 - RNA, 19 nt, Homo sapiens
ggucacugcuguccacaag

SEQ ID NO: 245390 - RNA, 19 nt, Homo sapiens
ggaaacauggcggcauuga

SEQ ID NO: 245391 - RNA, 19 nt, Homo sapiens
cagaugcggugaagaaggu

SEQ ID NO: 245392 - RNA, 19 nt, Homo sapiens
ggaguacagcucucuggaa

SEQ ID NO: 245393 - RNA, 19 nt, Homo sapiens
gggcaggaauauagccaau

SEQ ID NO: 245394 - RNA, 19 nt, Homo sapiens
caauaaagaacaugaacca

SEQ ID NO: 245395 - RNA, 19 nt, Homo sapiens
cagaauccuuaccaguuug

SEQ ID NO: 245396 - RNA, 19 nt, Homo sapiens
ugacauggguggcuaugcu

SEQ ID NO: 245397 - RNA, 19 nt, Homo sapiens
gaacuguaccccaaaauca

SEQ ID NO: 245398 - RNA, 19 nt, Homo sapiens
gaauacgcagucuuugaga

SEQ ID NO: 245399 - RNA, 19 nt, Homo sapiens
caaucucuaugggaacauu

SEQ ID NO: 245400 - RNA, 19 nt, Homo sapiens
gcuagccuccuaugauaug

SEQ ID NO: 245401 - RNA, 19 nt, Homo sapiens
agagcuauagugcagaaua

SEQ ID NO: 245402 - RNA, 19 nt, Homo sapiens
gagacaaugaucauagaca

SEQ ID NO: 245403 - RNA, 19 nt, Homo sapiens
guauaugacucggcacaac

SEQ ID NO: 245404 - RNA, 19 nt, Homo sapiens
ucacuuccuggguauauga

SEQ ID NO: 245405 - RNA, 19 nt, Homo sapiens
aaaguggccaucauuggaa

SEQ ID NO: 245406 - RNA, 19 nt, Homo sapiens
ucacugaggcugucauugc

SEQ ID NO: 245407 - RNA, 19 nt, Homo sapiens
gcagaauacgcagucuuug

SEQ ID NO: 245408 - RNA, 19 nt, Homo sapiens
uugagacaaugaucauaga

SEQ ID NO: 245409 - RNA, 19 nt, Homo sapiens
gcuaugcuacuugccauga

SEQ ID NO: 245410 - RNA, 19 nt, Homo sapiens
ugcggcaucuuaaucuuga

SEQ ID NO: 245411 - RNA, 19 nt, Homo sapiens
ugcagaauacgcagucuuu

SEQ ID NO: 245412 - RNA, 19 nt, Homo sapiens
ucuaugggaacauuauuga

SEQ ID NO: 245413 - RNA, 19 nt, Homo sapiens
ccaugaaggagaacaaagu

SEQ ID NO: 245414 - RNA, 19 nt, Homo sapiens
ccaacguaguccaugugaa

SEQ ID NO: 245415 - RNA, 19 nt, Homo sapiens
agaacaaaguggccaucau

SEQ ID NO: 245416 - RNA, 19 nt, Homo sapiens
gcugcggcaucuuaaucuu

SEQ ID NO: 245417 - RNA, 19 nt, Homo sapiens
gagaacaaaguggccauca

SEQ ID NO: 245418 - RNA, 19 nt, Homo sapiens
gaaacauggcggcauugag

SEQ ID NO: 245419 - RNA, 19 nt, Homo sapiens
caaggccaacaucaugaaa

SEQ ID NO: 245420 - RNA, 19 nt, Homo sapiens
aagaaggugaucaaaguug

SEQ ID NO: 245421 - RNA, 19 nt, Homo sapiens
gugaagaaggugaucaaag

SEQ ID NO: 245422 - RNA, 19 nt, Homo sapiens
ugcagaauccuuaccaguu

SEQ ID NO: 245423 - RNA, 19 nt, Homo sapiens
caaauuugagacaaugauc

SEQ ID NO: 245424 - RNA, 19 nt, Homo sapiens
gacauggguggcuaugcua

SEQ ID NO: 245425 - RNA, 19 nt, Homo sapiens
uaugggaacauuauugaca

SEQ ID NO: 245426 - RNA, 19 nt, Homo sapiens
cacaaggccaacaucauga

SEQ ID NO: 245427 - RNA, 19 nt, Homo sapiens
ggggugugauugaguguuu

SEQ ID NO: 245428 - RNA, 19 nt, Homo sapiens
ugacucggcacaacaaucu

SEQ ID NO: 245429 - RNA, 19 nt, Homo sapiens
ccaguuugaugugcuugug

SEQ ID NO: 245430 - RNA, 19 nt, Homo sapiens
ucacacgagccaagucuca

SEQ ID NO: 245431 - RNA, 19 nt, Homo sapiens
caaugaucauagacaacug

SEQ ID NO: 245432 - RNA, 19 nt, Homo sapiens
cguaguccaugugaaguca

SEQ ID NO: 245433 - RNA, 19 nt, Homo sapiens
ccauaggcccuguccauac

SEQ ID NO: 245434 - RNA, 19 nt, Homo sapiens
ggugaagaaggugaucaaa

SEQ ID NO: 245435 - RNA, 19 nt, Homo sapiens
ggcagugggcaggaauaua

SEQ ID NO: 245436 - RNA, 19 nt, Homo sapiens
ucagcggauugcaaaguuc

SEQ ID NO: 245437 - RNA, 19 nt, Homo sapiens
cucagcggauugcaaaguu

SEQ ID NO: 245438 - RNA, 19 nt, Homo sapiens
ggugcugaguuccaugaag

SEQ ID NO: 245439 - RNA, 19 nt, Homo sapiens
caugaaggagaacaaagug

SEQ ID NO: 245440 - RNA, 19 nt, Homo sapiens
agaauacgcagucuuugag

SEQ ID NO: 245441 - RNA, 19 nt, Homo sapiens
cccauaggcccuguccaua

SEQ ID NO: 245442 - RNA, 19 nt, Homo sapiens
gcugaacuguaccccaaaa

SEQ ID NO: 245443 - RNA, 19 nt, Homo sapiens
gagcuagccuccuaugaua

SEQ ID NO: 245444 - RNA, 19 nt, Homo sapiens
cauguaagguguucaauaa

SEQ ID NO: 245445 - RNA, 19 nt, Homo sapiens
gcagaauccuuaccaguuu

SEQ ID NO: 245446 - RNA, 19 nt, Homo sapiens
ggacuuauuugccaacgua

SEQ ID NO: 245447 - RNA, 19 nt, Homo sapiens
gaacaaaguggccaucauu

SEQ ID NO: 245448 - RNA, 19 nt, Homo sapiens
ugagugaggugcagaauau

SEQ ID NO: 245449 - RNA, 19 nt, Homo sapiens
ugaagaaggugaucaaagu

SEQ ID NO: 245450 - RNA, 19 nt, Homo sapiens
ccacauggaugaugaugau

SEQ ID NO: 245451 - RNA, 19 nt, Homo sapiens
guaagguguucaauaaaga

SEQ ID NO: 245452 - RNA, 19 nt, Homo sapiens
gagcuagagcccuuuauuu

SEQ ID NO: 245453 - RNA, 19 nt, Homo sapiens
ucaccuagcugcugcuuuc

SEQ ID NO: 245454 - RNA, 19 nt, Homo sapiens
gcagugggcaggaauauag

SEQ ID NO: 245455 - RNA, 19 nt, Homo sapiens
cuagagcccuuuauuucuu

SEQ ID NO: 245456 - RNA, 19 nt, Homo sapiens
gaagaaggugaucaaaguu

SEQ ID NO: 245457 - RNA, 19 nt, Homo sapiens
guacagcucucuggaacau

SEQ ID NO: 245458 - RNA, 19 nt, Homo sapiens
gcauggagaggucugagua

SEQ ID NO: 245459 - RNA, 19 nt, Homo sapiens
gcagugcugugaggaaguu

SEQ ID NO: 245460 - RNA, 19 nt, Homo sapiens
ccacaaggccaacaucaug

SEQ ID NO: 245461 - RNA, 19 nt, Homo sapiens
agacaaugaucauagacaa

SEQ ID NO: 245462 - RNA, 19 nt, Homo sapiens
ggccaucauuggaaagauu

SEQ ID NO: 245463 - RNA, 19 nt, Homo sapiens
ggagcuagagcccuuuauu

SEQ ID NO: 245464 - RNA, 19 nt, Homo sapiens
gcugucggcuuccaacaug

SEQ ID NO: 245465 - RNA, 19 nt, Homo sapiens
gugauugaguguuugaaga

SEQ ID NO: 245466 - RNA, 19 nt, Homo sapiens
caaaguggccaucauugga

SEQ ID NO: 245467 - RNA, 19 nt, Homo sapiens
gagcuauagugcagaauac

SEQ ID NO: 245468 - RNA, 19 nt, Homo sapiens
ucggucaccugcagacuaa

SEQ ID NO: 245469 - RNA, 19 nt, Homo sapiens
cagaauacgcagucuuuga

SEQ ID NO: 245470 - RNA, 19 nt, Homo sapiens
caacguaguccaugugaag

SEQ ID NO: 245471 - RNA, 19 nt, Homo sapiens
ugaguuccaugaaggagaa

SEQ ID NO: 245472 - RNA, 19 nt, Homo sapiens
uguaagguguucaauaaag

SEQ ID NO: 245473 - RNA, 19 nt, Homo sapiens
ccauguaagguguucaaua

SEQ ID NO: 245474 - RNA, 19 nt, Homo sapiens
gcaggaauauagccaaucc

SEQ ID NO: 245475 - RNA, 19 nt, Homo sapiens
gccaacaucaugaaacuug

SEQ ID NO: 245476 - RNA, 19 nt, Homo sapiens
gauugaguguuugaagauu

SEQ ID NO: 245477 - RNA, 19 nt, Homo sapiens
gagguggagcuccuuguuu

SEQ ID NO: 245478 - RNA, 19 nt, Homo sapiens
acagcucucuggaacauga

SEQ ID NO: 245479 - RNA, 19 nt, Homo sapiens
gcaucuuaaucuugaguau

SEQ ID NO: 245480 - RNA, 19 nt, Homo sapiens
ugagagcuauagugcagaa

SEQ ID NO: 245481 - RNA, 19 nt, Homo sapiens
ggucacugcuguccacaag

SEQ ID NO: 245482 - RNA, 19 nt, Homo sapiens
ggaaacauggcggcauuga

SEQ ID NO: 245483 - RNA, 19 nt, Homo sapiens
cagaugcggugaagaaggu

SEQ ID NO: 245484 - RNA, 19 nt, Homo sapiens
ggaguacagcucucuggaa

SEQ ID NO: 245485 - RNA, 19 nt, Homo sapiens
gggcaggaauauagccaau

SEQ ID NO: 245486 - RNA, 19 nt, Homo sapiens
caauaaagaacaugaacca

SEQ ID NO: 245487 - RNA, 19 nt, Homo sapiens
cagaauccuuaccaguuug

SEQ ID NO: 245488 - RNA, 19 nt, Homo sapiens
ugacauggguggcuaugcu

SEQ ID NO: 245489 - RNA, 19 nt, Homo sapiens
gaacuguaccccaaaauca

SEQ ID NO: 245490 - RNA, 19 nt, Homo sapiens
gaauacgcagucuuugaga

SEQ ID NO: 245491 - RNA, 19 nt, Homo sapiens
gcuagagcccuuuauuucu

SEQ ID NO: 245492 - RNA, 19 nt, Homo sapiens
caaucucuaugggaacauu

SEQ ID NO: 245493 - RNA, 19 nt, Homo sapiens
gcuagccuccuaugauaug

SEQ ID NO: 245494 - RNA, 19 nt, Homo sapiens
caggccacauggaugauga

SEQ ID NO: 245495 - RNA, 19 nt, Homo sapiens
gcccaggccacauggauga

SEQ ID NO: 245496 - RNA, 19 nt, Homo sapiens
ccuagcugcugcuuucuuc

SEQ ID NO: 245497 - RNA, 19 nt, Homo sapiens
agagcuauagugcagaaua

SEQ ID NO: 245498 - RNA, 19 nt, Homo sapiens
gagacaaugaucauagaca

SEQ ID NO: 245499 - RNA, 19 nt, Homo sapiens
aaaguggccaucauuggaa

SEQ ID NO: 245500 - RNA, 19 nt, Homo sapiens
guauaugacucggcacaac

SEQ ID NO: 245501 - RNA, 19 nt, Homo sapiens
ucacuuccuggguauauga

SEQ ID NO: 245502 - RNA, 19 nt, Homo sapiens
ucacugaggcugucauugc

SEQ ID NO: 245503 - RNA, 19 nt, Homo sapiens
ccacaaccgacuucaucaa

SEQ ID NO: 245504 - RNA, 19 nt, Homo sapiens
gcagaauacgcagucuuug

SEQ ID NO: 245505 - RNA, 19 nt, Homo sapiens
uugagacaaugaucauaga

SEQ ID NO: 245506 - RNA, 19 nt, Homo sapiens
ggagggcaaggaugaagau

SEQ ID NO: 245507 - RNA, 19 nt, Homo sapiens
agaacaaaguggccaucau

SEQ ID NO: 245508 - RNA, 19 nt, Homo sapiens
gcuaugcuacuugccauga

SEQ ID NO: 245509 - RNA, 19 nt, Homo sapiens
cauggaugaugaugauucu

SEQ ID NO: 245510 - RNA, 19 nt, Homo sapiens
ccaugaaggagaacaaagu

SEQ ID NO: 245511 - RNA, 19 nt, Homo sapiens
ugcggcaucuuaaucuuga

SEQ ID NO: 245512 - RNA, 19 nt, Homo sapiens
ugcagaauacgcagucuuu

SEQ ID NO: 245513 - RNA, 19 nt, Homo sapiens
ucuaugggaacauuauuga

SEQ ID NO: 245514 - RNA, 19 nt, Homo sapiens
ccaacguaguccaugugaa

SEQ ID NO: 245515 - RNA, 19 nt, Homo sapiens
gcugcggcaucuuaaucuu

SEQ ID NO: 245516 - RNA, 19 nt, Homo sapiens
gagaacaaaguggccauca

SEQ ID NO: 245517 - RNA, 19 nt, Homo sapiens
gaaacauggcggcauugag

SEQ ID NO: 245518 - RNA, 19 nt, Homo sapiens
caaggccaacaucaugaaa

SEQ ID NO: 245519 - RNA, 19 nt, Homo sapiens
agguggagcuccuuguuuc

SEQ ID NO: 245520 - RNA, 19 nt, Homo sapiens
uagagcccuuuauuucuuc

SEQ ID NO: 245521 - RNA, 19 nt, Homo sapiens
caccacaaccgacuucauc

SEQ ID NO: 245522 - RNA, 19 nt, Homo sapiens
aagaaggugaucaaaguug

SEQ ID NO: 245523 - RNA, 19 nt, Homo sapiens
gugaagaaggugaucaaag

SEQ ID NO: 245524 - RNA, 19 nt, Homo sapiens
ugcagaauccuuaccaguu

SEQ ID NO: 245525 - RNA, 19 nt, Homo sapiens
caaauuugagacaaugauc

SEQ ID NO: 245526 - RNA, 19 nt, Homo sapiens
gacauggguggcuaugcua

SEQ ID NO: 245527 - RNA, 19 nt, Homo sapiens
uaugggaacauuauugaca

SEQ ID NO: 245528 - RNA, 19 nt, Homo sapiens
cacaaggccaacaucauga

SEQ ID NO: 245529 - RNA, 19 nt, Homo sapiens
ggggugugauugaguguuu

SEQ ID NO: 245530 - RNA, 19 nt, Homo sapiens
ugacucggcacaacaaucu

SEQ ID NO: 245531 - RNA, 19 nt, Homo sapiens
ccaguuugaugugcuugug

SEQ ID NO: 245532 - RNA, 19 nt, Homo sapiens
ucacacgagccaagucuca

SEQ ID NO: 245533 - RNA, 19 nt, Homo sapiens
caaugaucauagacaacug

SEQ ID NO: 245534 - RNA, 19 nt, Homo sapiens
cguaguccaugugaaguca

SEQ ID NO: 245535 - RNA, 19 nt, Homo sapiens
ccauaggcccuguccauac

SEQ ID NO: 245536 - RNA, 19 nt, Homo sapiens
gagcccaggccacauggau

SEQ ID NO: 245537 - RNA, 19 nt, Homo sapiens
ggugaagaaggugaucaaa

SEQ ID NO: 245538 - RNA, 19 nt, Homo sapiens
ggcagugggcaggaauaua

SEQ ID NO: 245539 - RNA, 19 nt, Homo sapiens
ucagcggauugcaaaguuc

SEQ ID NO: 245540 - RNA, 19 nt, Homo sapiens
cucagcggauugcaaaguu

SEQ ID NO: 245541 - RNA, 19 nt, Homo sapiens
agcugcugcuuucuucuua

SEQ ID NO: 245542 - RNA, 19 nt, Homo sapiens
ggugcugaguuccaugaag

SEQ ID NO: 245543 - RNA, 19 nt, Homo sapiens
gcaagaguaucgccaauaa

SEQ ID NO: 245544 - RNA, 19 nt, Homo sapiens
guacgcagaucccagaaua

SEQ ID NO: 245545 - RNA, 19 nt, Homo sapiens
gcacaaaucucgaaacaac

SEQ ID NO: 245546 - RNA, 19 nt, Homo sapiens
ggacauagacauccucauu

SEQ ID NO: 245547 - RNA, 19 nt, Homo sapiens
gcacaaggccaacaucaug

SEQ ID NO: 245548 - RNA, 19 nt, Homo sapiens
ccuaggaccuucuugguuu

SEQ ID NO: 245549 - RNA, 19 nt, Homo sapiens
gaacaucuuuucagaacaa

SEQ ID NO: 245550 - RNA, 19 nt, Homo sapiens
uggcauccauggacaauga

SEQ ID NO: 245551 - RNA, 19 nt, Homo sapiens
agaacaugauuguggauaa

SEQ ID NO: 245552 - RNA, 19 nt, Homo sapiens
gaacacagagggcgaguac

SEQ ID NO: 245553 - RNA, 19 nt, Homo sapiens
gaacaugauuguggauaac

SEQ ID NO: 245554 - RNA, 19 nt, Homo sapiens
gcacaaggacauagacauc

SEQ ID NO: 245555 - RNA, 19 nt, Homo sapiens
guggagagccugaagauca

SEQ ID NO: 245556 - RNA, 19 nt, Homo sapiens
gugcggaggcucucacuuu

SEQ ID NO: 245557 - RNA, 19 nt, Homo sapiens
ccaacgucauccacuguaa

SEQ ID NO: 245558 - RNA, 19 nt, Homo sapiens
acauagacauccucauugu

SEQ ID NO: 245559 - RNA, 19 nt, Homo sapiens
gagaacaugauuguggaua

SEQ ID NO: 245560 - RNA, 19 nt, Homo sapiens
gacauagacauccucauug

SEQ ID NO: 245561 - RNA, 19 nt, Homo sapiens
gcacgugaguuccaaugcu

SEQ ID NO: 245562 - RNA, 19 nt, Homo sapiens
gcucucacuuuccgucaug

SEQ ID NO: 245563 - RNA, 19 nt, Homo sapiens
aagaguaucgccaauaaga

SEQ ID NO: 245564 - RNA, 19 nt, Homo sapiens
ucgcacaaaucucgaaaca

SEQ ID NO: 245565 - RNA, 19 nt, Homo sapiens
ggugaugcccaaucucuau

SEQ ID NO: 245566 - RNA, 19 nt, Homo sapiens
gccugaagaucaucaccaa

SEQ ID NO: 245567 - RNA, 19 nt, Homo sapiens
acagcagccuggagcauga

SEQ ID NO: 245568 - RNA, 19 nt, Homo sapiens
gcagaucccagaauaaagc

SEQ ID NO: 245569 - RNA, 19 nt, Homo sapiens
gaggaacaccggcaagagu

SEQ ID NO: 245570 - RNA, 19 nt, Homo sapiens
ggcaagaguaucgccaaua

SEQ ID NO: 245571 - RNA, 19 nt, Homo sapiens
gaguuccaaugcugaugaa

SEQ ID NO: 245572 - RNA, 19 nt, Homo sapiens
ccauggacaaugagaauau

SEQ ID NO: 245573 - RNA, 19 nt, Homo sapiens
ggcaacaucgucaacaaug

SEQ ID NO: 245574 - RNA, 19 nt, Homo sapiens
cagaucaccuucgagaaca

SEQ ID NO: 245575 - RNA, 19 nt, Homo sapiens
ggaacaccggcaagaguau

SEQ ID NO: 245576 - RNA, 19 nt, Homo sapiens
ccaacuauggccaugugua

SEQ ID NO: 245577 - RNA, 19 nt, Homo sapiens
caauuccuccguccgcuaa

SEQ ID NO: 245578 - RNA, 19 nt, Homo sapiens
gaagaggugcacgugaguu

SEQ ID NO: 245579 - RNA, 19 nt, Homo sapiens
caacuauggccauguguac

SEQ ID NO: 245580 - RNA, 19 nt, Homo sapiens
caaucucuauggcaacauc

SEQ ID NO: 245581 - RNA, 19 nt, Homo sapiens
cgaggaacaucuuuucaga

SEQ ID NO: 245582 - RNA, 19 nt, Homo sapiens
acgcagaucccagaauaaa

SEQ ID NO: 245583 - RNA, 19 nt, Homo sapiens
cgucauggcgcugaaggua

SEQ ID NO: 245584 - RNA, 19 nt, Homo sapiens
cauggacaaugagaauaug

SEQ ID NO: 245585 - RNA, 19 nt, Homo sapiens
ccagcaguuugaugucaug

SEQ ID NO: 245586 - RNA, 19 nt, Homo sapiens
gccaagucccugcgcauug

SEQ ID NO: 245587 - RNA, 19 nt, Homo sapiens
caacaucgaaaccaaccau

SEQ ID NO: 245588 - RNA, 19 nt, Homo sapiens
guguaccaguggacuuuga

SEQ ID NO: 245589 - RNA, 19 nt, Homo sapiens
cuaggaccuucuugguuug

SEQ ID NO: 245590 - RNA, 19 nt, Homo sapiens
gaguaucgccaauaagaac

SEQ ID NO: 245591 - RNA, 19 nt, Homo sapiens
ggacgucauccgccacauc

SEQ ID NO: 245592 - RNA, 19 nt, Homo sapiens
caaggccaacaucaugaaa

SEQ ID NO: 245593 - RNA, 19 nt, Homo sapiens
ccaagucccugcgcauugc

SEQ ID NO: 245594 - RNA, 19 nt, Homo sapiens
guuccaaugcugaugaaga

SEQ ID NO: 245595 - RNA, 19 nt, Homo sapiens
gaacaccggcaagaguauc

SEQ ID NO: 245596 - RNA, 19 nt, Homo sapiens
acaucgaaaccaaccauaa

SEQ ID NO: 245597 - RNA, 19 nt, Homo sapiens
ggcacacggugaccaugau

SEQ ID NO: 245598 - RNA, 19 nt, Homo sapiens
aggaacaccggcaagagua

SEQ ID NO: 245599 - RNA, 19 nt, Homo sapiens
cacaaggccaacaucauga

SEQ ID NO: 245600 - RNA, 19 nt, Homo sapiens
gccaacgucauccacugua

SEQ ID NO: 245601 - RNA, 19 nt, Homo sapiens
gaaacagcuacgaggaaca

SEQ ID NO: 245602 - RNA, 19 nt, Homo sapiens
ucagaucaccuucgagaac

SEQ ID NO: 245603 - RNA, 19 nt, Homo sapiens
aaacugggcgaugggcuuu

SEQ ID NO: 245604 - RNA, 19 nt, Homo sapiens
uggagagccugaagaucau

SEQ ID NO: 245605 - RNA, 19 nt, Homo sapiens
ugaguuccaaugcugauga

SEQ ID NO: 245606 - RNA, 19 nt, Homo sapiens
uugguuugcuccuuggauu

SEQ ID NO: 245607 - RNA, 19 nt, Homo sapiens
gcaugucaaguccgucuuc

SEQ ID NO: 245608 - RNA, 19 nt, Homo sapiens
cggcaagaguaucgccaau

SEQ ID NO: 245609 - RNA, 19 nt, Homo sapiens
acaaaucucgaaacaacau

SEQ ID NO: 245610 - RNA, 19 nt, Homo sapiens
caucgaaaccaaccauaac

SEQ ID NO: 245611 - RNA, 19 nt, Homo sapiens
ccacauccgcgucaucaac

SEQ ID NO: 245612 - RNA, 19 nt, Homo sapiens
ucauggugaugcccaaucu

SEQ ID NO: 245613 - RNA, 19 nt, Homo sapiens
ugaagaggacauucgcaau

SEQ ID NO: 245614 - RNA, 19 nt, Homo sapiens
ggccagggcacaacaucug

SEQ ID NO: 245615 - RNA, 19 nt, Homo sapiens
ugcggaggcucucacuuuc

SEQ ID NO: 245616 - RNA, 19 nt, Homo sapiens
ggccaagucccugcgcauu

SEQ ID NO: 245617 - RNA, 19 nt, Homo sapiens
acacagagggcgaguacag

SEQ ID NO: 245618 - RNA, 19 nt, Homo sapiens
gcaagaguaucgccaauaa

SEQ ID NO: 245619 - RNA, 19 nt, Homo sapiens
guacgcagaucccagaaua

SEQ ID NO: 245620 - RNA, 19 nt, Homo sapiens
gcacaaaucucgaaacaac

SEQ ID NO: 245621 - RNA, 19 nt, Homo sapiens
ggacauagacauccucauu

SEQ ID NO: 245622 - RNA, 19 nt, Homo sapiens
gcacaaggccaacaucaug

SEQ ID NO: 245623 - RNA, 19 nt, Homo sapiens
ccuaggaccuucuugguuu

SEQ ID NO: 245624 - RNA, 19 nt, Homo sapiens
gaacaucuuuucagaacaa

SEQ ID NO: 245625 - RNA, 19 nt, Homo sapiens
uggcauccauggacaauga

SEQ ID NO: 245626 - RNA, 19 nt, Homo sapiens
agaacaugauuguggauaa

SEQ ID NO: 245627 - RNA, 19 nt, Homo sapiens
gaacacagagggcgaguac

SEQ ID NO: 245628 - RNA, 19 nt, Homo sapiens
gaacaugauuguggauaac

SEQ ID NO: 245629 - RNA, 19 nt, Homo sapiens
gcacaaggacauagacauc

SEQ ID NO: 245630 - RNA, 19 nt, Homo sapiens
guggagagccugaagauca

SEQ ID NO: 245631 - RNA, 19 nt, Homo sapiens
gugcggaggcucucacuuu

SEQ ID NO: 245632 - RNA, 19 nt, Homo sapiens
ccaacgucauccacuguaa

SEQ ID NO: 245633 - RNA, 19 nt, Homo sapiens
acauagacauccucauugu

SEQ ID NO: 245634 - RNA, 19 nt, Homo sapiens
gagaacaugauuguggaua

SEQ ID NO: 245635 - RNA, 19 nt, Homo sapiens
gacauagacauccucauug

SEQ ID NO: 245636 - RNA, 19 nt, Homo sapiens
gcacgugaguuccaaugcu

SEQ ID NO: 245637 - RNA, 19 nt, Homo sapiens
gcucucacuuuccgucaug

SEQ ID NO: 245638 - RNA, 19 nt, Homo sapiens
acaaugagaaugugagguu

SEQ ID NO: 245639 - RNA, 19 nt, Homo sapiens
aagaguaucgccaauaaga

SEQ ID NO: 245640 - RNA, 19 nt, Homo sapiens
ucgcacaaaucucgaaaca

SEQ ID NO: 245641 - RNA, 19 nt, Homo sapiens
ggugaugcccaaucucuau

SEQ ID NO: 245642 - RNA, 19 nt, Homo sapiens
gccugaagaucaucaccaa

SEQ ID NO: 245643 - RNA, 19 nt, Homo sapiens
acagcagccuggagcauga

SEQ ID NO: 245644 - RNA, 19 nt, Homo sapiens
gcagaucccagaauaaagc

SEQ ID NO: 245645 - RNA, 19 nt, Homo sapiens
gaggaacaccggcaagagu

SEQ ID NO: 245646 - RNA, 19 nt, Homo sapiens
ggcaagaguaucgccaaua

SEQ ID NO: 245647 - RNA, 19 nt, Homo sapiens
gaguuccaaugcugaugaa

SEQ ID NO: 245648 - RNA, 19 nt, Homo sapiens
ggaggaugguacuggaucu

SEQ ID NO: 245649 - RNA, 19 nt, Homo sapiens
ggcaacaucgucaacaaug

SEQ ID NO: 245650 - RNA, 19 nt, Homo sapiens
cagaucaccuucgagaaca

SEQ ID NO: 245651 - RNA, 19 nt, Homo sapiens
ggaacaccggcaagaguau

SEQ ID NO: 245652 - RNA, 19 nt, Homo sapiens
caauuccuccguccgcuaa

SEQ ID NO: 245653 - RNA, 19 nt, Homo sapiens
ccaacuauggccaugugua

SEQ ID NO: 245654 - RNA, 19 nt, Homo sapiens
gaagaggugcacgugaguu

SEQ ID NO: 245655 - RNA, 19 nt, Homo sapiens
caacuauggccauguguac

SEQ ID NO: 245656 - RNA, 19 nt, Homo sapiens
caaucucuauggcaacauc

SEQ ID NO: 245657 - RNA, 19 nt, Homo sapiens
cgaggaacaucuuuucaga

SEQ ID NO: 245658 - RNA, 19 nt, Homo sapiens
acgcagaucccagaauaaa

SEQ ID NO: 245659 - RNA, 19 nt, Homo sapiens
cgucauggcgcugaaggua

SEQ ID NO: 245660 - RNA, 19 nt, Homo sapiens
ccagcaguuugaugucaug

SEQ ID NO: 245661 - RNA, 19 nt, Homo sapiens
gccaagucccugcgcauug

SEQ ID NO: 245662 - RNA, 19 nt, Homo sapiens
caacaucgaaaccaaccau

SEQ ID NO: 245663 - RNA, 19 nt, Homo sapiens
guguaccaguggacuuuga

SEQ ID NO: 245664 - RNA, 19 nt, Homo sapiens
cuaggaccuucuugguuug

SEQ ID NO: 245665 - RNA, 19 nt, Homo sapiens
gaguaucgccaauaagaac

SEQ ID NO: 245666 - RNA, 19 nt, Homo sapiens
ggacgucauccgccacauc

SEQ ID NO: 245667 - RNA, 19 nt, Homo sapiens
caaggccaacaucaugaaa

SEQ ID NO: 245668 - RNA, 19 nt, Homo sapiens
ccaagucccugcgcauugc

SEQ ID NO: 245669 - RNA, 19 nt, Homo sapiens
guuccaaugcugaugaaga

SEQ ID NO: 245670 - RNA, 19 nt, Homo sapiens
ccauggacaaugagaaugu

SEQ ID NO: 245671 - RNA, 19 nt, Homo sapiens
gaacaccggcaagaguauc

SEQ ID NO: 245672 - RNA, 19 nt, Homo sapiens
acaucgaaaccaaccauaa

SEQ ID NO: 245673 - RNA, 19 nt, Homo sapiens
aggaacaccggcaagagua

SEQ ID NO: 245674 - RNA, 19 nt, Homo sapiens
cacaaggccaacaucauga

SEQ ID NO: 245675 - RNA, 19 nt, Homo sapiens
ggcacacggugaccaugau

SEQ ID NO: 245676 - RNA, 19 nt, Homo sapiens
gccaacgucauccacugua

SEQ ID NO: 245677 - RNA, 19 nt, Homo sapiens
gaaacagcuacgaggaaca

SEQ ID NO: 245678 - RNA, 19 nt, Homo sapiens
ucagaucaccuucgagaac

SEQ ID NO: 245679 - RNA, 19 nt, Homo sapiens
aaacugggcgaugggcuuu

SEQ ID NO: 245680 - RNA, 19 nt, Homo sapiens
uggagagccugaagaucau

SEQ ID NO: 245681 - RNA, 19 nt, Homo sapiens
ugaguuccaaugcugauga

SEQ ID NO: 245682 - RNA, 19 nt, Homo sapiens
uugguuugcuccuuggauu

SEQ ID NO: 245683 - RNA, 19 nt, Homo sapiens
gcaugucaaguccgucuuc

SEQ ID NO: 245684 - RNA, 19 nt, Homo sapiens
cggcaagaguaucgccaau

SEQ ID NO: 245685 - RNA, 19 nt, Homo sapiens
acaaaucucgaaacaacau

SEQ ID NO: 245686 - RNA, 19 nt, Homo sapiens
caucgaaaccaaccauaac

SEQ ID NO: 245687 - RNA, 19 nt, Homo sapiens
ccacauccgcgucaucaac

SEQ ID NO: 245688 - RNA, 19 nt, Homo sapiens
ucauggugaugcccaaucu

SEQ ID NO: 245689 - RNA, 19 nt, Homo sapiens
ugaagaggacauucgcaau

SEQ ID NO: 245690 - RNA, 19 nt, Homo sapiens
ggccagggcacaacaucug

SEQ ID NO: 245691 - RNA, 19 nt, Homo sapiens
cauggacaaugagaaugug

SEQ ID NO: 245692 - RNA, 19 nt, Homo sapiens
ugcggaggcucucacuuuc

SEQ ID NO: 245693 - RNA, 19 nt, Homo sapiens
ggccaagucccugcgcauu

SEQ ID NO: 245694 - RNA, 19 nt, Homo sapiens
acacagagggcgaguacag

SEQ ID NO: 245695 - RNA, 19 nt, Homo sapiens
gcacagagguguucauaaa

SEQ ID NO: 245696 - RNA, 19 nt, Homo sapiens
gcagagauguguauccuua

SEQ ID NO: 245697 - RNA, 19 nt, Homo sapiens
caacaaaggccuauauuaa

SEQ ID NO: 245698 - RNA, 19 nt, Homo sapiens
gcagaggacuugcuauuug

SEQ ID NO: 245699 - RNA, 19 nt, Homo sapiens
gagcaagguucaaauuaaa

SEQ ID NO: 245700 - RNA, 19 nt, Homo sapiens
gauaugacccuaauuugua

SEQ ID NO: 245701 - RNA, 19 nt, Homo sapiens
ggaagaauguaacuuugaa

SEQ ID NO: 245702 - RNA, 19 nt, Homo sapiens
gaacauugagaaaggauua

SEQ ID NO: 245703 - RNA, 19 nt, Homo sapiens
cgacauuugugagagauua

SEQ ID NO: 245704 - RNA, 19 nt, Homo sapiens
gagcugagaccaagaagaa

SEQ ID NO: 245705 - RNA, 19 nt, Homo sapiens
acaaaggccuauauuaaug

SEQ ID NO: 245706 - RNA, 19 nt, Homo sapiens
gaggaagaauguaacuuug

SEQ ID NO: 245707 - RNA, 19 nt, Homo sapiens
agagcaagguucaaauuaa

SEQ ID NO: 245708 - RNA, 19 nt, Homo sapiens
guaaugaugccugaaauaa

SEQ ID NO: 245709 - RNA, 19 nt, Homo sapiens
gguugaaucuucuuguaaa

SEQ ID NO: 245710 - RNA, 19 nt, Homo sapiens
uagaggagauuauggaaug

SEQ ID NO: 245711 - RNA, 19 nt, Homo sapiens
uaagauaacgccaugguuu

SEQ ID NO: 245712 - RNA, 19 nt, Homo sapiens
uaacacgaauucacuacaa

SEQ ID NO: 245713 - RNA, 19 nt, Homo sapiens
uagaacagaucagacauuu

SEQ ID NO: 245714 - RNA, 19 nt, Homo sapiens
uaaauggugggauaacuua

SEQ ID NO: 245715 - RNA, 19 nt, Homo sapiens
gcacagagacggcugaaag

SEQ ID NO: 245716 - RNA, 19 nt, Homo sapiens
gaacgagaacauugagaaa

SEQ ID NO: 245717 - RNA, 19 nt, Homo sapiens
gcugaucaguguucuagaa

SEQ ID NO: 245718 - RNA, 19 nt, Homo sapiens
gaacagaucagacauuuug

SEQ ID NO: 245719 - RNA, 19 nt, Homo sapiens
caacaacaaaggccuauau

SEQ ID NO: 245720 - RNA, 19 nt, Homo sapiens
gaaauauuguagggagaaa

SEQ ID NO: 245721 - RNA, 19 nt, Homo sapiens
cagcgucccucucauguga

SEQ ID NO: 245722 - RNA, 19 nt, Homo sapiens
gcagagcaagguucaaauu

SEQ ID NO: 245723 - RNA, 19 nt, Homo sapiens
ccaaugagauuaaaagcua

SEQ ID NO: 245724 - RNA, 19 nt, Homo sapiens
gcaaagaucagaugcuaag

SEQ ID NO: 245725 - RNA, 19 nt, Homo sapiens
gacccuaauuuguaucauu

SEQ ID NO: 245726 - RNA, 19 nt, Homo sapiens
gaaugugaauauguaggua

SEQ ID NO: 245727 - RNA, 19 nt, Homo sapiens
aagaucagaugcuaagauu

SEQ ID NO: 245728 - RNA, 19 nt, Homo sapiens
ggugcuuuauguaucauua

SEQ ID NO: 245729 - RNA, 19 nt, Homo sapiens
cuggauauguguucuguuu

SEQ ID NO: 245730 - RNA, 19 nt, Homo sapiens
acaacaaaggccuauauua

SEQ ID NO: 245731 - RNA, 19 nt, Homo sapiens
cagagcaagguucaaauua

SEQ ID NO: 245732 - RNA, 19 nt, Homo sapiens
gaauguaacuuugaaucca

SEQ ID NO: 245733 - RNA, 19 nt, Homo sapiens
gaucagaugcuaagauuac

SEQ ID NO: 245734 - RNA, 19 nt, Homo sapiens
gagcacagagguguucaua

SEQ ID NO: 245735 - RNA, 19 nt, Homo sapiens
ggauauguguucuguuucu

SEQ ID NO: 245736 - RNA, 19 nt, Homo sapiens
ugaggaagaauguaacuuu

SEQ ID NO: 245737 - RNA, 19 nt, Homo sapiens
gaagaauugucaccugaac

SEQ ID NO: 245738 - RNA, 19 nt, Homo sapiens
gaauuacagugagcacaga

SEQ ID NO: 245739 - RNA, 19 nt, Homo sapiens
gugaauauguagguaaaug

SEQ ID NO: 245740 - RNA, 19 nt, Homo sapiens
uagguugaaucuucuugua

SEQ ID NO: 245741 - RNA, 19 nt, Homo sapiens
cagccgagcuugaggaaag

SEQ ID NO: 245742 - RNA, 19 nt, Homo sapiens
gaaacauguugauacuuac

SEQ ID NO: 245743 - RNA, 19 nt, Homo sapiens
gcaagguucaaauuaaaug

SEQ ID NO: 245744 - RNA, 19 nt, Homo sapiens
ccaggugcuuuauguauca

SEQ ID NO: 245745 - RNA, 19 nt, Homo sapiens
gauauguguucuguuucua

SEQ ID NO: 245746 - RNA, 19 nt, Homo sapiens
aagauaacgccaugguuua

SEQ ID NO: 245747 - RNA, 19 nt, Homo sapiens
agagauguguauccuuauu

SEQ ID NO: 245748 - RNA, 19 nt, Homo sapiens
gagauuauggaauguguau

SEQ ID NO: 245749 - RNA, 19 nt, Homo sapiens
ggaaauauuguagggagaa

SEQ ID NO: 245750 - RNA, 19 nt, Homo sapiens
ccacaguuaugccggaugu

SEQ ID NO: 245751 - RNA, 19 nt, Homo sapiens
guauuuaccaguuagcaaa

SEQ ID NO: 245752 - RNA, 19 nt, Homo sapiens
gcaaaggaaacuauugucu

SEQ ID NO: 245753 - RNA, 19 nt, Homo sapiens
aaaaugagagcgagaaaua

SEQ ID NO: 245754 - RNA, 19 nt, Homo sapiens
ggaaagugacgcccuugga

SEQ ID NO: 245755 - RNA, 19 nt, Homo sapiens
aaaauaagcuucugcuaca

SEQ ID NO: 245756 - RNA, 19 nt, Homo sapiens
gcugagaccaagaagaauu

SEQ ID NO: 245757 - RNA, 19 nt, Homo sapiens
gcagcgacuuuucucuuua

SEQ ID NO: 245758 - RNA, 19 nt, Homo sapiens
ugccugaaauaaacacuaa

SEQ ID NO: 245759 - RNA, 19 nt, Homo sapiens
gccggaggcugaucagugu

SEQ ID NO: 245760 - RNA, 19 nt, Homo sapiens
gcuuaaacuugacacuguu

SEQ ID NO: 245761 - RNA, 19 nt, Homo sapiens
gaauccagaucccaaugag

SEQ ID NO: 245762 - RNA, 19 nt, Homo sapiens
aaugaugccugaaauaaac

SEQ ID NO: 245763 - RNA, 19 nt, Homo sapiens
gcagccaguggugaaauua

SEQ ID NO: 245764 - RNA, 19 nt, Homo sapiens
ccagaucccaaugagauua

SEQ ID NO: 245765 - RNA, 19 nt, Homo sapiens
guguuguagucauccauua

SEQ ID NO: 245766 - RNA, 19 nt, Homo sapiens
gagcagcgucccucucaug

SEQ ID NO: 245767 - RNA, 19 nt, Homo sapiens
cuuugcagauacauacuua

SEQ ID NO: 245768 - RNA, 19 nt, Homo sapiens
agauguguauccuuauuga

SEQ ID NO: 245769 - RNA, 19 nt, Homo sapiens
aaugagagcgagaaauaaa

SEQ ID NO: 245770 - RNA, 19 nt, Homo sapiens
gugcuuaacaaacuuagaa

SEQ ID NO: 245771 - RNA, 19 nt, Homo sapiens
gaauacguguuguagucau

SEQ ID NO: 245772 - RNA, 19 nt, Homo sapiens
caacugaggaccacugucu

SEQ ID NO: 245773 - RNA, 19 nt, Homo sapiens
gaguugauugugugguuua

SEQ ID NO: 245774 - RNA, 19 nt, Homo sapiens
cgacuuuucucuuuaaaug

SEQ ID NO: 245775 - RNA, 19 nt, Homo sapiens
gauaacgccaugguuuaaa

SEQ ID NO: 245776 - RNA, 19 nt, Homo sapiens
gggugaacaugaaauugau

SEQ ID NO: 245777 - RNA, 19 nt, Homo sapiens
gagauguguauccuuauug

SEQ ID NO: 245778 - RNA, 19 nt, Homo sapiens
caaaggccuauauuaaugu

SEQ ID NO: 245779 - RNA, 19 nt, Homo sapiens
uguguauccuuauugauga

SEQ ID NO: 245780 - RNA, 19 nt, Homo sapiens
acgaauacguguuguaguc

SEQ ID NO: 245781 - RNA, 19 nt, Homo sapiens
ucacacacccuggauaugu

SEQ ID NO: 245782 - RNA, 19 nt, Homo sapiens
ggugggauaacuuaaauca

SEQ ID NO: 245783 - RNA, 19 nt, Homo sapiens
gccaggugcuuuauguauc

SEQ ID NO: 245784 - RNA, 19 nt, Homo sapiens
gaggcgagcagcacagaga

SEQ ID NO: 245785 - RNA, 19 nt, Homo sapiens
ugaacgagaacauugagaa

SEQ ID NO: 245786 - RNA, 19 nt, Homo sapiens
gcaauccagccgagcuuga

SEQ ID NO: 245787 - RNA, 19 nt, Homo sapiens
cgagaacauugagaaagga

SEQ ID NO: 245788 - RNA, 19 nt, Homo sapiens
ucuacagagucaggaaaua

SEQ ID NO: 245789 - RNA, 19 nt, Homo sapiens
ugauaugacccuaauuugu

SEQ ID NO: 245790 - RNA, 19 nt, Homo sapiens
gagcgagaaauaaaacuua

SEQ ID NO: 245791 - RNA, 19 nt, Homo sapiens
aaauagaggagauuaugga

SEQ ID NO: 245792 - RNA, 19 nt, Homo sapiens
cuaaccaccucgacaagca

SEQ ID NO: 245793 - RNA, 19 nt, Homo sapiens
cuacagagucaggaaauau

SEQ ID NO: 245794 - RNA, 19 nt, Homo sapiens
ugacauuugggcuggauaa

SEQ ID NO: 245795 - RNA, 19 nt, Homo sapiens
cgaagaccauacauaauaa

SEQ ID NO: 245796 - RNA, 19 nt, Homo sapiens
gcgagaagcuuuucccuua

SEQ ID NO: 245797 - RNA, 19 nt, Homo sapiens
ccaaggaauuucagaaguu

SEQ ID NO: 245798 - RNA, 19 nt, Homo sapiens
cacacuaaguuccugauua

SEQ ID NO: 245799 - RNA, 19 nt, Homo sapiens
acacuaaguuccugauuau

SEQ ID NO: 245800 - RNA, 19 nt, Homo sapiens
gaccauacauaauaaccaa

SEQ ID NO: 245801 - RNA, 19 nt, Homo sapiens
caauuuggccugagaauau

SEQ ID NO: 245802 - RNA, 19 nt, Homo sapiens
ggaauuuagugcauuucaa

SEQ ID NO: 245803 - RNA, 19 nt, Homo sapiens
aaacuaggcaccacacuaa

SEQ ID NO: 245804 - RNA, 19 nt, Homo sapiens
gcauuuaccucggaucaug

SEQ ID NO: 245805 - RNA, 19 nt, Homo sapiens
acgaagaccauacauaaua

SEQ ID NO: 245806 - RNA, 19 nt, Homo sapiens
gauacgaagaccauacaua

SEQ ID NO: 245807 - RNA, 19 nt, Homo sapiens
aaacaguuacggcuuauuu

SEQ ID NO: 245808 - RNA, 19 nt, Homo sapiens
caaggaauuucagaaguug

SEQ ID NO: 245809 - RNA, 19 nt, Homo sapiens
auacgaagaccauacauaa

SEQ ID NO: 245810 - RNA, 19 nt, Homo sapiens
gaucaugggugggcucuag

SEQ ID NO: 245811 - RNA, 19 nt, Homo sapiens
gaacguucuucucaucauc

SEQ ID NO: 245812 - RNA, 19 nt, Homo sapiens
guccaagccuuaaacauca

SEQ ID NO: 245813 - RNA, 19 nt, Homo sapiens
cuuaugagcccuauauauu

SEQ ID NO: 245814 - RNA, 19 nt, Homo sapiens
gcacugagcaagccauaca

SEQ ID NO: 245815 - RNA, 19 nt, Homo sapiens
ccaagucucuaacgugaca

SEQ ID NO: 245816 - RNA, 19 nt, Homo sapiens
caaacaugcaucaacaauu

SEQ ID NO: 245817 - RNA, 19 nt, Homo sapiens
gggauaucuucuaaccaua

SEQ ID NO: 245818 - RNA, 19 nt, Homo sapiens
caaggagaauggcuaugug

SEQ ID NO: 245819 - RNA, 19 nt, Homo sapiens
ggugcacgcuggaaacuuc

SEQ ID NO: 245820 - RNA, 19 nt, Homo sapiens
caaacuaggcaccacacua

SEQ ID NO: 245821 - RNA, 19 nt, Homo sapiens
ccugaugaauuucuagcua

SEQ ID NO: 245822 - RNA, 19 nt, Homo sapiens
uaugagcccuauauauuca

SEQ ID NO: 245823 - RNA, 19 nt, Homo sapiens
gcuaguuaauccaaacaug

SEQ ID NO: 245824 - RNA, 19 nt, Homo sapiens
gccaacagcaccaucauug

SEQ ID NO: 245825 - RNA, 19 nt, Homo sapiens
gccauacaguuguuggaaa

SEQ ID NO: 245826 - RNA, 19 nt, Homo sapiens
gccuauugcugcaggauga

SEQ ID NO: 245827 - RNA, 19 nt, Homo sapiens
ucccuuaccucgacccuuu

SEQ ID NO: 245828 - RNA, 19 nt, Homo sapiens
gcucugaacguucuucuca

SEQ ID NO: 245829 - RNA, 19 nt, Homo sapiens
cugaugaauuucuagcuaa

SEQ ID NO: 245830 - RNA, 19 nt, Homo sapiens
aaacaucagugugccguau

SEQ ID NO: 245831 - RNA, 19 nt, Homo sapiens
gcaccuugccugacaaaca

SEQ ID NO: 245832 - RNA, 19 nt, Homo sapiens
ucaacaauuuggccugaga

SEQ ID NO: 245833 - RNA, 19 nt, Homo sapiens
uuaaaacaguuacggcuua

SEQ ID NO: 245834 - RNA, 19 nt, Homo sapiens
guauaaugauucccaaggu

SEQ ID NO: 245835 - RNA, 19 nt, Homo sapiens
uaaagaucaugggcuauuc

SEQ ID NO: 245836 - RNA, 19 nt, Homo sapiens
gugaacugauugccuauag

SEQ ID NO: 245837 - RNA, 19 nt, Homo sapiens
ggaugacgcgcaccucuau

SEQ ID NO: 245838 - RNA, 19 nt, Homo sapiens
gagaaugggccaaauacag

SEQ ID NO: 245839 - RNA, 19 nt, Homo sapiens
gagcaagccauacaguugu

SEQ ID NO: 245840 - RNA, 19 nt, Homo sapiens
uaucauccuuccucugaga

SEQ ID NO: 245841 - RNA, 19 nt, Homo sapiens
ggugagaggaggaguuaga

SEQ ID NO: 245842 - RNA, 19 nt, Homo sapiens
gcaccaucauugcauuuac

SEQ ID NO: 245843 - RNA, 19 nt, Homo sapiens
ugucauauuuggauacaca

SEQ ID NO: 245844 - RNA, 19 nt, Homo sapiens
ugggauaucuucuaaccau

SEQ ID NO: 245845 - RNA, 19 nt, Homo sapiens
uaucuuaugagcccuauau

SEQ ID NO: 245846 - RNA, 19 nt, Homo sapiens
caacagcaccaucauugca

SEQ ID NO: 245847 - RNA, 19 nt, Homo sapiens
ugagcaagccauacaguug

SEQ ID NO: 245848 - RNA, 19 nt, Homo sapiens
ggaguuagagcuggucguu

SEQ ID NO: 245849 - RNA, 19 nt, Homo sapiens
caggaucacaauauguaua

SEQ ID NO: 245850 - RNA, 19 nt, Homo sapiens
agacaucccucaguggaau

SEQ ID NO: 245851 - RNA, 19 nt, Homo sapiens
ggcaauccauggaccuugu

SEQ ID NO: 245852 - RNA, 19 nt, Homo sapiens
ccaaacaugcaucaacaau

SEQ ID NO: 245853 - RNA, 19 nt, Homo sapiens
ccauggaccuuguggaacu

SEQ ID NO: 245854 - RNA, 19 nt, Homo sapiens
caauuccuguggacuuuca

SEQ ID NO: 245855 - RNA, 19 nt, Homo sapiens
gagcacugagcaagccaua

SEQ ID NO: 245856 - RNA, 19 nt, Homo sapiens
uguggaauuuagugcauuu

SEQ ID NO: 245857 - RNA, 19 nt, Homo sapiens
ggccugagaauauguaaca

SEQ ID NO: 245858 - RNA, 19 nt, Homo sapiens
gagggcuaguuaauccaaa

SEQ ID NO: 245859 - RNA, 19 nt, Homo sapiens
caauccugaugaauuucua

SEQ ID NO: 245860 - RNA, 19 nt, Homo sapiens
uugccucugugucauauuu

SEQ ID NO: 245861 - RNA, 19 nt, Homo sapiens
ggagggugcacgcuggaaa

SEQ ID NO: 245862 - RNA, 19 nt, Homo sapiens
cuacuuugccucuguguca

SEQ ID NO: 245863 - RNA, 19 nt, Homo sapiens
guugaugccuugaguuuug

SEQ ID NO: 245864 - RNA, 19 nt, Homo sapiens
gauuccgccucacaguuga

SEQ ID NO: 245865 - RNA, 19 nt, Homo sapiens
ggagaaugggccaaauaca

SEQ ID NO: 245866 - RNA, 19 nt, Homo sapiens
cguccaagccuuaaacauc

SEQ ID NO: 245867 - RNA, 19 nt, Homo sapiens
ucaaggagaauggcuaugu

SEQ ID NO: 245868 - RNA, 19 nt, Homo sapiens
caaagcaaacaaacucaag

SEQ ID NO: 245869 - RNA, 19 nt, Homo sapiens
gcaggaucacaauauguau

SEQ ID NO: 245870 - RNA, 19 nt, Homo sapiens
ugauguugcuacccauguu

SEQ ID NO: 245871 - RNA, 19 nt, Homo sapiens
ugggugggcucuaggugaa

SEQ ID NO: 245872 - RNA, 19 nt, Homo sapiens
acccugggauaucuucuaa

SEQ ID NO: 245873 - RNA, 19 nt, Homo sapiens
ccacccgccuguacgacuu

SEQ ID NO: 245874 - RNA, 19 nt, Homo sapiens
acaauuuggccugagaaua

SEQ ID NO: 245875 - RNA, 19 nt, Homo sapiens
ugcaggaucacaauaugua

SEQ ID NO: 245876 - RNA, 19 nt, Homo sapiens
ucagauaccccaaggaauu

SEQ ID NO: 245877 - RNA, 19 nt, Homo sapiens
cuuaucauccuuccucuga

SEQ ID NO: 245878 - RNA, 19 nt, Homo sapiens
cccaguacuucaaggagaa

SEQ ID NO: 245879 - RNA, 19 nt, Homo sapiens
uguggauucugacccauug

SEQ ID NO: 245880 - RNA, 19 nt, Homo sapiens
aagccgaguuuaaaagaua

SEQ ID NO: 245881 - RNA, 19 nt, Homo sapiens
gauugccuauagccaguau

SEQ ID NO: 245882 - RNA, 19 nt, Homo sapiens
guugagcugugcagagaag

SEQ ID NO: 245883 - RNA, 19 nt, Homo sapiens
cccaaggaauuucagaagu

SEQ ID NO: 245884 - RNA, 19 nt, Homo sapiens
ccauacaguuguuggaaaa

SEQ ID NO: 245885 - RNA, 19 nt, Homo sapiens
ggauaucuucuaaccauac

SEQ ID NO: 245886 - RNA, 19 nt, Homo sapiens
uguacgacuucaacuccua

SEQ ID NO: 245887 - RNA, 19 nt, Homo sapiens
caacaauuuggccugagaa

SEQ ID NO: 245888 - RNA, 19 nt, Homo sapiens
ucugacaagccgaguuuaa

SEQ ID NO: 245889 - RNA, 19 nt, Homo sapiens
acagcaccaucauugcauu

SEQ ID NO: 245890 - RNA, 19 nt, Homo sapiens
cuggugagguccccaaaua

SEQ ID NO: 245891 - RNA, 19 nt, Homo sapiens
ugagcccuauauauucaaa

SEQ ID NO: 245892 - RNA, 19 nt, Homo sapiens
uuaugagcccuauauauuc

SEQ ID NO: 245893 - RNA, 19 nt, Homo sapiens
ucauaccuuuggauacgaa

SEQ ID NO: 245894 - RNA, 19 nt, Homo sapiens
auacaaagcaaacaaacuc

SEQ ID NO: 245895 - RNA, 19 nt, Homo sapiens
uaaacaagcugugguauga

SEQ ID NO: 245896 - RNA, 19 nt, Homo sapiens
ccaaggaauuucagaaguu

SEQ ID NO: 245897 - RNA, 19 nt, Homo sapiens
gcauuuaccucggaucaug

SEQ ID NO: 245898 - RNA, 19 nt, Homo sapiens
ggugaugaguuucuacuuc

SEQ ID NO: 245899 - RNA, 19 nt, Homo sapiens
uaaagcagcauucaguuga

SEQ ID NO: 245900 - RNA, 19 nt, Homo sapiens
caaggaauuucagaaguug

SEQ ID NO: 245901 - RNA, 19 nt, Homo sapiens
gaacguucuucucaucauc

SEQ ID NO: 245902 - RNA, 19 nt, Homo sapiens
aacaggaaaugaaauggua

SEQ ID NO: 245903 - RNA, 19 nt, Homo sapiens
guccaagccuuaaacauca

SEQ ID NO: 245904 - RNA, 19 nt, Homo sapiens
gcacugagcaagccauaca

SEQ ID NO: 245905 - RNA, 19 nt, Homo sapiens
ggaaaugaaaugguaucua

SEQ ID NO: 245906 - RNA, 19 nt, Homo sapiens
gggauaucuucuaaccaua

SEQ ID NO: 245907 - RNA, 19 nt, Homo sapiens
caaggagaauggcuaugug

SEQ ID NO: 245908 - RNA, 19 nt, Homo sapiens
ggugcacgcuggaaacuuc

SEQ ID NO: 245909 - RNA, 19 nt, Homo sapiens
gccaacagcaccaucauug

SEQ ID NO: 245910 - RNA, 19 nt, Homo sapiens
gccauacaguuguuggaaa

SEQ ID NO: 245911 - RNA, 19 nt, Homo sapiens
gcugugguaugaugauaau

SEQ ID NO: 245912 - RNA, 19 nt, Homo sapiens
gcucugaacguucuucuca

SEQ ID NO: 245913 - RNA, 19 nt, Homo sapiens
aaacaucagugugccguau

SEQ ID NO: 245914 - RNA, 19 nt, Homo sapiens
gcaccuugccugacaaaca

SEQ ID NO: 245915 - RNA, 19 nt, Homo sapiens
aaauaaacaagcuguggua

SEQ ID NO: 245916 - RNA, 19 nt, Homo sapiens
gagcaagccauacaguugu

SEQ ID NO: 245917 - RNA, 19 nt, Homo sapiens
uaucauccuuccucugaga

SEQ ID NO: 245918 - RNA, 19 nt, Homo sapiens
ucuucuaggugaugaguuu

SEQ ID NO: 245919 - RNA, 19 nt, Homo sapiens
gcaccaucauugcauuuac

SEQ ID NO: 245920 - RNA, 19 nt, Homo sapiens
ugucauauuuggauacaca

SEQ ID NO: 245921 - RNA, 19 nt, Homo sapiens
ugggauaucuucuaaccau

SEQ ID NO: 245922 - RNA, 19 nt, Homo sapiens
aauaacccuuucuguggua

SEQ ID NO: 245923 - RNA, 19 nt, Homo sapiens
caacagcaccaucauugca

SEQ ID NO: 245924 - RNA, 19 nt, Homo sapiens
ugagcaagccauacaguug

SEQ ID NO: 245925 - RNA, 19 nt, Homo sapiens
caauuccuguggacuuuca

SEQ ID NO: 245926 - RNA, 19 nt, Homo sapiens
gagcacugagcaagccaua

SEQ ID NO: 245927 - RNA, 19 nt, Homo sapiens
uugccucugugucauauuu

SEQ ID NO: 245928 - RNA, 19 nt, Homo sapiens
ggagggugcacgcuggaaa

SEQ ID NO: 245929 - RNA, 19 nt, Homo sapiens
aacaagcugugguaugaug

SEQ ID NO: 245930 - RNA, 19 nt, Homo sapiens
caacaggaaaugaaauggu

SEQ ID NO: 245931 - RNA, 19 nt, Homo sapiens
cuacuuugccucuguguca

SEQ ID NO: 245932 - RNA, 19 nt, Homo sapiens
cguccaagccuuaaacauc

SEQ ID NO: 245933 - RNA, 19 nt, Homo sapiens
ucaaggagaauggcuaugu

SEQ ID NO: 245934 - RNA, 19 nt, Homo sapiens
acccugggauaucuucuaa

SEQ ID NO: 245935 - RNA, 19 nt, Homo sapiens
ccacccgccuguacgacuu

SEQ ID NO: 245936 - RNA, 19 nt, Homo sapiens
ucagauaccccaaggaauu

SEQ ID NO: 245937 - RNA, 19 nt, Homo sapiens
cuuaucauccuuccucuga

SEQ ID NO: 245938 - RNA, 19 nt, Homo sapiens
cccaguacuucaaggagaa

SEQ ID NO: 245939 - RNA, 19 nt, Homo sapiens
aagcugugguaugaugaua

SEQ ID NO: 245940 - RNA, 19 nt, Homo sapiens
ucaguugaaauaacccuuu

SEQ ID NO: 245941 - RNA, 19 nt, Homo sapiens
cccaaggaauuucagaagu

SEQ ID NO: 245942 - RNA, 19 nt, Homo sapiens
ccauacaguuguuggaaaa

SEQ ID NO: 245943 - RNA, 19 nt, Homo sapiens
ggauaucuucuaaccauac

SEQ ID NO: 245944 - RNA, 19 nt, Homo sapiens
uguacgacuucaacuccua

SEQ ID NO: 245945 - RNA, 19 nt, Homo sapiens
acagcaccaucauugcauu

SEQ ID NO: 245946 - RNA, 19 nt, Homo sapiens
cuggugagguccccaaaua

SEQ ID NO: 245947 - RNA, 19 nt, Homo sapiens
ucugaacguucuucucauc

SEQ ID NO: 245948 - RNA, 19 nt, Homo sapiens
caccuugccugacaaacag

SEQ ID NO: 245949 - RNA, 19 nt, Homo sapiens
ugaacguucuucucaucau

SEQ ID NO: 245950 - RNA, 19 nt, Homo sapiens
ugaggacaaauaccugauu

SEQ ID NO: 245951 - RNA, 19 nt, Homo sapiens
ggccaacagcaccaucauu

SEQ ID NO: 245952 - RNA, 19 nt, Homo sapiens
aaacgucagccaguccuuu

SEQ ID NO: 245953 - RNA, 19 nt, Homo sapiens
ugugguaauuccaagugaa

SEQ ID NO: 245954 - RNA, 19 nt, Homo sapiens
auaaagcagcauucaguug

SEQ ID NO: 245955 - RNA, 19 nt, Homo sapiens
uacaacaggaaaugaaaug

SEQ ID NO: 245956 - RNA, 19 nt, Homo sapiens
ucuaggugaugaguuucua

SEQ ID NO: 245957 - RNA, 19 nt, Homo sapiens
aauaaagcagcauucaguu

SEQ ID NO: 245958 - RNA, 19 nt, Homo sapiens
aggaauuucagaaguugua

SEQ ID NO: 245959 - RNA, 19 nt, Homo sapiens
cagcaccaucauugcauuu

SEQ ID NO: 245960 - RNA, 19 nt, Homo sapiens
ggaaaauccgccagagcua

SEQ ID NO: 245961 - RNA, 19 nt, Homo sapiens
uaccucggaucaugguuuc

SEQ ID NO: 245962 - RNA, 19 nt, Homo sapiens
ucugugucauauuuggaua

SEQ ID NO: 245963 - RNA, 19 nt, Homo sapiens
auaaacaagcugugguaug

SEQ ID NO: 245964 - RNA, 19 nt, Homo sapiens
ugagugcuuuggacgaucu

SEQ ID NO: 245965 - RNA, 19 nt, Homo sapiens
ugacaccacccgccuguac

SEQ ID NO: 245966 - RNA, 19 nt, Homo sapiens
ggaauuucagaaguuguau

SEQ ID NO: 245967 - RNA, 19 nt, Homo sapiens
ugaaaacacuaagacaugu

SEQ ID NO: 245968 - RNA, 19 nt, Homo sapiens
ggugagguccccaaauauu

SEQ ID NO: 245969 - RNA, 19 nt, Homo sapiens
ggagauacaucgguaggua

SEQ ID NO: 245970 - RNA, 19 nt, Homo sapiens
ccaagugccuguggacaua

SEQ ID NO: 245971 - RNA, 19 nt, Homo sapiens
ggacauacgagauccaguu

SEQ ID NO: 245972 - RNA, 19 nt, Homo sapiens
ggaggucccugugccaaga

SEQ ID NO: 245973 - RNA, 19 nt, Homo sapiens
ggccugagcuacaacuuca

SEQ ID NO: 245974 - RNA, 19 nt, Homo sapiens
gcaggaagccaucgaccuu

SEQ ID NO: 245975 - RNA, 19 nt, Homo sapiens
ccacuucacugacuuugag

SEQ ID NO: 245976 - RNA, 19 nt, Homo sapiens
ccacgacgguaccaacuuc

SEQ ID NO: 245977 - RNA, 19 nt, Homo sapiens
ggacaagcagcagguguuu

SEQ ID NO: 245978 - RNA, 19 nt, Homo sapiens
ucacugacuuugaggacaa

SEQ ID NO: 245979 - RNA, 19 nt, Homo sapiens
gguacggacuggcgcaugu

SEQ ID NO: 245980 - RNA, 19 nt, Homo sapiens
acaagcagcagguguuuga

SEQ ID NO: 245981 - RNA, 19 nt, Homo sapiens
acaaugccuuccugagcua

SEQ ID NO: 245982 - RNA, 19 nt, Homo sapiens
gaacacgugggcuccaagu

SEQ ID NO: 245983 - RNA, 19 nt, Homo sapiens
gccagaccaccacgacuuu

SEQ ID NO: 245984 - RNA, 19 nt, Homo sapiens
ugcaaggcuuccugaacua

SEQ ID NO: 245985 - RNA, 19 nt, Homo sapiens
uggcgcauguuuccaagug

SEQ ID NO: 245986 - RNA, 19 nt, Homo sapiens
ccuucaaccucuuuguguu

SEQ ID NO: 245987 - RNA, 19 nt, Homo sapiens
aaggcuuccugaacuacua

SEQ ID NO: 245988 - RNA, 19 nt, Homo sapiens
gaacuucgagacguggaau

SEQ ID NO: 245989 - RNA, 19 nt, Homo sapiens
gaccuucaaccucuuugug

SEQ ID NO: 245990 - RNA, 19 nt, Homo sapiens
gcgugcggcuggacuacau

SEQ ID NO: 245991 - RNA, 19 nt, Homo sapiens
gcagcucaaccucgccuau

SEQ ID NO: 245992 - RNA, 19 nt, Homo sapiens
ggacggguacuuggaccuu

SEQ ID NO: 245993 - RNA, 19 nt, Homo sapiens
acaucucccuccacaggaa

SEQ ID NO: 245994 - RNA, 19 nt, Homo sapiens
caucgaccuucaaccucuu

SEQ ID NO: 245995 - RNA, 19 nt, Homo sapiens
gacauacgagauccaguuc

SEQ ID NO: 245996 - RNA, 19 nt, Homo sapiens
cgacgguaccaacuucuuc

SEQ ID NO: 245997 - RNA, 19 nt, Homo sapiens
augcaaggcuuccugaacu

SEQ ID NO: 245998 - RNA, 19 nt, Homo sapiens
cagaccaccacgacuuuga

SEQ ID NO: 245999 - RNA, 19 nt, Homo sapiens
ugcuggcgcugcuggauga

SEQ ID NO: 246000 - RNA, 19 nt, Homo sapiens
gcagauccggcagcucuuc

SEQ ID NO: 246001 - RNA, 19 nt, Homo sapiens
ccaccuggacggguacuug

SEQ ID NO: 246002 - RNA, 19 nt, Homo sapiens
gcucaaccucgccuaugug

SEQ ID NO: 246003 - RNA, 19 nt, Homo sapiens
ccucgggccacuucacuga

SEQ ID NO: 246004 - RNA, 19 nt, Homo sapiens
gaaggaaaguuuaguguuu

SEQ ID NO: 246005 - RNA, 19 nt, Homo sapiens
gaaagcagauucuccaaug

SEQ ID NO: 246006 - RNA, 19 nt, Homo sapiens
caaagaagguuuaaguugu

SEQ ID NO: 246007 - RNA, 19 nt, Homo sapiens
gaaauggaaugugcaggua

SEQ ID NO: 246008 - RNA, 19 nt, Homo sapiens
gcagaaagaagacggauaa

SEQ ID NO: 246009 - RNA, 19 nt, Homo sapiens
ggagaagcuucccaacaua

SEQ ID NO: 246010 - RNA, 19 nt, Homo sapiens
acaccaaaguggccaauua

SEQ ID NO: 246011 - RNA, 19 nt, Homo sapiens
ugacauggaugcagaaaga

SEQ ID NO: 246012 - RNA, 19 nt, Homo sapiens
ggauuucgcugaugugguu

SEQ ID NO: 246013 - RNA, 19 nt, Homo sapiens
ugacaucgcuuugauugaa

SEQ ID NO: 246014 - RNA, 19 nt, Homo sapiens
gugaugaacuguguuguaa

SEQ ID NO: 246015 - RNA, 19 nt, Homo sapiens
ucgcugaugugguuuguua

SEQ ID NO: 246016 - RNA, 19 nt, Homo sapiens
ccaaaguggccaauuauuu

SEQ ID NO: 246017 - RNA, 19 nt, Homo sapiens
ugucugaucucucuauaaa

SEQ ID NO: 246018 - RNA, 19 nt, Homo sapiens
ccaacaaugugacuuaugu

SEQ ID NO: 246019 - RNA, 19 nt, Homo sapiens
gaccuuaaacguauaguaa

SEQ ID NO: 246020 - RNA, 19 nt, Homo sapiens
gaugaacuguguuguaaag

SEQ ID NO: 246021 - RNA, 19 nt, Homo sapiens
gggaauaguugaaguaaaa

SEQ ID NO: 246022 - RNA, 19 nt, Homo sapiens
ucucaagaguuccauuuaa

SEQ ID NO: 246023 - RNA, 19 nt, Homo sapiens
gaauacguggauagaauua

SEQ ID NO: 246024 - RNA, 19 nt, Homo sapiens
ccaaagugaugaacugugu

SEQ ID NO: 246025 - RNA, 19 nt, Homo sapiens
caaggucacuuauacaucu

SEQ ID NO: 246026 - RNA, 19 nt, Homo sapiens
cauggcagguggcaauuaa

SEQ ID NO: 246027 - RNA, 19 nt, Homo sapiens
gaaagaagacggauaaaau

SEQ ID NO: 246028 - RNA, 19 nt, Homo sapiens
aaugauacaugcaucguuu

SEQ ID NO: 246029 - RNA, 19 nt, Homo sapiens
ggaccaagauaagacaaug

SEQ ID NO: 246030 - RNA, 19 nt, Homo sapiens
ccaacauacugucaacaaa

SEQ ID NO: 246031 - RNA, 19 nt, Homo sapiens
gcauggaaauacagauuca

SEQ ID NO: 246032 - RNA, 19 nt, Homo sapiens
gagggcaccuguguuugua

SEQ ID NO: 246033 - RNA, 19 nt, Homo sapiens
guaauugaauacguggaua

SEQ ID NO: 246034 - RNA, 19 nt, Homo sapiens
gaacuguguuguaaagcau

SEQ ID NO: 246035 - RNA, 19 nt, Homo sapiens
ucaaagaagguuuaaguug

SEQ ID NO: 246036 - RNA, 19 nt, Homo sapiens
gaaagccugugaugguauc

SEQ ID NO: 246037 - RNA, 19 nt, Homo sapiens
gaugaaagccugugauggu

SEQ ID NO: 246038 - RNA, 19 nt, Homo sapiens
aagaggaucugguggagaa

SEQ ID NO: 246039 - RNA, 19 nt, Homo sapiens
ugugaucucucucuucauu

SEQ ID NO: 246040 - RNA, 19 nt, Homo sapiens
ccaaauauggacaacagua

SEQ ID NO: 246041 - RNA, 19 nt, Homo sapiens
uaaguugucugaucucucu

SEQ ID NO: 246042 - RNA, 19 nt, Homo sapiens
gaagacggauaaaaucauu

SEQ ID NO: 246043 - RNA, 19 nt, Homo sapiens
gaagaacuauggguuacca

SEQ ID NO: 246044 - RNA, 19 nt, Homo sapiens
gcagguacauaugaugguu

SEQ ID NO: 246045 - RNA, 19 nt, Homo sapiens
gagaagaacuauggguuac

SEQ ID NO: 246046 - RNA, 19 nt, Homo sapiens
gggcaccuguguuuguaaa

SEQ ID NO: 246047 - RNA, 19 nt, Homo sapiens
uuaaaggucuccacagagu

SEQ ID NO: 246048 - RNA, 19 nt, Homo sapiens
gauacucaaagaagguuua

SEQ ID NO: 246049 - RNA, 19 nt, Homo sapiens
aaaagcagcuggagcauga

SEQ ID NO: 246050 - RNA, 19 nt, Homo sapiens
gcugaugugguuuguuaua

SEQ ID NO: 246051 - RNA, 19 nt, Homo sapiens
agagaagaacuauggguua

SEQ ID NO: 246052 - RNA, 19 nt, Homo sapiens
guaggaaggccuuuuauuu

SEQ ID NO: 246053 - RNA, 19 nt, Homo sapiens
caagauaagacaauguuca

SEQ ID NO: 246054 - RNA, 19 nt, Homo sapiens
caaaguggccaauuauuuu

SEQ ID NO: 246055 - RNA, 19 nt, Homo sapiens
aaagaagguuuaaguuguc

SEQ ID NO: 246056 - RNA, 19 nt, Homo sapiens
gacaucgcuuugauugaaa

SEQ ID NO: 246057 - RNA, 19 nt, Homo sapiens
gaagguuuaaguugucuga

SEQ ID NO: 246058 - RNA, 19 nt, Homo sapiens
gagguggacugcauuacag

SEQ ID NO: 246059 - RNA, 19 nt, Homo sapiens
aggagaagcuucccaacau

SEQ ID NO: 246060 - RNA, 19 nt, Homo sapiens
uugaauacguggauagaau

SEQ ID NO: 246061 - RNA, 19 nt, Homo sapiens
acucaccucuccugcgaua

SEQ ID NO: 246062 - RNA, 19 nt, Homo sapiens
agacaauguucauaugcaa

SEQ ID NO: 246063 - RNA, 19 nt, Homo sapiens
gagggaauaguugaaguaa

SEQ ID NO: 246064 - RNA, 19 nt, Homo sapiens
aaaggucuccacagaguuu

SEQ ID NO: 246065 - RNA, 19 nt, Homo sapiens
acucaucguuaccaaauau

SEQ ID NO: 246066 - RNA, 19 nt, Homo sapiens
uuucugugcuuccacuuaa

SEQ ID NO: 246067 - RNA, 19 nt, Homo sapiens
acaaggugcugauacucaa

SEQ ID NO: 246068 - RNA, 19 nt, Homo sapiens
ucaacaaggugcugauacu

SEQ ID NO: 246069 - RNA, 19 nt, Homo sapiens
gcucuaaguuuuacggaaa

SEQ ID NO: 246070 - RNA, 19 nt, Homo sapiens
aaacucaucguuaccaaau

SEQ ID NO: 246071 - RNA, 19 nt, Homo sapiens
caaaggcuuccauugcaaa

SEQ ID NO: 246072 - RNA, 19 nt, Homo sapiens
ucacuuauacaucucaaga

SEQ ID NO: 246073 - RNA, 19 nt, Homo sapiens
cucaagaguuccauuuaau

SEQ ID NO: 246074 - RNA, 19 nt, Homo sapiens
guauggaugccaacaaugu

SEQ ID NO: 246075 - RNA, 19 nt, Homo sapiens
agaccaaagugaugaacug

SEQ ID NO: 246076 - RNA, 19 nt, Homo sapiens
gguuuaaguugucugaucu

SEQ ID NO: 246077 - RNA, 19 nt, Homo sapiens
uaucagugcccaaagaaug

SEQ ID NO: 246078 - RNA, 19 nt, Homo sapiens
uuauacaucucaagaggau

SEQ ID NO: 246079 - RNA, 19 nt, Homo sapiens
cgaaggaaaguuuaguguu

SEQ ID NO: 246080 - RNA, 19 nt, Homo sapiens
ggaaaacuguggaaaacca

SEQ ID NO: 246081 - RNA, 19 nt, Homo sapiens
ucgcuuugauugaaaugaa

SEQ ID NO: 246082 - RNA, 19 nt, Homo sapiens
ucaccucuccugcgauaaa

SEQ ID NO: 246083 - RNA, 19 nt, Homo sapiens
ugaauacguggauagaauu

SEQ ID NO: 246084 - RNA, 19 nt, Homo sapiens
gcucaagaagaaacagaaa

SEQ ID NO: 246085 - RNA, 19 nt, Homo sapiens
ggugagguggacugcauua

SEQ ID NO: 246086 - RNA, 19 nt, Homo sapiens
ugaacuguguuguaaagca

SEQ ID NO: 246087 - RNA, 19 nt, Homo sapiens
gaggauuagagaccaguuu

SEQ ID NO: 246088 - RNA, 19 nt, Homo sapiens
guugucugaucucucuaua

SEQ ID NO: 246089 - RNA, 19 nt, Homo sapiens
uuuguaaacuaccguauca

SEQ ID NO: 246090 - RNA, 19 nt, Homo sapiens
caaauauggacaacaguag

SEQ ID NO: 246091 - RNA, 19 nt, Homo sapiens
gcaaggucacuuauacauc

SEQ ID NO: 246092 - RNA, 19 nt, Homo sapiens
uaccaaauauggacaacag

SEQ ID NO: 246093 - RNA, 19 nt, Homo sapiens
gcauugagggcaccugugu

SEQ ID NO: 246094 - RNA, 19 nt, Homo sapiens
gcagguggcaauuaaggau

SEQ ID NO: 246095 - RNA, 19 nt, Homo sapiens
gcaacuaacaggagaagcu

SEQ ID NO: 246096 - RNA, 19 nt, Homo sapiens
uuaaauaacggaacaugca

SEQ ID NO: 246097 - RNA, 19 nt, Homo sapiens
ccaguaaaacucaucguua

SEQ ID NO: 246098 - RNA, 19 nt, Homo sapiens
augaaagccugugauggua

SEQ ID NO: 246099 - RNA, 19 nt, Homo sapiens
gagaccaguuuggcugaau

SEQ ID NO: 246100 - RNA, 19 nt, Homo sapiens
gugcuuccacuuaagguuu

SEQ ID NO: 246101 - RNA, 19 nt, Homo sapiens
caccaaaguggccaauuau

SEQ ID NO: 246102 - RNA, 19 nt, Homo sapiens
aaagauaacgaaagagucu

SEQ ID NO: 246103 - RNA, 19 nt, Homo sapiens
aauauggacaacaguagua

SEQ ID NO: 246104 - RNA, 19 nt, Homo sapiens
ggaaggagauaaacugaaa

SEQ ID NO: 246105 - RNA, 19 nt, Homo sapiens
caaacaagcuucaggaaau

SEQ ID NO: 246106 - RNA, 19 nt, Homo sapiens
gaacgcaacagaaucauuu

SEQ ID NO: 246107 - RNA, 19 nt, Homo sapiens
ugaagaaguuuccauagaa

SEQ ID NO: 246108 - RNA, 19 nt, Homo sapiens
gcaacagaaucauuuguau

SEQ ID NO: 246109 - RNA, 19 nt, Homo sapiens
ggagguauauccuuucaca

SEQ ID NO: 246110 - RNA, 19 nt, Homo sapiens
aaacaagcuucaggaaaua

SEQ ID NO: 246111 - RNA, 19 nt, Homo sapiens
ggaauaugauagucuccua

SEQ ID NO: 246112 - RNA, 19 nt, Homo sapiens
ggagauaaacugaaacuca

SEQ ID NO: 246113 - RNA, 19 nt, Homo sapiens
gaccagcccuaucaagaaa

SEQ ID NO: 246114 - RNA, 19 nt, Homo sapiens
gaagaaguuuccauagaag

SEQ ID NO: 246115 - RNA, 19 nt, Homo sapiens
gagagaagaguaugacaaa

SEQ ID NO: 246116 - RNA, 19 nt, Homo sapiens
gaagaucauugccauagca

SEQ ID NO: 246117 - RNA, 19 nt, Homo sapiens
aaaggaaacucugaagauu

SEQ ID NO: 246118 - RNA, 19 nt, Homo sapiens
gaucuggacuacuguugaa

SEQ ID NO: 246119 - RNA, 19 nt, Homo sapiens
gacugaaccugaagaaguu

SEQ ID NO: 246120 - RNA, 19 nt, Homo sapiens
ugaagaaucuacuguaucu

SEQ ID NO: 246121 - RNA, 19 nt, Homo sapiens
ucagguaacucccagaaga

SEQ ID NO: 246122 - RNA, 19 nt, Homo sapiens
ucacuuaugucuguaaaga

SEQ ID NO: 246123 - RNA, 19 nt, Homo sapiens
gaguugagaucuguaauuc

SEQ ID NO: 246124 - RNA, 19 nt, Homo sapiens
caagaaagaggaagaagga

SEQ ID NO: 246125 - RNA, 19 nt, Homo sapiens
acauauaccugguugaaau

SEQ ID NO: 246126 - RNA, 19 nt, Homo sapiens
caagaaagacauacucaau

SEQ ID NO: 246127 - RNA, 19 nt, Homo sapiens
ccaaaaggauugauuagaa

SEQ ID NO: 246128 - RNA, 19 nt, Homo sapiens
ccaagcagcaguuucuuaa

SEQ ID NO: 246129 - RNA, 19 nt, Homo sapiens
gaucuguaauucauaguca

SEQ ID NO: 246130 - RNA, 19 nt, Homo sapiens
gaaacucugaagauugaua

SEQ ID NO: 246131 - RNA, 19 nt, Homo sapiens
aggaaacucugaagauuga

SEQ ID NO: 246132 - RNA, 19 nt, Homo sapiens
caaaggaaacucugaagau

SEQ ID NO: 246133 - RNA, 19 nt, Homo sapiens
ggaccagcccuaucaagaa

SEQ ID NO: 246134 - RNA, 19 nt, Homo sapiens
ccauauauacuagcuguua

SEQ ID NO: 246135 - RNA, 19 nt, Homo sapiens
ggaaacuucaccagacuuu

SEQ ID NO: 246136 - RNA, 19 nt, Homo sapiens
gagcaacgauuuaaaacuu

SEQ ID NO: 246137 - RNA, 19 nt, Homo sapiens
ucugggaacuuuacugauu

SEQ ID NO: 246138 - RNA, 19 nt, Homo sapiens
gcaaaggaaacucugaaga

SEQ ID NO: 246139 - RNA, 19 nt, Homo sapiens
gcaucuacaacuucuauaa

SEQ ID NO: 246140 - RNA, 19 nt, Homo sapiens
guugagaucuguaauucau

SEQ ID NO: 246141 - RNA, 19 nt, Homo sapiens
guauauccuuucacacuug

SEQ ID NO: 246142 - RNA, 19 nt, Homo sapiens
ggaguugagaucuguaauu

SEQ ID NO: 246143 - RNA, 19 nt, Homo sapiens
aaccaagacugaagacuga

SEQ ID NO: 246144 - RNA, 19 nt, Homo sapiens
ggaugcagauacugaagga

SEQ ID NO: 246145 - RNA, 19 nt, Homo sapiens
aaacaaacccgagaaacaa

SEQ ID NO: 246146 - RNA, 19 nt, Homo sapiens
aaggagaaauucaauggaa

SEQ ID NO: 246147 - RNA, 19 nt, Homo sapiens
gaaagaggaagaaggaagu

SEQ ID NO: 246148 - RNA, 19 nt, Homo sapiens
gacacaaucuccaaaauga

SEQ ID NO: 246149 - RNA, 19 nt, Homo sapiens
guacauauaccugguugaa

SEQ ID NO: 246150 - RNA, 19 nt, Homo sapiens
gguauauccuuucacacuu

SEQ ID NO: 246151 - RNA, 19 nt, Homo sapiens
cugaagaaguuuccauaga

SEQ ID NO: 246152 - RNA, 19 nt, Homo sapiens
agacacaguucuuccaugu

SEQ ID NO: 246153 - RNA, 19 nt, Homo sapiens
gaggcucacuuaugucugu

SEQ ID NO: 246154 - RNA, 19 nt, Homo sapiens
ucaaucagcuuugcucaca

SEQ ID NO: 246155 - RNA, 19 nt, Homo sapiens
caaugaagaaucuacugua

SEQ ID NO: 246156 - RNA, 19 nt, Homo sapiens
agagugaccucaaagaagu

SEQ ID NO: 246157 - RNA, 19 nt, Homo sapiens
gaccacaaucuacgaaauu

SEQ ID NO: 246158 - RNA, 19 nt, Homo sapiens
ucacacaaauaagcauuga

SEQ ID NO: 246159 - RNA, 19 nt, Homo sapiens
gaagacugaaccugaagaa

SEQ ID NO: 246160 - RNA, 19 nt, Homo sapiens
caacugagaaugaagucuu

SEQ ID NO: 246161 - RNA, 19 nt, Homo sapiens
gagcaaaggaaacucugaa

SEQ ID NO: 246162 - RNA, 19 nt, Homo sapiens
gaagaccacaaucuacgaa

SEQ ID NO: 246163 - RNA, 19 nt, Homo sapiens
ugagaucuguaauucauag

SEQ ID NO: 246164 - RNA, 19 nt, Homo sapiens
ucuacgaaauucaggauga

SEQ ID NO: 246165 - RNA, 19 nt, Homo sapiens
gcucacuuaugucuguaaa

SEQ ID NO: 246166 - RNA, 19 nt, Homo sapiens
gaggaaggagauaaacuga

SEQ ID NO: 246167 - RNA, 19 nt, Homo sapiens
ccaaagagcagaagaaaau

SEQ ID NO: 246168 - RNA, 19 nt, Homo sapiens
ugggaacuuuacugauuua

SEQ ID NO: 246169 - RNA, 19 nt, Homo sapiens
aagcauugauuccugcauu

SEQ ID NO: 246170 - RNA, 19 nt, Homo sapiens
gcagauacuucauuuucuu

SEQ ID NO: 246171 - RNA, 19 nt, Homo sapiens
uaaaucagaagaccacaau

SEQ ID NO: 246172 - RNA, 19 nt, Homo sapiens
gaaggagaaauucaaugga

SEQ ID NO: 246173 - RNA, 19 nt, Homo sapiens
cauauaccugguugaaaua

SEQ ID NO: 246174 - RNA, 19 nt, Homo sapiens
gaaacauggagaucccaaa

SEQ ID NO: 246175 - RNA, 19 nt, Homo sapiens
caagaaaagugaagacaca

SEQ ID NO: 246176 - RNA, 19 nt, Homo sapiens
guaacucccagaagaaaug

SEQ ID NO: 246177 - RNA, 19 nt, Homo sapiens
agaaaaggcuggacccaaa

SEQ ID NO: 246178 - RNA, 19 nt, Homo sapiens
ccagagugaccucaaagaa

SEQ ID NO: 246179 - RNA, 19 nt, Homo sapiens
gcugaacgcaacagaauca

SEQ ID NO: 246180 - RNA, 19 nt, Homo sapiens
caacagagcaaaggaaacu

SEQ ID NO: 246181 - RNA, 19 nt, Homo sapiens
cgaaaacaguggccaaaug

SEQ ID NO: 246182 - RNA, 19 nt, Homo sapiens
cagcguaacuccuaaaauc

SEQ ID NO: 246183 - RNA, 19 nt, Homo sapiens
gagcaagccagcacuaguc

SEQ ID NO: 246184 - RNA, 19 nt, Homo sapiens
acaaacaagcuucaggaaa

SEQ ID NO: 246185 - RNA, 19 nt, Homo sapiens
aagaaucuacuguaucuga

SEQ ID NO: 246186 - RNA, 19 nt, Homo sapiens
cugggaacuuuacugauuu

SEQ ID NO: 246187 - RNA, 19 nt, Homo sapiens
ggaaagaaaaucaucauca

SEQ ID NO: 246188 - RNA, 19 nt, Homo sapiens
cucaagaucuggacuacug

SEQ ID NO: 246189 - RNA, 19 nt, Homo sapiens
ggagaaauucaauggaaag

SEQ ID NO: 246190 - RNA, 19 nt, Homo sapiens
aaacaguggccaaauguca

SEQ ID NO: 246191 - RNA, 19 nt, Homo sapiens
agaccuggcugaaacucuu

SEQ ID NO: 246192 - RNA, 19 nt, Homo sapiens
agaaagacauacucaaucc

SEQ ID NO: 246193 - RNA, 19 nt, Homo sapiens
ggacgacugaacacaauca

SEQ ID NO: 246194 - RNA, 19 nt, Homo sapiens
uguuugagguacauaagaa

SEQ ID NO: 246195 - RNA, 19 nt, Homo sapiens
agacugaaccugaagaagu

SEQ ID NO: 246196 - RNA, 19 nt, Homo sapiens
gaaggaagggagucauuuu

SEQ ID NO: 246197 - RNA, 19 nt, Homo sapiens
gaacagcgucagcuuccau

SEQ ID NO: 246198 - RNA, 19 nt, Homo sapiens
uuacugagcaacgauuuaa

SEQ ID NO: 246199 - RNA, 19 nt, Homo sapiens
uuagaaugguuaaguccuu

SEQ ID NO: 246200 - RNA, 19 nt, Homo sapiens
gcccaaagagcagaagaaa

SEQ ID NO: 246201 - RNA, 19 nt, Homo sapiens
aggagaaauucaauggaaa

SEQ ID NO: 246202 - RNA, 19 nt, Homo sapiens
gaaaacaguggccaaaugu

SEQ ID NO: 246203 - RNA, 19 nt, Homo sapiens
uauacuagcuguuaauccu

SEQ ID NO: 246204 - RNA, 19 nt, Homo sapiens
caacuggacucuccggauu

SEQ ID NO: 246205 - RNA, 19 nt, Homo sapiens
gaggaucucuuacucucua

SEQ ID NO: 246206 - RNA, 19 nt, Homo sapiens
ggugaaauauaccaaauuc

SEQ ID NO: 246207 - RNA, 19 nt, Homo sapiens
aaauauaccugggugaaau

SEQ ID NO: 246208 - RNA, 19 nt, Homo sapiens
ucucuaagccacggaauua

SEQ ID NO: 246209 - RNA, 19 nt, Homo sapiens
ccaacuaucccaaauauac

SEQ ID NO: 246210 - RNA, 19 nt, Homo sapiens
gagccaacuaucccaaaua

SEQ ID NO: 246211 - RNA, 19 nt, Homo sapiens
ggagccaacuaucccaaau

SEQ ID NO: 246212 - RNA, 19 nt, Homo sapiens
ugaaguugaggaucucuua

SEQ ID NO: 246213 - RNA, 19 nt, Homo sapiens
caucagcagugaccagugu

SEQ ID NO: 246214 - RNA, 19 nt, Homo sapiens
ugaauuguugcaacucuua

SEQ ID NO: 246215 - RNA, 19 nt, Homo sapiens
gaugaauuguugcaacucu

SEQ ID NO: 246216 - RNA, 19 nt, Homo sapiens
caaauauaccugggugaaa

SEQ ID NO: 246217 - RNA, 19 nt, Homo sapiens
ggccaggauugcuacaguu

SEQ ID NO: 246218 - RNA, 19 nt, Homo sapiens
ccaaauauaccugggugaa

SEQ ID NO: 246219 - RNA, 19 nt, Homo sapiens
agccaacuaucccaaauau

SEQ ID NO: 246220 - RNA, 19 nt, Homo sapiens
caggauugcuacaguugug

SEQ ID NO: 246221 - RNA, 19 nt, Homo sapiens
gaauuguugcaacucuuaa

SEQ ID NO: 246222 - RNA, 19 nt, Homo sapiens
ccucugcucucaccucauc

SEQ ID NO: 246223 - RNA, 19 nt, Homo sapiens
auaccugggugaaauauac

SEQ ID NO: 246224 - RNA, 19 nt, Homo sapiens
ugaccaguguggccaaagu

SEQ ID NO: 246225 - RNA, 19 nt, Homo sapiens
gggugaaauauaccaaauu

SEQ ID NO: 246226 - RNA, 19 nt, Homo sapiens
aauauaccugggugaaaua

SEQ ID NO: 246227 - RNA, 19 nt, Homo sapiens
ugggugaaauauaccaaau

SEQ ID NO: 246228 - RNA, 19 nt, Homo sapiens
uauaccaaauucugcaucu

SEQ ID NO: 246229 - RNA, 19 nt, Homo sapiens
ccagcgaggagccaacuau

SEQ ID NO: 246230 - RNA, 19 nt, Homo sapiens
aagaugaauuguugcaacu

SEQ ID NO: 246231 - RNA, 19 nt, Homo sapiens
cuccauagcagccaagaug

SEQ ID NO: 246232 - RNA, 19 nt, Homo sapiens
gccaacuaucccaaauaua

SEQ ID NO: 246233 - RNA, 19 nt, Homo sapiens
cauagcagccaagaugaug

SEQ ID NO: 246234 - RNA, 19 nt, Homo sapiens
gccaggauugcuacaguug

SEQ ID NO: 246235 - RNA, 19 nt, Homo sapiens
gaaguugaggaucucuuac

SEQ ID NO: 246236 - RNA, 19 nt, Homo sapiens
cggcugucauugcgagguu

SEQ ID NO: 246237 - RNA, 19 nt, Homo sapiens
caacauuccugauaucuug

SEQ ID NO: 246238 - RNA, 19 nt, Homo sapiens
gaacggagguggcgaugug

SEQ ID NO: 246239 - RNA, 19 nt, Homo sapiens
ggaagugccuaagucuuua

SEQ ID NO: 246240 - RNA, 19 nt, Homo sapiens
gcucugcucugaucaccuu

SEQ ID NO: 246241 - RNA, 19 nt, Homo sapiens
caaagacaaggucccauuu

SEQ ID NO: 246242 - RNA, 19 nt, Homo sapiens
ccucagcucuugccaaaca

SEQ ID NO: 246243 - RNA, 19 nt, Homo sapiens
uauaggaggucuguauguu

SEQ ID NO: 246244 - RNA, 19 nt, Homo sapiens
cggaagugccuaagucuuu

SEQ ID NO: 246245 - RNA, 19 nt, Homo sapiens
gcucaacauuccugauauc

SEQ ID NO: 246246 - RNA, 19 nt, Homo sapiens
caagcuagagaucuucuuu

SEQ ID NO: 246247 - RNA, 19 nt, Homo sapiens
gagcaggccagacucaaga

SEQ ID NO: 246248 - RNA, 19 nt, Homo sapiens
ccaaagacaaggucccauu

SEQ ID NO: 246249 - RNA, 19 nt, Homo sapiens
uaggaggucuguauguuca

SEQ ID NO: 246250 - RNA, 19 nt, Homo sapiens
gugcucaacauuccugaua

SEQ ID NO: 246251 - RNA, 19 nt, Homo sapiens
ccauauaggaggucuguau

SEQ ID NO: 246252 - RNA, 19 nt, Homo sapiens
aggaggagcugcuggacaa

SEQ ID NO: 246253 - RNA, 19 nt, Homo sapiens
guacuggugcucaacauuc

SEQ ID NO: 246254 - RNA, 19 nt, Homo sapiens
gcaaaacacugcccagaac

SEQ ID NO: 246255 - RNA, 19 nt, Homo sapiens
gcagcaagucccucugaga

SEQ ID NO: 246256 - RNA, 19 nt, Homo sapiens
gucuuuaguuuccaauuug

SEQ ID NO: 246257 - RNA, 19 nt, Homo sapiens
aaacaagaguucaguugcu

SEQ ID NO: 246258 - RNA, 19 nt, Homo sapiens
gcucagcgucugugccaaa

SEQ ID NO: 246259 - RNA, 19 nt, Homo sapiens
acaaacaagaguucaguug

SEQ ID NO: 246260 - RNA, 19 nt, Homo sapiens
uggacaagcuagagaucuu

SEQ ID NO: 246261 - RNA, 19 nt, Homo sapiens
gaugguguccagccaguug

SEQ ID NO: 246262 - RNA, 19 nt, Homo sapiens
gcucgguacuggugcucaa

SEQ ID NO: 246263 - RNA, 19 nt, Homo sapiens
gaucaggucgcagccaguu

SEQ ID NO: 246264 - RNA, 19 nt, Homo sapiens
agccucagcucuugccaaa

SEQ ID NO: 246265 - RNA, 19 nt, Homo sapiens
gggcagcaagucccucuga

SEQ ID NO: 246266 - RNA, 19 nt, Homo sapiens
ggucacacauugcaaaaca

SEQ ID NO: 246267 - RNA, 19 nt, Homo sapiens
guacaaacaagaguucagu

SEQ ID NO: 246268 - RNA, 19 nt, Homo sapiens
ccacugugcccagcucuga

SEQ ID NO: 246269 - RNA, 19 nt, Homo sapiens
ccaaaucggccaguucaca

SEQ ID NO: 246270 - RNA, 19 nt, Homo sapiens
gguguuggucacuggauuu

SEQ ID NO: 246271 - RNA, 19 nt, Homo sapiens
ggguguuggucacuggauu

SEQ ID NO: 246272 - RNA, 19 nt, Homo sapiens
cagcgucugugccaaaucg

SEQ ID NO: 246273 - RNA, 19 nt, Homo sapiens
ggacaagcuagagaucuuc

SEQ ID NO: 246274 - RNA, 19 nt, Homo sapiens
gagagaccacagcccuuug

SEQ ID NO: 246275 - RNA, 19 nt, Homo sapiens
agagagaccacagcccuuu

SEQ ID NO: 246276 - RNA, 19 nt, Homo sapiens
ggagcaggccagacucaag

SEQ ID NO: 246277 - RNA, 19 nt, Homo sapiens
gaggagcaggccagacuca

SEQ ID NO: 246278 - RNA, 19 nt, Homo sapiens
ccuuggagcugcccauggu

SEQ ID NO: 246279 - RNA, 19 nt, Homo sapiens
ggagcacacgaucaacaug

SEQ ID NO: 246280 - RNA, 19 nt, Homo sapiens
caggccagacucaagauga

SEQ ID NO: 246281 - RNA, 19 nt, Homo sapiens
ccgccaagguucucacacu

SEQ ID NO: 246282 - RNA, 19 nt, Homo sapiens
gguacuggugcucaacauu

SEQ ID NO: 246283 - RNA, 19 nt, Homo sapiens
cugcucugaucaccuuuga

SEQ ID NO: 246284 - RNA, 19 nt, Homo sapiens
cagcagggccuagcagucu

SEQ ID NO: 246285 - RNA, 19 nt, Homo sapiens
ucaacauuccugauaucuu

SEQ ID NO: 246286 - RNA, 19 nt, Homo sapiens
gaaggaagcucccuccaua

SEQ ID NO: 246287 - RNA, 19 nt, Homo sapiens
ggaaagaggucccagaaga

SEQ ID NO: 246288 - RNA, 19 nt, Homo sapiens
gaauauacguugugaagga

SEQ ID NO: 246289 - RNA, 19 nt, Homo sapiens
uuacaaggcuucugacuuu

SEQ ID NO: 246290 - RNA, 19 nt, Homo sapiens
aaagaugacucaacuugua

SEQ ID NO: 246291 - RNA, 19 nt, Homo sapiens
ggagaaagauaucuguuca

SEQ ID NO: 246292 - RNA, 19 nt, Homo sapiens
gcgaugagauccugaguga

SEQ ID NO: 246293 - RNA, 19 nt, Homo sapiens
ucaaagacgugcucgguuu

SEQ ID NO: 246294 - RNA, 19 nt, Homo sapiens
caaauuaaccugcgugaau

SEQ ID NO: 246295 - RNA, 19 nt, Homo sapiens
gaaauuugaucccuguauc

SEQ ID NO: 246296 - RNA, 19 nt, Homo sapiens
uaaggugacucaaaggaaa

SEQ ID NO: 246297 - RNA, 19 nt, Homo sapiens
ugacuuagaggcagaauuu

SEQ ID NO: 246298 - RNA, 19 nt, Homo sapiens
aaacacggauccucaguga

SEQ ID NO: 246299 - RNA, 19 nt, Homo sapiens
aaauuaaccugcgugaaua

SEQ ID NO: 246300 - RNA, 19 nt, Homo sapiens
gaauguacauggaaucucu

SEQ ID NO: 246301 - RNA, 19 nt, Homo sapiens
ccagguaggacuugacuua

SEQ ID NO: 246302 - RNA, 19 nt, Homo sapiens
aaagauaucuguucaagcu

SEQ ID NO: 246303 - RNA, 19 nt, Homo sapiens
ggauggaacuugguuaaca

SEQ ID NO: 246304 - RNA, 19 nt, Homo sapiens
gaacucagaggucaugaug

SEQ ID NO: 246305 - RNA, 19 nt, Homo sapiens
aaagaaagaugacucaacu

SEQ ID NO: 246306 - RNA, 19 nt, Homo sapiens
ggaagccuguagaaauuug

SEQ ID NO: 246307 - RNA, 19 nt, Homo sapiens
gaacuggaaacggaauaua

SEQ ID NO: 246308 - RNA, 19 nt, Homo sapiens
ggaacauccucccagcaaa

SEQ ID NO: 246309 - RNA, 19 nt, Homo sapiens
cuagacaacuccaucauca

SEQ ID NO: 246310 - RNA, 19 nt, Homo sapiens
caacagugccaucauguau

SEQ ID NO: 246311 - RNA, 19 nt, Homo sapiens
gaacuaaaugugcccgaaa

SEQ ID NO: 246312 - RNA, 19 nt, Homo sapiens
uaucacacccuccaucuuu

SEQ ID NO: 246313 - RNA, 19 nt, Homo sapiens
gaaaggcugauuacggaaa

SEQ ID NO: 246314 - RNA, 19 nt, Homo sapiens
ggaaugaggauggaacuug

SEQ ID NO: 246315 - RNA, 19 nt, Homo sapiens
gguuggaccugguuaagga

SEQ ID NO: 246316 - RNA, 19 nt, Homo sapiens
gaacugaaugugcccgaaa

SEQ ID NO: 246317 - RNA, 19 nt, Homo sapiens
agaagacccucaagagaug

SEQ ID NO: 246318 - RNA, 19 nt, Homo sapiens
gaaagaugacucaacuugu

SEQ ID NO: 246319 - RNA, 19 nt, Homo sapiens
gaugagauccugagugagu

SEQ ID NO: 246320 - RNA, 19 nt, Homo sapiens
cuggaagccuguagaaauu

SEQ ID NO: 246321 - RNA, 19 nt, Homo sapiens
guacauggaaucucuggaa

SEQ ID NO: 246322 - RNA, 19 nt, Homo sapiens
acaacuccaucaucacuaa

SEQ ID NO: 246323 - RNA, 19 nt, Homo sapiens
caagccauuucccuucuuu

SEQ ID NO: 246324 - RNA, 19 nt, Homo sapiens
guuaaggaaaggcugauua

SEQ ID NO: 246325 - RNA, 19 nt, Homo sapiens
gaggauggaacuugguuaa

SEQ ID NO: 246326 - RNA, 19 nt, Homo sapiens
cagcacaccuucagacaag

SEQ ID NO: 246327 - RNA, 19 nt, Homo sapiens
ugauggcacuucagaaaug

SEQ ID NO: 246328 - RNA, 19 nt, Homo sapiens
ccagacacuucauaggauu

SEQ ID NO: 246329 - RNA, 19 nt, Homo sapiens
agaaaugaaugaaggaaag

SEQ ID NO: 246330 - RNA, 19 nt, Homo sapiens
uaaagaagacccucaagag

SEQ ID NO: 246331 - RNA, 19 nt, Homo sapiens
gagcagagacacaccaauc

SEQ ID NO: 246332 - RNA, 19 nt, Homo sapiens
gggcauggcauccaagaga

SEQ ID NO: 246333 - RNA, 19 nt, Homo sapiens
gaacgacaaacucaaaguc

SEQ ID NO: 246334 - RNA, 19 nt, Homo sapiens
gauggcacuucagaaauga

SEQ ID NO: 246335 - RNA, 19 nt, Homo sapiens
aaagaagacccucaagaga

SEQ ID NO: 246336 - RNA, 19 nt, Homo sapiens
caucaucacuaagagaaug

SEQ ID NO: 246337 - RNA, 19 nt, Homo sapiens
guaacucucccaaucuuga

SEQ ID NO: 246338 - RNA, 19 nt, Homo sapiens
gaacgcaaagaacuggaaa

SEQ ID NO: 246339 - RNA, 19 nt, Homo sapiens
ggaaggaacgcaaagaacu

SEQ ID NO: 246340 - RNA, 19 nt, Homo sapiens
agaaagauaucuguucaag

SEQ ID NO: 246341 - RNA, 19 nt, Homo sapiens
agaaagaugacucaacuug

SEQ ID NO: 246342 - RNA, 19 nt, Homo sapiens
gaacauccucccagcaaag

SEQ ID NO: 246343 - RNA, 19 nt, Homo sapiens
ccuugacccuguucuguaa

SEQ ID NO: 246344 - RNA, 19 nt, Homo sapiens
gaaggaacgcaaagaacug

SEQ ID NO: 246345 - RNA, 19 nt, Homo sapiens
gauaaggugacucaaagga

SEQ ID NO: 246346 - RNA, 19 nt, Homo sapiens
gaaaugaaugaaggaaaga

SEQ ID NO: 246347 - RNA, 19 nt, Homo sapiens
ccagagauaagagauaauu

SEQ ID NO: 246348 - RNA, 19 nt, Homo sapiens
agugaccaaugacaaguua

SEQ ID NO: 246349 - RNA, 19 nt, Homo sapiens
acacaccaauccuacuuga

SEQ ID NO: 246350 - RNA, 19 nt, Homo sapiens
cuaagagaauguacaugga

SEQ ID NO: 246351 - RNA, 19 nt, Homo sapiens
gguaggacuugacuuagag

SEQ ID NO: 246352 - RNA, 19 nt, Homo sapiens
gaggaaaacccaaaaguga

SEQ ID NO: 246353 - RNA, 19 nt, Homo sapiens
ugccagagauaagagauaa

SEQ ID NO: 246354 - RNA, 19 nt, Homo sapiens
uggauaaggugacucaaag

SEQ ID NO: 246355 - RNA, 19 nt, Homo sapiens
ggcauggcauccaagagaa

SEQ ID NO: 246356 - RNA, 19 nt, Homo sapiens
uaagagaauguacauggaa

SEQ ID NO: 246357 - RNA, 19 nt, Homo sapiens
gguuaacaccaaaugaauu

SEQ ID NO: 246358 - RNA, 19 nt, Homo sapiens
gaaagaggucccagaagac

SEQ ID NO: 246359 - RNA, 19 nt, Homo sapiens
ugacaagagccauggaaga

SEQ ID NO: 246360 - RNA, 19 nt, Homo sapiens
cagugagucugggauguaa

SEQ ID NO: 246361 - RNA, 19 nt, Homo sapiens
gcaaguggccagugacaac

SEQ ID NO: 246362 - RNA, 19 nt, Homo sapiens
ccagaguggugcacaacau

SEQ ID NO: 246363 - RNA, 19 nt, Homo sapiens
uccaggauguucaccauga

SEQ ID NO: 246364 - RNA, 19 nt, Homo sapiens
gcacaccuucagacaagaa

SEQ ID NO: 246365 - RNA, 19 nt, Homo sapiens
gaccagcugauucgagauu

SEQ ID NO: 246366 - RNA, 19 nt, Homo sapiens
ccaacagugccaucaugua

SEQ ID NO: 246367 - RNA, 19 nt, Homo sapiens
gcuagcaucucccuguaac

SEQ ID NO: 246368 - RNA, 19 nt, Homo sapiens
gcgaaagggauuuuauaua

SEQ ID NO: 246369 - RNA, 19 nt, Homo sapiens
agaaccaaaugacccagaa

SEQ ID NO: 246370 - RNA, 19 nt, Homo sapiens
ccaaugacaaguuaacauc

SEQ ID NO: 246371 - RNA, 19 nt, Homo sapiens
gcacucauccaggaaggaa

SEQ ID NO: 246372 - RNA, 19 nt, Homo sapiens
caaacccagacacuucaua

SEQ ID NO: 246373 - RNA, 19 nt, Homo sapiens
caggaacgacaaacucaaa

SEQ ID NO: 246374 - RNA, 19 nt, Homo sapiens
aagaagacccucaagagau

SEQ ID NO: 246375 - RNA, 19 nt, Homo sapiens
uuucuggacucuuccuuga

SEQ ID NO: 246376 - RNA, 19 nt, Homo sapiens
guacacgguggcaugguuu

SEQ ID NO: 246377 - RNA, 19 nt, Homo sapiens
guccacgagucuuccauga

SEQ ID NO: 246378 - RNA, 19 nt, Homo sapiens
aauuugaagucgaaggaaa

SEQ ID NO: 246379 - RNA, 19 nt, Homo sapiens
guggauaaggugacucaaa

SEQ ID NO: 246380 - RNA, 19 nt, Homo sapiens
gacccuggcuuggacuguu

SEQ ID NO: 246381 - RNA, 19 nt, Homo sapiens
ggaacgcaaagaacuggaa

SEQ ID NO: 246382 - RNA, 19 nt, Homo sapiens
gaaaaggaaggaacgcaaa

SEQ ID NO: 246383 - RNA, 19 nt, Homo sapiens
gauccucagugaagugcau

SEQ ID NO: 246384 - RNA, 19 nt, Homo sapiens
gagaaagauaucuguucaa

SEQ ID NO: 246385 - RNA, 19 nt, Homo sapiens
gcccgaaaguccagaucga

SEQ ID NO: 246386 - RNA, 19 nt, Homo sapiens
gaaggaagcucccuccaua

SEQ ID NO: 246387 - RNA, 19 nt, Homo sapiens
ggaaagaggucccagaaga

SEQ ID NO: 246388 - RNA, 19 nt, Homo sapiens
gaauauacguugugaagga

SEQ ID NO: 246389 - RNA, 19 nt, Homo sapiens
aaagaugacucaacuugua

SEQ ID NO: 246390 - RNA, 19 nt, Homo sapiens
ggagaaagauaucuguuca

SEQ ID NO: 246391 - RNA, 19 nt, Homo sapiens
ggaagcaaaugacucuaaa

SEQ ID NO: 246392 - RNA, 19 nt, Homo sapiens
gcgaugagauccugaguga

SEQ ID NO: 246393 - RNA, 19 nt, Homo sapiens
ccuuagagcuucugaguuu

SEQ ID NO: 246394 - RNA, 19 nt, Homo sapiens
gcucuguccuccaagaaua

SEQ ID NO: 246395 - RNA, 19 nt, Homo sapiens
caaauuaaccugcgugaau

SEQ ID NO: 246396 - RNA, 19 nt, Homo sapiens
gaaauuugaucccuguauc

SEQ ID NO: 246397 - RNA, 19 nt, Homo sapiens
gcaagugaauuucuacuac

SEQ ID NO: 246398 - RNA, 19 nt, Homo sapiens
uaaggugacucaaaggaaa

SEQ ID NO: 246399 - RNA, 19 nt, Homo sapiens
aaacacggauccucaguga

SEQ ID NO: 246400 - RNA, 19 nt, Homo sapiens
aaauuaaccugcgugaaua

SEQ ID NO: 246401 - RNA, 19 nt, Homo sapiens
gaauguacauggaaucucu

SEQ ID NO: 246402 - RNA, 19 nt, Homo sapiens
aaagauaucuguucaagcu

SEQ ID NO: 246403 - RNA, 19 nt, Homo sapiens
ggauggaacuugguuaaca

SEQ ID NO: 246404 - RNA, 19 nt, Homo sapiens
gaacucagaggucaugaug

SEQ ID NO: 246405 - RNA, 19 nt, Homo sapiens
aaagaaagaugacucaacu

SEQ ID NO: 246406 - RNA, 19 nt, Homo sapiens
ggaagccuguagaaauuug

SEQ ID NO: 246407 - RNA, 19 nt, Homo sapiens
gaacuggaaacggaauaua

SEQ ID NO: 246408 - RNA, 19 nt, Homo sapiens
ugagucaccuccacauuug

SEQ ID NO: 246409 - RNA, 19 nt, Homo sapiens
ggaacauccucccagcaaa

SEQ ID NO: 246410 - RNA, 19 nt, Homo sapiens
cuagacaacuccaucauca

SEQ ID NO: 246411 - RNA, 19 nt, Homo sapiens
gaacuaaaugugcccgaaa

SEQ ID NO: 246412 - RNA, 19 nt, Homo sapiens
uaggagagcugcugaagag

SEQ ID NO: 246413 - RNA, 19 nt, Homo sapiens
ggaaugaggauggaacuug

SEQ ID NO: 246414 - RNA, 19 nt, Homo sapiens
gaacugaaugugcccgaaa

SEQ ID NO: 246415 - RNA, 19 nt, Homo sapiens
agaagacccucaagagaug

SEQ ID NO: 246416 - RNA, 19 nt, Homo sapiens
gaaagaugacucaacuugu

SEQ ID NO: 246417 - RNA, 19 nt, Homo sapiens
gaugagauccugagugagu

SEQ ID NO: 246418 - RNA, 19 nt, Homo sapiens
cuggaagccuguagaaauu

SEQ ID NO: 246419 - RNA, 19 nt, Homo sapiens
guacauggaaucucuggaa

SEQ ID NO: 246420 - RNA, 19 nt, Homo sapiens
acaacuccaucaucacuaa

SEQ ID NO: 246421 - RNA, 19 nt, Homo sapiens
caagccauuucccuucuuu

SEQ ID NO: 246422 - RNA, 19 nt, Homo sapiens
agaguuaaauagcaaguga

SEQ ID NO: 246423 - RNA, 19 nt, Homo sapiens
gaggauggaacuugguuaa

SEQ ID NO: 246424 - RNA, 19 nt, Homo sapiens
cagcacaccuucagacaag

SEQ ID NO: 246425 - RNA, 19 nt, Homo sapiens
ugauggcacuucagaaaug

SEQ ID NO: 246426 - RNA, 19 nt, Homo sapiens
gggaagcaaaugacucuaa

SEQ ID NO: 246427 - RNA, 19 nt, Homo sapiens
agaaaugaaugaaggaaag

SEQ ID NO: 246428 - RNA, 19 nt, Homo sapiens
uaaagaagacccucaagag

SEQ ID NO: 246429 - RNA, 19 nt, Homo sapiens
gagcagagacacaccaauc

SEQ ID NO: 246430 - RNA, 19 nt, Homo sapiens
gggcauggcauccaagaga

SEQ ID NO: 246431 - RNA, 19 nt, Homo sapiens
gaacgacaaacucaaaguc

SEQ ID NO: 246432 - RNA, 19 nt, Homo sapiens
gauggcacuucagaaauga

SEQ ID NO: 246433 - RNA, 19 nt, Homo sapiens
aaagaagacccucaagaga

SEQ ID NO: 246434 - RNA, 19 nt, Homo sapiens
caucaucacuaagagaaug

SEQ ID NO: 246435 - RNA, 19 nt, Homo sapiens
guaacucucccaaucuuga

SEQ ID NO: 246436 - RNA, 19 nt, Homo sapiens
agagagaguuaaauagcaa

SEQ ID NO: 246437 - RNA, 19 nt, Homo sapiens
gaacgcaaagaacuggaaa

SEQ ID NO: 246438 - RNA, 19 nt, Homo sapiens
ggaaggaacgcaaagaacu

SEQ ID NO: 246439 - RNA, 19 nt, Homo sapiens
agaaagauaucuguucaag

SEQ ID NO: 246440 - RNA, 19 nt, Homo sapiens
agaaagaugacucaacuug

SEQ ID NO: 246441 - RNA, 19 nt, Homo sapiens
gaacauccucccagcaaag

SEQ ID NO: 246442 - RNA, 19 nt, Homo sapiens
gaaggaacgcaaagaacug

SEQ ID NO: 246443 - RNA, 19 nt, Homo sapiens
gauaaggugacucaaagga

SEQ ID NO: 246444 - RNA, 19 nt, Homo sapiens
gaaaugaaugaaggaaaga

SEQ ID NO: 246445 - RNA, 19 nt, Homo sapiens
ccagagauaagagauaauu

SEQ ID NO: 246446 - RNA, 19 nt, Homo sapiens
agugaccaaugacaaguua

SEQ ID NO: 246447 - RNA, 19 nt, Homo sapiens
acacaccaauccuacuuga

SEQ ID NO: 246448 - RNA, 19 nt, Homo sapiens
cuaagagaauguacaugga

SEQ ID NO: 246449 - RNA, 19 nt, Homo sapiens
gaggaaaacccaaaaguga

SEQ ID NO: 246450 - RNA, 19 nt, Homo sapiens
ugccagagauaagagauaa

SEQ ID NO: 246451 - RNA, 19 nt, Homo sapiens
ucaccauguugcagacuuu

SEQ ID NO: 246452 - RNA, 19 nt, Homo sapiens
uggauaaggugacucaaag

SEQ ID NO: 246453 - RNA, 19 nt, Homo sapiens
ggcauggcauccaagagaa

SEQ ID NO: 246454 - RNA, 19 nt, Homo sapiens
uaagagaauguacauggaa

SEQ ID NO: 246455 - RNA, 19 nt, Homo sapiens
ucuggaggcucaccuuaga

SEQ ID NO: 246456 - RNA, 19 nt, Homo sapiens
gguuaacaccaaaugaauu

SEQ ID NO: 246457 - RNA, 19 nt, Homo sapiens
gaaagaggucccagaagac

SEQ ID NO: 246458 - RNA, 19 nt, Homo sapiens
cucaagagagaguuaaaua

SEQ ID NO: 246459 - RNA, 19 nt, Homo sapiens
uccaggauguucaccauga

SEQ ID NO: 246460 - RNA, 19 nt, Homo sapiens
ugacaagagccauggaaga

SEQ ID NO: 246461 - RNA, 19 nt, Homo sapiens
gcaaguggccagugacaac

SEQ ID NO: 246462 - RNA, 19 nt, Homo sapiens
ccagaguggugcacaacau

SEQ ID NO: 246463 - RNA, 19 nt, Homo sapiens
caagagagaguuaaauagc

SEQ ID NO: 246464 - RNA, 19 nt, Homo sapiens
ccaagaauaaaucucaaga

SEQ ID NO: 246465 - RNA, 19 nt, Homo sapiens
gcacaccuucagacaagaa

SEQ ID NO: 246466 - RNA, 19 nt, Homo sapiens
gcuagcaucucccuguaac

SEQ ID NO: 246467 - RNA, 19 nt, Homo sapiens
gcgaaagggauuuuauaua

SEQ ID NO: 246468 - RNA, 19 nt, Homo sapiens
agaaccaaaugacccagaa

SEQ ID NO: 246469 - RNA, 19 nt, Homo sapiens
ccaaugacaaguuaacauc

SEQ ID NO: 246470 - RNA, 19 nt, Homo sapiens
gcacucauccaggaaggaa

SEQ ID NO: 246471 - RNA, 19 nt, Homo sapiens
caggaacgacaaacucaaa

SEQ ID NO: 246472 - RNA, 19 nt, Homo sapiens
aagaagacccucaagagau

SEQ ID NO: 246473 - RNA, 19 nt, Homo sapiens
aauuugaagucgaaggaaa

SEQ ID NO: 246474 - RNA, 19 nt, Homo sapiens
guggauaaggugacucaaa

SEQ ID NO: 246475 - RNA, 19 nt, Homo sapiens
aagagagaguuaaauagca

SEQ ID NO: 246476 - RNA, 19 nt, Homo sapiens
ggaacgcaaagaacuggaa

SEQ ID NO: 246477 - RNA, 19 nt, Homo sapiens
gaaaaggaaggaacgcaaa

SEQ ID NO: 246478 - RNA, 19 nt, Homo sapiens
gauccucagugaagugcau

SEQ ID NO: 246479 - RNA, 19 nt, Homo sapiens
gagaaagauaucuguucaa

SEQ ID NO: 246480 - RNA, 19 nt, Homo sapiens
gcccgaaaguccagaucga

SEQ ID NO: 246481 - RNA, 19 nt, Homo sapiens
caaguuaacauccaaaaug

SEQ ID NO: 246482 - RNA, 19 nt, Homo sapiens
gacauuguucagucaaauu

SEQ ID NO: 246483 - RNA, 19 nt, Homo sapiens
ucaagagagaguuaaauag

SEQ ID NO: 246484 - RNA, 19 nt, Homo sapiens
gauggaacuugguuaacac

SEQ ID NO: 246485 - RNA, 19 nt, Homo sapiens
cagaaaugaaugaaggaaa

SEQ ID NO: 246486 - RNA, 19 nt, Homo sapiens
gaaggaagcucccuccaua

SEQ ID NO: 246487 - RNA, 19 nt, Homo sapiens
ggaaagaggucccagaaga

SEQ ID NO: 246488 - RNA, 19 nt, Homo sapiens
gaauauacguugugaagga

SEQ ID NO: 246489 - RNA, 19 nt, Homo sapiens
uuacaaggcuucugacuuu

SEQ ID NO: 246490 - RNA, 19 nt, Homo sapiens
aaagaugacucaacuugua

SEQ ID NO: 246491 - RNA, 19 nt, Homo sapiens
ggagaaagauaucuguuca

SEQ ID NO: 246492 - RNA, 19 nt, Homo sapiens
gcgaugagauccugaguga

SEQ ID NO: 246493 - RNA, 19 nt, Homo sapiens
ucaaagacgugcucgguuu

SEQ ID NO: 246494 - RNA, 19 nt, Homo sapiens
caaauuaaccugcgugaau

SEQ ID NO: 246495 - RNA, 19 nt, Homo sapiens
gaaauuugaucccuguauc

SEQ ID NO: 246496 - RNA, 19 nt, Homo sapiens
uaaggugacucaaaggaaa

SEQ ID NO: 246497 - RNA, 19 nt, Homo sapiens
ugacuuagaggcagaauuu

SEQ ID NO: 246498 - RNA, 19 nt, Homo sapiens
aaacacggauccucaguga

SEQ ID NO: 246499 - RNA, 19 nt, Homo sapiens
aaauuaaccugcgugaaua

SEQ ID NO: 246500 - RNA, 19 nt, Homo sapiens
gaauguacauggaaucucu

SEQ ID NO: 246501 - RNA, 19 nt, Homo sapiens
ccagguaggacuugacuua

SEQ ID NO: 246502 - RNA, 19 nt, Homo sapiens
aaagauaucuguucaagcu

SEQ ID NO: 246503 - RNA, 19 nt, Homo sapiens
ggauggaacuugguuaaca

SEQ ID NO: 246504 - RNA, 19 nt, Homo sapiens
gaacucagaggucaugaug

SEQ ID NO: 246505 - RNA, 19 nt, Homo sapiens
aaagaaagaugacucaacu

SEQ ID NO: 246506 - RNA, 19 nt, Homo sapiens
ggaagccuguagaaauuug

SEQ ID NO: 246507 - RNA, 19 nt, Homo sapiens
gaacuggaaacggaauaua

SEQ ID NO: 246508 - RNA, 19 nt, Homo sapiens
ggaacauccucccagcaaa

SEQ ID NO: 246509 - RNA, 19 nt, Homo sapiens
cuagacaacuccaucauca

SEQ ID NO: 246510 - RNA, 19 nt, Homo sapiens
caacagugccaucauguau

SEQ ID NO: 246511 - RNA, 19 nt, Homo sapiens
gaacuaaaugugcccgaaa

SEQ ID NO: 246512 - RNA, 19 nt, Homo sapiens
uaucacacccuccaucuuu

SEQ ID NO: 246513 - RNA, 19 nt, Homo sapiens
gaaaggcugauuacggaaa

SEQ ID NO: 246514 - RNA, 19 nt, Homo sapiens
gggcaucccauuuaauauu

SEQ ID NO: 246515 - RNA, 19 nt, Homo sapiens
ggaaugaggauggaacuug

SEQ ID NO: 246516 - RNA, 19 nt, Homo sapiens
gguuggaccugguuaagga

SEQ ID NO: 246517 - RNA, 19 nt, Homo sapiens
uuacgggcaucccauuuaa

SEQ ID NO: 246518 - RNA, 19 nt, Homo sapiens
gaacugaaugugcccgaaa

SEQ ID NO: 246519 - RNA, 19 nt, Homo sapiens
agaagacccucaagagaug

SEQ ID NO: 246520 - RNA, 19 nt, Homo sapiens
gaaagaugacucaacuugu

SEQ ID NO: 246521 - RNA, 19 nt, Homo sapiens
gaugagauccugagugagu

SEQ ID NO: 246522 - RNA, 19 nt, Homo sapiens
cuggaagccuguagaaauu

SEQ ID NO: 246523 - RNA, 19 nt, Homo sapiens
guacauggaaucucuggaa

SEQ ID NO: 246524 - RNA, 19 nt, Homo sapiens
acaacuccaucaucacuaa

SEQ ID NO: 246525 - RNA, 19 nt, Homo sapiens
caagccauuucccuucuuu

SEQ ID NO: 246526 - RNA, 19 nt, Homo sapiens
guuaaggaaaggcugauua

SEQ ID NO: 246527 - RNA, 19 nt, Homo sapiens
gaggauggaacuugguuaa

SEQ ID NO: 246528 - RNA, 19 nt, Homo sapiens
cagcacaccuucagacaag

SEQ ID NO: 246529 - RNA, 19 nt, Homo sapiens
ugauggcacuucagaaaug

SEQ ID NO: 246530 - RNA, 19 nt, Homo sapiens
ccagacacuucauaggauu

SEQ ID NO: 246531 - RNA, 19 nt, Homo sapiens
agaaaugaaugaaggaaag

SEQ ID NO: 246532 - RNA, 19 nt, Homo sapiens
uaaagaagacccucaagag

SEQ ID NO: 246533 - RNA, 19 nt, Homo sapiens
gagcagagacacaccaauc

SEQ ID NO: 246534 - RNA, 19 nt, Homo sapiens
gggcauggcauccaagaga

SEQ ID NO: 246535 - RNA, 19 nt, Homo sapiens
gaacgacaaacucaaaguc

SEQ ID NO: 246536 - RNA, 19 nt, Homo sapiens
gauggcacuucagaaauga

SEQ ID NO: 246537 - RNA, 19 nt, Homo sapiens
aaagaagacccucaagaga

SEQ ID NO: 246538 - RNA, 19 nt, Homo sapiens
caucaucacuaagagaaug

SEQ ID NO: 246539 - RNA, 19 nt, Homo sapiens
guaacucucccaaucuuga

SEQ ID NO: 246540 - RNA, 19 nt, Homo sapiens
gaacgcaaagaacuggaaa

SEQ ID NO: 246541 - RNA, 19 nt, Homo sapiens
ggaaggaacgcaaagaacu

SEQ ID NO: 246542 - RNA, 19 nt, Homo sapiens
agaaagauaucuguucaag

SEQ ID NO: 246543 - RNA, 19 nt, Homo sapiens
agaaagaugacucaacuug

SEQ ID NO: 246544 - RNA, 19 nt, Homo sapiens
gaacauccucccagcaaag

SEQ ID NO: 246545 - RNA, 19 nt, Homo sapiens
ccuugacccuguucuguaa

SEQ ID NO: 246546 - RNA, 19 nt, Homo sapiens
ggcaucccauuuaauauuc

SEQ ID NO: 246547 - RNA, 19 nt, Homo sapiens
gaaggaacgcaaagaacug

SEQ ID NO: 246548 - RNA, 19 nt, Homo sapiens
gauaaggugacucaaagga

SEQ ID NO: 246549 - RNA, 19 nt, Homo sapiens
gaaaugaaugaaggaaaga

SEQ ID NO: 246550 - RNA, 19 nt, Homo sapiens
ccagagauaagagauaauu

SEQ ID NO: 246551 - RNA, 19 nt, Homo sapiens
agugaccaaugacaaguua

SEQ ID NO: 246552 - RNA, 19 nt, Homo sapiens
acacaccaauccuacuuga

SEQ ID NO: 246553 - RNA, 19 nt, Homo sapiens
cuaagagaauguacaugga

SEQ ID NO: 246554 - RNA, 19 nt, Homo sapiens
gguaggacuugacuuagag

SEQ ID NO: 246555 - RNA, 19 nt, Homo sapiens
gaggaaaacccaaaaguga

SEQ ID NO: 246556 - RNA, 19 nt, Homo sapiens
ugccagagauaagagauaa

SEQ ID NO: 246557 - RNA, 19 nt, Homo sapiens
aggaccagcugaaauguga

SEQ ID NO: 246558 - RNA, 19 nt, Homo sapiens
uggauaaggugacucaaag

SEQ ID NO: 246559 - RNA, 19 nt, Homo sapiens
gugaguuccuccucuugaa

SEQ ID NO: 246560 - RNA, 19 nt, Homo sapiens
ggcauggcauccaagagaa

SEQ ID NO: 246561 - RNA, 19 nt, Homo sapiens
uaagagaauguacauggaa

SEQ ID NO: 246562 - RNA, 19 nt, Homo sapiens
gguuaacaccaaaugaauu

SEQ ID NO: 246563 - RNA, 19 nt, Homo sapiens
gaaagaggucccagaagac

SEQ ID NO: 246564 - RNA, 19 nt, Homo sapiens
cagugagucugggauguaa

SEQ ID NO: 246565 - RNA, 19 nt, Homo sapiens
ugacaagagccauggaaga

SEQ ID NO: 246566 - RNA, 19 nt, Homo sapiens
gcaaguggccagugacaac

SEQ ID NO: 246567 - RNA, 19 nt, Homo sapiens
uccaggauguucaccauga

SEQ ID NO: 246568 - RNA, 19 nt, Homo sapiens
ccagaguggugcacaacau

SEQ ID NO: 246569 - RNA, 19 nt, Homo sapiens
gcacaccuucagacaagaa

SEQ ID NO: 246570 - RNA, 19 nt, Homo sapiens
ccaacagugccaucaugua

SEQ ID NO: 246571 - RNA, 19 nt, Homo sapiens
gcuagcaucucccuguaac

SEQ ID NO: 246572 - RNA, 19 nt, Homo sapiens
gcgaaagggauuuuauaua

SEQ ID NO: 246573 - RNA, 19 nt, Homo sapiens
agaaccaaaugacccagaa

SEQ ID NO: 246574 - RNA, 19 nt, Homo sapiens
ccaaugacaaguuaacauc

SEQ ID NO: 246575 - RNA, 19 nt, Homo sapiens
gcacucauccaggaaggaa

SEQ ID NO: 246576 - RNA, 19 nt, Homo sapiens
caaacccagacacuucaua

SEQ ID NO: 246577 - RNA, 19 nt, Homo sapiens
caggaacgacaaacucaaa

SEQ ID NO: 246578 - RNA, 19 nt, Homo sapiens
aagaagacccucaagagau

SEQ ID NO: 246579 - RNA, 19 nt, Homo sapiens
uuucuggacucuuccuuga

SEQ ID NO: 246580 - RNA, 19 nt, Homo sapiens
guacacgguggcaugguuu

SEQ ID NO: 246581 - RNA, 19 nt, Homo sapiens
acgggcaucccauuuaaua

SEQ ID NO: 246582 - RNA, 19 nt, Homo sapiens
guccacgagucuuccauga

SEQ ID NO: 246583 - RNA, 19 nt, Homo sapiens
aauuugaagucgaaggaaa

SEQ ID NO: 246584 - RNA, 19 nt, Homo sapiens
guggauaaggugacucaaa

SEQ ID NO: 246585 - RNA, 19 nt, Homo sapiens
gacccuggcuuggacuguu

SEQ ID NO: 246586 - RNA, 19 nt, Homo sapiens
gaauucaagugccugauua

SEQ ID NO: 246587 - RNA, 19 nt, Homo sapiens
ccaaauccuucauguaaua

SEQ ID NO: 246588 - RNA, 19 nt, Homo sapiens
caaauugggugcugcuaua

SEQ ID NO: 246589 - RNA, 19 nt, Homo sapiens
uaauugagguggcaacaua

SEQ ID NO: 246590 - RNA, 19 nt, Homo sapiens
gcaaaagucuuccaaguaa

SEQ ID NO: 246591 - RNA, 19 nt, Homo sapiens
ucaagugccugauuaauug

SEQ ID NO: 246592 - RNA, 19 nt, Homo sapiens
ucucagacguucagauuua

SEQ ID NO: 246593 - RNA, 19 nt, Homo sapiens
gggcuuguuucuauauuua

SEQ ID NO: 246594 - RNA, 19 nt, Homo sapiens
gaagauacauagcuagaag

SEQ ID NO: 246595 - RNA, 19 nt, Homo sapiens
guccagagcuugacuguga

SEQ ID NO: 246596 - RNA, 19 nt, Homo sapiens
acguaaagcugaagaguua

SEQ ID NO: 246597 - RNA, 19 nt, Homo sapiens
agaaaggaaugcugguuua

SEQ ID NO: 246598 - RNA, 19 nt, Homo sapiens
ugaagaaggugaagaggaa

SEQ ID NO: 246599 - RNA, 19 nt, Homo sapiens
guaaucgaauggagaaauu

SEQ ID NO: 246600 - RNA, 19 nt, Homo sapiens
gauaaucucuuccgugucu

SEQ ID NO: 246601 - RNA, 19 nt, Homo sapiens
gagcgaaggugugcuuuga

SEQ ID NO: 246602 - RNA, 19 nt, Homo sapiens
gagagaaguuaguugaaga

SEQ ID NO: 246603 - RNA, 19 nt, Homo sapiens
gugggaaccuggugacuaa

SEQ ID NO: 246604 - RNA, 19 nt, Homo sapiens
gaagaagccuuggagaaag

SEQ ID NO: 246605 - RNA, 19 nt, Homo sapiens
gaacuguaacauuugcuua

SEQ ID NO: 246606 - RNA, 19 nt, Homo sapiens
gcaauguuguuccauacuu

SEQ ID NO: 246607 - RNA, 19 nt, Homo sapiens
ggaaugcugguuuaucuuu

SEQ ID NO: 246608 - RNA, 19 nt, Homo sapiens
gagaacaggaagauacaua

SEQ ID NO: 246609 - RNA, 19 nt, Homo sapiens
cgaaacaacugcuccaucu

SEQ ID NO: 246610 - RNA, 19 nt, Homo sapiens
cuagguagaugcugaauag

SEQ ID NO: 246611 - RNA, 19 nt, Homo sapiens
ccaguaaugugcuaaguuc

SEQ ID NO: 246612 - RNA, 19 nt, Homo sapiens
agaggaagauuucugaaga

SEQ ID NO: 246613 - RNA, 19 nt, Homo sapiens
gagaaaggaaugcugguuu

SEQ ID NO: 246614 - RNA, 19 nt, Homo sapiens
gaaauuccuccaccaaguu

SEQ ID NO: 246615 - RNA, 19 nt, Homo sapiens
ggaauucaguaaagagcuu

SEQ ID NO: 246616 - RNA, 19 nt, Homo sapiens
ggagagaaguuaguugaag

SEQ ID NO: 246617 - RNA, 19 nt, Homo sapiens
aaagcaauguguacaagaa

SEQ ID NO: 246618 - RNA, 19 nt, Homo sapiens
gaauacauaccaaacaaug

SEQ ID NO: 246619 - RNA, 19 nt, Homo sapiens
gcgaaggugugcuuugaga

SEQ ID NO: 246620 - RNA, 19 nt, Homo sapiens
caaaugaagugugaagaca

SEQ ID NO: 246621 - RNA, 19 nt, Homo sapiens
ggaccaaagucuaaauagg

SEQ ID NO: 246622 - RNA, 19 nt, Homo sapiens
ugagagagcccaaggaguu

SEQ ID NO: 246623 - RNA, 19 nt, Homo sapiens
gggcagaagaggaagauuu

SEQ ID NO: 246624 - RNA, 19 nt, Homo sapiens
ugaagaagccuuggagaaa

SEQ ID NO: 246625 - RNA, 19 nt, Homo sapiens
gucauaauguagcaaguaa

SEQ ID NO: 246626 - RNA, 19 nt, Homo sapiens
gcaaguauacagagaguuc

SEQ ID NO: 246627 - RNA, 19 nt, Homo sapiens
gaaugcugguuuaucuuug

SEQ ID NO: 246628 - RNA, 19 nt, Homo sapiens
acaggaagauacauagcua

SEQ ID NO: 246629 - RNA, 19 nt, Homo sapiens
gcagagaacaggaagauac

SEQ ID NO: 246630 - RNA, 19 nt, Homo sapiens
gcaaaagauuggacuaaga

SEQ ID NO: 246631 - RNA, 19 nt, Homo sapiens
ccucaucccuucagcauca

SEQ ID NO: 246632 - RNA, 19 nt, Homo sapiens
ccaaagaacccagaauuca

SEQ ID NO: 246633 - RNA, 19 nt, Homo sapiens
guaaugaaucuaagagaga

SEQ ID NO: 246634 - RNA, 19 nt, Homo sapiens
gaugaaagacaaacugcaa

SEQ ID NO: 246635 - RNA, 19 nt, Homo sapiens
gaaaucaagggagaaagaa

SEQ ID NO: 246636 - RNA, 19 nt, Homo sapiens
gcccuggaaugcuuacgua

SEQ ID NO: 246637 - RNA, 19 nt, Homo sapiens
caucaaaguuggugugaac

SEQ ID NO: 246638 - RNA, 19 nt, Homo sapiens
gcagccaaauccuucaugu

SEQ ID NO: 246639 - RNA, 19 nt, Homo sapiens
gaaaagaaaguuacuggaa

SEQ ID NO: 246640 - RNA, 19 nt, Homo sapiens
cuaccugcauugccaaauu

SEQ ID NO: 246641 - RNA, 19 nt, Homo sapiens
ggagaaagccccaggugua

SEQ ID NO: 246642 - RNA, 19 nt, Homo sapiens
uaagaugcgugaagaaggu

SEQ ID NO: 246643 - RNA, 19 nt, Homo sapiens
ugaauagccuagacaucaa

SEQ ID NO: 246644 - RNA, 19 nt, Homo sapiens
aauaaauguuccaccagua

SEQ ID NO: 246645 - RNA, 19 nt, Homo sapiens
gcaaguaaagaaugagaau

SEQ ID NO: 246646 - RNA, 19 nt, Homo sapiens
gggcuuggugauagaauua

SEQ ID NO: 246647 - RNA, 19 nt, Homo sapiens
ugaaauuccuccaccaagu

SEQ ID NO: 246648 - RNA, 19 nt, Homo sapiens
ggccauccaccacuuuaua

SEQ ID NO: 246649 - RNA, 19 nt, Homo sapiens
uaaagagcuuacuccugua

SEQ ID NO: 246650 - RNA, 19 nt, Homo sapiens
ugagugagaacaauaagaa

SEQ ID NO: 246651 - RNA, 19 nt, Homo sapiens
ggaaaauguuugccuguug

SEQ ID NO: 246652 - RNA, 19 nt, Homo sapiens
aaugaagacugaacucugu

SEQ ID NO: 246653 - RNA, 19 nt, Homo sapiens
gaaaggaaugcugguuuau

SEQ ID NO: 246654 - RNA, 19 nt, Homo sapiens
acaauacacuagaaaccaa

SEQ ID NO: 246655 - RNA, 19 nt, Homo sapiens
caauguuguuccauacuug

SEQ ID NO: 246656 - RNA, 19 nt, Homo sapiens
caaaaggaauucaguaaag

SEQ ID NO: 246657 - RNA, 19 nt, Homo sapiens
uagcagaucaguaugaaga

SEQ ID NO: 246658 - RNA, 19 nt, Homo sapiens
uauguuaacaccugaauug

SEQ ID NO: 246659 - RNA, 19 nt, Homo sapiens
ccacuaggcuacugcugau

SEQ ID NO: 246660 - RNA, 19 nt, Homo sapiens
gcaacaagcagaugaagac

SEQ ID NO: 246661 - RNA, 19 nt, Homo sapiens
ggaaggguggacacgguua

SEQ ID NO: 246662 - RNA, 19 nt, Homo sapiens
gaauagccuagacaucaaa

SEQ ID NO: 246663 - RNA, 19 nt, Homo sapiens
gccaaauccuucauguaau

SEQ ID NO: 246664 - RNA, 19 nt, Homo sapiens
agccaaauccuucauguaa

SEQ ID NO: 246665 - RNA, 19 nt, Homo sapiens
gaggaagauuucugaagag

SEQ ID NO: 246666 - RNA, 19 nt, Homo sapiens
gaaaacuccuuggaugauu

SEQ ID NO: 246667 - RNA, 19 nt, Homo sapiens
uguagcaaguaaagaauga

SEQ ID NO: 246668 - RNA, 19 nt, Homo sapiens
gagugcaauuugaacugua

SEQ ID NO: 246669 - RNA, 19 nt, Homo sapiens
cugaugaggccaaugauaa

SEQ ID NO: 246670 - RNA, 19 nt, Homo sapiens
gaaggguggacacgguuaa

SEQ ID NO: 246671 - RNA, 19 nt, Homo sapiens
uagccacuauuaggaauuu

SEQ ID NO: 246672 - RNA, 19 nt, Homo sapiens
acaagaagacuuucagcaa

SEQ ID NO: 246673 - RNA, 19 nt, Homo sapiens
guaaugugcuaaguucauc

SEQ ID NO: 246674 - RNA, 19 nt, Homo sapiens
gaauucaaagccacaaugu

SEQ ID NO: 246675 - RNA, 19 nt, Homo sapiens
acaagcagaugaagacucu

SEQ ID NO: 246676 - RNA, 19 nt, Homo sapiens
gcugaugaggccaaugaua

SEQ ID NO: 246677 - RNA, 19 nt, Homo sapiens
gaaggagagaaguuaguug

SEQ ID NO: 246678 - RNA, 19 nt, Homo sapiens
cauuucaccuggaacuuga

SEQ ID NO: 246679 - RNA, 19 nt, Homo sapiens
gaaacuaugccugggucua

SEQ ID NO: 246680 - RNA, 19 nt, Homo sapiens
ugaguauucuacacaaugu

SEQ ID NO: 246681 - RNA, 19 nt, Homo sapiens
gaaagcugaugaggccaau

SEQ ID NO: 246682 - RNA, 19 nt, Homo sapiens
gaagaggaagauuucugaa

SEQ ID NO: 246683 - RNA, 19 nt, Homo sapiens
ugacaaccaguaccuuaaa

SEQ ID NO: 246684 - RNA, 19 nt, Homo sapiens
gaaggugugcuuugagaag

SEQ ID NO: 246685 - RNA, 19 nt, Homo sapiens
aaggaaugcugguuuaucu

SEQ ID NO: 246686 - RNA, 19 nt, Homo sapiens
ggauaaagcucuugaguua

SEQ ID NO: 246687 - RNA, 19 nt, Homo sapiens
gaacaggcaucauuaacaa

SEQ ID NO: 246688 - RNA, 19 nt, Homo sapiens
caauugagaugucacuuua

SEQ ID NO: 246689 - RNA, 19 nt, Homo sapiens
gauaagaucagccauauuu

SEQ ID NO: 246690 - RNA, 19 nt, Homo sapiens
gcaagaagcuuucaaaucc

SEQ ID NO: 246691 - RNA, 19 nt, Homo sapiens
cagaacggcugccuaauuu

SEQ ID NO: 246692 - RNA, 19 nt, Homo sapiens
gagacuggcugcugacuuu

SEQ ID NO: 246693 - RNA, 19 nt, Homo sapiens
gaucagccauauuucauuu

SEQ ID NO: 246694 - RNA, 19 nt, Homo sapiens
ucaaaucccuuccgcuaua

SEQ ID NO: 246695 - RNA, 19 nt, Homo sapiens
ggaagaacaugacaaccaa

SEQ ID NO: 246696 - RNA, 19 nt, Homo sapiens
aaagaaaucugacgucaau

SEQ ID NO: 246697 - RNA, 19 nt, Homo sapiens
caaauacagugugggaaua

SEQ ID NO: 246698 - RNA, 19 nt, Homo sapiens
gcaagaauguauauagaag

SEQ ID NO: 246699 - RNA, 19 nt, Homo sapiens
gagaaaagcuagacaaaau

SEQ ID NO: 246700 - RNA, 19 nt, Homo sapiens
uaaggaaacuucggagaaa

SEQ ID NO: 246701 - RNA, 19 nt, Homo sapiens
ggaaggaaauaugaaugaa

SEQ ID NO: 246702 - RNA, 19 nt, Homo sapiens
acaggaagcugaaggagaa

SEQ ID NO: 246703 - RNA, 19 nt, Homo sapiens
gccaaggccugcuuugaaa

SEQ ID NO: 246704 - RNA, 19 nt, Homo sapiens
gcaauugagaugucacuuu

SEQ ID NO: 246705 - RNA, 19 nt, Homo sapiens
gaagaaacaaugcaagaca

SEQ ID NO: 246706 - RNA, 19 nt, Homo sapiens
ccagacaauggauauauua

SEQ ID NO: 246707 - RNA, 19 nt, Homo sapiens
agaaauagacugugaggaa

SEQ ID NO: 246708 - RNA, 19 nt, Homo sapiens
gacaauggauauauuaagg

SEQ ID NO: 246709 - RNA, 19 nt, Homo sapiens
gaacaugacaaccaagcaa

SEQ ID NO: 246710 - RNA, 19 nt, Homo sapiens
cauuagaucuggaaagcuu

SEQ ID NO: 246711 - RNA, 19 nt, Homo sapiens
gaucaucaggucaaggaua

SEQ ID NO: 246712 - RNA, 19 nt, Homo sapiens
cagaaaagcugaagagaau

SEQ ID NO: 246713 - RNA, 19 nt, Homo sapiens
ggagaacauuugcaagaag

SEQ ID NO: 246714 - RNA, 19 nt, Homo sapiens
gggaauacacaaccuacua

SEQ ID NO: 246715 - RNA, 19 nt, Homo sapiens
ggagaaaggcauuagaucu

SEQ ID NO: 246716 - RNA, 19 nt, Homo sapiens
ugaaugaagcccuggagua

SEQ ID NO: 246717 - RNA, 19 nt, Homo sapiens
guccagaaauagacuguga

SEQ ID NO: 246718 - RNA, 19 nt, Homo sapiens
uggcagaagcccagacuua

SEQ ID NO: 246719 - RNA, 19 nt, Homo sapiens
gagaaaggcauuagaucug

SEQ ID NO: 246720 - RNA, 19 nt, Homo sapiens
cagcaaccaugaguacaaa

SEQ ID NO: 246721 - RNA, 19 nt, Homo sapiens
aauagaacaggcaucauua

SEQ ID NO: 246722 - RNA, 19 nt, Homo sapiens
aaauagaacaggcaucauu

SEQ ID NO: 246723 - RNA, 19 nt, Homo sapiens
gccaacauguccucacaga

SEQ ID NO: 246724 - RNA, 19 nt, Homo sapiens
cuggauggcuuuaaauuag

SEQ ID NO: 246725 - RNA, 19 nt, Homo sapiens
gaacggcugccuaauuuac

SEQ ID NO: 246726 - RNA, 19 nt, Homo sapiens
ccuacuagccuaugugaaa

SEQ ID NO: 246727 - RNA, 19 nt, Homo sapiens
uggcaagaauguauauaga

SEQ ID NO: 246728 - RNA, 19 nt, Homo sapiens
ggaugggccuugcugaagu

SEQ ID NO: 246729 - RNA, 19 nt, Homo sapiens
gauaucagccacuuucaca

SEQ ID NO: 246730 - RNA, 19 nt, Homo sapiens
ugacgucaaugcaauuauc

SEQ ID NO: 246731 - RNA, 19 nt, Homo sapiens
gaaaagcugaagagaauuu

SEQ ID NO: 246732 - RNA, 19 nt, Homo sapiens
ccgcuuaaauccagacaau

SEQ ID NO: 246733 - RNA, 19 nt, Homo sapiens
aaggcaggcuguccgcuua

SEQ ID NO: 246734 - RNA, 19 nt, Homo sapiens
gaaaaggcucuguggauaa

SEQ ID NO: 246735 - RNA, 19 nt, Homo sapiens
gaguacaaauggugaugau

SEQ ID NO: 246736 - RNA, 19 nt, Homo sapiens
gaaugaagcccuggaguac

SEQ ID NO: 246737 - RNA, 19 nt, Homo sapiens
uaagaucagccauauuuca

SEQ ID NO: 246738 - RNA, 19 nt, Homo sapiens
aggauagucuggagcaauu

SEQ ID NO: 246739 - RNA, 19 nt, Homo sapiens
caacuuugccuggauguau

SEQ ID NO: 246740 - RNA, 19 nt, Homo sapiens
gaagcaggcaaucacagaa

SEQ ID NO: 246741 - RNA, 19 nt, Homo sapiens
ccuggauggcuuuaaauua

SEQ ID NO: 246742 - RNA, 19 nt, Homo sapiens
ggacaagguggagaacauu

SEQ ID NO: 246743 - RNA, 19 nt, Homo sapiens
ggaauacacaaccuacuag

SEQ ID NO: 246744 - RNA, 19 nt, Homo sapiens
cagauugaauuccuagaca

SEQ ID NO: 246745 - RNA, 19 nt, Homo sapiens
ggaucagauugaauuccua

SEQ ID NO: 246746 - RNA, 19 nt, Homo sapiens
ugagaacucugugagacaa

SEQ ID NO: 246747 - RNA, 19 nt, Homo sapiens
augaagcccuggaguacua

SEQ ID NO: 246748 - RNA, 19 nt, Homo sapiens
gaaggaaauaugaaugaag

SEQ ID NO: 246749 - RNA, 19 nt, Homo sapiens
gaaaagcuagacaaaauga

SEQ ID NO: 246750 - RNA, 19 nt, Homo sapiens
gaaaggccagaaugaggaa

SEQ ID NO: 246751 - RNA, 19 nt, Homo sapiens
gcaaccaugaguacaaaug

SEQ ID NO: 246752 - RNA, 19 nt, Homo sapiens
ccagauaucagccacuuuc

SEQ ID NO: 246753 - RNA, 19 nt, Homo sapiens
guucgucuauaaauuggaa

SEQ ID NO: 246754 - RNA, 19 nt, Homo sapiens
gauagggcuuugcuacaag

SEQ ID NO: 246755 - RNA, 19 nt, Homo sapiens
agauagggcuuugcuacaa

SEQ ID NO: 246756 - RNA, 19 nt, Homo sapiens
gcuuuaaauuagccacaaa

SEQ ID NO: 246757 - RNA, 19 nt, Homo sapiens
agaaacaaugcaagacaua

SEQ ID NO: 246758 - RNA, 19 nt, Homo sapiens
ggcaagaauguauauagaa

SEQ ID NO: 246759 - RNA, 19 nt, Homo sapiens
cuacaaggcacaaaugauc

SEQ ID NO: 246760 - RNA, 19 nt, Homo sapiens
aacacccacuucugucuua

SEQ ID NO: 246761 - RNA, 19 nt, Homo sapiens
agaaaaggcucuguggaua

SEQ ID NO: 246762 - RNA, 19 nt, Homo sapiens
gauaugcagccaaguuuua

SEQ ID NO: 246763 - RNA, 19 nt, Homo sapiens
uaucagccacuuucacauu

SEQ ID NO: 246764 - RNA, 19 nt, Homo sapiens
gaaacacccacuucugucu

SEQ ID NO: 246765 - RNA, 19 nt, Homo sapiens
guacauugaagaagcucua

SEQ ID NO: 246766 - RNA, 19 nt, Homo sapiens
gcugaaguguggaggaaag

SEQ ID NO: 246767 - RNA, 19 nt, Homo sapiens
uggagaacauuugcaagaa

SEQ ID NO: 246768 - RNA, 19 nt, Homo sapiens
ccaaauacagugugggaau

SEQ ID NO: 246769 - RNA, 19 nt, Homo sapiens
aaucugacgucaaugcaau

SEQ ID NO: 246770 - RNA, 19 nt, Homo sapiens
gaaguguggaggaaagaau

SEQ ID NO: 246771 - RNA, 19 nt, Homo sapiens
guggagaacauuugcaaga

SEQ ID NO: 246772 - RNA, 19 nt, Homo sapiens
uaauuuacagcaaccauga

SEQ ID NO: 246773 - RNA, 19 nt, Homo sapiens
uagaagaaacaaugcaaga

SEQ ID NO: 246774 - RNA, 19 nt, Homo sapiens
gaugggccuugcugaagug

SEQ ID NO: 246775 - RNA, 19 nt, Homo sapiens
gacaagguggagaacauuu

SEQ ID NO: 246776 - RNA, 19 nt, Homo sapiens
ccacuuucacauuucauuu

SEQ ID NO: 246777 - RNA, 19 nt, Homo sapiens
guauauagaagcaggcaau

SEQ ID NO: 246778 - RNA, 19 nt, Homo sapiens
cuuacugcaucaccagaua

SEQ ID NO: 246779 - RNA, 19 nt, Homo sapiens
ggagaaaaguacauugaag

SEQ ID NO: 246780 - RNA, 19 nt, Homo sapiens
gcaggaagaacaugacaac

SEQ ID NO: 246781 - RNA, 19 nt, Homo sapiens
guccuuaggcacccagaua

SEQ ID NO: 246782 - RNA, 19 nt, Homo sapiens
uuaaggaaacuucggagaa

SEQ ID NO: 246783 - RNA, 19 nt, Homo sapiens
gaccuggcaagaauguaua

SEQ ID NO: 246784 - RNA, 19 nt, Homo sapiens
ucacuuuacaugggaguua

SEQ ID NO: 246785 - RNA, 19 nt, Homo sapiens
ucgccuggauggcuuuaaa

SEQ ID NO: 246786 - RNA, 19 nt, Homo sapiens
gaauaaagcucuugagaag

SEQ ID NO: 246787 - RNA, 19 nt, Homo sapiens
gaaaucccgucucuacuaa

SEQ ID NO: 246788 - RNA, 19 nt, Homo sapiens
aaacaaaccugcaagaaau

SEQ ID NO: 246789 - RNA, 19 nt, Homo sapiens
gaaacaaaccugcaagaaa

SEQ ID NO: 246790 - RNA, 19 nt, Homo sapiens
gcaagaacaugcugaccaa

SEQ ID NO: 246791 - RNA, 19 nt, Homo sapiens
ggaagucccugaugcugaa

SEQ ID NO: 246792 - RNA, 19 nt, Homo sapiens
agacaaagcuauugaacug

SEQ ID NO: 246793 - RNA, 19 nt, Homo sapiens
ggaaauaaagagaugauug

SEQ ID NO: 246794 - RNA, 19 nt, Homo sapiens
ugaauccucugaaugcaua

SEQ ID NO: 246795 - RNA, 19 nt, Homo sapiens
gaauaaagaagcugaagga

SEQ ID NO: 246796 - RNA, 19 nt, Homo sapiens
gagagcaguuuguugaaga

SEQ ID NO: 246797 - RNA, 19 nt, Homo sapiens
gaaaucagaagucuaguca

SEQ ID NO: 246798 - RNA, 19 nt, Homo sapiens
uaucagacaccauucaaua

SEQ ID NO: 246799 - RNA, 19 nt, Homo sapiens
gcaauaugcuauggacuau

SEQ ID NO: 246800 - RNA, 19 nt, Homo sapiens
gcucagauuuauguagaua

SEQ ID NO: 246801 - RNA, 19 nt, Homo sapiens
gcagaaaucagaagucuag

SEQ ID NO: 246802 - RNA, 19 nt, Homo sapiens
uaagacaaaugcagaauac

SEQ ID NO: 246803 - RNA, 19 nt, Homo sapiens
acggcaagcugaagaguua

SEQ ID NO: 246804 - RNA, 19 nt, Homo sapiens
gaauggagaucugcugcaa

SEQ ID NO: 246805 - RNA, 19 nt, Homo sapiens
gaagaugaauaaagaagcu

SEQ ID NO: 246806 - RNA, 19 nt, Homo sapiens
guagauaaggugaaacaaa

SEQ ID NO: 246807 - RNA, 19 nt, Homo sapiens
ucucagaugcucagauuua

SEQ ID NO: 246808 - RNA, 19 nt, Homo sapiens
cagagcaacugaacugaga

SEQ ID NO: 246809 - RNA, 19 nt, Homo sapiens
uuagaggguuuguccauaa

SEQ ID NO: 246810 - RNA, 19 nt, Homo sapiens
guaagacaaaugcagaaua

SEQ ID NO: 246811 - RNA, 19 nt, Homo sapiens
gcagugcucaugccuguaa

SEQ ID NO: 246812 - RNA, 19 nt, Homo sapiens
acugcaaccuucagaaaua

SEQ ID NO: 246813 - RNA, 19 nt, Homo sapiens
ugcagaagaugaauaaaga

SEQ ID NO: 246814 - RNA, 19 nt, Homo sapiens
gagacggaauguuaucaga

SEQ ID NO: 246815 - RNA, 19 nt, Homo sapiens
uugaagcacuaaagcaaua

SEQ ID NO: 246816 - RNA, 19 nt, Homo sapiens
caaagcuauugaacuguuu

SEQ ID NO: 246817 - RNA, 19 nt, Homo sapiens
ugaaaucccgucucuacua

SEQ ID NO: 246818 - RNA, 19 nt, Homo sapiens
ugaagacacugcugugcaa

SEQ ID NO: 246819 - RNA, 19 nt, Homo sapiens
cgaauaaagcucuugagaa

SEQ ID NO: 246820 - RNA, 19 nt, Homo sapiens
cagggaagcuuugcauguu

SEQ ID NO: 246821 - RNA, 19 nt, Homo sapiens
caagccaaauguuaugaga

SEQ ID NO: 246822 - RNA, 19 nt, Homo sapiens
ggacugaauccucugaaug

SEQ ID NO: 246823 - RNA, 19 nt, Homo sapiens
acaaagcuauugaacuguu

SEQ ID NO: 246824 - RNA, 19 nt, Homo sapiens
uaaaacaccuagaugguaa

SEQ ID NO: 246825 - RNA, 19 nt, Homo sapiens
gaaaugaaagggcgaaggu

SEQ ID NO: 246826 - RNA, 19 nt, Homo sapiens
cacgaggucuggaguuuga

SEQ ID NO: 246827 - RNA, 19 nt, Homo sapiens
gaaaaucugcuuccacaaa

SEQ ID NO: 246828 - RNA, 19 nt, Homo sapiens
gcaaccuucagaaauauaa

SEQ ID NO: 246829 - RNA, 19 nt, Homo sapiens
gaaauauaaugggaagucu

SEQ ID NO: 246830 - RNA, 19 nt, Homo sapiens
gaauacaggagaaucugaa

SEQ ID NO: 246831 - RNA, 19 nt, Homo sapiens
uagauaaggugaaacaaac

SEQ ID NO: 246832 - RNA, 19 nt, Homo sapiens
gaaggagagcaguuuguug

SEQ ID NO: 246833 - RNA, 19 nt, Homo sapiens
auucugaacuugacuguga

SEQ ID NO: 246834 - RNA, 19 nt, Homo sapiens
gcagggaagcuuugcaugu

SEQ ID NO: 246835 - RNA, 19 nt, Homo sapiens
caaauguuaugagaaggaa

SEQ ID NO: 246836 - RNA, 19 nt, Homo sapiens
gaagauagaguguguaacc

SEQ ID NO: 246837 - RNA, 19 nt, Homo sapiens
gacggaauguuaucagaca

SEQ ID NO: 246838 - RNA, 19 nt, Homo sapiens
caacgaggcagcccuggaa

SEQ ID NO: 246839 - RNA, 19 nt, Homo sapiens
ggagagcaguuuguugaag

SEQ ID NO: 246840 - RNA, 19 nt, Homo sapiens
ggaacuuauucaaggaaga

SEQ ID NO: 246841 - RNA, 19 nt, Homo sapiens
gaggaaggguggacacaac

SEQ ID NO: 246842 - RNA, 19 nt, Homo sapiens
gaagcuaguggaaauaaag

SEQ ID NO: 246843 - RNA, 19 nt, Homo sapiens
aaacaauggcuaccucuau

SEQ ID NO: 246844 - RNA, 19 nt, Homo sapiens
gcugaguccugauaaccaa

SEQ ID NO: 246845 - RNA, 19 nt, Homo sapiens
gauugaagcacuaaagcaa

SEQ ID NO: 246846 - RNA, 19 nt, Homo sapiens
gaagaagccuuggaaaagu

SEQ ID NO: 246847 - RNA, 19 nt, Homo sapiens
gaaggguggacacaacuga

SEQ ID NO: 246848 - RNA, 19 nt, Homo sapiens
ugaccaagcagaaaucaga

SEQ ID NO: 246849 - RNA, 19 nt, Homo sapiens
ucaaagaccaaccacagaa

SEQ ID NO: 246850 - RNA, 19 nt, Homo sapiens
agagaugauugaagcacua

SEQ ID NO: 246851 - RNA, 19 nt, Homo sapiens
cuaccucuaucaccagauu

SEQ ID NO: 246852 - RNA, 19 nt, Homo sapiens
uagaagauagaguguguaa

SEQ ID NO: 246853 - RNA, 19 nt, Homo sapiens
gcaacugaacugagacaga

SEQ ID NO: 246854 - RNA, 19 nt, Homo sapiens
ccauuucaccuggaacuua

SEQ ID NO: 246855 - RNA, 19 nt, Homo sapiens
ggaauccacaccaaacaau

SEQ ID NO: 246856 - RNA, 19 nt, Homo sapiens
uguaccaucuggauaauca

SEQ ID NO: 246857 - RNA, 19 nt, Homo sapiens
gacuggcaauugcgaugua

SEQ ID NO: 246858 - RNA, 19 nt, Homo sapiens
acucucagaugcucagauu

SEQ ID NO: 246859 - RNA, 19 nt, Homo sapiens
aaaaucaacugacaaggaa

SEQ ID NO: 246860 - RNA, 19 nt, Homo sapiens
ugaagcuaguggaaauaaa

SEQ ID NO: 246861 - RNA, 19 nt, Homo sapiens
ccgcagugcagccaaauuu

SEQ ID NO: 246862 - RNA, 19 nt, Homo sapiens
gccugaaacugcagaagau

SEQ ID NO: 246863 - RNA, 19 nt, Homo sapiens
cauuucaccuggaacuuau

SEQ ID NO: 246864 - RNA, 19 nt, Homo sapiens
gcagaagaugaauaaagaa

SEQ ID NO: 246865 - RNA, 19 nt, Homo sapiens
uagaguguguaaccagauu

SEQ ID NO: 246866 - RNA, 19 nt, Homo sapiens
gcaggagaauggcgugaac

SEQ ID NO: 246867 - RNA, 19 nt, Homo sapiens
agagggcagucaugaguga

SEQ ID NO: 246868 - RNA, 19 nt, Homo sapiens
gcagugcagccaaauuuua

SEQ ID NO: 246869 - RNA, 19 nt, Homo sapiens
ggauaaucacccagagaaa

SEQ ID NO: 246870 - RNA, 19 nt, Homo sapiens
gaaacuacgccugggucua

SEQ ID NO: 246871 - RNA, 19 nt, Homo sapiens
caagaauucccuggagaaa

SEQ ID NO: 246872 - RNA, 19 nt, Homo sapiens
caacugacaaggaagagau

SEQ ID NO: 246873 - RNA, 19 nt, Homo sapiens
agacaccauucaauaagga

SEQ ID NO: 246874 - RNA, 19 nt, Homo sapiens
gggacugaauccucugaau

SEQ ID NO: 246875 - RNA, 19 nt, Homo sapiens
gcagaauacaggagaaucu

SEQ ID NO: 246876 - RNA, 19 nt, Homo sapiens
aaggagagcaguuuguuga

SEQ ID NO: 246877 - RNA, 19 nt, Homo sapiens
aaacugcagaagaugaaua

SEQ ID NO: 246878 - RNA, 19 nt, Homo sapiens
ccaagaauucccuggagaa

SEQ ID NO: 246879 - RNA, 19 nt, Homo sapiens
acaaggaagagaucaaaga

SEQ ID NO: 246880 - RNA, 19 nt, Homo sapiens
acaccuagaugguaacaac

SEQ ID NO: 246881 - RNA, 19 nt, Homo sapiens
cagaugcucagauuuaugu

SEQ ID NO: 246882 - RNA, 19 nt, Homo sapiens
aaucagaagucuagucacu

SEQ ID NO: 246883 - RNA, 19 nt, Homo sapiens
ugacaaggaagagaucaaa

SEQ ID NO: 246884 - RNA, 19 nt, Homo sapiens
cagauugggugcugcuaca

SEQ ID NO: 246885 - RNA, 19 nt, Homo sapiens
caaacaauggcuaccucua

SEQ ID NO: 246886 - RNA, 19 nt, Homo sapiens
ggacagacaugacuuugga

SEQ ID NO: 246887 - RNA, 19 nt, Homo sapiens
ucaacaaacuugcaagaaa

SEQ ID NO: 246888 - RNA, 19 nt, Homo sapiens
gagcagaaaucaugagauc

SEQ ID NO: 246889 - RNA, 19 nt, Homo sapiens
caacaaacuugcaagaaag

SEQ ID NO: 246890 - RNA, 19 nt, Homo sapiens
agaaguaucugcaauaucu

SEQ ID NO: 246891 - RNA, 19 nt, Homo sapiens
gcacaaaugagcagaaucu

SEQ ID NO: 246892 - RNA, 19 nt, Homo sapiens
gauuaaggaggaaggaaua

SEQ ID NO: 246893 - RNA, 19 nt, Homo sapiens
gcagcugaaugacuuggaa

SEQ ID NO: 246894 - RNA, 19 nt, Homo sapiens
gaagaaauacagcccuugu

SEQ ID NO: 246895 - RNA, 19 nt, Homo sapiens
agacaugacuuuggauuuc

SEQ ID NO: 246896 - RNA, 19 nt, Homo sapiens
ggucacgcuuucaugaauu

SEQ ID NO: 246897 - RNA, 19 nt, Homo sapiens
gauaacaggaggaccuuga

SEQ ID NO: 246898 - RNA, 19 nt, Homo sapiens
gcccuuugcuuuacugaug

SEQ ID NO: 246899 - RNA, 19 nt, Homo sapiens
gcagaucuucaaccucuuu

SEQ ID NO: 246900 - RNA, 19 nt, Homo sapiens
gaagaaucacucucuaucu

SEQ ID NO: 246901 - RNA, 19 nt, Homo sapiens
gugcucagcugcaagucaa

SEQ ID NO: 246902 - RNA, 19 nt, Homo sapiens
ugucagagcagaaaucaug

SEQ ID NO: 246903 - RNA, 19 nt, Homo sapiens
aagaaucacucucuaucug

SEQ ID NO: 246904 - RNA, 19 nt, Homo sapiens
ugaccaugcugauaaacug

SEQ ID NO: 246905 - RNA, 19 nt, Homo sapiens
gauggacagacaugacuuu

SEQ ID NO: 246906 - RNA, 19 nt, Homo sapiens
gaggagagggugggagaaa

SEQ ID NO: 246907 - RNA, 19 nt, Homo sapiens
cuaugaccaugcugauaaa

SEQ ID NO: 246908 - RNA, 19 nt, Homo sapiens
caaacuugcaagaaagauu

SEQ ID NO: 246909 - RNA, 19 nt, Homo sapiens
acuaugaccaugcugauaa

SEQ ID NO: 246910 - RNA, 19 nt, Homo sapiens
cgaagaaucacucucuauc

SEQ ID NO: 246911 - RNA, 19 nt, Homo sapiens
ccaggucacgcuuucauga

SEQ ID NO: 246912 - RNA, 19 nt, Homo sapiens
ugacagagaagaaauacag

SEQ ID NO: 246913 - RNA, 19 nt, Homo sapiens
ggccucgcccuuugcuuua

SEQ ID NO: 246914 - RNA, 19 nt, Homo sapiens
aacgucaugugcaccuuua

SEQ ID NO: 246915 - RNA, 19 nt, Homo sapiens
gaaguaucugcaauaucua

SEQ ID NO: 246916 - RNA, 19 nt, Homo sapiens
uaaggaggaaggaauaaca

SEQ ID NO: 246917 - RNA, 19 nt, Homo sapiens
ccaucucuguccuccauga

SEQ ID NO: 246918 - RNA, 19 nt, Homo sapiens
cagacaugacuuuggauuu

SEQ ID NO: 246919 - RNA, 19 nt, Homo sapiens
uaacgucaugugcaccuuu

SEQ ID NO: 246920 - RNA, 19 nt, Homo sapiens
guucauauaacgucaugug

SEQ ID NO: 246921 - RNA, 19 nt, Homo sapiens
gaaacuccccugaugaaug

SEQ ID NO: 246922 - RNA, 19 nt, Homo sapiens
gagaaacuccccugaugaa

SEQ ID NO: 246923 - RNA, 19 nt, Homo sapiens
ucagcaagcccagaaguau

SEQ ID NO: 246924 - RNA, 19 nt, Homo sapiens
gcugcucucugggcuguga

SEQ ID NO: 246925 - RNA, 19 nt, Homo sapiens
ggaccuccuagacaaauuc

SEQ ID NO: 246926 - RNA, 19 nt, Homo sapiens
uaucaacaaacuugcaaga

SEQ ID NO: 246927 - RNA, 19 nt, Homo sapiens
gagguugucagagcagaaa

SEQ ID NO: 246928 - RNA, 19 nt, Homo sapiens
agaaucacucucuaucuga

SEQ ID NO: 246929 - RNA, 19 nt, Homo sapiens
gagacccacagccuggaua

SEQ ID NO: 246930 - RNA, 19 nt, Homo sapiens
uaucugcaauaucuacgau

SEQ ID NO: 246931 - RNA, 19 nt, Homo sapiens
uaacaggaggaccuugaug

SEQ ID NO: 246932 - RNA, 19 nt, Homo sapiens
ccaugcugauaaacugauu

SEQ ID NO: 246933 - RNA, 19 nt, Homo sapiens
acgauggccucgcccuuug

SEQ ID NO: 246934 - RNA, 19 nt, Homo sapiens
cuuggaagccugugugaug

SEQ ID NO: 246935 - RNA, 19 nt, Homo sapiens
caucucagcaagcccagaa

SEQ ID NO: 246936 - RNA, 19 nt, Homo sapiens
gguccaacaugaaaacaau

SEQ ID NO: 246937 - RNA, 19 nt, Homo sapiens
gacuccaucuuggcuguga

SEQ ID NO: 246938 - RNA, 19 nt, Homo sapiens
ggagagggugggagaaacu

SEQ ID NO: 246939 - RNA, 19 nt, Homo sapiens
ucuccuuccuccugucuga

SEQ ID NO: 246940 - RNA, 19 nt, Homo sapiens
gaccaugcugauaaacuga

SEQ ID NO: 246941 - RNA, 19 nt, Homo sapiens
uaacuaugaccaugcugau

SEQ ID NO: 246942 - RNA, 19 nt, Homo sapiens
ccgaagaaucacucucuau

SEQ ID NO: 246943 - RNA, 19 nt, Homo sapiens
uggcacaaaugagcagaau

SEQ ID NO: 246944 - RNA, 19 nt, Homo sapiens
uggccucgcccuuugcuuu

SEQ ID NO: 246945 - RNA, 19 nt, Homo sapiens
gucacgcuuucaugaauuc

SEQ ID NO: 246946 - RNA, 19 nt, Homo sapiens
cagagcagaaaucaugaga

SEQ ID NO: 246947 - RNA, 19 nt, Homo sapiens
uccgaagaaucacucucua

SEQ ID NO: 246948 - RNA, 19 nt, Homo sapiens
caaauucugcaccgaacuc

SEQ ID NO: 246949 - RNA, 19 nt, Homo sapiens
ucaaccucuuuaccacaaa

SEQ ID NO: 246950 - RNA, 19 nt, Homo sapiens
acagacaugacuuuggauu

SEQ ID NO: 246951 - RNA, 19 nt, Homo sapiens
gcaccuuuacacugugguu

SEQ ID NO: 246952 - RNA, 19 nt, Homo sapiens
agcccaagguucagaguca

SEQ ID NO: 246953 - RNA, 19 nt, Homo sapiens
ggagguugucagagcagaa

SEQ ID NO: 246954 - RNA, 19 nt, Homo sapiens
cagaucuucaaccucuuua

SEQ ID NO: 246955 - RNA, 19 nt, Homo sapiens
ggacagacaugacuuugga

SEQ ID NO: 246956 - RNA, 19 nt, Homo sapiens
gcaagaaaguuuaagaagu

SEQ ID NO: 246957 - RNA, 19 nt, Homo sapiens
ucaacaaacuugcaagaaa

SEQ ID NO: 246958 - RNA, 19 nt, Homo sapiens
gagcagaaaucaugagauc

SEQ ID NO: 246959 - RNA, 19 nt, Homo sapiens
cagaauaacugguacacuu

SEQ ID NO: 246960 - RNA, 19 nt, Homo sapiens
gcaaccugauuacagaaua

SEQ ID NO: 246961 - RNA, 19 nt, Homo sapiens
gcacagugguuaauguaau

SEQ ID NO: 246962 - RNA, 19 nt, Homo sapiens
caacaaacuugcaagaaag

SEQ ID NO: 246963 - RNA, 19 nt, Homo sapiens
gguuuaggcucacccauuu

SEQ ID NO: 246964 - RNA, 19 nt, Homo sapiens
caugcugacugauccauua

SEQ ID NO: 246965 - RNA, 19 nt, Homo sapiens
caaccugauuacagaauaa

SEQ ID NO: 246966 - RNA, 19 nt, Homo sapiens
gcagaaaucaugagaucuu

SEQ ID NO: 246967 - RNA, 19 nt, Homo sapiens
gaaucacucucuaucugaa

SEQ ID NO: 246968 - RNA, 19 nt, Homo sapiens
gaaggacagacaugacuuu

SEQ ID NO: 246969 - RNA, 19 nt, Homo sapiens
cacagugguuaauguaaua

SEQ ID NO: 246970 - RNA, 19 nt, Homo sapiens
ccuggaagccugugugaua

SEQ ID NO: 246971 - RNA, 19 nt, Homo sapiens
gaccaugacacgauuuaaa

SEQ ID NO: 246972 - RNA, 19 nt, Homo sapiens
acaauggccuugaccuuug

SEQ ID NO: 246973 - RNA, 19 nt, Homo sapiens
ugacugauccauuaucuau

SEQ ID NO: 246974 - RNA, 19 nt, Homo sapiens
gaagaaauacagcccuugu

SEQ ID NO: 246975 - RNA, 19 nt, Homo sapiens
gaaauacuuccaaagaauc

SEQ ID NO: 246976 - RNA, 19 nt, Homo sapiens
agacaugacuuuggauuuc

SEQ ID NO: 246977 - RNA, 19 nt, Homo sapiens
gauuacagaauaacuggua

SEQ ID NO: 246978 - RNA, 19 nt, Homo sapiens
gaugagacccuccuagaca

SEQ ID NO: 246979 - RNA, 19 nt, Homo sapiens
ggccuugaccuuugcuuua

SEQ ID NO: 246980 - RNA, 19 nt, Homo sapiens
gcagcugaaugaccuggaa

SEQ ID NO: 246981 - RNA, 19 nt, Homo sapiens
uaacugguacacuucauuu

SEQ ID NO: 246982 - RNA, 19 nt, Homo sapiens
cagaaaucaugagaucuuu

SEQ ID NO: 246983 - RNA, 19 nt, Homo sapiens
cuucauuuguccaucaaua

SEQ ID NO: 246984 - RNA, 19 nt, Homo sapiens
caaagaaucacucucuauc

SEQ ID NO: 246985 - RNA, 19 nt, Homo sapiens
uuuaugaucugccauuuca

SEQ ID NO: 246986 - RNA, 19 nt, Homo sapiens
gaucugccauuucaaagac

SEQ ID NO: 246987 - RNA, 19 nt, Homo sapiens
agacucauguuucugcuau

SEQ ID NO: 246988 - RNA, 19 nt, Homo sapiens
gcugugaucugccucaaac

SEQ ID NO: 246989 - RNA, 19 nt, Homo sapiens
gugcucagcugcaagucaa

SEQ ID NO: 246990 - RNA, 19 nt, Homo sapiens
ccaaagaaucacucucuau

SEQ ID NO: 246991 - RNA, 19 nt, Homo sapiens
ugucagagcagaaaucaug

SEQ ID NO: 246992 - RNA, 19 nt, Homo sapiens
aagaaucacucucuaucug

SEQ ID NO: 246993 - RNA, 19 nt, Homo sapiens
gggaugagacccuccuaga

SEQ ID NO: 246994 - RNA, 19 nt, Homo sapiens
gaauaacugguacacuuca

SEQ ID NO: 246995 - RNA, 19 nt, Homo sapiens
agaggaccaugcugacuga

SEQ ID NO: 246996 - RNA, 19 nt, Homo sapiens
ugaaagagaagaaauacag

SEQ ID NO: 246997 - RNA, 19 nt, Homo sapiens
acacuucauuuguccauca

SEQ ID NO: 246998 - RNA, 19 nt, Homo sapiens
ggaguauuaaucaacauug

SEQ ID NO: 246999 - RNA, 19 nt, Homo sapiens
ugugcaaccugauuacaga

SEQ ID NO: 247000 - RNA, 19 nt, Homo sapiens
gaaaguuuaagaaguaagg

SEQ ID NO: 247001 - RNA, 19 nt, Homo sapiens
gcugacugauccauuaucu

SEQ ID NO: 247002 - RNA, 19 nt, Homo sapiens
gacaaauucuacacugaac

SEQ ID NO: 247003 - RNA, 19 nt, Homo sapiens
gcuaugaccaugacacgau

SEQ ID NO: 247004 - RNA, 19 nt, Homo sapiens
uaugaucugccauuucaaa

SEQ ID NO: 247005 - RNA, 19 nt, Homo sapiens
agacaaauucuacacugaa

SEQ ID NO: 247006 - RNA, 19 nt, Homo sapiens
uacaauggccuugaccuuu

SEQ ID NO: 247007 - RNA, 19 nt, Homo sapiens
cagacaugacuuuggauuu

SEQ ID NO: 247008 - RNA, 19 nt, Homo sapiens
aaugaaauuccaagccuaa

SEQ ID NO: 247009 - RNA, 19 nt, Homo sapiens
uccaaagaaucacucucua

SEQ ID NO: 247010 - RNA, 19 nt, Homo sapiens
cuaugaccaugacacgauu

SEQ ID NO: 247011 - RNA, 19 nt, Homo sapiens
uuucaaagacucauguuuc

SEQ ID NO: 247012 - RNA, 19 nt, Homo sapiens
gguucaacauggaaaugau

SEQ ID NO: 247013 - RNA, 19 nt, Homo sapiens
guucaacauggaaaugauu

SEQ ID NO: 247014 - RNA, 19 nt, Homo sapiens
gagguugucagagcagaaa

SEQ ID NO: 247015 - RNA, 19 nt, Homo sapiens
agaaucacucucuaucuga

SEQ ID NO: 247016 - RNA, 19 nt, Homo sapiens
gguagcaggaggaccuuga

SEQ ID NO: 247017 - RNA, 19 nt, Homo sapiens
uucaaucucuucagcacaa

SEQ ID NO: 247018 - RNA, 19 nt, Homo sapiens
cuaauugugcaaccugauu

SEQ ID NO: 247019 - RNA, 19 nt, Homo sapiens
ggaguuuggcaaccaguuc

SEQ ID NO: 247020 - RNA, 19 nt, Homo sapiens
caaauucuacacugaacuc

SEQ ID NO: 247021 - RNA, 19 nt, Homo sapiens
agacccuccuagacaaauu

SEQ ID NO: 247022 - RNA, 19 nt, Homo sapiens
cuauggaacuuuuguacuu

SEQ ID NO: 247023 - RNA, 19 nt, Homo sapiens
gacagagacuccccugaug

SEQ ID NO: 247024 - RNA, 19 nt, Homo sapiens
gaccuggaagccuguguga

SEQ ID NO: 247025 - RNA, 19 nt, Homo sapiens
uucaaagacucauguuucu

SEQ ID NO: 247026 - RNA, 19 nt, Homo sapiens
cauucuggcugugaggaaa

SEQ ID NO: 247027 - RNA, 19 nt, Homo sapiens
gcaagucaagcugcucugu

SEQ ID NO: 247028 - RNA, 19 nt, Homo sapiens
cuacaauggccuugaccuu

SEQ ID NO: 247029 - RNA, 19 nt, Homo sapiens
ucauugaacuuuugcuaug

SEQ ID NO: 247030 - RNA, 19 nt, Homo sapiens
agaauaacugguacacuuc

SEQ ID NO: 247031 - RNA, 19 nt, Homo sapiens
acauuguauucagcucuua

SEQ ID NO: 247032 - RNA, 19 nt, Homo sapiens
ucugcaacaucuacaaugg

SEQ ID NO: 247033 - RNA, 19 nt, Homo sapiens
aaagaaucacucucuaucu

SEQ ID NO: 247034 - RNA, 19 nt, Homo sapiens
ggcacuagucccuuacaga

SEQ ID NO: 247035 - RNA, 19 nt, Homo sapiens
caucuacaauggccuugac

SEQ ID NO: 247036 - RNA, 19 nt, Homo sapiens
ggaugagacccuccuagac

SEQ ID NO: 247037 - RNA, 19 nt, Homo sapiens
aaccaucccuguccuccau

SEQ ID NO: 247038 - RNA, 19 nt, Homo sapiens
acagacaugacuuuggauu

SEQ ID NO: 247039 - RNA, 19 nt, Homo sapiens
gcaggaggaccuugaugcu

SEQ ID NO: 247040 - RNA, 19 nt, Homo sapiens
gccuugaccuuugcuuuac

SEQ ID NO: 247041 - RNA, 19 nt, Homo sapiens
cagagcagaaaucaugaga

SEQ ID NO: 247042 - RNA, 19 nt, Homo sapiens
auucuacacugaacucuac

SEQ ID NO: 247043 - RNA, 19 nt, Homo sapiens
caccuuugcacagugguua

SEQ ID NO: 247044 - RNA, 19 nt, Homo sapiens
gcugcucugugggcuguga

SEQ ID NO: 247045 - RNA, 19 nt, Homo sapiens
aaacugguucaacauggaa

SEQ ID NO: 247046 - RNA, 19 nt, Homo sapiens
gucaacaaacuugcaagaa

SEQ ID NO: 247047 - RNA, 19 nt, Homo sapiens
ggagguugucagagcagaa

SEQ ID NO: 247048 - RNA, 19 nt, Homo sapiens
gcuugaaggacagacauga

SEQ ID NO: 247049 - RNA, 19 nt, Homo sapiens
ccaucccuguccuccauga

SEQ ID NO: 247050 - RNA, 19 nt, Homo sapiens
gaacagagccuccuagaaa

SEQ ID NO: 247051 - RNA, 19 nt, Homo sapiens
caaagacucacuucuauaa

SEQ ID NO: 247052 - RNA, 19 nt, Homo sapiens
gagcagaaaucaugagauc

SEQ ID NO: 247053 - RNA, 19 nt, Homo sapiens
cagcagaccuucaaucucu

SEQ ID NO: 247054 - RNA, 19 nt, Homo sapiens
gaacuuuaccagcaacuga

SEQ ID NO: 247055 - RNA, 19 nt, Homo sapiens
gaagaaauacagcccuugu

SEQ ID NO: 247056 - RNA, 19 nt, Homo sapiens
gaaauacuuccaaagaauc

SEQ ID NO: 247057 - RNA, 19 nt, Homo sapiens
ggccgaaguucaagguuau

SEQ ID NO: 247058 - RNA, 19 nt, Homo sapiens
gcacagagcaaagucuuca

SEQ ID NO: 247059 - RNA, 19 nt, Homo sapiens
ucaaagacucacuucuaua

SEQ ID NO: 247060 - RNA, 19 nt, Homo sapiens
uaacagagaagaaauacag

SEQ ID NO: 247061 - RNA, 19 nt, Homo sapiens
agagcaaagucuucagaaa

SEQ ID NO: 247062 - RNA, 19 nt, Homo sapiens
gaaucacucuuuaucuaac

SEQ ID NO: 247063 - RNA, 19 nt, Homo sapiens
ggaagagacuccccugaug

SEQ ID NO: 247064 - RNA, 19 nt, Homo sapiens
ggaacagagccuccuagaa

SEQ ID NO: 247065 - RNA, 19 nt, Homo sapiens
gaaggacagacaugauuuc

SEQ ID NO: 247066 - RNA, 19 nt, Homo sapiens
ugucagagcagaaaucaug

SEQ ID NO: 247067 - RNA, 19 nt, Homo sapiens
uaaggaggaaggauugaaa

SEQ ID NO: 247068 - RNA, 19 nt, Homo sapiens
gauuaaggaggaaggauug

SEQ ID NO: 247069 - RNA, 19 nt, Homo sapiens
gguuauccaucucaaguag

SEQ ID NO: 247070 - RNA, 19 nt, Homo sapiens
aggccgaaguucaagguua

SEQ ID NO: 247071 - RNA, 19 nt, Homo sapiens
gagcaaagucuucagaaaa

SEQ ID NO: 247072 - RNA, 19 nt, Homo sapiens
uucaaagacucacuucuau

SEQ ID NO: 247073 - RNA, 19 nt, Homo sapiens
ugaaggacagacaugauuu

SEQ ID NO: 247074 - RNA, 19 nt, Homo sapiens
uuucaaagacucacuucua

SEQ ID NO: 247075 - RNA, 19 nt, Homo sapiens
ggaagcaugugugauacag

SEQ ID NO: 247076 - RNA, 19 nt, Homo sapiens
uaauaggagggccuugaua

SEQ ID NO: 247077 - RNA, 19 nt, Homo sapiens
aaaccuagaggccgaaguu

SEQ ID NO: 247078 - RNA, 19 nt, Homo sapiens
ugucucuguucaucuauuu

SEQ ID NO: 247079 - RNA, 19 nt, Homo sapiens
gaagagacuccccugauga

SEQ ID NO: 247080 - RNA, 19 nt, Homo sapiens
cagacaugauuucggauuc

SEQ ID NO: 247081 - RNA, 19 nt, Homo sapiens
gguaauaggagggccuuga

SEQ ID NO: 247082 - RNA, 19 nt, Homo sapiens
ggaaauuaguauguucacu

SEQ ID NO: 247083 - RNA, 19 nt, Homo sapiens
ccaucucuguccuccauga

SEQ ID NO: 247084 - RNA, 19 nt, Homo sapiens
gaaguucaagguuauccau

SEQ ID NO: 247085 - RNA, 19 nt, Homo sapiens
guucacuauuuaagaccua

SEQ ID NO: 247086 - RNA, 19 nt, Homo sapiens
uuuaagaccuaugcacaga

SEQ ID NO: 247087 - RNA, 19 nt, Homo sapiens
gggaacagagccuccuaga

SEQ ID NO: 247088 - RNA, 19 nt, Homo sapiens
guaauaggagggccuugau

SEQ ID NO: 247089 - RNA, 19 nt, Homo sapiens
ucaagguuauccaucucaa

SEQ ID NO: 247090 - RNA, 19 nt, Homo sapiens
caaugcugaugucucuguu

SEQ ID NO: 247091 - RNA, 19 nt, Homo sapiens
gagguugucagagcagaaa

SEQ ID NO: 247092 - RNA, 19 nt, Homo sapiens
ccuagaggccgaaguucaa

SEQ ID NO: 247093 - RNA, 19 nt, Homo sapiens
cagaugacaaugcugaugu

SEQ ID NO: 247094 - RNA, 19 nt, Homo sapiens
agacuccccugaugaauga

SEQ ID NO: 247095 - RNA, 19 nt, Homo sapiens
agacucacuucuauaacca

SEQ ID NO: 247096 - RNA, 19 nt, Homo sapiens
cccaauggcccuguccuuu

SEQ ID NO: 247097 - RNA, 19 nt, Homo sapiens
cagagcaaagucuucagaa

SEQ ID NO: 247098 - RNA, 19 nt, Homo sapiens
gcagaccuucaaucucuuc

SEQ ID NO: 247099 - RNA, 19 nt, Homo sapiens
caauggcccuguccuuuuc

SEQ ID NO: 247100 - RNA, 19 nt, Homo sapiens
agauuaaggaggaaggauu

SEQ ID NO: 247101 - RNA, 19 nt, Homo sapiens
guucaagguuauccaucuc

SEQ ID NO: 247102 - RNA, 19 nt, Homo sapiens
cagagcagaaaucaugaga

SEQ ID NO: 247103 - RNA, 19 nt, Homo sapiens
ccaauggcccuguccuuuu

SEQ ID NO: 247104 - RNA, 19 nt, Homo sapiens
cagcacagaggacucaucu

SEQ ID NO: 247105 - RNA, 19 nt, Homo sapiens
acagacaugauuucggauu

SEQ ID NO: 247106 - RNA, 19 nt, Homo sapiens
ggagguugucagagcagaa

SEQ ID NO: 247107 - RNA, 19 nt, Homo sapiens
ggacagacaugacuuugga

SEQ ID NO: 247108 - RNA, 19 nt, Homo sapiens
ggaagacacuccucugaug

SEQ ID NO: 247109 - RNA, 19 nt, Homo sapiens
gagcagaaaucaugagauc

SEQ ID NO: 247110 - RNA, 19 nt, Homo sapiens
acaaaggacucaucugcua

SEQ ID NO: 247111 - RNA, 19 nt, Homo sapiens
cagcagaccuucaaucucu

SEQ ID NO: 247112 - RNA, 19 nt, Homo sapiens
caggaggacuuugaugaua

SEQ ID NO: 247113 - RNA, 19 nt, Homo sapiens
gaagacacuccucugauga

SEQ ID NO: 247114 - RNA, 19 nt, Homo sapiens
gaaggacagacaugacuuu

SEQ ID NO: 247115 - RNA, 19 nt, Homo sapiens
gcacaaaugggaagaaucu

SEQ ID NO: 247116 - RNA, 19 nt, Homo sapiens
gcaggagguuggaguggaa

SEQ ID NO: 247117 - RNA, 19 nt, Homo sapiens
ggaggacuuugaugauaau

SEQ ID NO: 247118 - RNA, 19 nt, Homo sapiens
gaagaaauacagcccuugu

SEQ ID NO: 247119 - RNA, 19 nt, Homo sapiens
ugagacacuucuagacaaa

SEQ ID NO: 247120 - RNA, 19 nt, Homo sapiens
agacaugacuuuggauuuc

SEQ ID NO: 247121 - RNA, 19 nt, Homo sapiens
gcagcugaaugaccuggaa

SEQ ID NO: 247122 - RNA, 19 nt, Homo sapiens
agacacuucuagacaaauu

SEQ ID NO: 247123 - RNA, 19 nt, Homo sapiens
ugaugaauguggacucuau

SEQ ID NO: 247124 - RNA, 19 nt, Homo sapiens
acacuccucugaugaaugu

SEQ ID NO: 247125 - RNA, 19 nt, Homo sapiens
gcaagucaaucuguucucu

SEQ ID NO: 247126 - RNA, 19 nt, Homo sapiens
gaugagacacuucuagaca

SEQ ID NO: 247127 - RNA, 19 nt, Homo sapiens
gaugauaauggcacaaaug

SEQ ID NO: 247128 - RNA, 19 nt, Homo sapiens
agaaucacccucuaucuga

SEQ ID NO: 247129 - RNA, 19 nt, Homo sapiens
caaagaaucacccucuauc

SEQ ID NO: 247130 - RNA, 19 nt, Homo sapiens
aggaggacuuugaugauaa

SEQ ID NO: 247131 - RNA, 19 nt, Homo sapiens
ugucagagcagaaaucaug

SEQ ID NO: 247132 - RNA, 19 nt, Homo sapiens
caaauucuacacugaacuu

SEQ ID NO: 247133 - RNA, 19 nt, Homo sapiens
ugggaagaaucucuccuuu

SEQ ID NO: 247134 - RNA, 19 nt, Homo sapiens
gugcucaacugcaagucaa

SEQ ID NO: 247135 - RNA, 19 nt, Homo sapiens
caaacuugcaagaaagauu

SEQ ID NO: 247136 - RNA, 19 nt, Homo sapiens
gaaaucaugagauccuucu

SEQ ID NO: 247137 - RNA, 19 nt, Homo sapiens
ucaaagaaucacccucuau

SEQ ID NO: 247138 - RNA, 19 nt, Homo sapiens
ccuggaagccuguaugaug

SEQ ID NO: 247139 - RNA, 19 nt, Homo sapiens
ugacagagaagaaauacag

SEQ ID NO: 247140 - RNA, 19 nt, Homo sapiens
gacaaauucuacacugaac

SEQ ID NO: 247141 - RNA, 19 nt, Homo sapiens
caacugcaagucaaucugu

SEQ ID NO: 247142 - RNA, 19 nt, Homo sapiens
gggaugagacacuucuaga

SEQ ID NO: 247143 - RNA, 19 nt, Homo sapiens
gauuaaggaggaaggaaug

SEQ ID NO: 247144 - RNA, 19 nt, Homo sapiens
agacaaauucuacacugaa

SEQ ID NO: 247145 - RNA, 19 nt, Homo sapiens
gggaagaaucucuccuuuc

SEQ ID NO: 247146 - RNA, 19 nt, Homo sapiens
gaccuggaagccuguauga

SEQ ID NO: 247147 - RNA, 19 nt, Homo sapiens
gcagaaaucaugagauccu

SEQ ID NO: 247148 - RNA, 19 nt, Homo sapiens
gacucuauccugacuguga

SEQ ID NO: 247149 - RNA, 19 nt, Homo sapiens
ccaucucuguccuccauga

SEQ ID NO: 247150 - RNA, 19 nt, Homo sapiens
cagacaugacuuuggauuu

SEQ ID NO: 247151 - RNA, 19 nt, Homo sapiens
uaacaggaggacuuugaug

SEQ ID NO: 247152 - RNA, 19 nt, Homo sapiens
guggaagacacuccucuga

SEQ ID NO: 247153 - RNA, 19 nt, Homo sapiens
gagguugucagagcagaaa

SEQ ID NO: 247154 - RNA, 19 nt, Homo sapiens
uucaaucucuucagcacaa

SEQ ID NO: 247155 - RNA, 19 nt, Homo sapiens
aaauacagcccuugugcau

SEQ ID NO: 247156 - RNA, 19 nt, Homo sapiens
ggccuugcccuuuguuuua

SEQ ID NO: 247157 - RNA, 19 nt, Homo sapiens
cagaaaucaugagauccuu

SEQ ID NO: 247158 - RNA, 19 nt, Homo sapiens
ugaguaacaggaggacuuu

SEQ ID NO: 247159 - RNA, 19 nt, Homo sapiens
aacaggaggacuuugauga

SEQ ID NO: 247160 - RNA, 19 nt, Homo sapiens
agacacuccucugaugaau

SEQ ID NO: 247161 - RNA, 19 nt, Homo sapiens
ucuguucucugggcuguga

SEQ ID NO: 247162 - RNA, 19 nt, Homo sapiens
augagacacuucuagacaa

SEQ ID NO: 247163 - RNA, 19 nt, Homo sapiens
ugaugauaauggcacaaau

SEQ ID NO: 247164 - RNA, 19 nt, Homo sapiens
guaacaggaggacuuugau

SEQ ID NO: 247165 - RNA, 19 nt, Homo sapiens
uggcacaaaugggaagaau

SEQ ID NO: 247166 - RNA, 19 nt, Homo sapiens
aguaacaggaggacuuuga

SEQ ID NO: 247167 - RNA, 19 nt, Homo sapiens
auucuacacugaacuuuac

SEQ ID NO: 247168 - RNA, 19 nt, Homo sapiens
gcagaccuucaaucucuuc

SEQ ID NO: 247169 - RNA, 19 nt, Homo sapiens
aagaaucacccucuaucug

SEQ ID NO: 247170 - RNA, 19 nt, Homo sapiens
cagagcagaaaucaugaga

SEQ ID NO: 247171 - RNA, 19 nt, Homo sapiens
uucaaagaaucacccucua

SEQ ID NO: 247172 - RNA, 19 nt, Homo sapiens
acagacaugacuuuggauu

SEQ ID NO: 247173 - RNA, 19 nt, Homo sapiens
ggagguugucagagcagaa

SEQ ID NO: 247174 - RNA, 19 nt, Homo sapiens
aaagaaucacccucuaucu

SEQ ID NO: 247175 - RNA, 19 nt, Homo sapiens
ggacagacaugacuucaga

SEQ ID NO: 247176 - RNA, 19 nt, Homo sapiens
gagcagaaaucaugagauc

SEQ ID NO: 247177 - RNA, 19 nt, Homo sapiens
acaaaggacucaucuguug

SEQ ID NO: 247178 - RNA, 19 nt, Homo sapiens
gcacaaaggacucaucugu

SEQ ID NO: 247179 - RNA, 19 nt, Homo sapiens
agacaugacuucagauuuc

SEQ ID NO: 247180 - RNA, 19 nt, Homo sapiens
cagcagaccuucaaucucu

SEQ ID NO: 247181 - RNA, 19 nt, Homo sapiens
gcacaaaugaggagaaucu

SEQ ID NO: 247182 - RNA, 19 nt, Homo sapiens
ggacuccccugaugaauga

SEQ ID NO: 247183 - RNA, 19 nt, Homo sapiens
gaugagaggcuucuagaca

SEQ ID NO: 247184 - RNA, 19 nt, Homo sapiens
caaacucuauacugaacuu

SEQ ID NO: 247185 - RNA, 19 nt, Homo sapiens
gcagcugaaugaccuggaa

SEQ ID NO: 247186 - RNA, 19 nt, Homo sapiens
aaacuugcaagaaagguua

SEQ ID NO: 247187 - RNA, 19 nt, Homo sapiens
ugagaggcuucuagacaaa

SEQ ID NO: 247188 - RNA, 19 nt, Homo sapiens
gacaaacucuauacugaac

SEQ ID NO: 247189 - RNA, 19 nt, Homo sapiens
gcugcucucuggacuguga

SEQ ID NO: 247190 - RNA, 19 nt, Homo sapiens
gugcucagcugcaagucaa

SEQ ID NO: 247191 - RNA, 19 nt, Homo sapiens
gagaaaauacuuccaaaga

SEQ ID NO: 247192 - RNA, 19 nt, Homo sapiens
gguuaaggaggaaggaaua

SEQ ID NO: 247193 - RNA, 19 nt, Homo sapiens
gaaacuugcaagaaagguu

SEQ ID NO: 247194 - RNA, 19 nt, Homo sapiens
ugucagagcagaaaucaug

SEQ ID NO: 247195 - RNA, 19 nt, Homo sapiens
gaaaucaugagauccuucu

SEQ ID NO: 247196 - RNA, 19 nt, Homo sapiens
agacaaacucuauacugaa

SEQ ID NO: 247197 - RNA, 19 nt, Homo sapiens
gggaugagaggcuucuaga

SEQ ID NO: 247198 - RNA, 19 nt, Homo sapiens
ccuggaagccugugugaug

SEQ ID NO: 247199 - RNA, 19 nt, Homo sapiens
gcagaaaucaugagauccu

SEQ ID NO: 247200 - RNA, 19 nt, Homo sapiens
ccaucucuguccuccauga

SEQ ID NO: 247201 - RNA, 19 nt, Homo sapiens
cagacaugacuucagauuu

SEQ ID NO: 247202 - RNA, 19 nt, Homo sapiens
uccaaagaaucacucucua

SEQ ID NO: 247203 - RNA, 19 nt, Homo sapiens
augagaggcuucuagacaa

SEQ ID NO: 247204 - RNA, 19 nt, Homo sapiens
cacaaaggacucaucuguu

SEQ ID NO: 247205 - RNA, 19 nt, Homo sapiens
gagguugucagagcagaaa

SEQ ID NO: 247206 - RNA, 19 nt, Homo sapiens
ccaaagaaucacucucuac

SEQ ID NO: 247207 - RNA, 19 nt, Homo sapiens
uucaaucucuucagcacaa

SEQ ID NO: 247208 - RNA, 19 nt, Homo sapiens
cagaaaucaugagauccuu

SEQ ID NO: 247209 - RNA, 19 nt, Homo sapiens
acagacaugacuucagauu

SEQ ID NO: 247210 - RNA, 19 nt, Homo sapiens
gaccuggaagccuguguga

SEQ ID NO: 247211 - RNA, 19 nt, Homo sapiens
ggcuuugccuuuugcuuua

SEQ ID NO: 247212 - RNA, 19 nt, Homo sapiens
guuaaggaggaaggaauaa

SEQ ID NO: 247213 - RNA, 19 nt, Homo sapiens
aagaaagguuaaggaggaa

SEQ ID NO: 247214 - RNA, 19 nt, Homo sapiens
aagcugcucucuggacugu

SEQ ID NO: 247215 - RNA, 19 nt, Homo sapiens
uggcacaaaugaggagaau

SEQ ID NO: 247216 - RNA, 19 nt, Homo sapiens
gcagaccuucaaucucuuc

SEQ ID NO: 247217 - RNA, 19 nt, Homo sapiens
gugagaaaauacuuccaaa

SEQ ID NO: 247218 - RNA, 19 nt, Homo sapiens
acucuauacugaacuuuac

SEQ ID NO: 247219 - RNA, 19 nt, Homo sapiens
cagagcagaaaucaugaga

SEQ ID NO: 247220 - RNA, 19 nt, Homo sapiens
ggagguugucagagcagaa

SEQ ID NO: 247221 - RNA, 19 nt, Homo sapiens
gaacagagccuccuagaaa

SEQ ID NO: 247222 - RNA, 19 nt, Homo sapiens
caaagacucacuucuauaa

SEQ ID NO: 247223 - RNA, 19 nt, Homo sapiens
gagcagaaaucaugagauc

SEQ ID NO: 247224 - RNA, 19 nt, Homo sapiens
cagcagaccuucaaucucu

SEQ ID NO: 247225 - RNA, 19 nt, Homo sapiens
gaacuuuaccagcaacuga

SEQ ID NO: 247226 - RNA, 19 nt, Homo sapiens
gcacaaaugggaagaaucu

SEQ ID NO: 247227 - RNA, 19 nt, Homo sapiens
gaagaaauacagcccuugu

SEQ ID NO: 247228 - RNA, 19 nt, Homo sapiens
gaaauacuuccaaagaauc

SEQ ID NO: 247229 - RNA, 19 nt, Homo sapiens
gaaggacagacaugaauuc

SEQ ID NO: 247230 - RNA, 19 nt, Homo sapiens
caugaguucuuccauuuca

SEQ ID NO: 247231 - RNA, 19 nt, Homo sapiens
ucaaagacucacuucuaua

SEQ ID NO: 247232 - RNA, 19 nt, Homo sapiens
uaacagagaagaaauacag

SEQ ID NO: 247233 - RNA, 19 nt, Homo sapiens
ggauuaaggaggaaggauu

SEQ ID NO: 247234 - RNA, 19 nt, Homo sapiens
gaaucacucuuuaucuaac

SEQ ID NO: 247235 - RNA, 19 nt, Homo sapiens
cagguagccuagugauauu

SEQ ID NO: 247236 - RNA, 19 nt, Homo sapiens
ggaagagacuccccugaug

SEQ ID NO: 247237 - RNA, 19 nt, Homo sapiens
ggaacagagccuccuagaa

SEQ ID NO: 247238 - RNA, 19 nt, Homo sapiens
ucagguagccuagugauau

SEQ ID NO: 247239 - RNA, 19 nt, Homo sapiens
ugucagagcagaaaucaug

SEQ ID NO: 247240 - RNA, 19 nt, Homo sapiens
acccacagccugcguaaua

SEQ ID NO: 247241 - RNA, 19 nt, Homo sapiens
uaaggaggaaggauugaaa

SEQ ID NO: 247242 - RNA, 19 nt, Homo sapiens
gauuaaggaggaaggauug

SEQ ID NO: 247243 - RNA, 19 nt, Homo sapiens
uucaugaguucuuccauuu

SEQ ID NO: 247244 - RNA, 19 nt, Homo sapiens
uucaaagacucacuucuau

SEQ ID NO: 247245 - RNA, 19 nt, Homo sapiens
ugggaagaaucucuccuuu

SEQ ID NO: 247246 - RNA, 19 nt, Homo sapiens
uuucaaagacucacuucua

SEQ ID NO: 247247 - RNA, 19 nt, Homo sapiens
ggaagcaugugugauacag

SEQ ID NO: 247248 - RNA, 19 nt, Homo sapiens
uaauaggagggccuugaua

SEQ ID NO: 247249 - RNA, 19 nt, Homo sapiens
uuucaugaguucuuccauu

SEQ ID NO: 247250 - RNA, 19 nt, Homo sapiens
gaggaaggauugaaaacug

SEQ ID NO: 247251 - RNA, 19 nt, Homo sapiens
gaagagacuccccugauga

SEQ ID NO: 247252 - RNA, 19 nt, Homo sapiens
ggccaccaguuccagaaga

SEQ ID NO: 247253 - RNA, 19 nt, Homo sapiens
gggaagaaucucuccuuuc

SEQ ID NO: 247254 - RNA, 19 nt, Homo sapiens
ugaaggacagacaugaauu

SEQ ID NO: 247255 - RNA, 19 nt, Homo sapiens
ccaucucuguccuccauga

SEQ ID NO: 247256 - RNA, 19 nt, Homo sapiens
guaauaggagggccuugau

SEQ ID NO: 247257 - RNA, 19 nt, Homo sapiens
gggaacagagccuccuaga

SEQ ID NO: 247258 - RNA, 19 nt, Homo sapiens
ugaguucuuccauuucaaa

SEQ ID NO: 247259 - RNA, 19 nt, Homo sapiens
gagguugucagagcagaaa

SEQ ID NO: 247260 - RNA, 19 nt, Homo sapiens
agacuccccugaugaauga

SEQ ID NO: 247261 - RNA, 19 nt, Homo sapiens
gccuagugauauuugcaaa

SEQ ID NO: 247262 - RNA, 19 nt, Homo sapiens
ugauacuccuggcacaaau

SEQ ID NO: 247263 - RNA, 19 nt, Homo sapiens
agacucacuucuauaacca

SEQ ID NO: 247264 - RNA, 19 nt, Homo sapiens
gguagccuagugauauuug

SEQ ID NO: 247265 - RNA, 19 nt, Homo sapiens
uggcacaaaugggaagaau

SEQ ID NO: 247266 - RNA, 19 nt, Homo sapiens
acacuuucaugaguucuuc

SEQ ID NO: 247267 - RNA, 19 nt, Homo sapiens
gcagaccuucaaucucuuc

SEQ ID NO: 247268 - RNA, 19 nt, Homo sapiens
cguaauaggagggccuuga

SEQ ID NO: 247269 - RNA, 19 nt, Homo sapiens
cagagcagaaaucaugaga

SEQ ID NO: 247270 - RNA, 19 nt, Homo sapiens
cagcacagaggacucaucu

SEQ ID NO: 247271 - RNA, 19 nt, Homo sapiens
gauacuccuggcacaaaug

SEQ ID NO: 247272 - RNA, 19 nt, Homo sapiens
agacucaagccaucucugu

SEQ ID NO: 247273 - RNA, 19 nt, Homo sapiens
aaacugguucaucauggaa

SEQ ID NO: 247274 - RNA, 19 nt, Homo sapiens
ggagguugucagagcagaa

SEQ ID NO: 247275 - RNA, 19 nt, Homo sapiens
ggacagacaugacuuugaa

SEQ ID NO: 247276 - RNA, 19 nt, Homo sapiens
ucaaaugugucaaguguuu

SEQ ID NO: 247277 - RNA, 19 nt, Homo sapiens
ggacucaucugcugcuuug

SEQ ID NO: 247278 - RNA, 19 nt, Homo sapiens
gcaaacugauuaaagaaug

SEQ ID NO: 247279 - RNA, 19 nt, Homo sapiens
gagcagaaaucaugagauc

SEQ ID NO: 247280 - RNA, 19 nt, Homo sapiens
gcacaaaugcgaagaaucu

SEQ ID NO: 247281 - RNA, 19 nt, Homo sapiens
uaacuacuauagggacuua

SEQ ID NO: 247282 - RNA, 19 nt, Homo sapiens
gaauugugcaaacugauua

SEQ ID NO: 247283 - RNA, 19 nt, Homo sapiens
guacaacacggaaaugauu

SEQ ID NO: 247284 - RNA, 19 nt, Homo sapiens
gaugagacccuucuagaug

SEQ ID NO: 247285 - RNA, 19 nt, Homo sapiens
gaacuccaacccaugaauu

SEQ ID NO: 247286 - RNA, 19 nt, Homo sapiens
auacagcagucuacacuuu

SEQ ID NO: 247287 - RNA, 19 nt, Homo sapiens
gaaggacagacaugacuuu

SEQ ID NO: 247288 - RNA, 19 nt, Homo sapiens
caaagaaucacucuauauc

SEQ ID NO: 247289 - RNA, 19 nt, Homo sapiens
aaucaaaugugucaagugu

SEQ ID NO: 247290 - RNA, 19 nt, Homo sapiens
ggaaugagaccugguacaa

SEQ ID NO: 247291 - RNA, 19 nt, Homo sapiens
uaacaggagggccuugaua

SEQ ID NO: 247292 - RNA, 19 nt, Homo sapiens
ccaaagaaucacucuauau

SEQ ID NO: 247293 - RNA, 19 nt, Homo sapiens
gcacuagucccuuacagau

SEQ ID NO: 247294 - RNA, 19 nt, Homo sapiens
gaaauacuuccaaagaauc

SEQ ID NO: 247295 - RNA, 19 nt, Homo sapiens
gcagcugaaugaccuggaa

SEQ ID NO: 247296 - RNA, 19 nt, Homo sapiens
ugugcaaacugauuaaaga

SEQ ID NO: 247297 - RNA, 19 nt, Homo sapiens
uaugggcacuagucccuua

SEQ ID NO: 247298 - RNA, 19 nt, Homo sapiens
caaguugugcucuuucaaa

SEQ ID NO: 247299 - RNA, 19 nt, Homo sapiens
aaugagaccugguacaaca

SEQ ID NO: 247300 - RNA, 19 nt, Homo sapiens
caugaauugugcaaacuga

SEQ ID NO: 247301 - RNA, 19 nt, Homo sapiens
uccaaagaaucacucuaua

SEQ ID NO: 247302 - RNA, 19 nt, Homo sapiens
acuagucccuuacagauga

SEQ ID NO: 247303 - RNA, 19 nt, Homo sapiens
cuacaauggccuugacuuu

SEQ ID NO: 247304 - RNA, 19 nt, Homo sapiens
aagaaucacucuauaucug

SEQ ID NO: 247305 - RNA, 19 nt, Homo sapiens
uaaggaaugagaccuggua

SEQ ID NO: 247306 - RNA, 19 nt, Homo sapiens
ugucagagcagaaaucaug

SEQ ID NO: 247307 - RNA, 19 nt, Homo sapiens
caaacugauuaaagaaugg

SEQ ID NO: 247308 - RNA, 19 nt, Homo sapiens
aaaccaugcuaugaauuga

SEQ ID NO: 247309 - RNA, 19 nt, Homo sapiens
gauugaagaguaaggaaug

SEQ ID NO: 247310 - RNA, 19 nt, Homo sapiens
ggaugagacccuucuagau

SEQ ID NO: 247311 - RNA, 19 nt, Homo sapiens
gauagagucuccccugaug

SEQ ID NO: 247312 - RNA, 19 nt, Homo sapiens
gaaaucaugagauccuucu

SEQ ID NO: 247313 - RNA, 19 nt, Homo sapiens
ugacagagaagaaauacag

SEQ ID NO: 247314 - RNA, 19 nt, Homo sapiens
ccaaaaccaugcuaugaau

SEQ ID NO: 247315 - RNA, 19 nt, Homo sapiens
acagcagucuacacuuuga

SEQ ID NO: 247316 - RNA, 19 nt, Homo sapiens
augagacccuucuagauga

SEQ ID NO: 247317 - RNA, 19 nt, Homo sapiens
ugaauugugcaaacugauu

SEQ ID NO: 247318 - RNA, 19 nt, Homo sapiens
cauugugaauuguguaaca

SEQ ID NO: 247319 - RNA, 19 nt, Homo sapiens
ugaaucaaaugugucaagu

SEQ ID NO: 247320 - RNA, 19 nt, Homo sapiens
ucaaagacccuuguuucug

SEQ ID NO: 247321 - RNA, 19 nt, Homo sapiens
gcagaaaucaugagauccu

SEQ ID NO: 247322 - RNA, 19 nt, Homo sapiens
ugagacccuucuagaugaa

SEQ ID NO: 247323 - RNA, 19 nt, Homo sapiens
ccaucucuguccuccauga

SEQ ID NO: 247324 - RNA, 19 nt, Homo sapiens
agaaucacucuauaucuga

SEQ ID NO: 247325 - RNA, 19 nt, Homo sapiens
gaaucaaaugugucaagug

SEQ ID NO: 247326 - RNA, 19 nt, Homo sapiens
gugcaaacugauuaaagaa

SEQ ID NO: 247327 - RNA, 19 nt, Homo sapiens
cuauagggacuuaaauuag

SEQ ID NO: 247328 - RNA, 19 nt, Homo sapiens
gacccuuguuucugccaaa

SEQ ID NO: 247329 - RNA, 19 nt, Homo sapiens
acagacaugacuuugaauu

SEQ ID NO: 247330 - RNA, 19 nt, Homo sapiens
gagguugucagagcagaaa

SEQ ID NO: 247331 - RNA, 19 nt, Homo sapiens
uuucaggaguguuaagcaa

SEQ ID NO: 247332 - RNA, 19 nt, Homo sapiens
ugaagaguaaggaaugaga

SEQ ID NO: 247333 - RNA, 19 nt, Homo sapiens
gugcucagcuacaagucau

SEQ ID NO: 247334 - RNA, 19 nt, Homo sapiens
ugaauucuacaucgaacuu

SEQ ID NO: 247335 - RNA, 19 nt, Homo sapiens
agacaugacuuugaauucc

SEQ ID NO: 247336 - RNA, 19 nt, Homo sapiens
uuucaaagacccuuguuuc

SEQ ID NO: 247337 - RNA, 19 nt, Homo sapiens
cagaaaucaugagauccuu

SEQ ID NO: 247338 - RNA, 19 nt, Homo sapiens
ugauacuccuggcacaaau

SEQ ID NO: 247339 - RNA, 19 nt, Homo sapiens
uaauacagcagucuacacu

SEQ ID NO: 247340 - RNA, 19 nt, Homo sapiens
gguacaacacggaaaugau

SEQ ID NO: 247341 - RNA, 19 nt, Homo sapiens
cagacaugacuuugaauuc

SEQ ID NO: 247342 - RNA, 19 nt, Homo sapiens
gcagcauccgcaacaucua

SEQ ID NO: 247343 - RNA, 19 nt, Homo sapiens
aauucuacaucgaacuuga

SEQ ID NO: 247344 - RNA, 19 nt, Homo sapiens
uggaugagacccuucuaga

SEQ ID NO: 247345 - RNA, 19 nt, Homo sapiens
uggcacaaaugcgaagaau

SEQ ID NO: 247346 - RNA, 19 nt, Homo sapiens
agacccuucuagaugaauu

SEQ ID NO: 247347 - RNA, 19 nt, Homo sapiens
gguaacaggagggccuuga

SEQ ID NO: 247348 - RNA, 19 nt, Homo sapiens
uggaaguccugugugauca

SEQ ID NO: 247349 - RNA, 19 nt, Homo sapiens
ggcacuagucccuuacaga

SEQ ID NO: 247350 - RNA, 19 nt, Homo sapiens
caucuacaauggccuugac

SEQ ID NO: 247351 - RNA, 19 nt, Homo sapiens
gaaugagaccugguacaac

SEQ ID NO: 247352 - RNA, 19 nt, Homo sapiens
gcagucuacacuuugacaa

SEQ ID NO: 247353 - RNA, 19 nt, Homo sapiens
cagagcagaaaucaugaga

SEQ ID NO: 247354 - RNA, 19 nt, Homo sapiens
gauacuccuggcacaaaug

SEQ ID NO: 247355 - RNA, 19 nt, Homo sapiens
uuccaaagaaucacucuau

SEQ ID NO: 247356 - RNA, 19 nt, Homo sapiens
gaauucuacaucgaacuug

SEQ ID NO: 247357 - RNA, 19 nt, Homo sapiens
agacucacagccuggguaa

SEQ ID NO: 247358 - RNA, 19 nt, Homo sapiens
accaugcuaugaauugaau

SEQ ID NO: 247359 - RNA, 19 nt, Homo sapiens
ggagguugucagagcagaa

SEQ ID NO: 247360 - RNA, 19 nt, Homo sapiens
gcagaccuucaaccucuuc

SEQ ID NO: 247361 - RNA, 19 nt, Homo sapiens
gaacagagccuccuagaaa

SEQ ID NO: 247362 - RNA, 19 nt, Homo sapiens
caaagacucacuucuauaa

SEQ ID NO: 247363 - RNA, 19 nt, Homo sapiens
gagcagaaaucaugagauc

SEQ ID NO: 247364 - RNA, 19 nt, Homo sapiens
cagcagaccuucaaucucu

SEQ ID NO: 247365 - RNA, 19 nt, Homo sapiens
gaacuuuaccagcaacuga

SEQ ID NO: 247366 - RNA, 19 nt, Homo sapiens
gcacuaguccuuuacagau

SEQ ID NO: 247367 - RNA, 19 nt, Homo sapiens
gaaauacuuccaaagaauc

SEQ ID NO: 247368 - RNA, 19 nt, Homo sapiens
ucaaagacucacuucuaua

SEQ ID NO: 247369 - RNA, 19 nt, Homo sapiens
ggaagagacuccccugaug

SEQ ID NO: 247370 - RNA, 19 nt, Homo sapiens
ggaacagagccuccuagaa

SEQ ID NO: 247371 - RNA, 19 nt, Homo sapiens
gaaggacagacaugauuuc

SEQ ID NO: 247372 - RNA, 19 nt, Homo sapiens
uaucaugagucgcuuuaca

SEQ ID NO: 247373 - RNA, 19 nt, Homo sapiens
ugucagagcagaaaucaug

SEQ ID NO: 247374 - RNA, 19 nt, Homo sapiens
gguuauccaucucaaguag

SEQ ID NO: 247375 - RNA, 19 nt, Homo sapiens
uaaggaggaaggauugaaa

SEQ ID NO: 247376 - RNA, 19 nt, Homo sapiens
uucaaagacucacuucuau

SEQ ID NO: 247377 - RNA, 19 nt, Homo sapiens
ugaaggacagacaugauuu

SEQ ID NO: 247378 - RNA, 19 nt, Homo sapiens
ugggaagaaucucuccuuu

SEQ ID NO: 247379 - RNA, 19 nt, Homo sapiens
uuucaaagacucacuucua

SEQ ID NO: 247380 - RNA, 19 nt, Homo sapiens
ggaagcaugugugauacag

SEQ ID NO: 247381 - RNA, 19 nt, Homo sapiens
uaauaggagggccuugaua

SEQ ID NO: 247382 - RNA, 19 nt, Homo sapiens
ugcaggcacuaguccuuua

SEQ ID NO: 247383 - RNA, 19 nt, Homo sapiens
augagucgcuuuacauugu

SEQ ID NO: 247384 - RNA, 19 nt, Homo sapiens
gguaauaggagggccuuga

SEQ ID NO: 247385 - RNA, 19 nt, Homo sapiens
gaggaaggauugaaaacug

SEQ ID NO: 247386 - RNA, 19 nt, Homo sapiens
gaagagacuccccugauga

SEQ ID NO: 247387 - RNA, 19 nt, Homo sapiens
gggaagaaucucuccuuuc

SEQ ID NO: 247388 - RNA, 19 nt, Homo sapiens
ccaucucuguccuccauga

SEQ ID NO: 247389 - RNA, 19 nt, Homo sapiens
gaggaaauacagcccuugu

SEQ ID NO: 247390 - RNA, 19 nt, Homo sapiens
guaauaggagggccuugau

SEQ ID NO: 247391 - RNA, 19 nt, Homo sapiens
aauaucaugagucgcuuua

SEQ ID NO: 247392 - RNA, 19 nt, Homo sapiens
uaauagagaggaaauacag

SEQ ID NO: 247393 - RNA, 19 nt, Homo sapiens
gggaacagagccuccuaga

SEQ ID NO: 247394 - RNA, 19 nt, Homo sapiens
acccacagccucgguaaua

SEQ ID NO: 247395 - RNA, 19 nt, Homo sapiens
acuaguccuuuacagauga

SEQ ID NO: 247396 - RNA, 19 nt, Homo sapiens
gagguugucagagcagaaa

SEQ ID NO: 247397 - RNA, 19 nt, Homo sapiens
cacuaguccuuuacagaug

SEQ ID NO: 247398 - RNA, 19 nt, Homo sapiens
agacuccccugaugaauga

SEQ ID NO: 247399 - RNA, 19 nt, Homo sapiens
ucaugagucgcuuuacauu

SEQ ID NO: 247400 - RNA, 19 nt, Homo sapiens
caugagucgcuuuacauug

SEQ ID NO: 247401 - RNA, 19 nt, Homo sapiens
ggcacuaguccuuuacaga

SEQ ID NO: 247402 - RNA, 19 nt, Homo sapiens
agacucacuucuauaacca

SEQ ID NO: 247403 - RNA, 19 nt, Homo sapiens
uuucagcaguguaaagaag

SEQ ID NO: 247404 - RNA, 19 nt, Homo sapiens
cccaauggcccuguccuuu

SEQ ID NO: 247405 - RNA, 19 nt, Homo sapiens
caauggcccuguccuuuuc

SEQ ID NO: 247406 - RNA, 19 nt, Homo sapiens
gcagaccuucaaucucuuc

SEQ ID NO: 247407 - RNA, 19 nt, Homo sapiens
ccaauggcccuguccuuuu

SEQ ID NO: 247408 - RNA, 19 nt, Homo sapiens
cagagcagaaaucaugaga

SEQ ID NO: 247409 - RNA, 19 nt, Homo sapiens
cagcacagaggacucaucu

SEQ ID NO: 247410 - RNA, 19 nt, Homo sapiens
ggagguugucagagcagaa

SEQ ID NO: 247411 - RNA, 19 nt, Homo sapiens
ggacagacaugacuuugga

SEQ ID NO: 247412 - RNA, 19 nt, Homo sapiens
ucaacaaacuugcaagaaa

SEQ ID NO: 247413 - RNA, 19 nt, Homo sapiens
gagcagaaaucaugagauc

SEQ ID NO: 247414 - RNA, 19 nt, Homo sapiens
caacaaacuugcaagaaag

SEQ ID NO: 247415 - RNA, 19 nt, Homo sapiens
gcacaaaugagcagaaucu

SEQ ID NO: 247416 - RNA, 19 nt, Homo sapiens
gauuaaggaggaaggaaua

SEQ ID NO: 247417 - RNA, 19 nt, Homo sapiens
gcagcugaaugacuuggaa

SEQ ID NO: 247418 - RNA, 19 nt, Homo sapiens
agaagcaucugcaauaucu

SEQ ID NO: 247419 - RNA, 19 nt, Homo sapiens
gaagaaauacagcccuugu

SEQ ID NO: 247420 - RNA, 19 nt, Homo sapiens
agacaugacuuuggauuuc

SEQ ID NO: 247421 - RNA, 19 nt, Homo sapiens
gauaacaggaggaccuuga

SEQ ID NO: 247422 - RNA, 19 nt, Homo sapiens
gcccuuugcuuuacugaug

SEQ ID NO: 247423 - RNA, 19 nt, Homo sapiens
gcagaucuucaaccucuuu

SEQ ID NO: 247424 - RNA, 19 nt, Homo sapiens
gaagaaucacucucuaucu

SEQ ID NO: 247425 - RNA, 19 nt, Homo sapiens
aauaacaccugguccaaca

SEQ ID NO: 247426 - RNA, 19 nt, Homo sapiens
gugcucagcugcaagucaa

SEQ ID NO: 247427 - RNA, 19 nt, Homo sapiens
ugucagagcagaaaucaug

SEQ ID NO: 247428 - RNA, 19 nt, Homo sapiens
aagaaucacucucuaucug

SEQ ID NO: 247429 - RNA, 19 nt, Homo sapiens
ggaauaacaccugguccaa

SEQ ID NO: 247430 - RNA, 19 nt, Homo sapiens
gauggacagacaugacuuu

SEQ ID NO: 247431 - RNA, 19 nt, Homo sapiens
gaggagagggugggagaaa

SEQ ID NO: 247432 - RNA, 19 nt, Homo sapiens
caaacuugcaagaaagauu

SEQ ID NO: 247433 - RNA, 19 nt, Homo sapiens
cgaagaaucacucucuauc

SEQ ID NO: 247434 - RNA, 19 nt, Homo sapiens
ugacagagaagaaauacag

SEQ ID NO: 247435 - RNA, 19 nt, Homo sapiens
ggccucgcccuuugcuuua

SEQ ID NO: 247436 - RNA, 19 nt, Homo sapiens
gcaucugcaauaucuauga

SEQ ID NO: 247437 - RNA, 19 nt, Homo sapiens
caucugcaauaucuaugau

SEQ ID NO: 247438 - RNA, 19 nt, Homo sapiens
uaaggaggaaggaauaaca

SEQ ID NO: 247439 - RNA, 19 nt, Homo sapiens
ccaucucuguccuccauga

SEQ ID NO: 247440 - RNA, 19 nt, Homo sapiens
cagacaugacuuuggauuu

SEQ ID NO: 247441 - RNA, 19 nt, Homo sapiens
gaaacuccccugaugaaug

SEQ ID NO: 247442 - RNA, 19 nt, Homo sapiens
gagaaacuccccugaugaa

SEQ ID NO: 247443 - RNA, 19 nt, Homo sapiens
gcugcucucugggcuguga

SEQ ID NO: 247444 - RNA, 19 nt, Homo sapiens
uaugauggccucgcccuuu

SEQ ID NO: 247445 - RNA, 19 nt, Homo sapiens
ggaccuccuagacaaauuc

SEQ ID NO: 247446 - RNA, 19 nt, Homo sapiens
uaucaacaaacuugcaaga

SEQ ID NO: 247447 - RNA, 19 nt, Homo sapiens
gagguugucagagcagaaa

SEQ ID NO: 247448 - RNA, 19 nt, Homo sapiens
agaaucacucucuaucuga

SEQ ID NO: 247449 - RNA, 19 nt, Homo sapiens
gagacccacagccuggaua

SEQ ID NO: 247450 - RNA, 19 nt, Homo sapiens
uaacaggaggaccuugaug

SEQ ID NO: 247451 - RNA, 19 nt, Homo sapiens
cuuggaagccugugugaug

SEQ ID NO: 247452 - RNA, 19 nt, Homo sapiens
caucucagcaagcccagaa

SEQ ID NO: 247453 - RNA, 19 nt, Homo sapiens
gacuccaucuuggcuguga

SEQ ID NO: 247454 - RNA, 19 nt, Homo sapiens
ggagagggugggagaaacu

SEQ ID NO: 247455 - RNA, 19 nt, Homo sapiens
ucuccuuccuccugucuga

SEQ ID NO: 247456 - RNA, 19 nt, Homo sapiens
aagcaucugcaauaucuau

SEQ ID NO: 247457 - RNA, 19 nt, Homo sapiens
ccgaagaaucacucucuau

SEQ ID NO: 247458 - RNA, 19 nt, Homo sapiens
uggcacaaaugagcagaau

SEQ ID NO: 247459 - RNA, 19 nt, Homo sapiens
uggccucgcccuuugcuuu

SEQ ID NO: 247460 - RNA, 19 nt, Homo sapiens
gaagcaucugcaauaucua

SEQ ID NO: 247461 - RNA, 19 nt, Homo sapiens
cagagcagaaaucaugaga

SEQ ID NO: 247462 - RNA, 19 nt, Homo sapiens
uccgaagaaucacucucua

SEQ ID NO: 247463 - RNA, 19 nt, Homo sapiens
caaauucugcaccgaacuc

SEQ ID NO: 247464 - RNA, 19 nt, Homo sapiens
ucaaccucuuuaccacaaa

SEQ ID NO: 247465 - RNA, 19 nt, Homo sapiens
acagacaugacuuuggauu

SEQ ID NO: 247466 - RNA, 19 nt, Homo sapiens
agcccaagguucagaguca

SEQ ID NO: 247467 - RNA, 19 nt, Homo sapiens
ggagguugucagagcagaa

SEQ ID NO: 247468 - RNA, 19 nt, Homo sapiens
cagaucuucaaccucuuua

SEQ ID NO: 247469 - RNA, 19 nt, Homo sapiens
ggacagacaugacuuugaa

SEQ ID NO: 247470 - RNA, 19 nt, Homo sapiens
gcaaaugaaugaccuggaa

SEQ ID NO: 247471 - RNA, 19 nt, Homo sapiens
caaagacucacuucuauaa

SEQ ID NO: 247472 - RNA, 19 nt, Homo sapiens
gagcagaaaucaugagauc

SEQ ID NO: 247473 - RNA, 19 nt, Homo sapiens
gaugagacccuccuagaaa

SEQ ID NO: 247474 - RNA, 19 nt, Homo sapiens
gcauugcccuuugcuuuaa

SEQ ID NO: 247475 - RNA, 19 nt, Homo sapiens
cagcagaccuucaaucucu

SEQ ID NO: 247476 - RNA, 19 nt, Homo sapiens
gaaggacagacaugacuuu

SEQ ID NO: 247477 - RNA, 19 nt, Homo sapiens
gcacaaaugaggagaaucu

SEQ ID NO: 247478 - RNA, 19 nt, Homo sapiens
gcacuaguccuuuacagau

SEQ ID NO: 247479 - RNA, 19 nt, Homo sapiens
agacaugacuuugaauuuc

SEQ ID NO: 247480 - RNA, 19 nt, Homo sapiens
ccuggaagccugugugaua

SEQ ID NO: 247481 - RNA, 19 nt, Homo sapiens
gcccuuugcuuuaaugaug

SEQ ID NO: 247482 - RNA, 19 nt, Homo sapiens
gaagaaauacagcccuugu

SEQ ID NO: 247483 - RNA, 19 nt, Homo sapiens
gaaauacuuccaaagaauc

SEQ ID NO: 247484 - RNA, 19 nt, Homo sapiens
uaagaagcaucguguuuac

SEQ ID NO: 247485 - RNA, 19 nt, Homo sapiens
uuaagaagcaucguguuua

SEQ ID NO: 247486 - RNA, 19 nt, Homo sapiens
gcuguaaucugucucaaac

SEQ ID NO: 247487 - RNA, 19 nt, Homo sapiens
guuaagaagcaucguguuu

SEQ ID NO: 247488 - RNA, 19 nt, Homo sapiens
ggaugagacccuccuagaa

SEQ ID NO: 247489 - RNA, 19 nt, Homo sapiens
ucaaagacucacuucuaua

SEQ ID NO: 247490 - RNA, 19 nt, Homo sapiens
ucucugggcuguaaucugu

SEQ ID NO: 247491 - RNA, 19 nt, Homo sapiens
ggaagagacuccccugaug

SEQ ID NO: 247492 - RNA, 19 nt, Homo sapiens
gugcucagcugcaagucaa

SEQ ID NO: 247493 - RNA, 19 nt, Homo sapiens
acuaauacaucaucucaca

SEQ ID NO: 247494 - RNA, 19 nt, Homo sapiens
ugucagagcagaaaucaug

SEQ ID NO: 247495 - RNA, 19 nt, Homo sapiens
caaacccacagccugaaua

SEQ ID NO: 247496 - RNA, 19 nt, Homo sapiens
uaaggaggaaggauugaaa

SEQ ID NO: 247497 - RNA, 19 nt, Homo sapiens
cagacaugacuuugaauuu

SEQ ID NO: 247498 - RNA, 19 nt, Homo sapiens
uucaaagacucacuucuau

SEQ ID NO: 247499 - RNA, 19 nt, Homo sapiens
gggaugagacccuccuaga

SEQ ID NO: 247500 - RNA, 19 nt, Homo sapiens
gcaaccaguuccagaaagc

SEQ ID NO: 247501 - RNA, 19 nt, Homo sapiens
augaguaccuuuacauugu

SEQ ID NO: 247502 - RNA, 19 nt, Homo sapiens
ugucuccuuucaucuauuu

SEQ ID NO: 247503 - RNA, 19 nt, Homo sapiens
uuucaaagacucacuucua

SEQ ID NO: 247504 - RNA, 19 nt, Homo sapiens
gcugcucucugggcuguaa

SEQ ID NO: 247505 - RNA, 19 nt, Homo sapiens
caugaguaccuuuacauug

SEQ ID NO: 247506 - RNA, 19 nt, Homo sapiens
ugcaggcacuaguccuuua

SEQ ID NO: 247507 - RNA, 19 nt, Homo sapiens
uacaucaucucacacuuuc

SEQ ID NO: 247508 - RNA, 19 nt, Homo sapiens
gaacuuuuccagcaaauga

SEQ ID NO: 247509 - RNA, 19 nt, Homo sapiens
ugacuaauacaucaucuca

SEQ ID NO: 247510 - RNA, 19 nt, Homo sapiens
uaucaugaguaccuuuaca

SEQ ID NO: 247511 - RNA, 19 nt, Homo sapiens
ugaauaacaggaggacuuu

SEQ ID NO: 247512 - RNA, 19 nt, Homo sapiens
aaacccacagccugaauaa

SEQ ID NO: 247513 - RNA, 19 nt, Homo sapiens
guaauaucaugaguaccuu

SEQ ID NO: 247514 - RNA, 19 nt, Homo sapiens
ucaggaguguuaagaagca

SEQ ID NO: 247515 - RNA, 19 nt, Homo sapiens
ucuauaaccaccacaaguu

SEQ ID NO: 247516 - RNA, 19 nt, Homo sapiens
gaggaaggauugaaaacug

SEQ ID NO: 247517 - RNA, 19 nt, Homo sapiens
gaagagacuccccugauga

SEQ ID NO: 247518 - RNA, 19 nt, Homo sapiens
ccauucugaugucuccuuu

SEQ ID NO: 247519 - RNA, 19 nt, Homo sapiens
aauaacaggaggacuuuga

SEQ ID NO: 247520 - RNA, 19 nt, Homo sapiens
auacaucaucucacacuuu

SEQ ID NO: 247521 - RNA, 19 nt, Homo sapiens
ccaucucuguccuccauga

SEQ ID NO: 247522 - RNA, 19 nt, Homo sapiens
caucucacacuuucauguu

SEQ ID NO: 247523 - RNA, 19 nt, Homo sapiens
agaaucacucuuuaucuga

SEQ ID NO: 247524 - RNA, 19 nt, Homo sapiens
gacaugacuuugaauuucc

SEQ ID NO: 247525 - RNA, 19 nt, Homo sapiens
ugaguaccuuuacauugug

SEQ ID NO: 247526 - RNA, 19 nt, Homo sapiens
uaacaggaggacuuugaug

SEQ ID NO: 247527 - RNA, 19 nt, Homo sapiens
acuaguccuuuacagauga

SEQ ID NO: 247528 - RNA, 19 nt, Homo sapiens
ggaggacuuugaugcucau

SEQ ID NO: 247529 - RNA, 19 nt, Homo sapiens
acagacaugacuuugaauu

SEQ ID NO: 247530 - RNA, 19 nt, Homo sapiens
gauucucauugacuaauac

SEQ ID NO: 247531 - RNA, 19 nt, Homo sapiens
gagguugucagagcagaaa

SEQ ID NO: 247532 - RNA, 19 nt, Homo sapiens
uucaaucucuucagcacaa

SEQ ID NO: 247533 - RNA, 19 nt, Homo sapiens
auucugaugucuccuuuca

SEQ ID NO: 247534 - RNA, 19 nt, Homo sapiens
cacuaguccuuuacagaug

SEQ ID NO: 247535 - RNA, 19 nt, Homo sapiens
agacuccccugaugaauga

SEQ ID NO: 247536 - RNA, 19 nt, Homo sapiens
ggcaaccaguuccagaaag

SEQ ID NO: 247537 - RNA, 19 nt, Homo sapiens
ucaugaguaccuuuacauu

SEQ ID NO: 247538 - RNA, 19 nt, Homo sapiens
cucuuuaucugauggagaa

SEQ ID NO: 247539 - RNA, 19 nt, Homo sapiens
uauaaccaccacaaguuga

SEQ ID NO: 247540 - RNA, 19 nt, Homo sapiens
cuauaaccaccacaaguug

SEQ ID NO: 247541 - RNA, 19 nt, Homo sapiens
cauguucuuccauuucaaa

SEQ ID NO: 247542 - RNA, 19 nt, Homo sapiens
cucauugacuaauacauca

SEQ ID NO: 247543 - RNA, 19 nt, Homo sapiens
gaccuggaagccuguguga

SEQ ID NO: 247544 - RNA, 19 nt, Homo sapiens
ggcacuaguccuuuacaga

SEQ ID NO: 247545 - RNA, 19 nt, Homo sapiens
agacucacuucuauaacca

SEQ ID NO: 247546 - RNA, 19 nt, Homo sapiens
caucaucucacacuuucau

SEQ ID NO: 247547 - RNA, 19 nt, Homo sapiens
uuucaggaguguuaagaag

SEQ ID NO: 247548 - RNA, 19 nt, Homo sapiens
cugaauaacaggaggacuu

SEQ ID NO: 247549 - RNA, 19 nt, Homo sapiens
uggcacaaaugaggagaau

SEQ ID NO: 247550 - RNA, 19 nt, Homo sapiens
cagcagcaucuucgggauu

SEQ ID NO: 247551 - RNA, 19 nt, Homo sapiens
uuuaucugauggagaagaa

SEQ ID NO: 247552 - RNA, 19 nt, Homo sapiens
gcagaccuucaaucucuuc

SEQ ID NO: 247553 - RNA, 19 nt, Homo sapiens
acccacagccugaauaaca

SEQ ID NO: 247554 - RNA, 19 nt, Homo sapiens
cagagcagaaaucaugaga

SEQ ID NO: 247555 - RNA, 19 nt, Homo sapiens
gaauaacaggaggacuuug

SEQ ID NO: 247556 - RNA, 19 nt, Homo sapiens
gcagcagaccuucaaucuc

SEQ ID NO: 247557 - RNA, 19 nt, Homo sapiens
uaauacaucaucucacacu

SEQ ID NO: 247558 - RNA, 19 nt, Homo sapiens
aaacugguucaucauggaa

SEQ ID NO: 247559 - RNA, 19 nt, Homo sapiens
ggagguugucagagcagaa

SEQ ID NO: 247560 - RNA, 19 nt, Homo sapiens
caaagacucacuucuauaa

SEQ ID NO: 247561 - RNA, 19 nt, Homo sapiens
gagcagaaaucaugagauc

SEQ ID NO: 247562 - RNA, 19 nt, Homo sapiens
gcaacugaaugaccuagaa

SEQ ID NO: 247563 - RNA, 19 nt, Homo sapiens
guaaagaagcaucguguuu

SEQ ID NO: 247564 - RNA, 19 nt, Homo sapiens
cagcagaccuucaaucucu

SEQ ID NO: 247565 - RNA, 19 nt, Homo sapiens
gaagagauugcccugauga

SEQ ID NO: 247566 - RNA, 19 nt, Homo sapiens
ggaagagauugcccugaug

SEQ ID NO: 247567 - RNA, 19 nt, Homo sapiens
gcacaaaugggaagaaucu

SEQ ID NO: 247568 - RNA, 19 nt, Homo sapiens
gcacuaguccuuuacagau

SEQ ID NO: 247569 - RNA, 19 nt, Homo sapiens
uaagaaggaaggauugaaa

SEQ ID NO: 247570 - RNA, 19 nt, Homo sapiens
gaagaaauacagcccuugu

SEQ ID NO: 247571 - RNA, 19 nt, Homo sapiens
agauugcccugaugaauga

SEQ ID NO: 247572 - RNA, 19 nt, Homo sapiens
gagauugcccugaugaaug

SEQ ID NO: 247573 - RNA, 19 nt, Homo sapiens
gaugagacccuccuagaca

SEQ ID NO: 247574 - RNA, 19 nt, Homo sapiens
ggauuaagaaggaaggauu

SEQ ID NO: 247575 - RNA, 19 nt, Homo sapiens
ugggaagaaucucucauuu

SEQ ID NO: 247576 - RNA, 19 nt, Homo sapiens
cagauaugauuucggauuc

SEQ ID NO: 247577 - RNA, 19 nt, Homo sapiens
ucaaagacucacuucuaua

SEQ ID NO: 247578 - RNA, 19 nt, Homo sapiens
gaaggacagauaugauuuc

SEQ ID NO: 247579 - RNA, 19 nt, Homo sapiens
gauccucauugauuaauac

SEQ ID NO: 247580 - RNA, 19 nt, Homo sapiens
aaagaagcaucguguuuac

SEQ ID NO: 247581 - RNA, 19 nt, Homo sapiens
gggaagaaucucucauuuc

SEQ ID NO: 247582 - RNA, 19 nt, Homo sapiens
ugucagagcagaaaucaug

SEQ ID NO: 247583 - RNA, 19 nt, Homo sapiens
ugaaggacagauaugauuu

SEQ ID NO: 247584 - RNA, 19 nt, Homo sapiens
acucacagccuggguaaua

SEQ ID NO: 247585 - RNA, 19 nt, Homo sapiens
uucaaagacucacuucuau

SEQ ID NO: 247586 - RNA, 19 nt, Homo sapiens
uggaagagauugcccugau

SEQ ID NO: 247587 - RNA, 19 nt, Homo sapiens
gggaugagacccuccuaga

SEQ ID NO: 247588 - RNA, 19 nt, Homo sapiens
uuucaaagacucacuucua

SEQ ID NO: 247589 - RNA, 19 nt, Homo sapiens
uaauaggagggccuugaua

SEQ ID NO: 247590 - RNA, 19 nt, Homo sapiens
gacaaauucuacauugaac

SEQ ID NO: 247591 - RNA, 19 nt, Homo sapiens
ugcaggcacuaguccuuua

SEQ ID NO: 247592 - RNA, 19 nt, Homo sapiens
ccuagaagccugugugaca

SEQ ID NO: 247593 - RNA, 19 nt, Homo sapiens
gauuaagaaggaaggauug

SEQ ID NO: 247594 - RNA, 19 nt, Homo sapiens
guaauaucauguguaccuu

SEQ ID NO: 247595 - RNA, 19 nt, Homo sapiens
cagaugaccaugcugaugu

SEQ ID NO: 247596 - RNA, 19 nt, Homo sapiens
gguaauaggagggccuuga

SEQ ID NO: 247597 - RNA, 19 nt, Homo sapiens
ugaccaugcugaugucucu

SEQ ID NO: 247598 - RNA, 19 nt, Homo sapiens
acagauaugauuucggauu

SEQ ID NO: 247599 - RNA, 19 nt, Homo sapiens
agaaucacucuuuaucuga

SEQ ID NO: 247600 - RNA, 19 nt, Homo sapiens
guaauaggagggccuugau

SEQ ID NO: 247601 - RNA, 19 nt, Homo sapiens
acuaguccuuuacagauga

SEQ ID NO: 247602 - RNA, 19 nt, Homo sapiens
gaacuuuuccagcaacuga

SEQ ID NO: 247603 - RNA, 19 nt, Homo sapiens
cugaaggacagauaugauu

SEQ ID NO: 247604 - RNA, 19 nt, Homo sapiens
gagguugucagagcagaaa

SEQ ID NO: 247605 - RNA, 19 nt, Homo sapiens
gaccuagaagccuguguga

SEQ ID NO: 247606 - RNA, 19 nt, Homo sapiens
uucaaucucuucagcacaa

SEQ ID NO: 247607 - RNA, 19 nt, Homo sapiens
augcugaugucucuauuca

SEQ ID NO: 247608 - RNA, 19 nt, Homo sapiens
cacuaguccuuuacagaug

SEQ ID NO: 247609 - RNA, 19 nt, Homo sapiens
ccaugcugaugucucuauu

SEQ ID NO: 247610 - RNA, 19 nt, Homo sapiens
ugauacuccuggcacaaau

SEQ ID NO: 247611 - RNA, 19 nt, Homo sapiens
agacccuccuagacaaauu

SEQ ID NO: 247612 - RNA, 19 nt, Homo sapiens
ucaggaguguaaagaagca

SEQ ID NO: 247613 - RNA, 19 nt, Homo sapiens
ggcacuaguccuuuacaga

SEQ ID NO: 247614 - RNA, 19 nt, Homo sapiens
agacucacuucuauaacca

SEQ ID NO: 247615 - RNA, 19 nt, Homo sapiens
uuucaggaguguaaagaag

SEQ ID NO: 247616 - RNA, 19 nt, Homo sapiens
cccaauggcccuguccuuu

SEQ ID NO: 247617 - RNA, 19 nt, Homo sapiens
uggcacaaaugggaagaau

SEQ ID NO: 247618 - RNA, 19 nt, Homo sapiens
aaacucauucaacauggaa

SEQ ID NO: 247619 - RNA, 19 nt, Homo sapiens
caauggcccuguccuuuuc

SEQ ID NO: 247620 - RNA, 19 nt, Homo sapiens
gcagaccuucaaucucuuc

SEQ ID NO: 247621 - RNA, 19 nt, Homo sapiens
ggaugagacccuccuagac

SEQ ID NO: 247622 - RNA, 19 nt, Homo sapiens
ccaauggcccuguccuuuu

SEQ ID NO: 247623 - RNA, 19 nt, Homo sapiens
cagagcagaaaucaugaga

SEQ ID NO: 247624 - RNA, 19 nt, Homo sapiens
agacucacagccuggguaa

SEQ ID NO: 247625 - RNA, 19 nt, Homo sapiens
gauacuccuggcacaaaug

SEQ ID NO: 247626 - RNA, 19 nt, Homo sapiens
caacugaaugaccuagaag

SEQ ID NO: 247627 - RNA, 19 nt, Homo sapiens
ggagguugucagagcagaa

SEQ ID NO: 247628 - RNA, 19 nt, Homo sapiens
gaacagagccuccuagaaa

SEQ ID NO: 247629 - RNA, 19 nt, Homo sapiens
caaagacucacuucuauaa

SEQ ID NO: 247630 - RNA, 19 nt, Homo sapiens
gagcagaaaucaugagauc

SEQ ID NO: 247631 - RNA, 19 nt, Homo sapiens
cagcagaccuucaaucucu

SEQ ID NO: 247632 - RNA, 19 nt, Homo sapiens
gaacuuuaccagcaacuga

SEQ ID NO: 247633 - RNA, 19 nt, Homo sapiens
gcacaaaugggaagaaucu

SEQ ID NO: 247634 - RNA, 19 nt, Homo sapiens
gaagaaauacagcccuugu

SEQ ID NO: 247635 - RNA, 19 nt, Homo sapiens
gaaauacuuccaaagaauc

SEQ ID NO: 247636 - RNA, 19 nt, Homo sapiens
ccuggaagcaugugugaua

SEQ ID NO: 247637 - RNA, 19 nt, Homo sapiens
ucaaagacucacuucuaua

SEQ ID NO: 247638 - RNA, 19 nt, Homo sapiens
uaacagagaagaaauacag

SEQ ID NO: 247639 - RNA, 19 nt, Homo sapiens
gaaucacucuuuaucuaac

SEQ ID NO: 247640 - RNA, 19 nt, Homo sapiens
ggaagagacuccccugaug

SEQ ID NO: 247641 - RNA, 19 nt, Homo sapiens
ggaacagagccuccuagaa

SEQ ID NO: 247642 - RNA, 19 nt, Homo sapiens
ugucagagcagaaaucaug

SEQ ID NO: 247643 - RNA, 19 nt, Homo sapiens
uaaggaggaaggauugaaa

SEQ ID NO: 247644 - RNA, 19 nt, Homo sapiens
uucaaagacucacuucuau

SEQ ID NO: 247645 - RNA, 19 nt, Homo sapiens
gcaaccaguuccagaagac

SEQ ID NO: 247646 - RNA, 19 nt, Homo sapiens
uuucaaagacucacuucua

SEQ ID NO: 247647 - RNA, 19 nt, Homo sapiens
ggaagcaugugugauacag

SEQ ID NO: 247648 - RNA, 19 nt, Homo sapiens
uaauaggagggccuugaua

SEQ ID NO: 247649 - RNA, 19 nt, Homo sapiens
ggcaaccaguuccagaaga

SEQ ID NO: 247650 - RNA, 19 nt, Homo sapiens
ugucucuguucaucuauuu

SEQ ID NO: 247651 - RNA, 19 nt, Homo sapiens
guaauaucauguguaccuu

SEQ ID NO: 247652 - RNA, 19 nt, Homo sapiens
gguaauaggagggccuuga

SEQ ID NO: 247653 - RNA, 19 nt, Homo sapiens
gaggaaggauugaaaacug

SEQ ID NO: 247654 - RNA, 19 nt, Homo sapiens
gaagagacuccccugauga

SEQ ID NO: 247655 - RNA, 19 nt, Homo sapiens
ccaucucuguccuccauga

SEQ ID NO: 247656 - RNA, 19 nt, Homo sapiens
gggaacagagccuccuaga

SEQ ID NO: 247657 - RNA, 19 nt, Homo sapiens
guaauaggagggccuugau

SEQ ID NO: 247658 - RNA, 19 nt, Homo sapiens
gguuacccaucucaaguag

SEQ ID NO: 247659 - RNA, 19 nt, Homo sapiens
gagguugucagagcagaaa

SEQ ID NO: 247660 - RNA, 19 nt, Homo sapiens
agacuccccugaugaauga

SEQ ID NO: 247661 - RNA, 19 nt, Homo sapiens
ugauacuccuggcacaaau

SEQ ID NO: 247662 - RNA, 19 nt, Homo sapiens
caagguuacccaucucaag

SEQ ID NO: 247663 - RNA, 19 nt, Homo sapiens
agacucacuucuauaacca

SEQ ID NO: 247664 - RNA, 19 nt, Homo sapiens
uuucagcaguguaaagaag

SEQ ID NO: 247665 - RNA, 19 nt, Homo sapiens
cccaauggcccuguccuuu

SEQ ID NO: 247666 - RNA, 19 nt, Homo sapiens
uggcacaaaugggaagaau

SEQ ID NO: 247667 - RNA, 19 nt, Homo sapiens
caauggcccuguccuuuuc

SEQ ID NO: 247668 - RNA, 19 nt, Homo sapiens
gcagaccuucaaucucuuc

SEQ ID NO: 247669 - RNA, 19 nt, Homo sapiens
cagagcagaaaucaugaga

SEQ ID NO: 247670 - RNA, 19 nt, Homo sapiens
ccaauggcccuguccuuuu

SEQ ID NO: 247671 - RNA, 19 nt, Homo sapiens
cagcacagaggacucaucu

SEQ ID NO: 247672 - RNA, 19 nt, Homo sapiens
agacucaagccaucucugu

SEQ ID NO: 247673 - RNA, 19 nt, Homo sapiens
gauacuccuggcacaaaug

SEQ ID NO: 247674 - RNA, 19 nt, Homo sapiens
caauuucaaagacucacuu

SEQ ID NO: 247675 - RNA, 19 nt, Homo sapiens
ggagguugucagagcagaa

SEQ ID NO: 247676 - RNA, 19 nt, Homo sapiens
gaacagagccuccuagaaa

SEQ ID NO: 247677 - RNA, 19 nt, Homo sapiens
gaaaugaucuguauugacu

SEQ ID NO: 247678 - RNA, 19 nt, Homo sapiens
ggacagacaugacuuugga

SEQ ID NO: 247679 - RNA, 19 nt, Homo sapiens
gagcagaaaucaugagauc

SEQ ID NO: 247680 - RNA, 19 nt, Homo sapiens
acaaaggacucaucugcua

SEQ ID NO: 247681 - RNA, 19 nt, Homo sapiens
agacucauuucuccuauaa

SEQ ID NO: 247682 - RNA, 19 nt, Homo sapiens
cagcagaccuucaaucucu

SEQ ID NO: 247683 - RNA, 19 nt, Homo sapiens
gaaggacagacaugacuuu

SEQ ID NO: 247684 - RNA, 19 nt, Homo sapiens
caaagacucauuucuccua

SEQ ID NO: 247685 - RNA, 19 nt, Homo sapiens
gcacuaguccuuuacagau

SEQ ID NO: 247686 - RNA, 19 nt, Homo sapiens
gaagaaauacagcccuugu

SEQ ID NO: 247687 - RNA, 19 nt, Homo sapiens
gaaauacuuccaaagaauc

SEQ ID NO: 247688 - RNA, 19 nt, Homo sapiens
acauggaaaugaucuguau

SEQ ID NO: 247689 - RNA, 19 nt, Homo sapiens
ggaagagacuccccugaug

SEQ ID NO: 247690 - RNA, 19 nt, Homo sapiens
ggaacagagccuccuagaa

SEQ ID NO: 247691 - RNA, 19 nt, Homo sapiens
ugucagagcagaaaucaug

SEQ ID NO: 247692 - RNA, 19 nt, Homo sapiens
ugacuucugccauuucaaa

SEQ ID NO: 247693 - RNA, 19 nt, Homo sapiens
uaaggaggaaggaaugaaa

SEQ ID NO: 247694 - RNA, 19 nt, Homo sapiens
uaauaggagggccuugaua

SEQ ID NO: 247695 - RNA, 19 nt, Homo sapiens
ugcaggcacuaguccuuua

SEQ ID NO: 247696 - RNA, 19 nt, Homo sapiens
ugaccaugcugauagaucu

SEQ ID NO: 247697 - RNA, 19 nt, Homo sapiens
uggaaaugaucuguauuga

SEQ ID NO: 247698 - RNA, 19 nt, Homo sapiens
gaaaucaugagauccuucu

SEQ ID NO: 247699 - RNA, 19 nt, Homo sapiens
ucuaugacuucugccauuu

SEQ ID NO: 247700 - RNA, 19 nt, Homo sapiens
ugacagagaagaaauacag

SEQ ID NO: 247701 - RNA, 19 nt, Homo sapiens
cagaugaccaugcugauag

SEQ ID NO: 247702 - RNA, 19 nt, Homo sapiens
gauuaaggaggaaggaaug

SEQ ID NO: 247703 - RNA, 19 nt, Homo sapiens
gaagagacuccccugauga

SEQ ID NO: 247704 - RNA, 19 nt, Homo sapiens
gguaauaggagggccuuga

SEQ ID NO: 247705 - RNA, 19 nt, Homo sapiens
aaagacucauuucuccuau

SEQ ID NO: 247706 - RNA, 19 nt, Homo sapiens
ccaguccacacuucuauga

SEQ ID NO: 247707 - RNA, 19 nt, Homo sapiens
gcagaaaucaugagauccu

SEQ ID NO: 247708 - RNA, 19 nt, Homo sapiens
aagacucauuucuccuaua

SEQ ID NO: 247709 - RNA, 19 nt, Homo sapiens
ggaaaugaucuguauugac

SEQ ID NO: 247710 - RNA, 19 nt, Homo sapiens
ccaucucuguccuccauga

SEQ ID NO: 247711 - RNA, 19 nt, Homo sapiens
uauaaccaccgcaugaguu

SEQ ID NO: 247712 - RNA, 19 nt, Homo sapiens
ccauuucaaagacucauuu

SEQ ID NO: 247713 - RNA, 19 nt, Homo sapiens
uaugacuucugccauuuca

SEQ ID NO: 247714 - RNA, 19 nt, Homo sapiens
caacauggaaaugaucugu

SEQ ID NO: 247715 - RNA, 19 nt, Homo sapiens
agaaucacucuuuaucuga

SEQ ID NO: 247716 - RNA, 19 nt, Homo sapiens
acagaugaccaugcugaua

SEQ ID NO: 247717 - RNA, 19 nt, Homo sapiens
guaauaggagggccuugau

SEQ ID NO: 247718 - RNA, 19 nt, Homo sapiens
gggaacagagccuccuaga

SEQ ID NO: 247719 - RNA, 19 nt, Homo sapiens
acuaguccuuuacagauga

SEQ ID NO: 247720 - RNA, 19 nt, Homo sapiens
auacaccaguccacacuuc

SEQ ID NO: 247721 - RNA, 19 nt, Homo sapiens
gagguugucagagcagaaa

SEQ ID NO: 247722 - RNA, 19 nt, Homo sapiens
uucaaucucuucagcacaa

SEQ ID NO: 247723 - RNA, 19 nt, Homo sapiens
agaugaccaugcugauaga

SEQ ID NO: 247724 - RNA, 19 nt, Homo sapiens
cacuaguccuuuacagaug

SEQ ID NO: 247725 - RNA, 19 nt, Homo sapiens
guccacacuucuaugacuu

SEQ ID NO: 247726 - RNA, 19 nt, Homo sapiens
gauccuucucuuuaucaaa

SEQ ID NO: 247727 - RNA, 19 nt, Homo sapiens
cagaaaucaugagauccuu

SEQ ID NO: 247728 - RNA, 19 nt, Homo sapiens
ggaguguaaggaaacauca

SEQ ID NO: 247729 - RNA, 19 nt, Homo sapiens
ggcacuaguccuuuacaga

SEQ ID NO: 247730 - RNA, 19 nt, Homo sapiens
agacaugacuuuggauucc

SEQ ID NO: 247731 - RNA, 19 nt, Homo sapiens
cccaauggcccuguccuuu

SEQ ID NO: 247732 - RNA, 19 nt, Homo sapiens
gcagaccuucaaucucuuc

SEQ ID NO: 247733 - RNA, 19 nt, Homo sapiens
caauggcccuguccuuuuc

SEQ ID NO: 247734 - RNA, 19 nt, Homo sapiens
gaucuuuucaggaguguaa

SEQ ID NO: 247735 - RNA, 19 nt, Homo sapiens
ccaauggcccuguccuuuu

SEQ ID NO: 247736 - RNA, 19 nt, Homo sapiens
cagagcagaaaucaugaga

SEQ ID NO: 247737 - RNA, 19 nt, Homo sapiens
acagacaugacuuuggauu

SEQ ID NO: 247738 - RNA, 19 nt, Homo sapiens
ggagguugucagagcagaa

SEQ ID NO: 247739 - RNA, 19 nt, Homo sapiens
gaaaguagcuuacccuaga

SEQ ID NO: 247740 - RNA, 19 nt, Homo sapiens
ggcaagcucuuaacuauuu

SEQ ID NO: 247741 - RNA, 19 nt, Homo sapiens
ccagaaagaugaucccuaa

SEQ ID NO: 247742 - RNA, 19 nt, Homo sapiens
gaacagccauugaagaauc

SEQ ID NO: 247743 - RNA, 19 nt, Homo sapiens
gaaaugaacugugucaagu

SEQ ID NO: 247744 - RNA, 19 nt, Homo sapiens
aaacugggauggauaauug

SEQ ID NO: 247745 - RNA, 19 nt, Homo sapiens
gaagauaaggcaauaguga

SEQ ID NO: 247746 - RNA, 19 nt, Homo sapiens
ugaaaccacugacuguaua

SEQ ID NO: 247747 - RNA, 19 nt, Homo sapiens
gcaaaugccagaaagauga

SEQ ID NO: 247748 - RNA, 19 nt, Homo sapiens
acaaauaccugacugugaa

SEQ ID NO: 247749 - RNA, 19 nt, Homo sapiens
gacaaacguuuccuacauu

SEQ ID NO: 247750 - RNA, 19 nt, Homo sapiens
gcaggagaaucgcuugaaa

SEQ ID NO: 247751 - RNA, 19 nt, Homo sapiens
gaccagaaaugaacugugu

SEQ ID NO: 247752 - RNA, 19 nt, Homo sapiens
ccuccagucuuuaacauua

SEQ ID NO: 247753 - RNA, 19 nt, Homo sapiens
ugaacugugucaaguauaa

SEQ ID NO: 247754 - RNA, 19 nt, Homo sapiens
ggacuucuguucauucauc

SEQ ID NO: 247755 - RNA, 19 nt, Homo sapiens
aaacaugaccuuucaaguu

SEQ ID NO: 247756 - RNA, 19 nt, Homo sapiens
gcgaaagucuucuugagau

SEQ ID NO: 247757 - RNA, 19 nt, Homo sapiens
gguaggcccuuaggaaauu

SEQ ID NO: 247758 - RNA, 19 nt, Homo sapiens
gcaagcucuuaacuauuua

SEQ ID NO: 247759 - RNA, 19 nt, Homo sapiens
ugagaugcaucaauuaugu

SEQ ID NO: 247760 - RNA, 19 nt, Homo sapiens
aauacaagcuuuccuacuu

SEQ ID NO: 247761 - RNA, 19 nt, Homo sapiens
ugaacuaccuccaccagaa

SEQ ID NO: 247762 - RNA, 19 nt, Homo sapiens
cacucaagcugaauguuua

SEQ ID NO: 247763 - RNA, 19 nt, Homo sapiens
gaagaugaaagcgaaagua

SEQ ID NO: 247764 - RNA, 19 nt, Homo sapiens
cugaagagauaaaguuuga

SEQ ID NO: 247765 - RNA, 19 nt, Homo sapiens
caccagagacuacuuauug

SEQ ID NO: 247766 - RNA, 19 nt, Homo sapiens
gacuguauauugugugaaa

SEQ ID NO: 247767 - RNA, 19 nt, Homo sapiens
gagauaaaguuugauacug

SEQ ID NO: 247768 - RNA, 19 nt, Homo sapiens
gauugguccuccagaagua

SEQ ID NO: 247769 - RNA, 19 nt, Homo sapiens
gaacauuggcuuccacauc

SEQ ID NO: 247770 - RNA, 19 nt, Homo sapiens
ggacuugcauuggaugaga

SEQ ID NO: 247771 - RNA, 19 nt, Homo sapiens
gcuuauaguuggaauuugu

SEQ ID NO: 247772 - RNA, 19 nt, Homo sapiens
gaacuaccuccaccagaaa

SEQ ID NO: 247773 - RNA, 19 nt, Homo sapiens
gauguuacaguuccuaauu

SEQ ID NO: 247774 - RNA, 19 nt, Homo sapiens
guauaaagaccacaguuga

SEQ ID NO: 247775 - RNA, 19 nt, Homo sapiens
gcugaauguuuaugaagaa

SEQ ID NO: 247776 - RNA, 19 nt, Homo sapiens
uaucuacccuuacaugguu

SEQ ID NO: 247777 - RNA, 19 nt, Homo sapiens
agacaaacguuuccuacau

SEQ ID NO: 247778 - RNA, 19 nt, Homo sapiens
uaaaccuucuuccaguaua

SEQ ID NO: 247779 - RNA, 19 nt, Homo sapiens
gcacacaccauggaugaaa

SEQ ID NO: 247780 - RNA, 19 nt, Homo sapiens
gagcacacaccauggauga

SEQ ID NO: 247781 - RNA, 19 nt, Homo sapiens
auacacaucucuccuggaa

SEQ ID NO: 247782 - RNA, 19 nt, Homo sapiens
caagcugaauguuuaugaa

SEQ ID NO: 247783 - RNA, 19 nt, Homo sapiens
acacaucucuccuggaaca

SEQ ID NO: 247784 - RNA, 19 nt, Homo sapiens
aaacacuucuucaugguau

SEQ ID NO: 247785 - RNA, 19 nt, Homo sapiens
cgggcaagcucuuaacuau

SEQ ID NO: 247786 - RNA, 19 nt, Homo sapiens
gaacaggagcgaugagucu

SEQ ID NO: 247787 - RNA, 19 nt, Homo sapiens
guuaaagcagcacuacuua

SEQ ID NO: 247788 - RNA, 19 nt, Homo sapiens
gaaaauuggugucuauagu

SEQ ID NO: 247789 - RNA, 19 nt, Homo sapiens
ugacucauuuacaccauuu

SEQ ID NO: 247790 - RNA, 19 nt, Homo sapiens
uagccaagauucaggaaau

SEQ ID NO: 247791 - RNA, 19 nt, Homo sapiens
gcuuucaacuucugaggaa

SEQ ID NO: 247792 - RNA, 19 nt, Homo sapiens
aacaugaccuuucaaguuc

SEQ ID NO: 247793 - RNA, 19 nt, Homo sapiens
caguauagaugaguauuuc

SEQ ID NO: 247794 - RNA, 19 nt, Homo sapiens
cagugugucuuuccucaaa

SEQ ID NO: 247795 - RNA, 19 nt, Homo sapiens
cuggaaaccauuuguauaa

SEQ ID NO: 247796 - RNA, 19 nt, Homo sapiens
ucacucaagcugaauguuu

SEQ ID NO: 247797 - RNA, 19 nt, Homo sapiens
aacauuagaucccuuagug

SEQ ID NO: 247798 - RNA, 19 nt, Homo sapiens
guagaagaaaggauugaaa

SEQ ID NO: 247799 - RNA, 19 nt, Homo sapiens
uuuagaagcugaagauaag

SEQ ID NO: 247800 - RNA, 19 nt, Homo sapiens
cuuacaugguuuaggauua

SEQ ID NO: 247801 - RNA, 19 nt, Homo sapiens
aggaaagucugaacacguu

SEQ ID NO: 247802 - RNA, 19 nt, Homo sapiens
gggagauauuucaaacauu

SEQ ID NO: 247803 - RNA, 19 nt, Homo sapiens
ugggauggauaauuggaua

SEQ ID NO: 247804 - RNA, 19 nt, Homo sapiens
ggucugaagagauaaaguu

SEQ ID NO: 247805 - RNA, 19 nt, Homo sapiens
ucagauugguccuccagaa

SEQ ID NO: 247806 - RNA, 19 nt, Homo sapiens
gaaaccccaucucuacuaa

SEQ ID NO: 247807 - RNA, 19 nt, Homo sapiens
gacuuuguaugaccagaaa

SEQ ID NO: 247808 - RNA, 19 nt, Homo sapiens
gaugaaagcgaaaguaaaa

SEQ ID NO: 247809 - RNA, 19 nt, Homo sapiens
cgaaagucuucuugagaug

SEQ ID NO: 247810 - RNA, 19 nt, Homo sapiens
uuggaugguuuaagcuuua
